United States Patent 7,341,835 (METHODS OF ANALYSIS OF ALTERNATIVE SPLICING IN MOUSE) - sequence listing, part 8

SEQ ID NO: 279357 - DNA, 25 bp, Mus musculus
cttcaccaccacctccaaagactgg

SEQ ID NO: 279358 - DNA, 25 bp, Mus musculus
cttcaccactaacgactctgacacc

SEQ ID NO: 279359 - DNA, 25 bp, Mus musculus
cttcaccactaacgggactcagaag

SEQ ID NO: 279360 - DNA, 25 bp, Mus musculus
cttcaccactgaccggggggtgtgt

SEQ ID NO: 279361 - DNA, 25 bp, Mus musculus
cttcaccagcccgaggacaagaaaa

SEQ ID NO: 279362 - DNA, 25 bp, Mus musculus
cttcaccaggtggagagcatatccg

SEQ ID NO: 279363 - DNA, 25 bp, Mus musculus
cttcaccaggtggagataagtcatt

SEQ ID NO: 279364 - DNA, 25 bp, Mus musculus
cttcaccagtttgggctcaagagtg

SEQ ID NO: 279365 - DNA, 25 bp, Mus musculus
cttcaccattggggctgtgcatttg

SEQ ID NO: 279366 - DNA, 25 bp, Mus musculus
cttcaccattgggttcacaggctgt

SEQ ID NO: 279367 - DNA, 25 bp, Mus musculus
cttcacccagtgctgtcaatcctga

SEQ ID NO: 279368 - DNA, 25 bp, Mus musculus
cttcaccccacagctgaacaatgtg

SEQ ID NO: 279369 - DNA, 25 bp, Mus musculus
cttcaccccacaggtgcgactggac

SEQ ID NO: 279370 - DNA, 25 bp, Mus musculus
cttcaccccaggagaaagaaagcag

SEQ ID NO: 279371 - DNA, 25 bp, Mus musculus
cttcaccccaggtgaacacctttat

SEQ ID NO: 279372 - DNA, 25 bp, Mus musculus
cttcaccccaggtttgtatggagag

SEQ ID NO: 279373 - DNA, 25 bp, Mus musculus
cttcacccggaggtttcagaaagtg

SEQ ID NO: 279374 - DNA, 25 bp, Mus musculus
cttcaccctgtgcacctctcctctt

SEQ ID NO: 279375 - DNA, 25 bp, Mus musculus
cttcaccgcacagacaccaagtgga

SEQ ID NO: 279376 - DNA, 25 bp, Mus musculus
cttcaccgcacggaatgacatcact

SEQ ID NO: 279377 - DNA, 25 bp, Mus musculus
cttcaccgctctccctacagccttg

SEQ ID NO: 279378 - DNA, 25 bp, Mus musculus
cttcacctaccaggaccctgtcctg

SEQ ID NO: 279379 - DNA, 25 bp, Mus musculus
cttcacctcagccaacactgatagg

SEQ ID NO: 279380 - DNA, 25 bp, Mus musculus
cttcacctcagccaagtaccaaagg

SEQ ID NO: 279381 - DNA, 25 bp, Mus musculus
cttcacctccagagccagctccagc

SEQ ID NO: 279382 - DNA, 25 bp, Mus musculus
cttcacctccattgggcacatgacc

SEQ ID NO: 279383 - DNA, 25 bp, Mus musculus
cttcacctcgccaggctgcctaaac

SEQ ID NO: 279384 - DNA, 25 bp, Mus musculus
cttcacctcgccagggtgcactcgt

SEQ ID NO: 279385 - DNA, 25 bp, Mus musculus
cttcacctcttttggcaatgaggag

SEQ ID NO: 279386 - DNA, 25 bp, Mus musculus
cttcacctgcctctgcctcctgagt

SEQ ID NO: 279387 - DNA, 25 bp, Mus musculus
cttcacctgctgcagaatcaagcta

SEQ ID NO: 279388 - DNA, 25 bp, Mus musculus
cttcacctgcttcctggcagtggac

SEQ ID NO: 279389 - DNA, 25 bp, Mus musculus
cttcacctggcaagcttcacatgga

SEQ ID NO: 279390 - DNA, 25 bp, Mus musculus
cttcacctttggtgtcctgtgcatg

SEQ ID NO: 279391 - DNA, 25 bp, Mus musculus
cttcacgaaagaacttatttgtcca

SEQ ID NO: 279392 - DNA, 25 bp, Mus musculus
cttcacgataggcaaggggaagtca

SEQ ID NO: 279393 - DNA, 25 bp, Mus musculus
cttcacgcctctgggaaacctaaat

SEQ ID NO: 279394 - DNA, 25 bp, Mus musculus
cttcacgctggatgttgaatgcgga

SEQ ID NO: 279395 - DNA, 25 bp, Mus musculus
cttcacgctggggtttctctgtata

SEQ ID NO: 279396 - DNA, 25 bp, Mus musculus
cttcacggaactcgatggagcaaac

SEQ ID NO: 279397 - DNA, 25 bp, Mus musculus
cttcacggcctccagtgacctgaca

SEQ ID NO: 279398 - DNA, 25 bp, Mus musculus
cttcacggcctccagtgactgccgg

SEQ ID NO: 279399 - DNA, 25 bp, Mus musculus
cttcacggtccaagtgtgggacttg

SEQ ID NO: 279400 - DNA, 25 bp, Mus musculus
cttcacgtggttggaaattgatgga

SEQ ID NO: 279401 - DNA, 25 bp, Mus musculus
cttcacgtggttggaatgtggtgtt

SEQ ID NO: 279402 - DNA, 25 bp, Mus musculus
cttcacgttgggttcgccaagcagc

SEQ ID NO: 279403 - DNA, 25 bp, Mus musculus
cttcacgtttctcaggttattactc

SEQ ID NO: 279404 - DNA, 25 bp, Mus musculus
cttcactaaacaagacctcctaagc

SEQ ID NO: 279405 - DNA, 25 bp, Mus musculus
cttcactaaagcaaaaatcgtgctt

SEQ ID NO: 279406 - DNA, 25 bp, Mus musculus
cttcactacacaacatgcctaaccg

SEQ ID NO: 279407 - DNA, 25 bp, Mus musculus
cttcactagccagtgagcgcatgag

SEQ ID NO: 279408 - DNA, 25 bp, Mus musculus
cttcactagccagtgcctaaggaag

SEQ ID NO: 279409 - DNA, 25 bp, Mus musculus
cttcactccctgaaaaatcgagttg

SEQ ID NO: 279410 - DNA, 25 bp, Mus musculus
cttcactccctgcagtctcgaatgg

SEQ ID NO: 279411 - DNA, 25 bp, Mus musculus
cttcactcctggagcaggcagcacc

SEQ ID NO: 279412 - DNA, 25 bp, Mus musculus
cttcactcctggagtagaaaaagac

SEQ ID NO: 279413 - DNA, 25 bp, Mus musculus
cttcactctctcatgaggagcccca

SEQ ID NO: 279414 - DNA, 25 bp, Mus musculus
cttcactgaagaagtggactctcga

SEQ ID NO: 279415 - DNA, 25 bp, Mus musculus
cttcactgacacatgccctgagccc

SEQ ID NO: 279416 - DNA, 25 bp, Mus musculus
cttcactgactagtctccagaggct

SEQ ID NO: 279417 - DNA, 25 bp, Mus musculus
cttcactgactattttaacagcgta

SEQ ID NO: 279418 - DNA, 25 bp, Mus musculus
cttcactgcaggtcccaaattggtt

SEQ ID NO: 279419 - DNA, 25 bp, Mus musculus
cttcactgcaggttcacctggagaa

SEQ ID NO: 279420 - DNA, 25 bp, Mus musculus
cttcactggggcactcagaaagaag

SEQ ID NO: 279421 - DNA, 25 bp, Mus musculus
cttcactgtaaaggtgcgagaagat

SEQ ID NO: 279422 - DNA, 25 bp, Mus musculus
cttcacttggtgcatcgggagcaat

SEQ ID NO: 279423 - DNA, 25 bp, Mus musculus
cttcacttgtgacagagccctgctt

SEQ ID NO: 279424 - DNA, 25 bp, Mus musculus
cttcactttcacgaggagaacattt

SEQ ID NO: 279425 - DNA, 25 bp, Mus musculus
cttcacttttggttccacaccctct

SEQ ID NO: 279426 - DNA, 25 bp, Mus musculus
cttcagaaacagacctcgatgcagt

SEQ ID NO: 279427 - DNA, 25 bp, Mus musculus
cttcagaaacaggtctggatgctta

SEQ ID NO: 279428 - DNA, 25 bp, Mus musculus
cttcagaaacaggtctggcaggatc

SEQ ID NO: 279429 - DNA, 25 bp, Mus musculus
cttcagaaacatctcctttcagcct

SEQ ID NO: 279430 - DNA, 25 bp, Mus musculus
cttcagaaaggccggagcctcaaca

SEQ ID NO: 279431 - DNA, 25 bp, Mus musculus
cttcagaaagtactgtccctgaagc

SEQ ID NO: 279432 - DNA, 25 bp, Mus musculus
cttcagaaatgggacactacacaga

SEQ ID NO: 279433 - DNA, 25 bp, Mus musculus
cttcagaaattgtgaaggttcccca

SEQ ID NO: 279434 - DNA, 25 bp, Mus musculus
cttcagaaccaggtgaccaacgcca

SEQ ID NO: 279435 - DNA, 25 bp, Mus musculus
cttcagaagataccatctatgtctt

SEQ ID NO: 279436 - DNA, 25 bp, Mus musculus
cttcagaagttaaggaaacatattc

SEQ ID NO: 279437 - DNA, 25 bp, Mus musculus
cttcagaatgaagtatgagaatgaa

SEQ ID NO: 279438 - DNA, 25 bp, Mus musculus
cttcagacaccaggaagcccctgag

SEQ ID NO: 279439 - DNA, 25 bp, Mus musculus
cttcagacagaaaacgaagtccatc

SEQ ID NO: 279440 - DNA, 25 bp, Mus musculus
cttcagacagacccttagagggcca

SEQ ID NO: 279441 - DNA, 25 bp, Mus musculus
cttcagacagagggccacagctacc

SEQ ID NO: 279442 - DNA, 25 bp, Mus musculus
cttcagacaggcccagtgctcgccg

SEQ ID NO: 279443 - DNA, 25 bp, Mus musculus
cttcagacctctcctgagatggggg

SEQ ID NO: 279444 - DNA, 25 bp, Mus musculus
cttcagacgcaagaccattctttaa

SEQ ID NO: 279445 - DNA, 25 bp, Mus musculus
cttcagactcaagtacgaaaacgag

SEQ ID NO: 279446 - DNA, 25 bp, Mus musculus
cttcagacttgctggtacaagtatg

SEQ ID NO: 279447 - DNA, 25 bp, Mus musculus
cttcagagaaagcaggttcatgttt

SEQ ID NO: 279448 - DNA, 25 bp, Mus musculus
cttcagagaaggacagtgtccccat

SEQ ID NO: 279449 - DNA, 25 bp, Mus musculus
cttcagagaaggatgggggaaccag

SEQ ID NO: 279450 - DNA, 25 bp, Mus musculus
cttcagagactcaggattgaaaaga

SEQ ID NO: 279451 - DNA, 25 bp, Mus musculus
cttcagagagaggtaccgacccttg

SEQ ID NO: 279452 - DNA, 25 bp, Mus musculus
cttcagagagagtctttctgcaggt

SEQ ID NO: 279453 - DNA, 25 bp, Mus musculus
cttcagagagatggtgtcttgtcaa

SEQ ID NO: 279454 - DNA, 25 bp, Mus musculus
cttcagagagctgccaggccgcaag

SEQ ID NO: 279455 - DNA, 25 bp, Mus musculus
cttcagagagtgtttaattccttcc

SEQ ID NO: 279456 - DNA, 25 bp, Mus musculus
cttcagagagttaggctgccaacag

SEQ ID NO: 279457 - DNA, 25 bp, Mus musculus
cttcagagattttgactttgtcttc

SEQ ID NO: 279458 - DNA, 25 bp, Mus musculus
cttcagagcaaagatttctgctgga

SEQ ID NO: 279459 - DNA, 25 bp, Mus musculus
cttcagagcaaaggggggctctact

SEQ ID NO: 279460 - DNA, 25 bp, Mus musculus
cttcagagccagatagacctcttgg

SEQ ID NO: 279461 - DNA, 25 bp, Mus musculus
cttcagagcgagggagcccgaacca

SEQ ID NO: 279462 - DNA, 25 bp, Mus musculus
cttcagagctgaagccagcaagcct

SEQ ID NO: 279463 - DNA, 25 bp, Mus musculus
cttcagagctgaaggctattctaga

SEQ ID NO: 279464 - DNA, 25 bp, Mus musculus
cttcagaggctgggcaaagtccttc

SEQ ID NO: 279465 - DNA, 25 bp, Mus musculus
cttcagagtgagatcatcatccaag

SEQ ID NO: 279466 - DNA, 25 bp, Mus musculus
cttcagataaatcagatgttttcgg

SEQ ID NO: 279467 - DNA, 25 bp, Mus musculus
cttcagataaatcagcttctctcca

SEQ ID NO: 279468 - DNA, 25 bp, Mus musculus
cttcagataccacggccagagatcc

SEQ ID NO: 279469 - DNA, 25 bp, Mus musculus
cttcagatcagagttggtgtggacc

SEQ ID NO: 279470 - DNA, 25 bp, Mus musculus
cttcagatgcacatatggatgcatc

SEQ ID NO: 279471 - DNA, 25 bp, Mus musculus
cttcagatgcacatcctcttctaga

SEQ ID NO: 279472 - DNA, 25 bp, Mus musculus
cttcagattctgagagtctgctagt

SEQ ID NO: 279473 - DNA, 25 bp, Mus musculus
cttcagattctgagtctgatatcct

SEQ ID NO: 279474 - DNA, 25 bp, Mus musculus
cttcagattctgagtggggacctca

SEQ ID NO: 279475 - DNA, 25 bp, Mus musculus
cttcagattggagattttatttctg

SEQ ID NO: 279476 - DNA, 25 bp, Mus musculus
cttcagattggttctgtaagcggac

SEQ ID NO: 279477 - DNA, 25 bp, Mus musculus
cttcagcaaaggcacacaccgaggc

SEQ ID NO: 279478 - DNA, 25 bp, Mus musculus
cttcagcaagacagaggagctgaac

SEQ ID NO: 279479 - DNA, 25 bp, Mus musculus
cttcagcaagatgaagacatcccgg

SEQ ID NO: 279480 - DNA, 25 bp, Mus musculus
cttcagcaagatgagtcgaaaggac

SEQ ID NO: 279481 - DNA, 25 bp, Mus musculus
cttcagcaccagatccctgctgtct

SEQ ID NO: 279482 - DNA, 25 bp, Mus musculus
cttcagcaccaggagggagctatgg

SEQ ID NO: 279483 - DNA, 25 bp, Mus musculus
cttcagcactgaggttcaagaattt

SEQ ID NO: 279484 - DNA, 25 bp, Mus musculus
cttcagcagactgagtcgtggtcct

SEQ ID NO: 279485 - DNA, 25 bp, Mus musculus
cttcagcagagcaggaagatccttc

SEQ ID NO: 279486 - DNA, 25 bp, Mus musculus
cttcagccaaagaaccccaaatctc

SEQ ID NO: 279487 - DNA, 25 bp, Mus musculus
cttcagccaaagcctattggtgtag

SEQ ID NO: 279488 - DNA, 25 bp, Mus musculus
cttcagccaaaggagccagtcacac

SEQ ID NO: 279489 - DNA, 25 bp, Mus musculus
cttcagccaaaggattgggacatga

SEQ ID NO: 279490 - DNA, 25 bp, Mus musculus
cttcagccatccaaggatgaggcca

SEQ ID NO: 279491 - DNA, 25 bp, Mus musculus
cttcagcccccatttgaataagact

SEQ ID NO: 279492 - DNA, 25 bp, Mus musculus
cttcagccctgagagggagattcgt

SEQ ID NO: 279493 - DNA, 25 bp, Mus musculus
cttcagccgagaaacatcccaaacc

SEQ ID NO: 279494 - DNA, 25 bp, Mus musculus
cttcagccgagaagaactttgatca

SEQ ID NO: 279495 - DNA, 25 bp, Mus musculus
cttcagccggattacacaggaagct

SEQ ID NO: 279496 - DNA, 25 bp, Mus musculus
cttcagcctaccaggtacaaccacg

SEQ ID NO: 279497 - DNA, 25 bp, Mus musculus
cttcagcctcagaaccgcaaattta

SEQ ID NO: 279498 - DNA, 25 bp, Mus musculus
cttcagcctcagcccagcgtaagcg

SEQ ID NO: 279499 - DNA, 25 bp, Mus musculus
cttcagcctcaggttatgaaaatga

SEQ ID NO: 279500 - DNA, 25 bp, Mus musculus
cttcagcctcagtggtgacccaagc

SEQ ID NO: 279501 - DNA, 25 bp, Mus musculus
cttcagcctggcagaaaacttcttc

SEQ ID NO: 279502 - DNA, 25 bp, Mus musculus
cttcagcctgggctcagccatcgcc

SEQ ID NO: 279503 - DNA, 25 bp, Mus musculus
cttcagcctggggctgacatggacc

SEQ ID NO: 279504 - DNA, 25 bp, Mus musculus
cttcagcgaggaagatgaggacgat

SEQ ID NO: 279505 - DNA, 25 bp, Mus musculus
cttcagcgagggaagcttcttgact

SEQ ID NO: 279506 - DNA, 25 bp, Mus musculus
cttcagcgccgccgctggagagatg

SEQ ID NO: 279507 - DNA, 25 bp, Mus musculus
cttcagcgtgtctcatactacaagg

SEQ ID NO: 279508 - DNA, 25 bp, Mus musculus
cttcagctacattttcagctttgtg

SEQ ID NO: 279509 - DNA, 25 bp, Mus musculus
cttcagctacgaaccaaaaaccaca

SEQ ID NO: 279510 - DNA, 25 bp, Mus musculus
cttcagctcacgaggcgcatacccc

SEQ ID NO: 279511 - DNA, 25 bp, Mus musculus
cttcagctcctgcagccggatgtat

SEQ ID NO: 279512 - DNA, 25 bp, Mus musculus
cttcagctcgcccaacttcatcaag

SEQ ID NO: 279513 - DNA, 25 bp, Mus musculus
cttcagctctgagaggatgtgcccg

SEQ ID NO: 279514 - DNA, 25 bp, Mus musculus
cttcagctgaaaaacattggattgc

SEQ ID NO: 279515 - DNA, 25 bp, Mus musculus
cttcagctgctgaggttatttaaac

SEQ ID NO: 279516 - DNA, 25 bp, Mus musculus
cttcagctggcaacacccaaggccc

SEQ ID NO: 279517 - DNA, 25 bp, Mus musculus
cttcagctggcaagaccggggttcg

SEQ ID NO: 279518 - DNA, 25 bp, Mus musculus
cttcagcttatcaggtgcccagata

SEQ ID NO: 279519 - DNA, 25 bp, Mus musculus
cttcagcttcaaatcagtaccacac

SEQ ID NO: 279520 - DNA, 25 bp, Mus musculus
cttcagcttcaaggtttggattcag

SEQ ID NO: 279521 - DNA, 25 bp, Mus musculus
cttcaggaaagagcaaataagttgg

SEQ ID NO: 279522 - DNA, 25 bp, Mus musculus
cttcaggaaagcctgtgggccgaag

SEQ ID NO: 279523 - DNA, 25 bp, Mus musculus
cttcaggaaattcactgagggccag

SEQ ID NO: 279524 - DNA, 25 bp, Mus musculus
cttcaggaaccatatcctaggcaat

SEQ ID NO: 279525 - DNA, 25 bp, Mus musculus
cttcaggaaccatatgactgcttac

SEQ ID NO: 279526 - DNA, 25 bp, Mus musculus
cttcaggaaccatattctgttttat

SEQ ID NO: 279527 - DNA, 25 bp, Mus musculus
cttcaggaagctgatgaagagtttg

SEQ ID NO: 279528 - DNA, 25 bp, Mus musculus
cttcaggaaggcagcctcctatcca

SEQ ID NO: 279529 - DNA, 25 bp, Mus musculus
cttcaggaaggtggtcagcgcgctg

SEQ ID NO: 279530 - DNA, 25 bp, Mus musculus
cttcaggacaaggttttcaaaataa

SEQ ID NO: 279531 - DNA, 25 bp, Mus musculus
cttcaggaccaagtatgagtcagag

SEQ ID NO: 279532 - DNA, 25 bp, Mus musculus
cttcaggaccccaaggtcatgatgc

SEQ ID NO: 279533 - DNA, 25 bp, Mus musculus
cttcaggacttgctgatgtggatgc

SEQ ID NO: 279534 - DNA, 25 bp, Mus musculus
cttcaggagcagaaggtatatgtgg

SEQ ID NO: 279535 - DNA, 25 bp, Mus musculus
cttcaggagcggaggtacactgtag

SEQ ID NO: 279536 - DNA, 25 bp, Mus musculus
cttcaggagcggcagtctcagagag

SEQ ID NO: 279537 - DNA, 25 bp, Mus musculus
cttcaggaggaggacttactgtgtt

SEQ ID NO: 279538 - DNA, 25 bp, Mus musculus
cttcaggaggaggtggcaaaccctg

SEQ ID NO: 279539 - DNA, 25 bp, Mus musculus
cttcaggagggggaacagacatcct

SEQ ID NO: 279540 - DNA, 25 bp, Mus musculus
cttcaggagtacagacagcaccctt

SEQ ID NO: 279541 - DNA, 25 bp, Mus musculus
cttcaggatgagctgcaaaggctgc

SEQ ID NO: 279542 - DNA, 25 bp, Mus musculus
cttcaggcaacatgaaattgatggg

SEQ ID NO: 279543 - DNA, 25 bp, Mus musculus
cttcaggcagagctggaaaaggtgc

SEQ ID NO: 279544 - DNA, 25 bp, Mus musculus
cttcaggcgctagggtctgggaacg

SEQ ID NO: 279545 - DNA, 25 bp, Mus musculus
cttcaggcttaaagggtatgtccct

SEQ ID NO: 279546 - DNA, 25 bp, Mus musculus
cttcaggctttgcagggacccttcc

SEQ ID NO: 279547 - DNA, 25 bp, Mus musculus
cttcagggaaccaggatgagattct

SEQ ID NO: 279548 - DNA, 25 bp, Mus musculus
cttcagggaaggacctctccgagcc

SEQ ID NO: 279549 - DNA, 25 bp, Mus musculus
cttcagggaagttttgctccagact

SEQ ID NO: 279550 - DNA, 25 bp, Mus musculus
cttcagggagacacacctgcaaaga

SEQ ID NO: 279551 - DNA, 25 bp, Mus musculus
cttcagggagaccctggtctccctg

SEQ ID NO: 279552 - DNA, 25 bp, Mus musculus
cttcagggggtaaatgtgattagtg

SEQ ID NO: 279553 - DNA, 25 bp, Mus musculus
cttcaggggtcaggaggcgggagcc

SEQ ID NO: 279554 - DNA, 25 bp, Mus musculus
cttcaggtctcggccagaaggtttg

SEQ ID NO: 279555 - DNA, 25 bp, Mus musculus
cttcaggtgaggcctttaccctccg

SEQ ID NO: 279556 - DNA, 25 bp, Mus musculus
cttcaggtggacacctccctttcct

SEQ ID NO: 279557 - DNA, 25 bp, Mus musculus
cttcaggtgtactcctccctttcct

SEQ ID NO: 279558 - DNA, 25 bp, Mus musculus
cttcaggtgtactcctctcttttca

SEQ ID NO: 279559 - DNA, 25 bp, Mus musculus
cttcaggttaggattcccaggaaaa

SEQ ID NO: 279560 - DNA, 25 bp, Mus musculus
cttcagtacaatcctgatttgtact

SEQ ID NO: 279561 - DNA, 25 bp, Mus musculus
cttcagtatcctgatcacatttgac

SEQ ID NO: 279562 - DNA, 25 bp, Mus musculus
cttcagtatgacgttcgcctggctc

SEQ ID NO: 279563 - DNA, 25 bp, Mus musculus
cttcagtattcctgtcttgacttcc

SEQ ID NO: 279564 - DNA, 25 bp, Mus musculus
cttcagtcagagatatatttctgag

SEQ ID NO: 279565 - DNA, 25 bp, Mus musculus
cttcagtccaagatatgagaaccac

SEQ ID NO: 279566 - DNA, 25 bp, Mus musculus
cttcagtccaagattgcccaatgat

SEQ ID NO: 279567 - DNA, 25 bp, Mus musculus
cttcagtcctacaggtttgttaaga

SEQ ID NO: 279568 - DNA, 25 bp, Mus musculus
cttcagtcctggccgccaagttgaa

SEQ ID NO: 279569 - DNA, 25 bp, Mus musculus
cttcagtcctggtgaactgtccatc

SEQ ID NO: 279570 - DNA, 25 bp, Mus musculus
cttcagtcctggtggtccccagcag

SEQ ID NO: 279571 - DNA, 25 bp, Mus musculus
cttcagtctcgttcgagaaatggct

SEQ ID NO: 279572 - DNA, 25 bp, Mus musculus
cttcagtctctcagtgcctgtgctg

SEQ ID NO: 279573 - DNA, 25 bp, Mus musculus
cttcagtctgagattggccaggtga

SEQ ID NO: 279574 - DNA, 25 bp, Mus musculus
cttcagtcttggctgttccttcttg

SEQ ID NO: 279575 - DNA, 25 bp, Mus musculus
cttcagtgaagagcgagatgttgaa

SEQ ID NO: 279576 - DNA, 25 bp, Mus musculus
cttcagtgaaggtaatggaaaaggt

SEQ ID NO: 279577 - DNA, 25 bp, Mus musculus
cttcagtgaggaggcttacatcccg

SEQ ID NO: 279578 - DNA, 25 bp, Mus musculus
cttcagtgaggatggattcctgaaa

SEQ ID NO: 279579 - DNA, 25 bp, Mus musculus
cttcagtgcaaggatggaaggaccc

SEQ ID NO: 279580 - DNA, 25 bp, Mus musculus
cttcagtgcaaggttatcctgctcg

SEQ ID NO: 279581 - DNA, 25 bp, Mus musculus
cttcagtgcttatccctctgaagaa

SEQ ID NO: 279582 - DNA, 25 bp, Mus musculus
cttcagtggaaggtaaacagaatct

SEQ ID NO: 279583 - DNA, 25 bp, Mus musculus
cttcagtggaccaaattttcaggat

SEQ ID NO: 279584 - DNA, 25 bp, Mus musculus
cttcagtggaccagccttcgtggtg

SEQ ID NO: 279585 - DNA, 25 bp, Mus musculus
cttcagtggctcggatgttcagcac

SEQ ID NO: 279586 - DNA, 25 bp, Mus musculus
cttcagtgtaggatctcttcactgg

SEQ ID NO: 279587 - DNA, 25 bp, Mus musculus
cttcagtgtcatcaaggtctttccg

SEQ ID NO: 279588 - DNA, 25 bp, Mus musculus
cttcagttagctgagacacttgtga

SEQ ID NO: 279589 - DNA, 25 bp, Mus musculus
cttcagttagctgagtcggctgcac

SEQ ID NO: 279590 - DNA, 25 bp, Mus musculus
cttcagttggagcaggccctgcagg

SEQ ID NO: 279591 - DNA, 25 bp, Mus musculus
cttcagtttccacagaatggactcg

SEQ ID NO: 279592 - DNA, 25 bp, Mus musculus
cttcagttttagatcaagaatgacc

SEQ ID NO: 279593 - DNA, 25 bp, Mus musculus
cttcataaatatccttttatcttgc

SEQ ID NO: 279594 - DNA, 25 bp, Mus musculus
cttcataacaaggatatagtgcaca

SEQ ID NO: 279595 - DNA, 25 bp, Mus musculus
cttcataactcgaatgaaactttgc

SEQ ID NO: 279596 - DNA, 25 bp, Mus musculus
cttcataacttccagagaatctcag

SEQ ID NO: 279597 - DNA, 25 bp, Mus musculus
cttcataacttccagatccaggcct

SEQ ID NO: 279598 - DNA, 25 bp, Mus musculus
cttcataagaagtgtttccacgatg

SEQ ID NO: 279599 - DNA, 25 bp, Mus musculus
cttcatactgcatgacatcaacagt

SEQ ID NO: 279600 - DNA, 25 bp, Mus musculus
cttcatagaagatcaagatgtagaa

SEQ ID NO: 279601 - DNA, 25 bp, Mus musculus
cttcatagaaggtacttcaagagta

SEQ ID NO: 279602 - DNA, 25 bp, Mus musculus
cttcatagaaggttctcattgtgta

SEQ ID NO: 279603 - DNA, 25 bp, Mus musculus
cttcatagagacacaccagaggagg

SEQ ID NO: 279604 - DNA, 25 bp, Mus musculus
cttcatagagatctccttgtcagct

SEQ ID NO: 279605 - DNA, 25 bp, Mus musculus
cttcatagcttacatacccttcgca

SEQ ID NO: 279606 - DNA, 25 bp, Mus musculus
cttcatagggcggtcagctcactaa

SEQ ID NO: 279607 - DNA, 25 bp, Mus musculus
cttcatatcagcacggacgattccg

SEQ ID NO: 279608 - DNA, 25 bp, Mus musculus
cttcatatcagcacgggtcacccag

SEQ ID NO: 279609 - DNA, 25 bp, Mus musculus
cttcatatccttcaggatggaacag

SEQ ID NO: 279610 - DNA, 25 bp, Mus musculus
cttcatatctaccgtcgacttaaaa

SEQ ID NO: 279611 - DNA, 25 bp, Mus musculus
cttcatatttggccacagccttcgt

SEQ ID NO: 279612 - DNA, 25 bp, Mus musculus
cttcatcaaagagtgtggcctgctc

SEQ ID NO: 279613 - DNA, 25 bp, Mus musculus
cttcatcaacagagctggcatgttt

SEQ ID NO: 279614 - DNA, 25 bp, Mus musculus
cttcatcaataggaagaagagagag

SEQ ID NO: 279615 - DNA, 25 bp, Mus musculus
cttcatcaatatgaagagtgtcaga

SEQ ID NO: 279616 - DNA, 25 bp, Mus musculus
cttcatcaccaactttccaagatta

SEQ ID NO: 279617 - DNA, 25 bp, Mus musculus
cttcatcaccagctatcacgtatgg

SEQ ID NO: 279618 - DNA, 25 bp, Mus musculus
cttcatcaccaggtatcacgtatgg

SEQ ID NO: 279619 - DNA, 25 bp, Mus musculus
cttcatcaggatgctgcacaacaag

SEQ ID NO: 279620 - DNA, 25 bp, Mus musculus
cttcatcatcaaggtctttcgcttc

SEQ ID NO: 279621 - DNA, 25 bp, Mus musculus
cttcatcatcacggtcttctggcca

SEQ ID NO: 279622 - DNA, 25 bp, Mus musculus
cttcatccaaggcgttagacaaacc

SEQ ID NO: 279623 - DNA, 25 bp, Mus musculus
cttcatccagcagatccgaatccag

SEQ ID NO: 279624 - DNA, 25 bp, Mus musculus
cttcatccagcattccatgatctac

SEQ ID NO: 279625 - DNA, 25 bp, Mus musculus
cttcatccatcaggcgtggtttctg

SEQ ID NO: 279626 - DNA, 25 bp, Mus musculus
cttcatcccaggagatcttcccacg

SEQ ID NO: 279627 - DNA, 25 bp, Mus musculus
cttcatccccaaggggacaaatgta

SEQ ID NO: 279628 - DNA, 25 bp, Mus musculus
cttcatccgaaaggcacagtgttcc

SEQ ID NO: 279629 - DNA, 25 bp, Mus musculus
cttcatccgaaagggactcctctag

SEQ ID NO: 279630 - DNA, 25 bp, Mus musculus
cttcatcctagcggtttgcctgaga

SEQ ID NO: 279631 - DNA, 25 bp, Mus musculus
cttcatcgacaaggtgcgcttcctg

SEQ ID NO: 279632 - DNA, 25 bp, Mus musculus
cttcatcgccaatgctgacttggag

SEQ ID NO: 279633 - DNA, 25 bp, Mus musculus
cttcatcgtcgcagaaagtaagccc

SEQ ID NO: 279634 - DNA, 25 bp, Mus musculus
cttcatcgtcgcagacagctgagta

SEQ ID NO: 279635 - DNA, 25 bp, Mus musculus
cttcatcgtgaagagcctccccagg

SEQ ID NO: 279636 - DNA, 25 bp, Mus musculus
cttcatctactcttggttcttcatt

SEQ ID NO: 279637 - DNA, 25 bp, Mus musculus
cttcatctcaaggatccttgacact

SEQ ID NO: 279638 - DNA, 25 bp, Mus musculus
cttcatctccaaggttggtgacaca

SEQ ID NO: 279639 - DNA, 25 bp, Mus musculus
cttcatctgcaaagaaatcctacga

SEQ ID NO: 279640 - DNA, 25 bp, Mus musculus
cttcatctgccgactccctgtcctg

SEQ ID NO: 279641 - DNA, 25 bp, Mus musculus
cttcatctgccggaagccgactctg

SEQ ID NO: 279642 - DNA, 25 bp, Mus musculus
cttcatctgctgggaccagagtgag

SEQ ID NO: 279643 - DNA, 25 bp, Mus musculus
cttcatctgtggcctggagagagac

SEQ ID NO: 279644 - DNA, 25 bp, Mus musculus
cttcatctgtgtgggaacgtgttcc

SEQ ID NO: 279645 - DNA, 25 bp, Mus musculus
cttcatcttcaggggtcagcaggaa

SEQ ID NO: 279646 - DNA, 25 bp, Mus musculus
cttcatcttccagagaggaggctca

SEQ ID NO: 279647 - DNA, 25 bp, Mus musculus
cttcatctttatcagcaatgctggt

SEQ ID NO: 279648 - DNA, 25 bp, Mus musculus
cttcatgaaaggaatacagatgtta

SEQ ID NO: 279649 - DNA, 25 bp, Mus musculus
cttcatgaaagttccgacgagatat

SEQ ID NO: 279650 - DNA, 25 bp, Mus musculus
cttcatgaagaacatatgacatcca

SEQ ID NO: 279651 - DNA, 25 bp, Mus musculus
cttcatgacagaggacatttgacac

SEQ ID NO: 279652 - DNA, 25 bp, Mus musculus
cttcatgacagatttctcaggaata

SEQ ID NO: 279653 - DNA, 25 bp, Mus musculus
cttcatgacagtgtggctcagactc

SEQ ID NO: 279654 - DNA, 25 bp, Mus musculus
cttcatgataagaaccaacttcttg

SEQ ID NO: 279655 - DNA, 25 bp, Mus musculus
cttcatgataagggaagaagacatg

SEQ ID NO: 279656 - DNA, 25 bp, Mus musculus
cttcatgccatttcagtgcccgatg

SEQ ID NO: 279657 - DNA, 25 bp, Mus musculus
cttcatgcccacctggtaacatctt

SEQ ID NO: 279658 - DNA, 25 bp, Mus musculus
cttcatgcccatccggttccagtgg

SEQ ID NO: 279659 - DNA, 25 bp, Mus musculus
cttcatgctggatgatactatcgtg

SEQ ID NO: 279660 - DNA, 25 bp, Mus musculus
cttcatggaagagggtagcacatta

SEQ ID NO: 279661 - DNA, 25 bp, Mus musculus
cttcatggaagaggtccagaaagtc

SEQ ID NO: 279662 - DNA, 25 bp, Mus musculus
cttcatggactggtgtccaaagaca

SEQ ID NO: 279663 - DNA, 25 bp, Mus musculus
cttcatggagcaggtgcaccgtggc

SEQ ID NO: 279664 - DNA, 25 bp, Mus musculus
cttcatggatgaattgaagccccac

SEQ ID NO: 279665 - DNA, 25 bp, Mus musculus
cttcatggatgaatttgctggactc

SEQ ID NO: 279666 - DNA, 25 bp, Mus musculus
cttcatggcgaagaagaagacaccc

SEQ ID NO: 279667 - DNA, 25 bp, Mus musculus
cttcatggctgtgtgattgatcctg

SEQ ID NO: 279668 - DNA, 25 bp, Mus musculus
cttcatgtacccaagagttgtcttg

SEQ ID NO: 279669 - DNA, 25 bp, Mus musculus
cttcatgtcaacaaagtccaaggtt

SEQ ID NO: 279670 - DNA, 25 bp, Mus musculus
cttcatgtctggatgtgtctagtcc

SEQ ID NO: 279671 - DNA, 25 bp, Mus musculus
cttcatgtgccaggctggcgacttc

SEQ ID NO: 279672 - DNA, 25 bp, Mus musculus
cttcatgtggaaggtgtgaatctgg

SEQ ID NO: 279673 - DNA, 25 bp, Mus musculus
cttcatgtgtagcaggtttcaaagc

SEQ ID NO: 279674 - DNA, 25 bp, Mus musculus
cttcatgttcgtgattgtgctgtcc

SEQ ID NO: 279675 - DNA, 25 bp, Mus musculus
cttcatgtttccagttggcctctat

SEQ ID NO: 279676 - DNA, 25 bp, Mus musculus
cttcatgtttgagggccatgacacc

SEQ ID NO: 279677 - DNA, 25 bp, Mus musculus
cttcattaaacccaacaaacctgtg

SEQ ID NO: 279678 - DNA, 25 bp, Mus musculus
cttcattaagatggatgtaggtcat

SEQ ID NO: 279679 - DNA, 25 bp, Mus musculus
cttcattaagcagaggtgacagctg

SEQ ID NO: 279680 - DNA, 25 bp, Mus musculus
cttcattaatgacggccttaaagct

SEQ ID NO: 279681 - DNA, 25 bp, Mus musculus
cttcattaatgagggccttaaagct

SEQ ID NO: 279682 - DNA, 25 bp, Mus musculus
cttcattaccaaattgttcccataa

SEQ ID NO: 279683 - DNA, 25 bp, Mus musculus
cttcattacctggagaagtgtgtct

SEQ ID NO: 279684 - DNA, 25 bp, Mus musculus
cttcattattctatggctagaaaat

SEQ ID NO: 279685 - DNA, 25 bp, Mus musculus
cttcattcaacgtgatgaaaggagg

SEQ ID NO: 279686 - DNA, 25 bp, Mus musculus
cttcattcaagggttttatggacac

SEQ ID NO: 279687 - DNA, 25 bp, Mus musculus
cttcattccccagactaggctgtcc

SEQ ID NO: 279688 - DNA, 25 bp, Mus musculus
cttcattcctaggtggtctcctagc

SEQ ID NO: 279689 - DNA, 25 bp, Mus musculus
cttcattcctctcagccaaaaagac

SEQ ID NO: 279690 - DNA, 25 bp, Mus musculus
cttcattcgttcacggctgctcaga

SEQ ID NO: 279691 - DNA, 25 bp, Mus musculus
cttcattgaccaggagctgtccagg

SEQ ID NO: 279692 - DNA, 25 bp, Mus musculus
cttcattgatctggttatccaggcc

SEQ ID NO: 279693 - DNA, 25 bp, Mus musculus
cttcattgatgggcagacacgcacc

SEQ ID NO: 279694 - DNA, 25 bp, Mus musculus
cttcattgccagcaaccgtgtcttc

SEQ ID NO: 279695 - DNA, 25 bp, Mus musculus
cttcattgctcagacggccagagca

SEQ ID NO: 279696 - DNA, 25 bp, Mus musculus
cttcattgctcagcatgagaatgat

SEQ ID NO: 279697 - DNA, 25 bp, Mus musculus
cttcattgctggctttgcggtgggc

SEQ ID NO: 279698 - DNA, 25 bp, Mus musculus
cttcattggaggtttaggattagca

SEQ ID NO: 279699 - DNA, 25 bp, Mus musculus
cttcattggattccgccattgatct

SEQ ID NO: 279700 - DNA, 25 bp, Mus musculus
cttcattggccccagagcagcagag

SEQ ID NO: 279701 - DNA, 25 bp, Mus musculus
cttcattgtaatcgattggtatcat

SEQ ID NO: 279702 - DNA, 25 bp, Mus musculus
cttcattgtcaggttcctggaaagc

SEQ ID NO: 279703 - DNA, 25 bp, Mus musculus
cttcattgtgtaaagcctcctgtac

SEQ ID NO: 279704 - DNA, 25 bp, Mus musculus
cttcatttagggacaagaagaccta

SEQ ID NO: 279705 - DNA, 25 bp, Mus musculus
cttcatttcaggccatcagctccag

SEQ ID NO: 279706 - DNA, 25 bp, Mus musculus
cttcatttcaggctcctgtggctgt

SEQ ID NO: 279707 - DNA, 25 bp, Mus musculus
cttcatttctcatctcccagcaggc

SEQ ID NO: 279708 - DNA, 25 bp, Mus musculus
cttcatttgagggggtcaggacaaa

SEQ ID NO: 279709 - DNA, 25 bp, Mus musculus
cttcatttgtgtaattttgtgccat

SEQ ID NO: 279710 - DNA, 25 bp, Mus musculus
cttccaaaaggagactttctgcact

SEQ ID NO: 279711 - DNA, 25 bp, Mus musculus
cttccaaaaggcccacagcagcaga

SEQ ID NO: 279712 - DNA, 25 bp, Mus musculus
cttccaaaatgataaactttataat

SEQ ID NO: 279713 - DNA, 25 bp, Mus musculus
cttccaaacagaacctttccctgag

SEQ ID NO: 279714 - DNA, 25 bp, Mus musculus
cttccaaacagtttcaaagaggcag

SEQ ID NO: 279715 - DNA, 25 bp, Mus musculus
cttccaaagcagatcctggagtaag

SEQ ID NO: 279716 - DNA, 25 bp, Mus musculus
cttccaaagggtgatgtcttcccag

SEQ ID NO: 279717 - DNA, 25 bp, Mus musculus
cttccaaagtaccaatacacgagac

SEQ ID NO: 279718 - DNA, 25 bp, Mus musculus
cttccaaagtgggatccggcactgg

SEQ ID NO: 279719 - DNA, 25 bp, Mus musculus
cttccaacaagacgatccacgcaga

SEQ ID NO: 279720 - DNA, 25 bp, Mus musculus
cttccaacaagaggaaaaagctatg

SEQ ID NO: 279721 - DNA, 25 bp, Mus musculus
cttccaacaggttgactacagtcag

SEQ ID NO: 279722 - DNA, 25 bp, Mus musculus
cttccaacagtccaaaccatagaca

SEQ ID NO: 279723 - DNA, 25 bp, Mus musculus
cttccaacatactgcagggttgtgt

SEQ ID NO: 279724 - DNA, 25 bp, Mus musculus
cttccaacatctgagcagctcaaag

SEQ ID NO: 279725 - DNA, 25 bp, Mus musculus
cttccaactcaggctgcttctgatg

SEQ ID NO: 279726 - DNA, 25 bp, Mus musculus
cttccaagagaggaggctgtgaaag

SEQ ID NO: 279727 - DNA, 25 bp, Mus musculus
cttccaagaggcaacaactgtatgt

SEQ ID NO: 279728 - DNA, 25 bp, Mus musculus
cttccaagccaactaagaagatcga

SEQ ID NO: 279729 - DNA, 25 bp, Mus musculus
cttccaagtacattcacttcttccc

SEQ ID NO: 279730 - DNA, 25 bp, Mus musculus
cttccaagtctgagtgtggataagt

SEQ ID NO: 279731 - DNA, 25 bp, Mus musculus
cttccaatacaagcacaggggagta

SEQ ID NO: 279732 - DNA, 25 bp, Mus musculus
cttccaatccagagacctcttttct

SEQ ID NO: 279733 - DNA, 25 bp, Mus musculus
cttccaatccagcctgaggtctcca

SEQ ID NO: 279734 - DNA, 25 bp, Mus musculus
cttccaatcccttgctgatctgaat

SEQ ID NO: 279735 - DNA, 25 bp, Mus musculus
cttccaatctatcagggcgtctaag

SEQ ID NO: 279736 - DNA, 25 bp, Mus musculus
cttccaatctatcagggtgaaggcg

SEQ ID NO: 279737 - DNA, 25 bp, Mus musculus
cttccaatgcagcctgtggcatctc

SEQ ID NO: 279738 - DNA, 25 bp, Mus musculus
cttccaatgctaatgccagtgactc

SEQ ID NO: 279739 - DNA, 25 bp, Mus musculus
cttccacaaagagcgcctggccatc

SEQ ID NO: 279740 - DNA, 25 bp, Mus musculus
cttccacaatcggtattaccagagc

SEQ ID NO: 279741 - DNA, 25 bp, Mus musculus
cttccacacacgccaccccaccttc

SEQ ID NO: 279742 - DNA, 25 bp, Mus musculus
cttccacacacggaggaggttggcc

SEQ ID NO: 279743 - DNA, 25 bp, Mus musculus
cttccacactgaggtgcactggcac

SEQ ID NO: 279744 - DNA, 25 bp, Mus musculus
cttccacagccagaaaagaaaaagt

SEQ ID NO: 279745 - DNA, 25 bp, Mus musculus
cttccacagcccagaaaagaaaaag

SEQ ID NO: 279746 - DNA, 25 bp, Mus musculus
cttccacagccggagagtcaaacac

SEQ ID NO: 279747 - DNA, 25 bp, Mus musculus
cttccacaggagtggtcccgtaggc

SEQ ID NO: 279748 - DNA, 25 bp, Mus musculus
cttccacatcctgactccgttcaac

SEQ ID NO: 279749 - DNA, 25 bp, Mus musculus
cttccaccaaggaggaatttcaaca

SEQ ID NO: 279750 - DNA, 25 bp, Mus musculus
cttccaccaaggcctcctatctttc

SEQ ID NO: 279751 - DNA, 25 bp, Mus musculus
cttccaccaaggtatggtgtggaag

SEQ ID NO: 279752 - DNA, 25 bp, Mus musculus
cttccaccgacctgatcaagggatc

SEQ ID NO: 279753 - DNA, 25 bp, Mus musculus
cttccaccgcagtgtgaagaaaaag

SEQ ID NO: 279754 - DNA, 25 bp, Mus musculus
cttccaccgcgccctgtctcactgc

SEQ ID NO: 279755 - DNA, 25 bp, Mus musculus
cttccaccgttgtggccagaacccc

SEQ ID NO: 279756 - DNA, 25 bp, Mus musculus
cttccacctagggactgccgcttcg

SEQ ID NO: 279757 - DNA, 25 bp, Mus musculus
cttccacctccacagcacaagagca

SEQ ID NO: 279758 - DNA, 25 bp, Mus musculus
cttccaccttcagcaacaacacttg

SEQ ID NO: 279759 - DNA, 25 bp, Mus musculus
cttccacgacagctccctcttgatg

SEQ ID NO: 279760 - DNA, 25 bp, Mus musculus
cttccacgccacttgtcggcagctc

SEQ ID NO: 279761 - DNA, 25 bp, Mus musculus
cttccactaaagattcagagtcacc

SEQ ID NO: 279762 - DNA, 25 bp, Mus musculus
cttccactcgcacaccgagagaaca

SEQ ID NO: 279763 - DNA, 25 bp, Mus musculus
cttccactctggtcagacatggttg

SEQ ID NO: 279764 - DNA, 25 bp, Mus musculus
cttccactcttgaagatgccgagat

SEQ ID NO: 279765 - DNA, 25 bp, Mus musculus
cttccactcttgaaggatgcccacc

SEQ ID NO: 279766 - DNA, 25 bp, Mus musculus
cttccactggggtgtgtctgcagca

SEQ ID NO: 279767 - DNA, 25 bp, Mus musculus
cttccagaaaaatgaaactgtgaag

SEQ ID NO: 279768 - DNA, 25 bp, Mus musculus
cttccagaacagggaaaggcaggag

SEQ ID NO: 279769 - DNA, 25 bp, Mus musculus
cttccagaaggatctgaaagccaat

SEQ ID NO: 279770 - DNA, 25 bp, Mus musculus
cttccagaccacagggatcacccat

SEQ ID NO: 279771 - DNA, 25 bp, Mus musculus
cttccagaccacaggtccctgtgga

SEQ ID NO: 279772 - DNA, 25 bp, Mus musculus
cttccagaccagggacggaaacttt

SEQ ID NO: 279773 - DNA, 25 bp, Mus musculus
cttccagaccggtggcagacatgga

SEQ ID NO: 279774 - DNA, 25 bp, Mus musculus
cttccagagcaatggcacggaatgc

SEQ ID NO: 279775 - DNA, 25 bp, Mus musculus
cttccagaggagaggtggtgaaggc

SEQ ID NO: 279776 - DNA, 25 bp, Mus musculus
cttccagatacattgacatcagcaa

SEQ ID NO: 279777 - DNA, 25 bp, Mus musculus
cttccagatacgtcttccaagttgc

SEQ ID NO: 279778 - DNA, 25 bp, Mus musculus
cttccagatgagaaaatgatgtagc

SEQ ID NO: 279779 - DNA, 25 bp, Mus musculus
cttccagatgatgttgatcctgtct

SEQ ID NO: 279780 - DNA, 25 bp, Mus musculus
cttccagatggcctaccttcttgcc

SEQ ID NO: 279781 - DNA, 25 bp, Mus musculus
cttccagatggggacttcagacgca

SEQ ID NO: 279782 - DNA, 25 bp, Mus musculus
cttccagattcttggataaggaatt

SEQ ID NO: 279783 - DNA, 25 bp, Mus musculus
cttccagcaaccagcacccggcagt

SEQ ID NO: 279784 - DNA, 25 bp, Mus musculus
cttccagcaacttgaggctcctgag

SEQ ID NO: 279785 - DNA, 25 bp, Mus musculus
cttccagcacgtgaggacaagtttt

SEQ ID NO: 279786 - DNA, 25 bp, Mus musculus
cttccagcagaataacaacaagcca

SEQ ID NO: 279787 - DNA, 25 bp, Mus musculus
cttccagcagacatccttctacggt

SEQ ID NO: 279788 - DNA, 25 bp, Mus musculus
cttccagcccaggtgctggggcccg

SEQ ID NO: 279789 - DNA, 25 bp, Mus musculus
cttccagccctgagatgctcacgta

SEQ ID NO: 279790 - DNA, 25 bp, Mus musculus
cttccagccttcaccgtatggtgtg

SEQ ID NO: 279791 - DNA, 25 bp, Mus musculus
cttccagctaccactatgccgcttc

SEQ ID NO: 279792 - DNA, 25 bp, Mus musculus
cttccaggaagaggcggtgacagag

SEQ ID NO: 279793 - DNA, 25 bp, Mus musculus
cttccaggaccacgatgtccctggt

SEQ ID NO: 279794 - DNA, 25 bp, Mus musculus
cttccaggagatggagttgctatgc

SEQ ID NO: 279795 - DNA, 25 bp, Mus musculus
cttccaggaggacagcgagacggtc

SEQ ID NO: 279796 - DNA, 25 bp, Mus musculus
cttccaggaggggctggagggtcag

SEQ ID NO: 279797 - DNA, 25 bp, Mus musculus
cttccaggcaactagggtttcaact

SEQ ID NO: 279798 - DNA, 25 bp, Mus musculus
cttccaggcagtgctgaaaaccaag

SEQ ID NO: 279799 - DNA, 25 bp, Mus musculus
cttccaggcatgctcagggtatggt

SEQ ID NO: 279800 - DNA, 25 bp, Mus musculus
cttccaggtggacattgaggcactg

SEQ ID NO: 279801 - DNA, 25 bp, Mus musculus
cttccaggttcaggtgttggcagcc

SEQ ID NO: 279802 - DNA, 25 bp, Mus musculus
cttccagtacaggaaattaaaatgc

SEQ ID NO: 279803 - DNA, 25 bp, Mus musculus
cttccagtacaggtcagaggaacgc

SEQ ID NO: 279804 - DNA, 25 bp, Mus musculus
cttccagtaccaagacaaagcctat

SEQ ID NO: 279805 - DNA, 25 bp, Mus musculus
cttccagtgaattcttggacctgag

SEQ ID NO: 279806 - DNA, 25 bp, Mus musculus
cttccagtgagcttgcttcccagag

SEQ ID NO: 279807 - DNA, 25 bp, Mus musculus
cttccagtgcaggcctaaccctgtc

SEQ ID NO: 279808 - DNA, 25 bp, Mus musculus
cttccagtgcagggaaaagctgtgt

SEQ ID NO: 279809 - DNA, 25 bp, Mus musculus
cttccagttactctacatcccctcc

SEQ ID NO: 279810 - DNA, 25 bp, Mus musculus
cttccagttactctacttcatctac

SEQ ID NO: 279811 - DNA, 25 bp, Mus musculus
cttccagttcagcagcctgcagcag

SEQ ID NO: 279812 - DNA, 25 bp, Mus musculus
cttccagttcagcagggcacctacg

SEQ ID NO: 279813 - DNA, 25 bp, Mus musculus
cttccagtttggagagtgtgacttg

SEQ ID NO: 279814 - DNA, 25 bp, Mus musculus
cttccagtttggagggtttctctgt

SEQ ID NO: 279815 - DNA, 25 bp, Mus musculus
cttccataaagggcaagaaaaagtc

SEQ ID NO: 279816 - DNA, 25 bp, Mus musculus
cttccataaaggggcagtaaatggc

SEQ ID NO: 279817 - DNA, 25 bp, Mus musculus
cttccataagaacgggagaggctcc

SEQ ID NO: 279818 - DNA, 25 bp, Mus musculus
cttccataattgtgtggattcttta

SEQ ID NO: 279819 - DNA, 25 bp, Mus musculus
cttccatacagatgatattgaaaat

SEQ ID NO: 279820 - DNA, 25 bp, Mus musculus
cttccatatcagctggaaggacggg

SEQ ID NO: 279821 - DNA, 25 bp, Mus musculus
cttccatatgaccaaaggctactat

SEQ ID NO: 279822 - DNA, 25 bp, Mus musculus
cttccatcaccagcatccatgtctt

SEQ ID NO: 279823 - DNA, 25 bp, Mus musculus
cttccatcaccaggtgcgtgatgac

SEQ ID NO: 279824 - DNA, 25 bp, Mus musculus
cttccatcactcagctggagcaatt

SEQ ID NO: 279825 - DNA, 25 bp, Mus musculus
cttccatcactcagggcgttccctt

SEQ ID NO: 279826 - DNA, 25 bp, Mus musculus
cttccatcagacctgaggtccaaca

SEQ ID NO: 279827 - DNA, 25 bp, Mus musculus
cttccatcatgaggaaatttgcccc

SEQ ID NO: 279828 - DNA, 25 bp, Mus musculus
cttccatccgagattgagcttgaag

SEQ ID NO: 279829 - DNA, 25 bp, Mus musculus
cttccatccgagcctgacctgatgg

SEQ ID NO: 279830 - DNA, 25 bp, Mus musculus
cttccatccgagtggcagcaagttg

SEQ ID NO: 279831 - DNA, 25 bp, Mus musculus
cttccatcctatatagtctacatgg

SEQ ID NO: 279832 - DNA, 25 bp, Mus musculus
cttccatcctgagcggctctctgtg

SEQ ID NO: 279833 - DNA, 25 bp, Mus musculus
cttccatcgtgatcggcaagaagcc

SEQ ID NO: 279834 - DNA, 25 bp, Mus musculus
cttccatcgtgatcggtgagaagga

SEQ ID NO: 279835 - DNA, 25 bp, Mus musculus
cttccatctacaggcctgtccactg

SEQ ID NO: 279836 - DNA, 25 bp, Mus musculus
cttccatctggtcctgcatgtccag

SEQ ID NO: 279837 - DNA, 25 bp, Mus musculus
cttccatcttcaagccttctgtgga

SEQ ID NO: 279838 - DNA, 25 bp, Mus musculus
cttccatgaaagagacaggtgttga

SEQ ID NO: 279839 - DNA, 25 bp, Mus musculus
cttccatgaaatgagtttctctaat

SEQ ID NO: 279840 - DNA, 25 bp, Mus musculus
cttccatgaaggcattgtcgccagc

SEQ ID NO: 279841 - DNA, 25 bp, Mus musculus
cttccatgaaggcctgcgggccctc

SEQ ID NO: 279842 - DNA, 25 bp, Mus musculus
cttccatgaaggcgagcctgtcagc

SEQ ID NO: 279843 - DNA, 25 bp, Mus musculus
cttccatgacctcgaaaacgggctg

SEQ ID NO: 279844 - DNA, 25 bp, Mus musculus
cttccatggctcagcaagcttccct

SEQ ID NO: 279845 - DNA, 25 bp, Mus musculus
cttccatgtccaggttttcccatca

SEQ ID NO: 279846 - DNA, 25 bp, Mus musculus
cttccatgtgctccccacactcctg

SEQ ID NO: 279847 - DNA, 25 bp, Mus musculus
cttccattatgtatagcagtgtttt

SEQ ID NO: 279848 - DNA, 25 bp, Mus musculus
cttccattgaaagaggcttcatcac

SEQ ID NO: 279849 - DNA, 25 bp, Mus musculus
cttccatttctgcaaggagtcctgg

SEQ ID NO: 279850 - DNA, 25 bp, Mus musculus
cttcccaaaaatgtatccatcgaga

SEQ ID NO: 279851 - DNA, 25 bp, Mus musculus
cttcccaaaacagaataaatggaga

SEQ ID NO: 279852 - DNA, 25 bp, Mus musculus
cttcccaaaacagtatctttcagaa

SEQ ID NO: 279853 - DNA, 25 bp, Mus musculus
cttcccaaacaggtgcagttaaaaa

SEQ ID NO: 279854 - DNA, 25 bp, Mus musculus
cttcccaacaagacgatgatgatga

SEQ ID NO: 279855 - DNA, 25 bp, Mus musculus
cttcccaactctgctcctgacatca

SEQ ID NO: 279856 - DNA, 25 bp, Mus musculus
cttcccaatcctcaaccagttctgt

SEQ ID NO: 279857 - DNA, 25 bp, Mus musculus
cttcccaatcctcgagccctgacat

SEQ ID NO: 279858 - DNA, 25 bp, Mus musculus
cttcccaatggtgatgatggtgaat

SEQ ID NO: 279859 - DNA, 25 bp, Mus musculus
cttcccacagaggttgaaatgggca

SEQ ID NO: 279860 - DNA, 25 bp, Mus musculus
cttcccacagcatcgccaaatgccc

SEQ ID NO: 279861 - DNA, 25 bp, Mus musculus
cttcccacaggtctgcctctcttgg

SEQ ID NO: 279862 - DNA, 25 bp, Mus musculus
cttcccacccaggaatccaaacgct

SEQ ID NO: 279863 - DNA, 25 bp, Mus musculus
cttcccacccagtgatgactacgat

SEQ ID NO: 279864 - DNA, 25 bp, Mus musculus
cttcccaccttcaaaactggtgaac

SEQ ID NO: 279865 - DNA, 25 bp, Mus musculus
cttcccacgctccaggagaggcggg

SEQ ID NO: 279866 - DNA, 25 bp, Mus musculus
cttcccacggctgctgacctcctgc

SEQ ID NO: 279867 - DNA, 25 bp, Mus musculus
cttcccactcatgttactgggcctg

SEQ ID NO: 279868 - DNA, 25 bp, Mus musculus
cttcccactctcctgaacttccagg

SEQ ID NO: 279869 - DNA, 25 bp, Mus musculus
cttcccactctcctggtcctgagtc

SEQ ID NO: 279870 - DNA, 25 bp, Mus musculus
cttcccagaagaaaacatgaattat

SEQ ID NO: 279871 - DNA, 25 bp, Mus musculus
cttcccagaagaatctgatgccaac

SEQ ID NO: 279872 - DNA, 25 bp, Mus musculus
cttcccagagaaaggatgcaagctg

SEQ ID NO: 279873 - DNA, 25 bp, Mus musculus
cttcccagagggcattcaaagggat

SEQ ID NO: 279874 - DNA, 25 bp, Mus musculus
cttcccagagtttccagagtctgac

SEQ ID NO: 279875 - DNA, 25 bp, Mus musculus
cttcccagatgaatgcactgatccc

SEQ ID NO: 279876 - DNA, 25 bp, Mus musculus
cttcccagatgctggcttggagatg

SEQ ID NO: 279877 - DNA, 25 bp, Mus musculus
cttcccagatggcgaatactgggtc

SEQ ID NO: 279878 - DNA, 25 bp, Mus musculus
cttcccagggaggtcagcacctcgg

SEQ ID NO: 279879 - DNA, 25 bp, Mus musculus
cttcccagggccaacaggtgaccga

SEQ ID NO: 279880 - DNA, 25 bp, Mus musculus
cttcccaggtgcagcctctaggtcg

SEQ ID NO: 279881 - DNA, 25 bp, Mus musculus
cttcccagtggggctcaagagtgtc

SEQ ID NO: 279882 - DNA, 25 bp, Mus musculus
cttcccagtggggtacatgtacccc

SEQ ID NO: 279883 - DNA, 25 bp, Mus musculus
cttcccatcagcccaggccacagca

SEQ ID NO: 279884 - DNA, 25 bp, Mus musculus
cttcccatccgacagcccgccggag

SEQ ID NO: 279885 - DNA, 25 bp, Mus musculus
cttcccatttgattgagaaatgtga

SEQ ID NO: 279886 - DNA, 25 bp, Mus musculus
cttccccacccaggcctggatacca

SEQ ID NO: 279887 - DNA, 25 bp, Mus musculus
cttccccacctgggaaaagatgccg

SEQ ID NO: 279888 - DNA, 25 bp, Mus musculus
cttccccacgatctccctggagttt

SEQ ID NO: 279889 - DNA, 25 bp, Mus musculus
cttccccacggaagacggcgctggg

SEQ ID NO: 279890 - DNA, 25 bp, Mus musculus
cttccccatcaagatcccacgcaat

SEQ ID NO: 279891 - DNA, 25 bp, Mus musculus
cttccccatctggcatgcccacgtg

SEQ ID NO: 279892 - DNA, 25 bp, Mus musculus
cttccccatgagaggtagctaagtg

SEQ ID NO: 279893 - DNA, 25 bp, Mus musculus
cttcccccacagtcccagacgaggc

SEQ ID NO: 279894 - DNA, 25 bp, Mus musculus
cttcccccactggagagaccactgc

SEQ ID NO: 279895 - DNA, 25 bp, Mus musculus
cttcccccagatgcctgtcggtgcc

SEQ ID NO: 279896 - DNA, 25 bp, Mus musculus
cttcccccagcagactggagggtgg

SEQ ID NO: 279897 - DNA, 25 bp, Mus musculus
cttcccccattggagaggaacctgc

SEQ ID NO: 279898 - DNA, 25 bp, Mus musculus
cttcccccattggagccaaggctgt

SEQ ID NO: 279899 - DNA, 25 bp, Mus musculus
cttccccccaggattcttcctacta

SEQ ID NO: 279900 - DNA, 25 bp, Mus musculus
cttccccccaggcttaagatactca

SEQ ID NO: 279901 - DNA, 25 bp, Mus musculus
cttccccccggcagatgagacacca

SEQ ID NO: 279902 - DNA, 25 bp, Mus musculus
cttccccccggcaggtaattctgac

SEQ ID NO: 279903 - DNA, 25 bp, Mus musculus
cttccccccgggtctgtctgccaaa

SEQ ID NO: 279904 - DNA, 25 bp, Mus musculus
cttccccctagaagtggccctgccg

SEQ ID NO: 279905 - DNA, 25 bp, Mus musculus
cttccccctgaggaggctgcggggc

SEQ ID NO: 279906 - DNA, 25 bp, Mus musculus
cttccccctggagtcctttcactgc

SEQ ID NO: 279907 - DNA, 25 bp, Mus musculus
cttcccccttggttgcctctctgca

SEQ ID NO: 279908 - DNA, 25 bp, Mus musculus
cttccccgaagccgggctgatgtga

SEQ ID NO: 279909 - DNA, 25 bp, Mus musculus
cttccccgtgaaggacagtcatggc

SEQ ID NO: 279910 - DNA, 25 bp, Mus musculus
cttcccctcagagttgtctgctggt

SEQ ID NO: 279911 - DNA, 25 bp, Mus musculus
cttcccctcaggagtggagtcaaca

SEQ ID NO: 279912 - DNA, 25 bp, Mus musculus
cttcccctcaggggtgatccattca

SEQ ID NO: 279913 - DNA, 25 bp, Mus musculus
cttcccctcagtgaatgtggctctc

SEQ ID NO: 279914 - DNA, 25 bp, Mus musculus
cttcccctcctgaagctgattggcg

SEQ ID NO: 279915 - DNA, 25 bp, Mus musculus
cttcccctcggatgcagatgggaaa

SEQ ID NO: 279916 - DNA, 25 bp, Mus musculus
cttcccctgtgaccctagtctctct

SEQ ID NO: 279917 - DNA, 25 bp, Mus musculus
cttccccttagctcagagctctggt

SEQ ID NO: 279918 - DNA, 25 bp, Mus musculus
cttccccttcagctcttggggtgaa

SEQ ID NO: 279919 - DNA, 25 bp, Mus musculus
cttccccttcaggagtcgctttcct

SEQ ID NO: 279920 - DNA, 25 bp, Mus musculus
cttccccttcaggcctgcctttttc

SEQ ID NO: 279921 - DNA, 25 bp, Mus musculus
cttccccttgtgctttgatgaccac

SEQ ID NO: 279922 - DNA, 25 bp, Mus musculus
cttccccttgtgctttggtctcctt

SEQ ID NO: 279923 - DNA, 25 bp, Mus musculus
cttcccgatttgcccatgaagctgt

SEQ ID NO: 279924 - DNA, 25 bp, Mus musculus
cttcccgccgcggaggagaatggcg

SEQ ID NO: 279925 - DNA, 25 bp, Mus musculus
cttcccgctggctgtaattcaaaat

SEQ ID NO: 279926 - DNA, 25 bp, Mus musculus
cttcccgcttggcaggccggcagag

SEQ ID NO: 279927 - DNA, 25 bp, Mus musculus
cttcccggagacaactagctgtgtt

SEQ ID NO: 279928 - DNA, 25 bp, Mus musculus
cttcccggagagccttacgagagac

SEQ ID NO: 279929 - DNA, 25 bp, Mus musculus
cttcccggagcacttggaatctcct

SEQ ID NO: 279930 - DNA, 25 bp, Mus musculus
cttcccggcccatcgggtgagcccg

SEQ ID NO: 279931 - DNA, 25 bp, Mus musculus
cttcccgggagcgagagctttgtaa

SEQ ID NO: 279932 - DNA, 25 bp, Mus musculus
cttccctaagacctaggacctaggc

SEQ ID NO: 279933 - DNA, 25 bp, Mus musculus
cttccctaaggtgaaaggactgaga

SEQ ID NO: 279934 - DNA, 25 bp, Mus musculus
cttccctaccctctgggtctggaga

SEQ ID NO: 279935 - DNA, 25 bp, Mus musculus
cttccctagagatggctttcctgac

SEQ ID NO: 279936 - DNA, 25 bp, Mus musculus
cttccctatctacttggaccagaag

SEQ ID NO: 279937 - DNA, 25 bp, Mus musculus
cttccctcacctcaggattctgggt

SEQ ID NO: 279938 - DNA, 25 bp, Mus musculus
cttccctcacctcagggaagaggga

SEQ ID NO: 279939 - DNA, 25 bp, Mus musculus
cttccctcagactcggggtcgcatc

SEQ ID NO: 279940 - DNA, 25 bp, Mus musculus
cttccctcagactcggtacctcgga

SEQ ID NO: 279941 - DNA, 25 bp, Mus musculus
cttccctcagactcggtcccccaga

SEQ ID NO: 279942 - DNA, 25 bp, Mus musculus
cttccctcaggacatcaatgcaagc

SEQ ID NO: 279943 - DNA, 25 bp, Mus musculus
cttccctcaggcgaaaatatttctt

SEQ ID NO: 279944 - DNA, 25 bp, Mus musculus
cttccctcaggtgtcagatcccctg

SEQ ID NO: 279945 - DNA, 25 bp, Mus musculus
cttccctcccgcccaagcctaatag

SEQ ID NO: 279946 - DNA, 25 bp, Mus musculus
cttccctcggaggcacgcgcctacc

SEQ ID NO: 279947 - DNA, 25 bp, Mus musculus
cttccctcggagtacaacacagaag

SEQ ID NO: 279948 - DNA, 25 bp, Mus musculus
cttccctctagatttgatcaaaaaa

SEQ ID NO: 279949 - DNA, 25 bp, Mus musculus
cttccctgaaacccaaatatgccaa

SEQ ID NO: 279950 - DNA, 25 bp, Mus musculus
cttccctgacagcaggggcttcagt

SEQ ID NO: 279951 - DNA, 25 bp, Mus musculus
cttccctgacagcagttcccacagc

SEQ ID NO: 279952 - DNA, 25 bp, Mus musculus
cttccctgagcatagtaacattcca

SEQ ID NO: 279953 - DNA, 25 bp, Mus musculus
cttccctgagctcaccatggaggtt

SEQ ID NO: 279954 - DNA, 25 bp, Mus musculus
cttccctgagctgggaacactccag

SEQ ID NO: 279955 - DNA, 25 bp, Mus musculus
cttccctgatgcgagagaacaagag

SEQ ID NO: 279956 - DNA, 25 bp, Mus musculus
cttccctgcaagatatggttgcagg

SEQ ID NO: 279957 - DNA, 25 bp, Mus musculus
cttccctgcaaggagtgttacggct

SEQ ID NO: 279958 - DNA, 25 bp, Mus musculus
cttccctgcaattttgaacccacca

SEQ ID NO: 279959 - DNA, 25 bp, Mus musculus
cttccctgccagaggttgagacaga

SEQ ID NO: 279960 - DNA, 25 bp, Mus musculus
cttccctgcccgaagggacagtttg

SEQ ID NO: 279961 - DNA, 25 bp, Mus musculus
cttccctgctacagcaacttctcct

SEQ ID NO: 279962 - DNA, 25 bp, Mus musculus
cttccctgctgtcaacggggtctca

SEQ ID NO: 279963 - DNA, 25 bp, Mus musculus
cttccctgcttcagcaagcttccct

SEQ ID NO: 279964 - DNA, 25 bp, Mus musculus
cttccctgcttccagcccctatgtt

SEQ ID NO: 279965 - DNA, 25 bp, Mus musculus
cttccctgctttttggagaggacga

SEQ ID NO: 279966 - DNA, 25 bp, Mus musculus
cttccctggcacagaaacatcatcc

SEQ ID NO: 279967 - DNA, 25 bp, Mus musculus
cttccctggcacagcaagcttccct

SEQ ID NO: 279968 - DNA, 25 bp, Mus musculus
cttccctggcaccgggcactgactg

SEQ ID NO: 279969 - DNA, 25 bp, Mus musculus
cttccctggcactgcaagtttcccc

SEQ ID NO: 279970 - DNA, 25 bp, Mus musculus
cttccctggctaagcaagcttccct

SEQ ID NO: 279971 - DNA, 25 bp, Mus musculus
cttccctggtacagcaaccttccat

SEQ ID NO: 279972 - DNA, 25 bp, Mus musculus
cttccctggtacagcaagcttccct

SEQ ID NO: 279973 - DNA, 25 bp, Mus musculus
cttccctggtacagcaagctttcct

SEQ ID NO: 279974 - DNA, 25 bp, Mus musculus
cttccctgtcagaatgatcatgcgt

SEQ ID NO: 279975 - DNA, 25 bp, Mus musculus
cttccctgtcctgaggccatgcttg

SEQ ID NO: 279976 - DNA, 25 bp, Mus musculus
cttccctgtctgtacctacagccgg

SEQ ID NO: 279977 - DNA, 25 bp, Mus musculus
cttccctgtttcagcaaccttccat

SEQ ID NO: 279978 - DNA, 25 bp, Mus musculus
cttccctgtttcagcaaccttccct

SEQ ID NO: 279979 - DNA, 25 bp, Mus musculus
cttccctgtttcagcaagcttccct

SEQ ID NO: 279980 - DNA, 25 bp, Mus musculus
cttccctgtttcagcaagtttcccc

SEQ ID NO: 279981 - DNA, 25 bp, Mus musculus
cttccctgtttcagcaatcttccct

SEQ ID NO: 279982 - DNA, 25 bp, Mus musculus
cttccctgtttcagcttccctgttt

SEQ ID NO: 279983 - DNA, 25 bp, Mus musculus
cttccctgtttcaggattatttttc

SEQ ID NO: 279984 - DNA, 25 bp, Mus musculus
cttcccttacatgaagtcgatggca

SEQ ID NO: 279985 - DNA, 25 bp, Mus musculus
cttcccttagaatgtgattttttct

SEQ ID NO: 279986 - DNA, 25 bp, Mus musculus
cttcccttccggcacaattgccaaa

SEQ ID NO: 279987 - DNA, 25 bp, Mus musculus
cttccctttctcaggtccaggtgga

SEQ ID NO: 279988 - DNA, 25 bp, Mus musculus
cttcccttttacttggcaagtcctt

SEQ ID NO: 279989 - DNA, 25 bp, Mus musculus
cttccgacaagagcctgaaacctgc

SEQ ID NO: 279990 - DNA, 25 bp, Mus musculus
cttccgacaagaggactactgcctt

SEQ ID NO: 279991 - DNA, 25 bp, Mus musculus
cttccgacatggaggatgacttgaa

SEQ ID NO: 279992 - DNA, 25 bp, Mus musculus
cttccgaccattagccaagtccagg

SEQ ID NO: 279993 - DNA, 25 bp, Mus musculus
cttccgacccctacttcagcaccct

SEQ ID NO: 279994 - DNA, 25 bp, Mus musculus
cttccgagcaggggaagagttgctg

SEQ ID NO: 279995 - DNA, 25 bp, Mus musculus
cttccgagcgggggaacctgatttg

SEQ ID NO: 279996 - DNA, 25 bp, Mus musculus
cttccgagtcagctacttcctgtgc

SEQ ID NO: 279997 - DNA, 25 bp, Mus musculus
cttccgagtccctcctggggggtca

SEQ ID NO: 279998 - DNA, 25 bp, Mus musculus
cttccgatcaattcgaagccgattt

SEQ ID NO: 279999 - DNA, 25 bp, Mus musculus
cttccgatcaggagagaaaagaaac

SEQ ID NO: 280000 - DNA, 25 bp, Mus musculus
cttccgatggcagaaacttgattga

SEQ ID NO: 280001 - DNA, 25 bp, Mus musculus
cttccgatgtgacctctgccatgcc

SEQ ID NO: 280002 - DNA, 25 bp, Mus musculus
cttccgccaaatggactggaacttc

SEQ ID NO: 280003 - DNA, 25 bp, Mus musculus
cttccgccaggtctcagttgtggcc

SEQ ID NO: 280004 - DNA, 25 bp, Mus musculus
cttccgccagtttcgtgatcctgag

SEQ ID NO: 280005 - DNA, 25 bp, Mus musculus
cttccgccgaccccgggatggcaca

SEQ ID NO: 280006 - DNA, 25 bp, Mus musculus
cttccgccgaccccgtgggctgttc

SEQ ID NO: 280007 - DNA, 25 bp, Mus musculus
cttccgcctggggtgactgtcccag

SEQ ID NO: 280008 - DNA, 25 bp, Mus musculus
cttccgcgggacggatttgatctac

SEQ ID NO: 280009 - DNA, 25 bp, Mus musculus
cttccgcgggacggggagaaagaga

SEQ ID NO: 280010 - DNA, 25 bp, Mus musculus
cttccgcgtcgagatttggtgactg

SEQ ID NO: 280011 - DNA, 25 bp, Mus musculus
cttccggaaggaactggtgagcaga

SEQ ID NO: 280012 - DNA, 25 bp, Mus musculus
cttccggaaggcctctggattctcc

SEQ ID NO: 280013 - DNA, 25 bp, Mus musculus
cttccggaatttggaactcagggcg

SEQ ID NO: 280014 - DNA, 25 bp, Mus musculus
cttccggaatttgggctctggacct

SEQ ID NO: 280015 - DNA, 25 bp, Mus musculus
cttccggcacaattgccaaaatcac

SEQ ID NO: 280016 - DNA, 25 bp, Mus musculus
cttccggcagaggtatcgcatcctg

SEQ ID NO: 280017 - DNA, 25 bp, Mus musculus
cttccggcagctccgtaaccgcctg

SEQ ID NO: 280018 - DNA, 25 bp, Mus musculus
cttccggcaggcagttcctccatca

SEQ ID NO: 280019 - DNA, 25 bp, Mus musculus
cttccggctgacgggctcctccccg

SEQ ID NO: 280020 - DNA, 25 bp, Mus musculus
cttccggctggccacccccatcagt

SEQ ID NO: 280021 - DNA, 25 bp, Mus musculus
cttccgggaaagggctctcttgtgc

SEQ ID NO: 280022 - DNA, 25 bp, Mus musculus
cttccgggagatccccactccttcc

SEQ ID NO: 280023 - DNA, 25 bp, Mus musculus
cttccgggctccctggtcctgaggg

SEQ ID NO: 280024 - DNA, 25 bp, Mus musculus
cttccggggtctggacagcattctt

SEQ ID NO: 280025 - DNA, 25 bp, Mus musculus
cttccggggtctggtggtacttgac

SEQ ID NO: 280026 - DNA, 25 bp, Mus musculus
cttccggtcagatgttcacacggaa

SEQ ID NO: 280027 - DNA, 25 bp, Mus musculus
cttccgtcataacgggcctgtgtga

SEQ ID NO: 280028 - DNA, 25 bp, Mus musculus
cttccgtctatagccaagcagaagc

SEQ ID NO: 280029 - DNA, 25 bp, Mus musculus
cttccgtctataggcggaacatgtt

SEQ ID NO: 280030 - DNA, 25 bp, Mus musculus
cttccgtgagaagtttatgcagcac

SEQ ID NO: 280031 - DNA, 25 bp, Mus musculus
cttccgtgcaggcgcctaaaagaaa

SEQ ID NO: 280032 - DNA, 25 bp, Mus musculus
cttccgttaaaggtcacacaactgg

SEQ ID NO: 280033 - DNA, 25 bp, Mus musculus
cttccgttcagcggacgccgcgggc

SEQ ID NO: 280034 - DNA, 25 bp, Mus musculus
cttcctaaaaggtaaagcaccgtgg

SEQ ID NO: 280035 - DNA, 25 bp, Mus musculus
cttcctaaggaatgggtattggctt

SEQ ID NO: 280036 - DNA, 25 bp, Mus musculus
cttcctacaaaaggtgtggcgtggc

SEQ ID NO: 280037 - DNA, 25 bp, Mus musculus
cttcctacagttggtcccgcagatc

SEQ ID NO: 280038 - DNA, 25 bp, Mus musculus
cttcctaccacagggtctgtaccaa

SEQ ID NO: 280039 - DNA, 25 bp, Mus musculus
cttcctactactgctcccagggctg

SEQ ID NO: 280040 - DNA, 25 bp, Mus musculus
cttcctagagaccaagatcacaagc

SEQ ID NO: 280041 - DNA, 25 bp, Mus musculus
cttcctagcagaggaaaagaagctt

SEQ ID NO: 280042 - DNA, 25 bp, Mus musculus
cttcctagcaggagtgatgatgtgc

SEQ ID NO: 280043 - DNA, 25 bp, Mus musculus
cttcctaggatggtggcccagatga

SEQ ID NO: 280044 - DNA, 25 bp, Mus musculus
cttcctatcagagagtgactcagac

SEQ ID NO: 280045 - DNA, 25 bp, Mus musculus
cttcctatcagggctcagttctgac

SEQ ID NO: 280046 - DNA, 25 bp, Mus musculus
cttcctatcgacatcccaggcgagg

SEQ ID NO: 280047 - DNA, 25 bp, Mus musculus
cttcctatcggcctttcagacatcc

SEQ ID NO: 280048 - DNA, 25 bp, Mus musculus
cttcctatggaccagggatttaaaa

SEQ ID NO: 280049 - DNA, 25 bp, Mus musculus
cttcctatgggctggtggaatatgg

SEQ ID NO: 280050 - DNA, 25 bp, Mus musculus
cttcctcaacagtgtctacattggg

SEQ ID NO: 280051 - DNA, 25 bp, Mus musculus
cttcctcaaccccctagaatccatg

SEQ ID NO: 280052 - DNA, 25 bp, Mus musculus
cttcctcaagctgagtcctgagagc

SEQ ID NO: 280053 - DNA, 25 bp, Mus musculus
cttcctcaagctggcagcagtgact

SEQ ID NO: 280054 - DNA, 25 bp, Mus musculus
cttcctcaatcacctctcccagtac

SEQ ID NO: 280055 - DNA, 25 bp, Mus musculus
cttcctcaatcacttatcacagttc

SEQ ID NO: 280056 - DNA, 25 bp, Mus musculus
cttcctcacactcagagccttccaa

SEQ ID NO: 280057 - DNA, 25 bp, Mus musculus
cttcctcacagaaaataaagcagtt

SEQ ID NO: 280058 - DNA, 25 bp, Mus musculus
cttcctcagaattatctgggaatgt

SEQ ID NO: 280059 - DNA, 25 bp, Mus musculus
cttcctcagacgctgactcatccca

SEQ ID NO: 280060 - DNA, 25 bp, Mus musculus
cttcctcagcatggctggaccgctt

SEQ ID NO: 280061 - DNA, 25 bp, Mus musculus
cttcctcagtaatgaccaattctcc

SEQ ID NO: 280062 - DNA, 25 bp, Mus musculus
cttcctcataaattccacatgagat

SEQ ID NO: 280063 - DNA, 25 bp, Mus musculus
cttcctcataaggtcacgttcatga

SEQ ID NO: 280064 - DNA, 25 bp, Mus musculus
cttcctcatcagtgccaactgtaaa

SEQ ID NO: 280065 - DNA, 25 bp, Mus musculus
cttcctcatcagtggccaccaatga

SEQ ID NO: 280066 - DNA, 25 bp, Mus musculus
cttcctcatgaggaaacggctgctc

SEQ ID NO: 280067 - DNA, 25 bp, Mus musculus
cttcctccaccaggtagctgagacc

SEQ ID NO: 280068 - DNA, 25 bp, Mus musculus
cttcctccagaagaagactcctacg

SEQ ID NO: 280069 - DNA, 25 bp, Mus musculus
cttcctccagacagcctggcaggct

SEQ ID NO: 280070 - DNA, 25 bp, Mus musculus
cttcctccagctgcagaatctgtga

SEQ ID NO: 280071 - DNA, 25 bp, Mus musculus
cttcctccaggactggacagtaagg

SEQ ID NO: 280072 - DNA, 25 bp, Mus musculus
cttcctccaggagccggccacccca

SEQ ID NO: 280073 - DNA, 25 bp, Mus musculus
cttcctccaggatggattcatgggt

SEQ ID NO: 280074 - DNA, 25 bp, Mus musculus
cttcctcccctgctacaaaaaattg

SEQ ID NO: 280075 - DNA, 25 bp, Mus musculus
cttcctccctcccatgcagccacct

SEQ ID NO: 280076 - DNA, 25 bp, Mus musculus
cttcctccgatggctacagatgtct

SEQ ID NO: 280077 - DNA, 25 bp, Mus musculus
cttcctcctaaggcgcctgtgtctg

SEQ ID NO: 280078 - DNA, 25 bp, Mus musculus
cttcctcctgccaggccaaaagcac

SEQ ID NO: 280079 - DNA, 25 bp, Mus musculus
cttcctcctggcaggccaaaagcac

SEQ ID NO: 280080 - DNA, 25 bp, Mus musculus
cttcctcctttggtggccgtgcctg

SEQ ID NO: 280081 - DNA, 25 bp, Mus musculus
cttcctcgaacacctatgtgccctt

SEQ ID NO: 280082 - DNA, 25 bp, Mus musculus
cttcctcgaacacctgagccagccc

SEQ ID NO: 280083 - DNA, 25 bp, Mus musculus
cttcctcgaaggtcctggccacacc

SEQ ID NO: 280084 - DNA, 25 bp, Mus musculus
cttcctcgaggcctacaattcaaag

SEQ ID NO: 280085 - DNA, 25 bp, Mus musculus
cttcctcgcgtttcatgcaggctct

SEQ ID NO: 280086 - DNA, 25 bp, Mus musculus
cttcctcggagtttgatccattttt

SEQ ID NO: 280087 - DNA, 25 bp, Mus musculus
cttcctcgggctccactctcgctca

SEQ ID NO: 280088 - DNA, 25 bp, Mus musculus
cttcctcgtccttgagagatgccaa

SEQ ID NO: 280089 - DNA, 25 bp, Mus musculus
cttcctctaaacaagacgggccgca

SEQ ID NO: 280090 - DNA, 25 bp, Mus musculus
cttcctctgacagtctcatctttgg

SEQ ID NO: 280091 - DNA, 25 bp, Mus musculus
cttcctcttcagctgctctgtccgg

SEQ ID NO: 280092 - DNA, 25 bp, Mus musculus
cttcctctttaaaggattggtgacc

SEQ ID NO: 280093 - DNA, 25 bp, Mus musculus
cttcctctttagaacctgggtgtgg

SEQ ID NO: 280094 - DNA, 25 bp, Mus musculus
cttcctgaaagatgatggcgtgagc

SEQ ID NO: 280095 - DNA, 25 bp, Mus musculus
cttcctgaagaacggtatcactgag

SEQ ID NO: 280096 - DNA, 25 bp, Mus musculus
cttcctgaagatcaaagacgcctta

SEQ ID NO: 280097 - DNA, 25 bp, Mus musculus
cttcctgaagccccagtcttattaa

SEQ ID NO: 280098 - DNA, 25 bp, Mus musculus
cttcctgaaggttgagaacaaaaag

SEQ ID NO: 280099 - DNA, 25 bp, Mus musculus
cttcctgacagggagccaggcttgg

SEQ ID NO: 280100 - DNA, 25 bp, Mus musculus
cttcctgacaggtagccaggcttgg

SEQ ID NO: 280101 - DNA, 25 bp, Mus musculus
cttcctgaccaagagtggcaacagc

SEQ ID NO: 280102 - DNA, 25 bp, Mus musculus
cttcctgactggctggtttttcaac

SEQ ID NO: 280103 - DNA, 25 bp, Mus musculus
cttcctgagaggctggcctccacat

SEQ ID NO: 280104 - DNA, 25 bp, Mus musculus
cttcctgagagtgcccgaggcgccc

SEQ ID NO: 280105 - DNA, 25 bp, Mus musculus
cttcctgagtgagctcattgcccac

SEQ ID NO: 280106 - DNA, 25 bp, Mus musculus
cttcctgagtggtatccttggcatg

SEQ ID NO: 280107 - DNA, 25 bp, Mus musculus
cttcctgatgaagttatagtgcctc

SEQ ID NO: 280108 - DNA, 25 bp, Mus musculus
cttcctgatgaatgtcattggtctc

SEQ ID NO: 280109 - DNA, 25 bp, Mus musculus
cttcctgatgaggagtctctgtttg

SEQ ID NO: 280110 - DNA, 25 bp, Mus musculus
cttcctgcaagaactgagcctggac

SEQ ID NO: 280111 - DNA, 25 bp, Mus musculus
cttcctgcaagcagccttcagatga

SEQ ID NO: 280112 - DNA, 25 bp, Mus musculus
cttcctgcaagggtggccatgggtg

SEQ ID NO: 280113 - DNA, 25 bp, Mus musculus
cttcctgcactttgaggaggaagag

SEQ ID NO: 280114 - DNA, 25 bp, Mus musculus
cttcctgcagccaggtgggaagatg

SEQ ID NO: 280115 - DNA, 25 bp, Mus musculus
cttcctgcatgctgggtccttcagg

SEQ ID NO: 280116 - DNA, 25 bp, Mus musculus
cttcctgccacctggagatggtgtt

SEQ ID NO: 280117 - DNA, 25 bp, Mus musculus
cttcctgcccacctggtacttcctg

SEQ ID NO: 280118 - DNA, 25 bp, Mus musculus
cttcctgcccacctggttcccagag

SEQ ID NO: 280119 - DNA, 25 bp, Mus musculus
cttcctgcccagtgggcagctgatc

SEQ ID NO: 280120 - DNA, 25 bp, Mus musculus
cttcctgccccagaaaacatcggac

SEQ ID NO: 280121 - DNA, 25 bp, Mus musculus
cttcctgcccccagaacctggaccc

SEQ ID NO: 280122 - DNA, 25 bp, Mus musculus
cttcctgccctcgctagttctgacg

SEQ ID NO: 280123 - DNA, 25 bp, Mus musculus
cttcctgcctaacaggtcgctgtta

SEQ ID NO: 280124 - DNA, 25 bp, Mus musculus
cttcctgcctggcacggcgcaggag

SEQ ID NO: 280125 - DNA, 25 bp, Mus musculus
cttcctgcggcagagagtacttcag

SEQ ID NO: 280126 - DNA, 25 bp, Mus musculus
cttcctgctcaggagactgcttcta

SEQ ID NO: 280127 - DNA, 25 bp, Mus musculus
cttcctgctgcaggctctggtccaa

SEQ ID NO: 280128 - DNA, 25 bp, Mus musculus
cttcctgctggccggcattgaatgt

SEQ ID NO: 280129 - DNA, 25 bp, Mus musculus
cttcctgctggtgtcagtgtctgaa

SEQ ID NO: 280130 - DNA, 25 bp, Mus musculus
cttcctggacaagaggggaagtccc

SEQ ID NO: 280131 - DNA, 25 bp, Mus musculus
cttcctggacaaggtagagcctcag

SEQ ID NO: 280132 - DNA, 25 bp, Mus musculus
cttcctggacctcctggtccaaatg

SEQ ID NO: 280133 - DNA, 25 bp, Mus musculus
cttcctggagcatgcagacggaggt

SEQ ID NO: 280134 - DNA, 25 bp, Mus musculus
cttcctggagccaggggtcttaccg

SEQ ID NO: 280135 - DNA, 25 bp, Mus musculus
cttcctggatgcgttaagatctcca

SEQ ID NO: 280136 - DNA, 25 bp, Mus musculus
cttcctggatgtccagaaggatgca

SEQ ID NO: 280137 - DNA, 25 bp, Mus musculus
cttcctggcagcagacttttcacag

SEQ ID NO: 280138 - DNA, 25 bp, Mus musculus
cttcctggcccagcgggtacaccag

SEQ ID NO: 280139 - DNA, 25 bp, Mus musculus
cttcctggctctatccaggcttaca

SEQ ID NO: 280140 - DNA, 25 bp, Mus musculus
cttcctggctctctacctggccaat

SEQ ID NO: 280141 - DNA, 25 bp, Mus musculus
cttcctgggatctgaacttcactgg

SEQ ID NO: 280142 - DNA, 25 bp, Mus musculus
cttcctgggatctgctgtgtcccag

SEQ ID NO: 280143 - DNA, 25 bp, Mus musculus
cttcctgggcacctgactcagcgtg

SEQ ID NO: 280144 - DNA, 25 bp, Mus musculus
cttcctgggtctttcgaatccttcg

SEQ ID NO: 280145 - DNA, 25 bp, Mus musculus
cttcctgggtgatgttttcagcttt

SEQ ID NO: 280146 - DNA, 25 bp, Mus musculus
cttcctgggttgcagcccagaggac

SEQ ID NO: 280147 - DNA, 25 bp, Mus musculus
cttcctgggttgcagttataataaa

SEQ ID NO: 280148 - DNA, 25 bp, Mus musculus
cttcctggtagtcccatattatgaa

SEQ ID NO: 280149 - DNA, 25 bp, Mus musculus
cttcctggtgctacctttttttgat

SEQ ID NO: 280150 - DNA, 25 bp, Mus musculus
cttcctggtgctagcacaggttagt

SEQ ID NO: 280151 - DNA, 25 bp, Mus musculus
cttcctggtgctagctggtgaagac

SEQ ID NO: 280152 - DNA, 25 bp, Mus musculus
cttcctggtgctaggagtggcctgc

SEQ ID NO: 280153 - DNA, 25 bp, Mus musculus
cttcctgtaaggacttaaatatttt

SEQ ID NO: 280154 - DNA, 25 bp, Mus musculus
cttcctgtatttaagaatgcaccaa

SEQ ID NO: 280155 - DNA, 25 bp, Mus musculus
cttcctgtatttaaggcccatctcc

SEQ ID NO: 280156 - DNA, 25 bp, Mus musculus
cttcctgtatttaaggttcttggac

SEQ ID NO: 280157 - DNA, 25 bp, Mus musculus
cttcctgtcagggattgtgccatct

SEQ ID NO: 280158 - DNA, 25 bp, Mus musculus
cttcctgtcagtgctctggatgttc

SEQ ID NO: 280159 - DNA, 25 bp, Mus musculus
cttcctgtccaccctgttggcagaa

SEQ ID NO: 280160 - DNA, 25 bp, Mus musculus
cttcctgtccagagagaacattata

SEQ ID NO: 280161 - DNA, 25 bp, Mus musculus
cttcctgtccaggagagaacacaag

SEQ ID NO: 280162 - DNA, 25 bp, Mus musculus
cttcctgtccgtacagagactcagc

SEQ ID NO: 280163 - DNA, 25 bp, Mus musculus
cttcctgtcgatccccagcctcagc

SEQ ID NO: 280164 - DNA, 25 bp, Mus musculus
cttcctgtgtgccctgctttcccca

SEQ ID NO: 280165 - DNA, 25 bp, Mus musculus
cttcctgtgtggaacaacgaagcct

SEQ ID NO: 280166 - DNA, 25 bp, Mus musculus
cttcctgttggcaaccgtgtcttca

SEQ ID NO: 280167 - DNA, 25 bp, Mus musculus
cttcctgttgggcatctcctatgtc

SEQ ID NO: 280168 - DNA, 25 bp, Mus musculus
cttcctgtttgcagtatgatctgga

SEQ ID NO: 280169 - DNA, 25 bp, Mus musculus
cttcctgttttatggctggcctggt

SEQ ID NO: 280170 - DNA, 25 bp, Mus musculus
cttccttaaagggattggagctgga

SEQ ID NO: 280171 - DNA, 25 bp, Mus musculus
cttccttaaaggggcgacctggcat

SEQ ID NO: 280172 - DNA, 25 bp, Mus musculus
cttccttacagccctcaagtatgcc

SEQ ID NO: 280173 - DNA, 25 bp, Mus musculus
cttccttagcaaccttccatggctc

SEQ ID NO: 280174 - DNA, 25 bp, Mus musculus
cttccttatcagaggtcgactcatg

SEQ ID NO: 280175 - DNA, 25 bp, Mus musculus
cttccttatcaggaactcaataaac

SEQ ID NO: 280176 - DNA, 25 bp, Mus musculus
cttccttatcagtgtagcccagtga

SEQ ID NO: 280177 - DNA, 25 bp, Mus musculus
cttccttatctaacagtgtcattca

SEQ ID NO: 280178 - DNA, 25 bp, Mus musculus
cttccttatctatttttcatcatcg

SEQ ID NO: 280179 - DNA, 25 bp, Mus musculus
cttccttcagaagagttcgctccgg

SEQ ID NO: 280180 - DNA, 25 bp, Mus musculus
cttccttcagggccactgatgacct

SEQ ID NO: 280181 - DNA, 25 bp, Mus musculus
cttccttcaggtccttcatttcttc

SEQ ID NO: 280182 - DNA, 25 bp, Mus musculus
cttccttcaggtgttagagatagaa

SEQ ID NO: 280183 - DNA, 25 bp, Mus musculus
cttccttcagtgaggaggcttacat

SEQ ID NO: 280184 - DNA, 25 bp, Mus musculus
cttccttcatccgctctgctttccg

SEQ ID NO: 280185 - DNA, 25 bp, Mus musculus
cttccttccagtgagcttgcttccc

SEQ ID NO: 280186 - DNA, 25 bp, Mus musculus
cttccttgttcatagggcggcgggg

SEQ ID NO: 280187 - DNA, 25 bp, Mus musculus
cttccttgttcatccgaacaaaaaa

SEQ ID NO: 280188 - DNA, 25 bp, Mus musculus
cttcctttccgtagccagcccaggc

SEQ ID NO: 280189 - DNA, 25 bp, Mus musculus
cttcctttcctaagaaccaagacaa

SEQ ID NO: 280190 - DNA, 25 bp, Mus musculus
cttcctttcttaccctcagctggat

SEQ ID NO: 280191 - DNA, 25 bp, Mus musculus
cttcctttgaggagagtactaaatt

SEQ ID NO: 280192 - DNA, 25 bp, Mus musculus
cttcctttgaggaggattctggagg

SEQ ID NO: 280193 - DNA, 25 bp, Mus musculus
cttcctttgcacaggtgacgccatc

SEQ ID NO: 280194 - DNA, 25 bp, Mus musculus
cttcctttgcttggccacagacaag

SEQ ID NO: 280195 - DNA, 25 bp, Mus musculus
cttccttttgggcagcaaggcgaac

SEQ ID NO: 280196 - DNA, 25 bp, Mus musculus
cttccttttgtgagatttttttgat

SEQ ID NO: 280197 - DNA, 25 bp, Mus musculus
cttccttttgttttcagctttgtga

SEQ ID NO: 280198 - DNA, 25 bp, Mus musculus
cttcgaaactggagggctctctggg

SEQ ID NO: 280199 - DNA, 25 bp, Mus musculus
cttcgaaactggaggtgacccctgt

SEQ ID NO: 280200 - DNA, 25 bp, Mus musculus
cttcgaaactggagttacctcgctg

SEQ ID NO: 280201 - DNA, 25 bp, Mus musculus
cttcgaaagcacagaatactattac

SEQ ID NO: 280202 - DNA, 25 bp, Mus musculus
cttcgaaagcacaggttttgcactg

SEQ ID NO: 280203 - DNA, 25 bp, Mus musculus
cttcgaaattacaggaagctctcgt

SEQ ID NO: 280204 - DNA, 25 bp, Mus musculus
cttcgaaatttacaatctttaagaa

SEQ ID NO: 280205 - DNA, 25 bp, Mus musculus
cttcgaacggcacccaccaggtgac

SEQ ID NO: 280206 - DNA, 25 bp, Mus musculus
cttcgaagaaagaagatggacgaca

SEQ ID NO: 280207 - DNA, 25 bp, Mus musculus
cttcgaagccaaggcccaggccttg

SEQ ID NO: 280208 - DNA, 25 bp, Mus musculus
cttcgaataaggactgcatcaaatt

SEQ ID NO: 280209 - DNA, 25 bp, Mus musculus
cttcgaataagtaataaaagagcag

SEQ ID NO: 280210 - DNA, 25 bp, Mus musculus
cttcgaatcaagccaaatctgaagt

SEQ ID NO: 280211 - DNA, 25 bp, Mus musculus
cttcgaatcaagccaatccatagga

SEQ ID NO: 280212 - DNA, 25 bp, Mus musculus
cttcgaatgcctggtgcagccggat

SEQ ID NO: 280213 - DNA, 25 bp, Mus musculus
cttcgacaggggaatctggtcggct

SEQ ID NO: 280214 - DNA, 25 bp, Mus musculus
cttcgacagtattccggaacctgtg

SEQ ID NO: 280215 - DNA, 25 bp, Mus musculus
cttcgacatagaaaggccaccttag

SEQ ID NO: 280216 - DNA, 25 bp, Mus musculus
cttcgacatagaaagggagccaccc

SEQ ID NO: 280217 - DNA, 25 bp, Mus musculus
cttcgaccagtggggagtggagctg

SEQ ID NO: 280218 - DNA, 25 bp, Mus musculus
cttcgaccagtggggctggggaagc

SEQ ID NO: 280219 - DNA, 25 bp, Mus musculus
cttcgacgaactccaggatgtgttt

SEQ ID NO: 280220 - DNA, 25 bp, Mus musculus
cttcgactctgttggttcactttaa

SEQ ID NO: 280221 - DNA, 25 bp, Mus musculus
cttcgactggaacatggtgcagccc

SEQ ID NO: 280222 - DNA, 25 bp, Mus musculus
cttcgagaaaagatgagagtcacgg

SEQ ID NO: 280223 - DNA, 25 bp, Mus musculus
cttcgagaaaaggaaaatgagaagt

SEQ ID NO: 280224 - DNA, 25 bp, Mus musculus
cttcgagaaatgagtcctctctggg

SEQ ID NO: 280225 - DNA, 25 bp, Mus musculus
cttcgagaacgaagaaagaaacaga

SEQ ID NO: 280226 - DNA, 25 bp, Mus musculus
cttcgagaacgtgactacgagaagg

SEQ ID NO: 280227 - DNA, 25 bp, Mus musculus
cttcgagaagaatttccgtgtggac

SEQ ID NO: 280228 - DNA, 25 bp, Mus musculus
cttcgagaagcctggaaaggaaatt

SEQ ID NO: 280229 - DNA, 25 bp, Mus musculus
cttcgagaaggccaaagaatcttgg

SEQ ID NO: 280230 - DNA, 25 bp, Mus musculus
cttcgagaaggtgccgacaatggcc

SEQ ID NO: 280231 - DNA, 25 bp, Mus musculus
cttcgagcacatgcccttaggccca

SEQ ID NO: 280232 - DNA, 25 bp, Mus musculus
cttcgagcacatgggagtgttgtga

SEQ ID NO: 280233 - DNA, 25 bp, Mus musculus
cttcgagcacttccggtggacactg

SEQ ID NO: 280234 - DNA, 25 bp, Mus musculus
cttcgagcacttccgtgtctgtctc

SEQ ID NO: 280235 - DNA, 25 bp, Mus musculus
cttcgagcaggacaatcccagaaca

SEQ ID NO: 280236 - DNA, 25 bp, Mus musculus
cttcgaggaatgtttaaatgggtgc

SEQ ID NO: 280237 - DNA, 25 bp, Mus musculus
cttcgaggacccgcgagatgctgag

SEQ ID NO: 280238 - DNA, 25 bp, Mus musculus
cttcgaggacgattacgtgcactct

SEQ ID NO: 280239 - DNA, 25 bp, Mus musculus
cttcgaggcgtggtgcaagatttgc

SEQ ID NO: 280240 - DNA, 25 bp, Mus musculus
cttcgagggcagagagtctcgctct

SEQ ID NO: 280241 - DNA, 25 bp, Mus musculus
cttcgagggcagagttaatgttcgt

SEQ ID NO: 280242 - DNA, 25 bp, Mus musculus
cttcgagtcacaggcctgagggcca

SEQ ID NO: 280243 - DNA, 25 bp, Mus musculus
cttcgagtcacagggggtgacatgg

SEQ ID NO: 280244 - DNA, 25 bp, Mus musculus
cttcgataccgacatccatgctgtc

SEQ ID NO: 280245 - DNA, 25 bp, Mus musculus
cttcgcacaggtgcaggtgtccggg

SEQ ID NO: 280246 - DNA, 25 bp, Mus musculus
cttcgcataggagagcgggctgagc

SEQ ID NO: 280247 - DNA, 25 bp, Mus musculus
cttcgcattgcctgctccccacact

SEQ ID NO: 280248 - DNA, 25 bp, Mus musculus
cttcgccacagaaatggcctccacc

SEQ ID NO: 280249 - DNA, 25 bp, Mus musculus
cttcgccataggtaacattgccaag

SEQ ID NO: 280250 - DNA, 25 bp, Mus musculus
cttcgccataggtagcattgccaag

SEQ ID NO: 280251 - DNA, 25 bp, Mus musculus
cttcgccatgcagtggccccgggaa

SEQ ID NO: 280252 - DNA, 25 bp, Mus musculus
cttcgccatggtagcgatggtggaa

SEQ ID NO: 280253 - DNA, 25 bp, Mus musculus
cttcgccatggtggccatggtggag

SEQ ID NO: 280254 - DNA, 25 bp, Mus musculus
cttcgccatgtactattttacctat

SEQ ID NO: 280255 - DNA, 25 bp, Mus musculus
cttcgcccacgactgcactgggccc

SEQ ID NO: 280256 - DNA, 25 bp, Mus musculus
cttcgccccctggtgtggacattgc

SEQ ID NO: 280257 - DNA, 25 bp, Mus musculus
cttcgccgcgtctggtgacttctgt

SEQ ID NO: 280258 - DNA, 25 bp, Mus musculus
cttcgcctcagaggtcgagcccagt

SEQ ID NO: 280259 - DNA, 25 bp, Mus musculus
cttcgcctcagaggtggcatgcaga

SEQ ID NO: 280260 - DNA, 25 bp, Mus musculus
cttcgcctctacctaacaccccaat

SEQ ID NO: 280261 - DNA, 25 bp, Mus musculus
cttcgcctctacctctttctagtaa

SEQ ID NO: 280262 - DNA, 25 bp, Mus musculus
cttcgcctgtggaggcgcagcccgg

SEQ ID NO: 280263 - DNA, 25 bp, Mus musculus
cttcgcctgtggtgaagaagttgca

SEQ ID NO: 280264 - DNA, 25 bp, Mus musculus
cttcgccttcaccagggatgactct

SEQ ID NO: 280265 - DNA, 25 bp, Mus musculus
cttcgcgatccgcagaagacctaac

SEQ ID NO: 280266 - DNA, 25 bp, Mus musculus
cttcgcgatccgcagagcagcttaa

SEQ ID NO: 280267 - DNA, 25 bp, Mus musculus
cttcgcgattatcagaatccctctg

SEQ ID NO: 280268 - DNA, 25 bp, Mus musculus
cttcgcgattatcagagtccagtag

SEQ ID NO: 280269 - DNA, 25 bp, Mus musculus
cttcgcgccgacgaaatggctacca

SEQ ID NO: 280270 - DNA, 25 bp, Mus musculus
cttcgcgctgtccttctcctccgcc

SEQ ID NO: 280271 - DNA, 25 bp, Mus musculus
cttcgcggaagatatatgttgggta

SEQ ID NO: 280272 - DNA, 25 bp, Mus musculus
cttcgcggcgggataaataaggaaa

SEQ ID NO: 280273 - DNA, 25 bp, Mus musculus
cttcgcggcgggcaaatgaccatgg

SEQ ID NO: 280274 - DNA, 25 bp, Mus musculus
cttcgcggcggggtggcggtgggat

SEQ ID NO: 280275 - DNA, 25 bp, Mus musculus
cttcgcgggcttcaggtagaagcca

SEQ ID NO: 280276 - DNA, 25 bp, Mus musculus
cttcgcgggcttcaggtgaggatcc

SEQ ID NO: 280277 - DNA, 25 bp, Mus musculus
cttcgcgggcttcagtgctggagga

SEQ ID NO: 280278 - DNA, 25 bp, Mus musculus
cttcgcgtcacggtcttgttgcagc

SEQ ID NO: 280279 - DNA, 25 bp, Mus musculus
cttcgctgctgaggtcgtacaccct

SEQ ID NO: 280280 - DNA, 25 bp, Mus musculus
cttcgcttggggtgcacacagtgag

SEQ ID NO: 280281 - DNA, 25 bp, Mus musculus
cttcggaaagtccttcaggctcccg

SEQ ID NO: 280282 - DNA, 25 bp, Mus musculus
cttcggaaagttggggccctggagt

SEQ ID NO: 280283 - DNA, 25 bp, Mus musculus
cttcggaatgagaaaaaggagaaga

SEQ ID NO: 280284 - DNA, 25 bp, Mus musculus
cttcggaccactcggagatgtggtc

SEQ ID NO: 280285 - DNA, 25 bp, Mus musculus
cttcggaccactcggcctctgcaga

SEQ ID NO: 280286 - DNA, 25 bp, Mus musculus
cttcggacccacatggtggacctgc

SEQ ID NO: 280287 - DNA, 25 bp, Mus musculus
cttcggactaggggctctgagacag

SEQ ID NO: 280288 - DNA, 25 bp, Mus musculus
cttcggagaagatgtggacccctgg

SEQ ID NO: 280289 - DNA, 25 bp, Mus musculus
cttcggagaaggcctcctgccagaa

SEQ ID NO: 280290 - DNA, 25 bp, Mus musculus
cttcggaggagccagttcttgcctt

SEQ ID NO: 280291 - DNA, 25 bp, Mus musculus
cttcggcaaaaatgagtctcatagt

SEQ ID NO: 280292 - DNA, 25 bp, Mus musculus
cttcggcaagcaaggcttatacccc

SEQ ID NO: 280293 - DNA, 25 bp, Mus musculus
cttcggcaaggtcggaacctggcgg

SEQ ID NO: 280294 - DNA, 25 bp, Mus musculus
cttcggcaagttggagtgcttaatg

SEQ ID NO: 280295 - DNA, 25 bp, Mus musculus
cttcggcagctagagacagtccgag

SEQ ID NO: 280296 - DNA, 25 bp, Mus musculus
cttcggcccaaagagatgaagttgg

SEQ ID NO: 280297 - DNA, 25 bp, Mus musculus
cttcggccttgtggtaccaatgggg

SEQ ID NO: 280298 - DNA, 25 bp, Mus musculus
cttcggctacatggtcctctctctg

SEQ ID NO: 280299 - DNA, 25 bp, Mus musculus
cttcggctccagaccaaagattcaa

SEQ ID NO: 280300 - DNA, 25 bp, Mus musculus
cttcggctccaggccaactggaata

SEQ ID NO: 280301 - DNA, 25 bp, Mus musculus
cttcggctcccacagagctgattta

SEQ ID NO: 280302 - DNA, 25 bp, Mus musculus
cttcgggaatctgggtggtactggg

SEQ ID NO: 280303 - DNA, 25 bp, Mus musculus
cttcgggaccaggtctcctgttctc

SEQ ID NO: 280304 - DNA, 25 bp, Mus musculus
cttcgggactagctccccgggatgc

SEQ ID NO: 280305 - DNA, 25 bp, Mus musculus
cttcgggactaggtccccgggatgc

SEQ ID NO: 280306 - DNA, 25 bp, Mus musculus
cttcgggagactagcgtggcgactc

SEQ ID NO: 280307 - DNA, 25 bp, Mus musculus
cttcgggagactaggtcacgagcct

SEQ ID NO: 280308 - DNA, 25 bp, Mus musculus
cttcgggagaggaacagtatccaga

SEQ ID NO: 280309 - DNA, 25 bp, Mus musculus
cttcgggagaggaggtttgggatgc

SEQ ID NO: 280310 - DNA, 25 bp, Mus musculus
cttcgggaggaattatgcttcagct

SEQ ID NO: 280311 - DNA, 25 bp, Mus musculus
cttcgggagggatgtactgagctgt

SEQ ID NO: 280312 - DNA, 25 bp, Mus musculus
cttcgggcactgagcaccagttttg

SEQ ID NO: 280313 - DNA, 25 bp, Mus musculus
cttcgggcagaagctgcgagacgct

SEQ ID NO: 280314 - DNA, 25 bp, Mus musculus
cttcgggcagctgctgattcacgga

SEQ ID NO: 280315 - DNA, 25 bp, Mus musculus
cttcgggcccagctctccagtctaa

SEQ ID NO: 280316 - DNA, 25 bp, Mus musculus
cttcggggaggacagggtaacagtc

SEQ ID NO: 280317 - DNA, 25 bp, Mus musculus
cttcggggaggtggccaagcaggag

SEQ ID NO: 280318 - DNA, 25 bp, Mus musculus
cttcggggctgacagatcaacttat

SEQ ID NO: 280319 - DNA, 25 bp, Mus musculus
cttcgggggccagccgccgccatga

SEQ ID NO: 280320 - DNA, 25 bp, Mus musculus
cttcgggtagccggagtatgccgcc

SEQ ID NO: 280321 - DNA, 25 bp, Mus musculus
cttcggtctccagattcgcctctaa

SEQ ID NO: 280322 - DNA, 25 bp, Mus musculus
cttcggtgacatgaccaatgaggaa

SEQ ID NO: 280323 - DNA, 25 bp, Mus musculus
cttcggtgagagctcaaggcttcta

SEQ ID NO: 280324 - DNA, 25 bp, Mus musculus
cttcggtgtcaggaggacatgtcta

SEQ ID NO: 280325 - DNA, 25 bp, Mus musculus
cttcggtgtcaggggacactcttaa

SEQ ID NO: 280326 - DNA, 25 bp, Mus musculus
cttcggtgttggtctggtcagctac

SEQ ID NO: 280327 - DNA, 25 bp, Mus musculus
cttcgtactagaggctgctgtccgt

SEQ ID NO: 280328 - DNA, 25 bp, Mus musculus
cttcgtactagctcacttcatgaca

SEQ ID NO: 280329 - DNA, 25 bp, Mus musculus
cttcgtactagctcctggacttcta

SEQ ID NO: 280330 - DNA, 25 bp, Mus musculus
cttcgtagaagtgttaaatgaatac

SEQ ID NO: 280331 - DNA, 25 bp, Mus musculus
cttcgtatcctagagaggtgctcgg

SEQ ID NO: 280332 - DNA, 25 bp, Mus musculus
cttcgtcaaggaaacctgcagatct

SEQ ID NO: 280333 - DNA, 25 bp, Mus musculus
cttcgtcaaggccggaagtgatggt

SEQ ID NO: 280334 - DNA, 25 bp, Mus musculus
cttcgtcaaggctggttatgacggc

SEQ ID NO: 280335 - DNA, 25 bp, Mus musculus
cttcgtcccatggtccttcagagga

SEQ ID NO: 280336 - DNA, 25 bp, Mus musculus
cttcgtcctggatcttcctgcccaa

SEQ ID NO: 280337 - DNA, 25 bp, Mus musculus
cttcgtcctgtcagtggtgcagtcc

SEQ ID NO: 280338 - DNA, 25 bp, Mus musculus
cttcgtcctgtgagagagattcccc

SEQ ID NO: 280339 - DNA, 25 bp, Mus musculus
cttcgtcctgtgagatctatgtaag

SEQ ID NO: 280340 - DNA, 25 bp, Mus musculus
cttcgtcgttccgccgccaccatga

SEQ ID NO: 280341 - DNA, 25 bp, Mus musculus
cttcgtctaccaagctgttccacgc

SEQ ID NO: 280342 - DNA, 25 bp, Mus musculus
cttcgtctaccaaggagaggaacgt

SEQ ID NO: 280343 - DNA, 25 bp, Mus musculus
cttcgtctccgggctggtttgataa

SEQ ID NO: 280344 - DNA, 25 bp, Mus musculus
cttcgtctcctgccgtggatgctgt

SEQ ID NO: 280345 - DNA, 25 bp, Mus musculus
cttcgtctctcaggtgccgcaccag

SEQ ID NO: 280346 - DNA, 25 bp, Mus musculus
cttcgtctgaagacaaacctgagac

SEQ ID NO: 280347 - DNA, 25 bp, Mus musculus
cttcgtctgaagatgggtcagagat

SEQ ID NO: 280348 - DNA, 25 bp, Mus musculus
cttcgtcttcatcgcgcccttgctg

SEQ ID NO: 280349 - DNA, 25 bp, Mus musculus
cttcgtcttcatcgtggacctgctg

SEQ ID NO: 280350 - DNA, 25 bp, Mus musculus
cttcgtgacgataagtgggcagaga

SEQ ID NO: 280351 - DNA, 25 bp, Mus musculus
cttcgtgacgttattagaagcccaa

SEQ ID NO: 280352 - DNA, 25 bp, Mus musculus
cttcgtgcaggtgacccggtttgga

SEQ ID NO: 280353 - DNA, 25 bp, Mus musculus
cttcgtgcagtgactccactggctc

SEQ ID NO: 280354 - DNA, 25 bp, Mus musculus
cttcgtggaggtcctggacctttaa

SEQ ID NO: 280355 - DNA, 25 bp, Mus musculus
cttcgtggaggtcctggtggcccag

SEQ ID NO: 280356 - DNA, 25 bp, Mus musculus
cttcgtggcagatctgattgccttc

SEQ ID NO: 280357 - DNA, 25 bp, Mus musculus
cttcgtggcaggttgttcctacatg

SEQ ID NO: 280358 - DNA, 25 bp, Mus musculus
cttcgtggcgaagcagcaggatgtg

SEQ ID NO: 280359 - DNA, 25 bp, Mus musculus
cttcgtggcgatcaagaagaagcag

SEQ ID NO: 280360 - DNA, 25 bp, Mus musculus
cttcgtggctggcggactatttcag

SEQ ID NO: 280361 - DNA, 25 bp, Mus musculus
cttcgtggctggtttgactcagaag

SEQ ID NO: 280362 - DNA, 25 bp, Mus musculus
cttcgtgtcctgcttagtcttgctg

SEQ ID NO: 280363 - DNA, 25 bp, Mus musculus
cttcgtgtcctgcttttttcacttc

SEQ ID NO: 280364 - DNA, 25 bp, Mus musculus
cttcgtgttcactttagaacacccg

SEQ ID NO: 280365 - DNA, 25 bp, Mus musculus
cttcgtgtttcaggtattctgcgtt

SEQ ID NO: 280366 - DNA, 25 bp, Mus musculus
cttcgttctctagcgaaatccctct

SEQ ID NO: 280367 - DNA, 25 bp, Mus musculus
cttcgttctctagcgtgatttttct

SEQ ID NO: 280368 - DNA, 25 bp, Mus musculus
cttcgttcttagatgagcccaggtc

SEQ ID NO: 280369 - DNA, 25 bp, Mus musculus
cttcgttgccaggagatggcctgac

SEQ ID NO: 280370 - DNA, 25 bp, Mus musculus
cttcgttgggggcactcagaaagaa

SEQ ID NO: 280371 - DNA, 25 bp, Mus musculus
cttcgttttcacaggggccgatcaa

SEQ ID NO: 280372 - DNA, 25 bp, Mus musculus
cttcgttttgacttatatgatgttg

SEQ ID NO: 280373 - DNA, 25 bp, Mus musculus
cttctaaacagaaaggtgtcaactc

SEQ ID NO: 280374 - DNA, 25 bp, Mus musculus
cttctaaacagaattctgatttttt

SEQ ID NO: 280375 - DNA, 25 bp, Mus musculus
cttctaaacagatggatttactgca

SEQ ID NO: 280376 - DNA, 25 bp, Mus musculus
cttctaaacgtttcactgcgcaaac

SEQ ID NO: 280377 - DNA, 25 bp, Mus musculus
cttctaaagaaaggtattgaggctc

SEQ ID NO: 280378 - DNA, 25 bp, Mus musculus
cttctaaatgataagaatggcacac

SEQ ID NO: 280379 - DNA, 25 bp, Mus musculus
cttctaaatgataaggaacatgaca

SEQ ID NO: 280380 - DNA, 25 bp, Mus musculus
cttctaaccactcacaatcagcgga

SEQ ID NO: 280381 - DNA, 25 bp, Mus musculus
cttctaaccagaggcaccaggatca

SEQ ID NO: 280382 - DNA, 25 bp, Mus musculus
cttctaactcaggaaggcgaagtgc

SEQ ID NO: 280383 - DNA, 25 bp, Mus musculus
cttctaagattggtgtcccttttcc

SEQ ID NO: 280384 - DNA, 25 bp, Mus musculus
cttctaagtgaaggacagagggtac

SEQ ID NO: 280385 - DNA, 25 bp, Mus musculus
cttctaagttggatcagtgatgatg

SEQ ID NO: 280386 - DNA, 25 bp, Mus musculus
cttctaagtttgcagcttggatgct

SEQ ID NO: 280387 - DNA, 25 bp, Mus musculus
cttctaatcaccaagccccgcccaa

SEQ ID NO: 280388 - DNA, 25 bp, Mus musculus
cttctaatcccaagcacggtagatg

SEQ ID NO: 280389 - DNA, 25 bp, Mus musculus
cttctaatcctaaatctccacagtt

SEQ ID NO: 280390 - DNA, 25 bp, Mus musculus
cttctacaaaggaagtaaccaggag

SEQ ID NO: 280391 - DNA, 25 bp, Mus musculus
cttctacaagccaggagccatgcga

SEQ ID NO: 280392 - DNA, 25 bp, Mus musculus
cttctacacccatgagcacttgctg

SEQ ID NO: 280393 - DNA, 25 bp, Mus musculus
cttctacagcatagccctcagggat

SEQ ID NO: 280394 - DNA, 25 bp, Mus musculus
cttctacagcatagggaagcagctg

SEQ ID NO: 280395 - DNA, 25 bp, Mus musculus
cttctacatcctggtgtttgtggta

SEQ ID NO: 280396 - DNA, 25 bp, Mus musculus
cttctacatctttggtattgttggg

SEQ ID NO: 280397 - DNA, 25 bp, Mus musculus
cttctacatggtgccatcagcaacg

SEQ ID NO: 280398 - DNA, 25 bp, Mus musculus
cttctacattaggcaaatcaacaat

SEQ ID NO: 280399 - DNA, 25 bp, Mus musculus
cttctaccaggcggaagatggacag

SEQ ID NO: 280400 - DNA, 25 bp, Mus musculus
cttctaccccacataatatttcttg

SEQ ID NO: 280401 - DNA, 25 bp, Mus musculus
cttctaccccacttaatatttcttg

SEQ ID NO: 280402 - DNA, 25 bp, Mus musculus
cttctacccgacagacatacttcct

SEQ ID NO: 280403 - DNA, 25 bp, Mus musculus
cttctacccgacagggtgtgaacaa

SEQ ID NO: 280404 - DNA, 25 bp, Mus musculus
cttctaccggtttcagacaccctat

SEQ ID NO: 280405 - DNA, 25 bp, Mus musculus
cttctacctgaacagggacccagaa

SEQ ID NO: 280406 - DNA, 25 bp, Mus musculus
cttctacgtggcagatggcagcctg

SEQ ID NO: 280407 - DNA, 25 bp, Mus musculus
cttctactagagttatctgggaatg

SEQ ID NO: 280408 - DNA, 25 bp, Mus musculus
cttctactcaaattctggaatatcc

SEQ ID NO: 280409 - DNA, 25 bp, Mus musculus
cttctactcctcgctgagcacctcc

SEQ ID NO: 280410 - DNA, 25 bp, Mus musculus
cttctactgacatgtaccataatgt

SEQ ID NO: 280411 - DNA, 25 bp, Mus musculus
cttctactgcggctggtgtcagtcg

SEQ ID NO: 280412 - DNA, 25 bp, Mus musculus
cttctactgcgggatggccatcgtc

SEQ ID NO: 280413 - DNA, 25 bp, Mus musculus
cttctactgcgggcatggtgaagcc

SEQ ID NO: 280414 - DNA, 25 bp, Mus musculus
cttctacttgtcagattgctgcccg

SEQ ID NO: 280415 - DNA, 25 bp, Mus musculus
cttctagaagaggcaatattgataa

SEQ ID NO: 280416 - DNA, 25 bp, Mus musculus
cttctagaagctcttctgtgccaac

SEQ ID NO: 280417 - DNA, 25 bp, Mus musculus
cttctagacaaggcaggttcaccgg

SEQ ID NO: 280418 - DNA, 25 bp, Mus musculus
cttctagacacagggcccatcatgg

SEQ ID NO: 280419 - DNA, 25 bp, Mus musculus
cttctagacacccaggacatggaga

SEQ ID NO: 280420 - DNA, 25 bp, Mus musculus
cttctagacccaggagttttgctct

SEQ ID NO: 280421 - DNA, 25 bp, Mus musculus
cttctagactttgaggaggaagaag

SEQ ID NO: 280422 - DNA, 25 bp, Mus musculus
cttctagatcagccaccatgcggcg

SEQ ID NO: 280423 - DNA, 25 bp, Mus musculus
cttctagatcctgaatgttgctgtg

SEQ ID NO: 280424 - DNA, 25 bp, Mus musculus
cttctagcaggcctgcctactttgg

SEQ ID NO: 280425 - DNA, 25 bp, Mus musculus
cttctagccagctgcagacggagct

SEQ ID NO: 280426 - DNA, 25 bp, Mus musculus
cttctagcctaccagggatggctct

SEQ ID NO: 280427 - DNA, 25 bp, Mus musculus
cttctaggacctcgagtataactgc

SEQ ID NO: 280428 - DNA, 25 bp, Mus musculus
cttctaggatgcgatacaaatctca

SEQ ID NO: 280429 - DNA, 25 bp, Mus musculus
cttctaggatgcgatgccctgtgga

SEQ ID NO: 280430 - DNA, 25 bp, Mus musculus
cttctagggacagaacaacagcttg

SEQ ID NO: 280431 - DNA, 25 bp, Mus musculus
cttctagtaaaagtgtcctagatga

SEQ ID NO: 280432 - DNA, 25 bp, Mus musculus
cttctagtagcttgtcttctcacag

SEQ ID NO: 280433 - DNA, 25 bp, Mus musculus
cttctagttaagaggtttggacatt

SEQ ID NO: 280434 - DNA, 25 bp, Mus musculus
cttctataacggctgggcacgtgga

SEQ ID NO: 280435 - DNA, 25 bp, Mus musculus
cttctataagaactgctccgctcgg

SEQ ID NO: 280436 - DNA, 25 bp, Mus musculus
cttctataagaactggcacaagtct

SEQ ID NO: 280437 - DNA, 25 bp, Mus musculus
cttctatatgacagactccattagc

SEQ ID NO: 280438 - DNA, 25 bp, Mus musculus
cttctatatgacagggcttctggtg

SEQ ID NO: 280439 - DNA, 25 bp, Mus musculus
cttctatccagggatgaactccatc

SEQ ID NO: 280440 - DNA, 25 bp, Mus musculus
cttctatccagggcccattgtggaa

SEQ ID NO: 280441 - DNA, 25 bp, Mus musculus
cttctatctttggtatagttggaat

SEQ ID NO: 280442 - DNA, 25 bp, Mus musculus
cttctatctttttgagttgtgtaaa

SEQ ID NO: 280443 - DNA, 25 bp, Mus musculus
cttctatgagaaagtccctccagga

SEQ ID NO: 280444 - DNA, 25 bp, Mus musculus
cttctatgaggttgactgtgggttc

SEQ ID NO: 280445 - DNA, 25 bp, Mus musculus
cttctatgcaggcacggtgctgttg

SEQ ID NO: 280446 - DNA, 25 bp, Mus musculus
cttctatgcttcagatggagtggat

SEQ ID NO: 280447 - DNA, 25 bp, Mus musculus
cttctatgcttcagcccctggtcat

SEQ ID NO: 280448 - DNA, 25 bp, Mus musculus
cttctatggagagaaacaacccgag

SEQ ID NO: 280449 - DNA, 25 bp, Mus musculus
cttctatgtcatggtggggtttttt

SEQ ID NO: 280450 - DNA, 25 bp, Mus musculus
cttctatgtggtgctgggtaggcca

SEQ ID NO: 280451 - DNA, 25 bp, Mus musculus
cttctattaacacagatgctgctca

SEQ ID NO: 280452 - DNA, 25 bp, Mus musculus
cttctattaacacagcacggtgcaa

SEQ ID NO: 280453 - DNA, 25 bp, Mus musculus
cttctattaacacaggatcacacta

SEQ ID NO: 280454 - DNA, 25 bp, Mus musculus
cttctattaacagcttcgaccttgc

SEQ ID NO: 280455 - DNA, 25 bp, Mus musculus
cttctatttcctagagctgtttgac

SEQ ID NO: 280456 - DNA, 25 bp, Mus musculus
cttctatttctgggttctgccagaa

SEQ ID NO: 280457 - DNA, 25 bp, Mus musculus
cttctattttgagagactgccttta

SEQ ID NO: 280458 - DNA, 25 bp, Mus musculus
cttctattttgaggttgagcacatc

SEQ ID NO: 280459 - DNA, 25 bp, Mus musculus
cttctcaacagccatctgcaatggc

SEQ ID NO: 280460 - DNA, 25 bp, Mus musculus
cttctcaactcagtttgacccattg

SEQ ID NO: 280461 - DNA, 25 bp, Mus musculus
cttctcaagaattaggtaagtggag

SEQ ID NO: 280462 - DNA, 25 bp, Mus musculus
cttctcaagcagatttcggaggcac

SEQ ID NO: 280463 - DNA, 25 bp, Mus musculus
cttctcaagcagggtactggtctct

SEQ ID NO: 280464 - DNA, 25 bp, Mus musculus
cttctcaagcaggtggcccacgcgc

SEQ ID NO: 280465 - DNA, 25 bp, Mus musculus
cttctcaaggagcgatgagcaagat

SEQ ID NO: 280466 - DNA, 25 bp, Mus musculus
cttctcaaggcaggttgtaaaagtt

SEQ ID NO: 280467 - DNA, 25 bp, Mus musculus
cttctcaaggcgaccctttgacagc

SEQ ID NO: 280468 - DNA, 25 bp, Mus musculus
cttctcaatgagaaattcagcaact

SEQ ID NO: 280469 - DNA, 25 bp, Mus musculus
cttctcaatgtgaaattcagcaact

SEQ ID NO: 280470 - DNA, 25 bp, Mus musculus
cttctcacaatggaggaagaacgag

SEQ ID NO: 280471 - DNA, 25 bp, Mus musculus
cttctcaccaaggtctgagtacctt

SEQ ID NO: 280472 - DNA, 25 bp, Mus musculus
cttctcacccggaaaatgactccct

SEQ ID NO: 280473 - DNA, 25 bp, Mus musculus
cttctcaccgcttagaattacatat

SEQ ID NO: 280474 - DNA, 25 bp, Mus musculus
cttctcaccgggcgagcctttcctt

SEQ ID NO: 280475 - DNA, 25 bp, Mus musculus
cttctcaccggtgcacgcctcctct

SEQ ID NO: 280476 - DNA, 25 bp, Mus musculus
cttctcaccgttatcctaggcgtct

SEQ ID NO: 280477 - DNA, 25 bp, Mus musculus
cttctcagagagacctgcttctggt

SEQ ID NO: 280478 - DNA, 25 bp, Mus musculus
cttctcagaggctccatctccattc

SEQ ID NO: 280479 - DNA, 25 bp, Mus musculus
cttctcagcatccctggctgagagc

SEQ ID NO: 280480 - DNA, 25 bp, Mus musculus
cttctcagcatttgccctggttccc

SEQ ID NO: 280481 - DNA, 25 bp, Mus musculus
cttctcaggaagtaaaccaggttct

SEQ ID NO: 280482 - DNA, 25 bp, Mus musculus
cttctcaggaagtgcttctgtttcc

SEQ ID NO: 280483 - DNA, 25 bp, Mus musculus
cttctcaggaagttctgatccagac

SEQ ID NO: 280484 - DNA, 25 bp, Mus musculus
cttctcagtagtgatcaagctcggc

SEQ ID NO: 280485 - DNA, 25 bp, Mus musculus
cttctcagtcaggtaccaagcgcct

SEQ ID NO: 280486 - DNA, 25 bp, Mus musculus
cttctcagtcaggtcgcagacattt

SEQ ID NO: 280487 - DNA, 25 bp, Mus musculus
cttctcagtgaagagtcacatactc

SEQ ID NO: 280488 - DNA, 25 bp, Mus musculus
cttctcataaaaatggatgagacat

SEQ ID NO: 280489 - DNA, 25 bp, Mus musculus
cttctcataaaattcccatggctct

SEQ ID NO: 280490 - DNA, 25 bp, Mus musculus
cttctcatactgcaggcagagaggt

SEQ ID NO: 280491 - DNA, 25 bp, Mus musculus
cttctcatactgcagtctggacaga

SEQ ID NO: 280492 - DNA, 25 bp, Mus musculus
cttctcatccgctgagacccatgcg

SEQ ID NO: 280493 - DNA, 25 bp, Mus musculus
cttctcatccgctgagatgctggtg

SEQ ID NO: 280494 - DNA, 25 bp, Mus musculus
cttctcatcttgagaacccagcagt

SEQ ID NO: 280495 - DNA, 25 bp, Mus musculus
cttctccaaagccaagcccgatacc

SEQ ID NO: 280496 - DNA, 25 bp, Mus musculus
cttctccaaaggtctgtcaaatatg

SEQ ID NO: 280497 - DNA, 25 bp, Mus musculus
cttctccaaattatgtgccaccaaa

SEQ ID NO: 280498 - DNA, 25 bp, Mus musculus
cttctccaagactctaaaaaacgat

SEQ ID NO: 280499 - DNA, 25 bp, Mus musculus
cttctccaagaggctactgaaagat

SEQ ID NO: 280500 - DNA, 25 bp, Mus musculus
cttctccaaggaaaaggaatccaca

SEQ ID NO: 280501 - DNA, 25 bp, Mus musculus
cttctccaagtatgaaggaggagta

SEQ ID NO: 280502 - DNA, 25 bp, Mus musculus
cttctccaagttgctgcaatagtat

SEQ ID NO: 280503 - DNA, 25 bp, Mus musculus
cttctccaccaagtcaaagtaaaca

SEQ ID NO: 280504 - DNA, 25 bp, Mus musculus
cttctccaccatcccttccagatat

SEQ ID NO: 280505 - DNA, 25 bp, Mus musculus
cttctccacccgcgggggccctagc

SEQ ID NO: 280506 - DNA, 25 bp, Mus musculus
cttctccacccggacagagtccttg

SEQ ID NO: 280507 - DNA, 25 bp, Mus musculus
cttctccacgcctctcgtcagaaga

SEQ ID NO: 280508 - DNA, 25 bp, Mus musculus
cttctccacggtactacttgtcctc

SEQ ID NO: 280509 - DNA, 25 bp, Mus musculus
cttctccacgttctaccacgcctgt

SEQ ID NO: 280510 - DNA, 25 bp, Mus musculus
cttctccacttcaggtactaaacag

SEQ ID NO: 280511 - DNA, 25 bp, Mus musculus
cttctccagaggcaagttcaaggtt

SEQ ID NO: 280512 - DNA, 25 bp, Mus musculus
cttctccagcagcaagagccagagg

SEQ ID NO: 280513 - DNA, 25 bp, Mus musculus
cttctccagcaggacccaacctcct

SEQ ID NO: 280514 - DNA, 25 bp, Mus musculus
cttctccatagcagactagagagaa

SEQ ID NO: 280515 - DNA, 25 bp, Mus musculus
cttctccatatacctggtgatggac

SEQ ID NO: 280516 - DNA, 25 bp, Mus musculus
cttctccatcagaatccaagagaaa

SEQ ID NO: 280517 - DNA, 25 bp, Mus musculus
cttctccatcagtatccaagagaaa

SEQ ID NO: 280518 - DNA, 25 bp, Mus musculus
cttctcccaaattaaatgatgaaca

SEQ ID NO: 280519 - DNA, 25 bp, Mus musculus
cttctcccacagtgcgtgctattat

SEQ ID NO: 280520 - DNA, 25 bp, Mus musculus
cttctcccagaggaactctgtgcct

SEQ ID NO: 280521 - DNA, 25 bp, Mus musculus
cttctcccagaggaggacgatgtca

SEQ ID NO: 280522 - DNA, 25 bp, Mus musculus
cttctcccagaggagttggatattc

SEQ ID NO: 280523 - DNA, 25 bp, Mus musculus
cttctcccagatgaccaagatgttg

SEQ ID NO: 280524 - DNA, 25 bp, Mus musculus
cttctcccaggaagcctcaaggaga

SEQ ID NO: 280525 - DNA, 25 bp, Mus musculus
cttctcccaggaagcgtgcccaact

SEQ ID NO: 280526 - DNA, 25 bp, Mus musculus
cttctcccaggaagtgatcccaaca

SEQ ID NO: 280527 - DNA, 25 bp, Mus musculus
cttctcccaggaagtgcaaagagga

SEQ ID NO: 280528 - DNA, 25 bp, Mus musculus
cttctcccctgacagacccggagtt

SEQ ID NO: 280529 - DNA, 25 bp, Mus musculus
cttctcccctggtttctgtatgcaa

SEQ ID NO: 280530 - DNA, 25 bp, Mus musculus
cttctccctccggaaagaacaagtt

SEQ ID NO: 280531 - DNA, 25 bp, Mus musculus
cttctccgagaacgggcagagaaaa

SEQ ID NO: 280532 - DNA, 25 bp, Mus musculus
cttctccgcaaaggcaccaccttcc

SEQ ID NO: 280533 - DNA, 25 bp, Mus musculus
cttctccgcaaagggtacacgcagc

SEQ ID NO: 280534 - DNA, 25 bp, Mus musculus
cttctccgccagtcaacaggagaag

SEQ ID NO: 280535 - DNA, 25 bp, Mus musculus
cttctccggctggcccaccttggga

SEQ ID NO: 280536 - DNA, 25 bp, Mus musculus
cttctccgggctgaggagccaacat

SEQ ID NO: 280537 - DNA, 25 bp, Mus musculus
cttctcctcagtgtttacaaaatat

SEQ ID NO: 280538 - DNA, 25 bp, Mus musculus
cttctcctgaaatgcctaacataca

SEQ ID NO: 280539 - DNA, 25 bp, Mus musculus
cttctcctgcagcgagcttcaagcg

SEQ ID NO: 280540 - DNA, 25 bp, Mus musculus
cttctcctgcagcgatatcgatgag

SEQ ID NO: 280541 - DNA, 25 bp, Mus musculus
cttctcctggacgtgcgaccgcatt

SEQ ID NO: 280542 - DNA, 25 bp, Mus musculus
cttctcctggcaacgatatccctgg

SEQ ID NO: 280543 - DNA, 25 bp, Mus musculus
cttctcctggcccagcaaccttccc

SEQ ID NO: 280544 - DNA, 25 bp, Mus musculus
cttctcctggcccagcaatcttccc

SEQ ID NO: 280545 - DNA, 25 bp, Mus musculus
cttctcctgggagggtcatctatgg

SEQ ID NO: 280546 - DNA, 25 bp, Mus musculus
cttctcctgggttggattgatctct

SEQ ID NO: 280547 - DNA, 25 bp, Mus musculus
cttctcctggtggaccacagaccag

SEQ ID NO: 280548 - DNA, 25 bp, Mus musculus
cttctcctgtcaggccagatttgga

SEQ ID NO: 280549 - DNA, 25 bp, Mus musculus
cttctcgactgagggtccaaacctt

SEQ ID NO: 280550 - DNA, 25 bp, Mus musculus
cttctcgagggaaagtgtccacaga

SEQ ID NO: 280551 - DNA, 25 bp, Mus musculus
cttctcgcgccagaggaaggtggga

SEQ ID NO: 280552 - DNA, 25 bp, Mus musculus
cttctcgcgccagagtttgtgatcc

SEQ ID NO: 280553 - DNA, 25 bp, Mus musculus
cttctcgctattcagattcttctgg

SEQ ID NO: 280554 - DNA, 25 bp, Mus musculus
cttctcgctgggaaatctacaaaat

SEQ ID NO: 280555 - DNA, 25 bp, Mus musculus
cttctcgtgggctgtgccggcattg

SEQ ID NO: 280556 - DNA, 25 bp, Mus musculus
cttctcgtgtaaggatcttctgcct

SEQ ID NO: 280557 - DNA, 25 bp, Mus musculus
cttctcgttggtgcctttgtgcctc

SEQ ID NO: 280558 - DNA, 25 bp, Mus musculus
cttctctaaaaaagattgatagcgc

SEQ ID NO: 280559 - DNA, 25 bp, Mus musculus
cttctctaaggcttgccctctgaac

SEQ ID NO: 280560 - DNA, 25 bp, Mus musculus
cttctctaataaagcaaggagtaaa

SEQ ID NO: 280561 - DNA, 25 bp, Mus musculus
cttctctaataaaggatatggtggt

SEQ ID NO: 280562 - DNA, 25 bp, Mus musculus
cttctctagcacaggttggtctggg

SEQ ID NO: 280563 - DNA, 25 bp, Mus musculus
cttctctaggaacaatgtgttctac

SEQ ID NO: 280564 - DNA, 25 bp, Mus musculus
cttctctatctgccaaagtaaacaa

SEQ ID NO: 280565 - DNA, 25 bp, Mus musculus
cttctctcagctacagcggaacatc

SEQ ID NO: 280566 - DNA, 25 bp, Mus musculus
cttctctcaggcaggcaaccttcag

SEQ ID NO: 280567 - DNA, 25 bp, Mus musculus
cttctctccagtggtggatgtgaag

SEQ ID NO: 280568 - DNA, 25 bp, Mus musculus
cttctctccttggtcacgcccgggt

SEQ ID NO: 280569 - DNA, 25 bp, Mus musculus
cttctctcgtcaagtgagccccagg

SEQ ID NO: 280570 - DNA, 25 bp, Mus musculus
cttctctctccagtacccccacttc

SEQ ID NO: 280571 - DNA, 25 bp, Mus musculus
cttctctctctctttgatgggggaa

SEQ ID NO: 280572 - DNA, 25 bp, Mus musculus
cttctctctgcaggtcaggaatcta

SEQ ID NO: 280573 - DNA, 25 bp, Mus musculus
cttctctctgcaggttaatatccga

SEQ ID NO: 280574 - DNA, 25 bp, Mus musculus
cttctctctgtctggtatctatcct

SEQ ID NO: 280575 - DNA, 25 bp, Mus musculus
cttctctgagagaaggtggagcagc

SEQ ID NO: 280576 - DNA, 25 bp, Mus musculus
cttctctgcagaccggcccaacgtg

SEQ ID NO: 280577 - DNA, 25 bp, Mus musculus
cttctctggcttcctcccgaggccg

SEQ ID NO: 280578 - DNA, 25 bp, Mus musculus
cttctctggggtctggccaaagatc

SEQ ID NO: 280579 - DNA, 25 bp, Mus musculus
cttctctggggtctggtcagaaaga

SEQ ID NO: 280580 - DNA, 25 bp, Mus musculus
cttctctgtaaaagggtgtctttaa

SEQ ID NO: 280581 - DNA, 25 bp, Mus musculus
cttctctgtctagggctgacggttg

SEQ ID NO: 280582 - DNA, 25 bp, Mus musculus
cttctctgtctccaggacacccaac

SEQ ID NO: 280583 - DNA, 25 bp, Mus musculus
cttctctgtggaataaatttgtgga

SEQ ID NO: 280584 - DNA, 25 bp, Mus musculus
cttctcttctcagggtctcagaatg

SEQ ID NO: 280585 - DNA, 25 bp, Mus musculus
cttctcttgttaggttcacctggag

SEQ ID NO: 280586 - DNA, 25 bp, Mus musculus
cttctctttgctgcgattatttgat

SEQ ID NO: 280587 - DNA, 25 bp, Mus musculus
cttctctttgctgcggcttcataga

SEQ ID NO: 280588 - DNA, 25 bp, Mus musculus
cttctctttttctcgaaagaaggat

SEQ ID NO: 280589 - DNA, 25 bp, Mus musculus
cttctgaaacaccaggaacgggagc

SEQ ID NO: 280590 - DNA, 25 bp, Mus musculus
cttctgaaacaccaggagttggaga

SEQ ID NO: 280591 - DNA, 25 bp, Mus musculus
cttctgaaacctcaggtggaaccga

SEQ ID NO: 280592 - DNA, 25 bp, Mus musculus
cttctgaaacttacttacagctacg

SEQ ID NO: 280593 - DNA, 25 bp, Mus musculus
cttctgaaggagacccagcatgtgc

SEQ ID NO: 280594 - DNA, 25 bp, Mus musculus
cttctgaaggagccggcatgaccaa

SEQ ID NO: 280595 - DNA, 25 bp, Mus musculus
cttctgacaatgcaatcccgcctat

SEQ ID NO: 280596 - DNA, 25 bp, Mus musculus
cttctgacaatggaatcccgcctat

SEQ ID NO: 280597 - DNA, 25 bp, Mus musculus
cttctgaccaaagaatacattccac

SEQ ID NO: 280598 - DNA, 25 bp, Mus musculus
cttctgaccaccacggcatcacggc

SEQ ID NO: 280599 - DNA, 25 bp, Mus musculus
cttctgaccgccctgctgctcatga

SEQ ID NO: 280600 - DNA, 25 bp, Mus musculus
cttctgagaaagattgtctaaagcc

SEQ ID NO: 280601 - DNA, 25 bp, Mus musculus
cttctgagaacaggaatggccttga

SEQ ID NO: 280602 - DNA, 25 bp, Mus musculus
cttctgagaccaccctcccttggaa

SEQ ID NO: 280603 - DNA, 25 bp, Mus musculus
cttctgagatagcaagcagattggg

SEQ ID NO: 280604 - DNA, 25 bp, Mus musculus
cttctgagccttgcgtgccctccca

SEQ ID NO: 280605 - DNA, 25 bp, Mus musculus
cttctgaggaagcactggattgcca

SEQ ID NO: 280606 - DNA, 25 bp, Mus musculus
cttctgaggaaggtattcggcacca

SEQ ID NO: 280607 - DNA, 25 bp, Mus musculus
cttctgagtaaaggtgaacatcagt

SEQ ID NO: 280608 - DNA, 25 bp, Mus musculus
cttctgagtaaaggtgaacgacgac

SEQ ID NO: 280609 - DNA, 25 bp, Mus musculus
cttctgagtcaagagcttggattct

SEQ ID NO: 280610 - DNA, 25 bp, Mus musculus
cttctgagtggagagggcgaggccc

SEQ ID NO: 280611 - DNA, 25 bp, Mus musculus
cttctgagttaatatgacagatacc

SEQ ID NO: 280612 - DNA, 25 bp, Mus musculus
cttctgagttattgcggaagcagaa

SEQ ID NO: 280613 - DNA, 25 bp, Mus musculus
cttctgagttgtagttagcgccttc

SEQ ID NO: 280614 - DNA, 25 bp, Mus musculus
cttctgagttttcctcttgctcctg

SEQ ID NO: 280615 - DNA, 25 bp, Mus musculus
cttctgataatagtgttatccaaga

SEQ ID NO: 280616 - DNA, 25 bp, Mus musculus
cttctgatagaggtgccctgggaca

SEQ ID NO: 280617 - DNA, 25 bp, Mus musculus
cttctgatatgaggacccatcctct

SEQ ID NO: 280618 - DNA, 25 bp, Mus musculus
cttctgatcagcagagtgaaatggt

SEQ ID NO: 280619 - DNA, 25 bp, Mus musculus
cttctgatgagctgggaagtcatca

SEQ ID NO: 280620 - DNA, 25 bp, Mus musculus
cttctgatggaggaatcaaaaatga

SEQ ID NO: 280621 - DNA, 25 bp, Mus musculus
cttctgcaaaaaggggatggaattc

SEQ ID NO: 280622 - DNA, 25 bp, Mus musculus
cttctgcaaaagaaatacaaagagt

SEQ ID NO: 280623 - DNA, 25 bp, Mus musculus
cttctgcaaaagagctgcagggatg

SEQ ID NO: 280624 - DNA, 25 bp, Mus musculus
cttctgcaagaaggagatctggaac

SEQ ID NO: 280625 - DNA, 25 bp, Mus musculus
cttctgcaagagcaataaaattgct

SEQ ID NO: 280626 - DNA, 25 bp, Mus musculus
cttctgcaagcactgcagagagcgg

SEQ ID NO: 280627 - DNA, 25 bp, Mus musculus
cttctgcacagaaaacccagccagt

SEQ ID NO: 280628 - DNA, 25 bp, Mus musculus
cttctgcacagacttggagcagttc

SEQ ID NO: 280629 - DNA, 25 bp, Mus musculus
cttctgcacgcccctccaggccggc

SEQ ID NO: 280630 - DNA, 25 bp, Mus musculus
cttctgcacggcgggtaacttcatg

SEQ ID NO: 280631 - DNA, 25 bp, Mus musculus
cttctgcacgtgcagcgcccacagg

SEQ ID NO: 280632 - DNA, 25 bp, Mus musculus
cttctgcacgtgcagggtccccgac

SEQ ID NO: 280633 - DNA, 25 bp, Mus musculus
cttctgcactagagtatcaagagag

SEQ ID NO: 280634 - DNA, 25 bp, Mus musculus
cttctgcagaaggtttcaacactaa

SEQ ID NO: 280635 - DNA, 25 bp, Mus musculus
cttctgcagcaaatctcccggaaat

SEQ ID NO: 280636 - DNA, 25 bp, Mus musculus
cttctgcagctggcactggggctgc

SEQ ID NO: 280637 - DNA, 25 bp, Mus musculus
cttctgcatgaacttctgcacagca

SEQ ID NO: 280638 - DNA, 25 bp, Mus musculus
cttctgcatgaatttcagttcgttg

SEQ ID NO: 280639 - DNA, 25 bp, Mus musculus
cttctgcattcctctgtgtaccgag

SEQ ID NO: 280640 - DNA, 25 bp, Mus musculus
cttctgcattcgctgtgacagcgag

SEQ ID NO: 280641 - DNA, 25 bp, Mus musculus
cttctgcattcgtgccgaggagttg

SEQ ID NO: 280642 - DNA, 25 bp, Mus musculus
cttctgcattcgtggtgtttgtctt

SEQ ID NO: 280643 - DNA, 25 bp, Mus musculus
cttctgcatttactgagaaacatgg

SEQ ID NO: 280644 - DNA, 25 bp, Mus musculus
cttctgcattttaaggaagatcctt

SEQ ID NO: 280645 - DNA, 25 bp, Mus musculus
cttctgcattttaaggagcataaac

SEQ ID NO: 280646 - DNA, 25 bp, Mus musculus
cttctgccaaggacctccctgcacc

SEQ ID NO: 280647 - DNA, 25 bp, Mus musculus
cttctgccaaggcgcagcacctccc

SEQ ID NO: 280648 - DNA, 25 bp, Mus musculus
cttctgccatacccgcaaaacagct

SEQ ID NO: 280649 - DNA, 25 bp, Mus musculus
cttctgcccagccaccccgctgggg

SEQ ID NO: 280650 - DNA, 25 bp, Mus musculus
cttctgccccaggtgtaaagaagag

SEQ ID NO: 280651 - DNA, 25 bp, Mus musculus
cttctgcccgggctgagcgccctgt

SEQ ID NO: 280652 - DNA, 25 bp, Mus musculus
cttctgcccggtgctggccacaggg

SEQ ID NO: 280653 - DNA, 25 bp, Mus musculus
cttctgccgccagcattgacctctt

SEQ ID NO: 280654 - DNA, 25 bp, Mus musculus
cttctgcctagcatcaacgatatag

SEQ ID NO: 280655 - DNA, 25 bp, Mus musculus
cttctgcctaggtatgtctatatag

SEQ ID NO: 280656 - DNA, 25 bp, Mus musculus
cttctgcctaggtcctcaactttga

SEQ ID NO: 280657 - DNA, 25 bp, Mus musculus
cttctgcctgacaaattgacatcag

SEQ ID NO: 280658 - DNA, 25 bp, Mus musculus
cttctgcctgacaattggcagcttc

SEQ ID NO: 280659 - DNA, 25 bp, Mus musculus
cttctgcctgggatgcgccgcagca

SEQ ID NO: 280660 - DNA, 25 bp, Mus musculus
cttctgcctgggattttcctggtct

SEQ ID NO: 280661 - DNA, 25 bp, Mus musculus
cttctgcgaaactgaagaagatgct

SEQ ID NO: 280662 - DNA, 25 bp, Mus musculus
cttctgcggaatggggtgagtgagg

SEQ ID NO: 280663 - DNA, 25 bp, Mus musculus
cttctgcgggtgcttctgtttccgg

SEQ ID NO: 280664 - DNA, 25 bp, Mus musculus
cttctgctacaagcttcctgacagt

SEQ ID NO: 280665 - DNA, 25 bp, Mus musculus
cttctgctacagcggctgtacagca

SEQ ID NO: 280666 - DNA, 25 bp, Mus musculus
cttctgctacaggagtcagcagccc

SEQ ID NO: 280667 - DNA, 25 bp, Mus musculus
cttctgctgataccggtgacagtgg

SEQ ID NO: 280668 - DNA, 25 bp, Mus musculus
cttctgctgtatgggtggtctatca

SEQ ID NO: 280669 - DNA, 25 bp, Mus musculus
cttctgctgtatggtgcccagcacg

SEQ ID NO: 280670 - DNA, 25 bp, Mus musculus
cttctgctgtggaacgacatcgcca

SEQ ID NO: 280671 - DNA, 25 bp, Mus musculus
cttctgcttccacctgtcacagcaa

SEQ ID NO: 280672 - DNA, 25 bp, Mus musculus
cttctggaaagagatggctgtctca

SEQ ID NO: 280673 - DNA, 25 bp, Mus musculus
cttctggaaagctaggtagaagccc

SEQ ID NO: 280674 - DNA, 25 bp, Mus musculus
cttctggaaaggcctagactggttc

SEQ ID NO: 280675 - DNA, 25 bp, Mus musculus
cttctggaactctgacagtgtccat

SEQ ID NO: 280676 - DNA, 25 bp, Mus musculus
cttctggaactctgccaaaaatgga

SEQ ID NO: 280677 - DNA, 25 bp, Mus musculus
cttctggaagccgctctctctcccc

SEQ ID NO: 280678 - DNA, 25 bp, Mus musculus
cttctggaaggactaccaccttgct

SEQ ID NO: 280679 - DNA, 25 bp, Mus musculus
cttctggaaggactcgggacacccc

SEQ ID NO: 280680 - DNA, 25 bp, Mus musculus
cttctggaaggatccgccgcgatgg

SEQ ID NO: 280681 - DNA, 25 bp, Mus musculus
cttctggaatgtggaacagccccaa

SEQ ID NO: 280682 - DNA, 25 bp, Mus musculus
cttctggaatgtggtagcgagatgg

SEQ ID NO: 280683 - DNA, 25 bp, Mus musculus
cttctggaccctgcatggtttattg

SEQ ID NO: 280684 - DNA, 25 bp, Mus musculus
cttctggactctcaggttgtgagga

SEQ ID NO: 280685 - DNA, 25 bp, Mus musculus
cttctggagaagctccagcacccga

SEQ ID NO: 280686 - DNA, 25 bp, Mus musculus
cttctggagagaagtgtgctggtgt

SEQ ID NO: 280687 - DNA, 25 bp, Mus musculus
cttctggagagggcatcatggctct

SEQ ID NO: 280688 - DNA, 25 bp, Mus musculus
cttctggaggcaaggatggccaggc

SEQ ID NO: 280689 - DNA, 25 bp, Mus musculus
cttctggaggcaaggctatgctgtg

SEQ ID NO: 280690 - DNA, 25 bp, Mus musculus
cttctggatgctatgtcaggatcgc

SEQ ID NO: 280691 - DNA, 25 bp, Mus musculus
cttctggattcttggcgcccgtgtt

SEQ ID NO: 280692 - DNA, 25 bp, Mus musculus
cttctggcagagacttggcagtgta

SEQ ID NO: 280693 - DNA, 25 bp, Mus musculus
cttctggcagaggcattgaagacaa

SEQ ID NO: 280694 - DNA, 25 bp, Mus musculus
cttctggcagggtccctgcatgtgg

SEQ ID NO: 280695 - DNA, 25 bp, Mus musculus
cttctggccctagaggtccacctgg

SEQ ID NO: 280696 - DNA, 25 bp, Mus musculus
cttctggcctcagatgccctgctgt

SEQ ID NO: 280697 - DNA, 25 bp, Mus musculus
cttctggcctccgatggtgacatta

SEQ ID NO: 280698 - DNA, 25 bp, Mus musculus
cttctggctcacagagaaggacttg

SEQ ID NO: 280699 - DNA, 25 bp, Mus musculus
cttctggctggcagcactgaaaact

SEQ ID NO: 280700 - DNA, 25 bp, Mus musculus
cttctggctggcaggaggcacagtg

SEQ ID NO: 280701 - DNA, 25 bp, Mus musculus
cttctggcttctggctccaggccgg

SEQ ID NO: 280702 - DNA, 25 bp, Mus musculus
cttctgggagaagatgctcagacca

SEQ ID NO: 280703 - DNA, 25 bp, Mus musculus
cttctgggaggcctggccttgatga

SEQ ID NO: 280704 - DNA, 25 bp, Mus musculus
cttctgggaggttgggaactacaaa

SEQ ID NO: 280705 - DNA, 25 bp, Mus musculus
cttctgggataaaaagaagcaaggc

SEQ ID NO: 280706 - DNA, 25 bp, Mus musculus
cttctgggcaacaagggaaatactg

SEQ ID NO: 280707 - DNA, 25 bp, Mus musculus
cttctgggcaacaaggtggaccccc

SEQ ID NO: 280708 - DNA, 25 bp, Mus musculus
cttctgggccatttcaagtccgagg

SEQ ID NO: 280709 - DNA, 25 bp, Mus musculus
cttctgggcgaggaaaaagtaaagg

SEQ ID NO: 280710 - DNA, 25 bp, Mus musculus
cttctgggcgaggagagaacacatt

SEQ ID NO: 280711 - DNA, 25 bp, Mus musculus
cttctgggcggaacgaagagctcta

SEQ ID NO: 280712 - DNA, 25 bp, Mus musculus
cttctggggaaggtgcagctggatc

SEQ ID NO: 280713 - DNA, 25 bp, Mus musculus
cttctggggcagatcctccttatcc

SEQ ID NO: 280714 - DNA, 25 bp, Mus musculus
cttctgggtcagggggattgatgtg

SEQ ID NO: 280715 - DNA, 25 bp, Mus musculus
cttctgggtcctggatggagcctgc

SEQ ID NO: 280716 - DNA, 25 bp, Mus musculus
cttctgggtcctgggagccacgctg

SEQ ID NO: 280717 - DNA, 25 bp, Mus musculus
cttctggtcagtgttcacaccgcgg

SEQ ID NO: 280718 - DNA, 25 bp, Mus musculus
cttctggtgccagctctaggaatga

SEQ ID NO: 280719 - DNA, 25 bp, Mus musculus
cttctggtgtgcttggattacacag

SEQ ID NO: 280720 - DNA, 25 bp, Mus musculus
cttctggtgtgcttgtgctcgccgt

SEQ ID NO: 280721 - DNA, 25 bp, Mus musculus
cttctggttctggctgatctcttcg

SEQ ID NO: 280722 - DNA, 25 bp, Mus musculus
cttctggttgagcaacaaaatcttg

SEQ ID NO: 280723 - DNA, 25 bp, Mus musculus
cttctggttgagcatcaaaatcttg

SEQ ID NO: 280724 - DNA, 25 bp, Mus musculus
cttctggtttcaaggtgacagatca

SEQ ID NO: 280725 - DNA, 25 bp, Mus musculus
cttctgtaacattgccattatcctc

SEQ ID NO: 280726 - DNA, 25 bp, Mus musculus
cttctgtaagcatggtcccctgtgt

SEQ ID NO: 280727 - DNA, 25 bp, Mus musculus
cttctgtactctcgggaggtgttcc

SEQ ID NO: 280728 - DNA, 25 bp, Mus musculus
cttctgtagaaaggaacatgtctca

SEQ ID NO: 280729 - DNA, 25 bp, Mus musculus
cttctgtagagatttggcccagtac

SEQ ID NO: 280730 - DNA, 25 bp, Mus musculus
cttctgtcaaaacttggctcttgac

SEQ ID NO: 280731 - DNA, 25 bp, Mus musculus
cttctgtcagacatgtgtaattatg

SEQ ID NO: 280732 - DNA, 25 bp, Mus musculus
cttctgtcagctggcatgtggccag

SEQ ID NO: 280733 - DNA, 25 bp, Mus musculus
cttctgtcaggtccccctggccgca

SEQ ID NO: 280734 - DNA, 25 bp, Mus musculus
cttctgtcaggtgagcgtcctcaca

SEQ ID NO: 280735 - DNA, 25 bp, Mus musculus
cttctgtccctcccctttctccctt

SEQ ID NO: 280736 - DNA, 25 bp, Mus musculus
cttctgtcggacggggctgaaaagc

SEQ ID NO: 280737 - DNA, 25 bp, Mus musculus
cttctgtcggacttagaagaattga

SEQ ID NO: 280738 - DNA, 25 bp, Mus musculus
cttctgtctcccctgaggcctttgc

SEQ ID NO: 280739 - DNA, 25 bp, Mus musculus
cttctgtctgagatcgtcagtggca

SEQ ID NO: 280740 - DNA, 25 bp, Mus musculus
cttctgtctgtggcggcacagtggt

SEQ ID NO: 280741 - DNA, 25 bp, Mus musculus
cttctgtctgtggcggtcattgtca

SEQ ID NO: 280742 - DNA, 25 bp, Mus musculus
cttctgtgaagtcaccttaattttc

SEQ ID NO: 280743 - DNA, 25 bp, Mus musculus
cttctgtgacaagggagcagaaaga

SEQ ID NO: 280744 - DNA, 25 bp, Mus musculus
cttctgtgacaaggtcatagtccgc

SEQ ID NO: 280745 - DNA, 25 bp, Mus musculus
cttctgtgatggactgcagtaatgg

SEQ ID NO: 280746 - DNA, 25 bp, Mus musculus
cttctgtgatggccaaagatctcat

SEQ ID NO: 280747 - DNA, 25 bp, Mus musculus
cttctgtgcacacatgtctgagagc

SEQ ID NO: 280748 - DNA, 25 bp, Mus musculus
cttctgtgccaggctgtttgattat

SEQ ID NO: 280749 - DNA, 25 bp, Mus musculus
cttctgtgctaacctcaggaggaaa

SEQ ID NO: 280750 - DNA, 25 bp, Mus musculus
cttctgtggagcggatgtgggtggc

SEQ ID NO: 280751 - DNA, 25 bp, Mus musculus
cttctgtggccatttctggcagctc

SEQ ID NO: 280752 - DNA, 25 bp, Mus musculus
cttctgtgggttagcgctaactgtc

SEQ ID NO: 280753 - DNA, 25 bp, Mus musculus
cttctgtgtacctcagctggattca

SEQ ID NO: 280754 - DNA, 25 bp, Mus musculus
cttctgtgtactgccttctgaaatg

SEQ ID NO: 280755 - DNA, 25 bp, Mus musculus
cttctgtgtagtagtttacaaatga

SEQ ID NO: 280756 - DNA, 25 bp, Mus musculus
cttctgtgtcaagcccaacaagctt

SEQ ID NO: 280757 - DNA, 25 bp, Mus musculus
cttctgttaggtgctggagagtcag

SEQ ID NO: 280758 - DNA, 25 bp, Mus musculus
cttctgttcaggaaactggagaccc

SEQ ID NO: 280759 - DNA, 25 bp, Mus musculus
cttctgttcaggatatagatctgat

SEQ ID NO: 280760 - DNA, 25 bp, Mus musculus
cttctgttctggcggatgaaatgtg

SEQ ID NO: 280761 - DNA, 25 bp, Mus musculus
cttctgttggagataccttcctatc

SEQ ID NO: 280762 - DNA, 25 bp, Mus musculus
cttctgtttccgggtgccatgcaga

SEQ ID NO: 280763 - DNA, 25 bp, Mus musculus
cttctgtttgaaatggctcggtttt

SEQ ID NO: 280764 - DNA, 25 bp, Mus musculus
cttctgtttgaggttcctgggtgga

SEQ ID NO: 280765 - DNA, 25 bp, Mus musculus
cttcttaacaaggcacctaattaca

SEQ ID NO: 280766 - DNA, 25 bp, Mus musculus
cttcttaacaaggtgcagatcactg

SEQ ID NO: 280767 - DNA, 25 bp, Mus musculus
cttcttaatataacttgcaccgatt

SEQ ID NO: 280768 - DNA, 25 bp, Mus musculus
cttcttaattctggcagttaaacca

SEQ ID NO: 280769 - DNA, 25 bp, Mus musculus
cttcttacagaagtaccctcctcca

SEQ ID NO: 280770 - DNA, 25 bp, Mus musculus
cttcttacagaagttactggacagt

SEQ ID NO: 280771 - DNA, 25 bp, Mus musculus
cttcttactgtgtcctactgaaacc

SEQ ID NO: 280772 - DNA, 25 bp, Mus musculus
cttcttagagagcttcctgccagca

SEQ ID NO: 280773 - DNA, 25 bp, Mus musculus
cttcttagtcaagggtctcatgtac

SEQ ID NO: 280774 - DNA, 25 bp, Mus musculus
cttcttagtcaaggttggcttcctg

SEQ ID NO: 280775 - DNA, 25 bp, Mus musculus
cttcttatagcaggttcttgtctgg

SEQ ID NO: 280776 - DNA, 25 bp, Mus musculus
cttcttatcagggtcaaagaaggca

SEQ ID NO: 280777 - DNA, 25 bp, Mus musculus
cttcttatctccatctcttcccact

SEQ ID NO: 280778 - DNA, 25 bp, Mus musculus
cttcttattgaaacatccatttcag

SEQ ID NO: 280779 - DNA, 25 bp, Mus musculus
cttcttattggacaagtgcaactgt

SEQ ID NO: 280780 - DNA, 25 bp, Mus musculus
cttcttattgtcgctctattctctc

SEQ ID NO: 280781 - DNA, 25 bp, Mus musculus
cttcttattgtcggttggtgatgag

SEQ ID NO: 280782 - DNA, 25 bp, Mus musculus
cttcttcaaaggatcccagagagct

SEQ ID NO: 280783 - DNA, 25 bp, Mus musculus
cttcttcaagggtggggtaattagt

SEQ ID NO: 280784 - DNA, 25 bp, Mus musculus
cttcttcacaggaagtcctcgggta

SEQ ID NO: 280785 - DNA, 25 bp, Mus musculus
cttcttcacctgggtgctacagaag

SEQ ID NO: 280786 - DNA, 25 bp, Mus musculus
cttcttcacctttggtgtcctgtgc

SEQ ID NO: 280787 - DNA, 25 bp, Mus musculus
cttcttcacggcatggatgatgatg

SEQ ID NO: 280788 - DNA, 25 bp, Mus musculus
cttcttcacggtgccttggagcact

SEQ ID NO: 280789 - DNA, 25 bp, Mus musculus
cttcttcacgtgacctgacagtgaa

SEQ ID NO: 280790 - DNA, 25 bp, Mus musculus
cttcttcactgacacatgccctgag

SEQ ID NO: 280791 - DNA, 25 bp, Mus musculus
cttcttcactgcaggtcccaaattg

SEQ ID NO: 280792 - DNA, 25 bp, Mus musculus
cttcttcactgcaggttcacctgga

SEQ ID NO: 280793 - DNA, 25 bp, Mus musculus
cttcttcactttcacgaggagaaca

SEQ ID NO: 280794 - DNA, 25 bp, Mus musculus
cttcttcagaaggtcgtgaaaatac

SEQ ID NO: 280795 - DNA, 25 bp, Mus musculus
cttcttcaggaaagagcaaataagt

SEQ ID NO: 280796 - DNA, 25 bp, Mus musculus
cttcttcattgccagcaaccgtgtc

SEQ ID NO: 280797 - DNA, 25 bp, Mus musculus
cttcttccaccaaggaggaatttca

SEQ ID NO: 280798 - DNA, 25 bp, Mus musculus
cttcttccagagaatttgtttcaac

SEQ ID NO: 280799 - DNA, 25 bp, Mus musculus
cttcttccagccctgagatgctcac

SEQ ID NO: 280800 - DNA, 25 bp, Mus musculus
cttcttccagcttcacccctcatcc

SEQ ID NO: 280801 - DNA, 25 bp, Mus musculus
cttcttccaggctgaaggaaggaag

SEQ ID NO: 280802 - DNA, 25 bp, Mus musculus
cttcttccagtgcaggcctaaccct

SEQ ID NO: 280803 - DNA, 25 bp, Mus musculus
cttcttccagtgcagggaaaagctg

SEQ ID NO: 280804 - DNA, 25 bp, Mus musculus
cttcttccagtgcaggtcctaatct

SEQ ID NO: 280805 - DNA, 25 bp, Mus musculus
cttcttcccacaatattctggataa

SEQ ID NO: 280806 - DNA, 25 bp, Mus musculus
cttcttcccacactcaccgagctct

SEQ ID NO: 280807 - DNA, 25 bp, Mus musculus
cttcttcccatcagcccaggccaca

SEQ ID NO: 280808 - DNA, 25 bp, Mus musculus
cttcttccctaagacctaggaccta

SEQ ID NO: 280809 - DNA, 25 bp, Mus musculus
cttcttccctaaggtgaaaggactg

SEQ ID NO: 280810 - DNA, 25 bp, Mus musculus
cttcttcctcatcggacccccagcc

SEQ ID NO: 280811 - DNA, 25 bp, Mus musculus
cttcttcctgcccagtgggcagctg

SEQ ID NO: 280812 - DNA, 25 bp, Mus musculus
cttcttcctggctctatccaggctt

SEQ ID NO: 280813 - DNA, 25 bp, Mus musculus
cttcttcctggctctctacctggcc

SEQ ID NO: 280814 - DNA, 25 bp, Mus musculus
cttcttccttcaggtccttcatttc

SEQ ID NO: 280815 - DNA, 25 bp, Mus musculus
cttcttcgcggaagatatatgttgg

SEQ ID NO: 280816 - DNA, 25 bp, Mus musculus
cttcttctatccagggatgaactcc

SEQ ID NO: 280817 - DNA, 25 bp, Mus musculus
cttcttctatccagggcccattgtg

SEQ ID NO: 280818 - DNA, 25 bp, Mus musculus
cttcttctatttctgggttctgcca

SEQ ID NO: 280819 - DNA, 25 bp, Mus musculus
cttcttctcagaaaagaggccagct

SEQ ID NO: 280820 - DNA, 25 bp, Mus musculus
cttcttctcagataaggatgaatgt

SEQ ID NO: 280821 - DNA, 25 bp, Mus musculus
cttcttctccatcacaatccaagag

SEQ ID NO: 280822 - DNA, 25 bp, Mus musculus
cttcttctccatcagaatccaagag

SEQ ID NO: 280823 - DNA, 25 bp, Mus musculus
cttcttctcgaccaacttgcagcgg

SEQ ID NO: 280824 - DNA, 25 bp, Mus musculus
cttcttcttatagcaggttcttgtc

SEQ ID NO: 280825 - DNA, 25 bp, Mus musculus
cttcttcttcaggcaacagacttta

SEQ ID NO: 280826 - DNA, 25 bp, Mus musculus
cttcttcttcaggttgccagtcaca

SEQ ID NO: 280827 - DNA, 25 bp, Mus musculus
cttcttcttgaaatctacccagaat

SEQ ID NO: 280828 - DNA, 25 bp, Mus musculus
cttcttctttgtactaggcggcctg

SEQ ID NO: 280829 - DNA, 25 bp, Mus musculus
cttcttctttttagggacaggggca

SEQ ID NO: 280830 - DNA, 25 bp, Mus musculus
cttcttctttttaggtcccgcctgg

SEQ ID NO: 280831 - DNA, 25 bp, Mus musculus
cttcttctttttaggtgaggagttc

SEQ ID NO: 280832 - DNA, 25 bp, Mus musculus
cttcttgaaatctacccagaatgga

SEQ ID NO: 280833 - DNA, 25 bp, Mus musculus
cttcttgaaccaccaggcctcagct

SEQ ID NO: 280834 - DNA, 25 bp, Mus musculus
cttcttgaacttgaggacccaagtt

SEQ ID NO: 280835 - DNA, 25 bp, Mus musculus
cttcttgacagggtcctgcaggcag

SEQ ID NO: 280836 - DNA, 25 bp, Mus musculus
cttcttgagtgagccctgaatctgt

SEQ ID NO: 280837 - DNA, 25 bp, Mus musculus
cttcttgagtgagggtatcctgtct

SEQ ID NO: 280838 - DNA, 25 bp, Mus musculus
cttcttgcagcaggtctgctttgcc

SEQ ID NO: 280839 - DNA, 25 bp, Mus musculus
cttcttgccggccccgcccccgcct

SEQ ID NO: 280840 - DNA, 25 bp, Mus musculus
cttcttgccgggatctgacccagac

SEQ ID NO: 280841 - DNA, 25 bp, Mus musculus
cttcttgctgactacatttcctcgg

SEQ ID NO: 280842 - DNA, 25 bp, Mus musculus
cttcttggaaccctaagctgggctc

SEQ ID NO: 280843 - DNA, 25 bp, Mus musculus
cttcttggagaggtaaccccaggtg

SEQ ID NO: 280844 - DNA, 25 bp, Mus musculus
cttcttgtaattcaggtgagcacct

SEQ ID NO: 280845 - DNA, 25 bp, Mus musculus
cttcttgtggccctattgtgtgccc

SEQ ID NO: 280846 - DNA, 25 bp, Mus musculus
cttctttaagaagacagagcacact

SEQ ID NO: 280847 - DNA, 25 bp, Mus musculus
cttctttaagagaagaatgtggcca

SEQ ID NO: 280848 - DNA, 25 bp, Mus musculus
cttctttacaaggattttcaccttg

SEQ ID NO: 280849 - DNA, 25 bp, Mus musculus
cttctttaccaggtatgactacgag

SEQ ID NO: 280850 - DNA, 25 bp, Mus musculus
cttctttacccacgtttttgcagct

SEQ ID NO: 280851 - DNA, 25 bp, Mus musculus
cttctttactatgcggagcaactga

SEQ ID NO: 280852 - DNA, 25 bp, Mus musculus
cttctttaggtctcctcacatggtg

SEQ ID NO: 280853 - DNA, 25 bp, Mus musculus
cttctttatgggaagaattgcggcg

SEQ ID NO: 280854 - DNA, 25 bp, Mus musculus
cttctttcagacaagcgtgagaatg

SEQ ID NO: 280855 - DNA, 25 bp, Mus musculus
cttctttcaggaaatgctgtcattc

SEQ ID NO: 280856 - DNA, 25 bp, Mus musculus
cttctttcaggtactcatgtgatgg

SEQ ID NO: 280857 - DNA, 25 bp, Mus musculus
cttctttcaggtattcatgtgatgg

SEQ ID NO: 280858 - DNA, 25 bp, Mus musculus
cttctttcccgagggagcacgggtc

SEQ ID NO: 280859 - DNA, 25 bp, Mus musculus
cttctttcccgaggtgttcacctac

SEQ ID NO: 280860 - DNA, 25 bp, Mus musculus
cttctttcctgactgatggcgcttc

SEQ ID NO: 280861 - DNA, 25 bp, Mus musculus
cttctttcctggagtaggtgacatg

SEQ ID NO: 280862 - DNA, 25 bp, Mus musculus
cttctttcgggaggcagcccgcgcc

SEQ ID NO: 280863 - DNA, 25 bp, Mus musculus
cttctttcggtgaagaatgctcgtg

SEQ ID NO: 280864 - DNA, 25 bp, Mus musculus
cttctttctgcccttgcagaactgg

SEQ ID NO: 280865 - DNA, 25 bp, Mus musculus
cttctttctgtgttgatgagaggct

SEQ ID NO: 280866 - DNA, 25 bp, Mus musculus
cttctttctgtgttgcggttccctc

SEQ ID NO: 280867 - DNA, 25 bp, Mus musculus
cttctttctttgaaggtgacgggcc

SEQ ID NO: 280868 - DNA, 25 bp, Mus musculus
cttctttctttgcagcacacagcac

SEQ ID NO: 280869 - DNA, 25 bp, Mus musculus
cttctttgaaagacactacgcacag

SEQ ID NO: 280870 - DNA, 25 bp, Mus musculus
cttctttgaacctttggtcagaaag

SEQ ID NO: 280871 - DNA, 25 bp, Mus musculus
cttctttgaggactccagattccaa

SEQ ID NO: 280872 - DNA, 25 bp, Mus musculus
cttctttgaggaggtattcacagaa

SEQ ID NO: 280873 - DNA, 25 bp, Mus musculus
cttctttgatccagatgccaagggg

SEQ ID NO: 280874 - DNA, 25 bp, Mus musculus
cttctttgatgagaagtcccgtgtt

SEQ ID NO: 280875 - DNA, 25 bp, Mus musculus
cttctttgatgtgaagacaacacgt

SEQ ID NO: 280876 - DNA, 25 bp, Mus musculus
cttctttgcacaagacccacaccat

SEQ ID NO: 280877 - DNA, 25 bp, Mus musculus
cttctttgcacaagggtttctctgt

SEQ ID NO: 280878 - DNA, 25 bp, Mus musculus
cttctttgccagcaagagaatccgg

SEQ ID NO: 280879 - DNA, 25 bp, Mus musculus
cttctttggggatgcccctgcctcc

SEQ ID NO: 280880 - DNA, 25 bp, Mus musculus
cttctttggggttccttgtggagaa

SEQ ID NO: 280881 - DNA, 25 bp, Mus musculus
cttctttgtcagtttgtccctgctg

SEQ ID NO: 280882 - DNA, 25 bp, Mus musculus
cttcttttcacaatgctcatgatct

SEQ ID NO: 280883 - DNA, 25 bp, Mus musculus
cttcttttgccaggctgagctggat

SEQ ID NO: 280884 - DNA, 25 bp, Mus musculus
cttcttttgggatccgagcaccagc

SEQ ID NO: 280885 - DNA, 25 bp, Mus musculus
cttctttttagggacaggggcagac

SEQ ID NO: 280886 - DNA, 25 bp, Mus musculus
cttctttttaggtcccgcctggcag

SEQ ID NO: 280887 - DNA, 25 bp, Mus musculus
cttctttttaggtgaggagttctac

SEQ ID NO: 280888 - DNA, 25 bp, Mus musculus
cttctttttttcctactcactgtgt

SEQ ID NO: 280889 - DNA, 25 bp, Mus musculus
cttgaaaacaaaacagaccagaacc

SEQ ID NO: 280890 - DNA, 25 bp, Mus musculus
cttgaaaacaaaacgaaccagctgc

SEQ ID NO: 280891 - DNA, 25 bp, Mus musculus
cttgaaaacattatgaactgctgag

SEQ ID NO: 280892 - DNA, 25 bp, Mus musculus
cttgaaaaccagatacaatggagag

SEQ ID NO: 280893 - DNA, 25 bp, Mus musculus
cttgaaaactatgctgaacttggtg

SEQ ID NO: 280894 - DNA, 25 bp, Mus musculus
cttgaaaactatgtgcttgacagaa

SEQ ID NO: 280895 - DNA, 25 bp, Mus musculus
cttgaaaagtttgataacttacagt

SEQ ID NO: 280896 - DNA, 25 bp, Mus musculus
cttgaaaatcttagattttgtccag

SEQ ID NO: 280897 - DNA, 25 bp, Mus musculus
cttgaaaatcttagcaaagagatgt

SEQ ID NO: 280898 - DNA, 25 bp, Mus musculus
cttgaaaatgtggagtgtgacaata

SEQ ID NO: 280899 - DNA, 25 bp, Mus musculus
cttgaaacaaggggttataatgaga

SEQ ID NO: 280900 - DNA, 25 bp, Mus musculus
cttgaaacagccgctgcaggagctg

SEQ ID NO: 280901 - DNA, 25 bp, Mus musculus
cttgaaacaggccggtagtggtgga

SEQ ID NO: 280902 - DNA, 25 bp, Mus musculus
cttgaaactgaagaagctattgcct

SEQ ID NO: 280903 - DNA, 25 bp, Mus musculus
cttgaaactgaagaagctcataatt

SEQ ID NO: 280904 - DNA, 25 bp, Mus musculus
cttgaaacttacaggccttacttct

SEQ ID NO: 280905 - DNA, 25 bp, Mus musculus
cttgaaacttacaggtgcttttggg

SEQ ID NO: 280906 - DNA, 25 bp, Mus musculus
cttgaaagagtcacatcagtttcac

SEQ ID NO: 280907 - DNA, 25 bp, Mus musculus
cttgaaagcagccgctaacgtcctg

SEQ ID NO: 280908 - DNA, 25 bp, Mus musculus
cttgaaagctatccttcaccagcgc

SEQ ID NO: 280909 - DNA, 25 bp, Mus musculus
cttgaaagcttatctgagtccatgc

SEQ ID NO: 280910 - DNA, 25 bp, Mus musculus
cttgaaagtccgctacgtgaaaaat

SEQ ID NO: 280911 - DNA, 25 bp, Mus musculus
cttgaaagtgcaggaaaggaagttc

SEQ ID NO: 280912 - DNA, 25 bp, Mus musculus
cttgaaatcacagagaacacccaga

SEQ ID NO: 280913 - DNA, 25 bp, Mus musculus
cttgaacaagataaggggatggtaa

SEQ ID NO: 280914 - DNA, 25 bp, Mus musculus
cttgaacaatgattttgtggtggat

SEQ ID NO: 280915 - DNA, 25 bp, Mus musculus
cttgaacaatgttatgatggttaat

SEQ ID NO: 280916 - DNA, 25 bp, Mus musculus
cttgaacagcataaggcttgctctt

SEQ ID NO: 280917 - DNA, 25 bp, Mus musculus
cttgaacatggatgtggacgccact

SEQ ID NO: 280918 - DNA, 25 bp, Mus musculus
cttgaaccagaatgtctgtaaggca

SEQ ID NO: 280919 - DNA, 25 bp, Mus musculus
cttgaaccagcagggtggcccacgc

SEQ ID NO: 280920 - DNA, 25 bp, Mus musculus
cttgaacctcaacaccaagatgata

SEQ ID NO: 280921 - DNA, 25 bp, Mus musculus
cttgaactcacagaaagcctcatat

SEQ ID NO: 280922 - DNA, 25 bp, Mus musculus
cttgaactctccagagtgctacaat

SEQ ID NO: 280923 - DNA, 25 bp, Mus musculus
cttgaactgatgaccaaacgggctg

SEQ ID NO: 280924 - DNA, 25 bp, Mus musculus
cttgaactgatgaccgcccagctct

SEQ ID NO: 280925 - DNA, 25 bp, Mus musculus
cttgaacttgaagctggttcatgtc

SEQ ID NO: 280926 - DNA, 25 bp, Mus musculus
cttgaacttgaggacccaagtttct

SEQ ID NO: 280927 - DNA, 25 bp, Mus musculus
cttgaactttaagaaaagatgtgga

SEQ ID NO: 280928 - DNA, 25 bp, Mus musculus
cttgaactttgcaaattgaagaatg

SEQ ID NO: 280929 - DNA, 25 bp, Mus musculus
cttgaagaaaaggaaatgttattcc

SEQ ID NO: 280930 - DNA, 25 bp, Mus musculus
cttgaagaaaaggaagatgaggagc

SEQ ID NO: 280931 - DNA, 25 bp, Mus musculus
cttgaagaacatcgagaagccaggt

SEQ ID NO: 280932 - DNA, 25 bp, Mus musculus
cttgaagaacctaaggcccgtgtct

SEQ ID NO: 280933 - DNA, 25 bp, Mus musculus
cttgaagaagaccttccccaggagc

SEQ ID NO: 280934 - DNA, 25 bp, Mus musculus
cttgaagaagtaaccctcctcccct

SEQ ID NO: 280935 - DNA, 25 bp, Mus musculus
cttgaagacatgaggactttcagtc

SEQ ID NO: 280936 - DNA, 25 bp, Mus musculus
cttgaagactctggtaggaacaacc

SEQ ID NO: 280937 - DNA, 25 bp, Mus musculus
cttgaagactctgtgcctggaatca

SEQ ID NO: 280938 - DNA, 25 bp, Mus musculus
cttgaagatgataattagcaccatg

SEQ ID NO: 280939 - DNA, 25 bp, Mus musculus
cttgaagcactgagccctccagagc

SEQ ID NO: 280940 - DNA, 25 bp, Mus musculus
cttgaagcactgagccctccccact

SEQ ID NO: 280941 - DNA, 25 bp, Mus musculus
cttgaagcaggtggactcccctaac

SEQ ID NO: 280942 - DNA, 25 bp, Mus musculus
cttgaagcatggcaatgaaatctac

SEQ ID NO: 280943 - DNA, 25 bp, Mus musculus
cttgaagcatggccagaagacatgt

SEQ ID NO: 280944 - DNA, 25 bp, Mus musculus
cttgaagctaccaaacgcaagcacc

SEQ ID NO: 280945 - DNA, 25 bp, Mus musculus
cttgaaggacgggcagtaccaggcg

SEQ ID NO: 280946 - DNA, 25 bp, Mus musculus
cttgaaggacgggctctccctacgg

SEQ ID NO: 280947 - DNA, 25 bp, Mus musculus
cttgaaggacgggggatggtggaca

SEQ ID NO: 280948 - DNA, 25 bp, Mus musculus
cttgaaggagaacgggaggctgccg

SEQ ID NO: 280949 - DNA, 25 bp, Mus musculus
cttgaaggagatggattctgatgca

SEQ ID NO: 280950 - DNA, 25 bp, Mus musculus
cttgaaggatactccagatgccaac

SEQ ID NO: 280951 - DNA, 25 bp, Mus musculus
cttgaaggcaacagaatgaagggac

SEQ ID NO: 280952 - DNA, 25 bp, Mus musculus
cttgaaggcaacagtgaagggacct

SEQ ID NO: 280953 - DNA, 25 bp, Mus musculus
cttgaagtctggctgtacatcattg

SEQ ID NO: 280954 - DNA, 25 bp, Mus musculus
cttgaatccagaagacattgatcag

SEQ ID NO: 280955 - DNA, 25 bp, Mus musculus
cttgaatctcaggactccagaggac

SEQ ID NO: 280956 - DNA, 25 bp, Mus musculus
cttgaatctgctttttacctttgtg

SEQ ID NO: 280957 - DNA, 25 bp, Mus musculus
cttgaatgattacaacatttcagaa

SEQ ID NO: 280958 - DNA, 25 bp, Mus musculus
cttgacaacaagcctgaccaccact

SEQ ID NO: 280959 - DNA, 25 bp, Mus musculus
cttgacaatagctctggtgcaagtg

SEQ ID NO: 280960 - DNA, 25 bp, Mus musculus
cttgacaattcagcctggagatgcc

SEQ ID NO: 280961 - DNA, 25 bp, Mus musculus
cttgacacactgcagcgtgctctgc

SEQ ID NO: 280962 - DNA, 25 bp, Mus musculus
cttgacaccaggaacctatgggcta

SEQ ID NO: 280963 - DNA, 25 bp, Mus musculus
cttgacaccaggctgaccttcttcc

SEQ ID NO: 280964 - DNA, 25 bp, Mus musculus
cttgacaccagggtggacccagtgc

SEQ ID NO: 280965 - DNA, 25 bp, Mus musculus
cttgacacttgggaggccatggagg

SEQ ID NO: 280966 - DNA, 25 bp, Mus musculus
cttgacagaaagcagatttcaacaa

SEQ ID NO: 280967 - DNA, 25 bp, Mus musculus
cttgacataagtgaacctagtaaca

SEQ ID NO: 280968 - DNA, 25 bp, Mus musculus
cttgacatagcctgcaggggtccac

SEQ ID NO: 280969 - DNA, 25 bp, Mus musculus
cttgaccaagttccaggaagacagc

SEQ ID NO: 280970 - DNA, 25 bp, Mus musculus
cttgaccagactcgcgctctccacc

SEQ ID NO: 280971 - DNA, 25 bp, Mus musculus
cttgaccagactggcgctctccacc

SEQ ID NO: 280972 - DNA, 25 bp, Mus musculus
cttgaccatcaggactcttcccccc

SEQ ID NO: 280973 - DNA, 25 bp, Mus musculus
cttgacccttcctgaaggagcagag

SEQ ID NO: 280974 - DNA, 25 bp, Mus musculus
cttgacctaccggttcttcagcgaa

SEQ ID NO: 280975 - DNA, 25 bp, Mus musculus
cttgacctcagatcttggtaatgtt

SEQ ID NO: 280976 - DNA, 25 bp, Mus musculus
cttgacctgactggcaccctcagga

SEQ ID NO: 280977 - DNA, 25 bp, Mus musculus
cttgacctgactggtcacagtaatg

SEQ ID NO: 280978 - DNA, 25 bp, Mus musculus
cttgacctgactggtcttaagtttt

SEQ ID NO: 280979 - DNA, 25 bp, Mus musculus
cttgacgagtttgttgtcacaatgc

SEQ ID NO: 280980 - DNA, 25 bp, Mus musculus
cttgacggaagaatcgggcagctca

SEQ ID NO: 280981 - DNA, 25 bp, Mus musculus
cttgacgtctaagattcctgctctg

SEQ ID NO: 280982 - DNA, 25 bp, Mus musculus
cttgactattgacctagccccatcc

SEQ ID NO: 280983 - DNA, 25 bp, Mus musculus
cttgactcactgattcatctgaaaa

SEQ ID NO: 280984 - DNA, 25 bp, Mus musculus
cttgactcagtacgtcaagtggacc

SEQ ID NO: 280985 - DNA, 25 bp, Mus musculus
cttgactcccaaagcctacaaggat

SEQ ID NO: 280986 - DNA, 25 bp, Mus musculus
cttgactcggaggaagacgatgatc

SEQ ID NO: 280987 - DNA, 25 bp, Mus musculus
cttgactcggtggacaccatgatta

SEQ ID NO: 280988 - DNA, 25 bp, Mus musculus
cttgactctcggtgtcctccaccag

SEQ ID NO: 280989 - DNA, 25 bp, Mus musculus
cttgactgggagaggatttgaatta

SEQ ID NO: 280990 - DNA, 25 bp, Mus musculus
cttgactgtgaagtgtgccttacat

SEQ ID NO: 280991 - DNA, 25 bp, Mus musculus
cttgacttacaaatcaggagtatac

SEQ ID NO: 280992 - DNA, 25 bp, Mus musculus
cttgacttggcggccatcgagtaaa

SEQ ID NO: 280993 - DNA, 25 bp, Mus musculus
cttgactttcacacaatcagggcat

SEQ ID NO: 280994 - DNA, 25 bp, Mus musculus
cttgactttgaaggttgtcttgaca

SEQ ID NO: 280995 - DNA, 25 bp, Mus musculus
cttgagaaaaaccatggtgaatccg

SEQ ID NO: 280996 - DNA, 25 bp, Mus musculus
cttgagaaattgcaggtctcaccca

SEQ ID NO: 280997 - DNA, 25 bp, Mus musculus
cttgagaacaccaaattccggggtg

SEQ ID NO: 280998 - DNA, 25 bp, Mus musculus
cttgagacaccgagagtgtgggttc

SEQ ID NO: 280999 - DNA, 25 bp, Mus musculus
cttgagaccagcaggtttctggacg

SEQ ID NO: 281000 - DNA, 25 bp, Mus musculus
cttgagactgggcagttggtcatca

SEQ ID NO: 281001 - DNA, 25 bp, Mus musculus
cttgagagagagagccagctgctcc

SEQ ID NO: 281002 - DNA, 25 bp, Mus musculus
cttgagagcaggtttaaacgcatct

SEQ ID NO: 281003 - DNA, 25 bp, Mus musculus
cttgagagctttggatatacaaccg

SEQ ID NO: 281004 - DNA, 25 bp, Mus musculus
cttgagagtctatcaccactacttt

SEQ ID NO: 281005 - DNA, 25 bp, Mus musculus
cttgagatcaacccctagtggtgac

SEQ ID NO: 281006 - DNA, 25 bp, Mus musculus
cttgagatgaatagcccagccaagc

SEQ ID NO: 281007 - DNA, 25 bp, Mus musculus
cttgagattactggagtgctgacag

SEQ ID NO: 281008 - DNA, 25 bp, Mus musculus
cttgagattggcgtttcagtgaaca

SEQ ID NO: 281009 - DNA, 25 bp, Mus musculus
cttgagcaccccacgatggtacctc

SEQ ID NO: 281010 - DNA, 25 bp, Mus musculus
cttgagcaccccacggacagacagc

SEQ ID NO: 281011 - DNA, 25 bp, Mus musculus
cttgagcaggagaagagtatcgatg

SEQ ID NO: 281012 - DNA, 25 bp, Mus musculus
cttgagcagggagatggcggtaaat

SEQ ID NO: 281013 - DNA, 25 bp, Mus musculus
cttgagcatgatgttgccatcccaa

SEQ ID NO: 281014 - DNA, 25 bp, Mus musculus
cttgagcatgcaccagccacaacgg

SEQ ID NO: 281015 - DNA, 25 bp, Mus musculus
cttgagccagcccatacccagccat

SEQ ID NO: 281016 - DNA, 25 bp, Mus musculus
cttgagccataatgaagagtctttg

SEQ ID NO: 281017 - DNA, 25 bp, Mus musculus
cttgagcccgagaggagccacagac

SEQ ID NO: 281018 - DNA, 25 bp, Mus musculus
cttgagcccgagaggcccatctgaa

SEQ ID NO: 281019 - DNA, 25 bp, Mus musculus
cttgagcccgagagtttccaaggag

SEQ ID NO: 281020 - DNA, 25 bp, Mus musculus
cttgagcgcggcatccagccagcgc

SEQ ID NO: 281021 - DNA, 25 bp, Mus musculus
cttgaggaagagccggaatcggtgg

SEQ ID NO: 281022 - DNA, 25 bp, Mus musculus
cttgaggcagctggaagctggccat

SEQ ID NO: 281023 - DNA, 25 bp, Mus musculus
cttgaggcaggtgcaagctggccat

SEQ ID NO: 281024 - DNA, 25 bp, Mus musculus
cttgaggccctcaagtctcacatca

SEQ ID NO: 281025 - DNA, 25 bp, Mus musculus
cttgaggctgacagacaagattgta

SEQ ID NO: 281026 - DNA, 25 bp, Mus musculus
cttgagggaggccttaaccatggca

SEQ ID NO: 281027 - DNA, 25 bp, Mus musculus
cttgagggatgctgactgtgcacca

SEQ ID NO: 281028 - DNA, 25 bp, Mus musculus
cttgaggtaatccattgtctgatcg

SEQ ID NO: 281029 - DNA, 25 bp, Mus musculus
cttgagtatatgggaagtactggag

SEQ ID NO: 281030 - DNA, 25 bp, Mus musculus
cttgagtatatggggcagagcccgg

SEQ ID NO: 281031 - DNA, 25 bp, Mus musculus
cttgagtcaagagaatcggctatcc

SEQ ID NO: 281032 - DNA, 25 bp, Mus musculus
cttgagtcaagagatcaggacttcc

SEQ ID NO: 281033 - DNA, 25 bp, Mus musculus
cttgagtcaagagatgaagccaccc

SEQ ID NO: 281034 - DNA, 25 bp, Mus musculus
cttgagtccaggttcacattgagat

SEQ ID NO: 281035 - DNA, 25 bp, Mus musculus
cttgagtcgatgtgcctgagacgta

SEQ ID NO: 281036 - DNA, 25 bp, Mus musculus
cttgagtgagcataatgaagctgag

SEQ ID NO: 281037 - DNA, 25 bp, Mus musculus
cttgagtgagccctgaatctgtgga

SEQ ID NO: 281038 - DNA, 25 bp, Mus musculus
cttgagtgaggcatttcatgaggag

SEQ ID NO: 281039 - DNA, 25 bp, Mus musculus
cttgagtgagggtatcctgtcttgg

SEQ ID NO: 281040 - DNA, 25 bp, Mus musculus
cttgagtgcaagaggcaagtgcagg

SEQ ID NO: 281041 - DNA, 25 bp, Mus musculus
cttgagtgcaaggcaccccggctgg

SEQ ID NO: 281042 - DNA, 25 bp, Mus musculus
cttgagtggacaggctgaatttgac

SEQ ID NO: 281043 - DNA, 25 bp, Mus musculus
cttgagtgggccttcccgctccatc

SEQ ID NO: 281044 - DNA, 25 bp, Mus musculus
cttgagtggggactgtcagggcagg

SEQ ID NO: 281045 - DNA, 25 bp, Mus musculus
cttgagtggtccatgtctctttctc

SEQ ID NO: 281046 - DNA, 25 bp, Mus musculus
cttgagtgtgcgcgggtcactcacc

SEQ ID NO: 281047 - DNA, 25 bp, Mus musculus
cttgagtttccgatgagacagaaga

SEQ ID NO: 281048 - DNA, 25 bp, Mus musculus
cttgagtttgacagtgtcattcaga

SEQ ID NO: 281049 - DNA, 25 bp, Mus musculus
cttgataaaacatgctggaggcatt

SEQ ID NO: 281050 - DNA, 25 bp, Mus musculus
cttgataaaacatggcattctgcat

SEQ ID NO: 281051 - DNA, 25 bp, Mus musculus
cttgataaaagtgaatttcctactg

SEQ ID NO: 281052 - DNA, 25 bp, Mus musculus
cttgataaagggaggtatgaaagga

SEQ ID NO: 281053 - DNA, 25 bp, Mus musculus
cttgataccctgggcaggattccta

SEQ ID NO: 281054 - DNA, 25 bp, Mus musculus
cttgatacgtttggaaagctggtct

SEQ ID NO: 281055 - DNA, 25 bp, Mus musculus
cttgatacgtttggaaatgttcctt

SEQ ID NO: 281056 - DNA, 25 bp, Mus musculus
cttgatagcggagaaaattggagag

SEQ ID NO: 281057 - DNA, 25 bp, Mus musculus
cttgatagtgagattggcagactca

SEQ ID NO: 281058 - DNA, 25 bp, Mus musculus
cttgatagtgatctttccagaacat

SEQ ID NO: 281059 - DNA, 25 bp, Mus musculus
cttgatatcatccgagttagaacaa

SEQ ID NO: 281060 - DNA, 25 bp, Mus musculus
cttgatatgaagcagattgattata

SEQ ID NO: 281061 - DNA, 25 bp, Mus musculus
cttgatatgtcgaccggaagaaaga

SEQ ID NO: 281062 - DNA, 25 bp, Mus musculus
cttgatcatcccagcctatgggaag

SEQ ID NO: 281063 - DNA, 25 bp, Mus musculus
cttgatcctggaggtggccttagac

SEQ ID NO: 281064 - DNA, 25 bp, Mus musculus
cttgatcggttatgaaaagtctgtt

SEQ ID NO: 281065 - DNA, 25 bp, Mus musculus
cttgatctaggccttcctatagatc

SEQ ID NO: 281066 - DNA, 25 bp, Mus musculus
cttgatctcagatctgcagactctc

SEQ ID NO: 281067 - DNA, 25 bp, Mus musculus
cttgatctcaggtgattactgacgc

SEQ ID NO: 281068 - DNA, 25 bp, Mus musculus
cttgatgaaattacttctgaaaagc

SEQ ID NO: 281069 - DNA, 25 bp, Mus musculus
cttgatgaaattatacgacctcctg

SEQ ID NO: 281070 - DNA, 25 bp, Mus musculus
cttgatgaaattgagcaactgaagc

SEQ ID NO: 281071 - DNA, 25 bp, Mus musculus
cttgatgaagaagatgaagtggaag

SEQ ID NO: 281072 - DNA, 25 bp, Mus musculus
cttgatgaagagtcagaagatgaag

SEQ ID NO: 281073 - DNA, 25 bp, Mus musculus
cttgatgatcttgagtctgcaactg

SEQ ID NO: 281074 - DNA, 25 bp, Mus musculus
cttgatgcaaggactcgtggggaaa

SEQ ID NO: 281075 - DNA, 25 bp, Mus musculus
cttgatgcagaatccaaatccagat

SEQ ID NO: 281076 - DNA, 25 bp, Mus musculus
cttgatgcagctgtggcagaagtaa

SEQ ID NO: 281077 - DNA, 25 bp, Mus musculus
cttgatggagtctctggagcagcgt

SEQ ID NO: 281078 - DNA, 25 bp, Mus musculus
cttgatggatatagacaacagaaag

SEQ ID NO: 281079 - DNA, 25 bp, Mus musculus
cttgatggcaagtatgtctatatag

SEQ ID NO: 281080 - DNA, 25 bp, Mus musculus
cttgatggtgagaagggagaggctg

SEQ ID NO: 281081 - DNA, 25 bp, Mus musculus
cttgatgtcatccaggaggtggagt

SEQ ID NO: 281082 - DNA, 25 bp, Mus musculus
cttgatgtcggtggcgcccaggggc

SEQ ID NO: 281083 - DNA, 25 bp, Mus musculus
cttgatgtgccaagtaatgtatatt

SEQ ID NO: 281084 - DNA, 25 bp, Mus musculus
cttgatgttatcaagaaaaagaata

SEQ ID NO: 281085 - DNA, 25 bp, Mus musculus
cttgattgccagaggcatgaatcct

SEQ ID NO: 281086 - DNA, 25 bp, Mus musculus
cttgattgttgaagatataattgac

SEQ ID NO: 281087 - DNA, 25 bp, Mus musculus
cttgatttgaaggagccaagcaata

SEQ ID NO: 281088 - DNA, 25 bp, Mus musculus
cttgatttggggttcccagcagtgg

SEQ ID NO: 281089 - DNA, 25 bp, Mus musculus
cttgcaaaaagacacacctgcaaag

SEQ ID NO: 281090 - DNA, 25 bp, Mus musculus
cttgcaaaaagaggtctccaaggtc

SEQ ID NO: 281091 - DNA, 25 bp, Mus musculus
cttgcaaaagaggccatgacgatgg

SEQ ID NO: 281092 - DNA, 25 bp, Mus musculus
cttgcaaacaggatgtctctccatt

SEQ ID NO: 281093 - DNA, 25 bp, Mus musculus
cttgcaaaggcctaacatttggaag

SEQ ID NO: 281094 - DNA, 25 bp, Mus musculus
cttgcaaaggcctaacctccaaaag

SEQ ID NO: 281095 - DNA, 25 bp, Mus musculus
cttgcaaagtgcaatacgaggattc

SEQ ID NO: 281096 - DNA, 25 bp, Mus musculus
cttgcaaagtgccacagttgaggct

SEQ ID NO: 281097 - DNA, 25 bp, Mus musculus
cttgcaaatttgatgcattcttcag

SEQ ID NO: 281098 - DNA, 25 bp, Mus musculus
cttgcaacactctgggttatgacat

SEQ ID NO: 281099 - DNA, 25 bp, Mus musculus
cttgcaagaagaacatccagagtct

SEQ ID NO: 281100 - DNA, 25 bp, Mus musculus
cttgcaagaaggggaccagctgctg

SEQ ID NO: 281101 - DNA, 25 bp, Mus musculus
cttgcaagaattgagagacatctcc

SEQ ID NO: 281102 - DNA, 25 bp, Mus musculus
cttgcaagatgaggagcctcagaga

SEQ ID NO: 281103 - DNA, 25 bp, Mus musculus
cttgcaagatgaggcagagaaggtt

SEQ ID NO: 281104 - DNA, 25 bp, Mus musculus
cttgcaatattaaagtaccaaccaa

SEQ ID NO: 281105 - DNA, 25 bp, Mus musculus
cttgcaattccatggctgcagaaga

SEQ ID NO: 281106 - DNA, 25 bp, Mus musculus
cttgcaattccatggtactctttga

SEQ ID NO: 281107 - DNA, 25 bp, Mus musculus
cttgcaattggaaagacagtgatgt

SEQ ID NO: 281108 - DNA, 25 bp, Mus musculus
cttgcaattggaaaggtatctggcc

SEQ ID NO: 281109 - DNA, 25 bp, Mus musculus
cttgcacaggggatgatgagacaga

SEQ ID NO: 281110 - DNA, 25 bp, Mus musculus
cttgcacatgataggctatgataga

SEQ ID NO: 281111 - DNA, 25 bp, Mus musculus
cttgcacatggagaggaaactgtca

SEQ ID NO: 281112 - DNA, 25 bp, Mus musculus
cttgcaccaagaagttaagtgttaa

SEQ ID NO: 281113 - DNA, 25 bp, Mus musculus
cttgcaccagtctctcaccatgtcc

SEQ ID NO: 281114 - DNA, 25 bp, Mus musculus
cttgcaccatccagagagatgccaa

SEQ ID NO: 281115 - DNA, 25 bp, Mus musculus
cttgcacttccagatctctgacatc

SEQ ID NO: 281116 - DNA, 25 bp, Mus musculus
cttgcagaaagcaggccgtctactg

SEQ ID NO: 281117 - DNA, 25 bp, Mus musculus
cttgcagaaagcagggctgactgtg

SEQ ID NO: 281118 - DNA, 25 bp, Mus musculus
cttgcagaagaacatgtttgggatg

SEQ ID NO: 281119 - DNA, 25 bp, Mus musculus
cttgcagaagagtcaggagctgctt

SEQ ID NO: 281120 - DNA, 25 bp, Mus musculus
cttgcagagacattttgagcagcac

SEQ ID NO: 281121 - DNA, 25 bp, Mus musculus
cttgcagagatcgggttctgcgggg

SEQ ID NO: 281122 - DNA, 25 bp, Mus musculus
cttgcagagcatggtctagtctcct

SEQ ID NO: 281123 - DNA, 25 bp, Mus musculus
cttgcagatcagacccagcatgtgc

SEQ ID NO: 281124 - DNA, 25 bp, Mus musculus
cttgcagatgatgggagaattctgt

SEQ ID NO: 281125 - DNA, 25 bp, Mus musculus
cttgcagatgatgggtgcagtttga

SEQ ID NO: 281126 - DNA, 25 bp, Mus musculus
cttgcagcaggtctgctttgccttg

SEQ ID NO: 281127 - DNA, 25 bp, Mus musculus
cttgcagcatgagttcaaagaagct

SEQ ID NO: 281128 - DNA, 25 bp, Mus musculus
cttgcagcatggctgaccaactgac

SEQ ID NO: 281129 - DNA, 25 bp, Mus musculus
cttgcagccactgcaagaaaaatga

SEQ ID NO: 281130 - DNA, 25 bp, Mus musculus
cttgcagccactgggttgccaagaa

SEQ ID NO: 281131 - DNA, 25 bp, Mus musculus
cttgcagccagacgttaggggataa

SEQ ID NO: 281132 - DNA, 25 bp, Mus musculus
cttgcagctgtctagcccatgccat

SEQ ID NO: 281133 - DNA, 25 bp, Mus musculus
cttgcagcttcatgagtttaaattc

SEQ ID NO: 281134 - DNA, 25 bp, Mus musculus
cttgcaggaaaagagttcctggtct

SEQ ID NO: 281135 - DNA, 25 bp, Mus musculus
cttgcaggcctggagataaagttcc

SEQ ID NO: 281136 - DNA, 25 bp, Mus musculus
cttgcaggctcacgctctcaccact

SEQ ID NO: 281137 - DNA, 25 bp, Mus musculus
cttgcagtaagcagcttaacaggag

SEQ ID NO: 281138 - DNA, 25 bp, Mus musculus
cttgcagtggtgatgctgtcatcaa

SEQ ID NO: 281139 - DNA, 25 bp, Mus musculus
cttgcagttctcaggaggggtcatc

SEQ ID NO: 281140 - DNA, 25 bp, Mus musculus
cttgcatatgtacaggcagaccgaa

SEQ ID NO: 281141 - DNA, 25 bp, Mus musculus
cttgcatatgtacagtcccagaagt

SEQ ID NO: 281142 - DNA, 25 bp, Mus musculus
cttgcatcagtggatcgatatcaac

SEQ ID NO: 281143 - DNA, 25 bp, Mus musculus
cttgcatccagggatgcaggcagcc

SEQ ID NO: 281144 - DNA, 25 bp, Mus musculus
cttgcatccagggatgttaatttta

SEQ ID NO: 281145 - DNA, 25 bp, Mus musculus
cttgcatccagtgatgtggccgtgg

SEQ ID NO: 281146 - DNA, 25 bp, Mus musculus
cttgcatcgggattctgtaacagca

SEQ ID NO: 281147 - DNA, 25 bp, Mus musculus
cttgcatcggggtcagtggataaat

SEQ ID NO: 281148 - DNA, 25 bp, Mus musculus
cttgcatctagtttgactaccaaag

SEQ ID NO: 281149 - DNA, 25 bp, Mus musculus
cttgcatgagacacacaaccttttt

SEQ ID NO: 281150 - DNA, 25 bp, Mus musculus
cttgcatgaggcaaaagagatttca

SEQ ID NO: 281151 - DNA, 25 bp, Mus musculus
cttgcatgagggctcgctgcccacc

SEQ ID NO: 281152 - DNA, 25 bp, Mus musculus
cttgcatgagtggtgtgacggctgt

SEQ ID NO: 281153 - DNA, 25 bp, Mus musculus
cttgcatgcacatgtctcgaattat

SEQ ID NO: 281154 - DNA, 25 bp, Mus musculus
cttgcatgcctgggccctggcccag

SEQ ID NO: 281155 - DNA, 25 bp, Mus musculus
cttgcatgctaatagaagtagtccc

SEQ ID NO: 281156 - DNA, 25 bp, Mus musculus
cttgcatgctaataggccaggtggt

SEQ ID NO: 281157 - DNA, 25 bp, Mus musculus
cttgcatgctaatagggaagaccgg

SEQ ID NO: 281158 - DNA, 25 bp, Mus musculus
cttgcatggaaacaggtttaatctt

SEQ ID NO: 281159 - DNA, 25 bp, Mus musculus
cttgcatggaaacagtcaccaagga

SEQ ID NO: 281160 - DNA, 25 bp, Mus musculus
cttgccaaaggaaagcgagcttgcc

SEQ ID NO: 281161 - DNA, 25 bp, Mus musculus
cttgccaaaggcagtttgatgtttt

SEQ ID NO: 281162 - DNA, 25 bp, Mus musculus
cttgccaagaacatactaaaagcaa

SEQ ID NO: 281163 - DNA, 25 bp, Mus musculus
cttgccaaggtccacccgactccat

SEQ ID NO: 281164 - DNA, 25 bp, Mus musculus
cttgccacactgtgaccctaaaacc

SEQ ID NO: 281165 - DNA, 25 bp, Mus musculus
cttgccacagagcccttgcttaggc

SEQ ID NO: 281166 - DNA, 25 bp, Mus musculus
cttgccacaggagacgtggctgaga

SEQ ID NO: 281167 - DNA, 25 bp, Mus musculus
cttgccactgtgagcttcaacctgg

SEQ ID NO: 281168 - DNA, 25 bp, Mus musculus
cttgccacttcaggatacatcagag

SEQ ID NO: 281169 - DNA, 25 bp, Mus musculus
cttgccacttcaggtaaaatatagt

SEQ ID NO: 281170 - DNA, 25 bp, Mus musculus
cttgccagccaacggaggccggctg

SEQ ID NO: 281171 - DNA, 25 bp, Mus musculus
cttgccagctggacatcaacgattg

SEQ ID NO: 281172 - DNA, 25 bp, Mus musculus
cttgccagctggacgccaatgagtg

SEQ ID NO: 281173 - DNA, 25 bp, Mus musculus
cttgcccaacacagagggtgaacag

SEQ ID NO: 281174 - DNA, 25 bp, Mus musculus
cttgcccaacacagtggggctgtgg

SEQ ID NO: 281175 - DNA, 25 bp, Mus musculus
cttgcccaaggagaatgaccccaga

SEQ ID NO: 281176 - DNA, 25 bp, Mus musculus
cttgcccaaggagtctctctgctgc

SEQ ID NO: 281177 - DNA, 25 bp, Mus musculus
cttgcccaaggagttctggcaggtg

SEQ ID NO: 281178 - DNA, 25 bp, Mus musculus
cttgcccaaggatctgggaaactcc

SEQ ID NO: 281179 - DNA, 25 bp, Mus musculus
cttgccccagcggggacgaagcagc

SEQ ID NO: 281180 - DNA, 25 bp, Mus musculus
cttgccccagctgacgagatgacag

SEQ ID NO: 281181 - DNA, 25 bp, Mus musculus
cttgccccgagtctccatctttgtc

SEQ ID NO: 281182 - DNA, 25 bp, Mus musculus
cttgcccgaaacaaccacaacatgc

SEQ ID NO: 281183 - DNA, 25 bp, Mus musculus
cttgcccgctggacagttgctgtgc

SEQ ID NO: 281184 - DNA, 25 bp, Mus musculus
cttgccctcagagcctgtggacatt

SEQ ID NO: 281185 - DNA, 25 bp, Mus musculus
cttgccctcagagggccgggttaaa

SEQ ID NO: 281186 - DNA, 25 bp, Mus musculus
cttgccctcttcggggaagaaatag

SEQ ID NO: 281187 - DNA, 25 bp, Mus musculus
cttgcccttgactggtacagactta

SEQ ID NO: 281188 - DNA, 25 bp, Mus musculus
cttgccgccgtaggaactgacccga

SEQ ID NO: 281189 - DNA, 25 bp, Mus musculus
cttgccgcctcctccgagcctgaag

SEQ ID NO: 281190 - DNA, 25 bp, Mus musculus
cttgccgtatggtgacagctggcca

SEQ ID NO: 281191 - DNA, 25 bp, Mus musculus
cttgccgtccggtggagagtacagt

SEQ ID NO: 281192 - DNA, 25 bp, Mus musculus
cttgcctaagttggaaaagcgtctg

SEQ ID NO: 281193 - DNA, 25 bp, Mus musculus
cttgcctcagtgacatcaggctgta

SEQ ID NO: 281194 - DNA, 25 bp, Mus musculus
cttgcctccaggctgaagaaggacc

SEQ ID NO: 281195 - DNA, 25 bp, Mus musculus
cttgcctccggaggtgtatgcagtt

SEQ ID NO: 281196 - DNA, 25 bp, Mus musculus
cttgcctccggttcacgctaaagat

SEQ ID NO: 281197 - DNA, 25 bp, Mus musculus
cttgcctctgaagcaggcagcaccc

SEQ ID NO: 281198 - DNA, 25 bp, Mus musculus
cttgcctgaacaagatgcactccca

SEQ ID NO: 281199 - DNA, 25 bp, Mus musculus
cttgcctgaacaagctcagccctgg

SEQ ID NO: 281200 - DNA, 25 bp, Mus musculus
cttgcctgaacaaggctcttcctcc

SEQ ID NO: 281201 - DNA, 25 bp, Mus musculus
cttgcctgagagtgaaataaagaaa

SEQ ID NO: 281202 - DNA, 25 bp, Mus musculus
cttgcctgcaggaagcaccatggcc

SEQ ID NO: 281203 - DNA, 25 bp, Mus musculus
cttgcctgcagttccgtttccccca

SEQ ID NO: 281204 - DNA, 25 bp, Mus musculus
cttgcctgcggccaggaggtggctt

SEQ ID NO: 281205 - DNA, 25 bp, Mus musculus
cttgcctgctggaagtctctaataa

SEQ ID NO: 281206 - DNA, 25 bp, Mus musculus
cttgcctggacctcctcccatctct

SEQ ID NO: 281207 - DNA, 25 bp, Mus musculus
cttgcctggtggaaagacagctgga

SEQ ID NO: 281208 - DNA, 25 bp, Mus musculus
cttgcctggtggaagctccatggtt

SEQ ID NO: 281209 - DNA, 25 bp, Mus musculus
cttgccttctgaaagacccggccat

SEQ ID NO: 281210 - DNA, 25 bp, Mus musculus
cttgcgaaggggcttcgcctctatg

SEQ ID NO: 281211 - DNA, 25 bp, Mus musculus
cttgcgacaacagatggagaagtct

SEQ ID NO: 281212 - DNA, 25 bp, Mus musculus
cttgcgagagcaatctgatgattct

SEQ ID NO: 281213 - DNA, 25 bp, Mus musculus
cttgcgatggcggtacagagactca

SEQ ID NO: 281214 - DNA, 25 bp, Mus musculus
cttgcgccacagactcttccaagca

SEQ ID NO: 281215 - DNA, 25 bp, Mus musculus
cttgcgccgccggtgtggccgtggc

SEQ ID NO: 281216 - DNA, 25 bp, Mus musculus
cttgcgcgcagctggggtcatgata

SEQ ID NO: 281217 - DNA, 25 bp, Mus musculus
cttgcgctccgcaagccccgcccaa

SEQ ID NO: 281218 - DNA, 25 bp, Mus musculus
cttgcgctgccttgactgtggaaag

SEQ ID NO: 281219 - DNA, 25 bp, Mus musculus
cttgcggagggtcctggaaacactc

SEQ ID NO: 281220 - DNA, 25 bp, Mus musculus
cttgcggatggggaagccagctttg

SEQ ID NO: 281221 - DNA, 25 bp, Mus musculus
cttgcggcgccggacaggatgtttg

SEQ ID NO: 281222 - DNA, 25 bp, Mus musculus
cttgcggtcacctctgtcttcctac

SEQ ID NO: 281223 - DNA, 25 bp, Mus musculus
cttgcgttcgggaagatgctggtgg

SEQ ID NO: 281224 - DNA, 25 bp, Mus musculus
cttgcgtttcagagggcccatagcc

SEQ ID NO: 281225 - DNA, 25 bp, Mus musculus
cttgctaacaacaacacctcgtcca

SEQ ID NO: 281226 - DNA, 25 bp, Mus musculus
cttgctaaggggcacctggccacat

SEQ ID NO: 281227 - DNA, 25 bp, Mus musculus
cttgctaatccgaataatttaaaaa

SEQ ID NO: 281228 - DNA, 25 bp, Mus musculus
cttgctaatgaagcaagtgtggagg

SEQ ID NO: 281229 - DNA, 25 bp, Mus musculus
cttgctacaagtgtggtgagaaagg

SEQ ID NO: 281230 - DNA, 25 bp, Mus musculus
cttgctacaagtgtggtgggctagt

SEQ ID NO: 281231 - DNA, 25 bp, Mus musculus
cttgctacccttctggttctttgtg

SEQ ID NO: 281232 - DNA, 25 bp, Mus musculus
cttgctacctcagtctcacggatga

SEQ ID NO: 281233 - DNA, 25 bp, Mus musculus
cttgctacctgcagggctgaccagc

SEQ ID NO: 281234 - DNA, 25 bp, Mus musculus
cttgctactgcaggggagccctatc

SEQ ID NO: 281235 - DNA, 25 bp, Mus musculus
cttgctagcagcaatcatctgggga

SEQ ID NO: 281236 - DNA, 25 bp, Mus musculus
cttgctaggtgttccctgctgctct

SEQ ID NO: 281237 - DNA, 25 bp, Mus musculus
cttgctatgaacacccctggctaca

SEQ ID NO: 281238 - DNA, 25 bp, Mus musculus
cttgctattgctcctgggcctgctc

SEQ ID NO: 281239 - DNA, 25 bp, Mus musculus
cttgctcaaccagatccttgcatga

SEQ ID NO: 281240 - DNA, 25 bp, Mus musculus
cttgctcaaccagggcatcgttctg

SEQ ID NO: 281241 - DNA, 25 bp, Mus musculus
cttgctcattagcttttttccagga

SEQ ID NO: 281242 - DNA, 25 bp, Mus musculus
cttgctcattaggtgtgtgatagca

SEQ ID NO: 281243 - DNA, 25 bp, Mus musculus
cttgctccaagggccccgccgtcac

SEQ ID NO: 281244 - DNA, 25 bp, Mus musculus
cttgctccctccagactccatctgc

SEQ ID NO: 281245 - DNA, 25 bp, Mus musculus
cttgctccctccagcgccaacgtca

SEQ ID NO: 281246 - DNA, 25 bp, Mus musculus
cttgctccctcgcttagcgctctgt

SEQ ID NO: 281247 - DNA, 25 bp, Mus musculus
cttgctccgagagtgctcccagagg

SEQ ID NO: 281248 - DNA, 25 bp, Mus musculus
cttgctccgtcctggatactccatg

SEQ ID NO: 281249 - DNA, 25 bp, Mus musculus
cttgctcctgcttgcttcccagagc

SEQ ID NO: 281250 - DNA, 25 bp, Mus musculus
cttgctcctggaggcagtgacattc

SEQ ID NO: 281251 - DNA, 25 bp, Mus musculus
cttgctctctcggacacggagagcc

SEQ ID NO: 281252 - DNA, 25 bp, Mus musculus
cttgctctttgtcaggtaagaatga

SEQ ID NO: 281253 - DNA, 25 bp, Mus musculus
cttgctgaacccccacagaacctga

SEQ ID NO: 281254 - DNA, 25 bp, Mus musculus
cttgctgaagctcaggtacctgaca

SEQ ID NO: 281255 - DNA, 25 bp, Mus musculus
cttgctgaagtggcttttcatggcc

SEQ ID NO: 281256 - DNA, 25 bp, Mus musculus
cttgctgacaagcccttcaaattgg

SEQ ID NO: 281257 - DNA, 25 bp, Mus musculus
cttgctgacctcaaggtttccctgg

SEQ ID NO: 281258 - DNA, 25 bp, Mus musculus
cttgctgactacatttcctcggcct

SEQ ID NO: 281259 - DNA, 25 bp, Mus musculus
cttgctgaggaacatggttggtgca

SEQ ID NO: 281260 - DNA, 25 bp, Mus musculus
cttgctgaggaagagaagtttattg

SEQ ID NO: 281261 - DNA, 25 bp, Mus musculus
cttgctgaggcctcttaagcaatgc

SEQ ID NO: 281262 - DNA, 25 bp, Mus musculus
cttgctgcaaccgaggtcacatggt

SEQ ID NO: 281263 - DNA, 25 bp, Mus musculus
cttgctgcgcagatgatgctgaata

SEQ ID NO: 281264 - DNA, 25 bp, Mus musculus
cttgctgcgcagatgcagaaccccg

SEQ ID NO: 281265 - DNA, 25 bp, Mus musculus
cttgctgctcatggatgaagttgct

SEQ ID NO: 281266 - DNA, 25 bp, Mus musculus
cttgctgctcctggtaacttcaatt

SEQ ID NO: 281267 - DNA, 25 bp, Mus musculus
cttgctgctgtccttcctgcttaga

SEQ ID NO: 281268 - DNA, 25 bp, Mus musculus
cttgctggacgaggtgccagtcatt

SEQ ID NO: 281269 - DNA, 25 bp, Mus musculus
cttgctggagtcagaacagggagcc

SEQ ID NO: 281270 - DNA, 25 bp, Mus musculus
cttgctggcaagagtattcaggagt

SEQ ID NO: 281271 - DNA, 25 bp, Mus musculus
cttgctggcaaggtggcgacctgca

SEQ ID NO: 281272 - DNA, 25 bp, Mus musculus
cttgctggtggaaggaggcaggatt

SEQ ID NO: 281273 - DNA, 25 bp, Mus musculus
cttgctgtaggttatgatgagttta

SEQ ID NO: 281274 - DNA, 25 bp, Mus musculus
cttgctgtcaaactacagagtgaat

SEQ ID NO: 281275 - DNA, 25 bp, Mus musculus
cttgctgtctcaggacactgctggc

SEQ ID NO: 281276 - DNA, 25 bp, Mus musculus
cttgctgtctcagggtgaaagagca

SEQ ID NO: 281277 - DNA, 25 bp, Mus musculus
cttgctgtgatcacggtgacaaact

SEQ ID NO: 281278 - DNA, 25 bp, Mus musculus
cttgctgtgatggagtcctcatgga

SEQ ID NO: 281279 - DNA, 25 bp, Mus musculus
cttgctgtgtggctgagagtgctag

SEQ ID NO: 281280 - DNA, 25 bp, Mus musculus
cttgctgttactataaagctctgaa

SEQ ID NO: 281281 - DNA, 25 bp, Mus musculus
cttgctgttactattgacaccgatt

SEQ ID NO: 281282 - DNA, 25 bp, Mus musculus
cttgctgttctttatcctgggtgct

SEQ ID NO: 281283 - DNA, 25 bp, Mus musculus
cttgctgtttatggaccttgagatc

SEQ ID NO: 281284 - DNA, 25 bp, Mus musculus
cttgcttaaaacatgctaattccac

SEQ ID NO: 281285 - DNA, 25 bp, Mus musculus
cttgcttaatagacttggtcccctg

SEQ ID NO: 281286 - DNA, 25 bp, Mus musculus
cttgcttaataggtgtgtcctctgg

SEQ ID NO: 281287 - DNA, 25 bp, Mus musculus
cttgcttaccctagaagccgttgtt

SEQ ID NO: 281288 - DNA, 25 bp, Mus musculus
cttgcttagcaaggcacaacacgta

SEQ ID NO: 281289 - DNA, 25 bp, Mus musculus
cttgcttcagccagagtaacagttg

SEQ ID NO: 281290 - DNA, 25 bp, Mus musculus
cttgcttcagccgtctgtggaggct

SEQ ID NO: 281291 - DNA, 25 bp, Mus musculus
cttgcttcaggcgtctgtggaggct

SEQ ID NO: 281292 - DNA, 25 bp, Mus musculus
cttgcttctgaaacctcaggtggaa

SEQ ID NO: 281293 - DNA, 25 bp, Mus musculus
cttgcttgtcggaatctgatgcttc

SEQ ID NO: 281294 - DNA, 25 bp, Mus musculus
cttgcttgtgggattcacagcctct

SEQ ID NO: 281295 - DNA, 25 bp, Mus musculus
cttgctttcaaagaacagcatgttt

SEQ ID NO: 281296 - DNA, 25 bp, Mus musculus
cttgctttgaaagtggtaacctcgg

SEQ ID NO: 281297 - DNA, 25 bp, Mus musculus
cttgctttgacacgagatgacataa

SEQ ID NO: 281298 - DNA, 25 bp, Mus musculus
cttgctttggtgggcagtcctggca

SEQ ID NO: 281299 - DNA, 25 bp, Mus musculus
cttgcttttgcggagatgcggcatt

SEQ ID NO: 281300 - DNA, 25 bp, Mus musculus
cttgcttttgcggagtcactattta

SEQ ID NO: 281301 - DNA, 25 bp, Mus musculus
cttggaaaaacacagactgcgatgg

SEQ ID NO: 281302 - DNA, 25 bp, Mus musculus
cttggaaaacatgaggaaggacaga

SEQ ID NO: 281303 - DNA, 25 bp, Mus musculus
cttggaaaagcacttggagctgctt

SEQ ID NO: 281304 - DNA, 25 bp, Mus musculus
cttggaaaagtgctcatgacctgac

SEQ ID NO: 281305 - DNA, 25 bp, Mus musculus
cttggaaacaactggtgccagcaca

SEQ ID NO: 281306 - DNA, 25 bp, Mus musculus
cttggaaagaaacacgaagaaaggc

SEQ ID NO: 281307 - DNA, 25 bp, Mus musculus
cttggaaagctgcggcctcagcctg

SEQ ID NO: 281308 - DNA, 25 bp, Mus musculus
cttggaaagctgcgtctcgcggcag

SEQ ID NO: 281309 - DNA, 25 bp, Mus musculus
cttggaacagtctggccagaaatac

SEQ ID NO: 281310 - DNA, 25 bp, Mus musculus
cttggaacatggagggttcactgtg

SEQ ID NO: 281311 - DNA, 25 bp, Mus musculus
cttggaaccctaagctgggctctcc

SEQ ID NO: 281312 - DNA, 25 bp, Mus musculus
cttggaactggtcaaggcctggcag

SEQ ID NO: 281313 - DNA, 25 bp, Mus musculus
cttggaagaatggcatctagtgctt

SEQ ID NO: 281314 - DNA, 25 bp, Mus musculus
cttggaagaggccctgggcttctcc

SEQ ID NO: 281315 - DNA, 25 bp, Mus musculus
cttggaatacagtgccgtgatgtga

SEQ ID NO: 281316 - DNA, 25 bp, Mus musculus
cttggaatcgcagttactgtgggaa

SEQ ID NO: 281317 - DNA, 25 bp, Mus musculus
cttggaatctccctgagcaagagtg

SEQ ID NO: 281318 - DNA, 25 bp, Mus musculus
cttggaatgagactgcagatcttgg

SEQ ID NO: 281319 - DNA, 25 bp, Mus musculus
cttggaattgaagatggatcaccta

SEQ ID NO: 281320 - DNA, 25 bp, Mus musculus
cttggaatttatggtacaggaaaac

SEQ ID NO: 281321 - DNA, 25 bp, Mus musculus
cttggacaacaccatcaagaaactg

SEQ ID NO: 281322 - DNA, 25 bp, Mus musculus
cttggacaacataaggaagtcagac

SEQ ID NO: 281323 - DNA, 25 bp, Mus musculus
cttggacaacgagagctggggcttt

SEQ ID NO: 281324 - DNA, 25 bp, Mus musculus
cttggacaacgagagttctgcctgc

SEQ ID NO: 281325 - DNA, 25 bp, Mus musculus
cttggacaagatagccaaggacttg

SEQ ID NO: 281326 - DNA, 25 bp, Mus musculus
cttggacaaggagcagatagccaag

SEQ ID NO: 281327 - DNA, 25 bp, Mus musculus
cttggacagcaagggccatgtgaaa

SEQ ID NO: 281328 - DNA, 25 bp, Mus musculus
cttggacagtgagcctcgaggtctc

SEQ ID NO: 281329 - DNA, 25 bp, Mus musculus
cttggacatgtcatctcctgaagat

SEQ ID NO: 281330 - DNA, 25 bp, Mus musculus
cttggaccaagaagttggtgtcctt

SEQ ID NO: 281331 - DNA, 25 bp, Mus musculus
cttggaccacaccagcattcggagg

SEQ ID NO: 281332 - DNA, 25 bp, Mus musculus
cttggaccacaccagttcctctaat

SEQ ID NO: 281333 - DNA, 25 bp, Mus musculus
cttggaccacgctatggttttggag

SEQ ID NO: 281334 - DNA, 25 bp, Mus musculus
cttggaccccagggtccattcagaa

SEQ ID NO: 281335 - DNA, 25 bp, Mus musculus
cttggacctcagagatgaggagttt

SEQ ID NO: 281336 - DNA, 25 bp, Mus musculus
cttggacctgaggtggcatctttag

SEQ ID NO: 281337 - DNA, 25 bp, Mus musculus
cttggaccttaagatttcctattat

SEQ ID NO: 281338 - DNA, 25 bp, Mus musculus
cttggacggacagaatacaccatca

SEQ ID NO: 281339 - DNA, 25 bp, Mus musculus
cttggacggcttgactaaaatacaa

SEQ ID NO: 281340 - DNA, 25 bp, Mus musculus
cttggacggcttgatgaggtctccc

SEQ ID NO: 281341 - DNA, 25 bp, Mus musculus
cttggacggcttgatgagtaagaaa

SEQ ID NO: 281342 - DNA, 25 bp, Mus musculus
cttggacggcttggggatccagcac

SEQ ID NO: 281343 - DNA, 25 bp, Mus musculus
cttggactgaaggtacgcagggaat

SEQ ID NO: 281344 - DNA, 25 bp, Mus musculus
cttggactgccagggtcacgtggta

SEQ ID NO: 281345 - DNA, 25 bp, Mus musculus
cttggactgccagtacttggctcca

SEQ ID NO: 281346 - DNA, 25 bp, Mus musculus
cttggacttcagccctagtctgaag

SEQ ID NO: 281347 - DNA, 25 bp, Mus musculus
cttggacttgagcagcgaccactga

SEQ ID NO: 281348 - DNA, 25 bp, Mus musculus
cttggactttgcaaggcagtactac

SEQ ID NO: 281349 - DNA, 25 bp, Mus musculus
cttggagaaaatcttggaccttcct

SEQ ID NO: 281350 - DNA, 25 bp, Mus musculus
cttggagaagagcagtacactaggt

SEQ ID NO: 281351 - DNA, 25 bp, Mus musculus
cttggagaagataaaaatatatacc

SEQ ID NO: 281352 - DNA, 25 bp, Mus musculus
cttggagaagggtcttatggaagtg

SEQ ID NO: 281353 - DNA, 25 bp, Mus musculus
cttggagaatggttataagtacatg

SEQ ID NO: 281354 - DNA, 25 bp, Mus musculus
cttggagacatgagcagctactcca

SEQ ID NO: 281355 - DNA, 25 bp, Mus musculus
cttggagacatgaggaactcagcca

SEQ ID NO: 281356 - DNA, 25 bp, Mus musculus
cttggagacatgagggctcatccgc

SEQ ID NO: 281357 - DNA, 25 bp, Mus musculus
cttggagacatgagtctaaggttgt

SEQ ID NO: 281358 - DNA, 25 bp, Mus musculus
cttggagagacagaacaaggatttg

SEQ ID NO: 281359 - DNA, 25 bp, Mus musculus
cttggagaggaggtcttcttctccg

SEQ ID NO: 281360 - DNA, 25 bp, Mus musculus
cttggagagtggacagaaaacatca

SEQ ID NO: 281361 - DNA, 25 bp, Mus musculus
cttggagataaacgaaattaggtcc

SEQ ID NO: 281362 - DNA, 25 bp, Mus musculus
cttggagataaacgagtgtgcaact

SEQ ID NO: 281363 - DNA, 25 bp, Mus musculus
cttggagatagtcgggcaatcctgt

SEQ ID NO: 281364 - DNA, 25 bp, Mus musculus
cttggagcaagatgagatggaccaa

SEQ ID NO: 281365 - DNA, 25 bp, Mus musculus
cttggagcactgaagaggaacctgc

SEQ ID NO: 281366 - DNA, 25 bp, Mus musculus
cttggagcagctgggaacactccag

SEQ ID NO: 281367 - DNA, 25 bp, Mus musculus
cttggagcaggtcaaagctgcaata

SEQ ID NO: 281368 - DNA, 25 bp, Mus musculus
cttggagccgggagttgatacaaaa

SEQ ID NO: 281369 - DNA, 25 bp, Mus musculus
cttggagccgtcgactctcaggtgg

SEQ ID NO: 281370 - DNA, 25 bp, Mus musculus
cttggagctgtcaaggccctgtgga

SEQ ID NO: 281371 - DNA, 25 bp, Mus musculus
cttggaggaagtccgccagttcctt

SEQ ID NO: 281372 - DNA, 25 bp, Mus musculus
cttggaggacagatgccctgctggc

SEQ ID NO: 281373 - DNA, 25 bp, Mus musculus
cttggaggagaatttaaaagaagat

SEQ ID NO: 281374 - DNA, 25 bp, Mus musculus
cttggaggctgcaaaagacatttga

SEQ ID NO: 281375 - DNA, 25 bp, Mus musculus
cttggaggcttggagaatctccccg

SEQ ID NO: 281376 - DNA, 25 bp, Mus musculus
cttggagtcaggggaaatgagcatc

SEQ ID NO: 281377 - DNA, 25 bp, Mus musculus
cttggagtcaggggtcactaggatt

SEQ ID NO: 281378 - DNA, 25 bp, Mus musculus
cttggagttaaaggtccttcacgtc

SEQ ID NO: 281379 - DNA, 25 bp, Mus musculus
cttggagttgactgtgttccctgcc

SEQ ID NO: 281380 - DNA, 25 bp, Mus musculus
cttggagttgggaatgagcaattac

SEQ ID NO: 281381 - DNA, 25 bp, Mus musculus
cttggataagattaatgtccttcat

SEQ ID NO: 281382 - DNA, 25 bp, Mus musculus
cttggataatagaatgacagcagca

SEQ ID NO: 281383 - DNA, 25 bp, Mus musculus
cttggatactggaagaagccataat

SEQ ID NO: 281384 - DNA, 25 bp, Mus musculus
cttggatagactacgagtctggtct

SEQ ID NO: 281385 - DNA, 25 bp, Mus musculus
cttggatagagcatatttaattagg

SEQ ID NO: 281386 - DNA, 25 bp, Mus musculus
cttggatcacacagtgagaccctgt

SEQ ID NO: 281387 - DNA, 25 bp, Mus musculus
cttggatcgaaggcacggagggagt

SEQ ID NO: 281388 - DNA, 25 bp, Mus musculus
cttggatcggatgaagaagataagg

SEQ ID NO: 281389 - DNA, 25 bp, Mus musculus
cttggatctactgagcgcagccttg

SEQ ID NO: 281390 - DNA, 25 bp, Mus musculus
cttggatctactggttctgcagtac

SEQ ID NO: 281391 - DNA, 25 bp, Mus musculus
cttggatctactgtgggcccagcca

SEQ ID NO: 281392 - DNA, 25 bp, Mus musculus
cttggatcttcccgctctgtgacca

SEQ ID NO: 281393 - DNA, 25 bp, Mus musculus
cttggatcttcccggttctcggact

SEQ ID NO: 281394 - DNA, 25 bp, Mus musculus
cttggatgaactgtatgacatcatg

SEQ ID NO: 281395 - DNA, 25 bp, Mus musculus
cttggatggagaggttggtacaggc

SEQ ID NO: 281396 - DNA, 25 bp, Mus musculus
cttggatggagccaaaaacaataca

SEQ ID NO: 281397 - DNA, 25 bp, Mus musculus
cttggatggagcgtcagtgagtgaa

SEQ ID NO: 281398 - DNA, 25 bp, Mus musculus
cttggatggcagctgtccggcagag

SEQ ID NO: 281399 - DNA, 25 bp, Mus musculus
cttggatggggtattgacaaatctc

SEQ ID NO: 281400 - DNA, 25 bp, Mus musculus
cttggatgttgaggttctctgctgc

SEQ ID NO: 281401 - DNA, 25 bp, Mus musculus
cttggattacaggtgaccaggactg

SEQ ID NO: 281402 - DNA, 25 bp, Mus musculus
cttggattacaggtggtgctctggg

SEQ ID NO: 281403 - DNA, 25 bp, Mus musculus
cttggattcagtttctttagaatgt

SEQ ID NO: 281404 - DNA, 25 bp, Mus musculus
cttggattcgctccggtgtaatgga

SEQ ID NO: 281405 - DNA, 25 bp, Mus musculus
cttggattcgctggttggtggggaa

SEQ ID NO: 281406 - DNA, 25 bp, Mus musculus
cttggattgacaggtcccaggtcgc

SEQ ID NO: 281407 - DNA, 25 bp, Mus musculus
cttggattgacaggtctgaacggcg

SEQ ID NO: 281408 - DNA, 25 bp, Mus musculus
cttggcaacagaccccaatatcctg

SEQ ID NO: 281409 - DNA, 25 bp, Mus musculus
cttggcaacagcaaggtgcacatgt

SEQ ID NO: 281410 - DNA, 25 bp, Mus musculus
cttggcaacagcaagtgctgacagt

SEQ ID NO: 281411 - DNA, 25 bp, Mus musculus
cttggcaacagggtctctgtgatga

SEQ ID NO: 281412 - DNA, 25 bp, Mus musculus
cttggcacctgaggacaaagtctgg

SEQ ID NO: 281413 - DNA, 25 bp, Mus musculus
cttggcagaagaggagaaagagaaa

SEQ ID NO: 281414 - DNA, 25 bp, Mus musculus
cttggcagaagctctgcagatccac

SEQ ID NO: 281415 - DNA, 25 bp, Mus musculus
cttggcagaaggtagcacggcttct

SEQ ID NO: 281416 - DNA, 25 bp, Mus musculus
cttggcagagcaacttattttcaac

SEQ ID NO: 281417 - DNA, 25 bp, Mus musculus
cttggcagaggaggctccgtgcccg

SEQ ID NO: 281418 - DNA, 25 bp, Mus musculus
cttggcagaggagtgacatcactga

SEQ ID NO: 281419 - DNA, 25 bp, Mus musculus
cttggcagaggtgagtaaaaagaag

SEQ ID NO: 281420 - DNA, 25 bp, Mus musculus
cttggcagaggtggataactgcaca

SEQ ID NO: 281421 - DNA, 25 bp, Mus musculus
cttggcagaggttacaaaatgtcct

SEQ ID NO: 281422 - DNA, 25 bp, Mus musculus
cttggcagcccaaggattccagctt

SEQ ID NO: 281423 - DNA, 25 bp, Mus musculus
cttggcagcccaagtctttgcagat

SEQ ID NO: 281424 - DNA, 25 bp, Mus musculus
cttggcagtcacaggttggatgaaa

SEQ ID NO: 281425 - DNA, 25 bp, Mus musculus
cttggcagttttgggggctcgccat

SEQ ID NO: 281426 - DNA, 25 bp, Mus musculus
cttggcatctgcaatgccgcgccag

SEQ ID NO: 281427 - DNA, 25 bp, Mus musculus
cttggcattataaaccgtgtcagca

SEQ ID NO: 281428 - DNA, 25 bp, Mus musculus
cttggcattatgtgccctccgtttt

SEQ ID NO: 281429 - DNA, 25 bp, Mus musculus
cttggccaacaagagtcctcgttga

SEQ ID NO: 281430 - DNA, 25 bp, Mus musculus
cttggccaacaagagtgatctgtcc

SEQ ID NO: 281431 - DNA, 25 bp, Mus musculus
cttggccaccacacagagtcattct

SEQ ID NO: 281432 - DNA, 25 bp, Mus musculus
cttggccaccactcctaatagtaca

SEQ ID NO: 281433 - DNA, 25 bp, Mus musculus
cttggccaccagagatcgagactca

SEQ ID NO: 281434 - DNA, 25 bp, Mus musculus
cttggccaccattgcaagtactcca

SEQ ID NO: 281435 - DNA, 25 bp, Mus musculus
cttggccaccattgcctcaactgtg

SEQ ID NO: 281436 - DNA, 25 bp, Mus musculus
cttggccacgtcaagactctggaag

SEQ ID NO: 281437 - DNA, 25 bp, Mus musculus
cttggccacgtcaagatgtcacgtg

SEQ ID NO: 281438 - DNA, 25 bp, Mus musculus
cttggccactgatagtgcctttgat

SEQ ID NO: 281439 - DNA, 25 bp, Mus musculus
cttggccagggagccacagctaact

SEQ ID NO: 281440 - DNA, 25 bp, Mus musculus
cttggccagggttaactttgaggaa

SEQ ID NO: 281441 - DNA, 25 bp, Mus musculus
cttggccatgagatgagatggacca

SEQ ID NO: 281442 - DNA, 25 bp, Mus musculus
cttggcccacgcctgtgtaggcttg

SEQ ID NO: 281443 - DNA, 25 bp, Mus musculus
cttggccctggtggatcagaacaag

SEQ ID NO: 281444 - DNA, 25 bp, Mus musculus
cttggccgagcagcctgcgccagcc

SEQ ID NO: 281445 - DNA, 25 bp, Mus musculus
cttggcctattttggatttcagtga

SEQ ID NO: 281446 - DNA, 25 bp, Mus musculus
cttggcctattttggcaactccgaa

SEQ ID NO: 281447 - DNA, 25 bp, Mus musculus
cttggcctgtggtcaaaatccagtt

SEQ ID NO: 281448 - DNA, 25 bp, Mus musculus
cttggcctgttgggtcacttccctc

SEQ ID NO: 281449 - DNA, 25 bp, Mus musculus
cttggccttcagagctccagatacc

SEQ ID NO: 281450 - DNA, 25 bp, Mus musculus
cttggccttgatgaagaacaacgag

SEQ ID NO: 281451 - DNA, 25 bp, Mus musculus
cttggccttgatgaggagtgggaag

SEQ ID NO: 281452 - DNA, 25 bp, Mus musculus
cttggcctttacagagatgagcatc

SEQ ID NO: 281453 - DNA, 25 bp, Mus musculus
cttggcgaaaatcagatcaaagatg

SEQ ID NO: 281454 - DNA, 25 bp, Mus musculus
cttggcgattaaaggcctgaagctc

SEQ ID NO: 281455 - DNA, 25 bp, Mus musculus
cttggcgccaaaggggccaaggaga

SEQ ID NO: 281456 - DNA, 25 bp, Mus musculus
cttggcgcctgaggtgctagaggac

SEQ ID NO: 281457 - DNA, 25 bp, Mus musculus
cttggcgcggactggtatccggttg

SEQ ID NO: 281458 - DNA, 25 bp, Mus musculus
cttggcgttatgggtgtgataggta

SEQ ID NO: 281459 - DNA, 25 bp, Mus musculus
cttggcgttatgtttgagatggtat

SEQ ID NO: 281460 - DNA, 25 bp, Mus musculus
cttggcgttcaacaggtggtgtccg

SEQ ID NO: 281461 - DNA, 25 bp, Mus musculus
cttggctagcaggtattcatgctag

SEQ ID NO: 281462 - DNA, 25 bp, Mus musculus
cttggctagctgcacatccctacaa

SEQ ID NO: 281463 - DNA, 25 bp, Mus musculus
cttggctataaaaaatgccaggcag

SEQ ID NO: 281464 - DNA, 25 bp, Mus musculus
cttggctatggcatcttccactgct

SEQ ID NO: 281465 - DNA, 25 bp, Mus musculus
cttggctatgggagaggagagaaca

SEQ ID NO: 281466 - DNA, 25 bp, Mus musculus
cttggctatgggggcggggcccgag

SEQ ID NO: 281467 - DNA, 25 bp, Mus musculus
cttggctatttcaggctttgatggg

SEQ ID NO: 281468 - DNA, 25 bp, Mus musculus
cttggctcagaaatcctacgaacat

SEQ ID NO: 281469 - DNA, 25 bp, Mus musculus
cttggctcatcagcagttattcaaa

SEQ ID NO: 281470 - DNA, 25 bp, Mus musculus
cttggctcctactttctgcactggc

SEQ ID NO: 281471 - DNA, 25 bp, Mus musculus
cttggctcctgcctgaggagcgatg

SEQ ID NO: 281472 - DNA, 25 bp, Mus musculus
cttggctctgaagattgccctctat

SEQ ID NO: 281473 - DNA, 25 bp, Mus musculus
cttggctgaccacgatattttcaat

SEQ ID NO: 281474 - DNA, 25 bp, Mus musculus
cttggctgaccaggatattttcaat

SEQ ID NO: 281475 - DNA, 25 bp, Mus musculus
cttggctgcacagtgtatgagaagc

SEQ ID NO: 281476 - DNA, 25 bp, Mus musculus
cttggctgcagaggtagaccctgac

SEQ ID NO: 281477 - DNA, 25 bp, Mus musculus
cttggctgcagaggtggaccctgat

SEQ ID NO: 281478 - DNA, 25 bp, Mus musculus
cttggctgctcagctgcactgagct

SEQ ID NO: 281479 - DNA, 25 bp, Mus musculus
cttggctgctcagtgtttcctttca

SEQ ID NO: 281480 - DNA, 25 bp, Mus musculus
cttggctggcgtatgaggagtggga

SEQ ID NO: 281481 - DNA, 25 bp, Mus musculus
cttggctggcgtgaggccaaagcaa

SEQ ID NO: 281482 - DNA, 25 bp, Mus musculus
cttggcttcttcagcactggagacc

SEQ ID NO: 281483 - DNA, 25 bp, Mus musculus
cttggcttcttcaggactctttcat

SEQ ID NO: 281484 - DNA, 25 bp, Mus musculus
cttggcttgcagataaaaatatata

SEQ ID NO: 281485 - DNA, 25 bp, Mus musculus
cttggctttcagagacgagttacaa

SEQ ID NO: 281486 - DNA, 25 bp, Mus musculus
cttggctttggagctcctgatggtt

SEQ ID NO: 281487 - DNA, 25 bp, Mus musculus
cttggctttggaggtcggtgagctg

SEQ ID NO: 281488 - DNA, 25 bp, Mus musculus
cttggctttttaaaggaaggcatcc

SEQ ID NO: 281489 - DNA, 25 bp, Mus musculus
cttgggaaaaaattatgcttcagct

SEQ ID NO: 281490 - DNA, 25 bp, Mus musculus
cttgggaaaagactgtaatgaaacc

SEQ ID NO: 281491 - DNA, 25 bp, Mus musculus
cttgggaaacaagaaagacagagtc

SEQ ID NO: 281492 - DNA, 25 bp, Mus musculus
cttgggaacttcagacccagccacc

SEQ ID NO: 281493 - DNA, 25 bp, Mus musculus
cttgggaagagacaaagacatctta

SEQ ID NO: 281494 - DNA, 25 bp, Mus musculus
cttgggaagatgctgctctttggcg

SEQ ID NO: 281495 - DNA, 25 bp, Mus musculus
cttgggaagatgctggagacctagg

SEQ ID NO: 281496 - DNA, 25 bp, Mus musculus
cttgggaagatggctccttctccta

SEQ ID NO: 281497 - DNA, 25 bp, Mus musculus
cttgggaataggccctttggagacg

SEQ ID NO: 281498 - DNA, 25 bp, Mus musculus
cttgggaattgacaggcatcgcctc

SEQ ID NO: 281499 - DNA, 25 bp, Mus musculus
cttgggacaaaacgcaccctacctg

SEQ ID NO: 281500 - DNA, 25 bp, Mus musculus
cttgggacagcagatccatgcccgc

SEQ ID NO: 281501 - DNA, 25 bp, Mus musculus
cttgggacagcagggccgcctcagt

SEQ ID NO: 281502 - DNA, 25 bp, Mus musculus
cttgggactaccaggcctgtacgga

SEQ ID NO: 281503 - DNA, 25 bp, Mus musculus
cttgggagaagtatgcttccactga

SEQ ID NO: 281504 - DNA, 25 bp, Mus musculus
cttgggagaagtttcttctagtatg

SEQ ID NO: 281505 - DNA, 25 bp, Mus musculus
cttgggagagcgcattaaagaggaa

SEQ ID NO: 281506 - DNA, 25 bp, Mus musculus
cttgggagaggaagaagaaaggacc

SEQ ID NO: 281507 - DNA, 25 bp, Mus musculus
cttgggagccagccccagcagttgt

SEQ ID NO: 281508 - DNA, 25 bp, Mus musculus
cttgggaggagactgacaaaaccaa

SEQ ID NO: 281509 - DNA, 25 bp, Mus musculus
cttgggaggaggcttgaagatgcag

SEQ ID NO: 281510 - DNA, 25 bp, Mus musculus
cttgggaggctatggtcgtggtggt

SEQ ID NO: 281511 - DNA, 25 bp, Mus musculus
cttgggagggggggcctgctgtagg

SEQ ID NO: 281512 - DNA, 25 bp, Mus musculus
cttgggaggggtcatccttcgggct

SEQ ID NO: 281513 - DNA, 25 bp, Mus musculus
cttgggatctgggacactgaatgga

SEQ ID NO: 281514 - DNA, 25 bp, Mus musculus
cttgggatctttgctttctcatgag

SEQ ID NO: 281515 - DNA, 25 bp, Mus musculus
cttgggatggtgaaggagacaaaat

SEQ ID NO: 281516 - DNA, 25 bp, Mus musculus
cttgggcacgtaagagatgatgatg

SEQ ID NO: 281517 - DNA, 25 bp, Mus musculus
cttgggcagcgccagtggctccgcg

SEQ ID NO: 281518 - DNA, 25 bp, Mus musculus
cttgggcatgatccagagcaatgag

SEQ ID NO: 281519 - DNA, 25 bp, Mus musculus
cttgggcatgctttggtggccccaa

SEQ ID NO: 281520 - DNA, 25 bp, Mus musculus
cttgggccaacacctgaatctcctg

SEQ ID NO: 281521 - DNA, 25 bp, Mus musculus
cttgggccagagagctgggtttgat

SEQ ID NO: 281522 - DNA, 25 bp, Mus musculus
cttgggccagattgtgtcacaaacc

SEQ ID NO: 281523 - DNA, 25 bp, Mus musculus
cttgggccaggctgctgtagaaatt

SEQ ID NO: 281524 - DNA, 25 bp, Mus musculus
cttgggccccacaagatccgtgtga

SEQ ID NO: 281525 - DNA, 25 bp, Mus musculus
cttgggcccggcagaatggctcccg

SEQ ID NO: 281526 - DNA, 25 bp, Mus musculus
cttgggccgccttggcttcctttct

SEQ ID NO: 281527 - DNA, 25 bp, Mus musculus
cttgggcctgggcccatacccactg

SEQ ID NO: 281528 - DNA, 25 bp, Mus musculus
cttgggcctttgttcaagcacacaa

SEQ ID NO: 281529 - DNA, 25 bp, Mus musculus
cttgggcgcctccagaacagcatgt

SEQ ID NO: 281530 - DNA, 25 bp, Mus musculus
cttgggcgcctccaggaacacttct

SEQ ID NO: 281531 - DNA, 25 bp, Mus musculus
cttgggctatggagctggtgctgtc

SEQ ID NO: 281532 - DNA, 25 bp, Mus musculus
cttgggctatggagtcccaacagga

SEQ ID NO: 281533 - DNA, 25 bp, Mus musculus
cttgggcttgacgacaatggaggta

SEQ ID NO: 281534 - DNA, 25 bp, Mus musculus
cttgggcttgacgtgtccaacctgt

SEQ ID NO: 281535 - DNA, 25 bp, Mus musculus
cttgggcttgtattgaaaaagcttg

SEQ ID NO: 281536 - DNA, 25 bp, Mus musculus
cttgggcttttcaggtcacctagca

SEQ ID NO: 281537 - DNA, 25 bp, Mus musculus
cttggggaagcagatggagttccag

SEQ ID NO: 281538 - DNA, 25 bp, Mus musculus
cttggggaagcctgagatgggggtt

SEQ ID NO: 281539 - DNA, 25 bp, Mus musculus
cttggggaatctggagcaattcaac

SEQ ID NO: 281540 - DNA, 25 bp, Mus musculus
cttggggaatcttgctctttgatga

SEQ ID NO: 281541 - DNA, 25 bp, Mus musculus
cttggggacaggacctttgagcagc

SEQ ID NO: 281542 - DNA, 25 bp, Mus musculus
cttggggaccctagggctgtgcctg

SEQ ID NO: 281543 - DNA, 25 bp, Mus musculus
cttggggatatggtgaacttgacca

SEQ ID NO: 281544 - DNA, 25 bp, Mus musculus
cttggggatatggttgcctgtaatc

SEQ ID NO: 281545 - DNA, 25 bp, Mus musculus
cttggggcaagatcgacatgctaca

SEQ ID NO: 281546 - DNA, 25 bp, Mus musculus
cttggggcaaggtggatacgacgct

SEQ ID NO: 281547 - DNA, 25 bp, Mus musculus
cttggggccccacggatgctggtgg

SEQ ID NO: 281548 - DNA, 25 bp, Mus musculus
cttggggcgcagacatgtcttttct

SEQ ID NO: 281549 - DNA, 25 bp, Mus musculus
cttggggcgcaggacccaagtttct

SEQ ID NO: 281550 - DNA, 25 bp, Mus musculus
cttggggctccagagataaagctgc

SEQ ID NO: 281551 - DNA, 25 bp, Mus musculus
cttggggctccagagattatttgtc

SEQ ID NO: 281552 - DNA, 25 bp, Mus musculus
cttggggctcggatggtaaaacacc

SEQ ID NO: 281553 - DNA, 25 bp, Mus musculus
cttggggctcggcatctatattgga

SEQ ID NO: 281554 - DNA, 25 bp, Mus musculus
cttgggggagccatgacagtagctg

SEQ ID NO: 281555 - DNA, 25 bp, Mus musculus
cttggggtccaggtcgggatggtgg

SEQ ID NO: 281556 - DNA, 25 bp, Mus musculus
cttggggtttgcccagatgggggat

SEQ ID NO: 281557 - DNA, 25 bp, Mus musculus
cttgggtaagcagtggattctgtac

SEQ ID NO: 281558 - DNA, 25 bp, Mus musculus
cttgggtatatagcttgaagtcaat

SEQ ID NO: 281559 - DNA, 25 bp, Mus musculus
cttgggtcaaggtcgagtatgccta

SEQ ID NO: 281560 - DNA, 25 bp, Mus musculus
cttgggttcaagatcttggcaacca

SEQ ID NO: 281561 - DNA, 25 bp, Mus musculus
cttgggttgtaggcttctccagtgg

SEQ ID NO: 281562 - DNA, 25 bp, Mus musculus
cttggtaaatgatgtggcaccattc

SEQ ID NO: 281563 - DNA, 25 bp, Mus musculus
cttggtacaggcagcagttatgggc

SEQ ID NO: 281564 - DNA, 25 bp, Mus musculus
cttggtactgcatagtgggacacca

SEQ ID NO: 281565 - DNA, 25 bp, Mus musculus
cttggtactgctgcatgccctgaag

SEQ ID NO: 281566 - DNA, 25 bp, Mus musculus
cttggtactggtgaacaccatgtcc

SEQ ID NO: 281567 - DNA, 25 bp, Mus musculus
cttggtagcgtacattgcaaacatt

SEQ ID NO: 281568 - DNA, 25 bp, Mus musculus
cttggtatacaggaggataccagat

SEQ ID NO: 281569 - DNA, 25 bp, Mus musculus
cttggtatacaggagtacttatgtg

SEQ ID NO: 281570 - DNA, 25 bp, Mus musculus
cttggtatttggaatgcagaaacaa

SEQ ID NO: 281571 - DNA, 25 bp, Mus musculus
cttggtattttgaagtccctggatg

SEQ ID NO: 281572 - DNA, 25 bp, Mus musculus
cttggtatttttaggctgttcattt

SEQ ID NO: 281573 - DNA, 25 bp, Mus musculus
cttggtcaagaactgtactcttgat

SEQ ID NO: 281574 - DNA, 25 bp, Mus musculus
cttggtcaaggtacaactgtaactg

SEQ ID NO: 281575 - DNA, 25 bp, Mus musculus
cttggtcacacagggctcgcttgcc

SEQ ID NO: 281576 - DNA, 25 bp, Mus musculus
cttggtccaggaaaatggacaaagg

SEQ ID NO: 281577 - DNA, 25 bp, Mus musculus
cttggtccaggatctttctcaagtg

SEQ ID NO: 281578 - DNA, 25 bp, Mus musculus
cttggtccaggcaaacagggaggaa

SEQ ID NO: 281579 - DNA, 25 bp, Mus musculus
cttggtccaggtcatcccagtggtg

SEQ ID NO: 281580 - DNA, 25 bp, Mus musculus
cttggtccagtttcccttgtgggta

SEQ ID NO: 281581 - DNA, 25 bp, Mus musculus
cttggtcccagctgtgcagtgccta

SEQ ID NO: 281582 - DNA, 25 bp, Mus musculus
cttggtccggagaaacattcatgct

SEQ ID NO: 281583 - DNA, 25 bp, Mus musculus
cttggtcctaaggccctttttgctt

SEQ ID NO: 281584 - DNA, 25 bp, Mus musculus
cttggtcctcactgtgatgatccgg

SEQ ID NO: 281585 - DNA, 25 bp, Mus musculus
cttggtccttgaggatttcaaacaa

SEQ ID NO: 281586 - DNA, 25 bp, Mus musculus
cttggtccttgttccaccctccaag

SEQ ID NO: 281587 - DNA, 25 bp, Mus musculus
cttggtctccgaggagtatgtctcc

SEQ ID NO: 281588 - DNA, 25 bp, Mus musculus
cttggtctctgtgggagcttgcatt

SEQ ID NO: 281589 - DNA, 25 bp, Mus musculus
cttggtctctgtgggtggtaaatct

SEQ ID NO: 281590 - DNA, 25 bp, Mus musculus
cttggtctgagcaggactcggaacc

SEQ ID NO: 281591 - DNA, 25 bp, Mus musculus
cttggtctgctggacgcctttagaa

SEQ ID NO: 281592 - DNA, 25 bp, Mus musculus
cttggtctgctgggaagcggaacag

SEQ ID NO: 281593 - DNA, 25 bp, Mus musculus
cttggtgaataagtacaacaaagcc

SEQ ID NO: 281594 - DNA, 25 bp, Mus musculus
cttggtgacaaggtgaattcccttg

SEQ ID NO: 281595 - DNA, 25 bp, Mus musculus
cttggtgacaccttcaggtggaagg

SEQ ID NO: 281596 - DNA, 25 bp, Mus musculus
cttggtgacagacagtcttcacaca

SEQ ID NO: 281597 - DNA, 25 bp, Mus musculus
cttggtgagacccaggttcaactgg

SEQ ID NO: 281598 - DNA, 25 bp, Mus musculus
cttggtgatgagaggaagctttgtc

SEQ ID NO: 281599 - DNA, 25 bp, Mus musculus
cttggtgcagacaacatcgctgtca

SEQ ID NO: 281600 - DNA, 25 bp, Mus musculus
cttggtgcagggtttgtggtagtga

SEQ ID NO: 281601 - DNA, 25 bp, Mus musculus
cttggtgcggccagagagtcgatat

SEQ ID NO: 281602 - DNA, 25 bp, Mus musculus
cttggtggaggaaccagagtctatg

SEQ ID NO: 281603 - DNA, 25 bp, Mus musculus
cttggtggatggatgagtttcatcc

SEQ ID NO: 281604 - DNA, 25 bp, Mus musculus
cttggtggctggagccctcagctgt

SEQ ID NO: 281605 - DNA, 25 bp, Mus musculus
cttggtggtggagggggacgatttg

SEQ ID NO: 281606 - DNA, 25 bp, Mus musculus
cttggtggtgtgtcggagctccaac

SEQ ID NO: 281607 - DNA, 25 bp, Mus musculus
cttggtggttctccgttctgagcta

SEQ ID NO: 281608 - DNA, 25 bp, Mus musculus
cttggtgtctggatgatgcatccca

SEQ ID NO: 281609 - DNA, 25 bp, Mus musculus
cttggtgtggacacttcccgagtgg

SEQ ID NO: 281610 - DNA, 25 bp, Mus musculus
cttggtgtggatggtgcctgcaggc

SEQ ID NO: 281611 - DNA, 25 bp, Mus musculus
cttggtgtgggacgcccctaaagga

SEQ ID NO: 281612 - DNA, 25 bp, Mus musculus
cttggttatgaggaggatgttagag

SEQ ID NO: 281613 - DNA, 25 bp, Mus musculus
cttggttccagatgggtgtgtttta

SEQ ID NO: 281614 - DNA, 25 bp, Mus musculus
cttggttccagggtgactgactgag

SEQ ID NO: 281615 - DNA, 25 bp, Mus musculus
cttggttcggtacatgggctgtgtg

SEQ ID NO: 281616 - DNA, 25 bp, Mus musculus
cttggttctgcagaggaacagctgt

SEQ ID NO: 281617 - DNA, 25 bp, Mus musculus
cttggttgcagatttgcaatacata

SEQ ID NO: 281618 - DNA, 25 bp, Mus musculus
cttggttgcaggaagaccgagtagt

SEQ ID NO: 281619 - DNA, 25 bp, Mus musculus
cttggttgcaggtttgcaatacatt

SEQ ID NO: 281620 - DNA, 25 bp, Mus musculus
cttggttgggaagtggattataaat

SEQ ID NO: 281621 - DNA, 25 bp, Mus musculus
cttggttgttcaagttataggtaaa

SEQ ID NO: 281622 - DNA, 25 bp, Mus musculus
cttggttgttgaaggactcgggaca

SEQ ID NO: 281623 - DNA, 25 bp, Mus musculus
cttggtttcctccgcaccaccacca

SEQ ID NO: 281624 - DNA, 25 bp, Mus musculus
cttggttttaaggctgtctgatccc

SEQ ID NO: 281625 - DNA, 25 bp, Mus musculus
cttgtaaaaaggtatatcatgtata

SEQ ID NO: 281626 - DNA, 25 bp, Mus musculus
cttgtaaaatcagaggtccggaccg

SEQ ID NO: 281627 - DNA, 25 bp, Mus musculus
cttgtaaacatcagctgcgggcagc

SEQ ID NO: 281628 - DNA, 25 bp, Mus musculus
cttgtaacaagcttaaatccagtga

SEQ ID NO: 281629 - DNA, 25 bp, Mus musculus
cttgtaacaaggctgtgtctgcttc

SEQ ID NO: 281630 - DNA, 25 bp, Mus musculus
cttgtaacaaggtacactttttgtc

SEQ ID NO: 281631 - DNA, 25 bp, Mus musculus
cttgtaacgtaaggacaagatggca

SEQ ID NO: 281632 - DNA, 25 bp, Mus musculus
cttgtaagtaccgagtgctgctttt

SEQ ID NO: 281633 - DNA, 25 bp, Mus musculus
cttgtaataaagctgcgaagctggg

SEQ ID NO: 281634 - DNA, 25 bp, Mus musculus
cttgtaattcaggtgagcacctcct

SEQ ID NO: 281635 - DNA, 25 bp, Mus musculus
cttgtacaaaactgtgggaacctgg

SEQ ID NO: 281636 - DNA, 25 bp, Mus musculus
cttgtacaaaggtctctggtaagaa

SEQ ID NO: 281637 - DNA, 25 bp, Mus musculus
cttgtacaaaggttggtgttcagcc

SEQ ID NO: 281638 - DNA, 25 bp, Mus musculus
cttgtacaagcttcaaaaccgctat

SEQ ID NO: 281639 - DNA, 25 bp, Mus musculus
cttgtacaagtctgcagatggcctg

SEQ ID NO: 281640 - DNA, 25 bp, Mus musculus
cttgtacagcaggcaggcaaccttc

SEQ ID NO: 281641 - DNA, 25 bp, Mus musculus
cttgtacatggaggctttgctgagg

SEQ ID NO: 281642 - DNA, 25 bp, Mus musculus
cttgtaccaccggtaactaaatgac

SEQ ID NO: 281643 - DNA, 25 bp, Mus musculus
cttgtaccaccggtatccatgccag

SEQ ID NO: 281644 - DNA, 25 bp, Mus musculus
cttgtaccagagaactgaaaagctc

SEQ ID NO: 281645 - DNA, 25 bp, Mus musculus
cttgtactcagccagaagcaccccc

SEQ ID NO: 281646 - DNA, 25 bp, Mus musculus
cttgtagaaaagatggcagccttta

SEQ ID NO: 281647 - DNA, 25 bp, Mus musculus
cttgtagatgtggaatggacagacc

SEQ ID NO: 281648 - DNA, 25 bp, Mus musculus
cttgtagatgtggatgaaaagaatc

SEQ ID NO: 281649 - DNA, 25 bp, Mus musculus
cttgtagctgttctagtaagcagag

SEQ ID NO: 281650 - DNA, 25 bp, Mus musculus
cttgtaggtcagagtttttgtgccg

SEQ ID NO: 281651 - DNA, 25 bp, Mus musculus
cttgtagtagacccttaagccctct

SEQ ID NO: 281652 - DNA, 25 bp, Mus musculus
cttgtagtggctctggcatgctgag

SEQ ID NO: 281653 - DNA, 25 bp, Mus musculus
cttgtataaagtacactggacacta

SEQ ID NO: 281654 - DNA, 25 bp, Mus musculus
cttgtataagctggaaaacaggctt

SEQ ID NO: 281655 - DNA, 25 bp, Mus musculus
cttgtatacagaggagcattccggc

SEQ ID NO: 281656 - DNA, 25 bp, Mus musculus
cttgtatacttagacaaaagtcctc

SEQ ID NO: 281657 - DNA, 25 bp, Mus musculus
cttgtatgctagttcactttaattg

SEQ ID NO: 281658 - DNA, 25 bp, Mus musculus
cttgtattaaagatccaaaaggtaa

SEQ ID NO: 281659 - DNA, 25 bp, Mus musculus
cttgtattaaagggtatgatgtgat

SEQ ID NO: 281660 - DNA, 25 bp, Mus musculus
cttgtattaagatgggcgtatgtct

SEQ ID NO: 281661 - DNA, 25 bp, Mus musculus
cttgtcaaacccaaggtatggaaga

SEQ ID NO: 281662 - DNA, 25 bp, Mus musculus
cttgtcaaagatcgactgtgccgct

SEQ ID NO: 281663 - DNA, 25 bp, Mus musculus
cttgtcaaaggatggctccggtgag

SEQ ID NO: 281664 - DNA, 25 bp, Mus musculus
cttgtcaaaggatggtggtgtgcga

SEQ ID NO: 281665 - DNA, 25 bp, Mus musculus
cttgtcaaagtctacaaaataccca

SEQ ID NO: 281666 - DNA, 25 bp, Mus musculus
cttgtcaacaggaggagccatggga

SEQ ID NO: 281667 - DNA, 25 bp, Mus musculus
cttgtcaacagggtccaggtgcacg

SEQ ID NO: 281668 - DNA, 25 bp, Mus musculus
cttgtcaagaacagctggggaagtg

SEQ ID NO: 281669 - DNA, 25 bp, Mus musculus
cttgtcaagctcgaaccagcccctc

SEQ ID NO: 281670 - DNA, 25 bp, Mus musculus
cttgtcaagtggtgtgggcatattc

SEQ ID NO: 281671 - DNA, 25 bp, Mus musculus
cttgtcaataaggtaatgttagcag

SEQ ID NO: 281672 - DNA, 25 bp, Mus musculus
cttgtcaatgaggcagaattccacc

SEQ ID NO: 281673 - DNA, 25 bp, Mus musculus
cttgtcacaaaggaagttgttcaag

SEQ ID NO: 281674 - DNA, 25 bp, Mus musculus
cttgtcacaggggcgggacaggaaa

SEQ ID NO: 281675 - DNA, 25 bp, Mus musculus
cttgtcacagggggtgagaaccctg

SEQ ID NO: 281676 - DNA, 25 bp, Mus musculus
cttgtcacagggggtggaaagcttt

SEQ ID NO: 281677 - DNA, 25 bp, Mus musculus
cttgtcacaggtggtgagattgcct

SEQ ID NO: 281678 - DNA, 25 bp, Mus musculus
cttgtcagaacctggcaccaccgag

SEQ ID NO: 281679 - DNA, 25 bp, Mus musculus
cttgtcagagagaagaatgaaagta

SEQ ID NO: 281680 - DNA, 25 bp, Mus musculus
cttgtcaggggtgacacccctggat

SEQ ID NO: 281681 - DNA, 25 bp, Mus musculus
cttgtcaggttgtaggttatcttga

SEQ ID NO: 281682 - DNA, 25 bp, Mus musculus
cttgtcataaaaatatgacagatac

SEQ ID NO: 281683 - DNA, 25 bp, Mus musculus
cttgtcataaaagaaatgtacccca

SEQ ID NO: 281684 - DNA, 25 bp, Mus musculus
cttgtcataaaagatgggcgaacca

SEQ ID NO: 281685 - DNA, 25 bp, Mus musculus
cttgtcatctcccagggactgcgca

SEQ ID NO: 281686 - DNA, 25 bp, Mus musculus
cttgtcatctgagtcaacggttgca

SEQ ID NO: 281687 - DNA, 25 bp, Mus musculus
cttgtccaaacataggaattccagg

SEQ ID NO: 281688 - DNA, 25 bp, Mus musculus
cttgtccaaacatgactttctggga

SEQ ID NO: 281689 - DNA, 25 bp, Mus musculus
cttgtccatgcagtatgctgcctgg

SEQ ID NO: 281690 - DNA, 25 bp, Mus musculus
cttgtccatgcagtcccccagcctg

SEQ ID NO: 281691 - DNA, 25 bp, Mus musculus
cttgtccccaagccacagcccaact

SEQ ID NO: 281692 - DNA, 25 bp, Mus musculus
cttgtccccagcaagtcttctggct

SEQ ID NO: 281693 - DNA, 25 bp, Mus musculus
cttgtccccaggaggcccccaaggt

SEQ ID NO: 281694 - DNA, 25 bp, Mus musculus
cttgtcccccacgtgccccgagccc

SEQ ID NO: 281695 - DNA, 25 bp, Mus musculus
cttgtcccctgggagtgcttacttt

SEQ ID NO: 281696 - DNA, 25 bp, Mus musculus
cttgtcccgattctgtggacaggcc

SEQ ID NO: 281697 - DNA, 25 bp, Mus musculus
cttgtccctccccagcaatctactc

SEQ ID NO: 281698 - DNA, 25 bp, Mus musculus
cttgtccctccccaggaacattgac

SEQ ID NO: 281699 - DNA, 25 bp, Mus musculus
cttgtcctacaagcctggacaaact

SEQ ID NO: 281700 - DNA, 25 bp, Mus musculus
cttgtcctacaaggccctcgttgcc

SEQ ID NO: 281701 - DNA, 25 bp, Mus musculus
cttgtcctacctgctgattttctcc

SEQ ID NO: 281702 - DNA, 25 bp, Mus musculus
cttgtcctataacaggataacataa

SEQ ID NO: 281703 - DNA, 25 bp, Mus musculus
cttgtcctcagggagtgcctgcact

SEQ ID NO: 281704 - DNA, 25 bp, Mus musculus
cttgtcctctgcgagtggcagtgtg

SEQ ID NO: 281705 - DNA, 25 bp, Mus musculus
cttgtcctgtaaggtggtctgtgat

SEQ ID NO: 281706 - DNA, 25 bp, Mus musculus
cttgtcctgttgcagggccacaata

SEQ ID NO: 281707 - DNA, 25 bp, Mus musculus
cttgtccttaaaaggttatggcttt

SEQ ID NO: 281708 - DNA, 25 bp, Mus musculus
cttgtcgaaccacactaaacaagat

SEQ ID NO: 281709 - DNA, 25 bp, Mus musculus
cttgtcgtgacctctaaatgtggtc

SEQ ID NO: 281710 - DNA, 25 bp, Mus musculus
cttgtcgtggtcagaatttcaaagg

SEQ ID NO: 281711 - DNA, 25 bp, Mus musculus
cttgtcgttcgaggtaaaaagagaa

SEQ ID NO: 281712 - DNA, 25 bp, Mus musculus
cttgtctactcacagagagaaaaaa

SEQ ID NO: 281713 - DNA, 25 bp, Mus musculus
cttgtctactcacagagccccgtgg

SEQ ID NO: 281714 - DNA, 25 bp, Mus musculus
cttgtctagttcaggccagctgctg

SEQ ID NO: 281715 - DNA, 25 bp, Mus musculus
cttgtctcctcaaggcaccttgttg

SEQ ID NO: 281716 - DNA, 25 bp, Mus musculus
cttgtctctgcagaccgctcgggaa

SEQ ID NO: 281717 - DNA, 25 bp, Mus musculus
cttgtctctggcgtgggtgactgat

SEQ ID NO: 281718 - DNA, 25 bp, Mus musculus
cttgtctgaagcgaaggtgtccgag

SEQ ID NO: 281719 - DNA, 25 bp, Mus musculus
cttgtctgacttcggtcagccatgt

SEQ ID NO: 281720 - DNA, 25 bp, Mus musculus
cttgtctgagaggaaccattctctg

SEQ ID NO: 281721 - DNA, 25 bp, Mus musculus
cttgtctgagaggaacccttctctg

SEQ ID NO: 281722 - DNA, 25 bp, Mus musculus
cttgtctgagaggaagttttatctg

SEQ ID NO: 281723 - DNA, 25 bp, Mus musculus
cttgtctggggcttcaatgggggca

SEQ ID NO: 281724 - DNA, 25 bp, Mus musculus
cttgtgaaactataagcagcaaaga

SEQ ID NO: 281725 - DNA, 25 bp, Mus musculus
cttgtgaagaagggaagtgtgttta

SEQ ID NO: 281726 - DNA, 25 bp, Mus musculus
cttgtgaagaattccatcaatggaa

SEQ ID NO: 281727 - DNA, 25 bp, Mus musculus
cttgtgaaggaatctgattgccttc

SEQ ID NO: 281728 - DNA, 25 bp, Mus musculus
cttgtgaatggaggttggagaccta

SEQ ID NO: 281729 - DNA, 25 bp, Mus musculus
cttgtgaatgtgagagacctctcag

SEQ ID NO: 281730 - DNA, 25 bp, Mus musculus
cttgtgaatgtgaggcctcagtgag

SEQ ID NO: 281731 - DNA, 25 bp, Mus musculus
cttgtgacagagccctgcttcaaga

SEQ ID NO: 281732 - DNA, 25 bp, Mus musculus
cttgtgagaaccgagaaatggcaaa

SEQ ID NO: 281733 - DNA, 25 bp, Mus musculus
cttgtgagaagaaatggaaatgatc

SEQ ID NO: 281734 - DNA, 25 bp, Mus musculus
cttgtgagagggtctgcatttgcta

SEQ ID NO: 281735 - DNA, 25 bp, Mus musculus
cttgtgagcatgaggttgtctatta

SEQ ID NO: 281736 - DNA, 25 bp, Mus musculus
cttgtgagcatgagttggatataca

SEQ ID NO: 281737 - DNA, 25 bp, Mus musculus
cttgtgagttcgactgtgatttacc

SEQ ID NO: 281738 - DNA, 25 bp, Mus musculus
cttgtgatagggagttctgaggctc

SEQ ID NO: 281739 - DNA, 25 bp, Mus musculus
cttgtgatctagccagatcttctgg

SEQ ID NO: 281740 - DNA, 25 bp, Mus musculus
cttgtgatggtcaaggttgttccta

SEQ ID NO: 281741 - DNA, 25 bp, Mus musculus
cttgtgcaaactgggatggatctat

SEQ ID NO: 281742 - DNA, 25 bp, Mus musculus
cttgtgcatctccaggtcccacctg

SEQ ID NO: 281743 - DNA, 25 bp, Mus musculus
cttgtgcatgctggatctctcgtct

SEQ ID NO: 281744 - DNA, 25 bp, Mus musculus
cttgtgccagtctaatgcactaccg

SEQ ID NO: 281745 - DNA, 25 bp, Mus musculus
cttgtgctcaaacaggctctggaaa

SEQ ID NO: 281746 - DNA, 25 bp, Mus musculus
cttgtgctggaggtgtccaaagaca

SEQ ID NO: 281747 - DNA, 25 bp, Mus musculus
cttgtgcttaggacgggttcccgat

SEQ ID NO: 281748 - DNA, 25 bp, Mus musculus
cttgtgcttgctaggggtcatgata

SEQ ID NO: 281749 - DNA, 25 bp, Mus musculus
cttgtggaaaacaacaggtttacaa

SEQ ID NO: 281750 - DNA, 25 bp, Mus musculus
cttgtggaaaagaaacctcttcggt

SEQ ID NO: 281751 - DNA, 25 bp, Mus musculus
cttgtggaaaagaaccagcgggtcc

SEQ ID NO: 281752 - DNA, 25 bp, Mus musculus
cttgtggaaaagatattctcatgta

SEQ ID NO: 281753 - DNA, 25 bp, Mus musculus
cttgtggaaaagctgacaacgtatg

SEQ ID NO: 281754 - DNA, 25 bp, Mus musculus
cttgtggaaacagcactcatgaaca

SEQ ID NO: 281755 - DNA, 25 bp, Mus musculus
cttgtggaactgtaccttcactcaa

SEQ ID NO: 281756 - DNA, 25 bp, Mus musculus
cttgtggaagtgcggcttcttcaag

SEQ ID NO: 281757 - DNA, 25 bp, Mus musculus
cttgtggaagtgtgacttctttaag

SEQ ID NO: 281758 - DNA, 25 bp, Mus musculus
cttgtggagcgggtaatggatgact

SEQ ID NO: 281759 - DNA, 25 bp, Mus musculus
cttgtggatggcttcaagccaggtc

SEQ ID NO: 281760 - DNA, 25 bp, Mus musculus
cttgtggcagctatgggaaagagat

SEQ ID NO: 281761 - DNA, 25 bp, Mus musculus
cttgtggcgttaaactttctccaga

SEQ ID NO: 281762 - DNA, 25 bp, Mus musculus
cttgtggctgctcccgcaggctggc

SEQ ID NO: 281763 - DNA, 25 bp, Mus musculus
cttgtggctttgaccatccacgaaa

SEQ ID NO: 281764 - DNA, 25 bp, Mus musculus
cttgtggctttgagtctgacaagat

SEQ ID NO: 281765 - DNA, 25 bp, Mus musculus
cttgtgggaagctcccctattttcc

SEQ ID NO: 281766 - DNA, 25 bp, Mus musculus
cttgtgggaagggcatttgtgtact

SEQ ID NO: 281767 - DNA, 25 bp, Mus musculus
cttgtgggcagaagctgacgttttt

SEQ ID NO: 281768 - DNA, 25 bp, Mus musculus
cttgtgggtcctcggggcgagcgag

SEQ ID NO: 281769 - DNA, 25 bp, Mus musculus
cttgtggtaatcagggtaacacgca

SEQ ID NO: 281770 - DNA, 25 bp, Mus musculus
cttgtggtgctagacctgaactata

SEQ ID NO: 281771 - DNA, 25 bp, Mus musculus
cttgtggtgctgcatctacataaca

SEQ ID NO: 281772 - DNA, 25 bp, Mus musculus
cttgtggtggctcgattcctgtctc

SEQ ID NO: 281773 - DNA, 25 bp, Mus musculus
cttgtgtatatgctgtagaaaaccc

SEQ ID NO: 281774 - DNA, 25 bp, Mus musculus
cttgtgtattggcattggaggtgac

SEQ ID NO: 281775 - DNA, 25 bp, Mus musculus
cttgtgtcaaaagcctatgtcccca

SEQ ID NO: 281776 - DNA, 25 bp, Mus musculus
cttgtgtcaaaagggaagatggaag

SEQ ID NO: 281777 - DNA, 25 bp, Mus musculus
cttgtgtcaagggaaaagatgccgt

SEQ ID NO: 281778 - DNA, 25 bp, Mus musculus
cttgtgtcgggaatgtgtttctgat

SEQ ID NO: 281779 - DNA, 25 bp, Mus musculus
cttgtgtctgaaggtgcttcctgga

SEQ ID NO: 281780 - DNA, 25 bp, Mus musculus
cttgtgtggacgctcgaattatcaa

SEQ ID NO: 281781 - DNA, 25 bp, Mus musculus
cttgtgtgttgaggatgggagtcac

SEQ ID NO: 281782 - DNA, 25 bp, Mus musculus
cttgtgttccagaatggggaggtag

SEQ ID NO: 281783 - DNA, 25 bp, Mus musculus
cttgtgttccagggagatgctattt

SEQ ID NO: 281784 - DNA, 25 bp, Mus musculus
cttgtgttcctgggtcttgctgtct

SEQ ID NO: 281785 - DNA, 25 bp, Mus musculus
cttgtgttggcaagagagatgaaga

SEQ ID NO: 281786 - DNA, 25 bp, Mus musculus
cttgtgttggcaagaggccacagca

SEQ ID NO: 281787 - DNA, 25 bp, Mus musculus
cttgttaatacaaaagaagttattt

SEQ ID NO: 281788 - DNA, 25 bp, Mus musculus
cttgttacacaggttacaaccctgg

SEQ ID NO: 281789 - DNA, 25 bp, Mus musculus
cttgttacaggaagaacccccagca

SEQ ID NO: 281790 - DNA, 25 bp, Mus musculus
cttgttagaagtccctccgctccaa

SEQ ID NO: 281791 - DNA, 25 bp, Mus musculus
cttgttagtaagcacagtacagaag

SEQ ID NO: 281792 - DNA, 25 bp, Mus musculus
cttgttagtgaccagatggttcaga

SEQ ID NO: 281793 - DNA, 25 bp, Mus musculus
cttgttagtgaccagtaaaaggtac

SEQ ID NO: 281794 - DNA, 25 bp, Mus musculus
cttgttatcagttgaatctggaggc

SEQ ID NO: 281795 - DNA, 25 bp, Mus musculus
cttgttcaaaggaaatgccaccatg

SEQ ID NO: 281796 - DNA, 25 bp, Mus musculus
cttgttcaaagggaagtggctgact

SEQ ID NO: 281797 - DNA, 25 bp, Mus musculus
cttgttcaacagaacaagtaagaag

SEQ ID NO: 281798 - DNA, 25 bp, Mus musculus
cttgttcaacaggtttatggtcggc

SEQ ID NO: 281799 - DNA, 25 bp, Mus musculus
cttgttcaacagttgttggtcttga

SEQ ID NO: 281800 - DNA, 25 bp, Mus musculus
cttgttcactgtacctcatcaactt

SEQ ID NO: 281801 - DNA, 25 bp, Mus musculus
cttgttcagatactgaatgaatctg

SEQ ID NO: 281802 - DNA, 25 bp, Mus musculus
cttgttcagggtgacagaaggtgac

SEQ ID NO: 281803 - DNA, 25 bp, Mus musculus
cttgttcataaacttgttcaagcca

SEQ ID NO: 281804 - DNA, 25 bp, Mus musculus
cttgttccaagaagaacgttggtga

SEQ ID NO: 281805 - DNA, 25 bp, Mus musculus
cttgttccaagtatctccatacttt

SEQ ID NO: 281806 - DNA, 25 bp, Mus musculus
cttgttcgtgctgggtgatagcaca

SEQ ID NO: 281807 - DNA, 25 bp, Mus musculus
cttgttctctaaagggcctggggat

SEQ ID NO: 281808 - DNA, 25 bp, Mus musculus
cttgttctctaaagttacaaattat

SEQ ID NO: 281809 - DNA, 25 bp, Mus musculus
cttgttctgggggtggtggagttgt

SEQ ID NO: 281810 - DNA, 25 bp, Mus musculus
cttgttgaacaacagatgcagcgaa

SEQ ID NO: 281811 - DNA, 25 bp, Mus musculus
cttgttgatgcaaatgtgctagttg

SEQ ID NO: 281812 - DNA, 25 bp, Mus musculus
cttgttgcaaccctggaccctgtcc

SEQ ID NO: 281813 - DNA, 25 bp, Mus musculus
cttgttgccagaaagcagcagctgg

SEQ ID NO: 281814 - DNA, 25 bp, Mus musculus
cttgttgccaggtgaacagctgctt

SEQ ID NO: 281815 - DNA, 25 bp, Mus musculus
cttgttgcccagctggcatttttca

SEQ ID NO: 281816 - DNA, 25 bp, Mus musculus
cttgttggaggggactttcccaaat

SEQ ID NO: 281817 - DNA, 25 bp, Mus musculus
cttgttggcatcagaccacagcagt

SEQ ID NO: 281818 - DNA, 25 bp, Mus musculus
cttgttgtaccccaggcattgggca

SEQ ID NO: 281819 - DNA, 25 bp, Mus musculus
cttgttgttcaggtttatcatggct

SEQ ID NO: 281820 - DNA, 25 bp, Mus musculus
cttgttgttgagccaccttctcctg

SEQ ID NO: 281821 - DNA, 25 bp, Mus musculus
cttgttgttgaggcagcatattata

SEQ ID NO: 281822 - DNA, 25 bp, Mus musculus
cttgtttcaggaaatggctgcagtc

SEQ ID NO: 281823 - DNA, 25 bp, Mus musculus
cttgtttcaggacttcctccatcag

SEQ ID NO: 281824 - DNA, 25 bp, Mus musculus
cttgtttctgactctaaaacaacat

SEQ ID NO: 281825 - DNA, 25 bp, Mus musculus
cttgtttctggatccttgacactga

SEQ ID NO: 281826 - DNA, 25 bp, Mus musculus
cttgtttgaatggtaaatgatctga

SEQ ID NO: 281827 - DNA, 25 bp, Mus musculus
cttgtttgccagaatggaggatagg

SEQ ID NO: 281828 - DNA, 25 bp, Mus musculus
cttgtttgctgaagaccaaggactg

SEQ ID NO: 281829 - DNA, 25 bp, Mus musculus
cttgtttgtacaaagggcaatcctg

SEQ ID NO: 281830 - DNA, 25 bp, Mus musculus
cttgtttgtgcagggatcgcttaca

SEQ ID NO: 281831 - DNA, 25 bp, Mus musculus
cttgttttaaaaggtgtccagtgtg

SEQ ID NO: 281832 - DNA, 25 bp, Mus musculus
cttgttttaaatggggctctctaag

SEQ ID NO: 281833 - DNA, 25 bp, Mus musculus
cttgttttacagatggctcattgcg

SEQ ID NO: 281834 - DNA, 25 bp, Mus musculus
cttgttttacaggtgtgtgtggttt

SEQ ID NO: 281835 - DNA, 25 bp, Mus musculus
cttgttttctgtcaagacaccatga

SEQ ID NO: 281836 - DNA, 25 bp, Mus musculus
ctttaaaaaagccgagctggaattc

SEQ ID NO: 281837 - DNA, 25 bp, Mus musculus
ctttaaaacggctaggacttctctc

SEQ ID NO: 281838 - DNA, 25 bp, Mus musculus
ctttaaaagaagatccagtcctgca

SEQ ID NO: 281839 - DNA, 25 bp, Mus musculus
ctttaaacaagaggctcaagatgtg

SEQ ID NO: 281840 - DNA, 25 bp, Mus musculus
ctttaaacaaggggcgcagagaaga

SEQ ID NO: 281841 - DNA, 25 bp, Mus musculus
ctttaaacatggtaccgggtgctgc

SEQ ID NO: 281842 - DNA, 25 bp, Mus musculus
ctttaaacatgtacccctctatgac

SEQ ID NO: 281843 - DNA, 25 bp, Mus musculus
ctttaaactagcagggggaggagca

SEQ ID NO: 281844 - DNA, 25 bp, Mus musculus
ctttaaagaccaccagtcttgccag

SEQ ID NO: 281845 - DNA, 25 bp, Mus musculus
ctttaaagaccagcagtcttgccag

SEQ ID NO: 281846 - DNA, 25 bp, Mus musculus
ctttaaatatatttactggctccac

SEQ ID NO: 281847 - DNA, 25 bp, Mus musculus
ctttaaatgacaacaattgacatat

SEQ ID NO: 281848 - DNA, 25 bp, Mus musculus
ctttaaatgtacagtctaaatccag

SEQ ID NO: 281849 - DNA, 25 bp, Mus musculus
ctttaacaaggtaaataagctgaag

SEQ ID NO: 281850 - DNA, 25 bp, Mus musculus
ctttaacagatgacaggtctgagga

SEQ ID NO: 281851 - DNA, 25 bp, Mus musculus
ctttaacaggattccagtcttagca

SEQ ID NO: 281852 - DNA, 25 bp, Mus musculus
ctttaaccaacaacctccagagtct

SEQ ID NO: 281853 - DNA, 25 bp, Mus musculus
ctttaaccagcaagccccgcccaac

SEQ ID NO: 281854 - DNA, 25 bp, Mus musculus
ctttaacccaggtgactcatattct

SEQ ID NO: 281855 - DNA, 25 bp, Mus musculus
ctttaactaccaagcatctatattt

SEQ ID NO: 281856 - DNA, 25 bp, Mus musculus
ctttaactggaaagaatgtcttgat

SEQ ID NO: 281857 - DNA, 25 bp, Mus musculus
ctttaactggaaaggatataattga

SEQ ID NO: 281858 - DNA, 25 bp, Mus musculus
ctttaacttggggtgagtcagaatt

SEQ ID NO: 281859 - DNA, 25 bp, Mus musculus
ctttaactttgagaagaaccaaaga

SEQ ID NO: 281860 - DNA, 25 bp, Mus musculus
ctttaagaaaagcagccactggaga

SEQ ID NO: 281861 - DNA, 25 bp, Mus musculus
ctttaagaaagctggacctgggctg

SEQ ID NO: 281862 - DNA, 25 bp, Mus musculus
ctttaagaacaaggacaacatccac

SEQ ID NO: 281863 - DNA, 25 bp, Mus musculus
ctttaagaacaagtactgaaagtgc

SEQ ID NO: 281864 - DNA, 25 bp, Mus musculus
ctttaagaagacagagcacactcct

SEQ ID NO: 281865 - DNA, 25 bp, Mus musculus
ctttaagaagggctctgctaaggcc

SEQ ID NO: 281866 - DNA, 25 bp, Mus musculus
ctttaagaagtttgatgaaggccgc

SEQ ID NO: 281867 - DNA, 25 bp, Mus musculus
ctttaagcaggtgctgctggtgagt

SEQ ID NO: 281868 - DNA, 25 bp, Mus musculus
ctttaagccacgaggaaagcgtcat

SEQ ID NO: 281869 - DNA, 25 bp, Mus musculus
ctttaagctgggaggaagagacagc

SEQ ID NO: 281870 - DNA, 25 bp, Mus musculus
ctttaaggggagagctcctgctttc

SEQ ID NO: 281871 - DNA, 25 bp, Mus musculus
ctttaaggggagaggaagctttgtc

SEQ ID NO: 281872 - DNA, 25 bp, Mus musculus
ctttaatagtgaggtagaggaggct

SEQ ID NO: 281873 - DNA, 25 bp, Mus musculus
ctttaatatcagaagtttcagtctg

SEQ ID NO: 281874 - DNA, 25 bp, Mus musculus
ctttaatcaaagcaatggaagtacc

SEQ ID NO: 281875 - DNA, 25 bp, Mus musculus
ctttaatctgagaggccagtcacca

SEQ ID NO: 281876 - DNA, 25 bp, Mus musculus
ctttaatgatccagattatatcaga

SEQ ID NO: 281877 - DNA, 25 bp, Mus musculus
ctttaatgatccggaccttcgagaa

SEQ ID NO: 281878 - DNA, 25 bp, Mus musculus
ctttaatgatgaagatgcagataga

SEQ ID NO: 281879 - DNA, 25 bp, Mus musculus
ctttaatgctgaggccgggataact

SEQ ID NO: 281880 - DNA, 25 bp, Mus musculus
ctttaatgtagaaagattaatgggg

SEQ ID NO: 281881 - DNA, 25 bp, Mus musculus
ctttaattgacagattagctttatt

SEQ ID NO: 281882 - DNA, 25 bp, Mus musculus
ctttaattgctacctcaggctctga

SEQ ID NO: 281883 - DNA, 25 bp, Mus musculus
ctttaatttccgagtggacaagatt

SEQ ID NO: 281884 - DNA, 25 bp, Mus musculus
ctttacaagcccttgtcccagcaga

SEQ ID NO: 281885 - DNA, 25 bp, Mus musculus
ctttacaataagattacatctcgct

SEQ ID NO: 281886 - DNA, 25 bp, Mus musculus
ctttacacactgcagcaatgcacgg

SEQ ID NO: 281887 - DNA, 25 bp, Mus musculus
ctttacagaatggggagcgctctct

SEQ ID NO: 281888 - DNA, 25 bp, Mus musculus
ctttacagaatgtctgcggattata

SEQ ID NO: 281889 - DNA, 25 bp, Mus musculus
ctttacagaccagtgtgtgccatcc

SEQ ID NO: 281890 - DNA, 25 bp, Mus musculus
ctttacagcaaatgcaacaaatgac

SEQ ID NO: 281891 - DNA, 25 bp, Mus musculus
ctttacagcaagccttttctgatta

SEQ ID NO: 281892 - DNA, 25 bp, Mus musculus
ctttacagcaaggtgaataaatctg

SEQ ID NO: 281893 - DNA, 25 bp, Mus musculus
ctttacagcttcagaagggtcatgt

SEQ ID NO: 281894 - DNA, 25 bp, Mus musculus
ctttacagcttcagcagctctatgc

SEQ ID NO: 281895 - DNA, 25 bp, Mus musculus
ctttacaggcgagatgatttttgat

SEQ ID NO: 281896 - DNA, 25 bp, Mus musculus
ctttacagtctattaaaggttgcac

SEQ ID NO: 281897 - DNA, 25 bp, Mus musculus
ctttacagtctgttatcaagaaatc

SEQ ID NO: 281898 - DNA, 25 bp, Mus musculus
ctttacatatgcagacatcaagccc

SEQ ID NO: 281899 - DNA, 25 bp, Mus musculus
ctttacatatgcaggaatctccaca

SEQ ID NO: 281900 - DNA, 25 bp, Mus musculus
ctttacatggaaagatcagtactga

SEQ ID NO: 281901 - DNA, 25 bp, Mus musculus
ctttacatggaaagggatcagtaat

SEQ ID NO: 281902 - DNA, 25 bp, Mus musculus
ctttacatttaagacaaatgaagag

SEQ ID NO: 281903 - DNA, 25 bp, Mus musculus
ctttaccaagagctgggtcgacgag

SEQ ID NO: 281904 - DNA, 25 bp, Mus musculus
ctttaccaaggagctggagaaggtg

SEQ ID NO: 281905 - DNA, 25 bp, Mus musculus
ctttaccagcggcactcagtcccag

SEQ ID NO: 281906 - DNA, 25 bp, Mus musculus
ctttacccacgtttttgcagcttcg

SEQ ID NO: 281907 - DNA, 25 bp, Mus musculus
ctttacccagcctccatagactcgc

SEQ ID NO: 281908 - DNA, 25 bp, Mus musculus
ctttacccctacaggaaggcccagg

SEQ ID NO: 281909 - DNA, 25 bp, Mus musculus
ctttaccgagcaggacccttcatgt

SEQ ID NO: 281910 - DNA, 25 bp, Mus musculus
ctttaccgagcaggtcacggaagag

SEQ ID NO: 281911 - DNA, 25 bp, Mus musculus
ctttacctacaactgctgcttgtac

SEQ ID NO: 281912 - DNA, 25 bp, Mus musculus
ctttacctctctgcagaaagcctgc

SEQ ID NO: 281913 - DNA, 25 bp, Mus musculus
ctttacctcttcaggctctgtgttc

SEQ ID NO: 281914 - DNA, 25 bp, Mus musculus
ctttaccttgcaaagaatccaaaac

SEQ ID NO: 281915 - DNA, 25 bp, Mus musculus
ctttaccttgcaaaggagtggccgt

SEQ ID NO: 281916 - DNA, 25 bp, Mus musculus
ctttacgagcagagggagccaaatt

SEQ ID NO: 281917 - DNA, 25 bp, Mus musculus
ctttacgcagaagatgttggacaac

SEQ ID NO: 281918 - DNA, 25 bp, Mus musculus
ctttacgcaggcccagatgacacca

SEQ ID NO: 281919 - DNA, 25 bp, Mus musculus
ctttacgcagttcacacagaagatg

SEQ ID NO: 281920 - DNA, 25 bp, Mus musculus
ctttacgttactggttgcttctata

SEQ ID NO: 281921 - DNA, 25 bp, Mus musculus
ctttactatgcggagcaactgaaga

SEQ ID NO: 281922 - DNA, 25 bp, Mus musculus
ctttactatgctgagcagattaaga

SEQ ID NO: 281923 - DNA, 25 bp, Mus musculus
ctttactatgctgagggccaaggat

SEQ ID NO: 281924 - DNA, 25 bp, Mus musculus
ctttactccagacaaatcgccatca

SEQ ID NO: 281925 - DNA, 25 bp, Mus musculus
ctttactccagtgcctatgactccc

SEQ ID NO: 281926 - DNA, 25 bp, Mus musculus
ctttactcgccaggcaagcgcttcc

SEQ ID NO: 281927 - DNA, 25 bp, Mus musculus
ctttactctggactttggagactat

SEQ ID NO: 281928 - DNA, 25 bp, Mus musculus
ctttactgaatataagtaccatatt

SEQ ID NO: 281929 - DNA, 25 bp, Mus musculus
ctttactgacagcttttgcctacca

SEQ ID NO: 281930 - DNA, 25 bp, Mus musculus
ctttactgcccttggctctggtcag

SEQ ID NO: 281931 - DNA, 25 bp, Mus musculus
ctttactgttaacaggacattcgac

SEQ ID NO: 281932 - DNA, 25 bp, Mus musculus
ctttacttatccctgtcctctacag

SEQ ID NO: 281933 - DNA, 25 bp, Mus musculus
ctttacttcgcacaggtgcaggtgt

SEQ ID NO: 281934 - DNA, 25 bp, Mus musculus
ctttacttctgtggagtcaattgag

SEQ ID NO: 281935 - DNA, 25 bp, Mus musculus
ctttactttacaagattaatgccgc

SEQ ID NO: 281936 - DNA, 25 bp, Mus musculus
ctttactttacaagccccaagcatt

SEQ ID NO: 281937 - DNA, 25 bp, Mus musculus
ctttactttacaagcttcaacaaat

SEQ ID NO: 281938 - DNA, 25 bp, Mus musculus
ctttactttcaacatcaaagtggct

SEQ ID NO: 281939 - DNA, 25 bp, Mus musculus
ctttacttttggtatatcatgtata

SEQ ID NO: 281940 - DNA, 25 bp, Mus musculus
ctttagaaagaagcatgtctgctgt

SEQ ID NO: 281941 - DNA, 25 bp, Mus musculus
ctttagaaccagaagagccaccaac

SEQ ID NO: 281942 - DNA, 25 bp, Mus musculus
ctttagaaccagaagatgccatctc

SEQ ID NO: 281943 - DNA, 25 bp, Mus musculus
ctttagaaccagaaggagcaccgta

SEQ ID NO: 281944 - DNA, 25 bp, Mus musculus
ctttagaagaagtgctctggatgtt

SEQ ID NO: 281945 - DNA, 25 bp, Mus musculus
ctttagacccccgagaaaccagctc

SEQ ID NO: 281946 - DNA, 25 bp, Mus musculus
ctttagagatggtgaagaatttaag

SEQ ID NO: 281947 - DNA, 25 bp, Mus musculus
ctttagagcaggtttaaacgcatct

SEQ ID NO: 281948 - DNA, 25 bp, Mus musculus
ctttagagttttggtcccagcaaca

SEQ ID NO: 281949 - DNA, 25 bp, Mus musculus
ctttagatcttgggaacctggtggc

SEQ ID NO: 281950 - DNA, 25 bp, Mus musculus
ctttagattgtcccagttgtgacat

SEQ ID NO: 281951 - DNA, 25 bp, Mus musculus
ctttagcaactggagcactaaagcg

SEQ ID NO: 281952 - DNA, 25 bp, Mus musculus
ctttagcaagagcagtatataaaga

SEQ ID NO: 281953 - DNA, 25 bp, Mus musculus
ctttagcaagagcatggtcaatacc

SEQ ID NO: 281954 - DNA, 25 bp, Mus musculus
ctttagcaagcagtccatctcagtc

SEQ ID NO: 281955 - DNA, 25 bp, Mus musculus
ctttagcaaggcccgcggccatgcc

SEQ ID NO: 281956 - DNA, 25 bp, Mus musculus
ctttagcaccagttcctctttccac

SEQ ID NO: 281957 - DNA, 25 bp, Mus musculus
ctttagcattaaggaatcttgggaa

SEQ ID NO: 281958 - DNA, 25 bp, Mus musculus
ctttagcccagcaaggaacaccagt

SEQ ID NO: 281959 - DNA, 25 bp, Mus musculus
ctttagccccagtggatctaaagga

SEQ ID NO: 281960 - DNA, 25 bp, Mus musculus
ctttagcccgaggggaccctgttga

SEQ ID NO: 281961 - DNA, 25 bp, Mus musculus
ctttagctcggttttgtacaaagaa

SEQ ID NO: 281962 - DNA, 25 bp, Mus musculus
ctttaggagaagacataatgtcaag

SEQ ID NO: 281963 - DNA, 25 bp, Mus musculus
ctttaggagaaggttgtggagttct

SEQ ID NO: 281964 - DNA, 25 bp, Mus musculus
ctttaggagtccggtgagttggagt

SEQ ID NO: 281965 - DNA, 25 bp, Mus musculus
ctttaggcacaaggatactgagaac

SEQ ID NO: 281966 - DNA, 25 bp, Mus musculus
ctttagggaagaaagtgtctggact

SEQ ID NO: 281967 - DNA, 25 bp, Mus musculus
ctttaggtaaatgagatcatgattc

SEQ ID NO: 281968 - DNA, 25 bp, Mus musculus
ctttaggtcgctgatctgccaggat

SEQ ID NO: 281969 - DNA, 25 bp, Mus musculus
ctttaggtcgctgcacacagggcca

SEQ ID NO: 281970 - DNA, 25 bp, Mus musculus
ctttagtcccgatcatccaggtttg

SEQ ID NO: 281971 - DNA, 25 bp, Mus musculus
ctttagtcctcagaggccagttgtt

SEQ ID NO: 281972 - DNA, 25 bp, Mus musculus
ctttagtgataggctctctcctaaa

SEQ ID NO: 281973 - DNA, 25 bp, Mus musculus
ctttagtgatagggttcactgtggg

SEQ ID NO: 281974 - DNA, 25 bp, Mus musculus
ctttataaaaatctgctgtatcttg

SEQ ID NO: 281975 - DNA, 25 bp, Mus musculus
ctttataagcaaatgggggaagccc

SEQ ID NO: 281976 - DNA, 25 bp, Mus musculus
ctttataatgtgtctgacttcttcc

SEQ ID NO: 281977 - DNA, 25 bp, Mus musculus
ctttatacagaaagatgttggatcc

SEQ ID NO: 281978 - DNA, 25 bp, Mus musculus
ctttatacctggggttttgtatgaa

SEQ ID NO: 281979 - DNA, 25 bp, Mus musculus
ctttatagaggacaaggaatatgtg

SEQ ID NO: 281980 - DNA, 25 bp, Mus musculus
ctttatatatgaggtaccagctcta

SEQ ID NO: 281981 - DNA, 25 bp, Mus musculus
ctttatatccttttagtgttgggca

SEQ ID NO: 281982 - DNA, 25 bp, Mus musculus
ctttatcaaagtgatctcagcgccc

SEQ ID NO: 281983 - DNA, 25 bp, Mus musculus
ctttatcacccaaggttcagacaat

SEQ ID NO: 281984 - DNA, 25 bp, Mus musculus
ctttatcagaaagctgtcggtgacc

SEQ ID NO: 281985 - DNA, 25 bp, Mus musculus
ctttatcattttttcgtcacagatc

SEQ ID NO: 281986 - DNA, 25 bp, Mus musculus
ctttatccagtcgcccctcccagag

SEQ ID NO: 281987 - DNA, 25 bp, Mus musculus
ctttatccagtcgccttctccttgc

SEQ ID NO: 281988 - DNA, 25 bp, Mus musculus
ctttatcctctctggcctctctctt

SEQ ID NO: 281989 - DNA, 25 bp, Mus musculus
ctttatctcaaattctggaattgag

SEQ ID NO: 281990 - DNA, 25 bp, Mus musculus
ctttatctcacacgccggtggacat

SEQ ID NO: 281991 - DNA, 25 bp, Mus musculus
ctttatctcaggcttcctgcttttt

SEQ ID NO: 281992 - DNA, 25 bp, Mus musculus
ctttatctgtagtgcaaagtactac

SEQ ID NO: 281993 - DNA, 25 bp, Mus musculus
ctttatgaccctctggagatcttcc

SEQ ID NO: 281994 - DNA, 25 bp, Mus musculus
ctttatgcatcaacgctgtaagatg

SEQ ID NO: 281995 - DNA, 25 bp, Mus musculus
ctttatgggaagaattgcggcgagc

SEQ ID NO: 281996 - DNA, 25 bp, Mus musculus
ctttatgtcagtcagccccagcaag

SEQ ID NO: 281997 - DNA, 25 bp, Mus musculus
ctttatgtctgagggtttggaaata

SEQ ID NO: 281998 - DNA, 25 bp, Mus musculus
ctttatgtctgaggtatctcattta

SEQ ID NO: 281999 - DNA, 25 bp, Mus musculus
ctttattaagcatgtgaagtacaaa

SEQ ID NO: 282000 - DNA, 25 bp, Mus musculus
ctttattaagtacaaatcgaagtca

SEQ ID NO: 282001 - DNA, 25 bp, Mus musculus
ctttattacaaggaatcgcctgctt

SEQ ID NO: 282002 - DNA, 25 bp, Mus musculus
ctttattaccaagatgaacccccaa

SEQ ID NO: 282003 - DNA, 25 bp, Mus musculus
ctttattaccaagcataccacaaaa

SEQ ID NO: 282004 - DNA, 25 bp, Mus musculus
ctttattaccaaggtgctatatctg

SEQ ID NO: 282005 - DNA, 25 bp, Mus musculus
ctttattcagaagtaccgggctttc

SEQ ID NO: 282006 - DNA, 25 bp, Mus musculus
ctttattcaggagatgatttggtag

SEQ ID NO: 282007 - DNA, 25 bp, Mus musculus
ctttattctgtcaaccacagaagcc

SEQ ID NO: 282008 - DNA, 25 bp, Mus musculus
ctttatttcagggaaaacaggcagc

SEQ ID NO: 282009 - DNA, 25 bp, Mus musculus
ctttatttgtctgtctcttctcaca

SEQ ID NO: 282010 - DNA, 25 bp, Mus musculus
ctttcaaaaacaggatctgagtctt

SEQ ID NO: 282011 - DNA, 25 bp, Mus musculus
ctttcaaaaacaggtcagcccttct

SEQ ID NO: 282012 - DNA, 25 bp, Mus musculus
ctttcaaaaaccaagaatggattgt

SEQ ID NO: 282013 - DNA, 25 bp, Mus musculus
ctttcaaagtgaaacctccacatgg

SEQ ID NO: 282014 - DNA, 25 bp, Mus musculus
ctttcaacaaacgaactccaatgtg

SEQ ID NO: 282015 - DNA, 25 bp, Mus musculus
ctttcaaccctcaggaatccaaacg

SEQ ID NO: 282016 - DNA, 25 bp, Mus musculus
ctttcaacttcagagctgtgcctga

SEQ ID NO: 282017 - DNA, 25 bp, Mus musculus
ctttcaacttcaggagcctttggag

SEQ ID NO: 282018 - DNA, 25 bp, Mus musculus
ctttcaagccgtaattgctggcttt

SEQ ID NO: 282019 - DNA, 25 bp, Mus musculus
ctttcaagctcctgctgaaccactc

SEQ ID NO: 282020 - DNA, 25 bp, Mus musculus
ctttcaatcctctagactttgagag

SEQ ID NO: 282021 - DNA, 25 bp, Mus musculus
ctttcaatcctctagttttgacctg

SEQ ID NO: 282022 - DNA, 25 bp, Mus musculus
ctttcaatggagagccgtgcagcgt

SEQ ID NO: 282023 - DNA, 25 bp, Mus musculus
ctttcacaagaggctccataggaat

SEQ ID NO: 282024 - DNA, 25 bp, Mus musculus
ctttcacacggcaagtactgaacct

SEQ ID NO: 282025 - DNA, 25 bp, Mus musculus
ctttcacagaaggagacattctgga

SEQ ID NO: 282026 - DNA, 25 bp, Mus musculus
ctttcacatttcaagttcatggcat

SEQ ID NO: 282027 - DNA, 25 bp, Mus musculus
ctttcaccaaaaagggaactacaag

SEQ ID NO: 282028 - DNA, 25 bp, Mus musculus
ctttcaccaaaggattctaaccaca

SEQ ID NO: 282029 - DNA, 25 bp, Mus musculus
ctttcaccaaaggtcctggcatggg

SEQ ID NO: 282030 - DNA, 25 bp, Mus musculus
ctttcaccaaccaatcaaagttgtt

SEQ ID NO: 282031 - DNA, 25 bp, Mus musculus
ctttcaccaagtgtggattcgcagg

SEQ ID NO: 282032 - DNA, 25 bp, Mus musculus
ctttcaccaccatcatttttgatga

SEQ ID NO: 282033 - DNA, 25 bp, Mus musculus
ctttcaccagggaagacagtgaccc

SEQ ID NO: 282034 - DNA, 25 bp, Mus musculus
ctttcaccgccgctttgacctcgaa

SEQ ID NO: 282035 - DNA, 25 bp, Mus musculus
ctttcacttaaggtccttcagacca

SEQ ID NO: 282036 - DNA, 25 bp, Mus musculus
ctttcacttaggaatgtgactctga

SEQ ID NO: 282037 - DNA, 25 bp, Mus musculus
ctttcagaagaatatgacagatacc

SEQ ID NO: 282038 - DNA, 25 bp, Mus musculus
ctttcagaagttctatgcaagaatg

SEQ ID NO: 282039 - DNA, 25 bp, Mus musculus
ctttcagaccaggcagcgagtacta

SEQ ID NO: 282040 - DNA, 25 bp, Mus musculus
ctttcagactaaggtggacttcacc

SEQ ID NO: 282041 - DNA, 25 bp, Mus musculus
ctttcagagttaacaaacatgatca

SEQ ID NO: 282042 - DNA, 25 bp, Mus musculus
ctttcagagttaacaggtggctgga

SEQ ID NO: 282043 - DNA, 25 bp, Mus musculus
ctttcagatacataccaaggagggt

SEQ ID NO: 282044 - DNA, 25 bp, Mus musculus
ctttcagatgagggaaagcactgcc

SEQ ID NO: 282045 - DNA, 25 bp, Mus musculus
ctttcagatggtgatatacatggga

SEQ ID NO: 282046 - DNA, 25 bp, Mus musculus
ctttcagcagtcagcatcaggggcg

SEQ ID NO: 282047 - DNA, 25 bp, Mus musculus
ctttcagcatagtctccattcagaa

SEQ ID NO: 282048 - DNA, 25 bp, Mus musculus
ctttcagccagaccatagtcctgct

SEQ ID NO: 282049 - DNA, 25 bp, Mus musculus
ctttcagccagagatcaccagaagc

SEQ ID NO: 282050 - DNA, 25 bp, Mus musculus
ctttcagccagagggggcttttaca

SEQ ID NO: 282051 - DNA, 25 bp, Mus musculus
ctttcagccagtgctccacctggtg

SEQ ID NO: 282052 - DNA, 25 bp, Mus musculus
ctttcagccccagctctcgggacag

SEQ ID NO: 282053 - DNA, 25 bp, Mus musculus
ctttcagccgatcaacttctgagac

SEQ ID NO: 282054 - DNA, 25 bp, Mus musculus
ctttcagctgctgggactccgaggt

SEQ ID NO: 282055 - DNA, 25 bp, Mus musculus
ctttcagcttggtgctgttaaaggg

SEQ ID NO: 282056 - DNA, 25 bp, Mus musculus
ctttcaggcccgcacaggcgcacag

SEQ ID NO: 282057 - DNA, 25 bp, Mus musculus
ctttcaggtattcatgtgatggaag

SEQ ID NO: 282058 - DNA, 25 bp, Mus musculus
ctttcagtaggagtgtgacttggaa

SEQ ID NO: 282059 - DNA, 25 bp, Mus musculus
ctttcagtgggtggtgatagtgacc

SEQ ID NO: 282060 - DNA, 25 bp, Mus musculus
ctttcataagattcggctcctttga

SEQ ID NO: 282061 - DNA, 25 bp, Mus musculus
ctttcatacagcacgcatttgatgg

SEQ ID NO: 282062 - DNA, 25 bp, Mus musculus
ctttcatagctccagtgacccaccg

SEQ ID NO: 282063 - DNA, 25 bp, Mus musculus
ctttcatcaagcctggtacttgcta

SEQ ID NO: 282064 - DNA, 25 bp, Mus musculus
ctttcatcgacaaagacaacactgc

SEQ ID NO: 282065 - DNA, 25 bp, Mus musculus
ctttcatctcagatgtggtgaacga

SEQ ID NO: 282066 - DNA, 25 bp, Mus musculus
ctttcatcttccaattctcctctgg

SEQ ID NO: 282067 - DNA, 25 bp, Mus musculus
ctttcatcttttggatcactggtgt

SEQ ID NO: 282068 - DNA, 25 bp, Mus musculus
ctttcatgacaccaggacttcctcc

SEQ ID NO: 282069 - DNA, 25 bp, Mus musculus
ctttcatgattatagtgcagcagct

SEQ ID NO: 282070 - DNA, 25 bp, Mus musculus
ctttcatgccaaaggcctctggctg

SEQ ID NO: 282071 - DNA, 25 bp, Mus musculus
ctttcatgccaaaggtcagttcacc

SEQ ID NO: 282072 - DNA, 25 bp, Mus musculus
ctttcatgccaccctctgcctccca

SEQ ID NO: 282073 - DNA, 25 bp, Mus musculus
ctttcatgctaggcaatggtcactc

SEQ ID NO: 282074 - DNA, 25 bp, Mus musculus
ctttcatgtagtgaggacagtagaa

SEQ ID NO: 282075 - DNA, 25 bp, Mus musculus
ctttcattggtgctgtccccggcat

SEQ ID NO: 282076 - DNA, 25 bp, Mus musculus
ctttcatttactgatgggagtcaca

SEQ ID NO: 282077 - DNA, 25 bp, Mus musculus
ctttcatttactttgtggccttttt

SEQ ID NO: 282078 - DNA, 25 bp, Mus musculus
ctttccaaaagcaactgctttgctc

SEQ ID NO: 282079 - DNA, 25 bp, Mus musculus
ctttccaaaagctcctgggacctga

SEQ ID NO: 282080 - DNA, 25 bp, Mus musculus
ctttccaaaggagttgaagcagaag

SEQ ID NO: 282081 - DNA, 25 bp, Mus musculus
ctttccaaatggacctgaggtgcag

SEQ ID NO: 282082 - DNA, 25 bp, Mus musculus
ctttccaaatgtgacgagaagaacg

SEQ ID NO: 282083 - DNA, 25 bp, Mus musculus
ctttccaacaaagcctacacaggtg

SEQ ID NO: 282084 - DNA, 25 bp, Mus musculus
ctttccaacaacctgcatcataagg

SEQ ID NO: 282085 - DNA, 25 bp, Mus musculus
ctttccaacagagcttaccaaatgc

SEQ ID NO: 282086 - DNA, 25 bp, Mus musculus
ctttccaacagagggagacgatgga

SEQ ID NO: 282087 - DNA, 25 bp, Mus musculus
ctttccaaccagctggctgaagcca

SEQ ID NO: 282088 - DNA, 25 bp, Mus musculus
ctttccaagctgttgagcaagcacc

SEQ ID NO: 282089 - DNA, 25 bp, Mus musculus
ctttccacagagcctttgatatggt

SEQ ID NO: 282090 - DNA, 25 bp, Mus musculus
ctttccacagagctctggagaccct

SEQ ID NO: 282091 - DNA, 25 bp, Mus musculus
ctttccacagcacggagctcgaaga

SEQ ID NO: 282092 - DNA, 25 bp, Mus musculus
ctttccacatgtctgccaggaactt

SEQ ID NO: 282093 - DNA, 25 bp, Mus musculus
ctttccaccgaaggtttctctgtag

SEQ ID NO: 282094 - DNA, 25 bp, Mus musculus
ctttccacctgtgggtccttgctgc

SEQ ID NO: 282095 - DNA, 25 bp, Mus musculus
ctttccactgctctggctcgacttc

SEQ ID NO: 282096 - DNA, 25 bp, Mus musculus
ctttccactgcttaggctcgacttc

SEQ ID NO: 282097 - DNA, 25 bp, Mus musculus
ctttccactttcaggaccatggtat

SEQ ID NO: 282098 - DNA, 25 bp, Mus musculus
ctttccagacccagcatgtagtcag

SEQ ID NO: 282099 - DNA, 25 bp, Mus musculus
ctttccagaggcggccagcaggtgg

SEQ ID NO: 282100 - DNA, 25 bp, Mus musculus
ctttccagctttgagatggctatga

SEQ ID NO: 282101 - DNA, 25 bp, Mus musculus
ctttccaggctacaggagatcgctc

SEQ ID NO: 282102 - DNA, 25 bp, Mus musculus
ctttccattgagttcctccgcaaca

SEQ ID NO: 282103 - DNA, 25 bp, Mus musculus
ctttcccagctcacttcttccccgt

SEQ ID NO: 282104 - DNA, 25 bp, Mus musculus
ctttcccaggacgatagccagccct

SEQ ID NO: 282105 - DNA, 25 bp, Mus musculus
ctttcccaggacggctactggcagg

SEQ ID NO: 282106 - DNA, 25 bp, Mus musculus
ctttcccatccagctggtgaagaca

SEQ ID NO: 282107 - DNA, 25 bp, Mus musculus
ctttcccatgggtcactgcccagcc

SEQ ID NO: 282108 - DNA, 25 bp, Mus musculus
ctttccccagagcccgactctgagg

SEQ ID NO: 282109 - DNA, 25 bp, Mus musculus
ctttccccaggcccggagcattctt

SEQ ID NO: 282110 - DNA, 25 bp, Mus musculus
ctttccccaggccctccatgatgaa

SEQ ID NO: 282111 - DNA, 25 bp, Mus musculus
ctttcccgagacttcccaagaaaga

SEQ ID NO: 282112 - DNA, 25 bp, Mus musculus
ctttcccgagggagcacgggtctgg

SEQ ID NO: 282113 - DNA, 25 bp, Mus musculus
ctttcccgaggtgttcacctacaag

SEQ ID NO: 282114 - DNA, 25 bp, Mus musculus
ctttccctaacatcgagaaggtgtc

SEQ ID NO: 282115 - DNA, 25 bp, Mus musculus
ctttccctaccttcaacaggactgg

SEQ ID NO: 282116 - DNA, 25 bp, Mus musculus
ctttccctcagagccagcccaggct

SEQ ID NO: 282117 - DNA, 25 bp, Mus musculus
ctttccctcagcagacacgcacccc

SEQ ID NO: 282118 - DNA, 25 bp, Mus musculus
ctttccgaagtctggggctatggat

SEQ ID NO: 282119 - DNA, 25 bp, Mus musculus
ctttccgatacgttctggacccttc

SEQ ID NO: 282120 - DNA, 25 bp, Mus musculus
ctttccgcaaggccctttatgggac

SEQ ID NO: 282121 - DNA, 25 bp, Mus musculus
ctttccgcgacagagactaggcctg

SEQ ID NO: 282122 - DNA, 25 bp, Mus musculus
ctttccgcgacaggcaggagactga

SEQ ID NO: 282123 - DNA, 25 bp, Mus musculus
ctttccgcgacaggggtccctccaa

SEQ ID NO: 282124 - DNA, 25 bp, Mus musculus
ctttccgcgacaggtcagggtattt

SEQ ID NO: 282125 - DNA, 25 bp, Mus musculus
ctttccggaaatggcactgttttta

SEQ ID NO: 282126 - DNA, 25 bp, Mus musculus
ctttccggaaatgtgagcgggagaa

SEQ ID NO: 282127 - DNA, 25 bp, Mus musculus
ctttccggaagattcatcgcagagt

SEQ ID NO: 282128 - DNA, 25 bp, Mus musculus
ctttccggcgagggctgtaaaaaat

SEQ ID NO: 282129 - DNA, 25 bp, Mus musculus
ctttccggttctcatcaagatcaat

SEQ ID NO: 282130 - DNA, 25 bp, Mus musculus
ctttccggttctcatgctcctgtgg

SEQ ID NO: 282131 - DNA, 25 bp, Mus musculus
ctttcctaaattctctgcccttctg

SEQ ID NO: 282132 - DNA, 25 bp, Mus musculus
ctttcctaacgctgctgcatttttt

SEQ ID NO: 282133 - DNA, 25 bp, Mus musculus
ctttcctaagaaccaagacaactat

SEQ ID NO: 282134 - DNA, 25 bp, Mus musculus
ctttcctactggctggacccatgag

SEQ ID NO: 282135 - DNA, 25 bp, Mus musculus
ctttcctaggacagggcttcgcctc

SEQ ID NO: 282136 - DNA, 25 bp, Mus musculus
ctttcctatggatttggccatggag

SEQ ID NO: 282137 - DNA, 25 bp, Mus musculus
ctttcctcagatttcctccctcctc

SEQ ID NO: 282138 - DNA, 25 bp, Mus musculus
ctttcctcaggacccctcatgcctc

SEQ ID NO: 282139 - DNA, 25 bp, Mus musculus
ctttcctccaacaaatgcagaaccc

SEQ ID NO: 282140 - DNA, 25 bp, Mus musculus
ctttcctcccaagattcccgtgggg

SEQ ID NO: 282141 - DNA, 25 bp, Mus musculus
ctttcctcctaaagaacagagcctg

SEQ ID NO: 282142 - DNA, 25 bp, Mus musculus
ctttcctcctaaagccgagcgccag

SEQ ID NO: 282143 - DNA, 25 bp, Mus musculus
ctttcctcctgccagacttggcagc

SEQ ID NO: 282144 - DNA, 25 bp, Mus musculus
ctttcctcctgccaggttttttcct

SEQ ID NO: 282145 - DNA, 25 bp, Mus musculus
ctttcctctctgacttcctctttgc

SEQ ID NO: 282146 - DNA, 25 bp, Mus musculus
ctttcctgaaggaggtactgtctga

SEQ ID NO: 282147 - DNA, 25 bp, Mus musculus
ctttcctgaggagcggcggcatgga

SEQ ID NO: 282148 - DNA, 25 bp, Mus musculus
ctttcctgcaagcatttgacattgt

SEQ ID NO: 282149 - DNA, 25 bp, Mus musculus
ctttcctgcagtatcaggagtgcga

SEQ ID NO: 282150 - DNA, 25 bp, Mus musculus
ctttcctgcctgacctggagctgca

SEQ ID NO: 282151 - DNA, 25 bp, Mus musculus
ctttcctggaaaattgttgtgtctg

SEQ ID NO: 282152 - DNA, 25 bp, Mus musculus
ctttcctggaacaggtgacatgtat

SEQ ID NO: 282153 - DNA, 25 bp, Mus musculus
ctttcctggagtaggtgacatgtat

SEQ ID NO: 282154 - DNA, 25 bp, Mus musculus
ctttcctggcacagaaacatcatcc

SEQ ID NO: 282155 - DNA, 25 bp, Mus musculus
ctttcctggcacagcaagcttccct

SEQ ID NO: 282156 - DNA, 25 bp, Mus musculus
ctttcctggctgaggtactttctga

SEQ ID NO: 282157 - DNA, 25 bp, Mus musculus
ctttcctggggatgggagtgagtgc

SEQ ID NO: 282158 - DNA, 25 bp, Mus musculus
ctttccttcggacgctgaacccaaa

SEQ ID NO: 282159 - DNA, 25 bp, Mus musculus
ctttcctttcaggcctcagggctgg

SEQ ID NO: 282160 - DNA, 25 bp, Mus musculus
ctttcctttgactgtggcagccaca

SEQ ID NO: 282161 - DNA, 25 bp, Mus musculus
ctttcctttgggtattcccatctgt

SEQ ID NO: 282162 - DNA, 25 bp, Mus musculus
ctttcgaaagaaagatcttcctcag

SEQ ID NO: 282163 - DNA, 25 bp, Mus musculus
ctttcgaaagaaagctgattcaagc

SEQ ID NO: 282164 - DNA, 25 bp, Mus musculus
ctttcgacacgccggagtctgaggg

SEQ ID NO: 282165 - DNA, 25 bp, Mus musculus
ctttcgacccgaggactatctccag

SEQ ID NO: 282166 - DNA, 25 bp, Mus musculus
ctttcgagagggagaatcccgtatc

SEQ ID NO: 282167 - DNA, 25 bp, Mus musculus
ctttcgaggagaaaattctatagcc

SEQ ID NO: 282168 - DNA, 25 bp, Mus musculus
ctttcgatgacgattgtggtgggtt

SEQ ID NO: 282169 - DNA, 25 bp, Mus musculus
ctttcgatttgcgatcttctgccta

SEQ ID NO: 282170 - DNA, 25 bp, Mus musculus
ctttcgatttgctttgtccatacgt

SEQ ID NO: 282171 - DNA, 25 bp, Mus musculus
ctttcgctgaagagcatccgtgcag

SEQ ID NO: 282172 - DNA, 25 bp, Mus musculus
ctttcgcttgcaggcctacagggtg

SEQ ID NO: 282173 - DNA, 25 bp, Mus musculus
ctttcggaagaggagggagaatccc

SEQ ID NO: 282174 - DNA, 25 bp, Mus musculus
ctttcggctaagaaccaaaaatcac

SEQ ID NO: 282175 - DNA, 25 bp, Mus musculus
ctttcggctctgcggggcgcctctg

SEQ ID NO: 282176 - DNA, 25 bp, Mus musculus
ctttcggtccaagaggtcctccagg

SEQ ID NO: 282177 - DNA, 25 bp, Mus musculus
ctttcgtatacaaggaattttctcg

SEQ ID NO: 282178 - DNA, 25 bp, Mus musculus
ctttcgtatacaagttccctctagg

SEQ ID NO: 282179 - DNA, 25 bp, Mus musculus
ctttcgtgaaggatgttttatttcc

SEQ ID NO: 282180 - DNA, 25 bp, Mus musculus
ctttctaaacagggaacagcagtgc

SEQ ID NO: 282181 - DNA, 25 bp, Mus musculus
ctttctaaatgaacttcagtaactt

SEQ ID NO: 282182 - DNA, 25 bp, Mus musculus
ctttctaacagagaagaatatcaag

SEQ ID NO: 282183 - DNA, 25 bp, Mus musculus
ctttctaatagcagcgtccccatgg

SEQ ID NO: 282184 - DNA, 25 bp, Mus musculus
ctttctacaacaggccattctttgc

SEQ ID NO: 282185 - DNA, 25 bp, Mus musculus
ctttctacaacagggcatccgtccc

SEQ ID NO: 282186 - DNA, 25 bp, Mus musculus
ctttctacaagactatggcgacaag

SEQ ID NO: 282187 - DNA, 25 bp, Mus musculus
ctttctacaaggtcatggaggcctt

SEQ ID NO: 282188 - DNA, 25 bp, Mus musculus
ctttctacaaggtcattcccaaaag

SEQ ID NO: 282189 - DNA, 25 bp, Mus musculus
ctttctacaagtctcgcctgctgct

SEQ ID NO: 282190 - DNA, 25 bp, Mus musculus
ctttctacaggccaactgccaattt

SEQ ID NO: 282191 - DNA, 25 bp, Mus musculus
ctttctactcaggaactgctgaaga

SEQ ID NO: 282192 - DNA, 25 bp, Mus musculus
ctttctactctgtctgaagaagagc

SEQ ID NO: 282193 - DNA, 25 bp, Mus musculus
ctttctactttctgctttcatctcc

SEQ ID NO: 282194 - DNA, 25 bp, Mus musculus
ctttctatagagctgggctcgtcga

SEQ ID NO: 282195 - DNA, 25 bp, Mus musculus
ctttctataggtatggggactgctt

SEQ ID NO: 282196 - DNA, 25 bp, Mus musculus
ctttctatccccaaacaggagactt

SEQ ID NO: 282197 - DNA, 25 bp, Mus musculus
ctttctcagtcagggtgacaaggga

SEQ ID NO: 282198 - DNA, 25 bp, Mus musculus
ctttctcataggtggaattgggctt

SEQ ID NO: 282199 - DNA, 25 bp, Mus musculus
ctttctcattaaggtaaatgaccgt

SEQ ID NO: 282200 - DNA, 25 bp, Mus musculus
ctttctccaagatggcctagactgc

SEQ ID NO: 282201 - DNA, 25 bp, Mus musculus
ctttctccaaggtggcctagactgc

SEQ ID NO: 282202 - DNA, 25 bp, Mus musculus
ctttctcccaggtgctcaccattgc

SEQ ID NO: 282203 - DNA, 25 bp, Mus musculus
ctttctcgacctttgaatgatagag

SEQ ID NO: 282204 - DNA, 25 bp, Mus musculus
ctttctcgttcagaatgtcataccc

SEQ ID NO: 282205 - DNA, 25 bp, Mus musculus
ctttctctacacaggaaatccacct

SEQ ID NO: 282206 - DNA, 25 bp, Mus musculus
ctttctctacacaggctgacaagaa

SEQ ID NO: 282207 - DNA, 25 bp, Mus musculus
ctttctctagatagggtgagcgtgg

SEQ ID NO: 282208 - DNA, 25 bp, Mus musculus
ctttctctagcttttcctatgatga

SEQ ID NO: 282209 - DNA, 25 bp, Mus musculus
ctttctctcagcagattccaaaggc

SEQ ID NO: 282210 - DNA, 25 bp, Mus musculus
ctttctctcagcaggccttgagcct

SEQ ID NO: 282211 - DNA, 25 bp, Mus musculus
ctttctctcagccaaagccttctac

SEQ ID NO: 282212 - DNA, 25 bp, Mus musculus
ctttctctctccagcgcctgtatta

SEQ ID NO: 282213 - DNA, 25 bp, Mus musculus
ctttctctctccagggagtgttcct

SEQ ID NO: 282214 - DNA, 25 bp, Mus musculus
ctttctctggaacttcgagtcaaat

SEQ ID NO: 282215 - DNA, 25 bp, Mus musculus
ctttctctggccctgtatccctgga

SEQ ID NO: 282216 - DNA, 25 bp, Mus musculus
ctttctctgggagctgaacatcgaa

SEQ ID NO: 282217 - DNA, 25 bp, Mus musculus
ctttctctgtaccgtcagaaggggc

SEQ ID NO: 282218 - DNA, 25 bp, Mus musculus
ctttctcttgagactcgttactggg

SEQ ID NO: 282219 - DNA, 25 bp, Mus musculus
ctttctcttgagggtaacaagaaga

SEQ ID NO: 282220 - DNA, 25 bp, Mus musculus
ctttctgaagcttcttcacattgat

SEQ ID NO: 282221 - DNA, 25 bp, Mus musculus
ctttctgagagaaactgcaagaaaa

SEQ ID NO: 282222 - DNA, 25 bp, Mus musculus
ctttctgagggagacttcctgagcg

SEQ ID NO: 282223 - DNA, 25 bp, Mus musculus
ctttctgatcaggtgttgtttgtgg

SEQ ID NO: 282224 - DNA, 25 bp, Mus musculus
ctttctgcaaagagccgtctagaca

SEQ ID NO: 282225 - DNA, 25 bp, Mus musculus
ctttctgcagcctccatctcaccat

SEQ ID NO: 282226 - DNA, 25 bp, Mus musculus
ctttctgcatgaggcttggatctag

SEQ ID NO: 282227 - DNA, 25 bp, Mus musculus
ctttctgccaaagttgctcaccaag

SEQ ID NO: 282228 - DNA, 25 bp, Mus musculus
ctttctgccagcgggtccggagtgg

SEQ ID NO: 282229 - DNA, 25 bp, Mus musculus
ctttctgccagggacatgaaatggc

SEQ ID NO: 282230 - DNA, 25 bp, Mus musculus
ctttctgctccagcaaggtgcagag

SEQ ID NO: 282231 - DNA, 25 bp, Mus musculus
ctttctgctttcaggttctcagaag

SEQ ID NO: 282232 - DNA, 25 bp, Mus musculus
ctttctgctttcaggttctgcagca

SEQ ID NO: 282233 - DNA, 25 bp, Mus musculus
ctttctgctttcaggttgggagaaa

SEQ ID NO: 282234 - DNA, 25 bp, Mus musculus
ctttctggaaagaatatccagttat

SEQ ID NO: 282235 - DNA, 25 bp, Mus musculus
ctttctggacaaggtcagtcctccc

SEQ ID NO: 282236 - DNA, 25 bp, Mus musculus
ctttctggacctggctgcaggtcct

SEQ ID NO: 282237 - DNA, 25 bp, Mus musculus
ctttctggagaaaaacaaaatgtac

SEQ ID NO: 282238 - DNA, 25 bp, Mus musculus
ctttctggagggagttggtggaatg

SEQ ID NO: 282239 - DNA, 25 bp, Mus musculus
ctttctgggcaaggagcacttcaat

SEQ ID NO: 282240 - DNA, 25 bp, Mus musculus
ctttctgggctaagacctccagtca

SEQ ID NO: 282241 - DNA, 25 bp, Mus musculus
ctttctggtaatccccggcagccca

SEQ ID NO: 282242 - DNA, 25 bp, Mus musculus
ctttctgtaccgatgcactcccgct

SEQ ID NO: 282243 - DNA, 25 bp, Mus musculus
ctttctgtccacttcagtccagctg

SEQ ID NO: 282244 - DNA, 25 bp, Mus musculus
ctttctgtccttggggatgggcccc

SEQ ID NO: 282245 - DNA, 25 bp, Mus musculus
ctttctgtgaagaaaagacatgctc

SEQ ID NO: 282246 - DNA, 25 bp, Mus musculus
ctttctgtgttgatgagaggctgta

SEQ ID NO: 282247 - DNA, 25 bp, Mus musculus
ctttctgtgttgcggttccctcatc

SEQ ID NO: 282248 - DNA, 25 bp, Mus musculus
ctttcttacctctggaaggcatcag

SEQ ID NO: 282249 - DNA, 25 bp, Mus musculus
ctttcttacctctgtcccaattcac

SEQ ID NO: 282250 - DNA, 25 bp, Mus musculus
ctttcttattcgcagtggctgtgac

SEQ ID NO: 282251 - DNA, 25 bp, Mus musculus
ctttcttattgaatatccagaagat

SEQ ID NO: 282252 - DNA, 25 bp, Mus musculus
ctttcttcaagcaccagattgtaca

SEQ ID NO: 282253 - DNA, 25 bp, Mus musculus
ctttcttcagttgtttcctctcgct

SEQ ID NO: 282254 - DNA, 25 bp, Mus musculus
ctttcttctggaaccagctattgca

SEQ ID NO: 282255 - DNA, 25 bp, Mus musculus
ctttcttgaccggatccgctccctg

SEQ ID NO: 282256 - DNA, 25 bp, Mus musculus
ctttcttgaccgggcttctcagagt

SEQ ID NO: 282257 - DNA, 25 bp, Mus musculus
ctttcttgagtttgacagtgtcatt

SEQ ID NO: 282258 - DNA, 25 bp, Mus musculus
ctttcttggcattataaaccgtgtc

SEQ ID NO: 282259 - DNA, 25 bp, Mus musculus
ctttcttggcattatgtgccctccg

SEQ ID NO: 282260 - DNA, 25 bp, Mus musculus
ctttcttgggagaggaagaagaaag

SEQ ID NO: 282261 - DNA, 25 bp, Mus musculus
ctttctttaacaaggtaaataagct

SEQ ID NO: 282262 - DNA, 25 bp, Mus musculus
ctttctttagtgtacactcttttct

SEQ ID NO: 282263 - DNA, 25 bp, Mus musculus
ctttctttctgccctgtttcacctt

SEQ ID NO: 282264 - DNA, 25 bp, Mus musculus
ctttctttgcagcacacagcacacc

SEQ ID NO: 282265 - DNA, 25 bp, Mus musculus
ctttcttttgggagcctcaatggtg

SEQ ID NO: 282266 - DNA, 25 bp, Mus musculus
ctttcttttgggagtgagtgtgtac

SEQ ID NO: 282267 - DNA, 25 bp, Mus musculus
ctttgaaaaagcgctctccagtgtc

SEQ ID NO: 282268 - DNA, 25 bp, Mus musculus
ctttgaaaaagctgtcaagagcaga

SEQ ID NO: 282269 - DNA, 25 bp, Mus musculus
ctttgaaaaccaaatcactgagctg

SEQ ID NO: 282270 - DNA, 25 bp, Mus musculus
ctttgaaaaccaggaaaataggtga

SEQ ID NO: 282271 - DNA, 25 bp, Mus musculus
ctttgaaaacttgtctttgcagaac

SEQ ID NO: 282272 - DNA, 25 bp, Mus musculus
ctttgaaaagctttctccagaccag

SEQ ID NO: 282273 - DNA, 25 bp, Mus musculus
ctttgaaaaggctgtcacccttgac

SEQ ID NO: 282274 - DNA, 25 bp, Mus musculus
ctttgaaactgaagaaactcggaaa

SEQ ID NO: 282275 - DNA, 25 bp, Mus musculus
ctttgaaagaagcagttccgaggcc

SEQ ID NO: 282276 - DNA, 25 bp, Mus musculus
ctttgaaagtggtaacctcggccgg

SEQ ID NO: 282277 - DNA, 25 bp, Mus musculus
ctttgaaatacaagctggcattttt

SEQ ID NO: 282278 - DNA, 25 bp, Mus musculus
ctttgaaatacaaggagcaactgtg

SEQ ID NO: 282279 - DNA, 25 bp, Mus musculus
ctttgaaccagaagactttgaaagc

SEQ ID NO: 282280 - DNA, 25 bp, Mus musculus
ctttgaaccagaagggctgtcaggg

SEQ ID NO: 282281 - DNA, 25 bp, Mus musculus
ctttgaacctttggtcagaaagcat

SEQ ID NO: 282282 - DNA, 25 bp, Mus musculus
ctttgaactgataagacgccttgaa

SEQ ID NO: 282283 - DNA, 25 bp, Mus musculus
ctttgaactgataatggcaaagaag

SEQ ID NO: 282284 - DNA, 25 bp, Mus musculus
ctttgaacttcaagctcttttggaa

SEQ ID NO: 282285 - DNA, 25 bp, Mus musculus
ctttgaagaagatgaagaggtgggt

SEQ ID NO: 282286 - DNA, 25 bp, Mus musculus
ctttgaagaatcaagaaactgatct

SEQ ID NO: 282287 - DNA, 25 bp, Mus musculus
ctttgaagactgtggaaacaccagg

SEQ ID NO: 282288 - DNA, 25 bp, Mus musculus
ctttgaagactgtggtcttgccgtc

SEQ ID NO: 282289 - DNA, 25 bp, Mus musculus
ctttgaagagaattgttgtgtgatg

SEQ ID NO: 282290 - DNA, 25 bp, Mus musculus
ctttgaagagcagatggcccagtga

SEQ ID NO: 282291 - DNA, 25 bp, Mus musculus
ctttgaagagcaggttgcttccata

SEQ ID NO: 282292 - DNA, 25 bp, Mus musculus
ctttgaagaggtgtgagtgttgagt

SEQ ID NO: 282293 - DNA, 25 bp, Mus musculus
ctttgaagagtatcacagacatttg

SEQ ID NO: 282294 - DNA, 25 bp, Mus musculus
ctttgaagatgaccgcaacccgcaa

SEQ ID NO: 282295 - DNA, 25 bp, Mus musculus
ctttgaagatgaggatttcttatct

SEQ ID NO: 282296 - DNA, 25 bp, Mus musculus
ctttgaagatgttccctcagccaat

SEQ ID NO: 282297 - DNA, 25 bp, Mus musculus
ctttgaagccaggtgtttggccttg

SEQ ID NO: 282298 - DNA, 25 bp, Mus musculus
ctttgaaggaggcagtgttttgtca

SEQ ID NO: 282299 - DNA, 25 bp, Mus musculus
ctttgaatataacatcagatattca

SEQ ID NO: 282300 - DNA, 25 bp, Mus musculus
ctttgaatggcaaggtgctggatgg

SEQ ID NO: 282301 - DNA, 25 bp, Mus musculus
ctttgacaaaaaatcagctgcccga

SEQ ID NO: 282302 - DNA, 25 bp, Mus musculus
ctttgacaaagccagctaccgagtc

SEQ ID NO: 282303 - DNA, 25 bp, Mus musculus
ctttgacaacagctacagtagggga

SEQ ID NO: 282304 - DNA, 25 bp, Mus musculus
ctttgacaacaggggaggcacttat

SEQ ID NO: 282305 - DNA, 25 bp, Mus musculus
ctttgacaagatcctggctgagtgg

SEQ ID NO: 282306 - DNA, 25 bp, Mus musculus
ctttgacacgagatgacataacact

SEQ ID NO: 282307 - DNA, 25 bp, Mus musculus
ctttgaccaggaacttagcccagca

SEQ ID NO: 282308 - DNA, 25 bp, Mus musculus
ctttgaccaggatgacctcacggta

SEQ ID NO: 282309 - DNA, 25 bp, Mus musculus
ctttgaccaggtaaccggtgtggtg

SEQ ID NO: 282310 - DNA, 25 bp, Mus musculus
ctttgaccatgcggatccttccatt

SEQ ID NO: 282311 - DNA, 25 bp, Mus musculus
ctttgaccgagaaggagaagagtta

SEQ ID NO: 282312 - DNA, 25 bp, Mus musculus
ctttgaccgcacaggtactgagaca

SEQ ID NO: 282313 - DNA, 25 bp, Mus musculus
ctttgaccggaagaagacgggcatg

SEQ ID NO: 282314 - DNA, 25 bp, Mus musculus
ctttgaccgggatcactccggcacg

SEQ ID NO: 282315 - DNA, 25 bp, Mus musculus
ctttgacctcaaggtcctaaatgct

SEQ ID NO: 282316 - DNA, 25 bp, Mus musculus
ctttgacctcatggtgttcgtgacc

SEQ ID NO: 282317 - DNA, 25 bp, Mus musculus
ctttgacctgggaattcctcaagct

SEQ ID NO: 282318 - DNA, 25 bp, Mus musculus
ctttgaccttgggtgccttccaacc

SEQ ID NO: 282319 - DNA, 25 bp, Mus musculus
ctttgacgagatcatcagtgaggag

SEQ ID NO: 282320 - DNA, 25 bp, Mus musculus
ctttgacgagtgaggagagattccg

SEQ ID NO: 282321 - DNA, 25 bp, Mus musculus
ctttgactacagcacggtggatgac

SEQ ID NO: 282322 - DNA, 25 bp, Mus musculus
ctttgactccagctattcacggaac

SEQ ID NO: 282323 - DNA, 25 bp, Mus musculus
ctttgactcggtccctaccacccgg

SEQ ID NO: 282324 - DNA, 25 bp, Mus musculus
ctttgactcgtgaagtcatcagagg

SEQ ID NO: 282325 - DNA, 25 bp, Mus musculus
ctttgactggaatggtatttccaaa

SEQ ID NO: 282326 - DNA, 25 bp, Mus musculus
ctttgactgtcaggaacatgacatt

SEQ ID NO: 282327 - DNA, 25 bp, Mus musculus
ctttgacttcaacaccctcttcaag

SEQ ID NO: 282328 - DNA, 25 bp, Mus musculus
ctttgacttgctgaacattgttccc

SEQ ID NO: 282329 - DNA, 25 bp, Mus musculus
ctttgagaaaggtttgcagctagaa

SEQ ID NO: 282330 - DNA, 25 bp, Mus musculus
ctttgagaaccctgactgaaataat

SEQ ID NO: 282331 - DNA, 25 bp, Mus musculus
ctttgagaagcatgtggatggcagc

SEQ ID NO: 282332 - DNA, 25 bp, Mus musculus
ctttgagaatccccggcagcccaac

SEQ ID NO: 282333 - DNA, 25 bp, Mus musculus
ctttgagaatctcctgtccaagaac

SEQ ID NO: 282334 - DNA, 25 bp, Mus musculus
ctttgagacctataatggtcagcaa

SEQ ID NO: 282335 - DNA, 25 bp, Mus musculus
ctttgagatcagctaattaagaacc

SEQ ID NO: 282336 - DNA, 25 bp, Mus musculus
ctttgagatgggtaaccttttggtg

SEQ ID NO: 282337 - DNA, 25 bp, Mus musculus
ctttgagatggtctgctttacggga

SEQ ID NO: 282338 - DNA, 25 bp, Mus musculus
ctttgagattgtaaaagctggcagg

SEQ ID NO: 282339 - DNA, 25 bp, Mus musculus
ctttgagcagcatatgaagaacagt

SEQ ID NO: 282340 - DNA, 25 bp, Mus musculus
ctttgagcataggtcctgatcactg

SEQ ID NO: 282341 - DNA, 25 bp, Mus musculus
ctttgagcgtggcggacctcatccg

SEQ ID NO: 282342 - DNA, 25 bp, Mus musculus
ctttgaggaaagatcaaactcagat

SEQ ID NO: 282343 - DNA, 25 bp, Mus musculus
ctttgaggaaagggaacgggagatg

SEQ ID NO: 282344 - DNA, 25 bp, Mus musculus
ctttgaggaagattgcaagcccaag

SEQ ID NO: 282345 - DNA, 25 bp, Mus musculus
ctttgaggaagcgagtctccagtta

SEQ ID NO: 282346 - DNA, 25 bp, Mus musculus
ctttgaggaagttatcaacatagtt

SEQ ID NO: 282347 - DNA, 25 bp, Mus musculus
ctttgaggaatgctcgccaaaacaa

SEQ ID NO: 282348 - DNA, 25 bp, Mus musculus
ctttgaggaatgctctctttggggt

SEQ ID NO: 282349 - DNA, 25 bp, Mus musculus
ctttgaggacaccgctcagtgggta

SEQ ID NO: 282350 - DNA, 25 bp, Mus musculus
ctttgaggacctttactctttgatg

SEQ ID NO: 282351 - DNA, 25 bp, Mus musculus
ctttgaggagagaagagaactatga

SEQ ID NO: 282352 - DNA, 25 bp, Mus musculus
ctttgaggatgaaggacggtggcgc

SEQ ID NO: 282353 - DNA, 25 bp, Mus musculus
ctttgagtacaggtctgtaccacaa

SEQ ID NO: 282354 - DNA, 25 bp, Mus musculus
ctttgagtacaggtgatttgaactg

SEQ ID NO: 282355 - DNA, 25 bp, Mus musculus
ctttgagtctaacaaatgcttcccc

SEQ ID NO: 282356 - DNA, 25 bp, Mus musculus
ctttgagtgacgggtttagcttttt

SEQ ID NO: 282357 - DNA, 25 bp, Mus musculus
ctttgagtggaacgcaaccttcctg

SEQ ID NO: 282358 - DNA, 25 bp, Mus musculus
ctttgataagaatggcaatcccaat

SEQ ID NO: 282359 - DNA, 25 bp, Mus musculus
ctttgataaggatggcattgtagca

SEQ ID NO: 282360 - DNA, 25 bp, Mus musculus
ctttgatattcggagctggagccct

SEQ ID NO: 282361 - DNA, 25 bp, Mus musculus
ctttgatattcggctgaattcatca

SEQ ID NO: 282362 - DNA, 25 bp, Mus musculus
ctttgatcacaaggtcacacttggt

SEQ ID NO: 282363 - DNA, 25 bp, Mus musculus
ctttgatcacagtattttcacaaag

SEQ ID NO: 282364 - DNA, 25 bp, Mus musculus
ctttgatccagatgccaaggggctg

SEQ ID NO: 282365 - DNA, 25 bp, Mus musculus
ctttgatctgaaggaaggcgaagtg

SEQ ID NO: 282366 - DNA, 25 bp, Mus musculus
ctttgatgagaagtcccgtgttgcc

SEQ ID NO: 282367 - DNA, 25 bp, Mus musculus
ctttgatgagatatgtgtcacaaag

SEQ ID NO: 282368 - DNA, 25 bp, Mus musculus
ctttgatgaggtacagtatcagatg

SEQ ID NO: 282369 - DNA, 25 bp, Mus musculus
ctttgatgagtgcttcctttgcagc

SEQ ID NO: 282370 - DNA, 25 bp, Mus musculus
ctttgatgatctattggatgataca

SEQ ID NO: 282371 - DNA, 25 bp, Mus musculus
ctttgatgctagagaggaggtggct

SEQ ID NO: 282372 - DNA, 25 bp, Mus musculus
ctttgatgctagagcctcagtctga

SEQ ID NO: 282373 - DNA, 25 bp, Mus musculus
ctttgatggaaagaaaattgcccag

SEQ ID NO: 282374 - DNA, 25 bp, Mus musculus
ctttgatggaaaggagttctggcag

SEQ ID NO: 282375 - DNA, 25 bp, Mus musculus
ctttgatgtcctgggtcatggtagt

SEQ ID NO: 282376 - DNA, 25 bp, Mus musculus
ctttgatgtgcatgtgtgggcatat

SEQ ID NO: 282377 - DNA, 25 bp, Mus musculus
ctttgattcaaaaggatggccaggc

SEQ ID NO: 282378 - DNA, 25 bp, Mus musculus
ctttgattccagctactcccgaaac

SEQ ID NO: 282379 - DNA, 25 bp, Mus musculus
ctttgatttttacatggacttgaca

SEQ ID NO: 282380 - DNA, 25 bp, Mus musculus
ctttgcaaaacatggcagaagaaga

SEQ ID NO: 282381 - DNA, 25 bp, Mus musculus
ctttgcaaaagactggctggaacat

SEQ ID NO: 282382 - DNA, 25 bp, Mus musculus
ctttgcaaaagtgatctgcaattcg

SEQ ID NO: 282383 - DNA, 25 bp, Mus musculus
ctttgcaaagacgtgtgcaagaact

SEQ ID NO: 282384 - DNA, 25 bp, Mus musculus
ctttgcaaagacgtgtgtgtctgct

SEQ ID NO: 282385 - DNA, 25 bp, Mus musculus
ctttgcaaagtgcattgaggtcatg

SEQ ID NO: 282386 - DNA, 25 bp, Mus musculus
ctttgcaaataccggtcaactattc

SEQ ID NO: 282387 - DNA, 25 bp, Mus musculus
ctttgcaaggaagtgggaggcagtt

SEQ ID NO: 282388 - DNA, 25 bp, Mus musculus
ctttgcaaggaagtggtataatggc

SEQ ID NO: 282389 - DNA, 25 bp, Mus musculus
ctttgcaagtcaggccgtctactgt

SEQ ID NO: 282390 - DNA, 25 bp, Mus musculus
ctttgcaatcgatggcagctcaacg

SEQ ID NO: 282391 - DNA, 25 bp, Mus musculus
ctttgcacaagacccacaccatctt

SEQ ID NO: 282392 - DNA, 25 bp, Mus musculus
ctttgcacaagggtttctctgtagc

SEQ ID NO: 282393 - DNA, 25 bp, Mus musculus
ctttgcacacagatggagtggccgg

SEQ ID NO: 282394 - DNA, 25 bp, Mus musculus
ctttgcacagcactgccagggggaa

SEQ ID NO: 282395 - DNA, 25 bp, Mus musculus
ctttgcacaggtgacgccatctggg

SEQ ID NO: 282396 - DNA, 25 bp, Mus musculus
ctttgcactcagcccccactgtaga

SEQ ID NO: 282397 - DNA, 25 bp, Mus musculus
ctttgcactcagcgtacatgttgtg

SEQ ID NO: 282398 - DNA, 25 bp, Mus musculus
ctttgcactgagcgggaactgagcc

SEQ ID NO: 282399 - DNA, 25 bp, Mus musculus
ctttgcagatggaaagatgacatcg

SEQ ID NO: 282400 - DNA, 25 bp, Mus musculus
ctttgcagccaagtccctgccgcct

SEQ ID NO: 282401 - DNA, 25 bp, Mus musculus
ctttgcagtctatgctggaaacagc

SEQ ID NO: 282402 - DNA, 25 bp, Mus musculus
ctttgcagtctatggactggaaacg

SEQ ID NO: 282403 - DNA, 25 bp, Mus musculus
ctttgcatatcagatctgatgtttt

SEQ ID NO: 282404 - DNA, 25 bp, Mus musculus
ctttgccaaagcagggctgcaggtg

SEQ ID NO: 282405 - DNA, 25 bp, Mus musculus
ctttgccaagacatactccagtgat

SEQ ID NO: 282406 - DNA, 25 bp, Mus musculus
ctttgccaagaccggacagggtctc

SEQ ID NO: 282407 - DNA, 25 bp, Mus musculus
ctttgccaagaccggggatcccaac

SEQ ID NO: 282408 - DNA, 25 bp, Mus musculus
ctttgccacacagtgaagatgccat

SEQ ID NO: 282409 - DNA, 25 bp, Mus musculus
ctttgccagcaagagaatccgggct

SEQ ID NO: 282410 - DNA, 25 bp, Mus musculus
ctttgccatcctcggtttctactta

SEQ ID NO: 282411 - DNA, 25 bp, Mus musculus
ctttgcccattgatttaggtcgctc

SEQ ID NO: 282412 - DNA, 25 bp, Mus musculus
ctttgccctcaggcaccgaataaac

SEQ ID NO: 282413 - DNA, 25 bp, Mus musculus
ctttgccgatcacagggagaacatt

SEQ ID NO: 282414 - DNA, 25 bp, Mus musculus
ctttgccgcagggggtgctacagaa

SEQ ID NO: 282415 - DNA, 25 bp, Mus musculus
ctttgccgcaggggtcatgttagcg

SEQ ID NO: 282416 - DNA, 25 bp, Mus musculus
ctttgcctaggttgagaacaaaaag

SEQ ID NO: 282417 - DNA, 25 bp, Mus musculus
ctttgcctcggcgcggatgtggtta

SEQ ID NO: 282418 - DNA, 25 bp, Mus musculus
ctttgcctgcactggcacacaggca

SEQ ID NO: 282419 - DNA, 25 bp, Mus musculus
ctttgcctgtcagtcccaggtcctg

SEQ ID NO: 282420 - DNA, 25 bp, Mus musculus
ctttgcctgtgaggtttctgtttac

SEQ ID NO: 282421 - DNA, 25 bp, Mus musculus
ctttgccttccgagatgagacggca

SEQ ID NO: 282422 - DNA, 25 bp, Mus musculus
ctttgccttccgagggcagtactgc

SEQ ID NO: 282423 - DNA, 25 bp, Mus musculus
ctttgcgcagaggttacatcggcgt

SEQ ID NO: 282424 - DNA, 25 bp, Mus musculus
ctttgcgctcagggaaaggtgaaca

SEQ ID NO: 282425 - DNA, 25 bp, Mus musculus
ctttgcgctcagggcatccatgtga

SEQ ID NO: 282426 - DNA, 25 bp, Mus musculus
ctttgcgctgtatagaatgcggggt

SEQ ID NO: 282427 - DNA, 25 bp, Mus musculus
ctttgcgtacagggatcttgtcctt

SEQ ID NO: 282428 - DNA, 25 bp, Mus musculus
ctttgcgtacagggggtggtactgg

SEQ ID NO: 282429 - DNA, 25 bp, Mus musculus
ctttgctacaacgctaacagttcct

SEQ ID NO: 282430 - DNA, 25 bp, Mus musculus
ctttgctcagccttctggccggggc

SEQ ID NO: 282431 - DNA, 25 bp, Mus musculus
ctttgctcgaaatgggaaccctaat

SEQ ID NO: 282432 - DNA, 25 bp, Mus musculus
ctttgctcgaagttgtccagtctgg

SEQ ID NO: 282433 - DNA, 25 bp, Mus musculus
ctttgctcgaggagtgcatgggtac

SEQ ID NO: 282434 - DNA, 25 bp, Mus musculus
ctttgctcggaatgggaaccctaat

SEQ ID NO: 282435 - DNA, 25 bp, Mus musculus
ctttgctctcacccgcccgagttcg

SEQ ID NO: 282436 - DNA, 25 bp, Mus musculus
ctttgctctcacccggtacttggtg

SEQ ID NO: 282437 - DNA, 25 bp, Mus musculus
ctttgctcttggcactaaacaagat

SEQ ID NO: 282438 - DNA, 25 bp, Mus musculus
ctttgctcttggggagatgcgaaaa

SEQ ID NO: 282439 - DNA, 25 bp, Mus musculus
ctttgctgaaatgcacctagtgtgt

SEQ ID NO: 282440 - DNA, 25 bp, Mus musculus
ctttgctgaaatggtgacccgcagg

SEQ ID NO: 282441 - DNA, 25 bp, Mus musculus
ctttgctgcgattatttgattctgg

SEQ ID NO: 282442 - DNA, 25 bp, Mus musculus
ctttgctgcggcttcatagagccca

SEQ ID NO: 282443 - DNA, 25 bp, Mus musculus
ctttgctgtaaaagagaggaggctc

SEQ ID NO: 282444 - DNA, 25 bp, Mus musculus
ctttgctgtaccagatcccacaacg

SEQ ID NO: 282445 - DNA, 25 bp, Mus musculus
ctttgcttccagatggcctaccttc

SEQ ID NO: 282446 - DNA, 25 bp, Mus musculus
ctttgcttgaatgggcctgtgtttt

SEQ ID NO: 282447 - DNA, 25 bp, Mus musculus
ctttgcttgaggtaatccattgtct

SEQ ID NO: 282448 - DNA, 25 bp, Mus musculus
ctttgcttgaggtagtccattgtct

SEQ ID NO: 282449 - DNA, 25 bp, Mus musculus
ctttgcttggtgggttcaggggtga

SEQ ID NO: 282450 - DNA, 25 bp, Mus musculus
ctttgctttcagaagaatatgacag

SEQ ID NO: 282451 - DNA, 25 bp, Mus musculus
ctttgctttccacatgtctgccagg

SEQ ID NO: 282452 - DNA, 25 bp, Mus musculus
ctttgctttccagaatgggcaaagg

SEQ ID NO: 282453 - DNA, 25 bp, Mus musculus
ctttgctttccatgggtcccacatt

SEQ ID NO: 282454 - DNA, 25 bp, Mus musculus
ctttgctttgacactggccaaaaga

SEQ ID NO: 282455 - DNA, 25 bp, Mus musculus
ctttgctttgtattacgtgcactct

SEQ ID NO: 282456 - DNA, 25 bp, Mus musculus
ctttggaaaaaagctctcttaagag

SEQ ID NO: 282457 - DNA, 25 bp, Mus musculus
ctttggaaaaaagttctaggcaaga

SEQ ID NO: 282458 - DNA, 25 bp, Mus musculus
ctttggaaaaacagaggccagaggg

SEQ ID NO: 282459 - DNA, 25 bp, Mus musculus
ctttggaaaaatacatttatataat

SEQ ID NO: 282460 - DNA, 25 bp, Mus musculus
ctttggaaaagttgctgtggttcca

SEQ ID NO: 282461 - DNA, 25 bp, Mus musculus
ctttggaaacttcaggagtcatggc

SEQ ID NO: 282462 - DNA, 25 bp, Mus musculus
ctttggaaagggacatcatcgaagg

SEQ ID NO: 282463 - DNA, 25 bp, Mus musculus
ctttggaaagtgacactgatgagac

SEQ ID NO: 282464 - DNA, 25 bp, Mus musculus
ctttggaaattgccgcagatgaccc

SEQ ID NO: 282465 - DNA, 25 bp, Mus musculus
ctttggaacagattcaagtcaatct

SEQ ID NO: 282466 - DNA, 25 bp, Mus musculus
ctttggaacatagacaacatagaaa

SEQ ID NO: 282467 - DNA, 25 bp, Mus musculus
ctttggacagaaaatcaccgtgctg

SEQ ID NO: 282468 - DNA, 25 bp, Mus musculus
ctttggacagagccagtatacagcg

SEQ ID NO: 282469 - DNA, 25 bp, Mus musculus
ctttggacaggatattgactagact

SEQ ID NO: 282470 - DNA, 25 bp, Mus musculus
ctttggacatgccagggctgtagca

SEQ ID NO: 282471 - DNA, 25 bp, Mus musculus
ctttggaccaaagacccagccattc

SEQ ID NO: 282472 - DNA, 25 bp, Mus musculus
ctttggaccaactgttctcagtttg

SEQ ID NO: 282473 - DNA, 25 bp, Mus musculus
ctttggaccacctggtccaagaggg

SEQ ID NO: 282474 - DNA, 25 bp, Mus musculus
ctttggaccggcacgtgtcggagct

SEQ ID NO: 282475 - DNA, 25 bp, Mus musculus
ctttggacctccctccaactcttct

SEQ ID NO: 282476 - DNA, 25 bp, Mus musculus
ctttggactcagaggcttgctgcat

SEQ ID NO: 282477 - DNA, 25 bp, Mus musculus
ctttggagaagaaccatcagtcatc

SEQ ID NO: 282478 - DNA, 25 bp, Mus musculus
ctttggagaaggagcttcagtgact

SEQ ID NO: 282479 - DNA, 25 bp, Mus musculus
ctttggagaagtattgaggctccct

SEQ ID NO: 282480 - DNA, 25 bp, Mus musculus
ctttggagaatgcagttccttttag

SEQ ID NO: 282481 - DNA, 25 bp, Mus musculus
ctttggagaattgcagtactgttta

SEQ ID NO: 282482 - DNA, 25 bp, Mus musculus
ctttggagagcgtcaagatcaagtt

SEQ ID NO: 282483 - DNA, 25 bp, Mus musculus
ctttggagagctcaaagagaagcac

SEQ ID NO: 282484 - DNA, 25 bp, Mus musculus
ctttggagcagtggccgtgcctgca

SEQ ID NO: 282485 - DNA, 25 bp, Mus musculus
ctttggagctgttggttttgaccct

SEQ ID NO: 282486 - DNA, 25 bp, Mus musculus
ctttggagggagttatggggggatg

SEQ ID NO: 282487 - DNA, 25 bp, Mus musculus
ctttggaggttctggaacagctaat

SEQ ID NO: 282488 - DNA, 25 bp, Mus musculus
ctttggaggttctggacggcatttg

SEQ ID NO: 282489 - DNA, 25 bp, Mus musculus
ctttggaggttctgggacagcaact

SEQ ID NO: 282490 - DNA, 25 bp, Mus musculus
ctttggagtcaagttctccaaggag

SEQ ID NO: 282491 - DNA, 25 bp, Mus musculus
ctttggatactcaggaatgggcaaa

SEQ ID NO: 282492 - DNA, 25 bp, Mus musculus
ctttggatgatacagacgtcctaca

SEQ ID NO: 282493 - DNA, 25 bp, Mus musculus
ctttggattcataggggcttcttct

SEQ ID NO: 282494 - DNA, 25 bp, Mus musculus
ctttggcaaatggagtattggcttc

SEQ ID NO: 282495 - DNA, 25 bp, Mus musculus
ctttggcaacaacgctctggtgcaa

SEQ ID NO: 282496 - DNA, 25 bp, Mus musculus
ctttggcaagtttgggcctgcctta

SEQ ID NO: 282497 - DNA, 25 bp, Mus musculus
ctttggcagcggatctccatctttc

SEQ ID NO: 282498 - DNA, 25 bp, Mus musculus
ctttggcatcaaggagacatcaaca

SEQ ID NO: 282499 - DNA, 25 bp, Mus musculus
ctttggccaaatggcaccgctccaa

SEQ ID NO: 282500 - DNA, 25 bp, Mus musculus
ctttggccagccttacagttcctcc

SEQ ID NO: 282501 - DNA, 25 bp, Mus musculus
ctttggccaggcttacagttcctcc

SEQ ID NO: 282502 - DNA, 25 bp, Mus musculus
ctttggcggcgaagaggtcctgagt

SEQ ID NO: 282503 - DNA, 25 bp, Mus musculus
ctttggcggcgaagtctcccctcac

SEQ ID NO: 282504 - DNA, 25 bp, Mus musculus
ctttggcggtaccagcccctctccc

SEQ ID NO: 282505 - DNA, 25 bp, Mus musculus
ctttggctatgaagaatgcccatat

SEQ ID NO: 282506 - DNA, 25 bp, Mus musculus
ctttggctatgaagccacattggga

SEQ ID NO: 282507 - DNA, 25 bp, Mus musculus
ctttggctccgcagcagaatgccaa

SEQ ID NO: 282508 - DNA, 25 bp, Mus musculus
ctttggctcttttacagacctcaaa

SEQ ID NO: 282509 - DNA, 25 bp, Mus musculus
ctttggctgaaaggacttctagatc

SEQ ID NO: 282510 - DNA, 25 bp, Mus musculus
ctttggctgggcagattggccacct

SEQ ID NO: 282511 - DNA, 25 bp, Mus musculus
ctttggcttcctcagcactggagac

SEQ ID NO: 282512 - DNA, 25 bp, Mus musculus
ctttggctttaagacactggaacgg

SEQ ID NO: 282513 - DNA, 25 bp, Mus musculus
ctttggcttttaatgatctagtgaa

SEQ ID NO: 282514 - DNA, 25 bp, Mus musculus
ctttgggaagcgcctgctgaacgag

SEQ ID NO: 282515 - DNA, 25 bp, Mus musculus
ctttgggaaggcgacagacttatta

SEQ ID NO: 282516 - DNA, 25 bp, Mus musculus
ctttgggaagttactccgagatgcc

SEQ ID NO: 282517 - DNA, 25 bp, Mus musculus
ctttgggaccggttcggaccatatc

SEQ ID NO: 282518 - DNA, 25 bp, Mus musculus
ctttgggaggagagaaggaagaatt

SEQ ID NO: 282519 - DNA, 25 bp, Mus musculus
ctttgggatgaagattgtggatgtc

SEQ ID NO: 282520 - DNA, 25 bp, Mus musculus
ctttgggatgaaggtgactgtcctg

SEQ ID NO: 282521 - DNA, 25 bp, Mus musculus
ctttgggcacaggaaagccatcacc

SEQ ID NO: 282522 - DNA, 25 bp, Mus musculus
ctttgggcagctgctcgccctgccc

SEQ ID NO: 282523 - DNA, 25 bp, Mus musculus
ctttgggcaggaaacaagttacatc

SEQ ID NO: 282524 - DNA, 25 bp, Mus musculus
ctttgggccaaaccaatatattgtg

SEQ ID NO: 282525 - DNA, 25 bp, Mus musculus
ctttgggccggttgctgatgacggc

SEQ ID NO: 282526 - DNA, 25 bp, Mus musculus
ctttgggcctgaatgatatgtttgg

SEQ ID NO: 282527 - DNA, 25 bp, Mus musculus
ctttgggcctgaatggctccgtgct

SEQ ID NO: 282528 - DNA, 25 bp, Mus musculus
ctttgggcctgaatgtctcttacag

SEQ ID NO: 282529 - DNA, 25 bp, Mus musculus
ctttgggcctttatggcatctgaac

SEQ ID NO: 282530 - DNA, 25 bp, Mus musculus
ctttgggcttcttgtgtccattgtc

SEQ ID NO: 282531 - DNA, 25 bp, Mus musculus
ctttggggatgcccctgcctccctg

SEQ ID NO: 282532 - DNA, 25 bp, Mus musculus
ctttgggggagacgttcatgggcgg

SEQ ID NO: 282533 - DNA, 25 bp, Mus musculus
ctttgggggagactatggtggaacc

SEQ ID NO: 282534 - DNA, 25 bp, Mus musculus
ctttggggtattataatattattgg

SEQ ID NO: 282535 - DNA, 25 bp, Mus musculus
ctttggggtggtaatactggagacc

SEQ ID NO: 282536 - DNA, 25 bp, Mus musculus
ctttgggtctcggcaaccaaactga

SEQ ID NO: 282537 - DNA, 25 bp, Mus musculus
ctttggtaaaatatcctgcccaaac

SEQ ID NO: 282538 - DNA, 25 bp, Mus musculus
ctttggtaaaatatcggatgcccgg

SEQ ID NO: 282539 - DNA, 25 bp, Mus musculus
ctttggtaagctgcgatatttaatt

SEQ ID NO: 282540 - DNA, 25 bp, Mus musculus
ctttggtagactctggctggaggcg

SEQ ID NO: 282541 - DNA, 25 bp, Mus musculus
ctttggtcagagaggtgctggtaac

SEQ ID NO: 282542 - DNA, 25 bp, Mus musculus
ctttggtgacaggcttccccacctc

SEQ ID NO: 282543 - DNA, 25 bp, Mus musculus
ctttggtgccacaagccccgcccaa

SEQ ID NO: 282544 - DNA, 25 bp, Mus musculus
ctttggtgggcagtcctggcagcac

SEQ ID NO: 282545 - DNA, 25 bp, Mus musculus
ctttggtgtcacaggcggcacgttt

SEQ ID NO: 282546 - DNA, 25 bp, Mus musculus
ctttggttcctcaagccccgcccaa

SEQ ID NO: 282547 - DNA, 25 bp, Mus musculus
ctttggttggagcaggtactggcct

SEQ ID NO: 282548 - DNA, 25 bp, Mus musculus
ctttggttggagcaggtggcaaagc

SEQ ID NO: 282549 - DNA, 25 bp, Mus musculus
ctttggtttgcgaggctggagcaaa

SEQ ID NO: 282550 - DNA, 25 bp, Mus musculus
ctttgtaaaagaatgatagagacag

SEQ ID NO: 282551 - DNA, 25 bp, Mus musculus
ctttgtaaagcaatccgaaggtcca

SEQ ID NO: 282552 - DNA, 25 bp, Mus musculus
ctttgtaagagaaataaagaaagat

SEQ ID NO: 282553 - DNA, 25 bp, Mus musculus
ctttgtaatcagcttggcttaccct

SEQ ID NO: 282554 - DNA, 25 bp, Mus musculus
ctttgtaatctcggattgtaagggc

SEQ ID NO: 282555 - DNA, 25 bp, Mus musculus
ctttgtaatcttgagaaaatgaaaa

SEQ ID NO: 282556 - DNA, 25 bp, Mus musculus
ctttgtacaaggagggtgacaatag

SEQ ID NO: 282557 - DNA, 25 bp, Mus musculus
ctttgtacacaatgccaaagaagct

SEQ ID NO: 282558 - DNA, 25 bp, Mus musculus
ctttgtacacagcccacttttaggt

SEQ ID NO: 282559 - DNA, 25 bp, Mus musculus
ctttgtaccaggatcttgaaacagg

SEQ ID NO: 282560 - DNA, 25 bp, Mus musculus
ctttgtaccagggggctggtggcat

SEQ ID NO: 282561 - DNA, 25 bp, Mus musculus
ctttgtaccctatgataaaaactac

SEQ ID NO: 282562 - DNA, 25 bp, Mus musculus
ctttgtaccctatgcatctgcctct

SEQ ID NO: 282563 - DNA, 25 bp, Mus musculus
ctttgtagaccaaagcccatggcct

SEQ ID NO: 282564 - DNA, 25 bp, Mus musculus
ctttgtagaccaagtggtgtctacc

SEQ ID NO: 282565 - DNA, 25 bp, Mus musculus
ctttgtagcacctgagttctcactc

SEQ ID NO: 282566 - DNA, 25 bp, Mus musculus
ctttgtagccatcctcccgccacac

SEQ ID NO: 282567 - DNA, 25 bp, Mus musculus
ctttgtagccggggacgatccggag

SEQ ID NO: 282568 - DNA, 25 bp, Mus musculus
ctttgtatctctcctggaaagaaat

SEQ ID NO: 282569 - DNA, 25 bp, Mus musculus
ctttgtatctgtcctggaaagaaat

SEQ ID NO: 282570 - DNA, 25 bp, Mus musculus
ctttgtcaaagaggtacagcagggt

SEQ ID NO: 282571 - DNA, 25 bp, Mus musculus
ctttgtcaagaacctacatggacgc

SEQ ID NO: 282572 - DNA, 25 bp, Mus musculus
ctttgtcaagggatacctccttccc

SEQ ID NO: 282573 - DNA, 25 bp, Mus musculus
ctttgtcaagggctggggagcagag

SEQ ID NO: 282574 - DNA, 25 bp, Mus musculus
ctttgtcaagtccaagacaggcctt

SEQ ID NO: 282575 - DNA, 25 bp, Mus musculus
ctttgtcaatctggtacaccagggg

SEQ ID NO: 282576 - DNA, 25 bp, Mus musculus
ctttgtcactatgccacagcccaac

SEQ ID NO: 282577 - DNA, 25 bp, Mus musculus
ctttgtcactgagaaacgtctcaga

SEQ ID NO: 282578 - DNA, 25 bp, Mus musculus
ctttgtcactgagctcctgcttcct

SEQ ID NO: 282579 - DNA, 25 bp, Mus musculus
ctttgtcatcaaaggcctctccctg

SEQ ID NO: 282580 - DNA, 25 bp, Mus musculus
ctttgtcatcaaaggtccagatgtt

SEQ ID NO: 282581 - DNA, 25 bp, Mus musculus
ctttgtcatccaggtcttggataaa

SEQ ID NO: 282582 - DNA, 25 bp, Mus musculus
ctttgtccagcggctcgaggacttc

SEQ ID NO: 282583 - DNA, 25 bp, Mus musculus
ctttgtcctaagattagcctcacag

SEQ ID NO: 282584 - DNA, 25 bp, Mus musculus
ctttgtctaccagcctcttaaaggt

SEQ ID NO: 282585 - DNA, 25 bp, Mus musculus
ctttgtctaccaggatcctcagggg

SEQ ID NO: 282586 - DNA, 25 bp, Mus musculus
ctttgtctagactggctgttcctgt

SEQ ID NO: 282587 - DNA, 25 bp, Mus musculus
ctttgtctgccagactgtcattgaa

SEQ ID NO: 282588 - DNA, 25 bp, Mus musculus
ctttgtctgctccctggtggttctc

SEQ ID NO: 282589 - DNA, 25 bp, Mus musculus
ctttgtctggaagcggcctctggag

SEQ ID NO: 282590 - DNA, 25 bp, Mus musculus
ctttgtctggtcccccttcctgtgt

SEQ ID NO: 282591 - DNA, 25 bp, Mus musculus
ctttgtcttcttgtctggggaggtc

SEQ ID NO: 282592 - DNA, 25 bp, Mus musculus
ctttgtctttaaggtctctaataga

SEQ ID NO: 282593 - DNA, 25 bp, Mus musculus
ctttgtctttaaggtggtgctgatc

SEQ ID NO: 282594 - DNA, 25 bp, Mus musculus
ctttgtgaacaagggttcccgagag

SEQ ID NO: 282595 - DNA, 25 bp, Mus musculus
ctttgtgaagctccgttttgttcag

SEQ ID NO: 282596 - DNA, 25 bp, Mus musculus
ctttgtgaagctctgaaaacctgga

SEQ ID NO: 282597 - DNA, 25 bp, Mus musculus
ctttgtgaaggaaggactccaccgc

SEQ ID NO: 282598 - DNA, 25 bp, Mus musculus
ctttgtgaaggacatctttggctgt

SEQ ID NO: 282599 - DNA, 25 bp, Mus musculus
ctttgtgaaggggcagcattttgaa

SEQ ID NO: 282600 - DNA, 25 bp, Mus musculus
ctttgtgagtgtgagagcccgctgt

SEQ ID NO: 282601 - DNA, 25 bp, Mus musculus
ctttgtgatatgatgagaaaaccaa

SEQ ID NO: 282602 - DNA, 25 bp, Mus musculus
ctttgtgcaggaagaagactacgag

SEQ ID NO: 282603 - DNA, 25 bp, Mus musculus
ctttgtgcaggcccagaggaactgg

SEQ ID NO: 282604 - DNA, 25 bp, Mus musculus
ctttgtgcaggtcccagccagctca

SEQ ID NO: 282605 - DNA, 25 bp, Mus musculus
ctttgtgcagtggctcgtgggtttc

SEQ ID NO: 282606 - DNA, 25 bp, Mus musculus
ctttgtgcatgctagatgtgaaaca

SEQ ID NO: 282607 - DNA, 25 bp, Mus musculus
ctttgtgcgagacggcccccttgag

SEQ ID NO: 282608 - DNA, 25 bp, Mus musculus
ctttgtgctccacggggaggcacac

SEQ ID NO: 282609 - DNA, 25 bp, Mus musculus
ctttgtgctggaaggcgcttttgtc

SEQ ID NO: 282610 - DNA, 25 bp, Mus musculus
ctttgtgctgggaaagagtatggca

SEQ ID NO: 282611 - DNA, 25 bp, Mus musculus
ctttgtggaacacgaagccctgcag

SEQ ID NO: 282612 - DNA, 25 bp, Mus musculus
ctttgtggaacacgctgtcttcaga

SEQ ID NO: 282613 - DNA, 25 bp, Mus musculus
ctttgtggcagtcttcccaggccaa

SEQ ID NO: 282614 - DNA, 25 bp, Mus musculus
ctttgtggcagtctttcagccaact

SEQ ID NO: 282615 - DNA, 25 bp, Mus musculus
ctttgtggcggacgtgacttgtagc

SEQ ID NO: 282616 - DNA, 25 bp, Mus musculus
ctttgtgtgggcttgcaaaattgct

SEQ ID NO: 282617 - DNA, 25 bp, Mus musculus
ctttgtgttgaaggtgcaggaccag

SEQ ID NO: 282618 - DNA, 25 bp, Mus musculus
ctttgttaacatgagctttctgctc

SEQ ID NO: 282619 - DNA, 25 bp, Mus musculus
ctttgttaacatgaggtctatccag

SEQ ID NO: 282620 - DNA, 25 bp, Mus musculus
ctttgttaaggtctggctcagttta

SEQ ID NO: 282621 - DNA, 25 bp, Mus musculus
ctttgttaccttgctgtatcgacat

SEQ ID NO: 282622 - DNA, 25 bp, Mus musculus
ctttgttatggctgaatcagagatc

SEQ ID NO: 282623 - DNA, 25 bp, Mus musculus
ctttgttcaggaatatcgttcagaa

SEQ ID NO: 282624 - DNA, 25 bp, Mus musculus
ctttgttcaggagtttaatctgatt

SEQ ID NO: 282625 - DNA, 25 bp, Mus musculus
ctttgttcagtcgggctctaagcaa

SEQ ID NO: 282626 - DNA, 25 bp, Mus musculus
ctttgttcagtcggtttccgtgaga

SEQ ID NO: 282627 - DNA, 25 bp, Mus musculus
ctttgttcctggggcctgtgtttta

SEQ ID NO: 282628 - DNA, 25 bp, Mus musculus
ctttgttcgaataaatgctgctcat

SEQ ID NO: 282629 - DNA, 25 bp, Mus musculus
ctttgttctccaatgttgtatgtgc

SEQ ID NO: 282630 - DNA, 25 bp, Mus musculus
ctttgttctcgagcaggttagccag

SEQ ID NO: 282631 - DNA, 25 bp, Mus musculus
ctttgttctgaggtgacgccatctg

SEQ ID NO: 282632 - DNA, 25 bp, Mus musculus
ctttgttctttaagatcgctccagt

SEQ ID NO: 282633 - DNA, 25 bp, Mus musculus
ctttgttctttaaggatcctatgta

SEQ ID NO: 282634 - DNA, 25 bp, Mus musculus
ctttgttgcttagcctcctgtaccc

SEQ ID NO: 282635 - DNA, 25 bp, Mus musculus
ctttgttgcttaggattccctgcac

SEQ ID NO: 282636 - DNA, 25 bp, Mus musculus
ctttgttggcaaagctagatctttc

SEQ ID NO: 282637 - DNA, 25 bp, Mus musculus
ctttgttggcaaagctgacaaacca

SEQ ID NO: 282638 - DNA, 25 bp, Mus musculus
ctttgttggcaaagcttcttcagct

SEQ ID NO: 282639 - DNA, 25 bp, Mus musculus
ctttgttggcaaaggtgactccaat

SEQ ID NO: 282640 - DNA, 25 bp, Mus musculus
ctttgtttacctaggtgcctatgat

SEQ ID NO: 282641 - DNA, 25 bp, Mus musculus
ctttgtttatctagactaaaacaaa

SEQ ID NO: 282642 - DNA, 25 bp, Mus musculus
ctttgtttatctaggtgcctatgac

SEQ ID NO: 282643 - DNA, 25 bp, Mus musculus
ctttgtttccccagatcctgtcttc

SEQ ID NO: 282644 - DNA, 25 bp, Mus musculus
ctttgtttctcccaggactcatgaa

SEQ ID NO: 282645 - DNA, 25 bp, Mus musculus
ctttgtttggtgctcctaaaaggag

SEQ ID NO: 282646 - DNA, 25 bp, Mus musculus
ctttgtttggtgttaggcaggaaca

SEQ ID NO: 282647 - DNA, 25 bp, Mus musculus
ctttgttttccagccaaatagagga

SEQ ID NO: 282648 - DNA, 25 bp, Mus musculus
ctttgtttttctggatcttgtttcc

SEQ ID NO: 282649 - DNA, 25 bp, Mus musculus
cttttaaaaattgttgcttcctgtt

SEQ ID NO: 282650 - DNA, 25 bp, Mus musculus
cttttaaaactatcacttgtggaag

SEQ ID NO: 282651 - DNA, 25 bp, Mus musculus
cttttaaagcatgcgcagatgacag

SEQ ID NO: 282652 - DNA, 25 bp, Mus musculus
cttttaaagcatgggcagtagctcg

SEQ ID NO: 282653 - DNA, 25 bp, Mus musculus
cttttaaaggattaaaggagagcaa

SEQ ID NO: 282654 - DNA, 25 bp, Mus musculus
cttttaaagtttgaggtgggatgtg

SEQ ID NO: 282655 - DNA, 25 bp, Mus musculus
cttttaaccagaaaggtgatctgta

SEQ ID NO: 282656 - DNA, 25 bp, Mus musculus
cttttaagaagatttaccactcggc

SEQ ID NO: 282657 - DNA, 25 bp, Mus musculus
cttttaattcagttgaaaagggcag

SEQ ID NO: 282658 - DNA, 25 bp, Mus musculus
cttttacaacaaaaggccaactact

SEQ ID NO: 282659 - DNA, 25 bp, Mus musculus
cttttacaagacagtccagcagcag

SEQ ID NO: 282660 - DNA, 25 bp, Mus musculus
cttttacaaggaagggcaaatgact

SEQ ID NO: 282661 - DNA, 25 bp, Mus musculus
cttttacaaggtggtacagcaacaa

SEQ ID NO: 282662 - DNA, 25 bp, Mus musculus
cttttacaataagagaccagcacca

SEQ ID NO: 282663 - DNA, 25 bp, Mus musculus
cttttacatttgtcataatccttca

SEQ ID NO: 282664 - DNA, 25 bp, Mus musculus
cttttacctattcatcgctccaccc

SEQ ID NO: 282665 - DNA, 25 bp, Mus musculus
cttttacctcaacagagaataggtg

SEQ ID NO: 282666 - DNA, 25 bp, Mus musculus
cttttacctcaacagggattctgaa

SEQ ID NO: 282667 - DNA, 25 bp, Mus musculus
cttttactatagccccagcgggaag

SEQ ID NO: 282668 - DNA, 25 bp, Mus musculus
cttttactcggaccaacatatgcta

SEQ ID NO: 282669 - DNA, 25 bp, Mus musculus
cttttactgtataagtcttgcttcc

SEQ ID NO: 282670 - DNA, 25 bp, Mus musculus
cttttacttggcaagtccttggggt

SEQ ID NO: 282671 - DNA, 25 bp, Mus musculus
cttttagaaagggggagctggtgac

SEQ ID NO: 282672 - DNA, 25 bp, Mus musculus
cttttagagatgaggctggaggggt

SEQ ID NO: 282673 - DNA, 25 bp, Mus musculus
cttttagcccagatagtcgccacat

SEQ ID NO: 282674 - DNA, 25 bp, Mus musculus
cttttaggactcagctccatgtcta

SEQ ID NO: 282675 - DNA, 25 bp, Mus musculus
cttttaggactcaggtctggctgtg

SEQ ID NO: 282676 - DNA, 25 bp, Mus musculus
cttttataaaagatctgcagtgggt

SEQ ID NO: 282677 - DNA, 25 bp, Mus musculus
cttttataagacaggaaaagactgt

SEQ ID NO: 282678 - DNA, 25 bp, Mus musculus
cttttataagatgaagacaggaaaa

SEQ ID NO: 282679 - DNA, 25 bp, Mus musculus
cttttataagtctttgcagattctt

SEQ ID NO: 282680 - DNA, 25 bp, Mus musculus
cttttatacaggactgacagacgaa

SEQ ID NO: 282681 - DNA, 25 bp, Mus musculus
cttttatagaccagtttgaatattc

SEQ ID NO: 282682 - DNA, 25 bp, Mus musculus
cttttatcaggttccttagctggcc

SEQ ID NO: 282683 - DNA, 25 bp, Mus musculus
cttttatcccagaaatgtgaatcct

SEQ ID NO: 282684 - DNA, 25 bp, Mus musculus
cttttatcccaggtgtgccattttg

SEQ ID NO: 282685 - DNA, 25 bp, Mus musculus
cttttatcctgtggtgtgagtgttg

SEQ ID NO: 282686 - DNA, 25 bp, Mus musculus
cttttatctcaggtgacataaatct

SEQ ID NO: 282687 - DNA, 25 bp, Mus musculus
cttttatgagtttgaaggaaggaag

SEQ ID NO: 282688 - DNA, 25 bp, Mus musculus
cttttatggccttgaactcagaaat

SEQ ID NO: 282689 - DNA, 25 bp, Mus musculus
cttttattcctacgccagagatgcg

SEQ ID NO: 282690 - DNA, 25 bp, Mus musculus
cttttattcctacggatctcataga

SEQ ID NO: 282691 - DNA, 25 bp, Mus musculus
cttttcaaagcagttgaaaactgaa

SEQ ID NO: 282692 - DNA, 25 bp, Mus musculus
cttttcaaaggagcggatttccatt

SEQ ID NO: 282693 - DNA, 25 bp, Mus musculus
cttttcaacaacaggcatgttacat

SEQ ID NO: 282694 - DNA, 25 bp, Mus musculus
cttttcaacagattttgttcctggc

SEQ ID NO: 282695 - DNA, 25 bp, Mus musculus
cttttcacaatgctcatgatctcac

SEQ ID NO: 282696 - DNA, 25 bp, Mus musculus
cttttcagaccaatacccacaggtc

SEQ ID NO: 282697 - DNA, 25 bp, Mus musculus
cttttcagtctaagtgtacacagga

SEQ ID NO: 282698 - DNA, 25 bp, Mus musculus
cttttcataccagctgcttttatgg

SEQ ID NO: 282699 - DNA, 25 bp, Mus musculus
cttttcataggttggatgatacatg

SEQ ID NO: 282700 - DNA, 25 bp, Mus musculus
cttttcatcatgggaggtgaggctc

SEQ ID NO: 282701 - DNA, 25 bp, Mus musculus
cttttcatcatggtcctccaggagg

SEQ ID NO: 282702 - DNA, 25 bp, Mus musculus
cttttcatctggagactgctcatct

SEQ ID NO: 282703 - DNA, 25 bp, Mus musculus
cttttcatctggagagtctgcagga

SEQ ID NO: 282704 - DNA, 25 bp, Mus musculus
cttttccaacgccgagatgactgac

SEQ ID NO: 282705 - DNA, 25 bp, Mus musculus
cttttccagaagaccagtttcccaa

SEQ ID NO: 282706 - DNA, 25 bp, Mus musculus
cttttccaggcatggtttattgaaa

SEQ ID NO: 282707 - DNA, 25 bp, Mus musculus
cttttcccatcaacctgctgtcctg

SEQ ID NO: 282708 - DNA, 25 bp, Mus musculus
cttttcccctgaagcattgaaaaag

SEQ ID NO: 282709 - DNA, 25 bp, Mus musculus
cttttcccctgaagccaatcatctg

SEQ ID NO: 282710 - DNA, 25 bp, Mus musculus
cttttcccgagccaggatcttgtgc

SEQ ID NO: 282711 - DNA, 25 bp, Mus musculus
cttttcctcagattgtctaaagcca

SEQ ID NO: 282712 - DNA, 25 bp, Mus musculus
cttttcctcatggctgtgacattga

SEQ ID NO: 282713 - DNA, 25 bp, Mus musculus
cttttcctgaaagctttggatagat

SEQ ID NO: 282714 - DNA, 25 bp, Mus musculus
cttttcctgaaagttaaatcggaga

SEQ ID NO: 282715 - DNA, 25 bp, Mus musculus
cttttcctgagagtttggattcgag

SEQ ID NO: 282716 - DNA, 25 bp, Mus musculus
cttttcctgggtgaaagacaaggag

SEQ ID NO: 282717 - DNA, 25 bp, Mus musculus
cttttcctttgagtccatcagcagt

SEQ ID NO: 282718 - DNA, 25 bp, Mus musculus
cttttcgaactacttaaagaaagat

SEQ ID NO: 282719 - DNA, 25 bp, Mus musculus
cttttcgacagtgcgaaaattttgc

SEQ ID NO: 282720 - DNA, 25 bp, Mus musculus
cttttcgcagaagccacagaagagg

SEQ ID NO: 282721 - DNA, 25 bp, Mus musculus
cttttcgcggattctttgggagccc

SEQ ID NO: 282722 - DNA, 25 bp, Mus musculus
cttttcgcttgtggggaatgttttt

SEQ ID NO: 282723 - DNA, 25 bp, Mus musculus
cttttcggcgtggttgagaacaaaa

SEQ ID NO: 282724 - DNA, 25 bp, Mus musculus
cttttctaacaggtctggattttac

SEQ ID NO: 282725 - DNA, 25 bp, Mus musculus
cttttctaaggcatcaatacttgtg

SEQ ID NO: 282726 - DNA, 25 bp, Mus musculus
cttttctcaaattaaatccaagtta

SEQ ID NO: 282727 - DNA, 25 bp, Mus musculus
cttttctcagagcaacacgttttaa

SEQ ID NO: 282728 - DNA, 25 bp, Mus musculus
cttttctcagctgtgacttcttttg

SEQ ID NO: 282729 - DNA, 25 bp, Mus musculus
cttttctcaggacagcatcccagcc

SEQ ID NO: 282730 - DNA, 25 bp, Mus musculus
cttttctctaggcaagaatcaaaag

SEQ ID NO: 282731 - DNA, 25 bp, Mus musculus
cttttctctgagcaaagaacgttct

SEQ ID NO: 282732 - DNA, 25 bp, Mus musculus
cttttctctgcagtcaatcgcaggc

SEQ ID NO: 282733 - DNA, 25 bp, Mus musculus
cttttctgaaggtgtagaagccaca

SEQ ID NO: 282734 - DNA, 25 bp, Mus musculus
cttttctgagtggtccaagccggcc

SEQ ID NO: 282735 - DNA, 25 bp, Mus musculus
cttttctgcggttgatccaaaagat

SEQ ID NO: 282736 - DNA, 25 bp, Mus musculus
cttttctgggtaacacaaggcacat

SEQ ID NO: 282737 - DNA, 25 bp, Mus musculus
cttttctgtagcgctggcgtggatg

SEQ ID NO: 282738 - DNA, 25 bp, Mus musculus
cttttcttcagacggtttctctaga

SEQ ID NO: 282739 - DNA, 25 bp, Mus musculus
cttttcttcagcagatgatgcccgc

SEQ ID NO: 282740 - DNA, 25 bp, Mus musculus
cttttcttccacagtgcctccggag

SEQ ID NO: 282741 - DNA, 25 bp, Mus musculus
cttttcttctggcggcatcgctgtc

SEQ ID NO: 282742 - DNA, 25 bp, Mus musculus
cttttcttgagcgttggtgatgact

SEQ ID NO: 282743 - DNA, 25 bp, Mus musculus
cttttcttgagtgattccacacaag

SEQ ID NO: 282744 - DNA, 25 bp, Mus musculus
cttttgaaagctctgcggagtcgga

SEQ ID NO: 282745 - DNA, 25 bp, Mus musculus
cttttgaaaggaacagattatacca

SEQ ID NO: 282746 - DNA, 25 bp, Mus musculus
cttttgaacttgatcgtactcgacc

SEQ ID NO: 282747 - DNA, 25 bp, Mus musculus
cttttgaacttggatgtccagaggc

SEQ ID NO: 282748 - DNA, 25 bp, Mus musculus
cttttgaaggtgaattcttcaaaga

SEQ ID NO: 282749 - DNA, 25 bp, Mus musculus
cttttgaaggtgtattcttcaaaga

SEQ ID NO: 282750 - DNA, 25 bp, Mus musculus
cttttgaatatccagggttctctga

SEQ ID NO: 282751 - DNA, 25 bp, Mus musculus
cttttgaattaggacgagtcttgca

SEQ ID NO: 282752 - DNA, 25 bp, Mus musculus
cttttgaattgttcctgtgaaggcc

SEQ ID NO: 282753 - DNA, 25 bp, Mus musculus
cttttgacacttaagggctacttga

SEQ ID NO: 282754 - DNA, 25 bp, Mus musculus
cttttgacagccacacctgcgccct

SEQ ID NO: 282755 - DNA, 25 bp, Mus musculus
cttttgagaatgctctggcttctcc

SEQ ID NO: 282756 - DNA, 25 bp, Mus musculus
cttttgagagctgtctctcttttcc

SEQ ID NO: 282757 - DNA, 25 bp, Mus musculus
cttttgagcaaaggagaagcgctac

SEQ ID NO: 282758 - DNA, 25 bp, Mus musculus
cttttgagcaggtagaagagaactg

SEQ ID NO: 282759 - DNA, 25 bp, Mus musculus
cttttgaggaaagcgaatctccccg

SEQ ID NO: 282760 - DNA, 25 bp, Mus musculus
cttttgagtagcagtgagcgtcctg

SEQ ID NO: 282761 - DNA, 25 bp, Mus musculus
cttttgataggacagaacaccaccc

SEQ ID NO: 282762 - DNA, 25 bp, Mus musculus
cttttgataggacagtgttcttcac

SEQ ID NO: 282763 - DNA, 25 bp, Mus musculus
cttttgatttcctgtcccctgaact

SEQ ID NO: 282764 - DNA, 25 bp, Mus musculus
cttttgcaatcaaagttctattttc

SEQ ID NO: 282765 - DNA, 25 bp, Mus musculus
cttttgcaattagaagatggaggtg

SEQ ID NO: 282766 - DNA, 25 bp, Mus musculus
cttttgcagaggtttcctggcagaa

SEQ ID NO: 282767 - DNA, 25 bp, Mus musculus
cttttgcagagttctctgtcattga

SEQ ID NO: 282768 - DNA, 25 bp, Mus musculus
cttttgcagatggagggaagactcc

SEQ ID NO: 282769 - DNA, 25 bp, Mus musculus
cttttgcagatggtagaaggacaag

SEQ ID NO: 282770 - DNA, 25 bp, Mus musculus
cttttgcatggtaagaccagctgtg

SEQ ID NO: 282771 - DNA, 25 bp, Mus musculus
cttttgccagacaagcagtgaaacc

SEQ ID NO: 282772 - DNA, 25 bp, Mus musculus
cttttgccaggtgatggaaaacgtg

SEQ ID NO: 282773 - DNA, 25 bp, Mus musculus
cttttgccctctccgctccctggag

SEQ ID NO: 282774 - DNA, 25 bp, Mus musculus
cttttgcgcaacgaaaaattcattt

SEQ ID NO: 282775 - DNA, 25 bp, Mus musculus
cttttgcgcaacgaatcctgactgt

SEQ ID NO: 282776 - DNA, 25 bp, Mus musculus
cttttgcggagatgcggcattccaa

SEQ ID NO: 282777 - DNA, 25 bp, Mus musculus
cttttgcggagtcactatttagaag

SEQ ID NO: 282778 - DNA, 25 bp, Mus musculus
cttttgctagaggtagaagagccac

SEQ ID NO: 282779 - DNA, 25 bp, Mus musculus
cttttgctatgctcagcacattgca

SEQ ID NO: 282780 - DNA, 25 bp, Mus musculus
cttttgctgagagtgtgtgactccc

SEQ ID NO: 282781 - DNA, 25 bp, Mus musculus
cttttgctggagggagctgggaagc

SEQ ID NO: 282782 - DNA, 25 bp, Mus musculus
cttttggaaagaaagatgcaccaac

SEQ ID NO: 282783 - DNA, 25 bp, Mus musculus
cttttggaaaggtttttcttgatat

SEQ ID NO: 282784 - DNA, 25 bp, Mus musculus
cttttggaagtgaagtttggtgagc

SEQ ID NO: 282785 - DNA, 25 bp, Mus musculus
cttttggacatggactgaagccctt

SEQ ID NO: 282786 - DNA, 25 bp, Mus musculus
cttttggacatggcccttagatgtt

SEQ ID NO: 282787 - DNA, 25 bp, Mus musculus
cttttggacggccagggggtggcac

SEQ ID NO: 282788 - DNA, 25 bp, Mus musculus
cttttggactgggttttgccaggtg

SEQ ID NO: 282789 - DNA, 25 bp, Mus musculus
cttttggagattggggcctgtgttt

SEQ ID NO: 282790 - DNA, 25 bp, Mus musculus
cttttggaggagtgggatcgagtgg

SEQ ID NO: 282791 - DNA, 25 bp, Mus musculus
cttttggatatggggtgcttcgagt

SEQ ID NO: 282792 - DNA, 25 bp, Mus musculus
cttttggccctgagatgacaaatcc

SEQ ID NO: 282793 - DNA, 25 bp, Mus musculus
cttttggctttcgcagagcagtcct

SEQ ID NO: 282794 - DNA, 25 bp, Mus musculus
cttttggctttcgcagagctgctct

SEQ ID NO: 282795 - DNA, 25 bp, Mus musculus
cttttgggaaagcttcaccacgacc

SEQ ID NO: 282796 - DNA, 25 bp, Mus musculus
cttttgggaccagctggaagatggg

SEQ ID NO: 282797 - DNA, 25 bp, Mus musculus
cttttgggagacagagatcctgagg

SEQ ID NO: 282798 - DNA, 25 bp, Mus musculus
cttttggtaatagaggatctgagaa

SEQ ID NO: 282799 - DNA, 25 bp, Mus musculus
cttttggtcacttgctgagatatgg

SEQ ID NO: 282800 - DNA, 25 bp, Mus musculus
cttttggtcatgaagaagcagaatt

SEQ ID NO: 282801 - DNA, 25 bp, Mus musculus
cttttggtcatgaagacatgtttaa

SEQ ID NO: 282802 - DNA, 25 bp, Mus musculus
cttttggtctgtgagcatccctcac

SEQ ID NO: 282803 - DNA, 25 bp, Mus musculus
cttttggtttttggtgaatgaatat

SEQ ID NO: 282804 - DNA, 25 bp, Mus musculus
cttttgtaacagttggatgaaaaat

SEQ ID NO: 282805 - DNA, 25 bp, Mus musculus
cttttgtagccgaagcagatccaca

SEQ ID NO: 282806 - DNA, 25 bp, Mus musculus
cttttgtcaaggactgtgaattgga

SEQ ID NO: 282807 - DNA, 25 bp, Mus musculus
cttttgtcaaggatggtgaggaaga

SEQ ID NO: 282808 - DNA, 25 bp, Mus musculus
cttttgtcagggattcgataaacac

SEQ ID NO: 282809 - DNA, 25 bp, Mus musculus
cttttgtctacaggcttcctgaaga

SEQ ID NO: 282810 - DNA, 25 bp, Mus musculus
cttttgtgaagatcatcacagttga

SEQ ID NO: 282811 - DNA, 25 bp, Mus musculus
cttttgtgccgcaggtcgagatttc

SEQ ID NO: 282812 - DNA, 25 bp, Mus musculus
cttttgtggaagcgatggtgaatga

SEQ ID NO: 282813 - DNA, 25 bp, Mus musculus
cttttgtggacaggttggtttaatg

SEQ ID NO: 282814 - DNA, 25 bp, Mus musculus
cttttgtggacagtatttttgaaca

SEQ ID NO: 282815 - DNA, 25 bp, Mus musculus
cttttgttacagactagcttccttt

SEQ ID NO: 282816 - DNA, 25 bp, Mus musculus
ctttttaaaaagtgtgttcaaagca

SEQ ID NO: 282817 - DNA, 25 bp, Mus musculus
ctttttaaaggaaggcatcccacgt

SEQ ID NO: 282818 - DNA, 25 bp, Mus musculus
ctttttaacaaggtgaactgaagat

SEQ ID NO: 282819 - DNA, 25 bp, Mus musculus
ctttttaatttctctttcctctctc

SEQ ID NO: 282820 - DNA, 25 bp, Mus musculus
ctttttacaaagtgattggagttgt

SEQ ID NO: 282821 - DNA, 25 bp, Mus musculus
ctttttacataatccccagatgcag

SEQ ID NO: 282822 - DNA, 25 bp, Mus musculus
ctttttacataatcggggtctaatg

SEQ ID NO: 282823 - DNA, 25 bp, Mus musculus
ctttttagaagcatggtcttagaaa

SEQ ID NO: 282824 - DNA, 25 bp, Mus musculus
ctttttatctgaaaggcttacctct

SEQ ID NO: 282825 - DNA, 25 bp, Mus musculus
ctttttatctgaaagtggtcccaaa

SEQ ID NO: 282826 - DNA, 25 bp, Mus musculus
ctttttattcaggccacgcaacggg

SEQ ID NO: 282827 - DNA, 25 bp, Mus musculus
ctttttattcagggatgtgaaatga

SEQ ID NO: 282828 - DNA, 25 bp, Mus musculus
ctttttcaagaccaacagcaaccac

SEQ ID NO: 282829 - DNA, 25 bp, Mus musculus
ctttttcaccccaggcttacagttc

SEQ ID NO: 282830 - DNA, 25 bp, Mus musculus
ctttttcagaatatagagtcatgga

SEQ ID NO: 282831 - DNA, 25 bp, Mus musculus
ctttttcatggaagtgtgtgatgac

SEQ ID NO: 282832 - DNA, 25 bp, Mus musculus
ctttttccagcagttggaattgatc

SEQ ID NO: 282833 - DNA, 25 bp, Mus musculus
ctttttccaggatcccattgttaac

SEQ ID NO: 282834 - DNA, 25 bp, Mus musculus
ctttttcccaggcttggatttagaa

SEQ ID NO: 282835 - DNA, 25 bp, Mus musculus
ctttttcctaactcttggcaagtat

SEQ ID NO: 282836 - DNA, 25 bp, Mus musculus
ctttttcctattcttctgccctaga

SEQ ID NO: 282837 - DNA, 25 bp, Mus musculus
ctttttcctccctatctgagctctt

SEQ ID NO: 282838 - DNA, 25 bp, Mus musculus
ctttttctcaggtgccttcagtcaa

SEQ ID NO: 282839 - DNA, 25 bp, Mus musculus
ctttttctcgaaagaaggatttcgg

SEQ ID NO: 282840 - DNA, 25 bp, Mus musculus
ctttttgaaagtaagcgtttcaagg

SEQ ID NO: 282841 - DNA, 25 bp, Mus musculus
ctttttgaaccgctcccattttcgc

SEQ ID NO: 282842 - DNA, 25 bp, Mus musculus
ctttttgaagaagcagaaaagtata

SEQ ID NO: 282843 - DNA, 25 bp, Mus musculus
ctttttgagagtagtataagaaaga

SEQ ID NO: 282844 - DNA, 25 bp, Mus musculus
ctttttgagagtattattggcattt

SEQ ID NO: 282845 - DNA, 25 bp, Mus musculus
ctttttgagcagacctgggcccagt

SEQ ID NO: 282846 - DNA, 25 bp, Mus musculus
ctttttgagcaggtcacaaacctac

SEQ ID NO: 282847 - DNA, 25 bp, Mus musculus
ctttttgagtatccggacaattcca

SEQ ID NO: 282848 - DNA, 25 bp, Mus musculus
ctttttgcctcaggtgacactggag

SEQ ID NO: 282849 - DNA, 25 bp, Mus musculus
ctttttgctttgatgaaaaaacaaa

SEQ ID NO: 282850 - DNA, 25 bp, Mus musculus
ctttttggattcagacgatgtcatg

SEQ ID NO: 282851 - DNA, 25 bp, Mus musculus
ctttttggccgcaggttctctccac

SEQ ID NO: 282852 - DNA, 25 bp, Mus musculus
ctttttgtggagccccgcaatctgt

SEQ ID NO: 282853 - DNA, 25 bp, Mus musculus
ctttttgttggaggtccagatggcc

SEQ ID NO: 282854 - DNA, 25 bp, Mus musculus
cttttttacaggagaaaccctgtgg

SEQ ID NO: 282855 - DNA, 25 bp, Mus musculus
cttttttacctccgcacatccgtga

SEQ ID NO: 282856 - DNA, 25 bp, Mus musculus
cttttttatcaggtcgcatcaaata

SEQ ID NO: 282857 - DNA, 25 bp, Mus musculus
cttttttcaagctatcagagatgcc

SEQ ID NO: 282858 - DNA, 25 bp, Mus musculus
cttttttcaaggatgttaattatga

SEQ ID NO: 282859 - DNA, 25 bp, Mus musculus
cttttttgaaacaggtgttctggct

SEQ ID NO: 282860 - DNA, 25 bp, Mus musculus
cttttttgaaggagcacatggatga

SEQ ID NO: 282861 - DNA, 25 bp, Mus musculus
cttttttgaaggattcactagcaaa

SEQ ID NO: 282862 - DNA, 25 bp, Mus musculus
cttttttgagacagaaaccaactta

SEQ ID NO: 282863 - DNA, 25 bp, Mus musculus
cttttttgagattgagctccttgat

SEQ ID NO: 282864 - DNA, 25 bp, Mus musculus
cttttttgctctctggagccaatta

SEQ ID NO: 282865 - DNA, 25 bp, Mus musculus
ctttttttcccagatgcattacacg

SEQ ID NO: 282866 - DNA, 25 bp, Mus musculus
ctttttttcccaggaccagatagca

SEQ ID NO: 282867 - DNA, 25 bp, Mus musculus
ctttttttcctactcactgtgtgct

SEQ ID NO: 282868 - DNA, 25 bp, Mus musculus
ctttttttggccggacgagcaatgg

SEQ ID NO: 282869 - DNA, 25 bp, Mus musculus
cttttttttattgagtctcatgtag

SEQ ID NO: 282870 - DNA, 25 bp, Mus musculus
gaaaaaaaaaccagtggagcagcgt

SEQ ID NO: 282871 - DNA, 25 bp, Mus musculus
gaaaaaaacacctggacttctctga

SEQ ID NO: 282872 - DNA, 25 bp, Mus musculus
gaaaaaaagctcaggagaaatcaaa

SEQ ID NO: 282873 - DNA, 25 bp, Mus musculus
gaaaaaacagacagtgatgtgactc

SEQ ID NO: 282874 - DNA, 25 bp, Mus musculus
gaaaaaaccgaatcgccatctatga

SEQ ID NO: 282875 - DNA, 25 bp, Mus musculus
gaaaaaagcagtggtttgtattgag

SEQ ID NO: 282876 - DNA, 25 bp, Mus musculus
gaaaaaataggttttcctgcagccc

SEQ ID NO: 282877 - DNA, 25 bp, Mus musculus
gaaaaaatcagcccccgactctcag

SEQ ID NO: 282878 - DNA, 25 bp, Mus musculus
gaaaaaatcagcgcccgactctcag

SEQ ID NO: 282879 - DNA, 25 bp, Mus musculus
gaaaaaatggacaggaatctgaatt

SEQ ID NO: 282880 - DNA, 25 bp, Mus musculus
gaaaaaatggacagttgtctcaaaa

SEQ ID NO: 282881 - DNA, 25 bp, Mus musculus
gaaaaaatgggtggacttggcctgg

SEQ ID NO: 282882 - DNA, 25 bp, Mus musculus
gaaaaaattacacaaacattacttc

SEQ ID NO: 282883 - DNA, 25 bp, Mus musculus
gaaaaacaaagggaatgtgactatt

SEQ ID NO: 282884 - DNA, 25 bp, Mus musculus
gaaaaacaaatgcaatttcaagttc

SEQ ID NO: 282885 - DNA, 25 bp, Mus musculus
gaaaaacaagagacagaaccctgtg

SEQ ID NO: 282886 - DNA, 25 bp, Mus musculus
gaaaaacaagagagtctcactatgt

SEQ ID NO: 282887 - DNA, 25 bp, Mus musculus
gaaaaacaagagcagtcagcacggc

SEQ ID NO: 282888 - DNA, 25 bp, Mus musculus
gaaaaacaagagggtggagatggcg

SEQ ID NO: 282889 - DNA, 25 bp, Mus musculus
gaaaaacaagagttactcacaaaac

SEQ ID NO: 282890 - DNA, 25 bp, Mus musculus
gaaaaacaaggacactgctggccga

SEQ ID NO: 282891 - DNA, 25 bp, Mus musculus
gaaaaacaagggaagcttagatatg

SEQ ID NO: 282892 - DNA, 25 bp, Mus musculus
gaaaaacaagtggagagattttggg

SEQ ID NO: 282893 - DNA, 25 bp, Mus musculus
gaaaaacacagactgcgatggatca

SEQ ID NO: 282894 - DNA, 25 bp, Mus musculus
gaaaaacagaggccagagggcatca

SEQ ID NO: 282895 - DNA, 25 bp, Mus musculus
gaaaaacagctagctgcacgagaaa

SEQ ID NO: 282896 - DNA, 25 bp, Mus musculus
gaaaaaccaatggctccccctgtga

SEQ ID NO: 282897 - DNA, 25 bp, Mus musculus
gaaaaaccagaaccagatggaagtt

SEQ ID NO: 282898 - DNA, 25 bp, Mus musculus
gaaaaaccagaagaacaggagaatg

SEQ ID NO: 282899 - DNA, 25 bp, Mus musculus
gaaaaaccagaagcctgtgccatct

SEQ ID NO: 282900 - DNA, 25 bp, Mus musculus
gaaaaaccaggtggaggatcttctg

SEQ ID NO: 282901 - DNA, 25 bp, Mus musculus
gaaaaacccaaagatgcagacagcc

SEQ ID NO: 282902 - DNA, 25 bp, Mus musculus
gaaaaaccgcacggccttcaacact

SEQ ID NO: 282903 - DNA, 25 bp, Mus musculus
gaaaaactacaaaatccacaggtag

SEQ ID NO: 282904 - DNA, 25 bp, Mus musculus
gaaaaactacagaagttaaatgaag

SEQ ID NO: 282905 - DNA, 25 bp, Mus musculus
gaaaaactatgagattaaaacaagg

SEQ ID NO: 282906 - DNA, 25 bp, Mus musculus
gaaaaactatgagttctgaatttca

SEQ ID NO: 282907 - DNA, 25 bp, Mus musculus
gaaaaactcagtcgtgcggggtcct

SEQ ID NO: 282908 - DNA, 25 bp, Mus musculus
gaaaaacttaagtaaatttgatcct

SEQ ID NO: 282909 - DNA, 25 bp, Mus musculus
gaaaaagaacaagaccgtggctacc

SEQ ID NO: 282910 - DNA, 25 bp, Mus musculus
gaaaaagaatgcggctggcgcattg

SEQ ID NO: 282911 - DNA, 25 bp, Mus musculus
gaaaaagacaagatctccctaggcg

SEQ ID NO: 282912 - DNA, 25 bp, Mus musculus
gaaaaagaccacaaattgatccagc

SEQ ID NO: 282913 - DNA, 25 bp, Mus musculus
gaaaaagagtctgtgctgcaggctg

SEQ ID NO: 282914 - DNA, 25 bp, Mus musculus
gaaaaagatatccttttggataagc

SEQ ID NO: 282915 - DNA, 25 bp, Mus musculus
gaaaaagatcaatggacagctcggc

SEQ ID NO: 282916 - DNA, 25 bp, Mus musculus
gaaaaagctcgccacccccatcagt

SEQ ID NO: 282917 - DNA, 25 bp, Mus musculus
gaaaaagctgaaggacagactgcgc

SEQ ID NO: 282918 - DNA, 25 bp, Mus musculus
gaaaaagctggaggcaagaaaggaa

SEQ ID NO: 282919 - DNA, 25 bp, Mus musculus
gaaaaaggaaggtcatcgtggagaa

SEQ ID NO: 282920 - DNA, 25 bp, Mus musculus
gaaaaaggaggggacgcgaggcgag

SEQ ID NO: 282921 - DNA, 25 bp, Mus musculus
gaaaaaggcagagggagcattcctg

SEQ ID NO: 282922 - DNA, 25 bp, Mus musculus
gaaaaaggccaaaactgtacatcat

SEQ ID NO: 282923 - DNA, 25 bp, Mus musculus
gaaaaaggccaagatatttatcaac

SEQ ID NO: 282924 - DNA, 25 bp, Mus musculus
gaaaaaggggagagcatcactggtc

SEQ ID NO: 282925 - DNA, 25 bp, Mus musculus
gaaaaaggttttgacgcatctggag

SEQ ID NO: 282926 - DNA, 25 bp, Mus musculus
gaaaaagtaagtgcttccttggcag

SEQ ID NO: 282927 - DNA, 25 bp, Mus musculus
gaaaaagtcaagccgagatgactga

SEQ ID NO: 282928 - DNA, 25 bp, Mus musculus
gaaaaagtcaaggaactcaacagag

SEQ ID NO: 282929 - DNA, 25 bp, Mus musculus
gaaaaataaattcggagctgtcttt

SEQ ID NO: 282930 - DNA, 25 bp, Mus musculus
gaaaaataagattggccaggtgaaa

SEQ ID NO: 282931 - DNA, 25 bp, Mus musculus
gaaaaataaggtagagcaactgaag

SEQ ID NO: 282932 - DNA, 25 bp, Mus musculus
gaaaaatacccaaagcacctcatta

SEQ ID NO: 282933 - DNA, 25 bp, Mus musculus
gaaaaatacctcaagggtgaggatc

SEQ ID NO: 282934 - DNA, 25 bp, Mus musculus
gaaaaatacttggagaaactggagg

SEQ ID NO: 282935 - DNA, 25 bp, Mus musculus
gaaaaatatggaacaaaagttgaac

SEQ ID NO: 282936 - DNA, 25 bp, Mus musculus
gaaaaatcaagaaatgtgcctgtgg

SEQ ID NO: 282937 - DNA, 25 bp, Mus musculus
gaaaaatcaagttgtcactcagccc

SEQ ID NO: 282938 - DNA, 25 bp, Mus musculus
gaaaaatcagggggcctgtggcagc

SEQ ID NO: 282939 - DNA, 25 bp, Mus musculus
gaaaaatccatggtgcctgagttca

SEQ ID NO: 282940 - DNA, 25 bp, Mus musculus
gaaaaatccattaccagtgcttggt

SEQ ID NO: 282941 - DNA, 25 bp, Mus musculus
gaaaaatgaaggattcagaaaccct

SEQ ID NO: 282942 - DNA, 25 bp, Mus musculus
gaaaaatgactggcatggaggtgca

SEQ ID NO: 282943 - DNA, 25 bp, Mus musculus
gaaaaatgactgggaaggatttaat

SEQ ID NO: 282944 - DNA, 25 bp, Mus musculus
gaaaaatgagaagaattcagggata

SEQ ID NO: 282945 - DNA, 25 bp, Mus musculus
gaaaaatgagttcattgagaagcga

SEQ ID NO: 282946 - DNA, 25 bp, Mus musculus
gaaaaatgagtttggcaaaggtgtc

SEQ ID NO: 282947 - DNA, 25 bp, Mus musculus
gaaaaatgcatcaaagagatgtctg

SEQ ID NO: 282948 - DNA, 25 bp, Mus musculus
gaaaaatgggagattatgtttaatg

SEQ ID NO: 282949 - DNA, 25 bp, Mus musculus
gaaaaatgtctacgaagagatctca

SEQ ID NO: 282950 - DNA, 25 bp, Mus musculus
gaaaaatgtgaaggggctctttcct

SEQ ID NO: 282951 - DNA, 25 bp, Mus musculus
gaaaaatgtgaaggttggtacagag

SEQ ID NO: 282952 - DNA, 25 bp, Mus musculus
gaaaaattaaccacatgagatatga

SEQ ID NO: 282953 - DNA, 25 bp, Mus musculus
gaaaaattatatggtttgacggatg

SEQ ID NO: 282954 - DNA, 25 bp, Mus musculus
gaaaaattcatgaacgagtttttct

SEQ ID NO: 282955 - DNA, 25 bp, Mus musculus
gaaaaattgaacgagaagtaaacac

SEQ ID NO: 282956 - DNA, 25 bp, Mus musculus
gaaaaattgaacgagaagtaaagtc

SEQ ID NO: 282957 - DNA, 25 bp, Mus musculus
gaaaaatttagaatatgacatctgc

SEQ ID NO: 282958 - DNA, 25 bp, Mus musculus
gaaaaatttggagacagaagcttaa

SEQ ID NO: 282959 - DNA, 25 bp, Mus musculus
gaaaaatttggagctgacatcaaca

SEQ ID NO: 282960 - DNA, 25 bp, Mus musculus
gaaaacaaaaaatcagtggttagcc

SEQ ID NO: 282961 - DNA, 25 bp, Mus musculus
gaaaacaaaaaatcagttcccaaga

SEQ ID NO: 282962 - DNA, 25 bp, Mus musculus
gaaaacaaaaagtgtgaacatggct

SEQ ID NO: 282963 - DNA, 25 bp, Mus musculus
gaaaacaaaacagaccagaaccagc

SEQ ID NO: 282964 - DNA, 25 bp, Mus musculus
gaaaacaaaacgaaccagctgcgat

SEQ ID NO: 282965 - DNA, 25 bp, Mus musculus
gaaaacaaacgatacaaggaggcaa

SEQ ID NO: 282966 - DNA, 25 bp, Mus musculus
gaaaacaaacggtcctgctgtctct

SEQ ID NO: 282967 - DNA, 25 bp, Mus musculus
gaaaacaaagaactgcggacatccc

SEQ ID NO: 282968 - DNA, 25 bp, Mus musculus
gaaaacaaaggcatccttacttcga

SEQ ID NO: 282969 - DNA, 25 bp, Mus musculus
gaaaacaaatggctccagcccactc

SEQ ID NO: 282970 - DNA, 25 bp, Mus musculus
gaaaacaaattagtgacagatcagt

SEQ ID NO: 282971 - DNA, 25 bp, Mus musculus
gaaaacaaattcaagtgctaaactg

SEQ ID NO: 282972 - DNA, 25 bp, Mus musculus
gaaaacaaccaggtattgaccaaga

SEQ ID NO: 282973 - DNA, 25 bp, Mus musculus
gaaaacaagacaggtcgattgagtg

SEQ ID NO: 282974 - DNA, 25 bp, Mus musculus
gaaaacaagctgcaggcttctccag

SEQ ID NO: 282975 - DNA, 25 bp, Mus musculus
gaaaacacacctgacttatttattt

SEQ ID NO: 282976 - DNA, 25 bp, Mus musculus
gaaaacacagccatcaccatcggcc

SEQ ID NO: 282977 - DNA, 25 bp, Mus musculus
gaaaacacaggtcgcctgacgagtc

SEQ ID NO: 282978 - DNA, 25 bp, Mus musculus
gaaaacaccaggcagtggtggatgc

SEQ ID NO: 282979 - DNA, 25 bp, Mus musculus
gaaaacactggaagcaagagaaaaa

SEQ ID NO: 282980 - DNA, 25 bp, Mus musculus
gaaaacactggcggaaccagtattt

SEQ ID NO: 282981 - DNA, 25 bp, Mus musculus
gaaaacagaattataacaattgaaa

SEQ ID NO: 282982 - DNA, 25 bp, Mus musculus
gaaaacagagaaacctgatcaggac

SEQ ID NO: 282983 - DNA, 25 bp, Mus musculus
gaaaacagatgatccagaggagtag

SEQ ID NO: 282984 - DNA, 25 bp, Mus musculus
gaaaacagatggtacaaagaagcgt

SEQ ID NO: 282985 - DNA, 25 bp, Mus musculus
gaaaacaggccacaggaaagcacag

SEQ ID NO: 282986 - DNA, 25 bp, Mus musculus
gaaaacagtgctctgcagttttgaa

SEQ ID NO: 282987 - DNA, 25 bp, Mus musculus
gaaaacataacaacattcccgtcaa

SEQ ID NO: 282988 - DNA, 25 bp, Mus musculus
gaaaacatacatgttgccaggatgc

SEQ ID NO: 282989 - DNA, 25 bp, Mus musculus
gaaaacatcaaaataaaccaggcga

SEQ ID NO: 282990 - DNA, 25 bp, Mus musculus
gaaaacatcaaggaacaataaaaag

SEQ ID NO: 282991 - DNA, 25 bp, Mus musculus
gaaaacatcactgtcgtcactgcgg

SEQ ID NO: 282992 - DNA, 25 bp, Mus musculus
gaaaacatccaatgtctcttcagat

SEQ ID NO: 282993 - DNA, 25 bp, Mus musculus
gaaaacatctccattccaacctggt

SEQ ID NO: 282994 - DNA, 25 bp, Mus musculus
gaaaacatgaggaaggacagacgaa

SEQ ID NO: 282995 - DNA, 25 bp, Mus musculus
gaaaacatgggtacaggaccctgga

SEQ ID NO: 282996 - DNA, 25 bp, Mus musculus
gaaaacatgtatagactttgatgaa

SEQ ID NO: 282997 - DNA, 25 bp, Mus musculus
gaaaacatgtatagctttagatgag

SEQ ID NO: 282998 - DNA, 25 bp, Mus musculus
gaaaacattaagtcttgggtacttg

SEQ ID NO: 282999 - DNA, 25 bp, Mus musculus
gaaaacattaataattaccgtgttt

SEQ ID NO: 283000 - DNA, 25 bp, Mus musculus
gaaaacattatgaactgctgagtgc

SEQ ID NO: 283001 - DNA, 25 bp, Mus musculus
gaaaacattcaaggtgtcaactctg

SEQ ID NO: 283002 - DNA, 25 bp, Mus musculus
gaaaacattgttacagaattgaatt

SEQ ID NO: 283003 - DNA, 25 bp, Mus musculus
gaaaaccaaaggtccagaatagcgt

SEQ ID NO: 283004 - DNA, 25 bp, Mus musculus
gaaaaccaacagggcatgaaagaag

SEQ ID NO: 283005 - DNA, 25 bp, Mus musculus
gaaaaccaagaatccacctcattgc

SEQ ID NO: 283006 - DNA, 25 bp, Mus musculus
gaaaaccaagggctcaccttgtgac

SEQ ID NO: 283007 - DNA, 25 bp, Mus musculus
gaaaaccaatggctcaccctgtgat

SEQ ID NO: 283008 - DNA, 25 bp, Mus musculus
gaaaaccacagtgtcctgtgcatgt

SEQ ID NO: 283009 - DNA, 25 bp, Mus musculus
gaaaaccagacagaataagaatgag

SEQ ID NO: 283010 - DNA, 25 bp, Mus musculus
gaaaaccatgtccagattcggaaac

SEQ ID NO: 283011 - DNA, 25 bp, Mus musculus
gaaaacccaacagcccactgagtgt

SEQ ID NO: 283012 - DNA, 25 bp, Mus musculus
gaaaacccaaggaatatggttgagc

SEQ ID NO: 283013 - DNA, 25 bp, Mus musculus
gaaaacccaatctctgcgattttat

SEQ ID NO: 283014 - DNA, 25 bp, Mus musculus
gaaaacccagtgagatgagtcagaa

SEQ ID NO: 283015 - DNA, 25 bp, Mus musculus
gaaaacccctcttatcctactagtt

SEQ ID NO: 283016 - DNA, 25 bp, Mus musculus
gaaaaccctggcgtttagagaagaa

SEQ ID NO: 283017 - DNA, 25 bp, Mus musculus
gaaaaccgacctatgtcaccttcgc

SEQ ID NO: 283018 - DNA, 25 bp, Mus musculus
gaaaaccgacttccagattaccagg

SEQ ID NO: 283019 - DNA, 25 bp, Mus musculus
gaaaaccgatccagagaaggcctac

SEQ ID NO: 283020 - DNA, 25 bp, Mus musculus
gaaaaccgatccagtggaagaggca

SEQ ID NO: 283021 - DNA, 25 bp, Mus musculus
gaaaaccgcagacctgtgttgcgtg

SEQ ID NO: 283022 - DNA, 25 bp, Mus musculus
gaaaaccgcaggtatggcatttcaa

SEQ ID NO: 283023 - DNA, 25 bp, Mus musculus
gaaaaccgcaggtgagaagacaaaa

SEQ ID NO: 283024 - DNA, 25 bp, Mus musculus
gaaaacctcggctctctgctcccct

SEQ ID NO: 283025 - DNA, 25 bp, Mus musculus
gaaaacctgaggagccaacagaagt

SEQ ID NO: 283026 - DNA, 25 bp, Mus musculus
gaaaacctgagggtgatttcagact

SEQ ID NO: 283027 - DNA, 25 bp, Mus musculus
gaaaacctgcagtgtcttaaaacat

SEQ ID NO: 283028 - DNA, 25 bp, Mus musculus
gaaaaccttcagttggatcctccag

SEQ ID NO: 283029 - DNA, 25 bp, Mus musculus
gaaaacgaagaaatgattctgggga

SEQ ID NO: 283030 - DNA, 25 bp, Mus musculus
gaaaacgagtagaagatgaaagtct

SEQ ID NO: 283031 - DNA, 25 bp, Mus musculus
gaaaacggaggatggacagtcatac

SEQ ID NO: 283032 - DNA, 25 bp, Mus musculus
gaaaacgttctgcagcccacacacc

SEQ ID NO: 283033 - DNA, 25 bp, Mus musculus
gaaaactaagatgtcaacttgtgga

SEQ ID NO: 283034 - DNA, 25 bp, Mus musculus
gaaaactacaagaaatatgtggaag

SEQ ID NO: 283035 - DNA, 25 bp, Mus musculus
gaaaactatgcaggtgtgcattgga

SEQ ID NO: 283036 - DNA, 25 bp, Mus musculus
gaaaactatgctgaacttggtgttg

SEQ ID NO: 283037 - DNA, 25 bp, Mus musculus
gaaaactatggattccaaaatgcgt

SEQ ID NO: 283038 - DNA, 25 bp, Mus musculus
gaaaactatggtgaaccgtgtgtgt

SEQ ID NO: 283039 - DNA, 25 bp, Mus musculus
gaaaactatggtgaaggctcttgct

SEQ ID NO: 283040 - DNA, 25 bp, Mus musculus
gaaaactatggtgacctgctggaat

SEQ ID NO: 283041 - DNA, 25 bp, Mus musculus
gaaaactatgtgcttgacagaagac

SEQ ID NO: 283042 - DNA, 25 bp, Mus musculus
gaaaactccaggatgtgtttgaaat

SEQ ID NO: 283043 - DNA, 25 bp, Mus musculus
gaaaactgaaaaaaggctgtgacct

SEQ ID NO: 283044 - DNA, 25 bp, Mus musculus
gaaaactgaaaatgatacagtgtga

SEQ ID NO: 283045 - DNA, 25 bp, Mus musculus
gaaaactgaaaatggtgttttcgat

SEQ ID NO: 283046 - DNA, 25 bp, Mus musculus
gaaaactgactgagactaaaataca

SEQ ID NO: 283047 - DNA, 25 bp, Mus musculus
gaaaactgagatgtgtctacattgg

SEQ ID NO: 283048 - DNA, 25 bp, Mus musculus
gaaaactgcaaagaaccgggtggtg

SEQ ID NO: 283049 - DNA, 25 bp, Mus musculus
gaaaactggaagtgacccagactac

SEQ ID NO: 283050 - DNA, 25 bp, Mus musculus
gaaaactggggtaattgaacatgaa

SEQ ID NO: 283051 - DNA, 25 bp, Mus musculus
gaaaactggtctctacttggctctg

SEQ ID NO: 283052 - DNA, 25 bp, Mus musculus
gaaaactggtctgtacttggctctg

SEQ ID NO: 283053 - DNA, 25 bp, Mus musculus
gaaaactgtccggccaggtatcatg

SEQ ID NO: 283054 - DNA, 25 bp, Mus musculus
gaaaactgtggcaacataacatgta

SEQ ID NO: 283055 - DNA, 25 bp, Mus musculus
gaaaactgttcaagctgggaggcac

SEQ ID NO: 283056 - DNA, 25 bp, Mus musculus
gaaaactgttcaagttgtcccccat

SEQ ID NO: 283057 - DNA, 25 bp, Mus musculus
gaaaacttgtgaggttctctaatga

SEQ ID NO: 283058 - DNA, 25 bp, Mus musculus
gaaaactttcagtgggtggtgatag

SEQ ID NO: 283059 - DNA, 25 bp, Mus musculus
gaaaagaaacagcaggtgattcagg

SEQ ID NO: 283060 - DNA, 25 bp, Mus musculus
gaaaagaaagaatgcgtccaccatc

SEQ ID NO: 283061 - DNA, 25 bp, Mus musculus
gaaaagaaagagagttcgatgccca

SEQ ID NO: 283062 - DNA, 25 bp, Mus musculus
gaaaagaaagctgttcagagctatt

SEQ ID NO: 283063 - DNA, 25 bp, Mus musculus
gaaaagaaagtctgccaaggcacaa

SEQ ID NO: 283064 - DNA, 25 bp, Mus musculus
gaaaagaaatacaaagatgactcaa

SEQ ID NO: 283065 - DNA, 25 bp, Mus musculus
gaaaagaaatagaggtacaacataa

SEQ ID NO: 283066 - DNA, 25 bp, Mus musculus
gaaaagaaatgtgcaattcctaaat

SEQ ID NO: 283067 - DNA, 25 bp, Mus musculus
gaaaagaaatgtgcacttggatctc

SEQ ID NO: 283068 - DNA, 25 bp, Mus musculus
gaaaagaaattcaaagatgactcaa

SEQ ID NO: 283069 - DNA, 25 bp, Mus musculus
gaaaagaacacagaacttgtccttt

SEQ ID NO: 283070 - DNA, 25 bp, Mus musculus
gaaaagaacacagtgccctggttcc

SEQ ID NO: 283071 - DNA, 25 bp, Mus musculus
gaaaagaaccgacgagctcacctgc

SEQ ID NO: 283072 - DNA, 25 bp, Mus musculus
gaaaagaaccgtggctctccaggct

SEQ ID NO: 283073 - DNA, 25 bp, Mus musculus
gaaaagaacgaaagtcagcgtggga

SEQ ID NO: 283074 - DNA, 25 bp, Mus musculus
gaaaagaactaaatggcagcacaaa

SEQ ID NO: 283075 - DNA, 25 bp, Mus musculus
gaaaagaactaatttcagcatatgt

SEQ ID NO: 283076 - DNA, 25 bp, Mus musculus
gaaaagaactatgtgcaacctcaag

SEQ ID NO: 283077 - DNA, 25 bp, Mus musculus
gaaaagaactgttcagctcctaatc

SEQ ID NO: 283078 - DNA, 25 bp, Mus musculus
gaaaagaaggaggacattttccgta

SEQ ID NO: 283079 - DNA, 25 bp, Mus musculus
gaaaagaaggaggacgaggatataa

SEQ ID NO: 283080 - DNA, 25 bp, Mus musculus
gaaaagacacaagaaatttacccaa

SEQ ID NO: 283081 - DNA, 25 bp, Mus musculus
gaaaagacatggagatacagaatta

SEQ ID NO: 283082 - DNA, 25 bp, Mus musculus
gaaaagacatggaggaagcaagggc

SEQ ID NO: 283083 - DNA, 25 bp, Mus musculus
gaaaagaccactaaccatgagttta

SEQ ID NO: 283084 - DNA, 25 bp, Mus musculus
gaaaagaccactgggttatcctatc

SEQ ID NO: 283085 - DNA, 25 bp, Mus musculus
gaaaagacggaaagctcatcaagca

SEQ ID NO: 283086 - DNA, 25 bp, Mus musculus
gaaaagacggaaaggagagatctgt

SEQ ID NO: 283087 - DNA, 25 bp, Mus musculus
gaaaagagaagctgttgcaggaaga

SEQ ID NO: 283088 - DNA, 25 bp, Mus musculus
gaaaagagagagaggtacctgtgtc

SEQ ID NO: 283089 - DNA, 25 bp, Mus musculus
gaaaagagagggggtccactgcgtc

SEQ ID NO: 283090 - DNA, 25 bp, Mus musculus
gaaaagagagtgtatctgtcagaat

SEQ ID NO: 283091 - DNA, 25 bp, Mus musculus
gaaaagagctggattctaatccctt

SEQ ID NO: 283092 - DNA, 25 bp, Mus musculus
gaaaagaggaccccaggacttcttc

SEQ ID NO: 283093 - DNA, 25 bp, Mus musculus
gaaaagaggagtgggagctcaaccc

SEQ ID NO: 283094 - DNA, 25 bp, Mus musculus
gaaaagataaaacagcgtttatttg

SEQ ID NO: 283095 - DNA, 25 bp, Mus musculus
gaaaagatgaaggagcttcatatgg

SEQ ID NO: 283096 - DNA, 25 bp, Mus musculus
gaaaagatgaaggggatggtaataa

SEQ ID NO: 283097 - DNA, 25 bp, Mus musculus
gaaaagcaaaacagggagccaccca

SEQ ID NO: 283098 - DNA, 25 bp, Mus musculus
gaaaagcaactggatgaactgcttg

SEQ ID NO: 283099 - DNA, 25 bp, Mus musculus
gaaaagcaagaagcacatggcatgt

SEQ ID NO: 283100 - DNA, 25 bp, Mus musculus
gaaaagcaagaaggacctagaccgc

SEQ ID NO: 283101 - DNA, 25 bp, Mus musculus
gaaaagcaagaagggtcttgttgca

SEQ ID NO: 283102 - DNA, 25 bp, Mus musculus
gaaaagcaagtgctgtcttcctgct

SEQ ID NO: 283103 - DNA, 25 bp, Mus musculus
gaaaagcacagacgagctaaactca

SEQ ID NO: 283104 - DNA, 25 bp, Mus musculus
gaaaagcacagccttcacaggctgc

SEQ ID NO: 283105 - DNA, 25 bp, Mus musculus
gaaaagcacaggctgctgaggaacc

SEQ ID NO: 283106 - DNA, 25 bp, Mus musculus
gaaaagcagaccagccctagtcgag

SEQ ID NO: 283107 - DNA, 25 bp, Mus musculus
gaaaagccaatagtaggaattccag

SEQ ID NO: 283108 - DNA, 25 bp, Mus musculus
gaaaagccagagaagtgtgtgacaa

SEQ ID NO: 283109 - DNA, 25 bp, Mus musculus
gaaaagccaggcctgtgatcctgga

SEQ ID NO: 283110 - DNA, 25 bp, Mus musculus
gaaaagcccaacaccagctacatca

SEQ ID NO: 283111 - DNA, 25 bp, Mus musculus
gaaaagcccaggtttaattcagaag

SEQ ID NO: 283112 - DNA, 25 bp, Mus musculus
gaaaagcccagtggctttgggtggc

SEQ ID NO: 283113 - DNA, 25 bp, Mus musculus
gaaaagcccagttctaattcagaag

SEQ ID NO: 283114 - DNA, 25 bp, Mus musculus
gaaaagccggctttctccttccaac

SEQ ID NO: 283115 - DNA, 25 bp, Mus musculus
gaaaagccgggtactggaaattggc

SEQ ID NO: 283116 - DNA, 25 bp, Mus musculus
gaaaagcctcctgctcctgagtcag

SEQ ID NO: 283117 - DNA, 25 bp, Mus musculus
gaaaagcctgacagaagtcgaggaa

SEQ ID NO: 283118 - DNA, 25 bp, Mus musculus
gaaaagcctgctccaggtctggttc

SEQ ID NO: 283119 - DNA, 25 bp, Mus musculus
gaaaagcgagctgggagaacagctg

SEQ ID NO: 283120 - DNA, 25 bp, Mus musculus
gaaaagcgaggaggcggctcagtgg

SEQ ID NO: 283121 - DNA, 25 bp, Mus musculus
gaaaagcgaggccttggaacagcgc

SEQ ID NO: 283122 - DNA, 25 bp, Mus musculus
gaaaagctcaagaagaaagagttcg

SEQ ID NO: 283123 - DNA, 25 bp, Mus musculus
gaaaagctcaggctgcaagcctgag

SEQ ID NO: 283124 - DNA, 25 bp, Mus musculus
gaaaagctcaggctggcaaatgagg

SEQ ID NO: 283125 - DNA, 25 bp, Mus musculus
gaaaagctccaagaggtgtgtgata

SEQ ID NO: 283126 - DNA, 25 bp, Mus musculus
gaaaagctgaccaagggactgcaca

SEQ ID NO: 283127 - DNA, 25 bp, Mus musculus
gaaaagctgagagaaacgaagtgag

SEQ ID NO: 283128 - DNA, 25 bp, Mus musculus
gaaaagctgcaagctttcagaaaga

SEQ ID NO: 283129 - DNA, 25 bp, Mus musculus
gaaaagctgcaagttgcagaattaa

SEQ ID NO: 283130 - DNA, 25 bp, Mus musculus
gaaaaggaaaaggagctctgtcagg

SEQ ID NO: 283131 - DNA, 25 bp, Mus musculus
gaaaaggaaaggagtgactggtcag

SEQ ID NO: 283132 - DNA, 25 bp, Mus musculus
gaaaaggaactgcaggggaagcaca

SEQ ID NO: 283133 - DNA, 25 bp, Mus musculus
gaaaaggaactgcaggttgacgtga

SEQ ID NO: 283134 - DNA, 25 bp, Mus musculus
gaaaaggaagatgacaagagaagaa

SEQ ID NO: 283135 - DNA, 25 bp, Mus musculus
gaaaaggaagatggaggaaagacaa

SEQ ID NO: 283136 - DNA, 25 bp, Mus musculus
gaaaaggaaggtacaagaggacacc

SEQ ID NO: 283137 - DNA, 25 bp, Mus musculus
gaaaaggaaggtgtcttctcgtccc

SEQ ID NO: 283138 - DNA, 25 bp, Mus musculus
gaaaaggacaggacctttcctagca

SEQ ID NO: 283139 - DNA, 25 bp, Mus musculus
gaaaaggacaggacgagtattatat

SEQ ID NO: 283140 - DNA, 25 bp, Mus musculus
gaaaaggacaggacggaaaaagaga

SEQ ID NO: 283141 - DNA, 25 bp, Mus musculus
gaaaaggagaagcccaacaggaggg

SEQ ID NO: 283142 - DNA, 25 bp, Mus musculus
gaaaaggagcgagagtaccccaggc

SEQ ID NO: 283143 - DNA, 25 bp, Mus musculus
gaaaaggagcgagagtttccactgt

SEQ ID NO: 283144 - DNA, 25 bp, Mus musculus
gaaaaggagctgggagactccctga

SEQ ID NO: 283145 - DNA, 25 bp, Mus musculus
gaaaaggagtgttaagcaaaaggaa

SEQ ID NO: 283146 - DNA, 25 bp, Mus musculus
gaaaaggatgaaaagcttattcgtc

SEQ ID NO: 283147 - DNA, 25 bp, Mus musculus
gaaaaggatgcctggcggaaagctt

SEQ ID NO: 283148 - DNA, 25 bp, Mus musculus
gaaaaggattttgagaacctgggtg

SEQ ID NO: 283149 - DNA, 25 bp, Mus musculus
gaaaaggattttgatcactggaggt

SEQ ID NO: 283150 - DNA, 25 bp, Mus musculus
gaaaaggattttggcaggaagagaa

SEQ ID NO: 283151 - DNA, 25 bp, Mus musculus
gaaaaggattttgttgaccagatat

SEQ ID NO: 283152 - DNA, 25 bp, Mus musculus
gaaaaggcacaaagtaagcgcaaag

SEQ ID NO: 283153 - DNA, 25 bp, Mus musculus
gaaaaggcagaagatgcatattgaa

SEQ ID NO: 283154 - DNA, 25 bp, Mus musculus
gaaaaggcagaagcagaaatgctaa

SEQ ID NO: 283155 - DNA, 25 bp, Mus musculus
gaaaaggcagcattctcatacaaga

SEQ ID NO: 283156 - DNA, 25 bp, Mus musculus
gaaaaggccaaaagcctgatagagg

SEQ ID NO: 283157 - DNA, 25 bp, Mus musculus
gaaaaggccaagattcttcaggaga

SEQ ID NO: 283158 - DNA, 25 bp, Mus musculus
gaaaaggccagcctgccgggagtga

SEQ ID NO: 283159 - DNA, 25 bp, Mus musculus
gaaaaggcggcggtcctttctacaa

SEQ ID NO: 283160 - DNA, 25 bp, Mus musculus
gaaaaggctaagagcctgaccaggg

SEQ ID NO: 283161 - DNA, 25 bp, Mus musculus
gaaaaggctgtaatttggcctcagt

SEQ ID NO: 283162 - DNA, 25 bp, Mus musculus
gaaaaggggacacattttagtttct

SEQ ID NO: 283163 - DNA, 25 bp, Mus musculus
gaaaaggtcaaaactctaacacgtg

SEQ ID NO: 283164 - DNA, 25 bp, Mus musculus
gaaaaggtgcagatcctggggcaga

SEQ ID NO: 283165 - DNA, 25 bp, Mus musculus
gaaaaggtgcagcaactgctttgct

SEQ ID NO: 283166 - DNA, 25 bp, Mus musculus
gaaaaggttgatgggaatgtaaata

SEQ ID NO: 283167 - DNA, 25 bp, Mus musculus
gaaaaggttgatggtccgcagacat

SEQ ID NO: 283168 - DNA, 25 bp, Mus musculus
gaaaagtaccaggtgttttcagctg

SEQ ID NO: 283169 - DNA, 25 bp, Mus musculus
gaaaagtcaagaagaacaaacaaca

SEQ ID NO: 283170 - DNA, 25 bp, Mus musculus
gaaaagtcaaggtgtactttgtggg

SEQ ID NO: 283171 - DNA, 25 bp, Mus musculus
gaaaagtcaggctattgaccttctg

SEQ ID NO: 283172 - DNA, 25 bp, Mus musculus
gaaaagtcctggaggcaggcgacaa

SEQ ID NO: 283173 - DNA, 25 bp, Mus musculus
gaaaagtcctggaggctggagtcac

SEQ ID NO: 283174 - DNA, 25 bp, Mus musculus
gaaaagtctaaagggccagtgtcct

SEQ ID NO: 283175 - DNA, 25 bp, Mus musculus
gaaaagtctaagggcagtttagcta

SEQ ID NO: 283176 - DNA, 25 bp, Mus musculus
gaaaagtgatgggattcgaagagtc

SEQ ID NO: 283177 - DNA, 25 bp, Mus musculus
gaaaagtgcatccatgcagtattca

SEQ ID NO: 283178 - DNA, 25 bp, Mus musculus
gaaaagtgcggggaagcgcttggcc

SEQ ID NO: 283179 - DNA, 25 bp, Mus musculus
gaaaagtgtgagaccatccatgtgg

SEQ ID NO: 283180 - DNA, 25 bp, Mus musculus
gaaaagtgtgagtccatccatgtgg

SEQ ID NO: 283181 - DNA, 25 bp, Mus musculus
gaaaagttaaccagagtttgagtga

SEQ ID NO: 283182 - DNA, 25 bp, Mus musculus
gaaaagtttgaccccccagacttct

SEQ ID NO: 283183 - DNA, 25 bp, Mus musculus
gaaaagtttgataacttacagtcct

SEQ ID NO: 283184 - DNA, 25 bp, Mus musculus
gaaaagtttgtcaaagacatagatg

SEQ ID NO: 283185 - DNA, 25 bp, Mus musculus
gaaaagttttggcatacaaatgctc

SEQ ID NO: 283186 - DNA, 25 bp, Mus musculus
gaaaataaagaataaactagacaaa

SEQ ID NO: 283187 - DNA, 25 bp, Mus musculus
gaaaataaaggtgcctcgtctccag

SEQ ID NO: 283188 - DNA, 25 bp, Mus musculus
gaaaataaataaggaagcagtatgg

SEQ ID NO: 283189 - DNA, 25 bp, Mus musculus
gaaaataagccttgtacactggaca

SEQ ID NO: 283190 - DNA, 25 bp, Mus musculus
gaaaataattgatgctgtgaaggct

SEQ ID NO: 283191 - DNA, 25 bp, Mus musculus
gaaaatacagagcatacgatgcgac

SEQ ID NO: 283192 - DNA, 25 bp, Mus musculus
gaaaatacagatctgtgtcagcatt

SEQ ID NO: 283193 - DNA, 25 bp, Mus musculus
gaaaatacgtcaaagagcagtgact

SEQ ID NO: 283194 - DNA, 25 bp, Mus musculus
gaaaatactgaattttctcagcgtg

SEQ ID NO: 283195 - DNA, 25 bp, Mus musculus
gaaaatactttccgtccagatcgcc

SEQ ID NO: 283196 - DNA, 25 bp, Mus musculus
gaaaatagattagcattcttgaagt

SEQ ID NO: 283197 - DNA, 25 bp, Mus musculus
gaaaatatcaagccgcctgtttctg

SEQ ID NO: 283198 - DNA, 25 bp, Mus musculus
gaaaatatcaagccgcgttttacga

SEQ ID NO: 283199 - DNA, 25 bp, Mus musculus
gaaaatatcaggaagcagtgcattg

SEQ ID NO: 283200 - DNA, 25 bp, Mus musculus
gaaaatatctttgtatcttaaaaga

SEQ ID NO: 283201 - DNA, 25 bp, Mus musculus
gaaaatattgaagtttaccatagtt

SEQ ID NO: 283202 - DNA, 25 bp, Mus musculus
gaaaatattggattggaagcctgcg

SEQ ID NO: 283203 - DNA, 25 bp, Mus musculus
gaaaatatttagattgaggatgggt

SEQ ID NO: 283204 - DNA, 25 bp, Mus musculus
gaaaatcaaggagcttgtagtgaag

SEQ ID NO: 283205 - DNA, 25 bp, Mus musculus
gaaaatcaccagatggtctcagcac

SEQ ID NO: 283206 - DNA, 25 bp, Mus musculus
gaaaatcagacaagaaccctaattc

SEQ ID NO: 283207 - DNA, 25 bp, Mus musculus
gaaaatcagacaagctatggtatct

SEQ ID NO: 283208 - DNA, 25 bp, Mus musculus
gaaaatcatatgtgacaaatacaag

SEQ ID NO: 283209 - DNA, 25 bp, Mus musculus
gaaaatccaaaaggacacatgtatg

SEQ ID NO: 283210 - DNA, 25 bp, Mus musculus
gaaaatccaaaaggatctggagact

SEQ ID NO: 283211 - DNA, 25 bp, Mus musculus
gaaaatccagcagacccgagaagcc

SEQ ID NO: 283212 - DNA, 25 bp, Mus musculus
gaaaatccagttcacagtgtagagc

SEQ ID NO: 283213 - DNA, 25 bp, Mus musculus
gaaaatcctatcaagaggcaggaag

SEQ ID NO: 283214 - DNA, 25 bp, Mus musculus
gaaaatcctatcaaggctcatcagc

SEQ ID NO: 283215 - DNA, 25 bp, Mus musculus
gaaaatcctgcaggactacaaatct

SEQ ID NO: 283216 - DNA, 25 bp, Mus musculus
gaaaatccttgccagagatcctcag

SEQ ID NO: 283217 - DNA, 25 bp, Mus musculus
gaaaatccttgctagagaaaatgag

SEQ ID NO: 283218 - DNA, 25 bp, Mus musculus
gaaaatctatgaaagccctggtttg

SEQ ID NO: 283219 - DNA, 25 bp, Mus musculus
gaaaatctatgaaatcagcaaccgc

SEQ ID NO: 283220 - DNA, 25 bp, Mus musculus
gaaaatctcaagacaaaaagatatt

SEQ ID NO: 283221 - DNA, 25 bp, Mus musculus
gaaaatctcaaggtctatcctaaag

SEQ ID NO: 283222 - DNA, 25 bp, Mus musculus
gaaaatctcagcctccttccctggg

SEQ ID NO: 283223 - DNA, 25 bp, Mus musculus
gaaaatcttagattttgtccagaca

SEQ ID NO: 283224 - DNA, 25 bp, Mus musculus
gaaaatcttagcaaagagatgtctg

SEQ ID NO: 283225 - DNA, 25 bp, Mus musculus
gaaaatctttcaacgccaaccactc

SEQ ID NO: 283226 - DNA, 25 bp, Mus musculus
gaaaatgaaacttggggaccatgcc

SEQ ID NO: 283227 - DNA, 25 bp, Mus musculus
gaaaatgaaagttgtaagcatcaat

SEQ ID NO: 283228 - DNA, 25 bp, Mus musculus
gaaaatgaacaatcactttttaatt

SEQ ID NO: 283229 - DNA, 25 bp, Mus musculus
gaaaatgaagagataggcgctcaca

SEQ ID NO: 283230 - DNA, 25 bp, Mus musculus
gaaaatgaagatgctagaaaataag

SEQ ID NO: 283231 - DNA, 25 bp, Mus musculus
gaaaatgaaggttctgggctgacaa

SEQ ID NO: 283232 - DNA, 25 bp, Mus musculus
gaaaatgaaggttgcacgatttcaa

SEQ ID NO: 283233 - DNA, 25 bp, Mus musculus
gaaaatgaagtcgagcctgttgacg

SEQ ID NO: 283234 - DNA, 25 bp, Mus musculus
gaaaatgaagtttctacactaaagg

SEQ ID NO: 283235 - DNA, 25 bp, Mus musculus
gaaaatgaatttcaaggggctgagg

SEQ ID NO: 283236 - DNA, 25 bp, Mus musculus
gaaaatgagaaagaagggagcctag

SEQ ID NO: 283237 - DNA, 25 bp, Mus musculus
gaaaatgagaaagatatagcaggtt

SEQ ID NO: 283238 - DNA, 25 bp, Mus musculus
gaaaatgagaaagattctgaagcaa

SEQ ID NO: 283239 - DNA, 25 bp, Mus musculus
gaaaatgagctgaacattatccaca

SEQ ID NO: 283240 - DNA, 25 bp, Mus musculus
gaaaatgagtaagagatttgaaaaa

SEQ ID NO: 283241 - DNA, 25 bp, Mus musculus
gaaaatgataagctgaatgatatgg

SEQ ID NO: 283242 - DNA, 25 bp, Mus musculus
gaaaatgataagctgggtaaaactc

SEQ ID NO: 283243 - DNA, 25 bp, Mus musculus
gaaaatgcaaaggcaggaaggagcc

SEQ ID NO: 283244 - DNA, 25 bp, Mus musculus
gaaaatgcaaaggtttcatcacttc

SEQ ID NO: 283245 - DNA, 25 bp, Mus musculus
gaaaatgcacgagcctggttacctg

SEQ ID NO: 283246 - DNA, 25 bp, Mus musculus
gaaaatgccgagctgccacaggcac

SEQ ID NO: 283247 - DNA, 25 bp, Mus musculus
gaaaatgctaaggtttatgggaccg

SEQ ID NO: 283248 - DNA, 25 bp, Mus musculus
gaaaatgctacaaagacatccttct

SEQ ID NO: 283249 - DNA, 25 bp, Mus musculus
gaaaatgctgaaggacgcattcagc

SEQ ID NO: 283250 - DNA, 25 bp, Mus musculus
gaaaatgctgacgtcctacaaccag

SEQ ID NO: 283251 - DNA, 25 bp, Mus musculus
gaaaatgcttcgagaacagaaagag

SEQ ID NO: 283252 - DNA, 25 bp, Mus musculus
gaaaatgcttgggtcaccagtggat

SEQ ID NO: 283253 - DNA, 25 bp, Mus musculus
gaaaatggaacaaggacctctgctt

SEQ ID NO: 283254 - DNA, 25 bp, Mus musculus
gaaaatggaacaagtacaaccctca

SEQ ID NO: 283255 - DNA, 25 bp, Mus musculus
gaaaatggaactagtaacaaggacg

SEQ ID NO: 283256 - DNA, 25 bp, Mus musculus
gaaaatggaagagacctgtgggtct

SEQ ID NO: 283257 - DNA, 25 bp, Mus musculus
gaaaatggaagcttggctgaagagg

SEQ ID NO: 283258 - DNA, 25 bp, Mus musculus
gaaaatggaaggtcactacgttcac

SEQ ID NO: 283259 - DNA, 25 bp, Mus musculus
gaaaatggacggacaaaggagacaa

SEQ ID NO: 283260 - DNA, 25 bp, Mus musculus
gaaaatggacggaggaagtgtgaac

SEQ ID NO: 283261 - DNA, 25 bp, Mus musculus
gaaaatggatgtcattgctagaatc

SEQ ID NO: 283262 - DNA, 25 bp, Mus musculus
gaaaatggatgttaccattgagcct

SEQ ID NO: 283263 - DNA, 25 bp, Mus musculus
gaaaatggcaacctcctctgacctc

SEQ ID NO: 283264 - DNA, 25 bp, Mus musculus
gaaaatggccaccaccggccacacc

SEQ ID NO: 283265 - DNA, 25 bp, Mus musculus
gaaaatggctcagggggagcaccgt

SEQ ID NO: 283266 - DNA, 25 bp, Mus musculus
gaaaatgggaagacagatgtctgag

SEQ ID NO: 283267 - DNA, 25 bp, Mus musculus
gaaaatgggcaaggtgaaattggtg

SEQ ID NO: 283268 - DNA, 25 bp, Mus musculus
gaaaatgtcaaggtatacatctatt

SEQ ID NO: 283269 - DNA, 25 bp, Mus musculus
gaaaatgtgctggccatgccttttt

SEQ ID NO: 283270 - DNA, 25 bp, Mus musculus
gaaaatgtggctaccctggtcatct

SEQ ID NO: 283271 - DNA, 25 bp, Mus musculus
gaaaatgtgtaagcggccatgtatt

SEQ ID NO: 283272 - DNA, 25 bp, Mus musculus
gaaaatgtgtaagcggtatttggag

SEQ ID NO: 283273 - DNA, 25 bp, Mus musculus
gaaaatgttaaaatgtgtcccctgc

SEQ ID NO: 283274 - DNA, 25 bp, Mus musculus
gaaaattaaagatgaactaatgact

SEQ ID NO: 283275 - DNA, 25 bp, Mus musculus
gaaaattaaaggaaattgatcgtga

SEQ ID NO: 283276 - DNA, 25 bp, Mus musculus
gaaaattaatatatgatcctgaaaa

SEQ ID NO: 283277 - DNA, 25 bp, Mus musculus
gaaaattactatagagaataggtca

SEQ ID NO: 283278 - DNA, 25 bp, Mus musculus
gaaaattactataggctgcagaaga

SEQ ID NO: 283279 - DNA, 25 bp, Mus musculus
gaaaattattcaagaacaggacgcg

SEQ ID NO: 283280 - DNA, 25 bp, Mus musculus
gaaaattattcaagagatcatcgat

SEQ ID NO: 283281 - DNA, 25 bp, Mus musculus
gaaaattattggattgcagtgctcc

SEQ ID NO: 283282 - DNA, 25 bp, Mus musculus
gaaaattcatgcagatgaatgagaa

SEQ ID NO: 283283 - DNA, 25 bp, Mus musculus
gaaaattcatgcgagggagaactgg

SEQ ID NO: 283284 - DNA, 25 bp, Mus musculus
gaaaattgcaccaggtgatgttatt

SEQ ID NO: 283285 - DNA, 25 bp, Mus musculus
gaaaattgcagaagggagagagtgg

SEQ ID NO: 283286 - DNA, 25 bp, Mus musculus
gaaaattgcagaaggtgcacatcag

SEQ ID NO: 283287 - DNA, 25 bp, Mus musculus
gaaaattgtccgatgccatgaacac

SEQ ID NO: 283288 - DNA, 25 bp, Mus musculus
gaaaatttaaaaggttgcagtgtgt

SEQ ID NO: 283289 - DNA, 25 bp, Mus musculus
gaaaatttaaagtaggaggagccaa

SEQ ID NO: 283290 - DNA, 25 bp, Mus musculus
gaaaatttcaggccctcagtaccgc

SEQ ID NO: 283291 - DNA, 25 bp, Mus musculus
gaaaatttggaggcagcaccggctt

SEQ ID NO: 283292 - DNA, 25 bp, Mus musculus
gaaacaaaagataaaatattttgac

SEQ ID NO: 283293 - DNA, 25 bp, Mus musculus
gaaacaaaagtggtccatgccgtgg

SEQ ID NO: 283294 - DNA, 25 bp, Mus musculus
gaaacaaaccagactgacctcggac

SEQ ID NO: 283295 - DNA, 25 bp, Mus musculus
gaaacaaaccagatcccccacctgt

SEQ ID NO: 283296 - DNA, 25 bp, Mus musculus
gaaacaaactttagggactccagct

SEQ ID NO: 283297 - DNA, 25 bp, Mus musculus
gaaacaaactttagggagtatagtc

SEQ ID NO: 283298 - DNA, 25 bp, Mus musculus
gaaacaaagatgcccttagaccacc

SEQ ID NO: 283299 - DNA, 25 bp, Mus musculus
gaaacaaaggctagtctacccaagt

SEQ ID NO: 283300 - DNA, 25 bp, Mus musculus
gaaacaaagttcatggagtcgctgg

SEQ ID NO: 283301 - DNA, 25 bp, Mus musculus
gaaacaaagttcatgggtgtttgcc

SEQ ID NO: 283302 - DNA, 25 bp, Mus musculus
gaaacaaagtttgggggagcattct

SEQ ID NO: 283303 - DNA, 25 bp, Mus musculus
gaaacaaatgggatggaagactgtg

SEQ ID NO: 283304 - DNA, 25 bp, Mus musculus
gaaacaaatggtgaagaagatggca

SEQ ID NO: 283305 - DNA, 25 bp, Mus musculus
gaaacaactgggctcgggccatcaa

SEQ ID NO: 283306 - DNA, 25 bp, Mus musculus
gaaacaactggtgccagcacatcat

SEQ ID NO: 283307 - DNA, 25 bp, Mus musculus
gaaacaagaagctcaggcgaaagga

SEQ ID NO: 283308 - DNA, 25 bp, Mus musculus
gaaacaagagaccaggtgaaaaaac

SEQ ID NO: 283309 - DNA, 25 bp, Mus musculus
gaaacaagtgcctgctttttctctt

SEQ ID NO: 283310 - DNA, 25 bp, Mus musculus
gaaacaatcctgaggtactgtactg

SEQ ID NO: 283311 - DNA, 25 bp, Mus musculus
gaaacaatggagtccaacacaatcc

SEQ ID NO: 283312 - DNA, 25 bp, Mus musculus
gaaacaatgtcacgaacttgtttcc

SEQ ID NO: 283313 - DNA, 25 bp, Mus musculus
gaaacacaacaaagattatcagaga

SEQ ID NO: 283314 - DNA, 25 bp, Mus musculus
gaaacacaagaacaggcaaggccct

SEQ ID NO: 283315 - DNA, 25 bp, Mus musculus
gaaacacaagagcaggcaaggccct

SEQ ID NO: 283316 - DNA, 25 bp, Mus musculus
gaaacacaatcagatgtcgtttggt

SEQ ID NO: 283317 - DNA, 25 bp, Mus musculus
gaaacacaatcagccgcataactca

SEQ ID NO: 283318 - DNA, 25 bp, Mus musculus
gaaacacaatcagccgtcattcagt

SEQ ID NO: 283319 - DNA, 25 bp, Mus musculus
gaaacacaatcagtcgaagggggca

SEQ ID NO: 283320 - DNA, 25 bp, Mus musculus
gaaacacacagcagatgcattacac

SEQ ID NO: 283321 - DNA, 25 bp, Mus musculus
gaaacacacaggcagatgtcatcaa

SEQ ID NO: 283322 - DNA, 25 bp, Mus musculus
gaaacacactggaaggatttgccag

SEQ ID NO: 283323 - DNA, 25 bp, Mus musculus
gaaacacactggaagtatttttgaa

SEQ ID NO: 283324 - DNA, 25 bp, Mus musculus
gaaacacagagagcttctcaggatg

SEQ ID NO: 283325 - DNA, 25 bp, Mus musculus
gaaacacagccggatgttctttggc

SEQ ID NO: 283326 - DNA, 25 bp, Mus musculus
gaaacacatcccaggcaccccacac

SEQ ID NO: 283327 - DNA, 25 bp, Mus musculus
gaaacaccagctgcgatactatgat

SEQ ID NO: 283328 - DNA, 25 bp, Mus musculus
gaaacaccaggaacgggagcgaagg

SEQ ID NO: 283329 - DNA, 25 bp, Mus musculus
gaaacaccaggagttggagaggcat

SEQ ID NO: 283330 - DNA, 25 bp, Mus musculus
gaaacaccatccagcacgtgcaggc

SEQ ID NO: 283331 - DNA, 25 bp, Mus musculus
gaaacaccattgctggggttcgaac

SEQ ID NO: 283332 - DNA, 25 bp, Mus musculus
gaaacacccagagcctctcggccct

SEQ ID NO: 283333 - DNA, 25 bp, Mus musculus
gaaacacggcatagatttcaccgag

SEQ ID NO: 283334 - DNA, 25 bp, Mus musculus
gaaacacggcataggaccactgcaa

SEQ ID NO: 283335 - DNA, 25 bp, Mus musculus
gaaacacggcataggagctggtggc

SEQ ID NO: 283336 - DNA, 25 bp, Mus musculus
gaaacacgtcggcttctgacgaaga

SEQ ID NO: 283337 - DNA, 25 bp, Mus musculus
gaaacactcagcagcgaatgagcat

SEQ ID NO: 283338 - DNA, 25 bp, Mus musculus
gaaacactcagccctggcaccatca

SEQ ID NO: 283339 - DNA, 25 bp, Mus musculus
gaaacactctctaatatgtttatgg

SEQ ID NO: 283340 - DNA, 25 bp, Mus musculus
gaaacacttaaagtatcaagagagc

SEQ ID NO: 283341 - DNA, 25 bp, Mus musculus
gaaacagaaaaaaattgaggagact

SEQ ID NO: 283342 - DNA, 25 bp, Mus musculus
gaaacagaagactctattcttcatc

SEQ ID NO: 283343 - DNA, 25 bp, Mus musculus
gaaacagaagagtctgaggttatgc

SEQ ID NO: 283344 - DNA, 25 bp, Mus musculus
gaaacagacacaagttttgagaaat

SEQ ID NO: 283345 - DNA, 25 bp, Mus musculus
gaaacagacacaggtaccagagaga

SEQ ID NO: 283346 - DNA, 25 bp, Mus musculus
gaaacagacacaggtggggtgaact

SEQ ID NO: 283347 - DNA, 25 bp, Mus musculus
gaaacagacagctctgtcttccccg

SEQ ID NO: 283348 - DNA, 25 bp, Mus musculus
gaaacagaggtaatctacaaaatgg

SEQ ID NO: 283349 - DNA, 25 bp, Mus musculus
gaaacagatgctgaccttaagagaa

SEQ ID NO: 283350 - DNA, 25 bp, Mus musculus
gaaacagcagagaactggggaaccc

SEQ ID NO: 283351 - DNA, 25 bp, Mus musculus
gaaacagcagattcctcagacaaaa

SEQ ID NO: 283352 - DNA, 25 bp, Mus musculus
gaaacagcaggatgtcgatcagatg

SEQ ID NO: 283353 - DNA, 25 bp, Mus musculus
gaaacagcagggaaggatctgtcct

SEQ ID NO: 283354 - DNA, 25 bp, Mus musculus
gaaacagcaggtgattcaggattac

SEQ ID NO: 283355 - DNA, 25 bp, Mus musculus
gaaacagcagtgaccagctcactaa

SEQ ID NO: 283356 - DNA, 25 bp, Mus musculus
gaaacagccaaagaaaactaactgc

SEQ ID NO: 283357 - DNA, 25 bp, Mus musculus
gaaacagccaaggaggcaccgagat

SEQ ID NO: 283358 - DNA, 25 bp, Mus musculus
gaaacagccaaggcttccaagcagc

SEQ ID NO: 283359 - DNA, 25 bp, Mus musculus
gaaacagccatgcggcttctccatg

SEQ ID NO: 283360 - DNA, 25 bp, Mus musculus
gaaacagctagagaccaaaaccaac

SEQ ID NO: 283361 - DNA, 25 bp, Mus musculus
gaaacagcttgagcccgcacagccc

SEQ ID NO: 283362 - DNA, 25 bp, Mus musculus
gaaacaggacaaaaacagtacaacg

SEQ ID NO: 283363 - DNA, 25 bp, Mus musculus
gaaacaggagaatccaaatgggaaa

SEQ ID NO: 283364 - DNA, 25 bp, Mus musculus
gaaacaggagttattaaaatgtgtt

SEQ ID NO: 283365 - DNA, 25 bp, Mus musculus
gaaacaggccctgttggtccccctg

SEQ ID NO: 283366 - DNA, 25 bp, Mus musculus
gaaacaggcggaggaaacctatgag

SEQ ID NO: 283367 - DNA, 25 bp, Mus musculus
gaaacaggcggaggctagacaaatg

SEQ ID NO: 283368 - DNA, 25 bp, Mus musculus
gaaacaggctgttgtgcagactaca

SEQ ID NO: 283369 - DNA, 25 bp, Mus musculus
gaaacaggggaacacctctactggg

SEQ ID NO: 283370 - DNA, 25 bp, Mus musculus
gaaacaggtggaaggtacagttaaa

SEQ ID NO: 283371 - DNA, 25 bp, Mus musculus
gaaacagttacctgcagaatgtgta

SEQ ID NO: 283372 - DNA, 25 bp, Mus musculus
gaaacataaaaaagaggacgaggcg

SEQ ID NO: 283373 - DNA, 25 bp, Mus musculus
gaaacataaaaaagcttgcacacac

SEQ ID NO: 283374 - DNA, 25 bp, Mus musculus
gaaacatacagtggatgaatatatc

SEQ ID NO: 283375 - DNA, 25 bp, Mus musculus
gaaacatagagaggaactacaagaa

SEQ ID NO: 283376 - DNA, 25 bp, Mus musculus
gaaacatcccttcagaatacacatg

SEQ ID NO: 283377 - DNA, 25 bp, Mus musculus
gaaacatccgaaaaagccggagcct

SEQ ID NO: 283378 - DNA, 25 bp, Mus musculus
gaaacatccggcatttgtagaaaca

SEQ ID NO: 283379 - DNA, 25 bp, Mus musculus
gaaacatcgagacctttgccactca

SEQ ID NO: 283380 - DNA, 25 bp, Mus musculus
gaaacatcgagagatccggggttct

SEQ ID NO: 283381 - DNA, 25 bp, Mus musculus
gaaacatctggaaggtatctcagac

SEQ ID NO: 283382 - DNA, 25 bp, Mus musculus
gaaacatcttcaaaaactgcaccta

SEQ ID NO: 283383 - DNA, 25 bp, Mus musculus
gaaacatgaagagggtaaatagctg

SEQ ID NO: 283384 - DNA, 25 bp, Mus musculus
gaaacatgaagaggtattgactgaa

SEQ ID NO: 283385 - DNA, 25 bp, Mus musculus
gaaacatgaccaggccatgtgaaac

SEQ ID NO: 283386 - DNA, 25 bp, Mus musculus
gaaacatgactttctgggacaagtg

SEQ ID NO: 283387 - DNA, 25 bp, Mus musculus
gaaacatgagcaaagggccacaata

SEQ ID NO: 283388 - DNA, 25 bp, Mus musculus
gaaacatgcctctaggttccagcag

SEQ ID NO: 283389 - DNA, 25 bp, Mus musculus
gaaacatgcgtacggctggcctcaa

SEQ ID NO: 283390 - DNA, 25 bp, Mus musculus
gaaacatgctggtggctgggacaac

SEQ ID NO: 283391 - DNA, 25 bp, Mus musculus
gaaacatgctggtggtgtcacaggt

SEQ ID NO: 283392 - DNA, 25 bp, Mus musculus
gaaacatgctggttgtcacaggtgg

SEQ ID NO: 283393 - DNA, 25 bp, Mus musculus
gaaacattagaaaaacataaatgca

SEQ ID NO: 283394 - DNA, 25 bp, Mus musculus
gaaacattcaagggtatccagaagt

SEQ ID NO: 283395 - DNA, 25 bp, Mus musculus
gaaacatttgtgggagatcaagttc

SEQ ID NO: 283396 - DNA, 25 bp, Mus musculus
gaaacatttgtggggaacagacaag

SEQ ID NO: 283397 - DNA, 25 bp, Mus musculus
gaaaccaaacaccagtatttctctg

SEQ ID NO: 283398 - DNA, 25 bp, Mus musculus
gaaaccaaaccatatggagaagggc

SEQ ID NO: 283399 - DNA, 25 bp, Mus musculus
gaaaccaaaccggataagctggagg

SEQ ID NO: 283400 - DNA, 25 bp, Mus musculus
gaaaccaagacccaaacttactgct

SEQ ID NO: 283401 - DNA, 25 bp, Mus musculus
gaaaccaagacccagacttactgct

SEQ ID NO: 283402 - DNA, 25 bp, Mus musculus
gaaaccacacagcaatgtttgcaga

SEQ ID NO: 283403 - DNA, 25 bp, Mus musculus
gaaaccacagaggaagcattctcat

SEQ ID NO: 283404 - DNA, 25 bp, Mus musculus
gaaaccacagcattctcatcttctg

SEQ ID NO: 283405 - DNA, 25 bp, Mus musculus
gaaaccacagctctagccaagagtt

SEQ ID NO: 283406 - DNA, 25 bp, Mus musculus
gaaaccacatccgtggttttttggc

SEQ ID NO: 283407 - DNA, 25 bp, Mus musculus
gaaaccacatccgtttggaaatgat

SEQ ID NO: 283408 - DNA, 25 bp, Mus musculus
gaaaccacctcaggagtgaagcgtg

SEQ ID NO: 283409 - DNA, 25 bp, Mus musculus
gaaaccagagccatgagggatctta

SEQ ID NO: 283410 - DNA, 25 bp, Mus musculus
gaaaccagagccatgcggtgctctt

SEQ ID NO: 283411 - DNA, 25 bp, Mus musculus
gaaaccagagccatgtggaaccagg

SEQ ID NO: 283412 - DNA, 25 bp, Mus musculus
gaaaccagaggtggtggaatgatgc

SEQ ID NO: 283413 - DNA, 25 bp, Mus musculus
gaaaccagccaaggactaactacga

SEQ ID NO: 283414 - DNA, 25 bp, Mus musculus
gaaaccaggacaggattccccctct

SEQ ID NO: 283415 - DNA, 25 bp, Mus musculus
gaaaccagtaagggcaaagatgacg

SEQ ID NO: 283416 - DNA, 25 bp, Mus musculus
gaaaccagtaccaggaatgggcacc

SEQ ID NO: 283417 - DNA, 25 bp, Mus musculus
gaaaccagtaccagtcctcttctcc

SEQ ID NO: 283418 - DNA, 25 bp, Mus musculus
gaaaccatcgatagtgtccggatgc

SEQ ID NO: 283419 - DNA, 25 bp, Mus musculus
gaaaccatggcagaacaaaaatcag

SEQ ID NO: 283420 - DNA, 25 bp, Mus musculus
gaaaccatggcagaattttctcagc

SEQ ID NO: 283421 - DNA, 25 bp, Mus musculus
gaaaccatggcaggtacagagctat

SEQ ID NO: 283422 - DNA, 25 bp, Mus musculus
gaaaccattaagttcgagaagctgg

SEQ ID NO: 283423 - DNA, 25 bp, Mus musculus
gaaacccaagcccaggacaccgtgc

SEQ ID NO: 283424 - DNA, 25 bp, Mus musculus
gaaacccaagcccagttccacaaga

SEQ ID NO: 283425 - DNA, 25 bp, Mus musculus
gaaacccaagcttatggcaaacccc

SEQ ID NO: 283426 - DNA, 25 bp, Mus musculus
gaaacccacagcatggtgagacaca

SEQ ID NO: 283427 - DNA, 25 bp, Mus musculus
gaaacccagcagccatccttgcagc

SEQ ID NO: 283428 - DNA, 25 bp, Mus musculus
gaaacccagcagtatgaatattctt

SEQ ID NO: 283429 - DNA, 25 bp, Mus musculus
gaaacccatgtgagcatgcccacaa

SEQ ID NO: 283430 - DNA, 25 bp, Mus musculus
gaaaccccacagccaaggcctggcc

SEQ ID NO: 283431 - DNA, 25 bp, Mus musculus
gaaacccccagcctccagtgatgcc

SEQ ID NO: 283432 - DNA, 25 bp, Mus musculus
gaaacccctcagcaagccccgccca

SEQ ID NO: 283433 - DNA, 25 bp, Mus musculus
gaaaccgaggaaggtccatgcgaag

SEQ ID NO: 283434 - DNA, 25 bp, Mus musculus
gaaaccgaggactcagagaggctga

SEQ ID NO: 283435 - DNA, 25 bp, Mus musculus
gaaaccgatcccagctctaccgccc

SEQ ID NO: 283436 - DNA, 25 bp, Mus musculus
gaaaccgcaggcttatgatggagca

SEQ ID NO: 283437 - DNA, 25 bp, Mus musculus
gaaacctgagatttctgtttttgct

SEQ ID NO: 283438 - DNA, 25 bp, Mus musculus
gaaacctgaggagttaggatctgta

SEQ ID NO: 283439 - DNA, 25 bp, Mus musculus
gaaacctgcgccagcacgcagggat

SEQ ID NO: 283440 - DNA, 25 bp, Mus musculus
gaaacctgcgccaggtgaccatctc

SEQ ID NO: 283441 - DNA, 25 bp, Mus musculus
gaaacctgggactttactggaaaga

SEQ ID NO: 283442 - DNA, 25 bp, Mus musculus
gaaacctgtgttctgatatagatga

SEQ ID NO: 283443 - DNA, 25 bp, Mus musculus
gaaaccttacataaactatactatg

SEQ ID NO: 283444 - DNA, 25 bp, Mus musculus
gaaaccttgcaccaagaagttaagt

SEQ ID NO: 283445 - DNA, 25 bp, Mus musculus
gaaaccttggctgggggatgggctc

SEQ ID NO: 283446 - DNA, 25 bp, Mus musculus
gaaacctttccatattgtattttag

SEQ ID NO: 283447 - DNA, 25 bp, Mus musculus
gaaacctttgaatggtaaccaatgg

SEQ ID NO: 283448 - DNA, 25 bp, Mus musculus
gaaacgaaccaaggagaaagaactg

SEQ ID NO: 283449 - DNA, 25 bp, Mus musculus
gaaacgaagaaagacccaggagagc

SEQ ID NO: 283450 - DNA, 25 bp, Mus musculus
gaaacgaatgtttcctgcaatcctg

SEQ ID NO: 283451 - DNA, 25 bp, Mus musculus
gaaacgagaaaggtgagatctcaat

SEQ ID NO: 283452 - DNA, 25 bp, Mus musculus
gaaacgaggcttgaagaaagaacaa

SEQ ID NO: 283453 - DNA, 25 bp, Mus musculus
gaaacgatatcatgcctctgacagc

SEQ ID NO: 283454 - DNA, 25 bp, Mus musculus
gaaacgattcagaggatcgacgaga

SEQ ID NO: 283455 - DNA, 25 bp, Mus musculus
gaaacgattccatacctgtgttgcg

SEQ ID NO: 283456 - DNA, 25 bp, Mus musculus
gaaacgattccatgtatggcatttc

SEQ ID NO: 283457 - DNA, 25 bp, Mus musculus
gaaacgattccattgtgacaccatc

SEQ ID NO: 283458 - DNA, 25 bp, Mus musculus
gaaacgcaacgtcatccccgctggc

SEQ ID NO: 283459 - DNA, 25 bp, Mus musculus
gaaacgcattgaagtggtggaagaa

SEQ ID NO: 283460 - DNA, 25 bp, Mus musculus
gaaacgccatggctgacaagatcct

SEQ ID NO: 283461 - DNA, 25 bp, Mus musculus
gaaacgcgaagatgtgacagcatgg

SEQ ID NO: 283462 - DNA, 25 bp, Mus musculus
gaaacgctgccgccaagttgaagtt

SEQ ID NO: 283463 - DNA, 25 bp, Mus musculus
gaaacgcttcctcagactgctgtca

SEQ ID NO: 283464 - DNA, 25 bp, Mus musculus
gaaacggaaggcatgaaagaagtga

SEQ ID NO: 283465 - DNA, 25 bp, Mus musculus
gaaacggattttggcaagtcaagca

SEQ ID NO: 283466 - DNA, 25 bp, Mus musculus
gaaacggctccaggctgctggcaat

SEQ ID NO: 283467 - DNA, 25 bp, Mus musculus
gaaacggtatctgcagagtttccag

SEQ ID NO: 283468 - DNA, 25 bp, Mus musculus
gaaacgtaaagagctacaagaaaat

SEQ ID NO: 283469 - DNA, 25 bp, Mus musculus
gaaactaaaaatgtcccatctgcag

SEQ ID NO: 283470 - DNA, 25 bp, Mus musculus
gaaactaaagccaaaaccaacagca

SEQ ID NO: 283471 - DNA, 25 bp, Mus musculus
gaaactaaatcatccatgcatcatc

SEQ ID NO: 283472 - DNA, 25 bp, Mus musculus
gaaactaagcaagaacaatactaca

SEQ ID NO: 283473 - DNA, 25 bp, Mus musculus
gaaactaagcaagaagactaagaac

SEQ ID NO: 283474 - DNA, 25 bp, Mus musculus
gaaactaagcaagaagtggtggtaa

SEQ ID NO: 283475 - DNA, 25 bp, Mus musculus
gaaactaagcaagaatgagctgaag

SEQ ID NO: 283476 - DNA, 25 bp, Mus musculus
gaaactaagcagaacaagccatcca

SEQ ID NO: 283477 - DNA, 25 bp, Mus musculus
gaaactaagcaggaagcagaacaag

SEQ ID NO: 283478 - DNA, 25 bp, Mus musculus
gaaactaagccgcccagccaccatc

SEQ ID NO: 283479 - DNA, 25 bp, Mus musculus
gaaactaccagagcagaagaatccc

SEQ ID NO: 283480 - DNA, 25 bp, Mus musculus
gaaactaccagatgctggcatcgcc

SEQ ID NO: 283481 - DNA, 25 bp, Mus musculus
gaaactaccaggtgacaaacagcat

SEQ ID NO: 283482 - DNA, 25 bp, Mus musculus
gaaactaccaggtgcactaggcctt

SEQ ID NO: 283483 - DNA, 25 bp, Mus musculus
gaaactactgcggctcaggatactt

SEQ ID NO: 283484 - DNA, 25 bp, Mus musculus
gaaactagaagatgaaatgaagacg

SEQ ID NO: 283485 - DNA, 25 bp, Mus musculus
gaaactagctgggatactaacaaaa

SEQ ID NO: 283486 - DNA, 25 bp, Mus musculus
gaaactatgtctgctggttgtggac

SEQ ID NO: 283487 - DNA, 25 bp, Mus musculus
gaaactcaaagagcgtcaggaagca

SEQ ID NO: 283488 - DNA, 25 bp, Mus musculus
gaaactcaaattttaatccaggtgc

SEQ ID NO: 283489 - DNA, 25 bp, Mus musculus
gaaactcaagatgtcggttggaccc

SEQ ID NO: 283490 - DNA, 25 bp, Mus musculus
gaaactcaagcacgtgttctttggc

SEQ ID NO: 283491 - DNA, 25 bp, Mus musculus
gaaactcaagcaggtgttctttggc

SEQ ID NO: 283492 - DNA, 25 bp, Mus musculus
gaaactcaaggctcctgactatgat

SEQ ID NO: 283493 - DNA, 25 bp, Mus musculus
gaaactcactaacagcatcaaggtg

SEQ ID NO: 283494 - DNA, 25 bp, Mus musculus
gaaactcatcctgactctcactcat

SEQ ID NO: 283495 - DNA, 25 bp, Mus musculus
gaaactccagatcaccatccggagg

SEQ ID NO: 283496 - DNA, 25 bp, Mus musculus
gaaactccaggctgcgctggctgac

SEQ ID NO: 283497 - DNA, 25 bp, Mus musculus
gaaactctacaagcacttgcagaag

SEQ ID NO: 283498 - DNA, 25 bp, Mus musculus
gaaactctacaccctagaggagagc

SEQ ID NO: 283499 - DNA, 25 bp, Mus musculus
gaaactctcccctcgtaccagtaat

SEQ ID NO: 283500 - DNA, 25 bp, Mus musculus
gaaactctcccctgtcctggagtgg

SEQ ID NO: 283501 - DNA, 25 bp, Mus musculus
gaaactcttcccagagaccgtgaag

SEQ ID NO: 283502 - DNA, 25 bp, Mus musculus
gaaactcttcccaggctttgaccta

SEQ ID NO: 283503 - DNA, 25 bp, Mus musculus
gaaactcttttttctcctcttgcct

SEQ ID NO: 283504 - DNA, 25 bp, Mus musculus
gaaactgaacagagtaccatttagg

SEQ ID NO: 283505 - DNA, 25 bp, Mus musculus
gaaactgaacagtaaccgatttcgc

SEQ ID NO: 283506 - DNA, 25 bp, Mus musculus
gaaactgaacagtgtaccatctata

SEQ ID NO: 283507 - DNA, 25 bp, Mus musculus
gaaactgaagaaactcggaaaattc

SEQ ID NO: 283508 - DNA, 25 bp, Mus musculus
gaaactgaagaagaggttaggaatt

SEQ ID NO: 283509 - DNA, 25 bp, Mus musculus
gaaactgaaggctggcaacatggct

SEQ ID NO: 283510 - DNA, 25 bp, Mus musculus
gaaactgagcacattaatccagtaa

SEQ ID NO: 283511 - DNA, 25 bp, Mus musculus
gaaactgagcaccaaacaacatgta

SEQ ID NO: 283512 - DNA, 25 bp, Mus musculus
gaaactgagcaccaagcttacaatg

SEQ ID NO: 283513 - DNA, 25 bp, Mus musculus
gaaactgagcagcagaataaagatg

SEQ ID NO: 283514 - DNA, 25 bp, Mus musculus
gaaactgagcattttgctctgtaaa

SEQ ID NO: 283515 - DNA, 25 bp, Mus musculus
gaaactgaggagaagtgtgagaaac

SEQ ID NO: 283516 - DNA, 25 bp, Mus musculus
gaaactgaggagagatcaggaatct

SEQ ID NO: 283517 - DNA, 25 bp, Mus musculus
gaaactgaggagatctagatccaga

SEQ ID NO: 283518 - DNA, 25 bp, Mus musculus
gaaactgaggaggtcccgatcacat

SEQ ID NO: 283519 - DNA, 25 bp, Mus musculus
gaaactgcaccttcagcagagcaca

SEQ ID NO: 283520 - DNA, 25 bp, Mus musculus
gaaactgcaccttcaggacgccgag

SEQ ID NO: 283521 - DNA, 25 bp, Mus musculus
gaaactgcagatccaggtggatgaa

SEQ ID NO: 283522 - DNA, 25 bp, Mus musculus
gaaactgcaggtcacggaagcgtat

SEQ ID NO: 283523 - DNA, 25 bp, Mus musculus
gaaactgcagtgctggcagaagacg

SEQ ID NO: 283524 - DNA, 25 bp, Mus musculus
gaaactgcagtggactgagtttagt

SEQ ID NO: 283525 - DNA, 25 bp, Mus musculus
gaaactgcatgttgcgggatgacat

SEQ ID NO: 283526 - DNA, 25 bp, Mus musculus
gaaactgccgccacagtacatgtgt

SEQ ID NO: 283527 - DNA, 25 bp, Mus musculus
gaaactgctccacttctatcagcaa

SEQ ID NO: 283528 - DNA, 25 bp, Mus musculus
gaaactgctctggatttctttgact

SEQ ID NO: 283529 - DNA, 25 bp, Mus musculus
gaaactgctgggcagctccagatga

SEQ ID NO: 283530 - DNA, 25 bp, Mus musculus
gaaactggacagagccaatgcagag

SEQ ID NO: 283531 - DNA, 25 bp, Mus musculus
gaaactggagaccttcttcgggaat

SEQ ID NO: 283532 - DNA, 25 bp, Mus musculus
gaaactggagggctctctgggatgc

SEQ ID NO: 283533 - DNA, 25 bp, Mus musculus
gaaactggaggtgacccctgtaaaa

SEQ ID NO: 283534 - DNA, 25 bp, Mus musculus
gaaactggagttacctcgctgagca

SEQ ID NO: 283535 - DNA, 25 bp, Mus musculus
gaaactggccacaatttactggttt

SEQ ID NO: 283536 - DNA, 25 bp, Mus musculus
gaaactggcggtgttttcagctgtg

SEQ ID NO: 283537 - DNA, 25 bp, Mus musculus
gaaactggcgttgttgacaagattt

SEQ ID NO: 283538 - DNA, 25 bp, Mus musculus
gaaactgggaccgtgcctgcaggtg

SEQ ID NO: 283539 - DNA, 25 bp, Mus musculus
gaaactggtacagtacaatatctcc

SEQ ID NO: 283540 - DNA, 25 bp, Mus musculus
gaaactgtaaataggtttgagtaca

SEQ ID NO: 283541 - DNA, 25 bp, Mus musculus
gaaactgtagcttctttgttacaga

SEQ ID NO: 283542 - DNA, 25 bp, Mus musculus
gaaactgtctccgattttactccta

SEQ ID NO: 283543 - DNA, 25 bp, Mus musculus
gaaacttaaagcacatacgtgtaat

SEQ ID NO: 283544 - DNA, 25 bp, Mus musculus
gaaacttaaaggggctgatcctgaa

SEQ ID NO: 283545 - DNA, 25 bp, Mus musculus
gaaacttaacagtgaaagatttccg

SEQ ID NO: 283546 - DNA, 25 bp, Mus musculus
gaaacttaacagtgaggaatgatat

SEQ ID NO: 283547 - DNA, 25 bp, Mus musculus
gaaacttaatgtcagccataacaaa

SEQ ID NO: 283548 - DNA, 25 bp, Mus musculus
gaaacttacaggccttacttctcta

SEQ ID NO: 283549 - DNA, 25 bp, Mus musculus
gaaacttacaggtgcttttgggtcg

SEQ ID NO: 283550 - DNA, 25 bp, Mus musculus
gaaacttagtgagtgtgtcccttct

SEQ ID NO: 283551 - DNA, 25 bp, Mus musculus
gaaacttcaggacccctgtgcagca

SEQ ID NO: 283552 - DNA, 25 bp, Mus musculus
gaaacttcaggaggagttagagttt

SEQ ID NO: 283553 - DNA, 25 bp, Mus musculus
gaaacttcaggagtcatggctggct

SEQ ID NO: 283554 - DNA, 25 bp, Mus musculus
gaaacttcattgatgccaaagaccc

SEQ ID NO: 283555 - DNA, 25 bp, Mus musculus
gaaacttctacaggtttccgtggac

SEQ ID NO: 283556 - DNA, 25 bp, Mus musculus
gaaacttctttcgggaggcagcccg

SEQ ID NO: 283557 - DNA, 25 bp, Mus musculus
gaaacttctttcggtgaagaatgct

SEQ ID NO: 283558 - DNA, 25 bp, Mus musculus
gaaacttgaggccagaagtcaatgt

SEQ ID NO: 283559 - DNA, 25 bp, Mus musculus
gaaacttgagtatgaaagcaaggta

SEQ ID NO: 283560 - DNA, 25 bp, Mus musculus
gaaacttggagagtggacagaaaac

SEQ ID NO: 283561 - DNA, 25 bp, Mus musculus
gaaacttggagcaggcaccgctcct

SEQ ID NO: 283562 - DNA, 25 bp, Mus musculus
gaaactttagtgccatggcagaaca

SEQ ID NO: 283563 - DNA, 25 bp, Mus musculus
gaaactttgatctgctgttgtgtgt

SEQ ID NO: 283564 - DNA, 25 bp, Mus musculus
gaaactttgatgaaacttttttggc

SEQ ID NO: 283565 - DNA, 25 bp, Mus musculus
gaaagaaaaagtggcccatcctcag

SEQ ID NO: 283566 - DNA, 25 bp, Mus musculus
gaaagaaaacaaaaagtgtgaacat

SEQ ID NO: 283567 - DNA, 25 bp, Mus musculus
gaaagaaaacagccccttcgaggaa

SEQ ID NO: 283568 - DNA, 25 bp, Mus musculus
gaaagaaaacagctttgtttactag

SEQ ID NO: 283569 - DNA, 25 bp, Mus musculus
gaaagaaaacagtgacaacataaga

SEQ ID NO: 283570 - DNA, 25 bp, Mus musculus
gaaagaaaacgagctgtttgacaac

SEQ ID NO: 283571 - DNA, 25 bp, Mus musculus
gaaagaaaagcgggtgccctccaat

SEQ ID NO: 283572 - DNA, 25 bp, Mus musculus
gaaagaaaagggctgaagaagagaa

SEQ ID NO: 283573 - DNA, 25 bp, Mus musculus
gaaagaaaattaaagatgaactaat

SEQ ID NO: 283574 - DNA, 25 bp, Mus musculus
gaaagaaaattaaaggaaattgatc

SEQ ID NO: 283575 - DNA, 25 bp, Mus musculus
gaaagaaacacgaagaaaggctttg

SEQ ID NO: 283576 - DNA, 25 bp, Mus musculus
gaaagaaacagaggtcaacagtctg

SEQ ID NO: 283577 - DNA, 25 bp, Mus musculus
gaaagaaacagcttttaaagacagg

SEQ ID NO: 283578 - DNA, 25 bp, Mus musculus
gaaagaaatataaggactgaggatc

SEQ ID NO: 283579 - DNA, 25 bp, Mus musculus
gaaagaaatgatggttcaacttctg

SEQ ID NO: 283580 - DNA, 25 bp, Mus musculus
gaaagaaatgcaaaatccgggagga

SEQ ID NO: 283581 - DNA, 25 bp, Mus musculus
gaaagaaatggcaaaagatgtgatt

SEQ ID NO: 283582 - DNA, 25 bp, Mus musculus
gaaagaacaagagacatgtttggcc

SEQ ID NO: 283583 - DNA, 25 bp, Mus musculus
gaaagaagaaatatctgccacctct

SEQ ID NO: 283584 - DNA, 25 bp, Mus musculus
gaaagaagaaatctctgtcatagac

SEQ ID NO: 283585 - DNA, 25 bp, Mus musculus
gaaagaagaaatctgtgtactttat

SEQ ID NO: 283586 - DNA, 25 bp, Mus musculus
gaaagaagaagaggcacactggagc

SEQ ID NO: 283587 - DNA, 25 bp, Mus musculus
gaaagaagaagaggtgagtaatctg

SEQ ID NO: 283588 - DNA, 25 bp, Mus musculus
gaaagaagagaaataataactgcca

SEQ ID NO: 283589 - DNA, 25 bp, Mus musculus
gaaagaagagaaatattacagcgac

SEQ ID NO: 283590 - DNA, 25 bp, Mus musculus
gaaagaagagactacaactaaagca

SEQ ID NO: 283591 - DNA, 25 bp, Mus musculus
gaaagaagagactacggccttattt

SEQ ID NO: 283592 - DNA, 25 bp, Mus musculus
gaaagaagagagagtacctcagccc

SEQ ID NO: 283593 - DNA, 25 bp, Mus musculus
gaaagaagagaggagaaggggacca

SEQ ID NO: 283594 - DNA, 25 bp, Mus musculus
gaaagaagagcaggaaccccagaac

SEQ ID NO: 283595 - DNA, 25 bp, Mus musculus
gaaagaagagctgctgaatgccatg

SEQ ID NO: 283596 - DNA, 25 bp, Mus musculus
gaaagaagaggctgggatcagtacc

SEQ ID NO: 283597 - DNA, 25 bp, Mus musculus
gaaagaagagtggaggaaccacaat

SEQ ID NO: 283598 - DNA, 25 bp, Mus musculus
gaaagaagcggcctgcatgacccgc

SEQ ID NO: 283599 - DNA, 25 bp, Mus musculus
gaaagaaggcacaggaagcatttct

SEQ ID NO: 283600 - DNA, 25 bp, Mus musculus
gaaagaaggcagaggtatgatgatg

SEQ ID NO: 283601 - DNA, 25 bp, Mus musculus
gaaagaagttggcatgaaagctgca

SEQ ID NO: 283602 - DNA, 25 bp, Mus musculus
gaaagaatacctcaggtgcctgaaa

SEQ ID NO: 283603 - DNA, 25 bp, Mus musculus
gaaagaatccagagaggaagacgac

SEQ ID NO: 283604 - DNA, 25 bp, Mus musculus
gaaagaatgccacaactgatgcctt

SEQ ID NO: 283605 - DNA, 25 bp, Mus musculus
gaaagaatgtcgaagcggaggccaa

SEQ ID NO: 283606 - DNA, 25 bp, Mus musculus
gaaagaattgaaggtgcctgaaaaa

SEQ ID NO: 283607 - DNA, 25 bp, Mus musculus
gaaagaattgcagagggtaattttc

SEQ ID NO: 283608 - DNA, 25 bp, Mus musculus
gaaagaattgcagttgcctcttttg

SEQ ID NO: 283609 - DNA, 25 bp, Mus musculus
gaaagaatttgctgtagacatttta

SEQ ID NO: 283610 - DNA, 25 bp, Mus musculus
gaaagacaattgcgccgcagagctc

SEQ ID NO: 283611 - DNA, 25 bp, Mus musculus
gaaagacaattttgggtgtttgatt

SEQ ID NO: 283612 - DNA, 25 bp, Mus musculus
gaaagacacaacagagcaggttagg

SEQ ID NO: 283613 - DNA, 25 bp, Mus musculus
gaaagacatgtattcgtaacaataa

SEQ ID NO: 283614 - DNA, 25 bp, Mus musculus
gaaagaccagacatcatcccacact

SEQ ID NO: 283615 - DNA, 25 bp, Mus musculus
gaaagaccagccaacaattctcttg

SEQ ID NO: 283616 - DNA, 25 bp, Mus musculus
gaaagaccaggacctcaccatccct

SEQ ID NO: 283617 - DNA, 25 bp, Mus musculus
gaaagacccttaaagatgaccttgc

SEQ ID NO: 283618 - DNA, 25 bp, Mus musculus
gaaagacctaatgaaagctgcaccg

SEQ ID NO: 283619 - DNA, 25 bp, Mus musculus
gaaagacctaatgcgcctagaaaag

SEQ ID NO: 283620 - DNA, 25 bp, Mus musculus
gaaagaccttgattcagatggtcca

SEQ ID NO: 283621 - DNA, 25 bp, Mus musculus
gaaagacgaaagaatcctgtggaag

SEQ ID NO: 283622 - DNA, 25 bp, Mus musculus
gaaagacgaaaggtacctgttgttc

SEQ ID NO: 283623 - DNA, 25 bp, Mus musculus
gaaagactaaggcagggcctagtaa

SEQ ID NO: 283624 - DNA, 25 bp, Mus musculus
gaaagactatcatgttccaagatgc

SEQ ID NO: 283625 - DNA, 25 bp, Mus musculus
gaaagactatcatttatttccgaga

SEQ ID NO: 283626 - DNA, 25 bp, Mus musculus
gaaagactggagagaagctgaagaa

SEQ ID NO: 283627 - DNA, 25 bp, Mus musculus
gaaagactgtaccaggcccagtctg

SEQ ID NO: 283628 - DNA, 25 bp, Mus musculus
gaaagactgtaccagggccacaccc

SEQ ID NO: 283629 - DNA, 25 bp, Mus musculus
gaaagactgtaccagtgacttcaat

SEQ ID NO: 283630 - DNA, 25 bp, Mus musculus
gaaagagaaaggtattaagtcatga

SEQ ID NO: 283631 - DNA, 25 bp, Mus musculus
gaaagagaaaggtgttgacctgaat

SEQ ID NO: 283632 - DNA, 25 bp, Mus musculus
gaaagagaaatggattccctgctaa

SEQ ID NO: 283633 - DNA, 25 bp, Mus musculus
gaaagagaacgcctcaaagagttgc

SEQ ID NO: 283634 - DNA, 25 bp, Mus musculus
gaaagagaacggccctacccacagg

SEQ ID NO: 283635 - DNA, 25 bp, Mus musculus
gaaagagaagcagtgaacttatttc

SEQ ID NO: 283636 - DNA, 25 bp, Mus musculus
gaaagagaataaatggcttgttggc

SEQ ID NO: 283637 - DNA, 25 bp, Mus musculus
gaaagagacagtgcattctgtgagt

SEQ ID NO: 283638 - DNA, 25 bp, Mus musculus
gaaagagacagtgtgggacttctgc

SEQ ID NO: 283639 - DNA, 25 bp, Mus musculus
gaaagagactgctggtgacaaggga

SEQ ID NO: 283640 - DNA, 25 bp, Mus musculus
gaaagagagaaggggaacagccaga

SEQ ID NO: 283641 - DNA, 25 bp, Mus musculus
gaaagagagagcaaggttgtagttc

SEQ ID NO: 283642 - DNA, 25 bp, Mus musculus
gaaagagagccaaatctgccaaggc

SEQ ID NO: 283643 - DNA, 25 bp, Mus musculus
gaaagagaggaagcatcaacacccc

SEQ ID NO: 283644 - DNA, 25 bp, Mus musculus
gaaagagaggaagtaaaactcaaaa

SEQ ID NO: 283645 - DNA, 25 bp, Mus musculus
gaaagagaggaggcgcaggcagggg

SEQ ID NO: 283646 - DNA, 25 bp, Mus musculus
gaaagagaggtgaaacggaaggtgg

SEQ ID NO: 283647 - DNA, 25 bp, Mus musculus
gaaagagaggtgaggaagaccctgg

SEQ ID NO: 283648 - DNA, 25 bp, Mus musculus
gaaagagaggtgccggcctccgccc

SEQ ID NO: 283649 - DNA, 25 bp, Mus musculus
gaaagagagtgtaatccacctaact

SEQ ID NO: 283650 - DNA, 25 bp, Mus musculus
gaaagagataacagcagacaggaaa

SEQ ID NO: 283651 - DNA, 25 bp, Mus musculus
gaaagagatgaaggactcgctggcc

SEQ ID NO: 283652 - DNA, 25 bp, Mus musculus
gaaagagccaaacgagccacaatca

SEQ ID NO: 283653 - DNA, 25 bp, Mus musculus
gaaagagcggaggccaacaccctgc

SEQ ID NO: 283654 - DNA, 25 bp, Mus musculus
gaaagagctgaggatcatctgtccc

SEQ ID NO: 283655 - DNA, 25 bp, Mus musculus
gaaagagctgtcagggacggtcaag

SEQ ID NO: 283656 - DNA, 25 bp, Mus musculus
gaaagaggaaatcagtgttgaagat

SEQ ID NO: 283657 - DNA, 25 bp, Mus musculus
gaaagaggaaatggagcctgtgacc

SEQ ID NO: 283658 - DNA, 25 bp, Mus musculus
gaaagaggagaaagggaagaaggca

SEQ ID NO: 283659 - DNA, 25 bp, Mus musculus
gaaagaggcacagatcttagatgag

SEQ ID NO: 283660 - DNA, 25 bp, Mus musculus
gaaagaggccctggaagaagaaagg

SEQ ID NO: 283661 - DNA, 25 bp, Mus musculus
gaaagagggacgatgggtgatctac

SEQ ID NO: 283662 - DNA, 25 bp, Mus musculus
gaaagagggacggataccaagctaa

SEQ ID NO: 283663 - DNA, 25 bp, Mus musculus
gaaagagggtgaagaaactgaaggc

SEQ ID NO: 283664 - DNA, 25 bp, Mus musculus
gaaagaggtcttggtccacagatga

SEQ ID NO: 283665 - DNA, 25 bp, Mus musculus
gaaagagtagtttcaagaacatggg

SEQ ID NO: 283666 - DNA, 25 bp, Mus musculus
gaaagagtcacatcagtttcaccta

SEQ ID NO: 283667 - DNA, 25 bp, Mus musculus
gaaagagtggcggaacatgaagttc

SEQ ID NO: 283668 - DNA, 25 bp, Mus musculus
gaaagagtggcggtcctggagtttg

SEQ ID NO: 283669 - DNA, 25 bp, Mus musculus
gaaagagtgtcttaggttcttgtag

SEQ ID NO: 283670 - DNA, 25 bp, Mus musculus
gaaagataaggtgaccatagctgat

SEQ ID NO: 283671 - DNA, 25 bp, Mus musculus
gaaagataatcagattataccgaaa

SEQ ID NO: 283672 - DNA, 25 bp, Mus musculus
gaaagataatcagccgtggggccaa

SEQ ID NO: 283673 - DNA, 25 bp, Mus musculus
gaaagataccaagctaatgagcgag

SEQ ID NO: 283674 - DNA, 25 bp, Mus musculus
gaaagatagtaacaggagactgaag

SEQ ID NO: 283675 - DNA, 25 bp, Mus musculus
gaaagatcaatgggcagcagcaatg

SEQ ID NO: 283676 - DNA, 25 bp, Mus musculus
gaaagatcaggaaaagactgatacc

SEQ ID NO: 283677 - DNA, 25 bp, Mus musculus
gaaagatcaggcgagtactaacagt

SEQ ID NO: 283678 - DNA, 25 bp, Mus musculus
gaaagatcaggggctggaaaacgag

SEQ ID NO: 283679 - DNA, 25 bp, Mus musculus
gaaagatcagtttggctttattaac

SEQ ID NO: 283680 - DNA, 25 bp, Mus musculus
gaaagatcctttcaggagcccagct

SEQ ID NO: 283681 - DNA, 25 bp, Mus musculus
gaaagatcctttcaggtgctgtagg

SEQ ID NO: 283682 - DNA, 25 bp, Mus musculus
gaaagatctgcatccaaagacaagt

SEQ ID NO: 283683 - DNA, 25 bp, Mus musculus
gaaagatctggccaacatagctgaa

SEQ ID NO: 283684 - DNA, 25 bp, Mus musculus
gaaagatgacaagttgaccccaaag

SEQ ID NO: 283685 - DNA, 25 bp, Mus musculus
gaaagatgacagtgaacgtcctgtt

SEQ ID NO: 283686 - DNA, 25 bp, Mus musculus
gaaagatgacccaggagttgcaagc

SEQ ID NO: 283687 - DNA, 25 bp, Mus musculus
gaaagatgagaatgcacctgtctgc

SEQ ID NO: 283688 - DNA, 25 bp, Mus musculus
gaaagatgagatcctgggcaacttc

SEQ ID NO: 283689 - DNA, 25 bp, Mus musculus
gaaagatgagctggatccagccata

SEQ ID NO: 283690 - DNA, 25 bp, Mus musculus
gaaagatgtcctcggtgactcagaa

SEQ ID NO: 283691 - DNA, 25 bp, Mus musculus
gaaagatgtgccagaaacagaaggg

SEQ ID NO: 283692 - DNA, 25 bp, Mus musculus
gaaagattaaggagctatcgaagaa

SEQ ID NO: 283693 - DNA, 25 bp, Mus musculus
gaaagatttctgaaaattaatgagt

SEQ ID NO: 283694 - DNA, 25 bp, Mus musculus
gaaagatttctggggtgatgactac

SEQ ID NO: 283695 - DNA, 25 bp, Mus musculus
gaaagcaaaaaccatgccttttgcc

SEQ ID NO: 283696 - DNA, 25 bp, Mus musculus
gaaagcaaaaaccatgtgtgagtgt

SEQ ID NO: 283697 - DNA, 25 bp, Mus musculus
gaaagcaaaagaggagtggttccat

SEQ ID NO: 283698 - DNA, 25 bp, Mus musculus
gaaagcaaaagggaagaaggatgca

SEQ ID NO: 283699 - DNA, 25 bp, Mus musculus
gaaagcaaagtggccaaagtgagga

SEQ ID NO: 283700 - DNA, 25 bp, Mus musculus
gaaagcaacagggatgaagtacaac

SEQ ID NO: 283701 - DNA, 25 bp, Mus musculus
gaaagcaacgaaagatgtgatacaa

SEQ ID NO: 283702 - DNA, 25 bp, Mus musculus
gaaagcaacgaaagctcctgcaaag

SEQ ID NO: 283703 - DNA, 25 bp, Mus musculus
gaaagcaactgtggaagaatttgag

SEQ ID NO: 283704 - DNA, 25 bp, Mus musculus
gaaagcaactttttctgctaatgcc

SEQ ID NO: 283705 - DNA, 25 bp, Mus musculus
gaaagcaagggaacctagtaacaaa

SEQ ID NO: 283706 - DNA, 25 bp, Mus musculus
gaaagcaagtcagatgaatggaaac

SEQ ID NO: 283707 - DNA, 25 bp, Mus musculus
gaaagcacagaactctttgttgctg

SEQ ID NO: 283708 - DNA, 25 bp, Mus musculus
gaaagcacagaatactattacaaag

SEQ ID NO: 283709 - DNA, 25 bp, Mus musculus
gaaagcacagagaccagctatggag

SEQ ID NO: 283710 - DNA, 25 bp, Mus musculus
gaaagcacagcaactttctccggct

SEQ ID NO: 283711 - DNA, 25 bp, Mus musculus
gaaagcacagggaagctgggaaaaa

SEQ ID NO: 283712 - DNA, 25 bp, Mus musculus
gaaagcacaggttttgcactgattg

SEQ ID NO: 283713 - DNA, 25 bp, Mus musculus
gaaagcaccaaagcttcgcataagg

SEQ ID NO: 283714 - DNA, 25 bp, Mus musculus
gaaagcaccaaagtaccatttaggt

SEQ ID NO: 283715 - DNA, 25 bp, Mus musculus
gaaagcaccagcaccaggtcttcga

SEQ ID NO: 283716 - DNA, 25 bp, Mus musculus
gaaagcaccagcccacctaaaccaa

SEQ ID NO: 283717 - DNA, 25 bp, Mus musculus
gaaagcaccaggtccccggcgctac

SEQ ID NO: 283718 - DNA, 25 bp, Mus musculus
gaaagcaccgcaggtatcagcctag

SEQ ID NO: 283719 - DNA, 25 bp, Mus musculus
gaaagcacgaggatggatgcgagtt

SEQ ID NO: 283720 - DNA, 25 bp, Mus musculus
gaaagcagaatgctggcagaagacg

SEQ ID NO: 283721 - DNA, 25 bp, Mus musculus
gaaagcagagaagagtgtagctgca

SEQ ID NO: 283722 - DNA, 25 bp, Mus musculus
gaaagcagaggagcaccgggggctg

SEQ ID NO: 283723 - DNA, 25 bp, Mus musculus
gaaagcagctgcagaggcattgcat

SEQ ID NO: 283724 - DNA, 25 bp, Mus musculus
gaaagcagctggtcaaccctccctg

SEQ ID NO: 283725 - DNA, 25 bp, Mus musculus
gaaagcagggtgaaggaggagggcg

SEQ ID NO: 283726 - DNA, 25 bp, Mus musculus
gaaagcaggtccccagcctggcagg

SEQ ID NO: 283727 - DNA, 25 bp, Mus musculus
gaaagcaggtctgggtattggatgg

SEQ ID NO: 283728 - DNA, 25 bp, Mus musculus
gaaagcataaagaccagtttcccaa

SEQ ID NO: 283729 - DNA, 25 bp, Mus musculus
gaaagcataaagatctgggcagtga

SEQ ID NO: 283730 - DNA, 25 bp, Mus musculus
gaaagcataaaggaacatgcctctg

SEQ ID NO: 283731 - DNA, 25 bp, Mus musculus
gaaagcataagaatgttttgagttt

SEQ ID NO: 283732 - DNA, 25 bp, Mus musculus
gaaagcataaggtgactcatattct

SEQ ID NO: 283733 - DNA, 25 bp, Mus musculus
gaaagcatccagtttgtgctcgatg

SEQ ID NO: 283734 - DNA, 25 bp, Mus musculus
gaaagcatgaagacgtggccattcg

SEQ ID NO: 283735 - DNA, 25 bp, Mus musculus
gaaagcattgattaatggaccacag

SEQ ID NO: 283736 - DNA, 25 bp, Mus musculus
gaaagcattgcattggtctctgcca

SEQ ID NO: 283737 - DNA, 25 bp, Mus musculus
gaaagccaaagaaggctcggcgcat

SEQ ID NO: 283738 - DNA, 25 bp, Mus musculus
gaaagccaaagaagtatccgagttc

SEQ ID NO: 283739 - DNA, 25 bp, Mus musculus
gaaagccaaagcggaggaagaaggt

SEQ ID NO: 283740 - DNA, 25 bp, Mus musculus
gaaagccaacattctcaccgacatc

SEQ ID NO: 283741 - DNA, 25 bp, Mus musculus
gaaagccaagaacagagagtacctg

SEQ ID NO: 283742 - DNA, 25 bp, Mus musculus
gaaagccaagatgccagaccagttt

SEQ ID NO: 283743 - DNA, 25 bp, Mus musculus
gaaagccaagctggagaaattttcc

SEQ ID NO: 283744 - DNA, 25 bp, Mus musculus
gaaagccaatgcaccatgaacacag

SEQ ID NO: 283745 - DNA, 25 bp, Mus musculus
gaaagccactgtcagaagagaaaac

SEQ ID NO: 283746 - DNA, 25 bp, Mus musculus
gaaagccagcggaaatggtccttct

SEQ ID NO: 283747 - DNA, 25 bp, Mus musculus
gaaagccagtgtgaataaatttgtg

SEQ ID NO: 283748 - DNA, 25 bp, Mus musculus
gaaagccatcaacgacctagacaga

SEQ ID NO: 283749 - DNA, 25 bp, Mus musculus
gaaagccatcaagttgcctgcagga

SEQ ID NO: 283750 - DNA, 25 bp, Mus musculus
gaaagccatgcattggaatttgaac

SEQ ID NO: 283751 - DNA, 25 bp, Mus musculus
gaaagcccaagtggccgcacgaggg

SEQ ID NO: 283752 - DNA, 25 bp, Mus musculus
gaaagcccagaaagaactagaagaa

SEQ ID NO: 283753 - DNA, 25 bp, Mus musculus
gaaagcccagaaaggatgtataata

SEQ ID NO: 283754 - DNA, 25 bp, Mus musculus
gaaagcccattcaaccatggatgtg

SEQ ID NO: 283755 - DNA, 25 bp, Mus musculus
gaaagcccctggggtgtccgatccg

SEQ ID NO: 283756 - DNA, 25 bp, Mus musculus
gaaagccctgggcttgaagaaccag

SEQ ID NO: 283757 - DNA, 25 bp, Mus musculus
gaaagccctgtcagagtttgtagac

SEQ ID NO: 283758 - DNA, 25 bp, Mus musculus
gaaagccctgtcagtgtttgtagac

SEQ ID NO: 283759 - DNA, 25 bp, Mus musculus
gaaagccgaaggtcctggttatggc

SEQ ID NO: 283760 - DNA, 25 bp, Mus musculus
gaaagcctatactacctacaatacc

SEQ ID NO: 283761 - DNA, 25 bp, Mus musculus
gaaagcctcagaaaccttgatttct

SEQ ID NO: 283762 - DNA, 25 bp, Mus musculus
gaaagcctcagagccttttcagcta

SEQ ID NO: 283763 - DNA, 25 bp, Mus musculus
gaaagcctcctaggcacccgaggga

SEQ ID NO: 283764 - DNA, 25 bp, Mus musculus
gaaagcctgccaagttctggaaatt

SEQ ID NO: 283765 - DNA, 25 bp, Mus musculus
gaaagccttgagggtgtttcttgaa

SEQ ID NO: 283766 - DNA, 25 bp, Mus musculus
gaaagcgaactgacaagttggatgg

SEQ ID NO: 283767 - DNA, 25 bp, Mus musculus
gaaagcgaactgggttacattccga

SEQ ID NO: 283768 - DNA, 25 bp, Mus musculus
gaaagcgacagaaagatgtccgacc

SEQ ID NO: 283769 - DNA, 25 bp, Mus musculus
gaaagcgacagctctacaacagaag

SEQ ID NO: 283770 - DNA, 25 bp, Mus musculus
gaaagcgaggatggtcatgaaagtc

SEQ ID NO: 283771 - DNA, 25 bp, Mus musculus
gaaagcgatgataactttgtgatgt

SEQ ID NO: 283772 - DNA, 25 bp, Mus musculus
gaaagcgcctgctggagttcaacaa

SEQ ID NO: 283773 - DNA, 25 bp, Mus musculus
gaaagcgcggatgacaacctcaagt

SEQ ID NO: 283774 - DNA, 25 bp, Mus musculus
gaaagcgcggatgggtaactcgtcc

SEQ ID NO: 283775 - DNA, 25 bp, Mus musculus
gaaagcgtcaaaccggtgcccaaac

SEQ ID NO: 283776 - DNA, 25 bp, Mus musculus
gaaagcgtcaaactccctgaattcc

SEQ ID NO: 283777 - DNA, 25 bp, Mus musculus
gaaagcgtctctcgaatctacactg

SEQ ID NO: 283778 - DNA, 25 bp, Mus musculus
gaaagcgtctctcgaggttgcctga

SEQ ID NO: 283779 - DNA, 25 bp, Mus musculus
gaaagcgttttcagaaaagatgtct

SEQ ID NO: 283780 - DNA, 25 bp, Mus musculus
gaaagctatcaactgagacattgtc

SEQ ID NO: 283781 - DNA, 25 bp, Mus musculus
gaaagctcaagttttctacagagat

SEQ ID NO: 283782 - DNA, 25 bp, Mus musculus
gaaagctcagatcaggtaagggagc

SEQ ID NO: 283783 - DNA, 25 bp, Mus musculus
gaaagctcagcccagtgtcgtgtgg

SEQ ID NO: 283784 - DNA, 25 bp, Mus musculus
gaaagctcaggaagtggaggtactg

SEQ ID NO: 283785 - DNA, 25 bp, Mus musculus
gaaagctcaggactctcggctctcc

SEQ ID NO: 283786 - DNA, 25 bp, Mus musculus
gaaagctccaaaggaccagtccatg

SEQ ID NO: 283787 - DNA, 25 bp, Mus musculus
gaaagctccaaaggttgtcgctgct

SEQ ID NO: 283788 - DNA, 25 bp, Mus musculus
gaaagctctaagttaggcaagagtt

SEQ ID NO: 283789 - DNA, 25 bp, Mus musculus
gaaagctgacggacgaatgctacaa

SEQ ID NO: 283790 - DNA, 25 bp, Mus musculus
gaaagctgactcaggaatttgaagc

SEQ ID NO: 283791 - DNA, 25 bp, Mus musculus
gaaagctgatgaatgcacccttgta

SEQ ID NO: 283792 - DNA, 25 bp, Mus musculus
gaaagctgccaggctctgggtgctc

SEQ ID NO: 283793 - DNA, 25 bp, Mus musculus
gaaagctgcggcctcagcctgggat

SEQ ID NO: 283794 - DNA, 25 bp, Mus musculus
gaaagctgcgtctcgcggcaggtgc

SEQ ID NO: 283795 - DNA, 25 bp, Mus musculus
gaaagctggacagaactcagcagat

SEQ ID NO: 283796 - DNA, 25 bp, Mus musculus
gaaagctggagaagaatatggagaa

SEQ ID NO: 283797 - DNA, 25 bp, Mus musculus
gaaagctggagaaggcattcggggc

SEQ ID NO: 283798 - DNA, 25 bp, Mus musculus
gaaagctggcgggtagaatcatttt

SEQ ID NO: 283799 - DNA, 25 bp, Mus musculus
gaaagctgttcccatttatgtacag

SEQ ID NO: 283800 - DNA, 25 bp, Mus musculus
gaaagcttatttggtatgctaacag

SEQ ID NO: 283801 - DNA, 25 bp, Mus musculus
gaaagcttccctggcacagaaacat

SEQ ID NO: 283802 - DNA, 25 bp, Mus musculus
gaaagcttcgaagaaaagcaatggg

SEQ ID NO: 283803 - DNA, 25 bp, Mus musculus
gaaagctttaaacaagaggctcaag

SEQ ID NO: 283804 - DNA, 25 bp, Mus musculus
gaaagctttaaacaaggggcgcaga

SEQ ID NO: 283805 - DNA, 25 bp, Mus musculus
gaaagctttcatagtgcctgcagtc

SEQ ID NO: 283806 - DNA, 25 bp, Mus musculus
gaaagcttttgaaataggaccaagg

SEQ ID NO: 283807 - DNA, 25 bp, Mus musculus
gaaaggaaaaaagcacctgacgttc

SEQ ID NO: 283808 - DNA, 25 bp, Mus musculus
gaaaggaaaaaagtctgatgccaac

SEQ ID NO: 283809 - DNA, 25 bp, Mus musculus
gaaaggaaaaggatgtgaggaagac

SEQ ID NO: 283810 - DNA, 25 bp, Mus musculus
gaaaggaaaggccttcgatatgaaa

SEQ ID NO: 283811 - DNA, 25 bp, Mus musculus
gaaaggaaataatccctccatatta

SEQ ID NO: 283812 - DNA, 25 bp, Mus musculus
gaaaggaacagagtgacttaaccac

SEQ ID NO: 283813 - DNA, 25 bp, Mus musculus
gaaaggaacaggtatgtcactggct

SEQ ID NO: 283814 - DNA, 25 bp, Mus musculus
gaaaggaacgcagcaactgctgctg

SEQ ID NO: 283815 - DNA, 25 bp, Mus musculus
gaaaggaactgaaagtgcctttgaa

SEQ ID NO: 283816 - DNA, 25 bp, Mus musculus
gaaaggaagagatcaaagatgagaa

SEQ ID NO: 283817 - DNA, 25 bp, Mus musculus
gaaaggaagcaagatttcctttcct

SEQ ID NO: 283818 - DNA, 25 bp, Mus musculus
gaaaggaagtcggtgtgttatctct

SEQ ID NO: 283819 - DNA, 25 bp, Mus musculus
gaaaggaattcaagatggtcaaata

SEQ ID NO: 283820 - DNA, 25 bp, Mus musculus
gaaaggaattccagatggtcaaata

SEQ ID NO: 283821 - DNA, 25 bp, Mus musculus
gaaaggacacgagttgcctagcaga

SEQ ID NO: 283822 - DNA, 25 bp, Mus musculus
gaaaggacagccctcccacagaatt

SEQ ID NO: 283823 - DNA, 25 bp, Mus musculus
gaaaggacttcctggcgagaaaggt

SEQ ID NO: 283824 - DNA, 25 bp, Mus musculus
gaaaggagagaaaacggtgtattga

SEQ ID NO: 283825 - DNA, 25 bp, Mus musculus
gaaaggagagaaaagcatctgtcca

SEQ ID NO: 283826 - DNA, 25 bp, Mus musculus
gaaaggagagaaagatcagccacaa

SEQ ID NO: 283827 - DNA, 25 bp, Mus musculus
gaaaggagagaagggccaatcaggc

SEQ ID NO: 283828 - DNA, 25 bp, Mus musculus
gaaaggagatgagtccccggcatgt

SEQ ID NO: 283829 - DNA, 25 bp, Mus musculus
gaaaggagattccagcctccaccgt

SEQ ID NO: 283830 - DNA, 25 bp, Mus musculus
gaaaggagattccagtactacagag

SEQ ID NO: 283831 - DNA, 25 bp, Mus musculus
gaaaggagcaaggggtcagccaggg

SEQ ID NO: 283832 - DNA, 25 bp, Mus musculus
gaaaggagccagaagcgacttgaag

SEQ ID NO: 283833 - DNA, 25 bp, Mus musculus
gaaaggagcttagtgctttgggctc

SEQ ID NO: 283834 - DNA, 25 bp, Mus musculus
gaaaggagggaagataattatgcca

SEQ ID NO: 283835 - DNA, 25 bp, Mus musculus
gaaaggagtatgtttgtcctgggtg

SEQ ID NO: 283836 - DNA, 25 bp, Mus musculus
gaaaggagtattgcaagaagaacag

SEQ ID NO: 283837 - DNA, 25 bp, Mus musculus
gaaaggatgatgatggaaaggaaga

SEQ ID NO: 283838 - DNA, 25 bp, Mus musculus
gaaaggatgatgatggtacaaaatg

SEQ ID NO: 283839 - DNA, 25 bp, Mus musculus
gaaaggatggaaaggtgaagctgga

SEQ ID NO: 283840 - DNA, 25 bp, Mus musculus
gaaaggattagggatcttggcaacc

SEQ ID NO: 283841 - DNA, 25 bp, Mus musculus
gaaaggattctatgacccctcacca

SEQ ID NO: 283842 - DNA, 25 bp, Mus musculus
gaaaggattctatgctgggcacaca

SEQ ID NO: 283843 - DNA, 25 bp, Mus musculus
gaaaggattcttccttgaaatttgc

SEQ ID NO: 283844 - DNA, 25 bp, Mus musculus
gaaaggcaaacagacagtgattgta

SEQ ID NO: 283845 - DNA, 25 bp, Mus musculus
gaaaggcaaagccatgtcatatcca

SEQ ID NO: 283846 - DNA, 25 bp, Mus musculus
gaaaggcaaaggtcagtgtcctggc

SEQ ID NO: 283847 - DNA, 25 bp, Mus musculus
gaaaggcacatacttggtacatttg

SEQ ID NO: 283848 - DNA, 25 bp, Mus musculus
gaaaggcactcatgggtggaggtgg

SEQ ID NO: 283849 - DNA, 25 bp, Mus musculus
gaaaggcactccagatgaaagcttg

SEQ ID NO: 283850 - DNA, 25 bp, Mus musculus
gaaaggcactccagtcaatgggtca

SEQ ID NO: 283851 - DNA, 25 bp, Mus musculus
gaaaggcatgtataatgcctgcgtt

SEQ ID NO: 283852 - DNA, 25 bp, Mus musculus
gaaaggccaagctggccctgcttgt

SEQ ID NO: 283853 - DNA, 25 bp, Mus musculus
gaaaggccaagcttgccctgcttgt

SEQ ID NO: 283854 - DNA, 25 bp, Mus musculus
gaaaggccaggttctgggagaagta

SEQ ID NO: 283855 - DNA, 25 bp, Mus musculus
gaaaggccataaggagctggtgggg

SEQ ID NO: 283856 - DNA, 25 bp, Mus musculus
gaaaggccgttttggactacatctg

SEQ ID NO: 283857 - DNA, 25 bp, Mus musculus
gaaaggcctgaagctgtctccagac

SEQ ID NO: 283858 - DNA, 25 bp, Mus musculus
gaaaggcctgaaggtgcgggagtat

SEQ ID NO: 283859 - DNA, 25 bp, Mus musculus
gaaaggcgagaagatccttatcctt

SEQ ID NO: 283860 - DNA, 25 bp, Mus musculus
gaaaggcgagaagatgggctgcatc

SEQ ID NO: 283861 - DNA, 25 bp, Mus musculus
gaaaggcgagtctacgtgacactga

SEQ ID NO: 283862 - DNA, 25 bp, Mus musculus
gaaaggctccacaggagatggcttt

SEQ ID NO: 283863 - DNA, 25 bp, Mus musculus
gaaaggctccaggggtgatggacaa

SEQ ID NO: 283864 - DNA, 25 bp, Mus musculus
gaaaggctgccccaggttgccactg

SEQ ID NO: 283865 - DNA, 25 bp, Mus musculus
gaaagggactcggagaatcatcatt

SEQ ID NO: 283866 - DNA, 25 bp, Mus musculus
gaaagggcaaaagacatatatccag

SEQ ID NO: 283867 - DNA, 25 bp, Mus musculus
gaaagggcaaaagagatatatccag

SEQ ID NO: 283868 - DNA, 25 bp, Mus musculus
gaaagggcccatgatctccatcttt

SEQ ID NO: 283869 - DNA, 25 bp, Mus musculus
gaaagggccgaggcgaagcccgaca

SEQ ID NO: 283870 - DNA, 25 bp, Mus musculus
gaaagggggcctggtccatcccgtg

SEQ ID NO: 283871 - DNA, 25 bp, Mus musculus
gaaaggggtcaaaattgacaagact

SEQ ID NO: 283872 - DNA, 25 bp, Mus musculus
gaaaggggtgaagactgaaccaata

SEQ ID NO: 283873 - DNA, 25 bp, Mus musculus
gaaaggggtgaagagggtcaacagg

SEQ ID NO: 283874 - DNA, 25 bp, Mus musculus
gaaagggtcacggacctcttcactg

SEQ ID NO: 283875 - DNA, 25 bp, Mus musculus
gaaagggtcacggttgcatctgatg

SEQ ID NO: 283876 - DNA, 25 bp, Mus musculus
gaaagggtcataggcacagaccaag

SEQ ID NO: 283877 - DNA, 25 bp, Mus musculus
gaaagggtgcagaagttccctcaac

SEQ ID NO: 283878 - DNA, 25 bp, Mus musculus
gaaagggtgcccgtgacaaatgaag

SEQ ID NO: 283879 - DNA, 25 bp, Mus musculus
gaaaggtagcatcaccaccgcctcc

SEQ ID NO: 283880 - DNA, 25 bp, Mus musculus
gaaaggtcacagaggacacaaaggt

SEQ ID NO: 283881 - DNA, 25 bp, Mus musculus
gaaaggtcgaggaccaaactcttac

SEQ ID NO: 283882 - DNA, 25 bp, Mus musculus
gaaaggtgaacgctgctggttgtct

SEQ ID NO: 283883 - DNA, 25 bp, Mus musculus
gaaaggtggatatgtccgaccccgg

SEQ ID NO: 283884 - DNA, 25 bp, Mus musculus
gaaaggtgtgctggtgcgatgcatg

SEQ ID NO: 283885 - DNA, 25 bp, Mus musculus
gaaaggttacaagagtgaaacatct

SEQ ID NO: 283886 - DNA, 25 bp, Mus musculus
gaaaggttacaccaggcttgtgaag

SEQ ID NO: 283887 - DNA, 25 bp, Mus musculus
gaaaggtttaatgaaatgatgaaag

SEQ ID NO: 283888 - DNA, 25 bp, Mus musculus
gaaaggtttaatgaaggtgattcag

SEQ ID NO: 283889 - DNA, 25 bp, Mus musculus
gaaagtaaaaactggcattgcttca

SEQ ID NO: 283890 - DNA, 25 bp, Mus musculus
gaaagtaaatggaaggcatacgatg

SEQ ID NO: 283891 - DNA, 25 bp, Mus musculus
gaaagtaacactgagtaccagtgat

SEQ ID NO: 283892 - DNA, 25 bp, Mus musculus
gaaagtaatgccaatcccatcttca

SEQ ID NO: 283893 - DNA, 25 bp, Mus musculus
gaaagtacagggttgtttcaaagag

SEQ ID NO: 283894 - DNA, 25 bp, Mus musculus
gaaagtacaggtagagatctgcctg

SEQ ID NO: 283895 - DNA, 25 bp, Mus musculus
gaaagtacccacacacccaaaccag

SEQ ID NO: 283896 - DNA, 25 bp, Mus musculus
gaaagtactggatccactggactcc

SEQ ID NO: 283897 - DNA, 25 bp, Mus musculus
gaaagtacttgaaaactggtggtca

SEQ ID NO: 283898 - DNA, 25 bp, Mus musculus
gaaagtagcgtgaaggttcttcatg

SEQ ID NO: 283899 - DNA, 25 bp, Mus musculus
gaaagtagttaccgtggtcaagaag

SEQ ID NO: 283900 - DNA, 25 bp, Mus musculus
gaaagtatcctgaaggaaagaccgt

SEQ ID NO: 283901 - DNA, 25 bp, Mus musculus
gaaagtcaaaaggtctccagatgag

SEQ ID NO: 283902 - DNA, 25 bp, Mus musculus
gaaagtcacagctttctcagggcct

SEQ ID NO: 283903 - DNA, 25 bp, Mus musculus
gaaagtcactggggacccctgtgca

SEQ ID NO: 283904 - DNA, 25 bp, Mus musculus
gaaagtcagaaaagtgttacatgta

SEQ ID NO: 283905 - DNA, 25 bp, Mus musculus
gaaagtcagcctttagttcctcttt

SEQ ID NO: 283906 - DNA, 25 bp, Mus musculus
gaaagtccaaggtgccccgagccct

SEQ ID NO: 283907 - DNA, 25 bp, Mus musculus
gaaagtccaagtgcgatatgatgaa

SEQ ID NO: 283908 - DNA, 25 bp, Mus musculus
gaaagtcccagcactccgtcctctc

SEQ ID NO: 283909 - DNA, 25 bp, Mus musculus
gaaagtccgactggaactggaaaag

SEQ ID NO: 283910 - DNA, 25 bp, Mus musculus
gaaagtccgctacgtgaaaaatgaa

SEQ ID NO: 283911 - DNA, 25 bp, Mus musculus
gaaagtctcaatcgtcctttttctt

SEQ ID NO: 283912 - DNA, 25 bp, Mus musculus
gaaagtctctgcaggtgcccaaaac

SEQ ID NO: 283913 - DNA, 25 bp, Mus musculus
gaaagtctgtctagagtttcaagaa

SEQ ID NO: 283914 - DNA, 25 bp, Mus musculus
gaaagtcttacagcctttgtttctg

SEQ ID NO: 283915 - DNA, 25 bp, Mus musculus
gaaagtcttacagcttgggcaatag

SEQ ID NO: 283916 - DNA, 25 bp, Mus musculus
gaaagtcttacaggagttaggatct

SEQ ID NO: 283917 - DNA, 25 bp, Mus musculus
gaaagtcttacagtattaccaggag

SEQ ID NO: 283918 - DNA, 25 bp, Mus musculus
gaaagtcttacagtccattttgaat

SEQ ID NO: 283919 - DNA, 25 bp, Mus musculus
gaaagtcttagcacctccgcacctg

SEQ ID NO: 283920 - DNA, 25 bp, Mus musculus
gaaagtcttagtgtcgagcacagcg

SEQ ID NO: 283921 - DNA, 25 bp, Mus musculus
gaaagtgaaaaggttgtccaggaag

SEQ ID NO: 283922 - DNA, 25 bp, Mus musculus
gaaagtgaaagaccattgcagcaaa

SEQ ID NO: 283923 - DNA, 25 bp, Mus musculus
gaaagtgaacagtaggtgagcttag

SEQ ID NO: 283924 - DNA, 25 bp, Mus musculus
gaaagtgaagatatggagtctggag

SEQ ID NO: 283925 - DNA, 25 bp, Mus musculus
gaaagtgaaggtgacaggtctattt

SEQ ID NO: 283926 - DNA, 25 bp, Mus musculus
gaaagtgacagagaaagtgatcttt

SEQ ID NO: 283927 - DNA, 25 bp, Mus musculus
gaaagtgacagagagtcagtgggcc

SEQ ID NO: 283928 - DNA, 25 bp, Mus musculus
gaaagtgaccagccgagaacgaggc

SEQ ID NO: 283929 - DNA, 25 bp, Mus musculus
gaaagtgaccagcgtgtccaccctg

SEQ ID NO: 283930 - DNA, 25 bp, Mus musculus
gaaagtgagcaagcaggaggaggcc

SEQ ID NO: 283931 - DNA, 25 bp, Mus musculus
gaaagtgcaaaacagatggagaata

SEQ ID NO: 283932 - DNA, 25 bp, Mus musculus
gaaagtgcaaaacaggatatcctgt

SEQ ID NO: 283933 - DNA, 25 bp, Mus musculus
gaaagtgcaggaaaggaagttcctt

SEQ ID NO: 283934 - DNA, 25 bp, Mus musculus
gaaagtgcgagacggtcgcagaggg

SEQ ID NO: 283935 - DNA, 25 bp, Mus musculus
gaaagtgcgaggagatgctcacgta

SEQ ID NO: 283936 - DNA, 25 bp, Mus musculus
gaaagtgcgcaaatgaagaagccgg

SEQ ID NO: 283937 - DNA, 25 bp, Mus musculus
gaaagtgcgcaaatgggagaagaaa

SEQ ID NO: 283938 - DNA, 25 bp, Mus musculus
gaaagtgcggaaatgggagaagaaa

SEQ ID NO: 283939 - DNA, 25 bp, Mus musculus
gaaagtggcaagaaggaaaacaaat

SEQ ID NO: 283940 - DNA, 25 bp, Mus musculus
gaaagtggcaagatcttagggttgg

SEQ ID NO: 283941 - DNA, 25 bp, Mus musculus
gaaagtggcaagtcagtacaggcta

SEQ ID NO: 283942 - DNA, 25 bp, Mus musculus
gaaagtggcctcagataatgatttt

SEQ ID NO: 283943 - DNA, 25 bp, Mus musculus
gaaagtggcctcaggtgcgttcatt

SEQ ID NO: 283944 - DNA, 25 bp, Mus musculus
gaaagtggcgaaggtcttccatgtt

SEQ ID NO: 283945 - DNA, 25 bp, Mus musculus
gaaagtgggacaagatgcagcaccg

SEQ ID NO: 283946 - DNA, 25 bp, Mus musculus
gaaagtgtggagagcctcaagtcag

SEQ ID NO: 283947 - DNA, 25 bp, Mus musculus
gaaagtgtgtggtgcaacagaatgg

SEQ ID NO: 283948 - DNA, 25 bp, Mus musculus
gaaagtgttcagtgatgtgatggag

SEQ ID NO: 283949 - DNA, 25 bp, Mus musculus
gaaagttactcaggtggctggtggt

SEQ ID NO: 283950 - DNA, 25 bp, Mus musculus
gaaagttagaaatttcaacgttgaa

SEQ ID NO: 283951 - DNA, 25 bp, Mus musculus
gaaagttcaagcaagactgtacatt

SEQ ID NO: 283952 - DNA, 25 bp, Mus musculus
gaaagttcaagcaagtaaaccggcc

SEQ ID NO: 283953 - DNA, 25 bp, Mus musculus
gaaagttcttcagagagatgacata

SEQ ID NO: 283954 - DNA, 25 bp, Mus musculus
gaaagttcttcagagggtttcatat

SEQ ID NO: 283955 - DNA, 25 bp, Mus musculus
gaaagttcttcagagggtttcatct

SEQ ID NO: 283956 - DNA, 25 bp, Mus musculus
gaaagttgcaaaaatcttggcaatg

SEQ ID NO: 283957 - DNA, 25 bp, Mus musculus
gaaagttgcaaatgattcattcctt

SEQ ID NO: 283958 - DNA, 25 bp, Mus musculus
gaaagttgcaggatgtgtttgagtt

SEQ ID NO: 283959 - DNA, 25 bp, Mus musculus
gaaagttggacaagatgcaagttct

SEQ ID NO: 283960 - DNA, 25 bp, Mus musculus
gaaagttggggccctggagtccaag

SEQ ID NO: 283961 - DNA, 25 bp, Mus musculus
gaaagttggggttcacggctggtgt

SEQ ID NO: 283962 - DNA, 25 bp, Mus musculus
gaaagtttggaagaatgacatacgg

SEQ ID NO: 283963 - DNA, 25 bp, Mus musculus
gaaagtttggaagttgccatccagt

SEQ ID NO: 283964 - DNA, 25 bp, Mus musculus
gaaagtttgtaaagcctcttcggtg

SEQ ID NO: 283965 - DNA, 25 bp, Mus musculus
gaaataaaaaaggggcctgctgact

SEQ ID NO: 283966 - DNA, 25 bp, Mus musculus
gaaataacaaagatgctactacaca

SEQ ID NO: 283967 - DNA, 25 bp, Mus musculus
gaaataacaaaggctcaccatcatg

SEQ ID NO: 283968 - DNA, 25 bp, Mus musculus
gaaataaccagatatcagtttttct

SEQ ID NO: 283969 - DNA, 25 bp, Mus musculus
gaaataaccaggtgaagcaagatgc

SEQ ID NO: 283970 - DNA, 25 bp, Mus musculus
gaaataagagatccagcccactcaa

SEQ ID NO: 283971 - DNA, 25 bp, Mus musculus
gaaataagaggtacccagactcatg

SEQ ID NO: 283972 - DNA, 25 bp, Mus musculus
gaaataatcaaatgggttgtgtggt

SEQ ID NO: 283973 - DNA, 25 bp, Mus musculus
gaaataattcactgctaaaatacat

SEQ ID NO: 283974 - DNA, 25 bp, Mus musculus
gaaatacaagctggcatttttcagg

SEQ ID NO: 283975 - DNA, 25 bp, Mus musculus
gaaatacaaggagcaactgtgccag

SEQ ID NO: 283976 - DNA, 25 bp, Mus musculus
gaaatacaatatggggctgccggtg

SEQ ID NO: 283977 - DNA, 25 bp, Mus musculus
gaaatacagatgtctctttaaggag

SEQ ID NO: 283978 - DNA, 25 bp, Mus musculus
gaaatacataaatatgcaaacaggg

SEQ ID NO: 283979 - DNA, 25 bp, Mus musculus
gaaatacatgctgtctgtgcttcat

SEQ ID NO: 283980 - DNA, 25 bp, Mus musculus
gaaatacatggtgtctgtgcttcat

SEQ ID NO: 283981 - DNA, 25 bp, Mus musculus
gaaatacattttcacggacaagccc

SEQ ID NO: 283982 - DNA, 25 bp, Mus musculus
gaaataccagtccctggcctacagc

SEQ ID NO: 283983 - DNA, 25 bp, Mus musculus
gaaataccatatcagtgccttgtat

SEQ ID NO: 283984 - DNA, 25 bp, Mus musculus
gaaataccatgatttctaggcaagg

SEQ ID NO: 283985 - DNA, 25 bp, Mus musculus
gaaatacccaagtaccagcaagtct

SEQ ID NO: 283986 - DNA, 25 bp, Mus musculus
gaaatacccggccccagcctgcaga

SEQ ID NO: 283987 - DNA, 25 bp, Mus musculus
gaaatacctccagttcagaagaaga

SEQ ID NO: 283988 - DNA, 25 bp, Mus musculus
gaaatacgattcagatggttacggc

SEQ ID NO: 283989 - DNA, 25 bp, Mus musculus
gaaatacgttccaggagttacagct

SEQ ID NO: 283990 - DNA, 25 bp, Mus musculus
gaaatacgttcgcaactcacggatg

SEQ ID NO: 283991 - DNA, 25 bp, Mus musculus
gaaatactaggttgcaggaatcctt

SEQ ID NO: 283992 - DNA, 25 bp, Mus musculus
gaaatagaagaggactccatataac

SEQ ID NO: 283993 - DNA, 25 bp, Mus musculus
gaaatagaagaggagcctgcaggtg

SEQ ID NO: 283994 - DNA, 25 bp, Mus musculus
gaaatagaagaggccttctttctag

SEQ ID NO: 283995 - DNA, 25 bp, Mus musculus
gaaatagaagggaacaagtcataca

SEQ ID NO: 283996 - DNA, 25 bp, Mus musculus
gaaatagaagtggacgacaacctgg

SEQ ID NO: 283997 - DNA, 25 bp, Mus musculus
gaaatagaccagatctcacaggaaa

SEQ ID NO: 283998 - DNA, 25 bp, Mus musculus
gaaatagcatgattcagctactagt

SEQ ID NO: 283999 - DNA, 25 bp, Mus musculus
gaaataggaaataggttaaatggaa

SEQ ID NO: 284000 - DNA, 25 bp, Mus musculus
gaaatataaggactgaggatctcga

SEQ ID NO: 284001 - DNA, 25 bp, Mus musculus
gaaatataatagatgtggtatctac

SEQ ID NO: 284002 - DNA, 25 bp, Mus musculus
gaaatatcacaggctaatgttatct

SEQ ID NO: 284003 - DNA, 25 bp, Mus musculus
gaaatatcagttactactcaactac

SEQ ID NO: 284004 - DNA, 25 bp, Mus musculus
gaaatatcatatctggccatcagac

SEQ ID NO: 284005 - DNA, 25 bp, Mus musculus
gaaatatcatatctgtgtgaaaata

SEQ ID NO: 284006 - DNA, 25 bp, Mus musculus
gaaatatccagagcgacgagattta

SEQ ID NO: 284007 - DNA, 25 bp, Mus musculus
gaaatatccagatttagagcgacga

SEQ ID NO: 284008 - DNA, 25 bp, Mus musculus
gaaatatccaggaaggctcagcaac

SEQ ID NO: 284009 - DNA, 25 bp, Mus musculus
gaaatatcttcagagactggaagtg

SEQ ID NO: 284010 - DNA, 25 bp, Mus musculus
gaaatatgaacaggcatgtaatgaa

SEQ ID NO: 284011 - DNA, 25 bp, Mus musculus
gaaatatgaagacactccagcaact

SEQ ID NO: 284012 - DNA, 25 bp, Mus musculus
gaaatatgaagcacaagcccaaggc

SEQ ID NO: 284013 - DNA, 25 bp, Mus musculus
gaaatatgaagccactctgatatct

SEQ ID NO: 284014 - DNA, 25 bp, Mus musculus
gaaatatgacaactgttggctggct

SEQ ID NO: 284015 - DNA, 25 bp, Mus musculus
gaaatatgaggaacacatcaagagg

SEQ ID NO: 284016 - DNA, 25 bp, Mus musculus
gaaatatgagtggttccatgtcaga

SEQ ID NO: 284017 - DNA, 25 bp, Mus musculus
gaaatatgatatcaccaccctcagg

SEQ ID NO: 284018 - DNA, 25 bp, Mus musculus
gaaatatgatatcatgactgtccgg

SEQ ID NO: 284019 - DNA, 25 bp, Mus musculus
gaaatatgatcagcaagaaggccgg

SEQ ID NO: 284020 - DNA, 25 bp, Mus musculus
gaaatatgatgaccgagaggaagac

SEQ ID NO: 284021 - DNA, 25 bp, Mus musculus
gaaatatgcacgaaggatggcgaga

SEQ ID NO: 284022 - DNA, 25 bp, Mus musculus
gaaatatgcaggaggggaagcagat

SEQ ID NO: 284023 - DNA, 25 bp, Mus musculus
gaaatatgcagtgagcatgtttttg

SEQ ID NO: 284024 - DNA, 25 bp, Mus musculus
gaaatatgcccagcgagccagagcc

SEQ ID NO: 284025 - DNA, 25 bp, Mus musculus
gaaatatgcccaggtgaagcctgac

SEQ ID NO: 284026 - DNA, 25 bp, Mus musculus
gaaatattagaggagtcgctaagat

SEQ ID NO: 284027 - DNA, 25 bp, Mus musculus
gaaatattccaagttcagtggtcac

SEQ ID NO: 284028 - DNA, 25 bp, Mus musculus
gaaatattgatgctgctgtccggcg

SEQ ID NO: 284029 - DNA, 25 bp, Mus musculus
gaaatattgcatagggtaaatgaga

SEQ ID NO: 284030 - DNA, 25 bp, Mus musculus
gaaatattttatataattggcctac

SEQ ID NO: 284031 - DNA, 25 bp, Mus musculus
gaaatattttctcagcaagccccgc

SEQ ID NO: 284032 - DNA, 25 bp, Mus musculus
gaaatcaaaactactaaatggaaat

SEQ ID NO: 284033 - DNA, 25 bp, Mus musculus
gaaatcaaagagaaaatggatcaac

SEQ ID NO: 284034 - DNA, 25 bp, Mus musculus
gaaatcaaagatatagatgtcagtg

SEQ ID NO: 284035 - DNA, 25 bp, Mus musculus
gaaatcaaccaagctgctcttctca

SEQ ID NO: 284036 - DNA, 25 bp, Mus musculus
gaaatcaagagaagcgagccagagc

SEQ ID NO: 284037 - DNA, 25 bp, Mus musculus
gaaatcaaggttacagaatgtctga

SEQ ID NO: 284038 - DNA, 25 bp, Mus musculus
gaaatcacacaatatgtagctggca

SEQ ID NO: 284039 - DNA, 25 bp, Mus musculus
gaaatcacacagttttcagatatgt

SEQ ID NO: 284040 - DNA, 25 bp, Mus musculus
gaaatcacagaactagacaccctga

SEQ ID NO: 284041 - DNA, 25 bp, Mus musculus
gaaatcacagagaacacccagatcg

SEQ ID NO: 284042 - DNA, 25 bp, Mus musculus
gaaatcacaggtcctgctgtctctt

SEQ ID NO: 284043 - DNA, 25 bp, Mus musculus
gaaatcagacaaaagattcgcctaa

SEQ ID NO: 284044 - DNA, 25 bp, Mus musculus
gaaatcagacagatccgagacacta

SEQ ID NO: 284045 - DNA, 25 bp, Mus musculus
gaaatcagacagtgatttcaatcag

SEQ ID NO: 284046 - DNA, 25 bp, Mus musculus
gaaatcagatagtcttccccgctgg

SEQ ID NO: 284047 - DNA, 25 bp, Mus musculus
gaaatcagcatcagattccaaatct

SEQ ID NO: 284048 - DNA, 25 bp, Mus musculus
gaaatcagcatcagtctggagcaaa

SEQ ID NO: 284049 - DNA, 25 bp, Mus musculus
gaaatcatcgaagtctttgtccagg

SEQ ID NO: 284050 - DNA, 25 bp, Mus musculus
gaaatcattattttagacacagaat

SEQ ID NO: 284051 - DNA, 25 bp, Mus musculus
gaaatcattcagtctgtgtatgaag

SEQ ID NO: 284052 - DNA, 25 bp, Mus musculus
gaaatccaagaaaatgtacaggcgg

SEQ ID NO: 284053 - DNA, 25 bp, Mus musculus
gaaatccaagccaagtgccctccaa

SEQ ID NO: 284054 - DNA, 25 bp, Mus musculus
gaaatccaagcttttagccaggctg

SEQ ID NO: 284055 - DNA, 25 bp, Mus musculus
gaaatccactagactctggaactgt

SEQ ID NO: 284056 - DNA, 25 bp, Mus musculus
gaaatccactaggagacttaatgga

SEQ ID NO: 284057 - DNA, 25 bp, Mus musculus
gaaatccagacacgcagttacagac

SEQ ID NO: 284058 - DNA, 25 bp, Mus musculus
gaaatccagacacgcattcctggga

SEQ ID NO: 284059 - DNA, 25 bp, Mus musculus
gaaatccagcgtgcgagaagatgta

SEQ ID NO: 284060 - DNA, 25 bp, Mus musculus
gaaatcccaggtgatgacacacctc

SEQ ID NO: 284061 - DNA, 25 bp, Mus musculus
gaaatcccgcaaggtcccgcacacc

SEQ ID NO: 284062 - DNA, 25 bp, Mus musculus
gaaatccgatggggagcctttactt

SEQ ID NO: 284063 - DNA, 25 bp, Mus musculus
gaaatccgatggttttcagacaaat

SEQ ID NO: 284064 - DNA, 25 bp, Mus musculus
gaaatcctgaagaagattaacttga

SEQ ID NO: 284065 - DNA, 25 bp, Mus musculus
gaaatcctgcaggagccagcagggg

SEQ ID NO: 284066 - DNA, 25 bp, Mus musculus
gaaatcctgtggtgggagcatgccg

SEQ ID NO: 284067 - DNA, 25 bp, Mus musculus
gaaatccttacgatgctgatgacat

SEQ ID NO: 284068 - DNA, 25 bp, Mus musculus
gaaatccttacggcatttttctgtg

SEQ ID NO: 284069 - DNA, 25 bp, Mus musculus
gaaatccttcctggaaggccggatg

SEQ ID NO: 284070 - DNA, 25 bp, Mus musculus
gaaatcgaagcagaaaatgaacagg

SEQ ID NO: 284071 - DNA, 25 bp, Mus musculus
gaaatcgctcagtcctgcatctggc

SEQ ID NO: 284072 - DNA, 25 bp, Mus musculus
gaaatcgctcagtgccacatatgtg

SEQ ID NO: 284073 - DNA, 25 bp, Mus musculus
gaaatcggaagatcttagatgagtt

SEQ ID NO: 284074 - DNA, 25 bp, Mus musculus
gaaatctaagataccaagtggtaga

SEQ ID NO: 284075 - DNA, 25 bp, Mus musculus
gaaatctaccagaacaatctggaac

SEQ ID NO: 284076 - DNA, 25 bp, Mus musculus
gaaatctaccagttgagaaatgtga

SEQ ID NO: 284077 - DNA, 25 bp, Mus musculus
gaaatctatgatgattcttttatta

SEQ ID NO: 284078 - DNA, 25 bp, Mus musculus
gaaatctattcagtattaatataaa

SEQ ID NO: 284079 - DNA, 25 bp, Mus musculus
gaaatctcaagaaaggatggatgat

SEQ ID NO: 284080 - DNA, 25 bp, Mus musculus
gaaatctgacagatttcatcataat

SEQ ID NO: 284081 - DNA, 25 bp, Mus musculus
gaaatctgactcagagcaacccagt

SEQ ID NO: 284082 - DNA, 25 bp, Mus musculus
gaaatctgataactgatttgaatag

SEQ ID NO: 284083 - DNA, 25 bp, Mus musculus
gaaatctgataagtcctttgcaaac

SEQ ID NO: 284084 - DNA, 25 bp, Mus musculus
gaaatctgcacttcgtggggagcag

SEQ ID NO: 284085 - DNA, 25 bp, Mus musculus
gaaatctggtaaagacgagatgctc

SEQ ID NO: 284086 - DNA, 25 bp, Mus musculus
gaaatctgtaacggaaggtgcatct

SEQ ID NO: 284087 - DNA, 25 bp, Mus musculus
gaaatctgtcagggccagagaacag

SEQ ID NO: 284088 - DNA, 25 bp, Mus musculus
gaaatctgtcagggggagatgactg

SEQ ID NO: 284089 - DNA, 25 bp, Mus musculus
gaaatctgttggtgttctggctgat

SEQ ID NO: 284090 - DNA, 25 bp, Mus musculus
gaaatcttatcagacaaagtaaatc

SEQ ID NO: 284091 - DNA, 25 bp, Mus musculus
gaaatcttgcatctgaaagctgggt

SEQ ID NO: 284092 - DNA, 25 bp, Mus musculus
gaaatcttgcatgacaacctggact

SEQ ID NO: 284093 - DNA, 25 bp, Mus musculus
gaaatgaaaaaggcccaagaggatg

SEQ ID NO: 284094 - DNA, 25 bp, Mus musculus
gaaatgaaaaaggttaaggagctga

SEQ ID NO: 284095 - DNA, 25 bp, Mus musculus
gaaatgaaaactgagggagatgaga

SEQ ID NO: 284096 - DNA, 25 bp, Mus musculus
gaaatgaaagatccagcaatgacat

SEQ ID NO: 284097 - DNA, 25 bp, Mus musculus
gaaatgaaagtatcaagcactgaag

SEQ ID NO: 284098 - DNA, 25 bp, Mus musculus
gaaatgaaagttccagcaatgacat

SEQ ID NO: 284099 - DNA, 25 bp, Mus musculus
gaaatgaaatgtctggatgctaatg

SEQ ID NO: 284100 - DNA, 25 bp, Mus musculus
gaaatgaaatgtgcagagccagtgt

SEQ ID NO: 284101 - DNA, 25 bp, Mus musculus
gaaatgaaccgtgaggggaactggt

SEQ ID NO: 284102 - DNA, 25 bp, Mus musculus
gaaatgaagctgaaggcatcataga

SEQ ID NO: 284103 - DNA, 25 bp, Mus musculus
gaaatgaatctgatcctggcctgtg

SEQ ID NO: 284104 - DNA, 25 bp, Mus musculus
gaaatgaatgcagcagcagcagtga

SEQ ID NO: 284105 - DNA, 25 bp, Mus musculus
gaaatgaccaaggaccctctgtcat

SEQ ID NO: 284106 - DNA, 25 bp, Mus musculus
gaaatgaccgaggtgaaggcagcta

SEQ ID NO: 284107 - DNA, 25 bp, Mus musculus
gaaatgagacgagaatgatgtcact

SEQ ID NO: 284108 - DNA, 25 bp, Mus musculus
gaaatgagacggaagctgccacttt

SEQ ID NO: 284109 - DNA, 25 bp, Mus musculus
gaaatgagacgtgctggagatcaaa

SEQ ID NO: 284110 - DNA, 25 bp, Mus musculus
gaaatgagagctcagccctagtcga

SEQ ID NO: 284111 - DNA, 25 bp, Mus musculus
gaaatgagcaaagccaaacaccatg

SEQ ID NO: 284112 - DNA, 25 bp, Mus musculus
gaaatgaggaccagtgggcatgggt

SEQ ID NO: 284113 - DNA, 25 bp, Mus musculus
gaaatgatcagcctcagtccgataa

SEQ ID NO: 284114 - DNA, 25 bp, Mus musculus
gaaatgatccaggtactgcagggtg

SEQ ID NO: 284115 - DNA, 25 bp, Mus musculus
gaaatgatgaaaggcatccttactt

SEQ ID NO: 284116 - DNA, 25 bp, Mus musculus
gaaatgattgactctggtgtgagat

SEQ ID NO: 284117 - DNA, 25 bp, Mus musculus
gaaatgcaaaaggaccctgatagaa

SEQ ID NO: 284118 - DNA, 25 bp, Mus musculus
gaaatgcaaaatccgggaggagatc

SEQ ID NO: 284119 - DNA, 25 bp, Mus musculus
gaaatgcaaacccagccatacattg

SEQ ID NO: 284120 - DNA, 25 bp, Mus musculus
gaaatgcaagattttgctggaagaa

SEQ ID NO: 284121 - DNA, 25 bp, Mus musculus
gaaatgcaagtttgtcaatatacag

SEQ ID NO: 284122 - DNA, 25 bp, Mus musculus
gaaatgcacgatgaggaaactgagg

SEQ ID NO: 284123 - DNA, 25 bp, Mus musculus
gaaatgcagacgtcttgtagaaatt

SEQ ID NO: 284124 - DNA, 25 bp, Mus musculus
gaaatgcataagttggttgatcgtg

SEQ ID NO: 284125 - DNA, 25 bp, Mus musculus
gaaatgcctcagcccagcgtaagcg

SEQ ID NO: 284126 - DNA, 25 bp, Mus musculus
gaaatgcgccagttgatgaaggttg

SEQ ID NO: 284127 - DNA, 25 bp, Mus musculus
gaaatgctcccgctaagtcgtcagc

SEQ ID NO: 284128 - DNA, 25 bp, Mus musculus
gaaatgctcccgctagtgttgcaga

SEQ ID NO: 284129 - DNA, 25 bp, Mus musculus
gaaatgctgagatggtgcagtcact

SEQ ID NO: 284130 - DNA, 25 bp, Mus musculus
gaaatgcttccagagtcttgtgata

SEQ ID NO: 284131 - DNA, 25 bp, Mus musculus
gaaatgcttgttaaggctgctgaaa

SEQ ID NO: 284132 - DNA, 25 bp, Mus musculus
gaaatggaaacacttgcagaagcaa

SEQ ID NO: 284133 - DNA, 25 bp, Mus musculus
gaaatggaaagtccctgacaggctg

SEQ ID NO: 284134 - DNA, 25 bp, Mus musculus
gaaatggaaggtggtgtagtggagc

SEQ ID NO: 284135 - DNA, 25 bp, Mus musculus
gaaatggaagtggctaccaaggact

SEQ ID NO: 284136 - DNA, 25 bp, Mus musculus
gaaatggacgtatgttccatcaagt

SEQ ID NO: 284137 - DNA, 25 bp, Mus musculus
gaaatggacgttcagagttactacc

SEQ ID NO: 284138 - DNA, 25 bp, Mus musculus
gaaatggactttttgatcgatgatg

SEQ ID NO: 284139 - DNA, 25 bp, Mus musculus
gaaatggagaggaaggcgcgggctg

SEQ ID NO: 284140 - DNA, 25 bp, Mus musculus
gaaatggagcaggagccctgcctag

SEQ ID NO: 284141 - DNA, 25 bp, Mus musculus
gaaatggatacacaactattgtccc

SEQ ID NO: 284142 - DNA, 25 bp, Mus musculus
gaaatggatctgctgcgaaagccat

SEQ ID NO: 284143 - DNA, 25 bp, Mus musculus
gaaatggcaaagtacccaggcaaga

SEQ ID NO: 284144 - DNA, 25 bp, Mus musculus
gaaatggcatttatctgggagtatt

SEQ ID NO: 284145 - DNA, 25 bp, Mus musculus
gaaatggcccatgattttgttcttt

SEQ ID NO: 284146 - DNA, 25 bp, Mus musculus
gaaatggcccatgtgctctgtaaca

SEQ ID NO: 284147 - DNA, 25 bp, Mus musculus
gaaatggcccattgaaaagagtcat

SEQ ID NO: 284148 - DNA, 25 bp, Mus musculus
gaaatggctcaaggaacagtgagca

SEQ ID NO: 284149 - DNA, 25 bp, Mus musculus
gaaatgggcagagagaaatgtcacc

SEQ ID NO: 284150 - DNA, 25 bp, Mus musculus
gaaatgggccaaggaaaatgatgaa

SEQ ID NO: 284151 - DNA, 25 bp, Mus musculus
gaaatggtcatcagagctgtactgg

SEQ ID NO: 284152 - DNA, 25 bp, Mus musculus
gaaatggtcatcagtgtcctcctat

SEQ ID NO: 284153 - DNA, 25 bp, Mus musculus
gaaatggtttacagactgttttcca

SEQ ID NO: 284154 - DNA, 25 bp, Mus musculus
gaaatggtttacaggtttactgcta

SEQ ID NO: 284155 - DNA, 25 bp, Mus musculus
gaaatgtactcaattagcatgacag

SEQ ID NO: 284156 - DNA, 25 bp, Mus musculus
gaaatgtcagaaaatcaagagaagc

SEQ ID NO: 284157 - DNA, 25 bp, Mus musculus
gaaatgtcagactcattgaaagaag

SEQ ID NO: 284158 - DNA, 25 bp, Mus musculus
gaaatgtcaggatgccccaggtgac

SEQ ID NO: 284159 - DNA, 25 bp, Mus musculus
gaaatgtcagtgcgattcccaactt

SEQ ID NO: 284160 - DNA, 25 bp, Mus musculus
gaaatgtcctgcagggtttcaaaga

SEQ ID NO: 284161 - DNA, 25 bp, Mus musculus
gaaatgtgacaggctaaactgtgac

SEQ ID NO: 284162 - DNA, 25 bp, Mus musculus
gaaatgtgagctcactctgcagagc

SEQ ID NO: 284163 - DNA, 25 bp, Mus musculus
gaaatgtgcaattcctaaatgcaat

SEQ ID NO: 284164 - DNA, 25 bp, Mus musculus
gaaatgtgcacttggatctcagtca

SEQ ID NO: 284165 - DNA, 25 bp, Mus musculus
gaaatgtgcagattgtgggttgaat

SEQ ID NO: 284166 - DNA, 25 bp, Mus musculus
gaaatgtggggctggcatggaaaat

SEQ ID NO: 284167 - DNA, 25 bp, Mus musculus
gaaatgtggggctggtgtcaggcat

SEQ ID NO: 284168 - DNA, 25 bp, Mus musculus
gaaatgtgtaagctgctggctctac

SEQ ID NO: 284169 - DNA, 25 bp, Mus musculus
gaaatgtgtccccagaaccaaggag

SEQ ID NO: 284170 - DNA, 25 bp, Mus musculus
gaaatgtttgccagaaatgtgcaaa

SEQ ID NO: 284171 - DNA, 25 bp, Mus musculus
gaaatgtttgccagacacgcgaaaa

SEQ ID NO: 284172 - DNA, 25 bp, Mus musculus
gaaattaaagtggcagcttgacttg

SEQ ID NO: 284173 - DNA, 25 bp, Mus musculus
gaaattacaaatacgatacactaaa

SEQ ID NO: 284174 - DNA, 25 bp, Mus musculus
gaaattacaggaagctctcgtagac

SEQ ID NO: 284175 - DNA, 25 bp, Mus musculus
gaaattaccctaagttatacattga

SEQ ID NO: 284176 - DNA, 25 bp, Mus musculus
gaaattacggccgagatccagtcca

SEQ ID NO: 284177 - DNA, 25 bp, Mus musculus
gaaattagatggcttccctttccct

SEQ ID NO: 284178 - DNA, 25 bp, Mus musculus
gaaattaggcagcaaaacataaaga

SEQ ID NO: 284179 - DNA, 25 bp, Mus musculus
gaaattagggcaagagccagaggga

SEQ ID NO: 284180 - DNA, 25 bp, Mus musculus
gaaattataagcaaattctacggtg

SEQ ID NO: 284181 - DNA, 25 bp, Mus musculus
gaaattataatcaggctggccagct

SEQ ID NO: 284182 - DNA, 25 bp, Mus musculus
gaaattatcatccaggccattcccc

SEQ ID NO: 284183 - DNA, 25 bp, Mus musculus
gaaattatccttaagatgactgctt

SEQ ID NO: 284184 - DNA, 25 bp, Mus musculus
gaaattattagggatgccagtaaag

SEQ ID NO: 284185 - DNA, 25 bp, Mus musculus
gaaattatttcagagtgccagaagg

SEQ ID NO: 284186 - DNA, 25 bp, Mus musculus
gaaattatttcaggtggatctaaag

SEQ ID NO: 284187 - DNA, 25 bp, Mus musculus
gaaattcaaggatccagtgaaagat

SEQ ID NO: 284188 - DNA, 25 bp, Mus musculus
gaaattcacaaaagggaaggatctg

SEQ ID NO: 284189 - DNA, 25 bp, Mus musculus
gaaattcacgacgggatgtttcgga

SEQ ID NO: 284190 - DNA, 25 bp, Mus musculus
gaaattcagagactgcctctttaag

SEQ ID NO: 284191 - DNA, 25 bp, Mus musculus
gaaattcatagtgaccatctttcca

SEQ ID NO: 284192 - DNA, 25 bp, Mus musculus
gaaattccaaggaacctggtggcca

SEQ ID NO: 284193 - DNA, 25 bp, Mus musculus
gaaattccaaggtccccctggagcc

SEQ ID NO: 284194 - DNA, 25 bp, Mus musculus
gaaattccaaggtgtgagactgctg

SEQ ID NO: 284195 - DNA, 25 bp, Mus musculus
gaaattccacaagctgatcaacgtc

SEQ ID NO: 284196 - DNA, 25 bp, Mus musculus
gaaattccaccagcagtatgagccc

SEQ ID NO: 284197 - DNA, 25 bp, Mus musculus
gaaattccaggatgtctgtgttaga

SEQ ID NO: 284198 - DNA, 25 bp, Mus musculus
gaaattccaggattgctgtgtctac

SEQ ID NO: 284199 - DNA, 25 bp, Mus musculus
gaaattcccaatgagttgccatata

SEQ ID NO: 284200 - DNA, 25 bp, Mus musculus
gaaattcctcaaggagtcacctggg

SEQ ID NO: 284201 - DNA, 25 bp, Mus musculus
gaaattcctcaaggcacttaggcag

SEQ ID NO: 284202 - DNA, 25 bp, Mus musculus
gaaattcctcaagggggaggataag

SEQ ID NO: 284203 - DNA, 25 bp, Mus musculus
gaaattcctgctgctgaactaacct

SEQ ID NO: 284204 - DNA, 25 bp, Mus musculus
gaaattcgaactggtgttgatcagt

SEQ ID NO: 284205 - DNA, 25 bp, Mus musculus
gaaattcgcagggctatgtgctcaa

SEQ ID NO: 284206 - DNA, 25 bp, Mus musculus
gaaattctcacctccctagcactgt

SEQ ID NO: 284207 - DNA, 25 bp, Mus musculus
gaaattcttataaatgtttatgtct

SEQ ID NO: 284208 - DNA, 25 bp, Mus musculus
gaaattgaagagaaacttcatgaag

SEQ ID NO: 284209 - DNA, 25 bp, Mus musculus
gaaattgagtattttatcatctttt

SEQ ID NO: 284210 - DNA, 25 bp, Mus musculus
gaaattgagtgctcctgtgctgtgt

SEQ ID NO: 284211 - DNA, 25 bp, Mus musculus
gaaattgagtgggacgacttggccc

SEQ ID NO: 284212 - DNA, 25 bp, Mus musculus
gaaattgcaggtctcacccaaaatg

SEQ ID NO: 284213 - DNA, 25 bp, Mus musculus
gaaattgctaagaacaccagaaccg

SEQ ID NO: 284214 - DNA, 25 bp, Mus musculus
gaaattgctcaggaaaatggacaaa

SEQ ID NO: 284215 - DNA, 25 bp, Mus musculus
gaaattgctcagtgagcaaccctaa

SEQ ID NO: 284216 - DNA, 25 bp, Mus musculus
gaaattgctctaaagatgactgctt

SEQ ID NO: 284217 - DNA, 25 bp, Mus musculus
gaaattggacaggattggcccctgc

SEQ ID NO: 284218 - DNA, 25 bp, Mus musculus
gaaattggacaggtccttcattttg

SEQ ID NO: 284219 - DNA, 25 bp, Mus musculus
gaaattggcttccctgagatcctgt

SEQ ID NO: 284220 - DNA, 25 bp, Mus musculus
gaaattgtgaaagaggtcctgtaat

SEQ ID NO: 284221 - DNA, 25 bp, Mus musculus
gaaattgtgaaggccctgtctcaaa

SEQ ID NO: 284222 - DNA, 25 bp, Mus musculus
gaaattgtgaaggtttgtctgggca

SEQ ID NO: 284223 - DNA, 25 bp, Mus musculus
gaaatttacaatctttaagaaatag

SEQ ID NO: 284224 - DNA, 25 bp, Mus musculus
gaaatttatgattccatattaataa

SEQ ID NO: 284225 - DNA, 25 bp, Mus musculus
gaaatttcaaagaggtaactcacgg

SEQ ID NO: 284226 - DNA, 25 bp, Mus musculus
gaaatttcactgaggttaatctata

SEQ ID NO: 284227 - DNA, 25 bp, Mus musculus
gaaatttcaggtcacgttcatgaat

SEQ ID NO: 284228 - DNA, 25 bp, Mus musculus
gaaatttccacggaggttaatctat

SEQ ID NO: 284229 - DNA, 25 bp, Mus musculus
gaaatttcccctcagcaaatccagt

SEQ ID NO: 284230 - DNA, 25 bp, Mus musculus
gaaatttcctaaaggagatataatc

SEQ ID NO: 284231 - DNA, 25 bp, Mus musculus
gaaatttcctaatcaccctcatgtt

SEQ ID NO: 284232 - DNA, 25 bp, Mus musculus
gaaatttgaaatttcaacaagaaaa

SEQ ID NO: 284233 - DNA, 25 bp, Mus musculus
gaaatttgagagtccaattggtaaa

SEQ ID NO: 284234 - DNA, 25 bp, Mus musculus
gaaatttggaagctacgcttacaca

SEQ ID NO: 284235 - DNA, 25 bp, Mus musculus
gaaatttggaggaattgatattttg

SEQ ID NO: 284236 - DNA, 25 bp, Mus musculus
gaaatttgggagttatgcatatccc

SEQ ID NO: 284237 - DNA, 25 bp, Mus musculus
gaaatttgttagaaagcctgcaagg

SEQ ID NO: 284238 - DNA, 25 bp, Mus musculus
gaacaaaaaaggcctgatggaatcg

SEQ ID NO: 284239 - DNA, 25 bp, Mus musculus
gaacaaaaatgcaagctgggcgtgg

SEQ ID NO: 284240 - DNA, 25 bp, Mus musculus
gaacaaaacagattaatagagacag

SEQ ID NO: 284241 - DNA, 25 bp, Mus musculus
gaacaaaacagattgcctgcagtta

SEQ ID NO: 284242 - DNA, 25 bp, Mus musculus
gaacaaaacaggcattggcagagat

SEQ ID NO: 284243 - DNA, 25 bp, Mus musculus
gaacaaacaagatacatttatataa

SEQ ID NO: 284244 - DNA, 25 bp, Mus musculus
gaacaaacaagggaatggcgtttac

SEQ ID NO: 284245 - DNA, 25 bp, Mus musculus
gaacaaactcaagatgggaagtcat

SEQ ID NO: 284246 - DNA, 25 bp, Mus musculus
gaacaaactcaaggccctcatcaaa

SEQ ID NO: 284247 - DNA, 25 bp, Mus musculus
gaacaaactgaaggctcgatgagag

SEQ ID NO: 284248 - DNA, 25 bp, Mus musculus
gaacaaactggttattaaatagatc

SEQ ID NO: 284249 - DNA, 25 bp, Mus musculus
gaacaaagaccggcaactatccatt

SEQ ID NO: 284250 - DNA, 25 bp, Mus musculus
gaacaaagagaagtgcagccccctt

SEQ ID NO: 284251 - DNA, 25 bp, Mus musculus
gaacaaagatcctctgagtgccagc

SEQ ID NO: 284252 - DNA, 25 bp, Mus musculus
gaacaaagatggctgcatgagagcg

SEQ ID NO: 284253 - DNA, 25 bp, Mus musculus
gaacaaagctaggaggactcacaca

SEQ ID NO: 284254 - DNA, 25 bp, Mus musculus
gaacaaagtcagctttctctggtct

SEQ ID NO: 284255 - DNA, 25 bp, Mus musculus
gaacaaagtggcctatgagcggcag

SEQ ID NO: 284256 - DNA, 25 bp, Mus musculus
gaacaaagttagcttgaacatcaca

SEQ ID NO: 284257 - DNA, 25 bp, Mus musculus
gaacaaataagacggttagcacatt

SEQ ID NO: 284258 - DNA, 25 bp, Mus musculus
gaacaaataagatgttctcaaacag

SEQ ID NO: 284259 - DNA, 25 bp, Mus musculus
gaacaaataagcctggggaactcat

SEQ ID NO: 284260 - DNA, 25 bp, Mus musculus
gaacaaatcccaggagcaagtgtcg

SEQ ID NO: 284261 - DNA, 25 bp, Mus musculus
gaacaaatcccagttgtaggccatc

SEQ ID NO: 284262 - DNA, 25 bp, Mus musculus
gaacaaatggggagaaactcctttg

SEQ ID NO: 284263 - DNA, 25 bp, Mus musculus
gaacaacaaagaatctgaagcagga

SEQ ID NO: 284264 - DNA, 25 bp, Mus musculus
gaacaacaaagaggaagcctgcact

SEQ ID NO: 284265 - DNA, 25 bp, Mus musculus
gaacaacaataggtgtttcaccaaa

SEQ ID NO: 284266 - DNA, 25 bp, Mus musculus
gaacaacactgaatatctcctgggc

SEQ ID NO: 284267 - DNA, 25 bp, Mus musculus
gaacaacagaaaaggcagccggagc

SEQ ID NO: 284268 - DNA, 25 bp, Mus musculus
gaacaacatgggacgaaacttagct

SEQ ID NO: 284269 - DNA, 25 bp, Mus musculus
gaacaaccaactgggcagcaacttg

SEQ ID NO: 284270 - DNA, 25 bp, Mus musculus
gaacaaccaggagccctacacaggt

SEQ ID NO: 284271 - DNA, 25 bp, Mus musculus
gaacaacccaccatgtatgcttgag

SEQ ID NO: 284272 - DNA, 25 bp, Mus musculus
gaacaacccgcaatactggagtaac

SEQ ID NO: 284273 - DNA, 25 bp, Mus musculus
gaacaacctggcttcctgctacctg

SEQ ID NO: 284274 - DNA, 25 bp, Mus musculus
gaacaacctgtacctgcaaatgagc

SEQ ID NO: 284275 - DNA, 25 bp, Mus musculus
gaacaacgaagagcaagctgaacta

SEQ ID NO: 284276 - DNA, 25 bp, Mus musculus
gaacaacgcaggactaaattcggag

SEQ ID NO: 284277 - DNA, 25 bp, Mus musculus
gaacaacgcgggggaccttatggat

SEQ ID NO: 284278 - DNA, 25 bp, Mus musculus
gaacaactaaacaggaatgcttcgt

SEQ ID NO: 284279 - DNA, 25 bp, Mus musculus
gaacaactgaacgtttggatgaagc

SEQ ID NO: 284280 - DNA, 25 bp, Mus musculus
gaacaagaagatctaccgcattggc

SEQ ID NO: 284281 - DNA, 25 bp, Mus musculus
gaacaagactcagaataagcctgca

SEQ ID NO: 284282 - DNA, 25 bp, Mus musculus
gaacaagagaggcaatgggtgacaa

SEQ ID NO: 284283 - DNA, 25 bp, Mus musculus
gaacaagagccccttcctctgcccc

SEQ ID NO: 284284 - DNA, 25 bp, Mus musculus
gaacaagaggcagatgggcatatca

SEQ ID NO: 284285 - DNA, 25 bp, Mus musculus
gaacaagataaggggatggtaataa

SEQ ID NO: 284286 - DNA, 25 bp, Mus musculus
gaacaagatcggttctctttgtagc

SEQ ID NO: 284287 - DNA, 25 bp, Mus musculus
gaacaagatcgttggaatgccaaga

SEQ ID NO: 284288 - DNA, 25 bp, Mus musculus
gaacaagatgacggtcagcgtcaat

SEQ ID NO: 284289 - DNA, 25 bp, Mus musculus
gaacaagattaatgaaccaccaaag

SEQ ID NO: 284290 - DNA, 25 bp, Mus musculus
gaacaagcatcccaggctgcgagac

SEQ ID NO: 284291 - DNA, 25 bp, Mus musculus
gaacaagccagggcctcctgctgcc

SEQ ID NO: 284292 - DNA, 25 bp, Mus musculus
gaacaagcccaggagacaatcaggc

SEQ ID NO: 284293 - DNA, 25 bp, Mus musculus
gaacaagcccatctggctcttgctg

SEQ ID NO: 284294 - DNA, 25 bp, Mus musculus
gaacaagccgtggcaaggagatgag

SEQ ID NO: 284295 - DNA, 25 bp, Mus musculus
gaacaagccgtggcattaaaaaaat

SEQ ID NO: 284296 - DNA, 25 bp, Mus musculus
gaacaagcctggcagcaaccttagt

SEQ ID NO: 284297 - DNA, 25 bp, Mus musculus
gaacaagcctggcagtgtcagcagc

SEQ ID NO: 284298 - DNA, 25 bp, Mus musculus
gaacaagctgaagagcatggagaag

SEQ ID NO: 284299 - DNA, 25 bp, Mus musculus
gaacaaggacgagaaaacgcagagg

SEQ ID NO: 284300 - DNA, 25 bp, Mus musculus
gaacaaggacgagaaggaccacttg

SEQ ID NO: 284301 - DNA, 25 bp, Mus musculus
gaacaaggccaagttgtgctggtaa

SEQ ID NO: 284302 - DNA, 25 bp, Mus musculus
gaacaaggccaggactgtggcggcc

SEQ ID NO: 284303 - DNA, 25 bp, Mus musculus
gaacaagtcaaagaggcaaaagcaa

SEQ ID NO: 284304 - DNA, 25 bp, Mus musculus
gaacaagtcaggctccaaaaacagg

SEQ ID NO: 284305 - DNA, 25 bp, Mus musculus
gaacaagtgcaagatgatttacctt

SEQ ID NO: 284306 - DNA, 25 bp, Mus musculus
gaacaagttgaggaacaatacgaag

SEQ ID NO: 284307 - DNA, 25 bp, Mus musculus
gaacaagttgaggaggaggcccaag

SEQ ID NO: 284308 - DNA, 25 bp, Mus musculus
gaacaagtttcttagacctctcaca

SEQ ID NO: 284309 - DNA, 25 bp, Mus musculus
gaacaatacaggtggccaagaagga

SEQ ID NO: 284310 - DNA, 25 bp, Mus musculus
gaacaatacagtcaggatggctaaa

SEQ ID NO: 284311 - DNA, 25 bp, Mus musculus
gaacaatagcacaggaatgattggc

SEQ ID NO: 284312 - DNA, 25 bp, Mus musculus
gaacaatcacagacagcttacctct

SEQ ID NO: 284313 - DNA, 25 bp, Mus musculus
gaacaatcacagaggccagaagaga

SEQ ID NO: 284314 - DNA, 25 bp, Mus musculus
gaacaatcacaggtgtagatgtcag

SEQ ID NO: 284315 - DNA, 25 bp, Mus musculus
gaacaatgcaagaaaacgaagtcca

SEQ ID NO: 284316 - DNA, 25 bp, Mus musculus
gaacaatggcctagaggtaatcaag

SEQ ID NO: 284317 - DNA, 25 bp, Mus musculus
gaacaattggaatgaaggctcagat

SEQ ID NO: 284318 - DNA, 25 bp, Mus musculus
gaacaatttccaggtcatgagcatg

SEQ ID NO: 284319 - DNA, 25 bp, Mus musculus
gaacacaaaacgaaacctcgtgttg

SEQ ID NO: 284320 - DNA, 25 bp, Mus musculus
gaacacaaaggtaagaaagcacgct

SEQ ID NO: 284321 - DNA, 25 bp, Mus musculus
gaacacaacatgtgggatcacatgc

SEQ ID NO: 284322 - DNA, 25 bp, Mus musculus
gaacacaacctgttcaagaaaattg

SEQ ID NO: 284323 - DNA, 25 bp, Mus musculus
gaacacaagatggcccgcagaggac

SEQ ID NO: 284324 - DNA, 25 bp, Mus musculus
gaacacaaggaaggagcagctgcaa

SEQ ID NO: 284325 - DNA, 25 bp, Mus musculus
gaacacaagggcaagatcatcatgc

SEQ ID NO: 284326 - DNA, 25 bp, Mus musculus
gaacacaataaggctcatgcacaat

SEQ ID NO: 284327 - DNA, 25 bp, Mus musculus
gaacacaatcaagcccccactgtgt

SEQ ID NO: 284328 - DNA, 25 bp, Mus musculus
gaacacaatcaaggcacttcggagg

SEQ ID NO: 284329 - DNA, 25 bp, Mus musculus
gaacacaatcaaggtccacaggatg

SEQ ID NO: 284330 - DNA, 25 bp, Mus musculus
gaacacacaaagattcagagctgga

SEQ ID NO: 284331 - DNA, 25 bp, Mus musculus
gaacacacaaaggttggttcctgta

SEQ ID NO: 284332 - DNA, 25 bp, Mus musculus
gaacacaccccaggacaccatcttg

SEQ ID NO: 284333 - DNA, 25 bp, Mus musculus
gaacacactcttcagtgggcccggg

SEQ ID NO: 284334 - DNA, 25 bp, Mus musculus
gaacacagaaaccgatcatcccagc

SEQ ID NO: 284335 - DNA, 25 bp, Mus musculus
gaacacagaaaccggtgctcccttg

SEQ ID NO: 284336 - DNA, 25 bp, Mus musculus
gaacacagccaaagatcggaaccgc

SEQ ID NO: 284337 - DNA, 25 bp, Mus musculus
gaacacagtctcagctgccacccga

SEQ ID NO: 284338 - DNA, 25 bp, Mus musculus
gaacacagtctcagctgcctcctgg

SEQ ID NO: 284339 - DNA, 25 bp, Mus musculus
gaacacataaaggcaagaaaactgg

SEQ ID NO: 284340 - DNA, 25 bp, Mus musculus
gaacacatagcagataaacttctgc

SEQ ID NO: 284341 - DNA, 25 bp, Mus musculus
gaacacatagtgtggatccaactag

SEQ ID NO: 284342 - DNA, 25 bp, Mus musculus
gaacacatagttaaccttggtgaca

SEQ ID NO: 284343 - DNA, 25 bp, Mus musculus
gaacacatgaacaggagtccttgcc

SEQ ID NO: 284344 - DNA, 25 bp, Mus musculus
gaacacatgagtaaggtagcctcca

SEQ ID NO: 284345 - DNA, 25 bp, Mus musculus
gaacacattgaagcaataccttctg

SEQ ID NO: 284346 - DNA, 25 bp, Mus musculus
gaacaccacaagagcatcgcaacat

SEQ ID NO: 284347 - DNA, 25 bp, Mus musculus
gaacaccagaagggccggcccacca

SEQ ID NO: 284348 - DNA, 25 bp, Mus musculus
gaacaccatctttgcacccaggatt

SEQ ID NO: 284349 - DNA, 25 bp, Mus musculus
gaacaccatctttgcatgaaagccc

SEQ ID NO: 284350 - DNA, 25 bp, Mus musculus
gaacaccatctttggattcaatttt

SEQ ID NO: 284351 - DNA, 25 bp, Mus musculus
gaacaccattgaaatcccagcctgc

SEQ ID NO: 284352 - DNA, 25 bp, Mus musculus
gaacacccagagggaagtgggctaa

SEQ ID NO: 284353 - DNA, 25 bp, Mus musculus
gaacaccccctcagtggccacagtt

SEQ ID NO: 284354 - DNA, 25 bp, Mus musculus
gaacaccccgggcttgcccaggtgg

SEQ ID NO: 284355 - DNA, 25 bp, Mus musculus
gaacaccctagatgtgctcctggag

SEQ ID NO: 284356 - DNA, 25 bp, Mus musculus
gaacaccctgtgtgtgttttgggaa

SEQ ID NO: 284357 - DNA, 25 bp, Mus musculus
gaacaccggcaagatagttgaagta

SEQ ID NO: 284358 - DNA, 25 bp, Mus musculus
gaacacctaaagccttagggtcagc

SEQ ID NO: 284359 - DNA, 25 bp, Mus musculus
gaacacctaaagcggactcctctga

SEQ ID NO: 284360 - DNA, 25 bp, Mus musculus
gaacacctcaaaggccacgagaccc

SEQ ID NO: 284361 - DNA, 25 bp, Mus musculus
gaacaccttgcagaacattccagga

SEQ ID NO: 284362 - DNA, 25 bp, Mus musculus
gaacaccttgcatcccacgagtcct

SEQ ID NO: 284363 - DNA, 25 bp, Mus musculus
gaacacgaacgcagggcactgcaga

SEQ ID NO: 284364 - DNA, 25 bp, Mus musculus
gaacacgcaagacagcagtccgttc

SEQ ID NO: 284365 - DNA, 25 bp, Mus musculus
gaacacgcaagggtgagatctttgg

SEQ ID NO: 284366 - DNA, 25 bp, Mus musculus
gaacacgcgcaagccctgaggtgcg

SEQ ID NO: 284367 - DNA, 25 bp, Mus musculus
gaacacgctcagaaatgacctgcag

SEQ ID NO: 284368 - DNA, 25 bp, Mus musculus
gaacactactgaccacgatgatgcc

SEQ ID NO: 284369 - DNA, 25 bp, Mus musculus
gaacactagtgccagcttcggtggt

SEQ ID NO: 284370 - DNA, 25 bp, Mus musculus
gaacactatccaggtcaggctgcta

SEQ ID NO: 284371 - DNA, 25 bp, Mus musculus
gaacactatccagtgggatctgccg

SEQ ID NO: 284372 - DNA, 25 bp, Mus musculus
gaacactcatctaagggagatgaag

SEQ ID NO: 284373 - DNA, 25 bp, Mus musculus
gaacactgacgcttttgtcaatctt

SEQ ID NO: 284374 - DNA, 25 bp, Mus musculus
gaacactgaggggttcctggactga

SEQ ID NO: 284375 - DNA, 25 bp, Mus musculus
gaacactgatatagaaaatcttgtt

SEQ ID NO: 284376 - DNA, 25 bp, Mus musculus
gaacactgatcaagaaaatcttgtt

SEQ ID NO: 284377 - DNA, 25 bp, Mus musculus
gaacactgccccaggaaagggtcac

SEQ ID NO: 284378 - DNA, 25 bp, Mus musculus
gaacactgcttgggaaatcctcaag

SEQ ID NO: 284379 - DNA, 25 bp, Mus musculus
gaacactgcttggttcgttccacca

SEQ ID NO: 284380 - DNA, 25 bp, Mus musculus
gaacactgcttggttggtgttaagg

SEQ ID NO: 284381 - DNA, 25 bp, Mus musculus
gaacactggccggagaagctggagg

SEQ ID NO: 284382 - DNA, 25 bp, Mus musculus
gaacactggccggcacaatatgacg

SEQ ID NO: 284383 - DNA, 25 bp, Mus musculus
gaacactgtccaacactggccagtg

SEQ ID NO: 284384 - DNA, 25 bp, Mus musculus
gaacactgtggctctccagagcaac

SEQ ID NO: 284385 - DNA, 25 bp, Mus musculus
gaacacttatccaggctgaataaaa

SEQ ID NO: 284386 - DNA, 25 bp, Mus musculus
gaacacttatccagggtgtattgag

SEQ ID NO: 284387 - DNA, 25 bp, Mus musculus
gaacacttggttatgaggaggatgt

SEQ ID NO: 284388 - DNA, 25 bp, Mus musculus
gaacactttgagaagcaccaggcgt

SEQ ID NO: 284389 - DNA, 25 bp, Mus musculus
gaacagaaacaagctccttgctcgg

SEQ ID NO: 284390 - DNA, 25 bp, Mus musculus
gaacagaaacaggtgattttttcag

SEQ ID NO: 284391 - DNA, 25 bp, Mus musculus
gaacagaaaggtcaaatcattaagg

SEQ ID NO: 284392 - DNA, 25 bp, Mus musculus
gaacagaaatgaaggctccagccag

SEQ ID NO: 284393 - DNA, 25 bp, Mus musculus
gaacagaacggagtgcaagatcccc

SEQ ID NO: 284394 - DNA, 25 bp, Mus musculus
gaacagaacgggaggaactataccc

SEQ ID NO: 284395 - DNA, 25 bp, Mus musculus
gaacagaagaaagaggaagtttgtt

SEQ ID NO: 284396 - DNA, 25 bp, Mus musculus
gaacagaagaaagaggttatggctt

SEQ ID NO: 284397 - DNA, 25 bp, Mus musculus
gaacagaagaacagatggaggcctt

SEQ ID NO: 284398 - DNA, 25 bp, Mus musculus
gaacagaagaacagtgtcccagcag

SEQ ID NO: 284399 - DNA, 25 bp, Mus musculus
gaacagaagagaaagaaagaccaga

SEQ ID NO: 284400 - DNA, 25 bp, Mus musculus
gaacagaagatgaagatgtctggtg

SEQ ID NO: 284401 - DNA, 25 bp, Mus musculus
gaacagaagcagagcagcagaccac

SEQ ID NO: 284402 - DNA, 25 bp, Mus musculus
gaacagaagtggaagagacaatgaa

SEQ ID NO: 284403 - DNA, 25 bp, Mus musculus
gaacagaatcgaggtacaaccagca

SEQ ID NO: 284404 - DNA, 25 bp, Mus musculus
gaacagaatgagatcatcgatgacc

SEQ ID NO: 284405 - DNA, 25 bp, Mus musculus
gaacagacaacctgacagatcgtta

SEQ ID NO: 284406 - DNA, 25 bp, Mus musculus
gaacagacaagcctttgaggacctc

SEQ ID NO: 284407 - DNA, 25 bp, Mus musculus
gaacagacaagggtgtgtctgcagc

SEQ ID NO: 284408 - DNA, 25 bp, Mus musculus
gaacagacaatgaagataaaattgc

SEQ ID NO: 284409 - DNA, 25 bp, Mus musculus
gaacagacaatgaagtgtttgctgg

SEQ ID NO: 284410 - DNA, 25 bp, Mus musculus
gaacagacacagctcacagacttcg

SEQ ID NO: 284411 - DNA, 25 bp, Mus musculus
gaacagacagctgaaattaccccag

SEQ ID NO: 284412 - DNA, 25 bp, Mus musculus
gaacagacatcatgatcgggagggt

SEQ ID NO: 284413 - DNA, 25 bp, Mus musculus
gaacagaccagagatgggcagcagt

SEQ ID NO: 284414 - DNA, 25 bp, Mus musculus
gaacagacctcgcggaaaactgtcc

SEQ ID NO: 284415 - DNA, 25 bp, Mus musculus
gaacagacctcgcgggcccatcctc

SEQ ID NO: 284416 - DNA, 25 bp, Mus musculus
gaacagagagaaataatgaagcatt

SEQ ID NO: 284417 - DNA, 25 bp, Mus musculus
gaacagagagatggatgatccttct

SEQ ID NO: 284418 - DNA, 25 bp, Mus musculus
gaacagagagcagatcttgagtgca

SEQ ID NO: 284419 - DNA, 25 bp, Mus musculus
gaacagagtaccactcattcggcga

SEQ ID NO: 284420 - DNA, 25 bp, Mus musculus
gaacagatcacaagggttctcttgg

SEQ ID NO: 284421 - DNA, 25 bp, Mus musculus
gaacagatccagcaattcttggcca

SEQ ID NO: 284422 - DNA, 25 bp, Mus musculus
gaacagatgaacctgtcctaaagga

SEQ ID NO: 284423 - DNA, 25 bp, Mus musculus
gaacagatggaaagtgggaagccac

SEQ ID NO: 284424 - DNA, 25 bp, Mus musculus
gaacagattcagagcctctctccca

SEQ ID NO: 284425 - DNA, 25 bp, Mus musculus
gaacagattcagcagcagcaacagc

SEQ ID NO: 284426 - DNA, 25 bp, Mus musculus
gaacagatttgccagggagatgtaa

SEQ ID NO: 284427 - DNA, 25 bp, Mus musculus
gaacagcaaaggtcaatatccaaca

SEQ ID NO: 284428 - DNA, 25 bp, Mus musculus
gaacagcaagcggaatatctccatg

SEQ ID NO: 284429 - DNA, 25 bp, Mus musculus
gaacagcaagcggatttcccttttc

SEQ ID NO: 284430 - DNA, 25 bp, Mus musculus
gaacagcaagcggttcagcagagga

SEQ ID NO: 284431 - DNA, 25 bp, Mus musculus
gaacagcagaaagagcacagagaac

SEQ ID NO: 284432 - DNA, 25 bp, Mus musculus
gaacagcagaaagaggagttcgtga

SEQ ID NO: 284433 - DNA, 25 bp, Mus musculus
gaacagcagagcaagagacgaatta

SEQ ID NO: 284434 - DNA, 25 bp, Mus musculus
gaacagcataaggcttgctcttcag

SEQ ID NO: 284435 - DNA, 25 bp, Mus musculus
gaacagccaggaggatgttggatgg

SEQ ID NO: 284436 - DNA, 25 bp, Mus musculus
gaacagcctaaaaaagcattcaact

SEQ ID NO: 284437 - DNA, 25 bp, Mus musculus
gaacagccttagctacatcaaaata

SEQ ID NO: 284438 - DNA, 25 bp, Mus musculus
gaacagcgaagccttggagctggtg

SEQ ID NO: 284439 - DNA, 25 bp, Mus musculus
gaacagcgacgcagaaaaccaacag

SEQ ID NO: 284440 - DNA, 25 bp, Mus musculus
gaacagcgacgcagaggagcctttg

SEQ ID NO: 284441 - DNA, 25 bp, Mus musculus
gaacagcgcaggacccagaagctgg

SEQ ID NO: 284442 - DNA, 25 bp, Mus musculus
gaacagctacttcgtaagaatgtct

SEQ ID NO: 284443 - DNA, 25 bp, Mus musculus
gaacagctcggggactttctctagt

SEQ ID NO: 284444 - DNA, 25 bp, Mus musculus
gaacagctcgggtttgagttttttg

SEQ ID NO: 284445 - DNA, 25 bp, Mus musculus
gaacagctggacatgcgccgggatg

SEQ ID NO: 284446 - DNA, 25 bp, Mus musculus
gaacagctgggccctgtctcaagca

SEQ ID NO: 284447 - DNA, 25 bp, Mus musculus
gaacagctgggctccctttcctgaa

SEQ ID NO: 284448 - DNA, 25 bp, Mus musculus
gaacagctggggcagaagtggcagt

SEQ ID NO: 284449 - DNA, 25 bp, Mus musculus
gaacagctgggtccagcggctggag

SEQ ID NO: 284450 - DNA, 25 bp, Mus musculus
gaacagctgtgtcactacttcgatg

SEQ ID NO: 284451 - DNA, 25 bp, Mus musculus
gaacaggaacatagcggcggagcca

SEQ ID NO: 284452 - DNA, 25 bp, Mus musculus
gaacaggaactggtggattgtctgg

SEQ ID NO: 284453 - DNA, 25 bp, Mus musculus
gaacaggaatatgtggcatcagcta

SEQ ID NO: 284454 - DNA, 25 bp, Mus musculus
gaacaggagcagatcaggaatcttt

SEQ ID NO: 284455 - DNA, 25 bp, Mus musculus
gaacaggagcagatccgctctcaca

SEQ ID NO: 284456 - DNA, 25 bp, Mus musculus
gaacaggaggagctgatccgagcac

SEQ ID NO: 284457 - DNA, 25 bp, Mus musculus
gaacaggatcgcaatagtcggtgct

SEQ ID NO: 284458 - DNA, 25 bp, Mus musculus
gaacaggatcggatctaccgttacc

SEQ ID NO: 284459 - DNA, 25 bp, Mus musculus
gaacaggatcggtctctccagtgtt

SEQ ID NO: 284460 - DNA, 25 bp, Mus musculus
gaacaggcaggatgagatagagcac

SEQ ID NO: 284461 - DNA, 25 bp, Mus musculus
gaacaggcaggtcacgaaagaagga

SEQ ID NO: 284462 - DNA, 25 bp, Mus musculus
gaacaggccagtaggagttaaaggg

SEQ ID NO: 284463 - DNA, 25 bp, Mus musculus
gaacagggaagttaggcacaatcac

SEQ ID NO: 284464 - DNA, 25 bp, Mus musculus
gaacagggcaaaggggtttcctgag

SEQ ID NO: 284465 - DNA, 25 bp, Mus musculus
gaacagggcagctgggcaccacaag

SEQ ID NO: 284466 - DNA, 25 bp, Mus musculus
gaacaggggtggcagactctcttct

SEQ ID NO: 284467 - DNA, 25 bp, Mus musculus
gaacaggggtggcaggcgcaccaac

SEQ ID NO: 284468 - DNA, 25 bp, Mus musculus
gaacagtaagtctatatggagacac

SEQ ID NO: 284469 - DNA, 25 bp, Mus musculus
gaacagtacctcccaagccggccgt

SEQ ID NO: 284470 - DNA, 25 bp, Mus musculus
gaacagtcacagactgtatgagagt

SEQ ID NO: 284471 - DNA, 25 bp, Mus musculus
gaacagtcacagagagtggtgaagg

SEQ ID NO: 284472 - DNA, 25 bp, Mus musculus
gaacagtcacagatggctttatgga

SEQ ID NO: 284473 - DNA, 25 bp, Mus musculus
gaacagtcacagcgtattgtcaggg

SEQ ID NO: 284474 - DNA, 25 bp, Mus musculus
gaacagtcacaggcagatattgtaa

SEQ ID NO: 284475 - DNA, 25 bp, Mus musculus
gaacagtcctgactatgccacctgc

SEQ ID NO: 284476 - DNA, 25 bp, Mus musculus
gaacagtgaagcaggcagggcattt

SEQ ID NO: 284477 - DNA, 25 bp, Mus musculus
gaacagtgccatatgagaacatgcc

SEQ ID NO: 284478 - DNA, 25 bp, Mus musculus
gaacagtgccgcaacataacatgta

SEQ ID NO: 284479 - DNA, 25 bp, Mus musculus
gaacagtgtcaaccagtgctcagag

SEQ ID NO: 284480 - DNA, 25 bp, Mus musculus
gaacagtgtcaaccatcttgctcta

SEQ ID NO: 284481 - DNA, 25 bp, Mus musculus
gaacagttagaggaaagaacaggct

SEQ ID NO: 284482 - DNA, 25 bp, Mus musculus
gaacagttagaggttcgagaaatgg

SEQ ID NO: 284483 - DNA, 25 bp, Mus musculus
gaacagttcatgaaatcttttgagc

SEQ ID NO: 284484 - DNA, 25 bp, Mus musculus
gaacagttcatgaggttacgtcccc

SEQ ID NO: 284485 - DNA, 25 bp, Mus musculus
gaacagtttctcaagggttgagctc

SEQ ID NO: 284486 - DNA, 25 bp, Mus musculus
gaacagtttggaggacgtaccatgc

SEQ ID NO: 284487 - DNA, 25 bp, Mus musculus
gaacagtttggaggctcacccgggt

SEQ ID NO: 284488 - DNA, 25 bp, Mus musculus
gaacataaacaaggcataatcaacc

SEQ ID NO: 284489 - DNA, 25 bp, Mus musculus
gaacataaacagtctgatgaaagtg

SEQ ID NO: 284490 - DNA, 25 bp, Mus musculus
gaacataaagagcagatcaaattgc

SEQ ID NO: 284491 - DNA, 25 bp, Mus musculus
gaacataaagagcagttctcctatt

SEQ ID NO: 284492 - DNA, 25 bp, Mus musculus
gaacataacctggagacagcctgtg

SEQ ID NO: 284493 - DNA, 25 bp, Mus musculus
gaacataagcgtattatttatgtgg

SEQ ID NO: 284494 - DNA, 25 bp, Mus musculus
gaacataatggactccctggaactg

SEQ ID NO: 284495 - DNA, 25 bp, Mus musculus
gaacataatggatggagaggagaag

SEQ ID NO: 284496 - DNA, 25 bp, Mus musculus
gaacataattagcttgaagtcaatg

SEQ ID NO: 284497 - DNA, 25 bp, Mus musculus
gaacatagactgtgaagtatttcgg

SEQ ID NO: 284498 - DNA, 25 bp, Mus musculus
gaacatagccagatgaggaagctgg

SEQ ID NO: 284499 - DNA, 25 bp, Mus musculus
gaacatatagaagattttaaacagt

SEQ ID NO: 284500 - DNA, 25 bp, Mus musculus
gaacatattggctccctgaccctga

SEQ ID NO: 284501 - DNA, 25 bp, Mus musculus
gaacatatttattgcatccgatatc

SEQ ID NO: 284502 - DNA, 25 bp, Mus musculus
gaacatatttattggatgactagga

SEQ ID NO: 284503 - DNA, 25 bp, Mus musculus
gaacatatttattggtgaagccgag

SEQ ID NO: 284504 - DNA, 25 bp, Mus musculus
gaacatatttgagaagatagatgaa

SEQ ID NO: 284505 - DNA, 25 bp, Mus musculus
gaacatcaacggttctcccatggcg

SEQ ID NO: 284506 - DNA, 25 bp, Mus musculus
gaacatcaagacaaaccaggtgatg

SEQ ID NO: 284507 - DNA, 25 bp, Mus musculus
gaacatcaagactggagtacctgca

SEQ ID NO: 284508 - DNA, 25 bp, Mus musculus
gaacatcacattggcgtcttctggg

SEQ ID NO: 284509 - DNA, 25 bp, Mus musculus
gaacatcaccttggatggcaaggtc

SEQ ID NO: 284510 - DNA, 25 bp, Mus musculus
gaacatcactcacgagctctttgac

SEQ ID NO: 284511 - DNA, 25 bp, Mus musculus
gaacatcatgcaggatccaaacgaa

SEQ ID NO: 284512 - DNA, 25 bp, Mus musculus
gaacatcatgcagttaaaccatatg

SEQ ID NO: 284513 - DNA, 25 bp, Mus musculus
gaacatcatgcatgctaagtggcag

SEQ ID NO: 284514 - DNA, 25 bp, Mus musculus
gaacatcattgcatatgatcactct

SEQ ID NO: 284515 - DNA, 25 bp, Mus musculus
gaacatcattgcatccatgccgagc

SEQ ID NO: 284516 - DNA, 25 bp, Mus musculus
gaacatccaaaagtttgcagtcctg

SEQ ID NO: 284517 - DNA, 25 bp, Mus musculus
gaacatccaaagacacacaggacca

SEQ ID NO: 284518 - DNA, 25 bp, Mus musculus
gaacatccacggagtcaggacgggg

SEQ ID NO: 284519 - DNA, 25 bp, Mus musculus
gaacatccagaacaactggcggggc

SEQ ID NO: 284520 - DNA, 25 bp, Mus musculus
gaacatccagagccgtctgggtaca

SEQ ID NO: 284521 - DNA, 25 bp, Mus musculus
gaacatccagatcatccacacggac

SEQ ID NO: 284522 - DNA, 25 bp, Mus musculus
gaacatccaggcttgccctctgttt

SEQ ID NO: 284523 - DNA, 25 bp, Mus musculus
gaacatccaggtcctgcctggcagc

SEQ ID NO: 284524 - DNA, 25 bp, Mus musculus
gaacatcccagattgctgaagctaa

SEQ ID NO: 284525 - DNA, 25 bp, Mus musculus
gaacatcccagcccactggtttgtt

SEQ ID NO: 284526 - DNA, 25 bp, Mus musculus
gaacatcctcaaagcgacccctgaa

SEQ ID NO: 284527 - DNA, 25 bp, Mus musculus
gaacatcctcaaaggatacaacttc

SEQ ID NO: 284528 - DNA, 25 bp, Mus musculus
gaacatcctcatcagatgttttaag

SEQ ID NO: 284529 - DNA, 25 bp, Mus musculus
gaacatctactttgactgcagcaga

SEQ ID NO: 284530 - DNA, 25 bp, Mus musculus
gaacatctactttgctcagcagata

SEQ ID NO: 284531 - DNA, 25 bp, Mus musculus
gaacatctagacagttcgaacctca

SEQ ID NO: 284532 - DNA, 25 bp, Mus musculus
gaacatcttggaacctaggtcctgt

SEQ ID NO: 284533 - DNA, 25 bp, Mus musculus
gaacatgaacatccagtaataatat

SEQ ID NO: 284534 - DNA, 25 bp, Mus musculus
gaacatgaagttggtgagcccgagt

SEQ ID NO: 284535 - DNA, 25 bp, Mus musculus
gaacatgacagaagctgattggcca

SEQ ID NO: 284536 - DNA, 25 bp, Mus musculus
gaacatgagaaagcatgctctctgt

SEQ ID NO: 284537 - DNA, 25 bp, Mus musculus
gaacatgatgaagaatagaattgct

SEQ ID NO: 284538 - DNA, 25 bp, Mus musculus
gaacatgatgatgaacttgttccta

SEQ ID NO: 284539 - DNA, 25 bp, Mus musculus
gaacatgatgtcagcgtcaatacta

SEQ ID NO: 284540 - DNA, 25 bp, Mus musculus
gaacatgattaatgacttccaccgt

SEQ ID NO: 284541 - DNA, 25 bp, Mus musculus
gaacatgcacaaggttcacctgctg

SEQ ID NO: 284542 - DNA, 25 bp, Mus musculus
gaacatgccggagttctctggggtg

SEQ ID NO: 284543 - DNA, 25 bp, Mus musculus
gaacatgcctgaagacgttattgct

SEQ ID NO: 284544 - DNA, 25 bp, Mus musculus
gaacatgcctgaaggctctggtgtc

SEQ ID NO: 284545 - DNA, 25 bp, Mus musculus
gaacatgcgtccaagctgtttcctc

SEQ ID NO: 284546 - DNA, 25 bp, Mus musculus
gaacatgcgtccaaggcaaatttca

SEQ ID NO: 284547 - DNA, 25 bp, Mus musculus
gaacatgcgtccaagtatctagcat

SEQ ID NO: 284548 - DNA, 25 bp, Mus musculus
gaacatggaaaagaaaatagatatc

SEQ ID NO: 284549 - DNA, 25 bp, Mus musculus
gaacatggaaaagatatcaccagta

SEQ ID NO: 284550 - DNA, 25 bp, Mus musculus
gaacatggaagacagagctgcatga

SEQ ID NO: 284551 - DNA, 25 bp, Mus musculus
gaacatggacacaggtatacaagga

SEQ ID NO: 284552 - DNA, 25 bp, Mus musculus
gaacatggactttggaggacagaaa

SEQ ID NO: 284553 - DNA, 25 bp, Mus musculus
gaacatggactttggagtctgaata

SEQ ID NO: 284554 - DNA, 25 bp, Mus musculus
gaacatggaggaggattgtccggag

SEQ ID NO: 284555 - DNA, 25 bp, Mus musculus
gaacatggagggccctgctcagtct

SEQ ID NO: 284556 - DNA, 25 bp, Mus musculus
gaacatggagggttcactgtgggag

SEQ ID NO: 284557 - DNA, 25 bp, Mus musculus
gaacatggaggttgctatcggctgg

SEQ ID NO: 284558 - DNA, 25 bp, Mus musculus
gaacatggatgtggacgccactatg

SEQ ID NO: 284559 - DNA, 25 bp, Mus musculus
gaacatgtgaagatttctgctccta

SEQ ID NO: 284560 - DNA, 25 bp, Mus musculus
gaacattaaaaggagtgcaagatcc

SEQ ID NO: 284561 - DNA, 25 bp, Mus musculus
gaacattacaagaagacgctgcagc

SEQ ID NO: 284562 - DNA, 25 bp, Mus musculus
gaacattacaaggtgggagagggcc

SEQ ID NO: 284563 - DNA, 25 bp, Mus musculus
gaacattataagattccccccctag

SEQ ID NO: 284564 - DNA, 25 bp, Mus musculus
gaacattatgcagagatgcacacaa

SEQ ID NO: 284565 - DNA, 25 bp, Mus musculus
gaacattatgcagagcttctgaaca

SEQ ID NO: 284566 - DNA, 25 bp, Mus musculus
gaacattatgcagaggatgattctg

SEQ ID NO: 284567 - DNA, 25 bp, Mus musculus
gaacattattgcttcacctctgctc

SEQ ID NO: 284568 - DNA, 25 bp, Mus musculus
gaacattccaccatgccagcagcac

SEQ ID NO: 284569 - DNA, 25 bp, Mus musculus
gaacattccagatacacttcagagc

SEQ ID NO: 284570 - DNA, 25 bp, Mus musculus
gaacattccagggagattccagact

SEQ ID NO: 284571 - DNA, 25 bp, Mus musculus
gaacattccagggagggtcccacct

SEQ ID NO: 284572 - DNA, 25 bp, Mus musculus
gaacattctaccgctcctggaggat

SEQ ID NO: 284573 - DNA, 25 bp, Mus musculus
gaacattctaccgctgaaaaagcag

SEQ ID NO: 284574 - DNA, 25 bp, Mus musculus
gaacattctaccgctttgatgcagc

SEQ ID NO: 284575 - DNA, 25 bp, Mus musculus
gaacattcttctgccttggctgtcg

SEQ ID NO: 284576 - DNA, 25 bp, Mus musculus
gaacattgaagagcatgcctctgca

SEQ ID NO: 284577 - DNA, 25 bp, Mus musculus
gaacattgaagagcatgcctctgga

SEQ ID NO: 284578 - DNA, 25 bp, Mus musculus
gaacattgcagggccgtgcaggcct

SEQ ID NO: 284579 - DNA, 25 bp, Mus musculus
gaacattgcaggtaaagatgagcct

SEQ ID NO: 284580 - DNA, 25 bp, Mus musculus
gaacattgccaaatgcaagctgtgc

SEQ ID NO: 284581 - DNA, 25 bp, Mus musculus
gaacattggagccatgtcaagctac

SEQ ID NO: 284582 - DNA, 25 bp, Mus musculus
gaacatttaagagtgaatgccatcc

SEQ ID NO: 284583 - DNA, 25 bp, Mus musculus
gaacatttaaggcaattctgccttg

SEQ ID NO: 284584 - DNA, 25 bp, Mus musculus
gaacatttaccagggaagacagtga

SEQ ID NO: 284585 - DNA, 25 bp, Mus musculus
gaacatttccaggttcagctcctaa

SEQ ID NO: 284586 - DNA, 25 bp, Mus musculus
gaacatttctgtattactatgaata

SEQ ID NO: 284587 - DNA, 25 bp, Mus musculus
gaacatttgaaagagccccggcagc

SEQ ID NO: 284588 - DNA, 25 bp, Mus musculus
gaacattttaaagacatttgagaac

SEQ ID NO: 284589 - DNA, 25 bp, Mus musculus
gaacattttcaagacatttgagaac

SEQ ID NO: 284590 - DNA, 25 bp, Mus musculus
gaacattttccctcctgtccttcct

SEQ ID NO: 284591 - DNA, 25 bp, Mus musculus
gaaccaaaatcagggccctgtggac

SEQ ID NO: 284592 - DNA, 25 bp, Mus musculus
gaaccaaacaaggttatatctgaag

SEQ ID NO: 284593 - DNA, 25 bp, Mus musculus
gaaccaaacagagtctccttaaaga

SEQ ID NO: 284594 - DNA, 25 bp, Mus musculus
gaaccaaaccaccgctgaagacgat

SEQ ID NO: 284595 - DNA, 25 bp, Mus musculus
gaaccaaaccaccgctgcagcccac

SEQ ID NO: 284596 - DNA, 25 bp, Mus musculus
gaaccaaagaagatgccgctccaat

SEQ ID NO: 284597 - DNA, 25 bp, Mus musculus
gaaccaaagaagtacggcgagctcc

SEQ ID NO: 284598 - DNA, 25 bp, Mus musculus
gaaccaaagattaaggtacacaggt

SEQ ID NO: 284599 - DNA, 25 bp, Mus musculus
gaaccaaagattaagttgctcagga

SEQ ID NO: 284600 - DNA, 25 bp, Mus musculus
gaaccaaccaaagccagacccacac

SEQ ID NO: 284601 - DNA, 25 bp, Mus musculus
gaaccaactgataaccaagctgaaa

SEQ ID NO: 284602 - DNA, 25 bp, Mus musculus
gaaccaactggagagacttccagaa

SEQ ID NO: 284603 - DNA, 25 bp, Mus musculus
gaaccaagaaatcccaggcaggcac

SEQ ID NO: 284604 - DNA, 25 bp, Mus musculus
gaaccaagaagagtttgtccctgat

SEQ ID NO: 284605 - DNA, 25 bp, Mus musculus
gaaccaagaaggcacagacagaagc

SEQ ID NO: 284606 - DNA, 25 bp, Mus musculus
gaaccaagaaggcctcaggtccagg

SEQ ID NO: 284607 - DNA, 25 bp, Mus musculus
gaaccaagaatgcttttgggtcgca

SEQ ID NO: 284608 - DNA, 25 bp, Mus musculus
gaaccaagagatgcaccttgcaagg

SEQ ID NO: 284609 - DNA, 25 bp, Mus musculus
gaaccaagagtttctagctctgggc

SEQ ID NO: 284610 - DNA, 25 bp, Mus musculus
gaaccaagatgaatgagcgccaacc

SEQ ID NO: 284611 - DNA, 25 bp, Mus musculus
gaaccaagatgctgtgcagaatgag

SEQ ID NO: 284612 - DNA, 25 bp, Mus musculus
gaaccaagcacttgtttctagttta

SEQ ID NO: 284613 - DNA, 25 bp, Mus musculus
gaaccaagcattccggagaaaacaa

SEQ ID NO: 284614 - DNA, 25 bp, Mus musculus
gaaccaagcattccggctactcctg

SEQ ID NO: 284615 - DNA, 25 bp, Mus musculus
gaaccaagccggccctgggcagtga

SEQ ID NO: 284616 - DNA, 25 bp, Mus musculus
gaaccacaaagaggaaatgcaggct

SEQ ID NO: 284617 - DNA, 25 bp, Mus musculus
gaaccacaacccaccaagcagttcc

SEQ ID NO: 284618 - DNA, 25 bp, Mus musculus
gaaccacaagaagacccactccgag

SEQ ID NO: 284619 - DNA, 25 bp, Mus musculus
gaaccacaattttcaggatgacgat

SEQ ID NO: 284620 - DNA, 25 bp, Mus musculus
gaaccacactgtaccagcaaggtga

SEQ ID NO: 284621 - DNA, 25 bp, Mus musculus
gaaccacagcgagggggcgctcctg

SEQ ID NO: 284622 - DNA, 25 bp, Mus musculus
gaaccaccacctggggccaggtcgc

SEQ ID NO: 284623 - DNA, 25 bp, Mus musculus
gaaccaccataggatacgacttgat

SEQ ID NO: 284624 - DNA, 25 bp, Mus musculus
gaaccacgaagaggaaatgcaggct

SEQ ID NO: 284625 - DNA, 25 bp, Mus musculus
gaaccacgagcaggtcctgcgcacc

SEQ ID NO: 284626 - DNA, 25 bp, Mus musculus
gaaccacgaggaggaaatgcaggct

SEQ ID NO: 284627 - DNA, 25 bp, Mus musculus
gaaccacgaggaggaaatggcctcc

SEQ ID NO: 284628 - DNA, 25 bp, Mus musculus
gaaccacgaggaggtggccaccaac

SEQ ID NO: 284629 - DNA, 25 bp, Mus musculus
gaaccacgtcacctctcacatctcc

SEQ ID NO: 284630 - DNA, 25 bp, Mus musculus
gaaccactcatatgatacagatttc

SEQ ID NO: 284631 - DNA, 25 bp, Mus musculus
gaaccactcatatgatttcaaccag

SEQ ID NO: 284632 - DNA, 25 bp, Mus musculus
gaaccactgcaggatttctggcacc

SEQ ID NO: 284633 - DNA, 25 bp, Mus musculus
gaaccagaagactttgaaagcattt

SEQ ID NO: 284634 - DNA, 25 bp, Mus musculus
gaaccagaagagccaccaaccaaat

SEQ ID NO: 284635 - DNA, 25 bp, Mus musculus
gaaccagaagatgccatctcatctg

SEQ ID NO: 284636 - DNA, 25 bp, Mus musculus
gaaccagaagctggaatcctttctg

SEQ ID NO: 284637 - DNA, 25 bp, Mus musculus
gaaccagaaggagcaccgtactgga

SEQ ID NO: 284638 - DNA, 25 bp, Mus musculus
gaaccagaagggctgtcagggggtt

SEQ ID NO: 284639 - DNA, 25 bp, Mus musculus
gaaccagacagctgtgccaccgcat

SEQ ID NO: 284640 - DNA, 25 bp, Mus musculus
gaaccagacaggcacctgtgctcag

SEQ ID NO: 284641 - DNA, 25 bp, Mus musculus
gaaccagacattgaggcaccaccta

SEQ ID NO: 284642 - DNA, 25 bp, Mus musculus
gaaccagaggagattggattccaga

SEQ ID NO: 284643 - DNA, 25 bp, Mus musculus
gaaccagagtcagaaaaatataact

SEQ ID NO: 284644 - DNA, 25 bp, Mus musculus
gaaccagcagatgacaccgtacatg

SEQ ID NO: 284645 - DNA, 25 bp, Mus musculus
gaaccagcagggtggcccacgcgct

SEQ ID NO: 284646 - DNA, 25 bp, Mus musculus
gaaccagccgcaagggaaggtgtga

SEQ ID NO: 284647 - DNA, 25 bp, Mus musculus
gaaccagccgcagagccccaaggac

SEQ ID NO: 284648 - DNA, 25 bp, Mus musculus
gaaccagcggagttcaatgcgagct

SEQ ID NO: 284649 - DNA, 25 bp, Mus musculus
gaaccagcggagtttcagtctggaa

SEQ ID NO: 284650 - DNA, 25 bp, Mus musculus
gaaccagctcaaaggcaaatcaaaa

SEQ ID NO: 284651 - DNA, 25 bp, Mus musculus
gaaccagctcgaaaaaacaatggca

SEQ ID NO: 284652 - DNA, 25 bp, Mus musculus
gaaccaggccgcgttgtctgtcttc

SEQ ID NO: 284653 - DNA, 25 bp, Mus musculus
gaaccagtgggaggtgggacttccg

SEQ ID NO: 284654 - DNA, 25 bp, Mus musculus
gaaccagtggtgactgccctgctga

SEQ ID NO: 284655 - DNA, 25 bp, Mus musculus
gaaccatactatgcattatccaatt

SEQ ID NO: 284656 - DNA, 25 bp, Mus musculus
gaaccatactatttgcttttgccaa

SEQ ID NO: 284657 - DNA, 25 bp, Mus musculus
gaaccatcaacaagcaaatccgcga

SEQ ID NO: 284658 - DNA, 25 bp, Mus musculus
gaaccatcccccatgcggctgggta

SEQ ID NO: 284659 - DNA, 25 bp, Mus musculus
gaaccatcctgaggcctgactacca

SEQ ID NO: 284660 - DNA, 25 bp, Mus musculus
gaaccatctggagaatgtgaggtgg

SEQ ID NO: 284661 - DNA, 25 bp, Mus musculus
gaaccatgaaaagaagagatgagac

SEQ ID NO: 284662 - DNA, 25 bp, Mus musculus
gaaccatgaagaggaagttggtgtc

SEQ ID NO: 284663 - DNA, 25 bp, Mus musculus
gaaccatgcaatcaatgtttgcaaa

SEQ ID NO: 284664 - DNA, 25 bp, Mus musculus
gaaccatgccgcctgctaagcccca

SEQ ID NO: 284665 - DNA, 25 bp, Mus musculus
gaaccatggacctagtccaaggcgg

SEQ ID NO: 284666 - DNA, 25 bp, Mus musculus
gaaccatggcagagcacctgaccca

SEQ ID NO: 284667 - DNA, 25 bp, Mus musculus
gaaccatggcagagcgatggcagca

SEQ ID NO: 284668 - DNA, 25 bp, Mus musculus
gaaccatgggaccggtccaacgggc

SEQ ID NO: 284669 - DNA, 25 bp, Mus musculus
gaaccatgtttgcagccagcagcaa

SEQ ID NO: 284670 - DNA, 25 bp, Mus musculus
gaaccattacagccatccccaggca

SEQ ID NO: 284671 - DNA, 25 bp, Mus musculus
gaacccaaaagatcttcccctgatg

SEQ ID NO: 284672 - DNA, 25 bp, Mus musculus
gaacccaaccatatgagagtctgtg

SEQ ID NO: 284673 - DNA, 25 bp, Mus musculus
gaacccaacccggaggaccaggact

SEQ ID NO: 284674 - DNA, 25 bp, Mus musculus
gaacccaactgatccccagctcaag

SEQ ID NO: 284675 - DNA, 25 bp, Mus musculus
gaacccaagaatttattgccaagcc

SEQ ID NO: 284676 - DNA, 25 bp, Mus musculus
gaacccaagagacttctctacccag

SEQ ID NO: 284677 - DNA, 25 bp, Mus musculus
gaacccaagaggctggggtctcaga

SEQ ID NO: 284678 - DNA, 25 bp, Mus musculus
gaacccaagcggaaggagcatagtg

SEQ ID NO: 284679 - DNA, 25 bp, Mus musculus
gaacccaagtcatcttggctgaaga

SEQ ID NO: 284680 - DNA, 25 bp, Mus musculus
gaacccacacatagagagactgaga

SEQ ID NO: 284681 - DNA, 25 bp, Mus musculus
gaacccacagagacgtttcatgtag

SEQ ID NO: 284682 - DNA, 25 bp, Mus musculus
gaacccacagagatataaactacac

SEQ ID NO: 284683 - DNA, 25 bp, Mus musculus
gaacccacagcagagtcttctggag

SEQ ID NO: 284684 - DNA, 25 bp, Mus musculus
gaacccacaggtgattcacatactt

SEQ ID NO: 284685 - DNA, 25 bp, Mus musculus
gaacccacagttacagatcaacata

SEQ ID NO: 284686 - DNA, 25 bp, Mus musculus
gaacccaccaagaataaagcgctaa

SEQ ID NO: 284687 - DNA, 25 bp, Mus musculus
gaacccaccagagagtgctgatccc

SEQ ID NO: 284688 - DNA, 25 bp, Mus musculus
gaacccaccagagcccgagacagtg

SEQ ID NO: 284689 - DNA, 25 bp, Mus musculus
gaacccagaagcaagacgcgggcga

SEQ ID NO: 284690 - DNA, 25 bp, Mus musculus
gaacccagaagcaaggggtggatga

SEQ ID NO: 284691 - DNA, 25 bp, Mus musculus
gaacccagcacctgcgcttagatcc

SEQ ID NO: 284692 - DNA, 25 bp, Mus musculus
gaacccagcacctgcggaaaatttc

SEQ ID NO: 284693 - DNA, 25 bp, Mus musculus
gaacccagcatgagtccgcagagtc

SEQ ID NO: 284694 - DNA, 25 bp, Mus musculus
gaacccaggcaccagaaacctcatc

SEQ ID NO: 284695 - DNA, 25 bp, Mus musculus
gaacccaggcaccagccagtaagtg

SEQ ID NO: 284696 - DNA, 25 bp, Mus musculus
gaacccaggcaccaggttgctccag

SEQ ID NO: 284697 - DNA, 25 bp, Mus musculus
gaacccaggcaccagtgtgtccatt

SEQ ID NO: 284698 - DNA, 25 bp, Mus musculus
gaacccaggctccaccaaacgtggt

SEQ ID NO: 284699 - DNA, 25 bp, Mus musculus
gaacccaggctcccactggcctcat

SEQ ID NO: 284700 - DNA, 25 bp, Mus musculus
gaacccatcagccagaccacagatg

SEQ ID NO: 284701 - DNA, 25 bp, Mus musculus
gaacccatcaggaaggatcatcgaa

SEQ ID NO: 284702 - DNA, 25 bp, Mus musculus
gaacccatcaggctgacatcaaaga

SEQ ID NO: 284703 - DNA, 25 bp, Mus musculus
gaacccatcgcaggtgcagaccata

SEQ ID NO: 284704 - DNA, 25 bp, Mus musculus
gaacccatctcagatcttctgccca

SEQ ID NO: 284705 - DNA, 25 bp, Mus musculus
gaacccatgtggcagtggtccccag

SEQ ID NO: 284706 - DNA, 25 bp, Mus musculus
gaacccattctcaaaaatttcaaag

SEQ ID NO: 284707 - DNA, 25 bp, Mus musculus
gaacccattggtcagtgacatcaaa

SEQ ID NO: 284708 - DNA, 25 bp, Mus musculus
gaaccccaacttctcggtctactat

SEQ ID NO: 284709 - DNA, 25 bp, Mus musculus
gaaccccaagctttgtgacgacaaa

SEQ ID NO: 284710 - DNA, 25 bp, Mus musculus
gaaccccaagggaaccatcagcgtt

SEQ ID NO: 284711 - DNA, 25 bp, Mus musculus
gaaccccaggcagaaagtaaatccg

SEQ ID NO: 284712 - DNA, 25 bp, Mus musculus
gaaccccagggtccattcacacagc

SEQ ID NO: 284713 - DNA, 25 bp, Mus musculus
gaaccccatcactgggaaaaggact

SEQ ID NO: 284714 - DNA, 25 bp, Mus musculus
gaaccccatcactgggtttggtaaa

SEQ ID NO: 284715 - DNA, 25 bp, Mus musculus
gaacccccaatatgaacattttccc

SEQ ID NO: 284716 - DNA, 25 bp, Mus musculus
gaaccccgaaatgccaggcagatcc

SEQ ID NO: 284717 - DNA, 25 bp, Mus musculus
gaaccccgaagacatcggcagaaac

SEQ ID NO: 284718 - DNA, 25 bp, Mus musculus
gaaccccgtcctgtgtgtcaccccg

SEQ ID NO: 284719 - DNA, 25 bp, Mus musculus
gaacccgaagagcctcagcttaagg

SEQ ID NO: 284720 - DNA, 25 bp, Mus musculus
gaacccgagggtttctctgccgatt

SEQ ID NO: 284721 - DNA, 25 bp, Mus musculus
gaacccgatggagggaccttgccag

SEQ ID NO: 284722 - DNA, 25 bp, Mus musculus
gaacccgccattcagggtgtcctgg

SEQ ID NO: 284723 - DNA, 25 bp, Mus musculus
gaacccggaggctgtttactttgtg

SEQ ID NO: 284724 - DNA, 25 bp, Mus musculus
gaacccggagtctggcacatccagg

SEQ ID NO: 284725 - DNA, 25 bp, Mus musculus
gaacccggctagagcgccacttagc

SEQ ID NO: 284726 - DNA, 25 bp, Mus musculus
gaacccgtgaggtcaatatccaaca

SEQ ID NO: 284727 - DNA, 25 bp, Mus musculus
gaaccctacagtaggcttcgagctg

SEQ ID NO: 284728 - DNA, 25 bp, Mus musculus
gaaccctacagtagggtctcactgt

SEQ ID NO: 284729 - DNA, 25 bp, Mus musculus
gaaccctatcgaagaagaaccgatc

SEQ ID NO: 284730 - DNA, 25 bp, Mus musculus
gaaccctcaaccgtgttaggagtgg

SEQ ID NO: 284731 - DNA, 25 bp, Mus musculus
gaaccctcagtgattgtgtgtcgct

SEQ ID NO: 284732 - DNA, 25 bp, Mus musculus
gaaccctccactagctggcattcct

SEQ ID NO: 284733 - DNA, 25 bp, Mus musculus
gaaccctctggctcatacatgtctc

SEQ ID NO: 284734 - DNA, 25 bp, Mus musculus
gaaccctgaaggatcctcgctctgc

SEQ ID NO: 284735 - DNA, 25 bp, Mus musculus
gaaccctgaaggatgatgactgggg

SEQ ID NO: 284736 - DNA, 25 bp, Mus musculus
gaaccctgagcgcccccgtggaatg

SEQ ID NO: 284737 - DNA, 25 bp, Mus musculus
gaaccctggcaggtgcacaggctgc

SEQ ID NO: 284738 - DNA, 25 bp, Mus musculus
gaaccctgggaaaggtgctgggtgt

SEQ ID NO: 284739 - DNA, 25 bp, Mus musculus
gaaccctgttgggaactgttgacaa

SEQ ID NO: 284740 - DNA, 25 bp, Mus musculus
gaaccctttatgctatgaaaccact

SEQ ID NO: 284741 - DNA, 25 bp, Mus musculus
gaaccctttatgctcaatatgaaga

SEQ ID NO: 284742 - DNA, 25 bp, Mus musculus
gaaccctttatgctgattctctgac

SEQ ID NO: 284743 - DNA, 25 bp, Mus musculus
gaaccctttcagatctcgctgccta

SEQ ID NO: 284744 - DNA, 25 bp, Mus musculus
gaaccctttcagccgttaaccacat

SEQ ID NO: 284745 - DNA, 25 bp, Mus musculus
gaaccgacttaaaacttcaggttgt

SEQ ID NO: 284746 - DNA, 25 bp, Mus musculus
gaaccgaggcatcaaggcctgcaag

SEQ ID NO: 284747 - DNA, 25 bp, Mus musculus
gaaccgatcagtatatacacttctg

SEQ ID NO: 284748 - DNA, 25 bp, Mus musculus
gaaccgcaagacaggagcccggcac

SEQ ID NO: 284749 - DNA, 25 bp, Mus musculus
gaaccgcaagcttccatacgacagt

SEQ ID NO: 284750 - DNA, 25 bp, Mus musculus
gaaccgcaggctgttgccgcacatc

SEQ ID NO: 284751 - DNA, 25 bp, Mus musculus
gaaccgcatccaggtcttggataaa

SEQ ID NO: 284752 - DNA, 25 bp, Mus musculus
gaaccgcatccaggttaaacgctcc

SEQ ID NO: 284753 - DNA, 25 bp, Mus musculus
gaaccgccaaagccgagggttgatg

SEQ ID NO: 284754 - DNA, 25 bp, Mus musculus
gaaccgccaaaggctttctcctggg

SEQ ID NO: 284755 - DNA, 25 bp, Mus musculus
gaaccgcccagggttcgctgatcac

SEQ ID NO: 284756 - DNA, 25 bp, Mus musculus
gaaccgcccaggtgctttttgaaga

SEQ ID NO: 284757 - DNA, 25 bp, Mus musculus
gaaccgccgatcggagaatgtcgtg

SEQ ID NO: 284758 - DNA, 25 bp, Mus musculus
gaaccgcctggctgaagagagggcc

SEQ ID NO: 284759 - DNA, 25 bp, Mus musculus
gaaccgctggttgggtgaacagttg

SEQ ID NO: 284760 - DNA, 25 bp, Mus musculus
gaaccggacactcagacaggacccc

SEQ ID NO: 284761 - DNA, 25 bp, Mus musculus
gaaccggacactcagcctgcagcct

SEQ ID NO: 284762 - DNA, 25 bp, Mus musculus
gaaccggcagtttcgaaactgcatc

SEQ ID NO: 284763 - DNA, 25 bp, Mus musculus
gaaccggcattgatgtccagctcgc

SEQ ID NO: 284764 - DNA, 25 bp, Mus musculus
gaaccggccagctgcttgacatcta

SEQ ID NO: 284765 - DNA, 25 bp, Mus musculus
gaaccggccagctgtctcctgaagg

SEQ ID NO: 284766 - DNA, 25 bp, Mus musculus
gaaccggcggcttcatggcggctga

SEQ ID NO: 284767 - DNA, 25 bp, Mus musculus
gaaccgggcagctgcccacggagca

SEQ ID NO: 284768 - DNA, 25 bp, Mus musculus
gaaccgggcggcagtgccatggcag

SEQ ID NO: 284769 - DNA, 25 bp, Mus musculus
gaaccgggtgccatgtttcctgaaa

SEQ ID NO: 284770 - DNA, 25 bp, Mus musculus
gaaccggtcaacaatgcatattcct

SEQ ID NO: 284771 - DNA, 25 bp, Mus musculus
gaaccgtcggcgagctgaagcgctg

SEQ ID NO: 284772 - DNA, 25 bp, Mus musculus
gaaccgtgaggggaactggtatctc

SEQ ID NO: 284773 - DNA, 25 bp, Mus musculus
gaaccgtgcgcgcagggtttcactt

SEQ ID NO: 284774 - DNA, 25 bp, Mus musculus
gaaccgtgcgcgcaggtacagcgca

SEQ ID NO: 284775 - DNA, 25 bp, Mus musculus
gaaccgtgtgtgtctgctgctgaca

SEQ ID NO: 284776 - DNA, 25 bp, Mus musculus
gaacctaaagaagcatgtcatttgc

SEQ ID NO: 284777 - DNA, 25 bp, Mus musculus
gaacctaaatggggggatcgcagcc

SEQ ID NO: 284778 - DNA, 25 bp, Mus musculus
gaacctaaatggtggagccactttg

SEQ ID NO: 284779 - DNA, 25 bp, Mus musculus
gaacctaacagcaaatgggaagtaa

SEQ ID NO: 284780 - DNA, 25 bp, Mus musculus
gaacctaaggaagatcctgtctcta

SEQ ID NO: 284781 - DNA, 25 bp, Mus musculus
gaacctaaggctgctgactttccga

SEQ ID NO: 284782 - DNA, 25 bp, Mus musculus
gaacctagaagaagaggaatgggta

SEQ ID NO: 284783 - DNA, 25 bp, Mus musculus
gaacctaggatagagattgttgtgg

SEQ ID NO: 284784 - DNA, 25 bp, Mus musculus
gaacctattttggaagagcagtcag

SEQ ID NO: 284785 - DNA, 25 bp, Mus musculus
gaacctattttggttgataatccct

SEQ ID NO: 284786 - DNA, 25 bp, Mus musculus
gaacctcaaagtcagtggctatctc

SEQ ID NO: 284787 - DNA, 25 bp, Mus musculus
gaacctcaacaccaagatgataccc

SEQ ID NO: 284788 - DNA, 25 bp, Mus musculus
gaacctcaccagcatgtccaaaatt

SEQ ID NO: 284789 - DNA, 25 bp, Mus musculus
gaacctcagaaacagaacttacaca

SEQ ID NO: 284790 - DNA, 25 bp, Mus musculus
gaacctcagaaacatcattcaagac

SEQ ID NO: 284791 - DNA, 25 bp, Mus musculus
gaacctcagcatcatgatccaggac

SEQ ID NO: 284792 - DNA, 25 bp, Mus musculus
gaacctcatcttgtacttgttgact

SEQ ID NO: 284793 - DNA, 25 bp, Mus musculus
gaacctccaggaggagatctcagac

SEQ ID NO: 284794 - DNA, 25 bp, Mus musculus
gaacctcccagaactccgaggtgac

SEQ ID NO: 284795 - DNA, 25 bp, Mus musculus
gaacctccccttcaggccagaaggt

SEQ ID NO: 284796 - DNA, 25 bp, Mus musculus
gaacctccgaacctgattcacagat

SEQ ID NO: 284797 - DNA, 25 bp, Mus musculus
gaacctccggtaaagtgacaaaaca

SEQ ID NO: 284798 - DNA, 25 bp, Mus musculus
gaacctctaacaccgcaagccccgc

SEQ ID NO: 284799 - DNA, 25 bp, Mus musculus
gaacctctcaacctgtctgcaaaca

SEQ ID NO: 284800 - DNA, 25 bp, Mus musculus
gaacctctcacagatgaatcagcag

SEQ ID NO: 284801 - DNA, 25 bp, Mus musculus
gaacctctccacgtgctttagctct

SEQ ID NO: 284802 - DNA, 25 bp, Mus musculus
gaacctctccggctggatgagcctg

SEQ ID NO: 284803 - DNA, 25 bp, Mus musculus
gaacctctgaaactgaactttctaa

SEQ ID NO: 284804 - DNA, 25 bp, Mus musculus
gaacctctgaacctagtgctacaat

SEQ ID NO: 284805 - DNA, 25 bp, Mus musculus
gaacctctgaacctatactttggca

SEQ ID NO: 284806 - DNA, 25 bp, Mus musculus
gaacctctgaacctcatagttttgg

SEQ ID NO: 284807 - DNA, 25 bp, Mus musculus
gaacctctgaacctccaccactggt

SEQ ID NO: 284808 - DNA, 25 bp, Mus musculus
gaacctctgaacctctccttcttct

SEQ ID NO: 284809 - DNA, 25 bp, Mus musculus
gaacctctgaacctgacagagattt

SEQ ID NO: 284810 - DNA, 25 bp, Mus musculus
gaacctctgaacctgacccagaagc

SEQ ID NO: 284811 - DNA, 25 bp, Mus musculus
gaacctctgaacctgctccgccccc

SEQ ID NO: 284812 - DNA, 25 bp, Mus musculus
gaacctctgaacctgtggatattgt

SEQ ID NO: 284813 - DNA, 25 bp, Mus musculus
gaacctctgaacttgtggcagggct

SEQ ID NO: 284814 - DNA, 25 bp, Mus musculus
gaacctctgcaaggtttgtctgggc

SEQ ID NO: 284815 - DNA, 25 bp, Mus musculus
gaacctctggaaacagaaaggactt

SEQ ID NO: 284816 - DNA, 25 bp, Mus musculus
gaacctcttcaatgaggggaagcgc

SEQ ID NO: 284817 - DNA, 25 bp, Mus musculus
gaacctgaaaacattattatgttag

SEQ ID NO: 284818 - DNA, 25 bp, Mus musculus
gaacctgaagggcagacaagatgaa

SEQ ID NO: 284819 - DNA, 25 bp, Mus musculus
gaacctgaagggcagggacattagt

SEQ ID NO: 284820 - DNA, 25 bp, Mus musculus
gaacctgaagggcaggtttggcata

SEQ ID NO: 284821 - DNA, 25 bp, Mus musculus
gaacctgagaagcaggctgtgcagc

SEQ ID NO: 284822 - DNA, 25 bp, Mus musculus
gaacctgagaagcaggtctgttctc

SEQ ID NO: 284823 - DNA, 25 bp, Mus musculus
gaacctgatgaggagatactggagt

SEQ ID NO: 284824 - DNA, 25 bp, Mus musculus
gaacctgcaggatagaaagagtggt

SEQ ID NO: 284825 - DNA, 25 bp, Mus musculus
gaacctgcaggtactaacaccacaa

SEQ ID NO: 284826 - DNA, 25 bp, Mus musculus
gaacctgcaggtcttttcatgtgtc

SEQ ID NO: 284827 - DNA, 25 bp, Mus musculus
gaacctgcagtaccatcccactgat

SEQ ID NO: 284828 - DNA, 25 bp, Mus musculus
gaacctgcagtggaccccgaaggat

SEQ ID NO: 284829 - DNA, 25 bp, Mus musculus
gaacctgctgctagcccgggcccca

SEQ ID NO: 284830 - DNA, 25 bp, Mus musculus
gaacctgctgctagccctgctcttg

SEQ ID NO: 284831 - DNA, 25 bp, Mus musculus
gaacctggaaaacactggccaaaag

SEQ ID NO: 284832 - DNA, 25 bp, Mus musculus
gaacctggaacaaggcctgagtaca

SEQ ID NO: 284833 - DNA, 25 bp, Mus musculus
gaacctggaaggccaaatccttgta

SEQ ID NO: 284834 - DNA, 25 bp, Mus musculus
gaacctggacaagcctggacaaact

SEQ ID NO: 284835 - DNA, 25 bp, Mus musculus
gaacctggacctagaggcctttatc

SEQ ID NO: 284836 - DNA, 25 bp, Mus musculus
gaacctggacgagagggcagccctg

SEQ ID NO: 284837 - DNA, 25 bp, Mus musculus
gaacctggagagatgctgtcccctc

SEQ ID NO: 284838 - DNA, 25 bp, Mus musculus
gaacctggagggaaaagcagttcaa

SEQ ID NO: 284839 - DNA, 25 bp, Mus musculus
gaacctggcgcccaatgaaccagaa

SEQ ID NO: 284840 - DNA, 25 bp, Mus musculus
gaacctggcgcggcactcctagaac

SEQ ID NO: 284841 - DNA, 25 bp, Mus musculus
gaacctggctacaaggctgagggaa

SEQ ID NO: 284842 - DNA, 25 bp, Mus musculus
gaacctggctacaagggatgggcat

SEQ ID NO: 284843 - DNA, 25 bp, Mus musculus
gaacctgggcaggagctcggggaga

SEQ ID NO: 284844 - DNA, 25 bp, Mus musculus
gaacctgggccagaaggtccggctg

SEQ ID NO: 284845 - DNA, 25 bp, Mus musculus
gaacctggtagcctataacattcac

SEQ ID NO: 284846 - DNA, 25 bp, Mus musculus
gaacctggttggcaaagtgatcgga

SEQ ID NO: 284847 - DNA, 25 bp, Mus musculus
gaacctgtcaggaccaccaatgaat

SEQ ID NO: 284848 - DNA, 25 bp, Mus musculus
gaacctgtcaggatataaatgaatg

SEQ ID NO: 284849 - DNA, 25 bp, Mus musculus
gaacctgtccgggcagccaaggaga

SEQ ID NO: 284850 - DNA, 25 bp, Mus musculus
gaacctgtcttaagaccttcacagc

SEQ ID NO: 284851 - DNA, 25 bp, Mus musculus
gaacctgtgaaaagagtggacaaga

SEQ ID NO: 284852 - DNA, 25 bp, Mus musculus
gaacctgtgaggtcatgcacttctg

SEQ ID NO: 284853 - DNA, 25 bp, Mus musculus
gaacctgtgtctaaggaaacagcaa

SEQ ID NO: 284854 - DNA, 25 bp, Mus musculus
gaacctgtgtctaagtgtctgtgct

SEQ ID NO: 284855 - DNA, 25 bp, Mus musculus
gaacctgtgtgtagccccatgtgga

SEQ ID NO: 284856 - DNA, 25 bp, Mus musculus
gaaccttaaaagaatgctgatgctg

SEQ ID NO: 284857 - DNA, 25 bp, Mus musculus
gaaccttccaacaagacgatccacg

SEQ ID NO: 284858 - DNA, 25 bp, Mus musculus
gaaccttccagggctcactgatcac

SEQ ID NO: 284859 - DNA, 25 bp, Mus musculus
gaaccttcctgacctgggcggccct

SEQ ID NO: 284860 - DNA, 25 bp, Mus musculus
gaaccttcctggggtctgtgatgtg

SEQ ID NO: 284861 - DNA, 25 bp, Mus musculus
gaaccttcgaggcgtggtgcaagat

SEQ ID NO: 284862 - DNA, 25 bp, Mus musculus
gaaccttctagaagctcttctgtgc

SEQ ID NO: 284863 - DNA, 25 bp, Mus musculus
gaaccttgagaggcttataccccta

SEQ ID NO: 284864 - DNA, 25 bp, Mus musculus
gaaccttgtggagatgggcagcagt

SEQ ID NO: 284865 - DNA, 25 bp, Mus musculus
gaacctttctcataggtggaattgg

SEQ ID NO: 284866 - DNA, 25 bp, Mus musculus
gaacctttgaggtctcagagctttt

SEQ ID NO: 284867 - DNA, 25 bp, Mus musculus
gaacctttgagttcctcatgaaggt

SEQ ID NO: 284868 - DNA, 25 bp, Mus musculus
gaacctttgtggcagtcttcccagg

SEQ ID NO: 284869 - DNA, 25 bp, Mus musculus
gaacctttgtggcagtctttcagcc

SEQ ID NO: 284870 - DNA, 25 bp, Mus musculus
gaaccttttctctaggcaagaatca

SEQ ID NO: 284871 - DNA, 25 bp, Mus musculus
gaacgaaaagggaactgtgaagcag

SEQ ID NO: 284872 - DNA, 25 bp, Mus musculus
gaacgaaataatttgaagaggacat

SEQ ID NO: 284873 - DNA, 25 bp, Mus musculus
gaacgaacccaggagttccgactct

SEQ ID NO: 284874 - DNA, 25 bp, Mus musculus
gaacgaaccccaagctttgtgacga

SEQ ID NO: 284875 - DNA, 25 bp, Mus musculus
gaacgaaccccaagggaaccatcag

SEQ ID NO: 284876 - DNA, 25 bp, Mus musculus
gaacgaatcacaggattagtcgtat

SEQ ID NO: 284877 - DNA, 25 bp, Mus musculus
gaacgaattgtcaagcaataccaag

SEQ ID NO: 284878 - DNA, 25 bp, Mus musculus
gaacgaattttagatgcacagagac

SEQ ID NO: 284879 - DNA, 25 bp, Mus musculus
gaacgaattttgttaagagcaggat

SEQ ID NO: 284880 - DNA, 25 bp, Mus musculus
gaacgacatcgaagacatgctccag

SEQ ID NO: 284881 - DNA, 25 bp, Mus musculus
gaacgacctggccagtaaaagctgg

SEQ ID NO: 284882 - DNA, 25 bp, Mus musculus
gaacgacgatagggtccaggtggag

SEQ ID NO: 284883 - DNA, 25 bp, Mus musculus
gaacgacgtaggtcaccccttctct

SEQ ID NO: 284884 - DNA, 25 bp, Mus musculus
gaacgagaagccagaaagaaagatc

SEQ ID NO: 284885 - DNA, 25 bp, Mus musculus
gaacgagcagcttttgaaatcctgt

SEQ ID NO: 284886 - DNA, 25 bp, Mus musculus
gaacgagcaggcgaaggagatgcag

SEQ ID NO: 284887 - DNA, 25 bp, Mus musculus
gaacgagccaagttcaagcgcaaat

SEQ ID NO: 284888 - DNA, 25 bp, Mus musculus
gaacgagccggtccgtgttcacctt

SEQ ID NO: 284889 - DNA, 25 bp, Mus musculus
gaacgaggacaaggaaccttacagc

SEQ ID NO: 284890 - DNA, 25 bp, Mus musculus
gaacgaggacaagtgccaatgcaag

SEQ ID NO: 284891 - DNA, 25 bp, Mus musculus
gaacgaggagatatccatcaatagt

SEQ ID NO: 284892 - DNA, 25 bp, Mus musculus
gaacgaggaggctgtgtctgcttca

SEQ ID NO: 284893 - DNA, 25 bp, Mus musculus
gaacgagtgcgtccagtatcagcat

SEQ ID NO: 284894 - DNA, 25 bp, Mus musculus
gaacgatacaagtgaccttattcaa

SEQ ID NO: 284895 - DNA, 25 bp, Mus musculus
gaacgatatgacgaatgggtgaaga

SEQ ID NO: 284896 - DNA, 25 bp, Mus musculus
gaacgatatgacgtgggcgacccag

SEQ ID NO: 284897 - DNA, 25 bp, Mus musculus
gaacgatgacactgcaccatctgtg

SEQ ID NO: 284898 - DNA, 25 bp, Mus musculus
gaacgatgaggacaatctcctcaac

SEQ ID NO: 284899 - DNA, 25 bp, Mus musculus
gaacgatgtggaacagggaaaggac

SEQ ID NO: 284900 - DNA, 25 bp, Mus musculus
gaacgatttctgatcgtctgccgta

SEQ ID NO: 284901 - DNA, 25 bp, Mus musculus
gaacgcaaagaggtaaatgatctga

SEQ ID NO: 284902 - DNA, 25 bp, Mus musculus
gaacgcaaagagtaacttgtttgaa

SEQ ID NO: 284903 - DNA, 25 bp, Mus musculus
gaacgcaccggtagctggagttagg

SEQ ID NO: 284904 - DNA, 25 bp, Mus musculus
gaacgcagagtctgtactcccacaa

SEQ ID NO: 284905 - DNA, 25 bp, Mus musculus
gaacgcatcaactgtccagcagaag

SEQ ID NO: 284906 - DNA, 25 bp, Mus musculus
gaacgcatcgtattgacgacagtgt

SEQ ID NO: 284907 - DNA, 25 bp, Mus musculus
gaacgcatcttgcagaccatgctca

SEQ ID NO: 284908 - DNA, 25 bp, Mus musculus
gaacgcatgaaacggccttcctggg

SEQ ID NO: 284909 - DNA, 25 bp, Mus musculus
gaacgcattcagccagaagacatgt

SEQ ID NO: 284910 - DNA, 25 bp, Mus musculus
gaacgccatagaaaagtttcacttt

SEQ ID NO: 284911 - DNA, 25 bp, Mus musculus
gaacgccatagaagtttcactcacc

SEQ ID NO: 284912 - DNA, 25 bp, Mus musculus
gaacgccatagcatcaaaagacgta

SEQ ID NO: 284913 - DNA, 25 bp, Mus musculus
gaacgccatagtggcattgaaccag

SEQ ID NO: 284914 - DNA, 25 bp, Mus musculus
gaacgcccgggcctggaagcgctgg

SEQ ID NO: 284915 - DNA, 25 bp, Mus musculus
gaacgccggcttggtgcctgttccg

SEQ ID NO: 284916 - DNA, 25 bp, Mus musculus
gaacgccgggaaaggtaatgatgtg

SEQ ID NO: 284917 - DNA, 25 bp, Mus musculus
gaacgcctcgggggtgtctgacggt

SEQ ID NO: 284918 - DNA, 25 bp, Mus musculus
gaacgcggagggccgcaacaccaag

SEQ ID NO: 284919 - DNA, 25 bp, Mus musculus
gaacgcggcgttctgatgagtgacc

SEQ ID NO: 284920 - DNA, 25 bp, Mus musculus
gaacgcggcgttctggttttttgca

SEQ ID NO: 284921 - DNA, 25 bp, Mus musculus
gaacgcggggatcagggcagagatg

SEQ ID NO: 284922 - DNA, 25 bp, Mus musculus
gaacgcgtgcgcagactttcctctt

SEQ ID NO: 284923 - DNA, 25 bp, Mus musculus
gaacgctgctcatttgaagacatgc

SEQ ID NO: 284924 - DNA, 25 bp, Mus musculus
gaacgctgcttcggtggtgtagtgg

SEQ ID NO: 284925 - DNA, 25 bp, Mus musculus
gaacgctgcttgtgaatggctgctg

SEQ ID NO: 284926 - DNA, 25 bp, Mus musculus
gaacgctgtgacagatctgagcact

SEQ ID NO: 284927 - DNA, 25 bp, Mus musculus
gaacgctgtgacagcacctccgtcc

SEQ ID NO: 284928 - DNA, 25 bp, Mus musculus
gaacgcttaagggaacaggaagaag

SEQ ID NO: 284929 - DNA, 25 bp, Mus musculus
gaacggaaaaatggaagtatagtct

SEQ ID NO: 284930 - DNA, 25 bp, Mus musculus
gaacggaaaaatgtgctccagctga

SEQ ID NO: 284931 - DNA, 25 bp, Mus musculus
gaacggaagtacccggacagagaga

SEQ ID NO: 284932 - DNA, 25 bp, Mus musculus
gaacggaagttggttgctgcatccc

SEQ ID NO: 284933 - DNA, 25 bp, Mus musculus
gaacggaatcgcaacaaactgacaa

SEQ ID NO: 284934 - DNA, 25 bp, Mus musculus
gaacggaatcgcaaggacagatcca

SEQ ID NO: 284935 - DNA, 25 bp, Mus musculus
gaacggaatgacttgtgtgcaaaca

SEQ ID NO: 284936 - DNA, 25 bp, Mus musculus
gaacggacaagaagtattttatctg

SEQ ID NO: 284937 - DNA, 25 bp, Mus musculus
gaacggacaaggagatcagcaggct

SEQ ID NO: 284938 - DNA, 25 bp, Mus musculus
gaacggacaagttgtgtgcgctgtt

SEQ ID NO: 284939 - DNA, 25 bp, Mus musculus
gaacggacagccagatgccaaagct

SEQ ID NO: 284940 - DNA, 25 bp, Mus musculus
gaacggacagccagcaggcgtctgt

SEQ ID NO: 284941 - DNA, 25 bp, Mus musculus
gaacggagagatagatctagctagt

SEQ ID NO: 284942 - DNA, 25 bp, Mus musculus
gaacggatgggatatttccacccag

SEQ ID NO: 284943 - DNA, 25 bp, Mus musculus
gaacggatgttaaggagagggcgcg

SEQ ID NO: 284944 - DNA, 25 bp, Mus musculus
gaacggatgttaaggtgccaagtcg

SEQ ID NO: 284945 - DNA, 25 bp, Mus musculus
gaacggcagatgataatgttcactt

SEQ ID NO: 284946 - DNA, 25 bp, Mus musculus
gaacggcagatgtggtacacggatg

SEQ ID NO: 284947 - DNA, 25 bp, Mus musculus
gaacggcatcaggcgcagatagatc

SEQ ID NO: 284948 - DNA, 25 bp, Mus musculus
gaacggccaggtgtcgtgattaaat

SEQ ID NO: 284949 - DNA, 25 bp, Mus musculus
gaacggccgccgcagatataaagac

SEQ ID NO: 284950 - DNA, 25 bp, Mus musculus
gaacggcgatgctttccgtcagaat

SEQ ID NO: 284951 - DNA, 25 bp, Mus musculus
gaacggcggccgaggtctgtctgca

SEQ ID NO: 284952 - DNA, 25 bp, Mus musculus
gaacgggaaagaagtgagaagataa

SEQ ID NO: 284953 - DNA, 25 bp, Mus musculus
gaacgggaatgctgatcactggaga

SEQ ID NO: 284954 - DNA, 25 bp, Mus musculus
gaacgggagacaggtacttgtggaa

SEQ ID NO: 284955 - DNA, 25 bp, Mus musculus
gaacgggattcctgcctgctccagg

SEQ ID NO: 284956 - DNA, 25 bp, Mus musculus
gaacgggcagtgtggtgagcactcg

SEQ ID NO: 284957 - DNA, 25 bp, Mus musculus
gaacggggagaaaagctggcactcg

SEQ ID NO: 284958 - DNA, 25 bp, Mus musculus
gaacgggtatgagtggcccaggatg

SEQ ID NO: 284959 - DNA, 25 bp, Mus musculus
gaacggtcagaagctccccgcaggc

SEQ ID NO: 284960 - DNA, 25 bp, Mus musculus
gaacggtctgacctgcagcaaattg

SEQ ID NO: 284961 - DNA, 25 bp, Mus musculus
gaacggtgaaggtgtggaatgtcat

SEQ ID NO: 284962 - DNA, 25 bp, Mus musculus
gaacgtactaaaactgtgcagggct

SEQ ID NO: 284963 - DNA, 25 bp, Mus musculus
gaacgtatgatggaaatttctatgg

SEQ ID NO: 284964 - DNA, 25 bp, Mus musculus
gaacgtatttaacagacaaatggtg

SEQ ID NO: 284965 - DNA, 25 bp, Mus musculus
gaacgtatttaacagacaatcatgg

SEQ ID NO: 284966 - DNA, 25 bp, Mus musculus
gaacgtcaaggcaatccttaggtgt

SEQ ID NO: 284967 - DNA, 25 bp, Mus musculus
gaacgtcaagggtgagtcagcactt

SEQ ID NO: 284968 - DNA, 25 bp, Mus musculus
gaacgtcacaggcatatatcgagca

SEQ ID NO: 284969 - DNA, 25 bp, Mus musculus
gaacgtcccagggtgatgtgaacag

SEQ ID NO: 284970 - DNA, 25 bp, Mus musculus
gaacgtcccggagcttggccagagt

SEQ ID NO: 284971 - DNA, 25 bp, Mus musculus
gaacgtctgcagaagcaacctctta

SEQ ID NO: 284972 - DNA, 25 bp, Mus musculus
gaacgtctgcagaaggccaagatgg

SEQ ID NO: 284973 - DNA, 25 bp, Mus musculus
gaacgtgatacgatgagcagctctc

SEQ ID NO: 284974 - DNA, 25 bp, Mus musculus
gaacgtgcagaggggtaccccaaga

SEQ ID NO: 284975 - DNA, 25 bp, Mus musculus
gaacgtgccacggtcagggaaactg

SEQ ID NO: 284976 - DNA, 25 bp, Mus musculus
gaacgtggaggcccctttgtgtgtg

SEQ ID NO: 284977 - DNA, 25 bp, Mus musculus
gaacgtggattccctccatccatat

SEQ ID NO: 284978 - DNA, 25 bp, Mus musculus
gaacgtgtgctaggtctcctcctgc

SEQ ID NO: 284979 - DNA, 25 bp, Mus musculus
gaacgtgtgctaggtttctgccacc

SEQ ID NO: 284980 - DNA, 25 bp, Mus musculus
gaacgtgttagactcccatttccag

SEQ ID NO: 284981 - DNA, 25 bp, Mus musculus
gaacgtgttcttgacagctaccagg

SEQ ID NO: 284982 - DNA, 25 bp, Mus musculus
gaacgtgttcttggtttctgccagc

SEQ ID NO: 284983 - DNA, 25 bp, Mus musculus
gaacgttacccaaaggtggctctgc

SEQ ID NO: 284984 - DNA, 25 bp, Mus musculus
gaacgttctggaagcctttgcttcc

SEQ ID NO: 284985 - DNA, 25 bp, Mus musculus
gaactaaagccggagactcttcctg

SEQ ID NO: 284986 - DNA, 25 bp, Mus musculus
gaactaaagccggagcgtgtttggt

SEQ ID NO: 284987 - DNA, 25 bp, Mus musculus
gaactaaatgaatgccatgagagcg

SEQ ID NO: 284988 - DNA, 25 bp, Mus musculus
gaactaaatgcgaaatcaccaggac

SEQ ID NO: 284989 - DNA, 25 bp, Mus musculus
gaactaactgagaaatgcaaacaga

SEQ ID NO: 284990 - DNA, 25 bp, Mus musculus
gaactaactgagttttagaagccaa

SEQ ID NO: 284991 - DNA, 25 bp, Mus musculus
gaactaagcctaaggtgctgtgctc

SEQ ID NO: 284992 - DNA, 25 bp, Mus musculus
gaactaatcaaggacactgacatca

SEQ ID NO: 284993 - DNA, 25 bp, Mus musculus
gaactacaacaacgagcatcgagga

SEQ ID NO: 284994 - DNA, 25 bp, Mus musculus
gaactacaataagtgtttcctcaat

SEQ ID NO: 284995 - DNA, 25 bp, Mus musculus
gaactacaccctgacaactggagtg

SEQ ID NO: 284996 - DNA, 25 bp, Mus musculus
gaactacaccctgtccccagaattc

SEQ ID NO: 284997 - DNA, 25 bp, Mus musculus
gaactacagtacagctaggtagaag

SEQ ID NO: 284998 - DNA, 25 bp, Mus musculus
gaactacagtgaagatcgttaccag

SEQ ID NO: 284999 - DNA, 25 bp, Mus musculus
gaactacatcaggaactggtttgag

SEQ ID NO: 285000 - DNA, 25 bp, Mus musculus
gaactacattaaagttctttcagat

SEQ ID NO: 285001 - DNA, 25 bp, Mus musculus
gaactaccacccaggaactaaggca

SEQ ID NO: 285002 - DNA, 25 bp, Mus musculus
gaactaccacccaggctgacccttc

SEQ ID NO: 285003 - DNA, 25 bp, Mus musculus
gaactaccagtccggcttcagcctt

SEQ ID NO: 285004 - DNA, 25 bp, Mus musculus
gaactacccagccacttactggacc

SEQ ID NO: 285005 - DNA, 25 bp, Mus musculus
gaactacccaggctccttctagatc

SEQ ID NO: 285006 - DNA, 25 bp, Mus musculus
gaactacctctagacgccagccttc

SEQ ID NO: 285007 - DNA, 25 bp, Mus musculus
gaactacctggacttccaccgctgt

SEQ ID NO: 285008 - DNA, 25 bp, Mus musculus
gaactacctgggtctcagcctggga

SEQ ID NO: 285009 - DNA, 25 bp, Mus musculus
gaactacgagcgcgaggtagatcgc

SEQ ID NO: 285010 - DNA, 25 bp, Mus musculus
gaactactatgaagacatccgttct

SEQ ID NO: 285011 - DNA, 25 bp, Mus musculus
gaactactgagacaggatttacatg

SEQ ID NO: 285012 - DNA, 25 bp, Mus musculus
gaactactgagactaaagcaagaaa

SEQ ID NO: 285013 - DNA, 25 bp, Mus musculus
gaactactgaggcaaggcagcaaat

SEQ ID NO: 285014 - DNA, 25 bp, Mus musculus
gaactactggccctgctctctgctc

SEQ ID NO: 285015 - DNA, 25 bp, Mus musculus
gaactacttaaactccgactgattg

SEQ ID NO: 285016 - DNA, 25 bp, Mus musculus
gaactacttaaagctctggattact

SEQ ID NO: 285017 - DNA, 25 bp, Mus musculus
gaactagaaatatgcggctatggat

SEQ ID NO: 285018 - DNA, 25 bp, Mus musculus
gaactagaccctgataatgcactgc

SEQ ID NO: 285019 - DNA, 25 bp, Mus musculus
gaactagcctggcatcccagccttt

SEQ ID NO: 285020 - DNA, 25 bp, Mus musculus
gaactagctaaggctcaaactcaga

SEQ ID NO: 285021 - DNA, 25 bp, Mus musculus
gaactaggtgctcctgccatgccct

SEQ ID NO: 285022 - DNA, 25 bp, Mus musculus
gaactatatacacaggccatcctgg

SEQ ID NO: 285023 - DNA, 25 bp, Mus musculus
gaactatcccgtggtctccattgag

SEQ ID NO: 285024 - DNA, 25 bp, Mus musculus
gaactatccgcaaagaagatatccg

SEQ ID NO: 285025 - DNA, 25 bp, Mus musculus
gaactatcctgtggtctccattgaa

SEQ ID NO: 285026 - DNA, 25 bp, Mus musculus
gaactatcgcaggattgggtttcct

SEQ ID NO: 285027 - DNA, 25 bp, Mus musculus
gaactatcgcagggatcccaggctg

SEQ ID NO: 285028 - DNA, 25 bp, Mus musculus
gaactatcttgtaaccgtggggatg

SEQ ID NO: 285029 - DNA, 25 bp, Mus musculus
gaactatcttgtaagcgtggggatg

SEQ ID NO: 285030 - DNA, 25 bp, Mus musculus
gaactatgcaggtattgcagctcgg

SEQ ID NO: 285031 - DNA, 25 bp, Mus musculus
gaactatgctgagctggtgaagcac

SEQ ID NO: 285032 - DNA, 25 bp, Mus musculus
gaactatgtgcaacctcaagcccag

SEQ ID NO: 285033 - DNA, 25 bp, Mus musculus
gaactattcaagagcccccaatttt

SEQ ID NO: 285034 - DNA, 25 bp, Mus musculus
gaactattcgagcaggtggggcgag

SEQ ID NO: 285035 - DNA, 25 bp, Mus musculus
gaactattgagacccgatcctggca

SEQ ID NO: 285036 - DNA, 25 bp, Mus musculus
gaactattgagaggccctggcccag

SEQ ID NO: 285037 - DNA, 25 bp, Mus musculus
gaactattgagagtgtatgggcaag

SEQ ID NO: 285038 - DNA, 25 bp, Mus musculus
gaactatttccagcactggccagtg

SEQ ID NO: 285039 - DNA, 25 bp, Mus musculus
gaactcaacaaggagatggcttcag

SEQ ID NO: 285040 - DNA, 25 bp, Mus musculus
gaactcaagcagctggtggcccggc

SEQ ID NO: 285041 - DNA, 25 bp, Mus musculus
gaactcaaggcttctagagaacatg

SEQ ID NO: 285042 - DNA, 25 bp, Mus musculus
gaactcacagaaaagcctcatatag

SEQ ID NO: 285043 - DNA, 25 bp, Mus musculus
gaactcacagaaagcctcatataga

SEQ ID NO: 285044 - DNA, 25 bp, Mus musculus
gaactcacccaagtgcaaaacatgt

SEQ ID NO: 285045 - DNA, 25 bp, Mus musculus
gaactcacccaagtgttgcccacca

SEQ ID NO: 285046 - DNA, 25 bp, Mus musculus
gaactcactgtgaatgggaacacag

SEQ ID NO: 285047 - DNA, 25 bp, Mus musculus
gaactcagaaatgattcccgttgcg

SEQ ID NO: 285048 - DNA, 25 bp, Mus musculus
gaactcagacacctgctcaacatgg

SEQ ID NO: 285049 - DNA, 25 bp, Mus musculus
gaactcagacacctggcagtgctta

SEQ ID NO: 285050 - DNA, 25 bp, Mus musculus
gaactcagacaggagcagagcccgg

SEQ ID NO: 285051 - DNA, 25 bp, Mus musculus
gaactcagagcacccctggctacat

SEQ ID NO: 285052 - DNA, 25 bp, Mus musculus
gaactcagcaaggagaagacagacg

SEQ ID NO: 285053 - DNA, 25 bp, Mus musculus
gaactcagcgtcagggccgcgttgg

SEQ ID NO: 285054 - DNA, 25 bp, Mus musculus
gaactcaggttcatgatggatgaca

SEQ ID NO: 285055 - DNA, 25 bp, Mus musculus
gaactcagtgagagttgtagtgcaa

SEQ ID NO: 285056 - DNA, 25 bp, Mus musculus
gaactcatcaagatgtttgacaagc

SEQ ID NO: 285057 - DNA, 25 bp, Mus musculus
gaactcatcaagtgctcggcgctct

SEQ ID NO: 285058 - DNA, 25 bp, Mus musculus
gaactcatggacaagattaatgccg

SEQ ID NO: 285059 - DNA, 25 bp, Mus musculus
gaactcatttccaaggctggtcttg

SEQ ID NO: 285060 - DNA, 25 bp, Mus musculus
gaactcatttccaagtccttccagg

SEQ ID NO: 285061 - DNA, 25 bp, Mus musculus
gaactccaaggtcctaggtgaggcc

SEQ ID NO: 285062 - DNA, 25 bp, Mus musculus
gaactccacagagcaggagcttgaa

SEQ ID NO: 285063 - DNA, 25 bp, Mus musculus
gaactccaggaacagctcaaggccg

SEQ ID NO: 285064 - DNA, 25 bp, Mus musculus
gaactccagggaggtcctgatgaca

SEQ ID NO: 285065 - DNA, 25 bp, Mus musculus
gaactccaggtctttccagcatgtt

SEQ ID NO: 285066 - DNA, 25 bp, Mus musculus
gaactccatcatgtccttcagtgct

SEQ ID NO: 285067 - DNA, 25 bp, Mus musculus
gaactcccaggctatgaagagaccc

SEQ ID NO: 285068 - DNA, 25 bp, Mus musculus
gaactccctgcagcttgacgtggcc

SEQ ID NO: 285069 - DNA, 25 bp, Mus musculus
gaactcctcggagagacctccattg

SEQ ID NO: 285070 - DNA, 25 bp, Mus musculus
gaactcctgagaggttgatcgtgtc

SEQ ID NO: 285071 - DNA, 25 bp, Mus musculus
gaactcctgagatatgaatctgaaa

SEQ ID NO: 285072 - DNA, 25 bp, Mus musculus
gaactcctgttgaggatattttctt

SEQ ID NO: 285073 - DNA, 25 bp, Mus musculus
gaactcctgttgaggcctggaatgt

SEQ ID NO: 285074 - DNA, 25 bp, Mus musculus
gaactcgatgagcctgtttgagctg

SEQ ID NO: 285075 - DNA, 25 bp, Mus musculus
gaactcgcactatggtccacgcttc

SEQ ID NO: 285076 - DNA, 25 bp, Mus musculus
gaactcgcaggcaccttttgtgtcc

SEQ ID NO: 285077 - DNA, 25 bp, Mus musculus
gaactcgcaggttctggctggactt

SEQ ID NO: 285078 - DNA, 25 bp, Mus musculus
gaactcgcggcggaagactgctagc

SEQ ID NO: 285079 - DNA, 25 bp, Mus musculus
gaactcggcaggcagaatgggaaac

SEQ ID NO: 285080 - DNA, 25 bp, Mus musculus
gaactcgggcagagatgggtggcct

SEQ ID NO: 285081 - DNA, 25 bp, Mus musculus
gaactctaccacaagatgctggtgg

SEQ ID NO: 285082 - DNA, 25 bp, Mus musculus
gaactctagcattgaggcctttgct

SEQ ID NO: 285083 - DNA, 25 bp, Mus musculus
gaactctatcatattgcagcaccca

SEQ ID NO: 285084 - DNA, 25 bp, Mus musculus
gaactctattcagctcccattttcg

SEQ ID NO: 285085 - DNA, 25 bp, Mus musculus
gaactctcagacacatgcctggaca

SEQ ID NO: 285086 - DNA, 25 bp, Mus musculus
gaactctcaggaaacccaaggaaac

SEQ ID NO: 285087 - DNA, 25 bp, Mus musculus
gaactctcatcaggtgaaaacatga

SEQ ID NO: 285088 - DNA, 25 bp, Mus musculus
gaactctcatcagttcttacccaag

SEQ ID NO: 285089 - DNA, 25 bp, Mus musculus
gaactctccagagtgctacaataac

SEQ ID NO: 285090 - DNA, 25 bp, Mus musculus
gaactctcctgctgggacacccctc

SEQ ID NO: 285091 - DNA, 25 bp, Mus musculus
gaactctcctgctgggtctgtgatg

SEQ ID NO: 285092 - DNA, 25 bp, Mus musculus
gaactctctctggctgagtgactgg

SEQ ID NO: 285093 - DNA, 25 bp, Mus musculus
gaactctgaaaaagtcctaatcaaa

SEQ ID NO: 285094 - DNA, 25 bp, Mus musculus
gaactctgaacctctatgaagtctt

SEQ ID NO: 285095 - DNA, 25 bp, Mus musculus
gaactctgcgggaccttctgtcatt

SEQ ID NO: 285096 - DNA, 25 bp, Mus musculus
gaactctggaagatgggtgtgtttt

SEQ ID NO: 285097 - DNA, 25 bp, Mus musculus
gaactctggaaggaaaaaaatctgg

SEQ ID NO: 285098 - DNA, 25 bp, Mus musculus
gaactctggaaggctgtcaagaaac

SEQ ID NO: 285099 - DNA, 25 bp, Mus musculus
gaactcttcaagaatgccatgaggg

SEQ ID NO: 285100 - DNA, 25 bp, Mus musculus
gaactcttcaagagagatcctggct

SEQ ID NO: 285101 - DNA, 25 bp, Mus musculus
gaactcttcaagatcctaaatttga

SEQ ID NO: 285102 - DNA, 25 bp, Mus musculus
gaactcttcaagtatgccatgaggg

SEQ ID NO: 285103 - DNA, 25 bp, Mus musculus
gaactctttgggcctgccttaagtg

SEQ ID NO: 285104 - DNA, 25 bp, Mus musculus
gaactgaaagctgtcctctattgta

SEQ ID NO: 285105 - DNA, 25 bp, Mus musculus
gaactgaaagctgttttaaaggaca

SEQ ID NO: 285106 - DNA, 25 bp, Mus musculus
gaactgaaagtgacaactggaacct

SEQ ID NO: 285107 - DNA, 25 bp, Mus musculus
gaactgaaagtgcctttgaaggaga

SEQ ID NO: 285108 - DNA, 25 bp, Mus musculus
gaactgaaagtgggtccctgaagtc

SEQ ID NO: 285109 - DNA, 25 bp, Mus musculus
gaactgaagacgagttggtgtcaga

SEQ ID NO: 285110 - DNA, 25 bp, Mus musculus
gaactgaagacgagttttcgtttct

SEQ ID NO: 285111 - DNA, 25 bp, Mus musculus
gaactgaagactatcaccttaacca

SEQ ID NO: 285112 - DNA, 25 bp, Mus musculus
gaactgaagcagggaacccaggggg

SEQ ID NO: 285113 - DNA, 25 bp, Mus musculus
gaactgaagcagggagggcaagctc

SEQ ID NO: 285114 - DNA, 25 bp, Mus musculus
gaactgaagcagggagtaatgcatg

SEQ ID NO: 285115 - DNA, 25 bp, Mus musculus
gaactgaagcgcctttcagtggaat

SEQ ID NO: 285116 - DNA, 25 bp, Mus musculus
gaactgaagcgttctgagaagaagt

SEQ ID NO: 285117 - DNA, 25 bp, Mus musculus
gaactgaatgtgtttcctttgccaa

SEQ ID NO: 285118 - DNA, 25 bp, Mus musculus
gaactgactctacagccactacgaa

SEQ ID NO: 285119 - DNA, 25 bp, Mus musculus
gaactgactctacaggcattgggca

SEQ ID NO: 285120 - DNA, 25 bp, Mus musculus
gaactgagaaaagttttgctcatgg

SEQ ID NO: 285121 - DNA, 25 bp, Mus musculus
gaactgaggagacttcttcgagggc

SEQ ID NO: 285122 - DNA, 25 bp, Mus musculus
gaactgaggagggtggccaaacaga

SEQ ID NO: 285123 - DNA, 25 bp, Mus musculus
gaactgagtgaggccttgttttcat

SEQ ID NO: 285124 - DNA, 25 bp, Mus musculus
gaactgatcacagaaggccagcaac

SEQ ID NO: 285125 - DNA, 25 bp, Mus musculus
gaactgatgaccaaacgggctgtaa

SEQ ID NO: 285126 - DNA, 25 bp, Mus musculus
gaactgatgaccgcccagctctcaa

SEQ ID NO: 285127 - DNA, 25 bp, Mus musculus
gaactgattcagacattgcagatgg

SEQ ID NO: 285128 - DNA, 25 bp, Mus musculus
gaactgattgacccttcccatgctt

SEQ ID NO: 285129 - DNA, 25 bp, Mus musculus
gaactgcacagaggggctctttaga

SEQ ID NO: 285130 - DNA, 25 bp, Mus musculus
gaactgcagaagggagaactttctg

SEQ ID NO: 285131 - DNA, 25 bp, Mus musculus
gaactgcagaaggtgctgatggaat

SEQ ID NO: 285132 - DNA, 25 bp, Mus musculus
gaactgcagaattgagctccttgat

SEQ ID NO: 285133 - DNA, 25 bp, Mus musculus
gaactgcaggcagggaggtgtgagc

SEQ ID NO: 285134 - DNA, 25 bp, Mus musculus
gaactgcatcaggctcactctttgg

SEQ ID NO: 285135 - DNA, 25 bp, Mus musculus
gaactgcatcagtgaacggctcttt

SEQ ID NO: 285136 - DNA, 25 bp, Mus musculus
gaactgcattcaggacaggggtccg

SEQ ID NO: 285137 - DNA, 25 bp, Mus musculus
gaactgccatgcgcagtacaacccg

SEQ ID NO: 285138 - DNA, 25 bp, Mus musculus
gaactgcccaccaggattctcagtc

SEQ ID NO: 285139 - DNA, 25 bp, Mus musculus
gaactgccccaccattctccagcag

SEQ ID NO: 285140 - DNA, 25 bp, Mus musculus
gaactgccctaagaggttatcaaga

SEQ ID NO: 285141 - DNA, 25 bp, Mus musculus
gaactgccgggttcatcgtggcaga

SEQ ID NO: 285142 - DNA, 25 bp, Mus musculus
gaactgcctaaggagcctcaaggca

SEQ ID NO: 285143 - DNA, 25 bp, Mus musculus
gaactgcctcgtcatctgggagggc

SEQ ID NO: 285144 - DNA, 25 bp, Mus musculus
gaactgcctcgtcatgcacaccaag

SEQ ID NO: 285145 - DNA, 25 bp, Mus musculus
gaactgcctgacagctggctgaagg

SEQ ID NO: 285146 - DNA, 25 bp, Mus musculus
gaactgcctgacttgtgacacctgg

SEQ ID NO: 285147 - DNA, 25 bp, Mus musculus
gaactgcctggcccggaagatgcaa

SEQ ID NO: 285148 - DNA, 25 bp, Mus musculus
gaactgcctggcccggtcacagcaa

SEQ ID NO: 285149 - DNA, 25 bp, Mus musculus
gaactgcgcaggttacatccaggca

SEQ ID NO: 285150 - DNA, 25 bp, Mus musculus
gaactgctaactctaaactgcgagg

SEQ ID NO: 285151 - DNA, 25 bp, Mus musculus
gaactgctaactctagcatatgaaa

SEQ ID NO: 285152 - DNA, 25 bp, Mus musculus
gaactgctagataaggtcctggaga

SEQ ID NO: 285153 - DNA, 25 bp, Mus musculus
gaactgctagataaggtcctggagg

SEQ ID NO: 285154 - DNA, 25 bp, Mus musculus
gaactgctgctcctccgttccctgc

SEQ ID NO: 285155 - DNA, 25 bp, Mus musculus
gaactgcttccctgtgctggtccac

SEQ ID NO: 285156 - DNA, 25 bp, Mus musculus
gaactgcttccctgtggtattattc

SEQ ID NO: 285157 - DNA, 25 bp, Mus musculus
gaactggacaaagaaacaacttcct

SEQ ID NO: 285158 - DNA, 25 bp, Mus musculus
gaactggacaaaggactgaggtctg

SEQ ID NO: 285159 - DNA, 25 bp, Mus musculus
gaactggacaaaggatgttgggaag

SEQ ID NO: 285160 - DNA, 25 bp, Mus musculus
gaactggacaagaaggagaagatcc

SEQ ID NO: 285161 - DNA, 25 bp, Mus musculus
gaactggacaaggccctgtgtgctg

SEQ ID NO: 285162 - DNA, 25 bp, Mus musculus
gaactggacaagtgtcttcttggtg

SEQ ID NO: 285163 - DNA, 25 bp, Mus musculus
gaactggacaggtacctctaagtca

SEQ ID NO: 285164 - DNA, 25 bp, Mus musculus
gaactggagacaatggtctgtggga

SEQ ID NO: 285165 - DNA, 25 bp, Mus musculus
gaactggagcgctgctgggaacgct

SEQ ID NO: 285166 - DNA, 25 bp, Mus musculus
gaactggagttagacgtgaccattt

SEQ ID NO: 285167 - DNA, 25 bp, Mus musculus
gaactggagttagaggtgaccattt

SEQ ID NO: 285168 - DNA, 25 bp, Mus musculus
gaactggatgaaggacattgatggt

SEQ ID NO: 285169 - DNA, 25 bp, Mus musculus
gaactggatgcagaccttcaatttg

SEQ ID NO: 285170 - DNA, 25 bp, Mus musculus
gaactggcaccagctggagaacata

SEQ ID NO: 285171 - DNA, 25 bp, Mus musculus
gaactggcagaacagctgattttac

SEQ ID NO: 285172 - DNA, 25 bp, Mus musculus
gaactggcagccagcgctcctgttg

SEQ ID NO: 285173 - DNA, 25 bp, Mus musculus
gaactggcagggagatctgctggca

SEQ ID NO: 285174 - DNA, 25 bp, Mus musculus
gaactggccagacaccttgttgcca

SEQ ID NO: 285175 - DNA, 25 bp, Mus musculus
gaactggccagatccgtctaccttg

SEQ ID NO: 285176 - DNA, 25 bp, Mus musculus
gaactggccagccccctgcctttct

SEQ ID NO: 285177 - DNA, 25 bp, Mus musculus
gaactggccggttctgcggtggatt

SEQ ID NO: 285178 - DNA, 25 bp, Mus musculus
gaactggcggaagctcaagatgaca

SEQ ID NO: 285179 - DNA, 25 bp, Mus musculus
gaactggctacctttctgaaggacg

SEQ ID NO: 285180 - DNA, 25 bp, Mus musculus
gaactggctcaacagatccaaaagg

SEQ ID NO: 285181 - DNA, 25 bp, Mus musculus
gaactggctgaaagataagcccctg

SEQ ID NO: 285182 - DNA, 25 bp, Mus musculus
gaactggctgactgccttgtgtgga

SEQ ID NO: 285183 - DNA, 25 bp, Mus musculus
gaactggctgactgctgatctgcct

SEQ ID NO: 285184 - DNA, 25 bp, Mus musculus
gaactggctgactgctgtagtggat

SEQ ID NO: 285185 - DNA, 25 bp, Mus musculus
gaactgggaaagggagccttctctg

SEQ ID NO: 285186 - DNA, 25 bp, Mus musculus
gaactgggcagaatgaacacgaaag

SEQ ID NO: 285187 - DNA, 25 bp, Mus musculus
gaactgggcagagaagaatatcaag

SEQ ID NO: 285188 - DNA, 25 bp, Mus musculus
gaactgggccgctctctgcctctct

SEQ ID NO: 285189 - DNA, 25 bp, Mus musculus
gaactgggtcaaggacacggcaaat

SEQ ID NO: 285190 - DNA, 25 bp, Mus musculus
gaactgggtcaagtcaccctgtgaa

SEQ ID NO: 285191 - DNA, 25 bp, Mus musculus
gaactggtgaagcttatgtgcgagc

SEQ ID NO: 285192 - DNA, 25 bp, Mus musculus
gaactggttgccaagaaggggtaga

SEQ ID NO: 285193 - DNA, 25 bp, Mus musculus
gaactggttgggaagccagctgcac

SEQ ID NO: 285194 - DNA, 25 bp, Mus musculus
gaactgtatcagctgcgaatccctc

SEQ ID NO: 285195 - DNA, 25 bp, Mus musculus
gaactgtatgaccagaattatccca

SEQ ID NO: 285196 - DNA, 25 bp, Mus musculus
gaactgtatttggaataaccacagt

SEQ ID NO: 285197 - DNA, 25 bp, Mus musculus
gaactgtcaggctggtctgctcagg

SEQ ID NO: 285198 - DNA, 25 bp, Mus musculus
gaactgtccagggccaaggaatatg

SEQ ID NO: 285199 - DNA, 25 bp, Mus musculus
gaactgtccagggtgaccaacgcca

SEQ ID NO: 285200 - DNA, 25 bp, Mus musculus
gaactgtctttatccgtctaccttg

SEQ ID NO: 285201 - DNA, 25 bp, Mus musculus
gaactgtgaagtgctttgtttaatt

SEQ ID NO: 285202 - DNA, 25 bp, Mus musculus
gaactgtgaattagatgcaacgtgt

SEQ ID NO: 285203 - DNA, 25 bp, Mus musculus
gaactgtggaacaggtcccctgttc

SEQ ID NO: 285204 - DNA, 25 bp, Mus musculus
gaactgtggagaagggtcaactgct

SEQ ID NO: 285205 - DNA, 25 bp, Mus musculus
gaactgtggagaagggtttcaaagc

SEQ ID NO: 285206 - DNA, 25 bp, Mus musculus
gaactgtggaggcagctgtgtctga

SEQ ID NO: 285207 - DNA, 25 bp, Mus musculus
gaactgtggagtatcacggtgatcg

SEQ ID NO: 285208 - DNA, 25 bp, Mus musculus
gaactgtgggcagaaatccctagcc

SEQ ID NO: 285209 - DNA, 25 bp, Mus musculus
gaactgtgttagactttcctggaac

SEQ ID NO: 285210 - DNA, 25 bp, Mus musculus
gaactgtgtttggagtaacaactgt

SEQ ID NO: 285211 - DNA, 25 bp, Mus musculus
gaactgttcaagaatgccatgagag

SEQ ID NO: 285212 - DNA, 25 bp, Mus musculus
gaactgttcagacgcctccttggca

SEQ ID NO: 285213 - DNA, 25 bp, Mus musculus
gaactgttgaataagttcgtgtgta

SEQ ID NO: 285214 - DNA, 25 bp, Mus musculus
gaactgtttgatcacattccagctc

SEQ ID NO: 285215 - DNA, 25 bp, Mus musculus
gaactgtttggaggccaatgaggcg

SEQ ID NO: 285216 - DNA, 25 bp, Mus musculus
gaacttaaaaaggagcttcgacgca

SEQ ID NO: 285217 - DNA, 25 bp, Mus musculus
gaacttaaaaaggtgattgaagcct

SEQ ID NO: 285218 - DNA, 25 bp, Mus musculus
gaacttaaaaaggtgtcctcagata

SEQ ID NO: 285219 - DNA, 25 bp, Mus musculus
gaacttacctgagagcactgtggac

SEQ ID NO: 285220 - DNA, 25 bp, Mus musculus
gaacttacctgagcacagttcccag

SEQ ID NO: 285221 - DNA, 25 bp, Mus musculus
gaacttacgagagtatttggaggta

SEQ ID NO: 285222 - DNA, 25 bp, Mus musculus
gaacttagaggagagccaagttgaa

SEQ ID NO: 285223 - DNA, 25 bp, Mus musculus
gaacttataagagagatgctaacat

SEQ ID NO: 285224 - DNA, 25 bp, Mus musculus
gaacttataagagaggtagaaatgg

SEQ ID NO: 285225 - DNA, 25 bp, Mus musculus
gaacttataaggcgtctcttttctc

SEQ ID NO: 285226 - DNA, 25 bp, Mus musculus
gaacttatccagtgaagaagttgca

SEQ ID NO: 285227 - DNA, 25 bp, Mus musculus
gaacttattcagagatttcctctga

SEQ ID NO: 285228 - DNA, 25 bp, Mus musculus
gaacttcaagctcttttggaagaag

SEQ ID NO: 285229 - DNA, 25 bp, Mus musculus
gaacttcaaggatgaagaaacacgg

SEQ ID NO: 285230 - DNA, 25 bp, Mus musculus
gaacttcaagtcctcctgcatatgc

SEQ ID NO: 285231 - DNA, 25 bp, Mus musculus
gaacttcacgattcctgtgttgaat

SEQ ID NO: 285232 - DNA, 25 bp, Mus musculus
gaacttcagcagagactccaagaag

SEQ ID NO: 285233 - DNA, 25 bp, Mus musculus
gaacttcaggctcctgggcaatatg

SEQ ID NO: 285234 - DNA, 25 bp, Mus musculus
gaacttccaggcacaaagtaccagg

SEQ ID NO: 285235 - DNA, 25 bp, Mus musculus
gaacttccatatcagctggaaggac

SEQ ID NO: 285236 - DNA, 25 bp, Mus musculus
gaacttcccagatgctggcttggag

SEQ ID NO: 285237 - DNA, 25 bp, Mus musculus
gaacttccgagcgggggaacctgat

SEQ ID NO: 285238 - DNA, 25 bp, Mus musculus
gaacttcctcgtcccatctctccaa

SEQ ID NO: 285239 - DNA, 25 bp, Mus musculus
gaacttcgacagtattccggaacct

SEQ ID NO: 285240 - DNA, 25 bp, Mus musculus
gaacttcgaggaatgtttaaatggg

SEQ ID NO: 285241 - DNA, 25 bp, Mus musculus
gaacttctacaaaggaagtaaccag

SEQ ID NO: 285242 - DNA, 25 bp, Mus musculus
gaacttctcagacaattgacatata

SEQ ID NO: 285243 - DNA, 25 bp, Mus musculus
gaacttctctatctgccaaagtaaa

SEQ ID NO: 285244 - DNA, 25 bp, Mus musculus
gaacttctgatgtttcttccagcaa

SEQ ID NO: 285245 - DNA, 25 bp, Mus musculus
gaacttctgcctagcatcaacgata

SEQ ID NO: 285246 - DNA, 25 bp, Mus musculus
gaacttctgcctaggtatgtctata

SEQ ID NO: 285247 - DNA, 25 bp, Mus musculus
gaacttctgcctaggtcctcaactt

SEQ ID NO: 285248 - DNA, 25 bp, Mus musculus
gaacttcttgacagggtcctgcagg

SEQ ID NO: 285249 - DNA, 25 bp, Mus musculus
gaacttctttaccaggtatgactac

SEQ ID NO: 285250 - DNA, 25 bp, Mus musculus
gaacttgaaactgaagaagctattg

SEQ ID NO: 285251 - DNA, 25 bp, Mus musculus
gaacttgaaactgaagaagctcata

SEQ ID NO: 285252 - DNA, 25 bp, Mus musculus
gaacttgaagctggttcatgtcttg

SEQ ID NO: 285253 - DNA, 25 bp, Mus musculus
gaacttgatgaaattacttctgaaa

SEQ ID NO: 285254 - DNA, 25 bp, Mus musculus
gaacttgatgaaattatacgacctc

SEQ ID NO: 285255 - DNA, 25 bp, Mus musculus
gaacttgatgaagaagatgaagtgg

SEQ ID NO: 285256 - DNA, 25 bp, Mus musculus
gaacttgatgaagagtcagaagatg

SEQ ID NO: 285257 - DNA, 25 bp, Mus musculus
gaacttggaccgcagccctctgcca

SEQ ID NO: 285258 - DNA, 25 bp, Mus musculus
gaacttggaccggaactgtccgact

SEQ ID NO: 285259 - DNA, 25 bp, Mus musculus
gaacttggagggccatggcggactc

SEQ ID NO: 285260 - DNA, 25 bp, Mus musculus
gaacttgggttgtaggcttctccag

SEQ ID NO: 285261 - DNA, 25 bp, Mus musculus
gaacttggtccaggcaaacagggag

SEQ ID NO: 285262 - DNA, 25 bp, Mus musculus
gaacttggtggatggatgagtttca

SEQ ID NO: 285263 - DNA, 25 bp, Mus musculus
gaacttgtaaagcttgtagaccctg

SEQ ID NO: 285264 - DNA, 25 bp, Mus musculus
gaacttgtaaagtcccacgagtcct

SEQ ID NO: 285265 - DNA, 25 bp, Mus musculus
gaacttgtagtagacccttaagccc

SEQ ID NO: 285266 - DNA, 25 bp, Mus musculus
gaacttgttaaggctcaggccatcc

SEQ ID NO: 285267 - DNA, 25 bp, Mus musculus
gaacttgttggatttgaactttttg

SEQ ID NO: 285268 - DNA, 25 bp, Mus musculus
gaactttagctcggttttgtacaaa

SEQ ID NO: 285269 - DNA, 25 bp, Mus musculus
gaactttctccaagatggcctagac

SEQ ID NO: 285270 - DNA, 25 bp, Mus musculus
gaactttgaatgctcacactgcctc

SEQ ID NO: 285271 - DNA, 25 bp, Mus musculus
gaactttgacaagatcctggctgag

SEQ ID NO: 285272 - DNA, 25 bp, Mus musculus
gaacttttcagctgccaaaagccta

SEQ ID NO: 285273 - DNA, 25 bp, Mus musculus
gaacttttcagttggcaggcagagc

SEQ ID NO: 285274 - DNA, 25 bp, Mus musculus
gaacttttttgctctctggagccaa

SEQ ID NO: 285275 - DNA, 25 bp, Mus musculus
gaacttttttgtaagaagacaagat

SEQ ID NO: 285276 - DNA, 25 bp, Mus musculus
gaagaaaaaaagaccccagcgcatc

SEQ ID NO: 285277 - DNA, 25 bp, Mus musculus
gaagaaaaaagattataagagatca

SEQ ID NO: 285278 - DNA, 25 bp, Mus musculus
gaagaaaaaccagaaccagatggaa

SEQ ID NO: 285279 - DNA, 25 bp, Mus musculus
gaagaaaaaccagaagaacaggaga

SEQ ID NO: 285280 - DNA, 25 bp, Mus musculus
gaagaaaaagaacgtttgctgaaga

SEQ ID NO: 285281 - DNA, 25 bp, Mus musculus
gaagaaaaagctctcttaagagcct

SEQ ID NO: 285282 - DNA, 25 bp, Mus musculus
gaagaaaaagggtgatcctgatacc

SEQ ID NO: 285283 - DNA, 25 bp, Mus musculus
gaagaaaaattcatcgttaaagcaa

SEQ ID NO: 285284 - DNA, 25 bp, Mus musculus
gaagaaaacaggctatggtgaaata

SEQ ID NO: 285285 - DNA, 25 bp, Mus musculus
gaagaaaacagtgctctgcagtttt

SEQ ID NO: 285286 - DNA, 25 bp, Mus musculus
gaagaaaacatcaaggaacaataaa

SEQ ID NO: 285287 - DNA, 25 bp, Mus musculus
gaagaaaaccttcagttggatcctc

SEQ ID NO: 285288 - DNA, 25 bp, Mus musculus
gaagaaaactgtggcaacataacat

SEQ ID NO: 285289 - DNA, 25 bp, Mus musculus
gaagaaaaggaaatgttattcccaa

SEQ ID NO: 285290 - DNA, 25 bp, Mus musculus
gaagaaaaggaagatgaggagctcc

SEQ ID NO: 285291 - DNA, 25 bp, Mus musculus
gaagaaaataaagaataaactagac

SEQ ID NO: 285292 - DNA, 25 bp, Mus musculus
gaagaaaatattgaagtttaccata

SEQ ID NO: 285293 - DNA, 25 bp, Mus musculus
gaagaaaatgaccctgccacatgga

SEQ ID NO: 285294 - DNA, 25 bp, Mus musculus
gaagaaaatgagtaagagatttgaa

SEQ ID NO: 285295 - DNA, 25 bp, Mus musculus
gaagaaaatgctttacacagatttt

SEQ ID NO: 285296 - DNA, 25 bp, Mus musculus
gaagaaaatggaagcttggctgaag

SEQ ID NO: 285297 - DNA, 25 bp, Mus musculus
gaagaaaatggagttgaagcagaag

SEQ ID NO: 285298 - DNA, 25 bp, Mus musculus
gaagaaaatggatgtcattgctaga

SEQ ID NO: 285299 - DNA, 25 bp, Mus musculus
gaagaaaatggatgttaccattgag

SEQ ID NO: 285300 - DNA, 25 bp, Mus musculus
gaagaaaattattgatattttcatt

SEQ ID NO: 285301 - DNA, 25 bp, Mus musculus
gaagaaaattgcagcctggagctaa

SEQ ID NO: 285302 - DNA, 25 bp, Mus musculus
gaagaaacatggatgtaaacagaaa

SEQ ID NO: 285303 - DNA, 25 bp, Mus musculus
gaagaaacccctcagcaagccccgc

SEQ ID NO: 285304 - DNA, 25 bp, Mus musculus
gaagaaacggaaggcatgaaagaag

SEQ ID NO: 285305 - DNA, 25 bp, Mus musculus
gaagaaactcttttttctcctcttg

SEQ ID NO: 285306 - DNA, 25 bp, Mus musculus
gaagaaactgaacagagtaccattt

SEQ ID NO: 285307 - DNA, 25 bp, Mus musculus
gaagaaagaagatagtaaaaagtat

SEQ ID NO: 285308 - DNA, 25 bp, Mus musculus
gaagaaagaaggatagatataagcg

SEQ ID NO: 285309 - DNA, 25 bp, Mus musculus
gaagaaagaagtgttgccgggaaag

SEQ ID NO: 285310 - DNA, 25 bp, Mus musculus
gaagaaagagcgagatggacagaga

SEQ ID NO: 285311 - DNA, 25 bp, Mus musculus
gaagaaagagcgatacttggtaacg

SEQ ID NO: 285312 - DNA, 25 bp, Mus musculus
gaagaaagaggaagatggacggcct

SEQ ID NO: 285313 - DNA, 25 bp, Mus musculus
gaagaaagaggaagtttgtttgctg

SEQ ID NO: 285314 - DNA, 25 bp, Mus musculus
gaagaaagaggatgctctggaggac

SEQ ID NO: 285315 - DNA, 25 bp, Mus musculus
gaagaaagaggttatggctttcaga

SEQ ID NO: 285316 - DNA, 25 bp, Mus musculus
gaagaaagatgtgtacactcttttc

SEQ ID NO: 285317 - DNA, 25 bp, Mus musculus
gaagaaagcaaggaaggaaggtctg

SEQ ID NO: 285318 - DNA, 25 bp, Mus musculus
gaagaaagcagggctttctgtgaga

SEQ ID NO: 285319 - DNA, 25 bp, Mus musculus
gaagaaagccatcaacgacctagac

SEQ ID NO: 285320 - DNA, 25 bp, Mus musculus
gaagaaagccatcaagttgcctgca

SEQ ID NO: 285321 - DNA, 25 bp, Mus musculus
gaagaaagcttcgaagaaaagcaat

SEQ ID NO: 285322 - DNA, 25 bp, Mus musculus
gaagaaataaccagatatcagtttt

SEQ ID NO: 285323 - DNA, 25 bp, Mus musculus
gaagaaataaccaggtgaagcaaga

SEQ ID NO: 285324 - DNA, 25 bp, Mus musculus
gaagaaataaggtttgacaactcac

SEQ ID NO: 285325 - DNA, 25 bp, Mus musculus
gaagaaatacgatgacagcgatggg

SEQ ID NO: 285326 - DNA, 25 bp, Mus musculus
gaagaaatacggcttcttggtaatg

SEQ ID NO: 285327 - DNA, 25 bp, Mus musculus
gaagaaatatctgccacctctgaag

SEQ ID NO: 285328 - DNA, 25 bp, Mus musculus
gaagaaatcaaggaaacactcatag

SEQ ID NO: 285329 - DNA, 25 bp, Mus musculus
gaagaaatcagacagatccgagaca

SEQ ID NO: 285330 - DNA, 25 bp, Mus musculus
gaagaaatcagacagtgatttcaat

SEQ ID NO: 285331 - DNA, 25 bp, Mus musculus
gaagaaatccgatggggagccttta

SEQ ID NO: 285332 - DNA, 25 bp, Mus musculus
gaagaaatccgatggttttcagaca

SEQ ID NO: 285333 - DNA, 25 bp, Mus musculus
gaagaaatcctgcaggagccagcag

SEQ ID NO: 285334 - DNA, 25 bp, Mus musculus
gaagaaatcgagcgccaggctccga

SEQ ID NO: 285335 - DNA, 25 bp, Mus musculus
gaagaaatctattcagtattaatat

SEQ ID NO: 285336 - DNA, 25 bp, Mus musculus
gaagaaatctctgtcatagacatcc

SEQ ID NO: 285337 - DNA, 25 bp, Mus musculus
gaagaaatctgtgtactttattgct

SEQ ID NO: 285338 - DNA, 25 bp, Mus musculus
gaagaaatgaatgcagcagcagcag

SEQ ID NO: 285339 - DNA, 25 bp, Mus musculus
gaagaaatgcaaacccagccataca

SEQ ID NO: 285340 - DNA, 25 bp, Mus musculus
gaagaaatggaggtgacagctacta

SEQ ID NO: 285341 - DNA, 25 bp, Mus musculus
gaagaaatgttgctgcccaggttct

SEQ ID NO: 285342 - DNA, 25 bp, Mus musculus
gaagaacaaaaatgcaagctgggcg

SEQ ID NO: 285343 - DNA, 25 bp, Mus musculus
gaagaacaaaaggctgacgaatgac

SEQ ID NO: 285344 - DNA, 25 bp, Mus musculus
gaagaacaaggatgtccccgtggag

SEQ ID NO: 285345 - DNA, 25 bp, Mus musculus
gaagaacaaggcagctgcaggaaaa

SEQ ID NO: 285346 - DNA, 25 bp, Mus musculus
gaagaacaaggtattgacaaatctc

SEQ ID NO: 285347 - DNA, 25 bp, Mus musculus
gaagaacaatgacctccgggaaaag

SEQ ID NO: 285348 - DNA, 25 bp, Mus musculus
gaagaacaccaaagagtgagtaaag

SEQ ID NO: 285349 - DNA, 25 bp, Mus musculus
gaagaacaccaaattttaagagtgg

SEQ ID NO: 285350 - DNA, 25 bp, Mus musculus
gaagaacagtgtttagtgtaaggtt

SEQ ID NO: 285351 - DNA, 25 bp, Mus musculus
gaagaacatcgagaagccaggtctc

SEQ ID NO: 285352 - DNA, 25 bp, Mus musculus
gaagaacatgatgcaaggagacgta

SEQ ID NO: 285353 - DNA, 25 bp, Mus musculus
gaagaacatggactggaaagttaat

SEQ ID NO: 285354 - DNA, 25 bp, Mus musculus
gaagaaccaagcaatgtcttcaatg

SEQ ID NO: 285355 - DNA, 25 bp, Mus musculus
gaagaaccaagccggccctgggcag

SEQ ID NO: 285356 - DNA, 25 bp, Mus musculus
gaagaaccacgagcaggtcctgcgc

SEQ ID NO: 285357 - DNA, 25 bp, Mus musculus
gaagaaccagggccagtgcgggtct

SEQ ID NO: 285358 - DNA, 25 bp, Mus musculus
gaagaacctcatcttgtacttgttg

SEQ ID NO: 285359 - DNA, 25 bp, Mus musculus
gaagaacctgcaggatagaaagagt

SEQ ID NO: 285360 - DNA, 25 bp, Mus musculus
gaagaacctgcagtaccatcccact

SEQ ID NO: 285361 - DNA, 25 bp, Mus musculus
gaagaacgaaaagggaactgtgaag

SEQ ID NO: 285362 - DNA, 25 bp, Mus musculus
gaagaacgaggccatccaggcggcc

SEQ ID NO: 285363 - DNA, 25 bp, Mus musculus
gaagaacgaggcggcccatgactcc

SEQ ID NO: 285364 - DNA, 25 bp, Mus musculus
gaagaacgcggagggagctatggat

SEQ ID NO: 285365 - DNA, 25 bp, Mus musculus
gaagaacggtctgacctgcagcaaa

SEQ ID NO: 285366 - DNA, 25 bp, Mus musculus
gaagaactaaaggataacttcaagc

SEQ ID NO: 285367 - DNA, 25 bp, Mus musculus
gaagaactaaatgaatgccatgaga

SEQ ID NO: 285368 - DNA, 25 bp, Mus musculus
gaagaactaaatgcgaaatcaccag

SEQ ID NO: 285369 - DNA, 25 bp, Mus musculus
gaagaactaactgagaaatgcaaac

SEQ ID NO: 285370 - DNA, 25 bp, Mus musculus
gaagaactaactgagttttagaagc

SEQ ID NO: 285371 - DNA, 25 bp, Mus musculus
gaagaactcagcaaggagaagacag

SEQ ID NO: 285372 - DNA, 25 bp, Mus musculus
gaagaactgcagaagggagaacttt

SEQ ID NO: 285373 - DNA, 25 bp, Mus musculus
gaagaactgcagaaggtgctgatgg

SEQ ID NO: 285374 - DNA, 25 bp, Mus musculus
gaagaactgcatcaggctcactctt

SEQ ID NO: 285375 - DNA, 25 bp, Mus musculus
gaagaactgcatcagtgaacggctc

SEQ ID NO: 285376 - DNA, 25 bp, Mus musculus
gaagaactggagaaaccatggaatg

SEQ ID NO: 285377 - DNA, 25 bp, Mus musculus
gaagaactggagtattttaaccaca

SEQ ID NO: 285378 - DNA, 25 bp, Mus musculus
gaagaactgtgaagtgctttgttta

SEQ ID NO: 285379 - DNA, 25 bp, Mus musculus
gaagaacttataaggcgtctctttt

SEQ ID NO: 285380 - DNA, 25 bp, Mus musculus
gaagaagaaaaagggtgatcctgat

SEQ ID NO: 285381 - DNA, 25 bp, Mus musculus
gaagaagaaaacaggctatggtgaa

SEQ ID NO: 285382 - DNA, 25 bp, Mus musculus
gaagaagaaaagctcaacagaggca

SEQ ID NO: 285383 - DNA, 25 bp, Mus musculus
gaagaagaaaaggctacagaaactt

SEQ ID NO: 285384 - DNA, 25 bp, Mus musculus
gaagaagaaaagtgttgccgggaaa

SEQ ID NO: 285385 - DNA, 25 bp, Mus musculus
gaagaagaaagaggatgctctggag

SEQ ID NO: 285386 - DNA, 25 bp, Mus musculus
gaagaagaaaggatacaagaccctt

SEQ ID NO: 285387 - DNA, 25 bp, Mus musculus
gaagaagaaaggttcatcctcaacc

SEQ ID NO: 285388 - DNA, 25 bp, Mus musculus
gaagaagaagaaaaggctacagaaa

SEQ ID NO: 285389 - DNA, 25 bp, Mus musculus
gaagaagaagaaaagtgttgccggg

SEQ ID NO: 285390 - DNA, 25 bp, Mus musculus
gaagaagaagaagggtcctgggctg

SEQ ID NO: 285391 - DNA, 25 bp, Mus musculus
gaagaagaagaaggtgaccggagag

SEQ ID NO: 285392 - DNA, 25 bp, Mus musculus
gaagaagaagaggcttctgtgtcag

SEQ ID NO: 285393 - DNA, 25 bp, Mus musculus
gaagaagaagaggtctaagagtgtc

SEQ ID NO: 285394 - DNA, 25 bp, Mus musculus
gaagaagaagcagcaacagttggag

SEQ ID NO: 285395 - DNA, 25 bp, Mus musculus
gaagaagaagcaggtcacgatctag

SEQ ID NO: 285396 - DNA, 25 bp, Mus musculus
gaagaagaagcaggtttcttcgttt

SEQ ID NO: 285397 - DNA, 25 bp, Mus musculus
gaagaagaagcccagggtgctgaga

SEQ ID NO: 285398 - DNA, 25 bp, Mus musculus
gaagaagaaggcgtcccatgagaat

SEQ ID NO: 285399 - DNA, 25 bp, Mus musculus
gaagaagaagggtcctgggctgtcc

SEQ ID NO: 285400 - DNA, 25 bp, Mus musculus
gaagaagaaggtagctacatcaagc

SEQ ID NO: 285401 - DNA, 25 bp, Mus musculus
gaagaagaaggtgaccggagaggag

SEQ ID NO: 285402 - DNA, 25 bp, Mus musculus
gaagaagaaggttttcgcatttcca

SEQ ID NO: 285403 - DNA, 25 bp, Mus musculus
gaagaagaagtatgaacgaggctct

SEQ ID NO: 285404 - DNA, 25 bp, Mus musculus
gaagaagaatatgccccagagaaga

SEQ ID NO: 285405 - DNA, 25 bp, Mus musculus
gaagaagaatgggctctacttgaat

SEQ ID NO: 285406 - DNA, 25 bp, Mus musculus
gaagaagaatgggtctttccttcca

SEQ ID NO: 285407 - DNA, 25 bp, Mus musculus
gaagaagacacagagggctgacagc

SEQ ID NO: 285408 - DNA, 25 bp, Mus musculus
gaagaagacagatgagcttccccaa

SEQ ID NO: 285409 - DNA, 25 bp, Mus musculus
gaagaagacaggacaggaagctctc

SEQ ID NO: 285410 - DNA, 25 bp, Mus musculus
gaagaagacagttcaaaagaccccc

SEQ ID NO: 285411 - DNA, 25 bp, Mus musculus
gaagaagaccagaagctctgactat

SEQ ID NO: 285412 - DNA, 25 bp, Mus musculus
gaagaagacggatctccatctttcc

SEQ ID NO: 285413 - DNA, 25 bp, Mus musculus
gaagaagagaagaagcgcaggaaag

SEQ ID NO: 285414 - DNA, 25 bp, Mus musculus
gaagaagagaatgcccaggctgaag

SEQ ID NO: 285415 - DNA, 25 bp, Mus musculus
gaagaagagcagagaaacttttcca

SEQ ID NO: 285416 - DNA, 25 bp, Mus musculus
gaagaagagctcaaaatgttaccag

SEQ ID NO: 285417 - DNA, 25 bp, Mus musculus
gaagaagagctcaaagccaagcact

SEQ ID NO: 285418 - DNA, 25 bp, Mus musculus
gaagaagataaacagatacagacag

SEQ ID NO: 285419 - DNA, 25 bp, Mus musculus
gaagaagataaacagtgtggcctac

SEQ ID NO: 285420 - DNA, 25 bp, Mus musculus
gaagaagatgactttgaaaaagcag

SEQ ID NO: 285421 - DNA, 25 bp, Mus musculus
gaagaagatgcagctgagaaggtag

SEQ ID NO: 285422 - DNA, 25 bp, Mus musculus
gaagaagatggatgcagattcctgg

SEQ ID NO: 285423 - DNA, 25 bp, Mus musculus
gaagaagatggattatgacaatgat

SEQ ID NO: 285424 - DNA, 25 bp, Mus musculus
gaagaagatgggcctgacggaggat

SEQ ID NO: 285425 - DNA, 25 bp, Mus musculus
gaagaagattattgatattttcatt

SEQ ID NO: 285426 - DNA, 25 bp, Mus musculus
gaagaagcaaaaaggcagaagactt

SEQ ID NO: 285427 - DNA, 25 bp, Mus musculus
gaagaagcaaaaaggtctgtctgtt

SEQ ID NO: 285428 - DNA, 25 bp, Mus musculus
gaagaagcaatatggtattcatgca

SEQ ID NO: 285429 - DNA, 25 bp, Mus musculus
gaagaagcaatgaactcccaggctg

SEQ ID NO: 285430 - DNA, 25 bp, Mus musculus
gaagaagcaatgatggagcaggaaa

SEQ ID NO: 285431 - DNA, 25 bp, Mus musculus
gaagaagcacagagagagattaaga

SEQ ID NO: 285432 - DNA, 25 bp, Mus musculus
gaagaagcactcagcacggcagctg

SEQ ID NO: 285433 - DNA, 25 bp, Mus musculus
gaagaagcacttttagatggctaac

SEQ ID NO: 285434 - DNA, 25 bp, Mus musculus
gaagaagcagaaggcttctcagaac

SEQ ID NO: 285435 - DNA, 25 bp, Mus musculus
gaagaagcagcaacagttggaggag

SEQ ID NO: 285436 - DNA, 25 bp, Mus musculus
gaagaagcaggtcacgatctagatc

SEQ ID NO: 285437 - DNA, 25 bp, Mus musculus
gaagaagcaggtccccaagaagctt

SEQ ID NO: 285438 - DNA, 25 bp, Mus musculus
gaagaagcaggtgattaaagtttac

SEQ ID NO: 285439 - DNA, 25 bp, Mus musculus
gaagaagcaggtttcttcgtttgag

SEQ ID NO: 285440 - DNA, 25 bp, Mus musculus
gaagaagccaaggcatgttatttga

SEQ ID NO: 285441 - DNA, 25 bp, Mus musculus
gaagaagccaagtcccatggcctcg

SEQ ID NO: 285442 - DNA, 25 bp, Mus musculus
gaagaagccaagttggcgagaggct

SEQ ID NO: 285443 - DNA, 25 bp, Mus musculus
gaagaagccacggatggtctcagca

SEQ ID NO: 285444 - DNA, 25 bp, Mus musculus
gaagaagcccaaagcatccaaagac

SEQ ID NO: 285445 - DNA, 25 bp, Mus musculus
gaagaagcccaaggatgatgaaaac

SEQ ID NO: 285446 - DNA, 25 bp, Mus musculus
gaagaagctgacgaggaaggggaag

SEQ ID NO: 285447 - DNA, 25 bp, Mus musculus
gaagaagctgacgagggttatcagc

SEQ ID NO: 285448 - DNA, 25 bp, Mus musculus
gaagaagctggtcccgtccatgggg

SEQ ID NO: 285449 - DNA, 25 bp, Mus musculus
gaagaagcttctggaggctctttca

SEQ ID NO: 285450 - DNA, 25 bp, Mus musculus
gaagaaggagaaaatcacttctcca

SEQ ID NO: 285451 - DNA, 25 bp, Mus musculus
gaagaaggagaaagcaagctgttct

SEQ ID NO: 285452 - DNA, 25 bp, Mus musculus
gaagaaggagagctcactactatac

SEQ ID NO: 285453 - DNA, 25 bp, Mus musculus
gaagaaggagccagctattcactta

SEQ ID NO: 285454 - DNA, 25 bp, Mus musculus
gaagaaggaggttccattttggggg

SEQ ID NO: 285455 - DNA, 25 bp, Mus musculus
gaagaaggcaaagagagacacaccc

SEQ ID NO: 285456 - DNA, 25 bp, Mus musculus
gaagaaggcaaatagcacccaggag

SEQ ID NO: 285457 - DNA, 25 bp, Mus musculus
gaagaaggcagataaggaaaagggg

SEQ ID NO: 285458 - DNA, 25 bp, Mus musculus
gaagaaggcagcccagatactcagc

SEQ ID NO: 285459 - DNA, 25 bp, Mus musculus
gaagaaggcaggcctccacttacag

SEQ ID NO: 285460 - DNA, 25 bp, Mus musculus
gaagaaggccaccgacgcattccac

SEQ ID NO: 285461 - DNA, 25 bp, Mus musculus
gaagaaggtgtctggccctctccag

SEQ ID NO: 285462 - DNA, 25 bp, Mus musculus
gaagaagtaaccctcctcccctgcc

SEQ ID NO: 285463 - DNA, 25 bp, Mus musculus
gaagaagtcaagccaggtgcccagg

SEQ ID NO: 285464 - DNA, 25 bp, Mus musculus
gaagaagtcaagggaaaagtatgtc

SEQ ID NO: 285465 - DNA, 25 bp, Mus musculus
gaagaagtgccaggaatccgaatct

SEQ ID NO: 285466 - DNA, 25 bp, Mus musculus
gaagaagtgccaggagaaatctgag

SEQ ID NO: 285467 - DNA, 25 bp, Mus musculus
gaagaagtggggtgccgccatgctg

SEQ ID NO: 285468 - DNA, 25 bp, Mus musculus
gaagaagttatgctgcaggcacacg

SEQ ID NO: 285469 - DNA, 25 bp, Mus musculus
gaagaagttcaagattgatgaccag

SEQ ID NO: 285470 - DNA, 25 bp, Mus musculus
gaagaagtttgcagctaggagccct

SEQ ID NO: 285471 - DNA, 25 bp, Mus musculus
gaagaagtttgcagtgtgtgacatc

SEQ ID NO: 285472 - DNA, 25 bp, Mus musculus
gaagaatacaagaagagggcagcag

SEQ ID NO: 285473 - DNA, 25 bp, Mus musculus
gaagaatacaagatcaaatgcctgt

SEQ ID NO: 285474 - DNA, 25 bp, Mus musculus
gaagaatacgcgggtcagataacac

SEQ ID NO: 285475 - DNA, 25 bp, Mus musculus
gaagaatacgtatcaccaaactcag

SEQ ID NO: 285476 - DNA, 25 bp, Mus musculus
gaagaatatggtggcctgggcctct

SEQ ID NO: 285477 - DNA, 25 bp, Mus musculus
gaagaatcaagaaactgatctcaga

SEQ ID NO: 285478 - DNA, 25 bp, Mus musculus
gaagaatcacagggctggaccctgc

SEQ ID NO: 285479 - DNA, 25 bp, Mus musculus
gaagaatctagagctgatcataagc

SEQ ID NO: 285480 - DNA, 25 bp, Mus musculus
gaagaatctgaaggtccagcctgat

SEQ ID NO: 285481 - DNA, 25 bp, Mus musculus
gaagaatgaaggctgaacttccact

SEQ ID NO: 285482 - DNA, 25 bp, Mus musculus
gaagaatgtcagcaggatggcacgc

SEQ ID NO: 285483 - DNA, 25 bp, Mus musculus
gaagaatgtgctggaattgtctgta

SEQ ID NO: 285484 - DNA, 25 bp, Mus musculus
gaagaatgtgctgggttttctgtct

SEQ ID NO: 285485 - DNA, 25 bp, Mus musculus
gaagaatgtggcaaaaaaacatttc

SEQ ID NO: 285486 - DNA, 25 bp, Mus musculus
gaagaatgtggccaggcctgcacca

SEQ ID NO: 285487 - DNA, 25 bp, Mus musculus
gaagaatgtggcgctttggagtctc

SEQ ID NO: 285488 - DNA, 25 bp, Mus musculus
gaagaatgtggcttcccagacacca

SEQ ID NO: 285489 - DNA, 25 bp, Mus musculus
gaagaatgtgtcctgattaccgaca

SEQ ID NO: 285490 - DNA, 25 bp, Mus musculus
gaagaatgtgtcctgtcccacgctc

SEQ ID NO: 285491 - DNA, 25 bp, Mus musculus
gaagaattcaggggggaggatgact

SEQ ID NO: 285492 - DNA, 25 bp, Mus musculus
gaagaattcagtgaacagagtatct

SEQ ID NO: 285493 - DNA, 25 bp, Mus musculus
gaagaattccaaatagcatagcttg

SEQ ID NO: 285494 - DNA, 25 bp, Mus musculus
gaagaattccaaatgcttacttttc

SEQ ID NO: 285495 - DNA, 25 bp, Mus musculus
gaagaattccacggacctagactca

SEQ ID NO: 285496 - DNA, 25 bp, Mus musculus
gaagaattctaatgttttgtgatcc

SEQ ID NO: 285497 - DNA, 25 bp, Mus musculus
gaagaattctagggtactcaatgca

SEQ ID NO: 285498 - DNA, 25 bp, Mus musculus
gaagaatttcaagactgcgagtgct

SEQ ID NO: 285499 - DNA, 25 bp, Mus musculus
gaagaatttcagatgcccgtgtggt

SEQ ID NO: 285500 - DNA, 25 bp, Mus musculus
gaagaatttcagtgtctctgaagaa

SEQ ID NO: 285501 - DNA, 25 bp, Mus musculus
gaagaatttgatgaggacagtggtg

SEQ ID NO: 285502 - DNA, 25 bp, Mus musculus
gaagaatttgtcagttggttactgg

SEQ ID NO: 285503 - DNA, 25 bp, Mus musculus
gaagaatttgtggaagaggagacag

SEQ ID NO: 285504 - DNA, 25 bp, Mus musculus
gaagacaaaaagagttcaaaattgg

SEQ ID NO: 285505 - DNA, 25 bp, Mus musculus
gaagacaaagacaggatgagagaca

SEQ ID NO: 285506 - DNA, 25 bp, Mus musculus
gaagacaaaggaaacagaggctaca

SEQ ID NO: 285507 - DNA, 25 bp, Mus musculus
gaagacaagtgcagatgaaatcatg

SEQ ID NO: 285508 - DNA, 25 bp, Mus musculus
gaagacaatagcacccaggcagaca

SEQ ID NO: 285509 - DNA, 25 bp, Mus musculus
gaagacacaaaaaaaaggcagtgga

SEQ ID NO: 285510 - DNA, 25 bp, Mus musculus
gaagacacaagtagaaggcagtgga

SEQ ID NO: 285511 - DNA, 25 bp, Mus musculus
gaagacacagagggctgacagcttt

SEQ ID NO: 285512 - DNA, 25 bp, Mus musculus
gaagacacagcctgcttctacctgg

SEQ ID NO: 285513 - DNA, 25 bp, Mus musculus
gaagacacagcgtgcttttacttgg

SEQ ID NO: 285514 - DNA, 25 bp, Mus musculus
gaagacacagcgtggccttgggtgg

SEQ ID NO: 285515 - DNA, 25 bp, Mus musculus
gaagacacaggattatgtactgaag

SEQ ID NO: 285516 - DNA, 25 bp, Mus musculus
gaagacacaggggctccttattgga

SEQ ID NO: 285517 - DNA, 25 bp, Mus musculus
gaagacacagtgaagcatgactggg

SEQ ID NO: 285518 - DNA, 25 bp, Mus musculus
gaagacaccagcaccaatggaacag

SEQ ID NO: 285519 - DNA, 25 bp, Mus musculus
gaagacacgggtgatgtcccgcacg

SEQ ID NO: 285520 - DNA, 25 bp, Mus musculus
gaagacactaaccctgagctcttgg

SEQ ID NO: 285521 - DNA, 25 bp, Mus musculus
gaagacactagggtggctaccgtct

SEQ ID NO: 285522 - DNA, 25 bp, Mus musculus
gaagacactgaaaagcgccatggct

SEQ ID NO: 285523 - DNA, 25 bp, Mus musculus
gaagacagagaatttcatcttcatg

SEQ ID NO: 285524 - DNA, 25 bp, Mus musculus
gaagacagagcaaggtcctgtttat

SEQ ID NO: 285525 - DNA, 25 bp, Mus musculus
gaagacagagttcctctgctaaagg

SEQ ID NO: 285526 - DNA, 25 bp, Mus musculus
gaagacagcacactagaaaccccat

SEQ ID NO: 285527 - DNA, 25 bp, Mus musculus
gaagacagcgaagggctcacaactc

SEQ ID NO: 285528 - DNA, 25 bp, Mus musculus
gaagacagctggcagaactcaacaa

SEQ ID NO: 285529 - DNA, 25 bp, Mus musculus
gaagacagtgatgaggatgaagatg

SEQ ID NO: 285530 - DNA, 25 bp, Mus musculus
gaagacagttacggtaaattctaca

SEQ ID NO: 285531 - DNA, 25 bp, Mus musculus
gaagacagttacggtatgcttccct

SEQ ID NO: 285532 - DNA, 25 bp, Mus musculus
gaagacatagggaatctgtccttga

SEQ ID NO: 285533 - DNA, 25 bp, Mus musculus
gaagacatatgggctgatgtgatgg

SEQ ID NO: 285534 - DNA, 25 bp, Mus musculus
gaagacatatgggtggagccttttg

SEQ ID NO: 285535 - DNA, 25 bp, Mus musculus
gaagacatcaagtgctgtaacagtt

SEQ ID NO: 285536 - DNA, 25 bp, Mus musculus
gaagacatcatcacaggagcgaggc

SEQ ID NO: 285537 - DNA, 25 bp, Mus musculus
gaagacatccagaaactgaaggatg

SEQ ID NO: 285538 - DNA, 25 bp, Mus musculus
gaagacatccagccggatggcgcag

SEQ ID NO: 285539 - DNA, 25 bp, Mus musculus
gaagacatccgagagctagcccacc

SEQ ID NO: 285540 - DNA, 25 bp, Mus musculus
gaagacatccgagaggccatcaaaa

SEQ ID NO: 285541 - DNA, 25 bp, Mus musculus
gaagacatcgctgaccctgtctcta

SEQ ID NO: 285542 - DNA, 25 bp, Mus musculus
gaagacatctactaaaccgcccaga

SEQ ID NO: 285543 - DNA, 25 bp, Mus musculus
gaagacatctatgaggaccggcacg

SEQ ID NO: 285544 - DNA, 25 bp, Mus musculus
gaagacatgaggactttcagtcaga

SEQ ID NO: 285545 - DNA, 25 bp, Mus musculus
gaagacatgtcagcttctctgtcca

SEQ ID NO: 285546 - DNA, 25 bp, Mus musculus
gaagacattcacgattgttggtgac

SEQ ID NO: 285547 - DNA, 25 bp, Mus musculus
gaagacattcttgaggtggagtctt

SEQ ID NO: 285548 - DNA, 25 bp, Mus musculus
gaagacattggcgtatttgctgcct

SEQ ID NO: 285549 - DNA, 25 bp, Mus musculus
gaagaccaaaacgccagccacctgc

SEQ ID NO: 285550 - DNA, 25 bp, Mus musculus
gaagaccaaaacgggggagcagtgc

SEQ ID NO: 285551 - DNA, 25 bp, Mus musculus
gaagaccaacagaacttgacgagag

SEQ ID NO: 285552 - DNA, 25 bp, Mus musculus
gaagaccaagactgtatcccttgcg

SEQ ID NO: 285553 - DNA, 25 bp, Mus musculus
gaagaccaagcgctggaaggtaggc

SEQ ID NO: 285554 - DNA, 25 bp, Mus musculus
gaagaccaagcggatctctttcctg

SEQ ID NO: 285555 - DNA, 25 bp, Mus musculus
gaagaccaaggctttgatccagtgt

SEQ ID NO: 285556 - DNA, 25 bp, Mus musculus
gaagaccagaagctctgactatgca

SEQ ID NO: 285557 - DNA, 25 bp, Mus musculus
gaagaccaggcagggtctcctggaa

SEQ ID NO: 285558 - DNA, 25 bp, Mus musculus
gaagaccagggaggtgactgactta

SEQ ID NO: 285559 - DNA, 25 bp, Mus musculus
gaagaccatcttgcagtgcgccctc

SEQ ID NO: 285560 - DNA, 25 bp, Mus musculus
gaagaccatgaagggctgccaacag

SEQ ID NO: 285561 - DNA, 25 bp, Mus musculus
gaagaccatgaagttggacaacttt

SEQ ID NO: 285562 - DNA, 25 bp, Mus musculus
gaagacccaaagcgtctgatggcta

SEQ ID NO: 285563 - DNA, 25 bp, Mus musculus
gaagacccaagcttggatctagcaa

SEQ ID NO: 285564 - DNA, 25 bp, Mus musculus
gaagacccacacctcacaaattgaa

SEQ ID NO: 285565 - DNA, 25 bp, Mus musculus
gaagacccagaaatttgtatgcccg

SEQ ID NO: 285566 - DNA, 25 bp, Mus musculus
gaagacccagaggacacaaagatcg

SEQ ID NO: 285567 - DNA, 25 bp, Mus musculus
gaagacccagaggaggaagagtttg

SEQ ID NO: 285568 - DNA, 25 bp, Mus musculus
gaagaccccactcagagatgctgag

SEQ ID NO: 285569 - DNA, 25 bp, Mus musculus
gaagaccccactgactcatcccagg

SEQ ID NO: 285570 - DNA, 25 bp, Mus musculus
gaagaccccgggtcttgttgcagca

SEQ ID NO: 285571 - DNA, 25 bp, Mus musculus
gaagaccccttggaggagaggatgc

SEQ ID NO: 285572 - DNA, 25 bp, Mus musculus
gaagaccctcacctccacgccctaa

SEQ ID NO: 285573 - DNA, 25 bp, Mus musculus
gaagaccctgacagcaagaccatca

SEQ ID NO: 285574 - DNA, 25 bp, Mus musculus
gaagaccgtgactctcaactccgaa

SEQ ID NO: 285575 - DNA, 25 bp, Mus musculus
gaagacctaaatgactggcttcccc

SEQ ID NO: 285576 - DNA, 25 bp, Mus musculus
gaagacctaaatggagaactgttcc

SEQ ID NO: 285577 - DNA, 25 bp, Mus musculus
gaagacctacaaggtcggacatcaa

SEQ ID NO: 285578 - DNA, 25 bp, Mus musculus
gaagacctcactccagtcccgctcg

SEQ ID NO: 285579 - DNA, 25 bp, Mus musculus
gaagacctcactgacctctcactgc

SEQ ID NO: 285580 - DNA, 25 bp, Mus musculus
gaagacctcactgtttctctatata

SEQ ID NO: 285581 - DNA, 25 bp, Mus musculus
gaagacctcccagatggtgttagca

SEQ ID NO: 285582 - DNA, 25 bp, Mus musculus
gaagacctcccataacacgacaagg

SEQ ID NO: 285583 - DNA, 25 bp, Mus musculus
gaagacctgatcctgtggaagaggt

SEQ ID NO: 285584 - DNA, 25 bp, Mus musculus
gaagacctggcacagtcaggttttc

SEQ ID NO: 285585 - DNA, 25 bp, Mus musculus
gaagacctggcacattcctcttcag

SEQ ID NO: 285586 - DNA, 25 bp, Mus musculus
gaagaccttaccaaggaccgtagcc

SEQ ID NO: 285587 - DNA, 25 bp, Mus musculus
gaagacgaagaaaggccacggaaca

SEQ ID NO: 285588 - DNA, 25 bp, Mus musculus
gaagacgaagaaaggctacttcgtg

SEQ ID NO: 285589 - DNA, 25 bp, Mus musculus
gaagacgacaaaggtcccccctgtg

SEQ ID NO: 285590 - DNA, 25 bp, Mus musculus
gaagacgaggcgggacatgttctca

SEQ ID NO: 285591 - DNA, 25 bp, Mus musculus
gaagacgaggcgggccatccgggta

SEQ ID NO: 285592 - DNA, 25 bp, Mus musculus
gaagacgcaaaagagtgtgaagatt

SEQ ID NO: 285593 - DNA, 25 bp, Mus musculus
gaagacgcaattcagtcaggatggc

SEQ ID NO: 285594 - DNA, 25 bp, Mus musculus
gaagacgcctatgcaggagcatctg

SEQ ID NO: 285595 - DNA, 25 bp, Mus musculus
gaagacgcctatggctcagaggact

SEQ ID NO: 285596 - DNA, 25 bp, Mus musculus
gaagacggacaccatgatatcttta

SEQ ID NO: 285597 - DNA, 25 bp, Mus musculus
gaagacggacagtgttacgaagcgg

SEQ ID NO: 285598 - DNA, 25 bp, Mus musculus
gaagacggtgagcagggatatcgct

SEQ ID NO: 285599 - DNA, 25 bp, Mus musculus
gaagacggtgcttggcctgttcttc

SEQ ID NO: 285600 - DNA, 25 bp, Mus musculus
gaagacgtgaaattgcaagctttct

SEQ ID NO: 285601 - DNA, 25 bp, Mus musculus
gaagacgtgaatatccgctccattc

SEQ ID NO: 285602 - DNA, 25 bp, Mus musculus
gaagacgtgggcgatggttgtggag

SEQ ID NO: 285603 - DNA, 25 bp, Mus musculus
gaagacgtgggcggctgttttgagc

SEQ ID NO: 285604 - DNA, 25 bp, Mus musculus
gaagactaagtggactaaagaggat

SEQ ID NO: 285605 - DNA, 25 bp, Mus musculus
gaagactacagatgggcagcagatt

SEQ ID NO: 285606 - DNA, 25 bp, Mus musculus
gaagactacagctcgacatgggtta

SEQ ID NO: 285607 - DNA, 25 bp, Mus musculus
gaagactacaggacctgcagggacc

SEQ ID NO: 285608 - DNA, 25 bp, Mus musculus
gaagactacagttgcagctcgacat

SEQ ID NO: 285609 - DNA, 25 bp, Mus musculus
gaagactactacagtcacctgaaga

SEQ ID NO: 285610 - DNA, 25 bp, Mus musculus
gaagactatcaccttaaccaacctt

SEQ ID NO: 285611 - DNA, 25 bp, Mus musculus
gaagactccaattcattgcttcttt

SEQ ID NO: 285612 - DNA, 25 bp, Mus musculus
gaagactccagtgagagttgctgga

SEQ ID NO: 285613 - DNA, 25 bp, Mus musculus
gaagactcctctgattcagatgcca

SEQ ID NO: 285614 - DNA, 25 bp, Mus musculus
gaagactccttggcgcttagtgctg

SEQ ID NO: 285615 - DNA, 25 bp, Mus musculus
gaagactcgaaacttatagctctca

SEQ ID NO: 285616 - DNA, 25 bp, Mus musculus
gaagactctcaggccggggagcgtc

SEQ ID NO: 285617 - DNA, 25 bp, Mus musculus
gaagactctggtaggaacaaccttg

SEQ ID NO: 285618 - DNA, 25 bp, Mus musculus
gaagactctgtgcctggaatcaaac

SEQ ID NO: 285619 - DNA, 25 bp, Mus musculus
gaagactgaaccagctctccaggag

SEQ ID NO: 285620 - DNA, 25 bp, Mus musculus
gaagactgaactaagacagaaagac

SEQ ID NO: 285621 - DNA, 25 bp, Mus musculus
gaagactgagaacaggtccaaagag

SEQ ID NO: 285622 - DNA, 25 bp, Mus musculus
gaagactgagaacaggtctaggtcc

SEQ ID NO: 285623 - DNA, 25 bp, Mus musculus
gaagactgcaggaggtctccaggtg

SEQ ID NO: 285624 - DNA, 25 bp, Mus musculus
gaagactgcgagcacgtagaagacc

SEQ ID NO: 285625 - DNA, 25 bp, Mus musculus
gaagactgcgaggaccgtcacgacg

SEQ ID NO: 285626 - DNA, 25 bp, Mus musculus
gaagactgcgctgagtggaccagat

SEQ ID NO: 285627 - DNA, 25 bp, Mus musculus
gaagactgcggttctacgggtgccg

SEQ ID NO: 285628 - DNA, 25 bp, Mus musculus
gaagactggcaggacagtttcttga

SEQ ID NO: 285629 - DNA, 25 bp, Mus musculus
gaagactgtcgctcctgtgcggcac

SEQ ID NO: 285630 - DNA, 25 bp, Mus musculus
gaagactgtgaaagtgtatgagaag

SEQ ID NO: 285631 - DNA, 25 bp, Mus musculus
gaagactgtgaacaggtatgagaag

SEQ ID NO: 285632 - DNA, 25 bp, Mus musculus
gaagactgtggaaacaccaggcaat

SEQ ID NO: 285633 - DNA, 25 bp, Mus musculus
gaagactgtggacgatgtcataaag

SEQ ID NO: 285634 - DNA, 25 bp, Mus musculus
gaagactgtggacgggattctctgc

SEQ ID NO: 285635 - DNA, 25 bp, Mus musculus
gaagactgtggtcttgccgtcacta

SEQ ID NO: 285636 - DNA, 25 bp, Mus musculus
gaagacttaatcaccgtcattaccc

SEQ ID NO: 285637 - DNA, 25 bp, Mus musculus
gaagacttagagaaggaagggaaca

SEQ ID NO: 285638 - DNA, 25 bp, Mus musculus
gaagacttcaacaaggtaatgcagg

SEQ ID NO: 285639 - DNA, 25 bp, Mus musculus
gaagacttcaagaggacgctggtag

SEQ ID NO: 285640 - DNA, 25 bp, Mus musculus
gaagacttctccaggctagaaaatg

SEQ ID NO: 285641 - DNA, 25 bp, Mus musculus
gaagacttgcactggttgttcatcg

SEQ ID NO: 285642 - DNA, 25 bp, Mus musculus
gaagacttggagcactttgaggaaa

SEQ ID NO: 285643 - DNA, 25 bp, Mus musculus
gaagacttgtctctggcgtgggtga

SEQ ID NO: 285644 - DNA, 25 bp, Mus musculus
gaagactttagtcctgcactagaaa

SEQ ID NO: 285645 - DNA, 25 bp, Mus musculus
gaagactttggtggcacgcggtgtc

SEQ ID NO: 285646 - DNA, 25 bp, Mus musculus
gaagacttttgggctctatacaacc

SEQ ID NO: 285647 - DNA, 25 bp, Mus musculus
gaagagaaaatgaaagcagaccgcg

SEQ ID NO: 285648 - DNA, 25 bp, Mus musculus
gaagagaaactggacagagccaatg

SEQ ID NO: 285649 - DNA, 25 bp, Mus musculus
gaagagaaagaaagaccagagagag

SEQ ID NO: 285650 - DNA, 25 bp, Mus musculus
gaagagaaagggcggtctggtcgag

SEQ ID NO: 285651 - DNA, 25 bp, Mus musculus
gaagagaaaggtctgtatccacccg

SEQ ID NO: 285652 - DNA, 25 bp, Mus musculus
gaagagaaagtacacactgcgctgt

SEQ ID NO: 285653 - DNA, 25 bp, Mus musculus
gaagagaaataataactgccatgga

SEQ ID NO: 285654 - DNA, 25 bp, Mus musculus
gaagagaaatatattgagcggtttc

SEQ ID NO: 285655 - DNA, 25 bp, Mus musculus
gaagagaaatattacagcgactgtg

SEQ ID NO: 285656 - DNA, 25 bp, Mus musculus
gaagagaaatggttcccataacaac

SEQ ID NO: 285657 - DNA, 25 bp, Mus musculus
gaagagaaattttgaaatgcccttg

SEQ ID NO: 285658 - DNA, 25 bp, Mus musculus
gaagagaacaagaggtttgaagatc

SEQ ID NO: 285659 - DNA, 25 bp, Mus musculus
gaagagaagaaagaggaagatggac

SEQ ID NO: 285660 - DNA, 25 bp, Mus musculus
gaagagaagaagcgcaggaaaggtg

SEQ ID NO: 285661 - DNA, 25 bp, Mus musculus
gaagagaagcccaaggagggtgtga

SEQ ID NO: 285662 - DNA, 25 bp, Mus musculus
gaagagaaggaggaagaggaggacg

SEQ ID NO: 285663 - DNA, 25 bp, Mus musculus
gaagagaataggagaaagcatccac

SEQ ID NO: 285664 - DNA, 25 bp, Mus musculus
gaagagaatatgaccacctatctag

SEQ ID NO: 285665 - DNA, 25 bp, Mus musculus
gaagagaatatgagatcctgcaacg

SEQ ID NO: 285666 - DNA, 25 bp, Mus musculus
gaagagaatatgagttccagcagca

SEQ ID NO: 285667 - DNA, 25 bp, Mus musculus
gaagagaatgcccaggctgaagcgc

SEQ ID NO: 285668 - DNA, 25 bp, Mus musculus
gaagagaattgagcgtttatcactc

SEQ ID NO: 285669 - DNA, 25 bp, Mus musculus
gaagagacaaaagaggcttttcaga

SEQ ID NO: 285670 - DNA, 25 bp, Mus musculus
gaagagacaaaagagtttcaactcc

SEQ ID NO: 285671 - DNA, 25 bp, Mus musculus
gaagagacaaggcatagtgcagtcg

SEQ ID NO: 285672 - DNA, 25 bp, Mus musculus
gaagagacacaagggtaaggaatca

SEQ ID NO: 285673 - DNA, 25 bp, Mus musculus
gaagagacacaagggtgctgatgga

SEQ ID NO: 285674 - DNA, 25 bp, Mus musculus
gaagagacctccggaaatttgtgag

SEQ ID NO: 285675 - DNA, 25 bp, Mus musculus
gaagagactacaactaaagcaagct

SEQ ID NO: 285676 - DNA, 25 bp, Mus musculus
gaagagactacggccttattttggc

SEQ ID NO: 285677 - DNA, 25 bp, Mus musculus
gaagagacttcacagctcaggcggg

SEQ ID NO: 285678 - DNA, 25 bp, Mus musculus
gaagagacttggttgaaaggccact

SEQ ID NO: 285679 - DNA, 25 bp, Mus musculus
gaagagagacccaggcactccagaa

SEQ ID NO: 285680 - DNA, 25 bp, Mus musculus
gaagagagagaagctcggacctaag

SEQ ID NO: 285681 - DNA, 25 bp, Mus musculus
gaagagagagtacctcagccctgtc

SEQ ID NO: 285682 - DNA, 25 bp, Mus musculus
gaagagagcggacaaggagatctga

SEQ ID NO: 285683 - DNA, 25 bp, Mus musculus
gaagagaggaaaagaacaaattacc

SEQ ID NO: 285684 - DNA, 25 bp, Mus musculus
gaagagatacaggtctcgttccaga

SEQ ID NO: 285685 - DNA, 25 bp, Mus musculus
gaagagatacagttctaggtctcgt

SEQ ID NO: 285686 - DNA, 25 bp, Mus musculus
gaagagataggtgatttcagactgg

SEQ ID NO: 285687 - DNA, 25 bp, Mus musculus
gaagagatcctcgagtgaggacgac

SEQ ID NO: 285688 - DNA, 25 bp, Mus musculus
gaagagatggaagatcaccgcctcc

SEQ ID NO: 285689 - DNA, 25 bp, Mus musculus
gaagagatggagttttttggaccat

SEQ ID NO: 285690 - DNA, 25 bp, Mus musculus
gaagagatggcagatactttggcaa

SEQ ID NO: 285691 - DNA, 25 bp, Mus musculus
gaagagatggcaggtgtatggtggc

SEQ ID NO: 285692 - DNA, 25 bp, Mus musculus
gaagagatggccatatacgcctact

SEQ ID NO: 285693 - DNA, 25 bp, Mus musculus
gaagagatggctacatgggaattgg

SEQ ID NO: 285694 - DNA, 25 bp, Mus musculus
gaagagatgggtattgctttcaccg

SEQ ID NO: 285695 - DNA, 25 bp, Mus musculus
gaagagattaaaaggatcttgctgc

SEQ ID NO: 285696 - DNA, 25 bp, Mus musculus
gaagagattagtggccaagcccagc

SEQ ID NO: 285697 - DNA, 25 bp, Mus musculus
gaagagattcaaagcagaataccag

SEQ ID NO: 285698 - DNA, 25 bp, Mus musculus
gaagagcaaaaagggcatcctggtc

SEQ ID NO: 285699 - DNA, 25 bp, Mus musculus
gaagagcaaagaaatctgcaggtgg

SEQ ID NO: 285700 - DNA, 25 bp, Mus musculus
gaagagcaaatttgacgccgagttc

SEQ ID NO: 285701 - DNA, 25 bp, Mus musculus
gaagagcaacatgaccatgtggagc

SEQ ID NO: 285702 - DNA, 25 bp, Mus musculus
gaagagcaagaacctgggagcagag

SEQ ID NO: 285703 - DNA, 25 bp, Mus musculus
gaagagcaagatcctggcagccacc

SEQ ID NO: 285704 - DNA, 25 bp, Mus musculus
gaagagcaagatgatttttgaatgt

SEQ ID NO: 285705 - DNA, 25 bp, Mus musculus
gaagagcaagcacgcccccagaggt

SEQ ID NO: 285706 - DNA, 25 bp, Mus musculus
gaagagcaagttaagtttgaaagtg

SEQ ID NO: 285707 - DNA, 25 bp, Mus musculus
gaagagcacagtgggtgttggacgt

SEQ ID NO: 285708 - DNA, 25 bp, Mus musculus
gaagagcacagtggtttattgctgt

SEQ ID NO: 285709 - DNA, 25 bp, Mus musculus
gaagagcaccagaattcatcctaca

SEQ ID NO: 285710 - DNA, 25 bp, Mus musculus
gaagagcacggatgttctttggcaa

SEQ ID NO: 285711 - DNA, 25 bp, Mus musculus
gaagagcagacagataaaggagctg

SEQ ID NO: 285712 - DNA, 25 bp, Mus musculus
gaagagcagcagagtggtaggattg

SEQ ID NO: 285713 - DNA, 25 bp, Mus musculus
gaagagcagcagatcagacctactg

SEQ ID NO: 285714 - DNA, 25 bp, Mus musculus
gaagagccactgggctcctagctta

SEQ ID NO: 285715 - DNA, 25 bp, Mus musculus
gaagagccactggggggaggggttg

SEQ ID NO: 285716 - DNA, 25 bp, Mus musculus
gaagagccaggcaggtgcttcagaa

SEQ ID NO: 285717 - DNA, 25 bp, Mus musculus
gaagagccatgaagccgaggaaagc

SEQ ID NO: 285718 - DNA, 25 bp, Mus musculus
gaagagcccaaagggggaccaggct

SEQ ID NO: 285719 - DNA, 25 bp, Mus musculus
gaagagccccagagtggtaaacagc

SEQ ID NO: 285720 - DNA, 25 bp, Mus musculus
gaagagccccagtcacgcggtgttt

SEQ ID NO: 285721 - DNA, 25 bp, Mus musculus
gaagagccgtctctacttaagaagc

SEQ ID NO: 285722 - DNA, 25 bp, Mus musculus
gaagagccgtctgggcaagcaggag

SEQ ID NO: 285723 - DNA, 25 bp, Mus musculus
gaagagccgtctggtgtggagggtg

SEQ ID NO: 285724 - DNA, 25 bp, Mus musculus
gaagagcctagaggagaaagtctcg

SEQ ID NO: 285725 - DNA, 25 bp, Mus musculus
gaagagcctgtgcaagggcggcctg

SEQ ID NO: 285726 - DNA, 25 bp, Mus musculus
gaagagcgagcgaagagagcaaaga

SEQ ID NO: 285727 - DNA, 25 bp, Mus musculus
gaagagcgaggagacgagcaaaaat

SEQ ID NO: 285728 - DNA, 25 bp, Mus musculus
gaagagcgaggaggtggaagatatc

SEQ ID NO: 285729 - DNA, 25 bp, Mus musculus
gaagagcggaggcaggcaaaaccca

SEQ ID NO: 285730 - DNA, 25 bp, Mus musculus
gaagagcgtggagataacaaaacag

SEQ ID NO: 285731 - DNA, 25 bp, Mus musculus
gaagagcgtgggtgtggtggcttaa

SEQ ID NO: 285732 - DNA, 25 bp, Mus musculus
gaagagctagagatatgtgtcacaa

SEQ ID NO: 285733 - DNA, 25 bp, Mus musculus
gaagagctcaaaatgttaccagact

SEQ ID NO: 285734 - DNA, 25 bp, Mus musculus
gaagagctcaaagccaagcactcgc

SEQ ID NO: 285735 - DNA, 25 bp, Mus musculus
gaagagctcaagaagttaagtgtta

SEQ ID NO: 285736 - DNA, 25 bp, Mus musculus
gaagagctcagagcagaaaacttat

SEQ ID NO: 285737 - DNA, 25 bp, Mus musculus
gaagagctcaggtgtaccagctgga

SEQ ID NO: 285738 - DNA, 25 bp, Mus musculus
gaagagctggaccgtgctggaatct

SEQ ID NO: 285739 - DNA, 25 bp, Mus musculus
gaagagctggagagacaaaagatag

SEQ ID NO: 285740 - DNA, 25 bp, Mus musculus
gaagagctggatgccttattggagg

SEQ ID NO: 285741 - DNA, 25 bp, Mus musculus
gaagagctggtggaaggatcatcga

SEQ ID NO: 285742 - DNA, 25 bp, Mus musculus
gaagagcttagcctatcttcagagc

SEQ ID NO: 285743 - DNA, 25 bp, Mus musculus
gaagagcttcgcctgaaacctcagc

SEQ ID NO: 285744 - DNA, 25 bp, Mus musculus
gaagagcttgctacaatgggtgaca

SEQ ID NO: 285745 - DNA, 25 bp, Mus musculus
gaagaggaaagagatgagccgccag

SEQ ID NO: 285746 - DNA, 25 bp, Mus musculus
gaagaggaacaggatctcatcatgt

SEQ ID NO: 285747 - DNA, 25 bp, Mus musculus
gaagaggaacatgcagaggcacgga

SEQ ID NO: 285748 - DNA, 25 bp, Mus musculus
gaagaggaacatgggatgtgaagtg

SEQ ID NO: 285749 - DNA, 25 bp, Mus musculus
gaagaggaagaagtctgttcccagt

SEQ ID NO: 285750 - DNA, 25 bp, Mus musculus
gaagaggaagaggaggcccaagagg

SEQ ID NO: 285751 - DNA, 25 bp, Mus musculus
gaagaggaagaggatacagtcatca

SEQ ID NO: 285752 - DNA, 25 bp, Mus musculus
gaagaggacaggcttttccctgggc

SEQ ID NO: 285753 - DNA, 25 bp, Mus musculus
gaagaggacatcgatccctttgacg

SEQ ID NO: 285754 - DNA, 25 bp, Mus musculus
gaagaggacattcgccaatggcagt

SEQ ID NO: 285755 - DNA, 25 bp, Mus musculus
gaagaggacattcgtctgtattcat

SEQ ID NO: 285756 - DNA, 25 bp, Mus musculus
gaagaggaccgaggatccagatcga

SEQ ID NO: 285757 - DNA, 25 bp, Mus musculus
gaagaggaccgaggcgttatcgaac

SEQ ID NO: 285758 - DNA, 25 bp, Mus musculus
gaagaggacctccaagacagggttt

SEQ ID NO: 285759 - DNA, 25 bp, Mus musculus
gaagaggacctccaagcgctcatcg

SEQ ID NO: 285760 - DNA, 25 bp, Mus musculus
gaagaggacggctgctgctgaactg

SEQ ID NO: 285761 - DNA, 25 bp, Mus musculus
gaagaggagaaaacgatgggatatt

SEQ ID NO: 285762 - DNA, 25 bp, Mus musculus
gaagaggagaaaacggcacacatgt

SEQ ID NO: 285763 - DNA, 25 bp, Mus musculus
gaagaggagaaagaggacagagctg

SEQ ID NO: 285764 - DNA, 25 bp, Mus musculus
gaagaggagagtgatgctgttgtgt

SEQ ID NO: 285765 - DNA, 25 bp, Mus musculus
gaagaggagctggcactgccctttt

SEQ ID NO: 285766 - DNA, 25 bp, Mus musculus
gaagaggaggaactatggtcctgga

SEQ ID NO: 285767 - DNA, 25 bp, Mus musculus
gaagaggaggacgagcaagaggagg

SEQ ID NO: 285768 - DNA, 25 bp, Mus musculus
gaagaggaggaggaggaggagtagg

SEQ ID NO: 285769 - DNA, 25 bp, Mus musculus
gaagaggaggaggaggctccgcccc

SEQ ID NO: 285770 - DNA, 25 bp, Mus musculus
gaagaggaggagggtccggaccgct

SEQ ID NO: 285771 - DNA, 25 bp, Mus musculus
gaagaggagttggaaaatcttcaag

SEQ ID NO: 285772 - DNA, 25 bp, Mus musculus
gaagaggataaattaggaatcccca

SEQ ID NO: 285773 - DNA, 25 bp, Mus musculus
gaagaggatagtgaagatgaagatg

SEQ ID NO: 285774 - DNA, 25 bp, Mus musculus
gaagaggatggctgctcccaggcaa

SEQ ID NO: 285775 - DNA, 25 bp, Mus musculus
gaagaggattgcgaggatcgccacg

SEQ ID NO: 285776 - DNA, 25 bp, Mus musculus
gaagaggcagaggaacgggtttccg

SEQ ID NO: 285777 - DNA, 25 bp, Mus musculus
gaagaggccaaaggaaatttgtgag

SEQ ID NO: 285778 - DNA, 25 bp, Mus musculus
gaagaggccaaagtaacctcaggct

SEQ ID NO: 285779 - DNA, 25 bp, Mus musculus
gaagaggcccaggtgcgggcgagtc

SEQ ID NO: 285780 - DNA, 25 bp, Mus musculus
gaagaggcctgggaggcccggcaca

SEQ ID NO: 285781 - DNA, 25 bp, Mus musculus
gaagaggcctttcagcttcaagaaa

SEQ ID NO: 285782 - DNA, 25 bp, Mus musculus
gaagaggcctttcaggtctgcctcg

SEQ ID NO: 285783 - DNA, 25 bp, Mus musculus
gaagaggctcagaacactggggatc

SEQ ID NO: 285784 - DNA, 25 bp, Mus musculus
gaagaggctctccctgaagtcaccc

SEQ ID NO: 285785 - DNA, 25 bp, Mus musculus
gaagaggctgaatgggagccatcga

SEQ ID NO: 285786 - DNA, 25 bp, Mus musculus
gaagaggctgggatcagtacctgtt

SEQ ID NO: 285787 - DNA, 25 bp, Mus musculus
gaagaggctgggctggagaaagagg

SEQ ID NO: 285788 - DNA, 25 bp, Mus musculus
gaagaggcttccaaggctaaggtgg

SEQ ID NO: 285789 - DNA, 25 bp, Mus musculus
gaagagggaggaggaacgctatcaa

SEQ ID NO: 285790 - DNA, 25 bp, Mus musculus
gaagagggcaaatatggttatgtcc

SEQ ID NO: 285791 - DNA, 25 bp, Mus musculus
gaagaggggaagcatccacaaacta

SEQ ID NO: 285792 - DNA, 25 bp, Mus musculus
gaagaggtcaaagaggcgccagctg

SEQ ID NO: 285793 - DNA, 25 bp, Mus musculus
gaagaggtgactgcccctgtcttag

SEQ ID NO: 285794 - DNA, 25 bp, Mus musculus
gaagaggtgattgaggacgcctcat

SEQ ID NO: 285795 - DNA, 25 bp, Mus musculus
gaagaggtgccagctacatcagaag

SEQ ID NO: 285796 - DNA, 25 bp, Mus musculus
gaagaggtggagatcagcagagtgg

SEQ ID NO: 285797 - DNA, 25 bp, Mus musculus
gaagaggtggaggatgacaaaatcc

SEQ ID NO: 285798 - DNA, 25 bp, Mus musculus
gaagaggtggaggccccagtcaaaa

SEQ ID NO: 285799 - DNA, 25 bp, Mus musculus
gaagaggtggcaacgagtctccagt

SEQ ID NO: 285800 - DNA, 25 bp, Mus musculus
gaagaggttgaagagaactctgata

SEQ ID NO: 285801 - DNA, 25 bp, Mus musculus
gaagaggttgaagagatgaaaagaa

SEQ ID NO: 285802 - DNA, 25 bp, Mus musculus
gaagaggttgaagagatttgacatc

SEQ ID NO: 285803 - DNA, 25 bp, Mus musculus
gaagagtacacaatgggtaccccaa

SEQ ID NO: 285804 - DNA, 25 bp, Mus musculus
gaagagtacacagctccttccatcc

SEQ ID NO: 285805 - DNA, 25 bp, Mus musculus
gaagagtacacaggtgtgtgccatc

SEQ ID NO: 285806 - DNA, 25 bp, Mus musculus
gaagagtatacaagattatcctgtc

SEQ ID NO: 285807 - DNA, 25 bp, Mus musculus
gaagagtatacaaggtatcagtact

SEQ ID NO: 285808 - DNA, 25 bp, Mus musculus
gaagagtatatcgcggacctgtact

SEQ ID NO: 285809 - DNA, 25 bp, Mus musculus
gaagagtcaggaaaggaatcccaat

SEQ ID NO: 285810 - DNA, 25 bp, Mus musculus
gaagagtcaggaaaggcacatgaat

SEQ ID NO: 285811 - DNA, 25 bp, Mus musculus
gaagagtcaggaaaggtgccctggg

SEQ ID NO: 285812 - DNA, 25 bp, Mus musculus
gaagagtccacctgggatcatgggc

SEQ ID NO: 285813 - DNA, 25 bp, Mus musculus
gaagagtccagcaagaggaccagag

SEQ ID NO: 285814 - DNA, 25 bp, Mus musculus
gaagagtctccgacgggcactatga

SEQ ID NO: 285815 - DNA, 25 bp, Mus musculus
gaagagtgaatatgttttgcatttt

SEQ ID NO: 285816 - DNA, 25 bp, Mus musculus
gaagagtgaatgaaggctttaacag

SEQ ID NO: 285817 - DNA, 25 bp, Mus musculus
gaagagtgaggtgggccagacatca

SEQ ID NO: 285818 - DNA, 25 bp, Mus musculus
gaagagtgcagatgggatgctttat

SEQ ID NO: 285819 - DNA, 25 bp, Mus musculus
gaagagtgggaagaacttccattac

SEQ ID NO: 285820 - DNA, 25 bp, Mus musculus
gaagagtgtttgctcagtgctggcc

SEQ ID NO: 285821 - DNA, 25 bp, Mus musculus
gaagagttgcgagcgaatacaggag

SEQ ID NO: 285822 - DNA, 25 bp, Mus musculus
gaagagttgcgaggccaggtggttg

SEQ ID NO: 285823 - DNA, 25 bp, Mus musculus
gaagagttggaagcctcgtcttccc

SEQ ID NO: 285824 - DNA, 25 bp, Mus musculus
gaagagttggaaggtcatagaactc

SEQ ID NO: 285825 - DNA, 25 bp, Mus musculus
gaagagttggtccatatatttcttc

SEQ ID NO: 285826 - DNA, 25 bp, Mus musculus
gaagagttggtgaagaaacttgtgg

SEQ ID NO: 285827 - DNA, 25 bp, Mus musculus
gaagagttgtgttagggttttactg

SEQ ID NO: 285828 - DNA, 25 bp, Mus musculus
gaagagtttcctagattgcttcctg

SEQ ID NO: 285829 - DNA, 25 bp, Mus musculus
gaagagtttcctggagaaggaactt

SEQ ID NO: 285830 - DNA, 25 bp, Mus musculus
gaagataaaacagaaagagtaggaa

SEQ ID NO: 285831 - DNA, 25 bp, Mus musculus
gaagataaacagatacagacagaag

SEQ ID NO: 285832 - DNA, 25 bp, Mus musculus
gaagataaacagtgtggcctaccaa

SEQ ID NO: 285833 - DNA, 25 bp, Mus musculus
gaagataaagcgaggctgaaaggaa

SEQ ID NO: 285834 - DNA, 25 bp, Mus musculus
gaagataaagcgagtttcactttca

SEQ ID NO: 285835 - DNA, 25 bp, Mus musculus
gaagataaaggaccctgatgctaag

SEQ ID NO: 285836 - DNA, 25 bp, Mus musculus
gaagataaagtttttggaagctttg

SEQ ID NO: 285837 - DNA, 25 bp, Mus musculus
gaagataaagtttttggtatgctgg

SEQ ID NO: 285838 - DNA, 25 bp, Mus musculus
gaagataacaagactcagattagcc

SEQ ID NO: 285839 - DNA, 25 bp, Mus musculus
gaagataacctaagtaccagcagtg

SEQ ID NO: 285840 - DNA, 25 bp, Mus musculus
gaagataccagagtatacccgcaat

SEQ ID NO: 285841 - DNA, 25 bp, Mus musculus
gaagatacttacagattggccagga

SEQ ID NO: 285842 - DNA, 25 bp, Mus musculus
gaagatacttacagtcacatgtggc

SEQ ID NO: 285843 - DNA, 25 bp, Mus musculus
gaagatagagatctggccgccccgg

SEQ ID NO: 285844 - DNA, 25 bp, Mus musculus
gaagatagcgaaacagagataaact

SEQ ID NO: 285845 - DNA, 25 bp, Mus musculus
gaagatataaaggattctaaggtga

SEQ ID NO: 285846 - DNA, 25 bp, Mus musculus
gaagatatcaaaaagggaatcttac

SEQ ID NO: 285847 - DNA, 25 bp, Mus musculus
gaagatatcaacttgattcgaggaa

SEQ ID NO: 285848 - DNA, 25 bp, Mus musculus
gaagatatctcagcaaagctaccac

SEQ ID NO: 285849 - DNA, 25 bp, Mus musculus
gaagatattaaatgggacctacaca

SEQ ID NO: 285850 - DNA, 25 bp, Mus musculus
gaagatattgacacagcagtccgag

SEQ ID NO: 285851 - DNA, 25 bp, Mus musculus
gaagatattgataaacgccaccgct

SEQ ID NO: 285852 - DNA, 25 bp, Mus musculus
gaagatattgataaagttcaacttc

SEQ ID NO: 285853 - DNA, 25 bp, Mus musculus
gaagatatttcacggacgtcagggc

SEQ ID NO: 285854 - DNA, 25 bp, Mus musculus
gaagatcaagaggtcagggccaaaa

SEQ ID NO: 285855 - DNA, 25 bp, Mus musculus
gaagatcaagatcattgctcctcct

SEQ ID NO: 285856 - DNA, 25 bp, Mus musculus
gaagatcaagcagatgtggatcagc

SEQ ID NO: 285857 - DNA, 25 bp, Mus musculus
gaagatcaaggaacgcatccgaaac

SEQ ID NO: 285858 - DNA, 25 bp, Mus musculus
gaagatcagagatggacagcagcat

SEQ ID NO: 285859 - DNA, 25 bp, Mus musculus
gaagatcagagatgttactctcgtc

SEQ ID NO: 285860 - DNA, 25 bp, Mus musculus
gaagatcatcaagggccactccaga

SEQ ID NO: 285861 - DNA, 25 bp, Mus musculus
gaagatcatgtgagcatcgtggaac

SEQ ID NO: 285862 - DNA, 25 bp, Mus musculus
gaagatcattaaggaacgagaactg

SEQ ID NO: 285863 - DNA, 25 bp, Mus musculus
gaagatccagggcttggaccgcctg

SEQ ID NO: 285864 - DNA, 25 bp, Mus musculus
gaagatccatgaaaagcaagatggg

SEQ ID NO: 285865 - DNA, 25 bp, Mus musculus
gaagatccatgagaaattgttcccc

SEQ ID NO: 285866 - DNA, 25 bp, Mus musculus
gaagatcccctgaaacatgctggtg

SEQ ID NO: 285867 - DNA, 25 bp, Mus musculus
gaagatcccgagaatacgcagacca

SEQ ID NO: 285868 - DNA, 25 bp, Mus musculus
gaagatcctgggggcagtgtatggg

SEQ ID NO: 285869 - DNA, 25 bp, Mus musculus
gaagatcgatgagctttcactctac

SEQ ID NO: 285870 - DNA, 25 bp, Mus musculus
gaagatcgcctgtagcaaagtccga

SEQ ID NO: 285871 - DNA, 25 bp, Mus musculus
gaagatcgtgcccgatgaacgagac

SEQ ID NO: 285872 - DNA, 25 bp, Mus musculus
gaagatctaagtacaccaaatgaaa

SEQ ID NO: 285873 - DNA, 25 bp, Mus musculus
gaagatctagatcccgctcaaggtc

SEQ ID NO: 285874 - DNA, 25 bp, Mus musculus
gaagatctatctaagtaagaagtat

SEQ ID NO: 285875 - DNA, 25 bp, Mus musculus
gaagatctcaaagtgagaaaacaag

SEQ ID NO: 285876 - DNA, 25 bp, Mus musculus
gaagatctcgaaacggtaataagcc

SEQ ID NO: 285877 - DNA, 25 bp, Mus musculus
gaagatctcgaaacttcagaggatg

SEQ ID NO: 285878 - DNA, 25 bp, Mus musculus
gaagatctctacagaggaaggcatt

SEQ ID NO: 285879 - DNA, 25 bp, Mus musculus
gaagatctggcaggccctcagaata

SEQ ID NO: 285880 - DNA, 25 bp, Mus musculus
gaagatctggcaggggactctcctg

SEQ ID NO: 285881 - DNA, 25 bp, Mus musculus
gaagatctgtgacgggtttcgtgct

SEQ ID NO: 285882 - DNA, 25 bp, Mus musculus
gaagatcttctcagtcctagaccaa

SEQ ID NO: 285883 - DNA, 25 bp, Mus musculus
gaagatcttctgattcctgccgttt

SEQ ID NO: 285884 - DNA, 25 bp, Mus musculus
gaagatcttctggcacagcttgccc

SEQ ID NO: 285885 - DNA, 25 bp, Mus musculus
gaagatcttgaagccatgatcaaag

SEQ ID NO: 285886 - DNA, 25 bp, Mus musculus
gaagatcttgaaggataccagaata

SEQ ID NO: 285887 - DNA, 25 bp, Mus musculus
gaagatcttgtggtcaagagcaatc

SEQ ID NO: 285888 - DNA, 25 bp, Mus musculus
gaagatgaaatcaaggttccgtgtt

SEQ ID NO: 285889 - DNA, 25 bp, Mus musculus
gaagatgaaatcaagtatgcaaccc

SEQ ID NO: 285890 - DNA, 25 bp, Mus musculus
gaagatgaaccggaagtatgaagag

SEQ ID NO: 285891 - DNA, 25 bp, Mus musculus
gaagatgaagatgtctggtgagaag

SEQ ID NO: 285892 - DNA, 25 bp, Mus musculus
gaagatgaaggagaaggaggaggta

SEQ ID NO: 285893 - DNA, 25 bp, Mus musculus
gaagatgaaggagagcccatcgcac

SEQ ID NO: 285894 - DNA, 25 bp, Mus musculus
gaagatgaaggtcaaactgggctca

SEQ ID NO: 285895 - DNA, 25 bp, Mus musculus
gaagatgaattacaggaaatgcttg

SEQ ID NO: 285896 - DNA, 25 bp, Mus musculus
gaagatgacacagaccattctttaa

SEQ ID NO: 285897 - DNA, 25 bp, Mus musculus
gaagatgaccaaacgttagaaaagt

SEQ ID NO: 285898 - DNA, 25 bp, Mus musculus
gaagatgagaaaggtcatttactac

SEQ ID NO: 285899 - DNA, 25 bp, Mus musculus
gaagatgagattctgttttgaagtt

SEQ ID NO: 285900 - DNA, 25 bp, Mus musculus
gaagatgagatttctgctttcactt

SEQ ID NO: 285901 - DNA, 25 bp, Mus musculus
gaagatgagtgatgaaaacaacgaa

SEQ ID NO: 285902 - DNA, 25 bp, Mus musculus
gaagatgagtgatgctgcaggtgat

SEQ ID NO: 285903 - DNA, 25 bp, Mus musculus
gaagatgataacacctgctctcatc

SEQ ID NO: 285904 - DNA, 25 bp, Mus musculus
gaagatgataactcctgctctcatc

SEQ ID NO: 285905 - DNA, 25 bp, Mus musculus
gaagatgatccccagtgtttccagg

SEQ ID NO: 285906 - DNA, 25 bp, Mus musculus
gaagatgatcgtcttcaagccttac

SEQ ID NO: 285907 - DNA, 25 bp, Mus musculus
gaagatgatgaaagccctctctata

SEQ ID NO: 285908 - DNA, 25 bp, Mus musculus
gaagatgatgagtctgatgacagtc

SEQ ID NO: 285909 - DNA, 25 bp, Mus musculus
gaagatgatgatgagaagggcaggt

SEQ ID NO: 285910 - DNA, 25 bp, Mus musculus
gaagatgattttggaagttgcttta

SEQ ID NO: 285911 - DNA, 25 bp, Mus musculus
gaagatgcaagatgcagagagaaat

SEQ ID NO: 285912 - DNA, 25 bp, Mus musculus
gaagatgcagaaattgctgcccggg

SEQ ID NO: 285913 - DNA, 25 bp, Mus musculus
gaagatgcagaagacggacaagacg

SEQ ID NO: 285914 - DNA, 25 bp, Mus musculus
gaagatgcagaagtgtatgagagag

SEQ ID NO: 285915 - DNA, 25 bp, Mus musculus
gaagatgcagaagttcctgctttgt

SEQ ID NO: 285916 - DNA, 25 bp, Mus musculus
gaagatgcagctgagaaggtagagg

SEQ ID NO: 285917 - DNA, 25 bp, Mus musculus
gaagatgcaggagaagattcgatga

SEQ ID NO: 285918 - DNA, 25 bp, Mus musculus
gaagatgcccaggaaatagcagaca

SEQ ID NO: 285919 - DNA, 25 bp, Mus musculus
gaagatgcccaggtggctgctgaga

SEQ ID NO: 285920 - DNA, 25 bp, Mus musculus
gaagatgcctggtacggagtcaaat

SEQ ID NO: 285921 - DNA, 25 bp, Mus musculus
gaagatgcgcatgggaggctttgtg

SEQ ID NO: 285922 - DNA, 25 bp, Mus musculus
gaagatgctagaagaatataaaaat

SEQ ID NO: 285923 - DNA, 25 bp, Mus musculus
gaagatgctagaaggtcccttcagc

SEQ ID NO: 285924 - DNA, 25 bp, Mus musculus
gaagatgctaggagttaaccagctt

SEQ ID NO: 285925 - DNA, 25 bp, Mus musculus
gaagatgctagggtaataatcttca

SEQ ID NO: 285926 - DNA, 25 bp, Mus musculus
gaagatgctgcaggcaccagaaagc

SEQ ID NO: 285927 - DNA, 25 bp, Mus musculus
gaagatgctgcaggtctgggaaggc

SEQ ID NO: 285928 - DNA, 25 bp, Mus musculus
gaagatgctgtcagggatggtgaag

SEQ ID NO: 285929 - DNA, 25 bp, Mus musculus
gaagatgcttgagaagatgaggtga

SEQ ID NO: 285930 - DNA, 25 bp, Mus musculus
gaagatggagagcttccctatggct

SEQ ID NO: 285931 - DNA, 25 bp, Mus musculus
gaagatggagatcagccagatgcta

SEQ ID NO: 285932 - DNA, 25 bp, Mus musculus
gaagatggagatggctcttggacaa

SEQ ID NO: 285933 - DNA, 25 bp, Mus musculus
gaagatggaggagctggagtcagat

SEQ ID NO: 285934 - DNA, 25 bp, Mus musculus
gaagatggcagaatagtgattgacg

SEQ ID NO: 285935 - DNA, 25 bp, Mus musculus
gaagatggcgaaattgggaaagaaa

SEQ ID NO: 285936 - DNA, 25 bp, Mus musculus
gaagatggcgaatcaccgcctccga

SEQ ID NO: 285937 - DNA, 25 bp, Mus musculus
gaagatggcgctggcgatggagacc

SEQ ID NO: 285938 - DNA, 25 bp, Mus musculus
gaagatgggagaccgggtgacactg

SEQ ID NO: 285939 - DNA, 25 bp, Mus musculus
gaagatgggattgatgatgattctg

SEQ ID NO: 285940 - DNA, 25 bp, Mus musculus
gaagatggtgcagattccatggaga

SEQ ID NO: 285941 - DNA, 25 bp, Mus musculus
gaagatggtggccagggttttaatg

SEQ ID NO: 285942 - DNA, 25 bp, Mus musculus
gaagatgtacagattttccagggca

SEQ ID NO: 285943 - DNA, 25 bp, Mus musculus
gaagatgtcagttcatatggagaga

SEQ ID NO: 285944 - DNA, 25 bp, Mus musculus
gaagatgtcatttgaagctgaggag

SEQ ID NO: 285945 - DNA, 25 bp, Mus musculus
gaagatgtcatttgggaggactcag

SEQ ID NO: 285946 - DNA, 25 bp, Mus musculus
gaagatgtcggtcaataggcttgat

SEQ ID NO: 285947 - DNA, 25 bp, Mus musculus
gaagatgtgaagatgatcagtgcag

SEQ ID NO: 285948 - DNA, 25 bp, Mus musculus
gaagatgtgcagaaagacgctcctt

SEQ ID NO: 285949 - DNA, 25 bp, Mus musculus
gaagatgtgcaggtcttgcctcagc

SEQ ID NO: 285950 - DNA, 25 bp, Mus musculus
gaagatgtgccagcctgcccccaag

SEQ ID NO: 285951 - DNA, 25 bp, Mus musculus
gaagatgtgtaggggagctgtcccg

SEQ ID NO: 285952 - DNA, 25 bp, Mus musculus
gaagatgttgaaagatgatgccaca

SEQ ID NO: 285953 - DNA, 25 bp, Mus musculus
gaagattaaggacctggagcagaag

SEQ ID NO: 285954 - DNA, 25 bp, Mus musculus
gaagattacaaagtgcgggtcgatg

SEQ ID NO: 285955 - DNA, 25 bp, Mus musculus
gaagattattgatattttcatttct

SEQ ID NO: 285956 - DNA, 25 bp, Mus musculus
gaagattcaggcttgttccccctgt

SEQ ID NO: 285957 - DNA, 25 bp, Mus musculus
gaagattcattattgaagaagttcc

SEQ ID NO: 285958 - DNA, 25 bp, Mus musculus
gaagattccagtcctgcaccgaggc

SEQ ID NO: 285959 - DNA, 25 bp, Mus musculus
gaagattccttaactcatgcagatg

SEQ ID NO: 285960 - DNA, 25 bp, Mus musculus
gaagattccttaactgcaacaagtt

SEQ ID NO: 285961 - DNA, 25 bp, Mus musculus
gaagattcggatccctaccgtggtt

SEQ ID NO: 285962 - DNA, 25 bp, Mus musculus
gaagattcgggcttcagttgtgttt

SEQ ID NO: 285963 - DNA, 25 bp, Mus musculus
gaagattctcagagttctgaacttc

SEQ ID NO: 285964 - DNA, 25 bp, Mus musculus
gaagattcttaagagaatacggacg

SEQ ID NO: 285965 - DNA, 25 bp, Mus musculus
gaagattcttaagagcatggataag

SEQ ID NO: 285966 - DNA, 25 bp, Mus musculus
gaagattgaagccatggctgagcaa

SEQ ID NO: 285967 - DNA, 25 bp, Mus musculus
gaagattgagagccagcgggccatg

SEQ ID NO: 285968 - DNA, 25 bp, Mus musculus
gaagattgaggagaagaaggtggca

SEQ ID NO: 285969 - DNA, 25 bp, Mus musculus
gaagattgatgtcggcagctctgct

SEQ ID NO: 285970 - DNA, 25 bp, Mus musculus
gaagattgcaaagtatggtataagg

SEQ ID NO: 285971 - DNA, 25 bp, Mus musculus
gaagattggccatgtgttcaagcgc

SEQ ID NO: 285972 - DNA, 25 bp, Mus musculus
gaagattgtcaagagcaactgcaat

SEQ ID NO: 285973 - DNA, 25 bp, Mus musculus
gaagattgtcaagatgaaatgtcct

SEQ ID NO: 285974 - DNA, 25 bp, Mus musculus
gaagattgtccagacggctgctctt

SEQ ID NO: 285975 - DNA, 25 bp, Mus musculus
gaagattgttggataaaagcttata

SEQ ID NO: 285976 - DNA, 25 bp, Mus musculus
gaagatttaaaaggtatgggtgaga

SEQ ID NO: 285977 - DNA, 25 bp, Mus musculus
gaagatttagagagttccagtgagt

SEQ ID NO: 285978 - DNA, 25 bp, Mus musculus
gaagatttccagaggataacgaaaa

SEQ ID NO: 285979 - DNA, 25 bp, Mus musculus
gaagatttccgaactgaaagacaac

SEQ ID NO: 285980 - DNA, 25 bp, Mus musculus
gaagattttcttggggacagtgaaa

SEQ ID NO: 285981 - DNA, 25 bp, Mus musculus
gaagattttgagaaggtcatcttgg

SEQ ID NO: 285982 - DNA, 25 bp, Mus musculus
gaagatttttctcagtaccaacaaa

SEQ ID NO: 285983 - DNA, 25 bp, Mus musculus
gaagcaaaaaggcagaagacttatt

SEQ ID NO: 285984 - DNA, 25 bp, Mus musculus
gaagcaaaaaggtctgtctgttact

SEQ ID NO: 285985 - DNA, 25 bp, Mus musculus
gaagcaaaacttttaatccaggtgc

SEQ ID NO: 285986 - DNA, 25 bp, Mus musculus
gaagcaaaagcaggcggaacatgtt

SEQ ID NO: 285987 - DNA, 25 bp, Mus musculus
gaagcaaaagctaaggatgaccaga

SEQ ID NO: 285988 - DNA, 25 bp, Mus musculus
gaagcaaagagaaccaacttcttgt

SEQ ID NO: 285989 - DNA, 25 bp, Mus musculus
gaagcaaagagcgtgctaatgcgcg

SEQ ID NO: 285990 - DNA, 25 bp, Mus musculus
gaagcaaagagggaagaagacatga

SEQ ID NO: 285991 - DNA, 25 bp, Mus musculus
gaagcaaaggaatattttgcagagt

SEQ ID NO: 285992 - DNA, 25 bp, Mus musculus
gaagcaaaggcaaagactctgagca

SEQ ID NO: 285993 - DNA, 25 bp, Mus musculus
gaagcaaattgtggaccgggtcagc

SEQ ID NO: 285994 - DNA, 25 bp, Mus musculus
gaagcaacaaggctgagatggtagt

SEQ ID NO: 285995 - DNA, 25 bp, Mus musculus
gaagcaacagagtggatcacattcc

SEQ ID NO: 285996 - DNA, 25 bp, Mus musculus
gaagcaacaggaggctgatcgaaaa

SEQ ID NO: 285997 - DNA, 25 bp, Mus musculus
gaagcaacaggagtgcaggaggatg

SEQ ID NO: 285998 - DNA, 25 bp, Mus musculus
gaagcaacaggcatgacttgccaag

SEQ ID NO: 285999 - DNA, 25 bp, Mus musculus
gaagcaacccgaagcagaagcaggt

SEQ ID NO: 286000 - DNA, 25 bp, Mus musculus
gaagcaacctccagctctcttccgg

SEQ ID NO: 286001 - DNA, 25 bp, Mus musculus
gaagcaacgatagtatttttgacag

SEQ ID NO: 286002 - DNA, 25 bp, Mus musculus
gaagcaactaagattcctctcgtgg

SEQ ID NO: 286003 - DNA, 25 bp, Mus musculus
gaagcaactaaggttcagagaaaca

SEQ ID NO: 286004 - DNA, 25 bp, Mus musculus
gaagcaagaagaaagagaagcaggg

SEQ ID NO: 286005 - DNA, 25 bp, Mus musculus
gaagcaagaatacaggtatggtttt

SEQ ID NO: 286006 - DNA, 25 bp, Mus musculus
gaagcaagaattaagtcagtggtgc

SEQ ID NO: 286007 - DNA, 25 bp, Mus musculus
gaagcaagacccagatcctctcttc

SEQ ID NO: 286008 - DNA, 25 bp, Mus musculus
gaagcaagacccaggacctgttccg

SEQ ID NO: 286009 - DNA, 25 bp, Mus musculus
gaagcaagaggaagaggagcagaga

SEQ ID NO: 286010 - DNA, 25 bp, Mus musculus
gaagcaagaggttgcagaattcagc

SEQ ID NO: 286011 - DNA, 25 bp, Mus musculus
gaagcaagcatgaatgaagtcttac

SEQ ID NO: 286012 - DNA, 25 bp, Mus musculus
gaagcaagcatgagaaaggctggga

SEQ ID NO: 286013 - DNA, 25 bp, Mus musculus
gaagcaaggacacagggtctcttac

SEQ ID NO: 286014 - DNA, 25 bp, Mus musculus
gaagcaaggtgaaggctcctcggga

SEQ ID NO: 286015 - DNA, 25 bp, Mus musculus
gaagcaagtgtctgaacgagaagaa

SEQ ID NO: 286016 - DNA, 25 bp, Mus musculus
gaagcaatgccagaggagtctaagt

SEQ ID NO: 286017 - DNA, 25 bp, Mus musculus
gaagcaatgccagaggagtctaatg

SEQ ID NO: 286018 - DNA, 25 bp, Mus musculus
gaagcaatgccagagtctgttataa

SEQ ID NO: 286019 - DNA, 25 bp, Mus musculus
gaagcaattgaaatcacagctcccg

SEQ ID NO: 286020 - DNA, 25 bp, Mus musculus
gaagcaattgaaatcagggaagctg

SEQ ID NO: 286021 - DNA, 25 bp, Mus musculus
gaagcacaacagagacacagtgtcg

SEQ ID NO: 286022 - DNA, 25 bp, Mus musculus
gaagcacaactcaagcctaccacca

SEQ ID NO: 286023 - DNA, 25 bp, Mus musculus
gaagcacaactcaaggtgaaatttg

SEQ ID NO: 286024 - DNA, 25 bp, Mus musculus
gaagcacaagaaaaggctgcagaag

SEQ ID NO: 286025 - DNA, 25 bp, Mus musculus
gaagcacacaagcggatgaaggtta

SEQ ID NO: 286026 - DNA, 25 bp, Mus musculus
gaagcacacacagacactggatccc

SEQ ID NO: 286027 - DNA, 25 bp, Mus musculus
gaagcacacacaggggcagttccag

SEQ ID NO: 286028 - DNA, 25 bp, Mus musculus
gaagcacacagatcgcaagtcctac

SEQ ID NO: 286029 - DNA, 25 bp, Mus musculus
gaagcacacaggggtagtgttgccc

SEQ ID NO: 286030 - DNA, 25 bp, Mus musculus
gaagcacacttgttgtttacctgct

SEQ ID NO: 286031 - DNA, 25 bp, Mus musculus
gaagcacagcgtggtcacctccagc

SEQ ID NO: 286032 - DNA, 25 bp, Mus musculus
gaagcacatccagaaggagcttgtg

SEQ ID NO: 286033 - DNA, 25 bp, Mus musculus
gaagcaccaacaaagttattcatgg

SEQ ID NO: 286034 - DNA, 25 bp, Mus musculus
gaagcaccagagggtgtctttaaga

SEQ ID NO: 286035 - DNA, 25 bp, Mus musculus
gaagcaccagaggtctgagttcttc

SEQ ID NO: 286036 - DNA, 25 bp, Mus musculus
gaagcaccagcatcggtgtgtggct

SEQ ID NO: 286037 - DNA, 25 bp, Mus musculus
gaagcaccagctggaggaagagcag

SEQ ID NO: 286038 - DNA, 25 bp, Mus musculus
gaagcaccaggtgaatgggattgcc

SEQ ID NO: 286039 - DNA, 25 bp, Mus musculus
gaagcaccaggtttggaaacagaaa

SEQ ID NO: 286040 - DNA, 25 bp, Mus musculus
gaagcacccagaaggcaagatcctc

SEQ ID NO: 286041 - DNA, 25 bp, Mus musculus
gaagcaccctgaggagcaccactcc

SEQ ID NO: 286042 - DNA, 25 bp, Mus musculus
gaagcacctctccagattcactaaa

SEQ ID NO: 286043 - DNA, 25 bp, Mus musculus
gaagcacctctccagcgttccctgc

SEQ ID NO: 286044 - DNA, 25 bp, Mus musculus
gaagcacctctccagtctctagata

SEQ ID NO: 286045 - DNA, 25 bp, Mus musculus
gaagcacctgccaatgttctctcgg

SEQ ID NO: 286046 - DNA, 25 bp, Mus musculus
gaagcacctgggagagccccccttg

SEQ ID NO: 286047 - DNA, 25 bp, Mus musculus
gaagcaccttggtgaccagaatgga

SEQ ID NO: 286048 - DNA, 25 bp, Mus musculus
gaagcactaacgtttgatccccaga

SEQ ID NO: 286049 - DNA, 25 bp, Mus musculus
gaagcactaactccagaactttcct

SEQ ID NO: 286050 - DNA, 25 bp, Mus musculus
gaagcactacagactgcagttctat

SEQ ID NO: 286051 - DNA, 25 bp, Mus musculus
gaagcactcagcacggcagctgcga

SEQ ID NO: 286052 - DNA, 25 bp, Mus musculus
gaagcactcatccagctcttcttac

SEQ ID NO: 286053 - DNA, 25 bp, Mus musculus
gaagcactccataaactaaagctgc

SEQ ID NO: 286054 - DNA, 25 bp, Mus musculus
gaagcactccatgtgtgtctgaaga

SEQ ID NO: 286055 - DNA, 25 bp, Mus musculus
gaagcactggaggaggcagatgagc

SEQ ID NO: 286056 - DNA, 25 bp, Mus musculus
gaagcactggcaaggggaccaggat

SEQ ID NO: 286057 - DNA, 25 bp, Mus musculus
gaagcacttcaccagtaaaaagcca

SEQ ID NO: 286058 - DNA, 25 bp, Mus musculus
gaagcacttcctgagctttctatcg

SEQ ID NO: 286059 - DNA, 25 bp, Mus musculus
gaagcacttcctgaggatgttgatc

SEQ ID NO: 286060 - DNA, 25 bp, Mus musculus
gaagcagaaaaaaaggtttatgaag

SEQ ID NO: 286061 - DNA, 25 bp, Mus musculus
gaagcagaagactctcttctgcagc

SEQ ID NO: 286062 - DNA, 25 bp, Mus musculus
gaagcagaagaggagagtgataatg

SEQ ID NO: 286063 - DNA, 25 bp, Mus musculus
gaagcagaagaggatcctgggcatg

SEQ ID NO: 286064 - DNA, 25 bp, Mus musculus
gaagcagaagatgccatactccaac

SEQ ID NO: 286065 - DNA, 25 bp, Mus musculus
gaagcagaaggagctaggtggcgag

SEQ ID NO: 286066 - DNA, 25 bp, Mus musculus
gaagcagaaggcttctcagaacctt

SEQ ID NO: 286067 - DNA, 25 bp, Mus musculus
gaagcagaagtcgacagagcacact

SEQ ID NO: 286068 - DNA, 25 bp, Mus musculus
gaagcagaatcgtatcgaattaaag

SEQ ID NO: 286069 - DNA, 25 bp, Mus musculus
gaagcagaatcgttttggatcccag

SEQ ID NO: 286070 - DNA, 25 bp, Mus musculus
gaagcagaccaaggtggaattccca

SEQ ID NO: 286071 - DNA, 25 bp, Mus musculus
gaagcagaccaaggtggaattccct

SEQ ID NO: 286072 - DNA, 25 bp, Mus musculus
gaagcagaccaagttccagaatcta

SEQ ID NO: 286073 - DNA, 25 bp, Mus musculus
gaagcagactgcaggaaactacaac

SEQ ID NO: 286074 - DNA, 25 bp, Mus musculus
gaagcagagaggagaaaaggaggac

SEQ ID NO: 286075 - DNA, 25 bp, Mus musculus
gaagcagaggagttttttgagctca

SEQ ID NO: 286076 - DNA, 25 bp, Mus musculus
gaagcagaggatctctcagcatggc

SEQ ID NO: 286077 - DNA, 25 bp, Mus musculus
gaagcagagggacctgtaccgcccc

SEQ ID NO: 286078 - DNA, 25 bp, Mus musculus
gaagcagagtacaaggtggtaaatc

SEQ ID NO: 286079 - DNA, 25 bp, Mus musculus
gaagcagatccggagtagcccctgg

SEQ ID NO: 286080 - DNA, 25 bp, Mus musculus
gaagcagatcttgaggttacggaaa

SEQ ID NO: 286081 - DNA, 25 bp, Mus musculus
gaagcagatggtctggtgtagccgt

SEQ ID NO: 286082 - DNA, 25 bp, Mus musculus
gaagcagcaaccatgcgtgagtgca

SEQ ID NO: 286083 - DNA, 25 bp, Mus musculus
gaagcagcacgagcgggtattcccc

SEQ ID NO: 286084 - DNA, 25 bp, Mus musculus
gaagcagcagcaaagtctgcatctg

SEQ ID NO: 286085 - DNA, 25 bp, Mus musculus
gaagcagcagcaacctcattgggcg

SEQ ID NO: 286086 - DNA, 25 bp, Mus musculus
gaagcagcgatgggccagggctttg

SEQ ID NO: 286087 - DNA, 25 bp, Mus musculus
gaagcagctaaagactgtttttgtt

SEQ ID NO: 286088 - DNA, 25 bp, Mus musculus
gaagcagctaaagagaggatcacct

SEQ ID NO: 286089 - DNA, 25 bp, Mus musculus
gaagcagctagagcgacagcagttg

SEQ ID NO: 286090 - DNA, 25 bp, Mus musculus
gaagcagctgagcctccccctgcag

SEQ ID NO: 286091 - DNA, 25 bp, Mus musculus
gaagcagctgccagactctgataga

SEQ ID NO: 286092 - DNA, 25 bp, Mus musculus
gaagcagctggaggtggtcaagctg

SEQ ID NO: 286093 - DNA, 25 bp, Mus musculus
gaagcagctggagttgaactttcta

SEQ ID NO: 286094 - DNA, 25 bp, Mus musculus
gaagcaggaaagttccaggggaaca

SEQ ID NO: 286095 - DNA, 25 bp, Mus musculus
gaagcaggaactcaggtggccactc

SEQ ID NO: 286096 - DNA, 25 bp, Mus musculus
gaagcaggaagcaggaagcctgtga

SEQ ID NO: 286097 - DNA, 25 bp, Mus musculus
gaagcaggaagtgtacttgatgtgt

SEQ ID NO: 286098 - DNA, 25 bp, Mus musculus
gaagcaggaatagcctgcacaggtt

SEQ ID NO: 286099 - DNA, 25 bp, Mus musculus
gaagcaggaccagagggtcctcctg

SEQ ID NO: 286100 - DNA, 25 bp, Mus musculus
gaagcaggagtgcactgccccccaa

SEQ ID NO: 286101 - DNA, 25 bp, Mus musculus
gaagcaggcaacagatcagcacggc

SEQ ID NO: 286102 - DNA, 25 bp, Mus musculus
gaagcaggcaaggtatacttgaagg

SEQ ID NO: 286103 - DNA, 25 bp, Mus musculus
gaagcaggcagtgaggccaggttcc

SEQ ID NO: 286104 - DNA, 25 bp, Mus musculus
gaagcagggaacccagggggcaagc

SEQ ID NO: 286105 - DNA, 25 bp, Mus musculus
gaagcagggaagcctggacccccag

SEQ ID NO: 286106 - DNA, 25 bp, Mus musculus
gaagcagggagggcaagctccccac

SEQ ID NO: 286107 - DNA, 25 bp, Mus musculus
gaagcagggaggtaaagcgttcggc

SEQ ID NO: 286108 - DNA, 25 bp, Mus musculus
gaagcagggagtaatgcatgaaatt

SEQ ID NO: 286109 - DNA, 25 bp, Mus musculus
gaagcagggcctgctcaggctgtgg

SEQ ID NO: 286110 - DNA, 25 bp, Mus musculus
gaagcagggtaccgcgagatactac

SEQ ID NO: 286111 - DNA, 25 bp, Mus musculus
gaagcaggtccccaagaagcttaag

SEQ ID NO: 286112 - DNA, 25 bp, Mus musculus
gaagcaggtgaagatgacgatggct

SEQ ID NO: 286113 - DNA, 25 bp, Mus musculus
gaagcagtatgttgatgcaacgtgt

SEQ ID NO: 286114 - DNA, 25 bp, Mus musculus
gaagcagtatgttgatggagatcag

SEQ ID NO: 286115 - DNA, 25 bp, Mus musculus
gaagcagtggctctagtctggccct

SEQ ID NO: 286116 - DNA, 25 bp, Mus musculus
gaagcagtgggtacaaacaaatttg

SEQ ID NO: 286117 - DNA, 25 bp, Mus musculus
gaagcatcaagatgacttacaagat

SEQ ID NO: 286118 - DNA, 25 bp, Mus musculus
gaagcatcagaaaggcaacatgtcg

SEQ ID NO: 286119 - DNA, 25 bp, Mus musculus
gaagcatctttcatgataaaggtga

SEQ ID NO: 286120 - DNA, 25 bp, Mus musculus
gaagcatgccaggcaagaaaaggaa

SEQ ID NO: 286121 - DNA, 25 bp, Mus musculus
gaagcatgcggatccccggatccaa

SEQ ID NO: 286122 - DNA, 25 bp, Mus musculus
gaagcatgcggtttctgatgtctgg

SEQ ID NO: 286123 - DNA, 25 bp, Mus musculus
gaagcatggaagaaaaagagagaga

SEQ ID NO: 286124 - DNA, 25 bp, Mus musculus
gaagcatggaaggatttagacaaga

SEQ ID NO: 286125 - DNA, 25 bp, Mus musculus
gaagcatggaaggtggaaaaaaccc

SEQ ID NO: 286126 - DNA, 25 bp, Mus musculus
gaagcatggccgaccgcattccaga

SEQ ID NO: 286127 - DNA, 25 bp, Mus musculus
gaagcatgggaggaagggagatata

SEQ ID NO: 286128 - DNA, 25 bp, Mus musculus
gaagcatggtgaacgcttctaggga

SEQ ID NO: 286129 - DNA, 25 bp, Mus musculus
gaagcatggtgaacgggacctatta

SEQ ID NO: 286130 - DNA, 25 bp, Mus musculus
gaagcattagcagcattcacagctc

SEQ ID NO: 286131 - DNA, 25 bp, Mus musculus
gaagcattagcagggttggtttccc

SEQ ID NO: 286132 - DNA, 25 bp, Mus musculus
gaagcattctgggggtcaaccggat

SEQ ID NO: 286133 - DNA, 25 bp, Mus musculus
gaagcatttaatgcctcctgcctgt

SEQ ID NO: 286134 - DNA, 25 bp, Mus musculus
gaagccaaaaagaagaagcacttaa

SEQ ID NO: 286135 - DNA, 25 bp, Mus musculus
gaagccaaaaagagcaagaagcgga

SEQ ID NO: 286136 - DNA, 25 bp, Mus musculus
gaagccaagagtgagagtggatcat

SEQ ID NO: 286137 - DNA, 25 bp, Mus musculus
gaagccaagtcccatggcctcgcaa

SEQ ID NO: 286138 - DNA, 25 bp, Mus musculus
gaagccaagttcaagcggtatgaat

SEQ ID NO: 286139 - DNA, 25 bp, Mus musculus
gaagccaagttggcgagaggctcct

SEQ ID NO: 286140 - DNA, 25 bp, Mus musculus
gaagccacacaggttcctttggttt

SEQ ID NO: 286141 - DNA, 25 bp, Mus musculus
gaagccacagccaggatatccctgt

SEQ ID NO: 286142 - DNA, 25 bp, Mus musculus
gaagccacaggaatcctgacctctg

SEQ ID NO: 286143 - DNA, 25 bp, Mus musculus
gaagccaccaaaggagtaacctatc

SEQ ID NO: 286144 - DNA, 25 bp, Mus musculus
gaagccaccaaaggttacagagaat

SEQ ID NO: 286145 - DNA, 25 bp, Mus musculus
gaagccacctccagtcgcagatatg

SEQ ID NO: 286146 - DNA, 25 bp, Mus musculus
gaagccaccttcagaatgaagagga

SEQ ID NO: 286147 - DNA, 25 bp, Mus musculus
gaagccaccttcagtgattttatag

SEQ ID NO: 286148 - DNA, 25 bp, Mus musculus
gaagccacgctatggacgcactgac

SEQ ID NO: 286149 - DNA, 25 bp, Mus musculus
gaagccacgctatgggattccaacc

SEQ ID NO: 286150 - DNA, 25 bp, Mus musculus
gaagccacggatggtctcagcacta

SEQ ID NO: 286151 - DNA, 25 bp, Mus musculus
gaagccacggctttctcagggcctc

SEQ ID NO: 286152 - DNA, 25 bp, Mus musculus
gaagccactgcgtctcttggcctgt

SEQ ID NO: 286153 - DNA, 25 bp, Mus musculus
gaagccactggagaggaactgtccg

SEQ ID NO: 286154 - DNA, 25 bp, Mus musculus
gaagccagaaatggggctggtgtca

SEQ ID NO: 286155 - DNA, 25 bp, Mus musculus
gaagccagacagccccaggatcctc

SEQ ID NO: 286156 - DNA, 25 bp, Mus musculus
gaagccagacagggttgccataccc

SEQ ID NO: 286157 - DNA, 25 bp, Mus musculus
gaagccagaccgagatgccttggat

SEQ ID NO: 286158 - DNA, 25 bp, Mus musculus
gaagccagaccgaggatcaaccatt

SEQ ID NO: 286159 - DNA, 25 bp, Mus musculus
gaagccagagagatgggtgtgattg

SEQ ID NO: 286160 - DNA, 25 bp, Mus musculus
gaagccagagagggtctgcgagctt

SEQ ID NO: 286161 - DNA, 25 bp, Mus musculus
gaagccagagatttaaggcaagaac

SEQ ID NO: 286162 - DNA, 25 bp, Mus musculus
gaagccagagggaggcttcagttgt

SEQ ID NO: 286163 - DNA, 25 bp, Mus musculus
gaagccagaggtacttgatgtgtgc

SEQ ID NO: 286164 - DNA, 25 bp, Mus musculus
gaagccagataaaggatgccccagg

SEQ ID NO: 286165 - DNA, 25 bp, Mus musculus
gaagccagcagggctgtgggacatg

SEQ ID NO: 286166 - DNA, 25 bp, Mus musculus
gaagccagccacaggcccaggcctt

SEQ ID NO: 286167 - DNA, 25 bp, Mus musculus
gaagccagcctgagcgagccagagg

SEQ ID NO: 286168 - DNA, 25 bp, Mus musculus
gaagccagcgtggggaaacctgctc

SEQ ID NO: 286169 - DNA, 25 bp, Mus musculus
gaagccagcgtggggtctgagatcc

SEQ ID NO: 286170 - DNA, 25 bp, Mus musculus
gaagccagctaaaggtatgctaaca

SEQ ID NO: 286171 - DNA, 25 bp, Mus musculus
gaagccaggagattagagtgggcct

SEQ ID NO: 286172 - DNA, 25 bp, Mus musculus
gaagccaggagtgggcctgaggcag

SEQ ID NO: 286173 - DNA, 25 bp, Mus musculus
gaagccagtaaacaaggccagggcc

SEQ ID NO: 286174 - DNA, 25 bp, Mus musculus
gaagccataccggcgaacgcccgtt

SEQ ID NO: 286175 - DNA, 25 bp, Mus musculus
gaagccatacgaattagtcctacat

SEQ ID NO: 286176 - DNA, 25 bp, Mus musculus
gaagccatcagacatattggctgga

SEQ ID NO: 286177 - DNA, 25 bp, Mus musculus
gaagccatgaaaggaacagagtggg

SEQ ID NO: 286178 - DNA, 25 bp, Mus musculus
gaagccatgctgcaggtgctgggcc

SEQ ID NO: 286179 - DNA, 25 bp, Mus musculus
gaagccatggcaggacaaagagaaa

SEQ ID NO: 286180 - DNA, 25 bp, Mus musculus
gaagccatgggactcgtggggaaaa

SEQ ID NO: 286181 - DNA, 25 bp, Mus musculus
gaagccattacaatgtgagatctgt

SEQ ID NO: 286182 - DNA, 25 bp, Mus musculus
gaagcccaagaaataaatcataatg

SEQ ID NO: 286183 - DNA, 25 bp, Mus musculus
gaagcccaagctgcagacggagctg

SEQ ID NO: 286184 - DNA, 25 bp, Mus musculus
gaagcccaaggagggtgtgaagaca

SEQ ID NO: 286185 - DNA, 25 bp, Mus musculus
gaagcccaaggatgatgaaaacaat

SEQ ID NO: 286186 - DNA, 25 bp, Mus musculus
gaagcccacagaaacgcatcccact

SEQ ID NO: 286187 - DNA, 25 bp, Mus musculus
gaagcccacagtccatggagacaac

SEQ ID NO: 286188 - DNA, 25 bp, Mus musculus
gaagcccaccaggccatcatgattg

SEQ ID NO: 286189 - DNA, 25 bp, Mus musculus
gaagcccagaagccctacccatgtc

SEQ ID NO: 286190 - DNA, 25 bp, Mus musculus
gaagcccagaagctgtgattggact

SEQ ID NO: 286191 - DNA, 25 bp, Mus musculus
gaagcccagacgcacgaagctcttt

SEQ ID NO: 286192 - DNA, 25 bp, Mus musculus
gaagcccagcaagattctgtgatga

SEQ ID NO: 286193 - DNA, 25 bp, Mus musculus
gaagcccagcaaggaccgccttcaa

SEQ ID NO: 286194 - DNA, 25 bp, Mus musculus
gaagcccagcagatttggcctggca

SEQ ID NO: 286195 - DNA, 25 bp, Mus musculus
gaagcccagcaggaggagactgcag

SEQ ID NO: 286196 - DNA, 25 bp, Mus musculus
gaagcccagcaggccagtgtgcttt

SEQ ID NO: 286197 - DNA, 25 bp, Mus musculus
gaagcccagcagggcagccaatgaa

SEQ ID NO: 286198 - DNA, 25 bp, Mus musculus
gaagcccagcagtattcggaggccc

SEQ ID NO: 286199 - DNA, 25 bp, Mus musculus
gaagccccaactcaggaatggatac

SEQ ID NO: 286200 - DNA, 25 bp, Mus musculus
gaagccccaactgaggaatggatac

SEQ ID NO: 286201 - DNA, 25 bp, Mus musculus
gaagcccccaagttcctggccttca

SEQ ID NO: 286202 - DNA, 25 bp, Mus musculus
gaagcccccacctagatcaagcact

SEQ ID NO: 286203 - DNA, 25 bp, Mus musculus
gaagcccccacctgaagaaaatgga

SEQ ID NO: 286204 - DNA, 25 bp, Mus musculus
gaagcccccgtccagacactacttt

SEQ ID NO: 286205 - DNA, 25 bp, Mus musculus
gaagccccggccaccatgttcaacc

SEQ ID NO: 286206 - DNA, 25 bp, Mus musculus
gaagcccgcaaaagctccctccaac

SEQ ID NO: 286207 - DNA, 25 bp, Mus musculus
gaagcccggagggatccttttgtgg

SEQ ID NO: 286208 - DNA, 25 bp, Mus musculus
gaagccctacactattaggaaacct

SEQ ID NO: 286209 - DNA, 25 bp, Mus musculus
gaagccctacagaaacctgtgggaa

SEQ ID NO: 286210 - DNA, 25 bp, Mus musculus
gaagccctaccaggggtttctctgt

SEQ ID NO: 286211 - DNA, 25 bp, Mus musculus
gaagccctaccagggtgtgggaaca

SEQ ID NO: 286212 - DNA, 25 bp, Mus musculus
gaagccctagggcagaaaacaaaaa

SEQ ID NO: 286213 - DNA, 25 bp, Mus musculus
gaagccctcgaaggttgcagctcca

SEQ ID NO: 286214 - DNA, 25 bp, Mus musculus
gaagccctcgatgccaattctcgga

SEQ ID NO: 286215 - DNA, 25 bp, Mus musculus
gaagccctgaactatcctccatgtg

SEQ ID NO: 286216 - DNA, 25 bp, Mus musculus
gaagccctgaactgtactctctcta

SEQ ID NO: 286217 - DNA, 25 bp, Mus musculus
gaagccctgaatgttctccctcctg

SEQ ID NO: 286218 - DNA, 25 bp, Mus musculus
gaagccctgaggtcacttggtcgct

SEQ ID NO: 286219 - DNA, 25 bp, Mus musculus
gaagccctgaggtgtggttcccagg

SEQ ID NO: 286220 - DNA, 25 bp, Mus musculus
gaagccctggaggcactggttccag

SEQ ID NO: 286221 - DNA, 25 bp, Mus musculus
gaagccctggctgggggatgggctc

SEQ ID NO: 286222 - DNA, 25 bp, Mus musculus
gaagccctgtgacgaatggcacacg

SEQ ID NO: 286223 - DNA, 25 bp, Mus musculus
gaagcccttaccagcccagctttgc

SEQ ID NO: 286224 - DNA, 25 bp, Mus musculus
gaagcccttcaagagcttctgcagt

SEQ ID NO: 286225 - DNA, 25 bp, Mus musculus
gaagcccttcaaggatatggactat

SEQ ID NO: 286226 - DNA, 25 bp, Mus musculus
gaagcccttcacagctgacattatc

SEQ ID NO: 286227 - DNA, 25 bp, Mus musculus
gaagcccttggtccagaatagcgtt

SEQ ID NO: 286228 - DNA, 25 bp, Mus musculus
gaagccctttatctgacttgttggc

SEQ ID NO: 286229 - DNA, 25 bp, Mus musculus
gaagccctttatctgtgaggtctgc

SEQ ID NO: 286230 - DNA, 25 bp, Mus musculus
gaagccgaaagcgaatattaattaa

SEQ ID NO: 286231 - DNA, 25 bp, Mus musculus
gaagccgactcagatccgtgatgag

SEQ ID NO: 286232 - DNA, 25 bp, Mus musculus
gaagccgcagccagagccacagcca

SEQ ID NO: 286233 - DNA, 25 bp, Mus musculus
gaagccgcgacatggcctcagtgag

SEQ ID NO: 286234 - DNA, 25 bp, Mus musculus
gaagccgcgccatggatttggtgag

SEQ ID NO: 286235 - DNA, 25 bp, Mus musculus
gaagccggaggttgagaacaaaaag

SEQ ID NO: 286236 - DNA, 25 bp, Mus musculus
gaagccggataatgacggcgtggag

SEQ ID NO: 286237 - DNA, 25 bp, Mus musculus
gaagccggataatgtgctagaattt

SEQ ID NO: 286238 - DNA, 25 bp, Mus musculus
gaagccggcctcggtgtggtacatg

SEQ ID NO: 286239 - DNA, 25 bp, Mus musculus
gaagccgtcaccccaaaattttgtg

SEQ ID NO: 286240 - DNA, 25 bp, Mus musculus
gaagcctaaaaagacggcacaaaca

SEQ ID NO: 286241 - DNA, 25 bp, Mus musculus
gaagcctaaaaaggtggtgctgtga

SEQ ID NO: 286242 - DNA, 25 bp, Mus musculus
gaagcctaagaaggcaccgacagcc

SEQ ID NO: 286243 - DNA, 25 bp, Mus musculus
gaagcctaagcctgatttctttatt

SEQ ID NO: 286244 - DNA, 25 bp, Mus musculus
gaagcctaagccttgctcagctcct

SEQ ID NO: 286245 - DNA, 25 bp, Mus musculus
gaagcctaaggatgatgctgttgaa

SEQ ID NO: 286246 - DNA, 25 bp, Mus musculus
gaagcctatccagagaaccattctg

SEQ ID NO: 286247 - DNA, 25 bp, Mus musculus
gaagcctcaggaactcaccccaggg

SEQ ID NO: 286248 - DNA, 25 bp, Mus musculus
gaagcctcaggctgtgggcgctgag

SEQ ID NO: 286249 - DNA, 25 bp, Mus musculus
gaagcctcagtgccactaagcctgg

SEQ ID NO: 286250 - DNA, 25 bp, Mus musculus
gaagcctcatcggaaatttgtatgc

SEQ ID NO: 286251 - DNA, 25 bp, Mus musculus
gaagcctcctcttgtgatgaagctc

SEQ ID NO: 286252 - DNA, 25 bp, Mus musculus
gaagcctcgcaaactatttcaatgg

SEQ ID NO: 286253 - DNA, 25 bp, Mus musculus
gaagcctctccaaggtggcccagct

SEQ ID NO: 286254 - DNA, 25 bp, Mus musculus
gaagcctctgagtcgcttcaaagta

SEQ ID NO: 286255 - DNA, 25 bp, Mus musculus
gaagcctctggaattggaaatgggt

SEQ ID NO: 286256 - DNA, 25 bp, Mus musculus
gaagcctgaaaagatcccaccaaat

SEQ ID NO: 286257 - DNA, 25 bp, Mus musculus
gaagcctgaaggtctccaccagctc

SEQ ID NO: 286258 - DNA, 25 bp, Mus musculus
gaagcctgacgaggggtctccgggc

SEQ ID NO: 286259 - DNA, 25 bp, Mus musculus
gaagcctgagagtgaatgggcaaga

SEQ ID NO: 286260 - DNA, 25 bp, Mus musculus
gaagcctgagagtggtaatcttttg

SEQ ID NO: 286261 - DNA, 25 bp, Mus musculus
gaagcctgctaacaggtgatatttt

SEQ ID NO: 286262 - DNA, 25 bp, Mus musculus
gaagcctgctggtcctacagtggag

SEQ ID NO: 286263 - DNA, 25 bp, Mus musculus
gaagcctggcaagggctactgacag

SEQ ID NO: 286264 - DNA, 25 bp, Mus musculus
gaagcctggggatggtgtgacccca

SEQ ID NO: 286265 - DNA, 25 bp, Mus musculus
gaagccttagaggacgtagagattt

SEQ ID NO: 286266 - DNA, 25 bp, Mus musculus
gaagccttcaaggcgccccccacag

SEQ ID NO: 286267 - DNA, 25 bp, Mus musculus
gaagccttcaaggtgaagtacatgg

SEQ ID NO: 286268 - DNA, 25 bp, Mus musculus
gaagccttcattcaacgtgatgaaa

SEQ ID NO: 286269 - DNA, 25 bp, Mus musculus
gaagccttcattcaagggttttatg

SEQ ID NO: 286270 - DNA, 25 bp, Mus musculus
gaagccttctcaggccagattttag

SEQ ID NO: 286271 - DNA, 25 bp, Mus musculus
gaagccttgataggaccttcgagaa

SEQ ID NO: 286272 - DNA, 25 bp, Mus musculus
gaagccttgataggagctgtttact

SEQ ID NO: 286273 - DNA, 25 bp, Mus musculus
gaagccttggagaaaacagagaaac

SEQ ID NO: 286274 - DNA, 25 bp, Mus musculus
gaagccttgtacaaaggtctctggt

SEQ ID NO: 286275 - DNA, 25 bp, Mus musculus
gaagccttgtacaaaggttggtgtt

SEQ ID NO: 286276 - DNA, 25 bp, Mus musculus
gaagccttgttcaggacgcacccct

SEQ ID NO: 286277 - DNA, 25 bp, Mus musculus
gaagccttgttcagggggagctggt

SEQ ID NO: 286278 - DNA, 25 bp, Mus musculus
gaagcctttcaggatgaagaccttg

SEQ ID NO: 286279 - DNA, 25 bp, Mus musculus
gaagcctttcaggtgcctctcccac

SEQ ID NO: 286280 - DNA, 25 bp, Mus musculus
gaagcctttgcaaaacatggcagaa

SEQ ID NO: 286281 - DNA, 25 bp, Mus musculus
gaagcctttgcaaaagactggctgg

SEQ ID NO: 286282 - DNA, 25 bp, Mus musculus
gaagcctttgcaaaagtgatctgca

SEQ ID NO: 286283 - DNA, 25 bp, Mus musculus
gaagcgaagaataggtgtgatgaat

SEQ ID NO: 286284 - DNA, 25 bp, Mus musculus
gaagcgaatccgaaatgaagcagat

SEQ ID NO: 286285 - DNA, 25 bp, Mus musculus
gaagcgaatccgtgaaatggccaaa

SEQ ID NO: 286286 - DNA, 25 bp, Mus musculus
gaagcgacatctcaggtgtcgttga

SEQ ID NO: 286287 - DNA, 25 bp, Mus musculus
gaagcgacatgcgtactgagcgctt

SEQ ID NO: 286288 - DNA, 25 bp, Mus musculus
gaagcgacatggtaagaatgattga

SEQ ID NO: 286289 - DNA, 25 bp, Mus musculus
gaagcgagaagagaaaaggaacacc

SEQ ID NO: 286290 - DNA, 25 bp, Mus musculus
gaagcgagacagggactctgatggt

SEQ ID NO: 286291 - DNA, 25 bp, Mus musculus
gaagcgagcactcaggagttttggg

SEQ ID NO: 286292 - DNA, 25 bp, Mus musculus
gaagcgaggccgaggttgcttccta

SEQ ID NO: 286293 - DNA, 25 bp, Mus musculus
gaagcgatgaagcagaactgcggac

SEQ ID NO: 286294 - DNA, 25 bp, Mus musculus
gaagcgatgaagcagtatcaggagg

SEQ ID NO: 286295 - DNA, 25 bp, Mus musculus
gaagcgcaacaggtcacctggagga

SEQ ID NO: 286296 - DNA, 25 bp, Mus musculus
gaagcgcaaggtgtcagacaaagaa

SEQ ID NO: 286297 - DNA, 25 bp, Mus musculus
gaagcgcagaaccctgttctgcagg

SEQ ID NO: 286298 - DNA, 25 bp, Mus musculus
gaagcgccacacccccagaggaaat

SEQ ID NO: 286299 - DNA, 25 bp, Mus musculus
gaagcgcgccaagagaaaattcagg

SEQ ID NO: 286300 - DNA, 25 bp, Mus musculus
gaagcgcgccaagagacgaggatgg

SEQ ID NO: 286301 - DNA, 25 bp, Mus musculus
gaagcgctacataaggtatctttcc

SEQ ID NO: 286302 - DNA, 25 bp, Mus musculus
gaagcgctgtcttcgagagaaaagt

SEQ ID NO: 286303 - DNA, 25 bp, Mus musculus
gaagcgctgtcttcggctcttcata

SEQ ID NO: 286304 - DNA, 25 bp, Mus musculus
gaagcggacatcatggagtatgctg

SEQ ID NO: 286305 - DNA, 25 bp, Mus musculus
gaagcggaccgaggacttgtgtgag

SEQ ID NO: 286306 - DNA, 25 bp, Mus musculus
gaagcggagagcaagactggtagtg

SEQ ID NO: 286307 - DNA, 25 bp, Mus musculus
gaagcggaggataggtcggccagtg

SEQ ID NO: 286308 - DNA, 25 bp, Mus musculus
gaagcggagtgttggtaactaaatg

SEQ ID NO: 286309 - DNA, 25 bp, Mus musculus
gaagcggccaaggatccatctgcag

SEQ ID NO: 286310 - DNA, 25 bp, Mus musculus
gaagcggcctgcatgacccgccggg

SEQ ID NO: 286311 - DNA, 25 bp, Mus musculus
gaagcggcggcgggttaacttcggc

SEQ ID NO: 286312 - DNA, 25 bp, Mus musculus
gaagcggcggcgggttggagttcaa

SEQ ID NO: 286313 - DNA, 25 bp, Mus musculus
gaagcggctacaggcggcaggaaat

SEQ ID NO: 286314 - DNA, 25 bp, Mus musculus
gaagcgggaattggtctcggtgtga

SEQ ID NO: 286315 - DNA, 25 bp, Mus musculus
gaagcgggaattggtctgggcgtca

SEQ ID NO: 286316 - DNA, 25 bp, Mus musculus
gaagcgggaattggtcttggagttc

SEQ ID NO: 286317 - DNA, 25 bp, Mus musculus
gaagcgggatctgttctctcagagg

SEQ ID NO: 286318 - DNA, 25 bp, Mus musculus
gaagcgggcagagaggaactaggaa

SEQ ID NO: 286319 - DNA, 25 bp, Mus musculus
gaagcgggcagtcagaaaatgggta

SEQ ID NO: 286320 - DNA, 25 bp, Mus musculus
gaagcggtcttaagaatcaacataa

SEQ ID NO: 286321 - DNA, 25 bp, Mus musculus
gaagcgtatcagcagtgtagtgatt

SEQ ID NO: 286322 - DNA, 25 bp, Mus musculus
gaagcgtctacaaacttcaccaaac

SEQ ID NO: 286323 - DNA, 25 bp, Mus musculus
gaagcgtctacaaagcccggttcct

SEQ ID NO: 286324 - DNA, 25 bp, Mus musculus
gaagcgtttgatgactccggaaagg

SEQ ID NO: 286325 - DNA, 25 bp, Mus musculus
gaagcgtttgcaatcccggaaggac

SEQ ID NO: 286326 - DNA, 25 bp, Mus musculus
gaagcgtttggaggtgccctccaag

SEQ ID NO: 286327 - DNA, 25 bp, Mus musculus
gaagcgtttggctccttccgctcca

SEQ ID NO: 286328 - DNA, 25 bp, Mus musculus
gaagctaaaaatctggccgccccgg

SEQ ID NO: 286329 - DNA, 25 bp, Mus musculus
gaagctaacaatcttggcaaagcgc

SEQ ID NO: 286330 - DNA, 25 bp, Mus musculus
gaagctaaccccccctggtgcacct

SEQ ID NO: 286331 - DNA, 25 bp, Mus musculus
gaagctaacggggaataaaagctgt

SEQ ID NO: 286332 - DNA, 25 bp, Mus musculus
gaagctaagaaactgccaggagtag

SEQ ID NO: 286333 - DNA, 25 bp, Mus musculus
gaagctaatgcagtcccaccccctg

SEQ ID NO: 286334 - DNA, 25 bp, Mus musculus
gaagctacaggactcttccccccac

SEQ ID NO: 286335 - DNA, 25 bp, Mus musculus
gaagctacagggttgaaaaatacag

SEQ ID NO: 286336 - DNA, 25 bp, Mus musculus
gaagctaccaaacgcaagcaccagg

SEQ ID NO: 286337 - DNA, 25 bp, Mus musculus
gaagctactgggccgcgttggcctc

SEQ ID NO: 286338 - DNA, 25 bp, Mus musculus
gaagctagaccaactttgcagagtt

SEQ ID NO: 286339 - DNA, 25 bp, Mus musculus
gaagctaggacctacagactacaag

SEQ ID NO: 286340 - DNA, 25 bp, Mus musculus
gaagctatgaggtaactgtggagaa

SEQ ID NO: 286341 - DNA, 25 bp, Mus musculus
gaagctatgaggtcatggagggaat

SEQ ID NO: 286342 - DNA, 25 bp, Mus musculus
gaagctatggcagaaagccctgcag

SEQ ID NO: 286343 - DNA, 25 bp, Mus musculus
gaagctatggcagagtgctgggatt

SEQ ID NO: 286344 - DNA, 25 bp, Mus musculus
gaagctatggcagctacttaaaatt

SEQ ID NO: 286345 - DNA, 25 bp, Mus musculus
gaagctatggcaggtgattggagtt

SEQ ID NO: 286346 - DNA, 25 bp, Mus musculus
gaagctatggcagtggttttatgaa

SEQ ID NO: 286347 - DNA, 25 bp, Mus musculus
gaagctatggtaaaagtttcatttg

SEQ ID NO: 286348 - DNA, 25 bp, Mus musculus
gaagctatttaacattgaggcttgg

SEQ ID NO: 286349 - DNA, 25 bp, Mus musculus
gaagctcaagacatactttgaagac

SEQ ID NO: 286350 - DNA, 25 bp, Mus musculus
gaagctcaagacatgaagcgccacc

SEQ ID NO: 286351 - DNA, 25 bp, Mus musculus
gaagctcaagatggagaaatggatc

SEQ ID NO: 286352 - DNA, 25 bp, Mus musculus
gaagctcaaggccacttcttactct

SEQ ID NO: 286353 - DNA, 25 bp, Mus musculus
gaagctcaaggttgattctttcaga

SEQ ID NO: 286354 - DNA, 25 bp, Mus musculus
gaagctcaagtccattacaatgctg

SEQ ID NO: 286355 - DNA, 25 bp, Mus musculus
gaagctcagaaacaggcggaaaaac

SEQ ID NO: 286356 - DNA, 25 bp, Mus musculus
gaagctcagagggatcagaaacatc

SEQ ID NO: 286357 - DNA, 25 bp, Mus musculus
gaagctcagccacgggggccgtgaa

SEQ ID NO: 286358 - DNA, 25 bp, Mus musculus
gaagctccaaggcgtctgaatttcc

SEQ ID NO: 286359 - DNA, 25 bp, Mus musculus
gaagctccaggaggcactgaagaaa

SEQ ID NO: 286360 - DNA, 25 bp, Mus musculus
gaagctccaggaggttatttccatg

SEQ ID NO: 286361 - DNA, 25 bp, Mus musculus
gaagctcccagagggaattcctgag

SEQ ID NO: 286362 - DNA, 25 bp, Mus musculus
gaagctccgcccagacggctcagag

SEQ ID NO: 286363 - DNA, 25 bp, Mus musculus
gaagctcctgaagacccagggggca

SEQ ID NO: 286364 - DNA, 25 bp, Mus musculus
gaagctcctgaaggaagaagaactg

SEQ ID NO: 286365 - DNA, 25 bp, Mus musculus
gaagctcctggagcaagaaaagcag

SEQ ID NO: 286366 - DNA, 25 bp, Mus musculus
gaagctcctggcggaggccatgaag

SEQ ID NO: 286367 - DNA, 25 bp, Mus musculus
gaagctcctggcggatgccatgaag

SEQ ID NO: 286368 - DNA, 25 bp, Mus musculus
gaagctcgcaaaggctggcaaaacc

SEQ ID NO: 286369 - DNA, 25 bp, Mus musculus
gaagctcggtcaagggggagtgcag

SEQ ID NO: 286370 - DNA, 25 bp, Mus musculus
gaagctctaccggcttgatctcagt

SEQ ID NO: 286371 - DNA, 25 bp, Mus musculus
gaagctctatgactttgtgaagaca

SEQ ID NO: 286372 - DNA, 25 bp, Mus musculus
gaagctctcatctgaaaataatgat

SEQ ID NO: 286373 - DNA, 25 bp, Mus musculus
gaagctctgcaaggacatccaggca

SEQ ID NO: 286374 - DNA, 25 bp, Mus musculus
gaagctctgttactgccaggcatct

SEQ ID NO: 286375 - DNA, 25 bp, Mus musculus
gaagctctgttactgcccatgaaac

SEQ ID NO: 286376 - DNA, 25 bp, Mus musculus
gaagctgaaaagaagatccagccgc

SEQ ID NO: 286377 - DNA, 25 bp, Mus musculus
gaagctgaaacccagatccttactg

SEQ ID NO: 286378 - DNA, 25 bp, Mus musculus
gaagctgaaagaggtggaagcggca

SEQ ID NO: 286379 - DNA, 25 bp, Mus musculus
gaagctgaaccaagtctgtgatgag

SEQ ID NO: 286380 - DNA, 25 bp, Mus musculus
gaagctgaaccacaggaattcaaac

SEQ ID NO: 286381 - DNA, 25 bp, Mus musculus
gaagctgaaccacaggatgtgaact

SEQ ID NO: 286382 - DNA, 25 bp, Mus musculus
gaagctgaagcctgcaggtctccac

SEQ ID NO: 286383 - DNA, 25 bp, Mus musculus
gaagctgaaggcatcatagacacgc

SEQ ID NO: 286384 - DNA, 25 bp, Mus musculus
gaagctgaagttcggttcctgtgtg

SEQ ID NO: 286385 - DNA, 25 bp, Mus musculus
gaagctgaatataaactgtcattat

SEQ ID NO: 286386 - DNA, 25 bp, Mus musculus
gaagctgacgaggaaggggaagaag

SEQ ID NO: 286387 - DNA, 25 bp, Mus musculus
gaagctgacgagggttatcagctct

SEQ ID NO: 286388 - DNA, 25 bp, Mus musculus
gaagctgagagcactctgtggaggg

SEQ ID NO: 286389 - DNA, 25 bp, Mus musculus
gaagctgagcagaaaggcgctctaa

SEQ ID NO: 286390 - DNA, 25 bp, Mus musculus
gaagctgagcaggcggaggaagaag

SEQ ID NO: 286391 - DNA, 25 bp, Mus musculus
gaagctgaggaggtcataacttcct

SEQ ID NO: 286392 - DNA, 25 bp, Mus musculus
gaagctgatcaaggtcttggataaa

SEQ ID NO: 286393 - DNA, 25 bp, Mus musculus
gaagctgatcaggctctaagggatg

SEQ ID NO: 286394 - DNA, 25 bp, Mus musculus
gaagctgatgccagtcattgcattc

SEQ ID NO: 286395 - DNA, 25 bp, Mus musculus
gaagctgatgccagtcattgtatac

SEQ ID NO: 286396 - DNA, 25 bp, Mus musculus
gaagctgatgtcattctcccatgtg

SEQ ID NO: 286397 - DNA, 25 bp, Mus musculus
gaagctgcaggagtggcatctccca

SEQ ID NO: 286398 - DNA, 25 bp, Mus musculus
gaagctgccaaccaggactgggcaa

SEQ ID NO: 286399 - DNA, 25 bp, Mus musculus
gaagctgccaaccagttgtctaatg

SEQ ID NO: 286400 - DNA, 25 bp, Mus musculus
gaagctgcccagaaggagtcgaaag

SEQ ID NO: 286401 - DNA, 25 bp, Mus musculus
gaagctgcctaccagatatgaaaga

SEQ ID NO: 286402 - DNA, 25 bp, Mus musculus
gaagctgcggcccaccaggacctcc

SEQ ID NO: 286403 - DNA, 25 bp, Mus musculus
gaagctgctagagcactgggaaaac

SEQ ID NO: 286404 - DNA, 25 bp, Mus musculus
gaagctgctatgcgtttctaatgtg

SEQ ID NO: 286405 - DNA, 25 bp, Mus musculus
gaagctgctgaggctcacaactcag

SEQ ID NO: 286406 - DNA, 25 bp, Mus musculus
gaagctgctgagggccttgcgggtg

SEQ ID NO: 286407 - DNA, 25 bp, Mus musculus
gaagctgctgatgaaccacgccttc

SEQ ID NO: 286408 - DNA, 25 bp, Mus musculus
gaagctgctgatggtcgacacccgc

SEQ ID NO: 286409 - DNA, 25 bp, Mus musculus
gaagctgctgcagccctgccagttt

SEQ ID NO: 286410 - DNA, 25 bp, Mus musculus
gaagctgctggcagaagctggaatg

SEQ ID NO: 286411 - DNA, 25 bp, Mus musculus
gaagctgctgggcaccaagccaaag

SEQ ID NO: 286412 - DNA, 25 bp, Mus musculus
gaagctgctgggccctaatgctggc

SEQ ID NO: 286413 - DNA, 25 bp, Mus musculus
gaagctggaaatggaaccagtgacc

SEQ ID NO: 286414 - DNA, 25 bp, Mus musculus
gaagctggagatcaggattgacttg

SEQ ID NO: 286415 - DNA, 25 bp, Mus musculus
gaagctggagcagcttgaacttgag

SEQ ID NO: 286416 - DNA, 25 bp, Mus musculus
gaagctggagcaggaaagatctata

SEQ ID NO: 286417 - DNA, 25 bp, Mus musculus
gaagctggaggaggccaagcacatt

SEQ ID NO: 286418 - DNA, 25 bp, Mus musculus
gaagctggagggaagaagaagaccg

SEQ ID NO: 286419 - DNA, 25 bp, Mus musculus
gaagctggatagaaggaagcaggcc

SEQ ID NO: 286420 - DNA, 25 bp, Mus musculus
gaagctggctctctgaacccccaca

SEQ ID NO: 286421 - DNA, 25 bp, Mus musculus
gaagctggtatgttgccagatggat

SEQ ID NO: 286422 - DNA, 25 bp, Mus musculus
gaagctggtcaagggtctagagaca

SEQ ID NO: 286423 - DNA, 25 bp, Mus musculus
gaagctggtgagaagaacagcagtg

SEQ ID NO: 286424 - DNA, 25 bp, Mus musculus
gaagctggtgtggatggagaggtcc

SEQ ID NO: 286425 - DNA, 25 bp, Mus musculus
gaagctgtaaagaggatagtgccat

SEQ ID NO: 286426 - DNA, 25 bp, Mus musculus
gaagctgtagtgcagttgaacactg

SEQ ID NO: 286427 - DNA, 25 bp, Mus musculus
gaagctgtagtgccaactactcaaa

SEQ ID NO: 286428 - DNA, 25 bp, Mus musculus
gaagctgtcacccatatggcccaca

SEQ ID NO: 286429 - DNA, 25 bp, Mus musculus
gaagctgtcacccatggtccgactt

SEQ ID NO: 286430 - DNA, 25 bp, Mus musculus
gaagctgtcagcattctgcctacat

SEQ ID NO: 286431 - DNA, 25 bp, Mus musculus
gaagctgtcagtgggtttcaccagc

SEQ ID NO: 286432 - DNA, 25 bp, Mus musculus
gaagctgtcagttctgagaagtcag

SEQ ID NO: 286433 - DNA, 25 bp, Mus musculus
gaagctgtggctataatgtgcaaga

SEQ ID NO: 286434 - DNA, 25 bp, Mus musculus
gaagcttattgtggggcatgaagga

SEQ ID NO: 286435 - DNA, 25 bp, Mus musculus
gaagcttcagattataccgaaaaga

SEQ ID NO: 286436 - DNA, 25 bp, Mus musculus
gaagcttcagcgacagcagtctcca

SEQ ID NO: 286437 - DNA, 25 bp, Mus musculus
gaagcttcaggctatgtctttcaga

SEQ ID NO: 286438 - DNA, 25 bp, Mus musculus
gaagcttccaagtatgaggatgaaa

SEQ ID NO: 286439 - DNA, 25 bp, Mus musculus
gaagcttcgagcagcagtttttact

SEQ ID NO: 286440 - DNA, 25 bp, Mus musculus
gaagcttctccaagactctaaaaaa

SEQ ID NO: 286441 - DNA, 25 bp, Mus musculus
gaagcttctccaagaggctactgaa

SEQ ID NO: 286442 - DNA, 25 bp, Mus musculus
gaagcttctggaggctctttcacac

SEQ ID NO: 286443 - DNA, 25 bp, Mus musculus
gaagcttgccagggcaagaaataca

SEQ ID NO: 286444 - DNA, 25 bp, Mus musculus
gaagcttgctcaggatggctgcagc

SEQ ID NO: 286445 - DNA, 25 bp, Mus musculus
gaagcttgctcaggctcctcggatt

SEQ ID NO: 286446 - DNA, 25 bp, Mus musculus
gaagcttggagaagggtcttatgga

SEQ ID NO: 286447 - DNA, 25 bp, Mus musculus
gaagctttcaaagccattggcacag

SEQ ID NO: 286448 - DNA, 25 bp, Mus musculus
gaagctttcaccaaccaatcaaagt

SEQ ID NO: 286449 - DNA, 25 bp, Mus musculus
gaagctttcaccaagtgtggattcg

SEQ ID NO: 286450 - DNA, 25 bp, Mus musculus
gaagctttgcagatctgaacgatgc

SEQ ID NO: 286451 - DNA, 25 bp, Mus musculus
gaagcttttagtacagagtcttgct

SEQ ID NO: 286452 - DNA, 25 bp, Mus musculus
gaagcttttagtgccaaagcctcac

SEQ ID NO: 286453 - DNA, 25 bp, Mus musculus
gaagcttttagtgttgtaggaagtg

SEQ ID NO: 286454 - DNA, 25 bp, Mus musculus
gaagcttttcttctggcggcatcgc

SEQ ID NO: 286455 - DNA, 25 bp, Mus musculus
gaaggaaaaccaggcacgcatcgag

SEQ ID NO: 286456 - DNA, 25 bp, Mus musculus
gaaggaaaagaatctgcaggcacac

SEQ ID NO: 286457 - DNA, 25 bp, Mus musculus
gaaggaaaagaatgtggagaagaaa

SEQ ID NO: 286458 - DNA, 25 bp, Mus musculus
gaaggaaaagaggccttggaagatc

SEQ ID NO: 286459 - DNA, 25 bp, Mus musculus
gaaggaaaaggaaacacaacctatc

SEQ ID NO: 286460 - DNA, 25 bp, Mus musculus
gaaggaaaaggtagagcagatcctg

SEQ ID NO: 286461 - DNA, 25 bp, Mus musculus
gaaggaaaagtatgatacagacttt

SEQ ID NO: 286462 - DNA, 25 bp, Mus musculus
gaaggaaacagttcagggcgacagc

SEQ ID NO: 286463 - DNA, 25 bp, Mus musculus
gaaggaaagaaaagggctgaagaag

SEQ ID NO: 286464 - DNA, 25 bp, Mus musculus
gaaggaaataaaatggttatgtcct

SEQ ID NO: 286465 - DNA, 25 bp, Mus musculus
gaaggaaattcgcagggctatgtgc

SEQ ID NO: 286466 - DNA, 25 bp, Mus musculus
gaaggaacaaataagacggttagca

SEQ ID NO: 286467 - DNA, 25 bp, Mus musculus
gaaggaacaaataagcctggggaac

SEQ ID NO: 286468 - DNA, 25 bp, Mus musculus
gaaggaacaaggtctgcaaacagca

SEQ ID NO: 286469 - DNA, 25 bp, Mus musculus
gaaggaacataaacaaggcataatc

SEQ ID NO: 286470 - DNA, 25 bp, Mus musculus
gaaggaacataaacagtctgatgaa

SEQ ID NO: 286471 - DNA, 25 bp, Mus musculus
gaaggaacatgtttccagagtgtgg

SEQ ID NO: 286472 - DNA, 25 bp, Mus musculus
gaaggaacggaggaagatgacagcg

SEQ ID NO: 286473 - DNA, 25 bp, Mus musculus
gaaggaacgtcccggagcttggcca

SEQ ID NO: 286474 - DNA, 25 bp, Mus musculus
gaaggaagaactaggctcctacgcg

SEQ ID NO: 286475 - DNA, 25 bp, Mus musculus
gaaggaagaactgactcagatttca

SEQ ID NO: 286476 - DNA, 25 bp, Mus musculus
gaaggaagaagaaaagacaccgaag

SEQ ID NO: 286477 - DNA, 25 bp, Mus musculus
gaaggaagaagaggaaaggattttg

SEQ ID NO: 286478 - DNA, 25 bp, Mus musculus
gaaggaagacagtgatgaggatgaa

SEQ ID NO: 286479 - DNA, 25 bp, Mus musculus
gaaggaagagctgggagagttcaga

SEQ ID NO: 286480 - DNA, 25 bp, Mus musculus
gaaggaagaggggatatgtggtaca

SEQ ID NO: 286481 - DNA, 25 bp, Mus musculus
gaaggaagagggtaaactggtgcag

SEQ ID NO: 286482 - DNA, 25 bp, Mus musculus
gaaggaagaggtgggagagttcaga

SEQ ID NO: 286483 - DNA, 25 bp, Mus musculus
gaaggaagaggtttatgggactgtc

SEQ ID NO: 286484 - DNA, 25 bp, Mus musculus
gaaggaagataaagccatcccgatg

SEQ ID NO: 286485 - DNA, 25 bp, Mus musculus
gaaggaagatacatgttgtcaggtg

SEQ ID NO: 286486 - DNA, 25 bp, Mus musculus
gaaggaagattgatgtcggcagctc

SEQ ID NO: 286487 - DNA, 25 bp, Mus musculus
gaaggaagcaggaggtgactttggc

SEQ ID NO: 286488 - DNA, 25 bp, Mus musculus
gaaggaagggaggtgcatggagact

SEQ ID NO: 286489 - DNA, 25 bp, Mus musculus
gaaggaagtggaggcagagttcctc

SEQ ID NO: 286490 - DNA, 25 bp, Mus musculus
gaaggaagtggaggtggaggaatgt

SEQ ID NO: 286491 - DNA, 25 bp, Mus musculus
gaaggaatacgtgctgcccagtttt

SEQ ID NO: 286492 - DNA, 25 bp, Mus musculus
gaaggaataggcgaggacgcggacc

SEQ ID NO: 286493 - DNA, 25 bp, Mus musculus
gaaggaatccaacgatgcagatctt

SEQ ID NO: 286494 - DNA, 25 bp, Mus musculus
gaaggaatcctgaggctccagccag

SEQ ID NO: 286495 - DNA, 25 bp, Mus musculus
gaaggaatgccaaccaggcagcggg

SEQ ID NO: 286496 - DNA, 25 bp, Mus musculus
gaaggaatgccccaaagcaaaatca

SEQ ID NO: 286497 - DNA, 25 bp, Mus musculus
gaaggaatgcggcctccttccctgg

SEQ ID NO: 286498 - DNA, 25 bp, Mus musculus
gaaggaatgggagaatgaaggggga

SEQ ID NO: 286499 - DNA, 25 bp, Mus musculus
gaaggaatgggagacgtacgcagca

SEQ ID NO: 286500 - DNA, 25 bp, Mus musculus
gaaggaattacagccgaagaagcag

SEQ ID NO: 286501 - DNA, 25 bp, Mus musculus
gaaggacaaaatggcagtggcagcc

SEQ ID NO: 286502 - DNA, 25 bp, Mus musculus
gaaggacaagataaacttgatggga

SEQ ID NO: 286503 - DNA, 25 bp, Mus musculus
gaaggacaagatatatctcacagac

SEQ ID NO: 286504 - DNA, 25 bp, Mus musculus
gaaggacaagatgtatatcacttgt

SEQ ID NO: 286505 - DNA, 25 bp, Mus musculus
gaaggacaaggttgttgacctcctg

SEQ ID NO: 286506 - DNA, 25 bp, Mus musculus
gaaggacaatgaggatggcagtacc

SEQ ID NO: 286507 - DNA, 25 bp, Mus musculus
gaaggacaccttaggtattggaaaa

SEQ ID NO: 286508 - DNA, 25 bp, Mus musculus
gaaggacacgcatggggtgtgattt

SEQ ID NO: 286509 - DNA, 25 bp, Mus musculus
gaaggacactggcagcagggcagtt

SEQ ID NO: 286510 - DNA, 25 bp, Mus musculus
gaaggacagtaaaggaggcagcccg

SEQ ID NO: 286511 - DNA, 25 bp, Mus musculus
gaaggacagtcactcggaggcttac

SEQ ID NO: 286512 - DNA, 25 bp, Mus musculus
gaaggacatagtttcaggcaccagt

SEQ ID NO: 286513 - DNA, 25 bp, Mus musculus
gaaggaccagctaaccctgagggtg

SEQ ID NO: 286514 - DNA, 25 bp, Mus musculus
gaaggaccaggacaaaggccttcat

SEQ ID NO: 286515 - DNA, 25 bp, Mus musculus
gaaggaccatgcaggttcgcaacgt

SEQ ID NO: 286516 - DNA, 25 bp, Mus musculus
gaaggacccggagggttgctatcgg

SEQ ID NO: 286517 - DNA, 25 bp, Mus musculus
gaaggacctaagctgcagaatcgag

SEQ ID NO: 286518 - DNA, 25 bp, Mus musculus
gaaggacgatgatgtttgtgatcct

SEQ ID NO: 286519 - DNA, 25 bp, Mus musculus
gaaggacgcgctatgaagtcttaca

SEQ ID NO: 286520 - DNA, 25 bp, Mus musculus
gaaggacgggcagtaccaggcggct

SEQ ID NO: 286521 - DNA, 25 bp, Mus musculus
gaaggacgggctctccctacggact

SEQ ID NO: 286522 - DNA, 25 bp, Mus musculus
gaaggacgggggatggtggacagat

SEQ ID NO: 286523 - DNA, 25 bp, Mus musculus
gaaggacgtgccaagcccagcacta

SEQ ID NO: 286524 - DNA, 25 bp, Mus musculus
gaaggactcagatacctgatggcgc

SEQ ID NO: 286525 - DNA, 25 bp, Mus musculus
gaaggactcaggctcaaaatggaaa

SEQ ID NO: 286526 - DNA, 25 bp, Mus musculus
gaaggactctgatggtgatggccga

SEQ ID NO: 286527 - DNA, 25 bp, Mus musculus
gaaggactgaccaggttccccagga

SEQ ID NO: 286528 - DNA, 25 bp, Mus musculus
gaaggactgctaagtcttcagcaaa

SEQ ID NO: 286529 - DNA, 25 bp, Mus musculus
gaaggactgggagagaaatatccac

SEQ ID NO: 286530 - DNA, 25 bp, Mus musculus
gaaggactgggagagggtgttacgt

SEQ ID NO: 286531 - DNA, 25 bp, Mus musculus
gaaggacttccggattaagcaatgc

SEQ ID NO: 286532 - DNA, 25 bp, Mus musculus
gaaggacttgaggaacttcctgtag

SEQ ID NO: 286533 - DNA, 25 bp, Mus musculus
gaaggactttatggtagcttttccc

SEQ ID NO: 286534 - DNA, 25 bp, Mus musculus
gaaggactttatggtctttagtagc

SEQ ID NO: 286535 - DNA, 25 bp, Mus musculus
gaaggactttgggattttcagaaag

SEQ ID NO: 286536 - DNA, 25 bp, Mus musculus
gaaggagaaacacagcttttcttct

SEQ ID NO: 286537 - DNA, 25 bp, Mus musculus
gaaggagaaacacaggtggaaaagg

SEQ ID NO: 286538 - DNA, 25 bp, Mus musculus
gaaggagaaaggcgccctggctctg

SEQ ID NO: 286539 - DNA, 25 bp, Mus musculus
gaaggagaaaggcgctgacttcctg

SEQ ID NO: 286540 - DNA, 25 bp, Mus musculus
gaaggagaacagcaaacctctgaag

SEQ ID NO: 286541 - DNA, 25 bp, Mus musculus
gaaggagaacgggaggctgccggcg

SEQ ID NO: 286542 - DNA, 25 bp, Mus musculus
gaaggagaagaataccaggaaaaac

SEQ ID NO: 286543 - DNA, 25 bp, Mus musculus
gaaggagaaggaaagcggtacaacc

SEQ ID NO: 286544 - DNA, 25 bp, Mus musculus
gaaggagaaggtctcaggagctatg

SEQ ID NO: 286545 - DNA, 25 bp, Mus musculus
gaaggagacaatcccagacattgat

SEQ ID NO: 286546 - DNA, 25 bp, Mus musculus
gaaggagacagcgaggtggattaag

SEQ ID NO: 286547 - DNA, 25 bp, Mus musculus
gaaggagacaggagtcatccagggc

SEQ ID NO: 286548 - DNA, 25 bp, Mus musculus
gaaggagaccagaaggactccatga

SEQ ID NO: 286549 - DNA, 25 bp, Mus musculus
gaaggagaccagagcctcagcttaa

SEQ ID NO: 286550 - DNA, 25 bp, Mus musculus
gaaggagactgaaggccttcggatg

SEQ ID NO: 286551 - DNA, 25 bp, Mus musculus
gaaggagactgaaggtgctgggggg

SEQ ID NO: 286552 - DNA, 25 bp, Mus musculus
gaaggagactggctgtgcttgccat

SEQ ID NO: 286553 - DNA, 25 bp, Mus musculus
gaaggagactggcttttcagtttcc

SEQ ID NO: 286554 - DNA, 25 bp, Mus musculus
gaaggagactggcttttcccacagt

SEQ ID NO: 286555 - DNA, 25 bp, Mus musculus
gaaggagagagccatcattgacatg

SEQ ID NO: 286556 - DNA, 25 bp, Mus musculus
gaaggagagcacagcgttgaatctg

SEQ ID NO: 286557 - DNA, 25 bp, Mus musculus
gaaggagagggaagtccagcggtgg

SEQ ID NO: 286558 - DNA, 25 bp, Mus musculus
gaaggagataaaaggacggactgtg

SEQ ID NO: 286559 - DNA, 25 bp, Mus musculus
gaaggagataacaggacggactgtg

SEQ ID NO: 286560 - DNA, 25 bp, Mus musculus
gaaggagatgaagaaatccatgcga

SEQ ID NO: 286561 - DNA, 25 bp, Mus musculus
gaaggagatgaagggttggtgaaat

SEQ ID NO: 286562 - DNA, 25 bp, Mus musculus
gaaggagatggaggcaaccaaactg

SEQ ID NO: 286563 - DNA, 25 bp, Mus musculus
gaaggagatggattctgatgcaatc

SEQ ID NO: 286564 - DNA, 25 bp, Mus musculus
gaaggagatggcaattccggtctta

SEQ ID NO: 286565 - DNA, 25 bp, Mus musculus
gaaggagattgagaagtggatgact

SEQ ID NO: 286566 - DNA, 25 bp, Mus musculus
gaaggagattgagaagtttctagat

SEQ ID NO: 286567 - DNA, 25 bp, Mus musculus
gaaggagcagcaagctggggcttgt

SEQ ID NO: 286568 - DNA, 25 bp, Mus musculus
gaaggagcagctgcccagagcataa

SEQ ID NO: 286569 - DNA, 25 bp, Mus musculus
gaaggagcaggagccgctcccgttc

SEQ ID NO: 286570 - DNA, 25 bp, Mus musculus
gaaggagcaggcctggcagaaccca

SEQ ID NO: 286571 - DNA, 25 bp, Mus musculus
gaaggagcaggttgatatgtcagac

SEQ ID NO: 286572 - DNA, 25 bp, Mus musculus
gaaggagcagtctcatggagccaga

SEQ ID NO: 286573 - DNA, 25 bp, Mus musculus
gaaggagcatcagaatttcagatga

SEQ ID NO: 286574 - DNA, 25 bp, Mus musculus
gaaggagcatcagattccagaattt

SEQ ID NO: 286575 - DNA, 25 bp, Mus musculus
gaaggagccccgcagggccagttcc

SEQ ID NO: 286576 - DNA, 25 bp, Mus musculus
gaaggagccgctggcttacagggtt

SEQ ID NO: 286577 - DNA, 25 bp, Mus musculus
gaaggagcctaaggaaccacgggaa

SEQ ID NO: 286578 - DNA, 25 bp, Mus musculus
gaaggagcggacgtgacgtatgact

SEQ ID NO: 286579 - DNA, 25 bp, Mus musculus
gaaggagcgggcaggatcctcttcg

SEQ ID NO: 286580 - DNA, 25 bp, Mus musculus
gaaggagcgggcaggggcctccctg

SEQ ID NO: 286581 - DNA, 25 bp, Mus musculus
gaaggagctaggatgaacagcaact

SEQ ID NO: 286582 - DNA, 25 bp, Mus musculus
gaaggagctagtgacattcattttt

SEQ ID NO: 286583 - DNA, 25 bp, Mus musculus
gaaggagctcagaaggagtgaaaag

SEQ ID NO: 286584 - DNA, 25 bp, Mus musculus
gaaggagctgactggccaatcacaa

SEQ ID NO: 286585 - DNA, 25 bp, Mus musculus
gaaggagctgaggtgggctggtatg

SEQ ID NO: 286586 - DNA, 25 bp, Mus musculus
gaaggagctgatcgaagcgttgcaa

SEQ ID NO: 286587 - DNA, 25 bp, Mus musculus
gaaggagctgccaaggcggcaactt

SEQ ID NO: 286588 - DNA, 25 bp, Mus musculus
gaaggagctggtacagacttacgtt

SEQ ID NO: 286589 - DNA, 25 bp, Mus musculus
gaaggagcttgctaatgacggtgca

SEQ ID NO: 286590 - DNA, 25 bp, Mus musculus
gaaggaggaagagagacgggtccag

SEQ ID NO: 286591 - DNA, 25 bp, Mus musculus
gaaggaggaagaggaggacgagaag

SEQ ID NO: 286592 - DNA, 25 bp, Mus musculus
gaaggaggacagcagtaccagcgct

SEQ ID NO: 286593 - DNA, 25 bp, Mus musculus
gaaggaggacattttccgtagattt

SEQ ID NO: 286594 - DNA, 25 bp, Mus musculus
gaaggaggacgaggatataaatgct

SEQ ID NO: 286595 - DNA, 25 bp, Mus musculus
gaaggaggagagatactgttatctg

SEQ ID NO: 286596 - DNA, 25 bp, Mus musculus
gaaggaggagagcaataaactggtc

SEQ ID NO: 286597 - DNA, 25 bp, Mus musculus
gaaggaggagagcaccaatggaaca

SEQ ID NO: 286598 - DNA, 25 bp, Mus musculus
gaaggaggagaggctgtgacctctc

SEQ ID NO: 286599 - DNA, 25 bp, Mus musculus
gaaggaggagagttgctcttctgga

SEQ ID NO: 286600 - DNA, 25 bp, Mus musculus
gaaggaggaggcagagcgcccgctg

SEQ ID NO: 286601 - DNA, 25 bp, Mus musculus
gaaggaggaggccgaagaagcactt

SEQ ID NO: 286602 - DNA, 25 bp, Mus musculus
gaaggaggaggttggaagtcggatt

SEQ ID NO: 286603 - DNA, 25 bp, Mus musculus
gaaggaggattattaattggaggct

SEQ ID NO: 286604 - DNA, 25 bp, Mus musculus
gaaggaggattctgataatcagcct

SEQ ID NO: 286605 - DNA, 25 bp, Mus musculus
gaaggaggcagtgttttgtcaagtt

SEQ ID NO: 286606 - DNA, 25 bp, Mus musculus
gaaggaggccaagcctttcatcacc

SEQ ID NO: 286607 - DNA, 25 bp, Mus musculus
gaaggagggcagaatctagatcttg

SEQ ID NO: 286608 - DNA, 25 bp, Mus musculus
gaaggagggggagctcaactaagca

SEQ ID NO: 286609 - DNA, 25 bp, Mus musculus
gaaggaggggttccccatcacagcc

SEQ ID NO: 286610 - DNA, 25 bp, Mus musculus
gaaggaggtgaagcccaggacccag

SEQ ID NO: 286611 - DNA, 25 bp, Mus musculus
gaaggaggtgaagtatttaggtcag

SEQ ID NO: 286612 - DNA, 25 bp, Mus musculus
gaaggagtacgaggagattatgcgg

SEQ ID NO: 286613 - DNA, 25 bp, Mus musculus
gaaggagtaggccctgtattggaaa

SEQ ID NO: 286614 - DNA, 25 bp, Mus musculus
gaaggagtattcatggctgctcgct

SEQ ID NO: 286615 - DNA, 25 bp, Mus musculus
gaaggagtccatggcaacgggcagc

SEQ ID NO: 286616 - DNA, 25 bp, Mus musculus
gaaggagtgccaaggccggcagagg

SEQ ID NO: 286617 - DNA, 25 bp, Mus musculus
gaaggagtgtggcatgttcatcaca

SEQ ID NO: 286618 - DNA, 25 bp, Mus musculus
gaaggagttagaaacaggtgagaac

SEQ ID NO: 286619 - DNA, 25 bp, Mus musculus
gaaggagtttctggtgtgatccctc

SEQ ID NO: 286620 - DNA, 25 bp, Mus musculus
gaaggataccctgctgggggctctc

SEQ ID NO: 286621 - DNA, 25 bp, Mus musculus
gaaggatacgagcaatcatttccat

SEQ ID NO: 286622 - DNA, 25 bp, Mus musculus
gaaggatacgagcagtagtaccgtt

SEQ ID NO: 286623 - DNA, 25 bp, Mus musculus
gaaggatactccagatgccaacgca

SEQ ID NO: 286624 - DNA, 25 bp, Mus musculus
gaaggatcaaggcagagatgcttta

SEQ ID NO: 286625 - DNA, 25 bp, Mus musculus
gaaggatcacgaggttgtacttgtt

SEQ ID NO: 286626 - DNA, 25 bp, Mus musculus
gaaggatcagctgaagaataaattc

SEQ ID NO: 286627 - DNA, 25 bp, Mus musculus
gaaggatcaggatgacgatgctgaa

SEQ ID NO: 286628 - DNA, 25 bp, Mus musculus
gaaggatcaggcccttaaggatgac

SEQ ID NO: 286629 - DNA, 25 bp, Mus musculus
gaaggatcttaccaatcctgggatg

SEQ ID NO: 286630 - DNA, 25 bp, Mus musculus
gaaggatcttcagagggttcccagc

SEQ ID NO: 286631 - DNA, 25 bp, Mus musculus
gaaggatcttttttgctccagacta

SEQ ID NO: 286632 - DNA, 25 bp, Mus musculus
gaaggatgaagagctaaggcgcatg

SEQ ID NO: 286633 - DNA, 25 bp, Mus musculus
gaaggatgaagagggccccgtgggg

SEQ ID NO: 286634 - DNA, 25 bp, Mus musculus
gaaggatgaagattcctatcacata

SEQ ID NO: 286635 - DNA, 25 bp, Mus musculus
gaaggatgacttggagattttgcat

SEQ ID NO: 286636 - DNA, 25 bp, Mus musculus
gaaggatgagctgggttcaggaggt

SEQ ID NO: 286637 - DNA, 25 bp, Mus musculus
gaaggatgatgagctgaactttgac

SEQ ID NO: 286638 - DNA, 25 bp, Mus musculus
gaaggatgccagcccaaaccaggtg

SEQ ID NO: 286639 - DNA, 25 bp, Mus musculus
gaaggatgccagccctccagggcca

SEQ ID NO: 286640 - DNA, 25 bp, Mus musculus
gaaggatgcccactgagcaggacgt

SEQ ID NO: 286641 - DNA, 25 bp, Mus musculus
gaaggatggacaaagctggtcagta

SEQ ID NO: 286642 - DNA, 25 bp, Mus musculus
gaaggatgtggatgggttgacgagc

SEQ ID NO: 286643 - DNA, 25 bp, Mus musculus
gaaggattagatctgccacctccct

SEQ ID NO: 286644 - DNA, 25 bp, Mus musculus
gaaggattcatgaaagtcctgaagt

SEQ ID NO: 286645 - DNA, 25 bp, Mus musculus
gaaggattctgggaggctccccagc

SEQ ID NO: 286646 - DNA, 25 bp, Mus musculus
gaaggcaaaaaaagtggacgctcag

SEQ ID NO: 286647 - DNA, 25 bp, Mus musculus
gaaggcaaaaaggccaaagcctcac

SEQ ID NO: 286648 - DNA, 25 bp, Mus musculus
gaaggcaaagagagacacaccctga

SEQ ID NO: 286649 - DNA, 25 bp, Mus musculus
gaaggcaaatgctatgctggatgaa

SEQ ID NO: 286650 - DNA, 25 bp, Mus musculus
gaaggcaaattcgtgattactggcc

SEQ ID NO: 286651 - DNA, 25 bp, Mus musculus
gaaggcaacaagatgaagaacaacg

SEQ ID NO: 286652 - DNA, 25 bp, Mus musculus
gaaggcaacaaggatgctacagcta

SEQ ID NO: 286653 - DNA, 25 bp, Mus musculus
gaaggcaacacagtgctgctcttag

SEQ ID NO: 286654 - DNA, 25 bp, Mus musculus
gaaggcaacagaatgaagggacctg

SEQ ID NO: 286655 - DNA, 25 bp, Mus musculus
gaaggcaacagtgaagggacctgca

SEQ ID NO: 286656 - DNA, 25 bp, Mus musculus
gaaggcaacatcgctgtgggcaaat

SEQ ID NO: 286657 - DNA, 25 bp, Mus musculus
gaaggcaacatcggatggcacttcc

SEQ ID NO: 286658 - DNA, 25 bp, Mus musculus
gaaggcaaccaagcattatgagatg

SEQ ID NO: 286659 - DNA, 25 bp, Mus musculus
gaaggcaagaagacagtaaccagtt

SEQ ID NO: 286660 - DNA, 25 bp, Mus musculus
gaaggcaagaagagacttgaggctt

SEQ ID NO: 286661 - DNA, 25 bp, Mus musculus
gaaggcaagaagtcctgccacactg

SEQ ID NO: 286662 - DNA, 25 bp, Mus musculus
gaaggcaaggaggtggatacgacgc

SEQ ID NO: 286663 - DNA, 25 bp, Mus musculus
gaaggcaaggatagcatccatgtct

SEQ ID NO: 286664 - DNA, 25 bp, Mus musculus
gaaggcaaggatagggagcgcctca

SEQ ID NO: 286665 - DNA, 25 bp, Mus musculus
gaaggcaatgaaggaaaccaaagga

SEQ ID NO: 286666 - DNA, 25 bp, Mus musculus
gaaggcaatggaatgatctcattaa

SEQ ID NO: 286667 - DNA, 25 bp, Mus musculus
gaaggcacagatggacagatggatg

SEQ ID NO: 286668 - DNA, 25 bp, Mus musculus
gaaggcacaggaagcatttcttaat

SEQ ID NO: 286669 - DNA, 25 bp, Mus musculus
gaaggcacaggtgaaggagacaaac

SEQ ID NO: 286670 - DNA, 25 bp, Mus musculus
gaaggcaccaatttcgttgtggacc

SEQ ID NO: 286671 - DNA, 25 bp, Mus musculus
gaaggcacctgaaaacagcaatgca

SEQ ID NO: 286672 - DNA, 25 bp, Mus musculus
gaaggcacctgactttgtgttctac

SEQ ID NO: 286673 - DNA, 25 bp, Mus musculus
gaaggcaccttgggtcctgggcctt

SEQ ID NO: 286674 - DNA, 25 bp, Mus musculus
gaaggcactacagatgttcatctag

SEQ ID NO: 286675 - DNA, 25 bp, Mus musculus
gaaggcagaaggtgatgtgggtcct

SEQ ID NO: 286676 - DNA, 25 bp, Mus musculus
gaaggcagagaactgtgccaagtgg

SEQ ID NO: 286677 - DNA, 25 bp, Mus musculus
gaaggcagaggaggcattatgagag

SEQ ID NO: 286678 - DNA, 25 bp, Mus musculus
gaaggcagaggcaggcgtgcccaca

SEQ ID NO: 286679 - DNA, 25 bp, Mus musculus
gaaggcagaggtatgatgatgttct

SEQ ID NO: 286680 - DNA, 25 bp, Mus musculus
gaaggcagaggtggcacggcgacac

SEQ ID NO: 286681 - DNA, 25 bp, Mus musculus
gaaggcagcactggattcccggtcg

SEQ ID NO: 286682 - DNA, 25 bp, Mus musculus
gaaggcagccgacgctgaagctgag

SEQ ID NO: 286683 - DNA, 25 bp, Mus musculus
gaaggcaggaagctgggccggcaca

SEQ ID NO: 286684 - DNA, 25 bp, Mus musculus
gaaggcatccacggaagaagtgcct

SEQ ID NO: 286685 - DNA, 25 bp, Mus musculus
gaaggcatccacggccatgggttct

SEQ ID NO: 286686 - DNA, 25 bp, Mus musculus
gaaggcatctggcacacctctatag

SEQ ID NO: 286687 - DNA, 25 bp, Mus musculus
gaaggcatctgggagggacattgct

SEQ ID NO: 286688 - DNA, 25 bp, Mus musculus
gaaggcatgatatggttccttgttc

SEQ ID NO: 286689 - DNA, 25 bp, Mus musculus
gaaggcatgggtcttcggatcagtg

SEQ ID NO: 286690 - DNA, 25 bp, Mus musculus
gaaggccaaaattagatcatagcag

SEQ ID NO: 286691 - DNA, 25 bp, Mus musculus
gaaggccaacccagatggcaagaag

SEQ ID NO: 286692 - DNA, 25 bp, Mus musculus
gaaggccaaggaaggcaccagacct

SEQ ID NO: 286693 - DNA, 25 bp, Mus musculus
gaaggccaatgtgggaagcaaagct

SEQ ID NO: 286694 - DNA, 25 bp, Mus musculus
gaaggccagagcagatgaagtgaga

SEQ ID NO: 286695 - DNA, 25 bp, Mus musculus
gaaggccagagcaggctccttaggc

SEQ ID NO: 286696 - DNA, 25 bp, Mus musculus
gaaggccagcagctctgcggagtcg

SEQ ID NO: 286697 - DNA, 25 bp, Mus musculus
gaaggcccagctctgataagataca

SEQ ID NO: 286698 - DNA, 25 bp, Mus musculus
gaaggcccaggtggctttcatgacg

SEQ ID NO: 286699 - DNA, 25 bp, Mus musculus
gaaggccctgaggtatcaccacagc

SEQ ID NO: 286700 - DNA, 25 bp, Mus musculus
gaaggccgctacggatacaggttca

SEQ ID NO: 286701 - DNA, 25 bp, Mus musculus
gaaggccggaggatggaaccaaatg

SEQ ID NO: 286702 - DNA, 25 bp, Mus musculus
gaaggccggagttccctcacaacag

SEQ ID NO: 286703 - DNA, 25 bp, Mus musculus
gaaggccgtcagaactcggtatatc

SEQ ID NO: 286704 - DNA, 25 bp, Mus musculus
gaaggccgtcagatgggtttcaagg

SEQ ID NO: 286705 - DNA, 25 bp, Mus musculus
gaaggccgtcagtgcctgatgccac

SEQ ID NO: 286706 - DNA, 25 bp, Mus musculus
gaaggcctcgccagaagccccccag

SEQ ID NO: 286707 - DNA, 25 bp, Mus musculus
gaaggcctctgtctgggcggcaatc

SEQ ID NO: 286708 - DNA, 25 bp, Mus musculus
gaaggcctgaagaaggagctgcggg

SEQ ID NO: 286709 - DNA, 25 bp, Mus musculus
gaaggcctgaggagcttttcatgca

SEQ ID NO: 286710 - DNA, 25 bp, Mus musculus
gaaggcctggcagtgtgtctccagg

SEQ ID NO: 286711 - DNA, 25 bp, Mus musculus
gaaggcctggttctgcataagcagc

SEQ ID NO: 286712 - DNA, 25 bp, Mus musculus
gaaggcctgtgagtgctgccgacct

SEQ ID NO: 286713 - DNA, 25 bp, Mus musculus
gaaggccttgacctgttgaggagac

SEQ ID NO: 286714 - DNA, 25 bp, Mus musculus
gaaggcgaagatgagcgttcggccg

SEQ ID NO: 286715 - DNA, 25 bp, Mus musculus
gaaggcgagcagaaacttggaccct

SEQ ID NO: 286716 - DNA, 25 bp, Mus musculus
gaaggcgaggaagaaaaaagtcatg

SEQ ID NO: 286717 - DNA, 25 bp, Mus musculus
gaaggcgaggaaggcattgggagag

SEQ ID NO: 286718 - DNA, 25 bp, Mus musculus
gaaggcgagttacaggagggaatct

SEQ ID NO: 286719 - DNA, 25 bp, Mus musculus
gaaggcgctcgagtatgcctgtggt

SEQ ID NO: 286720 - DNA, 25 bp, Mus musculus
gaaggcggaagtggttctgctgcct

SEQ ID NO: 286721 - DNA, 25 bp, Mus musculus
gaaggcggattccagcccaacatgc

SEQ ID NO: 286722 - DNA, 25 bp, Mus musculus
gaaggcgggtttgccacaatctgcc

SEQ ID NO: 286723 - DNA, 25 bp, Mus musculus
gaaggcggtaaatgggcttcttggt

SEQ ID NO: 286724 - DNA, 25 bp, Mus musculus
gaaggcgtccgcaggtttgatgaga

SEQ ID NO: 286725 - DNA, 25 bp, Mus musculus
gaaggcgtctcgagcctatcctcta

SEQ ID NO: 286726 - DNA, 25 bp, Mus musculus
gaaggcgtctcgaggaacgcctcga

SEQ ID NO: 286727 - DNA, 25 bp, Mus musculus
gaaggcgtgcgggtgtgaacaacgt

SEQ ID NO: 286728 - DNA, 25 bp, Mus musculus
gaaggcgtggcaacatacgcagctg

SEQ ID NO: 286729 - DNA, 25 bp, Mus musculus
gaaggctaatttatgatcgttgtcc

SEQ ID NO: 286730 - DNA, 25 bp, Mus musculus
gaaggctacaaggtgctggtggcaa

SEQ ID NO: 286731 - DNA, 25 bp, Mus musculus
gaaggctacaatccctctacttcgg

SEQ ID NO: 286732 - DNA, 25 bp, Mus musculus
gaaggctatgaaggggtcagaatac

SEQ ID NO: 286733 - DNA, 25 bp, Mus musculus
gaaggctcagtgccatggagaaggg

SEQ ID NO: 286734 - DNA, 25 bp, Mus musculus
gaaggctcagtgctgtatgccatgc

SEQ ID NO: 286735 - DNA, 25 bp, Mus musculus
gaaggctcatagacagggtttctct

SEQ ID NO: 286736 - DNA, 25 bp, Mus musculus
gaaggctcataggccaaactcaagg

SEQ ID NO: 286737 - DNA, 25 bp, Mus musculus
gaaggctcggggaacctccgcttca

SEQ ID NO: 286738 - DNA, 25 bp, Mus musculus
gaaggctctggagatggcaggttca

SEQ ID NO: 286739 - DNA, 25 bp, Mus musculus
gaaggctcttatcaggtatggggca

SEQ ID NO: 286740 - DNA, 25 bp, Mus musculus
gaaggctgaaggcttaactccggcc

SEQ ID NO: 286741 - DNA, 25 bp, Mus musculus
gaaggctgacaaggaatttcggcag

SEQ ID NO: 286742 - DNA, 25 bp, Mus musculus
gaaggctgcgaccaggctttggcgt

SEQ ID NO: 286743 - DNA, 25 bp, Mus musculus
gaaggctggacagatctgctcattt

SEQ ID NO: 286744 - DNA, 25 bp, Mus musculus
gaaggctggacagattcagataaca

SEQ ID NO: 286745 - DNA, 25 bp, Mus musculus
gaaggctggcgtagatcgactgtgc

SEQ ID NO: 286746 - DNA, 25 bp, Mus musculus
gaaggctggctgcctttgcggggcc

SEQ ID NO: 286747 - DNA, 25 bp, Mus musculus
gaaggctgggttcctgaatgccacg

SEQ ID NO: 286748 - DNA, 25 bp, Mus musculus
gaaggctgtttatggatgaccagga

SEQ ID NO: 286749 - DNA, 25 bp, Mus musculus
gaaggcttcaggaaatcaggacctt

SEQ ID NO: 286750 - DNA, 25 bp, Mus musculus
gaaggcttcgttccttgcgcgctgg

SEQ ID NO: 286751 - DNA, 25 bp, Mus musculus
gaaggcttgccactttcctaaatag

SEQ ID NO: 286752 - DNA, 25 bp, Mus musculus
gaaggcttggcagagcaacttattt

SEQ ID NO: 286753 - DNA, 25 bp, Mus musculus
gaaggcttgggaggaactgagtggt

SEQ ID NO: 286754 - DNA, 25 bp, Mus musculus
gaaggcttgggagggtgacacttcc

SEQ ID NO: 286755 - DNA, 25 bp, Mus musculus
gaaggctttccagccatggccatgc

SEQ ID NO: 286756 - DNA, 25 bp, Mus musculus
gaaggctttccagctccagcacctg

SEQ ID NO: 286757 - DNA, 25 bp, Mus musculus
gaaggctttgcaaggaagccatcac

SEQ ID NO: 286758 - DNA, 25 bp, Mus musculus
gaaggctttgtgtactgctctgctg

SEQ ID NO: 286759 - DNA, 25 bp, Mus musculus
gaagggaaaaaggtgatgtctatcc

SEQ ID NO: 286760 - DNA, 25 bp, Mus musculus
gaagggaaagaaagccgctctgcac

SEQ ID NO: 286761 - DNA, 25 bp, Mus musculus
gaagggaaagaaagtcacagacaag

SEQ ID NO: 286762 - DNA, 25 bp, Mus musculus
gaagggaaaggggaatgatgaaagg

SEQ ID NO: 286763 - DNA, 25 bp, Mus musculus
gaagggaagaataggtatcgtgtcc

SEQ ID NO: 286764 - DNA, 25 bp, Mus musculus
gaagggaagattcggatccctaccg

SEQ ID NO: 286765 - DNA, 25 bp, Mus musculus
gaagggaagggatgcatgggcatgg

SEQ ID NO: 286766 - DNA, 25 bp, Mus musculus
gaagggaagggctcgggtccgcacg

SEQ ID NO: 286767 - DNA, 25 bp, Mus musculus
gaagggaagtctcaggtgtcggtga

SEQ ID NO: 286768 - DNA, 25 bp, Mus musculus
gaagggaagtttgagaaatcaggga

SEQ ID NO: 286769 - DNA, 25 bp, Mus musculus
gaagggaatcctggcctcccagtaa

SEQ ID NO: 286770 - DNA, 25 bp, Mus musculus
gaagggaatcctggggacacttaac

SEQ ID NO: 286771 - DNA, 25 bp, Mus musculus
gaagggacaactgcttcggcccaca

SEQ ID NO: 286772 - DNA, 25 bp, Mus musculus
gaagggacaggtgccattgacattt

SEQ ID NO: 286773 - DNA, 25 bp, Mus musculus
gaagggacaggtgtatcatccctac

SEQ ID NO: 286774 - DNA, 25 bp, Mus musculus
gaagggactacatattctgtcccct

SEQ ID NO: 286775 - DNA, 25 bp, Mus musculus
gaagggactacatgacattaagaac

SEQ ID NO: 286776 - DNA, 25 bp, Mus musculus
gaagggactggacccatacaatatg

SEQ ID NO: 286777 - DNA, 25 bp, Mus musculus
gaagggactgtcaactcttgtctct

SEQ ID NO: 286778 - DNA, 25 bp, Mus musculus
gaagggacttgtcaggtttctaaac

SEQ ID NO: 286779 - DNA, 25 bp, Mus musculus
gaagggagagacgggtatcccagga

SEQ ID NO: 286780 - DNA, 25 bp, Mus musculus
gaagggagagttcgtgtcgatgggt

SEQ ID NO: 286781 - DNA, 25 bp, Mus musculus
gaagggagatgatgatgaggaatct

SEQ ID NO: 286782 - DNA, 25 bp, Mus musculus
gaagggagcgctgatcatggctcct

SEQ ID NO: 286783 - DNA, 25 bp, Mus musculus
gaagggagctctggatgctgaatgc

SEQ ID NO: 286784 - DNA, 25 bp, Mus musculus
gaagggagctctgggaattaacaag

SEQ ID NO: 286785 - DNA, 25 bp, Mus musculus
gaagggaggggatcaaactcttcac

SEQ ID NO: 286786 - DNA, 25 bp, Mus musculus
gaagggagggtccgggttgtggatc

SEQ ID NO: 286787 - DNA, 25 bp, Mus musculus
gaagggaggtgcatggagactcaga

SEQ ID NO: 286788 - DNA, 25 bp, Mus musculus
gaagggagtaaaggaaacagacagc

SEQ ID NO: 286789 - DNA, 25 bp, Mus musculus
gaagggagtaaaggcagtctaaagt

SEQ ID NO: 286790 - DNA, 25 bp, Mus musculus
gaagggattgaccgacgcctcttcg

SEQ ID NO: 286791 - DNA, 25 bp, Mus musculus
gaagggcaaagacgatgcggtccct

SEQ ID NO: 286792 - DNA, 25 bp, Mus musculus
gaagggcaaagatgagtggttctcc

SEQ ID NO: 286793 - DNA, 25 bp, Mus musculus
gaagggcaaaggctggagcaaaaca

SEQ ID NO: 286794 - DNA, 25 bp, Mus musculus
gaagggcaagaagcctggaattgtg

SEQ ID NO: 286795 - DNA, 25 bp, Mus musculus
gaagggcaagaagtatttaggtcag

SEQ ID NO: 286796 - DNA, 25 bp, Mus musculus
gaagggcaagacgggcgcagttctg

SEQ ID NO: 286797 - DNA, 25 bp, Mus musculus
gaagggcaaggaactaccgtgggga

SEQ ID NO: 286798 - DNA, 25 bp, Mus musculus
gaagggcaaggtgctcatctgcagg

SEQ ID NO: 286799 - DNA, 25 bp, Mus musculus
gaagggcagagggatacagtacagc

SEQ ID NO: 286800 - DNA, 25 bp, Mus musculus
gaagggcagcgccctcggagccctg

SEQ ID NO: 286801 - DNA, 25 bp, Mus musculus
gaagggcagcgtggccaagcggcga

SEQ ID NO: 286802 - DNA, 25 bp, Mus musculus
gaagggcagtgttgctgaagcagaa

SEQ ID NO: 286803 - DNA, 25 bp, Mus musculus
gaagggcataggcagccacctagat

SEQ ID NO: 286804 - DNA, 25 bp, Mus musculus
gaagggcatcaggcggtatgaatat

SEQ ID NO: 286805 - DNA, 25 bp, Mus musculus
gaagggccggggtgtgcacatggaa

SEQ ID NO: 286806 - DNA, 25 bp, Mus musculus
gaagggcgccagatgctggaggtaa

SEQ ID NO: 286807 - DNA, 25 bp, Mus musculus
gaagggcgctggcggaatggcttcc

SEQ ID NO: 286808 - DNA, 25 bp, Mus musculus
gaagggcgggtcagcaagctccggg

SEQ ID NO: 286809 - DNA, 25 bp, Mus musculus
gaagggcgggtcagcggccctgtga

SEQ ID NO: 286810 - DNA, 25 bp, Mus musculus
gaagggcgtcttagatgacgtggtc

SEQ ID NO: 286811 - DNA, 25 bp, Mus musculus
gaagggctcagccagagtaacagtt

SEQ ID NO: 286812 - DNA, 25 bp, Mus musculus
gaagggctccacactgtcccggaga

SEQ ID NO: 286813 - DNA, 25 bp, Mus musculus
gaagggctgccaggagatggacatg

SEQ ID NO: 286814 - DNA, 25 bp, Mus musculus
gaagggctgccaggttgaattctct

SEQ ID NO: 286815 - DNA, 25 bp, Mus musculus
gaagggctgccatgcctgtgactgc

SEQ ID NO: 286816 - DNA, 25 bp, Mus musculus
gaagggctgccgactgctgatctct

SEQ ID NO: 286817 - DNA, 25 bp, Mus musculus
gaaggggaagaggaatattgaagag

SEQ ID NO: 286818 - DNA, 25 bp, Mus musculus
gaaggggaaggtgatctgagcatct

SEQ ID NO: 286819 - DNA, 25 bp, Mus musculus
gaaggggagcagaaaatgttttcag

SEQ ID NO: 286820 - DNA, 25 bp, Mus musculus
gaaggggatcggtatcatgccaaag

SEQ ID NO: 286821 - DNA, 25 bp, Mus musculus
gaaggggatgcatgtggatggcagc

SEQ ID NO: 286822 - DNA, 25 bp, Mus musculus
gaaggggatgttgtggaagtgactg

SEQ ID NO: 286823 - DNA, 25 bp, Mus musculus
gaaggggcaacctaggtgttgactt

SEQ ID NO: 286824 - DNA, 25 bp, Mus musculus
gaaggggcagtctgtccatcagtta

SEQ ID NO: 286825 - DNA, 25 bp, Mus musculus
gaaggggccactcaacccaccctca

SEQ ID NO: 286826 - DNA, 25 bp, Mus musculus
gaaggggctccaggcagaagcgatg

SEQ ID NO: 286827 - DNA, 25 bp, Mus musculus
gaaggggctgaagtatatccatgcg

SEQ ID NO: 286828 - DNA, 25 bp, Mus musculus
gaaggggctggactgtaacagaaga

SEQ ID NO: 286829 - DNA, 25 bp, Mus musculus
gaaggggctggggaacagaaggcgg

SEQ ID NO: 286830 - DNA, 25 bp, Mus musculus
gaaggggctgttggacttcaagaaa

SEQ ID NO: 286831 - DNA, 25 bp, Mus musculus
gaagggggcaagggtggaccacttg

SEQ ID NO: 286832 - DNA, 25 bp, Mus musculus
gaagggggcgcgcaggtgtccacag

SEQ ID NO: 286833 - DNA, 25 bp, Mus musculus
gaaggggttccgggtggacaagatt

SEQ ID NO: 286834 - DNA, 25 bp, Mus musculus
gaagggtataggcatcgcctccatg

SEQ ID NO: 286835 - DNA, 25 bp, Mus musculus
gaagggtcagatttctcagctgatg

SEQ ID NO: 286836 - DNA, 25 bp, Mus musculus
gaagggtccagggtctcaggtccca

SEQ ID NO: 286837 - DNA, 25 bp, Mus musculus
gaagggtgaaaagggtgacatagga

SEQ ID NO: 286838 - DNA, 25 bp, Mus musculus
gaagggtgaacaaggtgttccagga

SEQ ID NO: 286839 - DNA, 25 bp, Mus musculus
gaagggtgagcaattgtgttcggag

SEQ ID NO: 286840 - DNA, 25 bp, Mus musculus
gaagggtgcaaaaggtaccagcaag

SEQ ID NO: 286841 - DNA, 25 bp, Mus musculus
gaagggtggcagggggacacctgga

SEQ ID NO: 286842 - DNA, 25 bp, Mus musculus
gaagggttaggatgatgctgttgaa

SEQ ID NO: 286843 - DNA, 25 bp, Mus musculus
gaagggttgggaaggttctggctgc

SEQ ID NO: 286844 - DNA, 25 bp, Mus musculus
gaagggtttgagagaatcgcacgtc

SEQ ID NO: 286845 - DNA, 25 bp, Mus musculus
gaagggtttgttcagtcgacctgat

SEQ ID NO: 286846 - DNA, 25 bp, Mus musculus
gaaggtaaaactgattgactgggga

SEQ ID NO: 286847 - DNA, 25 bp, Mus musculus
gaaggtaaagatacacctatggctg

SEQ ID NO: 286848 - DNA, 25 bp, Mus musculus
gaaggtaagaaggcaatggcaagcc

SEQ ID NO: 286849 - DNA, 25 bp, Mus musculus
gaaggtacaggagttaaagaccagt

SEQ ID NO: 286850 - DNA, 25 bp, Mus musculus
gaaggtcaagcacccctattgagca

SEQ ID NO: 286851 - DNA, 25 bp, Mus musculus
gaaggtcaaggccacaggcctctgc

SEQ ID NO: 286852 - DNA, 25 bp, Mus musculus
gaaggtcaagtcactggtgacgctg

SEQ ID NO: 286853 - DNA, 25 bp, Mus musculus
gaaggtcacccaggtcctgtccttg

SEQ ID NO: 286854 - DNA, 25 bp, Mus musculus
gaaggtcactgagggcggtgagccg

SEQ ID NO: 286855 - DNA, 25 bp, Mus musculus
gaaggtcagactgaggcaccaagta

SEQ ID NO: 286856 - DNA, 25 bp, Mus musculus
gaaggtccagagaaggcaagctgga

SEQ ID NO: 286857 - DNA, 25 bp, Mus musculus
gaaggtccagagaggtgtggagagg

SEQ ID NO: 286858 - DNA, 25 bp, Mus musculus
gaaggtccaggacctcagacaagat

SEQ ID NO: 286859 - DNA, 25 bp, Mus musculus
gaaggtcccggagcatgcaaaacaa

SEQ ID NO: 286860 - DNA, 25 bp, Mus musculus
gaaggtcccggagcatgcattcttt

SEQ ID NO: 286861 - DNA, 25 bp, Mus musculus
gaaggtcccggattgaaaagatgaa

SEQ ID NO: 286862 - DNA, 25 bp, Mus musculus
gaaggtcgatgtgggcccagaccct

SEQ ID NO: 286863 - DNA, 25 bp, Mus musculus
gaaggtcgtgccagaaggaatgaga

SEQ ID NO: 286864 - DNA, 25 bp, Mus musculus
gaaggtctcctcagatgaggaaact

SEQ ID NO: 286865 - DNA, 25 bp, Mus musculus
gaaggtgaaagacactcgtaatcgc

SEQ ID NO: 286866 - DNA, 25 bp, Mus musculus
gaaggtgaaagagactcggatgacg

SEQ ID NO: 286867 - DNA, 25 bp, Mus musculus
gaaggtgaaagtctcacacaggtcc

SEQ ID NO: 286868 - DNA, 25 bp, Mus musculus
gaaggtgaggctggtggagttcatg

SEQ ID NO: 286869 - DNA, 25 bp, Mus musculus
gaaggtgccggttttggcacgtgac

SEQ ID NO: 286870 - DNA, 25 bp, Mus musculus
gaaggtgctgaggcaccatcacagg

SEQ ID NO: 286871 - DNA, 25 bp, Mus musculus
gaaggtgctgagttcatgcaaagag

SEQ ID NO: 286872 - DNA, 25 bp, Mus musculus
gaaggtgctgctggaggcccggaca

SEQ ID NO: 286873 - DNA, 25 bp, Mus musculus
gaaggtggagaagctcaaggcaagg

SEQ ID NO: 286874 - DNA, 25 bp, Mus musculus
gaaggtggaggtgtggtacatccag

SEQ ID NO: 286875 - DNA, 25 bp, Mus musculus
gaaggtggcagaggtgctggctgga

SEQ ID NO: 286876 - DNA, 25 bp, Mus musculus
gaaggtgtacaatgaaaatcttgtt

SEQ ID NO: 286877 - DNA, 25 bp, Mus musculus
gaaggtgtacaatgagaaacatatt

SEQ ID NO: 286878 - DNA, 25 bp, Mus musculus
gaaggtgtctggccctctccaggcc

SEQ ID NO: 286879 - DNA, 25 bp, Mus musculus
gaaggttaaaacttcagcatcttct

SEQ ID NO: 286880 - DNA, 25 bp, Mus musculus
gaaggttatagcacacatccagaac

SEQ ID NO: 286881 - DNA, 25 bp, Mus musculus
gaaggttcatctctcccttctcagc

SEQ ID NO: 286882 - DNA, 25 bp, Mus musculus
gaaggttctgatatgtcacatgctg

SEQ ID NO: 286883 - DNA, 25 bp, Mus musculus
gaaggttgctcaatcatgtgaggaa

SEQ ID NO: 286884 - DNA, 25 bp, Mus musculus
gaaggttgctcattcatgtgaggaa

SEQ ID NO: 286885 - DNA, 25 bp, Mus musculus
gaaggtttctgtttgttttcttctg

SEQ ID NO: 286886 - DNA, 25 bp, Mus musculus
gaaggttttagggcaagtctgatga

SEQ ID NO: 286887 - DNA, 25 bp, Mus musculus
gaagtaaaaggcaaccagataaact

SEQ ID NO: 286888 - DNA, 25 bp, Mus musculus
gaagtaaagcaagagcaccagaagt

SEQ ID NO: 286889 - DNA, 25 bp, Mus musculus
gaagtaaagcaaggctgtggctctg

SEQ ID NO: 286890 - DNA, 25 bp, Mus musculus
gaagtaaatgacattaaagattcaa

SEQ ID NO: 286891 - DNA, 25 bp, Mus musculus
gaagtaaatgactttaagaagcttc

SEQ ID NO: 286892 - DNA, 25 bp, Mus musculus
gaagtaaatgcttgacaaaaaaggg

SEQ ID NO: 286893 - DNA, 25 bp, Mus musculus
gaagtaacagacctgaccaaagtca

SEQ ID NO: 286894 - DNA, 25 bp, Mus musculus
gaagtaacagactttgcatgaagtt

SEQ ID NO: 286895 - DNA, 25 bp, Mus musculus
gaagtaaccccaggttctgccttag

SEQ ID NO: 286896 - DNA, 25 bp, Mus musculus
gaagtaacctaggtctgctgcaggt

SEQ ID NO: 286897 - DNA, 25 bp, Mus musculus
gaagtaacttcaaggttatccaggc

SEQ ID NO: 286898 - DNA, 25 bp, Mus musculus
gaagtaagcggactggaaacagcaa

SEQ ID NO: 286899 - DNA, 25 bp, Mus musculus
gaagtaaggagagatgcctctggat

SEQ ID NO: 286900 - DNA, 25 bp, Mus musculus
gaagtaaggagagttttagatgcct

SEQ ID NO: 286901 - DNA, 25 bp, Mus musculus
gaagtaatgggggcctgcatcctta

SEQ ID NO: 286902 - DNA, 25 bp, Mus musculus
gaagtacaaagatgaacgagaccgt

SEQ ID NO: 286903 - DNA, 25 bp, Mus musculus
gaagtacaaataatctgcaggacag

SEQ ID NO: 286904 - DNA, 25 bp, Mus musculus
gaagtacaagaatcttatggcaagg

SEQ ID NO: 286905 - DNA, 25 bp, Mus musculus
gaagtacccggacagagagagatgc

SEQ ID NO: 286906 - DNA, 25 bp, Mus musculus
gaagtaccgaaagctggacgatggt

SEQ ID NO: 286907 - DNA, 25 bp, Mus musculus
gaagtaccgttgtgagctgctgggg

SEQ ID NO: 286908 - DNA, 25 bp, Mus musculus
gaagtacctgaacgtgctggccaaa

SEQ ID NO: 286909 - DNA, 25 bp, Mus musculus
gaagtacctggttaactttgtggct

SEQ ID NO: 286910 - DNA, 25 bp, Mus musculus
gaagtacgcccgaggacttcaggaa

SEQ ID NO: 286911 - DNA, 25 bp, Mus musculus
gaagtacggcgtggccttttacaac

SEQ ID NO: 286912 - DNA, 25 bp, Mus musculus
gaagtacgggatttgctggacagga

SEQ ID NO: 286913 - DNA, 25 bp, Mus musculus
gaagtacgtgggacctcttaaagtg

SEQ ID NO: 286914 - DNA, 25 bp, Mus musculus
gaagtactgcgaagatgtcaatgaa

SEQ ID NO: 286915 - DNA, 25 bp, Mus musculus
gaagtacttaaggctcaggccgtgg

SEQ ID NO: 286916 - DNA, 25 bp, Mus musculus
gaagtacttaagtcaggaggaggct

SEQ ID NO: 286917 - DNA, 25 bp, Mus musculus
gaagtacttcttgcacgatgacaga

SEQ ID NO: 286918 - DNA, 25 bp, Mus musculus
gaagtagaaagatctaaaggggtga

SEQ ID NO: 286919 - DNA, 25 bp, Mus musculus
gaagtagaagaacagaaactacata

SEQ ID NO: 286920 - DNA, 25 bp, Mus musculus
gaagtagacacctacatacagacta

SEQ ID NO: 286921 - DNA, 25 bp, Mus musculus
gaagtagacagcctgatgtgtgaaa

SEQ ID NO: 286922 - DNA, 25 bp, Mus musculus
gaagtagacaggcattggactactc

SEQ ID NO: 286923 - DNA, 25 bp, Mus musculus
gaagtagagaggcattttcttgaga

SEQ ID NO: 286924 - DNA, 25 bp, Mus musculus
gaagtagagccagcaagtccacatg

SEQ ID NO: 286925 - DNA, 25 bp, Mus musculus
gaagtagagccaggcttgccatctc

SEQ ID NO: 286926 - DNA, 25 bp, Mus musculus
gaagtagaggcaccagactccccct

SEQ ID NO: 286927 - DNA, 25 bp, Mus musculus
gaagtagcctccggctatgcatatg

SEQ ID NO: 286928 - DNA, 25 bp, Mus musculus
gaagtagctaaaacattctcataca

SEQ ID NO: 286929 - DNA, 25 bp, Mus musculus
gaagtagctcagcagacaagaaaaa

SEQ ID NO: 286930 - DNA, 25 bp, Mus musculus
gaagtagtttttgacagaaaatctg

SEQ ID NO: 286931 - DNA, 25 bp, Mus musculus
gaagtataaaaaacgcaataccaca

SEQ ID NO: 286932 - DNA, 25 bp, Mus musculus
gaagtataactcagggaatgggaca

SEQ ID NO: 286933 - DNA, 25 bp, Mus musculus
gaagtatagcagagggctcctgctg

SEQ ID NO: 286934 - DNA, 25 bp, Mus musculus
gaagtatattacaggattcactagc

SEQ ID NO: 286935 - DNA, 25 bp, Mus musculus
gaagtatattgcaggattcactagc

SEQ ID NO: 286936 - DNA, 25 bp, Mus musculus
gaagtatcatgtaccggagctttct

SEQ ID NO: 286937 - DNA, 25 bp, Mus musculus
gaagtatccatcatcagaagtactc

SEQ ID NO: 286938 - DNA, 25 bp, Mus musculus
gaagtatccatcttctgtatctcag

SEQ ID NO: 286939 - DNA, 25 bp, Mus musculus
gaagtatcggaagcttgtgtcggca

SEQ ID NO: 286940 - DNA, 25 bp, Mus musculus
gaagtatcttgatcccacctaaacc

SEQ ID NO: 286941 - DNA, 25 bp, Mus musculus
gaagtatgaacaggcctgtcgtgag

SEQ ID NO: 286942 - DNA, 25 bp, Mus musculus
gaagtatgaagaggtggcccgtaag

SEQ ID NO: 286943 - DNA, 25 bp, Mus musculus
gaagtatgaagaggtggctcgtaag

SEQ ID NO: 286944 - DNA, 25 bp, Mus musculus
gaagtatgacccacagggctctcta

SEQ ID NO: 286945 - DNA, 25 bp, Mus musculus
gaagtatgagaaggatgttgctgac

SEQ ID NO: 286946 - DNA, 25 bp, Mus musculus
gaagtatggatgggtacctggaatg

SEQ ID NO: 286947 - DNA, 25 bp, Mus musculus
gaagtatgtggaggaacatgtgtat

SEQ ID NO: 286948 - DNA, 25 bp, Mus musculus
gaagtatgtggaggccatgggaagt

SEQ ID NO: 286949 - DNA, 25 bp, Mus musculus
gaagtattagaaaaagatgttggtt

SEQ ID NO: 286950 - DNA, 25 bp, Mus musculus
gaagtattagaataaatgaaggatt

SEQ ID NO: 286951 - DNA, 25 bp, Mus musculus
gaagtatttatcagataaccacatt

SEQ ID NO: 286952 - DNA, 25 bp, Mus musculus
gaagtatttctggcctcggattaca

SEQ ID NO: 286953 - DNA, 25 bp, Mus musculus
gaagtatttgatcctgtgcccaagc

SEQ ID NO: 286954 - DNA, 25 bp, Mus musculus
gaagtatttgccagatcttctggag

SEQ ID NO: 286955 - DNA, 25 bp, Mus musculus
gaagtcaaaaggatcgtcagtggca

SEQ ID NO: 286956 - DNA, 25 bp, Mus musculus
gaagtcaagagcaagaagaagcaga

SEQ ID NO: 286957 - DNA, 25 bp, Mus musculus
gaagtcaagagcaagtttggcgccg

SEQ ID NO: 286958 - DNA, 25 bp, Mus musculus
gaagtcaagcctttcatcacctatc

SEQ ID NO: 286959 - DNA, 25 bp, Mus musculus
gaagtcaatgctcaggtgcagtgtc

SEQ ID NO: 286960 - DNA, 25 bp, Mus musculus
gaagtcacaacttagtcttgacttc

SEQ ID NO: 286961 - DNA, 25 bp, Mus musculus
gaagtcacaacttagtgtcttcaag

SEQ ID NO: 286962 - DNA, 25 bp, Mus musculus
gaagtcacctttcgggcaggtgata

SEQ ID NO: 286963 - DNA, 25 bp, Mus musculus
gaagtcacctttcgggtcatctagt

SEQ ID NO: 286964 - DNA, 25 bp, Mus musculus
gaagtcactcggtgtgggctttgcc

SEQ ID NO: 286965 - DNA, 25 bp, Mus musculus
gaagtcactgccaggtatgtgaagg

SEQ ID NO: 286966 - DNA, 25 bp, Mus musculus
gaagtcagaaaccccaggtttccca

SEQ ID NO: 286967 - DNA, 25 bp, Mus musculus
gaagtcagaagatgattcagctaaa

SEQ ID NO: 286968 - DNA, 25 bp, Mus musculus
gaagtcagagcagcagcaagtcctc

SEQ ID NO: 286969 - DNA, 25 bp, Mus musculus
gaagtcagaggccttgctcctaaat

SEQ ID NO: 286970 - DNA, 25 bp, Mus musculus
gaagtcagagggtgctggtgacagt

SEQ ID NO: 286971 - DNA, 25 bp, Mus musculus
gaagtcagagtgaaagtagaacctg

SEQ ID NO: 286972 - DNA, 25 bp, Mus musculus
gaagtcagccaagaaggtgaaggaa

SEQ ID NO: 286973 - DNA, 25 bp, Mus musculus
gaagtcagcctggaaactgcccgtg

SEQ ID NO: 286974 - DNA, 25 bp, Mus musculus
gaagtcagcctggcgcaagatgcag

SEQ ID NO: 286975 - DNA, 25 bp, Mus musculus
gaagtcagtcagctttccctgctgc

SEQ ID NO: 286976 - DNA, 25 bp, Mus musculus
gaagtcagtcaggtcagctttggct

SEQ ID NO: 286977 - DNA, 25 bp, Mus musculus
gaagtcagtgaaaaaaaattcaagc

SEQ ID NO: 286978 - DNA, 25 bp, Mus musculus
gaagtcagtgaaaaaattgtacaat

SEQ ID NO: 286979 - DNA, 25 bp, Mus musculus
gaagtcagtgaaggcaggagctggg

SEQ ID NO: 286980 - DNA, 25 bp, Mus musculus
gaagtcagtgaggacttacagaagc

SEQ ID NO: 286981 - DNA, 25 bp, Mus musculus
gaagtcatactggtgaacggccttt

SEQ ID NO: 286982 - DNA, 25 bp, Mus musculus
gaagtcatattcagagcctcagctt

SEQ ID NO: 286983 - DNA, 25 bp, Mus musculus
gaagtcatccttggcatggatgata

SEQ ID NO: 286984 - DNA, 25 bp, Mus musculus
gaagtcatggaacaggtgagaggct

SEQ ID NO: 286985 - DNA, 25 bp, Mus musculus
gaagtcattcaattctggaacaaga

SEQ ID NO: 286986 - DNA, 25 bp, Mus musculus
gaagtcattgggagagtccttatcg

SEQ ID NO: 286987 - DNA, 25 bp, Mus musculus
gaagtcatttcagccgtgtttgacc

SEQ ID NO: 286988 - DNA, 25 bp, Mus musculus
gaagtccaacctcgggctcaaaaaa

SEQ ID NO: 286989 - DNA, 25 bp, Mus musculus
gaagtccaagaagaggagaaaccaa

SEQ ID NO: 286990 - DNA, 25 bp, Mus musculus
gaagtccaagaagatgctgtcgccg

SEQ ID NO: 286991 - DNA, 25 bp, Mus musculus
gaagtccaagctggaggcattccat

SEQ ID NO: 286992 - DNA, 25 bp, Mus musculus
gaagtccacaccgggacaaccatca

SEQ ID NO: 286993 - DNA, 25 bp, Mus musculus
gaagtccagagcaaggttgctcttc

SEQ ID NO: 286994 - DNA, 25 bp, Mus musculus
gaagtcccaaatcagatcgacatca

SEQ ID NO: 286995 - DNA, 25 bp, Mus musculus
gaagtcccaagccaggctttcttga

SEQ ID NO: 286996 - DNA, 25 bp, Mus musculus
gaagtcccaggactctcggctctcc

SEQ ID NO: 286997 - DNA, 25 bp, Mus musculus
gaagtcccaggctctgtgtgagtgt

SEQ ID NO: 286998 - DNA, 25 bp, Mus musculus
gaagtcccaggttgttcagatgtca

SEQ ID NO: 286999 - DNA, 25 bp, Mus musculus
gaagtcccagtggccagtgaagaga

SEQ ID NO: 287000 - DNA, 25 bp, Mus musculus
gaagtcccccaaactgaagaagtag

SEQ ID NO: 287001 - DNA, 25 bp, Mus musculus
gaagtcccgaggccaaccgcgtagc

SEQ ID NO: 287002 - DNA, 25 bp, Mus musculus
gaagtcccgaggttgagccccacat

SEQ ID NO: 287003 - DNA, 25 bp, Mus musculus
gaagtccctaaatcaaaaagttgct

SEQ ID NO: 287004 - DNA, 25 bp, Mus musculus
gaagtccctactccggaccaaaatt

SEQ ID NO: 287005 - DNA, 25 bp, Mus musculus
gaagtccgagaaggaaaagtggtca

SEQ ID NO: 287006 - DNA, 25 bp, Mus musculus
gaagtccgagaaggcctgtgtgggc

SEQ ID NO: 287007 - DNA, 25 bp, Mus musculus
gaagtccgcgagtggggttgcggcc

SEQ ID NO: 287008 - DNA, 25 bp, Mus musculus
gaagtccggcagtaggacagtcctt

SEQ ID NO: 287009 - DNA, 25 bp, Mus musculus
gaagtccggcggtagccaccaagat

SEQ ID NO: 287010 - DNA, 25 bp, Mus musculus
gaagtcctatataggtgacagtgga

SEQ ID NO: 287011 - DNA, 25 bp, Mus musculus
gaagtcctcagggctgaactgaaaa

SEQ ID NO: 287012 - DNA, 25 bp, Mus musculus
gaagtcctccggaccatgctgcctg

SEQ ID NO: 287013 - DNA, 25 bp, Mus musculus
gaagtcctccggtctgaaactcttc

SEQ ID NO: 287014 - DNA, 25 bp, Mus musculus
gaagtcctggcacagagaacctgtg

SEQ ID NO: 287015 - DNA, 25 bp, Mus musculus
gaagtcctggcacaggtacaaagtg

SEQ ID NO: 287016 - DNA, 25 bp, Mus musculus
gaagtccttaaggtgcagacccacc

SEQ ID NO: 287017 - DNA, 25 bp, Mus musculus
gaagtccttacagcaaattgctgtt

SEQ ID NO: 287018 - DNA, 25 bp, Mus musculus
gaagtccttacagttttaagtggaa

SEQ ID NO: 287019 - DNA, 25 bp, Mus musculus
gaagtcgcagagaaagataagggcc

SEQ ID NO: 287020 - DNA, 25 bp, Mus musculus
gaagtcgccacgcgagcaagctctc

SEQ ID NO: 287021 - DNA, 25 bp, Mus musculus
gaagtcgctcaacaagagagaaggc

SEQ ID NO: 287022 - DNA, 25 bp, Mus musculus
gaagtcgctgatgaggagactgctc

SEQ ID NO: 287023 - DNA, 25 bp, Mus musculus
gaagtcggaaagtgtggagcaaaaa

SEQ ID NO: 287024 - DNA, 25 bp, Mus musculus
gaagtcggaattcctaccctcagaa

SEQ ID NO: 287025 - DNA, 25 bp, Mus musculus
gaagtcggccaaaactgttatggtt

SEQ ID NO: 287026 - DNA, 25 bp, Mus musculus
gaagtcggcttaggagccacatata

SEQ ID NO: 287027 - DNA, 25 bp, Mus musculus
gaagtctcaggtgtcggtgacgttt

SEQ ID NO: 287028 - DNA, 25 bp, Mus musculus
gaagtctcctcccagtgccctgggg

SEQ ID NO: 287029 - DNA, 25 bp, Mus musculus
gaagtctcgacaacatgcattcatt

SEQ ID NO: 287030 - DNA, 25 bp, Mus musculus
gaagtctgagaactcagatgattgg

SEQ ID NO: 287031 - DNA, 25 bp, Mus musculus
gaagtctgagatgattgggagaaat

SEQ ID NO: 287032 - DNA, 25 bp, Mus musculus
gaagtctgagggagccagaatcact

SEQ ID NO: 287033 - DNA, 25 bp, Mus musculus
gaagtctgcactggaaccacctgat

SEQ ID NO: 287034 - DNA, 25 bp, Mus musculus
gaagtctgcagagataaagccactc

SEQ ID NO: 287035 - DNA, 25 bp, Mus musculus
gaagtctgcagtgccggtgcccccc

SEQ ID NO: 287036 - DNA, 25 bp, Mus musculus
gaagtctggcaaaatgaacactacc

SEQ ID NO: 287037 - DNA, 25 bp, Mus musculus
gaagtctgtgattcgtaagacagaa

SEQ ID NO: 287038 - DNA, 25 bp, Mus musculus
gaagtcttagtgcaggccaaaagtc

SEQ ID NO: 287039 - DNA, 25 bp, Mus musculus
gaagtcttagtgcaggctttggcag

SEQ ID NO: 287040 - DNA, 25 bp, Mus musculus
gaagtcttcattgtcagtcagggat

SEQ ID NO: 287041 - DNA, 25 bp, Mus musculus
gaagtcttcgtgggacctcgcaagc

SEQ ID NO: 287042 - DNA, 25 bp, Mus musculus
gaagtctttaagtgagcccttgaat

SEQ ID NO: 287043 - DNA, 25 bp, Mus musculus
gaagtcttttgcagcagtcctatgc

SEQ ID NO: 287044 - DNA, 25 bp, Mus musculus
gaagtgaaaaagtgccactgaggtc

SEQ ID NO: 287045 - DNA, 25 bp, Mus musculus
gaagtgaaagctgctcctgacatca

SEQ ID NO: 287046 - DNA, 25 bp, Mus musculus
gaagtgaaaggagatttctaatagc

SEQ ID NO: 287047 - DNA, 25 bp, Mus musculus
gaagtgaacaaagtctggtttttgt

SEQ ID NO: 287048 - DNA, 25 bp, Mus musculus
gaagtgaagctcaagatggagaaat

SEQ ID NO: 287049 - DNA, 25 bp, Mus musculus
gaagtgaagctcaaggttgattctt

SEQ ID NO: 287050 - DNA, 25 bp, Mus musculus
gaagtgaaggagtttctggtgtgat

SEQ ID NO: 287051 - DNA, 25 bp, Mus musculus
gaagtgaatacgaagctgttgccgc

SEQ ID NO: 287052 - DNA, 25 bp, Mus musculus
gaagtgaatccaggtggcacaagac

SEQ ID NO: 287053 - DNA, 25 bp, Mus musculus
gaagtgacagaatgaatcgcaccgc

SEQ ID NO: 287054 - DNA, 25 bp, Mus musculus
gaagtgacaggcatgagtaaagaca

SEQ ID NO: 287055 - DNA, 25 bp, Mus musculus
gaagtgacagtatgaatcgcaccgc

SEQ ID NO: 287056 - DNA, 25 bp, Mus musculus
gaagtgaccatccagaaaaaacact

SEQ ID NO: 287057 - DNA, 25 bp, Mus musculus
gaagtgacgtgaaagccagagacgc

SEQ ID NO: 287058 - DNA, 25 bp, Mus musculus
gaagtgactgagagtggaatgcagt

SEQ ID NO: 287059 - DNA, 25 bp, Mus musculus
gaagtgagggaagatggagatattc

SEQ ID NO: 287060 - DNA, 25 bp, Mus musculus
gaagtgaggggcttgcagatgggtc

SEQ ID NO: 287061 - DNA, 25 bp, Mus musculus
gaagtgagtcaggtgttaaatgaat

SEQ ID NO: 287062 - DNA, 25 bp, Mus musculus
gaagtgataaaggagattgaggacg

SEQ ID NO: 287063 - DNA, 25 bp, Mus musculus
gaagtgataaaggaggccttggaaa

SEQ ID NO: 287064 - DNA, 25 bp, Mus musculus
gaagtgatcaagattagacgtggtc

SEQ ID NO: 287065 - DNA, 25 bp, Mus musculus
gaagtgatcaagattcaaaataaac

SEQ ID NO: 287066 - DNA, 25 bp, Mus musculus
gaagtgattccaggttcagtacctc

SEQ ID NO: 287067 - DNA, 25 bp, Mus musculus
gaagtgcaaaggaggtgttttagct

SEQ ID NO: 287068 - DNA, 25 bp, Mus musculus
gaagtgcagcagccccaccagtggg

SEQ ID NO: 287069 - DNA, 25 bp, Mus musculus
gaagtgcagcagggcaagcttctag

SEQ ID NO: 287070 - DNA, 25 bp, Mus musculus
gaagtgcagctgaggagcagctgcc

SEQ ID NO: 287071 - DNA, 25 bp, Mus musculus
gaagtgcataggaggagcttcctgg

SEQ ID NO: 287072 - DNA, 25 bp, Mus musculus
gaagtgcataggagtggctgctact

SEQ ID NO: 287073 - DNA, 25 bp, Mus musculus
gaagtgcatctggcctcgaactcag

SEQ ID NO: 287074 - DNA, 25 bp, Mus musculus
gaagtgcattgagaaagaagtcaac

SEQ ID NO: 287075 - DNA, 25 bp, Mus musculus
gaagtgcattgagagctgtctgtct

SEQ ID NO: 287076 - DNA, 25 bp, Mus musculus
gaagtgccaggaatccgaatcttga

SEQ ID NO: 287077 - DNA, 25 bp, Mus musculus
gaagtgccaggagaaatctgagctg

SEQ ID NO: 287078 - DNA, 25 bp, Mus musculus
gaagtgcctcccacgtcagaaccgt

SEQ ID NO: 287079 - DNA, 25 bp, Mus musculus
gaagtgcctgacagaggagggcgcg

SEQ ID NO: 287080 - DNA, 25 bp, Mus musculus
gaagtgcctgctcttgctcccagcg

SEQ ID NO: 287081 - DNA, 25 bp, Mus musculus
gaagtgcgttatcagagtgaagcca

SEQ ID NO: 287082 - DNA, 25 bp, Mus musculus
gaagtgctccaaggatcgtggagtt

SEQ ID NO: 287083 - DNA, 25 bp, Mus musculus
gaagtgctccagtatgcagattaag

SEQ ID NO: 287084 - DNA, 25 bp, Mus musculus
gaagtgctcccaaagcattagcaga

SEQ ID NO: 287085 - DNA, 25 bp, Mus musculus
gaagtgctctggtcctccttgtcct

SEQ ID NO: 287086 - DNA, 25 bp, Mus musculus
gaagtgctgaaggcagggaagcggc

SEQ ID NO: 287087 - DNA, 25 bp, Mus musculus
gaagtgctgagcagtaacttgaatc

SEQ ID NO: 287088 - DNA, 25 bp, Mus musculus
gaagtgctgataggatccacgcaca

SEQ ID NO: 287089 - DNA, 25 bp, Mus musculus
gaagtgctggaaagcacagaacttc

SEQ ID NO: 287090 - DNA, 25 bp, Mus musculus
gaagtgctggttcctacagcaccct

SEQ ID NO: 287091 - DNA, 25 bp, Mus musculus
gaagtggaaagcgtgactccagaac

SEQ ID NO: 287092 - DNA, 25 bp, Mus musculus
gaagtggaaaggcaggtgtccacag

SEQ ID NO: 287093 - DNA, 25 bp, Mus musculus
gaagtggaaatacgaaaaccagcaa

SEQ ID NO: 287094 - DNA, 25 bp, Mus musculus
gaagtggaaataggaaaaccagcaa

SEQ ID NO: 287095 - DNA, 25 bp, Mus musculus
gaagtggaacactgactgtcacagt

SEQ ID NO: 287096 - DNA, 25 bp, Mus musculus
gaagtggaagagacaatgaatatgt

SEQ ID NO: 287097 - DNA, 25 bp, Mus musculus
gaagtggacttgatccctgctgtct

SEQ ID NO: 287098 - DNA, 25 bp, Mus musculus
gaagtggagagcgtgaaagagtttc

SEQ ID NO: 287099 - DNA, 25 bp, Mus musculus
gaagtggagagggaccttcttcacc

SEQ ID NO: 287100 - DNA, 25 bp, Mus musculus
gaagtggaggaggacttggtgaaat

SEQ ID NO: 287101 - DNA, 25 bp, Mus musculus
gaagtggaggcaaatatctgaaaga

SEQ ID NO: 287102 - DNA, 25 bp, Mus musculus
gaagtggagggactgaacttttgaa

SEQ ID NO: 287103 - DNA, 25 bp, Mus musculus
gaagtggatcgcggggtcccagctc

SEQ ID NO: 287104 - DNA, 25 bp, Mus musculus
gaagtggcagcatgctaattccact

SEQ ID NO: 287105 - DNA, 25 bp, Mus musculus
gaagtggcatttctgatgggcagcc

SEQ ID NO: 287106 - DNA, 25 bp, Mus musculus
gaagtggcatttctgtggctaactt

SEQ ID NO: 287107 - DNA, 25 bp, Mus musculus
gaagtgggacaggagaacgagaaga

SEQ ID NO: 287108 - DNA, 25 bp, Mus musculus
gaagtgggcacaagacagacaagga

SEQ ID NO: 287109 - DNA, 25 bp, Mus musculus
gaagtgggcacaagagtcagctctg

SEQ ID NO: 287110 - DNA, 25 bp, Mus musculus
gaagtgggcaggcacccagcggaac

SEQ ID NO: 287111 - DNA, 25 bp, Mus musculus
gaagtgggcagggtgaagtgtgtcc

SEQ ID NO: 287112 - DNA, 25 bp, Mus musculus
gaagtgggctgcggtatcagcctag

SEQ ID NO: 287113 - DNA, 25 bp, Mus musculus
gaagtggtagaaatggacctaccaa

SEQ ID NO: 287114 - DNA, 25 bp, Mus musculus
gaagtggtagtaatggacctaccaa

SEQ ID NO: 287115 - DNA, 25 bp, Mus musculus
gaagtggtataggatcttgaaacag

SEQ ID NO: 287116 - DNA, 25 bp, Mus musculus
gaagtggtcggaattctgcctttgg

SEQ ID NO: 287117 - DNA, 25 bp, Mus musculus
gaagtggtgggagccctatgctgct

SEQ ID NO: 287118 - DNA, 25 bp, Mus musculus
gaagtggtgtgctcggaggacacta

SEQ ID NO: 287119 - DNA, 25 bp, Mus musculus
gaagtggttctgaacacggtacaac

SEQ ID NO: 287120 - DNA, 25 bp, Mus musculus
gaagtgtaagcccggccgaattcga

SEQ ID NO: 287121 - DNA, 25 bp, Mus musculus
gaagtgtactggataagaacaagaa

SEQ ID NO: 287122 - DNA, 25 bp, Mus musculus
gaagtgtatccaggctttaagcact

SEQ ID NO: 287123 - DNA, 25 bp, Mus musculus
gaagtgtatccagggaccaccacac

SEQ ID NO: 287124 - DNA, 25 bp, Mus musculus
gaagtgtatccagggataatcttgg

SEQ ID NO: 287125 - DNA, 25 bp, Mus musculus
gaagtgtatccctgggaagatgccg

SEQ ID NO: 287126 - DNA, 25 bp, Mus musculus
gaagtgtcagcttgatactcatgga

SEQ ID NO: 287127 - DNA, 25 bp, Mus musculus
gaagtgtcaggcgtttgcacatggg

SEQ ID NO: 287128 - DNA, 25 bp, Mus musculus
gaagtgtccaggtgtaaccagccat

SEQ ID NO: 287129 - DNA, 25 bp, Mus musculus
gaagtgtctactaatttcccagcag

SEQ ID NO: 287130 - DNA, 25 bp, Mus musculus
gaagtgtctatggacgaccataaac

SEQ ID NO: 287131 - DNA, 25 bp, Mus musculus
gaagtgtctggagataacaatcgaa

SEQ ID NO: 287132 - DNA, 25 bp, Mus musculus
gaagtgtggcttggtacctggaatg

SEQ ID NO: 287133 - DNA, 25 bp, Mus musculus
gaagtgtggtgctgataatactaga

SEQ ID NO: 287134 - DNA, 25 bp, Mus musculus
gaagtgtggtggattgaaccagctg

SEQ ID NO: 287135 - DNA, 25 bp, Mus musculus
gaagtgtgtcacacgtgtggggctg

SEQ ID NO: 287136 - DNA, 25 bp, Mus musculus
gaagtgtgtggacatcaatgagtgt

SEQ ID NO: 287137 - DNA, 25 bp, Mus musculus
gaagtgttccaggacatgctaccca

SEQ ID NO: 287138 - DNA, 25 bp, Mus musculus
gaagtgttgcttgctgtgcctcaga

SEQ ID NO: 287139 - DNA, 25 bp, Mus musculus
gaagtgttgcttgttttgctggtaa

SEQ ID NO: 287140 - DNA, 25 bp, Mus musculus
gaagtgtttggattcacaacacttc

SEQ ID NO: 287141 - DNA, 25 bp, Mus musculus
gaagttaaaaagtggaatgcagtgg

SEQ ID NO: 287142 - DNA, 25 bp, Mus musculus
gaagttaaagcacggtttgctccct

SEQ ID NO: 287143 - DNA, 25 bp, Mus musculus
gaagttacaatccaagtaaacgcca

SEQ ID NO: 287144 - DNA, 25 bp, Mus musculus
gaagttacagacccactgtccgtgt

SEQ ID NO: 287145 - DNA, 25 bp, Mus musculus
gaagttacaggcccactgtccgtgt

SEQ ID NO: 287146 - DNA, 25 bp, Mus musculus
gaagttacagtcaccggaagaagat

SEQ ID NO: 287147 - DNA, 25 bp, Mus musculus
gaagttacagtttgccccggctgag

SEQ ID NO: 287148 - DNA, 25 bp, Mus musculus
gaagttagatctagtgagcagcacc

SEQ ID NO: 287149 - DNA, 25 bp, Mus musculus
gaagttagatctagtttttagagaa

SEQ ID NO: 287150 - DNA, 25 bp, Mus musculus
gaagttagcaccgtggtgagtaata

SEQ ID NO: 287151 - DNA, 25 bp, Mus musculus
gaagttatatgaaagttacgagaag

SEQ ID NO: 287152 - DNA, 25 bp, Mus musculus
gaagttattcagaagagagccaacc

SEQ ID NO: 287153 - DNA, 25 bp, Mus musculus
gaagttattcatgctcgatttattc

SEQ ID NO: 287154 - DNA, 25 bp, Mus musculus
gaagttcaagattgatgaccagcga

SEQ ID NO: 287155 - DNA, 25 bp, Mus musculus
gaagttcaaggactcccttacttta

SEQ ID NO: 287156 - DNA, 25 bp, Mus musculus
gaagttcaatatgctcccaagctcc

SEQ ID NO: 287157 - DNA, 25 bp, Mus musculus
gaagttcacaagataaccaacaacc

SEQ ID NO: 287158 - DNA, 25 bp, Mus musculus
gaagttcacaaggaatgtatcattg

SEQ ID NO: 287159 - DNA, 25 bp, Mus musculus
gaagttcaccacagtgactccatac

SEQ ID NO: 287160 - DNA, 25 bp, Mus musculus
gaagttcactctagagtcttttatt

SEQ ID NO: 287161 - DNA, 25 bp, Mus musculus
gaagttcaggaagctgatttcacaa

SEQ ID NO: 287162 - DNA, 25 bp, Mus musculus
gaagttcaggaaggtgcagacacaa

SEQ ID NO: 287163 - DNA, 25 bp, Mus musculus
gaagttcaggcagctgtgctcactg

SEQ ID NO: 287164 - DNA, 25 bp, Mus musculus
gaagttcaggcaggtaatgccatca

SEQ ID NO: 287165 - DNA, 25 bp, Mus musculus
gaagttccagggatccttgtgggcc

SEQ ID NO: 287166 - DNA, 25 bp, Mus musculus
gaagttccaggtctggaggctcatc

SEQ ID NO: 287167 - DNA, 25 bp, Mus musculus
gaagttccgattaatggaacggcgg

SEQ ID NO: 287168 - DNA, 25 bp, Mus musculus
gaagttcctgggtttgatgaagata

SEQ ID NO: 287169 - DNA, 25 bp, Mus musculus
gaagttccttcgggcctctgaagaa

SEQ ID NO: 287170 - DNA, 25 bp, Mus musculus
gaagttccttcggtgtgtcctggtc

SEQ ID NO: 287171 - DNA, 25 bp, Mus musculus
gaagttcgactccagctatgacagg

SEQ ID NO: 287172 - DNA, 25 bp, Mus musculus
gaagttcgactccagctatgctcct

SEQ ID NO: 287173 - DNA, 25 bp, Mus musculus
gaagttcgggcaggtgcagtaagtg

SEQ ID NO: 287174 - DNA, 25 bp, Mus musculus
gaagttcgtggaaggcaagaagaaa

SEQ ID NO: 287175 - DNA, 25 bp, Mus musculus
gaagttcgtggaaggggaagacagc

SEQ ID NO: 287176 - DNA, 25 bp, Mus musculus
gaagttcgtggaagggtggctggcg

SEQ ID NO: 287177 - DNA, 25 bp, Mus musculus
gaagttctacaggcacatcatcttt

SEQ ID NO: 287178 - DNA, 25 bp, Mus musculus
gaagttctctgacaggaatgaattt

SEQ ID NO: 287179 - DNA, 25 bp, Mus musculus
gaagttctttcgatgcggaatataa

SEQ ID NO: 287180 - DNA, 25 bp, Mus musculus
gaagttctttcgttgcggaatataa

SEQ ID NO: 287181 - DNA, 25 bp, Mus musculus
gaagttgaaacactatggatcgcag

SEQ ID NO: 287182 - DNA, 25 bp, Mus musculus
gaagttgaagaagagcctggaagtg

SEQ ID NO: 287183 - DNA, 25 bp, Mus musculus
gaagttgaagaagtgggaatccgga

SEQ ID NO: 287184 - DNA, 25 bp, Mus musculus
gaagttgacacactggagggagact

SEQ ID NO: 287185 - DNA, 25 bp, Mus musculus
gaagttgagcggcggctggtaagaa

SEQ ID NO: 287186 - DNA, 25 bp, Mus musculus
gaagttgatgcaaggctttcctttg

SEQ ID NO: 287187 - DNA, 25 bp, Mus musculus
gaagttgatgcaagggagctggagg

SEQ ID NO: 287188 - DNA, 25 bp, Mus musculus
gaagttgcacaaggtcattgaagcc

SEQ ID NO: 287189 - DNA, 25 bp, Mus musculus
gaagttgcagcggcaatatggttta

SEQ ID NO: 287190 - DNA, 25 bp, Mus musculus
gaagttgcaggaattattgaagccc

SEQ ID NO: 287191 - DNA, 25 bp, Mus musculus
gaagttgctcagtggacaagattgt

SEQ ID NO: 287192 - DNA, 25 bp, Mus musculus
gaagttgctgtgaaaccgggctcca

SEQ ID NO: 287193 - DNA, 25 bp, Mus musculus
gaagttggcatgaaagctgcactgc

SEQ ID NO: 287194 - DNA, 25 bp, Mus musculus
gaagttggcttggcttgagattttt

SEQ ID NO: 287195 - DNA, 25 bp, Mus musculus
gaagttggtaaagagcatcataagg

SEQ ID NO: 287196 - DNA, 25 bp, Mus musculus
gaagttggttgggtgaatttcatga

SEQ ID NO: 287197 - DNA, 25 bp, Mus musculus
gaagttgtcaatcagcacaatgctc

SEQ ID NO: 287198 - DNA, 25 bp, Mus musculus
gaagttgttggagacaaagctggct

SEQ ID NO: 287199 - DNA, 25 bp, Mus musculus
gaagttgttggcagagaactgatag

SEQ ID NO: 287200 - DNA, 25 bp, Mus musculus
gaagttgttggcaggtattcaatac

SEQ ID NO: 287201 - DNA, 25 bp, Mus musculus
gaagtttccagactcaaactgtcac

SEQ ID NO: 287202 - DNA, 25 bp, Mus musculus
gaagtttccagcctcctctggtaaa

SEQ ID NO: 287203 - DNA, 25 bp, Mus musculus
gaagtttcctgcagctatccttcgg

SEQ ID NO: 287204 - DNA, 25 bp, Mus musculus
gaagtttgaccctgaggctttaatt

SEQ ID NO: 287205 - DNA, 25 bp, Mus musculus
gaagtttgagaaatcagggatgtgt

SEQ ID NO: 287206 - DNA, 25 bp, Mus musculus
gaagtttgatgcccaggcaacttaa

SEQ ID NO: 287207 - DNA, 25 bp, Mus musculus
gaagtttgcagctaggagccctggg

SEQ ID NO: 287208 - DNA, 25 bp, Mus musculus
gaagtttgcagtgtgtgacatccct

SEQ ID NO: 287209 - DNA, 25 bp, Mus musculus
gaagtttggaaacgccattatttgc

SEQ ID NO: 287210 - DNA, 25 bp, Mus musculus
gaagtttggaaacggattctgctct

SEQ ID NO: 287211 - DNA, 25 bp, Mus musculus
gaagtttggcaaggaagcagaacaa

SEQ ID NO: 287212 - DNA, 25 bp, Mus musculus
gaagtttgtgaatgattcccatcat

SEQ ID NO: 287213 - DNA, 25 bp, Mus musculus
gaagttttcagagattgctggcctc

SEQ ID NO: 287214 - DNA, 25 bp, Mus musculus
gaagttttttgggcattgttgtgac

SEQ ID NO: 287215 - DNA, 25 bp, Mus musculus
gaagttttttggttgcaaggaagct

SEQ ID NO: 287216 - DNA, 25 bp, Mus musculus
gaataaaacaacagttaatttagag

SEQ ID NO: 287217 - DNA, 25 bp, Mus musculus
gaataaaacagaaacatggagctcg

SEQ ID NO: 287218 - DNA, 25 bp, Mus musculus
gaataaaacttcagttgttgacctc

SEQ ID NO: 287219 - DNA, 25 bp, Mus musculus
gaataaaaggtgccacaggcaccat

SEQ ID NO: 287220 - DNA, 25 bp, Mus musculus
gaataaacagactgtgacagagcct

SEQ ID NO: 287221 - DNA, 25 bp, Mus musculus
gaataaacagtctgtgacagagcct

SEQ ID NO: 287222 - DNA, 25 bp, Mus musculus
gaataaaccagaactgagcagtgtc

SEQ ID NO: 287223 - DNA, 25 bp, Mus musculus
gaataaagaaaacagagacgaagac

SEQ ID NO: 287224 - DNA, 25 bp, Mus musculus
gaataaagaaaacagttgagtggta

SEQ ID NO: 287225 - DNA, 25 bp, Mus musculus
gaataaagaaaaggctggaagttct

SEQ ID NO: 287226 - DNA, 25 bp, Mus musculus
gaataaagaaaggtgaccagaatgg

SEQ ID NO: 287227 - DNA, 25 bp, Mus musculus
gaataaagagaaaaggtctttcgca

SEQ ID NO: 287228 - DNA, 25 bp, Mus musculus
gaataaagagaaaagtgttaatggc

SEQ ID NO: 287229 - DNA, 25 bp, Mus musculus
gaataaagcgaatgaacttttctat

SEQ ID NO: 287230 - DNA, 25 bp, Mus musculus
gaataaagtatcagaaatccacttc

SEQ ID NO: 287231 - DNA, 25 bp, Mus musculus
gaataaagtatcagatgtctttatt

SEQ ID NO: 287232 - DNA, 25 bp, Mus musculus
gaataaagtatcagggctggcagtc

SEQ ID NO: 287233 - DNA, 25 bp, Mus musculus
gaataaagtcagagatccagaaatt

SEQ ID NO: 287234 - DNA, 25 bp, Mus musculus
gaataaagtcaggtatcttttggat

SEQ ID NO: 287235 - DNA, 25 bp, Mus musculus
gaataaagtcaggttttgatatttc

SEQ ID NO: 287236 - DNA, 25 bp, Mus musculus
gaataaataccggttcttcctcggc

SEQ ID NO: 287237 - DNA, 25 bp, Mus musculus
gaataaataccggtttggagattct

SEQ ID NO: 287238 - DNA, 25 bp, Mus musculus
gaataaatgcagtatctctcctctc

SEQ ID NO: 287239 - DNA, 25 bp, Mus musculus
gaataacactgcagaggactagagt

SEQ ID NO: 287240 - DNA, 25 bp, Mus musculus
gaataacactgcagggtctccaact

SEQ ID NO: 287241 - DNA, 25 bp, Mus musculus
gaataaccaggtgaggaaaaccagt

SEQ ID NO: 287242 - DNA, 25 bp, Mus musculus
gaataacctggcttcctgctaccta

SEQ ID NO: 287243 - DNA, 25 bp, Mus musculus
gaataagacaagagtttgggaaatg

SEQ ID NO: 287244 - DNA, 25 bp, Mus musculus
gaataagaccagatcatctttagat

SEQ ID NO: 287245 - DNA, 25 bp, Mus musculus
gaataagagatgacagctgaggacc

SEQ ID NO: 287246 - DNA, 25 bp, Mus musculus
gaataagagatgacgtcaggggagg

SEQ ID NO: 287247 - DNA, 25 bp, Mus musculus
gaataagatgaggtcctccaccttc

SEQ ID NO: 287248 - DNA, 25 bp, Mus musculus
gaataagcagcctcaaaatgcagcc

SEQ ID NO: 287249 - DNA, 25 bp, Mus musculus
gaataagcagtccagatttcatcct

SEQ ID NO: 287250 - DNA, 25 bp, Mus musculus
gaataagcagtccagccctattctg

SEQ ID NO: 287251 - DNA, 25 bp, Mus musculus
gaataagcagtccagctcgtctgat

SEQ ID NO: 287252 - DNA, 25 bp, Mus musculus
gaataagcagtccaggttcttactc

SEQ ID NO: 287253 - DNA, 25 bp, Mus musculus
gaataagcagttccgggcttgcatt

SEQ ID NO: 287254 - DNA, 25 bp, Mus musculus
gaataagcgccggaggactgcatga

SEQ ID NO: 287255 - DNA, 25 bp, Mus musculus
gaataaggaagcggggagtgaggca

SEQ ID NO: 287256 - DNA, 25 bp, Mus musculus
gaataaggtggttcctttggggaga

SEQ ID NO: 287257 - DNA, 25 bp, Mus musculus
gaataataaaaagtgctctatgccc

SEQ ID NO: 287258 - DNA, 25 bp, Mus musculus
gaataataaggagaatctgtactac

SEQ ID NO: 287259 - DNA, 25 bp, Mus musculus
gaataataccaggtggtgccacaga

SEQ ID NO: 287260 - DNA, 25 bp, Mus musculus
gaataatagcagtggcagcaatgtt

SEQ ID NO: 287261 - DNA, 25 bp, Mus musculus
gaataatatttctaatgcggcattc

SEQ ID NO: 287262 - DNA, 25 bp, Mus musculus
gaataatcacactgaagtgatccca

SEQ ID NO: 287263 - DNA, 25 bp, Mus musculus
gaataatcaggttttaaaatcagtc

SEQ ID NO: 287264 - DNA, 25 bp, Mus musculus
gaataatcctgttttgatggaagga

SEQ ID NO: 287265 - DNA, 25 bp, Mus musculus
gaataatgatacctcgttcgtgtct

SEQ ID NO: 287266 - DNA, 25 bp, Mus musculus
gaataatggcctcggtcactttcac

SEQ ID NO: 287267 - DNA, 25 bp, Mus musculus
gaataattcctcacagacacactgg

SEQ ID NO: 287268 - DNA, 25 bp, Mus musculus
gaataattgcctgtcacctactcaa

SEQ ID NO: 287269 - DNA, 25 bp, Mus musculus
gaataattgtgaggatgaagtttct

SEQ ID NO: 287270 - DNA, 25 bp, Mus musculus
gaatacaaggataagaatgaagaag

SEQ ID NO: 287271 - DNA, 25 bp, Mus musculus
gaatacacagcagggcatcagccgt

SEQ ID NO: 287272 - DNA, 25 bp, Mus musculus
gaatacacagcctgcataccatgag

SEQ ID NO: 287273 - DNA, 25 bp, Mus musculus
gaatacacaggccccagtgccttca

SEQ ID NO: 287274 - DNA, 25 bp, Mus musculus
gaatacacaggtgaactgtgtgagg

SEQ ID NO: 287275 - DNA, 25 bp, Mus musculus
gaatacactgagctcatgaccaggt

SEQ ID NO: 287276 - DNA, 25 bp, Mus musculus
gaatacactgcatctatattggaaa

SEQ ID NO: 287277 - DNA, 25 bp, Mus musculus
gaatacagccaggatctgagtgttc

SEQ ID NO: 287278 - DNA, 25 bp, Mus musculus
gaatacagccaggatgaggtagatg

SEQ ID NO: 287279 - DNA, 25 bp, Mus musculus
gaatacatctgccagtgtcctggca

SEQ ID NO: 287280 - DNA, 25 bp, Mus musculus
gaatacatgggcaacgctggacgta

SEQ ID NO: 287281 - DNA, 25 bp, Mus musculus
gaatacatgtcaagatgtgaatgag

SEQ ID NO: 287282 - DNA, 25 bp, Mus musculus
gaatacatgtcaagatgtggatgag

SEQ ID NO: 287283 - DNA, 25 bp, Mus musculus
gaatacatgtcaagcatcagtgaac

SEQ ID NO: 287284 - DNA, 25 bp, Mus musculus
gaatacccagccaaagccctggact

SEQ ID NO: 287285 - DNA, 25 bp, Mus musculus
gaatacccctctataaaactggtgg

SEQ ID NO: 287286 - DNA, 25 bp, Mus musculus
gaatacccctctctggtggtggagc

SEQ ID NO: 287287 - DNA, 25 bp, Mus musculus
gaatacccgactcagccctagacaa

SEQ ID NO: 287288 - DNA, 25 bp, Mus musculus
gaatacccgagttggattgtccaga

SEQ ID NO: 287289 - DNA, 25 bp, Mus musculus
gaataccctgcagcatagcatctcc

SEQ ID NO: 287290 - DNA, 25 bp, Mus musculus
gaataccctgcaggtgatctgtctg

SEQ ID NO: 287291 - DNA, 25 bp, Mus musculus
gaatacccttaccacctatgtgcca

SEQ ID NO: 287292 - DNA, 25 bp, Mus musculus
gaataccgcaagggcctgctgaaaa

SEQ ID NO: 287293 - DNA, 25 bp, Mus musculus
gaatacctaagctttctccagacca

SEQ ID NO: 287294 - DNA, 25 bp, Mus musculus
gaatacctaagtagtgttggagtgc

SEQ ID NO: 287295 - DNA, 25 bp, Mus musculus
gaatacctagcaggtcctcatgggt

SEQ ID NO: 287296 - DNA, 25 bp, Mus musculus
gaatacctcaggtgcctgaaaaagc

SEQ ID NO: 287297 - DNA, 25 bp, Mus musculus
gaatacgaagctgttgccgcacatc

SEQ ID NO: 287298 - DNA, 25 bp, Mus musculus
gaatacgcatgggatgccaatgaag

SEQ ID NO: 287299 - DNA, 25 bp, Mus musculus
gaatacgtcagacatctggcaggag

SEQ ID NO: 287300 - DNA, 25 bp, Mus musculus
gaatacgtgaagttctccaaggaga

SEQ ID NO: 287301 - DNA, 25 bp, Mus musculus
gaatacgtgtcgtcagcagcctttt

SEQ ID NO: 287302 - DNA, 25 bp, Mus musculus
gaatactcagcaatgtgggctggcc

SEQ ID NO: 287303 - DNA, 25 bp, Mus musculus
gaatactcaggatactgggaacctc

SEQ ID NO: 287304 - DNA, 25 bp, Mus musculus
gaatactgatactggtgaagaaaat

SEQ ID NO: 287305 - DNA, 25 bp, Mus musculus
gaatactgcataccgacaacatctg

SEQ ID NO: 287306 - DNA, 25 bp, Mus musculus
gaatactgtttggcatggctgccag

SEQ ID NO: 287307 - DNA, 25 bp, Mus musculus
gaatacttaggaaagccccggcagc

SEQ ID NO: 287308 - DNA, 25 bp, Mus musculus
gaatacttccaagccaactaagaag

SEQ ID NO: 287309 - DNA, 25 bp, Mus musculus
gaatagaatcagcaggtctgatctt

SEQ ID NO: 287310 - DNA, 25 bp, Mus musculus
gaatagacaaggctttgatgaggcc

SEQ ID NO: 287311 - DNA, 25 bp, Mus musculus
gaatagactaccaggttgggataaa

SEQ ID NO: 287312 - DNA, 25 bp, Mus musculus
gaatagagggaaacaggccaccatc

SEQ ID NO: 287313 - DNA, 25 bp, Mus musculus
gaatagcaaaggatgcagtcatgct

SEQ ID NO: 287314 - DNA, 25 bp, Mus musculus
gaatagcgtgcctcaggagccgtac

SEQ ID NO: 287315 - DNA, 25 bp, Mus musculus
gaatagctaagagctttgaccctgt

SEQ ID NO: 287316 - DNA, 25 bp, Mus musculus
gaatagctacaacaaccgccgagac

SEQ ID NO: 287317 - DNA, 25 bp, Mus musculus
gaataggaggcggtaaccatagaga

SEQ ID NO: 287318 - DNA, 25 bp, Mus musculus
gaataggcgaggacgcggacctcag

SEQ ID NO: 287319 - DNA, 25 bp, Mus musculus
gaatagggcacaggtatattgaaat

SEQ ID NO: 287320 - DNA, 25 bp, Mus musculus
gaatagtaggcactgatattcgaga

SEQ ID NO: 287321 - DNA, 25 bp, Mus musculus
gaatagtcagacttctgccagagcc

SEQ ID NO: 287322 - DNA, 25 bp, Mus musculus
gaatagtccccaaggactttctgag

SEQ ID NO: 287323 - DNA, 25 bp, Mus musculus
gaatagtgtgataattggccttttg

SEQ ID NO: 287324 - DNA, 25 bp, Mus musculus
gaatagtgtgtgcagcttatgatgc

SEQ ID NO: 287325 - DNA, 25 bp, Mus musculus
gaatagtgttctgttgttattttcc

SEQ ID NO: 287326 - DNA, 25 bp, Mus musculus
gaatagttctgcagagttctacagc

SEQ ID NO: 287327 - DNA, 25 bp, Mus musculus
gaatagttctgcaggacaatgcctt

SEQ ID NO: 287328 - DNA, 25 bp, Mus musculus
gaatataacatcagatattcagtga

SEQ ID NO: 287329 - DNA, 25 bp, Mus musculus
gaatataacatctttaactacaagg

SEQ ID NO: 287330 - DNA, 25 bp, Mus musculus
gaatataacatgcagatattcagtg

SEQ ID NO: 287331 - DNA, 25 bp, Mus musculus
gaatatacagcgtttgacttttgcc

SEQ ID NO: 287332 - DNA, 25 bp, Mus musculus
gaatatacagctggcagggaagctg

SEQ ID NO: 287333 - DNA, 25 bp, Mus musculus
gaatatacggaagcccctctggaac

SEQ ID NO: 287334 - DNA, 25 bp, Mus musculus
gaatatagcaacttggttctcacga

SEQ ID NO: 287335 - DNA, 25 bp, Mus musculus
gaatatataaagaggcttgcacagc

SEQ ID NO: 287336 - DNA, 25 bp, Mus musculus
gaatatatacgggttctccttgctg

SEQ ID NO: 287337 - DNA, 25 bp, Mus musculus
gaatatatatggaagaccaccagac

SEQ ID NO: 287338 - DNA, 25 bp, Mus musculus
gaatatatgtatatactgccccgga

SEQ ID NO: 287339 - DNA, 25 bp, Mus musculus
gaatatattaaccgggaatcacctg

SEQ ID NO: 287340 - DNA, 25 bp, Mus musculus
gaatatcaagaaacccccatagaat

SEQ ID NO: 287341 - DNA, 25 bp, Mus musculus
gaatatcaatacagggtctgtgatg

SEQ ID NO: 287342 - DNA, 25 bp, Mus musculus
gaatatcaccggattcatggttggc

SEQ ID NO: 287343 - DNA, 25 bp, Mus musculus
gaatatccacgctttctctgctgcc

SEQ ID NO: 287344 - DNA, 25 bp, Mus musculus
gaatatccagagactaagtctggct

SEQ ID NO: 287345 - DNA, 25 bp, Mus musculus
gaatatccccaggtactgtgcaggc

SEQ ID NO: 287346 - DNA, 25 bp, Mus musculus
gaatatccgtcgaaaagcggcatct

SEQ ID NO: 287347 - DNA, 25 bp, Mus musculus
gaatatcgaacaaaagacgaggcga

SEQ ID NO: 287348 - DNA, 25 bp, Mus musculus
gaatatcgaacctcacatgagcccc

SEQ ID NO: 287349 - DNA, 25 bp, Mus musculus
gaatatctcaacaaggcacggcagc

SEQ ID NO: 287350 - DNA, 25 bp, Mus musculus
gaatatctcaagtatgcgagaccac

SEQ ID NO: 287351 - DNA, 25 bp, Mus musculus
gaatatgaactctcatccttattct

SEQ ID NO: 287352 - DNA, 25 bp, Mus musculus
gaatatgaagagcgggcagctaaag

SEQ ID NO: 287353 - DNA, 25 bp, Mus musculus
gaatatgaagaggaggcgggccccg

SEQ ID NO: 287354 - DNA, 25 bp, Mus musculus
gaatatgaagctttggttccagtgt

SEQ ID NO: 287355 - DNA, 25 bp, Mus musculus
gaatatgaaggcatgatgggtggct

SEQ ID NO: 287356 - DNA, 25 bp, Mus musculus
gaatatgaaggtgtgatgaatcaag

SEQ ID NO: 287357 - DNA, 25 bp, Mus musculus
gaatatgaagtatggatggaagaat

SEQ ID NO: 287358 - DNA, 25 bp, Mus musculus
gaatatgatggaccccagagagatg

SEQ ID NO: 287359 - DNA, 25 bp, Mus musculus
gaatatgtagatttgggtatccgga

SEQ ID NO: 287360 - DNA, 25 bp, Mus musculus
gaatatgtcaacagaattccagagg

SEQ ID NO: 287361 - DNA, 25 bp, Mus musculus
gaatatgtcaacagcccagaaggct

SEQ ID NO: 287362 - DNA, 25 bp, Mus musculus
gaatatgtcaacaggacccacagtt

SEQ ID NO: 287363 - DNA, 25 bp, Mus musculus
gaatatgttctcatccagagccttt

SEQ ID NO: 287364 - DNA, 25 bp, Mus musculus
gaatattcacagaagaacactcaag

SEQ ID NO: 287365 - DNA, 25 bp, Mus musculus
gaatattcacagattatttatagca

SEQ ID NO: 287366 - DNA, 25 bp, Mus musculus
gaatattccaggaacattagaatgc

SEQ ID NO: 287367 - DNA, 25 bp, Mus musculus
gaatattctaagatgctcctgccag

SEQ ID NO: 287368 - DNA, 25 bp, Mus musculus
gaatattgaagtacttggttttaat

SEQ ID NO: 287369 - DNA, 25 bp, Mus musculus
gaatattgagacggccagagcagag

SEQ ID NO: 287370 - DNA, 25 bp, Mus musculus
gaatattgagcagattctcgactat

SEQ ID NO: 287371 - DNA, 25 bp, Mus musculus
gaatattgccaggagttggcatcca

SEQ ID NO: 287372 - DNA, 25 bp, Mus musculus
gaatattggcaacagacctgcctgg

SEQ ID NO: 287373 - DNA, 25 bp, Mus musculus
gaatattggcaacagttggaacgct

SEQ ID NO: 287374 - DNA, 25 bp, Mus musculus
gaatattgtcaagatcgtaccgaga

SEQ ID NO: 287375 - DNA, 25 bp, Mus musculus
gaatatttaaaaacatatgacatct

SEQ ID NO: 287376 - DNA, 25 bp, Mus musculus
gaatcaaaaatcagataacaactat

SEQ ID NO: 287377 - DNA, 25 bp, Mus musculus
gaatcaaaaatcagataagaaacct

SEQ ID NO: 287378 - DNA, 25 bp, Mus musculus
gaatcaaaaggtggcagatgaggct

SEQ ID NO: 287379 - DNA, 25 bp, Mus musculus
gaatcaaaccacagctgcactggcg

SEQ ID NO: 287380 - DNA, 25 bp, Mus musculus
gaatcaaaccacagtgagaagtctg

SEQ ID NO: 287381 - DNA, 25 bp, Mus musculus
gaatcaaagagatggatctgtccgt

SEQ ID NO: 287382 - DNA, 25 bp, Mus musculus
gaatcaaagaggatgtatatacaaa

SEQ ID NO: 287383 - DNA, 25 bp, Mus musculus
gaatcaacaagaagttaattatacc

SEQ ID NO: 287384 - DNA, 25 bp, Mus musculus
gaatcaacagagtatgtcaataggc

SEQ ID NO: 287385 - DNA, 25 bp, Mus musculus
gaatcaagccaaatctgaagtggag

SEQ ID NO: 287386 - DNA, 25 bp, Mus musculus
gaatcaagccaatccataggaatcc

SEQ ID NO: 287387 - DNA, 25 bp, Mus musculus
gaatcaaggtctggatattgaagta

SEQ ID NO: 287388 - DNA, 25 bp, Mus musculus
gaatcaaggtctggtgagaagctgg

SEQ ID NO: 287389 - DNA, 25 bp, Mus musculus
gaatcacactattgggatggaagac

SEQ ID NO: 287390 - DNA, 25 bp, Mus musculus
gaatcacactattggtcctgagttc

SEQ ID NO: 287391 - DNA, 25 bp, Mus musculus
gaatcacagatggaacaatgttgca

SEQ ID NO: 287392 - DNA, 25 bp, Mus musculus
gaatcacatggatgaaaaaaaggac

SEQ ID NO: 287393 - DNA, 25 bp, Mus musculus
gaatcacatggatggtgttctcggg

SEQ ID NO: 287394 - DNA, 25 bp, Mus musculus
gaatcaccctcaggaggagaatgaa

SEQ ID NO: 287395 - DNA, 25 bp, Mus musculus
gaatcaccctcagtttgtgcttgtc

SEQ ID NO: 287396 - DNA, 25 bp, Mus musculus
gaatcaccggcgaggagtctgcagg

SEQ ID NO: 287397 - DNA, 25 bp, Mus musculus
gaatcacgtggagtgaactcagtga

SEQ ID NO: 287398 - DNA, 25 bp, Mus musculus
gaatcacgtggatggaatgaaacct

SEQ ID NO: 287399 - DNA, 25 bp, Mus musculus
gaatcactaagagggaccagtcttg

SEQ ID NO: 287400 - DNA, 25 bp, Mus musculus
gaatcactccgacacctcctgcccc

SEQ ID NO: 287401 - DNA, 25 bp, Mus musculus
gaatcactgcccatagaactagatc

SEQ ID NO: 287402 - DNA, 25 bp, Mus musculus
gaatcagaaaaatttgctcaggaaa

SEQ ID NO: 287403 - DNA, 25 bp, Mus musculus
gaatcagacaggaatctgcttgaat

SEQ ID NO: 287404 - DNA, 25 bp, Mus musculus
gaatcagacaggtgatttgaactgt

SEQ ID NO: 287405 - DNA, 25 bp, Mus musculus
gaatcagacttcagatctgttgaac

SEQ ID NO: 287406 - DNA, 25 bp, Mus musculus
gaatcagagtggtgtctcctttgac

SEQ ID NO: 287407 - DNA, 25 bp, Mus musculus
gaatcagatcaggtggatgtgtgta

SEQ ID NO: 287408 - DNA, 25 bp, Mus musculus
gaatcagcaggtctgatcttgctct

SEQ ID NO: 287409 - DNA, 25 bp, Mus musculus
gaatcaggagcttacagatgtcctt

SEQ ID NO: 287410 - DNA, 25 bp, Mus musculus
gaatcaggatgatctcaaagccatt

SEQ ID NO: 287411 - DNA, 25 bp, Mus musculus
gaatcaggatgtgtctctctccagt

SEQ ID NO: 287412 - DNA, 25 bp, Mus musculus
gaatcagtctttaagtgccttcagt

SEQ ID NO: 287413 - DNA, 25 bp, Mus musculus
gaatcagtggcaacagtaccattca

SEQ ID NO: 287414 - DNA, 25 bp, Mus musculus
gaatcagtggggcggcccctgcccg

SEQ ID NO: 287415 - DNA, 25 bp, Mus musculus
gaatcatacatgacgcctttgactt

SEQ ID NO: 287416 - DNA, 25 bp, Mus musculus
gaatcatcgagaaacctgaaaaatg

SEQ ID NO: 287417 - DNA, 25 bp, Mus musculus
gaatcatgacagaacagccttgtct

SEQ ID NO: 287418 - DNA, 25 bp, Mus musculus
gaatcatgacaggcccattcttccg

SEQ ID NO: 287419 - DNA, 25 bp, Mus musculus
gaatcatggggaaaagtgcgcaaac

SEQ ID NO: 287420 - DNA, 25 bp, Mus musculus
gaatcatgtaccaaggagacaaaat

SEQ ID NO: 287421 - DNA, 25 bp, Mus musculus
gaatcattacagacacacctgcaaa

SEQ ID NO: 287422 - DNA, 25 bp, Mus musculus
gaatcattacaggtcctgagataaa

SEQ ID NO: 287423 - DNA, 25 bp, Mus musculus
gaatcattcaggtctgtctatccct

SEQ ID NO: 287424 - DNA, 25 bp, Mus musculus
gaatcattcagtcttccgtgtctcc

SEQ ID NO: 287425 - DNA, 25 bp, Mus musculus
gaatcatttcaagagtgagaagcgc

SEQ ID NO: 287426 - DNA, 25 bp, Mus musculus
gaatccaaacacagatccgagtggt

SEQ ID NO: 287427 - DNA, 25 bp, Mus musculus
gaatccaaacacagatggatgtagt

SEQ ID NO: 287428 - DNA, 25 bp, Mus musculus
gaatccaatcggaagggtcctaaac

SEQ ID NO: 287429 - DNA, 25 bp, Mus musculus
gaatccaccacagataactctcttc

SEQ ID NO: 287430 - DNA, 25 bp, Mus musculus
gaatccaccacaggaggaaaaagaa

SEQ ID NO: 287431 - DNA, 25 bp, Mus musculus
gaatccacgttctagattggccgtt

SEQ ID NO: 287432 - DNA, 25 bp, Mus musculus
gaatccacgttctaggctcctgtgc

SEQ ID NO: 287433 - DNA, 25 bp, Mus musculus
gaatccagaaaatgtaaagcaattg

SEQ ID NO: 287434 - DNA, 25 bp, Mus musculus
gaatccagaagacattgatcagctc

SEQ ID NO: 287435 - DNA, 25 bp, Mus musculus
gaatccagaggttggaatgaaatac

SEQ ID NO: 287436 - DNA, 25 bp, Mus musculus
gaatccagcaaacagatactctgtc

SEQ ID NO: 287437 - DNA, 25 bp, Mus musculus
gaatccagcaaacagccaaagttgt

SEQ ID NO: 287438 - DNA, 25 bp, Mus musculus
gaatccagcctgaaactgttattgg

SEQ ID NO: 287439 - DNA, 25 bp, Mus musculus
gaatccagcctggctgacgttgggg

SEQ ID NO: 287440 - DNA, 25 bp, Mus musculus
gaatccagctcagttctgcgctcgg

SEQ ID NO: 287441 - DNA, 25 bp, Mus musculus
gaatccagtccacagccattcctgc

SEQ ID NO: 287442 - DNA, 25 bp, Mus musculus
gaatccatttgatgaagctcaacaa

SEQ ID NO: 287443 - DNA, 25 bp, Mus musculus
gaatcccaaaagatctagatccaga

SEQ ID NO: 287444 - DNA, 25 bp, Mus musculus
gaatcccaccaagctctctgctgga

SEQ ID NO: 287445 - DNA, 25 bp, Mus musculus
gaatccccaccaggacctgcaagca

SEQ ID NO: 287446 - DNA, 25 bp, Mus musculus
gaatccccaggcacagaaggagctg

SEQ ID NO: 287447 - DNA, 25 bp, Mus musculus
gaatccccagtatgcagtgtatagt

SEQ ID NO: 287448 - DNA, 25 bp, Mus musculus
gaatccccagttcttagaccctgta

SEQ ID NO: 287449 - DNA, 25 bp, Mus musculus
gaatccccatgatgaatcagcagat

SEQ ID NO: 287450 - DNA, 25 bp, Mus musculus
gaatcccggctgcagggtctgtcac

SEQ ID NO: 287451 - DNA, 25 bp, Mus musculus
gaatccctgagatcaaaaccatcct

SEQ ID NO: 287452 - DNA, 25 bp, Mus musculus
gaatccctgcctgaggagctgcaga

SEQ ID NO: 287453 - DNA, 25 bp, Mus musculus
gaatccctgctatgggcatattgta

SEQ ID NO: 287454 - DNA, 25 bp, Mus musculus
gaatccgcaatgccctggctttcct

SEQ ID NO: 287455 - DNA, 25 bp, Mus musculus
gaatccgcaatgcttctggaatttc

SEQ ID NO: 287456 - DNA, 25 bp, Mus musculus
gaatccggtcatgggagttagggag

SEQ ID NO: 287457 - DNA, 25 bp, Mus musculus
gaatccgttcaggctgacggctgag

SEQ ID NO: 287458 - DNA, 25 bp, Mus musculus
gaatccgttgaagactttctgggct

SEQ ID NO: 287459 - DNA, 25 bp, Mus musculus
gaatcctaaagagactaagccccag

SEQ ID NO: 287460 - DNA, 25 bp, Mus musculus
gaatcctatacccacctgtctctct

SEQ ID NO: 287461 - DNA, 25 bp, Mus musculus
gaatcctatcagggtgaaggaggtg

SEQ ID NO: 287462 - DNA, 25 bp, Mus musculus
gaatcctcacagccaacgaggtgac

SEQ ID NO: 287463 - DNA, 25 bp, Mus musculus
gaatcctcagctgtcgagaaaccca

SEQ ID NO: 287464 - DNA, 25 bp, Mus musculus
gaatcctcaggtatcagagaagaag

SEQ ID NO: 287465 - DNA, 25 bp, Mus musculus
gaatcctcaggttcctgccctcctt

SEQ ID NO: 287466 - DNA, 25 bp, Mus musculus
gaatcctccagccaggaatggcaag

SEQ ID NO: 287467 - DNA, 25 bp, Mus musculus
gaatcctccagccaggtgatgttct

SEQ ID NO: 287468 - DNA, 25 bp, Mus musculus
gaatcctccatgacgcctgacctgc

SEQ ID NO: 287469 - DNA, 25 bp, Mus musculus
gaatcctcctccttgggcccattga

SEQ ID NO: 287470 - DNA, 25 bp, Mus musculus
gaatcctctacatgggtaaaaagca

SEQ ID NO: 287471 - DNA, 25 bp, Mus musculus
gaatcctcttggttcagacaatgaa

SEQ ID NO: 287472 - DNA, 25 bp, Mus musculus
gaatcctgactgtctacagtgtcta

SEQ ID NO: 287473 - DNA, 25 bp, Mus musculus
gaatcctgagcaatggaagagttaa

SEQ ID NO: 287474 - DNA, 25 bp, Mus musculus
gaatcctgaggctccagccaggctg

SEQ ID NO: 287475 - DNA, 25 bp, Mus musculus
gaatcctgaggtgcagcgtggcgtt

SEQ ID NO: 287476 - DNA, 25 bp, Mus musculus
gaatcctgatggaaagaacagacaa

SEQ ID NO: 287477 - DNA, 25 bp, Mus musculus
gaatcctggacagaaccagctcctg

SEQ ID NO: 287478 - DNA, 25 bp, Mus musculus
gaatcctgtgaagatattgacgaat

SEQ ID NO: 287479 - DNA, 25 bp, Mus musculus
gaatcctgtgaagatgtggatgagt

SEQ ID NO: 287480 - DNA, 25 bp, Mus musculus
gaatcctgtgtctccaatcgtggat

SEQ ID NO: 287481 - DNA, 25 bp, Mus musculus
gaatccttaccacagaatccagatt

SEQ ID NO: 287482 - DNA, 25 bp, Mus musculus
gaatccttaccacaggctccaagat

SEQ ID NO: 287483 - DNA, 25 bp, Mus musculus
gaatccttaccacaggtgctacttt

SEQ ID NO: 287484 - DNA, 25 bp, Mus musculus
gaatccttgaaagccctctgggcgt

SEQ ID NO: 287485 - DNA, 25 bp, Mus musculus
gaatccttgcagtcagaaaatgggt

SEQ ID NO: 287486 - DNA, 25 bp, Mus musculus
gaatcctttttgtgttcttgggagt

SEQ ID NO: 287487 - DNA, 25 bp, Mus musculus
gaatcgaaaggctcaggtcacaggg

SEQ ID NO: 287488 - DNA, 25 bp, Mus musculus
gaatcgaaggcctggacatacgcac

SEQ ID NO: 287489 - DNA, 25 bp, Mus musculus
gaatcgatatcaggttgatccccaa

SEQ ID NO: 287490 - DNA, 25 bp, Mus musculus
gaatcgattccagcgtctcaaaggg

SEQ ID NO: 287491 - DNA, 25 bp, Mus musculus
gaatcgattccagcgtttcatgaac

SEQ ID NO: 287492 - DNA, 25 bp, Mus musculus
gaatcgcaggaaaccaacagaacca

SEQ ID NO: 287493 - DNA, 25 bp, Mus musculus
gaatcgcaggactgtgcctggaata

SEQ ID NO: 287494 - DNA, 25 bp, Mus musculus
gaatcgccacagagcctacagagtg

SEQ ID NO: 287495 - DNA, 25 bp, Mus musculus
gaatcgccgagaggaaccaagatga

SEQ ID NO: 287496 - DNA, 25 bp, Mus musculus
gaatcgcgcgcgggggtgttccctc

SEQ ID NO: 287497 - DNA, 25 bp, Mus musculus
gaatcggaaccagttccctcagcca

SEQ ID NO: 287498 - DNA, 25 bp, Mus musculus
gaatcggaaggcaggagagtatggc

SEQ ID NO: 287499 - DNA, 25 bp, Mus musculus
gaatcgggttaaggttgaggagccc

SEQ ID NO: 287500 - DNA, 25 bp, Mus musculus
gaatcgtcactgacaccaattctag

SEQ ID NO: 287501 - DNA, 25 bp, Mus musculus
gaatcgtcactgatgcccttcccgg

SEQ ID NO: 287502 - DNA, 25 bp, Mus musculus
gaatcgtcactgatgtatgacctgc

SEQ ID NO: 287503 - DNA, 25 bp, Mus musculus
gaatcgtgagtggtcctgtccaaga

SEQ ID NO: 287504 - DNA, 25 bp, Mus musculus
gaatctaagaaggctacaaggtggg

SEQ ID NO: 287505 - DNA, 25 bp, Mus musculus
gaatctaagccaggttgccatgaag

SEQ ID NO: 287506 - DNA, 25 bp, Mus musculus
gaatctacagggatgaatggatcca

SEQ ID NO: 287507 - DNA, 25 bp, Mus musculus
gaatctacaggttatacaatggtcg

SEQ ID NO: 287508 - DNA, 25 bp, Mus musculus
gaatctactggcaaggtggtctact

SEQ ID NO: 287509 - DNA, 25 bp, Mus musculus
gaatctactggcaaggtggtctatt

SEQ ID NO: 287510 - DNA, 25 bp, Mus musculus
gaatctagaggtgaacgagattatt

SEQ ID NO: 287511 - DNA, 25 bp, Mus musculus
gaatctaggagcccaccttgggaca

SEQ ID NO: 287512 - DNA, 25 bp, Mus musculus
gaatctagttccgagtcccgctcac

SEQ ID NO: 287513 - DNA, 25 bp, Mus musculus
gaatctatggagagagtgctgaggc

SEQ ID NO: 287514 - DNA, 25 bp, Mus musculus
gaatctatggggagacaccagaggc

SEQ ID NO: 287515 - DNA, 25 bp, Mus musculus
gaatctattattggtactggcggag

SEQ ID NO: 287516 - DNA, 25 bp, Mus musculus
gaatctattgcagagttacccctgg

SEQ ID NO: 287517 - DNA, 25 bp, Mus musculus
gaatctattgcagcagtgtcagaca

SEQ ID NO: 287518 - DNA, 25 bp, Mus musculus
gaatctcaaaaaggttactgcaggg

SEQ ID NO: 287519 - DNA, 25 bp, Mus musculus
gaatctcaacacctcacgaaggggc

SEQ ID NO: 287520 - DNA, 25 bp, Mus musculus
gaatctcaagcaagttgataatgaa

SEQ ID NO: 287521 - DNA, 25 bp, Mus musculus
gaatctcatgttgagtgacaaaaga

SEQ ID NO: 287522 - DNA, 25 bp, Mus musculus
gaatctcccaggaaacctcatcgtc

SEQ ID NO: 287523 - DNA, 25 bp, Mus musculus
gaatctcccaggtagtcaataccca

SEQ ID NO: 287524 - DNA, 25 bp, Mus musculus
gaatctccctgagcaagagtgggtc

SEQ ID NO: 287525 - DNA, 25 bp, Mus musculus
gaatctccctggcgagtgactcaga

SEQ ID NO: 287526 - DNA, 25 bp, Mus musculus
gaatctcctggaaaactgggcccat

SEQ ID NO: 287527 - DNA, 25 bp, Mus musculus
gaatctctcaagacctcttctagaa

SEQ ID NO: 287528 - DNA, 25 bp, Mus musculus
gaatctctgaacctgttccagctac

SEQ ID NO: 287529 - DNA, 25 bp, Mus musculus
gaatctgaaggtccagcctgatgag

SEQ ID NO: 287530 - DNA, 25 bp, Mus musculus
gaatctgaattcagaggaggtggct

SEQ ID NO: 287531 - DNA, 25 bp, Mus musculus
gaatctgactccacgtcgtggtcct

SEQ ID NO: 287532 - DNA, 25 bp, Mus musculus
gaatctgatcctggcctgtgttgga

SEQ ID NO: 287533 - DNA, 25 bp, Mus musculus
gaatctgatgaggttgtcttgaagg

SEQ ID NO: 287534 - DNA, 25 bp, Mus musculus
gaatctgcaaggcaggtcttccatg

SEQ ID NO: 287535 - DNA, 25 bp, Mus musculus
gaatctgctaagaaggattcatggt

SEQ ID NO: 287536 - DNA, 25 bp, Mus musculus
gaatctgctaagaagggtgctcact

SEQ ID NO: 287537 - DNA, 25 bp, Mus musculus
gaatctgctgacaattgcttctact

SEQ ID NO: 287538 - DNA, 25 bp, Mus musculus
gaatctggatggctatggtcaaggt

SEQ ID NO: 287539 - DNA, 25 bp, Mus musculus
gaatctgtcagacgtgttgatgccc

SEQ ID NO: 287540 - DNA, 25 bp, Mus musculus
gaatctgtggctgaattacacagtc

SEQ ID NO: 287541 - DNA, 25 bp, Mus musculus
gaatcttaaaagaggtctggaagac

SEQ ID NO: 287542 - DNA, 25 bp, Mus musculus
gaatcttaacaagggataactctct

SEQ ID NO: 287543 - DNA, 25 bp, Mus musculus
gaatcttcaggggctggctgtgggc

SEQ ID NO: 287544 - DNA, 25 bp, Mus musculus
gaatcttcattgagcatgtttttga

SEQ ID NO: 287545 - DNA, 25 bp, Mus musculus
gaatcttccatctggtcctgcatgt

SEQ ID NO: 287546 - DNA, 25 bp, Mus musculus
gaatcttcgaggtgctggaaagaca

SEQ ID NO: 287547 - DNA, 25 bp, Mus musculus
gaatcttgacaagtggagagtacag

SEQ ID NO: 287548 - DNA, 25 bp, Mus musculus
gaatcttgccggtcctgttagcctg

SEQ ID NO: 287549 - DNA, 25 bp, Mus musculus
gaatcttgtcaggaacctcagctga

SEQ ID NO: 287550 - DNA, 25 bp, Mus musculus
gaatcttgtcaggtgtgatgaatgc

SEQ ID NO: 287551 - DNA, 25 bp, Mus musculus
gaatctttctgggtcagaaacgtac

SEQ ID NO: 287552 - DNA, 25 bp, Mus musculus
gaatctttgagtgtgagaaacttta

SEQ ID NO: 287553 - DNA, 25 bp, Mus musculus
gaatgaacagcttctacctaagcac

SEQ ID NO: 287554 - DNA, 25 bp, Mus musculus
gaatgaacggacaagaagtatttta

SEQ ID NO: 287555 - DNA, 25 bp, Mus musculus
gaatgaacggacaagttgtgtgcgc

SEQ ID NO: 287556 - DNA, 25 bp, Mus musculus
gaatgaacttgggggactgcaggcc

SEQ ID NO: 287557 - DNA, 25 bp, Mus musculus
gaatgaagaaagagctgtgcaactc

SEQ ID NO: 287558 - DNA, 25 bp, Mus musculus
gaatgaagaagcttctcttcaggag

SEQ ID NO: 287559 - DNA, 25 bp, Mus musculus
gaatgaagaaggaggtgaagattga

SEQ ID NO: 287560 - DNA, 25 bp, Mus musculus
gaatgaagatctttctgagaccaag

SEQ ID NO: 287561 - DNA, 25 bp, Mus musculus
gaatgaagccaagccctcccaggac

SEQ ID NO: 287562 - DNA, 25 bp, Mus musculus
gaatgaagccaagggcccagtgtgc

SEQ ID NO: 287563 - DNA, 25 bp, Mus musculus
gaatgaaggcgtggcaacatacgca

SEQ ID NO: 287564 - DNA, 25 bp, Mus musculus
gaatgaaggctgaacttccactttg

SEQ ID NO: 287565 - DNA, 25 bp, Mus musculus
gaatgaatgcgggctttgaagactg

SEQ ID NO: 287566 - DNA, 25 bp, Mus musculus
gaatgaattcaaaagatagtgtttt

SEQ ID NO: 287567 - DNA, 25 bp, Mus musculus
gaatgaattcaaaagctgccgttcg

SEQ ID NO: 287568 - DNA, 25 bp, Mus musculus
gaatgacaaagaattactgactttg

SEQ ID NO: 287569 - DNA, 25 bp, Mus musculus
gaatgacaagctccccgaggctcag

SEQ ID NO: 287570 - DNA, 25 bp, Mus musculus
gaatgacaaggtggaggagcggcgg

SEQ ID NO: 287571 - DNA, 25 bp, Mus musculus
gaatgacacccatgaaccgcacacc

SEQ ID NO: 287572 - DNA, 25 bp, Mus musculus
gaatgacactgtctctggctttcct

SEQ ID NO: 287573 - DNA, 25 bp, Mus musculus
gaatgacatgggatacaaactgcag

SEQ ID NO: 287574 - DNA, 25 bp, Mus musculus
gaatgacattggctcgtgagctgag

SEQ ID NO: 287575 - DNA, 25 bp, Mus musculus
gaatgacatttttgccattggctct

SEQ ID NO: 287576 - DNA, 25 bp, Mus musculus
gaatgaccaacagcaacatggccaa

SEQ ID NO: 287577 - DNA, 25 bp, Mus musculus
gaatgaccaacagtttgaaggaagg

SEQ ID NO: 287578 - DNA, 25 bp, Mus musculus
gaatgaccggcagggtgatgctgag

SEQ ID NO: 287579 - DNA, 25 bp, Mus musculus
gaatgacgagccccacaggatcgcc

SEQ ID NO: 287580 - DNA, 25 bp, Mus musculus
gaatgacgagtgtggagagcaaagg

SEQ ID NO: 287581 - DNA, 25 bp, Mus musculus
gaatgactacctgggaattaccagg

SEQ ID NO: 287582 - DNA, 25 bp, Mus musculus
gaatgactacctgggacattcctgg

SEQ ID NO: 287583 - DNA, 25 bp, Mus musculus
gaatgactctctgtggacgcaagcg

SEQ ID NO: 287584 - DNA, 25 bp, Mus musculus
gaatgactttgtaagaaactggtca

SEQ ID NO: 287585 - DNA, 25 bp, Mus musculus
gaatgactttgtaaggtatctactt

SEQ ID NO: 287586 - DNA, 25 bp, Mus musculus
gaatgagaaaaaggattcagaattt

SEQ ID NO: 287587 - DNA, 25 bp, Mus musculus
gaatgagaaagaccttgtcctggcc

SEQ ID NO: 287588 - DNA, 25 bp, Mus musculus
gaatgagacaagagatgtgcttgtg

SEQ ID NO: 287589 - DNA, 25 bp, Mus musculus
gaatgagatcaacctgccactgtcc

SEQ ID NO: 287590 - DNA, 25 bp, Mus musculus
gaatgagatgagctgcccgacgggc

SEQ ID NO: 287591 - DNA, 25 bp, Mus musculus
gaatgagatttcctgactgctcttt

SEQ ID NO: 287592 - DNA, 25 bp, Mus musculus
gaatgagcaagcggcccttgattgt

SEQ ID NO: 287593 - DNA, 25 bp, Mus musculus
gaatgagcaagcggcttgttatgct

SEQ ID NO: 287594 - DNA, 25 bp, Mus musculus
gaatgagccaaggaccagagtgagg

SEQ ID NO: 287595 - DNA, 25 bp, Mus musculus
gaatgaggaagaaaaagagagagag

SEQ ID NO: 287596 - DNA, 25 bp, Mus musculus
gaatgaggctgctgcagagcctact

SEQ ID NO: 287597 - DNA, 25 bp, Mus musculus
gaatgagtccaaaggatcagactga

SEQ ID NO: 287598 - DNA, 25 bp, Mus musculus
gaatgagtccaaagtttccattggg

SEQ ID NO: 287599 - DNA, 25 bp, Mus musculus
gaatgagtttgaggcgggatccacg

SEQ ID NO: 287600 - DNA, 25 bp, Mus musculus
gaatgatcagatgagaggctgtaag

SEQ ID NO: 287601 - DNA, 25 bp, Mus musculus
gaatgatccagctacatcaaaatag

SEQ ID NO: 287602 - DNA, 25 bp, Mus musculus
gaatgatctggagtgccccgagcct

SEQ ID NO: 287603 - DNA, 25 bp, Mus musculus
gaatgatgaaacagtcaaaacaatt

SEQ ID NO: 287604 - DNA, 25 bp, Mus musculus
gaatgatgaaacagtgaaaaccata

SEQ ID NO: 287605 - DNA, 25 bp, Mus musculus
gaatgatgaatgacgaataggtgaa

SEQ ID NO: 287606 - DNA, 25 bp, Mus musculus
gaatgatgagagccagctctcccct

SEQ ID NO: 287607 - DNA, 25 bp, Mus musculus
gaatgatgagctctcccctgccacc

SEQ ID NO: 287608 - DNA, 25 bp, Mus musculus
gaatgatgcagagtcctccccgtca

SEQ ID NO: 287609 - DNA, 25 bp, Mus musculus
gaatgattaatgacaccaattctag

SEQ ID NO: 287610 - DNA, 25 bp, Mus musculus
gaatgattacaacatttcagaaggt

SEQ ID NO: 287611 - DNA, 25 bp, Mus musculus
gaatgattttaggttacagccaagc

SEQ ID NO: 287612 - DNA, 25 bp, Mus musculus
gaatgcacagacgtggacgaatgtg

SEQ ID NO: 287613 - DNA, 25 bp, Mus musculus
gaatgcacaggtcctgtggctgtta

SEQ ID NO: 287614 - DNA, 25 bp, Mus musculus
gaatgcagagcttaagccaatccat

SEQ ID NO: 287615 - DNA, 25 bp, Mus musculus
gaatgcagaggtgaggcatgaaatt

SEQ ID NO: 287616 - DNA, 25 bp, Mus musculus
gaatgcagccagcgggtattcccct

SEQ ID NO: 287617 - DNA, 25 bp, Mus musculus
gaatgcagccagggcctgtgtttgg

SEQ ID NO: 287618 - DNA, 25 bp, Mus musculus
gaatgcaggactgtctccttagtgc

SEQ ID NO: 287619 - DNA, 25 bp, Mus musculus
gaatgcaggcccaagcctccattga

SEQ ID NO: 287620 - DNA, 25 bp, Mus musculus
gaatgcaggcccaaggtctccatgg

SEQ ID NO: 287621 - DNA, 25 bp, Mus musculus
gaatgcagtagaagccatgctggcc

SEQ ID NO: 287622 - DNA, 25 bp, Mus musculus
gaatgccaaactccgtgtcgaccag

SEQ ID NO: 287623 - DNA, 25 bp, Mus musculus
gaatgccaatgcgactgcttttttc

SEQ ID NO: 287624 - DNA, 25 bp, Mus musculus
gaatgccacaactgatgccttaact

SEQ ID NO: 287625 - DNA, 25 bp, Mus musculus
gaatgccacgctgagcaccatcaat

SEQ ID NO: 287626 - DNA, 25 bp, Mus musculus
gaatgcccaatggcacccaggcccg

SEQ ID NO: 287627 - DNA, 25 bp, Mus musculus
gaatgcccgaaggagccgggtcaaa

SEQ ID NO: 287628 - DNA, 25 bp, Mus musculus
gaatgcccgaaggtagagaaaccta

SEQ ID NO: 287629 - DNA, 25 bp, Mus musculus
gaatgccctgcagggtttgtccgcc

SEQ ID NO: 287630 - DNA, 25 bp, Mus musculus
gaatgccgatggagctgtcttgcag

SEQ ID NO: 287631 - DNA, 25 bp, Mus musculus
gaatgccttccaaggaaacctctgc

SEQ ID NO: 287632 - DNA, 25 bp, Mus musculus
gaatgccttccaaggttgagagctg

SEQ ID NO: 287633 - DNA, 25 bp, Mus musculus
gaatgcgcacggtagcactcagcat

SEQ ID NO: 287634 - DNA, 25 bp, Mus musculus
gaatgcgcagattaagaaacaaacg

SEQ ID NO: 287635 - DNA, 25 bp, Mus musculus
gaatgcggatatgtggccgatctgt

SEQ ID NO: 287636 - DNA, 25 bp, Mus musculus
gaatgcgggagaaggtttttcgttg

SEQ ID NO: 287637 - DNA, 25 bp, Mus musculus
gaatgcgtcgagcagagtgtctaca

SEQ ID NO: 287638 - DNA, 25 bp, Mus musculus
gaatgctaacaagagtgaaattcca

SEQ ID NO: 287639 - DNA, 25 bp, Mus musculus
gaatgctatccagatgtacgtgccc

SEQ ID NO: 287640 - DNA, 25 bp, Mus musculus
gaatgctctggtgtccgccgatgcc

SEQ ID NO: 287641 - DNA, 25 bp, Mus musculus
gaatgctgaaaagaatgatggaaac

SEQ ID NO: 287642 - DNA, 25 bp, Mus musculus
gaatgctgaaaagttgccagtagtt

SEQ ID NO: 287643 - DNA, 25 bp, Mus musculus
gaatgctgatcaaccattgcagacc

SEQ ID NO: 287644 - DNA, 25 bp, Mus musculus
gaatgctgatcaagcaccacacagt

SEQ ID NO: 287645 - DNA, 25 bp, Mus musculus
gaatgctgccgtttggtggtgaagc

SEQ ID NO: 287646 - DNA, 25 bp, Mus musculus
gaatgctggcagaaggagctaactg

SEQ ID NO: 287647 - DNA, 25 bp, Mus musculus
gaatgcttataagggtccgtcgtaa

SEQ ID NO: 287648 - DNA, 25 bp, Mus musculus
gaatgcttgggaattgaatccaggg

SEQ ID NO: 287649 - DNA, 25 bp, Mus musculus
gaatgcttgggagagttaaccttgg

SEQ ID NO: 287650 - DNA, 25 bp, Mus musculus
gaatgctttcagccccagccgttca

SEQ ID NO: 287651 - DNA, 25 bp, Mus musculus
gaatgctttccaggattcacagaaa

SEQ ID NO: 287652 - DNA, 25 bp, Mus musculus
gaatggaaataatgctcttcatctt

SEQ ID NO: 287653 - DNA, 25 bp, Mus musculus
gaatggaagcagatcctgcctctca

SEQ ID NO: 287654 - DNA, 25 bp, Mus musculus
gaatggaagcccagctcacaggaag

SEQ ID NO: 287655 - DNA, 25 bp, Mus musculus
gaatggacagggtaaagaaggaatg

SEQ ID NO: 287656 - DNA, 25 bp, Mus musculus
gaatggactttgaagcatttttcag

SEQ ID NO: 287657 - DNA, 25 bp, Mus musculus
gaatggagagaggaggctgctcccc

SEQ ID NO: 287658 - DNA, 25 bp, Mus musculus
gaatggagagagtttggaagaactg

SEQ ID NO: 287659 - DNA, 25 bp, Mus musculus
gaatggagttggctctgctctgacc

SEQ ID NO: 287660 - DNA, 25 bp, Mus musculus
gaatggatagccaggtgccagaact

SEQ ID NO: 287661 - DNA, 25 bp, Mus musculus
gaatggatcccgggcgtccatgctg

SEQ ID NO: 287662 - DNA, 25 bp, Mus musculus
gaatggcaaaaaggtggtggagaaa

SEQ ID NO: 287663 - DNA, 25 bp, Mus musculus
gaatggcaaggtgctggatggttcc

SEQ ID NO: 287664 - DNA, 25 bp, Mus musculus
gaatggcagcacagcttagaaccat

SEQ ID NO: 287665 - DNA, 25 bp, Mus musculus
gaatggcaggaaatctcaccacatc

SEQ ID NO: 287666 - DNA, 25 bp, Mus musculus
gaatggcatgattgaggactgggag

SEQ ID NO: 287667 - DNA, 25 bp, Mus musculus
gaatggcccgccctcctcgcccgac

SEQ ID NO: 287668 - DNA, 25 bp, Mus musculus
gaatggcctgagaattcttttcgtc

SEQ ID NO: 287669 - DNA, 25 bp, Mus musculus
gaatggcgccgccgggttcaagcgc

SEQ ID NO: 287670 - DNA, 25 bp, Mus musculus
gaatggcggaagatataacagactt

SEQ ID NO: 287671 - DNA, 25 bp, Mus musculus
gaatggcgtgcattttctgcagcta

SEQ ID NO: 287672 - DNA, 25 bp, Mus musculus
gaatggcgtggcagtgtacagctgt

SEQ ID NO: 287673 - DNA, 25 bp, Mus musculus
gaatggcttccttcatgaagataag

SEQ ID NO: 287674 - DNA, 25 bp, Mus musculus
gaatggcttctgagaaactggtcaa

SEQ ID NO: 287675 - DNA, 25 bp, Mus musculus
gaatgggaaaagtacgagatgagaa

SEQ ID NO: 287676 - DNA, 25 bp, Mus musculus
gaatgggacaggagacaagatccct

SEQ ID NO: 287677 - DNA, 25 bp, Mus musculus
gaatgggagagatgcagaaagagag

SEQ ID NO: 287678 - DNA, 25 bp, Mus musculus
gaatgggagagcttttgcctaccaa

SEQ ID NO: 287679 - DNA, 25 bp, Mus musculus
gaatgggagctgatgttcaggtaaa

SEQ ID NO: 287680 - DNA, 25 bp, Mus musculus
gaatgggagctggtaaatgatgatg

SEQ ID NO: 287681 - DNA, 25 bp, Mus musculus
gaatgggaggctatggtcgtggtgg

SEQ ID NO: 287682 - DNA, 25 bp, Mus musculus
gaatgggcacaaggcgacccaagct

SEQ ID NO: 287683 - DNA, 25 bp, Mus musculus
gaatgggcacaagggtgtggactgc

SEQ ID NO: 287684 - DNA, 25 bp, Mus musculus
gaatgggcagcacatttaaaatcca

SEQ ID NO: 287685 - DNA, 25 bp, Mus musculus
gaatgggcaggtggcactgatggaa

SEQ ID NO: 287686 - DNA, 25 bp, Mus musculus
gaatgggcagttgttacaggtggca

SEQ ID NO: 287687 - DNA, 25 bp, Mus musculus
gaatgggcatgtctacacctgcatg

SEQ ID NO: 287688 - DNA, 25 bp, Mus musculus
gaatgggccaagcagaaaagaaatg

SEQ ID NO: 287689 - DNA, 25 bp, Mus musculus
gaatgggcgcagacatgaaagcttg

SEQ ID NO: 287690 - DNA, 25 bp, Mus musculus
gaatgggctacataccatctgccag

SEQ ID NO: 287691 - DNA, 25 bp, Mus musculus
gaatgggctacatcccgtatgtgca

SEQ ID NO: 287692 - DNA, 25 bp, Mus musculus
gaatgggctaggcaaaagatgtgat

SEQ ID NO: 287693 - DNA, 25 bp, Mus musculus
gaatgggctagtcacagttgcagat

SEQ ID NO: 287694 - DNA, 25 bp, Mus musculus
gaatgggctgaagagaatgcaaagc

SEQ ID NO: 287695 - DNA, 25 bp, Mus musculus
gaatggggacagtgtcttacactta

SEQ ID NO: 287696 - DNA, 25 bp, Mus musculus
gaatggggagctggccccacagggc

SEQ ID NO: 287697 - DNA, 25 bp, Mus musculus
gaatggggagctggctaagctggtg

SEQ ID NO: 287698 - DNA, 25 bp, Mus musculus
gaatgggtcagacagcgtcatcatg

SEQ ID NO: 287699 - DNA, 25 bp, Mus musculus
gaatgggtcagacaggcaagggctc

SEQ ID NO: 287700 - DNA, 25 bp, Mus musculus
gaatgggtctgacaggcacagtaga

SEQ ID NO: 287701 - DNA, 25 bp, Mus musculus
gaatgggtctgacagtgttgtcatg

SEQ ID NO: 287702 - DNA, 25 bp, Mus musculus
gaatggtaaagacagcacagccccc

SEQ ID NO: 287703 - DNA, 25 bp, Mus musculus
gaatggtaaagacagcctaaccatg

SEQ ID NO: 287704 - DNA, 25 bp, Mus musculus
gaatggtcagtgttggtttcaacct

SEQ ID NO: 287705 - DNA, 25 bp, Mus musculus
gaatggtcatgatggtaccaggagc

SEQ ID NO: 287706 - DNA, 25 bp, Mus musculus
gaatggtgtggagtttgcagattcc

SEQ ID NO: 287707 - DNA, 25 bp, Mus musculus
gaatggttatactaatggaattgct

SEQ ID NO: 287708 - DNA, 25 bp, Mus musculus
gaatggttatactgccttaacatgg

SEQ ID NO: 287709 - DNA, 25 bp, Mus musculus
gaatggttatgataattagcaccat

SEQ ID NO: 287710 - DNA, 25 bp, Mus musculus
gaatggttcacagagatcccagaaa

SEQ ID NO: 287711 - DNA, 25 bp, Mus musculus
gaatggtttttggtctcagtgtgtt

SEQ ID NO: 287712 - DNA, 25 bp, Mus musculus
gaatgtactgaaggatttctggtag

SEQ ID NO: 287713 - DNA, 25 bp, Mus musculus
gaatgtagcccggagccttctgatg

SEQ ID NO: 287714 - DNA, 25 bp, Mus musculus
gaatgtagcctacagatgaaaaacg

SEQ ID NO: 287715 - DNA, 25 bp, Mus musculus
gaatgtagcctacaggtggcggagg

SEQ ID NO: 287716 - DNA, 25 bp, Mus musculus
gaatgtagtgaagctatgccattgt

SEQ ID NO: 287717 - DNA, 25 bp, Mus musculus
gaatgtagtgaagctccttggcgag

SEQ ID NO: 287718 - DNA, 25 bp, Mus musculus
gaatgtatatattaggctatgtggt

SEQ ID NO: 287719 - DNA, 25 bp, Mus musculus
gaatgtatgacgaggagacccgcat

SEQ ID NO: 287720 - DNA, 25 bp, Mus musculus
gaatgtatgatgaggagacccgcat

SEQ ID NO: 287721 - DNA, 25 bp, Mus musculus
gaatgtattcaagatgctggagact

SEQ ID NO: 287722 - DNA, 25 bp, Mus musculus
gaatgtattcaaggtctgcgacgag

SEQ ID NO: 287723 - DNA, 25 bp, Mus musculus
gaatgtcaaagattgtaacataaaa

SEQ ID NO: 287724 - DNA, 25 bp, Mus musculus
gaatgtcaagatgaagatgaatgtg

SEQ ID NO: 287725 - DNA, 25 bp, Mus musculus
gaatgtcaagatgttaacgaatgtc

SEQ ID NO: 287726 - DNA, 25 bp, Mus musculus
gaatgtcaagggaagttgagaagca

SEQ ID NO: 287727 - DNA, 25 bp, Mus musculus
gaatgtcacagatgccatctcatct

SEQ ID NO: 287728 - DNA, 25 bp, Mus musculus
gaatgtcagattccagattaccagg

SEQ ID NO: 287729 - DNA, 25 bp, Mus musculus
gaatgtcagcaggatggcacgctca

SEQ ID NO: 287730 - DNA, 25 bp, Mus musculus
gaatgtcagcccaggtgctgtgagt

SEQ ID NO: 287731 - DNA, 25 bp, Mus musculus
gaatgtccactgttccccattttct

SEQ ID NO: 287732 - DNA, 25 bp, Mus musculus
gaatgtccaggaccccctggccccc

SEQ ID NO: 287733 - DNA, 25 bp, Mus musculus
gaatgtccaggtcctttcctcttcc

SEQ ID NO: 287734 - DNA, 25 bp, Mus musculus
gaatgtcccaacaggccatccgctg

SEQ ID NO: 287735 - DNA, 25 bp, Mus musculus
gaatgtctaataaaactggatggct

SEQ ID NO: 287736 - DNA, 25 bp, Mus musculus
gaatgtctcctgaacttcgaggcct

SEQ ID NO: 287737 - DNA, 25 bp, Mus musculus
gaatgtctcctgtctgtggtgcaat

SEQ ID NO: 287738 - DNA, 25 bp, Mus musculus
gaatgtctgcctttggaaaggagca

SEQ ID NO: 287739 - DNA, 25 bp, Mus musculus
gaatgtgaaaagagtgtcccagcag

SEQ ID NO: 287740 - DNA, 25 bp, Mus musculus
gaatgtgaacaaagtgaattccaag

SEQ ID NO: 287741 - DNA, 25 bp, Mus musculus
gaatgtgaagagctgctggagcagg

SEQ ID NO: 287742 - DNA, 25 bp, Mus musculus
gaatgtgacaagatcgtgaacctta

SEQ ID NO: 287743 - DNA, 25 bp, Mus musculus
gaatgtgacaaggcatatctagatg

SEQ ID NO: 287744 - DNA, 25 bp, Mus musculus
gaatgtgataggtttgccagatctg

SEQ ID NO: 287745 - DNA, 25 bp, Mus musculus
gaatgtgatctgcaggaccagtcca

SEQ ID NO: 287746 - DNA, 25 bp, Mus musculus
gaatgtgccagaaagctgccccacg

SEQ ID NO: 287747 - DNA, 25 bp, Mus musculus
gaatgtgctggaattgtctgtaagt

SEQ ID NO: 287748 - DNA, 25 bp, Mus musculus
gaatgtgctgggttttctgtctcca

SEQ ID NO: 287749 - DNA, 25 bp, Mus musculus
gaatgtgcttgtcaggaacaatcca

SEQ ID NO: 287750 - DNA, 25 bp, Mus musculus
gaatgtggagccactgtatggcttc

SEQ ID NO: 287751 - DNA, 25 bp, Mus musculus
gaatgtggcaaccagaatggggaat

SEQ ID NO: 287752 - DNA, 25 bp, Mus musculus
gaatgtggcaaccaggctgacaggg

SEQ ID NO: 287753 - DNA, 25 bp, Mus musculus
gaatgtggccaggcctgcaccacgg

SEQ ID NO: 287754 - DNA, 25 bp, Mus musculus
gaatgtgtatggcctgcaggcgtac

SEQ ID NO: 287755 - DNA, 25 bp, Mus musculus
gaatgtgtcctgattaccgacagca

SEQ ID NO: 287756 - DNA, 25 bp, Mus musculus
gaatgtgtcctgtcccacgctcagg

SEQ ID NO: 287757 - DNA, 25 bp, Mus musculus
gaatgtgtgagagaaaccttataag

SEQ ID NO: 287758 - DNA, 25 bp, Mus musculus
gaatgtgtgcatagagtgttattgt

SEQ ID NO: 287759 - DNA, 25 bp, Mus musculus
gaatgtgtgcatagctaatgtctgc

SEQ ID NO: 287760 - DNA, 25 bp, Mus musculus
gaatgtgtgttggcgctaccctgat

SEQ ID NO: 287761 - DNA, 25 bp, Mus musculus
gaatgttcaacagtgcacagtgtgt

SEQ ID NO: 287762 - DNA, 25 bp, Mus musculus
gaatgttccaagtaccccagcaaga

SEQ ID NO: 287763 - DNA, 25 bp, Mus musculus
gaatgttccagacgtgaagcccttc

SEQ ID NO: 287764 - DNA, 25 bp, Mus musculus
gaatgttccccattgtaacataaaa

SEQ ID NO: 287765 - DNA, 25 bp, Mus musculus
gaatgttccccgtaacaaatcacaa

SEQ ID NO: 287766 - DNA, 25 bp, Mus musculus
gaatgttccccgtcagaaacgtact

SEQ ID NO: 287767 - DNA, 25 bp, Mus musculus
gaatgtttcacagatagaagctttg

SEQ ID NO: 287768 - DNA, 25 bp, Mus musculus
gaatgtttcacagttcttccagaaa

SEQ ID NO: 287769 - DNA, 25 bp, Mus musculus
gaatgtttggatattgatgagtgtg

SEQ ID NO: 287770 - DNA, 25 bp, Mus musculus
gaatgtttggttattgatgagtgtg

SEQ ID NO: 287771 - DNA, 25 bp, Mus musculus
gaattaaacaggcatgatgcacagc

SEQ ID NO: 287772 - DNA, 25 bp, Mus musculus
gaattaaactaggcctgaggagcga

SEQ ID NO: 287773 - DNA, 25 bp, Mus musculus
gaattaagcaagatgagaagccagc

SEQ ID NO: 287774 - DNA, 25 bp, Mus musculus
gaattaagcaaggctgtggacttaa

SEQ ID NO: 287775 - DNA, 25 bp, Mus musculus
gaattaaggaagttacaatgatttt

SEQ ID NO: 287776 - DNA, 25 bp, Mus musculus
gaattaatagctaaaaggacaacgc

SEQ ID NO: 287777 - DNA, 25 bp, Mus musculus
gaattacaagtgtaaagtagtcgcc

SEQ ID NO: 287778 - DNA, 25 bp, Mus musculus
gaattacaagtgtgaagtagtcgcc

SEQ ID NO: 287779 - DNA, 25 bp, Mus musculus
gaattacagagcatgaaatgcattg

SEQ ID NO: 287780 - DNA, 25 bp, Mus musculus
gaattaccgatggatctggtggccc

SEQ ID NO: 287781 - DNA, 25 bp, Mus musculus
gaattacctgtgatgtctcacacca

SEQ ID NO: 287782 - DNA, 25 bp, Mus musculus
gaattagcaaaagtgcttggctgtc

SEQ ID NO: 287783 - DNA, 25 bp, Mus musculus
gaattagccctctttgaaccctgaa

SEQ ID NO: 287784 - DNA, 25 bp, Mus musculus
gaattagccctgtcttcttcccgtg

SEQ ID NO: 287785 - DNA, 25 bp, Mus musculus
gaattaggactcagtggcaatgtat

SEQ ID NO: 287786 - DNA, 25 bp, Mus musculus
gaattataaaaaggcacagaagaat

SEQ ID NO: 287787 - DNA, 25 bp, Mus musculus
gaattatcacaatgaggttgacatt

SEQ ID NO: 287788 - DNA, 25 bp, Mus musculus
gaattatcctgcaagggagcccggt

SEQ ID NO: 287789 - DNA, 25 bp, Mus musculus
gaattatgagcacgatcagtatgag

SEQ ID NO: 287790 - DNA, 25 bp, Mus musculus
gaattatgagcaggatcagtatgag

SEQ ID NO: 287791 - DNA, 25 bp, Mus musculus
gaattatgagctacagaagttattc

SEQ ID NO: 287792 - DNA, 25 bp, Mus musculus
gaattatgaggtctacaagcaggaa

SEQ ID NO: 287793 - DNA, 25 bp, Mus musculus
gaattatgatgcatcggatgtcgtc

SEQ ID NO: 287794 - DNA, 25 bp, Mus musculus
gaattattctgctcttcctcccctc

SEQ ID NO: 287795 - DNA, 25 bp, Mus musculus
gaattatttcggcaggaattagctc

SEQ ID NO: 287796 - DNA, 25 bp, Mus musculus
gaattatttcggcaggcaatacgga

SEQ ID NO: 287797 - DNA, 25 bp, Mus musculus
gaattattttcagagaagcagaaga

SEQ ID NO: 287798 - DNA, 25 bp, Mus musculus
gaattcaaaagaattactcagaagg

SEQ ID NO: 287799 - DNA, 25 bp, Mus musculus
gaattcaaaagatagtgttttgggt

SEQ ID NO: 287800 - DNA, 25 bp, Mus musculus
gaattcaaaagctgccgttcggctc

SEQ ID NO: 287801 - DNA, 25 bp, Mus musculus
gaattcaaaggaggttcatgagtta

SEQ ID NO: 287802 - DNA, 25 bp, Mus musculus
gaattcaaatgaactaactacttga

SEQ ID NO: 287803 - DNA, 25 bp, Mus musculus
gaattcaaatgaactgggaaactag

SEQ ID NO: 287804 - DNA, 25 bp, Mus musculus
gaattcaaattttgctacaaaaggc

SEQ ID NO: 287805 - DNA, 25 bp, Mus musculus
gaattcaaattttggcacgcagcta

SEQ ID NO: 287806 - DNA, 25 bp, Mus musculus
gaattcaacaagaatttggatgtat

SEQ ID NO: 287807 - DNA, 25 bp, Mus musculus
gaattcaacaaggtgtcggtgctga

SEQ ID NO: 287808 - DNA, 25 bp, Mus musculus
gaattcaacagacaagtcaagagca

SEQ ID NO: 287809 - DNA, 25 bp, Mus musculus
gaattcaagagtatggggaaaaaga

SEQ ID NO: 287810 - DNA, 25 bp, Mus musculus
gaattcaagagtattcggggaaacc

SEQ ID NO: 287811 - DNA, 25 bp, Mus musculus
gaattcaagcagagggttcgcaaag

SEQ ID NO: 287812 - DNA, 25 bp, Mus musculus
gaattcaagcagatttacaagggcc

SEQ ID NO: 287813 - DNA, 25 bp, Mus musculus
gaattcaaggagctgcaacaacatt

SEQ ID NO: 287814 - DNA, 25 bp, Mus musculus
gaattcaagtcctgagatgagccgc

SEQ ID NO: 287815 - DNA, 25 bp, Mus musculus
gaattcaagtcctgctctacagagg

SEQ ID NO: 287816 - DNA, 25 bp, Mus musculus
gaattcaagtcctggtgtggaggct

SEQ ID NO: 287817 - DNA, 25 bp, Mus musculus
gaattcaagtgttggactggaactt

SEQ ID NO: 287818 - DNA, 25 bp, Mus musculus
gaattcaagtgttggcagcagtggt

SEQ ID NO: 287819 - DNA, 25 bp, Mus musculus
gaattcaagttagttgatctgcctg

SEQ ID NO: 287820 - DNA, 25 bp, Mus musculus
gaattcaatcacgcagtcatgttta

SEQ ID NO: 287821 - DNA, 25 bp, Mus musculus
gaattcaatcacgcagtggatcgta

SEQ ID NO: 287822 - DNA, 25 bp, Mus musculus
gaattcagaaacagtggaagcatca

SEQ ID NO: 287823 - DNA, 25 bp, Mus musculus
gaattcaggggggaggatgacttgt

SEQ ID NO: 287824 - DNA, 25 bp, Mus musculus
gaattcatcttaggtcgggatggtg

SEQ ID NO: 287825 - DNA, 25 bp, Mus musculus
gaattcatgcagcactatgccttcc

SEQ ID NO: 287826 - DNA, 25 bp, Mus musculus
gaattcattgtggaggtcaacgtcc

SEQ ID NO: 287827 - DNA, 25 bp, Mus musculus
gaattccaaatagcatagcttgtgt

SEQ ID NO: 287828 - DNA, 25 bp, Mus musculus
gaattccaaatgcttacttttctgg

SEQ ID NO: 287829 - DNA, 25 bp, Mus musculus
gaattccacggacctagactcagca

SEQ ID NO: 287830 - DNA, 25 bp, Mus musculus
gaattccagaaagatggaaccgccc

SEQ ID NO: 287831 - DNA, 25 bp, Mus musculus
gaattccagaaagtgtctatcgcag

SEQ ID NO: 287832 - DNA, 25 bp, Mus musculus
gaattccagaacaagattcttttcg

SEQ ID NO: 287833 - DNA, 25 bp, Mus musculus
gaattccagaacaagtttccataga

SEQ ID NO: 287834 - DNA, 25 bp, Mus musculus
gaattccagacacaagtacccacca

SEQ ID NO: 287835 - DNA, 25 bp, Mus musculus
gaattccagacagcttttcaagatc

SEQ ID NO: 287836 - DNA, 25 bp, Mus musculus
gaattccagctgatggagacctgac

SEQ ID NO: 287837 - DNA, 25 bp, Mus musculus
gaattccagctgggtgagtctgtaa

SEQ ID NO: 287838 - DNA, 25 bp, Mus musculus
gaattccatttaacgttctgatgaa

SEQ ID NO: 287839 - DNA, 25 bp, Mus musculus
gaattcccaaatggatgacaagtgg

SEQ ID NO: 287840 - DNA, 25 bp, Mus musculus
gaattcccaaatggattttctctat

SEQ ID NO: 287841 - DNA, 25 bp, Mus musculus
gaattcccagcctaggcgaaacctg

SEQ ID NO: 287842 - DNA, 25 bp, Mus musculus
gaattccggagctggactgaacttt

SEQ ID NO: 287843 - DNA, 25 bp, Mus musculus
gaattcctaaaagcagccaacaaga

SEQ ID NO: 287844 - DNA, 25 bp, Mus musculus
gaattcctccaggagtacatcataa

SEQ ID NO: 287845 - DNA, 25 bp, Mus musculus
gaattccttgaatccgacgtggagg

SEQ ID NO: 287846 - DNA, 25 bp, Mus musculus
gaattccttgatccaaacgcacaga

SEQ ID NO: 287847 - DNA, 25 bp, Mus musculus
gaattcgaagagccacctaacaaag

SEQ ID NO: 287848 - DNA, 25 bp, Mus musculus
gaattcgatccaggctccccggctg

SEQ ID NO: 287849 - DNA, 25 bp, Mus musculus
gaattcgatccaggtgctaccaagt

SEQ ID NO: 287850 - DNA, 25 bp, Mus musculus
gaattcgcacagtggggtcggttac

SEQ ID NO: 287851 - DNA, 25 bp, Mus musculus
gaattcgcacagtgtgtgttttgtg

SEQ ID NO: 287852 - DNA, 25 bp, Mus musculus
gaattctactactgggactcgtact

SEQ ID NO: 287853 - DNA, 25 bp, Mus musculus
gaattctagggtactcaatgcaaga

SEQ ID NO: 287854 - DNA, 25 bp, Mus musculus
gaattctatgctaataacatgtacc

SEQ ID NO: 287855 - DNA, 25 bp, Mus musculus
gaattctcacgcaagaccctgactg

SEQ ID NO: 287856 - DNA, 25 bp, Mus musculus
gaattctcagatgccagcatgtctc

SEQ ID NO: 287857 - DNA, 25 bp, Mus musculus
gaattctcaggaacatcatgacaac

SEQ ID NO: 287858 - DNA, 25 bp, Mus musculus
gaattctcaggtcctctttcagctc

SEQ ID NO: 287859 - DNA, 25 bp, Mus musculus
gaattctcagttaaatttaaaaagg

SEQ ID NO: 287860 - DNA, 25 bp, Mus musculus
gaattctcatcaaggataacagcaa

SEQ ID NO: 287861 - DNA, 25 bp, Mus musculus
gaattctccaagaatgggaaatgca

SEQ ID NO: 287862 - DNA, 25 bp, Mus musculus
gaattctcgcccgaacctcttgaag

SEQ ID NO: 287863 - DNA, 25 bp, Mus musculus
gaattctcttcagtaccgggaggtg

SEQ ID NO: 287864 - DNA, 25 bp, Mus musculus
gaattctgaagaggacagctcttac

SEQ ID NO: 287865 - DNA, 25 bp, Mus musculus
gaattctgagggactaactacgacc

SEQ ID NO: 287866 - DNA, 25 bp, Mus musculus
gaattctgcactaggctccgcagga

SEQ ID NO: 287867 - DNA, 25 bp, Mus musculus
gaattctgcagacccatgcagatgc

SEQ ID NO: 287868 - DNA, 25 bp, Mus musculus
gaattctgcaggtatccaacggttg

SEQ ID NO: 287869 - DNA, 25 bp, Mus musculus
gaattctgcaggtcacgtacagtgc

SEQ ID NO: 287870 - DNA, 25 bp, Mus musculus
gaattctgccagataaaacacggac

SEQ ID NO: 287871 - DNA, 25 bp, Mus musculus
gaattctgccagatactggatttat

SEQ ID NO: 287872 - DNA, 25 bp, Mus musculus
gaattctgcctcaggacctcttcct

SEQ ID NO: 287873 - DNA, 25 bp, Mus musculus
gaattcttcaaggactggggatctc

SEQ ID NO: 287874 - DNA, 25 bp, Mus musculus
gaattcttcaaggtggtacctcatc

SEQ ID NO: 287875 - DNA, 25 bp, Mus musculus
gaattcttctatacagaaactgcac

SEQ ID NO: 287876 - DNA, 25 bp, Mus musculus
gaattcttctgcaagcactgcagag

SEQ ID NO: 287877 - DNA, 25 bp, Mus musculus
gaattcttgcagacacctttgtcct

SEQ ID NO: 287878 - DNA, 25 bp, Mus musculus
gaattcttgcagatccgtctacctt

SEQ ID NO: 287879 - DNA, 25 bp, Mus musculus
gaattgaaaagtttctagatgttgt

SEQ ID NO: 287880 - DNA, 25 bp, Mus musculus
gaattgaactcaggccatattccca

SEQ ID NO: 287881 - DNA, 25 bp, Mus musculus
gaattgactctgtttcccacagtca

SEQ ID NO: 287882 - DNA, 25 bp, Mus musculus
gaattgagaatatgaacgaggctct

SEQ ID NO: 287883 - DNA, 25 bp, Mus musculus
gaattgagggaaggtccccaccctg

SEQ ID NO: 287884 - DNA, 25 bp, Mus musculus
gaattgatccgatttggaacctggc

SEQ ID NO: 287885 - DNA, 25 bp, Mus musculus
gaattgatccgtgtgccattgaaag

SEQ ID NO: 287886 - DNA, 25 bp, Mus musculus
gaattgattcactgagctcctgcaa

SEQ ID NO: 287887 - DNA, 25 bp, Mus musculus
gaattgattgaggactctcaaagaa

SEQ ID NO: 287888 - DNA, 25 bp, Mus musculus
gaattgattgaggggtctcactcta

SEQ ID NO: 287889 - DNA, 25 bp, Mus musculus
gaattgcaaagatgtgtccaggtgt

SEQ ID NO: 287890 - DNA, 25 bp, Mus musculus
gaattgcaaagtgtactgggactaa

SEQ ID NO: 287891 - DNA, 25 bp, Mus musculus
gaattgcagatctgataaaaagagc

SEQ ID NO: 287892 - DNA, 25 bp, Mus musculus
gaattgcagtctgtgatgctcccaa

SEQ ID NO: 287893 - DNA, 25 bp, Mus musculus
gaattgccaacagtagtcggaaacg

SEQ ID NO: 287894 - DNA, 25 bp, Mus musculus
gaattgccaactggtgctctgttgc

SEQ ID NO: 287895 - DNA, 25 bp, Mus musculus
gaattgctacaaaagatttaaagat

SEQ ID NO: 287896 - DNA, 25 bp, Mus musculus
gaattgctacaaaagcagcagcaac

SEQ ID NO: 287897 - DNA, 25 bp, Mus musculus
gaattgctacagctgggctgggagg

SEQ ID NO: 287898 - DNA, 25 bp, Mus musculus
gaattgctagattagtggagtacct

SEQ ID NO: 287899 - DNA, 25 bp, Mus musculus
gaattgctcaggaggctttagaaag

SEQ ID NO: 287900 - DNA, 25 bp, Mus musculus
gaattgctcaggcgagagcaggctt

SEQ ID NO: 287901 - DNA, 25 bp, Mus musculus
gaattgctctacagagtgagcctag

SEQ ID NO: 287902 - DNA, 25 bp, Mus musculus
gaattgctgataagatctcccttga

SEQ ID NO: 287903 - DNA, 25 bp, Mus musculus
gaattgctgataagatgtctggtga

SEQ ID NO: 287904 - DNA, 25 bp, Mus musculus
gaattggaatcaggtggacagcagc

SEQ ID NO: 287905 - DNA, 25 bp, Mus musculus
gaattggagtgacaggtcctttccc

SEQ ID NO: 287906 - DNA, 25 bp, Mus musculus
gaattggatgcacacgagtatgagt

SEQ ID NO: 287907 - DNA, 25 bp, Mus musculus
gaattggatgcacaggagtatgagt

SEQ ID NO: 287908 - DNA, 25 bp, Mus musculus
gaattggccttcaaatctgcagaag

SEQ ID NO: 287909 - DNA, 25 bp, Mus musculus
gaattggccttcagaatacccggag

SEQ ID NO: 287910 - DNA, 25 bp, Mus musculus
gaattggggactttgcttgtggcca

SEQ ID NO: 287911 - DNA, 25 bp, Mus musculus
gaattgggtacccagttgcacaacc

SEQ ID NO: 287912 - DNA, 25 bp, Mus musculus
gaattggtcctcatctctccaggcg

SEQ ID NO: 287913 - DNA, 25 bp, Mus musculus
gaattggtcctggctctgtctgtac

SEQ ID NO: 287914 - DNA, 25 bp, Mus musculus
gaattggtggtgtgacaaacggagg

SEQ ID NO: 287915 - DNA, 25 bp, Mus musculus
gaattgtaatgtggagctgcccgac

SEQ ID NO: 287916 - DNA, 25 bp, Mus musculus
gaattgtacagatatcgatgagtgt

SEQ ID NO: 287917 - DNA, 25 bp, Mus musculus
gaattgtacagatccgctgtactct

SEQ ID NO: 287918 - DNA, 25 bp, Mus musculus
gaattgtagagaatttcttgctgct

SEQ ID NO: 287919 - DNA, 25 bp, Mus musculus
gaattgtagagttgctcacagactg

SEQ ID NO: 287920 - DNA, 25 bp, Mus musculus
gaattgtagagttggctcacgtctt

SEQ ID NO: 287921 - DNA, 25 bp, Mus musculus
gaattgtattagagggaattctgcc

SEQ ID NO: 287922 - DNA, 25 bp, Mus musculus
gaattgtattagaggttcataagcc

SEQ ID NO: 287923 - DNA, 25 bp, Mus musculus
gaattgtattagaggttggcaggaa

SEQ ID NO: 287924 - DNA, 25 bp, Mus musculus
gaattgtattttaggtacattttat

SEQ ID NO: 287925 - DNA, 25 bp, Mus musculus
gaattgtcaagcaataccaagacgc

SEQ ID NO: 287926 - DNA, 25 bp, Mus musculus
gaattgtctcaaagaacttttgagc

SEQ ID NO: 287927 - DNA, 25 bp, Mus musculus
gaattgtgcatggcagaagaggaaa

SEQ ID NO: 287928 - DNA, 25 bp, Mus musculus
gaattgtgcatgttccccctacctc

SEQ ID NO: 287929 - DNA, 25 bp, Mus musculus
gaattgtggaagaataagaatgagc

SEQ ID NO: 287930 - DNA, 25 bp, Mus musculus
gaattgtggagattgaagaagttcc

SEQ ID NO: 287931 - DNA, 25 bp, Mus musculus
gaattgtggaggttgacgttgatgc

SEQ ID NO: 287932 - DNA, 25 bp, Mus musculus
gaattgtggataagcctgagtggcg

SEQ ID NO: 287933 - DNA, 25 bp, Mus musculus
gaattgtgtttgtagacccatccct

SEQ ID NO: 287934 - DNA, 25 bp, Mus musculus
gaattgttgggatgattgcgaaggg

SEQ ID NO: 287935 - DNA, 25 bp, Mus musculus
gaatttaacacagtgttgctggcgg

SEQ ID NO: 287936 - DNA, 25 bp, Mus musculus
gaatttaaggagattaatagagaca

SEQ ID NO: 287937 - DNA, 25 bp, Mus musculus
gaatttaaggagttcatcagcctcc

SEQ ID NO: 287938 - DNA, 25 bp, Mus musculus
gaatttacccaaaggaagcctcaag

SEQ ID NO: 287939 - DNA, 25 bp, Mus musculus
gaatttagttaaaagctgtatcgac

SEQ ID NO: 287940 - DNA, 25 bp, Mus musculus
gaatttatcaggaaacaaaaggagg

SEQ ID NO: 287941 - DNA, 25 bp, Mus musculus
gaatttatcgtcagatacagagttc

SEQ ID NO: 287942 - DNA, 25 bp, Mus musculus
gaatttatctatgatgaagctgctc

SEQ ID NO: 287943 - DNA, 25 bp, Mus musculus
gaatttatctatggtcgaatatttc

SEQ ID NO: 287944 - DNA, 25 bp, Mus musculus
gaatttcaagactgcgagtgctacg

SEQ ID NO: 287945 - DNA, 25 bp, Mus musculus
gaatttcaagcccatctctcacctt

SEQ ID NO: 287946 - DNA, 25 bp, Mus musculus
gaatttcaaggggacgatttggtct

SEQ ID NO: 287947 - DNA, 25 bp, Mus musculus
gaatttcaaggtctttaagtggagt

SEQ ID NO: 287948 - DNA, 25 bp, Mus musculus
gaatttcacaatactacctgtctgc

SEQ ID NO: 287949 - DNA, 25 bp, Mus musculus
gaatttcagagggccttcagcggct

SEQ ID NO: 287950 - DNA, 25 bp, Mus musculus
gaatttcaggccagggaccgagaac

SEQ ID NO: 287951 - DNA, 25 bp, Mus musculus
gaatttcagttcagttttgctaact

SEQ ID NO: 287952 - DNA, 25 bp, Mus musculus
gaatttcattaagacctggtcccag

SEQ ID NO: 287953 - DNA, 25 bp, Mus musculus
gaatttcattaagatcgggaagctg

SEQ ID NO: 287954 - DNA, 25 bp, Mus musculus
gaatttccaaaagagaacggacact

SEQ ID NO: 287955 - DNA, 25 bp, Mus musculus
gaatttccaaaagcctgaaacattt

SEQ ID NO: 287956 - DNA, 25 bp, Mus musculus
gaatttccaccggtttgctgaggag

SEQ ID NO: 287957 - DNA, 25 bp, Mus musculus
gaatttccagatgcaggtgtcccca

SEQ ID NO: 287958 - DNA, 25 bp, Mus musculus
gaatttccaggcaggctcatggcag

SEQ ID NO: 287959 - DNA, 25 bp, Mus musculus
gaatttcccaagtggatggagacca

SEQ ID NO: 287960 - DNA, 25 bp, Mus musculus
gaatttccctcttggctgatggtga

SEQ ID NO: 287961 - DNA, 25 bp, Mus musculus
gaatttctaaagaagttggcatcag

SEQ ID NO: 287962 - DNA, 25 bp, Mus musculus
gaatttctactgaaggcttccaaag

SEQ ID NO: 287963 - DNA, 25 bp, Mus musculus
gaatttctggtaatctatgccagca

SEQ ID NO: 287964 - DNA, 25 bp, Mus musculus
gaatttctggtttgcggtgtaggag

SEQ ID NO: 287965 - DNA, 25 bp, Mus musculus
gaatttgaacagggcctgtctgaga

SEQ ID NO: 287966 - DNA, 25 bp, Mus musculus
gaatttgaacaggtcatgcagttgc

SEQ ID NO: 287967 - DNA, 25 bp, Mus musculus
gaatttgactctgagatggtagaga

SEQ ID NO: 287968 - DNA, 25 bp, Mus musculus
gaatttgactctgaggtgctgtagg

SEQ ID NO: 287969 - DNA, 25 bp, Mus musculus
gaatttgatgaggacagtggtgact

SEQ ID NO: 287970 - DNA, 25 bp, Mus musculus
gaatttgcaagtggattgtcttgcc

SEQ ID NO: 287971 - DNA, 25 bp, Mus musculus
gaatttgcagccaaggccacagagg

SEQ ID NO: 287972 - DNA, 25 bp, Mus musculus
gaatttgctggggagaaggaactca

SEQ ID NO: 287973 - DNA, 25 bp, Mus musculus
gaatttgctgtagacattttaagtc

SEQ ID NO: 287974 - DNA, 25 bp, Mus musculus
gaatttgtcagttggttactggctg

SEQ ID NO: 287975 - DNA, 25 bp, Mus musculus
gaatttgtccagccccagcatctca

SEQ ID NO: 287976 - DNA, 25 bp, Mus musculus
gaattttatgctcgacgccaatggg

SEQ ID NO: 287977 - DNA, 25 bp, Mus musculus
gaattttccaagctgatcatatgat

SEQ ID NO: 287978 - DNA, 25 bp, Mus musculus
gaattttccaggtctctttaaggtc

SEQ ID NO: 287979 - DNA, 25 bp, Mus musculus
gaattttccagttcaaaaggacata

SEQ ID NO: 287980 - DNA, 25 bp, Mus musculus
gaattttccagttccagtgcagact

SEQ ID NO: 287981 - DNA, 25 bp, Mus musculus
gaattttctgaagagacttgccttt

SEQ ID NO: 287982 - DNA, 25 bp, Mus musculus
gaattttctgaagaggcttatccat

SEQ ID NO: 287983 - DNA, 25 bp, Mus musculus
gaattttctgggggtcccacagagg

SEQ ID NO: 287984 - DNA, 25 bp, Mus musculus
gaattttgaggtggcccgggagagt

SEQ ID NO: 287985 - DNA, 25 bp, Mus musculus
gaattttgagtctttccttctgaca

SEQ ID NO: 287986 - DNA, 25 bp, Mus musculus
gaattttgtaagaggacaatgcgta

SEQ ID NO: 287987 - DNA, 25 bp, Mus musculus
gaattttgtaagtacaaacaggcca

SEQ ID NO: 287988 - DNA, 25 bp, Mus musculus
gaatttttatgttgagctaccaata

SEQ ID NO: 287989 - DNA, 25 bp, Mus musculus
gaatttttcaaatttctgctggacc

SEQ ID NO: 287990 - DNA, 25 bp, Mus musculus
gacaaaaaacttgagcccagcgggc

SEQ ID NO: 287991 - DNA, 25 bp, Mus musculus
gacaaaaaagagctctcttacaggg

SEQ ID NO: 287992 - DNA, 25 bp, Mus musculus
gacaaaaaagagttgatcaagagct

SEQ ID NO: 287993 - DNA, 25 bp, Mus musculus
gacaaaaacacagagcttaccatct

SEQ ID NO: 287994 - DNA, 25 bp, Mus musculus
gacaaaaacacagggggaagagggc

SEQ ID NO: 287995 - DNA, 25 bp, Mus musculus
gacaaaaacagcttatagagcacaa

SEQ ID NO: 287996 - DNA, 25 bp, Mus musculus
gacaaaaaccaaagaatgacttcgc

SEQ ID NO: 287997 - DNA, 25 bp, Mus musculus
gacaaaaaccaaaggccagcgtgac

SEQ ID NO: 287998 - DNA, 25 bp, Mus musculus
gacaaaaaccatctttcaggacctg

SEQ ID NO: 287999 - DNA, 25 bp, Mus musculus
gacaaaaatgggaggcttactcaat

SEQ ID NO: 288000 - DNA, 25 bp, Mus musculus
gacaaaaatgggagtgggtgaactc

SEQ ID NO: 288001 - DNA, 25 bp, Mus musculus
gacaaaaatttcaagtactcagact

SEQ ID NO: 288002 - DNA, 25 bp, Mus musculus
gacaaaacaggaatggaagccctaa

SEQ ID NO: 288003 - DNA, 25 bp, Mus musculus
gacaaaacagtgaccaagaagaaga

SEQ ID NO: 288004 - DNA, 25 bp, Mus musculus
gacaaaaccaaggatgtggagtaca

SEQ ID NO: 288005 - DNA, 25 bp, Mus musculus
gacaaaaccagatcaaattgacatc

SEQ ID NO: 288006 - DNA, 25 bp, Mus musculus
gacaaaacgctgagagagatgccaa

SEQ ID NO: 288007 - DNA, 25 bp, Mus musculus
gacaaaagaaaataagtaccatgaa

SEQ ID NO: 288008 - DNA, 25 bp, Mus musculus
gacaaaagactgacacatgcagccg

SEQ ID NO: 288009 - DNA, 25 bp, Mus musculus
gacaaaagaggcttttcagatgtgg

SEQ ID NO: 288010 - DNA, 25 bp, Mus musculus
gacaaaagagtttcaactcctagcc

SEQ ID NO: 288011 - DNA, 25 bp, Mus musculus
gacaaaaggccggtcatggtatgga

SEQ ID NO: 288012 - DNA, 25 bp, Mus musculus
gacaaaatcatagagcccatccagt

SEQ ID NO: 288013 - DNA, 25 bp, Mus musculus
gacaaaatgagtctggaatcagtct

SEQ ID NO: 288014 - DNA, 25 bp, Mus musculus
gacaaaatgcttcagggccgccttt

SEQ ID NO: 288015 - DNA, 25 bp, Mus musculus
gacaaaattaccccaagcattcttg

SEQ ID NO: 288016 - DNA, 25 bp, Mus musculus
gacaaaattagagaggaggaaaaag

SEQ ID NO: 288017 - DNA, 25 bp, Mus musculus
gacaaaattagtccatttcagtcct

SEQ ID NO: 288018 - DNA, 25 bp, Mus musculus
gacaaacaaaaagtactacaagaag

SEQ ID NO: 288019 - DNA, 25 bp, Mus musculus
gacaaacaagctgctaactcaggat

SEQ ID NO: 288020 - DNA, 25 bp, Mus musculus
gacaaacaagctttgaaaagtactg

SEQ ID NO: 288021 - DNA, 25 bp, Mus musculus
gacaaacacttggtgatgaagatga

SEQ ID NO: 288022 - DNA, 25 bp, Mus musculus
gacaaacacttggtggtgtgaatga

SEQ ID NO: 288023 - DNA, 25 bp, Mus musculus
gacaaacagaacagaaaagaaatgg

SEQ ID NO: 288024 - DNA, 25 bp, Mus musculus
gacaaacagaatgcaacaaggatga

SEQ ID NO: 288025 - DNA, 25 bp, Mus musculus
gacaaacatggggtcccagcaacag

SEQ ID NO: 288026 - DNA, 25 bp, Mus musculus
gacaaacatgggtttaggcaagagt

SEQ ID NO: 288027 - DNA, 25 bp, Mus musculus
gacaaacatgtgcagataacaatcg

SEQ ID NO: 288028 - DNA, 25 bp, Mus musculus
gacaaaccaaggctcatctgcggtg

SEQ ID NO: 288029 - DNA, 25 bp, Mus musculus
gacaaaccacattgggtgggtgcag

SEQ ID NO: 288030 - DNA, 25 bp, Mus musculus
gacaaactagacaagatgtcttggg

SEQ ID NO: 288031 - DNA, 25 bp, Mus musculus
gacaaactgaagcaggaggaggaga

SEQ ID NO: 288032 - DNA, 25 bp, Mus musculus
gacaaactgaagcaggtgtccatcc

SEQ ID NO: 288033 - DNA, 25 bp, Mus musculus
gacaaacttgggttctatggcctac

SEQ ID NO: 288034 - DNA, 25 bp, Mus musculus
gacaaagaaagagagaccagaggga

SEQ ID NO: 288035 - DNA, 25 bp, Mus musculus
gacaaagaaagagagatggcagcag

SEQ ID NO: 288036 - DNA, 25 bp, Mus musculus
gacaaagaaggctggattctcatag

SEQ ID NO: 288037 - DNA, 25 bp, Mus musculus
gacaaagaatcagagacaccagaga

SEQ ID NO: 288038 - DNA, 25 bp, Mus musculus
gacaaagaatcagagagacaactgg

SEQ ID NO: 288039 - DNA, 25 bp, Mus musculus
gacaaagacagcaggctgcctttga

SEQ ID NO: 288040 - DNA, 25 bp, Mus musculus
gacaaagacaggatgagagacaatg

SEQ ID NO: 288041 - DNA, 25 bp, Mus musculus
gacaaagacccaggagattagccgt

SEQ ID NO: 288042 - DNA, 25 bp, Mus musculus
gacaaagacctacagctgcaccaaa

SEQ ID NO: 288043 - DNA, 25 bp, Mus musculus
gacaaagacctacaggaatcacagg

SEQ ID NO: 288044 - DNA, 25 bp, Mus musculus
gacaaagacgaggaaccttcagctg

SEQ ID NO: 288045 - DNA, 25 bp, Mus musculus
gacaaagacggttatattaagaaca

SEQ ID NO: 288046 - DNA, 25 bp, Mus musculus
gacaaagactctaggatcaagtgag

SEQ ID NO: 288047 - DNA, 25 bp, Mus musculus
gacaaagactctagtctttcaggtt

SEQ ID NO: 288048 - DNA, 25 bp, Mus musculus
gacaaagagaaagccagtgagaccg

SEQ ID NO: 288049 - DNA, 25 bp, Mus musculus
gacaaagagaatgatggatatatct

SEQ ID NO: 288050 - DNA, 25 bp, Mus musculus
gacaaagagcgcgcgatttctaacg

SEQ ID NO: 288051 - DNA, 25 bp, Mus musculus
gacaaagagcgcgcgtggaaagaag

SEQ ID NO: 288052 - DNA, 25 bp, Mus musculus
gacaaagatgagtggataagtggag

SEQ ID NO: 288053 - DNA, 25 bp, Mus musculus
gacaaagcaagctaccaagagcaaa

SEQ ID NO: 288054 - DNA, 25 bp, Mus musculus
gacaaagcaaggagtaatataaaga

SEQ ID NO: 288055 - DNA, 25 bp, Mus musculus
gacaaagcagaaaatggatcgaaca

SEQ ID NO: 288056 - DNA, 25 bp, Mus musculus
gacaaagcagacgttgattccgagt

SEQ ID NO: 288057 - DNA, 25 bp, Mus musculus
gacaaagcagatctgcaggtgtctc

SEQ ID NO: 288058 - DNA, 25 bp, Mus musculus
gacaaagcagcttccaggagctgac

SEQ ID NO: 288059 - DNA, 25 bp, Mus musculus
gacaaagcaggggtcgggtcagagc

SEQ ID NO: 288060 - DNA, 25 bp, Mus musculus
gacaaagccaaagctgctcagactg

SEQ ID NO: 288061 - DNA, 25 bp, Mus musculus
gacaaagccagctaccgagtctatt

SEQ ID NO: 288062 - DNA, 25 bp, Mus musculus
gacaaagctgcaggcatcgttctgc

SEQ ID NO: 288063 - DNA, 25 bp, Mus musculus
gacaaaggaaatctgaaaaaagacg

SEQ ID NO: 288064 - DNA, 25 bp, Mus musculus
gacaaaggaaatctgccttaagaac

SEQ ID NO: 288065 - DNA, 25 bp, Mus musculus
gacaaaggacagaagagatctgctg

SEQ ID NO: 288066 - DNA, 25 bp, Mus musculus
gacaaaggacagaagggctctgcgt

SEQ ID NO: 288067 - DNA, 25 bp, Mus musculus
gacaaaggacagaagtcctccacag

SEQ ID NO: 288068 - DNA, 25 bp, Mus musculus
gacaaaggagaaaagggtgctcggg

SEQ ID NO: 288069 - DNA, 25 bp, Mus musculus
gacaaaggagaccctggcttcaaag

SEQ ID NO: 288070 - DNA, 25 bp, Mus musculus
gacaaaggagagaagagaggctctc

SEQ ID NO: 288071 - DNA, 25 bp, Mus musculus
gacaaaggcacagcgccctcaggcc

SEQ ID NO: 288072 - DNA, 25 bp, Mus musculus
gacaaaggcgacgacctgctgccgt

SEQ ID NO: 288073 - DNA, 25 bp, Mus musculus
gacaaaggcgacgatagggccagtg

SEQ ID NO: 288074 - DNA, 25 bp, Mus musculus
gacaaaggcgagcagggtcctcctg

SEQ ID NO: 288075 - DNA, 25 bp, Mus musculus
gacaaaggctttaagctctggtgca

SEQ ID NO: 288076 - DNA, 25 bp, Mus musculus
gacaaagggcctagcagagctcctc

SEQ ID NO: 288077 - DNA, 25 bp, Mus musculus
gacaaagggcctagcgccagccaga

SEQ ID NO: 288078 - DNA, 25 bp, Mus musculus
gacaaaggtttcaagaattggaggc

SEQ ID NO: 288079 - DNA, 25 bp, Mus musculus
gacaaagtcaaggtgtatgagatgg

SEQ ID NO: 288080 - DNA, 25 bp, Mus musculus
gacaaagtgctgatggagtttgtgg

SEQ ID NO: 288081 - DNA, 25 bp, Mus musculus
gacaaagtgtctcagaatgcaaagt

SEQ ID NO: 288082 - DNA, 25 bp, Mus musculus
gacaaagtgtctcagccttcgtagt

SEQ ID NO: 288083 - DNA, 25 bp, Mus musculus
gacaaagtgtctgcttttcagaaag

SEQ ID NO: 288084 - DNA, 25 bp, Mus musculus
gacaaagttggcatcctgactttga

SEQ ID NO: 288085 - DNA, 25 bp, Mus musculus
gacaaataagatgcacgccatccct

SEQ ID NO: 288086 - DNA, 25 bp, Mus musculus
gacaaataccggggtgaacctggag

SEQ ID NO: 288087 - DNA, 25 bp, Mus musculus
gacaaatactttgctgccttctgat

SEQ ID NO: 288088 - DNA, 25 bp, Mus musculus
gacaaatactttgttgaaccaagac

SEQ ID NO: 288089 - DNA, 25 bp, Mus musculus
gacaaatagctcctaggttgggagt

SEQ ID NO: 288090 - DNA, 25 bp, Mus musculus
gacaaatagctcctatacctgactg

SEQ ID NO: 288091 - DNA, 25 bp, Mus musculus
gacaaatcctcgtggctcctcccac

SEQ ID NO: 288092 - DNA, 25 bp, Mus musculus
gacaaatgacacccagtcttctggg

SEQ ID NO: 288093 - DNA, 25 bp, Mus musculus
gacaaatgcaggaatgtgctaaaag

SEQ ID NO: 288094 - DNA, 25 bp, Mus musculus
gacaaatgtaaggcaaatgaccatg

SEQ ID NO: 288095 - DNA, 25 bp, Mus musculus
gacaaatgtttggtcaatttggtaa

SEQ ID NO: 288096 - DNA, 25 bp, Mus musculus
gacaaattgaaactggaagcatata

SEQ ID NO: 288097 - DNA, 25 bp, Mus musculus
gacaaatttgtcaaagaactactat

SEQ ID NO: 288098 - DNA, 25 bp, Mus musculus
gacaacaaaaatgaaaagaaagttg

SEQ ID NO: 288099 - DNA, 25 bp, Mus musculus
gacaacaaatggaccccttctttct

SEQ ID NO: 288100 - DNA, 25 bp, Mus musculus
gacaacaaatgtcactagtgccaac

SEQ ID NO: 288101 - DNA, 25 bp, Mus musculus
gacaacaagcacaagttctgcctat

SEQ ID NO: 288102 - DNA, 25 bp, Mus musculus
gacaacacactgacggagcgcttct

SEQ ID NO: 288103 - DNA, 25 bp, Mus musculus
gacaacacagagtttcaaggcaaac

SEQ ID NO: 288104 - DNA, 25 bp, Mus musculus
gacaacacatgtaaggtatcgcaaa

SEQ ID NO: 288105 - DNA, 25 bp, Mus musculus
gacaacacatgtaagtccaacccct

SEQ ID NO: 288106 - DNA, 25 bp, Mus musculus
gacaacaccctattttataggcaat

SEQ ID NO: 288107 - DNA, 25 bp, Mus musculus
gacaacagatttcctctgcccctca

SEQ ID NO: 288108 - DNA, 25 bp, Mus musculus
gacaacagcaagcccaccaattcct

SEQ ID NO: 288109 - DNA, 25 bp, Mus musculus
gacaacagcacaggcgtggtgactg

SEQ ID NO: 288110 - DNA, 25 bp, Mus musculus
gacaacagtccagattccttctgga

SEQ ID NO: 288111 - DNA, 25 bp, Mus musculus
gacaacagtcctgattctttaagaa

SEQ ID NO: 288112 - DNA, 25 bp, Mus musculus
gacaacagtttgggggacatcctgc

SEQ ID NO: 288113 - DNA, 25 bp, Mus musculus
gacaacatacaggataagaacaaga

SEQ ID NO: 288114 - DNA, 25 bp, Mus musculus
gacaacatcaaggtgtctttggact

SEQ ID NO: 288115 - DNA, 25 bp, Mus musculus
gacaacatcctaggcttcatcgcct

SEQ ID NO: 288116 - DNA, 25 bp, Mus musculus
gacaacatctggagagagacttgcc

SEQ ID NO: 288117 - DNA, 25 bp, Mus musculus
gacaacatgcagggtgtgttggaga

SEQ ID NO: 288118 - DNA, 25 bp, Mus musculus
gacaaccaatagaccaagacaacaa

SEQ ID NO: 288119 - DNA, 25 bp, Mus musculus
gacaaccacagcgacccatacgtga

SEQ ID NO: 288120 - DNA, 25 bp, Mus musculus
gacaaccacgagatgtctgcagtca

SEQ ID NO: 288121 - DNA, 25 bp, Mus musculus
gacaaccacgtcattcacccatctc

SEQ ID NO: 288122 - DNA, 25 bp, Mus musculus
gacaaccagagcctggcagaagatg

SEQ ID NO: 288123 - DNA, 25 bp, Mus musculus
gacaaccagagcctgggtcatactt

SEQ ID NO: 288124 - DNA, 25 bp, Mus musculus
gacaaccagggtggtgcccccaact

SEQ ID NO: 288125 - DNA, 25 bp, Mus musculus
gacaacccagaagttctcctgattc

SEQ ID NO: 288126 - DNA, 25 bp, Mus musculus
gacaacccatacctgcacctcgcac

SEQ ID NO: 288127 - DNA, 25 bp, Mus musculus
gacaaccccaaggattaaaccagaa

SEQ ID NO: 288128 - DNA, 25 bp, Mus musculus
gacaaccccaagttctacagtgagt

SEQ ID NO: 288129 - DNA, 25 bp, Mus musculus
gacaacccccatacggtgcctcctg

SEQ ID NO: 288130 - DNA, 25 bp, Mus musculus
gacaacccgatagaggagcatagaa

SEQ ID NO: 288131 - DNA, 25 bp, Mus musculus
gacaacccggaggaggttctgctgc

SEQ ID NO: 288132 - DNA, 25 bp, Mus musculus
gacaacctagaggccttgtctcaca

SEQ ID NO: 288133 - DNA, 25 bp, Mus musculus
gacaacctatgtcttttgtgctaga

SEQ ID NO: 288134 - DNA, 25 bp, Mus musculus
gacaacctggcagaggaaaactcca

SEQ ID NO: 288135 - DNA, 25 bp, Mus musculus
gacaacctgttggagagaagacaca

SEQ ID NO: 288136 - DNA, 25 bp, Mus musculus
gacaaccttgcaggccctgtggttc

SEQ ID NO: 288137 - DNA, 25 bp, Mus musculus
gacaacgaaggtgaccccatctctg

SEQ ID NO: 288138 - DNA, 25 bp, Mus musculus
gacaacgagaaggatctggtgaaac

SEQ ID NO: 288139 - DNA, 25 bp, Mus musculus
gacaacgagagctggggctttgtgc

SEQ ID NO: 288140 - DNA, 25 bp, Mus musculus
gacaacgagagttctgcctgctgag

SEQ ID NO: 288141 - DNA, 25 bp, Mus musculus
gacaacgagcgagtggtgacgtatg

SEQ ID NO: 288142 - DNA, 25 bp, Mus musculus
gacaacgagcgagttgggatggcta

SEQ ID NO: 288143 - DNA, 25 bp, Mus musculus
gacaacgtcaaccctccacgccatc

SEQ ID NO: 288144 - DNA, 25 bp, Mus musculus
gacaacgtcaacccttcagaaagcc

SEQ ID NO: 288145 - DNA, 25 bp, Mus musculus
gacaacgtcaggtatggcatttcaa

SEQ ID NO: 288146 - DNA, 25 bp, Mus musculus
gacaacgtgataagaatttattctc

SEQ ID NO: 288147 - DNA, 25 bp, Mus musculus
gacaactacgattcatcccatcaga

SEQ ID NO: 288148 - DNA, 25 bp, Mus musculus
gacaactacgattccatgtacacgg

SEQ ID NO: 288149 - DNA, 25 bp, Mus musculus
gacaactacggaaagaatgatgaag

SEQ ID NO: 288150 - DNA, 25 bp, Mus musculus
gacaactacggaaagatcagaaaca

SEQ ID NO: 288151 - DNA, 25 bp, Mus musculus
gacaactacggaaaggtgactcaga

SEQ ID NO: 288152 - DNA, 25 bp, Mus musculus
gacaactatctcagcatcaagatga

SEQ ID NO: 288153 - DNA, 25 bp, Mus musculus
gacaactatgagtgaactccgggat

SEQ ID NO: 288154 - DNA, 25 bp, Mus musculus
gacaactcaacagcacagtcagcag

SEQ ID NO: 288155 - DNA, 25 bp, Mus musculus
gacaactcaattagcaatagcgaag

SEQ ID NO: 288156 - DNA, 25 bp, Mus musculus
gacaactctatcaagatctgggata

SEQ ID NO: 288157 - DNA, 25 bp, Mus musculus
gacaactgaaggctgcccgagagat

SEQ ID NO: 288158 - DNA, 25 bp, Mus musculus
gacaactggaggaagagcagtcagt

SEQ ID NO: 288159 - DNA, 25 bp, Mus musculus
gacaactggaggagttggaagagga

SEQ ID NO: 288160 - DNA, 25 bp, Mus musculus
gacaacttagaaactcctatcacgc

SEQ ID NO: 288161 - DNA, 25 bp, Mus musculus
gacaacttaggtgctggctacgccg

SEQ ID NO: 288162 - DNA, 25 bp, Mus musculus
gacaacttcaaggaggtttgcgggg

SEQ ID NO: 288163 - DNA, 25 bp, Mus musculus
gacaactttgaactctgcactttgt

SEQ ID NO: 288164 - DNA, 25 bp, Mus musculus
gacaactttgcaggataaggtagct

SEQ ID NO: 288165 - DNA, 25 bp, Mus musculus
gacaactttgtaagagaaataaaga

SEQ ID NO: 288166 - DNA, 25 bp, Mus musculus
gacaagaaaaatatcgctgtagtgc

SEQ ID NO: 288167 - DNA, 25 bp, Mus musculus
gacaagaaaactgttcattcgtatc

SEQ ID NO: 288168 - DNA, 25 bp, Mus musculus
gacaagaaaagactatctaagctgg

SEQ ID NO: 288169 - DNA, 25 bp, Mus musculus
gacaagaaaagtgaagaactggtgg

SEQ ID NO: 288170 - DNA, 25 bp, Mus musculus
gacaagaaaattgagcccagagtgc

SEQ ID NO: 288171 - DNA, 25 bp, Mus musculus
gacaagaaaattgagcccagcgggc

SEQ ID NO: 288172 - DNA, 25 bp, Mus musculus
gacaagaaaattgtgcccagggatt

SEQ ID NO: 288173 - DNA, 25 bp, Mus musculus
gacaagaaagccaacattctcaccg

SEQ ID NO: 288174 - DNA, 25 bp, Mus musculus
gacaagaaagctgttcttcctacca

SEQ ID NO: 288175 - DNA, 25 bp, Mus musculus
gacaagaaagcttgatccggagcat

SEQ ID NO: 288176 - DNA, 25 bp, Mus musculus
gacaagaaagggatctgtgtggcag

SEQ ID NO: 288177 - DNA, 25 bp, Mus musculus
gacaagaactgctgagaagaagcca

SEQ ID NO: 288178 - DNA, 25 bp, Mus musculus
gacaagaacttagtgatgtggagag

SEQ ID NO: 288179 - DNA, 25 bp, Mus musculus
gacaagaagaaagccggtggctggt

SEQ ID NO: 288180 - DNA, 25 bp, Mus musculus
gacaagaagaattaaagcacgcaca

SEQ ID NO: 288181 - DNA, 25 bp, Mus musculus
gacaagaagacagagccaagtcaga

SEQ ID NO: 288182 - DNA, 25 bp, Mus musculus
gacaagaagacagatgttaaggaag

SEQ ID NO: 288183 - DNA, 25 bp, Mus musculus
gacaagaagatggccctctctttca

SEQ ID NO: 288184 - DNA, 25 bp, Mus musculus
gacaagaagatggccgtggcaaccc

SEQ ID NO: 288185 - DNA, 25 bp, Mus musculus
gacaagaagccacaggaatcctgac

SEQ ID NO: 288186 - DNA, 25 bp, Mus musculus
gacaagaaggaaagattgaagactg

SEQ ID NO: 288187 - DNA, 25 bp, Mus musculus
gacaagaaggaaagatttctaagct

SEQ ID NO: 288188 - DNA, 25 bp, Mus musculus
gacaagaaggacctgagggaccggg

SEQ ID NO: 288189 - DNA, 25 bp, Mus musculus
gacaagaaggcacctgactttgtgt

SEQ ID NO: 288190 - DNA, 25 bp, Mus musculus
gacaagaatacagggaaaatggaga

SEQ ID NO: 288191 - DNA, 25 bp, Mus musculus
gacaagaatacatggcaaaagaaaa

SEQ ID NO: 288192 - DNA, 25 bp, Mus musculus
gacaagaatgacattggctcgtgag

SEQ ID NO: 288193 - DNA, 25 bp, Mus musculus
gacaagaatgacatttttgccattg

SEQ ID NO: 288194 - DNA, 25 bp, Mus musculus
gacaagaatgtacgccaggccagcg

SEQ ID NO: 288195 - DNA, 25 bp, Mus musculus
gacaagaattaggactcagtggcaa

SEQ ID NO: 288196 - DNA, 25 bp, Mus musculus
gacaagacaagctgaccttcattga

SEQ ID NO: 288197 - DNA, 25 bp, Mus musculus
gacaagacactgcagttcatcgtgg

SEQ ID NO: 288198 - DNA, 25 bp, Mus musculus
gacaagacagagagtggaggatgct

SEQ ID NO: 288199 - DNA, 25 bp, Mus musculus
gacaagacaggaaccctgacccaga

SEQ ID NO: 288200 - DNA, 25 bp, Mus musculus
gacaagacagggtgttgacgatgcc

SEQ ID NO: 288201 - DNA, 25 bp, Mus musculus
gacaagacagttcccttcagcattt

SEQ ID NO: 288202 - DNA, 25 bp, Mus musculus
gacaagaccaagccccagctgcgat

SEQ ID NO: 288203 - DNA, 25 bp, Mus musculus
gacaagaccattggagaaggagagg

SEQ ID NO: 288204 - DNA, 25 bp, Mus musculus
gacaagagaaagcgccaagggaaga

SEQ ID NO: 288205 - DNA, 25 bp, Mus musculus
gacaagagagatgcctcaggaacag

SEQ ID NO: 288206 - DNA, 25 bp, Mus musculus
gacaagagcaagcagaaacacagga

SEQ ID NO: 288207 - DNA, 25 bp, Mus musculus
gacaagagcaagcaggaaaaggaag

SEQ ID NO: 288208 - DNA, 25 bp, Mus musculus
gacaagagcggttccggagccttac

SEQ ID NO: 288209 - DNA, 25 bp, Mus musculus
gacaagagctgaagtgggagaaaaa

SEQ ID NO: 288210 - DNA, 25 bp, Mus musculus
gacaagagggagagaatatgctggc

SEQ ID NO: 288211 - DNA, 25 bp, Mus musculus
gacaagataataaaggtagtggatg

SEQ ID NO: 288212 - DNA, 25 bp, Mus musculus
gacaagataataaagtacaaaatgg

SEQ ID NO: 288213 - DNA, 25 bp, Mus musculus
gacaagcaaatgatcaaacttcaag

SEQ ID NO: 288214 - DNA, 25 bp, Mus musculus
gacaagcaagagtccggccacaaga

SEQ ID NO: 288215 - DNA, 25 bp, Mus musculus
gacaagcaaggaggtgagtgctctg

SEQ ID NO: 288216 - DNA, 25 bp, Mus musculus
gacaagcaagggctctgtaaaagac

SEQ ID NO: 288217 - DNA, 25 bp, Mus musculus
gacaagcacccaatgtcagaataca

SEQ ID NO: 288218 - DNA, 25 bp, Mus musculus
gacaagcagatgggacagcaaagag

SEQ ID NO: 288219 - DNA, 25 bp, Mus musculus
gacaagcagccagtctcaatggaaa

SEQ ID NO: 288220 - DNA, 25 bp, Mus musculus
gacaagccaaaggcaccatggctgg

SEQ ID NO: 288221 - DNA, 25 bp, Mus musculus
gacaagccaagaatgtgctgatcaa

SEQ ID NO: 288222 - DNA, 25 bp, Mus musculus
gacaagccaaggtcttcttctccgg

SEQ ID NO: 288223 - DNA, 25 bp, Mus musculus
gacaagccatgatgaacagctcatg

SEQ ID NO: 288224 - DNA, 25 bp, Mus musculus
gacaagcccataggaacctggctgc

SEQ ID NO: 288225 - DNA, 25 bp, Mus musculus
gacaagcccataggttacaaggaca

SEQ ID NO: 288226 - DNA, 25 bp, Mus musculus
gacaagccccagcttatcaagtacg

SEQ ID NO: 288227 - DNA, 25 bp, Mus musculus
gacaagccccagggcagtcctttac

SEQ ID NO: 288228 - DNA, 25 bp, Mus musculus
gacaagccccagggtgccacctcct

SEQ ID NO: 288229 - DNA, 25 bp, Mus musculus
gacaagccgattgccgacgtgttct

SEQ ID NO: 288230 - DNA, 25 bp, Mus musculus
gacaagcctgactgcctctttaagc

SEQ ID NO: 288231 - DNA, 25 bp, Mus musculus
gacaagcctggaggttcatgtctca

SEQ ID NO: 288232 - DNA, 25 bp, Mus musculus
gacaagcctggagttatgcctcttg

SEQ ID NO: 288233 - DNA, 25 bp, Mus musculus
gacaagcctggcaagtcacgtgact

SEQ ID NO: 288234 - DNA, 25 bp, Mus musculus
gacaagcgcgcctttaaagtgaagg

SEQ ID NO: 288235 - DNA, 25 bp, Mus musculus
gacaagcggcagattgtagacctgg

SEQ ID NO: 288236 - DNA, 25 bp, Mus musculus
gacaagctaaggatttggagtttca

SEQ ID NO: 288237 - DNA, 25 bp, Mus musculus
gacaagctcctagatcttgatgaca

SEQ ID NO: 288238 - DNA, 25 bp, Mus musculus
gacaagctccttccagtgacagcag

SEQ ID NO: 288239 - DNA, 25 bp, Mus musculus
gacaagctgcggaaggatgatccag

SEQ ID NO: 288240 - DNA, 25 bp, Mus musculus
gacaagctggatcaggatgcgggct

SEQ ID NO: 288241 - DNA, 25 bp, Mus musculus
gacaagctgggcgagtacatggaga

SEQ ID NO: 288242 - DNA, 25 bp, Mus musculus
gacaagcttaccagtgattttgagg

SEQ ID NO: 288243 - DNA, 25 bp, Mus musculus
gacaaggaaagctgccttcaccttc

SEQ ID NO: 288244 - DNA, 25 bp, Mus musculus
gacaaggaaagctggtgaagcacaa

SEQ ID NO: 288245 - DNA, 25 bp, Mus musculus
gacaaggaaagctgtctgcaatcct

SEQ ID NO: 288246 - DNA, 25 bp, Mus musculus
gacaaggaaagggatcttgctggac

SEQ ID NO: 288247 - DNA, 25 bp, Mus musculus
gacaaggaaaggtacgacatgatgg

SEQ ID NO: 288248 - DNA, 25 bp, Mus musculus
gacaaggaaatgacaaatggttatg

SEQ ID NO: 288249 - DNA, 25 bp, Mus musculus
gacaaggaagactttctctgtgtag

SEQ ID NO: 288250 - DNA, 25 bp, Mus musculus
gacaaggaagcggcctttgacgacg

SEQ ID NO: 288251 - DNA, 25 bp, Mus musculus
gacaaggaaggcctgaagggaaaga

SEQ ID NO: 288252 - DNA, 25 bp, Mus musculus
gacaaggaaggttctgagcctggat

SEQ ID NO: 288253 - DNA, 25 bp, Mus musculus
gacaaggacacaagggtgaagaggg

SEQ ID NO: 288254 - DNA, 25 bp, Mus musculus
gacaaggactccagaaaacatctcg

SEQ ID NO: 288255 - DNA, 25 bp, Mus musculus
gacaaggagaagacaggagtgcgat

SEQ ID NO: 288256 - DNA, 25 bp, Mus musculus
gacaaggagaatacacctctcattg

SEQ ID NO: 288257 - DNA, 25 bp, Mus musculus
gacaaggagaatgtcccttcagaga

SEQ ID NO: 288258 - DNA, 25 bp, Mus musculus
gacaaggagacagcttggtcacata

SEQ ID NO: 288259 - DNA, 25 bp, Mus musculus
gacaaggagatggacagtacagacc

SEQ ID NO: 288260 - DNA, 25 bp, Mus musculus
gacaaggagcaggacatggctgcca

SEQ ID NO: 288261 - DNA, 25 bp, Mus musculus
gacaaggagccagatgagaaaacca

SEQ ID NO: 288262 - DNA, 25 bp, Mus musculus
gacaaggagccagcttcacttcttc

SEQ ID NO: 288263 - DNA, 25 bp, Mus musculus
gacaaggagccagctttcttggatt

SEQ ID NO: 288264 - DNA, 25 bp, Mus musculus
gacaaggaggacggtgtgccgatgc

SEQ ID NO: 288265 - DNA, 25 bp, Mus musculus
gacaaggcaaagcggtcccaccagc

SEQ ID NO: 288266 - DNA, 25 bp, Mus musculus
gacaaggcaggagatcgggaagctg

SEQ ID NO: 288267 - DNA, 25 bp, Mus musculus
gacaaggcaggaggctggtcagatc

SEQ ID NO: 288268 - DNA, 25 bp, Mus musculus
gacaaggccaggtgtggaggcatca

SEQ ID NO: 288269 - DNA, 25 bp, Mus musculus
gacaaggcccctagccccatctctt

SEQ ID NO: 288270 - DNA, 25 bp, Mus musculus
gacaaggcggcagactttctgcact

SEQ ID NO: 288271 - DNA, 25 bp, Mus musculus
gacaagggagaaaagaacttcgcgg

SEQ ID NO: 288272 - DNA, 25 bp, Mus musculus
gacaagggagaaaagggtgcgcctg

SEQ ID NO: 288273 - DNA, 25 bp, Mus musculus
gacaagggagaattcggtggctttg

SEQ ID NO: 288274 - DNA, 25 bp, Mus musculus
gacaagggagggaaaattgaatgtg

SEQ ID NO: 288275 - DNA, 25 bp, Mus musculus
gacaagggcaacagtcatcatctga

SEQ ID NO: 288276 - DNA, 25 bp, Mus musculus
gacaagggcaacagtgaactaatgc

SEQ ID NO: 288277 - DNA, 25 bp, Mus musculus
gacaagggcaggctgctgtcaccaa

SEQ ID NO: 288278 - DNA, 25 bp, Mus musculus
gacaagggccaaagggttccattgg

SEQ ID NO: 288279 - DNA, 25 bp, Mus musculus
gacaagggtaggtccctgtatacca

SEQ ID NO: 288280 - DNA, 25 bp, Mus musculus
gacaaggtaaaagaagaaatgaaaa

SEQ ID NO: 288281 - DNA, 25 bp, Mus musculus
gacaaggtaactacggagatcagca

SEQ ID NO: 288282 - DNA, 25 bp, Mus musculus
gacaaggtggttctgaaacgaagtg

SEQ ID NO: 288283 - DNA, 25 bp, Mus musculus
gacaaggtttctacatgaaggaagg

SEQ ID NO: 288284 - DNA, 25 bp, Mus musculus
gacaagtaaagaatctgctggatga

SEQ ID NO: 288285 - DNA, 25 bp, Mus musculus
gacaagtacaggagctttgtcatcc

SEQ ID NO: 288286 - DNA, 25 bp, Mus musculus
gacaagtacaggaggccgagtgggt

SEQ ID NO: 288287 - DNA, 25 bp, Mus musculus
gacaagtatgagcctgccatacagc

SEQ ID NO: 288288 - DNA, 25 bp, Mus musculus
gacaagtcacaagagaatgcaggca

SEQ ID NO: 288289 - DNA, 25 bp, Mus musculus
gacaagtcacaagaggaactttgtg

SEQ ID NO: 288290 - DNA, 25 bp, Mus musculus
gacaagtccagtagaggaagccagc

SEQ ID NO: 288291 - DNA, 25 bp, Mus musculus
gacaagtcctttgctagggaaagag

SEQ ID NO: 288292 - DNA, 25 bp, Mus musculus
gacaagtgagaatgattggagcctg

SEQ ID NO: 288293 - DNA, 25 bp, Mus musculus
gacaagtgagaatgggttaactgct

SEQ ID NO: 288294 - DNA, 25 bp, Mus musculus
gacaagtgagcagactcggagtgcg

SEQ ID NO: 288295 - DNA, 25 bp, Mus musculus
gacaagtgagcagggacggcctcag

SEQ ID NO: 288296 - DNA, 25 bp, Mus musculus
gacaagtgcagatgaaatcatgcac

SEQ ID NO: 288297 - DNA, 25 bp, Mus musculus
gacaagtgcgagaacatgtttggga

SEQ ID NO: 288298 - DNA, 25 bp, Mus musculus
gacaagtgcgagatcaaagaactgc

SEQ ID NO: 288299 - DNA, 25 bp, Mus musculus
gacaagtggagaaatgattagcaga

SEQ ID NO: 288300 - DNA, 25 bp, Mus musculus
gacaagtggagtcattttataagaa

SEQ ID NO: 288301 - DNA, 25 bp, Mus musculus
gacaagtggctggcacccgatggcc

SEQ ID NO: 288302 - DNA, 25 bp, Mus musculus
gacaagtgtcacaagatggagcagg

SEQ ID NO: 288303 - DNA, 25 bp, Mus musculus
gacaagtgtcccaagagggtgtatt

SEQ ID NO: 288304 - DNA, 25 bp, Mus musculus
gacaagtgtgagaaaaaacaagaag

SEQ ID NO: 288305 - DNA, 25 bp, Mus musculus
gacaagttaggtgagaaagcagaag

SEQ ID NO: 288306 - DNA, 25 bp, Mus musculus
gacaagttcaggtaacgcacagtgg

SEQ ID NO: 288307 - DNA, 25 bp, Mus musculus
gacaagttcatcagcgggcccctct

SEQ ID NO: 288308 - DNA, 25 bp, Mus musculus
gacaagttcatcaggtatttgtact

SEQ ID NO: 288309 - DNA, 25 bp, Mus musculus
gacaagttcatgaggatctaccgtt

SEQ ID NO: 288310 - DNA, 25 bp, Mus musculus
gacaagttctcgcacacaagaagca

SEQ ID NO: 288311 - DNA, 25 bp, Mus musculus
gacaagttctcggcctatggctggt

SEQ ID NO: 288312 - DNA, 25 bp, Mus musculus
gacaagttgtgagagaaggaagagg

SEQ ID NO: 288313 - DNA, 25 bp, Mus musculus
gacaataaaacgggtaaaatgatcc

SEQ ID NO: 288314 - DNA, 25 bp, Mus musculus
gacaataaaaggaaagacaaagatg

SEQ ID NO: 288315 - DNA, 25 bp, Mus musculus
gacaataaggacgggccaaggtgga

SEQ ID NO: 288316 - DNA, 25 bp, Mus musculus
gacaatacaagaagagttatgaaaa

SEQ ID NO: 288317 - DNA, 25 bp, Mus musculus
gacaatacaggctaggggtgttctc

SEQ ID NO: 288318 - DNA, 25 bp, Mus musculus
gacaatacccagagatgtgaatacg

SEQ ID NO: 288319 - DNA, 25 bp, Mus musculus
gacaatatctatctgcatgtccaga

SEQ ID NO: 288320 - DNA, 25 bp, Mus musculus
gacaatatctggcaaaaaggataag

SEQ ID NO: 288321 - DNA, 25 bp, Mus musculus
gacaatcaaaagggaagttgtcctt

SEQ ID NO: 288322 - DNA, 25 bp, Mus musculus
gacaatcacttagcatgtgtgaact

SEQ ID NO: 288323 - DNA, 25 bp, Mus musculus
gacaatcagccaaggttactcctag

SEQ ID NO: 288324 - DNA, 25 bp, Mus musculus
gacaatcagggtctatctacacagc

SEQ ID NO: 288325 - DNA, 25 bp, Mus musculus
gacaatcatggctgtcatggtatcc

SEQ ID NO: 288326 - DNA, 25 bp, Mus musculus
gacaatcattgatatgtcaactcag

SEQ ID NO: 288327 - DNA, 25 bp, Mus musculus
gacaatccagcggctcctggaggag

SEQ ID NO: 288328 - DNA, 25 bp, Mus musculus
gacaatgaaaacgtatccaacggtt

SEQ ID NO: 288329 - DNA, 25 bp, Mus musculus
gacaatgaagaaaggaagtggaagc

SEQ ID NO: 288330 - DNA, 25 bp, Mus musculus
gacaatgaagataaaattgctactg

SEQ ID NO: 288331 - DNA, 25 bp, Mus musculus
gacaatgaagattacgaacatgaag

SEQ ID NO: 288332 - DNA, 25 bp, Mus musculus
gacaatgaagtgtttgctggtgtca

SEQ ID NO: 288333 - DNA, 25 bp, Mus musculus
gacaatgacgatagaaagatcctca

SEQ ID NO: 288334 - DNA, 25 bp, Mus musculus
gacaatgacgattctgactgcccat

SEQ ID NO: 288335 - DNA, 25 bp, Mus musculus
gacaatgagaggccttcagtttatg

SEQ ID NO: 288336 - DNA, 25 bp, Mus musculus
gacaatgatagaccaaactgcagct

SEQ ID NO: 288337 - DNA, 25 bp, Mus musculus
gacaatgatagattcaaacaccgaa

SEQ ID NO: 288338 - DNA, 25 bp, Mus musculus
gacaatgatgaagactctaaaatag

SEQ ID NO: 288339 - DNA, 25 bp, Mus musculus
gacaatgatgaaggaaagaagaaag

SEQ ID NO: 288340 - DNA, 25 bp, Mus musculus
gacaatgcaagtgcaccttccagcc

SEQ ID NO: 288341 - DNA, 25 bp, Mus musculus
gacaatgcacgactccgctctcact

SEQ ID NO: 288342 - DNA, 25 bp, Mus musculus
gacaatgcagctataaaaccattta

SEQ ID NO: 288343 - DNA, 25 bp, Mus musculus
gacaatgcagcttcacttggttcac

SEQ ID NO: 288344 - DNA, 25 bp, Mus musculus
gacaatgcagtgctgaaaggaggac

SEQ ID NO: 288345 - DNA, 25 bp, Mus musculus
gacaatgcctagaagagtggttctt

SEQ ID NO: 288346 - DNA, 25 bp, Mus musculus
gacaatgcctagaaggggcaatgtc

SEQ ID NO: 288347 - DNA, 25 bp, Mus musculus
gacaatgctcaagagtatagtcatg

SEQ ID NO: 288348 - DNA, 25 bp, Mus musculus
gacaatggccaagaagtctacatgt

SEQ ID NO: 288349 - DNA, 25 bp, Mus musculus
gacaatggttatggttatgcttcaa

SEQ ID NO: 288350 - DNA, 25 bp, Mus musculus
gacaatgtaaagaaccctgtgtatt

SEQ ID NO: 288351 - DNA, 25 bp, Mus musculus
gacaatgtcactcaggtgcggacat

SEQ ID NO: 288352 - DNA, 25 bp, Mus musculus
gacaattaaaaagacgctgaaccca

SEQ ID NO: 288353 - DNA, 25 bp, Mus musculus
gacaattaccagtgatatgctgtgg

SEQ ID NO: 288354 - DNA, 25 bp, Mus musculus
gacaattacggtgcccgagggccag

SEQ ID NO: 288355 - DNA, 25 bp, Mus musculus
gacaattatgagggttcagctccta

SEQ ID NO: 288356 - DNA, 25 bp, Mus musculus
gacaattcagcctggagatgcccaa

SEQ ID NO: 288357 - DNA, 25 bp, Mus musculus
gacaattcaggacccttttgtggaa

SEQ ID NO: 288358 - DNA, 25 bp, Mus musculus
gacaattccagcacaaggaattcgc

SEQ ID NO: 288359 - DNA, 25 bp, Mus musculus
gacaattctaacagagatataccgc

SEQ ID NO: 288360 - DNA, 25 bp, Mus musculus
gacaattgaggaaccaacacaagac

SEQ ID NO: 288361 - DNA, 25 bp, Mus musculus
gacaattgcaaagaaaagacccaag

SEQ ID NO: 288362 - DNA, 25 bp, Mus musculus
gacaatttaagaccctgctcacact

SEQ ID NO: 288363 - DNA, 25 bp, Mus musculus
gacaatttaagccacaagatccgta

SEQ ID NO: 288364 - DNA, 25 bp, Mus musculus
gacaattttgttaaggaaattaagc

SEQ ID NO: 288365 - DNA, 25 bp, Mus musculus
gacacaaaaaaaaggcagtggactt

SEQ ID NO: 288366 - DNA, 25 bp, Mus musculus
gacacaaaatcatggacgcattcag

SEQ ID NO: 288367 - DNA, 25 bp, Mus musculus
gacacaaacgaggtataagtattgt

SEQ ID NO: 288368 - DNA, 25 bp, Mus musculus
gacacaaagttcagtactagaagac

SEQ ID NO: 288369 - DNA, 25 bp, Mus musculus
gacacaacagagcaggttaggaaat

SEQ ID NO: 288370 - DNA, 25 bp, Mus musculus
gacacaagaaaagtcaggccctgct

SEQ ID NO: 288371 - DNA, 25 bp, Mus musculus
gacacaagaaatttacccaataaag

SEQ ID NO: 288372 - DNA, 25 bp, Mus musculus
gacacaagcaagcagttgtttcttg

SEQ ID NO: 288373 - DNA, 25 bp, Mus musculus
gacacaagcaggtcagatgtaccag

SEQ ID NO: 288374 - DNA, 25 bp, Mus musculus
gacacaatacaaaagaaagaaaatg

SEQ ID NO: 288375 - DNA, 25 bp, Mus musculus
gacacacaatgggtgatccattcat

SEQ ID NO: 288376 - DNA, 25 bp, Mus musculus
gacacacaattggcggcggctgccc

SEQ ID NO: 288377 - DNA, 25 bp, Mus musculus
gacacacaattgggccggcggcggc

SEQ ID NO: 288378 - DNA, 25 bp, Mus musculus
gacacacaattggtggacgcagacg

SEQ ID NO: 288379 - DNA, 25 bp, Mus musculus
gacacacaccaggggtgacagtcca

SEQ ID NO: 288380 - DNA, 25 bp, Mus musculus
gacacacagagaaaacatcccaggc

SEQ ID NO: 288381 - DNA, 25 bp, Mus musculus
gacacacccctgtctgcaggcattg

SEQ ID NO: 288382 - DNA, 25 bp, Mus musculus
gacacacctccacaggttccagatg

SEQ ID NO: 288383 - DNA, 25 bp, Mus musculus
gacacactccacgcagtatgagatg

SEQ ID NO: 288384 - DNA, 25 bp, Mus musculus
gacacactgcagcgtgctctgctag

SEQ ID NO: 288385 - DNA, 25 bp, Mus musculus
gacacactgtccaaactagcctctg

SEQ ID NO: 288386 - DNA, 25 bp, Mus musculus
gacacactgtccaagatctccgagg

SEQ ID NO: 288387 - DNA, 25 bp, Mus musculus
gacacagaaagggtgcttcgagtgc

SEQ ID NO: 288388 - DNA, 25 bp, Mus musculus
gacacagaagatctggaacttcctg

SEQ ID NO: 288389 - DNA, 25 bp, Mus musculus
gacacagaaggaaggaattcaggaa

SEQ ID NO: 288390 - DNA, 25 bp, Mus musculus
gacacagacatggactgtctaactt

SEQ ID NO: 288391 - DNA, 25 bp, Mus musculus
gacacagaccaggtgggagcatgcc

SEQ ID NO: 288392 - DNA, 25 bp, Mus musculus
gacacagactggaaggaacatgaca

SEQ ID NO: 288393 - DNA, 25 bp, Mus musculus
gacacagagctgtcccacattgggc

SEQ ID NO: 288394 - DNA, 25 bp, Mus musculus
gacacagagctgttgccaaaacaaa

SEQ ID NO: 288395 - DNA, 25 bp, Mus musculus
gacacagaggtggaggagagcatgg

SEQ ID NO: 288396 - DNA, 25 bp, Mus musculus
gacacagatagagaaaccaactgag

SEQ ID NO: 288397 - DNA, 25 bp, Mus musculus
gacacagcaaacggctgtccctcct

SEQ ID NO: 288398 - DNA, 25 bp, Mus musculus
gacacagcacctgcagtggctacct

SEQ ID NO: 288399 - DNA, 25 bp, Mus musculus
gacacagcagctggaactcattata

SEQ ID NO: 288400 - DNA, 25 bp, Mus musculus
gacacagcagggcaggatgagtaca

SEQ ID NO: 288401 - DNA, 25 bp, Mus musculus
gacacagcaggtggatgcagtgacc

SEQ ID NO: 288402 - DNA, 25 bp, Mus musculus
gacacagccagtccagtagctccat

SEQ ID NO: 288403 - DNA, 25 bp, Mus musculus
gacacagccagtccgggaacccagt

SEQ ID NO: 288404 - DNA, 25 bp, Mus musculus
gacacagccagtccgtaaaagctct

SEQ ID NO: 288405 - DNA, 25 bp, Mus musculus
gacacagcctctgccaagcagttct

SEQ ID NO: 288406 - DNA, 25 bp, Mus musculus
gacacagcctgcttctacctggcag

SEQ ID NO: 288407 - DNA, 25 bp, Mus musculus
gacacagcgtgcttttacttggctg

SEQ ID NO: 288408 - DNA, 25 bp, Mus musculus
gacacagcgtggccttgggtggacc

SEQ ID NO: 288409 - DNA, 25 bp, Mus musculus
gacacagctaagatcacagccatga

SEQ ID NO: 288410 - DNA, 25 bp, Mus musculus
gacacagctaagttcacagccatga

SEQ ID NO: 288411 - DNA, 25 bp, Mus musculus
gacacagctagacctttggatgatg

SEQ ID NO: 288412 - DNA, 25 bp, Mus musculus
gacacagctagagctttggatgatg

SEQ ID NO: 288413 - DNA, 25 bp, Mus musculus
gacacaggaggacctccaccatggc

SEQ ID NO: 288414 - DNA, 25 bp, Mus musculus
gacacaggtggagaatataaatatt

SEQ ID NO: 288415 - DNA, 25 bp, Mus musculus
gacacaggtgtgtatccagagtgtg

SEQ ID NO: 288416 - DNA, 25 bp, Mus musculus
gacacagtgaagtcccctcctggcc

SEQ ID NO: 288417 - DNA, 25 bp, Mus musculus
gacacagtgattatagttgattgaa

SEQ ID NO: 288418 - DNA, 25 bp, Mus musculus
gacacagtgcccgtgcgcagttctg

SEQ ID NO: 288419 - DNA, 25 bp, Mus musculus
gacacagtgctgccacgacccttcc

SEQ ID NO: 288420 - DNA, 25 bp, Mus musculus
gacacatacaagagaggtgactacg

SEQ ID NO: 288421 - DNA, 25 bp, Mus musculus
gacacatacggacctcaaacctgaa

SEQ ID NO: 288422 - DNA, 25 bp, Mus musculus
gacacatcaccagggaattcgtacc

SEQ ID NO: 288423 - DNA, 25 bp, Mus musculus
gacacatcaccaggtctcattattc

SEQ ID NO: 288424 - DNA, 25 bp, Mus musculus
gacacatcagggggcgtcagtcatt

SEQ ID NO: 288425 - DNA, 25 bp, Mus musculus
gacacatgaggtgcacgcctcctct

SEQ ID NO: 288426 - DNA, 25 bp, Mus musculus
gacacatgatgctatcatgaacata

SEQ ID NO: 288427 - DNA, 25 bp, Mus musculus
gacacatgatggctatttgaaactc

SEQ ID NO: 288428 - DNA, 25 bp, Mus musculus
gacacatgcagaaaagtaaagaaca

SEQ ID NO: 288429 - DNA, 25 bp, Mus musculus
gacacatgcagctggtgaatgagca

SEQ ID NO: 288430 - DNA, 25 bp, Mus musculus
gacacatgcaggcgcatacctcttg

SEQ ID NO: 288431 - DNA, 25 bp, Mus musculus
gacacatgctcaggacccatagatg

SEQ ID NO: 288432 - DNA, 25 bp, Mus musculus
gacacatggaagatctcaggcccat

SEQ ID NO: 288433 - DNA, 25 bp, Mus musculus
gacacatggggagagagggcaatgc

SEQ ID NO: 288434 - DNA, 25 bp, Mus musculus
gacacatgtagatctttcatttgtc

SEQ ID NO: 288435 - DNA, 25 bp, Mus musculus
gacacattctggtgctggagacaga

SEQ ID NO: 288436 - DNA, 25 bp, Mus musculus
gacacattggcggctttcttgatca

SEQ ID NO: 288437 - DNA, 25 bp, Mus musculus
gacacattttaactgtgacaaacgg

SEQ ID NO: 288438 - DNA, 25 bp, Mus musculus
gacaccaaaagggctcaggatgcta

SEQ ID NO: 288439 - DNA, 25 bp, Mus musculus
gacaccaacacaggttccttcctcc

SEQ ID NO: 288440 - DNA, 25 bp, Mus musculus
gacaccaagaagcagccctcaggca

SEQ ID NO: 288441 - DNA, 25 bp, Mus musculus
gacaccaagaagcagttactgccgc

SEQ ID NO: 288442 - DNA, 25 bp, Mus musculus
gacaccaaggagtcagtccgaccgc

SEQ ID NO: 288443 - DNA, 25 bp, Mus musculus
gacaccacaaccagctaaagaacgc

SEQ ID NO: 288444 - DNA, 25 bp, Mus musculus
gacaccacagagctccttggtagat

SEQ ID NO: 288445 - DNA, 25 bp, Mus musculus
gacaccacaggaaagaatgtttcca

SEQ ID NO: 288446 - DNA, 25 bp, Mus musculus
gacaccaccaagatcccatggtttc

SEQ ID NO: 288447 - DNA, 25 bp, Mus musculus
gacaccacgcagaatggtggcatct

SEQ ID NO: 288448 - DNA, 25 bp, Mus musculus
gacaccacgcagcccccacatcgac

SEQ ID NO: 288449 - DNA, 25 bp, Mus musculus
gacaccagagaccttaaccgaaggt

SEQ ID NO: 288450 - DNA, 25 bp, Mus musculus
gacaccagagcagcgtcatctccga

SEQ ID NO: 288451 - DNA, 25 bp, Mus musculus
gacaccagctgcaaggtgtgaggtt

SEQ ID NO: 288452 - DNA, 25 bp, Mus musculus
gacaccaggctgagtgtttatcatg

SEQ ID NO: 288453 - DNA, 25 bp, Mus musculus
gacaccatcaagcacccaggaggta

SEQ ID NO: 288454 - DNA, 25 bp, Mus musculus
gacaccatccaaccgaggagagtca

SEQ ID NO: 288455 - DNA, 25 bp, Mus musculus
gacaccatgcataggaagcaccttc

SEQ ID NO: 288456 - DNA, 25 bp, Mus musculus
gacaccatgcctgctgacaaggaca

SEQ ID NO: 288457 - DNA, 25 bp, Mus musculus
gacaccatggctgatcatcactccg

SEQ ID NO: 288458 - DNA, 25 bp, Mus musculus
gacaccatttcagacctcaagtgga

SEQ ID NO: 288459 - DNA, 25 bp, Mus musculus
gacacccaaccaatggcttcgagct

SEQ ID NO: 288460 - DNA, 25 bp, Mus musculus
gacacccaaggatgtgaatgagtgc

SEQ ID NO: 288461 - DNA, 25 bp, Mus musculus
gacacccacagagaaatgatctcct

SEQ ID NO: 288462 - DNA, 25 bp, Mus musculus
gacacccacagaggacgacaatgag

SEQ ID NO: 288463 - DNA, 25 bp, Mus musculus
gacacccacagggataaggaaggcg

SEQ ID NO: 288464 - DNA, 25 bp, Mus musculus
gacacccagcctggccgcagaagag

SEQ ID NO: 288465 - DNA, 25 bp, Mus musculus
gacacccagggtcctcactgcagtg

SEQ ID NO: 288466 - DNA, 25 bp, Mus musculus
gacacccatcccagaaccaggcaga

SEQ ID NO: 288467 - DNA, 25 bp, Mus musculus
gacacccatggctttgagcacacct

SEQ ID NO: 288468 - DNA, 25 bp, Mus musculus
gacacccattgagaatcctataagg

SEQ ID NO: 288469 - DNA, 25 bp, Mus musculus
gacacccattgaggcccaaacacga

SEQ ID NO: 288470 - DNA, 25 bp, Mus musculus
gacacccccaagttcaatctcatcc

SEQ ID NO: 288471 - DNA, 25 bp, Mus musculus
gacacccctcatgtttctgcagggt

SEQ ID NO: 288472 - DNA, 25 bp, Mus musculus
gacacccgcccgccgtgaaagccgg

SEQ ID NO: 288473 - DNA, 25 bp, Mus musculus
gacaccctctctggactctatagct

SEQ ID NO: 288474 - DNA, 25 bp, Mus musculus
gacaccgagcggagggcaagaggct

SEQ ID NO: 288475 - DNA, 25 bp, Mus musculus
gacaccgccagctctgctgtggctg

SEQ ID NO: 288476 - DNA, 25 bp, Mus musculus
gacaccgccgtcaggatctggaagt

SEQ ID NO: 288477 - DNA, 25 bp, Mus musculus
gacaccgcgcagatctcaagcatac

SEQ ID NO: 288478 - DNA, 25 bp, Mus musculus
gacaccgcgcggcgaagtcaatgaa

SEQ ID NO: 288479 - DNA, 25 bp, Mus musculus
gacaccgctcgtgtcttatctagca

SEQ ID NO: 288480 - DNA, 25 bp, Mus musculus
gacaccggattcggtgtatcctgct

SEQ ID NO: 288481 - DNA, 25 bp, Mus musculus
gacaccggcagaaaaagttacgtcg

SEQ ID NO: 288482 - DNA, 25 bp, Mus musculus
gacaccggcaggtgggtaatgctgt

SEQ ID NO: 288483 - DNA, 25 bp, Mus musculus
gacaccggcagttccagttactatg

SEQ ID NO: 288484 - DNA, 25 bp, Mus musculus
gacaccggccaggggcgcaagaagt

SEQ ID NO: 288485 - DNA, 25 bp, Mus musculus
gacaccggccaggtgctctcaccac

SEQ ID NO: 288486 - DNA, 25 bp, Mus musculus
gacaccgtacatcaggtacttcgtg

SEQ ID NO: 288487 - DNA, 25 bp, Mus musculus
gacaccgtacgaggcagctgtggcc

SEQ ID NO: 288488 - DNA, 25 bp, Mus musculus
gacacctaaaggctcccctttgatt

SEQ ID NO: 288489 - DNA, 25 bp, Mus musculus
gacacctaaggtgaaggcgataaag

SEQ ID NO: 288490 - DNA, 25 bp, Mus musculus
gacacctatgaacttgcgatgtagc

SEQ ID NO: 288491 - DNA, 25 bp, Mus musculus
gacacctatgttttcaaagatacat

SEQ ID NO: 288492 - DNA, 25 bp, Mus musculus
gacacctcagggcacacttgccgag

SEQ ID NO: 288493 - DNA, 25 bp, Mus musculus
gacacctcaggtaaaccccttgacc

SEQ ID NO: 288494 - DNA, 25 bp, Mus musculus
gacacctcaggtggaccccttgacc

SEQ ID NO: 288495 - DNA, 25 bp, Mus musculus
gacacctccatgtatcccaagggtt

SEQ ID NO: 288496 - DNA, 25 bp, Mus musculus
gacacctccgactgctctttgtcac

SEQ ID NO: 288497 - DNA, 25 bp, Mus musculus
gacacctccgactgggaggagaagg

SEQ ID NO: 288498 - DNA, 25 bp, Mus musculus
gacacctcgccacggcccagttcaa

SEQ ID NO: 288499 - DNA, 25 bp, Mus musculus
gacacctctcagaaaagttgtatgg

SEQ ID NO: 288500 - DNA, 25 bp, Mus musculus
gacacctctcctggagtgtctgtga

SEQ ID NO: 288501 - DNA, 25 bp, Mus musculus
gacacctctcctgggcctctgatac

SEQ ID NO: 288502 - DNA, 25 bp, Mus musculus
gacacctctttgcagatcttgatat

SEQ ID NO: 288503 - DNA, 25 bp, Mus musculus
gacacctgagatatcaagttcattg

SEQ ID NO: 288504 - DNA, 25 bp, Mus musculus
gacacctgcttggagtacaaggttc

SEQ ID NO: 288505 - DNA, 25 bp, Mus musculus
gacacctggaagctgaactcccacc

SEQ ID NO: 288506 - DNA, 25 bp, Mus musculus
gacacctggaaggcagccagagtaa

SEQ ID NO: 288507 - DNA, 25 bp, Mus musculus
gacacctggcataaggccactcaga

SEQ ID NO: 288508 - DNA, 25 bp, Mus musculus
gacacctgtcaggagaacagccagt

SEQ ID NO: 288509 - DNA, 25 bp, Mus musculus
gacacctgtcaggagatcttcctgt

SEQ ID NO: 288510 - DNA, 25 bp, Mus musculus
gacacctgtcgcccatattttaata

SEQ ID NO: 288511 - DNA, 25 bp, Mus musculus
gacacctgtcgcccctgagtgcaat

SEQ ID NO: 288512 - DNA, 25 bp, Mus musculus
gacacctgttgcaggcatgatgggt

SEQ ID NO: 288513 - DNA, 25 bp, Mus musculus
gacaccttaggtattggaaaagtga

SEQ ID NO: 288514 - DNA, 25 bp, Mus musculus
gacaccttcaggtggaagggagaga

SEQ ID NO: 288515 - DNA, 25 bp, Mus musculus
gacaccttgagagggttttatggac

SEQ ID NO: 288516 - DNA, 25 bp, Mus musculus
gacaccttggggcaacctatccaac

SEQ ID NO: 288517 - DNA, 25 bp, Mus musculus
gacacctttccaaaggagttgaagc

SEQ ID NO: 288518 - DNA, 25 bp, Mus musculus
gacacgagctggagtgagcaaacca

SEQ ID NO: 288519 - DNA, 25 bp, Mus musculus
gacacgagggctccttcttctacgc

SEQ ID NO: 288520 - DNA, 25 bp, Mus musculus
gacacgatggaagcagaaaccagtg

SEQ ID NO: 288521 - DNA, 25 bp, Mus musculus
gacacgatggaagctcagctgccaa

SEQ ID NO: 288522 - DNA, 25 bp, Mus musculus
gacacgattcacgaggtcctgtaat

SEQ ID NO: 288523 - DNA, 25 bp, Mus musculus
gacacgcaccagtggtatgtgtgca

SEQ ID NO: 288524 - DNA, 25 bp, Mus musculus
gacacgcatggggtgtgattttgcc

SEQ ID NO: 288525 - DNA, 25 bp, Mus musculus
gacacgccagataacacaactggag

SEQ ID NO: 288526 - DNA, 25 bp, Mus musculus
gacacgccagtggctgtttacctga

SEQ ID NO: 288527 - DNA, 25 bp, Mus musculus
gacacgccagtgggttcttctgtga

SEQ ID NO: 288528 - DNA, 25 bp, Mus musculus
gacacgcctgaagaggacatggatg

SEQ ID NO: 288529 - DNA, 25 bp, Mus musculus
gacacgcggagcctctgacctccag

SEQ ID NO: 288530 - DNA, 25 bp, Mus musculus
gacacgcggcataggccttcagaag

SEQ ID NO: 288531 - DNA, 25 bp, Mus musculus
gacacgctatggcaatctttaaatt

SEQ ID NO: 288532 - DNA, 25 bp, Mus musculus
gacacgctccccaaggaggtattcc

SEQ ID NO: 288533 - DNA, 25 bp, Mus musculus
gacacgctgagaaatacgaagaaaa

SEQ ID NO: 288534 - DNA, 25 bp, Mus musculus
gacacgctgagaatatatcagagcc

SEQ ID NO: 288535 - DNA, 25 bp, Mus musculus
gacacggacaatttgggtatccgga

SEQ ID NO: 288536 - DNA, 25 bp, Mus musculus
gacacggacattcagggcttcctga

SEQ ID NO: 288537 - DNA, 25 bp, Mus musculus
gacacggactggaggcgccagcccc

SEQ ID NO: 288538 - DNA, 25 bp, Mus musculus
gacacggagacgaccatgccgtcca

SEQ ID NO: 288539 - DNA, 25 bp, Mus musculus
gacacggagagaagattaaggacag

SEQ ID NO: 288540 - DNA, 25 bp, Mus musculus
gacacggagcagcccaccttgggac

SEQ ID NO: 288541 - DNA, 25 bp, Mus musculus
gacacggagcaggaaggcaaatact

SEQ ID NO: 288542 - DNA, 25 bp, Mus musculus
gacacggagcggtactgctcacgaa

SEQ ID NO: 288543 - DNA, 25 bp, Mus musculus
gacacggatagcagacactacaaga

SEQ ID NO: 288544 - DNA, 25 bp, Mus musculus
gacacggggctgcaggtcacagcgg

SEQ ID NO: 288545 - DNA, 25 bp, Mus musculus
gacacggtccagctgcccaccattc

SEQ ID NO: 288546 - DNA, 25 bp, Mus musculus
gacacgttttttgccattggtgtca

SEQ ID NO: 288547 - DNA, 25 bp, Mus musculus
gacactaaccctgagctcttggcta

SEQ ID NO: 288548 - DNA, 25 bp, Mus musculus
gacactacaggagagcacacagctg

SEQ ID NO: 288549 - DNA, 25 bp, Mus musculus
gacactacagggctcccagtttgtg

SEQ ID NO: 288550 - DNA, 25 bp, Mus musculus
gacactacaggtaacaggattgaga

SEQ ID NO: 288551 - DNA, 25 bp, Mus musculus
gacactactgatttcagctctgatc

SEQ ID NO: 288552 - DNA, 25 bp, Mus musculus
gacactagagaagagttggttgatc

SEQ ID NO: 288553 - DNA, 25 bp, Mus musculus
gacactattattcccggtgtggaat

SEQ ID NO: 288554 - DNA, 25 bp, Mus musculus
gacactcaagaaaattacaacacca

SEQ ID NO: 288555 - DNA, 25 bp, Mus musculus
gacactcaagagagggactcctggg

SEQ ID NO: 288556 - DNA, 25 bp, Mus musculus
gacactcaaggcatttccccactgc

SEQ ID NO: 288557 - DNA, 25 bp, Mus musculus
gacactcaagtggctgatgtgacaa

SEQ ID NO: 288558 - DNA, 25 bp, Mus musculus
gacactcacagaaggtggcttaaaa

SEQ ID NO: 288559 - DNA, 25 bp, Mus musculus
gacactcacagaaggtgtaacacgg

SEQ ID NO: 288560 - DNA, 25 bp, Mus musculus
gacactcagagactgtctctggagg

SEQ ID NO: 288561 - DNA, 25 bp, Mus musculus
gacactcagaggatttccctagaga

SEQ ID NO: 288562 - DNA, 25 bp, Mus musculus
gacactcattcccagacccagtgat

SEQ ID NO: 288563 - DNA, 25 bp, Mus musculus
gacactccacacgagaggctcacaa

SEQ ID NO: 288564 - DNA, 25 bp, Mus musculus
gacactccacacgaggagccagatg

SEQ ID NO: 288565 - DNA, 25 bp, Mus musculus
gacactccacacttggatgctcaac

SEQ ID NO: 288566 - DNA, 25 bp, Mus musculus
gacactccacagaagtgtacagtcc

SEQ ID NO: 288567 - DNA, 25 bp, Mus musculus
gacactccagcccagaattaaccct

SEQ ID NO: 288568 - DNA, 25 bp, Mus musculus
gacactccagcccagatggaggatg

SEQ ID NO: 288569 - DNA, 25 bp, Mus musculus
gacactccagcccagcagacaggag

SEQ ID NO: 288570 - DNA, 25 bp, Mus musculus
gacactccagcccagctggagatgg

SEQ ID NO: 288571 - DNA, 25 bp, Mus musculus
gacactccagcccaggccctccttg

SEQ ID NO: 288572 - DNA, 25 bp, Mus musculus
gacactcgaaacattctattcactg

SEQ ID NO: 288573 - DNA, 25 bp, Mus musculus
gacactcgaggatgtgaagcaggag

SEQ ID NO: 288574 - DNA, 25 bp, Mus musculus
gacactctactaagtgccctgcatt

SEQ ID NO: 288575 - DNA, 25 bp, Mus musculus
gacactgaaaaatgggatgggttgg

SEQ ID NO: 288576 - DNA, 25 bp, Mus musculus
gacactgaaaagcgccatggctact

SEQ ID NO: 288577 - DNA, 25 bp, Mus musculus
gacactgaagttggtgagtctagct

SEQ ID NO: 288578 - DNA, 25 bp, Mus musculus
gacactgaccaaagatgagaaagta

SEQ ID NO: 288579 - DNA, 25 bp, Mus musculus
gacactgacctggtgttgctgcacc

SEQ ID NO: 288580 - DNA, 25 bp, Mus musculus
gacactgacctggtgtttacagtgt

SEQ ID NO: 288581 - DNA, 25 bp, Mus musculus
gacactgagaagaaggtgtttctcc

SEQ ID NO: 288582 - DNA, 25 bp, Mus musculus
gacactgagggccgatatctcttct

SEQ ID NO: 288583 - DNA, 25 bp, Mus musculus
gacactgcaaaaacctggagccaga

SEQ ID NO: 288584 - DNA, 25 bp, Mus musculus
gacactgcaacaacgggatcccgga

SEQ ID NO: 288585 - DNA, 25 bp, Mus musculus
gacactgcagcggaccttacagaaa

SEQ ID NO: 288586 - DNA, 25 bp, Mus musculus
gacactgcaggacaggaggattaca

SEQ ID NO: 288587 - DNA, 25 bp, Mus musculus
gacactgcagttcatcgtggcagaa

SEQ ID NO: 288588 - DNA, 25 bp, Mus musculus
gacactgccaggtgtggcgctaatg

SEQ ID NO: 288589 - DNA, 25 bp, Mus musculus
gacactgccttacccatatctgtca

SEQ ID NO: 288590 - DNA, 25 bp, Mus musculus
gacactgcgtgggcccagtgggcag

SEQ ID NO: 288591 - DNA, 25 bp, Mus musculus
gacactgctgacagtgccacggcct

SEQ ID NO: 288592 - DNA, 25 bp, Mus musculus
gacactgctgatgccgagtgctgag

SEQ ID NO: 288593 - DNA, 25 bp, Mus musculus
gacactgctggtcagctctgcaatc

SEQ ID NO: 288594 - DNA, 25 bp, Mus musculus
gacactgctggtcaggcagagttca

SEQ ID NO: 288595 - DNA, 25 bp, Mus musculus
gacactgcttttctccttccgcaac

SEQ ID NO: 288596 - DNA, 25 bp, Mus musculus
gacactggaaaatggtggtggcttg

SEQ ID NO: 288597 - DNA, 25 bp, Mus musculus
gacactggagatgatccttacagca

SEQ ID NO: 288598 - DNA, 25 bp, Mus musculus
gacactggcagcagggcagtttcac

SEQ ID NO: 288599 - DNA, 25 bp, Mus musculus
gacactggcagtttccaggcacttg

SEQ ID NO: 288600 - DNA, 25 bp, Mus musculus
gacactggccagaaggatgtcaatg

SEQ ID NO: 288601 - DNA, 25 bp, Mus musculus
gacactggcctctgagagctgtcgg

SEQ ID NO: 288602 - DNA, 25 bp, Mus musculus
gacactggctgatctgcatccccaa

SEQ ID NO: 288603 - DNA, 25 bp, Mus musculus
gacactgggcctggttgtggagttg

SEQ ID NO: 288604 - DNA, 25 bp, Mus musculus
gacactggtgtaagaaatgaagctc

SEQ ID NO: 288605 - DNA, 25 bp, Mus musculus
gacactggtgttagaaatgaagctc

SEQ ID NO: 288606 - DNA, 25 bp, Mus musculus
gacactgtacttcgcagatatggcc

SEQ ID NO: 288607 - DNA, 25 bp, Mus musculus
gacactgtagccacgcgagttgtta

SEQ ID NO: 288608 - DNA, 25 bp, Mus musculus
gacactgtatcggttccatgtaagt

SEQ ID NO: 288609 - DNA, 25 bp, Mus musculus
gacactgtcaagcgcagggtcaaag

SEQ ID NO: 288610 - DNA, 25 bp, Mus musculus
gacactgtcaagggcagggtcaaag

SEQ ID NO: 288611 - DNA, 25 bp, Mus musculus
gacactgtcaccgactatttgcatc

SEQ ID NO: 288612 - DNA, 25 bp, Mus musculus
gacactgtcaccgagtttgtctctg

SEQ ID NO: 288613 - DNA, 25 bp, Mus musculus
gacactgtcaccgatgtggataagt

SEQ ID NO: 288614 - DNA, 25 bp, Mus musculus
gacactgtcagagtatttttctatt

SEQ ID NO: 288615 - DNA, 25 bp, Mus musculus
gacactgttgatccacagggatggc

SEQ ID NO: 288616 - DNA, 25 bp, Mus musculus
gacacttaaagctgcgcaaaccatg

SEQ ID NO: 288617 - DNA, 25 bp, Mus musculus
gacacttaacaggtccccaggcaag

SEQ ID NO: 288618 - DNA, 25 bp, Mus musculus
gacacttaagggctacttgattagc

SEQ ID NO: 288619 - DNA, 25 bp, Mus musculus
gacacttaccaggtctttgacagaa

SEQ ID NO: 288620 - DNA, 25 bp, Mus musculus
gacacttacgagcatacatctttga

SEQ ID NO: 288621 - DNA, 25 bp, Mus musculus
gacacttacgataaactttataatc

SEQ ID NO: 288622 - DNA, 25 bp, Mus musculus
gacacttccaaaatgataaacttta

SEQ ID NO: 288623 - DNA, 25 bp, Mus musculus
gacacttccgtgttaggcacgggca

SEQ ID NO: 288624 - DNA, 25 bp, Mus musculus
gacacttctgacgatcttgaccggc

SEQ ID NO: 288625 - DNA, 25 bp, Mus musculus
gacacttgagaggctacagacacac

SEQ ID NO: 288626 - DNA, 25 bp, Mus musculus
gacacttggacgttcatgagggatc

SEQ ID NO: 288627 - DNA, 25 bp, Mus musculus
gacacttgggaggccatggaggacc

SEQ ID NO: 288628 - DNA, 25 bp, Mus musculus
gacacttgtgaagcagcaggaagca

SEQ ID NO: 288629 - DNA, 25 bp, Mus musculus
gacacttgtgcggaggcccactgat

SEQ ID NO: 288630 - DNA, 25 bp, Mus musculus
gacacttgtgcgggtgactcaggag

SEQ ID NO: 288631 - DNA, 25 bp, Mus musculus
gacacttgtggaaggaatctgctat

SEQ ID NO: 288632 - DNA, 25 bp, Mus musculus
gacacttgtggagcattctggaaga

SEQ ID NO: 288633 - DNA, 25 bp, Mus musculus
gacactttggagaagtattgaggct

SEQ ID NO: 288634 - DNA, 25 bp, Mus musculus
gacagaaaaatctcatcagagttgt

SEQ ID NO: 288635 - DNA, 25 bp, Mus musculus
gacagaaaaatgcatacacagacta

SEQ ID NO: 288636 - DNA, 25 bp, Mus musculus
gacagaaaagaatgcagtcacagga

SEQ ID NO: 288637 - DNA, 25 bp, Mus musculus
gacagaaaccaagaccaaaaacact

SEQ ID NO: 288638 - DNA, 25 bp, Mus musculus
gacagaaaccaagtgctaaactgaa

SEQ ID NO: 288639 - DNA, 25 bp, Mus musculus
gacagaaacgggacttatctgcaga

SEQ ID NO: 288640 - DNA, 25 bp, Mus musculus
gacagaaacggtatctgcagagttt

SEQ ID NO: 288641 - DNA, 25 bp, Mus musculus
gacagaaagcagatttcaacaagaa

SEQ ID NO: 288642 - DNA, 25 bp, Mus musculus
gacagaaaggaaacatggagctcgg

SEQ ID NO: 288643 - DNA, 25 bp, Mus musculus
gacagaaaggccaggttctgggaga

SEQ ID NO: 288644 - DNA, 25 bp, Mus musculus
gacagaaaggcgatctctttccaag

SEQ ID NO: 288645 - DNA, 25 bp, Mus musculus
gacagaaaggcggaacagagtgttc

SEQ ID NO: 288646 - DNA, 25 bp, Mus musculus
gacagaaaggcgggaaagggctgtg

SEQ ID NO: 288647 - DNA, 25 bp, Mus musculus
gacagaaagggaacgcatcatcaac

SEQ ID NO: 288648 - DNA, 25 bp, Mus musculus
gacagaaaggtggatatgtccgacc

SEQ ID NO: 288649 - DNA, 25 bp, Mus musculus
gacagaacaggtcctgctgcaggca

SEQ ID NO: 288650 - DNA, 25 bp, Mus musculus
gacagaacagtttttggcctttgaa

SEQ ID NO: 288651 - DNA, 25 bp, Mus musculus
gacagaacccgaaaagggccctgta

SEQ ID NO: 288652 - DNA, 25 bp, Mus musculus
gacagaacccgagctgcctgccgac

SEQ ID NO: 288653 - DNA, 25 bp, Mus musculus
gacagaaccgcaagacaggagcccg

SEQ ID NO: 288654 - DNA, 25 bp, Mus musculus
gacagaaccgcaagcttccatacga

SEQ ID NO: 288655 - DNA, 25 bp, Mus musculus
gacagaacggttgattacaacggcg

SEQ ID NO: 288656 - DNA, 25 bp, Mus musculus
gacagaacggttgatttaggggatg

SEQ ID NO: 288657 - DNA, 25 bp, Mus musculus
gacagaagaggctcagaacactggg

SEQ ID NO: 288658 - DNA, 25 bp, Mus musculus
gacagaagaggctctccctgaagtc

SEQ ID NO: 288659 - DNA, 25 bp, Mus musculus
gacagaaggaagaagaaaagacacc

SEQ ID NO: 288660 - DNA, 25 bp, Mus musculus
gacagaaggaagaagaggaaaggat

SEQ ID NO: 288661 - DNA, 25 bp, Mus musculus
gacagaaggagaagaataccaggaa

SEQ ID NO: 288662 - DNA, 25 bp, Mus musculus
gacagaaggagaaggaaagcggtac

SEQ ID NO: 288663 - DNA, 25 bp, Mus musculus
gacagaatacatgcaagaccctgat

SEQ ID NO: 288664 - DNA, 25 bp, Mus musculus
gacagaattagggaacctgctggta

SEQ ID NO: 288665 - DNA, 25 bp, Mus musculus
gacagacaagaaattgcaaattcaa

SEQ ID NO: 288666 - DNA, 25 bp, Mus musculus
gacagacaagatttgaaagaagcgg

SEQ ID NO: 288667 - DNA, 25 bp, Mus musculus
gacagacaaggcttcagaagaggtg

SEQ ID NO: 288668 - DNA, 25 bp, Mus musculus
gacagacacagaaagggtgcttcga

SEQ ID NO: 288669 - DNA, 25 bp, Mus musculus
gacagacacatgaggtgcacgcctc

SEQ ID NO: 288670 - DNA, 25 bp, Mus musculus
gacagacaccggcaggtgggtaatg

SEQ ID NO: 288671 - DNA, 25 bp, Mus musculus
gacagacagaacagtctaagagtgt

SEQ ID NO: 288672 - DNA, 25 bp, Mus musculus
gacagacagactgggaaaacatcga

SEQ ID NO: 288673 - DNA, 25 bp, Mus musculus
gacagacagctgcagtgcttacaga

SEQ ID NO: 288674 - DNA, 25 bp, Mus musculus
gacagacagtgggaagtctgttgtt

SEQ ID NO: 288675 - DNA, 25 bp, Mus musculus
gacagacataggaagatcaccagca

SEQ ID NO: 288676 - DNA, 25 bp, Mus musculus
gacagacatggggagtcttctgagt

SEQ ID NO: 288677 - DNA, 25 bp, Mus musculus
gacagaccaagtctgctgaagacag

SEQ ID NO: 288678 - DNA, 25 bp, Mus musculus
gacagaccatccaggtgagcctcat

SEQ ID NO: 288679 - DNA, 25 bp, Mus musculus
gacagaccctggacatcaacatggc

SEQ ID NO: 288680 - DNA, 25 bp, Mus musculus
gacagaccctgggacagcaggtgcc

SEQ ID NO: 288681 - DNA, 25 bp, Mus musculus
gacagaccctgggctccaccctcat

SEQ ID NO: 288682 - DNA, 25 bp, Mus musculus
gacagaccctggtcactcatcaggc

SEQ ID NO: 288683 - DNA, 25 bp, Mus musculus
gacagaccgtcacggacaattgttc

SEQ ID NO: 288684 - DNA, 25 bp, Mus musculus
gacagacctgcaaatctcccagcca

SEQ ID NO: 288685 - DNA, 25 bp, Mus musculus
gacagacctgtcaagagaatccatc

SEQ ID NO: 288686 - DNA, 25 bp, Mus musculus
gacagacgaggtaaacagcccagat

SEQ ID NO: 288687 - DNA, 25 bp, Mus musculus
gacagactaaagaagtttccagaac

SEQ ID NO: 288688 - DNA, 25 bp, Mus musculus
gacagactccccagtttctcaaggg

SEQ ID NO: 288689 - DNA, 25 bp, Mus musculus
gacagactgaaggacagggtggcct

SEQ ID NO: 288690 - DNA, 25 bp, Mus musculus
gacagactgagccccttaggtgagg

SEQ ID NO: 288691 - DNA, 25 bp, Mus musculus
gacagactgcacttgtggtttgcta

SEQ ID NO: 288692 - DNA, 25 bp, Mus musculus
gacagactggaggagttgaaagaat

SEQ ID NO: 288693 - DNA, 25 bp, Mus musculus
gacagactggaggcattctggaatt

SEQ ID NO: 288694 - DNA, 25 bp, Mus musculus
gacagactgggaaaacatcgattgc

SEQ ID NO: 288695 - DNA, 25 bp, Mus musculus
gacagactgtaacctgtcctggtta

SEQ ID NO: 288696 - DNA, 25 bp, Mus musculus
gacagacttaggcgctaactgggat

SEQ ID NO: 288697 - DNA, 25 bp, Mus musculus
gacagagaaacgtctgtctgcaggt

SEQ ID NO: 288698 - DNA, 25 bp, Mus musculus
gacagagaaagatgccaagctgggg

SEQ ID NO: 288699 - DNA, 25 bp, Mus musculus
gacagagaacaagatttctccttat

SEQ ID NO: 288700 - DNA, 25 bp, Mus musculus
gacagagaacggggagttggctagg

SEQ ID NO: 288701 - DNA, 25 bp, Mus musculus
gacagagaatggggagctgtcccgg

SEQ ID NO: 288702 - DNA, 25 bp, Mus musculus
gacagagacaccagcttgggggccc

SEQ ID NO: 288703 - DNA, 25 bp, Mus musculus
gacagagactggggctgcaggatga

SEQ ID NO: 288704 - DNA, 25 bp, Mus musculus
gacagagaggaggagacacggtctc

SEQ ID NO: 288705 - DNA, 25 bp, Mus musculus
gacagagaggcgtcccagccaagcg

SEQ ID NO: 288706 - DNA, 25 bp, Mus musculus
gacagagatccaaggacaccacttc

SEQ ID NO: 288707 - DNA, 25 bp, Mus musculus
gacagagatccaaggttgaccacaa

SEQ ID NO: 288708 - DNA, 25 bp, Mus musculus
gacagagatcggtaccgttgctcca

SEQ ID NO: 288709 - DNA, 25 bp, Mus musculus
gacagagcaaggtcctgtttattgc

SEQ ID NO: 288710 - DNA, 25 bp, Mus musculus
gacagagcagaatttgatactagcg

SEQ ID NO: 288711 - DNA, 25 bp, Mus musculus
gacagagcagacgatttacatggat

SEQ ID NO: 288712 - DNA, 25 bp, Mus musculus
gacagagcaggggtgctcttctctc

SEQ ID NO: 288713 - DNA, 25 bp, Mus musculus
gacagagcaggtggctgtaggatgg

SEQ ID NO: 288714 - DNA, 25 bp, Mus musculus
gacagagcaggtgttttagaaacaa

SEQ ID NO: 288715 - DNA, 25 bp, Mus musculus
gacagagcatcccagaggaattcaa

SEQ ID NO: 288716 - DNA, 25 bp, Mus musculus
gacagagccagctgcgcaaaccatg

SEQ ID NO: 288717 - DNA, 25 bp, Mus musculus
gacagagccatggggaagctctttg

SEQ ID NO: 288718 - DNA, 25 bp, Mus musculus
gacagagcccaggagcacctcaact

SEQ ID NO: 288719 - DNA, 25 bp, Mus musculus
gacagagcccaggtctgctgccttg

SEQ ID NO: 288720 - DNA, 25 bp, Mus musculus
gacagagcctgtgagaaaactaact

SEQ ID NO: 288721 - DNA, 25 bp, Mus musculus
gacagagcctgtgagcttcaaactg

SEQ ID NO: 288722 - DNA, 25 bp, Mus musculus
gacagagcgaagacgggagcgggag

SEQ ID NO: 288723 - DNA, 25 bp, Mus musculus
gacagagcgaggtgtggacagttct

SEQ ID NO: 288724 - DNA, 25 bp, Mus musculus
gacagagctcgggaggtacagtggt

SEQ ID NO: 288725 - DNA, 25 bp, Mus musculus
gacagagctcgggaggttcccgtga

SEQ ID NO: 288726 - DNA, 25 bp, Mus musculus
gacagagctgaagagccagatgaag

SEQ ID NO: 288727 - DNA, 25 bp, Mus musculus
gacagaggaatggagaacatcccaa

SEQ ID NO: 288728 - DNA, 25 bp, Mus musculus
gacagaggaatggaggtggacattg

SEQ ID NO: 288729 - DNA, 25 bp, Mus musculus
gacagaggagaggctggtgcacaag

SEQ ID NO: 288730 - DNA, 25 bp, Mus musculus
gacagaggagcctcgagcatttagc

SEQ ID NO: 288731 - DNA, 25 bp, Mus musculus
gacagaggaggagatacttctgaca

SEQ ID NO: 288732 - DNA, 25 bp, Mus musculus
gacagaggaggagggaaaaagagag

SEQ ID NO: 288733 - DNA, 25 bp, Mus musculus
gacagaggaggtggtcctggggggc

SEQ ID NO: 288734 - DNA, 25 bp, Mus musculus
gacagaggggccggggcctgtgcag

SEQ ID NO: 288735 - DNA, 25 bp, Mus musculus
gacagagggggaggaagaaattgtc

SEQ ID NO: 288736 - DNA, 25 bp, Mus musculus
gacagagggtcagagagatggcaca

SEQ ID NO: 288737 - DNA, 25 bp, Mus musculus
gacagagggtcagttccaggaagac

SEQ ID NO: 288738 - DNA, 25 bp, Mus musculus
gacagagtgactgtatacgacattt

SEQ ID NO: 288739 - DNA, 25 bp, Mus musculus
gacagagtgtgtggaggagtgatgg

SEQ ID NO: 288740 - DNA, 25 bp, Mus musculus
gacagagtttagggaggagcaaaaa

SEQ ID NO: 288741 - DNA, 25 bp, Mus musculus
gacagataagcagcgtgcttccggc

SEQ ID NO: 288742 - DNA, 25 bp, Mus musculus
gacagataccagaccttcctgcgag

SEQ ID NO: 288743 - DNA, 25 bp, Mus musculus
gacagatacgaagaggaatcttttg

SEQ ID NO: 288744 - DNA, 25 bp, Mus musculus
gacagatacttctgtgagtgcaaag

SEQ ID NO: 288745 - DNA, 25 bp, Mus musculus
gacagatatagactcttcaagaaat

SEQ ID NO: 288746 - DNA, 25 bp, Mus musculus
gacagatatcctcagtgtttgtgcc

SEQ ID NO: 288747 - DNA, 25 bp, Mus musculus
gacagatattcagcaagccccgccc

SEQ ID NO: 288748 - DNA, 25 bp, Mus musculus
gacagatcaagaacctgctgggatt

SEQ ID NO: 288749 - DNA, 25 bp, Mus musculus
gacagatcaagcgtctcagaataac

SEQ ID NO: 288750 - DNA, 25 bp, Mus musculus
gacagatcagaagcacaattatatg

SEQ ID NO: 288751 - DNA, 25 bp, Mus musculus
gacagatcagaaggcttatggtagc

SEQ ID NO: 288752 - DNA, 25 bp, Mus musculus
gacagatctctgtggcaaggattaa

SEQ ID NO: 288753 - DNA, 25 bp, Mus musculus
gacagatctctgtgtggagctggcc

SEQ ID NO: 288754 - DNA, 25 bp, Mus musculus
gacagatctgcagggcgacactccc

SEQ ID NO: 288755 - DNA, 25 bp, Mus musculus
gacagatgatatgctggacaaattt

SEQ ID NO: 288756 - DNA, 25 bp, Mus musculus
gacagatgatcaggagttagtgagc

SEQ ID NO: 288757 - DNA, 25 bp, Mus musculus
gacagatgcaaagccgccatggata

SEQ ID NO: 288758 - DNA, 25 bp, Mus musculus
gacagatgcagacaggcttcgccgg

SEQ ID NO: 288759 - DNA, 25 bp, Mus musculus
gacagatgcagacagtgtggcatca

SEQ ID NO: 288760 - DNA, 25 bp, Mus musculus
gacagatgccccaacaagggagaag

SEQ ID NO: 288761 - DNA, 25 bp, Mus musculus
gacagatgtcatgctgtgtgcagga

SEQ ID NO: 288762 - DNA, 25 bp, Mus musculus
gacagatgttcatgataggagacaa

SEQ ID NO: 288763 - DNA, 25 bp, Mus musculus
gacagatgttcatgggactttcagt

SEQ ID NO: 288764 - DNA, 25 bp, Mus musculus
gacagatgttctgcgccccactcac

SEQ ID NO: 288765 - DNA, 25 bp, Mus musculus
gacagatgttctggccaacctctcc

SEQ ID NO: 288766 - DNA, 25 bp, Mus musculus
gacagattaaacaagccgctgcgcc

SEQ ID NO: 288767 - DNA, 25 bp, Mus musculus
gacagattaaacaaggctggagcca

SEQ ID NO: 288768 - DNA, 25 bp, Mus musculus
gacagattgagcagctctatgccgc

SEQ ID NO: 288769 - DNA, 25 bp, Mus musculus
gacagattgctctgccatcacctgt

SEQ ID NO: 288770 - DNA, 25 bp, Mus musculus
gacagattggatctggccgccccgg

SEQ ID NO: 288771 - DNA, 25 bp, Mus musculus
gacagatttaagagtttgtttctaa

SEQ ID NO: 288772 - DNA, 25 bp, Mus musculus
gacagatttaagcttccttccactg

SEQ ID NO: 288773 - DNA, 25 bp, Mus musculus
gacagcaaacgaggcctaagtcacc

SEQ ID NO: 288774 - DNA, 25 bp, Mus musculus
gacagcaaagaaaggcctcctggaa

SEQ ID NO: 288775 - DNA, 25 bp, Mus musculus
gacagcaaagcgcaggctatgaagt

SEQ ID NO: 288776 - DNA, 25 bp, Mus musculus
gacagcaaaggcacccggattctgg

SEQ ID NO: 288777 - DNA, 25 bp, Mus musculus
gacagcaaaggccgggtaggaccga

SEQ ID NO: 288778 - DNA, 25 bp, Mus musculus
gacagcaaaggttctggccgagaag

SEQ ID NO: 288779 - DNA, 25 bp, Mus musculus
gacagcaaagtacaggtgttgctgg

SEQ ID NO: 288780 - DNA, 25 bp, Mus musculus
gacagcaaattcaactacagtggga

SEQ ID NO: 288781 - DNA, 25 bp, Mus musculus
gacagcaacaactgtcccaggtctt

SEQ ID NO: 288782 - DNA, 25 bp, Mus musculus
gacagcaacaagcttgtagaggagt

SEQ ID NO: 288783 - DNA, 25 bp, Mus musculus
gacagcaacagttagagatggtgag

SEQ ID NO: 288784 - DNA, 25 bp, Mus musculus
gacagcaacatgaaatgtgtctaaa

SEQ ID NO: 288785 - DNA, 25 bp, Mus musculus
gacagcaacgcagtacttcatcctc

SEQ ID NO: 288786 - DNA, 25 bp, Mus musculus
gacagcaatgtgtgggttgaattta

SEQ ID NO: 288787 - DNA, 25 bp, Mus musculus
gacagcacactagaaaccccatttc

SEQ ID NO: 288788 - DNA, 25 bp, Mus musculus
gacagcacagaccggaagaaagact

SEQ ID NO: 288789 - DNA, 25 bp, Mus musculus
gacagcacccctttgagcccgctgt

SEQ ID NO: 288790 - DNA, 25 bp, Mus musculus
gacagcacccctttgtactatgcct

SEQ ID NO: 288791 - DNA, 25 bp, Mus musculus
gacagcagacactcatcagcctgaa

SEQ ID NO: 288792 - DNA, 25 bp, Mus musculus
gacagcagacagaagtgggagcaga

SEQ ID NO: 288793 - DNA, 25 bp, Mus musculus
gacagcagagaaacatggcttagtt

SEQ ID NO: 288794 - DNA, 25 bp, Mus musculus
gacagcagagagagggagttgagga

SEQ ID NO: 288795 - DNA, 25 bp, Mus musculus
gacagcagagagagttggatgaaaa

SEQ ID NO: 288796 - DNA, 25 bp, Mus musculus
gacagcagagcaggtgaagagaagg

SEQ ID NO: 288797 - DNA, 25 bp, Mus musculus
gacagcagatgctggacatccaggc

SEQ ID NO: 288798 - DNA, 25 bp, Mus musculus
gacagcagcacctggctgactgcct

SEQ ID NO: 288799 - DNA, 25 bp, Mus musculus
gacagcagcgcccggacgtcctccc

SEQ ID NO: 288800 - DNA, 25 bp, Mus musculus
gacagcagctcccaggaggttcatg

SEQ ID NO: 288801 - DNA, 25 bp, Mus musculus
gacagcagctgtaaggagcttcacc

SEQ ID NO: 288802 - DNA, 25 bp, Mus musculus
gacagcaggaacgattcaatcccaa

SEQ ID NO: 288803 - DNA, 25 bp, Mus musculus
gacagcaggaacgtatatgactgct

SEQ ID NO: 288804 - DNA, 25 bp, Mus musculus
gacagcaggaagacaggaagatctg

SEQ ID NO: 288805 - DNA, 25 bp, Mus musculus
gacagcaggaaggaaagaaaggaga

SEQ ID NO: 288806 - DNA, 25 bp, Mus musculus
gacagcaggaaggaggatgctgtcc

SEQ ID NO: 288807 - DNA, 25 bp, Mus musculus
gacagcagggagcaggatatggtta

SEQ ID NO: 288808 - DNA, 25 bp, Mus musculus
gacagcagtcccagcgcttcccgag

SEQ ID NO: 288809 - DNA, 25 bp, Mus musculus
gacagcagtgggaccaggatggaaa

SEQ ID NO: 288810 - DNA, 25 bp, Mus musculus
gacagcagtgtaaagatattgatga

SEQ ID NO: 288811 - DNA, 25 bp, Mus musculus
gacagcataggtccctcactctccc

SEQ ID NO: 288812 - DNA, 25 bp, Mus musculus
gacagcatcaaaatgccaggcaggc

SEQ ID NO: 288813 - DNA, 25 bp, Mus musculus
gacagcatcaaggacaattcaagct

SEQ ID NO: 288814 - DNA, 25 bp, Mus musculus
gacagcatcaaggcctgggaggagt

SEQ ID NO: 288815 - DNA, 25 bp, Mus musculus
gacagcatcaggattgctgaaagac

SEQ ID NO: 288816 - DNA, 25 bp, Mus musculus
gacagcattaacaggagaagggaag

SEQ ID NO: 288817 - DNA, 25 bp, Mus musculus
gacagcattcttaatttaccgagag

SEQ ID NO: 288818 - DNA, 25 bp, Mus musculus
gacagcattgtgagagctgtggaac

SEQ ID NO: 288819 - DNA, 25 bp, Mus musculus
gacagcattgtgagagtgaaaagct

SEQ ID NO: 288820 - DNA, 25 bp, Mus musculus
gacagccaagggatttgaattaatc

SEQ ID NO: 288821 - DNA, 25 bp, Mus musculus
gacagccagaagaattggctggacc

SEQ ID NO: 288822 - DNA, 25 bp, Mus musculus
gacagccagaaggtagcccctggaa

SEQ ID NO: 288823 - DNA, 25 bp, Mus musculus
gacagccagaggaacagatggagtc

SEQ ID NO: 288824 - DNA, 25 bp, Mus musculus
gacagccagatgaatagagaagaag

SEQ ID NO: 288825 - DNA, 25 bp, Mus musculus
gacagccagcaccagcactgccccc

SEQ ID NO: 288826 - DNA, 25 bp, Mus musculus
gacagccagctgttgaggaccctgt

SEQ ID NO: 288827 - DNA, 25 bp, Mus musculus
gacagccagggtctctggaactcga

SEQ ID NO: 288828 - DNA, 25 bp, Mus musculus
gacagccagggtgagtccagtgacc

SEQ ID NO: 288829 - DNA, 25 bp, Mus musculus
gacagccagtgagccatgaggctgg

SEQ ID NO: 288830 - DNA, 25 bp, Mus musculus
gacagccagtggaggtccaggttcc

SEQ ID NO: 288831 - DNA, 25 bp, Mus musculus
gacagccatgatcaactgggaccag

SEQ ID NO: 288832 - DNA, 25 bp, Mus musculus
gacagccatgatcctacagatcaac

SEQ ID NO: 288833 - DNA, 25 bp, Mus musculus
gacagccatgctgagcttcttgatg

SEQ ID NO: 288834 - DNA, 25 bp, Mus musculus
gacagcccaaaggatgactcaaagc

SEQ ID NO: 288835 - DNA, 25 bp, Mus musculus
gacagcccaagcgaaccccagctga

SEQ ID NO: 288836 - DNA, 25 bp, Mus musculus
gacagcccatctgctgctcctgcaa

SEQ ID NO: 288837 - DNA, 25 bp, Mus musculus
gacagcccgaaagaccacaactcga

SEQ ID NO: 288838 - DNA, 25 bp, Mus musculus
gacagccctgcgggataagaagtat

SEQ ID NO: 288839 - DNA, 25 bp, Mus musculus
gacagccctgtgtggggctgccttc

SEQ ID NO: 288840 - DNA, 25 bp, Mus musculus
gacagccgtgtagtttccatttatt

SEQ ID NO: 288841 - DNA, 25 bp, Mus musculus
gacagcctacggtggatcatgggct

SEQ ID NO: 288842 - DNA, 25 bp, Mus musculus
gacagcctcccactggttatagcac

SEQ ID NO: 288843 - DNA, 25 bp, Mus musculus
gacagcctcccactgtagaagggac

SEQ ID NO: 288844 - DNA, 25 bp, Mus musculus
gacagcctctctggtacatggcttc

SEQ ID NO: 288845 - DNA, 25 bp, Mus musculus
gacagcctgatgaaaatgcctttga

SEQ ID NO: 288846 - DNA, 25 bp, Mus musculus
gacagcctgatgaaagcatctgtgg

SEQ ID NO: 288847 - DNA, 25 bp, Mus musculus
gacagcctgcagccagccaggaccc

SEQ ID NO: 288848 - DNA, 25 bp, Mus musculus
gacagcctgcaggatgctttgctga

SEQ ID NO: 288849 - DNA, 25 bp, Mus musculus
gacagccttaccctgattaacctgg

SEQ ID NO: 288850 - DNA, 25 bp, Mus musculus
gacagccttcaggagcgggcctgtg

SEQ ID NO: 288851 - DNA, 25 bp, Mus musculus
gacagccttcaggaggtatgctgct

SEQ ID NO: 288852 - DNA, 25 bp, Mus musculus
gacagcgaagggctcacaactcagt

SEQ ID NO: 288853 - DNA, 25 bp, Mus musculus
gacagcgcccgcgcgggtcgcccaa

SEQ ID NO: 288854 - DNA, 25 bp, Mus musculus
gacagcggcaaaatagtgtttctag

SEQ ID NO: 288855 - DNA, 25 bp, Mus musculus
gacagcggcagacactctgggttca

SEQ ID NO: 288856 - DNA, 25 bp, Mus musculus
gacagcgggcgggattcccgaagcc

SEQ ID NO: 288857 - DNA, 25 bp, Mus musculus
gacagcgtgaatgggggcaatggca

SEQ ID NO: 288858 - DNA, 25 bp, Mus musculus
gacagctaaactcagcccaaggctt

SEQ ID NO: 288859 - DNA, 25 bp, Mus musculus
gacagctatcccaggaccgggactt

SEQ ID NO: 288860 - DNA, 25 bp, Mus musculus
gacagctatcccaggcccctctgcc

SEQ ID NO: 288861 - DNA, 25 bp, Mus musculus
gacagctatgtccccagtgacctga

SEQ ID NO: 288862 - DNA, 25 bp, Mus musculus
gacagctccagtttttcagccgtgc

SEQ ID NO: 288863 - DNA, 25 bp, Mus musculus
gacagctccagtttttcaggaatct

SEQ ID NO: 288864 - DNA, 25 bp, Mus musculus
gacagctcctggctgttggagacag

SEQ ID NO: 288865 - DNA, 25 bp, Mus musculus
gacagctctctatgatcttaccaat

SEQ ID NO: 288866 - DNA, 25 bp, Mus musculus
gacagctctgcaagagaagctgatg

SEQ ID NO: 288867 - DNA, 25 bp, Mus musculus
gacagctctgcaagtacggttagaa

SEQ ID NO: 288868 - DNA, 25 bp, Mus musculus
gacagctctgcctatttgatcaaga

SEQ ID NO: 288869 - DNA, 25 bp, Mus musculus
gacagctcttgctgtttccaaattc

SEQ ID NO: 288870 - DNA, 25 bp, Mus musculus
gacagctgatggttccagcatcttg

SEQ ID NO: 288871 - DNA, 25 bp, Mus musculus
gacagctgcagtgcttacagacaca

SEQ ID NO: 288872 - DNA, 25 bp, Mus musculus
gacagctggaagaggacaagctggg

SEQ ID NO: 288873 - DNA, 25 bp, Mus musculus
gacagctggaagaggactagtgtct

SEQ ID NO: 288874 - DNA, 25 bp, Mus musculus
gacagctggaagagtaccgttcccc

SEQ ID NO: 288875 - DNA, 25 bp, Mus musculus
gacagctggcagaactcaacaaaaa

SEQ ID NO: 288876 - DNA, 25 bp, Mus musculus
gacagcttccaggcatgctcagggt

SEQ ID NO: 288877 - DNA, 25 bp, Mus musculus
gacagcttctgggaggttgggaact

SEQ ID NO: 288878 - DNA, 25 bp, Mus musculus
gacaggaaagaagaagacctgtctg

SEQ ID NO: 288879 - DNA, 25 bp, Mus musculus
gacaggaaagaaggtggtggaagat

SEQ ID NO: 288880 - DNA, 25 bp, Mus musculus
gacaggaaagattgttttctgctct

SEQ ID NO: 288881 - DNA, 25 bp, Mus musculus
gacaggaaagcccatgttaccagaa

SEQ ID NO: 288882 - DNA, 25 bp, Mus musculus
gacaggaaagggcactgtggagtca

SEQ ID NO: 288883 - DNA, 25 bp, Mus musculus
gacaggaaaggtgtactcgggcatc

SEQ ID NO: 288884 - DNA, 25 bp, Mus musculus
gacaggaaatgcttgcccctaagcg

SEQ ID NO: 288885 - DNA, 25 bp, Mus musculus
gacaggaaatggctctctgctacca

SEQ ID NO: 288886 - DNA, 25 bp, Mus musculus
gacaggaacaaacattcaggccaaa

SEQ ID NO: 288887 - DNA, 25 bp, Mus musculus
gacaggaacgaccgtgctatgtttc

SEQ ID NO: 288888 - DNA, 25 bp, Mus musculus
gacaggaactgaggctccggagggt

SEQ ID NO: 288889 - DNA, 25 bp, Mus musculus
gacaggaagaggacgccctacctgg

SEQ ID NO: 288890 - DNA, 25 bp, Mus musculus
gacaggaatacgagaaagccctgca

SEQ ID NO: 288891 - DNA, 25 bp, Mus musculus
gacaggaattgtttgttccttacat

SEQ ID NO: 288892 - DNA, 25 bp, Mus musculus
gacaggaccagcaatggcaagccgg

SEQ ID NO: 288893 - DNA, 25 bp, Mus musculus
gacaggaccattaaagtgtggagca

SEQ ID NO: 288894 - DNA, 25 bp, Mus musculus
gacaggacccccgaggtgattcatg

SEQ ID NO: 288895 - DNA, 25 bp, Mus musculus
gacaggacccccgagtgtccaggtt

SEQ ID NO: 288896 - DNA, 25 bp, Mus musculus
gacaggactaagagggtgtttcttg

SEQ ID NO: 288897 - DNA, 25 bp, Mus musculus
gacaggactaaggggaagactgtca

SEQ ID NO: 288898 - DNA, 25 bp, Mus musculus
gacaggactacacagcatcctgcct

SEQ ID NO: 288899 - DNA, 25 bp, Mus musculus
gacaggactagagaaagtgtgcaat

SEQ ID NO: 288900 - DNA, 25 bp, Mus musculus
gacaggagactctaaagttgcagca

SEQ ID NO: 288901 - DNA, 25 bp, Mus musculus
gacaggagactctgtcttcctgtgt

SEQ ID NO: 288902 - DNA, 25 bp, Mus musculus
gacaggagagatgagacaccaatta

SEQ ID NO: 288903 - DNA, 25 bp, Mus musculus
gacaggagaggatgggagccaggag

SEQ ID NO: 288904 - DNA, 25 bp, Mus musculus
gacaggaggggaagaaaatggagac

SEQ ID NO: 288905 - DNA, 25 bp, Mus musculus
gacaggagttcgggactctgctgac

SEQ ID NO: 288906 - DNA, 25 bp, Mus musculus
gacaggatgtgtgaagatctgtggc

SEQ ID NO: 288907 - DNA, 25 bp, Mus musculus
gacaggatttctaagcattccatat

SEQ ID NO: 288908 - DNA, 25 bp, Mus musculus
gacaggatttctaaggcttcagaag

SEQ ID NO: 288909 - DNA, 25 bp, Mus musculus
gacaggcaaaagcagattttatcat

SEQ ID NO: 288910 - DNA, 25 bp, Mus musculus
gacaggcaagaaccggagacaatca

SEQ ID NO: 288911 - DNA, 25 bp, Mus musculus
gacaggcaagaaccgttctcaagaa

SEQ ID NO: 288912 - DNA, 25 bp, Mus musculus
gacaggcacagctactatgtgtgta

SEQ ID NO: 288913 - DNA, 25 bp, Mus musculus
gacaggcacaggtcgaggtggcgca

SEQ ID NO: 288914 - DNA, 25 bp, Mus musculus
gacaggcacgagctgcaggtcctgg

SEQ ID NO: 288915 - DNA, 25 bp, Mus musculus
gacaggcagaggcacggtagatgga

SEQ ID NO: 288916 - DNA, 25 bp, Mus musculus
gacaggcaggctaggttcctccggt

SEQ ID NO: 288917 - DNA, 25 bp, Mus musculus
gacaggcatcacatgaccagtggct

SEQ ID NO: 288918 - DNA, 25 bp, Mus musculus
gacaggcatccaagagcaactggtg

SEQ ID NO: 288919 - DNA, 25 bp, Mus musculus
gacaggcatccaagcaagcgaagat

SEQ ID NO: 288920 - DNA, 25 bp, Mus musculus
gacaggcatcctggtcatttgaaga

SEQ ID NO: 288921 - DNA, 25 bp, Mus musculus
gacaggcatgagtaaagacatttcc

SEQ ID NO: 288922 - DNA, 25 bp, Mus musculus
gacaggccaaagcttcctgaaagag

SEQ ID NO: 288923 - DNA, 25 bp, Mus musculus
gacaggccaggagggctcgctcgaa

SEQ ID NO: 288924 - DNA, 25 bp, Mus musculus
gacaggccattggtggctatggccc

SEQ ID NO: 288925 - DNA, 25 bp, Mus musculus
gacaggcctaagtgtccaccatcac

SEQ ID NO: 288926 - DNA, 25 bp, Mus musculus
gacaggcctagtgccaaaccagagg

SEQ ID NO: 288927 - DNA, 25 bp, Mus musculus
gacaggcctccgaatcacatgggtg

SEQ ID NO: 288928 - DNA, 25 bp, Mus musculus
gacaggccttccagggctgaccagt

SEQ ID NO: 288929 - DNA, 25 bp, Mus musculus
gacaggccttgccagagccatgcag

SEQ ID NO: 288930 - DNA, 25 bp, Mus musculus
gacaggctacttctgcgacagtgac

SEQ ID NO: 288931 - DNA, 25 bp, Mus musculus
gacaggctacttcttctggatctct

SEQ ID NO: 288932 - DNA, 25 bp, Mus musculus
gacaggctatgaggtacatccctga

SEQ ID NO: 288933 - DNA, 25 bp, Mus musculus
gacaggctgtgaaagctgtccagca

SEQ ID NO: 288934 - DNA, 25 bp, Mus musculus
gacaggcttcaagagtggtcttgtc

SEQ ID NO: 288935 - DNA, 25 bp, Mus musculus
gacaggcttcacttcatcttcatgg

SEQ ID NO: 288936 - DNA, 25 bp, Mus musculus
gacagggaacggcaggccgatctgt

SEQ ID NO: 288937 - DNA, 25 bp, Mus musculus
gacagggaagtaggctgaaccttcg

SEQ ID NO: 288938 - DNA, 25 bp, Mus musculus
gacagggatgagtgggatgtaccat

SEQ ID NO: 288939 - DNA, 25 bp, Mus musculus
gacagggccttcaagaaaattacaa

SEQ ID NO: 288940 - DNA, 25 bp, Mus musculus
gacagggccttgaggacctgctctc

SEQ ID NO: 288941 - DNA, 25 bp, Mus musculus
gacaggggcacaaggcattgccaca

SEQ ID NO: 288942 - DNA, 25 bp, Mus musculus
gacaggggcacaatctgcagctcag

SEQ ID NO: 288943 - DNA, 25 bp, Mus musculus
gacaggggctgcctgcctacagact

SEQ ID NO: 288944 - DNA, 25 bp, Mus musculus
gacagggtaaagaaggaatgggaag

SEQ ID NO: 288945 - DNA, 25 bp, Mus musculus
gacagggtcagctggtcacttgctc

SEQ ID NO: 288946 - DNA, 25 bp, Mus musculus
gacagggtgcccagtgctaggagac

SEQ ID NO: 288947 - DNA, 25 bp, Mus musculus
gacagggtgctggttggtggcacta

SEQ ID NO: 288948 - DNA, 25 bp, Mus musculus
gacagggtgtggtgggccgagccgc

SEQ ID NO: 288949 - DNA, 25 bp, Mus musculus
gacaggtaacagtgtcagctgactc

SEQ ID NO: 288950 - DNA, 25 bp, Mus musculus
gacaggtaacagtttcggccgagtc

SEQ ID NO: 288951 - DNA, 25 bp, Mus musculus
gacaggtaggcaaaggtggaggaag

SEQ ID NO: 288952 - DNA, 25 bp, Mus musculus
gacaggtctaaaaggcttggtggct

SEQ ID NO: 288953 - DNA, 25 bp, Mus musculus
gacaggtctatgctgaggggtggtc

SEQ ID NO: 288954 - DNA, 25 bp, Mus musculus
gacaggtggacccaggtttgccgaa

SEQ ID NO: 288955 - DNA, 25 bp, Mus musculus
gacaggtggctctctgatgcaagct

SEQ ID NO: 288956 - DNA, 25 bp, Mus musculus
gacaggtttaggaatcactgggcca

SEQ ID NO: 288957 - DNA, 25 bp, Mus musculus
gacagtaaaggaggcagcccgcgcc

SEQ ID NO: 288958 - DNA, 25 bp, Mus musculus
gacagtaagtacagttgatacacta

SEQ ID NO: 288959 - DNA, 25 bp, Mus musculus
gacagtacagaaccaacgaaacgta

SEQ ID NO: 288960 - DNA, 25 bp, Mus musculus
gacagtacagaggctttttcagggc

SEQ ID NO: 288961 - DNA, 25 bp, Mus musculus
gacagtacagaggtctatggccagc

SEQ ID NO: 288962 - DNA, 25 bp, Mus musculus
gacagtacagggttagctgagttgg

SEQ ID NO: 288963 - DNA, 25 bp, Mus musculus
gacagtacctggaggagctgcagtc

SEQ ID NO: 288964 - DNA, 25 bp, Mus musculus
gacagtagaggctccgcaggaggct

SEQ ID NO: 288965 - DNA, 25 bp, Mus musculus
gacagtagcttagcatggtttattg

SEQ ID NO: 288966 - DNA, 25 bp, Mus musculus
gacagtagggaagttgccacccaag

SEQ ID NO: 288967 - DNA, 25 bp, Mus musculus
gacagtagggcagcaccagcgaatg

SEQ ID NO: 288968 - DNA, 25 bp, Mus musculus
gacagtatcgaggagaaagaaaaga

SEQ ID NO: 288969 - DNA, 25 bp, Mus musculus
gacagtattctacagcccaggagtg

SEQ ID NO: 288970 - DNA, 25 bp, Mus musculus
gacagtattctacagctcaagactg

SEQ ID NO: 288971 - DNA, 25 bp, Mus musculus
gacagtattctacagctgaggaatg

SEQ ID NO: 288972 - DNA, 25 bp, Mus musculus
gacagtattgaggagaaacgaaacc

SEQ ID NO: 288973 - DNA, 25 bp, Mus musculus
gacagtcaaagaacactggtgaaga

SEQ ID NO: 288974 - DNA, 25 bp, Mus musculus
gacagtcaatcagaatcagatagta

SEQ ID NO: 288975 - DNA, 25 bp, Mus musculus
gacagtcaatcaggtacatccaaac

SEQ ID NO: 288976 - DNA, 25 bp, Mus musculus
gacagtcactcggaggcttactgct

SEQ ID NO: 288977 - DNA, 25 bp, Mus musculus
gacagtcatggtggaccagcacaca

SEQ ID NO: 288978 - DNA, 25 bp, Mus musculus
gacagtccagagcgcctccccatct

SEQ ID NO: 288979 - DNA, 25 bp, Mus musculus
gacagtccagcgagtgtgctagagg

SEQ ID NO: 288980 - DNA, 25 bp, Mus musculus
gacagtcctgcagatcgtcctgctt

SEQ ID NO: 288981 - DNA, 25 bp, Mus musculus
gacagtcggaccagatggtgacttg

SEQ ID NO: 288982 - DNA, 25 bp, Mus musculus
gacagtctgacacagcaattaccaa

SEQ ID NO: 288983 - DNA, 25 bp, Mus musculus
gacagtctgaggaagcctaacctga

SEQ ID NO: 288984 - DNA, 25 bp, Mus musculus
gacagtctgaggtgtcttcagaagc

SEQ ID NO: 288985 - DNA, 25 bp, Mus musculus
gacagtctgcagcatgtgtgaactg

SEQ ID NO: 288986 - DNA, 25 bp, Mus musculus
gacagtcttcggacatagactgact

SEQ ID NO: 288987 - DNA, 25 bp, Mus musculus
gacagtgaagatccagccataaaaa

SEQ ID NO: 288988 - DNA, 25 bp, Mus musculus
gacagtgaagatggagctggaggag

SEQ ID NO: 288989 - DNA, 25 bp, Mus musculus
gacagtgaaggtatgctgcaagacc

SEQ ID NO: 288990 - DNA, 25 bp, Mus musculus
gacagtgaaggtgacccttgtactg

SEQ ID NO: 288991 - DNA, 25 bp, Mus musculus
gacagtgaagtgtaacaactaaatt

SEQ ID NO: 288992 - DNA, 25 bp, Mus musculus
gacagtgacagcatcacggctgcgg

SEQ ID NO: 288993 - DNA, 25 bp, Mus musculus
gacagtgacccagttgacatccgac

SEQ ID NO: 288994 - DNA, 25 bp, Mus musculus
gacagtgacccggctaagcatgggg

SEQ ID NO: 288995 - DNA, 25 bp, Mus musculus
gacagtgacccggtgaagacttttg

SEQ ID NO: 288996 - DNA, 25 bp, Mus musculus
gacagtgacggccctggagatggaa

SEQ ID NO: 288997 - DNA, 25 bp, Mus musculus
gacagtgagaacacaaacctccaat

SEQ ID NO: 288998 - DNA, 25 bp, Mus musculus
gacagtgagagcgagcaaccttcaa

SEQ ID NO: 288999 - DNA, 25 bp, Mus musculus
gacagtgagcgggggctgagtgtca

SEQ ID NO: 289000 - DNA, 25 bp, Mus musculus
gacagtgatactagtcgacaattag

SEQ ID NO: 289001 - DNA, 25 bp, Mus musculus
gacagtgatactagtttaaaagccg

SEQ ID NO: 289002 - DNA, 25 bp, Mus musculus
gacagtgatggacaggtttttggtg

SEQ ID NO: 289003 - DNA, 25 bp, Mus musculus
gacagtgcagggtcaccatcatgat

SEQ ID NO: 289004 - DNA, 25 bp, Mus musculus
gacagtgccaacatttaaacgagtg

SEQ ID NO: 289005 - DNA, 25 bp, Mus musculus
gacagtgccaacctggagaaggcgc

SEQ ID NO: 289006 - DNA, 25 bp, Mus musculus
gacagtgccaacctgtgtgtcaacc

SEQ ID NO: 289007 - DNA, 25 bp, Mus musculus
gacagtgccaacctttctacgtctt

SEQ ID NO: 289008 - DNA, 25 bp, Mus musculus
gacagtgccagctgaggatggttcc

SEQ ID NO: 289009 - DNA, 25 bp, Mus musculus
gacagtgccggtcctgtaagaggaa

SEQ ID NO: 289010 - DNA, 25 bp, Mus musculus
gacagtgccggtgctgtaagaggaa

SEQ ID NO: 289011 - DNA, 25 bp, Mus musculus
gacagtgccttcagagtgatccacc

SEQ ID NO: 289012 - DNA, 25 bp, Mus musculus
gacagtgccttcaggtgccttggag

SEQ ID NO: 289013 - DNA, 25 bp, Mus musculus
gacagtgctctgagaacagtacgga

SEQ ID NO: 289014 - DNA, 25 bp, Mus musculus
gacagtggaaaggttgagttatttg

SEQ ID NO: 289015 - DNA, 25 bp, Mus musculus
gacagtggatccagatctcggacgc

SEQ ID NO: 289016 - DNA, 25 bp, Mus musculus
gacagtgggaccaagaacacggtac

SEQ ID NO: 289017 - DNA, 25 bp, Mus musculus
gacagtgggatggagctcctggtga

SEQ ID NO: 289018 - DNA, 25 bp, Mus musculus
gacagtggtgaacattagcaacaag

SEQ ID NO: 289019 - DNA, 25 bp, Mus musculus
gacagtggtgaagggacacgcctgc

SEQ ID NO: 289020 - DNA, 25 bp, Mus musculus
gacagtggtgaggtgtatggctggg

SEQ ID NO: 289021 - DNA, 25 bp, Mus musculus
gacagtgtcaagttctgtggatcta

SEQ ID NO: 289022 - DNA, 25 bp, Mus musculus
gacagtgtctcggttattcccaatt

SEQ ID NO: 289023 - DNA, 25 bp, Mus musculus
gacagtgtgaccgtaccgacccttg

SEQ ID NO: 289024 - DNA, 25 bp, Mus musculus
gacagtgtggagcggcagtctctgg

SEQ ID NO: 289025 - DNA, 25 bp, Mus musculus
gacagtgtggaggggcagtctctgg

SEQ ID NO: 289026 - DNA, 25 bp, Mus musculus
gacagtgttcaagggtctcttgtgg

SEQ ID NO: 289027 - DNA, 25 bp, Mus musculus
gacagtgtttggattctccagtgac

SEQ ID NO: 289028 - DNA, 25 bp, Mus musculus
gacagtgtttgggcggttcgacaag

SEQ ID NO: 289029 - DNA, 25 bp, Mus musculus
gacagttacggtaaattctacataa

SEQ ID NO: 289030 - DNA, 25 bp, Mus musculus
gacagttacggtatgcttccctgtg

SEQ ID NO: 289031 - DNA, 25 bp, Mus musculus
gacagttcacagggaaccccaatat

SEQ ID NO: 289032 - DNA, 25 bp, Mus musculus
gacagttcagggagggaaggatgcg

SEQ ID NO: 289033 - DNA, 25 bp, Mus musculus
gacagttcatcagaggagaaatggg

SEQ ID NO: 289034 - DNA, 25 bp, Mus musculus
gacagttctgccagcgcctgtgaga

SEQ ID NO: 289035 - DNA, 25 bp, Mus musculus
gacagttgaagggccttcagtgggg

SEQ ID NO: 289036 - DNA, 25 bp, Mus musculus
gacagttgcttagaggctcttgaaa

SEQ ID NO: 289037 - DNA, 25 bp, Mus musculus
gacagttgcttataggctcttgaaa

SEQ ID NO: 289038 - DNA, 25 bp, Mus musculus
gacagtttccatagaaccagtcttc

SEQ ID NO: 289039 - DNA, 25 bp, Mus musculus
gacataatgaaggtttatggaggtg

SEQ ID NO: 289040 - DNA, 25 bp, Mus musculus
gacatacaacatgctgttgtgaact

SEQ ID NO: 289041 - DNA, 25 bp, Mus musculus
gacatacagtatgctcctgaagttt

SEQ ID NO: 289042 - DNA, 25 bp, Mus musculus
gacatacccggttacataggatgac

SEQ ID NO: 289043 - DNA, 25 bp, Mus musculus
gacatactgatagaccctgttgact

SEQ ID NO: 289044 - DNA, 25 bp, Mus musculus
gacatactgccatttgatcacagcc

SEQ ID NO: 289045 - DNA, 25 bp, Mus musculus
gacatactggggtgagcatgccaac

SEQ ID NO: 289046 - DNA, 25 bp, Mus musculus
gacatagaaaggccaccttaggggt

SEQ ID NO: 289047 - DNA, 25 bp, Mus musculus
gacatagaaagggagccacccagcc

SEQ ID NO: 289048 - DNA, 25 bp, Mus musculus
gacatagaagggcttggctgagtag

SEQ ID NO: 289049 - DNA, 25 bp, Mus musculus
gacatagagacctaccttctggaga

SEQ ID NO: 289050 - DNA, 25 bp, Mus musculus
gacatagcctgctgggtccaccata

SEQ ID NO: 289051 - DNA, 25 bp, Mus musculus
gacatagctgcttggaagttggcag

SEQ ID NO: 289052 - DNA, 25 bp, Mus musculus
gacataggaagatcaccagcaaaag

SEQ ID NO: 289053 - DNA, 25 bp, Mus musculus
gacatagtttaggtattgctttcac

SEQ ID NO: 289054 - DNA, 25 bp, Mus musculus
gacatatagagcagtaccaaatatg

SEQ ID NO: 289055 - DNA, 25 bp, Mus musculus
gacatcaacaaggtgtttgagtttg

SEQ ID NO: 289056 - DNA, 25 bp, Mus musculus
gacatcaagaaggcgtaccgaaaga

SEQ ID NO: 289057 - DNA, 25 bp, Mus musculus
gacatcaagaagggagaagaaatgg

SEQ ID NO: 289058 - DNA, 25 bp, Mus musculus
gacatcaagactgccaaggttactt

SEQ ID NO: 289059 - DNA, 25 bp, Mus musculus
gacatcaagagttctaacgtgcttc

SEQ ID NO: 289060 - DNA, 25 bp, Mus musculus
gacatcaatgctttgaatttaaaat

SEQ ID NO: 289061 - DNA, 25 bp, Mus musculus
gacatcaatgctttgttcacagagg

SEQ ID NO: 289062 - DNA, 25 bp, Mus musculus
gacatcacaagagccccatgctaaa

SEQ ID NO: 289063 - DNA, 25 bp, Mus musculus
gacatcacaaggatgatgagggtgg

SEQ ID NO: 289064 - DNA, 25 bp, Mus musculus
gacatcacagatgagctccagtgtg

SEQ ID NO: 289065 - DNA, 25 bp, Mus musculus
gacatcacagcatggtttattgaaa

SEQ ID NO: 289066 - DNA, 25 bp, Mus musculus
gacatcacagctggtgaatgagcaa

SEQ ID NO: 289067 - DNA, 25 bp, Mus musculus
gacatcacagggcacccatgcatca

SEQ ID NO: 289068 - DNA, 25 bp, Mus musculus
gacatcaccctgacctgcaactcct

SEQ ID NO: 289069 - DNA, 25 bp, Mus musculus
gacatcacgggttatatatttgggg

SEQ ID NO: 289070 - DNA, 25 bp, Mus musculus
gacatcactaggaagggtgagtggg

SEQ ID NO: 289071 - DNA, 25 bp, Mus musculus
gacatcactcagctttccactgcca

SEQ ID NO: 289072 - DNA, 25 bp, Mus musculus
gacatcactgtggataaaaatatgc

SEQ ID NO: 289073 - DNA, 25 bp, Mus musculus
gacatcacttggctgtcggcgagcc

SEQ ID NO: 289074 - DNA, 25 bp, Mus musculus
gacatcagaaaattagaccgattca

SEQ ID NO: 289075 - DNA, 25 bp, Mus musculus
gacatcagaagactcaaatggtcat

SEQ ID NO: 289076 - DNA, 25 bp, Mus musculus
gacatcagaagatggtgaggattca

SEQ ID NO: 289077 - DNA, 25 bp, Mus musculus
gacatcagaagttttagagcgaaaa

SEQ ID NO: 289078 - DNA, 25 bp, Mus musculus
gacatcagaggagagcccagaggct

SEQ ID NO: 289079 - DNA, 25 bp, Mus musculus
gacatcagagtaggtttgattggca

SEQ ID NO: 289080 - DNA, 25 bp, Mus musculus
gacatcagcagcccagtggtactgc

SEQ ID NO: 289081 - DNA, 25 bp, Mus musculus
gacatcagcatcgtgtttactccag

SEQ ID NO: 289082 - DNA, 25 bp, Mus musculus
gacatcagccctggttcaggcagct

SEQ ID NO: 289083 - DNA, 25 bp, Mus musculus
gacatcagctctgagtggtgggacg

SEQ ID NO: 289084 - DNA, 25 bp, Mus musculus
gacatcagctctgggcgtcagtgtt

SEQ ID NO: 289085 - DNA, 25 bp, Mus musculus
gacatcagtgagaaagtggacacca

SEQ ID NO: 289086 - DNA, 25 bp, Mus musculus
gacatcatcacagatcttcggaacc

SEQ ID NO: 289087 - DNA, 25 bp, Mus musculus
gacatcatcacagcaatccgccact

SEQ ID NO: 289088 - DNA, 25 bp, Mus musculus
gacatcatcacaggagcgaggcacg

SEQ ID NO: 289089 - DNA, 25 bp, Mus musculus
gacatcatcacagtgctgaagacag

SEQ ID NO: 289090 - DNA, 25 bp, Mus musculus
gacatcatccacgcagtgattgacg

SEQ ID NO: 289091 - DNA, 25 bp, Mus musculus
gacatcatccggcgcctgtctcacg

SEQ ID NO: 289092 - DNA, 25 bp, Mus musculus
gacatcatcgagaccctgaggaaga

SEQ ID NO: 289093 - DNA, 25 bp, Mus musculus
gacatcatcgaggcgctgcacaaga

SEQ ID NO: 289094 - DNA, 25 bp, Mus musculus
gacatcatgagccaggactgctaga

SEQ ID NO: 289095 - DNA, 25 bp, Mus musculus
gacatcatgagccaggtggctgtgg

SEQ ID NO: 289096 - DNA, 25 bp, Mus musculus
gacatcatggaattcgtactgcgtt

SEQ ID NO: 289097 - DNA, 25 bp, Mus musculus
gacatcattcagaaatggcaaaatg

SEQ ID NO: 289098 - DNA, 25 bp, Mus musculus
gacatcattcagaatctgtccgtgt

SEQ ID NO: 289099 - DNA, 25 bp, Mus musculus
gacatcattcagggctgcaaaataa

SEQ ID NO: 289100 - DNA, 25 bp, Mus musculus
gacatcatttcagaagcatgtaatg

SEQ ID NO: 289101 - DNA, 25 bp, Mus musculus
gacatccacaacccagccaccaatg

SEQ ID NO: 289102 - DNA, 25 bp, Mus musculus
gacatccagaatgtggatcggtcat

SEQ ID NO: 289103 - DNA, 25 bp, Mus musculus
gacatccaggacctcatgtggcagg

SEQ ID NO: 289104 - DNA, 25 bp, Mus musculus
gacatccaggccaggtacatctatg

SEQ ID NO: 289105 - DNA, 25 bp, Mus musculus
gacatccatccgcgaggaaatctca

SEQ ID NO: 289106 - DNA, 25 bp, Mus musculus
gacatcccagacaattttggaaatg

SEQ ID NO: 289107 - DNA, 25 bp, Mus musculus
gacatcccagcaaagaaacgatgac

SEQ ID NO: 289108 - DNA, 25 bp, Mus musculus
gacatccccctggttggttttatca

SEQ ID NO: 289109 - DNA, 25 bp, Mus musculus
gacatccctgactaaggctggacca

SEQ ID NO: 289110 - DNA, 25 bp, Mus musculus
gacatccgacttcgccctcagcttt

SEQ ID NO: 289111 - DNA, 25 bp, Mus musculus
gacatccgagagctagcccaccagg

SEQ ID NO: 289112 - DNA, 25 bp, Mus musculus
gacatccgagaggccatcaaaaaca

SEQ ID NO: 289113 - DNA, 25 bp, Mus musculus
gacatccggacagccagcgatgggg

SEQ ID NO: 289114 - DNA, 25 bp, Mus musculus
gacatccggacaggctgacgatgct

SEQ ID NO: 289115 - DNA, 25 bp, Mus musculus
gacatccgtggctccattgtctacc

SEQ ID NO: 289116 - DNA, 25 bp, Mus musculus
gacatccgtgggctagcccatgcca

SEQ ID NO: 289117 - DNA, 25 bp, Mus musculus
gacatcctaagatcaaacaaatatg

SEQ ID NO: 289118 - DNA, 25 bp, Mus musculus
gacatcctaaggtcctcggcccagg

SEQ ID NO: 289119 - DNA, 25 bp, Mus musculus
gacatcctagacaacaacgggacct

SEQ ID NO: 289120 - DNA, 25 bp, Mus musculus
gacatcctcacgcagacagtgtcca

SEQ ID NO: 289121 - DNA, 25 bp, Mus musculus
gacatcctcatgatctcggacctaa

SEQ ID NO: 289122 - DNA, 25 bp, Mus musculus
gacatcctcatgtatgtggtcatcc

SEQ ID NO: 289123 - DNA, 25 bp, Mus musculus
gacatcctccatgagtgaacccaca

SEQ ID NO: 289124 - DNA, 25 bp, Mus musculus
gacatcctcgcccaaggagagctct

SEQ ID NO: 289125 - DNA, 25 bp, Mus musculus
gacatcctgaagaattacctggcaa

SEQ ID NO: 289126 - DNA, 25 bp, Mus musculus
gacatcctgaagtgtcttatctgtc

SEQ ID NO: 289127 - DNA, 25 bp, Mus musculus
gacatcctgatcttaggacagctcc

SEQ ID NO: 289128 - DNA, 25 bp, Mus musculus
gacatcctgttgtacgtggtgatcc

SEQ ID NO: 289129 - DNA, 25 bp, Mus musculus
gacatccttcaggctggtggctggt

SEQ ID NO: 289130 - DNA, 25 bp, Mus musculus
gacatccttggcagcactgcaggtg

SEQ ID NO: 289131 - DNA, 25 bp, Mus musculus
gacatcgaaagtcaggaaactgaag

SEQ ID NO: 289132 - DNA, 25 bp, Mus musculus
gacatcgaagacatgctccagctca

SEQ ID NO: 289133 - DNA, 25 bp, Mus musculus
gacatcgacatcaagatcatcgccc

SEQ ID NO: 289134 - DNA, 25 bp, Mus musculus
gacatcgaccctgagcttgcaagat

SEQ ID NO: 289135 - DNA, 25 bp, Mus musculus
gacatcgagcaggccctttccgatc

SEQ ID NO: 289136 - DNA, 25 bp, Mus musculus
gacatcgagtttgaaattcctatca

SEQ ID NO: 289137 - DNA, 25 bp, Mus musculus
gacatcgatttcgggacctacccct

SEQ ID NO: 289138 - DNA, 25 bp, Mus musculus
gacatcgcccaggttctcggactcc

SEQ ID NO: 289139 - DNA, 25 bp, Mus musculus
gacatcgccccagctccaaggaaac

SEQ ID NO: 289140 - DNA, 25 bp, Mus musculus
gacatcgctgaccctgtctctacag

SEQ ID NO: 289141 - DNA, 25 bp, Mus musculus
gacatcggcagaaagctaaaaagat

SEQ ID NO: 289142 - DNA, 25 bp, Mus musculus
gacatcgggacagcataagcagtac

SEQ ID NO: 289143 - DNA, 25 bp, Mus musculus
gacatcgtcacgagctgaggtcagg

SEQ ID NO: 289144 - DNA, 25 bp, Mus musculus
gacatcgtcgggagcattactgtat

SEQ ID NO: 289145 - DNA, 25 bp, Mus musculus
gacatcgtcggggccagtgactatc

SEQ ID NO: 289146 - DNA, 25 bp, Mus musculus
gacatcgtggccagacttcatgggc

SEQ ID NO: 289147 - DNA, 25 bp, Mus musculus
gacatcgtggctcctgcttcctgac

SEQ ID NO: 289148 - DNA, 25 bp, Mus musculus
gacatctacagctataacccagatc

SEQ ID NO: 289149 - DNA, 25 bp, Mus musculus
gacatctactaaaccgcccagaata

SEQ ID NO: 289150 - DNA, 25 bp, Mus musculus
gacatctatctcggtacggacattg

SEQ ID NO: 289151 - DNA, 25 bp, Mus musculus
gacatctatctcgtttttcaaaaca

SEQ ID NO: 289152 - DNA, 25 bp, Mus musculus
gacatctatgaggaccggcacgatg

SEQ ID NO: 289153 - DNA, 25 bp, Mus musculus
gacatctatgcagtgaatgggattg

SEQ ID NO: 289154 - DNA, 25 bp, Mus musculus
gacatctatgtgattggttaccagg

SEQ ID NO: 289155 - DNA, 25 bp, Mus musculus
gacatctcacaaaaaacatcggacc

SEQ ID NO: 289156 - DNA, 25 bp, Mus musculus
gacatctcagagcctgggacctgga

SEQ ID NO: 289157 - DNA, 25 bp, Mus musculus
gacatctcaggaggctgcggggcca

SEQ ID NO: 289158 - DNA, 25 bp, Mus musculus
gacatctcaggtgtcgttgacattt

SEQ ID NO: 289159 - DNA, 25 bp, Mus musculus
gacatctcatgggtttgtggatgca

SEQ ID NO: 289160 - DNA, 25 bp, Mus musculus
gacatctccaagatgcacatgatcc

SEQ ID NO: 289161 - DNA, 25 bp, Mus musculus
gacatctgaaagctgagccccaggg

SEQ ID NO: 289162 - DNA, 25 bp, Mus musculus
gacatctgcaagtgcacgttggttg

SEQ ID NO: 289163 - DNA, 25 bp, Mus musculus
gacatctgcaggatctgccactgtg

SEQ ID NO: 289164 - DNA, 25 bp, Mus musculus
gacatctgcctcaagaaatttgtca

SEQ ID NO: 289165 - DNA, 25 bp, Mus musculus
gacatctggaagtaacttgaatccc

SEQ ID NO: 289166 - DNA, 25 bp, Mus musculus
gacatctgtagcatatatccggtcg

SEQ ID NO: 289167 - DNA, 25 bp, Mus musculus
gacatctgttttttagcacaatgga

SEQ ID NO: 289168 - DNA, 25 bp, Mus musculus
gacatcttacatgctctgaagatgg

SEQ ID NO: 289169 - DNA, 25 bp, Mus musculus
gacatcttcaccaggtccagctagc

SEQ ID NO: 289170 - DNA, 25 bp, Mus musculus
gacatcttcaccagtctaaatccag

SEQ ID NO: 289171 - DNA, 25 bp, Mus musculus
gacatcttcaggcgctttggccgtg

SEQ ID NO: 289172 - DNA, 25 bp, Mus musculus
gacatcttcctgaggaatgtcacag

SEQ ID NO: 289173 - DNA, 25 bp, Mus musculus
gacatcttcctggacacatcttacc

SEQ ID NO: 289174 - DNA, 25 bp, Mus musculus
gacatcttctgggtattcggcacca

SEQ ID NO: 289175 - DNA, 25 bp, Mus musculus
gacatgaaacagtacctttgaccgg

SEQ ID NO: 289176 - DNA, 25 bp, Mus musculus
gacatgaaagtggccgaggtcctgt

SEQ ID NO: 289177 - DNA, 25 bp, Mus musculus
gacatgaaatggtgccacatcccag

SEQ ID NO: 289178 - DNA, 25 bp, Mus musculus
gacatgaacctcagcattgtgatga

SEQ ID NO: 289179 - DNA, 25 bp, Mus musculus
gacatgaagaaatattatcacaaag

SEQ ID NO: 289180 - DNA, 25 bp, Mus musculus
gacatgaatttggacctcactgagg

SEQ ID NO: 289181 - DNA, 25 bp, Mus musculus
gacatgaccccctgcccggcgtcag

SEQ ID NO: 289182 - DNA, 25 bp, Mus musculus
gacatgacccggtctcaagggagct

SEQ ID NO: 289183 - DNA, 25 bp, Mus musculus
gacatgacctctatagcgtctctac

SEQ ID NO: 289184 - DNA, 25 bp, Mus musculus
gacatgacctctatataaactgaag

SEQ ID NO: 289185 - DNA, 25 bp, Mus musculus
gacatgactgccaagattcatgaat

SEQ ID NO: 289186 - DNA, 25 bp, Mus musculus
gacatgagcaaggtctttgaagtaa

SEQ ID NO: 289187 - DNA, 25 bp, Mus musculus
gacatgagcctgcctttaccccagc

SEQ ID NO: 289188 - DNA, 25 bp, Mus musculus
gacatgaggaacaagattcgagagc

SEQ ID NO: 289189 - DNA, 25 bp, Mus musculus
gacatgagtttaaggttaaatgagc

SEQ ID NO: 289190 - DNA, 25 bp, Mus musculus
gacatgatagacggcttgaagcccc

SEQ ID NO: 289191 - DNA, 25 bp, Mus musculus
gacatgatctccacatcttatcctt

SEQ ID NO: 289192 - DNA, 25 bp, Mus musculus
gacatgcactccaccacgcagctgg

SEQ ID NO: 289193 - DNA, 25 bp, Mus musculus
gacatgcactccgcttacaagcacg

SEQ ID NO: 289194 - DNA, 25 bp, Mus musculus
gacatgcaggcactgcacgagtctg

SEQ ID NO: 289195 - DNA, 25 bp, Mus musculus
gacatgcatttcaggttaatatcct

SEQ ID NO: 289196 - DNA, 25 bp, Mus musculus
gacatgccagcccactggaagccga

SEQ ID NO: 289197 - DNA, 25 bp, Mus musculus
gacatgccagggctgtagcagtggc

SEQ ID NO: 289198 - DNA, 25 bp, Mus musculus
gacatgccaggtcctacatctcctt

SEQ ID NO: 289199 - DNA, 25 bp, Mus musculus
gacatgccccccaggagagtgtgct

SEQ ID NO: 289200 - DNA, 25 bp, Mus musculus
gacatgcctctcttggaattaaagg

SEQ ID NO: 289201 - DNA, 25 bp, Mus musculus
gacatgctcgcagaaaaagcagcga

SEQ ID NO: 289202 - DNA, 25 bp, Mus musculus
gacatgctgtgaatattctagagga

SEQ ID NO: 289203 - DNA, 25 bp, Mus musculus
gacatgctgtgatggacatactaaa

SEQ ID NO: 289204 - DNA, 25 bp, Mus musculus
gacatggaagcaagtgtggaggcaa

SEQ ID NO: 289205 - DNA, 25 bp, Mus musculus
gacatggaagggctgggactgctct

SEQ ID NO: 289206 - DNA, 25 bp, Mus musculus
gacatggacatcctgaactactttg

SEQ ID NO: 289207 - DNA, 25 bp, Mus musculus
gacatggacatcctgcctccttcct

SEQ ID NO: 289208 - DNA, 25 bp, Mus musculus
gacatggagcggagcctctctgcct

SEQ ID NO: 289209 - DNA, 25 bp, Mus musculus
gacatggagcggaggtctcattggg

SEQ ID NO: 289210 - DNA, 25 bp, Mus musculus
gacatggatctggtgtgagtgttga

SEQ ID NO: 289211 - DNA, 25 bp, Mus musculus
gacatggatgctgtgtccaccacgg

SEQ ID NO: 289212 - DNA, 25 bp, Mus musculus
gacatggccatccagaagcctcccc

SEQ ID NO: 289213 - DNA, 25 bp, Mus musculus
gacatggcctcaggtggcccggcag

SEQ ID NO: 289214 - DNA, 25 bp, Mus musculus
gacatggctgcaagaaaatgccaga

SEQ ID NO: 289215 - DNA, 25 bp, Mus musculus
gacatgggactaggatgatgtctac

SEQ ID NO: 289216 - DNA, 25 bp, Mus musculus
gacatgggatacaaagtcctctcag

SEQ ID NO: 289217 - DNA, 25 bp, Mus musculus
gacatgggatacaagaacaattttt

SEQ ID NO: 289218 - DNA, 25 bp, Mus musculus
gacatggtaaagggaatgcagtggt

SEQ ID NO: 289219 - DNA, 25 bp, Mus musculus
gacatggtctagagctttatggatt

SEQ ID NO: 289220 - DNA, 25 bp, Mus musculus
gacatggtggagcactacaccaagg

SEQ ID NO: 289221 - DNA, 25 bp, Mus musculus
gacatggtggagctggctggctact

SEQ ID NO: 289222 - DNA, 25 bp, Mus musculus
gacatgtacaacagaatgaccagtg

SEQ ID NO: 289223 - DNA, 25 bp, Mus musculus
gacatgtattcgtaacaataaagtt

SEQ ID NO: 289224 - DNA, 25 bp, Mus musculus
gacatgtcaaggtcctgggtgagcc

SEQ ID NO: 289225 - DNA, 25 bp, Mus musculus
gacatgtcagcttctctgtccactt

SEQ ID NO: 289226 - DNA, 25 bp, Mus musculus
gacatgtcagtggaaacctctgtgt

SEQ ID NO: 289227 - DNA, 25 bp, Mus musculus
gacatgtctgagcaggtgctcctgt

SEQ ID NO: 289228 - DNA, 25 bp, Mus musculus
gacatgtgcaacctgcaccatgggc

SEQ ID NO: 289229 - DNA, 25 bp, Mus musculus
gacatgtggaaatccccagaggagc

SEQ ID NO: 289230 - DNA, 25 bp, Mus musculus
gacatgtgtattgcaagacagatcg

SEQ ID NO: 289231 - DNA, 25 bp, Mus musculus
gacatgtgtattggtgagaagccag

SEQ ID NO: 289232 - DNA, 25 bp, Mus musculus
gacatgtgtgagggctgccggtcac

SEQ ID NO: 289233 - DNA, 25 bp, Mus musculus
gacatgtgtgtgaggaggttccccc

SEQ ID NO: 289234 - DNA, 25 bp, Mus musculus
gacatgttcaaggtaattcagagat

SEQ ID NO: 289235 - DNA, 25 bp, Mus musculus
gacatgttcagcctggccaaactga

SEQ ID NO: 289236 - DNA, 25 bp, Mus musculus
gacatgttcaggtttggcaaacatc

SEQ ID NO: 289237 - DNA, 25 bp, Mus musculus
gacatgttgaagagactttcaacag

SEQ ID NO: 289238 - DNA, 25 bp, Mus musculus
gacatgttgaaggtgttggctgccc

SEQ ID NO: 289239 - DNA, 25 bp, Mus musculus
gacattaaaaacctgcaactggatt

SEQ ID NO: 289240 - DNA, 25 bp, Mus musculus
gacattaaaaaccttaggttgttct

SEQ ID NO: 289241 - DNA, 25 bp, Mus musculus
gacattaaagggtatagtgccaaac

SEQ ID NO: 289242 - DNA, 25 bp, Mus musculus
gacattacaaagcctcccagactac

SEQ ID NO: 289243 - DNA, 25 bp, Mus musculus
gacattacaggaccaggtggacacg

SEQ ID NO: 289244 - DNA, 25 bp, Mus musculus
gacattaccaatggacgcatcgttg

SEQ ID NO: 289245 - DNA, 25 bp, Mus musculus
gacattacctcagagctgtggaacg

SEQ ID NO: 289246 - DNA, 25 bp, Mus musculus
gacattactggcatgcctgtggtcc

SEQ ID NO: 289247 - DNA, 25 bp, Mus musculus
gacattagaagatctcaggaaaaat

SEQ ID NO: 289248 - DNA, 25 bp, Mus musculus
gacattagagggcaggacaataaga

SEQ ID NO: 289249 - DNA, 25 bp, Mus musculus
gacattaggaaattagataggtttt

SEQ ID NO: 289250 - DNA, 25 bp, Mus musculus
gacattatggaggacactatcgaag

SEQ ID NO: 289251 - DNA, 25 bp, Mus musculus
gacattcaaagtaccattactatgg

SEQ ID NO: 289252 - DNA, 25 bp, Mus musculus
gacattcaacagagctgccttccgt

SEQ ID NO: 289253 - DNA, 25 bp, Mus musculus
gacattcacgattgttggtgacgca

SEQ ID NO: 289254 - DNA, 25 bp, Mus musculus
gacattcagagccacaggcaccatg

SEQ ID NO: 289255 - DNA, 25 bp, Mus musculus
gacattccaacacttcaaactcaat

SEQ ID NO: 289256 - DNA, 25 bp, Mus musculus
gacattccaacgtgtccgatccgta

SEQ ID NO: 289257 - DNA, 25 bp, Mus musculus
gacattccagatgtctggccagtcc

SEQ ID NO: 289258 - DNA, 25 bp, Mus musculus
gacattccaggagaatgccaggagg

SEQ ID NO: 289259 - DNA, 25 bp, Mus musculus
gacattccaggtttcgtcttgatat

SEQ ID NO: 289260 - DNA, 25 bp, Mus musculus
gacattccccaggattgggtttcct

SEQ ID NO: 289261 - DNA, 25 bp, Mus musculus
gacattcctggagggatcatgcctg

SEQ ID NO: 289262 - DNA, 25 bp, Mus musculus
gacattccttatcataacagaatcc

SEQ ID NO: 289263 - DNA, 25 bp, Mus musculus
gacattccttcattagtgaaaagaa

SEQ ID NO: 289264 - DNA, 25 bp, Mus musculus
gacattcgacaggggaatggtttgg

SEQ ID NO: 289265 - DNA, 25 bp, Mus musculus
gacattcgcgcctagtattttgtta

SEQ ID NO: 289266 - DNA, 25 bp, Mus musculus
gacattcggacccagatgacccagg

SEQ ID NO: 289267 - DNA, 25 bp, Mus musculus
gacattctcaacaacctgagattca

SEQ ID NO: 289268 - DNA, 25 bp, Mus musculus
gacattctgaagatactaagcaacc

SEQ ID NO: 289269 - DNA, 25 bp, Mus musculus
gacattctgaagatgtgggcacatg

SEQ ID NO: 289270 - DNA, 25 bp, Mus musculus
gacattctgaaggatttgacgttgg

SEQ ID NO: 289271 - DNA, 25 bp, Mus musculus
gacattctggagccagcagggcctc

SEQ ID NO: 289272 - DNA, 25 bp, Mus musculus
gacattctggagggatgagacacct

SEQ ID NO: 289273 - DNA, 25 bp, Mus musculus
gacattctggggaacggattgctgc

SEQ ID NO: 289274 - DNA, 25 bp, Mus musculus
gacattcttgaggtggagtctttca

SEQ ID NO: 289275 - DNA, 25 bp, Mus musculus
gacattgaaagagcccattctgcac

SEQ ID NO: 289276 - DNA, 25 bp, Mus musculus
gacattgaaggagttaaagaccagt

SEQ ID NO: 289277 - DNA, 25 bp, Mus musculus
gacattgagactttctttggggtag

SEQ ID NO: 289278 - DNA, 25 bp, Mus musculus
gacattgagagggaatgaggtcttg

SEQ ID NO: 289279 - DNA, 25 bp, Mus musculus
gacattgagagggagagtgtggaga

SEQ ID NO: 289280 - DNA, 25 bp, Mus musculus
gacattgagcaggcatacaaatgct

SEQ ID NO: 289281 - DNA, 25 bp, Mus musculus
gacattgataatccgctggctcggg

SEQ ID NO: 289282 - DNA, 25 bp, Mus musculus
gacattgatgaaactgttattggac

SEQ ID NO: 289283 - DNA, 25 bp, Mus musculus
gacattgatgacctttggcaagaag

SEQ ID NO: 289284 - DNA, 25 bp, Mus musculus
gacattgcaccagatcacagaactg

SEQ ID NO: 289285 - DNA, 25 bp, Mus musculus
gacattgcacgtggtggtaatcagt

SEQ ID NO: 289286 - DNA, 25 bp, Mus musculus
gacattgcagaggatttttgcagct

SEQ ID NO: 289287 - DNA, 25 bp, Mus musculus
gacattgcagaggggctacatgaca

SEQ ID NO: 289288 - DNA, 25 bp, Mus musculus
gacattgccaagtataaaggagaag

SEQ ID NO: 289289 - DNA, 25 bp, Mus musculus
gacattgccaagttaaaaggagaag

SEQ ID NO: 289290 - DNA, 25 bp, Mus musculus
gacattgccagccttggggagttct

SEQ ID NO: 289291 - DNA, 25 bp, Mus musculus
gacattgccataaaggtgacaaatg

SEQ ID NO: 289292 - DNA, 25 bp, Mus musculus
gacattgccgagcgtgagagccaag

SEQ ID NO: 289293 - DNA, 25 bp, Mus musculus
gacattgctaactgccttgcagtga

SEQ ID NO: 289294 - DNA, 25 bp, Mus musculus
gacattgctacagctgcacagagca

SEQ ID NO: 289295 - DNA, 25 bp, Mus musculus
gacattgctagcatttgaagacatg

SEQ ID NO: 289296 - DNA, 25 bp, Mus musculus
gacattggacggaagaagtcccaga

SEQ ID NO: 289297 - DNA, 25 bp, Mus musculus
gacattggcacagaggctcagatcc

SEQ ID NO: 289298 - DNA, 25 bp, Mus musculus
gacattggcgtatttgctgcctgcg

SEQ ID NO: 289299 - DNA, 25 bp, Mus musculus
gacattggtgccaagaagatgcacg

SEQ ID NO: 289300 - DNA, 25 bp, Mus musculus
gacattgtacagaagctgttgcaat

SEQ ID NO: 289301 - DNA, 25 bp, Mus musculus
gacattgtacagaaggacctggtgg

SEQ ID NO: 289302 - DNA, 25 bp, Mus musculus
gacattgtagaaaaaatcgatgccc

SEQ ID NO: 289303 - DNA, 25 bp, Mus musculus
gacattgtggagacattgagaaaga

SEQ ID NO: 289304 - DNA, 25 bp, Mus musculus
gacattgtggaggcattgaacaaga

SEQ ID NO: 289305 - DNA, 25 bp, Mus musculus
gacattgtgtggggtcaccgacaat

SEQ ID NO: 289306 - DNA, 25 bp, Mus musculus
gacattgtttactccctgaaggagt

SEQ ID NO: 289307 - DNA, 25 bp, Mus musculus
gacatttaaaacagttgccatccac

SEQ ID NO: 289308 - DNA, 25 bp, Mus musculus
gacatttaccatatgacttttccaa

SEQ ID NO: 289309 - DNA, 25 bp, Mus musculus
gacatttcaaaagaaaggacctatg

SEQ ID NO: 289310 - DNA, 25 bp, Mus musculus
gacatttcaaaagtttgatttccag

SEQ ID NO: 289311 - DNA, 25 bp, Mus musculus
gacatttcaagaagacagcatccca

SEQ ID NO: 289312 - DNA, 25 bp, Mus musculus
gacatttcaagctcttagcccccca

SEQ ID NO: 289313 - DNA, 25 bp, Mus musculus
gacatttccctgatagattgctaac

SEQ ID NO: 289314 - DNA, 25 bp, Mus musculus
gacatttctggggacacccagaaag

SEQ ID NO: 289315 - DNA, 25 bp, Mus musculus
gacatttctgttggaggcctccctt

SEQ ID NO: 289316 - DNA, 25 bp, Mus musculus
gacatttgtttgcaatcaattatac

SEQ ID NO: 289317 - DNA, 25 bp, Mus musculus
gacattttactaagagatgtggctt

SEQ ID NO: 289318 - DNA, 25 bp, Mus musculus
gacattttagcaggttttctgatta

SEQ ID NO: 289319 - DNA, 25 bp, Mus musculus
gacatttttaacagaagcaaaccca

SEQ ID NO: 289320 - DNA, 25 bp, Mus musculus
gacatttttaacagattagttcata

SEQ ID NO: 289321 - DNA, 25 bp, Mus musculus
gacattttttatcagccatcgtcta

SEQ ID NO: 289322 - DNA, 25 bp, Mus musculus
gaccaaaaataaggtacaagttcag

SEQ ID NO: 289323 - DNA, 25 bp, Mus musculus
gaccaaaaatgtggacatcttcaat

SEQ ID NO: 289324 - DNA, 25 bp, Mus musculus
gaccaaaacgccagccacctgctat

SEQ ID NO: 289325 - DNA, 25 bp, Mus musculus
gaccaaaacgggggagcagtgcctt

SEQ ID NO: 289326 - DNA, 25 bp, Mus musculus
gaccaaaaggagcagcagcagcagc

SEQ ID NO: 289327 - DNA, 25 bp, Mus musculus
gaccaaaagggcaacatccccgatg

SEQ ID NO: 289328 - DNA, 25 bp, Mus musculus
gaccaaacacgtgaagaagagtctc

SEQ ID NO: 289329 - DNA, 25 bp, Mus musculus
gaccaaacaggccatcgtgtatgaa

SEQ ID NO: 289330 - DNA, 25 bp, Mus musculus
gaccaaacaggcgctgctaagtttc

SEQ ID NO: 289331 - DNA, 25 bp, Mus musculus
gaccaaaccgcaggcaatactagcc

SEQ ID NO: 289332 - DNA, 25 bp, Mus musculus
gaccaaaccgcaggtataatcaaag

SEQ ID NO: 289333 - DNA, 25 bp, Mus musculus
gaccaaacgcagaagcttgcaggaa

SEQ ID NO: 289334 - DNA, 25 bp, Mus musculus
gaccaaactggatcccactgacctt

SEQ ID NO: 289335 - DNA, 25 bp, Mus musculus
gaccaaactgttgattggtgctgat

SEQ ID NO: 289336 - DNA, 25 bp, Mus musculus
gaccaaagaagagagggaacttcaa

SEQ ID NO: 289337 - DNA, 25 bp, Mus musculus
gaccaaagaccacgtggatgaaggc

SEQ ID NO: 289338 - DNA, 25 bp, Mus musculus
gaccaaagagcagccccggactcac

SEQ ID NO: 289339 - DNA, 25 bp, Mus musculus
gaccaaagagctgcctctgttcctc

SEQ ID NO: 289340 - DNA, 25 bp, Mus musculus
gaccaaagatgggttaatatccttc

SEQ ID NO: 289341 - DNA, 25 bp, Mus musculus
gaccaaagggaagggctccacctgt

SEQ ID NO: 289342 - DNA, 25 bp, Mus musculus
gaccaaatacaatgacccctgacaa

SEQ ID NO: 289343 - DNA, 25 bp, Mus musculus
gaccaaatacaatgccctcaagacc

SEQ ID NO: 289344 - DNA, 25 bp, Mus musculus
gaccaaatggagatataatcatgtg

SEQ ID NO: 289345 - DNA, 25 bp, Mus musculus
gaccaaatggccatgataacagcta

SEQ ID NO: 289346 - DNA, 25 bp, Mus musculus
gaccaaatgggaggtgtgtcagaaa

SEQ ID NO: 289347 - DNA, 25 bp, Mus musculus
gaccaaattaatgacaagaacggag

SEQ ID NO: 289348 - DNA, 25 bp, Mus musculus
gaccaaattaatgagtacaaggagt

SEQ ID NO: 289349 - DNA, 25 bp, Mus musculus
gaccaaattaatgtggatgatcttt

SEQ ID NO: 289350 - DNA, 25 bp, Mus musculus
gaccaacaacactgacaggggcatc

SEQ ID NO: 289351 - DNA, 25 bp, Mus musculus
gaccaacaagtagcaggattgtctc

SEQ ID NO: 289352 - DNA, 25 bp, Mus musculus
gaccaacagttcttccaatcccaca

SEQ ID NO: 289353 - DNA, 25 bp, Mus musculus
gaccaacattcagggtctactgaaa

SEQ ID NO: 289354 - DNA, 25 bp, Mus musculus
gaccaaccagattgagagccaccct

SEQ ID NO: 289355 - DNA, 25 bp, Mus musculus
gaccaaccaggggccttggccttac

SEQ ID NO: 289356 - DNA, 25 bp, Mus musculus
gaccaaccagggtcatgccattgcc

SEQ ID NO: 289357 - DNA, 25 bp, Mus musculus
gaccaaccaggtcgagtgtcaccct

SEQ ID NO: 289358 - DNA, 25 bp, Mus musculus
gaccaaccattgtaaaacttatgga

SEQ ID NO: 289359 - DNA, 25 bp, Mus musculus
gaccaaccgagtcatttaaggctgc

SEQ ID NO: 289360 - DNA, 25 bp, Mus musculus
gaccaactcagcagggcatctgaag

SEQ ID NO: 289361 - DNA, 25 bp, Mus musculus
gaccaacttgagaattggacagcgg

SEQ ID NO: 289362 - DNA, 25 bp, Mus musculus
gaccaacttgagagtgacttctgcg

SEQ ID NO: 289363 - DNA, 25 bp, Mus musculus
gaccaactttgctagatgtgtcttc

SEQ ID NO: 289364 - DNA, 25 bp, Mus musculus
gaccaactttgctgtcatttctcaa

SEQ ID NO: 289365 - DNA, 25 bp, Mus musculus
gaccaactttgcttcattacaggac

SEQ ID NO: 289366 - DNA, 25 bp, Mus musculus
gaccaagaagaactgagattcctac

SEQ ID NO: 289367 - DNA, 25 bp, Mus musculus
gaccaagaagcagccgatcaaaatc

SEQ ID NO: 289368 - DNA, 25 bp, Mus musculus
gaccaagaagcagtcgttccccatc

SEQ ID NO: 289369 - DNA, 25 bp, Mus musculus
gaccaagaagcttcgttacactaat

SEQ ID NO: 289370 - DNA, 25 bp, Mus musculus
gaccaagaatcacagacgcagtatg

SEQ ID NO: 289371 - DNA, 25 bp, Mus musculus
gaccaagaatcacagctcgccaaat

SEQ ID NO: 289372 - DNA, 25 bp, Mus musculus
gaccaagacccacatctggcaagtt

SEQ ID NO: 289373 - DNA, 25 bp, Mus musculus
gaccaagacccgggcctggttctca

SEQ ID NO: 289374 - DNA, 25 bp, Mus musculus
gaccaagacgcaaatggaacttcca

SEQ ID NO: 289375 - DNA, 25 bp, Mus musculus
gaccaagagcaagaccaggtgctac

SEQ ID NO: 289376 - DNA, 25 bp, Mus musculus
gaccaagagcaaggcgacggtgtgg

SEQ ID NO: 289377 - DNA, 25 bp, Mus musculus
gaccaagaggacggtgtgccgatgc

SEQ ID NO: 289378 - DNA, 25 bp, Mus musculus
gaccaagatccagatcttactctag

SEQ ID NO: 289379 - DNA, 25 bp, Mus musculus
gaccaagatcctaaaaatactcttg

SEQ ID NO: 289380 - DNA, 25 bp, Mus musculus
gaccaagatgatagggatgcaaact

SEQ ID NO: 289381 - DNA, 25 bp, Mus musculus
gaccaagatgcagacgacctggagg

SEQ ID NO: 289382 - DNA, 25 bp, Mus musculus
gaccaagatggaggagatcgggcgc

SEQ ID NO: 289383 - DNA, 25 bp, Mus musculus
gaccaagatggaggagattgggagg

SEQ ID NO: 289384 - DNA, 25 bp, Mus musculus
gaccaagcaatcaaggctttacaag

SEQ ID NO: 289385 - DNA, 25 bp, Mus musculus
gaccaagcaccagaatgcaagggtg

SEQ ID NO: 289386 - DNA, 25 bp, Mus musculus
gaccaagcaccagctgcgatactat

SEQ ID NO: 289387 - DNA, 25 bp, Mus musculus
gaccaagctcagcctcctcttagac

SEQ ID NO: 289388 - DNA, 25 bp, Mus musculus
gaccaagctgtagatcaagtctcca

SEQ ID NO: 289389 - DNA, 25 bp, Mus musculus
gaccaagctgtagcatagttttggg

SEQ ID NO: 289390 - DNA, 25 bp, Mus musculus
gaccaaggaacagatcctgaagctg

SEQ ID NO: 289391 - DNA, 25 bp, Mus musculus
gaccaaggaccagactttgaagaat

SEQ ID NO: 289392 - DNA, 25 bp, Mus musculus
gaccaaggaccaggagatccagact

SEQ ID NO: 289393 - DNA, 25 bp, Mus musculus
gaccaaggtgacaggaccctttgga

SEQ ID NO: 289394 - DNA, 25 bp, Mus musculus
gaccaagtcaaaaagattgataagt

SEQ ID NO: 289395 - DNA, 25 bp, Mus musculus
gaccaagtgcaccggaagatggacg

SEQ ID NO: 289396 - DNA, 25 bp, Mus musculus
gaccaagtgcaccggggtctgctga

SEQ ID NO: 289397 - DNA, 25 bp, Mus musculus
gaccaagtgtgccgatcccgtgcat

SEQ ID NO: 289398 - DNA, 25 bp, Mus musculus
gaccaagtgtgccggagccagtgtt

SEQ ID NO: 289399 - DNA, 25 bp, Mus musculus
gaccaagttacaggaggcagtgaca

SEQ ID NO: 289400 - DNA, 25 bp, Mus musculus
gaccaagttacaggaggcagtgacg

SEQ ID NO: 289401 - DNA, 25 bp, Mus musculus
gaccaagttacaggaggcagtgact

SEQ ID NO: 289402 - DNA, 25 bp, Mus musculus
gaccaagttacaggtctcctgtttc

SEQ ID NO: 289403 - DNA, 25 bp, Mus musculus
gaccaatcaggatgtgatcaaggca

SEQ ID NO: 289404 - DNA, 25 bp, Mus musculus
gaccaatcagttcatgcagaagaag

SEQ ID NO: 289405 - DNA, 25 bp, Mus musculus
gaccaatcgccactgtgttcacacg

SEQ ID NO: 289406 - DNA, 25 bp, Mus musculus
gaccaatgagggagagcccatgagg

SEQ ID NO: 289407 - DNA, 25 bp, Mus musculus
gaccaatgtgaagatatcaatgaat

SEQ ID NO: 289408 - DNA, 25 bp, Mus musculus
gaccaatgtgaagatattgatgaat

SEQ ID NO: 289409 - DNA, 25 bp, Mus musculus
gaccaatttagtattcgcctgggaa

SEQ ID NO: 289410 - DNA, 25 bp, Mus musculus
gaccaatttgaaattgcagactgtg

SEQ ID NO: 289411 - DNA, 25 bp, Mus musculus
gaccacaaagctagggaagaagata

SEQ ID NO: 289412 - DNA, 25 bp, Mus musculus
gaccacaaatgggcgacttccagtc

SEQ ID NO: 289413 - DNA, 25 bp, Mus musculus
gaccacacagagacttgaaaatcga

SEQ ID NO: 289414 - DNA, 25 bp, Mus musculus
gaccacacagagtttatggttcact

SEQ ID NO: 289415 - DNA, 25 bp, Mus musculus
gaccacacagcggggagaaggttgc

SEQ ID NO: 289416 - DNA, 25 bp, Mus musculus
gaccacacagcggtcgctatgcatt

SEQ ID NO: 289417 - DNA, 25 bp, Mus musculus
gaccacaccagcattcggaggggtt

SEQ ID NO: 289418 - DNA, 25 bp, Mus musculus
gaccacaccagttcctctaattctt

SEQ ID NO: 289419 - DNA, 25 bp, Mus musculus
gaccacaccctgttcttgcttcagc

SEQ ID NO: 289420 - DNA, 25 bp, Mus musculus
gaccacacggatatggaagagggat

SEQ ID NO: 289421 - DNA, 25 bp, Mus musculus
gaccacactgacacaatatggagtc

SEQ ID NO: 289422 - DNA, 25 bp, Mus musculus
gaccacagacaaggccaacatcaaa

SEQ ID NO: 289423 - DNA, 25 bp, Mus musculus
gaccacagagagttctccagatttg

SEQ ID NO: 289424 - DNA, 25 bp, Mus musculus
gaccacagagggtggctgtctgccc

SEQ ID NO: 289425 - DNA, 25 bp, Mus musculus
gaccacagatgaagagcaagtacag

SEQ ID NO: 289426 - DNA, 25 bp, Mus musculus
gaccacagatgaagatcttcaggat

SEQ ID NO: 289427 - DNA, 25 bp, Mus musculus
gaccacagccaactttccagatgtc

SEQ ID NO: 289428 - DNA, 25 bp, Mus musculus
gaccacaggaaaggggaatgtgact

SEQ ID NO: 289429 - DNA, 25 bp, Mus musculus
gaccacaggatacaggattctcata

SEQ ID NO: 289430 - DNA, 25 bp, Mus musculus
gaccacaggatacagggttatacag

SEQ ID NO: 289431 - DNA, 25 bp, Mus musculus
gaccacagggatgttggatggaaga

SEQ ID NO: 289432 - DNA, 25 bp, Mus musculus
gaccacagtaaggtgtaacacggct

SEQ ID NO: 289433 - DNA, 25 bp, Mus musculus
gaccacagtcaccgagagtgagcag

SEQ ID NO: 289434 - DNA, 25 bp, Mus musculus
gaccacagtgctgccatagtggacg

SEQ ID NO: 289435 - DNA, 25 bp, Mus musculus
gaccacagtgggcctgtgctttaat

SEQ ID NO: 289436 - DNA, 25 bp, Mus musculus
gaccacagtttctgctgcagttctc

SEQ ID NO: 289437 - DNA, 25 bp, Mus musculus
gaccacatctgtcaaattatcacac

SEQ ID NO: 289438 - DNA, 25 bp, Mus musculus
gaccacatgcagaatcacagcgagg

SEQ ID NO: 289439 - DNA, 25 bp, Mus musculus
gaccacatgcaggagagattttggg

SEQ ID NO: 289440 - DNA, 25 bp, Mus musculus
gaccacattaggactctgttggtgt

SEQ ID NO: 289441 - DNA, 25 bp, Mus musculus
gaccacattaggatctgaagtgaaa

SEQ ID NO: 289442 - DNA, 25 bp, Mus musculus
gaccaccaagacatccaggagctga

SEQ ID NO: 289443 - DNA, 25 bp, Mus musculus
gaccaccaagactcacaccctacag

SEQ ID NO: 289444 - DNA, 25 bp, Mus musculus
gaccaccacacaggccagacccatg

SEQ ID NO: 289445 - DNA, 25 bp, Mus musculus
gaccaccacacccagtgttgggcaa

SEQ ID NO: 289446 - DNA, 25 bp, Mus musculus
gaccaccacggcatcacggctgcgg

SEQ ID NO: 289447 - DNA, 25 bp, Mus musculus
gaccaccactaccatcacggagaag

SEQ ID NO: 289448 - DNA, 25 bp, Mus musculus
gaccaccagagcctgtactcctgga

SEQ ID NO: 289449 - DNA, 25 bp, Mus musculus
gaccaccatgatattggaccatgtg

SEQ ID NO: 289450 - DNA, 25 bp, Mus musculus
gaccacccagatgttgccgcactat

SEQ ID NO: 289451 - DNA, 25 bp, Mus musculus
gaccacccagctgtggctgcgaccc

SEQ ID NO: 289452 - DNA, 25 bp, Mus musculus
gaccacccttggtgaaggcagctac

SEQ ID NO: 289453 - DNA, 25 bp, Mus musculus
gaccaccgacatggtaaagaacttg

SEQ ID NO: 289454 - DNA, 25 bp, Mus musculus
gaccacctacaaccataggtacttc

SEQ ID NO: 289455 - DNA, 25 bp, Mus musculus
gaccacctctagaggcctataccat

SEQ ID NO: 289456 - DNA, 25 bp, Mus musculus
gaccacctctagagttgaccaagct

SEQ ID NO: 289457 - DNA, 25 bp, Mus musculus
gaccacctggacaggtcggaagctg

SEQ ID NO: 289458 - DNA, 25 bp, Mus musculus
gaccaccttctacaattcccagcga

SEQ ID NO: 289459 - DNA, 25 bp, Mus musculus
gaccacgaatgtgccgcttcatcag

SEQ ID NO: 289460 - DNA, 25 bp, Mus musculus
gaccacgaggagctgaaggaccagc

SEQ ID NO: 289461 - DNA, 25 bp, Mus musculus
gaccacgcagaggaaagatggtcca

SEQ ID NO: 289462 - DNA, 25 bp, Mus musculus
gaccacgcagagggaaggtgtgaac

SEQ ID NO: 289463 - DNA, 25 bp, Mus musculus
gaccacgctctcaaggccgagtaca

SEQ ID NO: 289464 - DNA, 25 bp, Mus musculus
gaccacgctctcaaggtatagtcct

SEQ ID NO: 289465 - DNA, 25 bp, Mus musculus
gaccacggtctggaggtcctgggcc

SEQ ID NO: 289466 - DNA, 25 bp, Mus musculus
gaccacgtgctgggcctggccagga

SEQ ID NO: 289467 - DNA, 25 bp, Mus musculus
gaccactacgcaggaggattacaac

SEQ ID NO: 289468 - DNA, 25 bp, Mus musculus
gaccactacgcagttaccgtgacgg

SEQ ID NO: 289469 - DNA, 25 bp, Mus musculus
gaccactcaagcccatcgtttctga

SEQ ID NO: 289470 - DNA, 25 bp, Mus musculus
gaccactcaaggcaccacaatggga

SEQ ID NO: 289471 - DNA, 25 bp, Mus musculus
gaccactcagctgctgcgctgcccc

SEQ ID NO: 289472 - DNA, 25 bp, Mus musculus
gaccactccatggattgccggaact

SEQ ID NO: 289473 - DNA, 25 bp, Mus musculus
gaccactcgaccaggttctgggctg

SEQ ID NO: 289474 - DNA, 25 bp, Mus musculus
gaccactcggagatgtggtcagctg

SEQ ID NO: 289475 - DNA, 25 bp, Mus musculus
gaccactcggcctctgcagagatgt

SEQ ID NO: 289476 - DNA, 25 bp, Mus musculus
gaccactgagaggcctacgtgaaga

SEQ ID NO: 289477 - DNA, 25 bp, Mus musculus
gaccactgagcctgagcagatgggg

SEQ ID NO: 289478 - DNA, 25 bp, Mus musculus
gaccactgatgagagaggtcctccg

SEQ ID NO: 289479 - DNA, 25 bp, Mus musculus
gaccactgcaaggtgctgagacgtg

SEQ ID NO: 289480 - DNA, 25 bp, Mus musculus
gaccactgcagtctctctctccagc

SEQ ID NO: 289481 - DNA, 25 bp, Mus musculus
gaccactgcccagattttcactgta

SEQ ID NO: 289482 - DNA, 25 bp, Mus musculus
gaccactgctacagctgctcctaca

SEQ ID NO: 289483 - DNA, 25 bp, Mus musculus
gaccactggactgcatggtctgaga

SEQ ID NO: 289484 - DNA, 25 bp, Mus musculus
gaccactgggacgcggccatccatg

SEQ ID NO: 289485 - DNA, 25 bp, Mus musculus
gaccactgggacgcgttctgtggat

SEQ ID NO: 289486 - DNA, 25 bp, Mus musculus
gaccactggttgagatcctctttag

SEQ ID NO: 289487 - DNA, 25 bp, Mus musculus
gaccactggttgagggcaatggcat

SEQ ID NO: 289488 - DNA, 25 bp, Mus musculus
gaccactgtgaggatatcaatgaat

SEQ ID NO: 289489 - DNA, 25 bp, Mus musculus
gaccacttaggaggcacatagacat

SEQ ID NO: 289490 - DNA, 25 bp, Mus musculus
gaccacttcaacaggactcatttca

SEQ ID NO: 289491 - DNA, 25 bp, Mus musculus
gaccacttgccatgcataatcttgg

SEQ ID NO: 289492 - DNA, 25 bp, Mus musculus
gaccacttgtgccggtcccgcctgg

SEQ ID NO: 289493 - DNA, 25 bp, Mus musculus
gaccagaaacggatgggctgtatgg

SEQ ID NO: 289494 - DNA, 25 bp, Mus musculus
gaccagaaagatctgcatccaaaga

SEQ ID NO: 289495 - DNA, 25 bp, Mus musculus
gaccagaactaaagggcttgttgtc

SEQ ID NO: 289496 - DNA, 25 bp, Mus musculus
gaccagaagacagtgatggcgactg

SEQ ID NO: 289497 - DNA, 25 bp, Mus musculus
gaccagaagacagttgccctctata

SEQ ID NO: 289498 - DNA, 25 bp, Mus musculus
gaccagaagcagctggtgaatgagc

SEQ ID NO: 289499 - DNA, 25 bp, Mus musculus
gaccagaagcagggaaaaggctcta

SEQ ID NO: 289500 - DNA, 25 bp, Mus musculus
gaccagaaggaccagctaaccctga

SEQ ID NO: 289501 - DNA, 25 bp, Mus musculus
gaccagaataaccaggtgaggaaaa

SEQ ID NO: 289502 - DNA, 25 bp, Mus musculus
gaccagaatcagaacattgtcctta

SEQ ID NO: 289503 - DNA, 25 bp, Mus musculus
gaccagaatcagagctgatcataag

SEQ ID NO: 289504 - DNA, 25 bp, Mus musculus
gaccagacaaagacatggaccctac

SEQ ID NO: 289505 - DNA, 25 bp, Mus musculus
gaccagacaaagccgaccctttccg

SEQ ID NO: 289506 - DNA, 25 bp, Mus musculus
gaccagacctacgataaccacttcc

SEQ ID NO: 289507 - DNA, 25 bp, Mus musculus
gaccagactgaggctgtgtttcaaa

SEQ ID NO: 289508 - DNA, 25 bp, Mus musculus
gaccagactgccgctctccacctgc

SEQ ID NO: 289509 - DNA, 25 bp, Mus musculus
gaccagactggcgctctccacctgc

SEQ ID NO: 289510 - DNA, 25 bp, Mus musculus
gaccagagaacatggatgtcagcaa

SEQ ID NO: 289511 - DNA, 25 bp, Mus musculus
gaccagagagggtccgggccatcag

SEQ ID NO: 289512 - DNA, 25 bp, Mus musculus
gaccagaggcagagtgaagaaatcg

SEQ ID NO: 289513 - DNA, 25 bp, Mus musculus
gaccagagggaactggtggaaactg

SEQ ID NO: 289514 - DNA, 25 bp, Mus musculus
gaccagatagagctggagctggcca

SEQ ID NO: 289515 - DNA, 25 bp, Mus musculus
gaccagatcagaagaacagtctatc

SEQ ID NO: 289516 - DNA, 25 bp, Mus musculus
gaccagatcagaagaccaggaaccc

SEQ ID NO: 289517 - DNA, 25 bp, Mus musculus
gaccagatcagaagagctctgcagg

SEQ ID NO: 289518 - DNA, 25 bp, Mus musculus
gaccagatctcaaaggaaaaccagt

SEQ ID NO: 289519 - DNA, 25 bp, Mus musculus
gaccagatgcggtggtagcaaagga

SEQ ID NO: 289520 - DNA, 25 bp, Mus musculus
gaccagatggcccaggtacttcaat

SEQ ID NO: 289521 - DNA, 25 bp, Mus musculus
gaccagatgggcaagggtgaggagg

SEQ ID NO: 289522 - DNA, 25 bp, Mus musculus
gaccagatgggcaaggtatcaatct

SEQ ID NO: 289523 - DNA, 25 bp, Mus musculus
gaccagattgccgacttcaaggagg

SEQ ID NO: 289524 - DNA, 25 bp, Mus musculus
gaccagattgccgatcgagttctct

SEQ ID NO: 289525 - DNA, 25 bp, Mus musculus
gaccagcaaaaaatgctatcagaag

SEQ ID NO: 289526 - DNA, 25 bp, Mus musculus
gaccagcaaactgcctactcgccca

SEQ ID NO: 289527 - DNA, 25 bp, Mus musculus
gaccagcaaactgcggggactgaag

SEQ ID NO: 289528 - DNA, 25 bp, Mus musculus
gaccagcaaactggcaccgacagcc

SEQ ID NO: 289529 - DNA, 25 bp, Mus musculus
gaccagcaaagaaaaaatggcgtca

SEQ ID NO: 289530 - DNA, 25 bp, Mus musculus
gaccagcaaagccaaacccatgcgt

SEQ ID NO: 289531 - DNA, 25 bp, Mus musculus
gaccagcaaatctcactggaagctc

SEQ ID NO: 289532 - DNA, 25 bp, Mus musculus
gaccagcagactgtaaaacagacta

SEQ ID NO: 289533 - DNA, 25 bp, Mus musculus
gaccagcagactttctcctgtctat

SEQ ID NO: 289534 - DNA, 25 bp, Mus musculus
gaccagcagagaaattcaaagggca

SEQ ID NO: 289535 - DNA, 25 bp, Mus musculus
gaccagcagagacgttcacagcctg

SEQ ID NO: 289536 - DNA, 25 bp, Mus musculus
gaccagcaggcatgggtaggatttg

SEQ ID NO: 289537 - DNA, 25 bp, Mus musculus
gaccagcaggtaattaacgagatgg

SEQ ID NO: 289538 - DNA, 25 bp, Mus musculus
gaccagcatcctcagctctgggccc

SEQ ID NO: 289539 - DNA, 25 bp, Mus musculus
gaccagcatttgattaaagcaccgt

SEQ ID NO: 289540 - DNA, 25 bp, Mus musculus
gaccagccctggggtacttgttgac

SEQ ID NO: 289541 - DNA, 25 bp, Mus musculus
gaccagcctgactggttgtgtcacc

SEQ ID NO: 289542 - DNA, 25 bp, Mus musculus
gaccagcctttacaggacgcctttg

SEQ ID NO: 289543 - DNA, 25 bp, Mus musculus
gaccagcggcaagcctgagactggt

SEQ ID NO: 289544 - DNA, 25 bp, Mus musculus
gaccagcgggagaagatggttggta

SEQ ID NO: 289545 - DNA, 25 bp, Mus musculus
gaccagcgggagaaggctctgcacc

SEQ ID NO: 289546 - DNA, 25 bp, Mus musculus
gaccagcgggagaaggttgatccaa

SEQ ID NO: 289547 - DNA, 25 bp, Mus musculus
gaccagctaaaggaggctgtgaggg

SEQ ID NO: 289548 - DNA, 25 bp, Mus musculus
gaccagctaagggtgtcagggtcac

SEQ ID NO: 289549 - DNA, 25 bp, Mus musculus
gaccagctccacctggaaatgttct

SEQ ID NO: 289550 - DNA, 25 bp, Mus musculus
gaccagctccacctgttatttggcc

SEQ ID NO: 289551 - DNA, 25 bp, Mus musculus
gaccagctctcggggatcttgaaac

SEQ ID NO: 289552 - DNA, 25 bp, Mus musculus
gaccagctgcactatgtgacggagc

SEQ ID NO: 289553 - DNA, 25 bp, Mus musculus
gaccagctggcaaggttatgaaaac

SEQ ID NO: 289554 - DNA, 25 bp, Mus musculus
gaccagctgggagagcgaggggttg

SEQ ID NO: 289555 - DNA, 25 bp, Mus musculus
gaccaggaacacgggggcttcttca

SEQ ID NO: 289556 - DNA, 25 bp, Mus musculus
gaccaggaagagaaggcttcagatg

SEQ ID NO: 289557 - DNA, 25 bp, Mus musculus
gaccaggaagcaggtgtctagtcac

SEQ ID NO: 289558 - DNA, 25 bp, Mus musculus
gaccaggaagcaggtgtctagtcat

SEQ ID NO: 289559 - DNA, 25 bp, Mus musculus
gaccaggacaagcaggtcccatgca

SEQ ID NO: 289560 - DNA, 25 bp, Mus musculus
gaccaggatgttgacctaaagattg

SEQ ID NO: 289561 - DNA, 25 bp, Mus musculus
gaccaggatgttgagaaagcaacta

SEQ ID NO: 289562 - DNA, 25 bp, Mus musculus
gaccaggcacccagagttttgctct

SEQ ID NO: 289563 - DNA, 25 bp, Mus musculus
gaccaggcagaagctgggaagtcat

SEQ ID NO: 289564 - DNA, 25 bp, Mus musculus
gaccaggcaggagtacctggagttc

SEQ ID NO: 289565 - DNA, 25 bp, Mus musculus
gaccaggcagggtctcctggaagag

SEQ ID NO: 289566 - DNA, 25 bp, Mus musculus
gaccaggcagtacacctatggcggt

SEQ ID NO: 289567 - DNA, 25 bp, Mus musculus
gaccaggcagttctagatgagcgct

SEQ ID NO: 289568 - DNA, 25 bp, Mus musculus
gaccaggcccggaagttcctgttcc

SEQ ID NO: 289569 - DNA, 25 bp, Mus musculus
gaccaggcctgtcttcagtccccta

SEQ ID NO: 289570 - DNA, 25 bp, Mus musculus
gaccaggctacaaagaacccaagag

SEQ ID NO: 289571 - DNA, 25 bp, Mus musculus
gaccaggctgacgggtatcaccaca

SEQ ID NO: 289572 - DNA, 25 bp, Mus musculus
gaccagggacagactcactctgtgg

SEQ ID NO: 289573 - DNA, 25 bp, Mus musculus
gaccagggaggtgactgacttacag

SEQ ID NO: 289574 - DNA, 25 bp, Mus musculus
gaccagggcagtgccctgcagacac

SEQ ID NO: 289575 - DNA, 25 bp, Mus musculus
gaccagggcgacttcgagaagcccc

SEQ ID NO: 289576 - DNA, 25 bp, Mus musculus
gaccaggtaagacccctgggcctcc

SEQ ID NO: 289577 - DNA, 25 bp, Mus musculus
gaccaggtgccccaggtgttccatg

SEQ ID NO: 289578 - DNA, 25 bp, Mus musculus
gaccaggtgccccaggtttcttgaa

SEQ ID NO: 289579 - DNA, 25 bp, Mus musculus
gaccaggtggcagaggacctggtgg

SEQ ID NO: 289580 - DNA, 25 bp, Mus musculus
gaccaggtggcaggtatttcccccc

SEQ ID NO: 289581 - DNA, 25 bp, Mus musculus
gaccaggtggttcgccctagtcgag

SEQ ID NO: 289582 - DNA, 25 bp, Mus musculus
gaccaggtttgggttccccaggatg

SEQ ID NO: 289583 - DNA, 25 bp, Mus musculus
gaccagtacaaggagcttcctccaa

SEQ ID NO: 289584 - DNA, 25 bp, Mus musculus
gaccagtcactatgtgctgtgagtg

SEQ ID NO: 289585 - DNA, 25 bp, Mus musculus
gaccagtccactgactttaactggt

SEQ ID NO: 289586 - DNA, 25 bp, Mus musculus
gaccagtctaggaaggtccttttga

SEQ ID NO: 289587 - DNA, 25 bp, Mus musculus
gaccagtctccaagatggcggtaaa

SEQ ID NO: 289588 - DNA, 25 bp, Mus musculus
gaccagtgactccaatatgcctgaa

SEQ ID NO: 289589 - DNA, 25 bp, Mus musculus
gaccagtgcaagacagggtctcatg

SEQ ID NO: 289590 - DNA, 25 bp, Mus musculus
gaccagtgcctctgactaggtctgc

SEQ ID NO: 289591 - DNA, 25 bp, Mus musculus
gaccagtggggagtggagctgggga

SEQ ID NO: 289592 - DNA, 25 bp, Mus musculus
gaccagtggggctggggaagcagct

SEQ ID NO: 289593 - DNA, 25 bp, Mus musculus
gaccagttgctcaggcagtgctttt

SEQ ID NO: 289594 - DNA, 25 bp, Mus musculus
gaccagtttcagcgtgcgggaggtg

SEQ ID NO: 289595 - DNA, 25 bp, Mus musculus
gaccataaagtctaaggttgtgggt

SEQ ID NO: 289596 - DNA, 25 bp, Mus musculus
gaccatacagatcatgtcatcaggc

SEQ ID NO: 289597 - DNA, 25 bp, Mus musculus
gaccatacaggctgggccggtaata

SEQ ID NO: 289598 - DNA, 25 bp, Mus musculus
gaccatacaggtatgtcatcaggca

SEQ ID NO: 289599 - DNA, 25 bp, Mus musculus
gaccatacagtcgtttacccttcgt

SEQ ID NO: 289600 - DNA, 25 bp, Mus musculus
gaccatactcccgagatgttagatg

SEQ ID NO: 289601 - DNA, 25 bp, Mus musculus
gaccatactggacaccctttcagcc

SEQ ID NO: 289602 - DNA, 25 bp, Mus musculus
gaccatagacgagttggagtggaaa

SEQ ID NO: 289603 - DNA, 25 bp, Mus musculus
gaccatagacgtggaaactgtctga

SEQ ID NO: 289604 - DNA, 25 bp, Mus musculus
gaccatatcaagtctatgcatggaa

SEQ ID NO: 289605 - DNA, 25 bp, Mus musculus
gaccatatgaacttggcatggaaca

SEQ ID NO: 289606 - DNA, 25 bp, Mus musculus
gaccatcaaaaggagaagaaatgct

SEQ ID NO: 289607 - DNA, 25 bp, Mus musculus
gaccatcaaaaggaggaagctggct

SEQ ID NO: 289608 - DNA, 25 bp, Mus musculus
gaccatcaaacagacctttggctat

SEQ ID NO: 289609 - DNA, 25 bp, Mus musculus
gaccatcaaggcactagatggggac

SEQ ID NO: 289610 - DNA, 25 bp, Mus musculus
gaccatcacaagatctgatactctt

SEQ ID NO: 289611 - DNA, 25 bp, Mus musculus
gaccatcacaaggtctgatactctt

SEQ ID NO: 289612 - DNA, 25 bp, Mus musculus
gaccatcacagggtttgtggatgca

SEQ ID NO: 289613 - DNA, 25 bp, Mus musculus
gaccatcacaggtctattctggata

SEQ ID NO: 289614 - DNA, 25 bp, Mus musculus
gaccatcacagtccgcaccaagaag

SEQ ID NO: 289615 - DNA, 25 bp, Mus musculus
gaccatcaccctggaggtcgagccc

SEQ ID NO: 289616 - DNA, 25 bp, Mus musculus
gaccatcactcgagcttctagggac

SEQ ID NO: 289617 - DNA, 25 bp, Mus musculus
gaccatcatcaatggcattgtggag

SEQ ID NO: 289618 - DNA, 25 bp, Mus musculus
gaccatcattggcgattccggggtg

SEQ ID NO: 289619 - DNA, 25 bp, Mus musculus
gaccatcattggcggtgcccagatc

SEQ ID NO: 289620 - DNA, 25 bp, Mus musculus
gaccatccagaaaaaacactgaata

SEQ ID NO: 289621 - DNA, 25 bp, Mus musculus
gaccatccaggtgagcctcatgttg

SEQ ID NO: 289622 - DNA, 25 bp, Mus musculus
gaccatcctagtcatgggagacttc

SEQ ID NO: 289623 - DNA, 25 bp, Mus musculus
gaccatccttaagtggccaaatgta

SEQ ID NO: 289624 - DNA, 25 bp, Mus musculus
gaccatcggcaaggttcagaagaag

SEQ ID NO: 289625 - DNA, 25 bp, Mus musculus
gaccatctatgagagaatatcaaag

SEQ ID NO: 289626 - DNA, 25 bp, Mus musculus
gaccatctccggtcctggcttaaca

SEQ ID NO: 289627 - DNA, 25 bp, Mus musculus
gaccatctctagatctccattcgga

SEQ ID NO: 289628 - DNA, 25 bp, Mus musculus
gaccatcttttccaaacatcaacat

SEQ ID NO: 289629 - DNA, 25 bp, Mus musculus
gaccatgaagacaccgtggaaggtt

SEQ ID NO: 289630 - DNA, 25 bp, Mus musculus
gaccatgaagatgaagcggcagctg

SEQ ID NO: 289631 - DNA, 25 bp, Mus musculus
gaccatgaaggaaagactcaggcag

SEQ ID NO: 289632 - DNA, 25 bp, Mus musculus
gaccatgaaggaaagttacccagca

SEQ ID NO: 289633 - DNA, 25 bp, Mus musculus
gaccatgaagggctgccaacagtgg

SEQ ID NO: 289634 - DNA, 25 bp, Mus musculus
gaccatgaaggtttataagaaacat

SEQ ID NO: 289635 - DNA, 25 bp, Mus musculus
gaccatgaagttggacaacttttct

SEQ ID NO: 289636 - DNA, 25 bp, Mus musculus
gaccatgaccaaggatgaacagcaa

SEQ ID NO: 289637 - DNA, 25 bp, Mus musculus
gaccatgaccaggaataactcaacc

SEQ ID NO: 289638 - DNA, 25 bp, Mus musculus
gaccatgaccaggcgctggctcagg

SEQ ID NO: 289639 - DNA, 25 bp, Mus musculus
gaccatgcaagtgaacgaagctttt

SEQ ID NO: 289640 - DNA, 25 bp, Mus musculus
gaccatgcaagtggaaagtacgcag

SEQ ID NO: 289641 - DNA, 25 bp, Mus musculus
gaccatgcaggttcgcaacgttctc

SEQ ID NO: 289642 - DNA, 25 bp, Mus musculus
gaccatgcgaatgttcggagcgacc

SEQ ID NO: 289643 - DNA, 25 bp, Mus musculus
gaccatgctccccacccccgatctt

SEQ ID NO: 289644 - DNA, 25 bp, Mus musculus
gaccatgctccgagccgctggtttg

SEQ ID NO: 289645 - DNA, 25 bp, Mus musculus
gaccatgctccgagggtctgactac

SEQ ID NO: 289646 - DNA, 25 bp, Mus musculus
gaccatgctgttcttttcaggggag

SEQ ID NO: 289647 - DNA, 25 bp, Mus musculus
gaccatggaagagatctgtgaaggt

SEQ ID NO: 289648 - DNA, 25 bp, Mus musculus
gaccatggacgatctgtttcccctc

SEQ ID NO: 289649 - DNA, 25 bp, Mus musculus
gaccatggagaccatagtctgtgtg

SEQ ID NO: 289650 - DNA, 25 bp, Mus musculus
gaccatggaggtgtgtgtacatgtg

SEQ ID NO: 289651 - DNA, 25 bp, Mus musculus
gaccatggcagcagcttctaggtgc

SEQ ID NO: 289652 - DNA, 25 bp, Mus musculus
gaccatggcaggggagtcctcatgg

SEQ ID NO: 289653 - DNA, 25 bp, Mus musculus
gaccatggccaagatggagttccag

SEQ ID NO: 289654 - DNA, 25 bp, Mus musculus
gaccatggccttatgttgacttact

SEQ ID NO: 289655 - DNA, 25 bp, Mus musculus
gaccatggctcactggtcctgcgac

SEQ ID NO: 289656 - DNA, 25 bp, Mus musculus
gaccatgggcaatgacacgtcccca

SEQ ID NO: 289657 - DNA, 25 bp, Mus musculus
gaccatggtcatcggaaattaccgg

SEQ ID NO: 289658 - DNA, 25 bp, Mus musculus
gaccatggtcatcggcaactatcga

SEQ ID NO: 289659 - DNA, 25 bp, Mus musculus
gaccatggtgagcccattggccggg

SEQ ID NO: 289660 - DNA, 25 bp, Mus musculus
gaccatgtgattctggaggagcaaa

SEQ ID NO: 289661 - DNA, 25 bp, Mus musculus
gaccattaaagtgtggagcacgagc

SEQ ID NO: 289662 - DNA, 25 bp, Mus musculus
gaccattacagaagctgaaccggaa

SEQ ID NO: 289663 - DNA, 25 bp, Mus musculus
gaccattactgggggatgcagagag

SEQ ID NO: 289664 - DNA, 25 bp, Mus musculus
gaccattagtatagcaagaagccag

SEQ ID NO: 289665 - DNA, 25 bp, Mus musculus
gaccattagtcagagaattgtaagt

SEQ ID NO: 289666 - DNA, 25 bp, Mus musculus
gaccattctcaagaggtctgaattt

SEQ ID NO: 289667 - DNA, 25 bp, Mus musculus
gaccattgaagatgatgactattct

SEQ ID NO: 289668 - DNA, 25 bp, Mus musculus
gaccattgagactgacaatttattt

SEQ ID NO: 289669 - DNA, 25 bp, Mus musculus
gaccattgagactgccaaacaagaa

SEQ ID NO: 289670 - DNA, 25 bp, Mus musculus
gaccattgagcaagaactatgtcat

SEQ ID NO: 289671 - DNA, 25 bp, Mus musculus
gaccattgaggttatctggctgttt

SEQ ID NO: 289672 - DNA, 25 bp, Mus musculus
gaccattgccagaatggaccatctg

SEQ ID NO: 289673 - DNA, 25 bp, Mus musculus
gaccattgccgcaggaacaccccaa

SEQ ID NO: 289674 - DNA, 25 bp, Mus musculus
gaccattgccgcaggggtgatgttt

SEQ ID NO: 289675 - DNA, 25 bp, Mus musculus
gaccattggagggttcccagtggga

SEQ ID NO: 289676 - DNA, 25 bp, Mus musculus
gaccatttagatctgaacaatgccc

SEQ ID NO: 289677 - DNA, 25 bp, Mus musculus
gacccaaaagcagaatacagacatc

SEQ ID NO: 289678 - DNA, 25 bp, Mus musculus
gacccaaaagtttgaggatagccag

SEQ ID NO: 289679 - DNA, 25 bp, Mus musculus
gacccaaaccagggtgtggacattg

SEQ ID NO: 289680 - DNA, 25 bp, Mus musculus
gacccaaacggatgaaaaccgtcaa

SEQ ID NO: 289681 - DNA, 25 bp, Mus musculus
gacccaaaggccctgcctgcctgac

SEQ ID NO: 289682 - DNA, 25 bp, Mus musculus
gacccaaagtccaggatgttgtacc

SEQ ID NO: 289683 - DNA, 25 bp, Mus musculus
gacccaacgttcagaaccccaaatc

SEQ ID NO: 289684 - DNA, 25 bp, Mus musculus
gacccaactgtcgacgcataattaa

SEQ ID NO: 289685 - DNA, 25 bp, Mus musculus
gacccaagacaagttcgagaaatgg

SEQ ID NO: 289686 - DNA, 25 bp, Mus musculus
gacccaaggaatgattcccgttgcg

SEQ ID NO: 289687 - DNA, 25 bp, Mus musculus
gacccaagttgcatttaaatattag

SEQ ID NO: 289688 - DNA, 25 bp, Mus musculus
gacccaagttgctggacaaatttgc

SEQ ID NO: 289689 - DNA, 25 bp, Mus musculus
gacccaatacagtgttatttctgct

SEQ ID NO: 289690 - DNA, 25 bp, Mus musculus
gacccacaccacgactactgtgaag

SEQ ID NO: 289691 - DNA, 25 bp, Mus musculus
gacccacacctcacaaattgaagtg

SEQ ID NO: 289692 - DNA, 25 bp, Mus musculus
gacccacacgtcaaactacaactcc

SEQ ID NO: 289693 - DNA, 25 bp, Mus musculus
gacccacagaacgagagcgccatct

SEQ ID NO: 289694 - DNA, 25 bp, Mus musculus
gacccacagagaggccgtgagacca

SEQ ID NO: 289695 - DNA, 25 bp, Mus musculus
gacccacagagggagcatgacttcg

SEQ ID NO: 289696 - DNA, 25 bp, Mus musculus
gacccacagggccctgtgtgctgca

SEQ ID NO: 289697 - DNA, 25 bp, Mus musculus
gacccacagttcagaaactgtgaag

SEQ ID NO: 289698 - DNA, 25 bp, Mus musculus
gacccacatggaatggacctgtcag

SEQ ID NO: 289699 - DNA, 25 bp, Mus musculus
gacccacatggttactgggaagtga

SEQ ID NO: 289700 - DNA, 25 bp, Mus musculus
gacccaccaccccaggcccagagtc

SEQ ID NO: 289701 - DNA, 25 bp, Mus musculus
gacccaccacgggagccaggtatgc

SEQ ID NO: 289702 - DNA, 25 bp, Mus musculus
gacccaccaggtgccagcctcacaa

SEQ ID NO: 289703 - DNA, 25 bp, Mus musculus
gacccaccaggtgtgccaggggaga

SEQ ID NO: 289704 - DNA, 25 bp, Mus musculus
gacccaccgccaagagaataaagac

SEQ ID NO: 289705 - DNA, 25 bp, Mus musculus
gacccaccgccaagatggattcatg

SEQ ID NO: 289706 - DNA, 25 bp, Mus musculus
gacccacctgcaagattctggtgct

SEQ ID NO: 289707 - DNA, 25 bp, Mus musculus
gacccacctgcaagtctacagagag

SEQ ID NO: 289708 - DNA, 25 bp, Mus musculus
gacccacgcaaactacagctgaatc

SEQ ID NO: 289709 - DNA, 25 bp, Mus musculus
gacccagaaagcatctgcatctcta

SEQ ID NO: 289710 - DNA, 25 bp, Mus musculus
gacccagaagacacgaaggcaacca

SEQ ID NO: 289711 - DNA, 25 bp, Mus musculus
gacccagaagacacggatactgaga

SEQ ID NO: 289712 - DNA, 25 bp, Mus musculus
gacccagaagatgatttttgatcct

SEQ ID NO: 289713 - DNA, 25 bp, Mus musculus
gacccagaaggattgccacaaggct

SEQ ID NO: 289714 - DNA, 25 bp, Mus musculus
gacccagaaggtttgaggctctgtg

SEQ ID NO: 289715 - DNA, 25 bp, Mus musculus
gacccagaattaggtatcgaagtga

SEQ ID NO: 289716 - DNA, 25 bp, Mus musculus
gacccagacaggtgcgtggtccaac

SEQ ID NO: 289717 - DNA, 25 bp, Mus musculus
gacccagacatgctgctcatcggga

SEQ ID NO: 289718 - DNA, 25 bp, Mus musculus
gacccagagaacaggctgtgaaaac

SEQ ID NO: 289719 - DNA, 25 bp, Mus musculus
gacccagagcttagttcacaagcca

SEQ ID NO: 289720 - DNA, 25 bp, Mus musculus
gacccagaggagaaggaggagcagg

SEQ ID NO: 289721 - DNA, 25 bp, Mus musculus
gacccagaggagattgagaaggagg

SEQ ID NO: 289722 - DNA, 25 bp, Mus musculus
gacccagcagaataactgccatgga

SEQ ID NO: 289723 - DNA, 25 bp, Mus musculus
gacccagcatacgggcaccttgttg

SEQ ID NO: 289724 - DNA, 25 bp, Mus musculus
gacccagccagccccggaaagccag

SEQ ID NO: 289725 - DNA, 25 bp, Mus musculus
gacccagccagggttgtcgccctgg

SEQ ID NO: 289726 - DNA, 25 bp, Mus musculus
gacccagcccagaacaagcctgcca

SEQ ID NO: 289727 - DNA, 25 bp, Mus musculus
gacccagcccaggtgaggaatttta

SEQ ID NO: 289728 - DNA, 25 bp, Mus musculus
gacccagcccaggttccgagtccga

SEQ ID NO: 289729 - DNA, 25 bp, Mus musculus
gacccagctggagaaagattccagt

SEQ ID NO: 289730 - DNA, 25 bp, Mus musculus
gacccagctggaggtcacctcagca

SEQ ID NO: 289731 - DNA, 25 bp, Mus musculus
gacccaggacagacagctgcagcac

SEQ ID NO: 289732 - DNA, 25 bp, Mus musculus
gacccaggacgagggcttcatcact

SEQ ID NO: 289733 - DNA, 25 bp, Mus musculus
gacccaggagatgaagtgataatta

SEQ ID NO: 289734 - DNA, 25 bp, Mus musculus
gacccaggagggtgtctccaaacaa

SEQ ID NO: 289735 - DNA, 25 bp, Mus musculus
gacccaggcataggtcacctccaag

SEQ ID NO: 289736 - DNA, 25 bp, Mus musculus
gacccaggccagatgaacgatggac

SEQ ID NO: 289737 - DNA, 25 bp, Mus musculus
gacccaggcgatcaaccgagaaagc

SEQ ID NO: 289738 - DNA, 25 bp, Mus musculus
gacccaggctaggttatcaatgctg

SEQ ID NO: 289739 - DNA, 25 bp, Mus musculus
gacccaggctcgggggctgcccctg

SEQ ID NO: 289740 - DNA, 25 bp, Mus musculus
gacccaggctcggggggaaagagga

SEQ ID NO: 289741 - DNA, 25 bp, Mus musculus
gacccaggctctgtgatcgtggcct

SEQ ID NO: 289742 - DNA, 25 bp, Mus musculus
gacccagggaaggtgctgtgggacg

SEQ ID NO: 289743 - DNA, 25 bp, Mus musculus
gacccagggccggagataatagaat

SEQ ID NO: 289744 - DNA, 25 bp, Mus musculus
gacccagtctaaaatcgatgtccat

SEQ ID NO: 289745 - DNA, 25 bp, Mus musculus
gacccagtctaacacagaggagatt

SEQ ID NO: 289746 - DNA, 25 bp, Mus musculus
gacccagtgacgggtgagcctgcaa

SEQ ID NO: 289747 - DNA, 25 bp, Mus musculus
gacccagttgatggtcacccttcct

SEQ ID NO: 289748 - DNA, 25 bp, Mus musculus
gacccagttgatggttggcagaacg

SEQ ID NO: 289749 - DNA, 25 bp, Mus musculus
gacccatcagaagtcctaggtactg

SEQ ID NO: 289750 - DNA, 25 bp, Mus musculus
gacccatcagctatgtggtggtgat

SEQ ID NO: 289751 - DNA, 25 bp, Mus musculus
gacccatctacagaggctgatcccc

SEQ ID NO: 289752 - DNA, 25 bp, Mus musculus
gacccatctttcgactaagatgctt

SEQ ID NO: 289753 - DNA, 25 bp, Mus musculus
gacccatgaagactcttgggaggat

SEQ ID NO: 289754 - DNA, 25 bp, Mus musculus
gacccatgaagatcccaattatctc

SEQ ID NO: 289755 - DNA, 25 bp, Mus musculus
gacccatgcaaacagaacatgttgg

SEQ ID NO: 289756 - DNA, 25 bp, Mus musculus
gacccatggatggagggatcgctta

SEQ ID NO: 289757 - DNA, 25 bp, Mus musculus
gacccatggtcctagtcaagagaat

SEQ ID NO: 289758 - DNA, 25 bp, Mus musculus
gacccattctgtgctgcctgccagc

SEQ ID NO: 289759 - DNA, 25 bp, Mus musculus
gacccattctgtggctttcactttt

SEQ ID NO: 289760 - DNA, 25 bp, Mus musculus
gacccattgaccagcaggaatccag

SEQ ID NO: 289761 - DNA, 25 bp, Mus musculus
gacccattgagaagagatgaggctg

SEQ ID NO: 289762 - DNA, 25 bp, Mus musculus
gaccccaaaccaccctgctgagaca

SEQ ID NO: 289763 - DNA, 25 bp, Mus musculus
gaccccaaaggagccaagtcagaac

SEQ ID NO: 289764 - DNA, 25 bp, Mus musculus
gaccccaaaggccatgaagaagatg

SEQ ID NO: 289765 - DNA, 25 bp, Mus musculus
gaccccaaagtggttgatcggttgc

SEQ ID NO: 289766 - DNA, 25 bp, Mus musculus
gaccccaaatgattataagcacacc

SEQ ID NO: 289767 - DNA, 25 bp, Mus musculus
gaccccaacatgcggacctcatgcc

SEQ ID NO: 289768 - DNA, 25 bp, Mus musculus
gaccccaacatgcgggaattcatcc

SEQ ID NO: 289769 - DNA, 25 bp, Mus musculus
gaccccaagagaagggagtggatca

SEQ ID NO: 289770 - DNA, 25 bp, Mus musculus
gaccccaagagagacaacaatcctc

SEQ ID NO: 289771 - DNA, 25 bp, Mus musculus
gaccccacaatcgaagatgcttata

SEQ ID NO: 289772 - DNA, 25 bp, Mus musculus
gaccccacaatcggcagagttcacg

SEQ ID NO: 289773 - DNA, 25 bp, Mus musculus
gaccccacagtcagccttttatgtc

SEQ ID NO: 289774 - DNA, 25 bp, Mus musculus
gaccccacagtgcaagaatccctgg

SEQ ID NO: 289775 - DNA, 25 bp, Mus musculus
gaccccaccccgctggcaaatctca

SEQ ID NO: 289776 - DNA, 25 bp, Mus musculus
gaccccaccccgctggctgccttca

SEQ ID NO: 289777 - DNA, 25 bp, Mus musculus
gaccccacgtgatggagtatcccgg

SEQ ID NO: 289778 - DNA, 25 bp, Mus musculus
gaccccacgtgctcctggcccagaa

SEQ ID NO: 289779 - DNA, 25 bp, Mus musculus
gaccccactgaggcttctcaaaccg

SEQ ID NO: 289780 - DNA, 25 bp, Mus musculus
gaccccactgcactgctgttaatgc

SEQ ID NO: 289781 - DNA, 25 bp, Mus musculus
gaccccagaacaagagctgaggctg

SEQ ID NO: 289782 - DNA, 25 bp, Mus musculus
gaccccagaagtaagattggcctgt

SEQ ID NO: 289783 - DNA, 25 bp, Mus musculus
gaccccagacctgcagctaaagcac

SEQ ID NO: 289784 - DNA, 25 bp, Mus musculus
gaccccagatgcaccatgggcttgg

SEQ ID NO: 289785 - DNA, 25 bp, Mus musculus
gaccccagcaaaggctaattctggc

SEQ ID NO: 289786 - DNA, 25 bp, Mus musculus
gaccccagcaagacattcaccccca

SEQ ID NO: 289787 - DNA, 25 bp, Mus musculus
gaccccagccaggcccccagcaaag

SEQ ID NO: 289788 - DNA, 25 bp, Mus musculus
gaccccagccaggtcagtggctatc

SEQ ID NO: 289789 - DNA, 25 bp, Mus musculus
gaccccagcctccgcatgagcatca

SEQ ID NO: 289790 - DNA, 25 bp, Mus musculus
gaccccaggaagagcctccacctct

SEQ ID NO: 289791 - DNA, 25 bp, Mus musculus
gaccccaggaagaggacatgacaga

SEQ ID NO: 289792 - DNA, 25 bp, Mus musculus
gaccccagtcagggtctggaggtga

SEQ ID NO: 289793 - DNA, 25 bp, Mus musculus
gaccccagtggtctctctggacttt

SEQ ID NO: 289794 - DNA, 25 bp, Mus musculus
gaccccatcagacggaactggtgtc

SEQ ID NO: 289795 - DNA, 25 bp, Mus musculus
gaccccatcagacggtatcgagtgg

SEQ ID NO: 289796 - DNA, 25 bp, Mus musculus
gaccccatcatctgcactgctctga

SEQ ID NO: 289797 - DNA, 25 bp, Mus musculus
gaccccatcttcaaggtgttcgacg

SEQ ID NO: 289798 - DNA, 25 bp, Mus musculus
gaccccatgaaggtacgggtggttc

SEQ ID NO: 289799 - DNA, 25 bp, Mus musculus
gaccccatgaagtgtttggtgtaca

SEQ ID NO: 289800 - DNA, 25 bp, Mus musculus
gaccccatgcagaccagactctgag

SEQ ID NO: 289801 - DNA, 25 bp, Mus musculus
gaccccatgcaggaatctgatgctt

SEQ ID NO: 289802 - DNA, 25 bp, Mus musculus
gaccccatgcaggtttatggtgtgc

SEQ ID NO: 289803 - DNA, 25 bp, Mus musculus
gaccccatgtggccacagtacacga

SEQ ID NO: 289804 - DNA, 25 bp, Mus musculus
gaccccattgagctcatgtttgctt

SEQ ID NO: 289805 - DNA, 25 bp, Mus musculus
gaccccattgagctggtggttttcc

SEQ ID NO: 289806 - DNA, 25 bp, Mus musculus
gacccccaagaggccattaactgtc

SEQ ID NO: 289807 - DNA, 25 bp, Mus musculus
gacccccaaggccatcgcccactat

SEQ ID NO: 289808 - DNA, 25 bp, Mus musculus
gacccccaatgacaggttcattttg

SEQ ID NO: 289809 - DNA, 25 bp, Mus musculus
gacccccaccaggagagaaaggaca

SEQ ID NO: 289810 - DNA, 25 bp, Mus musculus
gacccccacgcctggcctctgcctt

SEQ ID NO: 289811 - DNA, 25 bp, Mus musculus
gacccccacgtgattccttagaaac

SEQ ID NO: 289812 - DNA, 25 bp, Mus musculus
gacccccacgtggaagaaaggtcag

SEQ ID NO: 289813 - DNA, 25 bp, Mus musculus
gacccccagcagtctaaggtggtaa

SEQ ID NO: 289814 - DNA, 25 bp, Mus musculus
gacccccaggcccaggcgtgctggt

SEQ ID NO: 289815 - DNA, 25 bp, Mus musculus
gacccccatagtactttttgcatag

SEQ ID NO: 289816 - DNA, 25 bp, Mus musculus
gacccccccctccaactggcttaat

SEQ ID NO: 289817 - DNA, 25 bp, Mus musculus
gacccccgagaaaccagctcttcgg

SEQ ID NO: 289818 - DNA, 25 bp, Mus musculus
gacccccgaggtgattcatggcagg

SEQ ID NO: 289819 - DNA, 25 bp, Mus musculus
gacccccgagtgtccaggttatgga

SEQ ID NO: 289820 - DNA, 25 bp, Mus musculus
gacccccgctgcaggctttgctttc

SEQ ID NO: 289821 - DNA, 25 bp, Mus musculus
gacccccgctggtaagattgagaaa

SEQ ID NO: 289822 - DNA, 25 bp, Mus musculus
gacccccgctggtctcagctatcca

SEQ ID NO: 289823 - DNA, 25 bp, Mus musculus
gacccccgctgttggagacaggagc

SEQ ID NO: 289824 - DNA, 25 bp, Mus musculus
gacccccggaagccgaactgctttg

SEQ ID NO: 289825 - DNA, 25 bp, Mus musculus
gaccccctagactggcttaagatac

SEQ ID NO: 289826 - DNA, 25 bp, Mus musculus
gaccccctggcaggacactactgga

SEQ ID NO: 289827 - DNA, 25 bp, Mus musculus
gacccccttgtgaacgaggctgctg

SEQ ID NO: 289828 - DNA, 25 bp, Mus musculus
gaccccctttcgccacagcccaact

SEQ ID NO: 289829 - DNA, 25 bp, Mus musculus
gaccccgaagcagaggatgaaggac

SEQ ID NO: 289830 - DNA, 25 bp, Mus musculus
gaccccgaagcttgatggtgtgaag

SEQ ID NO: 289831 - DNA, 25 bp, Mus musculus
gaccccgaagttgatgaaacatatg

SEQ ID NO: 289832 - DNA, 25 bp, Mus musculus
gaccccgaattcctcctccaccgtc

SEQ ID NO: 289833 - DNA, 25 bp, Mus musculus
gaccccgagcaggatggtgaggatt

SEQ ID NO: 289834 - DNA, 25 bp, Mus musculus
gaccccgcacagcaggttctccaca

SEQ ID NO: 289835 - DNA, 25 bp, Mus musculus
gaccccgcagctcttggcaagtatg

SEQ ID NO: 289836 - DNA, 25 bp, Mus musculus
gaccccgcaggagacatatgaaaac

SEQ ID NO: 289837 - DNA, 25 bp, Mus musculus
gaccccgcgggtccttcacacaccc

SEQ ID NO: 289838 - DNA, 25 bp, Mus musculus
gaccccgcgtctcggaagactcttc

SEQ ID NO: 289839 - DNA, 25 bp, Mus musculus
gaccccgctcaggccccgcgatcag

SEQ ID NO: 289840 - DNA, 25 bp, Mus musculus
gaccccgctcaggtttccaggcttc

SEQ ID NO: 289841 - DNA, 25 bp, Mus musculus
gaccccggcaggtcagaagacatgt

SEQ ID NO: 289842 - DNA, 25 bp, Mus musculus
gaccccgggcaggtttagacacgtg

SEQ ID NO: 289843 - DNA, 25 bp, Mus musculus
gaccccgggttccagtgacagcaga

SEQ ID NO: 289844 - DNA, 25 bp, Mus musculus
gaccccgtggatggtgtggtcctgg

SEQ ID NO: 289845 - DNA, 25 bp, Mus musculus
gaccccgtggtctacgtgacactga

SEQ ID NO: 289846 - DNA, 25 bp, Mus musculus
gacccctacagccagggctgatgaa

SEQ ID NO: 289847 - DNA, 25 bp, Mus musculus
gacccctacagccaggtctgtgctg

SEQ ID NO: 289848 - DNA, 25 bp, Mus musculus
gacccctatgaggagctcctagtta

SEQ ID NO: 289849 - DNA, 25 bp, Mus musculus
gacccctctataaagcattgaggcc

SEQ ID NO: 289850 - DNA, 25 bp, Mus musculus
gacccctctataaagtctttcctgt

SEQ ID NO: 289851 - DNA, 25 bp, Mus musculus
gacccctgaaggacatagcattgtt

SEQ ID NO: 289852 - DNA, 25 bp, Mus musculus
gacccctgaaggttacagtctctag

SEQ ID NO: 289853 - DNA, 25 bp, Mus musculus
gacccctgcaggaagtggccagatg

SEQ ID NO: 289854 - DNA, 25 bp, Mus musculus
gacccctgccacagccccggccacc

SEQ ID NO: 289855 - DNA, 25 bp, Mus musculus
gacccctgcgaggcggtgctggtgg

SEQ ID NO: 289856 - DNA, 25 bp, Mus musculus
gacccctgcgaggggacatgcttcg

SEQ ID NO: 289857 - DNA, 25 bp, Mus musculus
gacccctggaggaaactctgatgcc

SEQ ID NO: 289858 - DNA, 25 bp, Mus musculus
gacccctggaggtggagacagaaaa

SEQ ID NO: 289859 - DNA, 25 bp, Mus musculus
gacccctgtgcgctgctcccgccag

SEQ ID NO: 289860 - DNA, 25 bp, Mus musculus
gaccccttcaaaggtgatcctttcc

SEQ ID NO: 289861 - DNA, 25 bp, Mus musculus
gaccccttccaaggtgatcctttcc

SEQ ID NO: 289862 - DNA, 25 bp, Mus musculus
gaccccttcttcgcagaatacaaac

SEQ ID NO: 289863 - DNA, 25 bp, Mus musculus
gaccccttcttcgctgattcttttc

SEQ ID NO: 289864 - DNA, 25 bp, Mus musculus
gaccccttggaagaacttgcaaaag

SEQ ID NO: 289865 - DNA, 25 bp, Mus musculus
gaccccttggaggagaggatgctta

SEQ ID NO: 289866 - DNA, 25 bp, Mus musculus
gaccccttgtatccagacttcagta

SEQ ID NO: 289867 - DNA, 25 bp, Mus musculus
gacccctttaggtgttccgaatgcc

SEQ ID NO: 289868 - DNA, 25 bp, Mus musculus
gacccgacccaaggcatgcgccaag

SEQ ID NO: 289869 - DNA, 25 bp, Mus musculus
gacccgatagcctcggccctgcgaa

SEQ ID NO: 289870 - DNA, 25 bp, Mus musculus
gacccgatgtgcgcattaaagagga

SEQ ID NO: 289871 - DNA, 25 bp, Mus musculus
gacccgatgtggctcttaaggactc

SEQ ID NO: 289872 - DNA, 25 bp, Mus musculus
gacccgcaaggttaataacttgaat

SEQ ID NO: 289873 - DNA, 25 bp, Mus musculus
gacccgccaggacaatggattttcc

SEQ ID NO: 289874 - DNA, 25 bp, Mus musculus
gacccgccgacagccaccatgcggc

SEQ ID NO: 289875 - DNA, 25 bp, Mus musculus
gacccgcgaggagttggcatccatt

SEQ ID NO: 289876 - DNA, 25 bp, Mus musculus
gacccgcgaggcaagcagtctccct

SEQ ID NO: 289877 - DNA, 25 bp, Mus musculus
gacccgcgcggcccgcgcagccgcc

SEQ ID NO: 289878 - DNA, 25 bp, Mus musculus
gacccgcgcgggcccacactcgctg

SEQ ID NO: 289879 - DNA, 25 bp, Mus musculus
gacccgctcagatcttgacagttgc

SEQ ID NO: 289880 - DNA, 25 bp, Mus musculus
gacccgctcagggaaacagatcttg

SEQ ID NO: 289881 - DNA, 25 bp, Mus musculus
gacccgctgtctgggaagagcatgg

SEQ ID NO: 289882 - DNA, 25 bp, Mus musculus
gacccggaaaagcatgccttggact

SEQ ID NO: 289883 - DNA, 25 bp, Mus musculus
gacccggaggagagtccaccactgc

SEQ ID NO: 289884 - DNA, 25 bp, Mus musculus
gacccggagggttgctatcggctgg

SEQ ID NO: 289885 - DNA, 25 bp, Mus musculus
gacccggccatcctacctgcctatt

SEQ ID NO: 289886 - DNA, 25 bp, Mus musculus
gacccggccatcgttgtggagctga

SEQ ID NO: 289887 - DNA, 25 bp, Mus musculus
gacccggccccagcatctgggtggt

SEQ ID NO: 289888 - DNA, 25 bp, Mus musculus
gacccgggaccgggagctgctgcag

SEQ ID NO: 289889 - DNA, 25 bp, Mus musculus
gacccggttcccgggctttgatgac

SEQ ID NO: 289890 - DNA, 25 bp, Mus musculus
gacccgtaagaccaagcgcccagcc

SEQ ID NO: 289891 - DNA, 25 bp, Mus musculus
gacccgtatatgatggagagggata

SEQ ID NO: 289892 - DNA, 25 bp, Mus musculus
gacccgtatatgatgggcaggatag

SEQ ID NO: 289893 - DNA, 25 bp, Mus musculus
gacccgtatatgatgggttttaaag

SEQ ID NO: 289894 - DNA, 25 bp, Mus musculus
gacccgtcagaagccactccgtgta

SEQ ID NO: 289895 - DNA, 25 bp, Mus musculus
gacccgtctccgccggcgctggaga

SEQ ID NO: 289896 - DNA, 25 bp, Mus musculus
gacccgtgtgagaaagtcagctctc

SEQ ID NO: 289897 - DNA, 25 bp, Mus musculus
gacccgtgtgaggctgaaaagaccc

SEQ ID NO: 289898 - DNA, 25 bp, Mus musculus
gacccgttgatgtgacccggtttgg

SEQ ID NO: 289899 - DNA, 25 bp, Mus musculus
gaccctaacagagtacacacgaagg

SEQ ID NO: 289900 - DNA, 25 bp, Mus musculus
gaccctaacagtggggagccagctc

SEQ ID NO: 289901 - DNA, 25 bp, Mus musculus
gaccctaagtctccccatgccctac

SEQ ID NO: 289902 - DNA, 25 bp, Mus musculus
gaccctacatggcttccttcccagt

SEQ ID NO: 289903 - DNA, 25 bp, Mus musculus
gaccctacgatagaggactcctaca

SEQ ID NO: 289904 - DNA, 25 bp, Mus musculus
gaccctacgatagagttgttggagt

SEQ ID NO: 289905 - DNA, 25 bp, Mus musculus
gaccctagcttaagtatacctggcc

SEQ ID NO: 289906 - DNA, 25 bp, Mus musculus
gaccctaggccagataaggaattgg

SEQ ID NO: 289907 - DNA, 25 bp, Mus musculus
gaccctaggtcagagtcttgtccag

SEQ ID NO: 289908 - DNA, 25 bp, Mus musculus
gaccctatgaagttgaaaacacagc

SEQ ID NO: 289909 - DNA, 25 bp, Mus musculus
gaccctatggtgcagtgcatcattg

SEQ ID NO: 289910 - DNA, 25 bp, Mus musculus
gaccctatgtcagggttcggagcga

SEQ ID NO: 289911 - DNA, 25 bp, Mus musculus
gaccctcagatgcaggaacccagag

SEQ ID NO: 289912 - DNA, 25 bp, Mus musculus
gaccctcagcaaagacaagattgag

SEQ ID NO: 289913 - DNA, 25 bp, Mus musculus
gaccctcatatagaaaaatactgaa

SEQ ID NO: 289914 - DNA, 25 bp, Mus musculus
gaccctcatccagcatttccaagct

SEQ ID NO: 289915 - DNA, 25 bp, Mus musculus
gaccctccaaagaatcataacggtt

SEQ ID NO: 289916 - DNA, 25 bp, Mus musculus
gaccctccaaaggtcctgcttagga

SEQ ID NO: 289917 - DNA, 25 bp, Mus musculus
gaccctccaggtagtccaggggcag

SEQ ID NO: 289918 - DNA, 25 bp, Mus musculus
gaccctcccagagcctccagagctt

SEQ ID NO: 289919 - DNA, 25 bp, Mus musculus
gaccctccccacagagcgcacgcga

SEQ ID NO: 289920 - DNA, 25 bp, Mus musculus
gaccctccctccaactctacaccct

SEQ ID NO: 289921 - DNA, 25 bp, Mus musculus
gaccctccgaccaggagtcaaactg

SEQ ID NO: 289922 - DNA, 25 bp, Mus musculus
gaccctcgaccgtttccaggataca

SEQ ID NO: 289923 - DNA, 25 bp, Mus musculus
gaccctcgacgccttattcaggatg

SEQ ID NO: 289924 - DNA, 25 bp, Mus musculus
gaccctcggctcacgcgccctcccg

SEQ ID NO: 289925 - DNA, 25 bp, Mus musculus
gaccctcgtgagagctgcttcagct

SEQ ID NO: 289926 - DNA, 25 bp, Mus musculus
gaccctcgtgagagggtttctctgt

SEQ ID NO: 289927 - DNA, 25 bp, Mus musculus
gaccctctaaagacaagattgagga

SEQ ID NO: 289928 - DNA, 25 bp, Mus musculus
gaccctctaaagacatcgcctggtg

SEQ ID NO: 289929 - DNA, 25 bp, Mus musculus
gaccctctaaggatatgctgtcatt

SEQ ID NO: 289930 - DNA, 25 bp, Mus musculus
gaccctctctctaccctcctgctga

SEQ ID NO: 289931 - DNA, 25 bp, Mus musculus
gaccctctctggcagaatccatgcg

SEQ ID NO: 289932 - DNA, 25 bp, Mus musculus
gaccctctctggcagcgaaattgga

SEQ ID NO: 289933 - DNA, 25 bp, Mus musculus
gaccctctgaaactgtgccgatccc

SEQ ID NO: 289934 - DNA, 25 bp, Mus musculus
gaccctctgaggggcaccatgtact

SEQ ID NO: 289935 - DNA, 25 bp, Mus musculus
gaccctctgctgaaggtgtccatca

SEQ ID NO: 289936 - DNA, 25 bp, Mus musculus
gaccctctgtgggtgaacgtgggtc

SEQ ID NO: 289937 - DNA, 25 bp, Mus musculus
gaccctcttcggctacagcaagtgg

SEQ ID NO: 289938 - DNA, 25 bp, Mus musculus
gaccctcttctaccactgaggggtt

SEQ ID NO: 289939 - DNA, 25 bp, Mus musculus
gaccctcttcttcagatacatgtct

SEQ ID NO: 289940 - DNA, 25 bp, Mus musculus
gaccctgaaaaatcgggttctgcct

SEQ ID NO: 289941 - DNA, 25 bp, Mus musculus
gaccctgaaactcaggtggtgctga

SEQ ID NO: 289942 - DNA, 25 bp, Mus musculus
gaccctgaactcaacatggcaaggc

SEQ ID NO: 289943 - DNA, 25 bp, Mus musculus
gaccctgaactcaagttcacgcaaa

SEQ ID NO: 289944 - DNA, 25 bp, Mus musculus
gaccctgaagagagcagataagatt

SEQ ID NO: 289945 - DNA, 25 bp, Mus musculus
gaccctgaagagatgccacctcggc

SEQ ID NO: 289946 - DNA, 25 bp, Mus musculus
gaccctgaagggacctttgacgcgg

SEQ ID NO: 289947 - DNA, 25 bp, Mus musculus
gaccctgaaggtggacttgtttgtc

SEQ ID NO: 289948 - DNA, 25 bp, Mus musculus
gaccctgacagagtcatgtggctgg

SEQ ID NO: 289949 - DNA, 25 bp, Mus musculus
gaccctgacagcaagaccatcaccc

SEQ ID NO: 289950 - DNA, 25 bp, Mus musculus
gaccctgacccagccccaccattct

SEQ ID NO: 289951 - DNA, 25 bp, Mus musculus
gaccctgacccagcttctcgtgtag

SEQ ID NO: 289952 - DNA, 25 bp, Mus musculus
gaccctgacccaggaacacagtgtg

SEQ ID NO: 289953 - DNA, 25 bp, Mus musculus
gaccctgacccaggtcaacagctga

SEQ ID NO: 289954 - DNA, 25 bp, Mus musculus
gaccctgactttcatgatgccccca

SEQ ID NO: 289955 - DNA, 25 bp, Mus musculus
gaccctgagacccaggtggtactga

SEQ ID NO: 289956 - DNA, 25 bp, Mus musculus
gaccctgagcaggctcctgctgaag

SEQ ID NO: 289957 - DNA, 25 bp, Mus musculus
gaccctgagctggccaaaaggccag

SEQ ID NO: 289958 - DNA, 25 bp, Mus musculus
gaccctgagctggctctctgacaaa

SEQ ID NO: 289959 - DNA, 25 bp, Mus musculus
gaccctgaggaaatggggattaagg

SEQ ID NO: 289960 - DNA, 25 bp, Mus musculus
gaccctgagggagcgcttcagcgag

SEQ ID NO: 289961 - DNA, 25 bp, Mus musculus
gaccctgatccagatctggccgccc

SEQ ID NO: 289962 - DNA, 25 bp, Mus musculus
gaccctgatctgcggcggtcaggga

SEQ ID NO: 289963 - DNA, 25 bp, Mus musculus
gaccctgatgctgaggcctgacctg

SEQ ID NO: 289964 - DNA, 25 bp, Mus musculus
gaccctgcaagagttctttttgcag

SEQ ID NO: 289965 - DNA, 25 bp, Mus musculus
gaccctgcaagatggagggggcaga

SEQ ID NO: 289966 - DNA, 25 bp, Mus musculus
gaccctgcacggctgtggacttaag

SEQ ID NO: 289967 - DNA, 25 bp, Mus musculus
gaccctgcagggagagagaatcaat

SEQ ID NO: 289968 - DNA, 25 bp, Mus musculus
gaccctgcatctgagtgccgtactg

SEQ ID NO: 289969 - DNA, 25 bp, Mus musculus
gaccctgccagggatggcgcggccg

SEQ ID NO: 289970 - DNA, 25 bp, Mus musculus
gaccctgcctccagcactgggaagc

SEQ ID NO: 289971 - DNA, 25 bp, Mus musculus
gaccctgctcctgggcttgtggaga

SEQ ID NO: 289972 - DNA, 25 bp, Mus musculus
gaccctgctcctggtggcatcttta

SEQ ID NO: 289973 - DNA, 25 bp, Mus musculus
gaccctgctcctggtttctgaactt

SEQ ID NO: 289974 - DNA, 25 bp, Mus musculus
gaccctgctctgacgtatgacttct

SEQ ID NO: 289975 - DNA, 25 bp, Mus musculus
gaccctgctgaccctgtacacatac

SEQ ID NO: 289976 - DNA, 25 bp, Mus musculus
gaccctgcttactggtttctctcga

SEQ ID NO: 289977 - DNA, 25 bp, Mus musculus
gaccctgcttactggtttctgtctg

SEQ ID NO: 289978 - DNA, 25 bp, Mus musculus
gaccctgcttgcgaggcaggaaaca

SEQ ID NO: 289979 - DNA, 25 bp, Mus musculus
gaccctgcttgcgagggtgacactt

SEQ ID NO: 289980 - DNA, 25 bp, Mus musculus
gaccctggacaaatgtcccttcact

SEQ ID NO: 289981 - DNA, 25 bp, Mus musculus
gaccctggacaacaagaaggggcga

SEQ ID NO: 289982 - DNA, 25 bp, Mus musculus
gaccctggacaagttaatcgatggc

SEQ ID NO: 289983 - DNA, 25 bp, Mus musculus
gaccctggacaatggtgaacaaccc

SEQ ID NO: 289984 - DNA, 25 bp, Mus musculus
gaccctggagccaccccgctggggt

SEQ ID NO: 289985 - DNA, 25 bp, Mus musculus
gaccctggagggaagggtggtgatg

SEQ ID NO: 289986 - DNA, 25 bp, Mus musculus
gaccctggaggtgagaaagtctggg

SEQ ID NO: 289987 - DNA, 25 bp, Mus musculus
gaccctggatgatgggctaggccat

SEQ ID NO: 289988 - DNA, 25 bp, Mus musculus
gaccctggatgatggtgtgattgcc

SEQ ID NO: 289989 - DNA, 25 bp, Mus musculus
gaccctggcacaaggcaggcgacaa

SEQ ID NO: 289990 - DNA, 25 bp, Mus musculus
gaccctggcacaaggtaacacggaa

SEQ ID NO: 289991 - DNA, 25 bp, Mus musculus
gaccctggcccttagagtaatccat

SEQ ID NO: 289992 - DNA, 25 bp, Mus musculus
gaccctggcctgcctgagggatctg

SEQ ID NO: 289993 - DNA, 25 bp, Mus musculus
gaccctgggaagactaaaatgtcaa

SEQ ID NO: 289994 - DNA, 25 bp, Mus musculus
gaccctggtcaggcagttccagggc

SEQ ID NO: 289995 - DNA, 25 bp, Mus musculus
gaccctggtggcaggatcaagttct

SEQ ID NO: 289996 - DNA, 25 bp, Mus musculus
gaccctggttcctgtctgcagctgt

SEQ ID NO: 289997 - DNA, 25 bp, Mus musculus
gaccctgtacagagagctccaagtc

SEQ ID NO: 289998 - DNA, 25 bp, Mus musculus
gaccctgtacagagccaccttgtct

SEQ ID NO: 289999 - DNA, 25 bp, Mus musculus
gaccctgtctcggtgctcttcaaat

SEQ ID NO: 290000 - DNA, 25 bp, Mus musculus
gaccctgtctcggtgtccttcccgt

SEQ ID NO: 290001 - DNA, 25 bp, Mus musculus
gaccctgtgacgaaagaagaaatta

SEQ ID NO: 290002 - DNA, 25 bp, Mus musculus
gaccctgtgagctcggtcgaggagt

SEQ ID NO: 290003 - DNA, 25 bp, Mus musculus
gaccctgtgtttgtggtcctccact

SEQ ID NO: 290004 - DNA, 25 bp, Mus musculus
gaccctgtgtttgtggtctttgctg

SEQ ID NO: 290005 - DNA, 25 bp, Mus musculus
gacccttaaagatgaccttgcttcc

SEQ ID NO: 290006 - DNA, 25 bp, Mus musculus
gacccttaagggccacaccaaggat

SEQ ID NO: 290007 - DNA, 25 bp, Mus musculus
gacccttcaaccaggtcaggctgtt

SEQ ID NO: 290008 - DNA, 25 bp, Mus musculus
gacccttcagcagatgaatggaaac

SEQ ID NO: 290009 - DNA, 25 bp, Mus musculus
gacccttcctgaaggagcagagagt

SEQ ID NO: 290010 - DNA, 25 bp, Mus musculus
gacccttgaactgaggaacgggcat

SEQ ID NO: 290011 - DNA, 25 bp, Mus musculus
gacccttgccgtatggtgacagctg

SEQ ID NO: 290012 - DNA, 25 bp, Mus musculus
gacccttggcagacagggtcccttg

SEQ ID NO: 290013 - DNA, 25 bp, Mus musculus
gacccttggcaggagctgtgaaatc

SEQ ID NO: 290014 - DNA, 25 bp, Mus musculus
gacccttggcgttcaacaggtggtg

SEQ ID NO: 290015 - DNA, 25 bp, Mus musculus
gacccttgggtcaaggtcgagtatg

SEQ ID NO: 290016 - DNA, 25 bp, Mus musculus
gacccttgttcactgtacctcatca

SEQ ID NO: 290017 - DNA, 25 bp, Mus musculus
gaccctttgcctggctccaagatga

SEQ ID NO: 290018 - DNA, 25 bp, Mus musculus
gaccgaaagcagaggagcaccgggg

SEQ ID NO: 290019 - DNA, 25 bp, Mus musculus
gaccgaagacacaagtagaaggcag

SEQ ID NO: 290020 - DNA, 25 bp, Mus musculus
gaccgaatgagaaaggtttaactga

SEQ ID NO: 290021 - DNA, 25 bp, Mus musculus
gaccgaatgagagactctacaggag

SEQ ID NO: 290022 - DNA, 25 bp, Mus musculus
gaccgaatgagctgccgagtgtttc

SEQ ID NO: 290023 - DNA, 25 bp, Mus musculus
gaccgacctggtcagtcttacttct

SEQ ID NO: 290024 - DNA, 25 bp, Mus musculus
gaccgacgagcccttgctgctcttg

SEQ ID NO: 290025 - DNA, 25 bp, Mus musculus
gaccgactgaagcacggtgcaacag

SEQ ID NO: 290026 - DNA, 25 bp, Mus musculus
gaccgactggaggatgctttgctga

SEQ ID NO: 290027 - DNA, 25 bp, Mus musculus
gaccgacttcacccgaggcaaaggt

SEQ ID NO: 290028 - DNA, 25 bp, Mus musculus
gaccgacttttcagagccactcagc

SEQ ID NO: 290029 - DNA, 25 bp, Mus musculus
gaccgacttttcagggttcagactg

SEQ ID NO: 290030 - DNA, 25 bp, Mus musculus
gaccgagaaggagaagagttagaat

SEQ ID NO: 290031 - DNA, 25 bp, Mus musculus
gaccgagaataagtccaagtttggg

SEQ ID NO: 290032 - DNA, 25 bp, Mus musculus
gaccgagacagctccttccgcttcc

SEQ ID NO: 290033 - DNA, 25 bp, Mus musculus
gaccgagatgcagctgttgccgcac

SEQ ID NO: 290034 - DNA, 25 bp, Mus musculus
gaccgagatggaatgaagaaaagca

SEQ ID NO: 290035 - DNA, 25 bp, Mus musculus
gaccgagcagcgaacagttgaatag

SEQ ID NO: 290036 - DNA, 25 bp, Mus musculus
gaccgaggaccagcgcaacaaaaag

SEQ ID NO: 290037 - DNA, 25 bp, Mus musculus
gaccgaggaggcccagccagcagaa

SEQ ID NO: 290038 - DNA, 25 bp, Mus musculus
gaccgaggccaaaactgggtttcac

SEQ ID NO: 290039 - DNA, 25 bp, Mus musculus
gaccgaggccaaagttcaggacatc

SEQ ID NO: 290040 - DNA, 25 bp, Mus musculus
gaccgagtcaagcaggtctgcggag

SEQ ID NO: 290041 - DNA, 25 bp, Mus musculus
gaccgagtcctcaggccaatgtgct

SEQ ID NO: 290042 - DNA, 25 bp, Mus musculus
gaccgagttccgggtcatgcatcca

SEQ ID NO: 290043 - DNA, 25 bp, Mus musculus
gaccgagttccgggtgctgggtgtg

SEQ ID NO: 290044 - DNA, 25 bp, Mus musculus
gaccgagtttccagagccctgaaga

SEQ ID NO: 290045 - DNA, 25 bp, Mus musculus
gaccgatcacaggtcacttggcatg

SEQ ID NO: 290046 - DNA, 25 bp, Mus musculus
gaccgatgagtcggatgcagaggcc

SEQ ID NO: 290047 - DNA, 25 bp, Mus musculus
gaccgattcccagcttccaccatcc

SEQ ID NO: 290048 - DNA, 25 bp, Mus musculus
gaccgcaacaacgccatctatgaga

SEQ ID NO: 290049 - DNA, 25 bp, Mus musculus
gaccgcaagaaaagtatcaaggagg

SEQ ID NO: 290050 - DNA, 25 bp, Mus musculus
gaccgcacagctgcggatcaccaga

SEQ ID NO: 290051 - DNA, 25 bp, Mus musculus
gaccgcacaggtactgagacagagg

SEQ ID NO: 290052 - DNA, 25 bp, Mus musculus
gaccgcaccaaagtggagcccctgc

SEQ ID NO: 290053 - DNA, 25 bp, Mus musculus
gaccgcagacgggaccttcttttgg

SEQ ID NO: 290054 - DNA, 25 bp, Mus musculus
gaccgcagacgggagctgcaaagtt

SEQ ID NO: 290055 - DNA, 25 bp, Mus musculus
gaccgcagcaccggcgtgttgccca

SEQ ID NO: 290056 - DNA, 25 bp, Mus musculus
gaccgcagcacttcatccaccagat

SEQ ID NO: 290057 - DNA, 25 bp, Mus musculus
gaccgcaggacgcggaaccatgtgc

SEQ ID NO: 290058 - DNA, 25 bp, Mus musculus
gaccgccacgggaagaagcgcacgt

SEQ ID NO: 290059 - DNA, 25 bp, Mus musculus
gaccgcccggtagtgtctctattgc

SEQ ID NO: 290060 - DNA, 25 bp, Mus musculus
gaccgcccggtgttgcttctgctgt

SEQ ID NO: 290061 - DNA, 25 bp, Mus musculus
gaccgccgccaaggctgaagctgac

SEQ ID NO: 290062 - DNA, 25 bp, Mus musculus
gaccgccggagctgttttatgacca

SEQ ID NO: 290063 - DNA, 25 bp, Mus musculus
gaccgcctacacatccaggtggccc

SEQ ID NO: 290064 - DNA, 25 bp, Mus musculus
gaccgcctgagattgtcgcagcaat

SEQ ID NO: 290065 - DNA, 25 bp, Mus musculus
gaccgcctgcaggtgatttccgatt

SEQ ID NO: 290066 - DNA, 25 bp, Mus musculus
gaccgcctggtctacgtgatcattg

SEQ ID NO: 290067 - DNA, 25 bp, Mus musculus
gaccgcgaagaggatgaaccttctt

SEQ ID NO: 290068 - DNA, 25 bp, Mus musculus
gaccgcgaaggtcatctaacttgaa

SEQ ID NO: 290069 - DNA, 25 bp, Mus musculus
gaccgcgctattcaggcctttggag

SEQ ID NO: 290070 - DNA, 25 bp, Mus musculus
gaccgcgctcaaagatccaggtgct

SEQ ID NO: 290071 - DNA, 25 bp, Mus musculus
gaccgcgctcaaaggactgtgtatt

SEQ ID NO: 290072 - DNA, 25 bp, Mus musculus
gaccgcgctcaaaggcaaaggagga

SEQ ID NO: 290073 - DNA, 25 bp, Mus musculus
gaccgcggagacccttccaatctga

SEQ ID NO: 290074 - DNA, 25 bp, Mus musculus
gaccgctacagctcccaagtgccaa

SEQ ID NO: 290075 - DNA, 25 bp, Mus musculus
gaccgctccaagtttgttgaaagtg

SEQ ID NO: 290076 - DNA, 25 bp, Mus musculus
gaccgctccgcgtgagaatcaaata

SEQ ID NO: 290077 - DNA, 25 bp, Mus musculus
gaccgctgaccaaggcgccatggaa

SEQ ID NO: 290078 - DNA, 25 bp, Mus musculus
gaccgctgactcggatcgagcccta

SEQ ID NO: 290079 - DNA, 25 bp, Mus musculus
gaccgctgactcggccaaccaatgg

SEQ ID NO: 290080 - DNA, 25 bp, Mus musculus
gaccgctgactcgggtcattacaaa

SEQ ID NO: 290081 - DNA, 25 bp, Mus musculus
gaccgctgataagaaaaccactgag

SEQ ID NO: 290082 - DNA, 25 bp, Mus musculus
gaccgctgcaccccgtcagtcatat

SEQ ID NO: 290083 - DNA, 25 bp, Mus musculus
gaccgctgcacgccggcatgtgttt

SEQ ID NO: 290084 - DNA, 25 bp, Mus musculus
gaccgctgcacgccgtaatttctaa

SEQ ID NO: 290085 - DNA, 25 bp, Mus musculus
gaccgctgtgacaactgccccctgg

SEQ ID NO: 290086 - DNA, 25 bp, Mus musculus
gaccgcttatagcccaaggaacaga

SEQ ID NO: 290087 - DNA, 25 bp, Mus musculus
gaccgcttataggcttggggcatat

SEQ ID NO: 290088 - DNA, 25 bp, Mus musculus
gaccgcttctccaggagagggaaga

SEQ ID NO: 290089 - DNA, 25 bp, Mus musculus
gaccgcttggccagggttaactttg

SEQ ID NO: 290090 - DNA, 25 bp, Mus musculus
gaccgcttggctctacagagggaag

SEQ ID NO: 290091 - DNA, 25 bp, Mus musculus
gaccggaaagcgtctgcaccagggt

SEQ ID NO: 290092 - DNA, 25 bp, Mus musculus
gaccggaacggatgtatacatctca

SEQ ID NO: 290093 - DNA, 25 bp, Mus musculus
gaccggaaggtcaagtcactggtga

SEQ ID NO: 290094 - DNA, 25 bp, Mus musculus
gaccggaagtgacgagagctgtcgg

SEQ ID NO: 290095 - DNA, 25 bp, Mus musculus
gaccggaagtggcagcatgctaatt

SEQ ID NO: 290096 - DNA, 25 bp, Mus musculus
gaccggacttagcacactcctgggc

SEQ ID NO: 290097 - DNA, 25 bp, Mus musculus
gaccggagagaaggtctaatgcgct

SEQ ID NO: 290098 - DNA, 25 bp, Mus musculus
gaccggagcaagcagctcgaggagg

SEQ ID NO: 290099 - DNA, 25 bp, Mus musculus
gaccggagcaagcagctggaagatg

SEQ ID NO: 290100 - DNA, 25 bp, Mus musculus
gaccggagctgagcatttcagatct

SEQ ID NO: 290101 - DNA, 25 bp, Mus musculus
gaccggatcagctccccatatatac

SEQ ID NO: 290102 - DNA, 25 bp, Mus musculus
gaccggatgctcagcgaggacccgt

SEQ ID NO: 290103 - DNA, 25 bp, Mus musculus
gaccggcacgtgtcggagctccaac

SEQ ID NO: 290104 - DNA, 25 bp, Mus musculus
gaccggcagcaggagaatcctcatt

SEQ ID NO: 290105 - DNA, 25 bp, Mus musculus
gaccggcagcaggagaatgccatct

SEQ ID NO: 290106 - DNA, 25 bp, Mus musculus
gaccggcctctctggaggaaatcca

SEQ ID NO: 290107 - DNA, 25 bp, Mus musculus
gaccggcgcggcaggtaccagctgg

SEQ ID NO: 290108 - DNA, 25 bp, Mus musculus
gaccggcgcggcagtctgcgagtaa

SEQ ID NO: 290109 - DNA, 25 bp, Mus musculus
gaccggcgttgttaggaagatgatc

SEQ ID NO: 290110 - DNA, 25 bp, Mus musculus
gaccggcgttgttaggattatgtac

SEQ ID NO: 290111 - DNA, 25 bp, Mus musculus
gaccggctgaaggcagacacatctg

SEQ ID NO: 290112 - DNA, 25 bp, Mus musculus
gaccggctgaaggcttgtgaaaaag

SEQ ID NO: 290113 - DNA, 25 bp, Mus musculus
gaccggctgaagggcctctggaaat

SEQ ID NO: 290114 - DNA, 25 bp, Mus musculus
gaccggctgacctgcaaatctggtt

SEQ ID NO: 290115 - DNA, 25 bp, Mus musculus
gaccggctgacctggccctctgtcc

SEQ ID NO: 290116 - DNA, 25 bp, Mus musculus
gaccggctgacctgttgaacactct

SEQ ID NO: 290117 - DNA, 25 bp, Mus musculus
gaccggcttctttagctctcctcac

SEQ ID NO: 290118 - DNA, 25 bp, Mus musculus
gaccggcttctttaggacgacagcc

SEQ ID NO: 290119 - DNA, 25 bp, Mus musculus
gaccgggaagttcaggcctggtgat

SEQ ID NO: 290120 - DNA, 25 bp, Mus musculus
gaccgggacagagcgcctcctcaag

SEQ ID NO: 290121 - DNA, 25 bp, Mus musculus
gaccgggacaggcaagcacaagctg

SEQ ID NO: 290122 - DNA, 25 bp, Mus musculus
gaccgggacaggcaccttctgtatt

SEQ ID NO: 290123 - DNA, 25 bp, Mus musculus
gaccgggcagaggcggaacgtgatg

SEQ ID NO: 290124 - DNA, 25 bp, Mus musculus
gaccggggcaggaagtggtccttct

SEQ ID NO: 290125 - DNA, 25 bp, Mus musculus
gaccgggtgccggtcatcgtggaga

SEQ ID NO: 290126 - DNA, 25 bp, Mus musculus
gaccggtccctcagggtctggagta

SEQ ID NO: 290127 - DNA, 25 bp, Mus musculus
gaccggttagccagggattacgcag

SEQ ID NO: 290128 - DNA, 25 bp, Mus musculus
gaccggttccaggatccagccgcag

SEQ ID NO: 290129 - DNA, 25 bp, Mus musculus
gaccgtaaagtgttcgtgggtagat

SEQ ID NO: 290130 - DNA, 25 bp, Mus musculus
gaccgtaccaagggatagcccacct

SEQ ID NO: 290131 - DNA, 25 bp, Mus musculus
gaccgtaggcgctgaggcatgtgtt

SEQ ID NO: 290132 - DNA, 25 bp, Mus musculus
gaccgtaggggttcacgaaccagaa

SEQ ID NO: 290133 - DNA, 25 bp, Mus musculus
gaccgtatcaccattgaaatacctg

SEQ ID NO: 290134 - DNA, 25 bp, Mus musculus
gaccgtcacggacaattgttccagt

SEQ ID NO: 290135 - DNA, 25 bp, Mus musculus
gaccgtcctcagctggcagctgtcc

SEQ ID NO: 290136 - DNA, 25 bp, Mus musculus
gaccgtcctgtttggagtgcttaat

SEQ ID NO: 290137 - DNA, 25 bp, Mus musculus
gaccgtgaaaggagcaatagagctg

SEQ ID NO: 290138 - DNA, 25 bp, Mus musculus
gaccgtgaaaggagtcgctttcctt

SEQ ID NO: 290139 - DNA, 25 bp, Mus musculus
gaccgtgacccagcccgtccgcctc

SEQ ID NO: 290140 - DNA, 25 bp, Mus musculus
gaccgtgactctcaactccgaagtc

SEQ ID NO: 290141 - DNA, 25 bp, Mus musculus
gaccgtgatggtaacaaatcacaag

SEQ ID NO: 290142 - DNA, 25 bp, Mus musculus
gaccgtgccgaacgtgctggccaaa

SEQ ID NO: 290143 - DNA, 25 bp, Mus musculus
gaccgtgcgcgctccccaggctaga

SEQ ID NO: 290144 - DNA, 25 bp, Mus musculus
gaccgtgctgaaaggaagcaggtcc

SEQ ID NO: 290145 - DNA, 25 bp, Mus musculus
gaccgtgctgggcaggtacctggac

SEQ ID NO: 290146 - DNA, 25 bp, Mus musculus
gaccgtggaggatgacttgattatc

SEQ ID NO: 290147 - DNA, 25 bp, Mus musculus
gaccgtggatgggagggccccaaga

SEQ ID NO: 290148 - DNA, 25 bp, Mus musculus
gaccgtgggggagattttctacctt

SEQ ID NO: 290149 - DNA, 25 bp, Mus musculus
gaccgtgggggaggatcccatagcc

SEQ ID NO: 290150 - DNA, 25 bp, Mus musculus
gaccgtgggggaggtgacagattat

SEQ ID NO: 290151 - DNA, 25 bp, Mus musculus
gaccgttctggaagccctggaagag

SEQ ID NO: 290152 - DNA, 25 bp, Mus musculus
gaccgttggtggcatagctctaatt

SEQ ID NO: 290153 - DNA, 25 bp, Mus musculus
gaccgttgtagagtgtgtaatgctg

SEQ ID NO: 290154 - DNA, 25 bp, Mus musculus
gacctaaaactttgcagattccttt

SEQ ID NO: 290155 - DNA, 25 bp, Mus musculus
gacctaaatgactggcttccccagc

SEQ ID NO: 290156 - DNA, 25 bp, Mus musculus
gacctaaatggagaactgttcctag

SEQ ID NO: 290157 - DNA, 25 bp, Mus musculus
gacctaacaaatgtcgagtggctgg

SEQ ID NO: 290158 - DNA, 25 bp, Mus musculus
gacctaacaggtgtgaaagatgttc

SEQ ID NO: 290159 - DNA, 25 bp, Mus musculus
gacctaagaagagatccagagtttt

SEQ ID NO: 290160 - DNA, 25 bp, Mus musculus
gacctaatcagtgagaccaagtacc

SEQ ID NO: 290161 - DNA, 25 bp, Mus musculus
gacctaatcagtgagcaagtacaaa

SEQ ID NO: 290162 - DNA, 25 bp, Mus musculus
gacctaatgcagtcatccttcctag

SEQ ID NO: 290163 - DNA, 25 bp, Mus musculus
gacctacaaggtcggacatcaaata

SEQ ID NO: 290164 - DNA, 25 bp, Mus musculus
gacctacaggacagctatacagctc

SEQ ID NO: 290165 - DNA, 25 bp, Mus musculus
gacctacaggaggggcccggccttg

SEQ ID NO: 290166 - DNA, 25 bp, Mus musculus
gacctacaggattgagacaccggta

SEQ ID NO: 290167 - DNA, 25 bp, Mus musculus
gacctaccagggtacgagccgcccc

SEQ ID NO: 290168 - DNA, 25 bp, Mus musculus
gacctaccatggggcgcagttctga

SEQ ID NO: 290169 - DNA, 25 bp, Mus musculus
gacctaccgagtgaccctgagcaag

SEQ ID NO: 290170 - DNA, 25 bp, Mus musculus
gacctaccggttcttcagcgaacct

SEQ ID NO: 290171 - DNA, 25 bp, Mus musculus
gacctacctcagggaagagtcccac

SEQ ID NO: 290172 - DNA, 25 bp, Mus musculus
gacctacctcagggagcagaaggcc

SEQ ID NO: 290173 - DNA, 25 bp, Mus musculus
gacctactaagatcgagagcgatga

SEQ ID NO: 290174 - DNA, 25 bp, Mus musculus
gacctactaggtcactgcccagccc

SEQ ID NO: 290175 - DNA, 25 bp, Mus musculus
gacctactcccagtgaccttcagaa

SEQ ID NO: 290176 - DNA, 25 bp, Mus musculus
gacctactgtgtctctggaccaaat

SEQ ID NO: 290177 - DNA, 25 bp, Mus musculus
gacctacttggagccctataataaa

SEQ ID NO: 290178 - DNA, 25 bp, Mus musculus
gacctagaacaatagaaagcagtct

SEQ ID NO: 290179 - DNA, 25 bp, Mus musculus
gacctagaagaaaagaaaaatcaag

SEQ ID NO: 290180 - DNA, 25 bp, Mus musculus
gacctagaagaaaagtttctgtttc

SEQ ID NO: 290181 - DNA, 25 bp, Mus musculus
gacctagaaggttttaggctagcca

SEQ ID NO: 290182 - DNA, 25 bp, Mus musculus
gacctagaatggtgtgccaggacag

SEQ ID NO: 290183 - DNA, 25 bp, Mus musculus
gacctagaatggtttgcaatagcaa

SEQ ID NO: 290184 - DNA, 25 bp, Mus musculus
gacctagaatgtgggcacaatgccc

SEQ ID NO: 290185 - DNA, 25 bp, Mus musculus
gacctagcagccttacagttcctcc

SEQ ID NO: 290186 - DNA, 25 bp, Mus musculus
gacctagcaggcttacagttcctcc

SEQ ID NO: 290187 - DNA, 25 bp, Mus musculus
gacctagctgagccctacaaaggct

SEQ ID NO: 290188 - DNA, 25 bp, Mus musculus
gacctatcaccagtatcatagttaa

SEQ ID NO: 290189 - DNA, 25 bp, Mus musculus
gacctatccaaaagataggaagtgc

SEQ ID NO: 290190 - DNA, 25 bp, Mus musculus
gacctatccagcccaccagaaccgc

SEQ ID NO: 290191 - DNA, 25 bp, Mus musculus
gacctatctcgacgtcggatgcgcc

SEQ ID NO: 290192 - DNA, 25 bp, Mus musculus
gacctatctgaaagaccccgcttgg

SEQ ID NO: 290193 - DNA, 25 bp, Mus musculus
gacctatctgaaagattgctgaagc

SEQ ID NO: 290194 - DNA, 25 bp, Mus musculus
gacctatgagatggtagacaaacac

SEQ ID NO: 290195 - DNA, 25 bp, Mus musculus
gacctatgtgcacaggaaaggaagt

SEQ ID NO: 290196 - DNA, 25 bp, Mus musculus
gacctatgtgcacagggtcgggaga

SEQ ID NO: 290197 - DNA, 25 bp, Mus musculus
gacctattcccgacataggaggcgg

SEQ ID NO: 290198 - DNA, 25 bp, Mus musculus
gacctcaaagacagaaataaaaata

SEQ ID NO: 290199 - DNA, 25 bp, Mus musculus
gacctcaaagacaggccagttaaat

SEQ ID NO: 290200 - DNA, 25 bp, Mus musculus
gacctcaacagggtgagccaggtcc

SEQ ID NO: 290201 - DNA, 25 bp, Mus musculus
gacctcaacagtgggcagctgatca

SEQ ID NO: 290202 - DNA, 25 bp, Mus musculus
gacctcaagaagcaggttgcctagc

SEQ ID NO: 290203 - DNA, 25 bp, Mus musculus
gacctcaagaagcagtgtgacgtgc

SEQ ID NO: 290204 - DNA, 25 bp, Mus musculus
gacctcaaggagctgtaggtggcga

SEQ ID NO: 290205 - DNA, 25 bp, Mus musculus
gacctcaagggtggttttgactgga

SEQ ID NO: 290206 - DNA, 25 bp, Mus musculus
gacctcaatcaccatgcccaccgcc

SEQ ID NO: 290207 - DNA, 25 bp, Mus musculus
gacctcaatggcaatgccctcggag

SEQ ID NO: 290208 - DNA, 25 bp, Mus musculus
gacctcacaaggtgactggacagaa

SEQ ID NO: 290209 - DNA, 25 bp, Mus musculus
gacctcacaagtgcacgatctgatt

SEQ ID NO: 290210 - DNA, 25 bp, Mus musculus
gacctcacagcagagtgccatcttg

SEQ ID NO: 290211 - DNA, 25 bp, Mus musculus
gacctcacaggtccagttgtactgc

SEQ ID NO: 290212 - DNA, 25 bp, Mus musculus
gacctcacagtggaagggttccaat

SEQ ID NO: 290213 - DNA, 25 bp, Mus musculus
gacctcaccaagctgctgtccagag

SEQ ID NO: 290214 - DNA, 25 bp, Mus musculus
gacctcaccgactctgcaaagcact

SEQ ID NO: 290215 - DNA, 25 bp, Mus musculus
gacctcaccgtgatcaacttttgta

SEQ ID NO: 290216 - DNA, 25 bp, Mus musculus
gacctcactcagagccatgatgctg

SEQ ID NO: 290217 - DNA, 25 bp, Mus musculus
gacctcagaaactgtggcccgaggc

SEQ ID NO: 290218 - DNA, 25 bp, Mus musculus
gacctcagactcagggttgagctcc

SEQ ID NO: 290219 - DNA, 25 bp, Mus musculus
gacctcagagcaggtcactttgaat

SEQ ID NO: 290220 - DNA, 25 bp, Mus musculus
gacctcagagccaggttggttcctg

SEQ ID NO: 290221 - DNA, 25 bp, Mus musculus
gacctcagatcagaaccagtcttca

SEQ ID NO: 290222 - DNA, 25 bp, Mus musculus
gacctcagcaaatgtggtaaacagc

SEQ ID NO: 290223 - DNA, 25 bp, Mus musculus
gacctcagcactgtcagacatagat

SEQ ID NO: 290224 - DNA, 25 bp, Mus musculus
gacctcagcagcggggttctctgga

SEQ ID NO: 290225 - DNA, 25 bp, Mus musculus
gacctcagctggttgtgcagacaaa

SEQ ID NO: 290226 - DNA, 25 bp, Mus musculus
gacctcagctggttgtgcagtcaaa

SEQ ID NO: 290227 - DNA, 25 bp, Mus musculus
gacctcagggaaaaggtcattaaag

SEQ ID NO: 290228 - DNA, 25 bp, Mus musculus
gacctcagttctgtgactgatgaag

SEQ ID NO: 290229 - DNA, 25 bp, Mus musculus
gacctcagttttcccaagcaaccct

SEQ ID NO: 290230 - DNA, 25 bp, Mus musculus
gacctcatcaacagtgagggggact

SEQ ID NO: 290231 - DNA, 25 bp, Mus musculus
gacctcatcaacagtttgcaggaca

SEQ ID NO: 290232 - DNA, 25 bp, Mus musculus
gacctcatccagaccagagggcctg

SEQ ID NO: 290233 - DNA, 25 bp, Mus musculus
gacctcatccagcttactggcggtt

SEQ ID NO: 290234 - DNA, 25 bp, Mus musculus
gacctcatcgagaagcccatgggca

SEQ ID NO: 290235 - DNA, 25 bp, Mus musculus
gacctcatctaggtacgtaggtgcc

SEQ ID NO: 290236 - DNA, 25 bp, Mus musculus
gacctcatctccaagagtgaatgtg

SEQ ID NO: 290237 - DNA, 25 bp, Mus musculus
gacctcatctccaagtccttccagg

SEQ ID NO: 290238 - DNA, 25 bp, Mus musculus
gacctcatgctttcgaaatgaataa

SEQ ID NO: 290239 - DNA, 25 bp, Mus musculus
gacctcattaagaagaacaatcacc

SEQ ID NO: 290240 - DNA, 25 bp, Mus musculus
gacctcattacagtgtgactgcaca

SEQ ID NO: 290241 - DNA, 25 bp, Mus musculus
gacctcattatccagatacacagac

SEQ ID NO: 290242 - DNA, 25 bp, Mus musculus
gacctccaaatggttctgaatcaga

SEQ ID NO: 290243 - DNA, 25 bp, Mus musculus
gacctccaagatctcctacctctgc

SEQ ID NO: 290244 - DNA, 25 bp, Mus musculus
gacctccaagggcaccatgaacaca

SEQ ID NO: 290245 - DNA, 25 bp, Mus musculus
gacctccaagggcccaatgtaaagg

SEQ ID NO: 290246 - DNA, 25 bp, Mus musculus
gacctccacagggacaactcccaat

SEQ ID NO: 290247 - DNA, 25 bp, Mus musculus
gacctccacccccgcctcccagaca

SEQ ID NO: 290248 - DNA, 25 bp, Mus musculus
gacctccagactcagctggcggtgc

SEQ ID NO: 290249 - DNA, 25 bp, Mus musculus
gacctccagagtggtggattgtcca

SEQ ID NO: 290250 - DNA, 25 bp, Mus musculus
gacctcccacagtgttatctttgtt

SEQ ID NO: 290251 - DNA, 25 bp, Mus musculus
gacctcccagatggtgttagcagga

SEQ ID NO: 290252 - DNA, 25 bp, Mus musculus
gacctccccgtaatgctggtgagat

SEQ ID NO: 290253 - DNA, 25 bp, Mus musculus
gacctccccgtaattacgctgggga

SEQ ID NO: 290254 - DNA, 25 bp, Mus musculus
gacctcccggatttctgcaccccct

SEQ ID NO: 290255 - DNA, 25 bp, Mus musculus
gacctccctaggattctcaaagctg

SEQ ID NO: 290256 - DNA, 25 bp, Mus musculus
gacctccctaggtgaggattatgaa

SEQ ID NO: 290257 - DNA, 25 bp, Mus musculus
gacctccctggaggtggagcctttt

SEQ ID NO: 290258 - DNA, 25 bp, Mus musculus
gacctccgaaaggcccgacgactct

SEQ ID NO: 290259 - DNA, 25 bp, Mus musculus
gacctccgcaatttcaccgagatga

SEQ ID NO: 290260 - DNA, 25 bp, Mus musculus
gacctccgcagctaggtaattttta

SEQ ID NO: 290261 - DNA, 25 bp, Mus musculus
gacctccggggatataaaattccgg

SEQ ID NO: 290262 - DNA, 25 bp, Mus musculus
gacctcctcagtgggaacacaggct

SEQ ID NO: 290263 - DNA, 25 bp, Mus musculus
gacctcctgaacaaggtccaggaca

SEQ ID NO: 290264 - DNA, 25 bp, Mus musculus
gacctcctgagaaacagtcatggaa

SEQ ID NO: 290265 - DNA, 25 bp, Mus musculus
gacctcctgataggcaacatgtcgg

SEQ ID NO: 290266 - DNA, 25 bp, Mus musculus
gacctcctgggcattgtcgccagca

SEQ ID NO: 290267 - DNA, 25 bp, Mus musculus
gacctcctgtagagagccatataca

SEQ ID NO: 290268 - DNA, 25 bp, Mus musculus
gacctcctgtagaggtgaggcatga

SEQ ID NO: 290269 - DNA, 25 bp, Mus musculus
gacctcgcaagttcttccatcagtg

SEQ ID NO: 290270 - DNA, 25 bp, Mus musculus
gacctcgcaggaaattctacagaag

SEQ ID NO: 290271 - DNA, 25 bp, Mus musculus
gacctcgcaggaagacagatcttcc

SEQ ID NO: 290272 - DNA, 25 bp, Mus musculus
gacctcgcgagtttcctgacaggca

SEQ ID NO: 290273 - DNA, 25 bp, Mus musculus
gacctcgcggaaaactgtccttggg

SEQ ID NO: 290274 - DNA, 25 bp, Mus musculus
gacctcgcgggcccatcctcccgtg

SEQ ID NO: 290275 - DNA, 25 bp, Mus musculus
gacctcgctcaaaggagaaaggatc

SEQ ID NO: 290276 - DNA, 25 bp, Mus musculus
gacctcgctcaaaggtcgatccttc

SEQ ID NO: 290277 - DNA, 25 bp, Mus musculus
gacctcggagaacttccaggtcctg

SEQ ID NO: 290278 - DNA, 25 bp, Mus musculus
gacctcggagccacagagatccttt

SEQ ID NO: 290279 - DNA, 25 bp, Mus musculus
gacctcggagctgcccagacccctc

SEQ ID NO: 290280 - DNA, 25 bp, Mus musculus
gacctcggagggatgactcgagatg

SEQ ID NO: 290281 - DNA, 25 bp, Mus musculus
gacctcggcctcaggaaattccttc

SEQ ID NO: 290282 - DNA, 25 bp, Mus musculus
gacctcggcctcagtagagtgatgc

SEQ ID NO: 290283 - DNA, 25 bp, Mus musculus
gacctcggcgcgggaactggcatca

SEQ ID NO: 290284 - DNA, 25 bp, Mus musculus
gacctcggcgcgggtgaacaccatg

SEQ ID NO: 290285 - DNA, 25 bp, Mus musculus
gacctcggcgcgggtgagccctatt

SEQ ID NO: 290286 - DNA, 25 bp, Mus musculus
gacctcgggaaacatacccagagaa

SEQ ID NO: 290287 - DNA, 25 bp, Mus musculus
gacctcgggaaacatcacagaagta

SEQ ID NO: 290288 - DNA, 25 bp, Mus musculus
gacctcgggagagaaattttaagcg

SEQ ID NO: 290289 - DNA, 25 bp, Mus musculus
gacctcggtgacagaacaaatcagt

SEQ ID NO: 290290 - DNA, 25 bp, Mus musculus
gacctcggtgacaggtttggggcct

SEQ ID NO: 290291 - DNA, 25 bp, Mus musculus
gacctctaccagcaggcttccccac

SEQ ID NO: 290292 - DNA, 25 bp, Mus musculus
gacctctagaagcgaaggaatacac

SEQ ID NO: 290293 - DNA, 25 bp, Mus musculus
gacctctatccaagggaaggaaaat

SEQ ID NO: 290294 - DNA, 25 bp, Mus musculus
gacctctatgtaactgtcaccgttt

SEQ ID NO: 290295 - DNA, 25 bp, Mus musculus
gacctctcccaccatcccaaattta

SEQ ID NO: 290296 - DNA, 25 bp, Mus musculus
gacctctcccaccatgaaacaaaag

SEQ ID NO: 290297 - DNA, 25 bp, Mus musculus
gacctctcttaccagtctccactca

SEQ ID NO: 290298 - DNA, 25 bp, Mus musculus
gacctctgacaaacagttgctcaga

SEQ ID NO: 290299 - DNA, 25 bp, Mus musculus
gacctctgagagatggatttataac

SEQ ID NO: 290300 - DNA, 25 bp, Mus musculus
gacctctgagagctcccaggaggca

SEQ ID NO: 290301 - DNA, 25 bp, Mus musculus
gacctctgcgaaccaaacacactgg

SEQ ID NO: 290302 - DNA, 25 bp, Mus musculus
gacctctgcgaaccaactgccaggg

SEQ ID NO: 290303 - DNA, 25 bp, Mus musculus
gacctctggaagagaacctgtggac

SEQ ID NO: 290304 - DNA, 25 bp, Mus musculus
gacctctgggagccagcagaggcct

SEQ ID NO: 290305 - DNA, 25 bp, Mus musculus
gacctctgggagcccacagagagtc

SEQ ID NO: 290306 - DNA, 25 bp, Mus musculus
gacctctgtgaaggcaatggtgctc

SEQ ID NO: 290307 - DNA, 25 bp, Mus musculus
gacctctgtggtaacatggccaacc

SEQ ID NO: 290308 - DNA, 25 bp, Mus musculus
gacctcttcatgcgcatggacttgg

SEQ ID NO: 290309 - DNA, 25 bp, Mus musculus
gacctcttgtctacccagctgggtt

SEQ ID NO: 290310 - DNA, 25 bp, Mus musculus
gacctctttcttctggaaccagcta

SEQ ID NO: 290311 - DNA, 25 bp, Mus musculus
gacctgaaaaggaaacctgcagatc

SEQ ID NO: 290312 - DNA, 25 bp, Mus musculus
gacctgaaagctttacaactcctga

SEQ ID NO: 290313 - DNA, 25 bp, Mus musculus
gacctgaagagcaagatcctggcag

SEQ ID NO: 290314 - DNA, 25 bp, Mus musculus
gacctgaagggcatgttcctgtcag

SEQ ID NO: 290315 - DNA, 25 bp, Mus musculus
gacctgaatagcgtgcctcaggagc

SEQ ID NO: 290316 - DNA, 25 bp, Mus musculus
gacctgacaggtgatctggagagct

SEQ ID NO: 290317 - DNA, 25 bp, Mus musculus
gacctgaccagtctatatatattgg

SEQ ID NO: 290318 - DNA, 25 bp, Mus musculus
gacctgacctcaatgtctttacatc

SEQ ID NO: 290319 - DNA, 25 bp, Mus musculus
gacctgacgcaggcaaaacccattt

SEQ ID NO: 290320 - DNA, 25 bp, Mus musculus
gacctgactcagagaggaagaacct

SEQ ID NO: 290321 - DNA, 25 bp, Mus musculus
gacctgactgacccattgaagaagc

SEQ ID NO: 290322 - DNA, 25 bp, Mus musculus
gacctgactggcaccctcaggaaga

SEQ ID NO: 290323 - DNA, 25 bp, Mus musculus
gacctgactggtcacagtaatgaaa

SEQ ID NO: 290324 - DNA, 25 bp, Mus musculus
gacctgactggtcttaagttttgaa

SEQ ID NO: 290325 - DNA, 25 bp, Mus musculus
gacctgacttctggatggacagtct

SEQ ID NO: 290326 - DNA, 25 bp, Mus musculus
gacctgagataccatggccaaagtt

SEQ ID NO: 290327 - DNA, 25 bp, Mus musculus
gacctgagccccgagcctttgacat

SEQ ID NO: 290328 - DNA, 25 bp, Mus musculus
gacctgaggaagcagatataaagac

SEQ ID NO: 290329 - DNA, 25 bp, Mus musculus
gacctgaggactttgcaactgctgc

SEQ ID NO: 290330 - DNA, 25 bp, Mus musculus
gacctgagtccctagaagcaagacg

SEQ ID NO: 290331 - DNA, 25 bp, Mus musculus
gacctgagtgaggtagataaagatt

SEQ ID NO: 290332 - DNA, 25 bp, Mus musculus
gacctgagtgatgatggaatcagcg

SEQ ID NO: 290333 - DNA, 25 bp, Mus musculus
gacctgatagcagctgtgagtacca

SEQ ID NO: 290334 - DNA, 25 bp, Mus musculus
gacctgatgtccgggcactagagca

SEQ ID NO: 290335 - DNA, 25 bp, Mus musculus
gacctgattgaaagtaatcacccaa

SEQ ID NO: 290336 - DNA, 25 bp, Mus musculus
gacctgattgaaagtataattgcag

SEQ ID NO: 290337 - DNA, 25 bp, Mus musculus
gacctgcaagccctacctgacctga

SEQ ID NO: 290338 - DNA, 25 bp, Mus musculus
gacctgcaaggaatctccggttcca

SEQ ID NO: 290339 - DNA, 25 bp, Mus musculus
gacctgcaaggtccccaaccctact

SEQ ID NO: 290340 - DNA, 25 bp, Mus musculus
gacctgcacaagcaaaacctggaaa

SEQ ID NO: 290341 - DNA, 25 bp, Mus musculus
gacctgcactgggaaatatggcttt

SEQ ID NO: 290342 - DNA, 25 bp, Mus musculus
gacctgcactgggaaggcttgtcgc

SEQ ID NO: 290343 - DNA, 25 bp, Mus musculus
gacctgcactgtcacgcggtgttta

SEQ ID NO: 290344 - DNA, 25 bp, Mus musculus
gacctgcagaccccggaaagccaga

SEQ ID NO: 290345 - DNA, 25 bp, Mus musculus
gacctgcagcaggtgatagagggaa

SEQ ID NO: 290346 - DNA, 25 bp, Mus musculus
gacctgcagtgctcccaccaccttc

SEQ ID NO: 290347 - DNA, 25 bp, Mus musculus
gacctgccaaaagttgtggagctcc

SEQ ID NO: 290348 - DNA, 25 bp, Mus musculus
gacctgccaatcccatctctcccgc

SEQ ID NO: 290349 - DNA, 25 bp, Mus musculus
gacctgccactcacgcgagttccag

SEQ ID NO: 290350 - DNA, 25 bp, Mus musculus
gacctgccaggacgctgagcctggg

SEQ ID NO: 290351 - DNA, 25 bp, Mus musculus
gacctgccaggtgtcaccatgctgt

SEQ ID NO: 290352 - DNA, 25 bp, Mus musculus
gacctgcccccaagaggacgagtct

SEQ ID NO: 290353 - DNA, 25 bp, Mus musculus
gacctgcccccaaggtggtgttcgt

SEQ ID NO: 290354 - DNA, 25 bp, Mus musculus
gacctgcccgcaggagcgcagcaat

SEQ ID NO: 290355 - DNA, 25 bp, Mus musculus
gacctgccggcggggtctcctgtga

SEQ ID NO: 290356 - DNA, 25 bp, Mus musculus
gacctgcctcgggtgagccctagat

SEQ ID NO: 290357 - DNA, 25 bp, Mus musculus
gacctgcctctgagtgctgcaccca

SEQ ID NO: 290358 - DNA, 25 bp, Mus musculus
gacctgcgccgagagatcccgatgt

SEQ ID NO: 290359 - DNA, 25 bp, Mus musculus
gacctgcgtgcatcagagtcttcaa

SEQ ID NO: 290360 - DNA, 25 bp, Mus musculus
gacctgcgtggagctcaggcctgca

SEQ ID NO: 290361 - DNA, 25 bp, Mus musculus
gacctgcgtggagtgttcagccaag

SEQ ID NO: 290362 - DNA, 25 bp, Mus musculus
gacctgctgcggaagaacgcagagg

SEQ ID NO: 290363 - DNA, 25 bp, Mus musculus
gacctgctgggcttgtgtcttccaa

SEQ ID NO: 290364 - DNA, 25 bp, Mus musculus
gacctgcttggttcaactggagagc

SEQ ID NO: 290365 - DNA, 25 bp, Mus musculus
gacctgcttgtgatatatgttgggt

SEQ ID NO: 290366 - DNA, 25 bp, Mus musculus
gacctggaaaccaacctgaccttcc

SEQ ID NO: 290367 - DNA, 25 bp, Mus musculus
gacctggaaaccactaagaaacttc

SEQ ID NO: 290368 - DNA, 25 bp, Mus musculus
gacctggaaagtgtctttgccatga

SEQ ID NO: 290369 - DNA, 25 bp, Mus musculus
gacctggaacctgatgaagagctgg

SEQ ID NO: 290370 - DNA, 25 bp, Mus musculus
gacctggaactgctggcctctggag

SEQ ID NO: 290371 - DNA, 25 bp, Mus musculus
gacctggaagacgagctctatgccc

SEQ ID NO: 290372 - DNA, 25 bp, Mus musculus
gacctggaagataaactgaagtgca

SEQ ID NO: 290373 - DNA, 25 bp, Mus musculus
gacctggaagcccagaagaaactgt

SEQ ID NO: 290374 - DNA, 25 bp, Mus musculus
gacctggacaagatcatagaactca

SEQ ID NO: 290375 - DNA, 25 bp, Mus musculus
gacctggacattcggatttccattt

SEQ ID NO: 290376 - DNA, 25 bp, Mus musculus
gacctggacattcggtcacagtctc

SEQ ID NO: 290377 - DNA, 25 bp, Mus musculus
gacctggacgctcagccttcaaaca

SEQ ID NO: 290378 - DNA, 25 bp, Mus musculus
gacctggacgctcaggacccaccag

SEQ ID NO: 290379 - DNA, 25 bp, Mus musculus
gacctggagaagctgacctctctct

SEQ ID NO: 290380 - DNA, 25 bp, Mus musculus
gacctggagcatcagctgctgacct

SEQ ID NO: 290381 - DNA, 25 bp, Mus musculus
gacctggagcatcagctgtggtcct

SEQ ID NO: 290382 - DNA, 25 bp, Mus musculus
gacctggagcgtgtatcgacagtga

SEQ ID NO: 290383 - DNA, 25 bp, Mus musculus
gacctggataaagccgatcacgcgt

SEQ ID NO: 290384 - DNA, 25 bp, Mus musculus
gacctggatcccaagacagaccctg

SEQ ID NO: 290385 - DNA, 25 bp, Mus musculus
gacctggcacagtcaggttttcagc

SEQ ID NO: 290386 - DNA, 25 bp, Mus musculus
gacctggcacattcctcttcagatg

SEQ ID NO: 290387 - DNA, 25 bp, Mus musculus
gacctggcagaaagggctgaggcca

SEQ ID NO: 290388 - DNA, 25 bp, Mus musculus
gacctggcaggatgggagcctcctg

SEQ ID NO: 290389 - DNA, 25 bp, Mus musculus
gacctggcaggatgggccaccgctg

SEQ ID NO: 290390 - DNA, 25 bp, Mus musculus
gacctggccaactgtaacagaagac

SEQ ID NO: 290391 - DNA, 25 bp, Mus musculus
gacctggccaagcctaccaggtacc

SEQ ID NO: 290392 - DNA, 25 bp, Mus musculus
gacctggccaaggtaccacggttcg

SEQ ID NO: 290393 - DNA, 25 bp, Mus musculus
gacctggccaggagtgaattggagg

SEQ ID NO: 290394 - DNA, 25 bp, Mus musculus
gacctggccagtaaaagctggcagg

SEQ ID NO: 290395 - DNA, 25 bp, Mus musculus
gacctggccagtatattattctcca

SEQ ID NO: 290396 - DNA, 25 bp, Mus musculus
gacctggccgaagcatgacccgccg

SEQ ID NO: 290397 - DNA, 25 bp, Mus musculus
gacctggctccagtctgttctcctg

SEQ ID NO: 290398 - DNA, 25 bp, Mus musculus
gacctggctccattccatgaggcgc

SEQ ID NO: 290399 - DNA, 25 bp, Mus musculus
gacctggctgagcagcaaaggtgaa

SEQ ID NO: 290400 - DNA, 25 bp, Mus musculus
gacctggctgaggacctcctttctt

SEQ ID NO: 290401 - DNA, 25 bp, Mus musculus
gacctggctgaggacctcggatggg

SEQ ID NO: 290402 - DNA, 25 bp, Mus musculus
gacctggctttgtctgttgctgtgg

SEQ ID NO: 290403 - DNA, 25 bp, Mus musculus
gacctgggagagtttgtgagaagct

SEQ ID NO: 290404 - DNA, 25 bp, Mus musculus
gacctgggcaaggagatccacgatt

SEQ ID NO: 290405 - DNA, 25 bp, Mus musculus
gacctgggctgaagctaggcggccg

SEQ ID NO: 290406 - DNA, 25 bp, Mus musculus
gacctgggctgaaggagacagagga

SEQ ID NO: 290407 - DNA, 25 bp, Mus musculus
gacctgggctgaaggggagcttctg

SEQ ID NO: 290408 - DNA, 25 bp, Mus musculus
gacctgggtcagaacatctttgcct

SEQ ID NO: 290409 - DNA, 25 bp, Mus musculus
gacctggtacatggtggtcaacctg

SEQ ID NO: 290410 - DNA, 25 bp, Mus musculus
gacctggtaggaaagagaaaatccc

SEQ ID NO: 290411 - DNA, 25 bp, Mus musculus
gacctggtaggaaaggtccagcaag

SEQ ID NO: 290412 - DNA, 25 bp, Mus musculus
gacctggtcagtcttacttctcgct

SEQ ID NO: 290413 - DNA, 25 bp, Mus musculus
gacctggtgacccacaaccgcactt

SEQ ID NO: 290414 - DNA, 25 bp, Mus musculus
gacctggtggccaattggagcatct

SEQ ID NO: 290415 - DNA, 25 bp, Mus musculus
gacctggtggccagcaaccttcctg

SEQ ID NO: 290416 - DNA, 25 bp, Mus musculus
gacctggtttagattctcaaaccat

SEQ ID NO: 290417 - DNA, 25 bp, Mus musculus
gacctgtaaagctcggatgcccaac

SEQ ID NO: 290418 - DNA, 25 bp, Mus musculus
gacctgtaaagttgcttttagacac

SEQ ID NO: 290419 - DNA, 25 bp, Mus musculus
gacctgtacttggagaggctccggc

SEQ ID NO: 290420 - DNA, 25 bp, Mus musculus
gacctgtagagaacctccatgtact

SEQ ID NO: 290421 - DNA, 25 bp, Mus musculus
gacctgtatcagacacctctgcact

SEQ ID NO: 290422 - DNA, 25 bp, Mus musculus
gacctgtcaatggactatctcatcg

SEQ ID NO: 290423 - DNA, 25 bp, Mus musculus
gacctgtcaatggtacggatgaaat

SEQ ID NO: 290424 - DNA, 25 bp, Mus musculus
gacctgtcacccagactaagaaact

SEQ ID NO: 290425 - DNA, 25 bp, Mus musculus
gacctgtcatcagatgacctcatcc

SEQ ID NO: 290426 - DNA, 25 bp, Mus musculus
gacctgtcccacaggcggaatgtgc

SEQ ID NO: 290427 - DNA, 25 bp, Mus musculus
gacctgtcctgaggttgctacaggc

SEQ ID NO: 290428 - DNA, 25 bp, Mus musculus
gacctgtcttcaaggtgccgccatg

SEQ ID NO: 290429 - DNA, 25 bp, Mus musculus
gacctgtcttgtaaccctgagataa

SEQ ID NO: 290430 - DNA, 25 bp, Mus musculus
gacctgtggcaaaagactgctggag

SEQ ID NO: 290431 - DNA, 25 bp, Mus musculus
gacctgtggcaaaagccctggaaga

SEQ ID NO: 290432 - DNA, 25 bp, Mus musculus
gacctgtggggtttggtggtgactt

SEQ ID NO: 290433 - DNA, 25 bp, Mus musculus
gacctgtgtggagtgttcagcaaaa

SEQ ID NO: 290434 - DNA, 25 bp, Mus musculus
gacctgttagggatccttgtgggcc

SEQ ID NO: 290435 - DNA, 25 bp, Mus musculus
gacctgttattgaaggacctctctt

SEQ ID NO: 290436 - DNA, 25 bp, Mus musculus
gacctgttcagtagacagtataaca

SEQ ID NO: 290437 - DNA, 25 bp, Mus musculus
gacctgttgcaagagggtgaagaag

SEQ ID NO: 290438 - DNA, 25 bp, Mus musculus
gaccttaacaggtgaagatggttct

SEQ ID NO: 290439 - DNA, 25 bp, Mus musculus
gaccttaacctagcttaccatctag

SEQ ID NO: 290440 - DNA, 25 bp, Mus musculus
gaccttacaatcaacatttctgacc

SEQ ID NO: 290441 - DNA, 25 bp, Mus musculus
gaccttacaatcaagatttctgacc

SEQ ID NO: 290442 - DNA, 25 bp, Mus musculus
gaccttacacaggtcaccactcaag

SEQ ID NO: 290443 - DNA, 25 bp, Mus musculus
gaccttaccaaggaccgtagcctgg

SEQ ID NO: 290444 - DNA, 25 bp, Mus musculus
gaccttactatgaggtctacaccat

SEQ ID NO: 290445 - DNA, 25 bp, Mus musculus
gaccttactatggagaaggaagcat

SEQ ID NO: 290446 - DNA, 25 bp, Mus musculus
gaccttataggagtaaagatgggaa

SEQ ID NO: 290447 - DNA, 25 bp, Mus musculus
gaccttatcacgaagaaaaacgtga

SEQ ID NO: 290448 - DNA, 25 bp, Mus musculus
gaccttatcaggtttgcacagacgc

SEQ ID NO: 290449 - DNA, 25 bp, Mus musculus
gaccttcaaaaagtcaaggtgattc

SEQ ID NO: 290450 - DNA, 25 bp, Mus musculus
gaccttcacaccctcagaacagcaa

SEQ ID NO: 290451 - DNA, 25 bp, Mus musculus
gaccttcaccttccagagaaggaga

SEQ ID NO: 290452 - DNA, 25 bp, Mus musculus
gaccttcacttttggttccacaccc

SEQ ID NO: 290453 - DNA, 25 bp, Mus musculus
gaccttcagaaggaagacaacatgg

SEQ ID NO: 290454 - DNA, 25 bp, Mus musculus
gaccttcagagcgagggagcccgaa

SEQ ID NO: 290455 - DNA, 25 bp, Mus musculus
gaccttcagctcacgaggcgcatac

SEQ ID NO: 290456 - DNA, 25 bp, Mus musculus
gaccttccagcagcagcatgaagcg

SEQ ID NO: 290457 - DNA, 25 bp, Mus musculus
gaccttccaggaacttccattacat

SEQ ID NO: 290458 - DNA, 25 bp, Mus musculus
gaccttccaggagatcctgaacact

SEQ ID NO: 290459 - DNA, 25 bp, Mus musculus
gaccttccaggtgacgctgactgcg

SEQ ID NO: 290460 - DNA, 25 bp, Mus musculus
gaccttccaggtggaggatttttca

SEQ ID NO: 290461 - DNA, 25 bp, Mus musculus
gaccttccaggttttgggaactcag

SEQ ID NO: 290462 - DNA, 25 bp, Mus musculus
gaccttccagtacaggaaattaaaa

SEQ ID NO: 290463 - DNA, 25 bp, Mus musculus
gaccttccagtacaggtcagaggaa

SEQ ID NO: 290464 - DNA, 25 bp, Mus musculus
gaccttcccaactctgctcctgaca

SEQ ID NO: 290465 - DNA, 25 bp, Mus musculus
gaccttccggcaggcagttcctcca

SEQ ID NO: 290466 - DNA, 25 bp, Mus musculus
gaccttcggctccagaccaaagatt

SEQ ID NO: 290467 - DNA, 25 bp, Mus musculus
gaccttcggctccaggccaactgga

SEQ ID NO: 290468 - DNA, 25 bp, Mus musculus
gaccttctagacaaggcaggttcac

SEQ ID NO: 290469 - DNA, 25 bp, Mus musculus
gaccttctagctcaccctagcattc

SEQ ID NO: 290470 - DNA, 25 bp, Mus musculus
gaccttcttcacctgggtgctacag

SEQ ID NO: 290471 - DNA, 25 bp, Mus musculus
gaccttctttggggttccttgtgga

SEQ ID NO: 290472 - DNA, 25 bp, Mus musculus
gaccttgaagaggatcccagtcctc

SEQ ID NO: 290473 - DNA, 25 bp, Mus musculus
gaccttgaaggggactcagaagaag

SEQ ID NO: 290474 - DNA, 25 bp, Mus musculus
gaccttgaccagctcttcattggga

SEQ ID NO: 290475 - DNA, 25 bp, Mus musculus
gaccttgagagcaggtttaaacgca

SEQ ID NO: 290476 - DNA, 25 bp, Mus musculus
gaccttgagcagcccaaagaagtgc

SEQ ID NO: 290477 - DNA, 25 bp, Mus musculus
gaccttgagcaggaggcttctcaga

SEQ ID NO: 290478 - DNA, 25 bp, Mus musculus
gaccttgagccaaagccctgttttc

SEQ ID NO: 290479 - DNA, 25 bp, Mus musculus
gaccttgcaaagtgcaatacgagga

SEQ ID NO: 290480 - DNA, 25 bp, Mus musculus
gaccttgcaaagtgccacagttgag

SEQ ID NO: 290481 - DNA, 25 bp, Mus musculus
gaccttgcacgacctagtggtttat

SEQ ID NO: 290482 - DNA, 25 bp, Mus musculus
gaccttgcacgggctgcaggatgac

SEQ ID NO: 290483 - DNA, 25 bp, Mus musculus
gaccttgcatccagtgatgtggccg

SEQ ID NO: 290484 - DNA, 25 bp, Mus musculus
gaccttgcatgagtggtgtgacggc

SEQ ID NO: 290485 - DNA, 25 bp, Mus musculus
gaccttgctgcgcagatgatgctga

SEQ ID NO: 290486 - DNA, 25 bp, Mus musculus
gaccttgctgcgcagatgcagaacc

SEQ ID NO: 290487 - DNA, 25 bp, Mus musculus
gaccttgctggactcgccagtgatg

SEQ ID NO: 290488 - DNA, 25 bp, Mus musculus
gaccttgctgtgatggagtcctcat

SEQ ID NO: 290489 - DNA, 25 bp, Mus musculus
gaccttggaagggcctggttctcag

SEQ ID NO: 290490 - DNA, 25 bp, Mus musculus
gaccttggacaagatagccaaggac

SEQ ID NO: 290491 - DNA, 25 bp, Mus musculus
gaccttggacaaggagcagatagcc

SEQ ID NO: 290492 - DNA, 25 bp, Mus musculus
gaccttggaccaagaagttggtgtc

SEQ ID NO: 290493 - DNA, 25 bp, Mus musculus
gaccttggcaggggaatcaaagact

SEQ ID NO: 290494 - DNA, 25 bp, Mus musculus
gaccttggtgcagacaacatcgctg

SEQ ID NO: 290495 - DNA, 25 bp, Mus musculus
gaccttgtaacaaggctgtgtctgc

SEQ ID NO: 290496 - DNA, 25 bp, Mus musculus
gaccttgtaacaaggtacacttttt

SEQ ID NO: 290497 - DNA, 25 bp, Mus musculus
gaccttgtgcaggcaccttttgtgt

SEQ ID NO: 290498 - DNA, 25 bp, Mus musculus
gacctttaaccagcaagccccgccc

SEQ ID NO: 290499 - DNA, 25 bp, Mus musculus
gacctttaagaggtgtgctgatgtc

SEQ ID NO: 290500 - DNA, 25 bp, Mus musculus
gacctttaccaagagctgggtcgac

SEQ ID NO: 290501 - DNA, 25 bp, Mus musculus
gacctttacgacagtgtgaactgga

SEQ ID NO: 290502 - DNA, 25 bp, Mus musculus
gacctttatctcaggcttcctgctt

SEQ ID NO: 290503 - DNA, 25 bp, Mus musculus
gacctttccccagagcccgactctg

SEQ ID NO: 290504 - DNA, 25 bp, Mus musculus
gacctttccccaggcccggagcatt

SEQ ID NO: 290505 - DNA, 25 bp, Mus musculus
gacctttctactcaggaactgctga

SEQ ID NO: 290506 - DNA, 25 bp, Mus musculus
gacctttctaggtgactactttggg

SEQ ID NO: 290507 - DNA, 25 bp, Mus musculus
gacctttctgagggagacttcctga

SEQ ID NO: 290508 - DNA, 25 bp, Mus musculus
gacctttgctttagggatcagtctg

SEQ ID NO: 290509 - DNA, 25 bp, Mus musculus
gacctttgctttgattctttcagcc

SEQ ID NO: 290510 - DNA, 25 bp, Mus musculus
gacctttggccacgcttacagttcc

SEQ ID NO: 290511 - DNA, 25 bp, Mus musculus
gacctttggccaggcttacagttcc

SEQ ID NO: 290512 - DNA, 25 bp, Mus musculus
gacctttgtaaaagaatgatagaga

SEQ ID NO: 290513 - DNA, 25 bp, Mus musculus
gaccttttcataggttggatgatac

SEQ ID NO: 290514 - DNA, 25 bp, Mus musculus
gaccttttcggactgggtgaaagct

SEQ ID NO: 290515 - DNA, 25 bp, Mus musculus
gaccttttcggatcaagattatagg

SEQ ID NO: 290516 - DNA, 25 bp, Mus musculus
gaccttttcggggtcatcttggcac

SEQ ID NO: 290517 - DNA, 25 bp, Mus musculus
gaccttttcgtgggagccaagaaga

SEQ ID NO: 290518 - DNA, 25 bp, Mus musculus
gaccttttctctgagcaaagaacgt

SEQ ID NO: 290519 - DNA, 25 bp, Mus musculus
gaccttttgctagaggtagaagagc

SEQ ID NO: 290520 - DNA, 25 bp, Mus musculus
gaccttttgggaccagctggaagat

SEQ ID NO: 290521 - DNA, 25 bp, Mus musculus
gacgaaaaaagatgattcttttatt

SEQ ID NO: 290522 - DNA, 25 bp, Mus musculus
gacgaaaaaaggaatgtcctccaag

SEQ ID NO: 290523 - DNA, 25 bp, Mus musculus
gacgaaaacgacagaagataccaaa

SEQ ID NO: 290524 - DNA, 25 bp, Mus musculus
gacgaaaacgagctgttgcgcagcc

SEQ ID NO: 290525 - DNA, 25 bp, Mus musculus
gacgaaacaaaagtggtccatgccg

SEQ ID NO: 290526 - DNA, 25 bp, Mus musculus
gacgaaacagccaaggcttccaagc

SEQ ID NO: 290527 - DNA, 25 bp, Mus musculus
gacgaaaccacgaaccgcatgcacg

SEQ ID NO: 290528 - DNA, 25 bp, Mus musculus
gacgaaagcagcttttaatatattt

SEQ ID NO: 290529 - DNA, 25 bp, Mus musculus
gacgaaatcgggaagctctttgtgg

SEQ ID NO: 290530 - DNA, 25 bp, Mus musculus
gacgaactaggtcctgtgccattga

SEQ ID NO: 290531 - DNA, 25 bp, Mus musculus
gacgaactccaggatgtgtttgtcc

SEQ ID NO: 290532 - DNA, 25 bp, Mus musculus
gacgaactgagaaaagttttgctca

SEQ ID NO: 290533 - DNA, 25 bp, Mus musculus
gacgaagaaaggccacggaacacag

SEQ ID NO: 290534 - DNA, 25 bp, Mus musculus
gacgaagaaaggctacttcgtgtcc

SEQ ID NO: 290535 - DNA, 25 bp, Mus musculus
gacgaagaagacctgtattccccgc

SEQ ID NO: 290536 - DNA, 25 bp, Mus musculus
gacgaagaagacctgtattcctcgc

SEQ ID NO: 290537 - DNA, 25 bp, Mus musculus
gacgaagatgaaggtcaaactgggc

SEQ ID NO: 290538 - DNA, 25 bp, Mus musculus
gacgaagcagaggagttttttgagc

SEQ ID NO: 290539 - DNA, 25 bp, Mus musculus
gacgaagcaggagtgcactgccccc

SEQ ID NO: 290540 - DNA, 25 bp, Mus musculus
gacgaagcgggcagtcagaaaatgg

SEQ ID NO: 290541 - DNA, 25 bp, Mus musculus
gacgaaggaagacgtgggagagttc

SEQ ID NO: 290542 - DNA, 25 bp, Mus musculus
gacgaaggaagaggtgggagagttc

SEQ ID NO: 290543 - DNA, 25 bp, Mus musculus
gacgaaggggatgcatgtggatggc

SEQ ID NO: 290544 - DNA, 25 bp, Mus musculus
gacgaaggggatgttgtggaagtga

SEQ ID NO: 290545 - DNA, 25 bp, Mus musculus
gacgaagtggtcggaattctgcctt

SEQ ID NO: 290546 - DNA, 25 bp, Mus musculus
gacgaagttccgacagcagcccaac

SEQ ID NO: 290547 - DNA, 25 bp, Mus musculus
gacgaatctgatgaggttgtcttga

SEQ ID NO: 290548 - DNA, 25 bp, Mus musculus
gacgaatcttcgaggtgctggaaag

SEQ ID NO: 290549 - DNA, 25 bp, Mus musculus
gacgaatgcaaggcaccaacagaga

SEQ ID NO: 290550 - DNA, 25 bp, Mus musculus
gacgaatgcaaggtgagagcacaga

SEQ ID NO: 290551 - DNA, 25 bp, Mus musculus
gacgaattacctattgaagtggacc

SEQ ID NO: 290552 - DNA, 25 bp, Mus musculus
gacgaattggggactttgcttgtgg

SEQ ID NO: 290553 - DNA, 25 bp, Mus musculus
gacgacaaaggtcccccctgtggcc

SEQ ID NO: 290554 - DNA, 25 bp, Mus musculus
gacgacaagaactgctgagaagaag

SEQ ID NO: 290555 - DNA, 25 bp, Mus musculus
gacgacaagactggccaggtcatcc

SEQ ID NO: 290556 - DNA, 25 bp, Mus musculus
gacgacaatgcagctataaaaccat

SEQ ID NO: 290557 - DNA, 25 bp, Mus musculus
gacgacaccaaaagggctcaggatg

SEQ ID NO: 290558 - DNA, 25 bp, Mus musculus
gacgacaccaaggagtcagtccgac

SEQ ID NO: 290559 - DNA, 25 bp, Mus musculus
gacgacactcattcccagacccagt

SEQ ID NO: 290560 - DNA, 25 bp, Mus musculus
gacgacacttacgagcatacatctt

SEQ ID NO: 290561 - DNA, 25 bp, Mus musculus
gacgacacttacgataaactttata

SEQ ID NO: 290562 - DNA, 25 bp, Mus musculus
gacgacagcagagaaacatggctta

SEQ ID NO: 290563 - DNA, 25 bp, Mus musculus
gacgacagccaggtccccctggagc

SEQ ID NO: 290564 - DNA, 25 bp, Mus musculus
gacgacagcccatctgctgctcctg

SEQ ID NO: 290565 - DNA, 25 bp, Mus musculus
gacgaccagaagagagccaagcctc

SEQ ID NO: 290566 - DNA, 25 bp, Mus musculus
gacgacccaggaagagaaagagaaa

SEQ ID NO: 290567 - DNA, 25 bp, Mus musculus
gacgacccaggcaaagggaattact

SEQ ID NO: 290568 - DNA, 25 bp, Mus musculus
gacgaccctcaagtgccctgtgatg

SEQ ID NO: 290569 - DNA, 25 bp, Mus musculus
gacgaccctctaaggatatgctgtc

SEQ ID NO: 290570 - DNA, 25 bp, Mus musculus
gacgaccgactggaggatgctttgc

SEQ ID NO: 290571 - DNA, 25 bp, Mus musculus
gacgacctagagatgtggtcagctg

SEQ ID NO: 290572 - DNA, 25 bp, Mus musculus
gacgacctccaaatggttctgaatc

SEQ ID NO: 290573 - DNA, 25 bp, Mus musculus
gacgacgaagcaaacctttgaccag

SEQ ID NO: 290574 - DNA, 25 bp, Mus musculus
gacgacgaagcactggggaagaggc

SEQ ID NO: 290575 - DNA, 25 bp, Mus musculus
gacgacgaagtcgttctccccgcca

SEQ ID NO: 290576 - DNA, 25 bp, Mus musculus
gacgacgacagtttcagccctcttg

SEQ ID NO: 290577 - DNA, 25 bp, Mus musculus
gacgacgacgacgagattttccagg

SEQ ID NO: 290578 - DNA, 25 bp, Mus musculus
gacgacgacgacgagctagacgaga

SEQ ID NO: 290579 - DNA, 25 bp, Mus musculus
gacgacgacgagattttccagggca

SEQ ID NO: 290580 - DNA, 25 bp, Mus musculus
gacgacgacgagctagacgagaccc

SEQ ID NO: 290581 - DNA, 25 bp, Mus musculus
gacgacgatgactcccctgcaactg

SEQ ID NO: 290582 - DNA, 25 bp, Mus musculus
gacgacggcgaagagttcatatggg

SEQ ID NO: 290583 - DNA, 25 bp, Mus musculus
gacgacgtggtcaagacccagagaa

SEQ ID NO: 290584 - DNA, 25 bp, Mus musculus
gacgacgtggtcaagattgactttg

SEQ ID NO: 290585 - DNA, 25 bp, Mus musculus
gacgactactgagggtgtgacttct

SEQ ID NO: 290586 - DNA, 25 bp, Mus musculus
gacgactacttggggctcgtgagct

SEQ ID NO: 290587 - DNA, 25 bp, Mus musculus
gacgactgactggggatggaggtaa

SEQ ID NO: 290588 - DNA, 25 bp, Mus musculus
gacgactgactgggtgatgcccacg

SEQ ID NO: 290589 - DNA, 25 bp, Mus musculus
gacgactgccagtctccctatgagc

SEQ ID NO: 290590 - DNA, 25 bp, Mus musculus
gacgactgccccaagaggacctgcg

SEQ ID NO: 290591 - DNA, 25 bp, Mus musculus
gacgactggcgaagcagtgccccct

SEQ ID NO: 290592 - DNA, 25 bp, Mus musculus
gacgacttagacagagctgaggacc

SEQ ID NO: 290593 - DNA, 25 bp, Mus musculus
gacgacttagacaggtgctgccaga

SEQ ID NO: 290594 - DNA, 25 bp, Mus musculus
gacgacttggagccccacgcaatca

SEQ ID NO: 290595 - DNA, 25 bp, Mus musculus
gacgagaaaaagctggagagatgtc

SEQ ID NO: 290596 - DNA, 25 bp, Mus musculus
gacgagaacagaaaatactcttgcg

SEQ ID NO: 290597 - DNA, 25 bp, Mus musculus
gacgagaagcacatcaaggtgaacc

SEQ ID NO: 290598 - DNA, 25 bp, Mus musculus
gacgagaatggaaacttgagttcgg

SEQ ID NO: 290599 - DNA, 25 bp, Mus musculus
gacgagaatgggcaattgcttccca

SEQ ID NO: 290600 - DNA, 25 bp, Mus musculus
gacgagacaaactgccagaaagtat

SEQ ID NO: 290601 - DNA, 25 bp, Mus musculus
gacgagacaaagtgctgctgttttt

SEQ ID NO: 290602 - DNA, 25 bp, Mus musculus
gacgagaccgaggcttacttctttg

SEQ ID NO: 290603 - DNA, 25 bp, Mus musculus
gacgagaccgaggtctttgacagaa

SEQ ID NO: 290604 - DNA, 25 bp, Mus musculus
gacgagaccgagttacttgccggtc

SEQ ID NO: 290605 - DNA, 25 bp, Mus musculus
gacgagaccggcggcaagtacattg

SEQ ID NO: 290606 - DNA, 25 bp, Mus musculus
gacgagacgagagtgatctcagcgc

SEQ ID NO: 290607 - DNA, 25 bp, Mus musculus
gacgagaggctgcaggctacagaac

SEQ ID NO: 290608 - DNA, 25 bp, Mus musculus
gacgagagtgtcaaaggatcaatgt

SEQ ID NO: 290609 - DNA, 25 bp, Mus musculus
gacgagagtgtcaaagtacttcaac

SEQ ID NO: 290610 - DNA, 25 bp, Mus musculus
gacgagatcttaaggacctggggat

SEQ ID NO: 290611 - DNA, 25 bp, Mus musculus
gacgagcatgagaggaggagcttgg

SEQ ID NO: 290612 - DNA, 25 bp, Mus musculus
gacgagcatgagcttagcagcctgg

SEQ ID NO: 290613 - DNA, 25 bp, Mus musculus
gacgagcatgagtggggtccggcca

SEQ ID NO: 290614 - DNA, 25 bp, Mus musculus
gacgagcgagatgaagcacacaggc

SEQ ID NO: 290615 - DNA, 25 bp, Mus musculus
gacgagctcatcgagaaacatggct

SEQ ID NO: 290616 - DNA, 25 bp, Mus musculus
gacgagctcatcgaggagaatcagc

SEQ ID NO: 290617 - DNA, 25 bp, Mus musculus
gacgagctccagatgctctccaagt

SEQ ID NO: 290618 - DNA, 25 bp, Mus musculus
gacgagctccagggtttctcagtgt

SEQ ID NO: 290619 - DNA, 25 bp, Mus musculus
gacgagctcttgaaggatctgcagc

SEQ ID NO: 290620 - DNA, 25 bp, Mus musculus
gacgagctgaattctttatacaatt

SEQ ID NO: 290621 - DNA, 25 bp, Mus musculus
gacgagctggcgggtgaaaattttg

SEQ ID NO: 290622 - DNA, 25 bp, Mus musculus
gacgagctggcggttttgtaccaat

SEQ ID NO: 290623 - DNA, 25 bp, Mus musculus
gacgagctgtaaggtgacagaagac

SEQ ID NO: 290624 - DNA, 25 bp, Mus musculus
gacgagctgtaagtgagcttcacta

SEQ ID NO: 290625 - DNA, 25 bp, Mus musculus
gacgagctgtcggcattatgccagt

SEQ ID NO: 290626 - DNA, 25 bp, Mus musculus
gacgagctgtcgggagaaaattttg

SEQ ID NO: 290627 - DNA, 25 bp, Mus musculus
gacgagcttacaaagaatggaattg

SEQ ID NO: 290628 - DNA, 25 bp, Mus musculus
gacgaggaagagaaggctgaggcag

SEQ ID NO: 290629 - DNA, 25 bp, Mus musculus
gacgaggaagaggagaaaccaagac

SEQ ID NO: 290630 - DNA, 25 bp, Mus musculus
gacgaggacgagctaaagcggctgc

SEQ ID NO: 290631 - DNA, 25 bp, Mus musculus
gacgaggacgagctacagccctaca

SEQ ID NO: 290632 - DNA, 25 bp, Mus musculus
gacgaggagcaggttgctatcggct

SEQ ID NO: 290633 - DNA, 25 bp, Mus musculus
gacgaggagtctggctcgggtcttt

SEQ ID NO: 290634 - DNA, 25 bp, Mus musculus
gacgaggagtctggtggaggctcca

SEQ ID NO: 290635 - DNA, 25 bp, Mus musculus
gacgaggagtggttccgatctaagt

SEQ ID NO: 290636 - DNA, 25 bp, Mus musculus
gacgaggatgaggactcgtccagtg

SEQ ID NO: 290637 - DNA, 25 bp, Mus musculus
gacgaggccgagcccctcggagccc

SEQ ID NO: 290638 - DNA, 25 bp, Mus musculus
gacgaggcctaccaggtcagcttgc

SEQ ID NO: 290639 - DNA, 25 bp, Mus musculus
gacgaggcgggacatgttctcagaa

SEQ ID NO: 290640 - DNA, 25 bp, Mus musculus
gacgaggcgggccatccgggtattc

SEQ ID NO: 290641 - DNA, 25 bp, Mus musculus
gacgaggcgtgagcacctccgcacc

SEQ ID NO: 290642 - DNA, 25 bp, Mus musculus
gacgaggctcgtcaggcacagaagg

SEQ ID NO: 290643 - DNA, 25 bp, Mus musculus
gacgaggcttccagctccagaaatc

SEQ ID NO: 290644 - DNA, 25 bp, Mus musculus
gacgagggactgcaggtgtgagagt

SEQ ID NO: 290645 - DNA, 25 bp, Mus musculus
gacgagtatgaattggagctactgc

SEQ ID NO: 290646 - DNA, 25 bp, Mus musculus
gacgagtccagattgctgaagctaa

SEQ ID NO: 290647 - DNA, 25 bp, Mus musculus
gacgagtcctatggtgaaggctgca

SEQ ID NO: 290648 - DNA, 25 bp, Mus musculus
gacgagtctgatagctgctgcttcc

SEQ ID NO: 290649 - DNA, 25 bp, Mus musculus
gacgagtctgatatctgctgcttcc

SEQ ID NO: 290650 - DNA, 25 bp, Mus musculus
gacgagttcatgaaggaagcgggtg

SEQ ID NO: 290651 - DNA, 25 bp, Mus musculus
gacgagttcatgaaggaggatttcg

SEQ ID NO: 290652 - DNA, 25 bp, Mus musculus
gacgagtttgacaagatgaatgacc

SEQ ID NO: 290653 - DNA, 25 bp, Mus musculus
gacgagtttgttgtcacaatgctta

SEQ ID NO: 290654 - DNA, 25 bp, Mus musculus
gacgataatgaagaaaacgggagtg

SEQ ID NO: 290655 - DNA, 25 bp, Mus musculus
gacgatacagaaagagtctttctcc

SEQ ID NO: 290656 - DNA, 25 bp, Mus musculus
gacgatagctgagagtcgacaatta

SEQ ID NO: 290657 - DNA, 25 bp, Mus musculus
gacgatcagaagactcacagtggtg

SEQ ID NO: 290658 - DNA, 25 bp, Mus musculus
gacgatcagaagatgcgctgatcct

SEQ ID NO: 290659 - DNA, 25 bp, Mus musculus
gacgatccagcttacattgcagttt

SEQ ID NO: 290660 - DNA, 25 bp, Mus musculus
gacgatccagcttgtattgcagttt

SEQ ID NO: 290661 - DNA, 25 bp, Mus musculus
gacgatccgtgacagactcaaacta

SEQ ID NO: 290662 - DNA, 25 bp, Mus musculus
gacgatccgtgacaggccctttgaa

SEQ ID NO: 290663 - DNA, 25 bp, Mus musculus
gacgatcctgccttgacactagttg

SEQ ID NO: 290664 - DNA, 25 bp, Mus musculus
gacgatccttgtggacttctgggat

SEQ ID NO: 290665 - DNA, 25 bp, Mus musculus
gacgatccttgtgggtatttgatgt

SEQ ID NO: 290666 - DNA, 25 bp, Mus musculus
gacgatgaaggtgaagatgccatca

SEQ ID NO: 290667 - DNA, 25 bp, Mus musculus
gacgatgaagtaaggaaagccagcg

SEQ ID NO: 290668 - DNA, 25 bp, Mus musculus
gacgatgactcccctgcaactgtgc

SEQ ID NO: 290669 - DNA, 25 bp, Mus musculus
gacgatgactgaggtgcttcacctt

SEQ ID NO: 290670 - DNA, 25 bp, Mus musculus
gacgatgatgtttgtgatcctgtgc

SEQ ID NO: 290671 - DNA, 25 bp, Mus musculus
gacgatgcacaggccatagaagcca

SEQ ID NO: 290672 - DNA, 25 bp, Mus musculus
gacgatgcggagtacatgaagcaca

SEQ ID NO: 290673 - DNA, 25 bp, Mus musculus
gacgatggacccaggtaaacagttg

SEQ ID NO: 290674 - DNA, 25 bp, Mus musculus
gacgatggacccaggttactccagt

SEQ ID NO: 290675 - DNA, 25 bp, Mus musculus
gacgattactttgaataccctggag

SEQ ID NO: 290676 - DNA, 25 bp, Mus musculus
gacgattactttggccgttgtgccc

SEQ ID NO: 290677 - DNA, 25 bp, Mus musculus
gacgatttcagaatgctccccggga

SEQ ID NO: 290678 - DNA, 25 bp, Mus musculus
gacgatttggggctcatcacaagca

SEQ ID NO: 290679 - DNA, 25 bp, Mus musculus
gacgatttgggtgtcctgctccctg

SEQ ID NO: 290680 - DNA, 25 bp, Mus musculus
gacgcaaaagagtgtgaagattgct

SEQ ID NO: 290681 - DNA, 25 bp, Mus musculus
gacgcaaacacaggtgaaaatctgg

SEQ ID NO: 290682 - DNA, 25 bp, Mus musculus
gacgcaagaagaagaaggtgccatc

SEQ ID NO: 290683 - DNA, 25 bp, Mus musculus
gacgcaagaagaagcaccccactgg

SEQ ID NO: 290684 - DNA, 25 bp, Mus musculus
gacgcaagagcaggaatccagccat

SEQ ID NO: 290685 - DNA, 25 bp, Mus musculus
gacgcaaggaaatgcccggaaccgc

SEQ ID NO: 290686 - DNA, 25 bp, Mus musculus
gacgcaattcagtcaggatggctaa

SEQ ID NO: 290687 - DNA, 25 bp, Mus musculus
gacgcaccagctcccttccccgatc

SEQ ID NO: 290688 - DNA, 25 bp, Mus musculus
gacgcaccagggggactccctgggg

SEQ ID NO: 290689 - DNA, 25 bp, Mus musculus
gacgcaccaggtcacacacacatac

SEQ ID NO: 290690 - DNA, 25 bp, Mus musculus
gacgcacccttcagtacaagcccac

SEQ ID NO: 290691 - DNA, 25 bp, Mus musculus
gacgcagaagagactgagaggaatc

SEQ ID NO: 290692 - DNA, 25 bp, Mus musculus
gacgcagaagagcctaccgaggacg

SEQ ID NO: 290693 - DNA, 25 bp, Mus musculus
gacgcagaagagtttgactttggcg

SEQ ID NO: 290694 - DNA, 25 bp, Mus musculus
gacgcagagaagggcccagtgtgca

SEQ ID NO: 290695 - DNA, 25 bp, Mus musculus
gacgcagagctgctcagggtgccgc

SEQ ID NO: 290696 - DNA, 25 bp, Mus musculus
gacgcagagctggctcccgcgtatg

SEQ ID NO: 290697 - DNA, 25 bp, Mus musculus
gacgcagcacgccatcaatgatgat

SEQ ID NO: 290698 - DNA, 25 bp, Mus musculus
gacgcagcacgccgtatgtgcagga

SEQ ID NO: 290699 - DNA, 25 bp, Mus musculus
gacgcagcaggtcttctatcagaaa

SEQ ID NO: 290700 - DNA, 25 bp, Mus musculus
gacgcagccagagagggaaactgag

SEQ ID NO: 290701 - DNA, 25 bp, Mus musculus
gacgcagccagagcttgtccaggtg

SEQ ID NO: 290702 - DNA, 25 bp, Mus musculus
gacgcagcgacacttgtccttcaca

SEQ ID NO: 290703 - DNA, 25 bp, Mus musculus
gacgcagcgctagcctaaattgtat

SEQ ID NO: 290704 - DNA, 25 bp, Mus musculus
gacgcagctgaaggtgatcaactgg

SEQ ID NO: 290705 - DNA, 25 bp, Mus musculus
gacgcaggagaagaaccaccaccaa

SEQ ID NO: 290706 - DNA, 25 bp, Mus musculus
gacgcaggagaagcacatcatgcaa

SEQ ID NO: 290707 - DNA, 25 bp, Mus musculus
gacgcaggatgatgtctggcaggac

SEQ ID NO: 290708 - DNA, 25 bp, Mus musculus
gacgcaggccaagttggtggaaggc

SEQ ID NO: 290709 - DNA, 25 bp, Mus musculus
gacgcaggctggctcaccatcatgg

SEQ ID NO: 290710 - DNA, 25 bp, Mus musculus
gacgcagtctatgggacgcctcaga

SEQ ID NO: 290711 - DNA, 25 bp, Mus musculus
gacgcagtctgacctctacaagaag

SEQ ID NO: 290712 - DNA, 25 bp, Mus musculus
gacgcatacctgtggcagcaccggg

SEQ ID NO: 290713 - DNA, 25 bp, Mus musculus
gacgcatacctgtggtctcaccagc

SEQ ID NO: 290714 - DNA, 25 bp, Mus musculus
gacgcatccctgcaggggcctgtgt

SEQ ID NO: 290715 - DNA, 25 bp, Mus musculus
gacgcatgctggcgatgcccctaga

SEQ ID NO: 290716 - DNA, 25 bp, Mus musculus
gacgcatttctatcgcaggcacatc

SEQ ID NO: 290717 - DNA, 25 bp, Mus musculus
gacgcatttctatcgcatgaagata

SEQ ID NO: 290718 - DNA, 25 bp, Mus musculus
gacgcatttctatcgggttcatagt

SEQ ID NO: 290719 - DNA, 25 bp, Mus musculus
gacgcatttctatcggtatccgccc

SEQ ID NO: 290720 - DNA, 25 bp, Mus musculus
gacgcatttggatgaggatggaaga

SEQ ID NO: 290721 - DNA, 25 bp, Mus musculus
gacgccaaggagtgggtatggagga

SEQ ID NO: 290722 - DNA, 25 bp, Mus musculus
gacgccagcaccttctgcttcccgg

SEQ ID NO: 290723 - DNA, 25 bp, Mus musculus
gacgccatcatcggagaagcttctg

SEQ ID NO: 290724 - DNA, 25 bp, Mus musculus
gacgccatcatcggcgctggcgaga

SEQ ID NO: 290725 - DNA, 25 bp, Mus musculus
gacgccatgccaggtatgcaggaca

SEQ ID NO: 290726 - DNA, 25 bp, Mus musculus
gacgccatgccaggtgtgtttgatc

SEQ ID NO: 290727 - DNA, 25 bp, Mus musculus
gacgcccaaggaccacctaccctgg

SEQ ID NO: 290728 - DNA, 25 bp, Mus musculus
gacgcccaggccggtcccggatgtt

SEQ ID NO: 290729 - DNA, 25 bp, Mus musculus
gacgccccaaagagggtcttgagag

SEQ ID NO: 290730 - DNA, 25 bp, Mus musculus
gacgccccggctgccctcaaagcgg

SEQ ID NO: 290731 - DNA, 25 bp, Mus musculus
gacgccctctgatgtgaaagagctg

SEQ ID NO: 290732 - DNA, 25 bp, Mus musculus
gacgccgagaagaaggaactcggag

SEQ ID NO: 290733 - DNA, 25 bp, Mus musculus
gacgccgccttggggcatcatgaca

SEQ ID NO: 290734 - DNA, 25 bp, Mus musculus
gacgccgcgaggatctaagatgtcc

SEQ ID NO: 290735 - DNA, 25 bp, Mus musculus
gacgccgcggcagccagtcccgctc

SEQ ID NO: 290736 - DNA, 25 bp, Mus musculus
gacgccgctctcagaacccaggaag

SEQ ID NO: 290737 - DNA, 25 bp, Mus musculus
gacgccgctctcaggtcaaatctaa

SEQ ID NO: 290738 - DNA, 25 bp, Mus musculus
gacgccggaagatgatgccagacca

SEQ ID NO: 290739 - DNA, 25 bp, Mus musculus
gacgccggtggagggtcaggatggc

SEQ ID NO: 290740 - DNA, 25 bp, Mus musculus
gacgccggtggagggtgtcccctgc

SEQ ID NO: 290741 - DNA, 25 bp, Mus musculus
gacgccggtggaggtcgactggcca

SEQ ID NO: 290742 - DNA, 25 bp, Mus musculus
gacgcctaaaaaaggtctgtgcacc

SEQ ID NO: 290743 - DNA, 25 bp, Mus musculus
gacgcctatgcaggagcatctgcag

SEQ ID NO: 290744 - DNA, 25 bp, Mus musculus
gacgcctatggctcagaggactcca

SEQ ID NO: 290745 - DNA, 25 bp, Mus musculus
gacgcctcaagcacttgtctctgca

SEQ ID NO: 290746 - DNA, 25 bp, Mus musculus
gacgcctcaagggttgagacatccc

SEQ ID NO: 290747 - DNA, 25 bp, Mus musculus
gacgcctcagctgcacactgcccca

SEQ ID NO: 290748 - DNA, 25 bp, Mus musculus
gacgcctccacggggtttgacttca

SEQ ID NO: 290749 - DNA, 25 bp, Mus musculus
gacgcctctcatggtcgctgtctta

SEQ ID NO: 290750 - DNA, 25 bp, Mus musculus
gacgcctgaacggctccaggactgg

SEQ ID NO: 290751 - DNA, 25 bp, Mus musculus
gacgcctgctcggtcagtcagcagt

SEQ ID NO: 290752 - DNA, 25 bp, Mus musculus
gacgcctgctcgtgtgtataagctg

SEQ ID NO: 290753 - DNA, 25 bp, Mus musculus
gacgccttccccagctgggccgcga

SEQ ID NO: 290754 - DNA, 25 bp, Mus musculus
gacgcctttgaggtcttgctgatcc

SEQ ID NO: 290755 - DNA, 25 bp, Mus musculus
gacgcgacagaaaccgcccagaata

SEQ ID NO: 290756 - DNA, 25 bp, Mus musculus
gacgcgacagcacaccacatgtatt

SEQ ID NO: 290757 - DNA, 25 bp, Mus musculus
gacgcgatagttctgacacaacacc

SEQ ID NO: 290758 - DNA, 25 bp, Mus musculus
gacgcgatttacgaaatctaccaga

SEQ ID NO: 290759 - DNA, 25 bp, Mus musculus
gacgcgcctcgataaggaaaagggg

SEQ ID NO: 290760 - DNA, 25 bp, Mus musculus
gacgcgcctttccctctggagcccc

SEQ ID NO: 290761 - DNA, 25 bp, Mus musculus
gacgcgcctttcctctctggagagc

SEQ ID NO: 290762 - DNA, 25 bp, Mus musculus
gacgcgcctttctccaccccaggcc

SEQ ID NO: 290763 - DNA, 25 bp, Mus musculus
gacgcgcggaggaaaacttggttat

SEQ ID NO: 290764 - DNA, 25 bp, Mus musculus
gacgcgcggggaagagtcttgcgct

SEQ ID NO: 290765 - DNA, 25 bp, Mus musculus
gacgcgctttggaggtgacaaactt

SEQ ID NO: 290766 - DNA, 25 bp, Mus musculus
gacgcggaaccggagctggactggc

SEQ ID NO: 290767 - DNA, 25 bp, Mus musculus
gacgcggaagatctcagcggttcta

SEQ ID NO: 290768 - DNA, 25 bp, Mus musculus
gacgcggaagggaccagatttttga

SEQ ID NO: 290769 - DNA, 25 bp, Mus musculus
gacgcggacggacccctggacttcg

SEQ ID NO: 290770 - DNA, 25 bp, Mus musculus
gacgcggacggacttgatgtggatg

SEQ ID NO: 290771 - DNA, 25 bp, Mus musculus
gacgcggagagtagattggatccag

SEQ ID NO: 290772 - DNA, 25 bp, Mus musculus
gacgcggccctgcagatcaccagca

SEQ ID NO: 290773 - DNA, 25 bp, Mus musculus
gacgcggccctgcaggagtgactag

SEQ ID NO: 290774 - DNA, 25 bp, Mus musculus
gacgcggcgacaggtcttctactta

SEQ ID NO: 290775 - DNA, 25 bp, Mus musculus
gacgcggcgctgcggagagctcaga

SEQ ID NO: 290776 - DNA, 25 bp, Mus musculus
gacgcggcgctgcggcaatgccaag

SEQ ID NO: 290777 - DNA, 25 bp, Mus musculus
gacgcggctgccaaaagcggaggcc

SEQ ID NO: 290778 - DNA, 25 bp, Mus musculus
gacgcgggcagcagcttggcaaatg

SEQ ID NO: 290779 - DNA, 25 bp, Mus musculus
gacgcgggcagcaggtcactacgtt

SEQ ID NO: 290780 - DNA, 25 bp, Mus musculus
gacgcgggcagcagtgacagccctg

SEQ ID NO: 290781 - DNA, 25 bp, Mus musculus
gacgcggggaaatggactcagtggc

SEQ ID NO: 290782 - DNA, 25 bp, Mus musculus
gacgcgggtgggtcatcgtggagaa

SEQ ID NO: 290783 - DNA, 25 bp, Mus musculus
gacgcgtccgactgaggctccacgg

SEQ ID NO: 290784 - DNA, 25 bp, Mus musculus
gacgcgtccggccccagcggtgctc

SEQ ID NO: 290785 - DNA, 25 bp, Mus musculus
gacgcgtgtgtgcagttcaccttcc

SEQ ID NO: 290786 - DNA, 25 bp, Mus musculus
gacgcgtgtgtggagttcaccttcc

SEQ ID NO: 290787 - DNA, 25 bp, Mus musculus
gacgctaacccaggagaacgtcagc

SEQ ID NO: 290788 - DNA, 25 bp, Mus musculus
gacgctagcactaacgtgaccctgg

SEQ ID NO: 290789 - DNA, 25 bp, Mus musculus
gacgctagcactaactgacctgggc

SEQ ID NO: 290790 - DNA, 25 bp, Mus musculus
gacgctagtcagggacaagaagacc

SEQ ID NO: 290791 - DNA, 25 bp, Mus musculus
gacgctcaaacacagctcaaagatt

SEQ ID NO: 290792 - DNA, 25 bp, Mus musculus
gacgctcaaggatgaagaaacacgg

SEQ ID NO: 290793 - DNA, 25 bp, Mus musculus
gacgctcaagtcctcctgcatatgc

SEQ ID NO: 290794 - DNA, 25 bp, Mus musculus
gacgctcagagagggggaggcatga

SEQ ID NO: 290795 - DNA, 25 bp, Mus musculus
gacgctcagaggttttctcttttta

SEQ ID NO: 290796 - DNA, 25 bp, Mus musculus
gacgctcaggggaggggcgacatcc

SEQ ID NO: 290797 - DNA, 25 bp, Mus musculus
gacgctcagtggcagcactccgcca

SEQ ID NO: 290798 - DNA, 25 bp, Mus musculus
gacgctcccccttagacactacttt

SEQ ID NO: 290799 - DNA, 25 bp, Mus musculus
gacgctcggcccaggataagtacgg

SEQ ID NO: 290800 - DNA, 25 bp, Mus musculus
gacgctctacacgatgcggccgaaa

SEQ ID NO: 290801 - DNA, 25 bp, Mus musculus
gacgctctacacgtatgaagtacac

SEQ ID NO: 290802 - DNA, 25 bp, Mus musculus
gacgctctgccctgattccttctgg

SEQ ID NO: 290803 - DNA, 25 bp, Mus musculus
gacgctgaatgtcatgtatttcaac

SEQ ID NO: 290804 - DNA, 25 bp, Mus musculus
gacgctgacatggactgggctgtgg

SEQ ID NO: 290805 - DNA, 25 bp, Mus musculus
gacgctgacattcagagttgaaact

SEQ ID NO: 290806 - DNA, 25 bp, Mus musculus
gacgctgacattcaggtgcagtctt

SEQ ID NO: 290807 - DNA, 25 bp, Mus musculus
gacgctgacgggctgacaggcgagc

SEQ ID NO: 290808 - DNA, 25 bp, Mus musculus
gacgctgacggggtggaggagctac

SEQ ID NO: 290809 - DNA, 25 bp, Mus musculus
gacgctgaggaagccgccactggag

SEQ ID NO: 290810 - DNA, 25 bp, Mus musculus
gacgctgaggtggtatataaccgtt

SEQ ID NO: 290811 - DNA, 25 bp, Mus musculus
gacgctgcacgatagtatgaccggt

SEQ ID NO: 290812 - DNA, 25 bp, Mus musculus
gacgctgccggccatcgtcgttctt

SEQ ID NO: 290813 - DNA, 25 bp, Mus musculus
gacgctgccgggtctcttccactgt

SEQ ID NO: 290814 - DNA, 25 bp, Mus musculus
gacgctgcgaggaagagccctgggg

SEQ ID NO: 290815 - DNA, 25 bp, Mus musculus
gacgctgctgcctctgattggcctt

SEQ ID NO: 290816 - DNA, 25 bp, Mus musculus
gacgctgctgcctgtattgaccaag

SEQ ID NO: 290817 - DNA, 25 bp, Mus musculus
gacgctggaatctggccctggttct

SEQ ID NO: 290818 - DNA, 25 bp, Mus musculus
gacgctggaatctgtgggcgggcag

SEQ ID NO: 290819 - DNA, 25 bp, Mus musculus
gacgctggcagacaccactaactgt

SEQ ID NO: 290820 - DNA, 25 bp, Mus musculus
gacgctggctctctcttggcctgtt

SEQ ID NO: 290821 - DNA, 25 bp, Mus musculus
gacgctggtgctggggtcctttatg

SEQ ID NO: 290822 - DNA, 25 bp, Mus musculus
gacgctgttaagagttcacatgaga

SEQ ID NO: 290823 - DNA, 25 bp, Mus musculus
gacgctgttgccgtgacctttgcag

SEQ ID NO: 290824 - DNA, 25 bp, Mus musculus
gacgcttgtccggcctctgtagagc

SEQ ID NO: 290825 - DNA, 25 bp, Mus musculus
gacgcttgtccgggcgggttgaggc

SEQ ID NO: 290826 - DNA, 25 bp, Mus musculus
gacgctttggatgagtgtgaactgg

SEQ ID NO: 290827 - DNA, 25 bp, Mus musculus
gacgctttggatggctcccggacct

SEQ ID NO: 290828 - DNA, 25 bp, Mus musculus
gacgctttggatggtgatgatgaag

SEQ ID NO: 290829 - DNA, 25 bp, Mus musculus
gacgctttggatgtgccttcggagg

SEQ ID NO: 290830 - DNA, 25 bp, Mus musculus
gacgcttttgccagacaagcagtga

SEQ ID NO: 290831 - DNA, 25 bp, Mus musculus
gacgcttttgccaggtgatggaaaa

SEQ ID NO: 290832 - DNA, 25 bp, Mus musculus
gacggaaaaacaagagttactcaca

SEQ ID NO: 290833 - DNA, 25 bp, Mus musculus
gacggaaaaccagagtccagcctct

SEQ ID NO: 290834 - DNA, 25 bp, Mus musculus
gacggaaaagtgtcattggtctcag

SEQ ID NO: 290835 - DNA, 25 bp, Mus musculus
gacggaaatcaaggattcttaatca

SEQ ID NO: 290836 - DNA, 25 bp, Mus musculus
gacggaagaatcgggcagctcagtg

SEQ ID NO: 290837 - DNA, 25 bp, Mus musculus
gacggaagacacggagtatatatcc

SEQ ID NO: 290838 - DNA, 25 bp, Mus musculus
gacggaagccatggcaggacaaaga

SEQ ID NO: 290839 - DNA, 25 bp, Mus musculus
gacggaagctgagccagacccaggg

SEQ ID NO: 290840 - DNA, 25 bp, Mus musculus
gacggaagctgatcctcttcccagc

SEQ ID NO: 290841 - DNA, 25 bp, Mus musculus
gacggaataggggtcgaggatgtca

SEQ ID NO: 290842 - DNA, 25 bp, Mus musculus
gacggaatgacaaagaattactgac

SEQ ID NO: 290843 - DNA, 25 bp, Mus musculus
gacggaccccggcaggaggactgtt

SEQ ID NO: 290844 - DNA, 25 bp, Mus musculus
gacggacccctgtttgtaagcggtg

SEQ ID NO: 290845 - DNA, 25 bp, Mus musculus
gacggacccgatgtgcgcattaaag

SEQ ID NO: 290846 - DNA, 25 bp, Mus musculus
gacggacccgatgtggctcttaagg

SEQ ID NO: 290847 - DNA, 25 bp, Mus musculus
gacggaccctgggagcctacttcca

SEQ ID NO: 290848 - DNA, 25 bp, Mus musculus
gacggactgaggaaaacaaaaatca

SEQ ID NO: 290849 - DNA, 25 bp, Mus musculus
gacggagacagggagttctcagatg

SEQ ID NO: 290850 - DNA, 25 bp, Mus musculus
gacggagactccagatgaggacgat

SEQ ID NO: 290851 - DNA, 25 bp, Mus musculus
gacggagactccaggccacaatgga

SEQ ID NO: 290852 - DNA, 25 bp, Mus musculus
gacggagactgaggatgaggctgta

SEQ ID NO: 290853 - DNA, 25 bp, Mus musculus
gacggagcaggcctgtctcgtcatg

SEQ ID NO: 290854 - DNA, 25 bp, Mus musculus
gacggagcatggttggagcctctct

SEQ ID NO: 290855 - DNA, 25 bp, Mus musculus
gacggagcgactcgatcccctgaac

SEQ ID NO: 290856 - DNA, 25 bp, Mus musculus
gacggagcgactcgttctgcctccc

SEQ ID NO: 290857 - DNA, 25 bp, Mus musculus
gacggaggagaaggaactatcccct

SEQ ID NO: 290858 - DNA, 25 bp, Mus musculus
gacggaggagaagtctggacagagg

SEQ ID NO: 290859 - DNA, 25 bp, Mus musculus
gacggaggcagcatctgcatctcta

SEQ ID NO: 290860 - DNA, 25 bp, Mus musculus
gacggaggcgagcgggcttggctga

SEQ ID NO: 290861 - DNA, 25 bp, Mus musculus
gacggaggctgagatcactggagat

SEQ ID NO: 290862 - DNA, 25 bp, Mus musculus
gacggaggggaggaaatgagaaaga

SEQ ID NO: 290863 - DNA, 25 bp, Mus musculus
gacggaggggaggaagatggcactg

SEQ ID NO: 290864 - DNA, 25 bp, Mus musculus
gacggaggggaggaagcctagccgc

SEQ ID NO: 290865 - DNA, 25 bp, Mus musculus
gacggaggggaggaaggcatccccc

SEQ ID NO: 290866 - DNA, 25 bp, Mus musculus
gacggatacgcggcgagccggtgtg

SEQ ID NO: 290867 - DNA, 25 bp, Mus musculus
gacggatacgcggcggcgcctgtgt

SEQ ID NO: 290868 - DNA, 25 bp, Mus musculus
gacggatctcagataataaccaaag

SEQ ID NO: 290869 - DNA, 25 bp, Mus musculus
gacggatgcggatgccatgaagtac

SEQ ID NO: 290870 - DNA, 25 bp, Mus musculus
gacggatgctggagctctcttgagt

SEQ ID NO: 290871 - DNA, 25 bp, Mus musculus
gacggatggcacaggagctgataca

SEQ ID NO: 290872 - DNA, 25 bp, Mus musculus
gacggattcctcctcaagtactaca

SEQ ID NO: 290873 - DNA, 25 bp, Mus musculus
gacggattcctggtgggtattgtgc

SEQ ID NO: 290874 - DNA, 25 bp, Mus musculus
gacggcaaaaaatgtaacatttcac

SEQ ID NO: 290875 - DNA, 25 bp, Mus musculus
gacggcaaaaaatgttggtttgcca

SEQ ID NO: 290876 - DNA, 25 bp, Mus musculus
gacggcaagtacctggcttcctgtg

SEQ ID NO: 290877 - DNA, 25 bp, Mus musculus
gacggcacactgaaaagatccgctt

SEQ ID NO: 290878 - DNA, 25 bp, Mus musculus
gacggcacactgatgagcgccccta

SEQ ID NO: 290879 - DNA, 25 bp, Mus musculus
gacggcacagagctcctggccagtt

SEQ ID NO: 290880 - DNA, 25 bp, Mus musculus
gacggcaccatggcgtttatgtttg

SEQ ID NO: 290881 - DNA, 25 bp, Mus musculus
gacggcacccagtaatctttggaaa

SEQ ID NO: 290882 - DNA, 25 bp, Mus musculus
gacggcaggagagcctgtgtcctga

SEQ ID NO: 290883 - DNA, 25 bp, Mus musculus
gacggcaggagagggctgtagcagt

SEQ ID NO: 290884 - DNA, 25 bp, Mus musculus
gacggcaggattcacgttggtgacc

SEQ ID NO: 290885 - DNA, 25 bp, Mus musculus
gacggcagtactggcaccttctcca

SEQ ID NO: 290886 - DNA, 25 bp, Mus musculus
gacggcagtactggtcctaaccgta

SEQ ID NO: 290887 - DNA, 25 bp, Mus musculus
gacggcatgtacgctaacttgggta

SEQ ID NO: 290888 - DNA, 25 bp, Mus musculus
gacggccaaagcacatgctccattt

SEQ ID NO: 290889 - DNA, 25 bp, Mus musculus
gacggccacattgattttcctcgca

SEQ ID NO: 290890 - DNA, 25 bp, Mus musculus
gacggccacattgccctgtcagcct

SEQ ID NO: 290891 - DNA, 25 bp, Mus musculus
gacggccatggaaccacaaaccacc

SEQ ID NO: 290892 - DNA, 25 bp, Mus musculus
gacggcccaagcctactcgcccagc

SEQ ID NO: 290893 - DNA, 25 bp, Mus musculus
gacggccctaagggtggaactactc

SEQ ID NO: 290894 - DNA, 25 bp, Mus musculus
gacggccctaaggtttgaggattgc

SEQ ID NO: 290895 - DNA, 25 bp, Mus musculus
gacggccctaagtgggagccggtga

SEQ ID NO: 290896 - DNA, 25 bp, Mus musculus
gacggccctcgatggggcatcctgg

SEQ ID NO: 290897 - DNA, 25 bp, Mus musculus
gacggcccttggtgtggacagttct

SEQ ID NO: 290898 - DNA, 25 bp, Mus musculus
gacggccgaggcggcccagggcctt

SEQ ID NO: 290899 - DNA, 25 bp, Mus musculus
gacggccgcctgcagcagagatgct

SEQ ID NO: 290900 - DNA, 25 bp, Mus musculus
gacggccgcctgcagcatgtttgta

SEQ ID NO: 290901 - DNA, 25 bp, Mus musculus
gacggcctggtagtattaaaggaac

SEQ ID NO: 290902 - DNA, 25 bp, Mus musculus
gacggcgaagagttcatatgggaag

SEQ ID NO: 290903 - DNA, 25 bp, Mus musculus
gacggcgctatggtggattgtccag

SEQ ID NO: 290904 - DNA, 25 bp, Mus musculus
gacggcggccagcatcaggaagatg

SEQ ID NO: 290905 - DNA, 25 bp, Mus musculus
gacggcgtgacctccaactacattg

SEQ ID NO: 290906 - DNA, 25 bp, Mus musculus
gacggctatgaatcatccaggtttg

SEQ ID NO: 290907 - DNA, 25 bp, Mus musculus
gacggctcagaaaagggggatttca

SEQ ID NO: 290908 - DNA, 25 bp, Mus musculus
gacggctccagattactacaaggga

SEQ ID NO: 290909 - DNA, 25 bp, Mus musculus
gacggctgcacgagtcacaccggaa

SEQ ID NO: 290910 - DNA, 25 bp, Mus musculus
gacggctgccgggttgtgagccccg

SEQ ID NO: 290911 - DNA, 25 bp, Mus musculus
gacggctgcgattacatcaccctga

SEQ ID NO: 290912 - DNA, 25 bp, Mus musculus
gacgggaaagaacacatgtcggagg

SEQ ID NO: 290913 - DNA, 25 bp, Mus musculus
gacgggaaggagtggaaaagagaga

SEQ ID NO: 290914 - DNA, 25 bp, Mus musculus
gacgggaaggagttatccagcttgt

SEQ ID NO: 290915 - DNA, 25 bp, Mus musculus
gacgggaccatagtggagggacggc

SEQ ID NO: 290916 - DNA, 25 bp, Mus musculus
gacgggacccagggtgaaatggtca

SEQ ID NO: 290917 - DNA, 25 bp, Mus musculus
gacgggagcatcaaaaccctactga

SEQ ID NO: 290918 - DNA, 25 bp, Mus musculus
gacgggagcatcaagaagtcatgct

SEQ ID NO: 290919 - DNA, 25 bp, Mus musculus
gacgggagctgcaggagatgcgggc

SEQ ID NO: 290920 - DNA, 25 bp, Mus musculus
gacgggagggacggtattcaggctg

SEQ ID NO: 290921 - DNA, 25 bp, Mus musculus
gacgggagggaggaagatttgctcc

SEQ ID NO: 290922 - DNA, 25 bp, Mus musculus
gacgggagtctcagatgaaagaaac

SEQ ID NO: 290923 - DNA, 25 bp, Mus musculus
gacgggattaaggaatcttccgaca

SEQ ID NO: 290924 - DNA, 25 bp, Mus musculus
gacgggcaggctcgatggctcccgc

SEQ ID NO: 290925 - DNA, 25 bp, Mus musculus
gacgggccgtgtgagagattggtgt

SEQ ID NO: 290926 - DNA, 25 bp, Mus musculus
gacgggcggcgccaggtctgaccac

SEQ ID NO: 290927 - DNA, 25 bp, Mus musculus
gacgggcgggactggtctccaaaaa

SEQ ID NO: 290928 - DNA, 25 bp, Mus musculus
gacgggctgcagccgatacgacaaa

SEQ ID NO: 290929 - DNA, 25 bp, Mus musculus
gacgggctgcagccggaaggatccc

SEQ ID NO: 290930 - DNA, 25 bp, Mus musculus
gacggggaccccggattgcacaggc

SEQ ID NO: 290931 - DNA, 25 bp, Mus musculus
gacggggacgcaatgtgtctggaat

SEQ ID NO: 290932 - DNA, 25 bp, Mus musculus
gacggggaggtgctgacggagaaac

SEQ ID NO: 290933 - DNA, 25 bp, Mus musculus
gacggggatgacttcagggactcac

SEQ ID NO: 290934 - DNA, 25 bp, Mus musculus
gacggggcaagtgcatttggcacaa

SEQ ID NO: 290935 - DNA, 25 bp, Mus musculus
gacggggcgcgaggtgcagggaagg

SEQ ID NO: 290936 - DNA, 25 bp, Mus musculus
gacggggcttggcagagatggagtt

SEQ ID NO: 290937 - DNA, 25 bp, Mus musculus
gacggggcttgtgtgttgcatactt

SEQ ID NO: 290938 - DNA, 25 bp, Mus musculus
gacgggttgttgccgtaatctagct

SEQ ID NO: 290939 - DNA, 25 bp, Mus musculus
gacggtacctgcattgtgcttcttc

SEQ ID NO: 290940 - DNA, 25 bp, Mus musculus
gacggtcaataaggctgtggctctg

SEQ ID NO: 290941 - DNA, 25 bp, Mus musculus
gacggtcaatgacaaatcaggacct

SEQ ID NO: 290942 - DNA, 25 bp, Mus musculus
gacggtcctagcctcagcgttctca

SEQ ID NO: 290943 - DNA, 25 bp, Mus musculus
gacggtctgattaaacaaattggag

SEQ ID NO: 290944 - DNA, 25 bp, Mus musculus
gacggtctggtcaaagctgttcctg

SEQ ID NO: 290945 - DNA, 25 bp, Mus musculus
gacggtgaagaaggtgataaatgca

SEQ ID NO: 290946 - DNA, 25 bp, Mus musculus
gacggtgagcagggatatcgctcga

SEQ ID NO: 290947 - DNA, 25 bp, Mus musculus
gacggtgcttggcctgttcttcttg

SEQ ID NO: 290948 - DNA, 25 bp, Mus musculus
gacggtggatttggtggagctagag

SEQ ID NO: 290949 - DNA, 25 bp, Mus musculus
gacggtggtcagtgtcctcaagagg

SEQ ID NO: 290950 - DNA, 25 bp, Mus musculus
gacggtgtgtacaggccccgactct

SEQ ID NO: 290951 - DNA, 25 bp, Mus musculus
gacggtgttcgtgcggtcttttgat

SEQ ID NO: 290952 - DNA, 25 bp, Mus musculus
gacggttcagaccatgacacccgaa

SEQ ID NO: 290953 - DNA, 25 bp, Mus musculus
gacggttccgagctgtagccctcat

SEQ ID NO: 290954 - DNA, 25 bp, Mus musculus
gacggttgtgaggtagatgttgtag

SEQ ID NO: 290955 - DNA, 25 bp, Mus musculus
gacggtttagcaactccagctatca

SEQ ID NO: 290956 - DNA, 25 bp, Mus musculus
gacgtaactctgagataaagtgcag

SEQ ID NO: 290957 - DNA, 25 bp, Mus musculus
gacgtaactctgagtcacaggaatg

SEQ ID NO: 290958 - DNA, 25 bp, Mus musculus
gacgtaagaccaatcgcagcctgca

SEQ ID NO: 290959 - DNA, 25 bp, Mus musculus
gacgtaagaccagtgggagcaggtg

SEQ ID NO: 290960 - DNA, 25 bp, Mus musculus
gacgtagaaggcctctttgacagcc

SEQ ID NO: 290961 - DNA, 25 bp, Mus musculus
gacgtagagcctagccccgtgtctg

SEQ ID NO: 290962 - DNA, 25 bp, Mus musculus
gacgtagcagaagcagatataattt

SEQ ID NO: 290963 - DNA, 25 bp, Mus musculus
gacgtagcagaagggttcactgcag

SEQ ID NO: 290964 - DNA, 25 bp, Mus musculus
gacgtagcttcaggtgacctcactg

SEQ ID NO: 290965 - DNA, 25 bp, Mus musculus
gacgtatgatgacatcgactatggc

SEQ ID NO: 290966 - DNA, 25 bp, Mus musculus
gacgtcaagcagtggcatcagaaat

SEQ ID NO: 290967 - DNA, 25 bp, Mus musculus
gacgtcaagcagtgggtatatgctt

SEQ ID NO: 290968 - DNA, 25 bp, Mus musculus
gacgtcacaaactcttacgacatga

SEQ ID NO: 290969 - DNA, 25 bp, Mus musculus
gacgtcacccaataggcaactccga

SEQ ID NO: 290970 - DNA, 25 bp, Mus musculus
gacgtcactggagttcttttcaaag

SEQ ID NO: 290971 - DNA, 25 bp, Mus musculus
gacgtcagagcccagtctcagatct

SEQ ID NO: 290972 - DNA, 25 bp, Mus musculus
gacgtcaggtaatcaaattaaatag

SEQ ID NO: 290973 - DNA, 25 bp, Mus musculus
gacgtcagtccaggaccacttggtc

SEQ ID NO: 290974 - DNA, 25 bp, Mus musculus
gacgtcatagtacaggattcatccc

SEQ ID NO: 290975 - DNA, 25 bp, Mus musculus
gacgtcatagtactagattcatccc

SEQ ID NO: 290976 - DNA, 25 bp, Mus musculus
gacgtcatccacggtgtggcctctt

SEQ ID NO: 290977 - DNA, 25 bp, Mus musculus
gacgtccaccagtgaaaatgtgcta

SEQ ID NO: 290978 - DNA, 25 bp, Mus musculus
gacgtccaggagataattgtgtgga

SEQ ID NO: 290979 - DNA, 25 bp, Mus musculus
gacgtccccttcacggcatatggat

SEQ ID NO: 290980 - DNA, 25 bp, Mus musculus
gacgtccccttcacggttgcagctt

SEQ ID NO: 290981 - DNA, 25 bp, Mus musculus
gacgtcctaatggagccatctttaa

SEQ ID NO: 290982 - DNA, 25 bp, Mus musculus
gacgtcctaatggaggtaattttgg

SEQ ID NO: 290983 - DNA, 25 bp, Mus musculus
gacgtcctcgctttgtactggttcc

SEQ ID NO: 290984 - DNA, 25 bp, Mus musculus
gacgtccttgcggggcctgtgctct

SEQ ID NO: 290985 - DNA, 25 bp, Mus musculus
gacgtcgaagtcgctgacatcaatg

SEQ ID NO: 290986 - DNA, 25 bp, Mus musculus
gacgtcgcccctgagaaaaatgttt

SEQ ID NO: 290987 - DNA, 25 bp, Mus musculus
gacgtcgcggccgcatggcggacaa

SEQ ID NO: 290988 - DNA, 25 bp, Mus musculus
gacgtcgggaactgaagagccgagt

SEQ ID NO: 290989 - DNA, 25 bp, Mus musculus
gacgtcgggaagttccgtgtaccac

SEQ ID NO: 290990 - DNA, 25 bp, Mus musculus
gacgtcgtgaagttaagcaaaactg

SEQ ID NO: 290991 - DNA, 25 bp, Mus musculus
gacgtcgtgtggcatgtgggcacat

SEQ ID NO: 290992 - DNA, 25 bp, Mus musculus
gacgtctaagattcctgctctggct

SEQ ID NO: 290993 - DNA, 25 bp, Mus musculus
gacgtctagccccaggctcaatttg

SEQ ID NO: 290994 - DNA, 25 bp, Mus musculus
gacgtctccacagccagagaacctg

SEQ ID NO: 290995 - DNA, 25 bp, Mus musculus
gacgtctctaagtaacatacaagag

SEQ ID NO: 290996 - DNA, 25 bp, Mus musculus
gacgtctgaggacacagactcagaa

SEQ ID NO: 290997 - DNA, 25 bp, Mus musculus
gacgtctgaggcagcgggagcccat

SEQ ID NO: 290998 - DNA, 25 bp, Mus musculus
gacgtctgaggtggcttggtttgct

SEQ ID NO: 290999 - DNA, 25 bp, Mus musculus
gacgtctggagaatgctgggaccca

SEQ ID NO: 291000 - DNA, 25 bp, Mus musculus
gacgtctggagcttcggggttcttc

SEQ ID NO: 291001 - DNA, 25 bp, Mus musculus
gacgtctgtcagccatcgtctagag

SEQ ID NO: 291002 - DNA, 25 bp, Mus musculus
gacgtcttggctcatgctgcctgat

SEQ ID NO: 291003 - DNA, 25 bp, Mus musculus
gacgtctttcagaagttctatgcaa

SEQ ID NO: 291004 - DNA, 25 bp, Mus musculus
gacgtctttcagacagacatgagtg

SEQ ID NO: 291005 - DNA, 25 bp, Mus musculus
gacgtgaaaagtgacgtgaacactg

SEQ ID NO: 291006 - DNA, 25 bp, Mus musculus
gacgtgaaaatgttctgcctgcagg

SEQ ID NO: 291007 - DNA, 25 bp, Mus musculus
gacgtgaaagactggaggccagcac

SEQ ID NO: 291008 - DNA, 25 bp, Mus musculus
gacgtgaaagataaagcttttaaag

SEQ ID NO: 291009 - DNA, 25 bp, Mus musculus
gacgtgaagactgacaagcactgcc

SEQ ID NO: 291010 - DNA, 25 bp, Mus musculus
gacgtgacagaaaagatcaagggat

SEQ ID NO: 291011 - DNA, 25 bp, Mus musculus
gacgtgacagggaggcccggatgca

SEQ ID NO: 291012 - DNA, 25 bp, Mus musculus
gacgtgatgacagggtccaaggctg

SEQ ID NO: 291013 - DNA, 25 bp, Mus musculus
gacgtgcactatgagtctacctgaa

SEQ ID NO: 291014 - DNA, 25 bp, Mus musculus
gacgtgcagaacagagcctacttcc

SEQ ID NO: 291015 - DNA, 25 bp, Mus musculus
gacgtgccaagcccagcactatggt

SEQ ID NO: 291016 - DNA, 25 bp, Mus musculus
gacgtgcccggaaagccccggcagc

SEQ ID NO: 291017 - DNA, 25 bp, Mus musculus
gacgtgctcaccagtttgacttcgg

SEQ ID NO: 291018 - DNA, 25 bp, Mus musculus
gacgtgctggtaggcccacagaaca

SEQ ID NO: 291019 - DNA, 25 bp, Mus musculus
gacgtgctgtactggatgcaagacg

SEQ ID NO: 291020 - DNA, 25 bp, Mus musculus
gacgtgctgtactgggtcaatgatg

SEQ ID NO: 291021 - DNA, 25 bp, Mus musculus
gacgtggaaggcattttgtgacttt

SEQ ID NO: 291022 - DNA, 25 bp, Mus musculus
gacgtggaaggccttgatcctgctc

SEQ ID NO: 291023 - DNA, 25 bp, Mus musculus
gacgtggactacaagatgtcccact

SEQ ID NO: 291024 - DNA, 25 bp, Mus musculus
gacgtggactctacaggagagtatt

SEQ ID NO: 291025 - DNA, 25 bp, Mus musculus
gacgtggagcacctgggagatactg

SEQ ID NO: 291026 - DNA, 25 bp, Mus musculus
gacgtggagtcaaagagtggcttca

SEQ ID NO: 291027 - DNA, 25 bp, Mus musculus
gacgtggatgagtacgctccagaag

SEQ ID NO: 291028 - DNA, 25 bp, Mus musculus
gacgtggatgcaggccctgcttctc

SEQ ID NO: 291029 - DNA, 25 bp, Mus musculus
gacgtggatgcagggagcccccggg

SEQ ID NO: 291030 - DNA, 25 bp, Mus musculus
gacgtggccagcttcatcttccgtg

SEQ ID NO: 291031 - DNA, 25 bp, Mus musculus
gacgtggccagtgcttttacagtga

SEQ ID NO: 291032 - DNA, 25 bp, Mus musculus
gacgtggcgaggggatcgtgggatt

SEQ ID NO: 291033 - DNA, 25 bp, Mus musculus
gacgtggcgctgtatactccatgtt

SEQ ID NO: 291034 - DNA, 25 bp, Mus musculus
gacgtgggccagaggcttcatgtgg

SEQ ID NO: 291035 - DNA, 25 bp, Mus musculus
gacgtgggccagagggtccaggtgg

SEQ ID NO: 291036 - DNA, 25 bp, Mus musculus
gacgtgggccagatgggccctcctg

SEQ ID NO: 291037 - DNA, 25 bp, Mus musculus
gacgtgggcgatggttgtggagtca

SEQ ID NO: 291038 - DNA, 25 bp, Mus musculus
gacgtgggcggctgttttgagctgc

SEQ ID NO: 291039 - DNA, 25 bp, Mus musculus
gacgtgggtgcaggtctcaggagct

SEQ ID NO: 291040 - DNA, 25 bp, Mus musculus
gacgtggtaaaagactacgcgtttg

SEQ ID NO: 291041 - DNA, 25 bp, Mus musculus
gacgtggtcaagacccagagaacat

SEQ ID NO: 291042 - DNA, 25 bp, Mus musculus
gacgtggtcaagattgactttgaag

SEQ ID NO: 291043 - DNA, 25 bp, Mus musculus
gacgtgtcgccaggtcagccatgtc

SEQ ID NO: 291044 - DNA, 25 bp, Mus musculus
gacgtgtcgccagtgtggaagggga

SEQ ID NO: 291045 - DNA, 25 bp, Mus musculus
gacgtgtgttgaggagcccaccgca

SEQ ID NO: 291046 - DNA, 25 bp, Mus musculus
gacgtgttcaattttcacagctgag

SEQ ID NO: 291047 - DNA, 25 bp, Mus musculus
gacgtgttcacattctggtggtaga

SEQ ID NO: 291048 - DNA, 25 bp, Mus musculus
gacgtgttcagattccagcattctg

SEQ ID NO: 291049 - DNA, 25 bp, Mus musculus
gacgtgttgttcggagatgggtatc

SEQ ID NO: 291050 - DNA, 25 bp, Mus musculus
gacgttaagcagattttgaagcatg

SEQ ID NO: 291051 - DNA, 25 bp, Mus musculus
gacgttaagcagatttttcattact

SEQ ID NO: 291052 - DNA, 25 bp, Mus musculus
gacgttaatgagtgcaatgctcacc

SEQ ID NO: 291053 - DNA, 25 bp, Mus musculus
gacgttacaagtgggatgcctggaa

SEQ ID NO: 291054 - DNA, 25 bp, Mus musculus
gacgttagaaggaggattgcttcct

SEQ ID NO: 291055 - DNA, 25 bp, Mus musculus
gacgttagaaggaggccattaggaa

SEQ ID NO: 291056 - DNA, 25 bp, Mus musculus
gacgttagaaggaggggctaaggag

SEQ ID NO: 291057 - DNA, 25 bp, Mus musculus
gacgttccggaagctgcagcttcaa

SEQ ID NO: 291058 - DNA, 25 bp, Mus musculus
gacgttctaaagaccaaggacaagt

SEQ ID NO: 291059 - DNA, 25 bp, Mus musculus
gacgttctatgtgagcaactgggac

SEQ ID NO: 291060 - DNA, 25 bp, Mus musculus
gacgttctatgtgaggaaaaacggg

SEQ ID NO: 291061 - DNA, 25 bp, Mus musculus
gacgttgctgaggtattatgatcag

SEQ ID NO: 291062 - DNA, 25 bp, Mus musculus
gacgttgtggaaggctcaaagcagt

SEQ ID NO: 291063 - DNA, 25 bp, Mus musculus
gacgtttcccagatctgtctcgaga

SEQ ID NO: 291064 - DNA, 25 bp, Mus musculus
gacgtttgaaggaactctcaagggg

SEQ ID NO: 291065 - DNA, 25 bp, Mus musculus
gacgtttgtcctgctgtgtttcaaa

SEQ ID NO: 291066 - DNA, 25 bp, Mus musculus
gacgttttaatcaagtacggcgagc

SEQ ID NO: 291067 - DNA, 25 bp, Mus musculus
gacgttttaatcaagtgctaccgga

SEQ ID NO: 291068 - DNA, 25 bp, Mus musculus
gactaaaagccatgaaagtatatct

SEQ ID NO: 291069 - DNA, 25 bp, Mus musculus
gactaaaagccatgcagcaccagcg

SEQ ID NO: 291070 - DNA, 25 bp, Mus musculus
gactaaagaagaaaaatgatacctt

SEQ ID NO: 291071 - DNA, 25 bp, Mus musculus
gactaacatattttaatttcaggaa

SEQ ID NO: 291072 - DNA, 25 bp, Mus musculus
gactaacatattttatccaagtttg

SEQ ID NO: 291073 - DNA, 25 bp, Mus musculus
gactaagcacaagagtcacctgtac

SEQ ID NO: 291074 - DNA, 25 bp, Mus musculus
gactaagcaggaagggatggaaggc

SEQ ID NO: 291075 - DNA, 25 bp, Mus musculus
gactaagcaggtggaagaactaagt

SEQ ID NO: 291076 - DNA, 25 bp, Mus musculus
gactaaggaacaggtgtggtatcag

SEQ ID NO: 291077 - DNA, 25 bp, Mus musculus
gactaaggcaatcgtgaagtcctac

SEQ ID NO: 291078 - DNA, 25 bp, Mus musculus
gactaaggcagggcctagtaactat

SEQ ID NO: 291079 - DNA, 25 bp, Mus musculus
gactaagtactttggcagcccgggc

SEQ ID NO: 291080 - DNA, 25 bp, Mus musculus
gactaatctgaaggtgccctgggac

SEQ ID NO: 291081 - DNA, 25 bp, Mus musculus
gactaatgccactaaacctggaccc

SEQ ID NO: 291082 - DNA, 25 bp, Mus musculus
gactaatttagagatgaaatccttc

SEQ ID NO: 291083 - DNA, 25 bp, Mus musculus
gactaatttagaggggctccataga

SEQ ID NO: 291084 - DNA, 25 bp, Mus musculus
gactacaaacagtactttgtgttct

SEQ ID NO: 291085 - DNA, 25 bp, Mus musculus
gactacaaactgactggttctgcag

SEQ ID NO: 291086 - DNA, 25 bp, Mus musculus
gactacaacagcgtccatgccattg

SEQ ID NO: 291087 - DNA, 25 bp, Mus musculus
gactacaaggacccccagagttgat

SEQ ID NO: 291088 - DNA, 25 bp, Mus musculus
gactacagagcagaaaaggaaggcc

SEQ ID NO: 291089 - DNA, 25 bp, Mus musculus
gactacagcggtcagcagagcactt

SEQ ID NO: 291090 - DNA, 25 bp, Mus musculus
gactacatcgactccctgggctgtg

SEQ ID NO: 291091 - DNA, 25 bp, Mus musculus
gactacatgaagtgccctccgtttt

SEQ ID NO: 291092 - DNA, 25 bp, Mus musculus
gactacatggccatccacaaggagg

SEQ ID NO: 291093 - DNA, 25 bp, Mus musculus
gactacatgtccttctgcgcgtgcg

SEQ ID NO: 291094 - DNA, 25 bp, Mus musculus
gactaccaacagctcttcgcggcaa

SEQ ID NO: 291095 - DNA, 25 bp, Mus musculus
gactaccagcagacttttgatttca

SEQ ID NO: 291096 - DNA, 25 bp, Mus musculus
gactaccagcaggagtcgcctcccg

SEQ ID NO: 291097 - DNA, 25 bp, Mus musculus
gactaccagcaggcgttgctgctgc

SEQ ID NO: 291098 - DNA, 25 bp, Mus musculus
gactaccagcccaggtcaaccattc

SEQ ID NO: 291099 - DNA, 25 bp, Mus musculus
gactaccagctgaagacttgattgc

SEQ ID NO: 291100 - DNA, 25 bp, Mus musculus
gactaccctttactgaaattaccat

SEQ ID NO: 291101 - DNA, 25 bp, Mus musculus
gactacctccaggtcggagtgacct

SEQ ID NO: 291102 - DNA, 25 bp, Mus musculus
gactacctccaggtggttgttggag

SEQ ID NO: 291103 - DNA, 25 bp, Mus musculus
gactacctcctaatggtttctgtag

SEQ ID NO: 291104 - DNA, 25 bp, Mus musculus
gactacctcctttcgcttcaagcac

SEQ ID NO: 291105 - DNA, 25 bp, Mus musculus
gactacctctgtgaggtttttcaag

SEQ ID NO: 291106 - DNA, 25 bp, Mus musculus
gactacctcttaggtctctttgagc

SEQ ID NO: 291107 - DNA, 25 bp, Mus musculus
gactacctgaggctggcccagcctg

SEQ ID NO: 291108 - DNA, 25 bp, Mus musculus
gactacctgagggtgaacaacatgc

SEQ ID NO: 291109 - DNA, 25 bp, Mus musculus
gactacctgggaattaccaggaggc

SEQ ID NO: 291110 - DNA, 25 bp, Mus musculus
gactacctgggacattcctggaggt

SEQ ID NO: 291111 - DNA, 25 bp, Mus musculus
gactacctgtgggctctggggtgtg

SEQ ID NO: 291112 - DNA, 25 bp, Mus musculus
gactacgagacggtggtgaaagtga

SEQ ID NO: 291113 - DNA, 25 bp, Mus musculus
gactacgagctaaggaggctcgcat

SEQ ID NO: 291114 - DNA, 25 bp, Mus musculus
gactacgagcttaagtacccaccag

SEQ ID NO: 291115 - DNA, 25 bp, Mus musculus
gactacgagtctgaggctgcttatg

SEQ ID NO: 291116 - DNA, 25 bp, Mus musculus
gactacgctgatggcagtgaagaca

SEQ ID NO: 291117 - DNA, 25 bp, Mus musculus
gactacggactgacgctgcacctgg

SEQ ID NO: 291118 - DNA, 25 bp, Mus musculus
gactacggttgtcagaaacttatgg

SEQ ID NO: 291119 - DNA, 25 bp, Mus musculus
gactacggttgtcagtccgcagatg

SEQ ID NO: 291120 - DNA, 25 bp, Mus musculus
gactacgtgaagcaacatcctttgt

SEQ ID NO: 291121 - DNA, 25 bp, Mus musculus
gactacgtggcacgtggatcagaca

SEQ ID NO: 291122 - DNA, 25 bp, Mus musculus
gactacgtggcaggtggatcagaca

SEQ ID NO: 291123 - DNA, 25 bp, Mus musculus
gactactacagtcacctgaagaagg

SEQ ID NO: 291124 - DNA, 25 bp, Mus musculus
gactactatcggcgacgcctgggct

SEQ ID NO: 291125 - DNA, 25 bp, Mus musculus
gactactatcggcgtcttcccaaag

SEQ ID NO: 291126 - DNA, 25 bp, Mus musculus
gactactccacggattacctcacgg

SEQ ID NO: 291127 - DNA, 25 bp, Mus musculus
gactactccagtcactgtggggctg

SEQ ID NO: 291128 - DNA, 25 bp, Mus musculus
gactactccatgcggctctgcagag

SEQ ID NO: 291129 - DNA, 25 bp, Mus musculus
gactactccgagcaggacacttggc

SEQ ID NO: 291130 - DNA, 25 bp, Mus musculus
gactactccgagcaggatgacagca

SEQ ID NO: 291131 - DNA, 25 bp, Mus musculus
gactactccgagcagtcatcctttg

SEQ ID NO: 291132 - DNA, 25 bp, Mus musculus
gactactctctctcaggtctgaaca

SEQ ID NO: 291133 - DNA, 25 bp, Mus musculus
gactactgagggtgtgacttcttta

SEQ ID NO: 291134 - DNA, 25 bp, Mus musculus
gactactggccacaggaccagctgc

SEQ ID NO: 291135 - DNA, 25 bp, Mus musculus
gactacttcaaagccaaggactacg

SEQ ID NO: 291136 - DNA, 25 bp, Mus musculus
gactacttcaaaggtggtgaaagtg

SEQ ID NO: 291137 - DNA, 25 bp, Mus musculus
gactacttggcaccggtgcagcctt

SEQ ID NO: 291138 - DNA, 25 bp, Mus musculus
gactacttggggctcgtgagctgag

SEQ ID NO: 291139 - DNA, 25 bp, Mus musculus
gactactttaagggactgatggacg

SEQ ID NO: 291140 - DNA, 25 bp, Mus musculus
gactactttagggccatgttcactg

SEQ ID NO: 291141 - DNA, 25 bp, Mus musculus
gactactttagtgctgaggtgacac

SEQ ID NO: 291142 - DNA, 25 bp, Mus musculus
gactagaacaaaaggaagccagatg

SEQ ID NO: 291143 - DNA, 25 bp, Mus musculus
gactagagttagaatcccttcgcca

SEQ ID NO: 291144 - DNA, 25 bp, Mus musculus
gactagatatggaacgggagcgaag

SEQ ID NO: 291145 - DNA, 25 bp, Mus musculus
gactagattttagcaggtcaatggc

SEQ ID NO: 291146 - DNA, 25 bp, Mus musculus
gactagcaaatcagaagttacgaga

SEQ ID NO: 291147 - DNA, 25 bp, Mus musculus
gactagcaaatcaggaggtgcttgt

SEQ ID NO: 291148 - DNA, 25 bp, Mus musculus
gactagcaatcagaacccaagagat

SEQ ID NO: 291149 - DNA, 25 bp, Mus musculus
gactagccagaaaggtccacaccag

SEQ ID NO: 291150 - DNA, 25 bp, Mus musculus
gactagccagaaagtttcaggccat

SEQ ID NO: 291151 - DNA, 25 bp, Mus musculus
gactaggaagaagagaatggaccgg

SEQ ID NO: 291152 - DNA, 25 bp, Mus musculus
gactagggagtgttcagtcaccagt

SEQ ID NO: 291153 - DNA, 25 bp, Mus musculus
gactagtattaagtgcgtaatagct

SEQ ID NO: 291154 - DNA, 25 bp, Mus musculus
gactagtggcgagaatttgctgaga

SEQ ID NO: 291155 - DNA, 25 bp, Mus musculus
gactagtggcgagactttatgatgc

SEQ ID NO: 291156 - DNA, 25 bp, Mus musculus
gactagtggcgagcacatgccaacg

SEQ ID NO: 291157 - DNA, 25 bp, Mus musculus
gactagttttccaggtcgtggttca

SEQ ID NO: 291158 - DNA, 25 bp, Mus musculus
gactatacaaggtggggatgcgtca

SEQ ID NO: 291159 - DNA, 25 bp, Mus musculus
gactatacatgtgaatgaactcatt

SEQ ID NO: 291160 - DNA, 25 bp, Mus musculus
gactatacgaaaaggaacttacaca

SEQ ID NO: 291161 - DNA, 25 bp, Mus musculus
gactatacgaaaaggctctacctct

SEQ ID NO: 291162 - DNA, 25 bp, Mus musculus
gactatagcacatgggagggactgg

SEQ ID NO: 291163 - DNA, 25 bp, Mus musculus
gactatagctctccaggtcaatggc

SEQ ID NO: 291164 - DNA, 25 bp, Mus musculus
gactatagctctctgctcagtacaa

SEQ ID NO: 291165 - DNA, 25 bp, Mus musculus
gactatataagatatccagaaagtg

SEQ ID NO: 291166 - DNA, 25 bp, Mus musculus
gactatataaggtaaatgaattggt

SEQ ID NO: 291167 - DNA, 25 bp, Mus musculus
gactatcagaaaggagatgaatatg

SEQ ID NO: 291168 - DNA, 25 bp, Mus musculus
gactatcagaaagggatgaatatga

SEQ ID NO: 291169 - DNA, 25 bp, Mus musculus
gactatcagtttaggattcagctgg

SEQ ID NO: 291170 - DNA, 25 bp, Mus musculus
gactatcgataattccggcgggagg

SEQ ID NO: 291171 - DNA, 25 bp, Mus musculus
gactatctccaagcatgctggacta

SEQ ID NO: 291172 - DNA, 25 bp, Mus musculus
gactatctccaagtcggttgtgggg

SEQ ID NO: 291173 - DNA, 25 bp, Mus musculus
gactatgaaacagaaaaacaccgag

SEQ ID NO: 291174 - DNA, 25 bp, Mus musculus
gactatgaaatggtccaccaggctg

SEQ ID NO: 291175 - DNA, 25 bp, Mus musculus
gactatgaaatggttttactgggca

SEQ ID NO: 291176 - DNA, 25 bp, Mus musculus
gactatgaacaaataggagacagct

SEQ ID NO: 291177 - DNA, 25 bp, Mus musculus
gactatgaagacaggagtcttttat

SEQ ID NO: 291178 - DNA, 25 bp, Mus musculus
gactatgactcagacaagctatttc

SEQ ID NO: 291179 - DNA, 25 bp, Mus musculus
gactatgcatcatctatactcttct

SEQ ID NO: 291180 - DNA, 25 bp, Mus musculus
gactatgccctcagctggggccagg

SEQ ID NO: 291181 - DNA, 25 bp, Mus musculus
gactatgctgactcgagcattgcag

SEQ ID NO: 291182 - DNA, 25 bp, Mus musculus
gactatggcagcagttttttatggt

SEQ ID NO: 291183 - DNA, 25 bp, Mus musculus
gactatggctagatccagactacat

SEQ ID NO: 291184 - DNA, 25 bp, Mus musculus
gactatggctagcattcaacatcct

SEQ ID NO: 291185 - DNA, 25 bp, Mus musculus
gactatgggcaggtattcacctaca

SEQ ID NO: 291186 - DNA, 25 bp, Mus musculus
gactatgggcaggtgttcacctaca

SEQ ID NO: 291187 - DNA, 25 bp, Mus musculus
gactatggtgtcagaaaaaatgtgg

SEQ ID NO: 291188 - DNA, 25 bp, Mus musculus
gactattacgcaacttgggaggagc

SEQ ID NO: 291189 - DNA, 25 bp, Mus musculus
gactattcagtacaggaaggctgtg

SEQ ID NO: 291190 - DNA, 25 bp, Mus musculus
gactattcagtacagggcttcttcg

SEQ ID NO: 291191 - DNA, 25 bp, Mus musculus
gactattgacctagccccatccctc

SEQ ID NO: 291192 - DNA, 25 bp, Mus musculus
gactatttattccagctacctggag

SEQ ID NO: 291193 - DNA, 25 bp, Mus musculus
gactatttggttcctgctgctcttc

SEQ ID NO: 291194 - DNA, 25 bp, Mus musculus
gactcaaagagcaacttgatttctt

SEQ ID NO: 291195 - DNA, 25 bp, Mus musculus
gactcaaagatgcagtgccagtttt

SEQ ID NO: 291196 - DNA, 25 bp, Mus musculus
gactcaaatgtgatgcatgtggcat

SEQ ID NO: 291197 - DNA, 25 bp, Mus musculus
gactcaacgggggggcagtgcccaa

SEQ ID NO: 291198 - DNA, 25 bp, Mus musculus
gactcaataaggtcactcttcagcc

SEQ ID NO: 291199 - DNA, 25 bp, Mus musculus
gactcaatagcatagacatggacta

SEQ ID NO: 291200 - DNA, 25 bp, Mus musculus
gactcaatagcatagacatggactt

SEQ ID NO: 291201 - DNA, 25 bp, Mus musculus
gactcaatcagaggtgcttcttaaa

SEQ ID NO: 291202 - DNA, 25 bp, Mus musculus
gactcaatgaggccctgctggaggc

SEQ ID NO: 291203 - DNA, 25 bp, Mus musculus
gactcaatgatgttgatgccctgct

SEQ ID NO: 291204 - DNA, 25 bp, Mus musculus
gactcaatgcgatctggttctacac

SEQ ID NO: 291205 - DNA, 25 bp, Mus musculus
gactcacaaggtgaaactaatgaat

SEQ ID NO: 291206 - DNA, 25 bp, Mus musculus
gactcacacaaagtttgctaggtat

SEQ ID NO: 291207 - DNA, 25 bp, Mus musculus
gactcacagttgtagaggatctgag

SEQ ID NO: 291208 - DNA, 25 bp, Mus musculus
gactcacggcacaggtcagacggga

SEQ ID NO: 291209 - DNA, 25 bp, Mus musculus
gactcactccactggttcgtcgcct

SEQ ID NO: 291210 - DNA, 25 bp, Mus musculus
gactcactgaacccaaccagaatcg

SEQ ID NO: 291211 - DNA, 25 bp, Mus musculus
gactcactgcctgataaatacaaca

SEQ ID NO: 291212 - DNA, 25 bp, Mus musculus
gactcactgcctgatgttgtccagg

SEQ ID NO: 291213 - DNA, 25 bp, Mus musculus
gactcactgtccagtgcttctactt

SEQ ID NO: 291214 - DNA, 25 bp, Mus musculus
gactcactgtccagttaatgtgtta

SEQ ID NO: 291215 - DNA, 25 bp, Mus musculus
gactcactttcagacatccggctcc

SEQ ID NO: 291216 - DNA, 25 bp, Mus musculus
gactcagaacttgggagacgactgc

SEQ ID NO: 291217 - DNA, 25 bp, Mus musculus
gactcagaagaaaaaaagtattcag

SEQ ID NO: 291218 - DNA, 25 bp, Mus musculus
gactcagaagaaccaatcactgaaa

SEQ ID NO: 291219 - DNA, 25 bp, Mus musculus
gactcagaagctcttgtcctgaaca

SEQ ID NO: 291220 - DNA, 25 bp, Mus musculus
gactcagaaggtgtacagactccac

SEQ ID NO: 291221 - DNA, 25 bp, Mus musculus
gactcagactgggcccagtcttctg

SEQ ID NO: 291222 - DNA, 25 bp, Mus musculus
gactcagactggttgatccccaaag

SEQ ID NO: 291223 - DNA, 25 bp, Mus musculus
gactcagagagctgcatgcctcatg

SEQ ID NO: 291224 - DNA, 25 bp, Mus musculus
gactcagatcagaagagcagcagaa

SEQ ID NO: 291225 - DNA, 25 bp, Mus musculus
gactcagatcagccttgcagcagaa

SEQ ID NO: 291226 - DNA, 25 bp, Mus musculus
gactcagatcagctgggaagggcta

SEQ ID NO: 291227 - DNA, 25 bp, Mus musculus
gactcagattaagggtttcaaaaac

SEQ ID NO: 291228 - DNA, 25 bp, Mus musculus
gactcagatttggggccaggaccct

SEQ ID NO: 291229 - DNA, 25 bp, Mus musculus
gactcagcaggtgatgaggaattta

SEQ ID NO: 291230 - DNA, 25 bp, Mus musculus
gactcagcccactggatcaaacaac

SEQ ID NO: 291231 - DNA, 25 bp, Mus musculus
gactcagcccgtcacaatcattacc

SEQ ID NO: 291232 - DNA, 25 bp, Mus musculus
gactcagcgtgatcgcaatgagagg

SEQ ID NO: 291233 - DNA, 25 bp, Mus musculus
gactcagctacccaggttgaggctg

SEQ ID NO: 291234 - DNA, 25 bp, Mus musculus
gactcaggaggatatttccacccag

SEQ ID NO: 291235 - DNA, 25 bp, Mus musculus
gactcaggctaagaatggttttagc

SEQ ID NO: 291236 - DNA, 25 bp, Mus musculus
gactcagggaacaagcccaggactg

SEQ ID NO: 291237 - DNA, 25 bp, Mus musculus
gactcagggagaaagagcctggccc

SEQ ID NO: 291238 - DNA, 25 bp, Mus musculus
gactcaggtaggcctgtcaacccaa

SEQ ID NO: 291239 - DNA, 25 bp, Mus musculus
gactcagtgatggctgtcacgaccg

SEQ ID NO: 291240 - DNA, 25 bp, Mus musculus
gactcagtgcaagtacagagactca

SEQ ID NO: 291241 - DNA, 25 bp, Mus musculus
gactcagtgtctgaaaccaaggaag

SEQ ID NO: 291242 - DNA, 25 bp, Mus musculus
gactcagtgtctggacatttattca

SEQ ID NO: 291243 - DNA, 25 bp, Mus musculus
gactcagtgtctggtgcagagtggt

SEQ ID NO: 291244 - DNA, 25 bp, Mus musculus
gactcatatgagtccaacactggat

SEQ ID NO: 291245 - DNA, 25 bp, Mus musculus
gactcatatgccctggtgtggggct

SEQ ID NO: 291246 - DNA, 25 bp, Mus musculus
gactcatattaaatcctgaagtcca

SEQ ID NO: 291247 - DNA, 25 bp, Mus musculus
gactcatcacactgttgaagagaag

SEQ ID NO: 291248 - DNA, 25 bp, Mus musculus
gactcatctaaggaattagctgaac

SEQ ID NO: 291249 - DNA, 25 bp, Mus musculus
gactcatgagaaaagagaagcagct

SEQ ID NO: 291250 - DNA, 25 bp, Mus musculus
gactcatgaggcaagtcagaggcca

SEQ ID NO: 291251 - DNA, 25 bp, Mus musculus
gactcatgaggctcatccagagctc

SEQ ID NO: 291252 - DNA, 25 bp, Mus musculus
gactcatgcaatagaaatgatcaaa

SEQ ID NO: 291253 - DNA, 25 bp, Mus musculus
gactcatgcaatagttccagttcag

SEQ ID NO: 291254 - DNA, 25 bp, Mus musculus
gactcatgccagggttgtcgccctg

SEQ ID NO: 291255 - DNA, 25 bp, Mus musculus
gactcatgggatagacaagaacgga

SEQ ID NO: 291256 - DNA, 25 bp, Mus musculus
gactcattaaagagtggccgagcgg

SEQ ID NO: 291257 - DNA, 25 bp, Mus musculus
gactcattaaaggaaaaggatataa

SEQ ID NO: 291258 - DNA, 25 bp, Mus musculus
gactcattacagagggagtttattc

SEQ ID NO: 291259 - DNA, 25 bp, Mus musculus
gactccaaaaccagcaccgtcttct

SEQ ID NO: 291260 - DNA, 25 bp, Mus musculus
gactccaaaaccagtgtcgtcacca

SEQ ID NO: 291261 - DNA, 25 bp, Mus musculus
gactccaacgacccgtgcccaggga

SEQ ID NO: 291262 - DNA, 25 bp, Mus musculus
gactccaagggctactacatgggca

SEQ ID NO: 291263 - DNA, 25 bp, Mus musculus
gactccaccacagatgaagaagaag

SEQ ID NO: 291264 - DNA, 25 bp, Mus musculus
gactccacggtgagagtctgggatg

SEQ ID NO: 291265 - DNA, 25 bp, Mus musculus
gactccactaaagactgacacgttt

SEQ ID NO: 291266 - DNA, 25 bp, Mus musculus
gactccagaataagctgaactccca

SEQ ID NO: 291267 - DNA, 25 bp, Mus musculus
gactccagagatctacctggcgtat

SEQ ID NO: 291268 - DNA, 25 bp, Mus musculus
gactccagctgccaaacgtcaaact

SEQ ID NO: 291269 - DNA, 25 bp, Mus musculus
gactccagctgcctttttcaacatg

SEQ ID NO: 291270 - DNA, 25 bp, Mus musculus
gactccagcttccagatacctcagt

SEQ ID NO: 291271 - DNA, 25 bp, Mus musculus
gactccagcttccagccctacgttc

SEQ ID NO: 291272 - DNA, 25 bp, Mus musculus
gactccaggagccggaaagaagaga

SEQ ID NO: 291273 - DNA, 25 bp, Mus musculus
gactccaggagccgggcattcaact

SEQ ID NO: 291274 - DNA, 25 bp, Mus musculus
gactccaggaggagcgacagttttg

SEQ ID NO: 291275 - DNA, 25 bp, Mus musculus
gactccaggaggcttccagcttgtc

SEQ ID NO: 291276 - DNA, 25 bp, Mus musculus
gactccaggatgcaggagcctccag

SEQ ID NO: 291277 - DNA, 25 bp, Mus musculus
gactccagggctgacagcttcgaaa

SEQ ID NO: 291278 - DNA, 25 bp, Mus musculus
gactccagggtttgctgagagtgga

SEQ ID NO: 291279 - DNA, 25 bp, Mus musculus
gactccagtctgcagcaagccccgc

SEQ ID NO: 291280 - DNA, 25 bp, Mus musculus
gactccagtgagagttgctggaact

SEQ ID NO: 291281 - DNA, 25 bp, Mus musculus
gactccatagaactttccaaagcat

SEQ ID NO: 291282 - DNA, 25 bp, Mus musculus
gactccataggaccttctgtctccc

SEQ ID NO: 291283 - DNA, 25 bp, Mus musculus
gactccatgcagcacatttaaaatc

SEQ ID NO: 291284 - DNA, 25 bp, Mus musculus
gactccatgcaggtattgaggctct

SEQ ID NO: 291285 - DNA, 25 bp, Mus musculus
gactccatgcaggtctatgaagggc

SEQ ID NO: 291286 - DNA, 25 bp, Mus musculus
gactccatggagacgatctatgaca

SEQ ID NO: 291287 - DNA, 25 bp, Mus musculus
gactccatttacaacttcagggtca

SEQ ID NO: 291288 - DNA, 25 bp, Mus musculus
gactcccacagccagcgtttccccc

SEQ ID NO: 291289 - DNA, 25 bp, Mus musculus
gactcccaccccagggttcctgctg

SEQ ID NO: 291290 - DNA, 25 bp, Mus musculus
gactcccaccccagtacggcctcta

SEQ ID NO: 291291 - DNA, 25 bp, Mus musculus
gactcccagaagatagtcacatgct

SEQ ID NO: 291292 - DNA, 25 bp, Mus musculus
gactcccaggagaggaatgctgtgg

SEQ ID NO: 291293 - DNA, 25 bp, Mus musculus
gactcccaggagagtcccggagagt

SEQ ID NO: 291294 - DNA, 25 bp, Mus musculus
gactcccaggagattaccaaggaaa

SEQ ID NO: 291295 - DNA, 25 bp, Mus musculus
gactcccaggagttgaccctggagg

SEQ ID NO: 291296 - DNA, 25 bp, Mus musculus
gactccccagtttctcaagggagga

SEQ ID NO: 291297 - DNA, 25 bp, Mus musculus
gactccccatcagctgtttctccaa

SEQ ID NO: 291298 - DNA, 25 bp, Mus musculus
gactccccatcaggtttggacatat

SEQ ID NO: 291299 - DNA, 25 bp, Mus musculus
gactcccccaagcaggcggacgctc

SEQ ID NO: 291300 - DNA, 25 bp, Mus musculus
gactcccccaaggaggcggacgctc

SEQ ID NO: 291301 - DNA, 25 bp, Mus musculus
gactcccccaaggaggtctctgagt

SEQ ID NO: 291302 - DNA, 25 bp, Mus musculus
gactcccccaggaggcatcacagca

SEQ ID NO: 291303 - DNA, 25 bp, Mus musculus
gactcccctgaatttaaggagcagt

SEQ ID NO: 291304 - DNA, 25 bp, Mus musculus
gactccccttagcagctcaagccca

SEQ ID NO: 291305 - DNA, 25 bp, Mus musculus
gactcccgcaaagacaggtggtgtc

SEQ ID NO: 291306 - DNA, 25 bp, Mus musculus
gactcccgcaagacgcttaaaggat

SEQ ID NO: 291307 - DNA, 25 bp, Mus musculus
gactcccggagaagcctccccagct

SEQ ID NO: 291308 - DNA, 25 bp, Mus musculus
gactcccgggagatgcagcttcaga

SEQ ID NO: 291309 - DNA, 25 bp, Mus musculus
gactcccgggaggctcaccatcatg

SEQ ID NO: 291310 - DNA, 25 bp, Mus musculus
gactccctcaagaacaaagtcacaa

SEQ ID NO: 291311 - DNA, 25 bp, Mus musculus
gactccctcaagattcaaacagaca

SEQ ID NO: 291312 - DNA, 25 bp, Mus musculus
gactccctggaggtttgcctcaaat

SEQ ID NO: 291313 - DNA, 25 bp, Mus musculus
gactccgacccacagatccctctag

SEQ ID NO: 291314 - DNA, 25 bp, Mus musculus
gactccgcatatttcagacttcaag

SEQ ID NO: 291315 - DNA, 25 bp, Mus musculus
gactccgcattggaactggaacaca

SEQ ID NO: 291316 - DNA, 25 bp, Mus musculus
gactccgccacctccgccttactct

SEQ ID NO: 291317 - DNA, 25 bp, Mus musculus
gactccgctctccgaatcaagctat

SEQ ID NO: 291318 - DNA, 25 bp, Mus musculus
gactccggaagaacctcagctatga

SEQ ID NO: 291319 - DNA, 25 bp, Mus musculus
gactccggaagtaaggacaagacca

SEQ ID NO: 291320 - DNA, 25 bp, Mus musculus
gactccggaggaacctggctcaccg

SEQ ID NO: 291321 - DNA, 25 bp, Mus musculus
gactccggcatccagtcctctctct

SEQ ID NO: 291322 - DNA, 25 bp, Mus musculus
gactccggcggcagatgtgatggca

SEQ ID NO: 291323 - DNA, 25 bp, Mus musculus
gactccggtgaagaatgctatcaga

SEQ ID NO: 291324 - DNA, 25 bp, Mus musculus
gactccgtgaacgctctcactcttg

SEQ ID NO: 291325 - DNA, 25 bp, Mus musculus
gactccgtgtgtcacattagctttt

SEQ ID NO: 291326 - DNA, 25 bp, Mus musculus
gactcctaggagggagcctccctgt

SEQ ID NO: 291327 - DNA, 25 bp, Mus musculus
gactcctatagtggactcgggaggg

SEQ ID NO: 291328 - DNA, 25 bp, Mus musculus
gactcctcacctttacagattggag

SEQ ID NO: 291329 - DNA, 25 bp, Mus musculus
gactcctcagacagcactcaaagaa

SEQ ID NO: 291330 - DNA, 25 bp, Mus musculus
gactcctccacccaggtgtcaacac

SEQ ID NO: 291331 - DNA, 25 bp, Mus musculus
gactcctccatgctggacagtgcta

SEQ ID NO: 291332 - DNA, 25 bp, Mus musculus
gactcctccgagaagccccggcagc

SEQ ID NO: 291333 - DNA, 25 bp, Mus musculus
gactcctctcaaagggacagccagc

SEQ ID NO: 291334 - DNA, 25 bp, Mus musculus
gactcctctcaaaggtttattttat

SEQ ID NO: 291335 - DNA, 25 bp, Mus musculus
gactcctctgattcagatgccaccg

SEQ ID NO: 291336 - DNA, 25 bp, Mus musculus
gactcctctttgaagacctttgcac

SEQ ID NO: 291337 - DNA, 25 bp, Mus musculus
gactcctgacggtgaccctaaaacc

SEQ ID NO: 291338 - DNA, 25 bp, Mus musculus
gactcctgactacagaggatgcgtc

SEQ ID NO: 291339 - DNA, 25 bp, Mus musculus
gactcctgactacaggtacaataga

SEQ ID NO: 291340 - DNA, 25 bp, Mus musculus
gactcctgagatcatgaaggaagtc

SEQ ID NO: 291341 - DNA, 25 bp, Mus musculus
gactcctgagccgctctgcacagct

SEQ ID NO: 291342 - DNA, 25 bp, Mus musculus
gactcctgccagccattctgtattg

SEQ ID NO: 291343 - DNA, 25 bp, Mus musculus
gactcctgccagggcgattcagggg

SEQ ID NO: 291344 - DNA, 25 bp, Mus musculus
gactcctggcataaggatgctttca

SEQ ID NO: 291345 - DNA, 25 bp, Mus musculus
gactcctggcataagggagctggta

SEQ ID NO: 291346 - DNA, 25 bp, Mus musculus
gactcctgtgaagacagggccagtg

SEQ ID NO: 291347 - DNA, 25 bp, Mus musculus
gactccttccaaagggtgatgtctt

SEQ ID NO: 291348 - DNA, 25 bp, Mus musculus
gactccttccagtgggatgatctgg

SEQ ID NO: 291349 - DNA, 25 bp, Mus musculus
gactccttgcaacactctgggttat

SEQ ID NO: 291350 - DNA, 25 bp, Mus musculus
gactccttggcgcttagtgctgctc

SEQ ID NO: 291351 - DNA, 25 bp, Mus musculus
gactccttgtgggaccgacgtctgc

SEQ ID NO: 291352 - DNA, 25 bp, Mus musculus
gactcctttacgcagaagatgttgg

SEQ ID NO: 291353 - DNA, 25 bp, Mus musculus
gactcctttacgcaggcccagatga

SEQ ID NO: 291354 - DNA, 25 bp, Mus musculus
gactcctttacgcagttcacacaga

SEQ ID NO: 291355 - DNA, 25 bp, Mus musculus
gactcctttcccaacactatgactt

SEQ ID NO: 291356 - DNA, 25 bp, Mus musculus
gactcgaaacttatagctctcatat

SEQ ID NO: 291357 - DNA, 25 bp, Mus musculus
gactcgacagtgttagcaacaagac

SEQ ID NO: 291358 - DNA, 25 bp, Mus musculus
gactcgagaggtcactggatgttca

SEQ ID NO: 291359 - DNA, 25 bp, Mus musculus
gactcgagagttacaggtcactgga

SEQ ID NO: 291360 - DNA, 25 bp, Mus musculus
gactcgatgtgtttacagtggataa

SEQ ID NO: 291361 - DNA, 25 bp, Mus musculus
gactcgcaacgagtctgtagctcgt

SEQ ID NO: 291362 - DNA, 25 bp, Mus musculus
gactcgcagaaagaagctctacaaa

SEQ ID NO: 291363 - DNA, 25 bp, Mus musculus
gactcgcatttgctgtccgctacag

SEQ ID NO: 291364 - DNA, 25 bp, Mus musculus
gactcgcgcatccaggtcatccttc

SEQ ID NO: 291365 - DNA, 25 bp, Mus musculus
gactcgcgcctccagtgaccaaaga

SEQ ID NO: 291366 - DNA, 25 bp, Mus musculus
gactcgcgcctccagtttttggctt

SEQ ID NO: 291367 - DNA, 25 bp, Mus musculus
gactcgcggagatcgtaccgagaag

SEQ ID NO: 291368 - DNA, 25 bp, Mus musculus
gactcgcggagccgagtaaagacat

SEQ ID NO: 291369 - DNA, 25 bp, Mus musculus
gactcgctgagctccagttataaac

SEQ ID NO: 291370 - DNA, 25 bp, Mus musculus
gactcggaaaagtcatgttgcaaat

SEQ ID NO: 291371 - DNA, 25 bp, Mus musculus
gactcggaaagttccattttggggg

SEQ ID NO: 291372 - DNA, 25 bp, Mus musculus
gactcggaagtggacagtggcatcg

SEQ ID NO: 291373 - DNA, 25 bp, Mus musculus
gactcggacacagagaagcagggtc

SEQ ID NO: 291374 - DNA, 25 bp, Mus musculus
gactcggacacagatgcctccagct

SEQ ID NO: 291375 - DNA, 25 bp, Mus musculus
gactcggaggacagcataagcagta

SEQ ID NO: 291376 - DNA, 25 bp, Mus musculus
gactcggaggcgggttcagccgact

SEQ ID NO: 291377 - DNA, 25 bp, Mus musculus
gactcggcatcttactacctgaacc

SEQ ID NO: 291378 - DNA, 25 bp, Mus musculus
gactcggctgaggaggccaccatgg

SEQ ID NO: 291379 - DNA, 25 bp, Mus musculus
gactcgggtggtggaggacaaccat

SEQ ID NO: 291380 - DNA, 25 bp, Mus musculus
gactcgggtggtggctctgtctctg

SEQ ID NO: 291381 - DNA, 25 bp, Mus musculus
gactcgtggcaggggtactacaaga

SEQ ID NO: 291382 - DNA, 25 bp, Mus musculus
gactcgtgtccctcgtttagctttt

SEQ ID NO: 291383 - DNA, 25 bp, Mus musculus
gactcgttggatcctcctctgtaga

SEQ ID NO: 291384 - DNA, 25 bp, Mus musculus
gactcgttggatcctgcgggttgag

SEQ ID NO: 291385 - DNA, 25 bp, Mus musculus
gactctaaaatagagctggagtaac

SEQ ID NO: 291386 - DNA, 25 bp, Mus musculus
gactctaacaccgcaagccccgccc

SEQ ID NO: 291387 - DNA, 25 bp, Mus musculus
gactctacagccactacgaaggttt

SEQ ID NO: 291388 - DNA, 25 bp, Mus musculus
gactctacaggcattgggcatggag

SEQ ID NO: 291389 - DNA, 25 bp, Mus musculus
gactctaccaaatactatctgaatg

SEQ ID NO: 291390 - DNA, 25 bp, Mus musculus
gactctaccaaatattgcatttagc

SEQ ID NO: 291391 - DNA, 25 bp, Mus musculus
gactctactactgaataccccaagt

SEQ ID NO: 291392 - DNA, 25 bp, Mus musculus
gactctactatggagatgtcatctg

SEQ ID NO: 291393 - DNA, 25 bp, Mus musculus
gactctactatggaggggctccacg

SEQ ID NO: 291394 - DNA, 25 bp, Mus musculus
gactctactgtgaaggtgtggtccg

SEQ ID NO: 291395 - DNA, 25 bp, Mus musculus
gactctactgtgaggtctacatcac

SEQ ID NO: 291396 - DNA, 25 bp, Mus musculus
gactctagctgggcgaggacccgtg

SEQ ID NO: 291397 - DNA, 25 bp, Mus musculus
gactctataaattggagctggcctg

SEQ ID NO: 291398 - DNA, 25 bp, Mus musculus
gactctatcacatagatgagaattc

SEQ ID NO: 291399 - DNA, 25 bp, Mus musculus
gactctatttcaggactcagtggct

SEQ ID NO: 291400 - DNA, 25 bp, Mus musculus
gactctcaaaccacgcggagtgtcc

SEQ ID NO: 291401 - DNA, 25 bp, Mus musculus
gactctcaaaccacgtgacctcttg

SEQ ID NO: 291402 - DNA, 25 bp, Mus musculus
gactctcacaggggagaagcgagct

SEQ ID NO: 291403 - DNA, 25 bp, Mus musculus
gactctcaccaagcggacagagaag

SEQ ID NO: 291404 - DNA, 25 bp, Mus musculus
gactctcaccaaggctctggcctat

SEQ ID NO: 291405 - DNA, 25 bp, Mus musculus
gactctcagagctgtggcagctcag

SEQ ID NO: 291406 - DNA, 25 bp, Mus musculus
gactctcccagggatgaacaggccg

SEQ ID NO: 291407 - DNA, 25 bp, Mus musculus
gactctcctcagaagactggtcccc

SEQ ID NO: 291408 - DNA, 25 bp, Mus musculus
gactctcctcaggtcatgtttactg

SEQ ID NO: 291409 - DNA, 25 bp, Mus musculus
gactctctcaaaccccttatccctc

SEQ ID NO: 291410 - DNA, 25 bp, Mus musculus
gactctctcccagatgacagtcatg

SEQ ID NO: 291411 - DNA, 25 bp, Mus musculus
gactctctgaagagcactctggcca

SEQ ID NO: 291412 - DNA, 25 bp, Mus musculus
gactctctgcctggcccgatttccc

SEQ ID NO: 291413 - DNA, 25 bp, Mus musculus
gactctctgctgcaggatgctgcca

SEQ ID NO: 291414 - DNA, 25 bp, Mus musculus
gactctctgtggaccccgttcatgt

SEQ ID NO: 291415 - DNA, 25 bp, Mus musculus
gactctctgtggacgcaagcgccgc

SEQ ID NO: 291416 - DNA, 25 bp, Mus musculus
gactctcttgatcagcaagccccgc

SEQ ID NO: 291417 - DNA, 25 bp, Mus musculus
gactctgaaacagagatggctccca

SEQ ID NO: 291418 - DNA, 25 bp, Mus musculus
gactctgaaacaggtcctgcctaat

SEQ ID NO: 291419 - DNA, 25 bp, Mus musculus
gactctgaacaaatcctgctgcatc

SEQ ID NO: 291420 - DNA, 25 bp, Mus musculus
gactctgaaccagcctccagtccct

SEQ ID NO: 291421 - DNA, 25 bp, Mus musculus
gactctgaacctggctctggtagcc

SEQ ID NO: 291422 - DNA, 25 bp, Mus musculus
gactctgaagcagattcgctgcctg

SEQ ID NO: 291423 - DNA, 25 bp, Mus musculus
gactctgaagcgagaccaccgtggg

SEQ ID NO: 291424 - DNA, 25 bp, Mus musculus
gactctgacatagcctaggaagtag

SEQ ID NO: 291425 - DNA, 25 bp, Mus musculus
gactctgacatatggggcatcatgg

SEQ ID NO: 291426 - DNA, 25 bp, Mus musculus
gactctgagacagactgcatgtatg

SEQ ID NO: 291427 - DNA, 25 bp, Mus musculus
gactctgagcaggaggatgagtctg

SEQ ID NO: 291428 - DNA, 25 bp, Mus musculus
gactctgatggtgatggccgaggtg

SEQ ID NO: 291429 - DNA, 25 bp, Mus musculus
gactctgattttgagaattcagagc

SEQ ID NO: 291430 - DNA, 25 bp, Mus musculus
gactctgattttgagtttgaaaatg

SEQ ID NO: 291431 - DNA, 25 bp, Mus musculus
gactctgcaaacagtgccaccaaaa

SEQ ID NO: 291432 - DNA, 25 bp, Mus musculus
gactctgcaaagcgccatcaaagga

SEQ ID NO: 291433 - DNA, 25 bp, Mus musculus
gactctgcaaagcgctactgttgag

SEQ ID NO: 291434 - DNA, 25 bp, Mus musculus
gactctgcacccagccaaggtagcc

SEQ ID NO: 291435 - DNA, 25 bp, Mus musculus
gactctgccaaggagttaatcagtc

SEQ ID NO: 291436 - DNA, 25 bp, Mus musculus
gactctgcggcactctgtccagcag

SEQ ID NO: 291437 - DNA, 25 bp, Mus musculus
gactctgctgacagacactgtcctg

SEQ ID NO: 291438 - DNA, 25 bp, Mus musculus
gactctgctggcaagaacttgacct

SEQ ID NO: 291439 - DNA, 25 bp, Mus musculus
gactctgctttccagcaagccccgc

SEQ ID NO: 291440 - DNA, 25 bp, Mus musculus
gactctgcttttggcaactcgttgg

SEQ ID NO: 291441 - DNA, 25 bp, Mus musculus
gactctggacaaactgtcctgtgtg

SEQ ID NO: 291442 - DNA, 25 bp, Mus musculus
gactctggacaatgccaacagtata

SEQ ID NO: 291443 - DNA, 25 bp, Mus musculus
gactctggagaaggccaacagcagg

SEQ ID NO: 291444 - DNA, 25 bp, Mus musculus
gactctggatccaggtggtacccgg

SEQ ID NO: 291445 - DNA, 25 bp, Mus musculus
gactctgggctatgtgggtgagcct

SEQ ID NO: 291446 - DNA, 25 bp, Mus musculus
gactctggggctgacaaaaagttca

SEQ ID NO: 291447 - DNA, 25 bp, Mus musculus
gactctggttcaggctggcctgcct

SEQ ID NO: 291448 - DNA, 25 bp, Mus musculus
gactctgtacggcttgtgaaatgga

SEQ ID NO: 291449 - DNA, 25 bp, Mus musculus
gactctgtgcccaagattgggtgtg

SEQ ID NO: 291450 - DNA, 25 bp, Mus musculus
gactctgtgctgagctgggtgaaga

SEQ ID NO: 291451 - DNA, 25 bp, Mus musculus
gactctgttggttcactttaattga

SEQ ID NO: 291452 - DNA, 25 bp, Mus musculus
gactcttaaagatgagaattctcca

SEQ ID NO: 291453 - DNA, 25 bp, Mus musculus
gactcttacctgcctgtgccgtgtg

SEQ ID NO: 291454 - DNA, 25 bp, Mus musculus
gactcttacggaattaattcgagaa

SEQ ID NO: 291455 - DNA, 25 bp, Mus musculus
gactcttacggtcttaccacaaaca

SEQ ID NO: 291456 - DNA, 25 bp, Mus musculus
gactcttactccgtggcgaatctca

SEQ ID NO: 291457 - DNA, 25 bp, Mus musculus
gactcttagagaacatgctggatag

SEQ ID NO: 291458 - DNA, 25 bp, Mus musculus
gactcttagagaagatccatctgac

SEQ ID NO: 291459 - DNA, 25 bp, Mus musculus
gactcttcaagccacttagccaaga

SEQ ID NO: 291460 - DNA, 25 bp, Mus musculus
gactcttcaaggtgctggaggactc

SEQ ID NO: 291461 - DNA, 25 bp, Mus musculus
gactcttcagacagacccttagagg

SEQ ID NO: 291462 - DNA, 25 bp, Mus musculus
gactcttcagacagagggccacagc

SEQ ID NO: 291463 - DNA, 25 bp, Mus musculus
gactcttcatttgatgcagcaatta

SEQ ID NO: 291464 - DNA, 25 bp, Mus musculus
gactcttcccaagctaaagcccatt

SEQ ID NO: 291465 - DNA, 25 bp, Mus musculus
gactcttctctaaaaaagattgata

SEQ ID NO: 291466 - DNA, 25 bp, Mus musculus
gactcttctggaagccgctctctct

SEQ ID NO: 291467 - DNA, 25 bp, Mus musculus
gactcttctggaaggatccgccgcg

SEQ ID NO: 291468 - DNA, 25 bp, Mus musculus
gactcttcttcacggtgccttggag

SEQ ID NO: 291469 - DNA, 25 bp, Mus musculus
gactcttgaagaacatatccccaag

SEQ ID NO: 291470 - DNA, 25 bp, Mus musculus
gactcttgaaggacatagatgctgc

SEQ ID NO: 291471 - DNA, 25 bp, Mus musculus
gactcttgatgagggtccaccaaaa

SEQ ID NO: 291472 - DNA, 25 bp, Mus musculus
gactcttggagaaaatccaagttct

SEQ ID NO: 291473 - DNA, 25 bp, Mus musculus
gactcttggagctggaagagaaaac

SEQ ID NO: 291474 - DNA, 25 bp, Mus musculus
gactctttgatgtaacccacggctg

SEQ ID NO: 291475 - DNA, 25 bp, Mus musculus
gactctttgcaggcttcctccccag

SEQ ID NO: 291476 - DNA, 25 bp, Mus musculus
gactcttttatgagtttgaaggaag

SEQ ID NO: 291477 - DNA, 25 bp, Mus musculus
gactgaaaaagttccaccaggtgag

SEQ ID NO: 291478 - DNA, 25 bp, Mus musculus
gactgaaaaatgagttcattgagaa

SEQ ID NO: 291479 - DNA, 25 bp, Mus musculus
gactgaaatctcgagatctttgcaa

SEQ ID NO: 291480 - DNA, 25 bp, Mus musculus
gactgaaccttatcaagcactgaag

SEQ ID NO: 291481 - DNA, 25 bp, Mus musculus
gactgaactaagacagaaagacatg

SEQ ID NO: 291482 - DNA, 25 bp, Mus musculus
gactgaactctcagacacatgcctg

SEQ ID NO: 291483 - DNA, 25 bp, Mus musculus
gactgaactctcaggaaacccaagg

SEQ ID NO: 291484 - DNA, 25 bp, Mus musculus
gactgaagacccctatacaaccagt

SEQ ID NO: 291485 - DNA, 25 bp, Mus musculus
gactgaagatctctctgaaacaaag

SEQ ID NO: 291486 - DNA, 25 bp, Mus musculus
gactgaagctgggatcaagcacttc

SEQ ID NO: 291487 - DNA, 25 bp, Mus musculus
gactgaaggaggaagctgacctaga

SEQ ID NO: 291488 - DNA, 25 bp, Mus musculus
gactgaaggagtctccagcctcccc

SEQ ID NO: 291489 - DNA, 25 bp, Mus musculus
gactgaaggcagatcatgcctgggg

SEQ ID NO: 291490 - DNA, 25 bp, Mus musculus
gactgaatatagtatgtgcagcact

SEQ ID NO: 291491 - DNA, 25 bp, Mus musculus
gactgaattgtacagatccgctgta

SEQ ID NO: 291492 - DNA, 25 bp, Mus musculus
gactgaatttttcaaatttctgctg

SEQ ID NO: 291493 - DNA, 25 bp, Mus musculus
gactgacaaagaaggctggattctc

SEQ ID NO: 291494 - DNA, 25 bp, Mus musculus
gactgacacctccatgtatcccaag

SEQ ID NO: 291495 - DNA, 25 bp, Mus musculus
gactgacagaagttaccaaatggga

SEQ ID NO: 291496 - DNA, 25 bp, Mus musculus
gactgaccaaggctccagaaatgtt

SEQ ID NO: 291497 - DNA, 25 bp, Mus musculus
gactgaccaaggggctgacgggacc

SEQ ID NO: 291498 - DNA, 25 bp, Mus musculus
gactgaccaggttccccaggatgaa

SEQ ID NO: 291499 - DNA, 25 bp, Mus musculus
gactgacccaccaggtgccagcctc

SEQ ID NO: 291500 - DNA, 25 bp, Mus musculus
gactgacccaccaggtgtgccaggg

SEQ ID NO: 291501 - DNA, 25 bp, Mus musculus
gactgaccgggagagggataaagtg

SEQ ID NO: 291502 - DNA, 25 bp, Mus musculus
gactgaccttctagctcaccctagc

SEQ ID NO: 291503 - DNA, 25 bp, Mus musculus
gactgaccttgaaggggactcagaa

SEQ ID NO: 291504 - DNA, 25 bp, Mus musculus
gactgaccttggcatgcttgctcgg

SEQ ID NO: 291505 - DNA, 25 bp, Mus musculus
gactgacgcagatgaagagctagag

SEQ ID NO: 291506 - DNA, 25 bp, Mus musculus
gactgacgcagtctggcttgccacg

SEQ ID NO: 291507 - DNA, 25 bp, Mus musculus
gactgacggatgcggatgccatgaa

SEQ ID NO: 291508 - DNA, 25 bp, Mus musculus
gactgactccgtatgaggttgatga

SEQ ID NO: 291509 - DNA, 25 bp, Mus musculus
gactgactgggagacttgtggcaat

SEQ ID NO: 291510 - DNA, 25 bp, Mus musculus
gactgactggggatggaggtaaagg

SEQ ID NO: 291511 - DNA, 25 bp, Mus musculus
gactgactgggtgatgcccacgctg

SEQ ID NO: 291512 - DNA, 25 bp, Mus musculus
gactgactgtgtgtcccatgggtgc

SEQ ID NO: 291513 - DNA, 25 bp, Mus musculus
gactgacttcactaaggcaaaaatc

SEQ ID NO: 291514 - DNA, 25 bp, Mus musculus
gactgagaacaggtccaaagagaaa

SEQ ID NO: 291515 - DNA, 25 bp, Mus musculus
gactgagaacaggtctaggtccaaa

SEQ ID NO: 291516 - DNA, 25 bp, Mus musculus
gactgagaacctgccctgcagttaa

SEQ ID NO: 291517 - DNA, 25 bp, Mus musculus
gactgagaagatgggtaatgccatc

SEQ ID NO: 291518 - DNA, 25 bp, Mus musculus
gactgagaaggacaaattggagcct

SEQ ID NO: 291519 - DNA, 25 bp, Mus musculus
gactgagaaggacaaggttaactgc

SEQ ID NO: 291520 - DNA, 25 bp, Mus musculus
gactgagaagtcgggtacaaagtaa

SEQ ID NO: 291521 - DNA, 25 bp, Mus musculus
gactgagaataaatccaagtttggg

SEQ ID NO: 291522 - DNA, 25 bp, Mus musculus
gactgagaataaatccttggagctg

SEQ ID NO: 291523 - DNA, 25 bp, Mus musculus
gactgagaataaatgcctttaatgt

SEQ ID NO: 291524 - DNA, 25 bp, Mus musculus
gactgagagaggaccatgctcccca

SEQ ID NO: 291525 - DNA, 25 bp, Mus musculus
gactgagatagaaagaaaggcccag

SEQ ID NO: 291526 - DNA, 25 bp, Mus musculus
gactgagatagacaccatcttgctg

SEQ ID NO: 291527 - DNA, 25 bp, Mus musculus
gactgagatagatttcaaatatgcc

SEQ ID NO: 291528 - DNA, 25 bp, Mus musculus
gactgagcacacctgaggagaggtg

SEQ ID NO: 291529 - DNA, 25 bp, Mus musculus
gactgagcacactctgcagaggacg

SEQ ID NO: 291530 - DNA, 25 bp, Mus musculus
gactgagcacgcggtggagggagac

SEQ ID NO: 291531 - DNA, 25 bp, Mus musculus
gactgagcagcacagattctaactc

SEQ ID NO: 291532 - DNA, 25 bp, Mus musculus
gactgagcatgtaagctctggcttc

SEQ ID NO: 291533 - DNA, 25 bp, Mus musculus
gactgagccaagtggtggcgggaat

SEQ ID NO: 291534 - DNA, 25 bp, Mus musculus
gactgagcgccagagtacagtcgct

SEQ ID NO: 291535 - DNA, 25 bp, Mus musculus
gactgagctgagctggcaactattg

SEQ ID NO: 291536 - DNA, 25 bp, Mus musculus
gactgaggaacctgagaagaaggat

SEQ ID NO: 291537 - DNA, 25 bp, Mus musculus
gactgaggaagattgacttctaaac

SEQ ID NO: 291538 - DNA, 25 bp, Mus musculus
gactgaggaccacatgggtggcatc

SEQ ID NO: 291539 - DNA, 25 bp, Mus musculus
gactgaggagctgagtgataacatt

SEQ ID NO: 291540 - DNA, 25 bp, Mus musculus
gactgaggagctgagtgattttgag

SEQ ID NO: 291541 - DNA, 25 bp, Mus musculus
gactgaggcaggcagaagaagcttt

SEQ ID NO: 291542 - DNA, 25 bp, Mus musculus
gactgaggcgccgcccggttaacct

SEQ ID NO: 291543 - DNA, 25 bp, Mus musculus
gactgaggtgtggtctcggattggg

SEQ ID NO: 291544 - DNA, 25 bp, Mus musculus
gactgagtacaaggttggaagtcgg

SEQ ID NO: 291545 - DNA, 25 bp, Mus musculus
gactgagtcagaggaggggtgaggg

SEQ ID NO: 291546 - DNA, 25 bp, Mus musculus
gactgagtcagaggatccacactgg

SEQ ID NO: 291547 - DNA, 25 bp, Mus musculus
gactgagtcagccaaggtagccacg

SEQ ID NO: 291548 - DNA, 25 bp, Mus musculus
gactgagtccaagaaatggcctcca

SEQ ID NO: 291549 - DNA, 25 bp, Mus musculus
gactgagttgccctgactctaccgc

SEQ ID NO: 291550 - DNA, 25 bp, Mus musculus
gactgatagaaaggtttacgaaaga

SEQ ID NO: 291551 - DNA, 25 bp, Mus musculus
gactgatagaaagttgatcttctta

SEQ ID NO: 291552 - DNA, 25 bp, Mus musculus
gactgatagacagcccctgttgcat

SEQ ID NO: 291553 - DNA, 25 bp, Mus musculus
gactgatagacagctgctgctccag

SEQ ID NO: 291554 - DNA, 25 bp, Mus musculus
gactgatatccagtatggaagggtg

SEQ ID NO: 291555 - DNA, 25 bp, Mus musculus
gactgatcgaaaggtggcctcctca

SEQ ID NO: 291556 - DNA, 25 bp, Mus musculus
gactgatgcaaaaaggtctgctgaa

SEQ ID NO: 291557 - DNA, 25 bp, Mus musculus
gactgatgcagggtaatcaggaagc

SEQ ID NO: 291558 - DNA, 25 bp, Mus musculus
gactgatggcaaaagtttcttctgg

SEQ ID NO: 291559 - DNA, 25 bp, Mus musculus
gactgatgtgggaggtacgtgggag

SEQ ID NO: 291560 - DNA, 25 bp, Mus musculus
gactgatttaaggcttttgcctacc

SEQ ID NO: 291561 - DNA, 25 bp, Mus musculus
gactgatttaagggcagcagggaac

SEQ ID NO: 291562 - DNA, 25 bp, Mus musculus
gactgcaaaatgggagccaggagtc

SEQ ID NO: 291563 - DNA, 25 bp, Mus musculus
gactgcaaagaggctgatttatcgc

SEQ ID NO: 291564 - DNA, 25 bp, Mus musculus
gactgcaaaggtaaccagagcgagc

SEQ ID NO: 291565 - DNA, 25 bp, Mus musculus
gactgcaaaggtgaccagagcgagc

SEQ ID NO: 291566 - DNA, 25 bp, Mus musculus
gactgcacagtgtacaaggcagatg

SEQ ID NO: 291567 - DNA, 25 bp, Mus musculus
gactgcacagttatggtgtgggaga

SEQ ID NO: 291568 - DNA, 25 bp, Mus musculus
gactgcacgcagaaagatgacagga

SEQ ID NO: 291569 - DNA, 25 bp, Mus musculus
gactgcacggtgaagatctggaaca

SEQ ID NO: 291570 - DNA, 25 bp, Mus musculus
gactgcactgtcagagagtggggac

SEQ ID NO: 291571 - DNA, 25 bp, Mus musculus
gactgcactgtcagcagcattcctt

SEQ ID NO: 291572 - DNA, 25 bp, Mus musculus
gactgcacttgtggtttgctatctt

SEQ ID NO: 291573 - DNA, 25 bp, Mus musculus
gactgcagaatgacagatttgacca

SEQ ID NO: 291574 - DNA, 25 bp, Mus musculus
gactgcagactcacgcccactggaa

SEQ ID NO: 291575 - DNA, 25 bp, Mus musculus
gactgcagactgccgaatacaccaa

SEQ ID NO: 291576 - DNA, 25 bp, Mus musculus
gactgcagactggcatccgtctctt

SEQ ID NO: 291577 - DNA, 25 bp, Mus musculus
gactgcagagaaagagggggcccgc

SEQ ID NO: 291578 - DNA, 25 bp, Mus musculus
gactgcagagaaatgtgatttgttc

SEQ ID NO: 291579 - DNA, 25 bp, Mus musculus
gactgcagagaggctggcctccaca

SEQ ID NO: 291580 - DNA, 25 bp, Mus musculus
gactgcagaggacccgcgcgcaaga

SEQ ID NO: 291581 - DNA, 25 bp, Mus musculus
gactgcagaggaggtgttactagta

SEQ ID NO: 291582 - DNA, 25 bp, Mus musculus
gactgcagcacaggttctgattcgg

SEQ ID NO: 291583 - DNA, 25 bp, Mus musculus
gactgcagcaggcaccagagttttt

SEQ ID NO: 291584 - DNA, 25 bp, Mus musculus
gactgcagcctaaatggcaaaatgt

SEQ ID NO: 291585 - DNA, 25 bp, Mus musculus
gactgcagcctcttttatgaaacag

SEQ ID NO: 291586 - DNA, 25 bp, Mus musculus
gactgcaggaagaaagtctgcacca

SEQ ID NO: 291587 - DNA, 25 bp, Mus musculus
gactgcaggaagcttgggatccgct

SEQ ID NO: 291588 - DNA, 25 bp, Mus musculus
gactgcaggaggtctccaggtggtc

SEQ ID NO: 291589 - DNA, 25 bp, Mus musculus
gactgcagttgcagctctaagaaca

SEQ ID NO: 291590 - DNA, 25 bp, Mus musculus
gactgcagttgcaggtttcttcggg

SEQ ID NO: 291591 - DNA, 25 bp, Mus musculus
gactgcattacaagcccacagagca

SEQ ID NO: 291592 - DNA, 25 bp, Mus musculus
gactgcattacaagccttcccgctc

SEQ ID NO: 291593 - DNA, 25 bp, Mus musculus
gactgcattgacatagatgaatgtg

SEQ ID NO: 291594 - DNA, 25 bp, Mus musculus
gactgcattgtcatagatgaatgtg

SEQ ID NO: 291595 - DNA, 25 bp, Mus musculus
gactgccaagactcactctgtggag

SEQ ID NO: 291596 - DNA, 25 bp, Mus musculus
gactgccaaggaggccgagttagct

SEQ ID NO: 291597 - DNA, 25 bp, Mus musculus
gactgccacggcctcctcagcagcc

SEQ ID NO: 291598 - DNA, 25 bp, Mus musculus
gactgccacggtcatctctcatgga

SEQ ID NO: 291599 - DNA, 25 bp, Mus musculus
gactgccagtgggatcccactaaat

SEQ ID NO: 291600 - DNA, 25 bp, Mus musculus
gactgccagtgggatcgctgttgtg

SEQ ID NO: 291601 - DNA, 25 bp, Mus musculus
gactgccatatttagattataaaaa

SEQ ID NO: 291602 - DNA, 25 bp, Mus musculus
gactgccatatttagcattcccgtc

SEQ ID NO: 291603 - DNA, 25 bp, Mus musculus
gactgccatgcagtgagctgctggt

SEQ ID NO: 291604 - DNA, 25 bp, Mus musculus
gactgccattgaagctgaagaagat

SEQ ID NO: 291605 - DNA, 25 bp, Mus musculus
gactgccccaaggctgacttcccca

SEQ ID NO: 291606 - DNA, 25 bp, Mus musculus
gactgccccggccagctgactgctg

SEQ ID NO: 291607 - DNA, 25 bp, Mus musculus
gactgcccgacttgggcaggtaaac

SEQ ID NO: 291608 - DNA, 25 bp, Mus musculus
gactgcccgttttagcttggctgaa

SEQ ID NO: 291609 - DNA, 25 bp, Mus musculus
gactgccgccccaacccgtgtcaca

SEQ ID NO: 291610 - DNA, 25 bp, Mus musculus
gactgccggctgggctgctgattca

SEQ ID NO: 291611 - DNA, 25 bp, Mus musculus
gactgccgtatcaacattgatgagt

SEQ ID NO: 291612 - DNA, 25 bp, Mus musculus
gactgccgtgttagatgagaaccac

SEQ ID NO: 291613 - DNA, 25 bp, Mus musculus
gactgccgtgttagtccctataacc

SEQ ID NO: 291614 - DNA, 25 bp, Mus musculus
gactgcctagtgagtttacaggctg

SEQ ID NO: 291615 - DNA, 25 bp, Mus musculus
gactgcctgccaggattttaccgga

SEQ ID NO: 291616 - DNA, 25 bp, Mus musculus
gactgccttcaggacgaatgctaca

SEQ ID NO: 291617 - DNA, 25 bp, Mus musculus
gactgcgacttggataagaaaactt

SEQ ID NO: 291618 - DNA, 25 bp, Mus musculus
gactgcgacttgggcttcctgtatc

SEQ ID NO: 291619 - DNA, 25 bp, Mus musculus
gactgcgagcccgcatggattccag

SEQ ID NO: 291620 - DNA, 25 bp, Mus musculus
gactgcgaggggaagattgcatctg

SEQ ID NO: 291621 - DNA, 25 bp, Mus musculus
gactgcgaggggaaggtgaagtatt

SEQ ID NO: 291622 - DNA, 25 bp, Mus musculus
gactgcgccatctctgtctgcccca

SEQ ID NO: 291623 - DNA, 25 bp, Mus musculus
gactgcggaggggtgggaggctgcc

SEQ ID NO: 291624 - DNA, 25 bp, Mus musculus
gactgcggattcggagcattcttga

SEQ ID NO: 291625 - DNA, 25 bp, Mus musculus
gactgcggattcggatggattccaa

SEQ ID NO: 291626 - DNA, 25 bp, Mus musculus
gactgcggcaaagaggcattctgga

SEQ ID NO: 291627 - DNA, 25 bp, Mus musculus
gactgcggcgcaaccatgaaggtga

SEQ ID NO: 291628 - DNA, 25 bp, Mus musculus
gactgcgtcaagacccggatgcaga

SEQ ID NO: 291629 - DNA, 25 bp, Mus musculus
gactgcgtcaaggtgcagccggatg

SEQ ID NO: 291630 - DNA, 25 bp, Mus musculus
gactgcgtcccgagggaaatggagc

SEQ ID NO: 291631 - DNA, 25 bp, Mus musculus
gactgctaagtcttcagcaaacgac

SEQ ID NO: 291632 - DNA, 25 bp, Mus musculus
gactgctacgacaggtacctgtgtc

SEQ ID NO: 291633 - DNA, 25 bp, Mus musculus
gactgctacgataggtacctgtgtc

SEQ ID NO: 291634 - DNA, 25 bp, Mus musculus
gactgctccagcggctgtgacagcg

SEQ ID NO: 291635 - DNA, 25 bp, Mus musculus
gactgctccagggaaaatagagaaa

SEQ ID NO: 291636 - DNA, 25 bp, Mus musculus
gactgctccaggtcctggaggccac

SEQ ID NO: 291637 - DNA, 25 bp, Mus musculus
gactgctccgagctcacaggaagga

SEQ ID NO: 291638 - DNA, 25 bp, Mus musculus
gactgctccgaggcatgtcccccag

SEQ ID NO: 291639 - DNA, 25 bp, Mus musculus
gactgctcctggtgcatggaggact

SEQ ID NO: 291640 - DNA, 25 bp, Mus musculus
gactgctctacgaagcgctgcgctg

SEQ ID NO: 291641 - DNA, 25 bp, Mus musculus
gactgctctatcgaggctacatgaa

SEQ ID NO: 291642 - DNA, 25 bp, Mus musculus
gactgctgacagaaatcttaaaaag

SEQ ID NO: 291643 - DNA, 25 bp, Mus musculus
gactgctgacaggcaccacacagtc

SEQ ID NO: 291644 - DNA, 25 bp, Mus musculus
gactgctgcagcagagagccagcca

SEQ ID NO: 291645 - DNA, 25 bp, Mus musculus
gactgctgccaggtggagagagcca

SEQ ID NO: 291646 - DNA, 25 bp, Mus musculus
gactgctgcccacagagaggtgaca

SEQ ID NO: 291647 - DNA, 25 bp, Mus musculus
gactgctgcccacaggaaataacag

SEQ ID NO: 291648 - DNA, 25 bp, Mus musculus
gactgctgcggacaagtttttactt

SEQ ID NO: 291649 - DNA, 25 bp, Mus musculus
gactgctgtaggtctgaccacccgg

SEQ ID NO: 291650 - DNA, 25 bp, Mus musculus
gactgctgtcaatgggagccggtga

SEQ ID NO: 291651 - DNA, 25 bp, Mus musculus
gactgctgtcctagggacaaagtat

SEQ ID NO: 291652 - DNA, 25 bp, Mus musculus
gactgctgtcctaggggctcaagga

SEQ ID NO: 291653 - DNA, 25 bp, Mus musculus
gactgcttcagggagacacacctgc

SEQ ID NO: 291654 - DNA, 25 bp, Mus musculus
gactgcttcctcaagctggcagcag

SEQ ID NO: 291655 - DNA, 25 bp, Mus musculus
gactgcttctaagactctgaattcg

SEQ ID NO: 291656 - DNA, 25 bp, Mus musculus
gactgcttctgtatcaagatattat

SEQ ID NO: 291657 - DNA, 25 bp, Mus musculus
gactgctttctatccctgtgcacat

SEQ ID NO: 291658 - DNA, 25 bp, Mus musculus
gactgctttttaggaccttgttcct

SEQ ID NO: 291659 - DNA, 25 bp, Mus musculus
gactgctttttagtggtgatcatgt

SEQ ID NO: 291660 - DNA, 25 bp, Mus musculus
gactggaaaaaggacaggtgcagtc

SEQ ID NO: 291661 - DNA, 25 bp, Mus musculus
gactggaaaaaggataggtgcggtc

SEQ ID NO: 291662 - DNA, 25 bp, Mus musculus
gactggaaaacagtgaaggcccacg

SEQ ID NO: 291663 - DNA, 25 bp, Mus musculus
gactggaaagatggagccagcactg

SEQ ID NO: 291664 - DNA, 25 bp, Mus musculus
gactggaaaggtggtctacttctca

SEQ ID NO: 291665 - DNA, 25 bp, Mus musculus
gactggaaaggttggtttcttcatg

SEQ ID NO: 291666 - DNA, 25 bp, Mus musculus
gactggaaagttggggttcacggct

SEQ ID NO: 291667 - DNA, 25 bp, Mus musculus
gactggaacaggaaggttcatatgg

SEQ ID NO: 291668 - DNA, 25 bp, Mus musculus
gactggaacatggtgcagcccggaa

SEQ ID NO: 291669 - DNA, 25 bp, Mus musculus
gactggaaggatctgcgatggcgtc

SEQ ID NO: 291670 - DNA, 25 bp, Mus musculus
gactggaatgaagatctttctgaga

SEQ ID NO: 291671 - DNA, 25 bp, Mus musculus
gactggaatggtatttccaaactat

SEQ ID NO: 291672 - DNA, 25 bp, Mus musculus
gactggacagaacgattccgggatt

SEQ ID NO: 291673 - DNA, 25 bp, Mus musculus
gactggacagcaggtcatgttggga

SEQ ID NO: 291674 - DNA, 25 bp, Mus musculus
gactggacaggttttatacgttcct

SEQ ID NO: 291675 - DNA, 25 bp, Mus musculus
gactggacatcacagcatggtttat

SEQ ID NO: 291676 - DNA, 25 bp, Mus musculus
gactggacatgattttgggcatcac

SEQ ID NO: 291677 - DNA, 25 bp, Mus musculus
gactggacatggggatcctgtgggc

SEQ ID NO: 291678 - DNA, 25 bp, Mus musculus
gactggacattgatgaaactgttat

SEQ ID NO: 291679 - DNA, 25 bp, Mus musculus
gactggacccatgtccttcaggacc

SEQ ID NO: 291680 - DNA, 25 bp, Mus musculus
gactggactcaagcggatagccaag

SEQ ID NO: 291681 - DNA, 25 bp, Mus musculus
gactggactgaagatctctctgaaa

SEQ ID NO: 291682 - DNA, 25 bp, Mus musculus
gactggagaaggtcttcgcttatgt

SEQ ID NO: 291683 - DNA, 25 bp, Mus musculus
gactggagaagtatgtgggtgccct

SEQ ID NO: 291684 - DNA, 25 bp, Mus musculus
gactggagagatcttgtggcgccat

SEQ ID NO: 291685 - DNA, 25 bp, Mus musculus
gactggagaggctcccccaccgaaa

SEQ ID NO: 291686 - DNA, 25 bp, Mus musculus
gactggagcaaggtggccctgacaa

SEQ ID NO: 291687 - DNA, 25 bp, Mus musculus
gactggagccaagagagctgaagcg

SEQ ID NO: 291688 - DNA, 25 bp, Mus musculus
gactggagccagaattcacactgga

SEQ ID NO: 291689 - DNA, 25 bp, Mus musculus
gactggagcttggtgtctgtctctc

SEQ ID NO: 291690 - DNA, 25 bp, Mus musculus
gactggaggacggaaaccactgaga

SEQ ID NO: 291691 - DNA, 25 bp, Mus musculus
gactggaggagttgaaagaatttgc

SEQ ID NO: 291692 - DNA, 25 bp, Mus musculus
gactggaggatacgtcctctgccag

SEQ ID NO: 291693 - DNA, 25 bp, Mus musculus
gactggagggctagatgggatgtga

SEQ ID NO: 291694 - DNA, 25 bp, Mus musculus
gactggagggctaggcttcaacttg

SEQ ID NO: 291695 - DNA, 25 bp, Mus musculus
gactggaggtggccgatgtgacagc

SEQ ID NO: 291696 - DNA, 25 bp, Mus musculus
gactggagtccagcaatccaaactt

SEQ ID NO: 291697 - DNA, 25 bp, Mus musculus
gactggagtgaggaaaatggcacac

SEQ ID NO: 291698 - DNA, 25 bp, Mus musculus
gactggagtgaggagaagaaacact

SEQ ID NO: 291699 - DNA, 25 bp, Mus musculus
gactggagtgaggtcaagggtcttc

SEQ ID NO: 291700 - DNA, 25 bp, Mus musculus
gactggatactgcctgtgcctcaca

SEQ ID NO: 291701 - DNA, 25 bp, Mus musculus
gactggatactggtaacagcatgac

SEQ ID NO: 291702 - DNA, 25 bp, Mus musculus
gactggatagcctgcttggcagtga

SEQ ID NO: 291703 - DNA, 25 bp, Mus musculus
gactggatagcctggtaggacagtc

SEQ ID NO: 291704 - DNA, 25 bp, Mus musculus
gactggatcaaggagaaaatacaac

SEQ ID NO: 291705 - DNA, 25 bp, Mus musculus
gactggatctgggagcatcaaggtc

SEQ ID NO: 291706 - DNA, 25 bp, Mus musculus
gactggatgccactggtaagaccac

SEQ ID NO: 291707 - DNA, 25 bp, Mus musculus
gactggatgccactggtactggcat

SEQ ID NO: 291708 - DNA, 25 bp, Mus musculus
gactggatggggggtgtgccagcct

SEQ ID NO: 291709 - DNA, 25 bp, Mus musculus
gactggattctcggagagtccttct

SEQ ID NO: 291710 - DNA, 25 bp, Mus musculus
gactggattctcggtgggagccagc

SEQ ID NO: 291711 - DNA, 25 bp, Mus musculus
gactggcaaatcaccccttttccag

SEQ ID NO: 291712 - DNA, 25 bp, Mus musculus
gactggcaacccagaactgatagtg

SEQ ID NO: 291713 - DNA, 25 bp, Mus musculus
gactggcaacccagattgacttgat

SEQ ID NO: 291714 - DNA, 25 bp, Mus musculus
gactggcaagacggcttccttgtgg

SEQ ID NO: 291715 - DNA, 25 bp, Mus musculus
gactggcaaggttactttggagtac

SEQ ID NO: 291716 - DNA, 25 bp, Mus musculus
gactggcacatgaggtcgggtggaa

SEQ ID NO: 291717 - DNA, 25 bp, Mus musculus
gactggccgcaggaagctaagcaac

SEQ ID NO: 291718 - DNA, 25 bp, Mus musculus
gactggccgcagggtacattcgcct

SEQ ID NO: 291719 - DNA, 25 bp, Mus musculus
gactggcctggggtctacatcaccg

SEQ ID NO: 291720 - DNA, 25 bp, Mus musculus
gactggcgcaaggttcccaatcaag

SEQ ID NO: 291721 - DNA, 25 bp, Mus musculus
gactggcgcggccgaggctgcttcc

SEQ ID NO: 291722 - DNA, 25 bp, Mus musculus
gactggctaagaactgccagtgtat

SEQ ID NO: 291723 - DNA, 25 bp, Mus musculus
gactggctatcccagatggatgact

SEQ ID NO: 291724 - DNA, 25 bp, Mus musculus
gactggctcatggggaagtctaaag

SEQ ID NO: 291725 - DNA, 25 bp, Mus musculus
gactggctcatgggttctgcaatct

SEQ ID NO: 291726 - DNA, 25 bp, Mus musculus
gactggctcttggcgacaactggcc

SEQ ID NO: 291727 - DNA, 25 bp, Mus musculus
gactgggaaactactatagaaaact

SEQ ID NO: 291728 - DNA, 25 bp, Mus musculus
gactgggaaaggacccagctgttgt

SEQ ID NO: 291729 - DNA, 25 bp, Mus musculus
gactgggaaaggagtgtgctcgggt

SEQ ID NO: 291730 - DNA, 25 bp, Mus musculus
gactgggaaaggatcatcgggttat

SEQ ID NO: 291731 - DNA, 25 bp, Mus musculus
gactgggaaagggtgactgtggccc

SEQ ID NO: 291732 - DNA, 25 bp, Mus musculus
gactgggacctcatcattctctggc

SEQ ID NO: 291733 - DNA, 25 bp, Mus musculus
gactgggacctcatctacgtgggcc

SEQ ID NO: 291734 - DNA, 25 bp, Mus musculus
gactgggagagaaatatccaccccc

SEQ ID NO: 291735 - DNA, 25 bp, Mus musculus
gactgggagaggatttgaattaatc

SEQ ID NO: 291736 - DNA, 25 bp, Mus musculus
gactgggagagggtgttacgtttcc

SEQ ID NO: 291737 - DNA, 25 bp, Mus musculus
gactgggaggagaaggtcctgttga

SEQ ID NO: 291738 - DNA, 25 bp, Mus musculus
gactgggataaaggattccagcaga

SEQ ID NO: 291739 - DNA, 25 bp, Mus musculus
gactgggattgggctagtgaaccgg

SEQ ID NO: 291740 - DNA, 25 bp, Mus musculus
gactgggcacgaggctggaaggctg

SEQ ID NO: 291741 - DNA, 25 bp, Mus musculus
gactgggcagttggtcatcatggag

SEQ ID NO: 291742 - DNA, 25 bp, Mus musculus
gactggggccgtcatcatagccagc

SEQ ID NO: 291743 - DNA, 25 bp, Mus musculus
gactggggtactgctgcaggtcctg

SEQ ID NO: 291744 - DNA, 25 bp, Mus musculus
gactgggtggaggctaatctcgacg

SEQ ID NO: 291745 - DNA, 25 bp, Mus musculus
gactggtagagctgcgcttgtgcac

SEQ ID NO: 291746 - DNA, 25 bp, Mus musculus
gactggtcaacacaggtcttctgac

SEQ ID NO: 291747 - DNA, 25 bp, Mus musculus
gactggtcaagaggaaattgatgag

SEQ ID NO: 291748 - DNA, 25 bp, Mus musculus
gactggtcagatgagggtacgggcg

SEQ ID NO: 291749 - DNA, 25 bp, Mus musculus
gactggtcctcaggcattaacaagt

SEQ ID NO: 291750 - DNA, 25 bp, Mus musculus
gactggtggcctcaagggttacagg

SEQ ID NO: 291751 - DNA, 25 bp, Mus musculus
gactggtgggcagcttcatgttgtg

SEQ ID NO: 291752 - DNA, 25 bp, Mus musculus
gactggtgggcagggccttcgtata

SEQ ID NO: 291753 - DNA, 25 bp, Mus musculus
gactggtgtcaagcctgagggatct

SEQ ID NO: 291754 - DNA, 25 bp, Mus musculus
gactggtgtcaagctcccagactcc

SEQ ID NO: 291755 - DNA, 25 bp, Mus musculus
gactggtgtgagccttctctgagga

SEQ ID NO: 291756 - DNA, 25 bp, Mus musculus
gactggttaacgcttatttcctcaa

SEQ ID NO: 291757 - DNA, 25 bp, Mus musculus
gactggttaggaaacctgccatatg

SEQ ID NO: 291758 - DNA, 25 bp, Mus musculus
gactggttcctggagggatcaatgt

SEQ ID NO: 291759 - DNA, 25 bp, Mus musculus
gactggtttcagaaggtttgaagac

SEQ ID NO: 291760 - DNA, 25 bp, Mus musculus
gactggtttggtgttcatcatgggt

SEQ ID NO: 291761 - DNA, 25 bp, Mus musculus
gactggttttggaggctgataagct

SEQ ID NO: 291762 - DNA, 25 bp, Mus musculus
gactgtaaagaagctggctgtgaac

SEQ ID NO: 291763 - DNA, 25 bp, Mus musculus
gactgtaacctgtcctggttatggc

SEQ ID NO: 291764 - DNA, 25 bp, Mus musculus
gactgtacaccaggtcctgataagc

SEQ ID NO: 291765 - DNA, 25 bp, Mus musculus
gactgtacactgacgaggatagtgc

SEQ ID NO: 291766 - DNA, 25 bp, Mus musculus
gactgtacactgacgtccagaaacg

SEQ ID NO: 291767 - DNA, 25 bp, Mus musculus
gactgtacagtatgtgcagagcatt

SEQ ID NO: 291768 - DNA, 25 bp, Mus musculus
gactgtacagtgaaacagatgtgca

SEQ ID NO: 291769 - DNA, 25 bp, Mus musculus
gactgtaccaggcccagtctgtgcg

SEQ ID NO: 291770 - DNA, 25 bp, Mus musculus
gactgtaccagggccacaccctacg

SEQ ID NO: 291771 - DNA, 25 bp, Mus musculus
gactgtaccagtgacttcaatgcag

SEQ ID NO: 291772 - DNA, 25 bp, Mus musculus
gactgtaccccagctatcatgaaca

SEQ ID NO: 291773 - DNA, 25 bp, Mus musculus
gactgtaccgaggtctgatcccaca

SEQ ID NO: 291774 - DNA, 25 bp, Mus musculus
gactgtaccgggctgtcagggggtt

SEQ ID NO: 291775 - DNA, 25 bp, Mus musculus
gactgtagcaaggtgtctgatgcca

SEQ ID NO: 291776 - DNA, 25 bp, Mus musculus
gactgtagcaattccttcttggagg

SEQ ID NO: 291777 - DNA, 25 bp, Mus musculus
gactgtagcccggacatcaccttga

SEQ ID NO: 291778 - DNA, 25 bp, Mus musculus
gactgtatcaagcaatgtgacccag

SEQ ID NO: 291779 - DNA, 25 bp, Mus musculus
gactgtatggcacgaatgaggaaga

SEQ ID NO: 291780 - DNA, 25 bp, Mus musculus
gactgtattccagaatgcccatatc

SEQ ID NO: 291781 - DNA, 25 bp, Mus musculus
gactgtcacaacagctcgcaatgcc

SEQ ID NO: 291782 - DNA, 25 bp, Mus musculus
gactgtcacaggggcaggtggcagt

SEQ ID NO: 291783 - DNA, 25 bp, Mus musculus
gactgtcaccctgtctggaaagaaa

SEQ ID NO: 291784 - DNA, 25 bp, Mus musculus
gactgtcatccaggaccccatgcct

SEQ ID NO: 291785 - DNA, 25 bp, Mus musculus
gactgtccacagatacttggataag

SEQ ID NO: 291786 - DNA, 25 bp, Mus musculus
gactgtcccacaaggcatgctagtc

SEQ ID NO: 291787 - DNA, 25 bp, Mus musculus
gactgtccctcaagttgcctgcagg

SEQ ID NO: 291788 - DNA, 25 bp, Mus musculus
gactgtccctcaatgcaaaaaggcc

SEQ ID NO: 291789 - DNA, 25 bp, Mus musculus
gactgtccctcaatggcacgctcct

SEQ ID NO: 291790 - DNA, 25 bp, Mus musculus
gactgtccctcaatttcgaggactc

SEQ ID NO: 291791 - DNA, 25 bp, Mus musculus
gactgtccctctatgccaaaaggcc

SEQ ID NO: 291792 - DNA, 25 bp, Mus musculus
gactgtcctcccgggtaaatagctg

SEQ ID NO: 291793 - DNA, 25 bp, Mus musculus
gactgtcctggaggagagggaagaa

SEQ ID NO: 291794 - DNA, 25 bp, Mus musculus
gactgtctaccccaggtggcagcct

SEQ ID NO: 291795 - DNA, 25 bp, Mus musculus
gactgtctatacaactaaaattata

SEQ ID NO: 291796 - DNA, 25 bp, Mus musculus
gactgtctatagacctgcaatgacg

SEQ ID NO: 291797 - DNA, 25 bp, Mus musculus
gactgtctcagatcttgtaggactc

SEQ ID NO: 291798 - DNA, 25 bp, Mus musculus
gactgtctggaaggtcgctgtgcta

SEQ ID NO: 291799 - DNA, 25 bp, Mus musculus
gactgtcttgagtgtctagctgcca

SEQ ID NO: 291800 - DNA, 25 bp, Mus musculus
gactgtgaaacagacaagcagatgg

SEQ ID NO: 291801 - DNA, 25 bp, Mus musculus
gactgtgaaacagggaagcagctgg

SEQ ID NO: 291802 - DNA, 25 bp, Mus musculus
gactgtgaaagtgtatgagaagttg

SEQ ID NO: 291803 - DNA, 25 bp, Mus musculus
gactgtgaacagttcaaattccatc

SEQ ID NO: 291804 - DNA, 25 bp, Mus musculus
gactgtgaacagtttaaagcatgct

SEQ ID NO: 291805 - DNA, 25 bp, Mus musculus
gactgtgaagaaccgacgcagaccc

SEQ ID NO: 291806 - DNA, 25 bp, Mus musculus
gactgtgaagcgaggtctaagccga

SEQ ID NO: 291807 - DNA, 25 bp, Mus musculus
gactgtgaagcgagtttcagggaca

SEQ ID NO: 291808 - DNA, 25 bp, Mus musculus
gactgtgaagggaagacatgtgaaa

SEQ ID NO: 291809 - DNA, 25 bp, Mus musculus
gactgtgaagtgtgccttacatcca

SEQ ID NO: 291810 - DNA, 25 bp, Mus musculus
gactgtgaagttagtagaaaaagga

SEQ ID NO: 291811 - DNA, 25 bp, Mus musculus
gactgtgaatctaggtgtagaagcc

SEQ ID NO: 291812 - DNA, 25 bp, Mus musculus
gactgtgaatgggtgaatttggaag

SEQ ID NO: 291813 - DNA, 25 bp, Mus musculus
gactgtgaatgggttctaacgttcc

SEQ ID NO: 291814 - DNA, 25 bp, Mus musculus
gactgtgacaggcatcatagctgcg

SEQ ID NO: 291815 - DNA, 25 bp, Mus musculus
gactgtgagctgaagatcctagact

SEQ ID NO: 291816 - DNA, 25 bp, Mus musculus
gactgtgatgggtgtacaatagact

SEQ ID NO: 291817 - DNA, 25 bp, Mus musculus
gactgtgcaaggaagatctggagac

SEQ ID NO: 291818 - DNA, 25 bp, Mus musculus
gactgtgcactcagccatagattgt

SEQ ID NO: 291819 - DNA, 25 bp, Mus musculus
gactgtgcagagccaatatgaagag

SEQ ID NO: 291820 - DNA, 25 bp, Mus musculus
gactgtgcagaggttcacctggtca

SEQ ID NO: 291821 - DNA, 25 bp, Mus musculus
gactgtgcaggttgaaaacgaggct

SEQ ID NO: 291822 - DNA, 25 bp, Mus musculus
gactgtgcccggaatcccagtcaga

SEQ ID NO: 291823 - DNA, 25 bp, Mus musculus
gactgtggaagaaggtggtgatctt

SEQ ID NO: 291824 - DNA, 25 bp, Mus musculus
gactgtggacgaagcaatggcaagc

SEQ ID NO: 291825 - DNA, 25 bp, Mus musculus
gactgtggacgatgtcataaaggaa

SEQ ID NO: 291826 - DNA, 25 bp, Mus musculus
gactgtggacgggattctctgctct

SEQ ID NO: 291827 - DNA, 25 bp, Mus musculus
gactgtggagaccacagacagcaag

SEQ ID NO: 291828 - DNA, 25 bp, Mus musculus
gactgtggagagagatggtatggtg

SEQ ID NO: 291829 - DNA, 25 bp, Mus musculus
gactgtggaggtcttctgcgagtac

SEQ ID NO: 291830 - DNA, 25 bp, Mus musculus
gactgtggagtgtgcacagccccct

SEQ ID NO: 291831 - DNA, 25 bp, Mus musculus
gactgtggctgggaccaggagctga

SEQ ID NO: 291832 - DNA, 25 bp, Mus musculus
gactgtggggtgtgccttcttcaca

SEQ ID NO: 291833 - DNA, 25 bp, Mus musculus
gactgtggtgctaagaggcttcctg

SEQ ID NO: 291834 - DNA, 25 bp, Mus musculus
gactgtggtgctaaggcaacatctg

SEQ ID NO: 291835 - DNA, 25 bp, Mus musculus
gactgtggtgctaaggtggtggaga

SEQ ID NO: 291836 - DNA, 25 bp, Mus musculus
gactgtgtctaaagggcttctctgc

SEQ ID NO: 291837 - DNA, 25 bp, Mus musculus
gactgtgtctaaaggtaaaacagac

SEQ ID NO: 291838 - DNA, 25 bp, Mus musculus
gactgtgtctgccgtgcgtctcttc

SEQ ID NO: 291839 - DNA, 25 bp, Mus musculus
gactgtgtgataaagttggagtcat

SEQ ID NO: 291840 - DNA, 25 bp, Mus musculus
gactgtgtgccaaggcgaaagccca

SEQ ID NO: 291841 - DNA, 25 bp, Mus musculus
gactgtgtgccaaggtttgacctgc

SEQ ID NO: 291842 - DNA, 25 bp, Mus musculus
gactgtgtgggtgaaagccggcggg

SEQ ID NO: 291843 - DNA, 25 bp, Mus musculus
gactgtgtggtgtcgattgatgagg

SEQ ID NO: 291844 - DNA, 25 bp, Mus musculus
gactgtgtggttgcagaagctggag

SEQ ID NO: 291845 - DNA, 25 bp, Mus musculus
gactgtgtgtctggcgtgtgtgtgc

SEQ ID NO: 291846 - DNA, 25 bp, Mus musculus
gactgtgtgtgccaagtctatattt

SEQ ID NO: 291847 - DNA, 25 bp, Mus musculus
gactgtgtgtgccaagttccatatc

SEQ ID NO: 291848 - DNA, 25 bp, Mus musculus
gactgtgttagatgctcctgaagtt

SEQ ID NO: 291849 - DNA, 25 bp, Mus musculus
gactgtgttagttgaacccacagtg

SEQ ID NO: 291850 - DNA, 25 bp, Mus musculus
gactgtgttctagactcaagaatga

SEQ ID NO: 291851 - DNA, 25 bp, Mus musculus
gactgtgtttatggactacaaagaa

SEQ ID NO: 291852 - DNA, 25 bp, Mus musculus
gactgtgtttgaggaattattttat

SEQ ID NO: 291853 - DNA, 25 bp, Mus musculus
gactgttaatagcccacaggtcctg

SEQ ID NO: 291854 - DNA, 25 bp, Mus musculus
gactgttaataggtcctgcctccca

SEQ ID NO: 291855 - DNA, 25 bp, Mus musculus
gactgttaccaatgcaccttccagc

SEQ ID NO: 291856 - DNA, 25 bp, Mus musculus
gactgttaggaacagcctcaggccc

SEQ ID NO: 291857 - DNA, 25 bp, Mus musculus
gactgttaggcaccgtgggcctaac

SEQ ID NO: 291858 - DNA, 25 bp, Mus musculus
gactgttatatgcagcagaagatgt

SEQ ID NO: 291859 - DNA, 25 bp, Mus musculus
gactgttcatgggagaagggcaggt

SEQ ID NO: 291860 - DNA, 25 bp, Mus musculus
gactgttcatgggagaggggtaact

SEQ ID NO: 291861 - DNA, 25 bp, Mus musculus
gactgttccattgagatctgtgccg

SEQ ID NO: 291862 - DNA, 25 bp, Mus musculus
gactgttctctaattttccaggtgc

SEQ ID NO: 291863 - DNA, 25 bp, Mus musculus
gacttaaccaaagaggatatagatc

SEQ ID NO: 291864 - DNA, 25 bp, Mus musculus
gacttaagcacagaaggtgggactg

SEQ ID NO: 291865 - DNA, 25 bp, Mus musculus
gacttaagttccagtggtaactcat

SEQ ID NO: 291866 - DNA, 25 bp, Mus musculus
gacttaatcaccgtcattacccaaa

SEQ ID NO: 291867 - DNA, 25 bp, Mus musculus
gacttaatgtttgtgtgtctaaaca

SEQ ID NO: 291868 - DNA, 25 bp, Mus musculus
gacttaatttgagcataaggagaat

SEQ ID NO: 291869 - DNA, 25 bp, Mus musculus
gacttacaaatcaggagtatacaag

SEQ ID NO: 291870 - DNA, 25 bp, Mus musculus
gacttacacacaggctgagggtatc

SEQ ID NO: 291871 - DNA, 25 bp, Mus musculus
gacttacacttcaacggtctgagcg

SEQ ID NO: 291872 - DNA, 25 bp, Mus musculus
gacttacacttcaagatgtttgatg

SEQ ID NO: 291873 - DNA, 25 bp, Mus musculus
gacttacagctattgcgtctgcacc

SEQ ID NO: 291874 - DNA, 25 bp, Mus musculus
gacttacagtaaggggctccacggg

SEQ ID NO: 291875 - DNA, 25 bp, Mus musculus
gacttacatcacggagaatgtactg

SEQ ID NO: 291876 - DNA, 25 bp, Mus musculus
gacttaccaaagaggaattcaaggg

SEQ ID NO: 291877 - DNA, 25 bp, Mus musculus
gacttaccagctgggaagggctacc

SEQ ID NO: 291878 - DNA, 25 bp, Mus musculus
gacttaccgattctgttcccagttc

SEQ ID NO: 291879 - DNA, 25 bp, Mus musculus
gacttactacagctgggcatggcag

SEQ ID NO: 291880 - DNA, 25 bp, Mus musculus
gacttactacaggtggctgcggctt

SEQ ID NO: 291881 - DNA, 25 bp, Mus musculus
gacttagaagacgagctgtatgctc

SEQ ID NO: 291882 - DNA, 25 bp, Mus musculus
gacttagaagagaaagtggcccatg

SEQ ID NO: 291883 - DNA, 25 bp, Mus musculus
gacttagaagataagtttctttgct

SEQ ID NO: 291884 - DNA, 25 bp, Mus musculus
gacttagaagatcaactctaccatc

SEQ ID NO: 291885 - DNA, 25 bp, Mus musculus
gacttagacagagctgaggaccgaa

SEQ ID NO: 291886 - DNA, 25 bp, Mus musculus
gacttagacaggtgctgccagactc

SEQ ID NO: 291887 - DNA, 25 bp, Mus musculus
gacttagagaaggaagggaacatgc

SEQ ID NO: 291888 - DNA, 25 bp, Mus musculus
gacttagaggactagcccactgtgc

SEQ ID NO: 291889 - DNA, 25 bp, Mus musculus
gacttagaggactgtcagaaaaccc

SEQ ID NO: 291890 - DNA, 25 bp, Mus musculus
gacttagcatggcagatgaaccgga

SEQ ID NO: 291891 - DNA, 25 bp, Mus musculus
gacttagccgagttcaatctcatcc

SEQ ID NO: 291892 - DNA, 25 bp, Mus musculus
gacttaggagtacagagactcagcc

SEQ ID NO: 291893 - DNA, 25 bp, Mus musculus
gacttaggcccaaagctctacagac

SEQ ID NO: 291894 - DNA, 25 bp, Mus musculus
gacttaggcccaaaggtacagagat

SEQ ID NO: 291895 - DNA, 25 bp, Mus musculus
gacttaggcccaaaggtgttctaca

SEQ ID NO: 291896 - DNA, 25 bp, Mus musculus
gacttagtgcggctgtgtggagatg

SEQ ID NO: 291897 - DNA, 25 bp, Mus musculus
gacttagttggacagagctggcaag

SEQ ID NO: 291898 - DNA, 25 bp, Mus musculus
gacttatatatgacattatgcagaa

SEQ ID NO: 291899 - DNA, 25 bp, Mus musculus
gacttatcaaaggtgtggcccacca

SEQ ID NO: 291900 - DNA, 25 bp, Mus musculus
gacttatgggatatcttcagaaaaa

SEQ ID NO: 291901 - DNA, 25 bp, Mus musculus
gacttattaaggtcacagtaatgaa

SEQ ID NO: 291902 - DNA, 25 bp, Mus musculus
gacttcaacaaggtaatgcaggtgg

SEQ ID NO: 291903 - DNA, 25 bp, Mus musculus
gacttcaacctctaaaagcccgatt

SEQ ID NO: 291904 - DNA, 25 bp, Mus musculus
gacttcaacctctatgtgacggacg

SEQ ID NO: 291905 - DNA, 25 bp, Mus musculus
gacttcaagaaaggtttcagactga

SEQ ID NO: 291906 - DNA, 25 bp, Mus musculus
gacttcaagaacaagtatgaggatg

SEQ ID NO: 291907 - DNA, 25 bp, Mus musculus
gacttcaagcccagctatgggaccc

SEQ ID NO: 291908 - DNA, 25 bp, Mus musculus
gacttcaagcccagtcttgcctcca

SEQ ID NO: 291909 - DNA, 25 bp, Mus musculus
gacttcaaggaaggaatcttttgtg

SEQ ID NO: 291910 - DNA, 25 bp, Mus musculus
gacttcaataatgatttccagggta

SEQ ID NO: 291911 - DNA, 25 bp, Mus musculus
gacttcaataatgtggtgaaaacaa

SEQ ID NO: 291912 - DNA, 25 bp, Mus musculus
gacttcacaacaaaccgagaaagga

SEQ ID NO: 291913 - DNA, 25 bp, Mus musculus
gacttcacacacatttaccttcagt

SEQ ID NO: 291914 - DNA, 25 bp, Mus musculus
gacttcacactgttccaggctttac

SEQ ID NO: 291915 - DNA, 25 bp, Mus musculus
gacttcacagacttctacctggtga

SEQ ID NO: 291916 - DNA, 25 bp, Mus musculus
gacttcacagtggaaggacattccc

SEQ ID NO: 291917 - DNA, 25 bp, Mus musculus
gacttcaccacagtgtttacaaaat

SEQ ID NO: 291918 - DNA, 25 bp, Mus musculus
gacttcacccgaggcaaaggtccac

SEQ ID NO: 291919 - DNA, 25 bp, Mus musculus
gacttcaccgcacggaatgacatca

SEQ ID NO: 291920 - DNA, 25 bp, Mus musculus
gacttcacctcttttggcaatgagg

SEQ ID NO: 291921 - DNA, 25 bp, Mus musculus
gacttcactaaagcaaaaatcgtgc

SEQ ID NO: 291922 - DNA, 25 bp, Mus musculus
gacttcactaaggcaaaaatcgtgc

SEQ ID NO: 291923 - DNA, 25 bp, Mus musculus
gacttcactacacaacatgcctaac

SEQ ID NO: 291924 - DNA, 25 bp, Mus musculus
gacttcactggaccttcaggcaagg

SEQ ID NO: 291925 - DNA, 25 bp, Mus musculus
gacttcactggaccttcatctcggt

SEQ ID NO: 291926 - DNA, 25 bp, Mus musculus
gacttcagaaatgggacactacaca

SEQ ID NO: 291927 - DNA, 25 bp, Mus musculus
gacttcagaaattgtgaaggttccc

SEQ ID NO: 291928 - DNA, 25 bp, Mus musculus
gacttcagaatgaagtatgagaatg

SEQ ID NO: 291929 - DNA, 25 bp, Mus musculus
gacttcagactcaagtacgaaaacg

SEQ ID NO: 291930 - DNA, 25 bp, Mus musculus
gacttcagagcaaagatttctgctg

SEQ ID NO: 291931 - DNA, 25 bp, Mus musculus
gacttcagcaaaggcacacaccgag

SEQ ID NO: 291932 - DNA, 25 bp, Mus musculus
gacttcaggaccaagtatgagtcag

SEQ ID NO: 291933 - DNA, 25 bp, Mus musculus
gacttcagggaaggacctctccgag

SEQ ID NO: 291934 - DNA, 25 bp, Mus musculus
gacttcagggaagttttgctccaga

SEQ ID NO: 291935 - DNA, 25 bp, Mus musculus
gacttcagtgaaggtaatggaaaag

SEQ ID NO: 291936 - DNA, 25 bp, Mus musculus
gacttcagtgaggatggattcctga

SEQ ID NO: 291937 - DNA, 25 bp, Mus musculus
gacttcagtggggcgtctccgctgg

SEQ ID NO: 291938 - DNA, 25 bp, Mus musculus
gacttcattaatgacggccttaaag

SEQ ID NO: 291939 - DNA, 25 bp, Mus musculus
gacttcattaatgagggccttaaag

SEQ ID NO: 291940 - DNA, 25 bp, Mus musculus
gacttcattgaccaggagctgtcca

SEQ ID NO: 291941 - DNA, 25 bp, Mus musculus
gacttccacaagaaatttgccccgc

SEQ ID NO: 291942 - DNA, 25 bp, Mus musculus
gacttccacagccagaaaagaaaaa

SEQ ID NO: 291943 - DNA, 25 bp, Mus musculus
gacttccacaggacctataagaaca

SEQ ID NO: 291944 - DNA, 25 bp, Mus musculus
gacttccacatcctgactccgttca

SEQ ID NO: 291945 - DNA, 25 bp, Mus musculus
gacttccaccaaggcctcctatctt

SEQ ID NO: 291946 - DNA, 25 bp, Mus musculus
gacttccaccaaggtatggtgtgga

SEQ ID NO: 291947 - DNA, 25 bp, Mus musculus
gacttccagaaggatctgaaagcca

SEQ ID NO: 291948 - DNA, 25 bp, Mus musculus
gacttccagatgatgttgatcctgt

SEQ ID NO: 291949 - DNA, 25 bp, Mus musculus
gacttcccaaacaggtgcagttaaa

SEQ ID NO: 291950 - DNA, 25 bp, Mus musculus
gacttcccagagaatgttgctgagg

SEQ ID NO: 291951 - DNA, 25 bp, Mus musculus
gacttcccagatggcgaatactggg

SEQ ID NO: 291952 - DNA, 25 bp, Mus musculus
gacttcccagctctcttctccttct

SEQ ID NO: 291953 - DNA, 25 bp, Mus musculus
gacttcccaggagctgatgcactga

SEQ ID NO: 291954 - DNA, 25 bp, Mus musculus
gacttcccagggctatacatcctat

SEQ ID NO: 291955 - DNA, 25 bp, Mus musculus
gacttccccacctgggaaaagatgc

SEQ ID NO: 291956 - DNA, 25 bp, Mus musculus
gacttccccacgatctccctggagt

SEQ ID NO: 291957 - DNA, 25 bp, Mus musculus
gacttccccacggaagacggcgctg

SEQ ID NO: 291958 - DNA, 25 bp, Mus musculus
gacttcccctcggatgcagatggga

SEQ ID NO: 291959 - DNA, 25 bp, Mus musculus
gacttccctctagatttgatcaaaa

SEQ ID NO: 291960 - DNA, 25 bp, Mus musculus
gacttccctgagctcaccatggagg

SEQ ID NO: 291961 - DNA, 25 bp, Mus musculus
gacttcccttagaatgtgatttttt

SEQ ID NO: 291962 - DNA, 25 bp, Mus musculus
gacttccgaggtcctggaggccaca

SEQ ID NO: 291963 - DNA, 25 bp, Mus musculus
gacttccggcagaggtatcgcatcc

SEQ ID NO: 291964 - DNA, 25 bp, Mus musculus
gacttccgtggtgggattttcctgt

SEQ ID NO: 291965 - DNA, 25 bp, Mus musculus
gacttcctcgctgcacctggtggaa

SEQ ID NO: 291966 - DNA, 25 bp, Mus musculus
gacttcctctttagaacctgggtgt

SEQ ID NO: 291967 - DNA, 25 bp, Mus musculus
gacttccttatctaacagtgtcatt

SEQ ID NO: 291968 - DNA, 25 bp, Mus musculus
gacttccttatctatttttcatcat

SEQ ID NO: 291969 - DNA, 25 bp, Mus musculus
gacttccttcagggccactgatgac

SEQ ID NO: 291970 - DNA, 25 bp, Mus musculus
gacttccttcaggtgttagagatag

SEQ ID NO: 291971 - DNA, 25 bp, Mus musculus
gacttcgacaggggaatctggtcgg

SEQ ID NO: 291972 - DNA, 25 bp, Mus musculus
gacttcgagcaggacaatcccagaa

SEQ ID NO: 291973 - DNA, 25 bp, Mus musculus
gacttcgaggacgattacgtgcact

SEQ ID NO: 291974 - DNA, 25 bp, Mus musculus
gacttcgctgctgaggtcgtacacc

SEQ ID NO: 291975 - DNA, 25 bp, Mus musculus
gacttcggactaggggctctgagac

SEQ ID NO: 291976 - DNA, 25 bp, Mus musculus
gacttcgtgcagtgactccactggc

SEQ ID NO: 291977 - DNA, 25 bp, Mus musculus
gacttctaaggcctctcctgcagcc

SEQ ID NO: 291978 - DNA, 25 bp, Mus musculus
gacttctacattaggcaaatcaaca

SEQ ID NO: 291979 - DNA, 25 bp, Mus musculus
gacttctagtaaaagtgtcctagat

SEQ ID NO: 291980 - DNA, 25 bp, Mus musculus
gacttctatgcaggcacggtgctgt

SEQ ID NO: 291981 - DNA, 25 bp, Mus musculus
gacttctatgtggtgctgggtaggc

SEQ ID NO: 291982 - DNA, 25 bp, Mus musculus
gacttctcaagatgaggttccaggt

SEQ ID NO: 291983 - DNA, 25 bp, Mus musculus
gacttctcaaggaatctgaattttt

SEQ ID NO: 291984 - DNA, 25 bp, Mus musculus
gacttctcaaggagcgatgagcaag

SEQ ID NO: 291985 - DNA, 25 bp, Mus musculus
gacttctcaaggcgaccctttgaca

SEQ ID NO: 291986 - DNA, 25 bp, Mus musculus
gacttctcaaggctcagaaatcctg

SEQ ID NO: 291987 - DNA, 25 bp, Mus musculus
gacttctcaagtctattgcatctgc

SEQ ID NO: 291988 - DNA, 25 bp, Mus musculus
gacttctcagaggctccatctccat

SEQ ID NO: 291989 - DNA, 25 bp, Mus musculus
gacttctccaggctagaaaatgccc

SEQ ID NO: 291990 - DNA, 25 bp, Mus musculus
gacttctctaaggcttgccctctga

SEQ ID NO: 291991 - DNA, 25 bp, Mus musculus
gacttctctcagctacagcggaaca

SEQ ID NO: 291992 - DNA, 25 bp, Mus musculus
gacttctgcagctaatgggaatgac

SEQ ID NO: 291993 - DNA, 25 bp, Mus musculus
gacttctgcattcctctgtgtaccg

SEQ ID NO: 291994 - DNA, 25 bp, Mus musculus
gacttctgcattcgctgtgacagcg

SEQ ID NO: 291995 - DNA, 25 bp, Mus musculus
gacttctgctacaagcttcctgaca

SEQ ID NO: 291996 - DNA, 25 bp, Mus musculus
gacttctggctcacagagaaggact

SEQ ID NO: 291997 - DNA, 25 bp, Mus musculus
gacttctgtagagtccaattggtaa

SEQ ID NO: 291998 - DNA, 25 bp, Mus musculus
gacttctgtaggcataaactgggaa

SEQ ID NO: 291999 - DNA, 25 bp, Mus musculus
gacttctgtgtacctcagctggatt

SEQ ID NO: 292000 - DNA, 25 bp, Mus musculus
gacttcttcaagggtggggtaatta

SEQ ID NO: 292001 - DNA, 25 bp, Mus musculus
gacttcttcacggcatggatgatga

SEQ ID NO: 292002 - DNA, 25 bp, Mus musculus
gacttcttccctaagacctaggacc

SEQ ID NO: 292003 - DNA, 25 bp, Mus musculus
gacttcttccctaaggtgaaaggac

SEQ ID NO: 292004 - DNA, 25 bp, Mus musculus
gacttctttggtcttctaggggact

SEQ ID NO: 292005 - DNA, 25 bp, Mus musculus
gacttgaaaactatgctgaacttgg

SEQ ID NO: 292006 - DNA, 25 bp, Mus musculus
gacttgaaaactatgtgcttgacag

SEQ ID NO: 292007 - DNA, 25 bp, Mus musculus
gacttgaaacaaggggttataatga

SEQ ID NO: 292008 - DNA, 25 bp, Mus musculus
gacttgaacagcattgaggatcctg

SEQ ID NO: 292009 - DNA, 25 bp, Mus musculus
gacttgaacatggatgtggacgcca

SEQ ID NO: 292010 - DNA, 25 bp, Mus musculus
gacttgaagtctggctgtacatcat

SEQ ID NO: 292011 - DNA, 25 bp, Mus musculus
gacttgacaaggtggtgacagtggc

SEQ ID NO: 292012 - DNA, 25 bp, Mus musculus
gacttgacaatagctctggtgcaag

SEQ ID NO: 292013 - DNA, 25 bp, Mus musculus
gacttgacctcagatcttggtaatg

SEQ ID NO: 292014 - DNA, 25 bp, Mus musculus
gacttgagaggcccaggatgggtga

SEQ ID NO: 292015 - DNA, 25 bp, Mus musculus
gacttgatagcatagaaaattggag

SEQ ID NO: 292016 - DNA, 25 bp, Mus musculus
gacttgatagcggagaaaattggag

SEQ ID NO: 292017 - DNA, 25 bp, Mus musculus
gacttgatcctggaggtggccttag

SEQ ID NO: 292018 - DNA, 25 bp, Mus musculus
gacttgcaagctctttacagttttc

SEQ ID NO: 292019 - DNA, 25 bp, Mus musculus
gacttgcaagtctctttacagaaaa

SEQ ID NO: 292020 - DNA, 25 bp, Mus musculus
gacttgcactggttgttcatcgcct

SEQ ID NO: 292021 - DNA, 25 bp, Mus musculus
gacttgccagggaaaatcatagtga

SEQ ID NO: 292022 - DNA, 25 bp, Mus musculus
gacttgccgggtctggaatgtgacc

SEQ ID NO: 292023 - DNA, 25 bp, Mus musculus
gacttgccgggtggagacagagtat

SEQ ID NO: 292024 - DNA, 25 bp, Mus musculus
gacttgcctaagttggaaaagcgtc

SEQ ID NO: 292025 - DNA, 25 bp, Mus musculus
gacttgcctgagagtgaaataaaga

SEQ ID NO: 292026 - DNA, 25 bp, Mus musculus
gacttgcggatggggaagccagctt

SEQ ID NO: 292027 - DNA, 25 bp, Mus musculus
gacttgctccaagggccccgccgtc

SEQ ID NO: 292028 - DNA, 25 bp, Mus musculus
gacttgctgtaggttatgatgagtt

SEQ ID NO: 292029 - DNA, 25 bp, Mus musculus
gacttggacaacaccatcaagaaac

SEQ ID NO: 292030 - DNA, 25 bp, Mus musculus
gacttggacatgtcatctcctgaag

SEQ ID NO: 292031 - DNA, 25 bp, Mus musculus
gacttggaggaagtccgccagttcc

SEQ ID NO: 292032 - DNA, 25 bp, Mus musculus
gacttggaggagaatttaaaagaag

SEQ ID NO: 292033 - DNA, 25 bp, Mus musculus
gacttggagttaaaggtccttcacg

SEQ ID NO: 292034 - DNA, 25 bp, Mus musculus
gacttggcaacagggtctctgtgat

SEQ ID NO: 292035 - DNA, 25 bp, Mus musculus
gacttggcagaagaggagaaagaga

SEQ ID NO: 292036 - DNA, 25 bp, Mus musculus
gacttggcagaggaggctccgtgcc

SEQ ID NO: 292037 - DNA, 25 bp, Mus musculus
gacttggcagaggagtgacatcact

SEQ ID NO: 292038 - DNA, 25 bp, Mus musculus
gacttggcagctcatgctgtttcta

SEQ ID NO: 292039 - DNA, 25 bp, Mus musculus
gacttggcaggtccaacgtcggaaa

SEQ ID NO: 292040 - DNA, 25 bp, Mus musculus
gacttggccagggagccacagctaa

SEQ ID NO: 292041 - DNA, 25 bp, Mus musculus
gacttggccatgagatgagatggac

SEQ ID NO: 292042 - DNA, 25 bp, Mus musculus
gacttggcggccatcgagtaaaatc

SEQ ID NO: 292043 - DNA, 25 bp, Mus musculus
gacttggctagcaggtattcatgct

SEQ ID NO: 292044 - DNA, 25 bp, Mus musculus
gacttggctcctactttctgcactg

SEQ ID NO: 292045 - DNA, 25 bp, Mus musculus
gacttggctcctgcctgaggagcga

SEQ ID NO: 292046 - DNA, 25 bp, Mus musculus
gacttggctgctcagctgcactgag

SEQ ID NO: 292047 - DNA, 25 bp, Mus musculus
gacttggctgctcagtgtttccttt

SEQ ID NO: 292048 - DNA, 25 bp, Mus musculus
gacttgggaggagactgacaaaacc

SEQ ID NO: 292049 - DNA, 25 bp, Mus musculus
gacttgggagggggggcctgctgta

SEQ ID NO: 292050 - DNA, 25 bp, Mus musculus
gacttggggtccaggtcgggatggt

SEQ ID NO: 292051 - DNA, 25 bp, Mus musculus
gacttgggtatatagcttgaagtca

SEQ ID NO: 292052 - DNA, 25 bp, Mus musculus
gacttggtgaaaaattgcatgtgtg

SEQ ID NO: 292053 - DNA, 25 bp, Mus musculus
gacttggtgaagactccattagagg

SEQ ID NO: 292054 - DNA, 25 bp, Mus musculus
gacttggtgataaggtacagttttg

SEQ ID NO: 292055 - DNA, 25 bp, Mus musculus
gacttggtgatgaaaccattagagg

SEQ ID NO: 292056 - DNA, 25 bp, Mus musculus
gacttggtggttctccgttctgagc

SEQ ID NO: 292057 - DNA, 25 bp, Mus musculus
gacttgtaacgtaaggacaagatgg

SEQ ID NO: 292058 - DNA, 25 bp, Mus musculus
gacttgtaataaagctgcgaagctg

SEQ ID NO: 292059 - DNA, 25 bp, Mus musculus
gacttgtaggtcagagtttttgtgc

SEQ ID NO: 292060 - DNA, 25 bp, Mus musculus
gacttgtattaagatgggcgtatgt

SEQ ID NO: 292061 - DNA, 25 bp, Mus musculus
gacttgtattccctgtgagtgtgat

SEQ ID NO: 292062 - DNA, 25 bp, Mus musculus
gacttgtcaggtttctaaacagcct

SEQ ID NO: 292063 - DNA, 25 bp, Mus musculus
gacttgtcctacctgctgattttct

SEQ ID NO: 292064 - DNA, 25 bp, Mus musculus
gacttgtctctggcgtgggtgactg

SEQ ID NO: 292065 - DNA, 25 bp, Mus musculus
gacttgtgagttcgactgtgattta

SEQ ID NO: 292066 - DNA, 25 bp, Mus musculus
gacttgtgccggtcctgcccccttc

SEQ ID NO: 292067 - DNA, 25 bp, Mus musculus
gacttgttaagtttctagtgggaat

SEQ ID NO: 292068 - DNA, 25 bp, Mus musculus
gacttgtttgtgcagggatcgctta

SEQ ID NO: 292069 - DNA, 25 bp, Mus musculus
gactttaaaagaagatccagtcctg

SEQ ID NO: 292070 - DNA, 25 bp, Mus musculus
gactttaaactagcagggggaggag

SEQ ID NO: 292071 - DNA, 25 bp, Mus musculus
gactttaactttgagaagaaccaaa

SEQ ID NO: 292072 - DNA, 25 bp, Mus musculus
gactttaagcaggtgctgctggtga

SEQ ID NO: 292073 - DNA, 25 bp, Mus musculus
gactttaaggacagttatctgctga

SEQ ID NO: 292074 - DNA, 25 bp, Mus musculus
gactttaatagtgaggtagaggagg

SEQ ID NO: 292075 - DNA, 25 bp, Mus musculus
gactttaatcaaagcaatggaagta

SEQ ID NO: 292076 - DNA, 25 bp, Mus musculus
gactttacaggaaaaccaccaaaga

SEQ ID NO: 292077 - DNA, 25 bp, Mus musculus
gactttacttctgtggagtcaattg

SEQ ID NO: 292078 - DNA, 25 bp, Mus musculus
gactttagtcctgcactagaaaccc

SEQ ID NO: 292079 - DNA, 25 bp, Mus musculus
gactttatggtagcttttcccaagc

SEQ ID NO: 292080 - DNA, 25 bp, Mus musculus
gactttatggtctttagtagctttt

SEQ ID NO: 292081 - DNA, 25 bp, Mus musculus
gactttatttgtctgtctcttctca

SEQ ID NO: 292082 - DNA, 25 bp, Mus musculus
gactttcaagatgacgggacgactt

SEQ ID NO: 292083 - DNA, 25 bp, Mus musculus
gactttcaagcctatgtgtttcgat

SEQ ID NO: 292084 - DNA, 25 bp, Mus musculus
gactttcacacaatcagggcatgga

SEQ ID NO: 292085 - DNA, 25 bp, Mus musculus
gactttcaccagggaagacagtgac

SEQ ID NO: 292086 - DNA, 25 bp, Mus musculus
gactttcagccagaccatagtcctg

SEQ ID NO: 292087 - DNA, 25 bp, Mus musculus
gactttcagccagtgctccacctgg

SEQ ID NO: 292088 - DNA, 25 bp, Mus musculus
gactttcaggctgtggaccttgact

SEQ ID NO: 292089 - DNA, 25 bp, Mus musculus
gactttcaggttccagctgtggacc

SEQ ID NO: 292090 - DNA, 25 bp, Mus musculus
gactttcatacagcacgcatttgat

SEQ ID NO: 292091 - DNA, 25 bp, Mus musculus
gactttcattggtgctgtccccggc

SEQ ID NO: 292092 - DNA, 25 bp, Mus musculus
gactttccaagaaagtcactgtaac

SEQ ID NO: 292093 - DNA, 25 bp, Mus musculus
gactttccaaggtggaacttgcaga

SEQ ID NO: 292094 - DNA, 25 bp, Mus musculus
gactttccactgcttaggctcgact

SEQ ID NO: 292095 - DNA, 25 bp, Mus musculus
gactttcccaataaagactgagttc

SEQ ID NO: 292096 - DNA, 25 bp, Mus musculus
gactttcctcaggacccctcatgcc

SEQ ID NO: 292097 - DNA, 25 bp, Mus musculus
gactttctcagatcgtttaggaaag

SEQ ID NO: 292098 - DNA, 25 bp, Mus musculus
gactttctcaggagtctcatgaaca

SEQ ID NO: 292099 - DNA, 25 bp, Mus musculus
gactttctcattaaggtaaatgacc

SEQ ID NO: 292100 - DNA, 25 bp, Mus musculus
gactttctctgtaccgtcagaaggg

SEQ ID NO: 292101 - DNA, 25 bp, Mus musculus
gactttctgaagcttcttcacattg

SEQ ID NO: 292102 - DNA, 25 bp, Mus musculus
gactttcttcagttgtttcctctcg

SEQ ID NO: 292103 - DNA, 25 bp, Mus musculus
gactttgaaaaccaaatcactgagc

SEQ ID NO: 292104 - DNA, 25 bp, Mus musculus
gactttgaaaacttgtctttgcaga

SEQ ID NO: 292105 - DNA, 25 bp, Mus musculus
gactttgaagatgaccgcaacccgc

SEQ ID NO: 292106 - DNA, 25 bp, Mus musculus
gactttgaagatgaggatttcttat

SEQ ID NO: 292107 - DNA, 25 bp, Mus musculus
gactttgaagctgttaagaagaaag

SEQ ID NO: 292108 - DNA, 25 bp, Mus musculus
gactttgaaggacaaattgcacatc

SEQ ID NO: 292109 - DNA, 25 bp, Mus musculus
gactttgaaggtccttgctgccaaa

SEQ ID NO: 292110 - DNA, 25 bp, Mus musculus
gactttgaaggttgtcttgacaccc

SEQ ID NO: 292111 - DNA, 25 bp, Mus musculus
gactttgacgagatcatcagtgagg

SEQ ID NO: 292112 - DNA, 25 bp, Mus musculus
gactttgacgagtgaggagagattc

SEQ ID NO: 292113 - DNA, 25 bp, Mus musculus
gactttgactgtcaggaacatgaca

SEQ ID NO: 292114 - DNA, 25 bp, Mus musculus
gactttgagaaccctgactgaaata

SEQ ID NO: 292115 - DNA, 25 bp, Mus musculus
gactttgagacctataatggtcagc

SEQ ID NO: 292116 - DNA, 25 bp, Mus musculus
gactttgagtctaacaaatgcttcc

SEQ ID NO: 292117 - DNA, 25 bp, Mus musculus
gactttgatgaggtacagtatcaga

SEQ ID NO: 292118 - DNA, 25 bp, Mus musculus
gactttgcaaagacgtgtgcaagaa

SEQ ID NO: 292119 - DNA, 25 bp, Mus musculus
gactttgcaaagacgtgtgtgtctg

SEQ ID NO: 292120 - DNA, 25 bp, Mus musculus
gactttgcaaggcagtactacgaga

SEQ ID NO: 292121 - DNA, 25 bp, Mus musculus
gactttgcagaaatgaagcagatga

SEQ ID NO: 292122 - DNA, 25 bp, Mus musculus
gactttgcagtctatggactggaaa

SEQ ID NO: 292123 - DNA, 25 bp, Mus musculus
gactttgccagaaagtgagccacgc

SEQ ID NO: 292124 - DNA, 25 bp, Mus musculus
gactttgccaggacctgtgtcatgt

SEQ ID NO: 292125 - DNA, 25 bp, Mus musculus
gactttgccaggcgctgtgctttgg

SEQ ID NO: 292126 - DNA, 25 bp, Mus musculus
gactttgctggatgcttttgttaat

SEQ ID NO: 292127 - DNA, 25 bp, Mus musculus
gactttggaccaaagacccagccat

SEQ ID NO: 292128 - DNA, 25 bp, Mus musculus
gactttggaccaactgttctcagtt

SEQ ID NO: 292129 - DNA, 25 bp, Mus musculus
gactttggaggtctcccagtggact

SEQ ID NO: 292130 - DNA, 25 bp, Mus musculus
gactttggatggaagacttcgagtt

SEQ ID NO: 292131 - DNA, 25 bp, Mus musculus
gactttggcaaatggagtattggct

SEQ ID NO: 292132 - DNA, 25 bp, Mus musculus
gactttgggcaggaaacaagttaca

SEQ ID NO: 292133 - DNA, 25 bp, Mus musculus
gactttgggggagacgttcatgggc

SEQ ID NO: 292134 - DNA, 25 bp, Mus musculus
gactttgggggagactatggtggaa

SEQ ID NO: 292135 - DNA, 25 bp, Mus musculus
gactttgtaagaaactggtcaaaat

SEQ ID NO: 292136 - DNA, 25 bp, Mus musculus
gactttgtaaggtatctactttatc

SEQ ID NO: 292137 - DNA, 25 bp, Mus musculus
gactttgtcatccaggtcttggata

SEQ ID NO: 292138 - DNA, 25 bp, Mus musculus
gactttgtgaagctccgttttgttc

SEQ ID NO: 292139 - DNA, 25 bp, Mus musculus
gactttgtggctgagttcctgtttt

SEQ ID NO: 292140 - DNA, 25 bp, Mus musculus
gactttgtgggcctgctgtcccttc

SEQ ID NO: 292141 - DNA, 25 bp, Mus musculus
gacttttagaaccagctcagctagt

SEQ ID NO: 292142 - DNA, 25 bp, Mus musculus
gacttttaggccatctcttggcgtc

SEQ ID NO: 292143 - DNA, 25 bp, Mus musculus
gacttttagggccaaagatctcatc

SEQ ID NO: 292144 - DNA, 25 bp, Mus musculus
gacttttatacaggactgacagacg

SEQ ID NO: 292145 - DNA, 25 bp, Mus musculus
gacttttatcctgtggtgtgagtgt

SEQ ID NO: 292146 - DNA, 25 bp, Mus musculus
gacttttcagagccactcagcacgc

SEQ ID NO: 292147 - DNA, 25 bp, Mus musculus
gacttttcagggttcagactgggca

SEQ ID NO: 292148 - DNA, 25 bp, Mus musculus
gacttttgcagagttctctgtcatt

SEQ ID NO: 292149 - DNA, 25 bp, Mus musculus
gacttttggatatggggtgcttcga

SEQ ID NO: 292150 - DNA, 25 bp, Mus musculus
gacttttgggctctatacaaccata

SEQ ID NO: 292151 - DNA, 25 bp, Mus musculus
gacttttgttacagactagcttcct

SEQ ID NO: 292152 - DNA, 25 bp, Mus musculus
gactttttacaaagtgattggagtt

SEQ ID NO: 292153 - DNA, 25 bp, Mus musculus
gactttttacataatccccagatgc

SEQ ID NO: 292154 - DNA, 25 bp, Mus musculus
gactttttacataatcggggtctaa

SEQ ID NO: 292155 - DNA, 25 bp, Mus musculus
gactttttcgctgccttggggtgct

SEQ ID NO: 292156 - DNA, 25 bp, Mus musculus
gactttttcggtgcctcctgagaag

SEQ ID NO: 292157 - DNA, 25 bp, Mus musculus
gactttttgaaccgctcccattttc

SEQ ID NO: 292158 - DNA, 25 bp, Mus musculus
gacttttttgagacagaaaccaact

SEQ ID NO: 292159 - DNA, 25 bp, Mus musculus
gagaaaaaagaatggaatggcaaac

SEQ ID NO: 292160 - DNA, 25 bp, Mus musculus
gagaaaaaagatttgatgttgaatt

SEQ ID NO: 292161 - DNA, 25 bp, Mus musculus
gagaaaaaagcagtggtttgtattg

SEQ ID NO: 292162 - DNA, 25 bp, Mus musculus
gagaaaaacagctagctgcacgaga

SEQ ID NO: 292163 - DNA, 25 bp, Mus musculus
gagaaaaacagtaccaaggagttat

SEQ ID NO: 292164 - DNA, 25 bp, Mus musculus
gagaaaaaccaatggctccccctgt

SEQ ID NO: 292165 - DNA, 25 bp, Mus musculus
gagaaaaacggctcttgcttcttgc

SEQ ID NO: 292166 - DNA, 25 bp, Mus musculus
gagaaaaaggcagagggagcattcc

SEQ ID NO: 292167 - DNA, 25 bp, Mus musculus
gagaaaaatgagaagaattcaggga

SEQ ID NO: 292168 - DNA, 25 bp, Mus musculus
gagaaaaatggaatctctacgaagg

SEQ ID NO: 292169 - DNA, 25 bp, Mus musculus
gagaaaaattgaacgagaagtaaac

SEQ ID NO: 292170 - DNA, 25 bp, Mus musculus
gagaaaaattgaacgagaagtaaag

SEQ ID NO: 292171 - DNA, 25 bp, Mus musculus
gagaaaaatttagaatatgacatct

SEQ ID NO: 292172 - DNA, 25 bp, Mus musculus
gagaaaacaaatggctccagcccac

SEQ ID NO: 292173 - DNA, 25 bp, Mus musculus
gagaaaacaagacaggtcgattgag

SEQ ID NO: 292174 - DNA, 25 bp, Mus musculus
gagaaaacagaagattctagtgttc

SEQ ID NO: 292175 - DNA, 25 bp, Mus musculus
gagaaaacaggatctgactttgtgg

SEQ ID NO: 292176 - DNA, 25 bp, Mus musculus
gagaaaacaggcatgtaatgaattc

SEQ ID NO: 292177 - DNA, 25 bp, Mus musculus
gagaaaacaggtctcagcatcagag

SEQ ID NO: 292178 - DNA, 25 bp, Mus musculus
gagaaaacccaacagcccactgagt

SEQ ID NO: 292179 - DNA, 25 bp, Mus musculus
gagaaaaccctggcgtttagagaag

SEQ ID NO: 292180 - DNA, 25 bp, Mus musculus
gagaaaacctgaagactgagcagtg

SEQ ID NO: 292181 - DNA, 25 bp, Mus musculus
gagaaaactaagatgtcaacttgtg

SEQ ID NO: 292182 - DNA, 25 bp, Mus musculus
gagaaaactgagatgtgtctacatt

SEQ ID NO: 292183 - DNA, 25 bp, Mus musculus
gagaaaactggggtaattgaacatg

SEQ ID NO: 292184 - DNA, 25 bp, Mus musculus
gagaaaagagaatattttccagatg

SEQ ID NO: 292185 - DNA, 25 bp, Mus musculus
gagaaaagaggaatattagttagag

SEQ ID NO: 292186 - DNA, 25 bp, Mus musculus
gagaaaagcaagtgctgtcttcctg

SEQ ID NO: 292187 - DNA, 25 bp, Mus musculus
gagaaaagcacagccttcacaggct

SEQ ID NO: 292188 - DNA, 25 bp, Mus musculus
gagaaaagcacaggctgctgaggaa

SEQ ID NO: 292189 - DNA, 25 bp, Mus musculus
gagaaaagcccaacaccagctacat

SEQ ID NO: 292190 - DNA, 25 bp, Mus musculus
gagaaaaggcggcggtcctttctac

SEQ ID NO: 292191 - DNA, 25 bp, Mus musculus
gagaaaaggtcaaaactctaacacg

SEQ ID NO: 292192 - DNA, 25 bp, Mus musculus
gagaaaaggtgcagatcctggggca

SEQ ID NO: 292193 - DNA, 25 bp, Mus musculus
gagaaaaggtgcagcaactgctttg

SEQ ID NO: 292194 - DNA, 25 bp, Mus musculus
gagaaaagtcaagaagaacaaacaa

SEQ ID NO: 292195 - DNA, 25 bp, Mus musculus
gagaaaagtcaaggtgtactttgtg

SEQ ID NO: 292196 - DNA, 25 bp, Mus musculus
gagaaaagttttggcatacaaatgc

SEQ ID NO: 292197 - DNA, 25 bp, Mus musculus
gagaaaataaataaggaagcagtat

SEQ ID NO: 292198 - DNA, 25 bp, Mus musculus
gagaaaataagccttgtacactgga

SEQ ID NO: 292199 - DNA, 25 bp, Mus musculus
gagaaaatcaaggagcttgtagtga

SEQ ID NO: 292200 - DNA, 25 bp, Mus musculus
gagaaaatggccaccaccggccaca

SEQ ID NO: 292201 - DNA, 25 bp, Mus musculus
gagaaaattagagccccttccaatg

SEQ ID NO: 292202 - DNA, 25 bp, Mus musculus
gagaaacaatggagtccaacacaat

SEQ ID NO: 292203 - DNA, 25 bp, Mus musculus
gagaaacacagcttttcttctcaca

SEQ ID NO: 292204 - DNA, 25 bp, Mus musculus
gagaaacacaggtggaaaaggaggg

SEQ ID NO: 292205 - DNA, 25 bp, Mus musculus
gagaaacacgtcggcttctgacgaa

SEQ ID NO: 292206 - DNA, 25 bp, Mus musculus
gagaaacagaggtaatctacaaaat

SEQ ID NO: 292207 - DNA, 25 bp, Mus musculus
gagaaacatgctggtggctgggaca

SEQ ID NO: 292208 - DNA, 25 bp, Mus musculus
gagaaacatgctggtggtgtcacag

SEQ ID NO: 292209 - DNA, 25 bp, Mus musculus
gagaaacatgctggttgtcacaggt

SEQ ID NO: 292210 - DNA, 25 bp, Mus musculus
gagaaacatggtggcgacagacaag

SEQ ID NO: 292211 - DNA, 25 bp, Mus musculus
gagaaacattcaagggtatccagaa

SEQ ID NO: 292212 - DNA, 25 bp, Mus musculus
gagaaaccaagacccagacttactg

SEQ ID NO: 292213 - DNA, 25 bp, Mus musculus
gagaaaccacctcaggagtgaagcg

SEQ ID NO: 292214 - DNA, 25 bp, Mus musculus
gagaaaccagaggtggtggaatgat

SEQ ID NO: 292215 - DNA, 25 bp, Mus musculus
gagaaaccaggcagaagaagttaga

SEQ ID NO: 292216 - DNA, 25 bp, Mus musculus
gagaaaccgaggaaggtccatgcga

SEQ ID NO: 292217 - DNA, 25 bp, Mus musculus
gagaaacctgagatttctgtttttg

SEQ ID NO: 292218 - DNA, 25 bp, Mus musculus
gagaaacctgaggagttaggatctg

SEQ ID NO: 292219 - DNA, 25 bp, Mus musculus
gagaaacgaaccaaggagaaagaac

SEQ ID NO: 292220 - DNA, 25 bp, Mus musculus
gagaaacgctgccgccaagttgaag

SEQ ID NO: 292221 - DNA, 25 bp, Mus musculus
gagaaactaaaaatgtcccatctgc

SEQ ID NO: 292222 - DNA, 25 bp, Mus musculus
gagaaactatgtctgctggttgtgg

SEQ ID NO: 292223 - DNA, 25 bp, Mus musculus
gagaaactccagatcaccatccgga

SEQ ID NO: 292224 - DNA, 25 bp, Mus musculus
gagaaactgaggagatctagatcca

SEQ ID NO: 292225 - DNA, 25 bp, Mus musculus
gagaaactgaggaggtcccgatcac

SEQ ID NO: 292226 - DNA, 25 bp, Mus musculus
gagaaactggacagagccaatgcag

SEQ ID NO: 292227 - DNA, 25 bp, Mus musculus
gagaaactggagaccttcttcggga

SEQ ID NO: 292228 - DNA, 25 bp, Mus musculus
gagaaactggccacaatttactggt

SEQ ID NO: 292229 - DNA, 25 bp, Mus musculus
gagaaacttaaagcacatacgtgta

SEQ ID NO: 292230 - DNA, 25 bp, Mus musculus
gagaaacttaaaggggctgatcctg

SEQ ID NO: 292231 - DNA, 25 bp, Mus musculus
gagaaacttgaggccagaagtcaat

SEQ ID NO: 292232 - DNA, 25 bp, Mus musculus
gagaaacttgagtatgaaagcaagg

SEQ ID NO: 292233 - DNA, 25 bp, Mus musculus
gagaaagaaaaagtggagtacatgg

SEQ ID NO: 292234 - DNA, 25 bp, Mus musculus
gagaaagaagcctcaggtacagtgc

SEQ ID NO: 292235 - DNA, 25 bp, Mus musculus
gagaaagaagctgctccagctgctg

SEQ ID NO: 292236 - DNA, 25 bp, Mus musculus
gagaaagaaggcatgtcatgttgcc

SEQ ID NO: 292237 - DNA, 25 bp, Mus musculus
gagaaagaatgtcgaagcggaggcc

SEQ ID NO: 292238 - DNA, 25 bp, Mus musculus
gagaaagacaattgcgccgcagagc

SEQ ID NO: 292239 - DNA, 25 bp, Mus musculus
gagaaagacaattttgggtgtttga

SEQ ID NO: 292240 - DNA, 25 bp, Mus musculus
gagaaagacgaaagaatcctgtgga

SEQ ID NO: 292241 - DNA, 25 bp, Mus musculus
gagaaagacgaaaggtacctgttgt

SEQ ID NO: 292242 - DNA, 25 bp, Mus musculus
gagaaagagaacgcctcaaagagtt

SEQ ID NO: 292243 - DNA, 25 bp, Mus musculus
gagaaagagaacggccctacccaca

SEQ ID NO: 292244 - DNA, 25 bp, Mus musculus
gagaaagagactgctggtgacaagg

SEQ ID NO: 292245 - DNA, 25 bp, Mus musculus
gagaaagagagtgtaatccacctaa

SEQ ID NO: 292246 - DNA, 25 bp, Mus musculus
gagaaagaggcagagaaacccgcat

SEQ ID NO: 292247 - DNA, 25 bp, Mus musculus
gagaaagaggccctggaagaagaaa

SEQ ID NO: 292248 - DNA, 25 bp, Mus musculus
gagaaagataggttgcagctgtcta

SEQ ID NO: 292249 - DNA, 25 bp, Mus musculus
gagaaagatgacaagttgaccccaa

SEQ ID NO: 292250 - DNA, 25 bp, Mus musculus
gagaaagatgagctggatccagcca

SEQ ID NO: 292251 - DNA, 25 bp, Mus musculus
gagaaagatgtgccagaaacagaag

SEQ ID NO: 292252 - DNA, 25 bp, Mus musculus
gagaaagattaaggagctatcgaag

SEQ ID NO: 292253 - DNA, 25 bp, Mus musculus
gagaaagcaccagcaccaggtcttc

SEQ ID NO: 292254 - DNA, 25 bp, Mus musculus
gagaaagcaccaggtccccggcgct

SEQ ID NO: 292255 - DNA, 25 bp, Mus musculus
gagaaagcagagaagagtgtagctg

SEQ ID NO: 292256 - DNA, 25 bp, Mus musculus
gagaaagcagccgtgaagccgctca

SEQ ID NO: 292257 - DNA, 25 bp, Mus musculus
gagaaagcaggccaccccttccacc

SEQ ID NO: 292258 - DNA, 25 bp, Mus musculus
gagaaagcaggttcatgttttatcc

SEQ ID NO: 292259 - DNA, 25 bp, Mus musculus
gagaaagcataaagaccagtttccc

SEQ ID NO: 292260 - DNA, 25 bp, Mus musculus
gagaaagcataaagatctgggcagt

SEQ ID NO: 292261 - DNA, 25 bp, Mus musculus
gagaaagcataagaatgttttgagt

SEQ ID NO: 292262 - DNA, 25 bp, Mus musculus
gagaaagcataaggtgactcatatt

SEQ ID NO: 292263 - DNA, 25 bp, Mus musculus
gagaaagccaatgcaccatgaacac

SEQ ID NO: 292264 - DNA, 25 bp, Mus musculus
gagaaagccagtgtgaataaatttg

SEQ ID NO: 292265 - DNA, 25 bp, Mus musculus
gagaaagccgagtccatctaccgcc

SEQ ID NO: 292266 - DNA, 25 bp, Mus musculus
gagaaagcgcctgctggagttcaac

SEQ ID NO: 292267 - DNA, 25 bp, Mus musculus
gagaaagctccaaaggaccagtcca

SEQ ID NO: 292268 - DNA, 25 bp, Mus musculus
gagaaagctccaaaggttgtcgctg

SEQ ID NO: 292269 - DNA, 25 bp, Mus musculus
gagaaagctgccaggctctgggtgc

SEQ ID NO: 292270 - DNA, 25 bp, Mus musculus
gagaaaggaaaggccttcgatatga

SEQ ID NO: 292271 - DNA, 25 bp, Mus musculus
gagaaaggaaataatccctccatat

SEQ ID NO: 292272 - DNA, 25 bp, Mus musculus
gagaaaggaacgcagcaactgctgc

SEQ ID NO: 292273 - DNA, 25 bp, Mus musculus
gagaaaggacttcctggcgagaaag

SEQ ID NO: 292274 - DNA, 25 bp, Mus musculus
gagaaaggagagaagggccaatcag

SEQ ID NO: 292275 - DNA, 25 bp, Mus musculus
gagaaaggagcaaggggtcagccag

SEQ ID NO: 292276 - DNA, 25 bp, Mus musculus
gagaaaggattagggatcttggcaa

SEQ ID NO: 292277 - DNA, 25 bp, Mus musculus
gagaaaggccaagcttgccctgctt

SEQ ID NO: 292278 - DNA, 25 bp, Mus musculus
gagaaaggcctgaagctgtctccag

SEQ ID NO: 292279 - DNA, 25 bp, Mus musculus
gagaaaggcctgaaggtgcgggagt

SEQ ID NO: 292280 - DNA, 25 bp, Mus musculus
gagaaaggctggagctggaaccttg

SEQ ID NO: 292281 - DNA, 25 bp, Mus musculus
gagaaaggctgggtgaagaccctta

SEQ ID NO: 292282 - DNA, 25 bp, Mus musculus
gagaaagtcactggggacccctgtg

SEQ ID NO: 292283 - DNA, 25 bp, Mus musculus
gagaaagtgaggacttttgctgcca

SEQ ID NO: 292284 - DNA, 25 bp, Mus musculus
gagaaagtggcaagaaggaaaacaa

SEQ ID NO: 292285 - DNA, 25 bp, Mus musculus
gagaaagtggcaagatcttagggtt

SEQ ID NO: 292286 - DNA, 25 bp, Mus musculus
gagaaagtggcaagtcagtacaggc

SEQ ID NO: 292287 - DNA, 25 bp, Mus musculus
gagaaataaagacaaaaggcttgat

SEQ ID NO: 292288 - DNA, 25 bp, Mus musculus
gagaaataagaggtacccagactca

SEQ ID NO: 292289 - DNA, 25 bp, Mus musculus
gagaaatacagatgtctctttaagg

SEQ ID NO: 292290 - DNA, 25 bp, Mus musculus
gagaaataccagtccctggcctaca

SEQ ID NO: 292291 - DNA, 25 bp, Mus musculus
gagaaatacctccagttcagaagaa

SEQ ID NO: 292292 - DNA, 25 bp, Mus musculus
gagaaatacggtgaggccctgggac

SEQ ID NO: 292293 - DNA, 25 bp, Mus musculus
gagaaatagaagaggagcctgcagg

SEQ ID NO: 292294 - DNA, 25 bp, Mus musculus
gagaaatagaagggaacaagtcata

SEQ ID NO: 292295 - DNA, 25 bp, Mus musculus
gagaaatagaagtggacgacaacct

SEQ ID NO: 292296 - DNA, 25 bp, Mus musculus
gagaaatagcatgattcagctacta

SEQ ID NO: 292297 - DNA, 25 bp, Mus musculus
gagaaatatgaacaggcatgtaatg

SEQ ID NO: 292298 - DNA, 25 bp, Mus musculus
gagaaatatgaggaacacatcaaga

SEQ ID NO: 292299 - DNA, 25 bp, Mus musculus
gagaaatatgagtggttccatgtca

SEQ ID NO: 292300 - DNA, 25 bp, Mus musculus
gagaaatatgatgaccgagaggaag

SEQ ID NO: 292301 - DNA, 25 bp, Mus musculus
gagaaatcaagggcttaaggaataa

SEQ ID NO: 292302 - DNA, 25 bp, Mus musculus
gagaaatcaagtttgcttttcctct

SEQ ID NO: 292303 - DNA, 25 bp, Mus musculus
gagaaatcaggtcttaatttgcaga

SEQ ID NO: 292304 - DNA, 25 bp, Mus musculus
gagaaatcattcagtctgtgtatga

SEQ ID NO: 292305 - DNA, 25 bp, Mus musculus
gagaaatccaagcttttagccaggc

SEQ ID NO: 292306 - DNA, 25 bp, Mus musculus
gagaaatgaaatgtctggatgctaa

SEQ ID NO: 292307 - DNA, 25 bp, Mus musculus
gagaaatgaaatgtgcagagccagt

SEQ ID NO: 292308 - DNA, 25 bp, Mus musculus
gagaaatgaaggactgcagtaatgg

SEQ ID NO: 292309 - DNA, 25 bp, Mus musculus
gagaaatgagtcctctctgggagat

SEQ ID NO: 292310 - DNA, 25 bp, Mus musculus
gagaaatgcagacgtcttgtagaaa

SEQ ID NO: 292311 - DNA, 25 bp, Mus musculus
gagaaatgcaggaatctccggttcc

SEQ ID NO: 292312 - DNA, 25 bp, Mus musculus
gagaaatgcataagttggttgatcg

SEQ ID NO: 292313 - DNA, 25 bp, Mus musculus
gagaaatggagagaagcccgggacg

SEQ ID NO: 292314 - DNA, 25 bp, Mus musculus
gagaaatggcatttatctgggagta

SEQ ID NO: 292315 - DNA, 25 bp, Mus musculus
gagaaatgggcagagagaaatgtca

SEQ ID NO: 292316 - DNA, 25 bp, Mus musculus
gagaaattaggcagcaaaacataaa

SEQ ID NO: 292317 - DNA, 25 bp, Mus musculus
gagaaattatttcagagtgccagaa

SEQ ID NO: 292318 - DNA, 25 bp, Mus musculus
gagaaattatttcaggtggatctaa

SEQ ID NO: 292319 - DNA, 25 bp, Mus musculus
gagaaattccaccagcagtatgagc

SEQ ID NO: 292320 - DNA, 25 bp, Mus musculus
gagaaattcgggccaatggtggctg

SEQ ID NO: 292321 - DNA, 25 bp, Mus musculus
gagaaattgagtattttatcatctt

SEQ ID NO: 292322 - DNA, 25 bp, Mus musculus
gagaaattgcaggtctcacccaaaa

SEQ ID NO: 292323 - DNA, 25 bp, Mus musculus
gagaaatttgagagtccaattggta

SEQ ID NO: 292324 - DNA, 25 bp, Mus musculus
gagaaatttggaggaattgatattt

SEQ ID NO: 292325 - DNA, 25 bp, Mus musculus
gagaacaaagatcctctgagtgcca

SEQ ID NO: 292326 - DNA, 25 bp, Mus musculus
gagaacaaagtggcctatgagcggc

SEQ ID NO: 292327 - DNA, 25 bp, Mus musculus
gagaacaacaggaacctgaggagaa

SEQ ID NO: 292328 - DNA, 25 bp, Mus musculus
gagaacaacaggactccgggagaag

SEQ ID NO: 292329 - DNA, 25 bp, Mus musculus
gagaacaacgtttccctcagtaccg

SEQ ID NO: 292330 - DNA, 25 bp, Mus musculus
gagaacaagaaagcatctaaagaca

SEQ ID NO: 292331 - DNA, 25 bp, Mus musculus
gagaacaagactcagaataagcctg

SEQ ID NO: 292332 - DNA, 25 bp, Mus musculus
gagaacaagaggtttgaagatcaac

SEQ ID NO: 292333 - DNA, 25 bp, Mus musculus
gagaacaagatcggttctctttgta

SEQ ID NO: 292334 - DNA, 25 bp, Mus musculus
gagaacaagatcgttggaatgccaa

SEQ ID NO: 292335 - DNA, 25 bp, Mus musculus
gagaacaagatttctccttattacc

SEQ ID NO: 292336 - DNA, 25 bp, Mus musculus
gagaacaagcccatctggctcttgc

SEQ ID NO: 292337 - DNA, 25 bp, Mus musculus
gagaacaagtgcaagatgatttacc

SEQ ID NO: 292338 - DNA, 25 bp, Mus musculus
gagaacacaaggaaggagcagctgc

SEQ ID NO: 292339 - DNA, 25 bp, Mus musculus
gagaacaccaaattccggggtgcac

SEQ ID NO: 292340 - DNA, 25 bp, Mus musculus
gagaacaccagaagggccggcccac

SEQ ID NO: 292341 - DNA, 25 bp, Mus musculus
gagaacactgtgatctgctcttctg

SEQ ID NO: 292342 - DNA, 25 bp, Mus musculus
gagaacactgtggctctccagagca

SEQ ID NO: 292343 - DNA, 25 bp, Mus musculus
gagaacactgttttcatgaaccatc

SEQ ID NO: 292344 - DNA, 25 bp, Mus musculus
gagaacagacaacctgacagatcgt

SEQ ID NO: 292345 - DNA, 25 bp, Mus musculus
gagaacagagagatggatgatcctt

SEQ ID NO: 292346 - DNA, 25 bp, Mus musculus
gagaacagcaagcggaatatctcca

SEQ ID NO: 292347 - DNA, 25 bp, Mus musculus
gagaacagcaagcggatttcccttt

SEQ ID NO: 292348 - DNA, 25 bp, Mus musculus
gagaacagcaagcggttcagcagag

SEQ ID NO: 292349 - DNA, 25 bp, Mus musculus
gagaacagcagaggttcagaagggt

SEQ ID NO: 292350 - DNA, 25 bp, Mus musculus
gagaacagcagctccattttattcg

SEQ ID NO: 292351 - DNA, 25 bp, Mus musculus
gagaacagcagtaccactagcccag

SEQ ID NO: 292352 - DNA, 25 bp, Mus musculus
gagaacagcgaagccttggagctgg

SEQ ID NO: 292353 - DNA, 25 bp, Mus musculus
gagaacagctcggggactttctcta

SEQ ID NO: 292354 - DNA, 25 bp, Mus musculus
gagaacagctcgggtttgagttttt

SEQ ID NO: 292355 - DNA, 25 bp, Mus musculus
gagaacagggcaaaggggtttcctg

SEQ ID NO: 292356 - DNA, 25 bp, Mus musculus
gagaacatagactgtgaagtatttc

SEQ ID NO: 292357 - DNA, 25 bp, Mus musculus
gagaacatcaagacaaaccaggtga

SEQ ID NO: 292358 - DNA, 25 bp, Mus musculus
gagaacatcaagactggagtacctg

SEQ ID NO: 292359 - DNA, 25 bp, Mus musculus
gagaacatcatgcaggatccaaacg

SEQ ID NO: 292360 - DNA, 25 bp, Mus musculus
gagaacatcatgcagttaaaccata

SEQ ID NO: 292361 - DNA, 25 bp, Mus musculus
gagaacatctagacagttcgaacct

SEQ ID NO: 292362 - DNA, 25 bp, Mus musculus
gagaacatgattaatgacttccacc

SEQ ID NO: 292363 - DNA, 25 bp, Mus musculus
gagaacatgcacaaggttcacctgc

SEQ ID NO: 292364 - DNA, 25 bp, Mus musculus
gagaacatggaggttgctatcggct

SEQ ID NO: 292365 - DNA, 25 bp, Mus musculus
gagaacatggatgtcagcaattgag

SEQ ID NO: 292366 - DNA, 25 bp, Mus musculus
gagaacattccagatacacttcaga

SEQ ID NO: 292367 - DNA, 25 bp, Mus musculus
gagaacattgcagggccgtgcaggc

SEQ ID NO: 292368 - DNA, 25 bp, Mus musculus
gagaacattgcaggtaaagatgagc

SEQ ID NO: 292369 - DNA, 25 bp, Mus musculus
gagaaccaaaaataatctataagtg

SEQ ID NO: 292370 - DNA, 25 bp, Mus musculus
gagaaccaaacaaatgaagaagcac

SEQ ID NO: 292371 - DNA, 25 bp, Mus musculus
gagaaccaaacagagtctccttaaa

SEQ ID NO: 292372 - DNA, 25 bp, Mus musculus
gagaaccaaaggacttcaggaacca

SEQ ID NO: 292373 - DNA, 25 bp, Mus musculus
gagaaccagagcatcgtgctggagc

SEQ ID NO: 292374 - DNA, 25 bp, Mus musculus
gagaaccagagggacagcatcgtgc

SEQ ID NO: 292375 - DNA, 25 bp, Mus musculus
gagaacccacagagacgtttcatgt

SEQ ID NO: 292376 - DNA, 25 bp, Mus musculus
gagaacccacagcagagtcttctgg

SEQ ID NO: 292377 - DNA, 25 bp, Mus musculus
gagaacccagatgagatggaccaaa

SEQ ID NO: 292378 - DNA, 25 bp, Mus musculus
gagaaccccagggtccattcacaca

SEQ ID NO: 292379 - DNA, 25 bp, Mus musculus
gagaaccccgaaatgccaggcagat

SEQ ID NO: 292380 - DNA, 25 bp, Mus musculus
gagaaccccgaagacatcggcagaa

SEQ ID NO: 292381 - DNA, 25 bp, Mus musculus
gagaaccctcgatggtttcaaggct

SEQ ID NO: 292382 - DNA, 25 bp, Mus musculus
gagaaccgagaaatggcaaaatgtc

SEQ ID NO: 292383 - DNA, 25 bp, Mus musculus
gagaaccgagttcctgttcctctca

SEQ ID NO: 292384 - DNA, 25 bp, Mus musculus
gagaacctggagagatgctgtcccc

SEQ ID NO: 292385 - DNA, 25 bp, Mus musculus
gagaacgaatcacaggattagtcgt

SEQ ID NO: 292386 - DNA, 25 bp, Mus musculus
gagaacgagccaagttcaagcgcaa

SEQ ID NO: 292387 - DNA, 25 bp, Mus musculus
gagaacgagccggtccgtgttcacc

SEQ ID NO: 292388 - DNA, 25 bp, Mus musculus
gagaacgaggagatatccatcaata

SEQ ID NO: 292389 - DNA, 25 bp, Mus musculus
gagaacgatgacactgcaccatctg

SEQ ID NO: 292390 - DNA, 25 bp, Mus musculus
gagaacggaagttggttgctgcatc

SEQ ID NO: 292391 - DNA, 25 bp, Mus musculus
gagaacggacagccagatgccaaag

SEQ ID NO: 292392 - DNA, 25 bp, Mus musculus
gagaacggacagccagcaggcgtct

SEQ ID NO: 292393 - DNA, 25 bp, Mus musculus
gagaacggatgggatatttccaccc

SEQ ID NO: 292394 - DNA, 25 bp, Mus musculus
gagaacgtcccagggtgatgtgaac

SEQ ID NO: 292395 - DNA, 25 bp, Mus musculus
gagaacgtgcagaggggtaccccaa

SEQ ID NO: 292396 - DNA, 25 bp, Mus musculus
gagaacgtgtgctaggtttctgcca

SEQ ID NO: 292397 - DNA, 25 bp, Mus musculus
gagaactacatcaggaactggtttg

SEQ ID NO: 292398 - DNA, 25 bp, Mus musculus
gagaactacttgtctacccacagca

SEQ ID NO: 292399 - DNA, 25 bp, Mus musculus
gagaactaggtgctcctgccatgcc

SEQ ID NO: 292400 - DNA, 25 bp, Mus musculus
gagaactatgcaggtattgcagctc

SEQ ID NO: 292401 - DNA, 25 bp, Mus musculus
gagaactcaaggcttctagagaaca

SEQ ID NO: 292402 - DNA, 25 bp, Mus musculus
gagaactcagaacatacaacatcag

SEQ ID NO: 292403 - DNA, 25 bp, Mus musculus
gagaactcagagcacccctggctac

SEQ ID NO: 292404 - DNA, 25 bp, Mus musculus
gagaactcagcagagcacccgactc

SEQ ID NO: 292405 - DNA, 25 bp, Mus musculus
gagaactcagctcatggcagctccc

SEQ ID NO: 292406 - DNA, 25 bp, Mus musculus
gagaactcaggccaggaacaagtgc

SEQ ID NO: 292407 - DNA, 25 bp, Mus musculus
gagaactccaaggtcctaggtgagg

SEQ ID NO: 292408 - DNA, 25 bp, Mus musculus
gagaactccacagagcaggagcttg

SEQ ID NO: 292409 - DNA, 25 bp, Mus musculus
gagaactccagggaggtcctgatga

SEQ ID NO: 292410 - DNA, 25 bp, Mus musculus
gagaactccaggtctttccagcatg

SEQ ID NO: 292411 - DNA, 25 bp, Mus musculus
gagaactcgcaccagggtccacgct

SEQ ID NO: 292412 - DNA, 25 bp, Mus musculus
gagaactcgcactatggtccacgct

SEQ ID NO: 292413 - DNA, 25 bp, Mus musculus
gagaactgaaagtgacaactggaac

SEQ ID NO: 292414 - DNA, 25 bp, Mus musculus
gagaactgaaagtgggtccctgaag

SEQ ID NO: 292415 - DNA, 25 bp, Mus musculus
gagaactgagtgaggccttgttttc

SEQ ID NO: 292416 - DNA, 25 bp, Mus musculus
gagaactgcacagcgaaccccctgc

SEQ ID NO: 292417 - DNA, 25 bp, Mus musculus
gagaactgcaggcatcagaagggga

SEQ ID NO: 292418 - DNA, 25 bp, Mus musculus
gagaactgcaggttctcccatgggc

SEQ ID NO: 292419 - DNA, 25 bp, Mus musculus
gagaactgccccaccattctccagc

SEQ ID NO: 292420 - DNA, 25 bp, Mus musculus
gagaactggcagggagatctgctgg

SEQ ID NO: 292421 - DNA, 25 bp, Mus musculus
gagaactggccggttctgcggtgga

SEQ ID NO: 292422 - DNA, 25 bp, Mus musculus
gagaactggcggaagctcaagatga

SEQ ID NO: 292423 - DNA, 25 bp, Mus musculus
gagaactgtgttagactttcctgga

SEQ ID NO: 292424 - DNA, 25 bp, Mus musculus
gagaacttcaggctcctgggcaata

SEQ ID NO: 292425 - DNA, 25 bp, Mus musculus
gagaacttcaggtctgctgtaacag

SEQ ID NO: 292426 - DNA, 25 bp, Mus musculus
gagaacttcaggtttgctgtcttat

SEQ ID NO: 292427 - DNA, 25 bp, Mus musculus
gagaacttcttaacatatgacatct

SEQ ID NO: 292428 - DNA, 25 bp, Mus musculus
gagaacttggagatctcattccgag

SEQ ID NO: 292429 - DNA, 25 bp, Mus musculus
gagaacttgggctctgctctgcttt

SEQ ID NO: 292430 - DNA, 25 bp, Mus musculus
gagaacttgttaaggctcaggccat

SEQ ID NO: 292431 - DNA, 25 bp, Mus musculus
gagaactttagctcggttttgtaca

SEQ ID NO: 292432 - DNA, 25 bp, Mus musculus
gagaagaaaaagctctcttaagagc

SEQ ID NO: 292433 - DNA, 25 bp, Mus musculus
gagaagaaaaggagttggaaccctg

SEQ ID NO: 292434 - DNA, 25 bp, Mus musculus
gagaagaaaatgaccctgccacatg

SEQ ID NO: 292435 - DNA, 25 bp, Mus musculus
gagaagaaaatgctttacacagatt

SEQ ID NO: 292436 - DNA, 25 bp, Mus musculus
gagaagaaaatggagttgaagcaga

SEQ ID NO: 292437 - DNA, 25 bp, Mus musculus
gagaagaaagaagtgttgccgggaa

SEQ ID NO: 292438 - DNA, 25 bp, Mus musculus
gagaagaaagaggaagatggacggc

SEQ ID NO: 292439 - DNA, 25 bp, Mus musculus
gagaagaacaaggtattgacaaatc

SEQ ID NO: 292440 - DNA, 25 bp, Mus musculus
gagaagaacagtgtttagtgtaagg

SEQ ID NO: 292441 - DNA, 25 bp, Mus musculus
gagaagaacgaggccatccaggcgg

SEQ ID NO: 292442 - DNA, 25 bp, Mus musculus
gagaagaacgaggcggcccatgact

SEQ ID NO: 292443 - DNA, 25 bp, Mus musculus
gagaagaacggtctgacctgcagca

SEQ ID NO: 292444 - DNA, 25 bp, Mus musculus
gagaagaagaaggtagctacatcaa

SEQ ID NO: 292445 - DNA, 25 bp, Mus musculus
gagaagaagaagtatgaacgaggct

SEQ ID NO: 292446 - DNA, 25 bp, Mus musculus
gagaagaagaataacccatggctgt

SEQ ID NO: 292447 - DNA, 25 bp, Mus musculus
gagaagaagaattaactctgctgtt

SEQ ID NO: 292448 - DNA, 25 bp, Mus musculus
gagaagaagaatttgggcttcctgt

SEQ ID NO: 292449 - DNA, 25 bp, Mus musculus
gagaagaagcacaagcttctggccc

SEQ ID NO: 292450 - DNA, 25 bp, Mus musculus
gagaagaagcagaaggcttctcaga

SEQ ID NO: 292451 - DNA, 25 bp, Mus musculus
gagaagaagcaggaattcttaggca

SEQ ID NO: 292452 - DNA, 25 bp, Mus musculus
gagaagaagcccaaagcatccaaag

SEQ ID NO: 292453 - DNA, 25 bp, Mus musculus
gagaagaaggagaaaatcacttctc

SEQ ID NO: 292454 - DNA, 25 bp, Mus musculus
gagaagaaggagccagctattcact

SEQ ID NO: 292455 - DNA, 25 bp, Mus musculus
gagaagaaggcagataaggaaaagg

SEQ ID NO: 292456 - DNA, 25 bp, Mus musculus
gagaagaaggcagcccagatactca

SEQ ID NO: 292457 - DNA, 25 bp, Mus musculus
gagaagaaggcaggcctccacttac

SEQ ID NO: 292458 - DNA, 25 bp, Mus musculus
gagaagaagttatgctgcaggcaca

SEQ ID NO: 292459 - DNA, 25 bp, Mus musculus
gagaagaattctagggtactcaatg

SEQ ID NO: 292460 - DNA, 25 bp, Mus musculus
gagaagacaaggttctttaacgaag

SEQ ID NO: 292461 - DNA, 25 bp, Mus musculus
gagaagaccaagactgtatcccttg

SEQ ID NO: 292462 - DNA, 25 bp, Mus musculus
gagaagaccaaggctttgatccagt

SEQ ID NO: 292463 - DNA, 25 bp, Mus musculus
gagaagacccagaaatttgtatgcc

SEQ ID NO: 292464 - DNA, 25 bp, Mus musculus
gagaagacgaggcgggacatgttct

SEQ ID NO: 292465 - DNA, 25 bp, Mus musculus
gagaagacgaggcgggccatccggg

SEQ ID NO: 292466 - DNA, 25 bp, Mus musculus
gagaagactacagatgggcagcaga

SEQ ID NO: 292467 - DNA, 25 bp, Mus musculus
gagaagactacaggacctgcaggga

SEQ ID NO: 292468 - DNA, 25 bp, Mus musculus
gagaagactgcggttctacgggtgc

SEQ ID NO: 292469 - DNA, 25 bp, Mus musculus
gagaagactgtgaacaggtatgaga

SEQ ID NO: 292470 - DNA, 25 bp, Mus musculus
gagaagagaaaggtctgtatccacc

SEQ ID NO: 292471 - DNA, 25 bp, Mus musculus
gagaagagaagacactaccactgag

SEQ ID NO: 292472 - DNA, 25 bp, Mus musculus
gagaagagaaggaagatccctgtgg

SEQ ID NO: 292473 - DNA, 25 bp, Mus musculus
gagaagagaagggactcggccagac

SEQ ID NO: 292474 - DNA, 25 bp, Mus musculus
gagaagagaattgagcgtttatcac

SEQ ID NO: 292475 - DNA, 25 bp, Mus musculus
gagaagagacactgcagcggaagat

SEQ ID NO: 292476 - DNA, 25 bp, Mus musculus
gagaagagagagaagctcggaccta

SEQ ID NO: 292477 - DNA, 25 bp, Mus musculus
gagaagagcagacagataaaggagc

SEQ ID NO: 292478 - DNA, 25 bp, Mus musculus
gagaagagcagtacactaggtacca

SEQ ID NO: 292479 - DNA, 25 bp, Mus musculus
gagaagagccactgggctcctagct

SEQ ID NO: 292480 - DNA, 25 bp, Mus musculus
gagaagagccactggggggaggggt

SEQ ID NO: 292481 - DNA, 25 bp, Mus musculus
gagaagagccccagtcacgcggtgt

SEQ ID NO: 292482 - DNA, 25 bp, Mus musculus
gagaagagcgtggagataacaaaac

SEQ ID NO: 292483 - DNA, 25 bp, Mus musculus
gagaagaggacggctgctgctgaac

SEQ ID NO: 292484 - DNA, 25 bp, Mus musculus
gagaagaggatggctgctcccaggc

SEQ ID NO: 292485 - DNA, 25 bp, Mus musculus
gagaagataccagagtatacccgca

SEQ ID NO: 292486 - DNA, 25 bp, Mus musculus
gagaagatatgtagtcagaagatgg

SEQ ID NO: 292487 - DNA, 25 bp, Mus musculus
gagaagatattgacacagcagtccg

SEQ ID NO: 292488 - DNA, 25 bp, Mus musculus
gagaagatccagggcttggaccgcc

SEQ ID NO: 292489 - DNA, 25 bp, Mus musculus
gagaagatcttctgattcctgccgt

SEQ ID NO: 292490 - DNA, 25 bp, Mus musculus
gagaagatcttctggcacagcttgc

SEQ ID NO: 292491 - DNA, 25 bp, Mus musculus
gagaagatgagattctgttttgaag

SEQ ID NO: 292492 - DNA, 25 bp, Mus musculus
gagaagatgagatttctgctttcac

SEQ ID NO: 292493 - DNA, 25 bp, Mus musculus
gagaagattacgacgggcagaaccc

SEQ ID NO: 292494 - DNA, 25 bp, Mus musculus
gagaagattgaagccatggctgagc

SEQ ID NO: 292495 - DNA, 25 bp, Mus musculus
gagaagattgcaaagtatggtataa

SEQ ID NO: 292496 - DNA, 25 bp, Mus musculus
gagaagattgtcaagagcaactgca

SEQ ID NO: 292497 - DNA, 25 bp, Mus musculus
gagaagcaaaacttttaatccaggt

SEQ ID NO: 292498 - DNA, 25 bp, Mus musculus
gagaagcaagcatgaatgaagtctt

SEQ ID NO: 292499 - DNA, 25 bp, Mus musculus
gagaagcaagcatgagaaaggctgg

SEQ ID NO: 292500 - DNA, 25 bp, Mus musculus
gagaagcacatcaaggtgaacctga

SEQ ID NO: 292501 - DNA, 25 bp, Mus musculus
gagaagcacctgggagagcccccct

SEQ ID NO: 292502 - DNA, 25 bp, Mus musculus
gagaagcagagcactggcagatccc

SEQ ID NO: 292503 - DNA, 25 bp, Mus musculus
gagaagcagcacgagcgggtattcc

SEQ ID NO: 292504 - DNA, 25 bp, Mus musculus
gagaagcaggcaaggtatacttgaa

SEQ ID NO: 292505 - DNA, 25 bp, Mus musculus
gagaagccagaaagaaagatcacag

SEQ ID NO: 292506 - DNA, 25 bp, Mus musculus
gagaagccagctggagattcacgta

SEQ ID NO: 292507 - DNA, 25 bp, Mus musculus
gagaagccaggagaaactacaactc

SEQ ID NO: 292508 - DNA, 25 bp, Mus musculus
gagaagccaggtggtgaccatagaa

SEQ ID NO: 292509 - DNA, 25 bp, Mus musculus
gagaagccaggttacaaactacctg

SEQ ID NO: 292510 - DNA, 25 bp, Mus musculus
gagaagccattacaatgtgagatct

SEQ ID NO: 292511 - DNA, 25 bp, Mus musculus
gagaagcccaagctgcagacggagc

SEQ ID NO: 292512 - DNA, 25 bp, Mus musculus
gagaagcccaaggagggtgtgaaga

SEQ ID NO: 292513 - DNA, 25 bp, Mus musculus
gagaagcccacagaaacgcatccca

SEQ ID NO: 292514 - DNA, 25 bp, Mus musculus
gagaagcccacagtccatggagaca

SEQ ID NO: 292515 - DNA, 25 bp, Mus musculus
gagaagccggaggttgagaacaaaa

SEQ ID NO: 292516 - DNA, 25 bp, Mus musculus
gagaagccggcctcggtgtggtaca

SEQ ID NO: 292517 - DNA, 25 bp, Mus musculus
gagaagccggcctctggtgctcttg

SEQ ID NO: 292518 - DNA, 25 bp, Mus musculus
gagaagccggttatacaatggtcga

SEQ ID NO: 292519 - DNA, 25 bp, Mus musculus
gagaagcctaagcctgatttcttta

SEQ ID NO: 292520 - DNA, 25 bp, Mus musculus
gagaagcctaagccttgctcagctc

SEQ ID NO: 292521 - DNA, 25 bp, Mus musculus
gagaagcctgaaaagatcccaccaa

SEQ ID NO: 292522 - DNA, 25 bp, Mus musculus
gagaagcgggaattggtctcggtgt

SEQ ID NO: 292523 - DNA, 25 bp, Mus musculus
gagaagcgggaattggtctgggcgt

SEQ ID NO: 292524 - DNA, 25 bp, Mus musculus
gagaagcgggaattggtcttggagt

SEQ ID NO: 292525 - DNA, 25 bp, Mus musculus
gagaagcgtctacaaacttcaccaa

SEQ ID NO: 292526 - DNA, 25 bp, Mus musculus
gagaagcgtctacaaagcccggttc

SEQ ID NO: 292527 - DNA, 25 bp, Mus musculus
gagaagctcaagacatactttgaag

SEQ ID NO: 292528 - DNA, 25 bp, Mus musculus
gagaagctctatgactttgtgaaga

SEQ ID NO: 292529 - DNA, 25 bp, Mus musculus
gagaagctgaggacaagatctaatt

SEQ ID NO: 292530 - DNA, 25 bp, Mus musculus
gagaagctgatcaaggtcttggata

SEQ ID NO: 292531 - DNA, 25 bp, Mus musculus
gagaagctgcggcccaccaggacct

SEQ ID NO: 292532 - DNA, 25 bp, Mus musculus
gagaagctgctgaggctcacaactc

SEQ ID NO: 292533 - DNA, 25 bp, Mus musculus
gagaagctgctgggccctaatgctg

SEQ ID NO: 292534 - DNA, 25 bp, Mus musculus
gagaagctggagcaggaaagatcta

SEQ ID NO: 292535 - DNA, 25 bp, Mus musculus
gagaagctgggcttcaacaaatcca

SEQ ID NO: 292536 - DNA, 25 bp, Mus musculus
gagaagctgggtatcagtaccatta

SEQ ID NO: 292537 - DNA, 25 bp, Mus musculus
gagaagctggtgtggatggagaggt

SEQ ID NO: 292538 - DNA, 25 bp, Mus musculus
gagaagcttcgagcagcagttttta

SEQ ID NO: 292539 - DNA, 25 bp, Mus musculus
gagaagcttgccagggcaagaaata

SEQ ID NO: 292540 - DNA, 25 bp, Mus musculus
gagaaggaaaaggaaacacaaccta

SEQ ID NO: 292541 - DNA, 25 bp, Mus musculus
gagaaggaacaaggtctgcaaacag

SEQ ID NO: 292542 - DNA, 25 bp, Mus musculus
gagaaggaacatgtttccagagtgt

SEQ ID NO: 292543 - DNA, 25 bp, Mus musculus
gagaaggaacggaggaagatgacag

SEQ ID NO: 292544 - DNA, 25 bp, Mus musculus
gagaaggaagacaccaaatcctact

SEQ ID NO: 292545 - DNA, 25 bp, Mus musculus
gagaaggaagagggtaaactggtgc

SEQ ID NO: 292546 - DNA, 25 bp, Mus musculus
gagaaggaaggaatgtcactgtctg

SEQ ID NO: 292547 - DNA, 25 bp, Mus musculus
gagaaggaaggtatttccaaactat

SEQ ID NO: 292548 - DNA, 25 bp, Mus musculus
gagaaggaaggtctgtctgcaggtt

SEQ ID NO: 292549 - DNA, 25 bp, Mus musculus
gagaaggaagtggaggcagagttcc

SEQ ID NO: 292550 - DNA, 25 bp, Mus musculus
gagaaggaatgccaaccaggcagcg

SEQ ID NO: 292551 - DNA, 25 bp, Mus musculus
gagaaggaatgccccaaagcaaaat

SEQ ID NO: 292552 - DNA, 25 bp, Mus musculus
gagaaggacaaattggagcctgccg

SEQ ID NO: 292553 - DNA, 25 bp, Mus musculus
gagaaggacaaggttaactgctctt

SEQ ID NO: 292554 - DNA, 25 bp, Mus musculus
gagaaggacaatgaggatggcagta

SEQ ID NO: 292555 - DNA, 25 bp, Mus musculus
gagaaggaccaggacaaaggccttc

SEQ ID NO: 292556 - DNA, 25 bp, Mus musculus
gagaaggagacaatcccagacattg

SEQ ID NO: 292557 - DNA, 25 bp, Mus musculus
gagaaggagctaggatgaacagcaa

SEQ ID NO: 292558 - DNA, 25 bp, Mus musculus
gagaaggagctagtgacattcattt

SEQ ID NO: 292559 - DNA, 25 bp, Mus musculus
gagaaggagctgatcgaagcgttgc

SEQ ID NO: 292560 - DNA, 25 bp, Mus musculus
gagaaggagctgccaaggcggcaac

SEQ ID NO: 292561 - DNA, 25 bp, Mus musculus
gagaaggaggaagaggaggacgaga

SEQ ID NO: 292562 - DNA, 25 bp, Mus musculus
gagaaggaggccaagcctttcatca

SEQ ID NO: 292563 - DNA, 25 bp, Mus musculus
gagaaggagggggagctcaactaag

SEQ ID NO: 292564 - DNA, 25 bp, Mus musculus
gagaaggaggggttccccatcacag

SEQ ID NO: 292565 - DNA, 25 bp, Mus musculus
gagaaggaggtgaagcccaggaccc

SEQ ID NO: 292566 - DNA, 25 bp, Mus musculus
gagaaggaggtgaagtatttaggtc

SEQ ID NO: 292567 - DNA, 25 bp, Mus musculus
gagaaggatcagctgaagaataaat

SEQ ID NO: 292568 - DNA, 25 bp, Mus musculus
gagaaggatgagctgggttcaggag

SEQ ID NO: 292569 - DNA, 25 bp, Mus musculus
gagaaggatgcatcttcctggtcat

SEQ ID NO: 292570 - DNA, 25 bp, Mus musculus
gagaaggatgcccactgagcaggac

SEQ ID NO: 292571 - DNA, 25 bp, Mus musculus
gagaaggatggcatccccatcagca

SEQ ID NO: 292572 - DNA, 25 bp, Mus musculus
gagaaggcagattctcattgccaag

SEQ ID NO: 292573 - DNA, 25 bp, Mus musculus
gagaaggccagacccccatcccggc

SEQ ID NO: 292574 - DNA, 25 bp, Mus musculus
gagaaggccagggtagacagcaaga

SEQ ID NO: 292575 - DNA, 25 bp, Mus musculus
gagaaggccgagcctgctaggcctc

SEQ ID NO: 292576 - DNA, 25 bp, Mus musculus
gagaaggctcagtgccatggagaag

SEQ ID NO: 292577 - DNA, 25 bp, Mus musculus
gagaaggctcagtgctgtatgccat

SEQ ID NO: 292578 - DNA, 25 bp, Mus musculus
gagaagggaaaggggaatgatgaaa

SEQ ID NO: 292579 - DNA, 25 bp, Mus musculus
gagaagggaggtgtgaactgaaccc

SEQ ID NO: 292580 - DNA, 25 bp, Mus musculus
gagaagggcaaagacgatgcggtcc

SEQ ID NO: 292581 - DNA, 25 bp, Mus musculus
gagaagggcaaaggctggagcaaaa

SEQ ID NO: 292582 - DNA, 25 bp, Mus musculus
gagaagggcagtgttgctgaagcag

SEQ ID NO: 292583 - DNA, 25 bp, Mus musculus
gagaaggggagcagaaaatgttttc

SEQ ID NO: 292584 - DNA, 25 bp, Mus musculus
gagaaggggttccgggtggacaaga

SEQ ID NO: 292585 - DNA, 25 bp, Mus musculus
gagaagggtgagcaattgtgttcgg

SEQ ID NO: 292586 - DNA, 25 bp, Mus musculus
gagaagggtggcagggggacacctg

SEQ ID NO: 292587 - DNA, 25 bp, Mus musculus
gagaaggtcacccaggtcctgtcct

SEQ ID NO: 292588 - DNA, 25 bp, Mus musculus
gagaaggtgggaggctggaatatca

SEQ ID NO: 292589 - DNA, 25 bp, Mus musculus
gagaaggttgctcaatcatgtgagg

SEQ ID NO: 292590 - DNA, 25 bp, Mus musculus
gagaaggttgctcattcatgtgagg

SEQ ID NO: 292591 - DNA, 25 bp, Mus musculus
gagaagtaaatgacattaaagattc

SEQ ID NO: 292592 - DNA, 25 bp, Mus musculus
gagaagtaaatgactttaagaagct

SEQ ID NO: 292593 - DNA, 25 bp, Mus musculus
gagaagtaaatgcttgacaaaaaag

SEQ ID NO: 292594 - DNA, 25 bp, Mus musculus
gagaagtacaaagatgaacgagacc

SEQ ID NO: 292595 - DNA, 25 bp, Mus musculus
gagaagtatcggaagcttgtgtcgg

SEQ ID NO: 292596 - DNA, 25 bp, Mus musculus
gagaagtatgaacaggcctgtcgtg

SEQ ID NO: 292597 - DNA, 25 bp, Mus musculus
gagaagtatgagaaggatgttgctg

SEQ ID NO: 292598 - DNA, 25 bp, Mus musculus
gagaagtcagagcagcagcaagtcc

SEQ ID NO: 292599 - DNA, 25 bp, Mus musculus
gagaagtcagagtgaaagtagaacc

SEQ ID NO: 292600 - DNA, 25 bp, Mus musculus
gagaagtcagcctggaaactgcccg

SEQ ID NO: 292601 - DNA, 25 bp, Mus musculus
gagaagtcagcctggcgcaagatgc

SEQ ID NO: 292602 - DNA, 25 bp, Mus musculus
gagaagtcaggttccaaggagcagg

SEQ ID NO: 292603 - DNA, 25 bp, Mus musculus
gagaagtccaggaagatgggctcct

SEQ ID NO: 292604 - DNA, 25 bp, Mus musculus
gagaagtcccgttgtatcagagtaa

SEQ ID NO: 292605 - DNA, 25 bp, Mus musculus
gagaagtcggaattcctaccctcag

SEQ ID NO: 292606 - DNA, 25 bp, Mus musculus
gagaagtcgggtacaaagtaagaaa

SEQ ID NO: 292607 - DNA, 25 bp, Mus musculus
gagaagtctggagaaatctgggctc

SEQ ID NO: 292608 - DNA, 25 bp, Mus musculus
gagaagtgaacaaagtctggttttt

SEQ ID NO: 292609 - DNA, 25 bp, Mus musculus
gagaagtgacgtgaaagccagagac

SEQ ID NO: 292610 - DNA, 25 bp, Mus musculus
gagaagtgcacgtaagttcatatag

SEQ ID NO: 292611 - DNA, 25 bp, Mus musculus
gagaagtgcagcagccccaccagtg

SEQ ID NO: 292612 - DNA, 25 bp, Mus musculus
gagaagtgcagcagggcaagcttct

SEQ ID NO: 292613 - DNA, 25 bp, Mus musculus
gagaagtgcctcccacgtcagaacc

SEQ ID NO: 292614 - DNA, 25 bp, Mus musculus
gagaagttcaggaagctgatttcac

SEQ ID NO: 292615 - DNA, 25 bp, Mus musculus
gagaagttcaggaaggtgcagacac

SEQ ID NO: 292616 - DNA, 25 bp, Mus musculus
gagaagtttgaccctgaggctttaa

SEQ ID NO: 292617 - DNA, 25 bp, Mus musculus
gagaataaaacagaaacatggagct

SEQ ID NO: 292618 - DNA, 25 bp, Mus musculus
gagaataaaggacctttttcagaaa

SEQ ID NO: 292619 - DNA, 25 bp, Mus musculus
gagaataaataccggttcttcctcg

SEQ ID NO: 292620 - DNA, 25 bp, Mus musculus
gagaataaataccggtttggagatt

SEQ ID NO: 292621 - DNA, 25 bp, Mus musculus
gagaataaatccaagtttggggcca

SEQ ID NO: 292622 - DNA, 25 bp, Mus musculus
gagaataaatccttggagctggtga

SEQ ID NO: 292623 - DNA, 25 bp, Mus musculus
gagaataaatgcctttaatgtgatc

SEQ ID NO: 292624 - DNA, 25 bp, Mus musculus
gagaataagtccaagtttggggcca

SEQ ID NO: 292625 - DNA, 25 bp, Mus musculus
gagaataataaggagaatctgtact

SEQ ID NO: 292626 - DNA, 25 bp, Mus musculus
gagaataatcaggttttaaaatcag

SEQ ID NO: 292627 - DNA, 25 bp, Mus musculus
gagaatacagggattacagcaatga

SEQ ID NO: 292628 - DNA, 25 bp, Mus musculus
gagaatacagggtctgttcactaga

SEQ ID NO: 292629 - DNA, 25 bp, Mus musculus
gagaataccattgagtcagacgttc

SEQ ID NO: 292630 - DNA, 25 bp, Mus musculus
gagaatactataaggcaagaagtgt

SEQ ID NO: 292631 - DNA, 25 bp, Mus musculus
gagaatactatatgtggagacggtc

SEQ ID NO: 292632 - DNA, 25 bp, Mus musculus
gagaatactattgagtcagacgttc

SEQ ID NO: 292633 - DNA, 25 bp, Mus musculus
gagaatactgatactggtgaagaaa

SEQ ID NO: 292634 - DNA, 25 bp, Mus musculus
gagaatagctaagagctttgaccct

SEQ ID NO: 292635 - DNA, 25 bp, Mus musculus
gagaatagtcagacttctgccagag

SEQ ID NO: 292636 - DNA, 25 bp, Mus musculus
gagaatatattaaccgggaatcacc

SEQ ID NO: 292637 - DNA, 25 bp, Mus musculus
gagaatatcagctgcaagaaaaatg

SEQ ID NO: 292638 - DNA, 25 bp, Mus musculus
gagaatatgaccacctatctagagt

SEQ ID NO: 292639 - DNA, 25 bp, Mus musculus
gagaatatgagatcctgcaacgaag

SEQ ID NO: 292640 - DNA, 25 bp, Mus musculus
gagaatatgagttccagcagcactg

SEQ ID NO: 292641 - DNA, 25 bp, Mus musculus
gagaatattgagcagattctcgact

SEQ ID NO: 292642 - DNA, 25 bp, Mus musculus
gagaatcaccctcaggaggagaatg

SEQ ID NO: 292643 - DNA, 25 bp, Mus musculus
gagaatcaccctcagtttgtgcttg

SEQ ID NO: 292644 - DNA, 25 bp, Mus musculus
gagaatcagagtggtgtctcctttg

SEQ ID NO: 292645 - DNA, 25 bp, Mus musculus
gagaatccagaaatggcctccacct

SEQ ID NO: 292646 - DNA, 25 bp, Mus musculus
gagaatccagatccagggttcctga

SEQ ID NO: 292647 - DNA, 25 bp, Mus musculus
gagaatccaggtctcccggacttaa

SEQ ID NO: 292648 - DNA, 25 bp, Mus musculus
gagaatccgaggccacaggcctctg

SEQ ID NO: 292649 - DNA, 25 bp, Mus musculus
gagaatccggtcatgggagttaggg

SEQ ID NO: 292650 - DNA, 25 bp, Mus musculus
gagaatcctgcgttttctggaagat

SEQ ID NO: 292651 - DNA, 25 bp, Mus musculus
gagaatcctgtgaagatattgacga

SEQ ID NO: 292652 - DNA, 25 bp, Mus musculus
gagaatcgatatcaggttgatcccc

SEQ ID NO: 292653 - DNA, 25 bp, Mus musculus
gagaatcgtgagtggtcctgtccaa

SEQ ID NO: 292654 - DNA, 25 bp, Mus musculus
gagaatctagaggtgaacgagatta

SEQ ID NO: 292655 - DNA, 25 bp, Mus musculus
gagaatctaggcggcttcagcgggc

SEQ ID NO: 292656 - DNA, 25 bp, Mus musculus
gagaatctagggctcaccatcatgg

SEQ ID NO: 292657 - DNA, 25 bp, Mus musculus
gagaatcttgccggtcctgttagcc

SEQ ID NO: 292658 - DNA, 25 bp, Mus musculus
gagaatcttgtcaggaacctcagct

SEQ ID NO: 292659 - DNA, 25 bp, Mus musculus
gagaatcttgtcaggtgtgatgaat

SEQ ID NO: 292660 - DNA, 25 bp, Mus musculus
gagaatgaaaagtgaagctgaggac

SEQ ID NO: 292661 - DNA, 25 bp, Mus musculus
gagaatgaagacactcagccggagt

SEQ ID NO: 292662 - DNA, 25 bp, Mus musculus
gagaatgaagatgctgggttttcag

SEQ ID NO: 292663 - DNA, 25 bp, Mus musculus
gagaatgaagccaagccctcccagg

SEQ ID NO: 292664 - DNA, 25 bp, Mus musculus
gagaatgaagccaagggcccagtgt

SEQ ID NO: 292665 - DNA, 25 bp, Mus musculus
gagaatgaaggctctggaatggcag

SEQ ID NO: 292666 - DNA, 25 bp, Mus musculus
gagaatgacactgtctctggctttc

SEQ ID NO: 292667 - DNA, 25 bp, Mus musculus
gagaatgacaggagccatccgcaaa

SEQ ID NO: 292668 - DNA, 25 bp, Mus musculus
gagaatgacatgggatacaaactgc

SEQ ID NO: 292669 - DNA, 25 bp, Mus musculus
gagaatgaccggcagggtgatgctg

SEQ ID NO: 292670 - DNA, 25 bp, Mus musculus
gagaatgactggtgggtgtgcaaac

SEQ ID NO: 292671 - DNA, 25 bp, Mus musculus
gagaatgagatgagctgcccgacgg

SEQ ID NO: 292672 - DNA, 25 bp, Mus musculus
gagaatgatagcttggagatttctt

SEQ ID NO: 292673 - DNA, 25 bp, Mus musculus
gagaatgatccagctacatcaaaat

SEQ ID NO: 292674 - DNA, 25 bp, Mus musculus
gagaatgcacaggtcctgtggctgt

SEQ ID NO: 292675 - DNA, 25 bp, Mus musculus
gagaatgcccaatggcacccaggcc

SEQ ID NO: 292676 - DNA, 25 bp, Mus musculus
gagaatgctgaaaagaatgatggaa

SEQ ID NO: 292677 - DNA, 25 bp, Mus musculus
gagaatgctgaaaagttgccagtag

SEQ ID NO: 292678 - DNA, 25 bp, Mus musculus
gagaatgctttcagccccagccgtt

SEQ ID NO: 292679 - DNA, 25 bp, Mus musculus
gagaatgctttccaggattcacaga

SEQ ID NO: 292680 - DNA, 25 bp, Mus musculus
gagaatggagttggctctgctctga

SEQ ID NO: 292681 - DNA, 25 bp, Mus musculus
gagaatggcccgccctcctcgcccg

SEQ ID NO: 292682 - DNA, 25 bp, Mus musculus
gagaatggctgataatgcctgcgtt

SEQ ID NO: 292683 - DNA, 25 bp, Mus musculus
gagaatgggacaggagacaagatcc

SEQ ID NO: 292684 - DNA, 25 bp, Mus musculus
gagaatgggcaggtggcactgatgg

SEQ ID NO: 292685 - DNA, 25 bp, Mus musculus
gagaatgggcagttgttacaggtgg

SEQ ID NO: 292686 - DNA, 25 bp, Mus musculus
gagaatgggctaggcaaaagatgtg

SEQ ID NO: 292687 - DNA, 25 bp, Mus musculus
gagaatgggctagtcacagttgcag

SEQ ID NO: 292688 - DNA, 25 bp, Mus musculus
gagaatggggacagtgtcttacact

SEQ ID NO: 292689 - DNA, 25 bp, Mus musculus
gagaatggttatactaatggaattg

SEQ ID NO: 292690 - DNA, 25 bp, Mus musculus
gagaatggttatactgccttaacat

SEQ ID NO: 292691 - DNA, 25 bp, Mus musculus
gagaatgtattcaagatgctggaga

SEQ ID NO: 292692 - DNA, 25 bp, Mus musculus
gagaatgtattcaaggtctgcgacg

SEQ ID NO: 292693 - DNA, 25 bp, Mus musculus
gagaatgtcagattccagattacca

SEQ ID NO: 292694 - DNA, 25 bp, Mus musculus
gagaatgtccactgttccccatttt

SEQ ID NO: 292695 - DNA, 25 bp, Mus musculus
gagaatgtccaggtcctttcctctt

SEQ ID NO: 292696 - DNA, 25 bp, Mus musculus
gagaatgtctaataaaactggatgg

SEQ ID NO: 292697 - DNA, 25 bp, Mus musculus
gagaatgtgctagagatcaataagc

SEQ ID NO: 292698 - DNA, 25 bp, Mus musculus
gagaatgtgtatggcctgcaggcgt

SEQ ID NO: 292699 - DNA, 25 bp, Mus musculus
gagaatgtttggatattgatgagtg

SEQ ID NO: 292700 - DNA, 25 bp, Mus musculus
gagaatgtttggttattgatgagtg

SEQ ID NO: 292701 - DNA, 25 bp, Mus musculus
gagaattaaggcaccaaggagagga

SEQ ID NO: 292702 - DNA, 25 bp, Mus musculus
gagaattaatagctaaaaggacaac

SEQ ID NO: 292703 - DNA, 25 bp, Mus musculus
gagaattacaagtgtgaagtagtcg

SEQ ID NO: 292704 - DNA, 25 bp, Mus musculus
gagaattacagtactgtttatcaga

SEQ ID NO: 292705 - DNA, 25 bp, Mus musculus
gagaattatgagctacagaagttat

SEQ ID NO: 292706 - DNA, 25 bp, Mus musculus
gagaattatgaggtctacaagcagg

SEQ ID NO: 292707 - DNA, 25 bp, Mus musculus
gagaattattctgctcttcctcccc

SEQ ID NO: 292708 - DNA, 25 bp, Mus musculus
gagaattcaagtctgtcacctaaag

SEQ ID NO: 292709 - DNA, 25 bp, Mus musculus
gagaattcccaaatggatgacaagt

SEQ ID NO: 292710 - DNA, 25 bp, Mus musculus
gagaattctcaggtcctctttcagc

SEQ ID NO: 292711 - DNA, 25 bp, Mus musculus
gagaattgactctgtttcccacagt

SEQ ID NO: 292712 - DNA, 25 bp, Mus musculus
gagaattgagcgtttatcactccga

SEQ ID NO: 292713 - DNA, 25 bp, Mus musculus
gagaattgcagatctgataaaaaga

SEQ ID NO: 292714 - DNA, 25 bp, Mus musculus
gagaattgtggaagaataagaatga

SEQ ID NO: 292715 - DNA, 25 bp, Mus musculus
gagaatttccaggcaggctcatggc

SEQ ID NO: 292716 - DNA, 25 bp, Mus musculus
gagaatttcccaagtggatggagac

SEQ ID NO: 292717 - DNA, 25 bp, Mus musculus
gagaattttacagaatcctgaaatg

SEQ ID NO: 292718 - DNA, 25 bp, Mus musculus
gagaattttctgggggtcccacaga

SEQ ID NO: 292719 - DNA, 25 bp, Mus musculus
gagacaaaaaagagttgatcaagag

SEQ ID NO: 292720 - DNA, 25 bp, Mus musculus
gagacaaaaaccatctttcaggacc

SEQ ID NO: 292721 - DNA, 25 bp, Mus musculus
gagacaaaagaggcttttcagatgt

SEQ ID NO: 292722 - DNA, 25 bp, Mus musculus
gagacaaaagagtttcaactcctag

SEQ ID NO: 292723 - DNA, 25 bp, Mus musculus
gagacaaaatgagtctggaatcagt

SEQ ID NO: 292724 - DNA, 25 bp, Mus musculus
gagacaaaattgcaatgcatgaacc

SEQ ID NO: 292725 - DNA, 25 bp, Mus musculus
gagacaaaattgtagaagaacccat

SEQ ID NO: 292726 - DNA, 25 bp, Mus musculus
gagacaaaggcgacgacctgctgcc

SEQ ID NO: 292727 - DNA, 25 bp, Mus musculus
gagacaaaggcgacgatagggccag

SEQ ID NO: 292728 - DNA, 25 bp, Mus musculus
gagacaacaccctattttataggca

SEQ ID NO: 292729 - DNA, 25 bp, Mus musculus
gagacaacagatttcctctgcccct

SEQ ID NO: 292730 - DNA, 25 bp, Mus musculus
gagacaacatacaggataagaacaa

SEQ ID NO: 292731 - DNA, 25 bp, Mus musculus
gagacaacggaaagacgatgctcaa

SEQ ID NO: 292732 - DNA, 25 bp, Mus musculus
gagacaactggaacccacagttccc

SEQ ID NO: 292733 - DNA, 25 bp, Mus musculus
gagacaactttgcaggataaggtag

SEQ ID NO: 292734 - DNA, 25 bp, Mus musculus
gagacaagagatgtgcttgtgtgga

SEQ ID NO: 292735 - DNA, 25 bp, Mus musculus
gagacaagagattcagatgccaccg

SEQ ID NO: 292736 - DNA, 25 bp, Mus musculus
gagacaagagtttccttctagatcg

SEQ ID NO: 292737 - DNA, 25 bp, Mus musculus
gagacaagcaaggaggtgagtgctc

SEQ ID NO: 292738 - DNA, 25 bp, Mus musculus
gagacaagcaagggctctgtaaaag

SEQ ID NO: 292739 - DNA, 25 bp, Mus musculus
gagacaagccaaaggcaccatggct

SEQ ID NO: 292740 - DNA, 25 bp, Mus musculus
gagacaagccaaggtcttcttctcc

SEQ ID NO: 292741 - DNA, 25 bp, Mus musculus
gagacaagcctggaggttcatgtct

SEQ ID NO: 292742 - DNA, 25 bp, Mus musculus
gagacaagcctggagttatgcctct

SEQ ID NO: 292743 - DNA, 25 bp, Mus musculus
gagacaaggcaggagatcgggaagc

SEQ ID NO: 292744 - DNA, 25 bp, Mus musculus
gagacaaggcaggaggctggtcaga

SEQ ID NO: 292745 - DNA, 25 bp, Mus musculus
gagacaagggtaggtccctgtatac

SEQ ID NO: 292746 - DNA, 25 bp, Mus musculus
gagacaagtatgagcctgccataca

SEQ ID NO: 292747 - DNA, 25 bp, Mus musculus
gagacaagttcaggtaacgcacagt

SEQ ID NO: 292748 - DNA, 25 bp, Mus musculus
gagacaatccagcggctcctggagg

SEQ ID NO: 292749 - DNA, 25 bp, Mus musculus
gagacaatctcatttgagatgcttg

SEQ ID NO: 292750 - DNA, 25 bp, Mus musculus
gagacaatctcgctgcgaaaagaca

SEQ ID NO: 292751 - DNA, 25 bp, Mus musculus
gagacaattccagcacaaggaattc

SEQ ID NO: 292752 - DNA, 25 bp, Mus musculus
gagacaattgaggaaccaacacaag

SEQ ID NO: 292753 - DNA, 25 bp, Mus musculus
gagacaattgcaaagaaaagaccca

SEQ ID NO: 292754 - DNA, 25 bp, Mus musculus
gagacaattgggttcatagtggcgc

SEQ ID NO: 292755 - DNA, 25 bp, Mus musculus
gagacacaagggtaaggaatcagct

SEQ ID NO: 292756 - DNA, 25 bp, Mus musculus
gagacacaagggtgctgatggagct

SEQ ID NO: 292757 - DNA, 25 bp, Mus musculus
gagacacagcaggtggatgcagtga

SEQ ID NO: 292758 - DNA, 25 bp, Mus musculus
gagacacagcctctgccaagcagtt

SEQ ID NO: 292759 - DNA, 25 bp, Mus musculus
gagacaccagcttgggggccccatg

SEQ ID NO: 292760 - DNA, 25 bp, Mus musculus
gagacacccagcctggccgcagaag

SEQ ID NO: 292761 - DNA, 25 bp, Mus musculus
gagacaccgagagtgtgggttcgca

SEQ ID NO: 292762 - DNA, 25 bp, Mus musculus
gagacacctaaaggctcccctttga

SEQ ID NO: 292763 - DNA, 25 bp, Mus musculus
gagacaccttcaggtggaagggaga

SEQ ID NO: 292764 - DNA, 25 bp, Mus musculus
gagacacggagcggtactgctcacg

SEQ ID NO: 292765 - DNA, 25 bp, Mus musculus
gagacactacaggagagcacacagc

SEQ ID NO: 292766 - DNA, 25 bp, Mus musculus
gagacactgacctggtgttgctgca

SEQ ID NO: 292767 - DNA, 25 bp, Mus musculus
gagacactgacctggtgtttacagt

SEQ ID NO: 292768 - DNA, 25 bp, Mus musculus
gagacactgaggctttcaggtttcc

SEQ ID NO: 292769 - DNA, 25 bp, Mus musculus
gagacagaaaagaatgcagtcacag

SEQ ID NO: 292770 - DNA, 25 bp, Mus musculus
gagacagaaagctcagaggctgaga

SEQ ID NO: 292771 - DNA, 25 bp, Mus musculus
gagacagaagattgtcacaatgcct

SEQ ID NO: 292772 - DNA, 25 bp, Mus musculus
gagacagaagcaccattgcaagaat

SEQ ID NO: 292773 - DNA, 25 bp, Mus musculus
gagacagagcagacgatttacatgg

SEQ ID NO: 292774 - DNA, 25 bp, Mus musculus
gagacagagcaggtggctgtaggat

SEQ ID NO: 292775 - DNA, 25 bp, Mus musculus
gagacagagcaggtgttttagaaac

SEQ ID NO: 292776 - DNA, 25 bp, Mus musculus
gagacagaggaggagatacttctga

SEQ ID NO: 292777 - DNA, 25 bp, Mus musculus
gagacagaggaggagggaaaaagag

SEQ ID NO: 292778 - DNA, 25 bp, Mus musculus
gagacagaggaggtggtcctggggg

SEQ ID NO: 292779 - DNA, 25 bp, Mus musculus
gagacagaggctgctttgggagaag

SEQ ID NO: 292780 - DNA, 25 bp, Mus musculus
gagacagagtggtgattagaaattc

SEQ ID NO: 292781 - DNA, 25 bp, Mus musculus
gagacagagtttagggaggagcaaa

SEQ ID NO: 292782 - DNA, 25 bp, Mus musculus
gagacagatggaccctcctcatccg

SEQ ID NO: 292783 - DNA, 25 bp, Mus musculus
gagacagattacttcgcaacctggc

SEQ ID NO: 292784 - DNA, 25 bp, Mus musculus
gagacagcaaagcgcaggctatgaa

SEQ ID NO: 292785 - DNA, 25 bp, Mus musculus
gagacagcaacaactgtcccaggtc

SEQ ID NO: 292786 - DNA, 25 bp, Mus musculus
gagacagcaacaagcttgtagagga

SEQ ID NO: 292787 - DNA, 25 bp, Mus musculus
gagacagcagccttcccagtccacc

SEQ ID NO: 292788 - DNA, 25 bp, Mus musculus
gagacagcaggattttcgaaaatac

SEQ ID NO: 292789 - DNA, 25 bp, Mus musculus
gagacagcaggcacaccaagatgaa

SEQ ID NO: 292790 - DNA, 25 bp, Mus musculus
gagacagcagggtccaccaacagca

SEQ ID NO: 292791 - DNA, 25 bp, Mus musculus
gagacagcagtcttcccagatttgg

SEQ ID NO: 292792 - DNA, 25 bp, Mus musculus
gagacagccatgatcaactgggacc

SEQ ID NO: 292793 - DNA, 25 bp, Mus musculus
gagacagccatgatcctacagatca

SEQ ID NO: 292794 - DNA, 25 bp, Mus musculus
gagacagcccaaaggatgactcaaa

SEQ ID NO: 292795 - DNA, 25 bp, Mus musculus
gagacagcccaaggatgtcacagtg

SEQ ID NO: 292796 - DNA, 25 bp, Mus musculus
gagacagcctgccccgcgagaaagg

SEQ ID NO: 292797 - DNA, 25 bp, Mus musculus
gagacagcctgccgagggagcggga

SEQ ID NO: 292798 - DNA, 25 bp, Mus musculus
gagacagcgaggtggattaagtttg

SEQ ID NO: 292799 - DNA, 25 bp, Mus musculus
gagacaggaccagcaatggcaagcc

SEQ ID NO: 292800 - DNA, 25 bp, Mus musculus
gagacaggcagtcatttgaagactg

SEQ ID NO: 292801 - DNA, 25 bp, Mus musculus
gagacagggtgctggttggtggcac

SEQ ID NO: 292802 - DNA, 25 bp, Mus musculus
gagacaggtaacagtttcggccgag

SEQ ID NO: 292803 - DNA, 25 bp, Mus musculus
gagacaggtttaggaatcactgggc

SEQ ID NO: 292804 - DNA, 25 bp, Mus musculus
gagacagtctgaggaagcctaacct

SEQ ID NO: 292805 - DNA, 25 bp, Mus musculus
gagacagtctgaggtgtcttcagaa

SEQ ID NO: 292806 - DNA, 25 bp, Mus musculus
gagacatcaagagttctaacgtgct

SEQ ID NO: 292807 - DNA, 25 bp, Mus musculus
gagacatcaaggcagaagacttatt

SEQ ID NO: 292808 - DNA, 25 bp, Mus musculus
gagacatcagaagatggtgaggatt

SEQ ID NO: 292809 - DNA, 25 bp, Mus musculus
gagacatcagaagttttagagcgaa

SEQ ID NO: 292810 - DNA, 25 bp, Mus musculus
gagacatcctaagatcaaacaaata

SEQ ID NO: 292811 - DNA, 25 bp, Mus musculus
gagacatcctaaggtcctcggccca

SEQ ID NO: 292812 - DNA, 25 bp, Mus musculus
gagacatctatctcggtacggacat

SEQ ID NO: 292813 - DNA, 25 bp, Mus musculus
gagacatctatctcgtttttcaaaa

SEQ ID NO: 292814 - DNA, 25 bp, Mus musculus
gagacatgagcagctactccatccg

SEQ ID NO: 292815 - DNA, 25 bp, Mus musculus
gagacatgaggaactcagccacctt

SEQ ID NO: 292816 - DNA, 25 bp, Mus musculus
gagacatgaggatgcagagagaaat

SEQ ID NO: 292817 - DNA, 25 bp, Mus musculus
gagacatgagggctcatccgctctc

SEQ ID NO: 292818 - DNA, 25 bp, Mus musculus
gagacatgagtctaaggttgtgggt

SEQ ID NO: 292819 - DNA, 25 bp, Mus musculus
gagacatgcactccaccacgcagct

SEQ ID NO: 292820 - DNA, 25 bp, Mus musculus
gagacatgcactccgcttacaagca

SEQ ID NO: 292821 - DNA, 25 bp, Mus musculus
gagacatggatctggtgtgagtgtt

SEQ ID NO: 292822 - DNA, 25 bp, Mus musculus
gagacattaaagggtatagtgccaa

SEQ ID NO: 292823 - DNA, 25 bp, Mus musculus
gagacattctgaagatactaagcaa

SEQ ID NO: 292824 - DNA, 25 bp, Mus musculus
gagacattctgaagatgtgggcaca

SEQ ID NO: 292825 - DNA, 25 bp, Mus musculus
gagacattctgaaggatttgacgtt

SEQ ID NO: 292826 - DNA, 25 bp, Mus musculus
gagacattgaaggagttaaagacca

SEQ ID NO: 292827 - DNA, 25 bp, Mus musculus
gagacattgcaccagatcacagaac

SEQ ID NO: 292828 - DNA, 25 bp, Mus musculus
gagacattgctacagctgcacagag

SEQ ID NO: 292829 - DNA, 25 bp, Mus musculus
gagacatttcaagaagacagcatcc

SEQ ID NO: 292830 - DNA, 25 bp, Mus musculus
gagacatttcaagctcttagccccc

SEQ ID NO: 292831 - DNA, 25 bp, Mus musculus
gagacatttccctgatagattgcta

SEQ ID NO: 292832 - DNA, 25 bp, Mus musculus
gagaccaaactggatcccactgacc

SEQ ID NO: 292833 - DNA, 25 bp, Mus musculus
gagaccaaatgggaggtgtgtcaga

SEQ ID NO: 292834 - DNA, 25 bp, Mus musculus
gagaccaacaaatagctgtatgaaa

SEQ ID NO: 292835 - DNA, 25 bp, Mus musculus
gagaccaacaaatgacaccgtacat

SEQ ID NO: 292836 - DNA, 25 bp, Mus musculus
gagaccaacagacctgatagcaaga

SEQ ID NO: 292837 - DNA, 25 bp, Mus musculus
gagaccaacagcaagaactggcagt

SEQ ID NO: 292838 - DNA, 25 bp, Mus musculus
gagaccaagacccacatctggcaag

SEQ ID NO: 292839 - DNA, 25 bp, Mus musculus
gagaccaaggaacagatcctgaagc

SEQ ID NO: 292840 - DNA, 25 bp, Mus musculus
gagaccaaggtgacaggaccctttg

SEQ ID NO: 292841 - DNA, 25 bp, Mus musculus
gagaccacaagccggtgttcctggc

SEQ ID NO: 292842 - DNA, 25 bp, Mus musculus
gagaccacagatgccaattcatcag

SEQ ID NO: 292843 - DNA, 25 bp, Mus musculus
gagaccacgcagaggaaagatggtc

SEQ ID NO: 292844 - DNA, 25 bp, Mus musculus
gagaccacgcagagggaaggtgtga

SEQ ID NO: 292845 - DNA, 25 bp, Mus musculus
gagaccactgtgaggatatcaatga

SEQ ID NO: 292846 - DNA, 25 bp, Mus musculus
gagaccacttgccatgcataatctt

SEQ ID NO: 292847 - DNA, 25 bp, Mus musculus
gagaccagaagattcgtaagacaga

SEQ ID NO: 292848 - DNA, 25 bp, Mus musculus
gagaccagaatcagaacattgtcct

SEQ ID NO: 292849 - DNA, 25 bp, Mus musculus
gagaccagaatcagagctgatcata

SEQ ID NO: 292850 - DNA, 25 bp, Mus musculus
gagaccagacgtctccaccagctga

SEQ ID NO: 292851 - DNA, 25 bp, Mus musculus
gagaccagactgaggctgtgtttca

SEQ ID NO: 292852 - DNA, 25 bp, Mus musculus
gagaccagcaaaaaatgctatcaga

SEQ ID NO: 292853 - DNA, 25 bp, Mus musculus
gagaccagcaaagccaaacccatgc

SEQ ID NO: 292854 - DNA, 25 bp, Mus musculus
gagaccagcagcccagagtatgttc

SEQ ID NO: 292855 - DNA, 25 bp, Mus musculus
gagaccaggtaagacccctgggcct

SEQ ID NO: 292856 - DNA, 25 bp, Mus musculus
gagaccataggacaaggatgagagc

SEQ ID NO: 292857 - DNA, 25 bp, Mus musculus
gagaccatcctagtcatgggagact

SEQ ID NO: 292858 - DNA, 25 bp, Mus musculus
gagaccatcggcaaggttcagaaga

SEQ ID NO: 292859 - DNA, 25 bp, Mus musculus
gagaccatctctagatctccattcg

SEQ ID NO: 292860 - DNA, 25 bp, Mus musculus
gagaccatgaccaaggatgaacagc

SEQ ID NO: 292861 - DNA, 25 bp, Mus musculus
gagaccattacagaagctgaaccgg

SEQ ID NO: 292862 - DNA, 25 bp, Mus musculus
gagaccattgacaaagccaactttg

SEQ ID NO: 292863 - DNA, 25 bp, Mus musculus
gagacccaaaagcagaatacagaca

SEQ ID NO: 292864 - DNA, 25 bp, Mus musculus
gagacccaaaagtttgaggatagcc

SEQ ID NO: 292865 - DNA, 25 bp, Mus musculus
gagacccaactgtcgacgcataatt

SEQ ID NO: 292866 - DNA, 25 bp, Mus musculus
gagacccaagacgatactgtatccg

SEQ ID NO: 292867 - DNA, 25 bp, Mus musculus
gagacccaagctgtcctggaactca

SEQ ID NO: 292868 - DNA, 25 bp, Mus musculus
gagacccacaccacgactactgtga

SEQ ID NO: 292869 - DNA, 25 bp, Mus musculus
gagacccacagtatcagaaattatg

SEQ ID NO: 292870 - DNA, 25 bp, Mus musculus
gagacccacatggaatggacctgtc

SEQ ID NO: 292871 - DNA, 25 bp, Mus musculus
gagacccagaggagaaggaggagca

SEQ ID NO: 292872 - DNA, 25 bp, Mus musculus
gagacccagaggagattgagaagga

SEQ ID NO: 292873 - DNA, 25 bp, Mus musculus
gagacccaggagggtgtctccaaac

SEQ ID NO: 292874 - DNA, 25 bp, Mus musculus
gagacccaggctaggttatcaatgc

SEQ ID NO: 292875 - DNA, 25 bp, Mus musculus
gagacccatcagaagtcctaggtac

SEQ ID NO: 292876 - DNA, 25 bp, Mus musculus
gagacccattgtgccccaattcctg

SEQ ID NO: 292877 - DNA, 25 bp, Mus musculus
gagaccccaagagaagggagtggat

SEQ ID NO: 292878 - DNA, 25 bp, Mus musculus
gagaccccaagagagacaacaatcc

SEQ ID NO: 292879 - DNA, 25 bp, Mus musculus
gagaccccagcaaaggctaattctg

SEQ ID NO: 292880 - DNA, 25 bp, Mus musculus
gagaccccagcaccacatctgccac

SEQ ID NO: 292881 - DNA, 25 bp, Mus musculus
gagaccccagtggtctctctggact

SEQ ID NO: 292882 - DNA, 25 bp, Mus musculus
gagaccccgctcaggccccgcgatc

SEQ ID NO: 292883 - DNA, 25 bp, Mus musculus
gagaccccgctcaggtttccaggct

SEQ ID NO: 292884 - DNA, 25 bp, Mus musculus
gagaccccgggcaggtttagacacg

SEQ ID NO: 292885 - DNA, 25 bp, Mus musculus
gagacccctttaggtgttccgaatg

SEQ ID NO: 292886 - DNA, 25 bp, Mus musculus
gagacccgggaccgggagctgctgc

SEQ ID NO: 292887 - DNA, 25 bp, Mus musculus
gagaccctacatggcttccttccca

SEQ ID NO: 292888 - DNA, 25 bp, Mus musculus
gagaccctacatgtacccctcaatg

SEQ ID NO: 292889 - DNA, 25 bp, Mus musculus
gagaccctctgtgggtgaacgtggg

SEQ ID NO: 292890 - DNA, 25 bp, Mus musculus
gagaccctgaagagagcagataaga

SEQ ID NO: 292891 - DNA, 25 bp, Mus musculus
gagaccctgaagagatgccacctcg

SEQ ID NO: 292892 - DNA, 25 bp, Mus musculus
gagaccctgaattaccggtattgta

SEQ ID NO: 292893 - DNA, 25 bp, Mus musculus
gagaccctgagctggccaaaaggcc

SEQ ID NO: 292894 - DNA, 25 bp, Mus musculus
gagaccctgagctggctctctgaca

SEQ ID NO: 292895 - DNA, 25 bp, Mus musculus
gagaccctgaggaaatggggattaa

SEQ ID NO: 292896 - DNA, 25 bp, Mus musculus
gagaccctgagggagcgcttcagcg

SEQ ID NO: 292897 - DNA, 25 bp, Mus musculus
gagaccctgatccagatctggccgc

SEQ ID NO: 292898 - DNA, 25 bp, Mus musculus
gagaccctggacaacaagaaggggc

SEQ ID NO: 292899 - DNA, 25 bp, Mus musculus
gagaccgaggaggcccagccagcag

SEQ ID NO: 292900 - DNA, 25 bp, Mus musculus
gagaccgaggccaaaactgggtttc

SEQ ID NO: 292901 - DNA, 25 bp, Mus musculus
gagaccgaggccaaagttcaggaca

SEQ ID NO: 292902 - DNA, 25 bp, Mus musculus
gagaccgcaggacgcggaaccatgt

SEQ ID NO: 292903 - DNA, 25 bp, Mus musculus
gagaccgccgccaaggctgaagctg

SEQ ID NO: 292904 - DNA, 25 bp, Mus musculus
gagaccgcctgcaggtgatttccga

SEQ ID NO: 292905 - DNA, 25 bp, Mus musculus
gagaccgctgataagaaaaccactg

SEQ ID NO: 292906 - DNA, 25 bp, Mus musculus
gagaccggatcagctccccatatat

SEQ ID NO: 292907 - DNA, 25 bp, Mus musculus
gagaccggcggcaagtacattgcct

SEQ ID NO: 292908 - DNA, 25 bp, Mus musculus
gagaccgggacagagcgcctcctca

SEQ ID NO: 292909 - DNA, 25 bp, Mus musculus
gagaccgtcctcagctggcagctgt

SEQ ID NO: 292910 - DNA, 25 bp, Mus musculus
gagaccgtgaaaggagcaatagagc

SEQ ID NO: 292911 - DNA, 25 bp, Mus musculus
gagaccgtgaaaggagtcgctttcc

SEQ ID NO: 292912 - DNA, 25 bp, Mus musculus
gagaccgtgcgcgctccccaggcta

SEQ ID NO: 292913 - DNA, 25 bp, Mus musculus
gagaccgttgtagagtgtgtaatgc

SEQ ID NO: 292914 - DNA, 25 bp, Mus musculus
gagacctaagaagagatccagagtt

SEQ ID NO: 292915 - DNA, 25 bp, Mus musculus
gagacctacgacttcctcttcaaat

SEQ ID NO: 292916 - DNA, 25 bp, Mus musculus
gagacctagaacaatagaaagcagt

SEQ ID NO: 292917 - DNA, 25 bp, Mus musculus
gagacctccacagggacaactccca

SEQ ID NO: 292918 - DNA, 25 bp, Mus musculus
gagacctccgaaaggcccgacgact

SEQ ID NO: 292919 - DNA, 25 bp, Mus musculus
gagacctccggaaatttgtgagaat

SEQ ID NO: 292920 - DNA, 25 bp, Mus musculus
gagacctctgagagatggatttata

SEQ ID NO: 292921 - DNA, 25 bp, Mus musculus
gagacctctgagagctcccaggagg

SEQ ID NO: 292922 - DNA, 25 bp, Mus musculus
gagacctgcgacaacaacgggacct

SEQ ID NO: 292923 - DNA, 25 bp, Mus musculus
gagacctgcgtggagctcaggcctg

SEQ ID NO: 292924 - DNA, 25 bp, Mus musculus
gagacctgcgtggagtgttcagcca

SEQ ID NO: 292925 - DNA, 25 bp, Mus musculus
gagacctggaggatccccaggacgc

SEQ ID NO: 292926 - DNA, 25 bp, Mus musculus
gagacctggtgggtgtgaacaaaga

SEQ ID NO: 292927 - DNA, 25 bp, Mus musculus
gagacctgtatagcagaacatcatg

SEQ ID NO: 292928 - DNA, 25 bp, Mus musculus
gagacctgtcaatggactatctcat

SEQ ID NO: 292929 - DNA, 25 bp, Mus musculus
gagacctgtcaatggtacggatgaa

SEQ ID NO: 292930 - DNA, 25 bp, Mus musculus
gagacctgtggggtttggtggtgac

SEQ ID NO: 292931 - DNA, 25 bp, Mus musculus
gagacctgtgtggagtgttcagcaa

SEQ ID NO: 292932 - DNA, 25 bp, Mus musculus
gagaccttaacaggtgaagatggtt

SEQ ID NO: 292933 - DNA, 25 bp, Mus musculus
gagaccttataggagtaaagatggg

SEQ ID NO: 292934 - DNA, 25 bp, Mus musculus
gagaccttcaaaaagtcaaggtgat

SEQ ID NO: 292935 - DNA, 25 bp, Mus musculus
gagaccttcaccttccagagaagga

SEQ ID NO: 292936 - DNA, 25 bp, Mus musculus
gagaccttccaggaacttccattac

SEQ ID NO: 292937 - DNA, 25 bp, Mus musculus
gagaccttccaggtggaggattttt

SEQ ID NO: 292938 - DNA, 25 bp, Mus musculus
gagaccttgagacagatgggagctt

SEQ ID NO: 292939 - DNA, 25 bp, Mus musculus
gagacctttacgacagtgtgaactg

SEQ ID NO: 292940 - DNA, 25 bp, Mus musculus
gagacgaaacagcttggattctgaa

SEQ ID NO: 292941 - DNA, 25 bp, Mus musculus
gagacgaaagacaatgcagggtgag

SEQ ID NO: 292942 - DNA, 25 bp, Mus musculus
gagacgaaagcagcttttaatatat

SEQ ID NO: 292943 - DNA, 25 bp, Mus musculus
gagacgaaagctccggtctgatatc

SEQ ID NO: 292944 - DNA, 25 bp, Mus musculus
gagacgaaggcctggagcccagccc

SEQ ID NO: 292945 - DNA, 25 bp, Mus musculus
gagacgaagggcagaggtgaccaga

SEQ ID NO: 292946 - DNA, 25 bp, Mus musculus
gagacgacaccaaggagtcagtccg

SEQ ID NO: 292947 - DNA, 25 bp, Mus musculus
gagacgacagccaggtccccctgga

SEQ ID NO: 292948 - DNA, 25 bp, Mus musculus
gagacgaccctcaagtgccctgtga

SEQ ID NO: 292949 - DNA, 25 bp, Mus musculus
gagacgacgaagcaaacctttgacc

SEQ ID NO: 292950 - DNA, 25 bp, Mus musculus
gagacgacgaagcactggggaagag

SEQ ID NO: 292951 - DNA, 25 bp, Mus musculus
gagacgacgaagtcgttctccccgc

SEQ ID NO: 292952 - DNA, 25 bp, Mus musculus
gagacgactgccagtctccctatga

SEQ ID NO: 292953 - DNA, 25 bp, Mus musculus
gagacgagagtgatctcagcgccct

SEQ ID NO: 292954 - DNA, 25 bp, Mus musculus
gagacgagctccagatgctctccaa

SEQ ID NO: 292955 - DNA, 25 bp, Mus musculus
gagacgagctccagggtttctcagt

SEQ ID NO: 292956 - DNA, 25 bp, Mus musculus
gagacgagggctcttgtgttaaggc

SEQ ID NO: 292957 - DNA, 25 bp, Mus musculus
gagacgcacaggcatatctgctgtt

SEQ ID NO: 292958 - DNA, 25 bp, Mus musculus
gagacgcagctgaaggtgatcaact

SEQ ID NO: 292959 - DNA, 25 bp, Mus musculus
gagacgcaggccaagttggtggaag

SEQ ID NO: 292960 - DNA, 25 bp, Mus musculus
gagacgcaggctggctcaccatcat

SEQ ID NO: 292961 - DNA, 25 bp, Mus musculus
gagacgccagttctacctccagtgt

SEQ ID NO: 292962 - DNA, 25 bp, Mus musculus
gagacgcctgaacggctccaggact

SEQ ID NO: 292963 - DNA, 25 bp, Mus musculus
gagacgcctgctcggtcagtcagca

SEQ ID NO: 292964 - DNA, 25 bp, Mus musculus
gagacgcctgctcgtgtgtataagc

SEQ ID NO: 292965 - DNA, 25 bp, Mus musculus
gagacgcgcctcgataaggaaaagg

SEQ ID NO: 292966 - DNA, 25 bp, Mus musculus
gagacgctcaaatcatgcactctcc

SEQ ID NO: 292967 - DNA, 25 bp, Mus musculus
gagacgctcaacttgtcccaaaaca

SEQ ID NO: 292968 - DNA, 25 bp, Mus musculus
gagacgctcaaggatgaagaaacac

SEQ ID NO: 292969 - DNA, 25 bp, Mus musculus
gagacgctcaagtcctcctgcatat

SEQ ID NO: 292970 - DNA, 25 bp, Mus musculus
gagacgcttgtccggcctctgtaga

SEQ ID NO: 292971 - DNA, 25 bp, Mus musculus
gagacgcttgtccgggcgggttgag

SEQ ID NO: 292972 - DNA, 25 bp, Mus musculus
gagacggaaaaccagagtccagcct

SEQ ID NO: 292973 - DNA, 25 bp, Mus musculus
gagacggaaaagtgtcattggtctc

SEQ ID NO: 292974 - DNA, 25 bp, Mus musculus
gagacggaggagaaggaactatccc

SEQ ID NO: 292975 - DNA, 25 bp, Mus musculus
gagacggaggagaagtctggacaga

SEQ ID NO: 292976 - DNA, 25 bp, Mus musculus
gagacggattcctcctcaagtacta

SEQ ID NO: 292977 - DNA, 25 bp, Mus musculus
gagacggattcctggtgggtattgt

SEQ ID NO: 292978 - DNA, 25 bp, Mus musculus
gagacggcacccagtaatctttgga

SEQ ID NO: 292979 - DNA, 25 bp, Mus musculus
gagacggccctcgatggggcatcct

SEQ ID NO: 292980 - DNA, 25 bp, Mus musculus
gagacgggaagctgtacagagaggc

SEQ ID NO: 292981 - DNA, 25 bp, Mus musculus
gagacggggcgcgaggtgcagggaa

SEQ ID NO: 292982 - DNA, 25 bp, Mus musculus
gagacggtcaataaggctgtggctc

SEQ ID NO: 292983 - DNA, 25 bp, Mus musculus
gagacggtggtgaccatgaaagata

SEQ ID NO: 292984 - DNA, 25 bp, Mus musculus
gagacggttctacatccctttcagc

SEQ ID NO: 292985 - DNA, 25 bp, Mus musculus
gagacggttctagatccctttcagc

SEQ ID NO: 292986 - DNA, 25 bp, Mus musculus
gagacgtaagatcaacgagagatgg

SEQ ID NO: 292987 - DNA, 25 bp, Mus musculus
gagacgtctgtcagccatcgtctag

SEQ ID NO: 292988 - DNA, 25 bp, Mus musculus
gagacgtgaaagataaagcttttaa

SEQ ID NO: 292989 - DNA, 25 bp, Mus musculus
gagacgtgatggttaagatctccat

SEQ ID NO: 292990 - DNA, 25 bp, Mus musculus
gagacgtggaggtactatgcctgcc

SEQ ID NO: 292991 - DNA, 25 bp, Mus musculus
gagacgtggcgctgtatactccatg

SEQ ID NO: 292992 - DNA, 25 bp, Mus musculus
gagacgtgggactccagtgattttg

SEQ ID NO: 292993 - DNA, 25 bp, Mus musculus
gagacgttgctgaggtattatgatc

SEQ ID NO: 292994 - DNA, 25 bp, Mus musculus
gagacgttgtggaaggctcaaagca

SEQ ID NO: 292995 - DNA, 25 bp, Mus musculus
gagactaaaagatatggagggaaac

SEQ ID NO: 292996 - DNA, 25 bp, Mus musculus
gagactaaaagtgctgaagaggttc

SEQ ID NO: 292997 - DNA, 25 bp, Mus musculus
gagactaaagaaacgtgttcctgga

SEQ ID NO: 292998 - DNA, 25 bp, Mus musculus
gagactaaagtctttaagaaataga

SEQ ID NO: 292999 - DNA, 25 bp, Mus musculus
gagactaaggaacaggtgtggtatc

SEQ ID NO: 293000 - DNA, 25 bp, Mus musculus
gagactacgtggcacgtggatcaga

SEQ ID NO: 293001 - DNA, 25 bp, Mus musculus
gagactacgtggcaggtggatcaga

SEQ ID NO: 293002 - DNA, 25 bp, Mus musculus
gagactagcaatcagaacccaagag

SEQ ID NO: 293003 - DNA, 25 bp, Mus musculus
gagactattacgcaacttgggagga

SEQ ID NO: 293004 - DNA, 25 bp, Mus musculus
gagactcaaactgaagtgagtagtg

SEQ ID NO: 293005 - DNA, 25 bp, Mus musculus
gagactcaagggactttcggtgccg

SEQ ID NO: 293006 - DNA, 25 bp, Mus musculus
gagactcaagggatcctctgaagct

SEQ ID NO: 293007 - DNA, 25 bp, Mus musculus
gagactcaaggtcaacatggccatg

SEQ ID NO: 293008 - DNA, 25 bp, Mus musculus
gagactcaagtttagctgttaacta

SEQ ID NO: 293009 - DNA, 25 bp, Mus musculus
gagactcacaaggtgaaactaatga

SEQ ID NO: 293010 - DNA, 25 bp, Mus musculus
gagactcagcaggtgatgaggaatt

SEQ ID NO: 293011 - DNA, 25 bp, Mus musculus
gagactcagtgatggctgtcacgac

SEQ ID NO: 293012 - DNA, 25 bp, Mus musculus
gagactccaagggctactacatggg

SEQ ID NO: 293013 - DNA, 25 bp, Mus musculus
gagactccagatgaggacgatgtgc

SEQ ID NO: 293014 - DNA, 25 bp, Mus musculus
gagactccaggccacaatggagaat

SEQ ID NO: 293015 - DNA, 25 bp, Mus musculus
gagactccccatcagctgtttctcc

SEQ ID NO: 293016 - DNA, 25 bp, Mus musculus
gagactccccatcaggtttggacat

SEQ ID NO: 293017 - DNA, 25 bp, Mus musculus
gagactccctggaggtttgcctcaa

SEQ ID NO: 293018 - DNA, 25 bp, Mus musculus
gagactcctgccagccattctgtat

SEQ ID NO: 293019 - DNA, 25 bp, Mus musculus
gagactcctgccagggcgattcagg

SEQ ID NO: 293020 - DNA, 25 bp, Mus musculus
gagactctaacaccgcaagccccgc

SEQ ID NO: 293021 - DNA, 25 bp, Mus musculus
gagactctctgtggaccccgttcat

SEQ ID NO: 293022 - DNA, 25 bp, Mus musculus
gagactctgcggcactctgtccagc

SEQ ID NO: 293023 - DNA, 25 bp, Mus musculus
gagactctgtacggcttgtgaaatg

SEQ ID NO: 293024 - DNA, 25 bp, Mus musculus
gagactcttacggaattaattcgag

SEQ ID NO: 293025 - DNA, 25 bp, Mus musculus
gagactcttacggtcttaccacaaa

SEQ ID NO: 293026 - DNA, 25 bp, Mus musculus
gagactcttcccaagctaaagccca

SEQ ID NO: 293027 - DNA, 25 bp, Mus musculus
gagactcttgatgagggtccaccaa

SEQ ID NO: 293028 - DNA, 25 bp, Mus musculus
gagactgaaggaggaagctgaccta

SEQ ID NO: 293029 - DNA, 25 bp, Mus musculus
gagactgaaggagtctccagcctcc

SEQ ID NO: 293030 - DNA, 25 bp, Mus musculus
gagactgaaggccttcggatgccca

SEQ ID NO: 293031 - DNA, 25 bp, Mus musculus
gagactgaaggtgctggggggaccc

SEQ ID NO: 293032 - DNA, 25 bp, Mus musculus
gagactgaccaaggctccagaaatg

SEQ ID NO: 293033 - DNA, 25 bp, Mus musculus
gagactgaccaaggggctgacggga

SEQ ID NO: 293034 - DNA, 25 bp, Mus musculus
gagactgacgcagtctggcttgcca

SEQ ID NO: 293035 - DNA, 25 bp, Mus musculus
gagactgactgtgtgtcccatgggt

SEQ ID NO: 293036 - DNA, 25 bp, Mus musculus
gagactgagaacctgccctgcagtt

SEQ ID NO: 293037 - DNA, 25 bp, Mus musculus
gagactgagagaggaccatgctccc

SEQ ID NO: 293038 - DNA, 25 bp, Mus musculus
gagactgagagccctgagcccggag

SEQ ID NO: 293039 - DNA, 25 bp, Mus musculus
gagactgagaggctatcagggcgtc

SEQ ID NO: 293040 - DNA, 25 bp, Mus musculus
gagactgagatagacaccatcttgc

SEQ ID NO: 293041 - DNA, 25 bp, Mus musculus
gagactgagatagatttcaaatatg

SEQ ID NO: 293042 - DNA, 25 bp, Mus musculus
gagactgaggaagattgacttctaa

SEQ ID NO: 293043 - DNA, 25 bp, Mus musculus
gagactgaggaccacatgggtggca

SEQ ID NO: 293044 - DNA, 25 bp, Mus musculus
gagactgagtacaaggttggaagtc

SEQ ID NO: 293045 - DNA, 25 bp, Mus musculus
gagactgcattgacatagatgaatg

SEQ ID NO: 293046 - DNA, 25 bp, Mus musculus
gagactgcattgtcatagatgaatg

SEQ ID NO: 293047 - DNA, 25 bp, Mus musculus
gagactgccaagactcactctgtgg

SEQ ID NO: 293048 - DNA, 25 bp, Mus musculus
gagactgccaaggaggccgagttag

SEQ ID NO: 293049 - DNA, 25 bp, Mus musculus
gagactgctcctggtgcatggagga

SEQ ID NO: 293050 - DNA, 25 bp, Mus musculus
gagactgctgactcgataccaggaa

SEQ ID NO: 293051 - DNA, 25 bp, Mus musculus
gagactggacagaacgattccggga

SEQ ID NO: 293052 - DNA, 25 bp, Mus musculus
gagactggagcttggtgtctgtctc

SEQ ID NO: 293053 - DNA, 25 bp, Mus musculus
gagactggatggggggtgtgccagc

SEQ ID NO: 293054 - DNA, 25 bp, Mus musculus
gagactggctaagaactgccagtgt

SEQ ID NO: 293055 - DNA, 25 bp, Mus musculus
gagactggctcttggcgacaactgg

SEQ ID NO: 293056 - DNA, 25 bp, Mus musculus
gagactggctgtgcttgccatcaaa

SEQ ID NO: 293057 - DNA, 25 bp, Mus musculus
gagactggcttttcccacagtcaga

SEQ ID NO: 293058 - DNA, 25 bp, Mus musculus
gagactgggcagttggtcatcatgg

SEQ ID NO: 293059 - DNA, 25 bp, Mus musculus
gagactggggccgtcatcatagcca

SEQ ID NO: 293060 - DNA, 25 bp, Mus musculus
gagactgtagcaaggtgtctgatgc

SEQ ID NO: 293061 - DNA, 25 bp, Mus musculus
gagactgtagcaattccttcttgga

SEQ ID NO: 293062 - DNA, 25 bp, Mus musculus
gagactgtcctggaggagagggaag

SEQ ID NO: 293063 - DNA, 25 bp, Mus musculus
gagactgtgagccaaaaagcagggc

SEQ ID NO: 293064 - DNA, 25 bp, Mus musculus
gagactgtgggatagtgtgctggcg

SEQ ID NO: 293065 - DNA, 25 bp, Mus musculus
gagactgtggtgtgtctgcaggata

SEQ ID NO: 293066 - DNA, 25 bp, Mus musculus
gagacttaaaatgaaatggaagggg

SEQ ID NO: 293067 - DNA, 25 bp, Mus musculus
gagacttacagattgccaaaatgct

SEQ ID NO: 293068 - DNA, 25 bp, Mus musculus
gagacttacatcacggagaatgtac

SEQ ID NO: 293069 - DNA, 25 bp, Mus musculus
gagacttcagaatcaagatgtgtac

SEQ ID NO: 293070 - DNA, 25 bp, Mus musculus
gagacttcaggctccaggatgactg

SEQ ID NO: 293071 - DNA, 25 bp, Mus musculus
gagacttcccctcggatgcagatgg

SEQ ID NO: 293072 - DNA, 25 bp, Mus musculus
gagacttccttcagggccactgatg

SEQ ID NO: 293073 - DNA, 25 bp, Mus musculus
gagacttccttcaggtgttagagat

SEQ ID NO: 293074 - DNA, 25 bp, Mus musculus
gagacttctgcattcctctgtgtac

SEQ ID NO: 293075 - DNA, 25 bp, Mus musculus
gagacttctgcattcgctgtgacag

SEQ ID NO: 293076 - DNA, 25 bp, Mus musculus
gagacttcttcacggcatggatgat

SEQ ID NO: 293077 - DNA, 25 bp, Mus musculus
gagacttgacaaggtggtgacagtg

SEQ ID NO: 293078 - DNA, 25 bp, Mus musculus
gagacttgacaatagctctggtgca

SEQ ID NO: 293079 - DNA, 25 bp, Mus musculus
gagacttgcaaaaggtgctggatca

SEQ ID NO: 293080 - DNA, 25 bp, Mus musculus
gagacttgccagggaaaatcatagt

SEQ ID NO: 293081 - DNA, 25 bp, Mus musculus
gagacttggagacccagacccagct

SEQ ID NO: 293082 - DNA, 25 bp, Mus musculus
gagacttggagctgaccacagtggc

SEQ ID NO: 293083 - DNA, 25 bp, Mus musculus
gagacttggctcctactttctgcac

SEQ ID NO: 293084 - DNA, 25 bp, Mus musculus
gagacttggctcctgcctgaggagc

SEQ ID NO: 293085 - DNA, 25 bp, Mus musculus
gagacttgggagggggggcctgctg

SEQ ID NO: 293086 - DNA, 25 bp, Mus musculus
gagacttgtattccctgtgagtgtg

SEQ ID NO: 293087 - DNA, 25 bp, Mus musculus
gagactttcaggctgtggaccttga

SEQ ID NO: 293088 - DNA, 25 bp, Mus musculus
gagactttcaggttccagctgtgga

SEQ ID NO: 293089 - DNA, 25 bp, Mus musculus
gagactttccaagaaagtcactgta

SEQ ID NO: 293090 - DNA, 25 bp, Mus musculus
gagactttccaaggtggaacttgca

SEQ ID NO: 293091 - DNA, 25 bp, Mus musculus
gagactttgctggatgcttttgtta

SEQ ID NO: 293092 - DNA, 25 bp, Mus musculus
gagactttgtggctgagttcctgtt

SEQ ID NO: 293093 - DNA, 25 bp, Mus musculus
gagactttgtgggcctgctgtccct

SEQ ID NO: 293094 - DNA, 25 bp, Mus musculus
gagacttttaggccatctcttggcg

SEQ ID NO: 293095 - DNA, 25 bp, Mus musculus
gagacttttagggccaaagatctca

SEQ ID NO: 293096 - DNA, 25 bp, Mus musculus
gagagaaaaaatcaaccactcagat

SEQ ID NO: 293097 - DNA, 25 bp, Mus musculus
gagagaaaaaatcaatccaggaaca

SEQ ID NO: 293098 - DNA, 25 bp, Mus musculus
gagagaaaagaaaaaacaagaaggg

SEQ ID NO: 293099 - DNA, 25 bp, Mus musculus
gagagaaaagattaatacacaaaat

SEQ ID NO: 293100 - DNA, 25 bp, Mus musculus
gagagaaaagccttaccaatagttc

SEQ ID NO: 293101 - DNA, 25 bp, Mus musculus
gagagaaaagggagctgtgattggt

SEQ ID NO: 293102 - DNA, 25 bp, Mus musculus
gagagaaaagtcaagaagaacaaac

SEQ ID NO: 293103 - DNA, 25 bp, Mus musculus
gagagaaaagtcaaggtgtactttg

SEQ ID NO: 293104 - DNA, 25 bp, Mus musculus
gagagaaaccaggcagaagaagtta

SEQ ID NO: 293105 - DNA, 25 bp, Mus musculus
gagagaaagacaattgcgccgcaga

SEQ ID NO: 293106 - DNA, 25 bp, Mus musculus
gagagaaagacaattttgggtgttt

SEQ ID NO: 293107 - DNA, 25 bp, Mus musculus
gagagaaagattaaggagctatcga

SEQ ID NO: 293108 - DNA, 25 bp, Mus musculus
gagagaaagtgatgtatcgcctgag

SEQ ID NO: 293109 - DNA, 25 bp, Mus musculus
gagagaaagtttgctcttcaaaaaa

SEQ ID NO: 293110 - DNA, 25 bp, Mus musculus
gagagaaataatgaagcattggatg

SEQ ID NO: 293111 - DNA, 25 bp, Mus musculus
gagagaaattgagtattttatcatc

SEQ ID NO: 293112 - DNA, 25 bp, Mus musculus
gagagaacaacgtttccctcagtac

SEQ ID NO: 293113 - DNA, 25 bp, Mus musculus
gagagaacactgtgatctgctcttc

SEQ ID NO: 293114 - DNA, 25 bp, Mus musculus
gagagaacactgttttcatgaacca

SEQ ID NO: 293115 - DNA, 25 bp, Mus musculus
gagagaacatgaacaaaaagtttcc

SEQ ID NO: 293116 - DNA, 25 bp, Mus musculus
gagagaacgagccggtccgtgttca

SEQ ID NO: 293117 - DNA, 25 bp, Mus musculus
gagagaactcagaacatacaacatc

SEQ ID NO: 293118 - DNA, 25 bp, Mus musculus
gagagaactcagagcacccctggct

SEQ ID NO: 293119 - DNA, 25 bp, Mus musculus
gagagaactcagcagagcacccgac

SEQ ID NO: 293120 - DNA, 25 bp, Mus musculus
gagagaactcagctcatggcagctc

SEQ ID NO: 293121 - DNA, 25 bp, Mus musculus
gagagaactcaggccaggaacaagt

SEQ ID NO: 293122 - DNA, 25 bp, Mus musculus
gagagaacttacctaaagacgtcaa

SEQ ID NO: 293123 - DNA, 25 bp, Mus musculus
gagagaacttggagatctcattccg

SEQ ID NO: 293124 - DNA, 25 bp, Mus musculus
gagagaagaacagtgtttagtgtaa

SEQ ID NO: 293125 - DNA, 25 bp, Mus musculus
gagagaagaggacggctgctgctga

SEQ ID NO: 293126 - DNA, 25 bp, Mus musculus
gagagaagatatgtagtcagaagat

SEQ ID NO: 293127 - DNA, 25 bp, Mus musculus
gagagaagcaggaggatcatgcggc

SEQ ID NO: 293128 - DNA, 25 bp, Mus musculus
gagagaagccggcctctggtgctct

SEQ ID NO: 293129 - DNA, 25 bp, Mus musculus
gagagaagccggttatacaatggtc

SEQ ID NO: 293130 - DNA, 25 bp, Mus musculus
gagagaagctgctgggccctaatgc

SEQ ID NO: 293131 - DNA, 25 bp, Mus musculus
gagagaaggcagattctcattgcca

SEQ ID NO: 293132 - DNA, 25 bp, Mus musculus
gagagaagggaggtgtgaactgaac

SEQ ID NO: 293133 - DNA, 25 bp, Mus musculus
gagagaatatcagctgcaagaaaaa

SEQ ID NO: 293134 - DNA, 25 bp, Mus musculus
gagagaatcctgcgttttctggaag

SEQ ID NO: 293135 - DNA, 25 bp, Mus musculus
gagagaatgcacaggtcctgtggct

SEQ ID NO: 293136 - DNA, 25 bp, Mus musculus
gagagaatggctgataatgcctgcg

SEQ ID NO: 293137 - DNA, 25 bp, Mus musculus
gagagaatgggttcaatgtatctat

SEQ ID NO: 293138 - DNA, 25 bp, Mus musculus
gagagaattaaggcaccaaggagag

SEQ ID NO: 293139 - DNA, 25 bp, Mus musculus
gagagaattggaaaatgactccctc

SEQ ID NO: 293140 - DNA, 25 bp, Mus musculus
gagagacaaggcaagaaatacagcc

SEQ ID NO: 293141 - DNA, 25 bp, Mus musculus
gagagacaaggggatgacaatttta

SEQ ID NO: 293142 - DNA, 25 bp, Mus musculus
gagagacaattgggttcatagtggc

SEQ ID NO: 293143 - DNA, 25 bp, Mus musculus
gagagacacagtgccctctcccctt

SEQ ID NO: 293144 - DNA, 25 bp, Mus musculus
gagagacagaagattgtcacaatgc

SEQ ID NO: 293145 - DNA, 25 bp, Mus musculus
gagagacagcagccttcccagtcca

SEQ ID NO: 293146 - DNA, 25 bp, Mus musculus
gagagacagcagggtccaccaacag

SEQ ID NO: 293147 - DNA, 25 bp, Mus musculus
gagagacagcagtcttcccagattt

SEQ ID NO: 293148 - DNA, 25 bp, Mus musculus
gagagacattgaaggagttaaagac

SEQ ID NO: 293149 - DNA, 25 bp, Mus musculus
gagagaccagaagattcgtaagaca

SEQ ID NO: 293150 - DNA, 25 bp, Mus musculus
gagagaccagcaaagccaaacccat

SEQ ID NO: 293151 - DNA, 25 bp, Mus musculus
gagagacccaaaagcagaatacaga

SEQ ID NO: 293152 - DNA, 25 bp, Mus musculus
gagagacccaaaagtttgaggatag

SEQ ID NO: 293153 - DNA, 25 bp, Mus musculus
gagagacccaggcactccagaaaac

SEQ ID NO: 293154 - DNA, 25 bp, Mus musculus
gagagaccgtgaaaggagcaataga

SEQ ID NO: 293155 - DNA, 25 bp, Mus musculus
gagagaccgtgaaaggagtcgcttt

SEQ ID NO: 293156 - DNA, 25 bp, Mus musculus
gagagaccttaacaggtgaagatgg

SEQ ID NO: 293157 - DNA, 25 bp, Mus musculus
gagagacgcaggtcatacctcactc

SEQ ID NO: 293158 - DNA, 25 bp, Mus musculus
gagagactattacgcaacttgggag

SEQ ID NO: 293159 - DNA, 25 bp, Mus musculus
gagagactcaagggactttcggtgc

SEQ ID NO: 293160 - DNA, 25 bp, Mus musculus
gagagactgacctagtctggcttgc

SEQ ID NO: 293161 - DNA, 25 bp, Mus musculus
gagagactgacgcagtctggcttgc

SEQ ID NO: 293162 - DNA, 25 bp, Mus musculus
gagagactgctgactcgataccagg

SEQ ID NO: 293163 - DNA, 25 bp, Mus musculus
gagagacttaaaatgaaatggaagg

SEQ ID NO: 293164 - DNA, 25 bp, Mus musculus
gagagacttgccagggaaaatcata

SEQ ID NO: 293165 - DNA, 25 bp, Mus musculus
gagagactttgtggctgagttcctg

SEQ ID NO: 293166 - DNA, 25 bp, Mus musculus
gagagactttgtgggcctgctgtcc

SEQ ID NO: 293167 - DNA, 25 bp, Mus musculus
gagagagaaaaaatcaaccactcag

SEQ ID NO: 293168 - DNA, 25 bp, Mus musculus
gagagagaaaaaatcaatccaggaa

SEQ ID NO: 293169 - DNA, 25 bp, Mus musculus
gagagagaaaccaggcagaagaagt

SEQ ID NO: 293170 - DNA, 25 bp, Mus musculus
gagagagaaggaaccaacacaagac

SEQ ID NO: 293171 - DNA, 25 bp, Mus musculus
gagagagagaagagagagagaggga

SEQ ID NO: 293172 - DNA, 25 bp, Mus musculus
gagagagagagaacaggcagttttg

SEQ ID NO: 293173 - DNA, 25 bp, Mus musculus
gagagagagagaagagagagagagg

SEQ ID NO: 293174 - DNA, 25 bp, Mus musculus
gagagagagagagaacaggcagttt

SEQ ID NO: 293175 - DNA, 25 bp, Mus musculus
gagagagagagagagaacaggcagt

SEQ ID NO: 293176 - DNA, 25 bp, Mus musculus
gagagagatacgctccttgctcgga

SEQ ID NO: 293177 - DNA, 25 bp, Mus musculus
gagagagcaagaaggagcagagagt

SEQ ID NO: 293178 - DNA, 25 bp, Mus musculus
gagagagcaaggttgtagttccccc

SEQ ID NO: 293179 - DNA, 25 bp, Mus musculus
gagagagccaagagcgccttgctgg

SEQ ID NO: 293180 - DNA, 25 bp, Mus musculus
gagagagccatcattgacatgtaca

SEQ ID NO: 293181 - DNA, 25 bp, Mus musculus
gagagagccgaagccgaaagcggta

SEQ ID NO: 293182 - DNA, 25 bp, Mus musculus
gagagagccgaatattaattaaccc

SEQ ID NO: 293183 - DNA, 25 bp, Mus musculus
gagagagcgagagttactacctgga

SEQ ID NO: 293184 - DNA, 25 bp, Mus musculus
gagagagcgaggttgcacataggca

SEQ ID NO: 293185 - DNA, 25 bp, Mus musculus
gagagagctcagtggccctgctctt

SEQ ID NO: 293186 - DNA, 25 bp, Mus musculus
gagagagctgcaagcaggggtagag

SEQ ID NO: 293187 - DNA, 25 bp, Mus musculus
gagagaggaaaaggcatttatatgt

SEQ ID NO: 293188 - DNA, 25 bp, Mus musculus
gagagaggaaaagggctcggatggc

SEQ ID NO: 293189 - DNA, 25 bp, Mus musculus
gagagaggaagaactacagagaact

SEQ ID NO: 293190 - DNA, 25 bp, Mus musculus
gagagaggaagacaggagtctgcgg

SEQ ID NO: 293191 - DNA, 25 bp, Mus musculus
gagagaggagaaagaacgtttgctg

SEQ ID NO: 293192 - DNA, 25 bp, Mus musculus
gagagaggagagagagagagagaga

SEQ ID NO: 293193 - DNA, 25 bp, Mus musculus
gagagaggaggacagttactaccag

SEQ ID NO: 293194 - DNA, 25 bp, Mus musculus
gagagaggagggagatggtgtttcc

SEQ ID NO: 293195 - DNA, 25 bp, Mus musculus
gagagaggcagatgtgagcccacct

SEQ ID NO: 293196 - DNA, 25 bp, Mus musculus
gagagaggctttgagtcgctgggtt

SEQ ID NO: 293197 - DNA, 25 bp, Mus musculus
gagagagtcccgaaggggacagctt

SEQ ID NO: 293198 - DNA, 25 bp, Mus musculus
gagagagtcctcagaatggcaatgt

SEQ ID NO: 293199 - DNA, 25 bp, Mus musculus
gagagagtcctcaggcacctccaag

SEQ ID NO: 293200 - DNA, 25 bp, Mus musculus
gagagagtgatccagtctgttgtct

SEQ ID NO: 293201 - DNA, 25 bp, Mus musculus
gagagagtgctgttctctgcagctt

SEQ ID NO: 293202 - DNA, 25 bp, Mus musculus
gagagagttggaaggaaggcttgca

SEQ ID NO: 293203 - DNA, 25 bp, Mus musculus
gagagagttggaagggagctagctc

SEQ ID NO: 293204 - DNA, 25 bp, Mus musculus
gagagataaacccagctccctacac

SEQ ID NO: 293205 - DNA, 25 bp, Mus musculus
gagagataaattgattgagtctgtt

SEQ ID NO: 293206 - DNA, 25 bp, Mus musculus
gagagataagaaggttgtgacaaag

SEQ ID NO: 293207 - DNA, 25 bp, Mus musculus
gagagataaggcacctccaagtgga

SEQ ID NO: 293208 - DNA, 25 bp, Mus musculus
gagagataagtatgggagtgaagga

SEQ ID NO: 293209 - DNA, 25 bp, Mus musculus
gagagataagtatgggtggtactgc

SEQ ID NO: 293210 - DNA, 25 bp, Mus musculus
gagagatacagaatgaatgaagaaa

SEQ ID NO: 293211 - DNA, 25 bp, Mus musculus
gagagatacagagcactggtgaagt

SEQ ID NO: 293212 - DNA, 25 bp, Mus musculus
gagagatacgaaagggcgagaggtt

SEQ ID NO: 293213 - DNA, 25 bp, Mus musculus
gagagatacgctccttgctcggatt

SEQ ID NO: 293214 - DNA, 25 bp, Mus musculus
gagagatcagaagtaacaggagaaa

SEQ ID NO: 293215 - DNA, 25 bp, Mus musculus
gagagatcagtgttgaagatgaagc

SEQ ID NO: 293216 - DNA, 25 bp, Mus musculus
gagagatcccaagttctttcagatt

SEQ ID NO: 293217 - DNA, 25 bp, Mus musculus
gagagatcccagcatatcaatgagt

SEQ ID NO: 293218 - DNA, 25 bp, Mus musculus
gagagatcccaggatatcaatgagt

SEQ ID NO: 293219 - DNA, 25 bp, Mus musculus
gagagatcctttcggctgtcggcga

SEQ ID NO: 293220 - DNA, 25 bp, Mus musculus
gagagatctgaagcagataaagaaa

SEQ ID NO: 293221 - DNA, 25 bp, Mus musculus
gagagatgaaggatgatgaggaatt

SEQ ID NO: 293222 - DNA, 25 bp, Mus musculus
gagagatgagcaagttctatagtcc

SEQ ID NO: 293223 - DNA, 25 bp, Mus musculus
gagagatgataaggagagaccccct

SEQ ID NO: 293224 - DNA, 25 bp, Mus musculus
gagagatgataaggtccagagttca

SEQ ID NO: 293225 - DNA, 25 bp, Mus musculus
gagagatgcaagctgataggagcat

SEQ ID NO: 293226 - DNA, 25 bp, Mus musculus
gagagatgcaggtaacccctctaaa

SEQ ID NO: 293227 - DNA, 25 bp, Mus musculus
gagagatgcagtatgacttctcctt

SEQ ID NO: 293228 - DNA, 25 bp, Mus musculus
gagagatggcagtggagcaaataag

SEQ ID NO: 293229 - DNA, 25 bp, Mus musculus
gagagatgttagaagatggctccga

SEQ ID NO: 293230 - DNA, 25 bp, Mus musculus
gagagattagaagaaaaccacgagc

SEQ ID NO: 293231 - DNA, 25 bp, Mus musculus
gagagattaggttccaaggagcagg

SEQ ID NO: 293232 - DNA, 25 bp, Mus musculus
gagagattcttcaggtctatggaaa

SEQ ID NO: 293233 - DNA, 25 bp, Mus musculus
gagagattgttcagcaggtcagggt

SEQ ID NO: 293234 - DNA, 25 bp, Mus musculus
gagagattttatacaagctgtactt

SEQ ID NO: 293235 - DNA, 25 bp, Mus musculus
gagagattttatgagaggctgtaag

SEQ ID NO: 293236 - DNA, 25 bp, Mus musculus
gagagcaaaaagaacatgtttggga

SEQ ID NO: 293237 - DNA, 25 bp, Mus musculus
gagagcaaaaagaatcgggttgaga

SEQ ID NO: 293238 - DNA, 25 bp, Mus musculus
gagagcaaaaagtttcgtgaacaga

SEQ ID NO: 293239 - DNA, 25 bp, Mus musculus
gagagcaaaacagaggcccagagtt

SEQ ID NO: 293240 - DNA, 25 bp, Mus musculus
gagagcaaaaccaaggactctgctt

SEQ ID NO: 293241 - DNA, 25 bp, Mus musculus
gagagcaaaaccaaggagcgcttct

SEQ ID NO: 293242 - DNA, 25 bp, Mus musculus
gagagcaaaaccaagttcttgacat

SEQ ID NO: 293243 - DNA, 25 bp, Mus musculus
gagagcaaagaaccccagctgaaag

SEQ ID NO: 293244 - DNA, 25 bp, Mus musculus
gagagcaaagctgtcattctgtgct

SEQ ID NO: 293245 - DNA, 25 bp, Mus musculus
gagagcaaaggtgtcattctgtgct

SEQ ID NO: 293246 - DNA, 25 bp, Mus musculus
gagagcaacaggagcaccaggcaag

SEQ ID NO: 293247 - DNA, 25 bp, Mus musculus
gagagcaagaggatattatcaggag

SEQ ID NO: 293248 - DNA, 25 bp, Mus musculus
gagagcaagagggtttgttccttac

SEQ ID NO: 293249 - DNA, 25 bp, Mus musculus
gagagcaagcacgtggttgaagact

SEQ ID NO: 293250 - DNA, 25 bp, Mus musculus
gagagcaaggacgaagaggatgacg

SEQ ID NO: 293251 - DNA, 25 bp, Mus musculus
gagagcaaggaggagtgttgagtgg

SEQ ID NO: 293252 - DNA, 25 bp, Mus musculus
gagagcaaggatttatatgaatact

SEQ ID NO: 293253 - DNA, 25 bp, Mus musculus
gagagcaaggcaaagtttgaaactg

SEQ ID NO: 293254 - DNA, 25 bp, Mus musculus
gagagcaaggcgagagggtatccca

SEQ ID NO: 293255 - DNA, 25 bp, Mus musculus
gagagcaaggtcgaagaggatgacg

SEQ ID NO: 293256 - DNA, 25 bp, Mus musculus
gagagcacagcgttgaatctgcgtg

SEQ ID NO: 293257 - DNA, 25 bp, Mus musculus
gagagcacaggattcagtaacctac

SEQ ID NO: 293258 - DNA, 25 bp, Mus musculus
gagagcaccccgatcccagagagct

SEQ ID NO: 293259 - DNA, 25 bp, Mus musculus
gagagcacgcgaggagcatgtcatg

SEQ ID NO: 293260 - DNA, 25 bp, Mus musculus
gagagcacggaccgaaagtgagaag

SEQ ID NO: 293261 - DNA, 25 bp, Mus musculus
gagagcacggactagaagtgagaag

SEQ ID NO: 293262 - DNA, 25 bp, Mus musculus
gagagcactacccaggaaaatggca

SEQ ID NO: 293263 - DNA, 25 bp, Mus musculus
gagagcagaaggaacttgacctcat

SEQ ID NO: 293264 - DNA, 25 bp, Mus musculus
gagagcagagcatggtggagctgaa

SEQ ID NO: 293265 - DNA, 25 bp, Mus musculus
gagagcagaggtgtggagaagacag

SEQ ID NO: 293266 - DNA, 25 bp, Mus musculus
gagagcagctgaggggtaatcagga

SEQ ID NO: 293267 - DNA, 25 bp, Mus musculus
gagagcagctgctgaaagacctaag

SEQ ID NO: 293268 - DNA, 25 bp, Mus musculus
gagagcagtctgaggcctctgggga

SEQ ID NO: 293269 - DNA, 25 bp, Mus musculus
gagagcagtgaaagcaatgacattt

SEQ ID NO: 293270 - DNA, 25 bp, Mus musculus
gagagcatcagacctttgaagaccc

SEQ ID NO: 293271 - DNA, 25 bp, Mus musculus
gagagcatctgattgtggggaaatg

SEQ ID NO: 293272 - DNA, 25 bp, Mus musculus
gagagcatgaagactccgtggtttc

SEQ ID NO: 293273 - DNA, 25 bp, Mus musculus
gagagcatgaagggcgttttttcta

SEQ ID NO: 293274 - DNA, 25 bp, Mus musculus
gagagcatgaagtgggccaatccga

SEQ ID NO: 293275 - DNA, 25 bp, Mus musculus
gagagcatgcagcaatgttgctttg

SEQ ID NO: 293276 - DNA, 25 bp, Mus musculus
gagagcatgcagcacccaatgatga

SEQ ID NO: 293277 - DNA, 25 bp, Mus musculus
gagagcattaagcatccagcatgtg

SEQ ID NO: 293278 - DNA, 25 bp, Mus musculus
gagagccaaatctgccaaggcacaa

SEQ ID NO: 293279 - DNA, 25 bp, Mus musculus
gagagccaacagatgaagaaacaac

SEQ ID NO: 293280 - DNA, 25 bp, Mus musculus
gagagccaagagcgccttgctggag

SEQ ID NO: 293281 - DNA, 25 bp, Mus musculus
gagagccactgattgccacagcagt

SEQ ID NO: 293282 - DNA, 25 bp, Mus musculus
gagagccactggactgacagacgaa

SEQ ID NO: 293283 - DNA, 25 bp, Mus musculus
gagagccagaccgcggcgggcagga

SEQ ID NO: 293284 - DNA, 25 bp, Mus musculus
gagagccagaccgcgggcagcgtgg

SEQ ID NO: 293285 - DNA, 25 bp, Mus musculus
gagagccagaggcactgagagtatg

SEQ ID NO: 293286 - DNA, 25 bp, Mus musculus
gagagccagcctggcgacccagtgg

SEQ ID NO: 293287 - DNA, 25 bp, Mus musculus
gagagccaggcggagcacgccccag

SEQ ID NO: 293288 - DNA, 25 bp, Mus musculus
gagagcccaggcttacagtgattct

SEQ ID NO: 293289 - DNA, 25 bp, Mus musculus
gagagccccaagcaggtgaggaatt

SEQ ID NO: 293290 - DNA, 25 bp, Mus musculus
gagagccccggtgccaaagcctgcg

SEQ ID NO: 293291 - DNA, 25 bp, Mus musculus
gagagcccgcgcaggatccaagaca

SEQ ID NO: 293292 - DNA, 25 bp, Mus musculus
gagagccggaacaggtacttaaaat

SEQ ID NO: 293293 - DNA, 25 bp, Mus musculus
gagagccggaaggataaagaaatgg

SEQ ID NO: 293294 - DNA, 25 bp, Mus musculus
gagagccggattcaggaggtggatg

SEQ ID NO: 293295 - DNA, 25 bp, Mus musculus
gagagccggcagccatcatgttaag

SEQ ID NO: 293296 - DNA, 25 bp, Mus musculus
gagagccggcaggatttctccatat

SEQ ID NO: 293297 - DNA, 25 bp, Mus musculus
gagagccggcccgcgtacggcatcc

SEQ ID NO: 293298 - DNA, 25 bp, Mus musculus
gagagcctaacacaggtggtgaccg

SEQ ID NO: 293299 - DNA, 25 bp, Mus musculus
gagagcctcctgacatgatgtagct

SEQ ID NO: 293300 - DNA, 25 bp, Mus musculus
gagagcctcctggagctggtggagt

SEQ ID NO: 293301 - DNA, 25 bp, Mus musculus
gagagcctgaaggctagatatggat

SEQ ID NO: 293302 - DNA, 25 bp, Mus musculus
gagagcctggtgggcagcctggaga

SEQ ID NO: 293303 - DNA, 25 bp, Mus musculus
gagagccttagaggcccacgaggct

SEQ ID NO: 293304 - DNA, 25 bp, Mus musculus
gagagccttcgagaggtgctgagct

SEQ ID NO: 293305 - DNA, 25 bp, Mus musculus
gagagcgacctgtggaggcttggca

SEQ ID NO: 293306 - DNA, 25 bp, Mus musculus
gagagcgatccagtttgacgccgag

SEQ ID NO: 293307 - DNA, 25 bp, Mus musculus
gagagcgcatcagctgcagttaaag

SEQ ID NO: 293308 - DNA, 25 bp, Mus musculus
gagagcgctacattgcccccacagt

SEQ ID NO: 293309 - DNA, 25 bp, Mus musculus
gagagcgctacattggtcatcaaac

SEQ ID NO: 293310 - DNA, 25 bp, Mus musculus
gagagcggacaaggagatctgacgg

SEQ ID NO: 293311 - DNA, 25 bp, Mus musculus
gagagcggcgcgggtccaacccaga

SEQ ID NO: 293312 - DNA, 25 bp, Mus musculus
gagagcggcgcggtccccagagcca

SEQ ID NO: 293313 - DNA, 25 bp, Mus musculus
gagagcggcggaccgcagcagaaga

SEQ ID NO: 293314 - DNA, 25 bp, Mus musculus
gagagcggtgagcgacatgtccttc

SEQ ID NO: 293315 - DNA, 25 bp, Mus musculus
gagagcgtgtccggccctgaacgcc

SEQ ID NO: 293316 - DNA, 25 bp, Mus musculus
gagagctaacgagatgaacgtgacg

SEQ ID NO: 293317 - DNA, 25 bp, Mus musculus
gagagctaacgaggttgactgcctc

SEQ ID NO: 293318 - DNA, 25 bp, Mus musculus
gagagctaaggatcaagcacttcct

SEQ ID NO: 293319 - DNA, 25 bp, Mus musculus
gagagctaccggagccgcatcaatg

SEQ ID NO: 293320 - DNA, 25 bp, Mus musculus
gagagctaccggaggtatggggcag

SEQ ID NO: 293321 - DNA, 25 bp, Mus musculus
gagagctagcagacatctctgtgag

SEQ ID NO: 293322 - DNA, 25 bp, Mus musculus
gagagctagcagttccagtgcagac

SEQ ID NO: 293323 - DNA, 25 bp, Mus musculus
gagagctcagccctagtcgagggaa

SEQ ID NO: 293324 - DNA, 25 bp, Mus musculus
gagagctcaggtttggaggagacca

SEQ ID NO: 293325 - DNA, 25 bp, Mus musculus
gagagctcagtggccctgctcttgg

SEQ ID NO: 293326 - DNA, 25 bp, Mus musculus
gagagctctaacaggacccaggtct

SEQ ID NO: 293327 - DNA, 25 bp, Mus musculus
gagagctctaacagggcaggatggc

SEQ ID NO: 293328 - DNA, 25 bp, Mus musculus
gagagctctggcgcaacagcgtgac

SEQ ID NO: 293329 - DNA, 25 bp, Mus musculus
gagagctgaagaatggctttgctgt

SEQ ID NO: 293330 - DNA, 25 bp, Mus musculus
gagagctgacacgctggagatggag

SEQ ID NO: 293331 - DNA, 25 bp, Mus musculus
gagagctgaggcacctccaagtgga

SEQ ID NO: 293332 - DNA, 25 bp, Mus musculus
gagagctgcaagcaggggtagagcc

SEQ ID NO: 293333 - DNA, 25 bp, Mus musculus
gagagctgcagcagatggagcagag

SEQ ID NO: 293334 - DNA, 25 bp, Mus musculus
gagagctgcagcaggctgttctgca

SEQ ID NO: 293335 - DNA, 25 bp, Mus musculus
gagagctgcctcagagtggggagta

SEQ ID NO: 293336 - DNA, 25 bp, Mus musculus
gagagctgcctcaggctacaaggaa

SEQ ID NO: 293337 - DNA, 25 bp, Mus musculus
gagagctgctacgatgcagacagac

SEQ ID NO: 293338 - DNA, 25 bp, Mus musculus
gagagctgctacgccacacagtctc

SEQ ID NO: 293339 - DNA, 25 bp, Mus musculus
gagagctgctagaaggctgaagaac

SEQ ID NO: 293340 - DNA, 25 bp, Mus musculus
gagagctgctatgtggccaccctgg

SEQ ID NO: 293341 - DNA, 25 bp, Mus musculus
gagagctgctgtgctctcctgctat

SEQ ID NO: 293342 - DNA, 25 bp, Mus musculus
gagagctggctcccttccccaggac

SEQ ID NO: 293343 - DNA, 25 bp, Mus musculus
gagagctgtaatagttccgaggatg

SEQ ID NO: 293344 - DNA, 25 bp, Mus musculus
gagagcttacggtcattcctgatcg

SEQ ID NO: 293345 - DNA, 25 bp, Mus musculus
gagagcttccaaagccacccgcggt

SEQ ID NO: 293346 - DNA, 25 bp, Mus musculus
gagagcttccaaagcgcggctgggt

SEQ ID NO: 293347 - DNA, 25 bp, Mus musculus
gagagcttctccgagaacgggcaga

SEQ ID NO: 293348 - DNA, 25 bp, Mus musculus
gagagctttagtgtagggccaagtc

SEQ ID NO: 293349 - DNA, 25 bp, Mus musculus
gagagctttagtgtataggggagca

SEQ ID NO: 293350 - DNA, 25 bp, Mus musculus
gagagctttttccaggatcccattg

SEQ ID NO: 293351 - DNA, 25 bp, Mus musculus
gagaggaaaaacagagagagagaaa

SEQ ID NO: 293352 - DNA, 25 bp, Mus musculus
gagaggaaaaagagagaaaaggaac

SEQ ID NO: 293353 - DNA, 25 bp, Mus musculus
gagaggaaaagaacaaattacctgc

SEQ ID NO: 293354 - DNA, 25 bp, Mus musculus
gagaggaaaagcagacttgtgtcct

SEQ ID NO: 293355 - DNA, 25 bp, Mus musculus
gagaggaaaagcagcagatatacca

SEQ ID NO: 293356 - DNA, 25 bp, Mus musculus
gagaggaaaaggcatttatatgtgg

SEQ ID NO: 293357 - DNA, 25 bp, Mus musculus
gagaggaaaagggctcggatggcgt

SEQ ID NO: 293358 - DNA, 25 bp, Mus musculus
gagaggaaaataaggtacttcaatt

SEQ ID NO: 293359 - DNA, 25 bp, Mus musculus
gagaggaaaatccagttcacagtgt

SEQ ID NO: 293360 - DNA, 25 bp, Mus musculus
gagaggaaacgatcctggggcagag

SEQ ID NO: 293361 - DNA, 25 bp, Mus musculus
gagaggaacgagtgtggccagacgc

SEQ ID NO: 293362 - DNA, 25 bp, Mus musculus
gagaggaactatcggctctttctac

SEQ ID NO: 293363 - DNA, 25 bp, Mus musculus
gagaggaactatcgtcttgaagaac

SEQ ID NO: 293364 - DNA, 25 bp, Mus musculus
gagaggaagaagagtcaagcgaagg

SEQ ID NO: 293365 - DNA, 25 bp, Mus musculus
gagaggaagaagcgacttgaagaga

SEQ ID NO: 293366 - DNA, 25 bp, Mus musculus
gagaggaagacaggagtctgcggtg

SEQ ID NO: 293367 - DNA, 25 bp, Mus musculus
gagaggaagactctgcagcttcaac

SEQ ID NO: 293368 - DNA, 25 bp, Mus musculus
gagaggaagagatcaagcacttcct

SEQ ID NO: 293369 - DNA, 25 bp, Mus musculus
gagaggaagatgacagcctgtttga

SEQ ID NO: 293370 - DNA, 25 bp, Mus musculus
gagaggaagcactggaggaggcaga

SEQ ID NO: 293371 - DNA, 25 bp, Mus musculus
gagaggaagcactggcaaggggacc

SEQ ID NO: 293372 - DNA, 25 bp, Mus musculus
gagaggaatcagaatcagactggat

SEQ ID NO: 293373 - DNA, 25 bp, Mus musculus
gagaggaatcagttcacagcgctgt

SEQ ID NO: 293374 - DNA, 25 bp, Mus musculus
gagaggaatccaacctcagtgcaga

SEQ ID NO: 293375 - DNA, 25 bp, Mus musculus
gagaggacagaaagctttttacctt

SEQ ID NO: 293376 - DNA, 25 bp, Mus musculus
gagaggacagaagagtgtgtttgac

SEQ ID NO: 293377 - DNA, 25 bp, Mus musculus
gagaggacagccctgactcccccat

SEQ ID NO: 293378 - DNA, 25 bp, Mus musculus
gagaggacaggcattgttatcggca

SEQ ID NO: 293379 - DNA, 25 bp, Mus musculus
gagaggaccttcggggctgggcttc

SEQ ID NO: 293380 - DNA, 25 bp, Mus musculus
gagaggaccttcgggtaaatggcca

SEQ ID NO: 293381 - DNA, 25 bp, Mus musculus
gagaggacgcagagcttgttgatgt

SEQ ID NO: 293382 - DNA, 25 bp, Mus musculus
gagaggacgcgtgagcatgccaact

SEQ ID NO: 293383 - DNA, 25 bp, Mus musculus
gagaggagaaagaacgtttgctgaa

SEQ ID NO: 293384 - DNA, 25 bp, Mus musculus
gagaggagaaccgggtgagccctat

SEQ ID NO: 293385 - DNA, 25 bp, Mus musculus
gagaggagagagagagagagagaga

SEQ ID NO: 293386 - DNA, 25 bp, Mus musculus
gagaggagcacaggaccatcagaat

SEQ ID NO: 293387 - DNA, 25 bp, Mus musculus
gagaggagtgcaaaggcaagcagaa

SEQ ID NO: 293388 - DNA, 25 bp, Mus musculus
gagaggatagaaagagctcagcagt

SEQ ID NO: 293389 - DNA, 25 bp, Mus musculus
gagaggatccaacaggtgtgggccc

SEQ ID NO: 293390 - DNA, 25 bp, Mus musculus
gagaggatcgaagcggccttgggat

SEQ ID NO: 293391 - DNA, 25 bp, Mus musculus
gagaggatgaggaagccatggcaga

SEQ ID NO: 293392 - DNA, 25 bp, Mus musculus
gagaggatgaggagaacaacgagaa

SEQ ID NO: 293393 - DNA, 25 bp, Mus musculus
gagaggatgctgagagtccatgcca

SEQ ID NO: 293394 - DNA, 25 bp, Mus musculus
gagaggcaaacagtggctctgaagc

SEQ ID NO: 293395 - DNA, 25 bp, Mus musculus
gagaggcacgcccccattggtccag

SEQ ID NO: 293396 - DNA, 25 bp, Mus musculus
gagaggcacgggcaatgaggtggct

SEQ ID NO: 293397 - DNA, 25 bp, Mus musculus
gagaggcagactggtgccctgggac

SEQ ID NO: 293398 - DNA, 25 bp, Mus musculus
gagaggcagagatggacttcctgag

SEQ ID NO: 293399 - DNA, 25 bp, Mus musculus
gagaggcagtttgaggagtgcattt

SEQ ID NO: 293400 - DNA, 25 bp, Mus musculus
gagaggcatcaagagtcattcccga

SEQ ID NO: 293401 - DNA, 25 bp, Mus musculus
gagaggccagatcctaaatttgacc

SEQ ID NO: 293402 - DNA, 25 bp, Mus musculus
gagaggccagccatagctcttggat

SEQ ID NO: 293403 - DNA, 25 bp, Mus musculus
gagaggccctcgaatgtgccgttct

SEQ ID NO: 293404 - DNA, 25 bp, Mus musculus
gagaggccgaatccctttctaaata

SEQ ID NO: 293405 - DNA, 25 bp, Mus musculus
gagaggccggagacagtataacaaa

SEQ ID NO: 293406 - DNA, 25 bp, Mus musculus
gagaggcgagggttgtgagccccgg

SEQ ID NO: 293407 - DNA, 25 bp, Mus musculus
gagaggcgcaggcggaggtcagacc

SEQ ID NO: 293408 - DNA, 25 bp, Mus musculus
gagaggcgcgaggccgcaaaacggg

SEQ ID NO: 293409 - DNA, 25 bp, Mus musculus
gagaggcggatctgggtacgcgtct

SEQ ID NO: 293410 - DNA, 25 bp, Mus musculus
gagaggcggattgcggccaagatcg

SEQ ID NO: 293411 - DNA, 25 bp, Mus musculus
gagaggctcagcaggaaacaaggac

SEQ ID NO: 293412 - DNA, 25 bp, Mus musculus
gagaggctcagcagggtgctacagt

SEQ ID NO: 293413 - DNA, 25 bp, Mus musculus
gagaggctcaggcagaagatcctga

SEQ ID NO: 293414 - DNA, 25 bp, Mus musculus
gagaggctgcaggctacagaacctg

SEQ ID NO: 293415 - DNA, 25 bp, Mus musculus
gagaggctgtgtcccattgtatcca

SEQ ID NO: 293416 - DNA, 25 bp, Mus musculus
gagaggcttgtccagggtatcttat

SEQ ID NO: 293417 - DNA, 25 bp, Mus musculus
gagaggctttgagtcgctgggttta

SEQ ID NO: 293418 - DNA, 25 bp, Mus musculus
gagagggaaaggtctgaaaaggagc

SEQ ID NO: 293419 - DNA, 25 bp, Mus musculus
gagagggaagtccagcggtggtgct

SEQ ID NO: 293420 - DNA, 25 bp, Mus musculus
gagagggaccgatgaatccttcaca

SEQ ID NO: 293421 - DNA, 25 bp, Mus musculus
gagagggaggggctctgcctcctta

SEQ ID NO: 293422 - DNA, 25 bp, Mus musculus
gagagggatccttggatggtggcac

SEQ ID NO: 293423 - DNA, 25 bp, Mus musculus
gagagggatggcagaggagctggct

SEQ ID NO: 293424 - DNA, 25 bp, Mus musculus
gagagggatggcaggtagaagaggc

SEQ ID NO: 293425 - DNA, 25 bp, Mus musculus
gagagggcagcggccgtctgggctg

SEQ ID NO: 293426 - DNA, 25 bp, Mus musculus
gagagggcagcggttccttcctcca

SEQ ID NO: 293427 - DNA, 25 bp, Mus musculus
gagagggcggaaggccaccaggcct

SEQ ID NO: 293428 - DNA, 25 bp, Mus musculus
gagagggctcaggtggtggagaaaa

SEQ ID NO: 293429 - DNA, 25 bp, Mus musculus
gagaggggagaccggtttccaaggc

SEQ ID NO: 293430 - DNA, 25 bp, Mus musculus
gagaggggcaggtggcagctcagca

SEQ ID NO: 293431 - DNA, 25 bp, Mus musculus
gagaggggcatccagataagatctg

SEQ ID NO: 293432 - DNA, 25 bp, Mus musculus
gagagggggaccaagtcattgagaa

SEQ ID NO: 293433 - DNA, 25 bp, Mus musculus
gagagggggaggcatttgcaggccc

SEQ ID NO: 293434 - DNA, 25 bp, Mus musculus
gagagggggatgaagtcattgagaa

SEQ ID NO: 293435 - DNA, 25 bp, Mus musculus
gagagggtgaagcaggagcttctgg

SEQ ID NO: 293436 - DNA, 25 bp, Mus musculus
gagaggtaagcttgtctcctctctc

SEQ ID NO: 293437 - DNA, 25 bp, Mus musculus
gagaggtaatgcctgtggtcgtcgt

SEQ ID NO: 293438 - DNA, 25 bp, Mus musculus
gagaggtcaaggccccacgcatggg

SEQ ID NO: 293439 - DNA, 25 bp, Mus musculus
gagaggtcaatgaggaagtaagtgc

SEQ ID NO: 293440 - DNA, 25 bp, Mus musculus
gagaggtcaatgaggtggacatgga

SEQ ID NO: 293441 - DNA, 25 bp, Mus musculus
gagaggtcagaggatgcaaagaagg

SEQ ID NO: 293442 - DNA, 25 bp, Mus musculus
gagaggtcagaggctgtcaaaatac

SEQ ID NO: 293443 - DNA, 25 bp, Mus musculus
gagaggtcaggaaagaatccacctt

SEQ ID NO: 293444 - DNA, 25 bp, Mus musculus
gagaggtccaagagaacagaaagag

SEQ ID NO: 293445 - DNA, 25 bp, Mus musculus
gagaggtcggaggaggtgggcgttg

SEQ ID NO: 293446 - DNA, 25 bp, Mus musculus
gagaggtcggaggaggttgctgaac

SEQ ID NO: 293447 - DNA, 25 bp, Mus musculus
gagaggtcggcagacggcgatgacc

SEQ ID NO: 293448 - DNA, 25 bp, Mus musculus
gagaggtgacacgtttcatcacttc

SEQ ID NO: 293449 - DNA, 25 bp, Mus musculus
gagaggtgacatttgaaaatgtcaa

SEQ ID NO: 293450 - DNA, 25 bp, Mus musculus
gagaggttacttttgaggatgtcaa

SEQ ID NO: 293451 - DNA, 25 bp, Mus musculus
gagaggttacttttggaaatacagt

SEQ ID NO: 293452 - DNA, 25 bp, Mus musculus
gagaggttccacaacttagaaggct

SEQ ID NO: 293453 - DNA, 25 bp, Mus musculus
gagaggttccagatggagctgaaag

SEQ ID NO: 293454 - DNA, 25 bp, Mus musculus
gagaggttccagttaccagtaagat

SEQ ID NO: 293455 - DNA, 25 bp, Mus musculus
gagaggttcgtctgctttgccttga

SEQ ID NO: 293456 - DNA, 25 bp, Mus musculus
gagaggtttggagaagcctgaaagg

SEQ ID NO: 293457 - DNA, 25 bp, Mus musculus
gagaggtttgggaaaagcttgttgg

SEQ ID NO: 293458 - DNA, 25 bp, Mus musculus
gagagtaaaaaagaatgcactgctc

SEQ ID NO: 293459 - DNA, 25 bp, Mus musculus
gagagtaactagctttgcatcatgc

SEQ ID NO: 293460 - DNA, 25 bp, Mus musculus
gagagtaagaactgtgccaagtggt

SEQ ID NO: 293461 - DNA, 25 bp, Mus musculus
gagagtaagacaaacccaggagatg

SEQ ID NO: 293462 - DNA, 25 bp, Mus musculus
gagagtaagacaattgcgtgaagaa

SEQ ID NO: 293463 - DNA, 25 bp, Mus musculus
gagagtacgacatggctgccagaaa

SEQ ID NO: 293464 - DNA, 25 bp, Mus musculus
gagagtactggcggtgtctctttgg

SEQ ID NO: 293465 - DNA, 25 bp, Mus musculus
gagagtagagaaaaggttttctgtc

SEQ ID NO: 293466 - DNA, 25 bp, Mus musculus
gagagtatgcacagggtatccagaa

SEQ ID NO: 293467 - DNA, 25 bp, Mus musculus
gagagtatgcagtccttcagctcac

SEQ ID NO: 293468 - DNA, 25 bp, Mus musculus
gagagtcaacaaggtcccagtgaag

SEQ ID NO: 293469 - DNA, 25 bp, Mus musculus
gagagtcaacaaggtgatcattggc

SEQ ID NO: 293470 - DNA, 25 bp, Mus musculus
gagagtcacagctaaagaacgcttc

SEQ ID NO: 293471 - DNA, 25 bp, Mus musculus
gagagtcaccacactgctccgcagg

SEQ ID NO: 293472 - DNA, 25 bp, Mus musculus
gagagtccacgagaaatggaagatt

SEQ ID NO: 293473 - DNA, 25 bp, Mus musculus
gagagtccacgatatgttttcttct

SEQ ID NO: 293474 - DNA, 25 bp, Mus musculus
gagagtccacggttttctctgtgta

SEQ ID NO: 293475 - DNA, 25 bp, Mus musculus
gagagtcccgaaggggacagcttcg

SEQ ID NO: 293476 - DNA, 25 bp, Mus musculus
gagagtcctcagaatggcaatgttc

SEQ ID NO: 293477 - DNA, 25 bp, Mus musculus
gagagtcctcaggcacctccaagtg

SEQ ID NO: 293478 - DNA, 25 bp, Mus musculus
gagagtcctcctccacctaaggtgg

SEQ ID NO: 293479 - DNA, 25 bp, Mus musculus
gagagtcgggccctgtctccaacac

SEQ ID NO: 293480 - DNA, 25 bp, Mus musculus
gagagtcgggggcctggtgtacacc

SEQ ID NO: 293481 - DNA, 25 bp, Mus musculus
gagagtctaccatatttggtataag

SEQ ID NO: 293482 - DNA, 25 bp, Mus musculus
gagagtctcaaggctacatgtgagc

SEQ ID NO: 293483 - DNA, 25 bp, Mus musculus
gagagtgagaaaggagacacggtct

SEQ ID NO: 293484 - DNA, 25 bp, Mus musculus
gagagtgagaacaggtcctatgagg

SEQ ID NO: 293485 - DNA, 25 bp, Mus musculus
gagagtgagaagcatttcttcactt

SEQ ID NO: 293486 - DNA, 25 bp, Mus musculus
gagagtgagagaggcatgaaagtca

SEQ ID NO: 293487 - DNA, 25 bp, Mus musculus
gagagtgagagcaagagatacttca

SEQ ID NO: 293488 - DNA, 25 bp, Mus musculus
gagagtgaggccacagtgtgtcaga

SEQ ID NO: 293489 - DNA, 25 bp, Mus musculus
gagagtgatccagtctgttgtctac

SEQ ID NO: 293490 - DNA, 25 bp, Mus musculus
gagagtgatgcatggagcagtgctg

SEQ ID NO: 293491 - DNA, 25 bp, Mus musculus
gagagtgatttaaaggatgacgaga

SEQ ID NO: 293492 - DNA, 25 bp, Mus musculus
gagagtgccaggaaatagcctttaa

SEQ ID NO: 293493 - DNA, 25 bp, Mus musculus
gagagtgccaggctttggggacttg

SEQ ID NO: 293494 - DNA, 25 bp, Mus musculus
gagagtgctgggagccgacagggag

SEQ ID NO: 293495 - DNA, 25 bp, Mus musculus
gagagtgctgggagcctcttagctg

SEQ ID NO: 293496 - DNA, 25 bp, Mus musculus
gagagtgctgttctctgcagcttga

SEQ ID NO: 293497 - DNA, 25 bp, Mus musculus
gagagtggaacagatcgctgtagtg

SEQ ID NO: 293498 - DNA, 25 bp, Mus musculus
gagagtggaaggggttccatgatgg

SEQ ID NO: 293499 - DNA, 25 bp, Mus musculus
gagagtggagaagagatgctggtcc

SEQ ID NO: 293500 - DNA, 25 bp, Mus musculus
gagagtggagaagaggatgcccctg

SEQ ID NO: 293501 - DNA, 25 bp, Mus musculus
gagagtggcaggaagaagtcccaga

SEQ ID NO: 293502 - DNA, 25 bp, Mus musculus
gagagtgtcaaaggatcaatgtgac

SEQ ID NO: 293503 - DNA, 25 bp, Mus musculus
gagagtgtcaaagtacttcaactcc

SEQ ID NO: 293504 - DNA, 25 bp, Mus musculus
gagagttaagggcacagagaactga

SEQ ID NO: 293505 - DNA, 25 bp, Mus musculus
gagagttataccaaattcttctgga

SEQ ID NO: 293506 - DNA, 25 bp, Mus musculus
gagagttataccaaattgaaaagat

SEQ ID NO: 293507 - DNA, 25 bp, Mus musculus
gagagttatgatgaggccaagcacg

SEQ ID NO: 293508 - DNA, 25 bp, Mus musculus
gagagttcaaggggctgagatttat

SEQ ID NO: 293509 - DNA, 25 bp, Mus musculus
gagagttcatcacgactgtgcaaca

SEQ ID NO: 293510 - DNA, 25 bp, Mus musculus
gagagttcgaattgctctggcgtta

SEQ ID NO: 293511 - DNA, 25 bp, Mus musculus
gagagttcgaattgttcactgagga

SEQ ID NO: 293512 - DNA, 25 bp, Mus musculus
gagagttctctagaaccaggcagcg

SEQ ID NO: 293513 - DNA, 25 bp, Mus musculus
gagagttgccggctgaatttgacaa

SEQ ID NO: 293514 - DNA, 25 bp, Mus musculus
gagagttggaaggaaggcttgcaaa

SEQ ID NO: 293515 - DNA, 25 bp, Mus musculus
gagagttggaagggagctagctcat

SEQ ID NO: 293516 - DNA, 25 bp, Mus musculus
gagagttgtgaggagatcccccaag

SEQ ID NO: 293517 - DNA, 25 bp, Mus musculus
gagagttttgtcaagacaatggatt

SEQ ID NO: 293518 - DNA, 25 bp, Mus musculus
gagagttttgtgagcaccttcagct

SEQ ID NO: 293519 - DNA, 25 bp, Mus musculus
gagataaaagctgaagtgaagtctg

SEQ ID NO: 293520 - DNA, 25 bp, Mus musculus
gagataaaaggacggactgtggctg

SEQ ID NO: 293521 - DNA, 25 bp, Mus musculus
gagataaacccagctccctacacta

SEQ ID NO: 293522 - DNA, 25 bp, Mus musculus
gagataaacgaaattaggtccagag

SEQ ID NO: 293523 - DNA, 25 bp, Mus musculus
gagataaacgagtgtgcaactgcgt

SEQ ID NO: 293524 - DNA, 25 bp, Mus musculus
gagataaagggcagtcattcaatga

SEQ ID NO: 293525 - DNA, 25 bp, Mus musculus
gagataaaggggagatccctgacga

SEQ ID NO: 293526 - DNA, 25 bp, Mus musculus
gagataaattgattgagtctgtttc

SEQ ID NO: 293527 - DNA, 25 bp, Mus musculus
gagataacagcaatggcctccaact

SEQ ID NO: 293528 - DNA, 25 bp, Mus musculus
gagataacagcaatgggccaccaga

SEQ ID NO: 293529 - DNA, 25 bp, Mus musculus
gagataactcagcaggaactatgaa

SEQ ID NO: 293530 - DNA, 25 bp, Mus musculus
gagataagaaggttgtgacaaagac

SEQ ID NO: 293531 - DNA, 25 bp, Mus musculus
gagataagagcgttctctggtgcaa

SEQ ID NO: 293532 - DNA, 25 bp, Mus musculus
gagataagcagagtccagttcagct

SEQ ID NO: 293533 - DNA, 25 bp, Mus musculus
gagataagtatgggagtgaaggata

SEQ ID NO: 293534 - DNA, 25 bp, Mus musculus
gagataagtatgggtggtactgcag

SEQ ID NO: 293535 - DNA, 25 bp, Mus musculus
gagataatccaccatgactggtgga

SEQ ID NO: 293536 - DNA, 25 bp, Mus musculus
gagatacaaacggtctccctgcaac

SEQ ID NO: 293537 - DNA, 25 bp, Mus musculus
gagatacaagcgggctttgctgctg

SEQ ID NO: 293538 - DNA, 25 bp, Mus musculus
gagatacaaggaaagaaaggagagg

SEQ ID NO: 293539 - DNA, 25 bp, Mus musculus
gagatacaagggtcaatatagacct

SEQ ID NO: 293540 - DNA, 25 bp, Mus musculus
gagatacaaggtgtagtggctggca

SEQ ID NO: 293541 - DNA, 25 bp, Mus musculus
gagatacacgtgcaggtactgtggc

SEQ ID NO: 293542 - DNA, 25 bp, Mus musculus
gagatacagaatgaatgaagaaagg

SEQ ID NO: 293543 - DNA, 25 bp, Mus musculus
gagatacagagcactggtgaagtgg

SEQ ID NO: 293544 - DNA, 25 bp, Mus musculus
gagatacagggcatggatgggcaga

SEQ ID NO: 293545 - DNA, 25 bp, Mus musculus
gagatacatcaggaagtggcaaggc

SEQ ID NO: 293546 - DNA, 25 bp, Mus musculus
gagatacatcagggtcttggggctg

SEQ ID NO: 293547 - DNA, 25 bp, Mus musculus
gagataccaaaaatagcgaccagtt

SEQ ID NO: 293548 - DNA, 25 bp, Mus musculus
gagataccaggcacaatcacttcct

SEQ ID NO: 293549 - DNA, 25 bp, Mus musculus
gagatacccagagccctgcaactcc

SEQ ID NO: 293550 - DNA, 25 bp, Mus musculus
gagatacccgacccgatttctctgt

SEQ ID NO: 293551 - DNA, 25 bp, Mus musculus
gagatacccgacccggcaccagcca

SEQ ID NO: 293552 - DNA, 25 bp, Mus musculus
gagatacgaaagggcgagaggttaa

SEQ ID NO: 293553 - DNA, 25 bp, Mus musculus
gagatacgggcgcgagggcgccgag

SEQ ID NO: 293554 - DNA, 25 bp, Mus musculus
gagatactgaagaaggacagctcct

SEQ ID NO: 293555 - DNA, 25 bp, Mus musculus
gagatactgcagagctacgagtctg

SEQ ID NO: 293556 - DNA, 25 bp, Mus musculus
gagatacttgatccttcttaccagc

SEQ ID NO: 293557 - DNA, 25 bp, Mus musculus
gagatacttttggactgaccaaggc

SEQ ID NO: 293558 - DNA, 25 bp, Mus musculus
gagatagaaagaaaggcccaggcta

SEQ ID NO: 293559 - DNA, 25 bp, Mus musculus
gagatagagaaggtaaaggggaatg

SEQ ID NO: 293560 - DNA, 25 bp, Mus musculus
gagatagcagcttgggtcttgacga

SEQ ID NO: 293561 - DNA, 25 bp, Mus musculus
gagatagccaatgagatagatggaa

SEQ ID NO: 293562 - DNA, 25 bp, Mus musculus
gagatagccgactgcagatgacaga

SEQ ID NO: 293563 - DNA, 25 bp, Mus musculus
gagatagccgggcatcagcagtacg

SEQ ID NO: 293564 - DNA, 25 bp, Mus musculus
gagatagctcagttgtggtagtgtg

SEQ ID NO: 293565 - DNA, 25 bp, Mus musculus
gagatagtagaagagaaaactctct

SEQ ID NO: 293566 - DNA, 25 bp, Mus musculus
gagatagtcgggcaatcctgtgtcg

SEQ ID NO: 293567 - DNA, 25 bp, Mus musculus
gagatataccaggtgaacctgagtg

SEQ ID NO: 293568 - DNA, 25 bp, Mus musculus
gagatataccagtccggttctccac

SEQ ID NO: 293569 - DNA, 25 bp, Mus musculus
gagatatcaaagctgccaacgtgct

SEQ ID NO: 293570 - DNA, 25 bp, Mus musculus
gagatatcactctgggaggcccggt

SEQ ID NO: 293571 - DNA, 25 bp, Mus musculus
gagatatcactctgttccatgccat

SEQ ID NO: 293572 - DNA, 25 bp, Mus musculus
gagatatcagagatatcataggacc

SEQ ID NO: 293573 - DNA, 25 bp, Mus musculus
gagatatcagagatggacctgcagg

SEQ ID NO: 293574 - DNA, 25 bp, Mus musculus
gagatatctaaagtggttccctcaa

SEQ ID NO: 293575 - DNA, 25 bp, Mus musculus
gagatatctcagaaagtgtcaccgt

SEQ ID NO: 293576 - DNA, 25 bp, Mus musculus
gagatatgagacgaaagtaggtggg

SEQ ID NO: 293577 - DNA, 25 bp, Mus musculus
gagatatgaggtactccatccgcca

SEQ ID NO: 293578 - DNA, 25 bp, Mus musculus
gagatatgcgcaacaaaagcggtac

SEQ ID NO: 293579 - DNA, 25 bp, Mus musculus
gagatatgtttagagcttcccccac

SEQ ID NO: 293580 - DNA, 25 bp, Mus musculus
gagatattattgatacatccatggg

SEQ ID NO: 293581 - DNA, 25 bp, Mus musculus
gagatattattgatattgacccatt

SEQ ID NO: 293582 - DNA, 25 bp, Mus musculus
gagatattggcaaaatatccagaga

SEQ ID NO: 293583 - DNA, 25 bp, Mus musculus
gagatatttaaagctgcaggcacac

SEQ ID NO: 293584 - DNA, 25 bp, Mus musculus
gagatatttagaaggttctacttag

SEQ ID NO: 293585 - DNA, 25 bp, Mus musculus
gagatatttgtggtagtgtgaagcc

SEQ ID NO: 293586 - DNA, 25 bp, Mus musculus
gagatcaaaatggctcgcgctgtat

SEQ ID NO: 293587 - DNA, 25 bp, Mus musculus
gagatcaaagcactggcgcctgcgc

SEQ ID NO: 293588 - DNA, 25 bp, Mus musculus
gagatcaaagcactgggggagctgc

SEQ ID NO: 293589 - DNA, 25 bp, Mus musculus
gagatcaacccctagtggtgaccaa

SEQ ID NO: 293590 - DNA, 25 bp, Mus musculus
gagatcaacctgccactgtccatga

SEQ ID NO: 293591 - DNA, 25 bp, Mus musculus
gagatcaacgctgaccatttgaaga

SEQ ID NO: 293592 - DNA, 25 bp, Mus musculus
gagatcaacggtgaccatttgaaga

SEQ ID NO: 293593 - DNA, 25 bp, Mus musculus
gagatcaaggcacaggatctagata

SEQ ID NO: 293594 - DNA, 25 bp, Mus musculus
gagatcaatcgggagttcctctgtg

SEQ ID NO: 293595 - DNA, 25 bp, Mus musculus
gagatcacagaaaagaaccggcact

SEQ ID NO: 293596 - DNA, 25 bp, Mus musculus
gagatcacagaaaagggaacagaga

SEQ ID NO: 293597 - DNA, 25 bp, Mus musculus
gagatcacaggggacctcagcccgg

SEQ ID NO: 293598 - DNA, 25 bp, Mus musculus
gagatcacctcagtggctctggagc

SEQ ID NO: 293599 - DNA, 25 bp, Mus musculus
gagatcagaagtaacaggagaaaca

SEQ ID NO: 293600 - DNA, 25 bp, Mus musculus
gagatcagaccttaggggacttact

SEQ ID NO: 293601 - DNA, 25 bp, Mus musculus
gagatcagaggatgcagcaccgagg

SEQ ID NO: 293602 - DNA, 25 bp, Mus musculus
gagatcagatagtgccggcattggc

SEQ ID NO: 293603 - DNA, 25 bp, Mus musculus
gagatcagcagagaactactttctc

SEQ ID NO: 293604 - DNA, 25 bp, Mus musculus
gagatcagctaattaagaacctagc

SEQ ID NO: 293605 - DNA, 25 bp, Mus musculus
gagatcagggtcaagacaaatcttc

SEQ ID NO: 293606 - DNA, 25 bp, Mus musculus
gagatcagggtcaaggttgtagttc

SEQ ID NO: 293607 - DNA, 25 bp, Mus musculus
gagatcaggtaatcacaggtccttc

SEQ ID NO: 293608 - DNA, 25 bp, Mus musculus
gagatcagtcggtactccctggcat

SEQ ID NO: 293609 - DNA, 25 bp, Mus musculus
gagatcatcaaaccagaagatttct

SEQ ID NO: 293610 - DNA, 25 bp, Mus musculus
gagatcatggagatgctccaagctg

SEQ ID NO: 293611 - DNA, 25 bp, Mus musculus
gagatcattaggaaacaggtctcag

SEQ ID NO: 293612 - DNA, 25 bp, Mus musculus
gagatcattaggtctcagccactaa

SEQ ID NO: 293613 - DNA, 25 bp, Mus musculus
gagatcattgcagatgttcgagctg

SEQ ID NO: 293614 - DNA, 25 bp, Mus musculus
gagatccagccttggatccaattat

SEQ ID NO: 293615 - DNA, 25 bp, Mus musculus
gagatccagctgatggtagaagaga

SEQ ID NO: 293616 - DNA, 25 bp, Mus musculus
gagatccagctgtaggagactttgt

SEQ ID NO: 293617 - DNA, 25 bp, Mus musculus
gagatccatgagaaggtactgaatg

SEQ ID NO: 293618 - DNA, 25 bp, Mus musculus
gagatcccaagttctttcagattac

SEQ ID NO: 293619 - DNA, 25 bp, Mus musculus
gagatcccagcccccgaaactctgg

SEQ ID NO: 293620 - DNA, 25 bp, Mus musculus
gagatcccagctgagaaagcgctgc

SEQ ID NO: 293621 - DNA, 25 bp, Mus musculus
gagatccccaaggcgagttctggct

SEQ ID NO: 293622 - DNA, 25 bp, Mus musculus
gagatccccagagacagaacttctg

SEQ ID NO: 293623 - DNA, 25 bp, Mus musculus
gagatcccccaagagcaagagaagc

SEQ ID NO: 293624 - DNA, 25 bp, Mus musculus
gagatcccccaaggaagctctttgt

SEQ ID NO: 293625 - DNA, 25 bp, Mus musculus
gagatcccccaggcccggctctact

SEQ ID NO: 293626 - DNA, 25 bp, Mus musculus
gagatccgagagactacaggagccc

SEQ ID NO: 293627 - DNA, 25 bp, Mus musculus
gagatccgcagtatgttccggaagc

SEQ ID NO: 293628 - DNA, 25 bp, Mus musculus
gagatccgcagtggtttctctgtat

SEQ ID NO: 293629 - DNA, 25 bp, Mus musculus
gagatccggaggatccaaggactgt

SEQ ID NO: 293630 - DNA, 25 bp, Mus musculus
gagatccgggacagaggaccaggag

SEQ ID NO: 293631 - DNA, 25 bp, Mus musculus
gagatccgggacagcaagaagttcc

SEQ ID NO: 293632 - DNA, 25 bp, Mus musculus
gagatccgggagaaggtcctgggca

SEQ ID NO: 293633 - DNA, 25 bp, Mus musculus
gagatccgggagctggagtcctttg

SEQ ID NO: 293634 - DNA, 25 bp, Mus musculus
gagatcctcaaggggaaactgtttg

SEQ ID NO: 293635 - DNA, 25 bp, Mus musculus
gagatcctccgacagttcaaccaga

SEQ ID NO: 293636 - DNA, 25 bp, Mus musculus
gagatcctccgacagttcagtcaac

SEQ ID NO: 293637 - DNA, 25 bp, Mus musculus
gagatcctcctagcccacagacgct

SEQ ID NO: 293638 - DNA, 25 bp, Mus musculus
gagatcctcgagtgaggacgacgat

SEQ ID NO: 293639 - DNA, 25 bp, Mus musculus
gagatcctgaaaaatgtgggggttg

SEQ ID NO: 293640 - DNA, 25 bp, Mus musculus
gagatcctgaaaagtattgataatg

SEQ ID NO: 293641 - DNA, 25 bp, Mus musculus
gagatcctttcggctgtcggcgagc

SEQ ID NO: 293642 - DNA, 25 bp, Mus musculus
gagatcgacaggaagcccgcaatgc

SEQ ID NO: 293643 - DNA, 25 bp, Mus musculus
gagatcgagcaggtgaatgagcgag

SEQ ID NO: 293644 - DNA, 25 bp, Mus musculus
gagatcgagcaggttcctcatgagg

SEQ ID NO: 293645 - DNA, 25 bp, Mus musculus
gagatcgatgagctatgtgccacct

SEQ ID NO: 293646 - DNA, 25 bp, Mus musculus
gagatcgatgaggaagggaacctga

SEQ ID NO: 293647 - DNA, 25 bp, Mus musculus
gagatcgcaggggtgccttctgtaa

SEQ ID NO: 293648 - DNA, 25 bp, Mus musculus
gagatcgccaagcggacccagccac

SEQ ID NO: 293649 - DNA, 25 bp, Mus musculus
gagatcgcccggcaggcctatgaga

SEQ ID NO: 293650 - DNA, 25 bp, Mus musculus
gagatcgctgtgtctatcgtgcggg

SEQ ID NO: 293651 - DNA, 25 bp, Mus musculus
gagatcgctgtgtctatgtgaagcc

SEQ ID NO: 293652 - DNA, 25 bp, Mus musculus
gagatcggcaggatgactgactttc

SEQ ID NO: 293653 - DNA, 25 bp, Mus musculus
gagatcgggcttgggcccagagtat

SEQ ID NO: 293654 - DNA, 25 bp, Mus musculus
gagatctaccagcaaaatcttgcta

SEQ ID NO: 293655 - DNA, 25 bp, Mus musculus
gagatctaccagggatgagtttgtg

SEQ ID NO: 293656 - DNA, 25 bp, Mus musculus
gagatctcaaagggggaaaaaccaa

SEQ ID NO: 293657 - DNA, 25 bp, Mus musculus
gagatctcaggtctcctgtgagcag

SEQ ID NO: 293658 - DNA, 25 bp, Mus musculus
gagatctcagtccaagaaagctgtt

SEQ ID NO: 293659 - DNA, 25 bp, Mus musculus
gagatctcagtgctgatctgggacg

SEQ ID NO: 293660 - DNA, 25 bp, Mus musculus
gagatctcccaggctgtgacctctc

SEQ ID NO: 293661 - DNA, 25 bp, Mus musculus
gagatctccgaagatacttgaacca

SEQ ID NO: 293662 - DNA, 25 bp, Mus musculus
gagatctcggcacaacggtcgtcgg

SEQ ID NO: 293663 - DNA, 25 bp, Mus musculus
gagatctcgggtgagcacctgcgga

SEQ ID NO: 293664 - DNA, 25 bp, Mus musculus
gagatctgagcacagccagcgtgtc

SEQ ID NO: 293665 - DNA, 25 bp, Mus musculus
gagatctgagccatggatttccccc

SEQ ID NO: 293666 - DNA, 25 bp, Mus musculus
gagatctgcattcacacaaatagca

SEQ ID NO: 293667 - DNA, 25 bp, Mus musculus
gagatctgcattcacacaattacca

SEQ ID NO: 293668 - DNA, 25 bp, Mus musculus
gagatctgctgcccaccaattcctg

SEQ ID NO: 293669 - DNA, 25 bp, Mus musculus
gagatctgtgaggaaggtctacgag

SEQ ID NO: 293670 - DNA, 25 bp, Mus musculus
gagatcttaaaggttgccaggatgc

SEQ ID NO: 293671 - DNA, 25 bp, Mus musculus
gagatcttaaggacctggggattcc

SEQ ID NO: 293672 - DNA, 25 bp, Mus musculus
gagatcttaccaagattctaaggtg

SEQ ID NO: 293673 - DNA, 25 bp, Mus musculus
gagatcttcacaggagagagactga

SEQ ID NO: 293674 - DNA, 25 bp, Mus musculus
gagatcttcgatttcaacagctttg

SEQ ID NO: 293675 - DNA, 25 bp, Mus musculus
gagatctttgacaagcactataaga

SEQ ID NO: 293676 - DNA, 25 bp, Mus musculus
gagatctttgagaatccccggcagc

SEQ ID NO: 293677 - DNA, 25 bp, Mus musculus
gagatgaaactgctgccacaggtga

SEQ ID NO: 293678 - DNA, 25 bp, Mus musculus
gagatgaaatcaagaatctcgatct

SEQ ID NO: 293679 - DNA, 25 bp, Mus musculus
gagatgaaatcacagaactagacac

SEQ ID NO: 293680 - DNA, 25 bp, Mus musculus
gagatgaaatcacaggtcctgctgt

SEQ ID NO: 293681 - DNA, 25 bp, Mus musculus
gagatgaacagatttgccagggaga

SEQ ID NO: 293682 - DNA, 25 bp, Mus musculus
gagatgaacctggaaggccaaatcc

SEQ ID NO: 293683 - DNA, 25 bp, Mus musculus
gagatgaaggatgatgaggaattta

SEQ ID NO: 293684 - DNA, 25 bp, Mus musculus
gagatgaagtacaagaatcttatgg

SEQ ID NO: 293685 - DNA, 25 bp, Mus musculus
gagatgaagtcctggcctgcagctg

SEQ ID NO: 293686 - DNA, 25 bp, Mus musculus
gagatgaagtgacttcaatccccga

SEQ ID NO: 293687 - DNA, 25 bp, Mus musculus
gagatgaagtgatgactcgttggct

SEQ ID NO: 293688 - DNA, 25 bp, Mus musculus
gagatgaatagcccagccaagcggc

SEQ ID NO: 293689 - DNA, 25 bp, Mus musculus
gagatgacagcagaagtccataact

SEQ ID NO: 293690 - DNA, 25 bp, Mus musculus
gagatgacagcagccttcaagggtt

SEQ ID NO: 293691 - DNA, 25 bp, Mus musculus
gagatgacatcgggaggaatgctgt

SEQ ID NO: 293692 - DNA, 25 bp, Mus musculus
gagatgacttcagatggaggctgga

SEQ ID NO: 293693 - DNA, 25 bp, Mus musculus
gagatgagattagcattaagaagaa

SEQ ID NO: 293694 - DNA, 25 bp, Mus musculus
gagatgagattgactgggaaacaga

SEQ ID NO: 293695 - DNA, 25 bp, Mus musculus
gagatgagcaagttctatagtccac

SEQ ID NO: 293696 - DNA, 25 bp, Mus musculus
gagatgagcaggagccggccccgtg

SEQ ID NO: 293697 - DNA, 25 bp, Mus musculus
gagatgagtaagctcaatcagaacc

SEQ ID NO: 293698 - DNA, 25 bp, Mus musculus
gagatgagtcaagattactatgaca

SEQ ID NO: 293699 - DNA, 25 bp, Mus musculus
gagatgagtcaagccgagatgactg

SEQ ID NO: 293700 - DNA, 25 bp, Mus musculus
gagatgataaggagagacccccttt

SEQ ID NO: 293701 - DNA, 25 bp, Mus musculus
gagatgataaggtccagagttcaaa

SEQ ID NO: 293702 - DNA, 25 bp, Mus musculus
gagatgatcaatggtcgtagttatg

SEQ ID NO: 293703 - DNA, 25 bp, Mus musculus
gagatgatcaattcgtagttatgat

SEQ ID NO: 293704 - DNA, 25 bp, Mus musculus
gagatgatccgagaggccttggaag

SEQ ID NO: 293705 - DNA, 25 bp, Mus musculus
gagatgatgatcaggaatctagaga

SEQ ID NO: 293706 - DNA, 25 bp, Mus musculus
gagatgatgcagaacatgttggagc

SEQ ID NO: 293707 - DNA, 25 bp, Mus musculus
gagatgattttacactgtgctacca

SEQ ID NO: 293708 - DNA, 25 bp, Mus musculus
gagatgattttacagtgtgctacca

SEQ ID NO: 293709 - DNA, 25 bp, Mus musculus
gagatgcaagctgataggagcatga

SEQ ID NO: 293710 - DNA, 25 bp, Mus musculus
gagatgcaaggagagtctcttccgc

SEQ ID NO: 293711 - DNA, 25 bp, Mus musculus
gagatgcacaaacaggcggaaattg

SEQ ID NO: 293712 - DNA, 25 bp, Mus musculus
gagatgcacaaacagtgccccaggt

SEQ ID NO: 293713 - DNA, 25 bp, Mus musculus
gagatgcacaaccaggcggaaattg

SEQ ID NO: 293714 - DNA, 25 bp, Mus musculus
gagatgcacaaggccacagatgact

SEQ ID NO: 293715 - DNA, 25 bp, Mus musculus
gagatgcacaagttcatattctctc

SEQ ID NO: 293716 - DNA, 25 bp, Mus musculus
gagatgcagatggtgaaagtgatga

SEQ ID NO: 293717 - DNA, 25 bp, Mus musculus
gagatgcagccgctggatccagccg

SEQ ID NO: 293718 - DNA, 25 bp, Mus musculus
gagatgcataaacaggctgagattg

SEQ ID NO: 293719 - DNA, 25 bp, Mus musculus
gagatgccacagcccgtgttcctct

SEQ ID NO: 293720 - DNA, 25 bp, Mus musculus
gagatgccacagctcccaacccctc

SEQ ID NO: 293721 - DNA, 25 bp, Mus musculus
gagatgcccaagagcgatctagggc

SEQ ID NO: 293722 - DNA, 25 bp, Mus musculus
gagatgcccaccagagcgagtacat

SEQ ID NO: 293723 - DNA, 25 bp, Mus musculus
gagatgcccaccagttgacagggct

SEQ ID NO: 293724 - DNA, 25 bp, Mus musculus
gagatgcccagatcatgagccacgg

SEQ ID NO: 293725 - DNA, 25 bp, Mus musculus
gagatgccccagctgaaaaaaaacc

SEQ ID NO: 293726 - DNA, 25 bp, Mus musculus
gagatgccccagctgagaaaaaacg

SEQ ID NO: 293727 - DNA, 25 bp, Mus musculus
gagatgcctgatcaacatgacacac

SEQ ID NO: 293728 - DNA, 25 bp, Mus musculus
gagatgcgccccagcgccctgtgtg

SEQ ID NO: 293729 - DNA, 25 bp, Mus musculus
gagatgcggtggacaccaaagtgaa

SEQ ID NO: 293730 - DNA, 25 bp, Mus musculus
gagatgcggtggtggtacgcctgga

SEQ ID NO: 293731 - DNA, 25 bp, Mus musculus
gagatgctaccggtactaaacagac

SEQ ID NO: 293732 - DNA, 25 bp, Mus musculus
gagatgctcagcaagccccgcccaa

SEQ ID NO: 293733 - DNA, 25 bp, Mus musculus
gagatgctgagagctctggtgtact

SEQ ID NO: 293734 - DNA, 25 bp, Mus musculus
gagatgctgagctgtcgatgccacc

SEQ ID NO: 293735 - DNA, 25 bp, Mus musculus
gagatgctgagggtggttagaaagc

SEQ ID NO: 293736 - DNA, 25 bp, Mus musculus
gagatgcttcagattctgaagggag

SEQ ID NO: 293737 - DNA, 25 bp, Mus musculus
gagatgcttcagcaggagctgctaa

SEQ ID NO: 293738 - DNA, 25 bp, Mus musculus
gagatgcttcaggactctctgattc

SEQ ID NO: 293739 - DNA, 25 bp, Mus musculus
gagatgcttctgtactcacttctgc

SEQ ID NO: 293740 - DNA, 25 bp, Mus musculus
gagatgcttctgtggcctacctgtt

SEQ ID NO: 293741 - DNA, 25 bp, Mus musculus
gagatgcttggtactacatgaggcc

SEQ ID NO: 293742 - DNA, 25 bp, Mus musculus
gagatggaaaaaagggaacgaagag

SEQ ID NO: 293743 - DNA, 25 bp, Mus musculus
gagatggaaaaaagggtggccggca

SEQ ID NO: 293744 - DNA, 25 bp, Mus musculus
gagatggaaaagcaaaaggtggcgc

SEQ ID NO: 293745 - DNA, 25 bp, Mus musculus
gagatggaaaaggtggcgcgttact

SEQ ID NO: 293746 - DNA, 25 bp, Mus musculus
gagatggaagatcaccgcctccgac

SEQ ID NO: 293747 - DNA, 25 bp, Mus musculus
gagatggaagctgccactgactgta

SEQ ID NO: 293748 - DNA, 25 bp, Mus musculus
gagatggaagttgactgagcacgtg

SEQ ID NO: 293749 - DNA, 25 bp, Mus musculus
gagatggaatgaagaaaagcaatgg

SEQ ID NO: 293750 - DNA, 25 bp, Mus musculus
gagatggaatggaaggccttgttac

SEQ ID NO: 293751 - DNA, 25 bp, Mus musculus
gagatggaatggataatcaaggagg

SEQ ID NO: 293752 - DNA, 25 bp, Mus musculus
gagatggacaggcagcgggcaggca

SEQ ID NO: 293753 - DNA, 25 bp, Mus musculus
gagatggacggaatgggcaccacag

SEQ ID NO: 293754 - DNA, 25 bp, Mus musculus
gagatggagaaggaaaaacacagcc

SEQ ID NO: 293755 - DNA, 25 bp, Mus musculus
gagatggagagcagattgaaggtgc

SEQ ID NO: 293756 - DNA, 25 bp, Mus musculus
gagatggagaggtgaggctgctggc

SEQ ID NO: 293757 - DNA, 25 bp, Mus musculus
gagatggagtctctagccaagagtt

SEQ ID NO: 293758 - DNA, 25 bp, Mus musculus
gagatggatttcaaatctaaagcgg

SEQ ID NO: 293759 - DNA, 25 bp, Mus musculus
gagatggcagatactttggcaaaag

SEQ ID NO: 293760 - DNA, 25 bp, Mus musculus
gagatggcaggtgtatggtggctga

SEQ ID NO: 293761 - DNA, 25 bp, Mus musculus
gagatggcagtggagcaaataagag

SEQ ID NO: 293762 - DNA, 25 bp, Mus musculus
gagatggcagttccctccaggcttt

SEQ ID NO: 293763 - DNA, 25 bp, Mus musculus
gagatggccaaaacaagagttcaag

SEQ ID NO: 293764 - DNA, 25 bp, Mus musculus
gagatggccatatacgcctactatt

SEQ ID NO: 293765 - DNA, 25 bp, Mus musculus
gagatggcccccatggttcagcatg

SEQ ID NO: 293766 - DNA, 25 bp, Mus musculus
gagatggcggacagtttcctgtggc

SEQ ID NO: 293767 - DNA, 25 bp, Mus musculus
gagatggctaagtgggccctgcatt

SEQ ID NO: 293768 - DNA, 25 bp, Mus musculus
gagatggctagcctatgtctcaggt

SEQ ID NO: 293769 - DNA, 25 bp, Mus musculus
gagatggctaggtacaaatggatgc

SEQ ID NO: 293770 - DNA, 25 bp, Mus musculus
gagatgggaaggaaaaagtgtgagc

SEQ ID NO: 293771 - DNA, 25 bp, Mus musculus
gagatgggaagggaaaatgaacaag

SEQ ID NO: 293772 - DNA, 25 bp, Mus musculus
gagatgggatgcctggattctgcac

SEQ ID NO: 293773 - DNA, 25 bp, Mus musculus
gagatgggccacgctctgtgcaccg

SEQ ID NO: 293774 - DNA, 25 bp, Mus musculus
gagatgggccacggaactcatcttc

SEQ ID NO: 293775 - DNA, 25 bp, Mus musculus
gagatgggtcatggaactcatcttc

SEQ ID NO: 293776 - DNA, 25 bp, Mus musculus
gagatgggtggaggcaaagacactt

SEQ ID NO: 293777 - DNA, 25 bp, Mus musculus
gagatggtcaagcaagaagcgaaac

SEQ ID NO: 293778 - DNA, 25 bp, Mus musculus
gagatggtccaatttgtctagtgct

SEQ ID NO: 293779 - DNA, 25 bp, Mus musculus
gagatggtgcaggacatgggggccg

SEQ ID NO: 293780 - DNA, 25 bp, Mus musculus
gagatggttctaggctttgatgaca

SEQ ID NO: 293781 - DNA, 25 bp, Mus musculus
gagatgtaaccatagatcgcaagcc

SEQ ID NO: 293782 - DNA, 25 bp, Mus musculus
gagatgtaaccataggcccgaggac

SEQ ID NO: 293783 - DNA, 25 bp, Mus musculus
gagatgtacggttcctcatttgact

SEQ ID NO: 293784 - DNA, 25 bp, Mus musculus
gagatgtatcagattcagctactag

SEQ ID NO: 293785 - DNA, 25 bp, Mus musculus
gagatgtcaagaaaaatcaggaaat

SEQ ID NO: 293786 - DNA, 25 bp, Mus musculus
gagatgtcaaggggagagaccttat

SEQ ID NO: 293787 - DNA, 25 bp, Mus musculus
gagatgtcccagcaacattttgatg

SEQ ID NO: 293788 - DNA, 25 bp, Mus musculus
gagatgtgagggatctaccaaggcc

SEQ ID NO: 293789 - DNA, 25 bp, Mus musculus
gagatgtgcagaggtccctgctgga

SEQ ID NO: 293790 - DNA, 25 bp, Mus musculus
gagatgtggtgatggtacaccaggg

SEQ ID NO: 293791 - DNA, 25 bp, Mus musculus
gagatgtgtatagcgagatctttgc

SEQ ID NO: 293792 - DNA, 25 bp, Mus musculus
gagatgttagaagatggctccgagc

SEQ ID NO: 293793 - DNA, 25 bp, Mus musculus
gagatgttcagctacgagtcctcgg

SEQ ID NO: 293794 - DNA, 25 bp, Mus musculus
gagatgttcagttatgaggagtcca

SEQ ID NO: 293795 - DNA, 25 bp, Mus musculus
gagatgttgctgaggggcggcctga

SEQ ID NO: 293796 - DNA, 25 bp, Mus musculus
gagatgtttgttggattcagtcctt

SEQ ID NO: 293797 - DNA, 25 bp, Mus musculus
gagattaaaaggatcttgctgcata

SEQ ID NO: 293798 - DNA, 25 bp, Mus musculus
gagattaaagacagctgcagcacga

SEQ ID NO: 293799 - DNA, 25 bp, Mus musculus
gagattaaagcattggataccctgt

SEQ ID NO: 293800 - DNA, 25 bp, Mus musculus
gagattaaaggacaaccctccatat

SEQ ID NO: 293801 - DNA, 25 bp, Mus musculus
gagattaaaggcctctggggacctg

SEQ ID NO: 293802 - DNA, 25 bp, Mus musculus
gagattaaagtaattggcaactgga

SEQ ID NO: 293803 - DNA, 25 bp, Mus musculus
gagattaaatgagaataaggctcaa

SEQ ID NO: 293804 - DNA, 25 bp, Mus musculus
gagattaacaagaagattgacctga

SEQ ID NO: 293805 - DNA, 25 bp, Mus musculus
gagattaacaagaagatttacaaga

SEQ ID NO: 293806 - DNA, 25 bp, Mus musculus
gagattaatttgaagggtgattcag

SEQ ID NO: 293807 - DNA, 25 bp, Mus musculus
gagattacaaggagctagaggaaga

SEQ ID NO: 293808 - DNA, 25 bp, Mus musculus
gagattacaaggctctaagggatgg

SEQ ID NO: 293809 - DNA, 25 bp, Mus musculus
gagattacagaatcgtatggaagct

SEQ ID NO: 293810 - DNA, 25 bp, Mus musculus
gagattacagagaaaacagaggcca

SEQ ID NO: 293811 - DNA, 25 bp, Mus musculus
gagattacagaggcctcattcacat

SEQ ID NO: 293812 - DNA, 25 bp, Mus musculus
gagattacaggaatggaagaaagca

SEQ ID NO: 293813 - DNA, 25 bp, Mus musculus
gagattacagggacagtgatcattc

SEQ ID NO: 293814 - DNA, 25 bp, Mus musculus
gagattacaggtgtggttgaatcta

SEQ ID NO: 293815 - DNA, 25 bp, Mus musculus
gagattacgccaggtggtgccacag

SEQ ID NO: 293816 - DNA, 25 bp, Mus musculus
gagattactctaaggccttcctcct

SEQ ID NO: 293817 - DNA, 25 bp, Mus musculus
gagattactggagtgctgacagagg

SEQ ID NO: 293818 - DNA, 25 bp, Mus musculus
gagattagaagaaaaccacgagctg

SEQ ID NO: 293819 - DNA, 25 bp, Mus musculus
gagattagtggccaagcccagccac

SEQ ID NO: 293820 - DNA, 25 bp, Mus musculus
gagattagtggccaggtcctgctct

SEQ ID NO: 293821 - DNA, 25 bp, Mus musculus
gagattcaaagcagaataccagagt

SEQ ID NO: 293822 - DNA, 25 bp, Mus musculus
gagattcagaaactgtacggacatg

SEQ ID NO: 293823 - DNA, 25 bp, Mus musculus
gagattcattgaattctgtctttat

SEQ ID NO: 293824 - DNA, 25 bp, Mus musculus
gagattccagcaattcctggagtgg

SEQ ID NO: 293825 - DNA, 25 bp, Mus musculus
gagattccagcctccaccgtcgtcc

SEQ ID NO: 293826 - DNA, 25 bp, Mus musculus
gagattccaggaagcccctgaggaa

SEQ ID NO: 293827 - DNA, 25 bp, Mus musculus
gagattccaggtggcagacatggaa

SEQ ID NO: 293828 - DNA, 25 bp, Mus musculus
gagattccagtactacagagccaga

SEQ ID NO: 293829 - DNA, 25 bp, Mus musculus
gagattcctcccagatgatgggcgt

SEQ ID NO: 293830 - DNA, 25 bp, Mus musculus
gagattcctgagatgaccacagggc

SEQ ID NO: 293831 - DNA, 25 bp, Mus musculus
gagattcggcgacctgacaaagccc

SEQ ID NO: 293832 - DNA, 25 bp, Mus musculus
gagattcggcggtttatcaagagct

SEQ ID NO: 293833 - DNA, 25 bp, Mus musculus
gagattcggctgctgaactaagaac

SEQ ID NO: 293834 - DNA, 25 bp, Mus musculus
gagattctatgctaggtattctctg

SEQ ID NO: 293835 - DNA, 25 bp, Mus musculus
gagattctgaccaagtgttgtacac

SEQ ID NO: 293836 - DNA, 25 bp, Mus musculus
gagattctgacccatgcttctctgc

SEQ ID NO: 293837 - DNA, 25 bp, Mus musculus
gagattctgagaccttgctacatct

SEQ ID NO: 293838 - DNA, 25 bp, Mus musculus
gagattctgaggcgaatggacccgc

SEQ ID NO: 293839 - DNA, 25 bp, Mus musculus
gagattctgcttatggcgtgcgcag

SEQ ID NO: 293840 - DNA, 25 bp, Mus musculus
gagattctgcttatgtgcttctggg

SEQ ID NO: 293841 - DNA, 25 bp, Mus musculus
gagattcttcaggtctatggaaatg

SEQ ID NO: 293842 - DNA, 25 bp, Mus musculus
gagattgaaagctacgggaaagaaa

SEQ ID NO: 293843 - DNA, 25 bp, Mus musculus
gagattgaaagctgaaaggaagttc

SEQ ID NO: 293844 - DNA, 25 bp, Mus musculus
gagattgaagaaaccgggctccatg

SEQ ID NO: 293845 - DNA, 25 bp, Mus musculus
gagattgagaaggtcatagaagagc

SEQ ID NO: 293846 - DNA, 25 bp, Mus musculus
gagattgagaagtggatgactacag

SEQ ID NO: 293847 - DNA, 25 bp, Mus musculus
gagattgagaagtttctagatccag

SEQ ID NO: 293848 - DNA, 25 bp, Mus musculus
gagattgagcaggtttaccgacaag

SEQ ID NO: 293849 - DNA, 25 bp, Mus musculus
gagattgatgatgaatatgaaggag

SEQ ID NO: 293850 - DNA, 25 bp, Mus musculus
gagattgatgtggccagcctgcgga

SEQ ID NO: 293851 - DNA, 25 bp, Mus musculus
gagattgcaaaggtcatttggtgtc

SEQ ID NO: 293852 - DNA, 25 bp, Mus musculus
gagattgcaaggtacaaaagaaaac

SEQ ID NO: 293853 - DNA, 25 bp, Mus musculus
gagattgcaagttctgattcaaagg

SEQ ID NO: 293854 - DNA, 25 bp, Mus musculus
gagattgcagaggcccagcagctca

SEQ ID NO: 293855 - DNA, 25 bp, Mus musculus
gagattgccaggcccgacgactctt

SEQ ID NO: 293856 - DNA, 25 bp, Mus musculus
gagattgcccaggatgccctgaagt

SEQ ID NO: 293857 - DNA, 25 bp, Mus musculus
gagattgcccaggttcgcggcaagg

SEQ ID NO: 293858 - DNA, 25 bp, Mus musculus
gagattgccttcaaggacctactga

SEQ ID NO: 293859 - DNA, 25 bp, Mus musculus
gagattggaaaagcgcagcctggag

SEQ ID NO: 293860 - DNA, 25 bp, Mus musculus
gagattggaggggactccttttcac

SEQ ID NO: 293861 - DNA, 25 bp, Mus musculus
gagattggcgtttcagtgaacaacg

SEQ ID NO: 293862 - DNA, 25 bp, Mus musculus
gagattgggaaggtggccttagtag

SEQ ID NO: 293863 - DNA, 25 bp, Mus musculus
gagattgtcactggggtgcggctac

SEQ ID NO: 293864 - DNA, 25 bp, Mus musculus
gagattgtcactgggttttacctgc

SEQ ID NO: 293865 - DNA, 25 bp, Mus musculus
gagattgtgccaaagataaatttga

SEQ ID NO: 293866 - DNA, 25 bp, Mus musculus
gagattgttcagcaggtcagggttt

SEQ ID NO: 293867 - DNA, 25 bp, Mus musculus
gagatttagaagatcttttacagga

SEQ ID NO: 293868 - DNA, 25 bp, Mus musculus
gagatttagaagatgatggtgagga

SEQ ID NO: 293869 - DNA, 25 bp, Mus musculus
gagatttcccagaccacgaactgtc

SEQ ID NO: 293870 - DNA, 25 bp, Mus musculus
gagatttcccagggatccggcactg

SEQ ID NO: 293871 - DNA, 25 bp, Mus musculus
gagatttcgaccaggaaaaaatcct

SEQ ID NO: 293872 - DNA, 25 bp, Mus musculus
gagatttcgaccagttaccttactc

SEQ ID NO: 293873 - DNA, 25 bp, Mus musculus
gagatttctgaaggggcttgtcaat

SEQ ID NO: 293874 - DNA, 25 bp, Mus musculus
gagatttgcagtccaacgtcgtgca

SEQ ID NO: 293875 - DNA, 25 bp, Mus musculus
gagattttagaaggccccaggacac

SEQ ID NO: 293876 - DNA, 25 bp, Mus musculus
gagattttgaaagacaagaagctga

SEQ ID NO: 293877 - DNA, 25 bp, Mus musculus
gagattttgctctgatggttggcac

SEQ ID NO: 293878 - DNA, 25 bp, Mus musculus
gagatttttgtggacagcacatggg

SEQ ID NO: 293879 - DNA, 25 bp, Mus musculus
gagcaaaaacatagccaaggacatg

SEQ ID NO: 293880 - DNA, 25 bp, Mus musculus
gagcaaaaagaacatgtttgggatg

SEQ ID NO: 293881 - DNA, 25 bp, Mus musculus
gagcaaaaagaatcgggttgagatt

SEQ ID NO: 293882 - DNA, 25 bp, Mus musculus
gagcaaaaagatttaaggcaagaac

SEQ ID NO: 293883 - DNA, 25 bp, Mus musculus
gagcaaaaagggcaacaatagtttc

SEQ ID NO: 293884 - DNA, 25 bp, Mus musculus
gagcaaaaagggcatcctggtcaac

SEQ ID NO: 293885 - DNA, 25 bp, Mus musculus
gagcaaaaagtttcgtgaacagaca

SEQ ID NO: 293886 - DNA, 25 bp, Mus musculus
gagcaaaaccaaggactctgctttt

SEQ ID NO: 293887 - DNA, 25 bp, Mus musculus
gagcaaaaccaaggagcgcttctgg

SEQ ID NO: 293888 - DNA, 25 bp, Mus musculus
gagcaaaaccaagttcttgacatct

SEQ ID NO: 293889 - DNA, 25 bp, Mus musculus
gagcaaaagccagagcccaggctgt

SEQ ID NO: 293890 - DNA, 25 bp, Mus musculus
gagcaaaagccagtgttggaggtga

SEQ ID NO: 293891 - DNA, 25 bp, Mus musculus
gagcaaaagctggtgcaacacgtgg

SEQ ID NO: 293892 - DNA, 25 bp, Mus musculus
gagcaaaatctcaaattgctcttaa

SEQ ID NO: 293893 - DNA, 25 bp, Mus musculus
gagcaaacagctgcccgggaggagg

SEQ ID NO: 293894 - DNA, 25 bp, Mus musculus
gagcaaacccaaagagatgtggttg

SEQ ID NO: 293895 - DNA, 25 bp, Mus musculus
gagcaaaccggtggccagaaccccg

SEQ ID NO: 293896 - DNA, 25 bp, Mus musculus
gagcaaactcagagggcccccccca

SEQ ID NO: 293897 - DNA, 25 bp, Mus musculus
gagcaaactcaggagaggaaacgag

SEQ ID NO: 293898 - DNA, 25 bp, Mus musculus
gagcaaagaggtgcaagatctcttc

SEQ ID NO: 293899 - DNA, 25 bp, Mus musculus
gagcaaagctcaggaacggcgagaa

SEQ ID NO: 293900 - DNA, 25 bp, Mus musculus
gagcaaagctcaggctctcatgcag

SEQ ID NO: 293901 - DNA, 25 bp, Mus musculus
gagcaaaggggggctctactacatg

SEQ ID NO: 293902 - DNA, 25 bp, Mus musculus
gagcaaagtgcagagatccgtggac

SEQ ID NO: 293903 - DNA, 25 bp, Mus musculus
gagcaaagtgcagaggattcctacg

SEQ ID NO: 293904 - DNA, 25 bp, Mus musculus
gagcaaatgtgaaacgctaccattg

SEQ ID NO: 293905 - DNA, 25 bp, Mus musculus
gagcaaatgtgaaaggctaccttgg

SEQ ID NO: 293906 - DNA, 25 bp, Mus musculus
gagcaaatgtgaaaggctggcacag

SEQ ID NO: 293907 - DNA, 25 bp, Mus musculus
gagcaaattaacagagtgtccaagc

SEQ ID NO: 293908 - DNA, 25 bp, Mus musculus
gagcaaattcagatataaaaagatc

SEQ ID NO: 293909 - DNA, 25 bp, Mus musculus
gagcaaattcagctaataattttca

SEQ ID NO: 293910 - DNA, 25 bp, Mus musculus
gagcaacaaggggaaagcgagagct

SEQ ID NO: 293911 - DNA, 25 bp, Mus musculus
gagcaacaagtccgtgcactggaga

SEQ ID NO: 293912 - DNA, 25 bp, Mus musculus
gagcaacacagggactattccaaca

SEQ ID NO: 293913 - DNA, 25 bp, Mus musculus
gagcaacactcaaagattgacatgg

SEQ ID NO: 293914 - DNA, 25 bp, Mus musculus
gagcaacactcaaaggagttgcaag

SEQ ID NO: 293915 - DNA, 25 bp, Mus musculus
gagcaacagcgatggtgagaaggcc

SEQ ID NO: 293916 - DNA, 25 bp, Mus musculus
gagcaacagcgcgggatgggggcac

SEQ ID NO: 293917 - DNA, 25 bp, Mus musculus
gagcaacaggaggacttcaaggagg

SEQ ID NO: 293918 - DNA, 25 bp, Mus musculus
gagcaaccagagagcaccgtactgg

SEQ ID NO: 293919 - DNA, 25 bp, Mus musculus
gagcaaccagagcacctgtctcctg

SEQ ID NO: 293920 - DNA, 25 bp, Mus musculus
gagcaacgcgtttgggtctcttaca

SEQ ID NO: 293921 - DNA, 25 bp, Mus musculus
gagcaacggcaaggtggttgctgta

SEQ ID NO: 293922 - DNA, 25 bp, Mus musculus
gagcaacgtcagggctacacatctt

SEQ ID NO: 293923 - DNA, 25 bp, Mus musculus
gagcaacgtcaggtaagaatgacaa

SEQ ID NO: 293924 - DNA, 25 bp, Mus musculus
gagcaactagggttacagggaaacc

SEQ ID NO: 293925 - DNA, 25 bp, Mus musculus
gagcaactagtctaaatgttcagag

SEQ ID NO: 293926 - DNA, 25 bp, Mus musculus
gagcaactgaagactgtcactagat

SEQ ID NO: 293927 - DNA, 25 bp, Mus musculus
gagcaacttgtcttcactctgccta

SEQ ID NO: 293928 - DNA, 25 bp, Mus musculus
gagcaagaaggagagcgtggcaaac

SEQ ID NO: 293929 - DNA, 25 bp, Mus musculus
gagcaagaaggtcagtcaggagatc

SEQ ID NO: 293930 - DNA, 25 bp, Mus musculus
gagcaagaagtggaggcaggactct

SEQ ID NO: 293931 - DNA, 25 bp, Mus musculus
gagcaagaatctgaggcctgtgaga

SEQ ID NO: 293932 - DNA, 25 bp, Mus musculus
gagcaagacaatcctaaccagtaca

SEQ ID NO: 293933 - DNA, 25 bp, Mus musculus
gagcaagaccacaacagcatgtagt

SEQ ID NO: 293934 - DNA, 25 bp, Mus musculus
gagcaagaccatgactggccaaaac

SEQ ID NO: 293935 - DNA, 25 bp, Mus musculus
gagcaagaggatattatcaggagaa

SEQ ID NO: 293936 - DNA, 25 bp, Mus musculus
gagcaagagggtttgttccttacat

SEQ ID NO: 293937 - DNA, 25 bp, Mus musculus
gagcaagatgatttttgaatgtcat

SEQ ID NO: 293938 - DNA, 25 bp, Mus musculus
gagcaagatgtggaaaaagccaaac

SEQ ID NO: 293939 - DNA, 25 bp, Mus musculus
gagcaagatgtggaaaaagccacaa

SEQ ID NO: 293940 - DNA, 25 bp, Mus musculus
gagcaagatgtggcaatccccagag

SEQ ID NO: 293941 - DNA, 25 bp, Mus musculus
gagcaagcacgcccccagaggtact

SEQ ID NO: 293942 - DNA, 25 bp, Mus musculus
gagcaagcacgtggttgaagacttg

SEQ ID NO: 293943 - DNA, 25 bp, Mus musculus
gagcaagcagaaacacaggaaaagg

SEQ ID NO: 293944 - DNA, 25 bp, Mus musculus
gagcaagcagctcgaggaggacatc

SEQ ID NO: 293945 - DNA, 25 bp, Mus musculus
gagcaagcagctggaagatgagctg

SEQ ID NO: 293946 - DNA, 25 bp, Mus musculus
gagcaagcaggaaaaggaagttctt

SEQ ID NO: 293947 - DNA, 25 bp, Mus musculus
gagcaagccatcagaaggagtgaaa

SEQ ID NO: 293948 - DNA, 25 bp, Mus musculus
gagcaagccatcaggaaatcccttg

SEQ ID NO: 293949 - DNA, 25 bp, Mus musculus
gagcaagcctgagcctgaagagact

SEQ ID NO: 293950 - DNA, 25 bp, Mus musculus
gagcaagctaacgcctactctgtat

SEQ ID NO: 293951 - DNA, 25 bp, Mus musculus
gagcaagctggaagaagagactttt

SEQ ID NO: 293952 - DNA, 25 bp, Mus musculus
gagcaagctggaagaagctgggagg

SEQ ID NO: 293953 - DNA, 25 bp, Mus musculus
gagcaagctggaagctgaaattaaa

SEQ ID NO: 293954 - DNA, 25 bp, Mus musculus
gagcaagctggaaggggctgcagtg

SEQ ID NO: 293955 - DNA, 25 bp, Mus musculus
gagcaaggaggacttcgtggagatc

SEQ ID NO: 293956 - DNA, 25 bp, Mus musculus
gagcaaggaggagtgttgagtggag

SEQ ID NO: 293957 - DNA, 25 bp, Mus musculus
gagcaaggaggctcatctgcggtgt

SEQ ID NO: 293958 - DNA, 25 bp, Mus musculus
gagcaaggagtggctccgcgggccg

SEQ ID NO: 293959 - DNA, 25 bp, Mus musculus
gagcaaggatttatatgaatactcg

SEQ ID NO: 293960 - DNA, 25 bp, Mus musculus
gagcaaggcaaagtttgaaactgct

SEQ ID NO: 293961 - DNA, 25 bp, Mus musculus
gagcaaggcatggaactcagtggct

SEQ ID NO: 293962 - DNA, 25 bp, Mus musculus
gagcaaggcgaacaactcgatcgtg

SEQ ID NO: 293963 - DNA, 25 bp, Mus musculus
gagcaaggcgaacaactggaacgca

SEQ ID NO: 293964 - DNA, 25 bp, Mus musculus
gagcaaggcgagagggtatcccagg

SEQ ID NO: 293965 - DNA, 25 bp, Mus musculus
gagcaagggatacccggcgtaatct

SEQ ID NO: 293966 - DNA, 25 bp, Mus musculus
gagcaagggcgattccccaaaggcc

SEQ ID NO: 293967 - DNA, 25 bp, Mus musculus
gagcaaggtaagctctgaggatgag

SEQ ID NO: 293968 - DNA, 25 bp, Mus musculus
gagcaaggtatggcgtgatcattgt

SEQ ID NO: 293969 - DNA, 25 bp, Mus musculus
gagcaaggtcaggacccagctgtgg

SEQ ID NO: 293970 - DNA, 25 bp, Mus musculus
gagcaaggtgaccatgctgcttgtt

SEQ ID NO: 293971 - DNA, 25 bp, Mus musculus
gagcaaggtgacgatgctgcttgtt

SEQ ID NO: 293972 - DNA, 25 bp, Mus musculus
gagcaaggtggccctgacaagtgaa

SEQ ID NO: 293973 - DNA, 25 bp, Mus musculus
gagcaagtagctgatattgacgggc

SEQ ID NO: 293974 - DNA, 25 bp, Mus musculus
gagcaataagagcggtctcacccca

SEQ ID NO: 293975 - DNA, 25 bp, Mus musculus
gagcaatctcaacaggacaagaaaa

SEQ ID NO: 293976 - DNA, 25 bp, Mus musculus
gagcaatctcaacaggtttatttat

SEQ ID NO: 293977 - DNA, 25 bp, Mus musculus
gagcaatgagtccagatccgaaacc

SEQ ID NO: 293978 - DNA, 25 bp, Mus musculus
gagcaatgcaggggggcttggtggg

SEQ ID NO: 293979 - DNA, 25 bp, Mus musculus
gagcaatggagaaaaagtaaatata

SEQ ID NO: 293980 - DNA, 25 bp, Mus musculus
gagcaatggagaaaacttctaaaga

SEQ ID NO: 293981 - DNA, 25 bp, Mus musculus
gagcaatggagaaaatttgccttga

SEQ ID NO: 293982 - DNA, 25 bp, Mus musculus
gagcaattcaaggtattcacactgc

SEQ ID NO: 293983 - DNA, 25 bp, Mus musculus
gagcaattcagtgaggccttggaaa

SEQ ID NO: 293984 - DNA, 25 bp, Mus musculus
gagcaattcagtgaggtcaaaggac

SEQ ID NO: 293985 - DNA, 25 bp, Mus musculus
gagcaattgcgagctctgcaggagc

SEQ ID NO: 293986 - DNA, 25 bp, Mus musculus
gagcaattggcgaggactttgtgtt

SEQ ID NO: 293987 - DNA, 25 bp, Mus musculus
gagcacaaattaatcacaatatcgc

SEQ ID NO: 293988 - DNA, 25 bp, Mus musculus
gagcacaatcaagtctaaactagag

SEQ ID NO: 293989 - DNA, 25 bp, Mus musculus
gagcacaatcagagctattctcaag

SEQ ID NO: 293990 - DNA, 25 bp, Mus musculus
gagcacaatcaggtggaaacttcac

SEQ ID NO: 293991 - DNA, 25 bp, Mus musculus
gagcacaatcaggtggccaataggt

SEQ ID NO: 293992 - DNA, 25 bp, Mus musculus
gagcacaatcaggtgggagaaaaaa

SEQ ID NO: 293993 - DNA, 25 bp, Mus musculus
gagcacacagagccatgaggctggc

SEQ ID NO: 293994 - DNA, 25 bp, Mus musculus
gagcacacagatggagtgatcaaga

SEQ ID NO: 293995 - DNA, 25 bp, Mus musculus
gagcacacaggagagaccttctggt

SEQ ID NO: 293996 - DNA, 25 bp, Mus musculus
gagcacactggccatgaacgtcctg

SEQ ID NO: 293997 - DNA, 25 bp, Mus musculus
gagcacagaaaaagagaagctgatg

SEQ ID NO: 293998 - DNA, 25 bp, Mus musculus
gagcacagaaaggagcttgaaggat

SEQ ID NO: 293999 - DNA, 25 bp, Mus musculus
gagcacagccatcttgcttcctcac

SEQ ID NO: 294000 - DNA, 25 bp, Mus musculus
gagcacagccccaggccagcagagg

SEQ ID NO: 294001 - DNA, 25 bp, Mus musculus
gagcacagccccagtgctctctctg

SEQ ID NO: 294002 - DNA, 25 bp, Mus musculus
gagcacagcctaagatggtcactcg

SEQ ID NO: 294003 - DNA, 25 bp, Mus musculus
gagcacaggaaagaagattcttgac

SEQ ID NO: 294004 - DNA, 25 bp, Mus musculus
gagcacaggaagattcatgagatat

SEQ ID NO: 294005 - DNA, 25 bp, Mus musculus
gagcacagtaaaggtctgtggagga

SEQ ID NO: 294006 - DNA, 25 bp, Mus musculus
gagcacagtgggtgttggacgtcag

SEQ ID NO: 294007 - DNA, 25 bp, Mus musculus
gagcacagtggtttattgctgtgcg

SEQ ID NO: 294008 - DNA, 25 bp, Mus musculus
gagcacatcaaggaacttctagcca

SEQ ID NO: 294009 - DNA, 25 bp, Mus musculus
gagcacatcaagttacaacaggaac

SEQ ID NO: 294010 - DNA, 25 bp, Mus musculus
gagcacatccgtctcaggtgaaaag

SEQ ID NO: 294011 - DNA, 25 bp, Mus musculus
gagcacatcgactccagcacccagt

SEQ ID NO: 294012 - DNA, 25 bp, Mus musculus
gagcacatgctgattttgggcatca

SEQ ID NO: 294013 - DNA, 25 bp, Mus musculus
gagcaccaaaccggattgagtttat

SEQ ID NO: 294014 - DNA, 25 bp, Mus musculus
gagcaccaaaccgggtgaggcacag

SEQ ID NO: 294015 - DNA, 25 bp, Mus musculus
gagcaccaagcagccttctctccgt

SEQ ID NO: 294016 - DNA, 25 bp, Mus musculus
gagcaccagtcgcggacagtggcaa

SEQ ID NO: 294017 - DNA, 25 bp, Mus musculus
gagcaccatacagaaatatgatcct

SEQ ID NO: 294018 - DNA, 25 bp, Mus musculus
gagcacccagaggtccatggctggg

SEQ ID NO: 294019 - DNA, 25 bp, Mus musculus
gagcacccaggcttccactgctgga

SEQ ID NO: 294020 - DNA, 25 bp, Mus musculus
gagcacccatacaggtagtgctgcc

SEQ ID NO: 294021 - DNA, 25 bp, Mus musculus
gagcaccccacgatggtacctcaca

SEQ ID NO: 294022 - DNA, 25 bp, Mus musculus
gagcaccccacggacagacagctgt

SEQ ID NO: 294023 - DNA, 25 bp, Mus musculus
gagcaccccagtgcccgaggcgccc

SEQ ID NO: 294024 - DNA, 25 bp, Mus musculus
gagcacccgggatacacttttggcg

SEQ ID NO: 294025 - DNA, 25 bp, Mus musculus
gagcacccggggaggcagagtaaga

SEQ ID NO: 294026 - DNA, 25 bp, Mus musculus
gagcaccctgcttatgaaagccatc

SEQ ID NO: 294027 - DNA, 25 bp, Mus musculus
gagcaccctgcttatgagtcagcag

SEQ ID NO: 294028 - DNA, 25 bp, Mus musculus
gagcaccctggactacattgcagaa

SEQ ID NO: 294029 - DNA, 25 bp, Mus musculus
gagcaccggcttctgccccccactg

SEQ ID NO: 294030 - DNA, 25 bp, Mus musculus
gagcaccggcttctggaagtcacct

SEQ ID NO: 294031 - DNA, 25 bp, Mus musculus
gagcaccgtgacatggggggatgga

SEQ ID NO: 294032 - DNA, 25 bp, Mus musculus
gagcacctaagggcagccagtccat

SEQ ID NO: 294033 - DNA, 25 bp, Mus musculus
gagcacctaagggtgctggagagtc

SEQ ID NO: 294034 - DNA, 25 bp, Mus musculus
gagcacctccgggacctgtttcaga

SEQ ID NO: 294035 - DNA, 25 bp, Mus musculus
gagcacgagggttttttgcattgac

SEQ ID NO: 294036 - DNA, 25 bp, Mus musculus
gagcacgataaggaagagcggatcc

SEQ ID NO: 294037 - DNA, 25 bp, Mus musculus
gagcacgcgaggagcatgtcatgtt

SEQ ID NO: 294038 - DNA, 25 bp, Mus musculus
gagcacggaccgaaagtgagaagca

SEQ ID NO: 294039 - DNA, 25 bp, Mus musculus
gagcacggtgcctgtggcctaaggc

SEQ ID NO: 294040 - DNA, 25 bp, Mus musculus
gagcacggtgttcctgtagttgctg

SEQ ID NO: 294041 - DNA, 25 bp, Mus musculus
gagcacggttcagatcctgagggaa

SEQ ID NO: 294042 - DNA, 25 bp, Mus musculus
gagcacgtctttgaccatccatggg

SEQ ID NO: 294043 - DNA, 25 bp, Mus musculus
gagcacgtctttgacttattggtgc

SEQ ID NO: 294044 - DNA, 25 bp, Mus musculus
gagcactaatcaggaaaatggcaga

SEQ ID NO: 294045 - DNA, 25 bp, Mus musculus
gagcactaccaggaagacatgggat

SEQ ID NO: 294046 - DNA, 25 bp, Mus musculus
gagcactacccaggaaaatggcaga

SEQ ID NO: 294047 - DNA, 25 bp, Mus musculus
gagcactagtgggactctgtaagct

SEQ ID NO: 294048 - DNA, 25 bp, Mus musculus
gagcactatgacccctcccagtccc

SEQ ID NO: 294049 - DNA, 25 bp, Mus musculus
gagcactcaaggcagcccctgttac

SEQ ID NO: 294050 - DNA, 25 bp, Mus musculus
gagcactcaggagttttgggaatgc

SEQ ID NO: 294051 - DNA, 25 bp, Mus musculus
gagcactcccactgggtgtggagtg

SEQ ID NO: 294052 - DNA, 25 bp, Mus musculus
gagcactccttctggagatcctttc

SEQ ID NO: 294053 - DNA, 25 bp, Mus musculus
gagcactcggatcaaacagggttcc

SEQ ID NO: 294054 - DNA, 25 bp, Mus musculus
gagcactcggatcaatgcacaaaga

SEQ ID NO: 294055 - DNA, 25 bp, Mus musculus
gagcactctcctccaggcacaactg

SEQ ID NO: 294056 - DNA, 25 bp, Mus musculus
gagcactctgcgaagggaaatgctc

SEQ ID NO: 294057 - DNA, 25 bp, Mus musculus
gagcactgaagaggaacctgctttg

SEQ ID NO: 294058 - DNA, 25 bp, Mus musculus
gagcactgctagggctctgtgccga

SEQ ID NO: 294059 - DNA, 25 bp, Mus musculus
gagcactggaggagttgtaatggct

SEQ ID NO: 294060 - DNA, 25 bp, Mus musculus
gagcactggccccgggccctcagca

SEQ ID NO: 294061 - DNA, 25 bp, Mus musculus
gagcactggccctctctggggggtc

SEQ ID NO: 294062 - DNA, 25 bp, Mus musculus
gagcacttcacaagaaattaccatg

SEQ ID NO: 294063 - DNA, 25 bp, Mus musculus
gagcacttcatcaataggaagaaga

SEQ ID NO: 294064 - DNA, 25 bp, Mus musculus
gagcacttcatcaatatgaagagtg

SEQ ID NO: 294065 - DNA, 25 bp, Mus musculus
gagcacttccacagatctgcagact

SEQ ID NO: 294066 - DNA, 25 bp, Mus musculus
gagcacttccggtggacactgcact

SEQ ID NO: 294067 - DNA, 25 bp, Mus musculus
gagcacttccgtgtctgtctctcta

SEQ ID NO: 294068 - DNA, 25 bp, Mus musculus
gagcacttgaacagatggggtgttt

SEQ ID NO: 294069 - DNA, 25 bp, Mus musculus
gagcacttgaacagattcattatgt

SEQ ID NO: 294070 - DNA, 25 bp, Mus musculus
gagcactttgaagagaattgttgtg

SEQ ID NO: 294071 - DNA, 25 bp, Mus musculus
gagcactttgaagaggtgtgagtgt

SEQ ID NO: 294072 - DNA, 25 bp, Mus musculus
gagcactttgaagagtatcacagac

SEQ ID NO: 294073 - DNA, 25 bp, Mus musculus
gagcacttttgagcacaagtgcagc

SEQ ID NO: 294074 - DNA, 25 bp, Mus musculus
gagcacttttggactacattgcaga

SEQ ID NO: 294075 - DNA, 25 bp, Mus musculus
gagcagaaagatcagtatgcattct

SEQ ID NO: 294076 - DNA, 25 bp, Mus musculus
gagcagaaagccaatgctcttcatg

SEQ ID NO: 294077 - DNA, 25 bp, Mus musculus
gagcagaaaggacaaagcccagtta

SEQ ID NO: 294078 - DNA, 25 bp, Mus musculus
gagcagaaccctcagtgattgtgtg

SEQ ID NO: 294079 - DNA, 25 bp, Mus musculus
gagcagaacctcaggttctccctgg

SEQ ID NO: 294080 - DNA, 25 bp, Mus musculus
gagcagaagaaaccttgttccccct

SEQ ID NO: 294081 - DNA, 25 bp, Mus musculus
gagcagaagagtgaccaaatgaccc

SEQ ID NO: 294082 - DNA, 25 bp, Mus musculus
gagcagaagattaaggacctggagc

SEQ ID NO: 294083 - DNA, 25 bp, Mus musculus
gagcagaagcaaaggtctcagccag

SEQ ID NO: 294084 - DNA, 25 bp, Mus musculus
gagcagaaggaacttgacctcatgg

SEQ ID NO: 294085 - DNA, 25 bp, Mus musculus
gagcagaagtcagaaattacacttg

SEQ ID NO: 294086 - DNA, 25 bp, Mus musculus
gagcagaagtggttcccagtgggaa

SEQ ID NO: 294087 - DNA, 25 bp, Mus musculus
gagcagaatgatttccagagcagga

SEQ ID NO: 294088 - DNA, 25 bp, Mus musculus
gagcagacatcagaaaccttacaat

SEQ ID NO: 294089 - DNA, 25 bp, Mus musculus
gagcagacatcagataatggaggtg

SEQ ID NO: 294090 - DNA, 25 bp, Mus musculus
gagcagaccaggtgactggttatcc

SEQ ID NO: 294091 - DNA, 25 bp, Mus musculus
gagcagaccagtaggggcaagcgca

SEQ ID NO: 294092 - DNA, 25 bp, Mus musculus
gagcagaccgtggatgggagggccc

SEQ ID NO: 294093 - DNA, 25 bp, Mus musculus
gagcagacgcgaaactggatggctt

SEQ ID NO: 294094 - DNA, 25 bp, Mus musculus
gagcagactaagcaggtggaagaac

SEQ ID NO: 294095 - DNA, 25 bp, Mus musculus
gagcagagaatgagaaaatgaaaat

SEQ ID NO: 294096 - DNA, 25 bp, Mus musculus
gagcagagacagcaggattttcgaa

SEQ ID NO: 294097 - DNA, 25 bp, Mus musculus
gagcagagagacacagtgccctctc

SEQ ID NO: 294098 - DNA, 25 bp, Mus musculus
gagcagagaggagcttggctttgat

SEQ ID NO: 294099 - DNA, 25 bp, Mus musculus
gagcagagcacacagagccatgagg

SEQ ID NO: 294100 - DNA, 25 bp, Mus musculus
gagcagagcatggtggagctgaagg

SEQ ID NO: 294101 - DNA, 25 bp, Mus musculus
gagcagagcccacagcaacctcaag

SEQ ID NO: 294102 - DNA, 25 bp, Mus musculus
gagcagagcgaggggtccgtctccc

SEQ ID NO: 294103 - DNA, 25 bp, Mus musculus
gagcagagctgaagaaggttatgag

SEQ ID NO: 294104 - DNA, 25 bp, Mus musculus
gagcagaggaagctgaaccaataac

SEQ ID NO: 294105 - DNA, 25 bp, Mus musculus
gagcagagtacaggtggagtttcga

SEQ ID NO: 294106 - DNA, 25 bp, Mus musculus
gagcagagtcaggagcgcagggcag

SEQ ID NO: 294107 - DNA, 25 bp, Mus musculus
gagcagagtcagggaccaggactga

SEQ ID NO: 294108 - DNA, 25 bp, Mus musculus
gagcagatatcggcacaacgatggc

SEQ ID NO: 294109 - DNA, 25 bp, Mus musculus
gagcagatcaatgaaattggagatc

SEQ ID NO: 294110 - DNA, 25 bp, Mus musculus
gagcagatccaatactgcagcaatg

SEQ ID NO: 294111 - DNA, 25 bp, Mus musculus
gagcagatccaatcacgagaccagg

SEQ ID NO: 294112 - DNA, 25 bp, Mus musculus
gagcagatgctcgggctgtcatttc

SEQ ID NO: 294113 - DNA, 25 bp, Mus musculus
gagcagatggaaaggtcgtgtctta

SEQ ID NO: 294114 - DNA, 25 bp, Mus musculus
gagcagatgggatgagccggcaggt

SEQ ID NO: 294115 - DNA, 25 bp, Mus musculus
gagcagatgtagttcatcctatcta

SEQ ID NO: 294116 - DNA, 25 bp, Mus musculus
gagcagattcgcagaatagcagaga

SEQ ID NO: 294117 - DNA, 25 bp, Mus musculus
gagcagattgcagagttcaaagaag

SEQ ID NO: 294118 - DNA, 25 bp, Mus musculus
gagcagattttgaggtattcgtgga

SEQ ID NO: 294119 - DNA, 25 bp, Mus musculus
gagcagattttgaggtcttgccgtg

SEQ ID NO: 294120 - DNA, 25 bp, Mus musculus
gagcagcaaggagctggaagacatg

SEQ ID NO: 294121 - DNA, 25 bp, Mus musculus
gagcagcaatggtaaatatgtgtgt

SEQ ID NO: 294122 - DNA, 25 bp, Mus musculus
gagcagcaatgttaagtcttcttag

SEQ ID NO: 294123 - DNA, 25 bp, Mus musculus
gagcagcacaaggccgaggccgtgg

SEQ ID NO: 294124 - DNA, 25 bp, Mus musculus
gagcagcacagattctaactcagaa

SEQ ID NO: 294125 - DNA, 25 bp, Mus musculus
gagcagcaccagaaataccggtatc

SEQ ID NO: 294126 - DNA, 25 bp, Mus musculus
gagcagcactgcggagagccagctg

SEQ ID NO: 294127 - DNA, 25 bp, Mus musculus
gagcagcactgcggagttgagagct

SEQ ID NO: 294128 - DNA, 25 bp, Mus musculus
gagcagcagagactggacgcggatt

SEQ ID NO: 294129 - DNA, 25 bp, Mus musculus
gagcagcagagactggactacgaga

SEQ ID NO: 294130 - DNA, 25 bp, Mus musculus
gagcagcagcagtaggcactggtga

SEQ ID NO: 294131 - DNA, 25 bp, Mus musculus
gagcagcagcgagaatgcttcgtgg

SEQ ID NO: 294132 - DNA, 25 bp, Mus musculus
gagcagcagcttggtctgggaacgt

SEQ ID NO: 294133 - DNA, 25 bp, Mus musculus
gagcagcaggaggatatggctcggc

SEQ ID NO: 294134 - DNA, 25 bp, Mus musculus
gagcagcaggcgttgcagaaactga

SEQ ID NO: 294135 - DNA, 25 bp, Mus musculus
gagcagcaggttcctgtgtggtggg

SEQ ID NO: 294136 - DNA, 25 bp, Mus musculus
gagcagcatacaaggtcaacatggc

SEQ ID NO: 294137 - DNA, 25 bp, Mus musculus
gagcagcatgggatcccggagaact

SEQ ID NO: 294138 - DNA, 25 bp, Mus musculus
gagcagccacacagagccagaccta

SEQ ID NO: 294139 - DNA, 25 bp, Mus musculus
gagcagccaggacaatcccagaaca

SEQ ID NO: 294140 - DNA, 25 bp, Mus musculus
gagcagccatgatgagtctcctccg

SEQ ID NO: 294141 - DNA, 25 bp, Mus musculus
gagcagcccaaggaggctccgcccc

SEQ ID NO: 294142 - DNA, 25 bp, Mus musculus
gagcagcccggacaccaaggacttc

SEQ ID NO: 294143 - DNA, 25 bp, Mus musculus
gagcagccgggcaggtttgccaagc

SEQ ID NO: 294144 - DNA, 25 bp, Mus musculus
gagcagcctccggctggcttaactc

SEQ ID NO: 294145 - DNA, 25 bp, Mus musculus
gagcagcctccgggacccccgaggc

SEQ ID NO: 294146 - DNA, 25 bp, Mus musculus
gagcagcgagctgaaattctgtccc

SEQ ID NO: 294147 - DNA, 25 bp, Mus musculus
gagcagcgcggcaggccgcggtagc

SEQ ID NO: 294148 - DNA, 25 bp, Mus musculus
gagcagcggcctcaggtccattcag

SEQ ID NO: 294149 - DNA, 25 bp, Mus musculus
gagcagcggcgcaggttgccccgga

SEQ ID NO: 294150 - DNA, 25 bp, Mus musculus
gagcagcgtccttgagctgaggctg

SEQ ID NO: 294151 - DNA, 25 bp, Mus musculus
gagcagctacgagacgctctgtctc

SEQ ID NO: 294152 - DNA, 25 bp, Mus musculus
gagcagctactaagcgactctcgca

SEQ ID NO: 294153 - DNA, 25 bp, Mus musculus
gagcagctagagattgcgctggctc

SEQ ID NO: 294154 - DNA, 25 bp, Mus musculus
gagcagctcctgacaaacgtcctgg

SEQ ID NO: 294155 - DNA, 25 bp, Mus musculus
gagcagctctgcagtatgctgaccc

SEQ ID NO: 294156 - DNA, 25 bp, Mus musculus
gagcagctctgtgctgtattttcat

SEQ ID NO: 294157 - DNA, 25 bp, Mus musculus
gagcagctctgtggtttgggctcag

SEQ ID NO: 294158 - DNA, 25 bp, Mus musculus
gagcagctgacaggattcagtttgc

SEQ ID NO: 294159 - DNA, 25 bp, Mus musculus
gagcagctgaggggtaatcaggaag

SEQ ID NO: 294160 - DNA, 25 bp, Mus musculus
gagcagctgcagcagggctcatggc

SEQ ID NO: 294161 - DNA, 25 bp, Mus musculus
gagcagctgcgctgggttgtggcag

SEQ ID NO: 294162 - DNA, 25 bp, Mus musculus
gagcagctggctaagaatgtgactg

SEQ ID NO: 294163 - DNA, 25 bp, Mus musculus
gagcagctgtggggttccacagcac

SEQ ID NO: 294164 - DNA, 25 bp, Mus musculus
gagcagcttggctatattgtcttca

SEQ ID NO: 294165 - DNA, 25 bp, Mus musculus
gagcaggaaaaggtggtcactaact

SEQ ID NO: 294166 - DNA, 25 bp, Mus musculus
gagcaggaaacaagattatccagct

SEQ ID NO: 294167 - DNA, 25 bp, Mus musculus
gagcaggaacagggtcaagtcctcc

SEQ ID NO: 294168 - DNA, 25 bp, Mus musculus
gagcaggaacagggtttaatgtgga

SEQ ID NO: 294169 - DNA, 25 bp, Mus musculus
gagcaggaattccgggtcagctgct

SEQ ID NO: 294170 - DNA, 25 bp, Mus musculus
gagcaggacaaagcatgtggggcag

SEQ ID NO: 294171 - DNA, 25 bp, Mus musculus
gagcaggacaaaggagtctcacctg

SEQ ID NO: 294172 - DNA, 25 bp, Mus musculus
gagcaggacatgctggcctcaaact

SEQ ID NO: 294173 - DNA, 25 bp, Mus musculus
gagcaggacatgtttgcacaccctt

SEQ ID NO: 294174 - DNA, 25 bp, Mus musculus
gagcaggaccaagctggcaagcgcg

SEQ ID NO: 294175 - DNA, 25 bp, Mus musculus
gagcaggaccaaggatcagacaagg

SEQ ID NO: 294176 - DNA, 25 bp, Mus musculus
gagcaggacctgaaaggattaatag

SEQ ID NO: 294177 - DNA, 25 bp, Mus musculus
gagcaggacctgaaatttcagattg

SEQ ID NO: 294178 - DNA, 25 bp, Mus musculus
gagcaggacgggaaggatgcgaacg

SEQ ID NO: 294179 - DNA, 25 bp, Mus musculus
gagcaggagaagagtatcgatgatg

SEQ ID NO: 294180 - DNA, 25 bp, Mus musculus
gagcaggagagattgttgacgctgc

SEQ ID NO: 294181 - DNA, 25 bp, Mus musculus
gagcaggagagcgtgaaagagttcc

SEQ ID NO: 294182 - DNA, 25 bp, Mus musculus
gagcaggagctgacattcacactct

SEQ ID NO: 294183 - DNA, 25 bp, Mus musculus
gagcaggagctgtctgaggaggaca

SEQ ID NO: 294184 - DNA, 25 bp, Mus musculus
gagcaggaggacgaggtgctgctgg

SEQ ID NO: 294185 - DNA, 25 bp, Mus musculus
gagcaggatgagagcagacactgca

SEQ ID NO: 294186 - DNA, 25 bp, Mus musculus
gagcaggatgaggaggaagatgagg

SEQ ID NO: 294187 - DNA, 25 bp, Mus musculus
gagcaggatgcagagggacgccctg

SEQ ID NO: 294188 - DNA, 25 bp, Mus musculus
gagcaggatgcagaggttcgccatc

SEQ ID NO: 294189 - DNA, 25 bp, Mus musculus
gagcaggattcaccatgactctgct

SEQ ID NO: 294190 - DNA, 25 bp, Mus musculus
gagcaggccaaggccaaggctgccg

SEQ ID NO: 294191 - DNA, 25 bp, Mus musculus
gagcaggcgggactgtcctgtgcag

SEQ ID NO: 294192 - DNA, 25 bp, Mus musculus
gagcaggctcagagatgggcccagt

SEQ ID NO: 294193 - DNA, 25 bp, Mus musculus
gagcaggctgtatgggtctgacaga

SEQ ID NO: 294194 - DNA, 25 bp, Mus musculus
gagcagggagatggcggtaaatgat

SEQ ID NO: 294195 - DNA, 25 bp, Mus musculus
gagcagggcaatgttctgtcttccc

SEQ ID NO: 294196 - DNA, 25 bp, Mus musculus
gagcagggccagatgtagtgctgag

SEQ ID NO: 294197 - DNA, 25 bp, Mus musculus
gagcagggccagtgctgagcagcgg

SEQ ID NO: 294198 - DNA, 25 bp, Mus musculus
gagcagggcgaaggagcagggcgcg

SEQ ID NO: 294199 - DNA, 25 bp, Mus musculus
gagcagggcgccgggcttcttcaca

SEQ ID NO: 294200 - DNA, 25 bp, Mus musculus
gagcagggctgtggcctggagatgc

SEQ ID NO: 294201 - DNA, 25 bp, Mus musculus
gagcaggggcctcaggtggatgaaa

SEQ ID NO: 294202 - DNA, 25 bp, Mus musculus
gagcagggggacaaggttggggagg

SEQ ID NO: 294203 - DNA, 25 bp, Mus musculus
gagcaggtaaagtaccaaatatgcc

SEQ ID NO: 294204 - DNA, 25 bp, Mus musculus
gagcaggtaagcagctgctcccttt

SEQ ID NO: 294205 - DNA, 25 bp, Mus musculus
gagcaggtatcgaggaattctatac

SEQ ID NO: 294206 - DNA, 25 bp, Mus musculus
gagcaggtgagggggtcggggtttg

SEQ ID NO: 294207 - DNA, 25 bp, Mus musculus
gagcaggtggcaacgctgacagagc

SEQ ID NO: 294208 - DNA, 25 bp, Mus musculus
gagcaggtttgagatgttctcaaac

SEQ ID NO: 294209 - DNA, 25 bp, Mus musculus
gagcagtacaatgagaaaaaaagac

SEQ ID NO: 294210 - DNA, 25 bp, Mus musculus
gagcagtagcgagccacaggttgtg

SEQ ID NO: 294211 - DNA, 25 bp, Mus musculus
gagcagtagtggcttcacggaaacc

SEQ ID NO: 294212 - DNA, 25 bp, Mus musculus
gagcagtcagagagaacgtgaggct

SEQ ID NO: 294213 - DNA, 25 bp, Mus musculus
gagcagtcagagagactcaagaacg

SEQ ID NO: 294214 - DNA, 25 bp, Mus musculus
gagcagtccgcaggtctttggccag

SEQ ID NO: 294215 - DNA, 25 bp, Mus musculus
gagcagtcgaaagaggcagacatcg

SEQ ID NO: 294216 - DNA, 25 bp, Mus musculus
gagcagtctcatggagccagatcct

SEQ ID NO: 294217 - DNA, 25 bp, Mus musculus
gagcagtctgaggcctctggggacc

SEQ ID NO: 294218 - DNA, 25 bp, Mus musculus
gagcagtctggcatgctcccaaatg

SEQ ID NO: 294219 - DNA, 25 bp, Mus musculus
gagcagtgaaagcaatgacatttct

SEQ ID NO: 294220 - DNA, 25 bp, Mus musculus
gagcagtgagcagtgggagacattt

SEQ ID NO: 294221 - DNA, 25 bp, Mus musculus
gagcagtgagcgagatgcagcaccg

SEQ ID NO: 294222 - DNA, 25 bp, Mus musculus
gagcagtgaggataccgctattgtg

SEQ ID NO: 294223 - DNA, 25 bp, Mus musculus
gagcagtgcaaaggtgattcttact

SEQ ID NO: 294224 - DNA, 25 bp, Mus musculus
gagcagtggatggaagacagcgagc

SEQ ID NO: 294225 - DNA, 25 bp, Mus musculus
gagcagtgggagaaagatgatgaca

SEQ ID NO: 294226 - DNA, 25 bp, Mus musculus
gagcagttaaccagtgctgagccta

SEQ ID NO: 294227 - DNA, 25 bp, Mus musculus
gagcagttaagctaccttaagggcg

SEQ ID NO: 294228 - DNA, 25 bp, Mus musculus
gagcagttggggaccagagttggcc

SEQ ID NO: 294229 - DNA, 25 bp, Mus musculus
gagcagttgtttgtctgccaggaac

SEQ ID NO: 294230 - DNA, 25 bp, Mus musculus
gagcataactcaggtccaaaggcca

SEQ ID NO: 294231 - DNA, 25 bp, Mus musculus
gagcatataaggagaagtgcccggc

SEQ ID NO: 294232 - DNA, 25 bp, Mus musculus
gagcatataaggagcttttcatcct

SEQ ID NO: 294233 - DNA, 25 bp, Mus musculus
gagcatatgctgatcctgggcataa

SEQ ID NO: 294234 - DNA, 25 bp, Mus musculus
gagcatcacgaaatagatatgattg

SEQ ID NO: 294235 - DNA, 25 bp, Mus musculus
gagcatcacgccagtagaaatagat

SEQ ID NO: 294236 - DNA, 25 bp, Mus musculus
gagcatcagacctttgaagaccctg

SEQ ID NO: 294237 - DNA, 25 bp, Mus musculus
gagcatcagcaaggtactgcccttt

SEQ ID NO: 294238 - DNA, 25 bp, Mus musculus
gagcatcagcgggcaaatcatttag

SEQ ID NO: 294239 - DNA, 25 bp, Mus musculus
gagcatcatgctgagcacttttgtg

SEQ ID NO: 294240 - DNA, 25 bp, Mus musculus
gagcatccagggtgagtgtccatgt

SEQ ID NO: 294241 - DNA, 25 bp, Mus musculus
gagcatccagtgtatccagagtgtg

SEQ ID NO: 294242 - DNA, 25 bp, Mus musculus
gagcatcccagaggaattcaagggc

SEQ ID NO: 294243 - DNA, 25 bp, Mus musculus
gagcatcccgagatgacacgaattt

SEQ ID NO: 294244 - DNA, 25 bp, Mus musculus
gagcatcccgaggtgtttacaattg

SEQ ID NO: 294245 - DNA, 25 bp, Mus musculus
gagcatccgtgaggtatttgaatat

SEQ ID NO: 294246 - DNA, 25 bp, Mus musculus
gagcatcctctaccacacccgtgac

SEQ ID NO: 294247 - DNA, 25 bp, Mus musculus
gagcatcctgccgtggtgaaggcat

SEQ ID NO: 294248 - DNA, 25 bp, Mus musculus
gagcatcctggtccagggctaagtc

SEQ ID NO: 294249 - DNA, 25 bp, Mus musculus
gagcatcctggtgaccagccaggat

SEQ ID NO: 294250 - DNA, 25 bp, Mus musculus
gagcatccttgcagctggccagctt

SEQ ID NO: 294251 - DNA, 25 bp, Mus musculus
gagcatcgagctggaatacgtctac

SEQ ID NO: 294252 - DNA, 25 bp, Mus musculus
gagcatctacgacaggctcatcagc

SEQ ID NO: 294253 - DNA, 25 bp, Mus musculus
gagcatctacttacggctggcccgc

SEQ ID NO: 294254 - DNA, 25 bp, Mus musculus
gagcatctacttcagctgcgtgcag

SEQ ID NO: 294255 - DNA, 25 bp, Mus musculus
gagcatctcaagaacactcaccagt

SEQ ID NO: 294256 - DNA, 25 bp, Mus musculus
gagcatctcaagcaaaacgaagaga

SEQ ID NO: 294257 - DNA, 25 bp, Mus musculus
gagcatctcaagcccaagcagtagc

SEQ ID NO: 294258 - DNA, 25 bp, Mus musculus
gagcatctctcggattgggctatcc

SEQ ID NO: 294259 - DNA, 25 bp, Mus musculus
gagcatctgtgcagggtgatagcac

SEQ ID NO: 294260 - DNA, 25 bp, Mus musculus
gagcatgaaactcgactccagggaa

SEQ ID NO: 294261 - DNA, 25 bp, Mus musculus
gagcatgaaagatcagacctgtcgc

SEQ ID NO: 294262 - DNA, 25 bp, Mus musculus
gagcatgaaaggacgtccacgtctg

SEQ ID NO: 294263 - DNA, 25 bp, Mus musculus
gagcatgaacgggtgtgactctctt

SEQ ID NO: 294264 - DNA, 25 bp, Mus musculus
gagcatgaagaaaggctacagcagg

SEQ ID NO: 294265 - DNA, 25 bp, Mus musculus
gagcatgaagaagcctccaggactg

SEQ ID NO: 294266 - DNA, 25 bp, Mus musculus
gagcatgaagactccgtggtttccg

SEQ ID NO: 294267 - DNA, 25 bp, Mus musculus
gagcatgaagggcgttttttctatc

SEQ ID NO: 294268 - DNA, 25 bp, Mus musculus
gagcatgaagtgggccaatccgagc

SEQ ID NO: 294269 - DNA, 25 bp, Mus musculus
gagcatgagcaggctactgccctgt

SEQ ID NO: 294270 - DNA, 25 bp, Mus musculus
gagcatgatgcagaggccaagaaga

SEQ ID NO: 294271 - DNA, 25 bp, Mus musculus
gagcatgcacaggaaaagttattga

SEQ ID NO: 294272 - DNA, 25 bp, Mus musculus
gagcatgcagcaatgttgctttgtg

SEQ ID NO: 294273 - DNA, 25 bp, Mus musculus
gagcatgcagcacccaatgatgatc

SEQ ID NO: 294274 - DNA, 25 bp, Mus musculus
gagcatgcaggctctgctctgacca

SEQ ID NO: 294275 - DNA, 25 bp, Mus musculus
gagcatgcgcaggtggtggagctgg

SEQ ID NO: 294276 - DNA, 25 bp, Mus musculus
gagcatgctttcatgagcatgtttt

SEQ ID NO: 294277 - DNA, 25 bp, Mus musculus
gagcatggaaaaccgtggacttgca

SEQ ID NO: 294278 - DNA, 25 bp, Mus musculus
gagcatgggaagcaaatgaagaagc

SEQ ID NO: 294279 - DNA, 25 bp, Mus musculus
gagcatgggtcaggttttctactat

SEQ ID NO: 294280 - DNA, 25 bp, Mus musculus
gagcatgtaagctctggcttctcct

SEQ ID NO: 294281 - DNA, 25 bp, Mus musculus
gagcatgtatccagaggatgttggg

SEQ ID NO: 294282 - DNA, 25 bp, Mus musculus
gagcatgtcggctaccttgagaggc

SEQ ID NO: 294283 - DNA, 25 bp, Mus musculus
gagcatgtgtggctgacctgatcgc

SEQ ID NO: 294284 - DNA, 25 bp, Mus musculus
gagcattaagcatccagcatgtgta

SEQ ID NO: 294285 - DNA, 25 bp, Mus musculus
gagcattacctggttcataagccag

SEQ ID NO: 294286 - DNA, 25 bp, Mus musculus
gagcattctggctgcagcagtgaag

SEQ ID NO: 294287 - DNA, 25 bp, Mus musculus
gagcattgacataggctcgttcagg

SEQ ID NO: 294288 - DNA, 25 bp, Mus musculus
gagcattgacatagggaacgtctag

SEQ ID NO: 294289 - DNA, 25 bp, Mus musculus
gagcattgctgagcagatgggccgc

SEQ ID NO: 294290 - DNA, 25 bp, Mus musculus
gagcattgctgcggtgacagaggcc

SEQ ID NO: 294291 - DNA, 25 bp, Mus musculus
gagcattgctgtctctgaaaaatga

SEQ ID NO: 294292 - DNA, 25 bp, Mus musculus
gagcattggcgtcccccatccacct

SEQ ID NO: 294293 - DNA, 25 bp, Mus musculus
gagcatttcaatacgcgctaccctg

SEQ ID NO: 294294 - DNA, 25 bp, Mus musculus
gagcatttcacagctattgtccagg

SEQ ID NO: 294295 - DNA, 25 bp, Mus musculus
gagcatttcctcacaacaaacaatt

SEQ ID NO: 294296 - DNA, 25 bp, Mus musculus
gagcatttcctcacctccatctgct

SEQ ID NO: 294297 - DNA, 25 bp, Mus musculus
gagcatttgagacagttccgacgag

SEQ ID NO: 294298 - DNA, 25 bp, Mus musculus
gagcatttggaggagtatagaacat

SEQ ID NO: 294299 - DNA, 25 bp, Mus musculus
gagcattttgagaaagcaattgagc

SEQ ID NO: 294300 - DNA, 25 bp, Mus musculus
gagcattttgaggttttctctgtgt

SEQ ID NO: 294301 - DNA, 25 bp, Mus musculus
gagccaaaagattcttcagtttgaa

SEQ ID NO: 294302 - DNA, 25 bp, Mus musculus
gagccaaaatgggctccgggccttt

SEQ ID NO: 294303 - DNA, 25 bp, Mus musculus
gagccaaaatgggttttatggaaga

SEQ ID NO: 294304 - DNA, 25 bp, Mus musculus
gagccaaacgagccacaatcatgtc

SEQ ID NO: 294305 - DNA, 25 bp, Mus musculus
gagccaaactaggaaatgccgcttg

SEQ ID NO: 294306 - DNA, 25 bp, Mus musculus
gagccaacacagcagcaccataggt

SEQ ID NO: 294307 - DNA, 25 bp, Mus musculus
gagccaacacagcaggtcatcacca

SEQ ID NO: 294308 - DNA, 25 bp, Mus musculus
gagccaacagatgaagaaacaactg

SEQ ID NO: 294309 - DNA, 25 bp, Mus musculus
gagccaacatggtcgtgaaaataca

SEQ ID NO: 294310 - DNA, 25 bp, Mus musculus
gagccaagaaggtaaggcgagttcc

SEQ ID NO: 294311 - DNA, 25 bp, Mus musculus
gagccaagagagctgaagcgctgca

SEQ ID NO: 294312 - DNA, 25 bp, Mus musculus
gagccaagagctatgagccagaatt

SEQ ID NO: 294313 - DNA, 25 bp, Mus musculus
gagccaagaggagtgaatggtgtgg

SEQ ID NO: 294314 - DNA, 25 bp, Mus musculus
gagccaagaggggtctccaatgaca

SEQ ID NO: 294315 - DNA, 25 bp, Mus musculus
gagccaagagtgaagaacaatccag

SEQ ID NO: 294316 - DNA, 25 bp, Mus musculus
gagccaagctgtgcggatgccggga

SEQ ID NO: 294317 - DNA, 25 bp, Mus musculus
gagccaaggaagccaattaaaatgc

SEQ ID NO: 294318 - DNA, 25 bp, Mus musculus
gagccaaggacaggctgagggtatc

SEQ ID NO: 294319 - DNA, 25 bp, Mus musculus
gagccaaggagatcgttgtccaact

SEQ ID NO: 294320 - DNA, 25 bp, Mus musculus
gagccaatatctatctactactctg

SEQ ID NO: 294321 - DNA, 25 bp, Mus musculus
gagccaatggaccttgccaccatgg

SEQ ID NO: 294322 - DNA, 25 bp, Mus musculus
gagccaatgggtctcataacaacaa

SEQ ID NO: 294323 - DNA, 25 bp, Mus musculus
gagccacaaactcctgcttcctgac

SEQ ID NO: 294324 - DNA, 25 bp, Mus musculus
gagccacaaattgcggttgccaata

SEQ ID NO: 294325 - DNA, 25 bp, Mus musculus
gagccacaagccaagaaagctcgct

SEQ ID NO: 294326 - DNA, 25 bp, Mus musculus
gagccacaagccaaggacctctaat

SEQ ID NO: 294327 - DNA, 25 bp, Mus musculus
gagccacagagtgagagaatagaac

SEQ ID NO: 294328 - DNA, 25 bp, Mus musculus
gagccacagagtgagttactagagc

SEQ ID NO: 294329 - DNA, 25 bp, Mus musculus
gagccacaggatgaaataacagtta

SEQ ID NO: 294330 - DNA, 25 bp, Mus musculus
gagccacaggatgatggcagtgaaa

SEQ ID NO: 294331 - DNA, 25 bp, Mus musculus
gagccacatttgccaaaaagcaggg

SEQ ID NO: 294332 - DNA, 25 bp, Mus musculus
gagccaccaaaaaggaatcactggg

SEQ ID NO: 294333 - DNA, 25 bp, Mus musculus
gagccaccagagagctgtgcctgag

SEQ ID NO: 294334 - DNA, 25 bp, Mus musculus
gagccaccaggagaggaaacgaggc

SEQ ID NO: 294335 - DNA, 25 bp, Mus musculus
gagccaccaggttgacagacaaggc

SEQ ID NO: 294336 - DNA, 25 bp, Mus musculus
gagccaccccagacccaagaatctt

SEQ ID NO: 294337 - DNA, 25 bp, Mus musculus
gagccaccgacaaggtacaaccacg

SEQ ID NO: 294338 - DNA, 25 bp, Mus musculus
gagccacctaaggtgacaaaagaac

SEQ ID NO: 294339 - DNA, 25 bp, Mus musculus
gagccacctcaggatggtagagcac

SEQ ID NO: 294340 - DNA, 25 bp, Mus musculus
gagccacctctaaaggaggaagatg

SEQ ID NO: 294341 - DNA, 25 bp, Mus musculus
gagccaccttgtgtgtggaatgtca

SEQ ID NO: 294342 - DNA, 25 bp, Mus musculus
gagccactctcagagttttgtacac

SEQ ID NO: 294343 - DNA, 25 bp, Mus musculus
gagccactctgggaggagcctgagt

SEQ ID NO: 294344 - DNA, 25 bp, Mus musculus
gagccactgacggaccagagtgagg

SEQ ID NO: 294345 - DNA, 25 bp, Mus musculus
gagccactggagcagggtcggtgat

SEQ ID NO: 294346 - DNA, 25 bp, Mus musculus
gagccactgggctcctagcttacag

SEQ ID NO: 294347 - DNA, 25 bp, Mus musculus
gagccactggggggaggggttgcac

SEQ ID NO: 294348 - DNA, 25 bp, Mus musculus
gagccacttctcaggcctacagggt

SEQ ID NO: 294349 - DNA, 25 bp, Mus musculus
gagccactttgggaggggggatcgc

SEQ ID NO: 294350 - DNA, 25 bp, Mus musculus
gagccagaaaagagctggactacag

SEQ ID NO: 294351 - DNA, 25 bp, Mus musculus
gagccagaaacatgtaggcctcatt

SEQ ID NO: 294352 - DNA, 25 bp, Mus musculus
gagccagaaattggggttgatcgcc

SEQ ID NO: 294353 - DNA, 25 bp, Mus musculus
gagccagaagaccagtgaagtcaag

SEQ ID NO: 294354 - DNA, 25 bp, Mus musculus
gagccagaagcgacttgaagagatt

SEQ ID NO: 294355 - DNA, 25 bp, Mus musculus
gagccagaatacaatattggccagc

SEQ ID NO: 294356 - DNA, 25 bp, Mus musculus
gagccagaccgcggcgggcaggaag

SEQ ID NO: 294357 - DNA, 25 bp, Mus musculus
gagccagaccgcgggcagcgtggac

SEQ ID NO: 294358 - DNA, 25 bp, Mus musculus
gagccagagttacaggaacgtcatc

SEQ ID NO: 294359 - DNA, 25 bp, Mus musculus
gagccagcaagggggaagaaaccga

SEQ ID NO: 294360 - DNA, 25 bp, Mus musculus
gagccagcagagaagagtccagaca

SEQ ID NO: 294361 - DNA, 25 bp, Mus musculus
gagccagcagagaaggtgacagaag

SEQ ID NO: 294362 - DNA, 25 bp, Mus musculus
gagccagcagctctgaactccaacg

SEQ ID NO: 294363 - DNA, 25 bp, Mus musculus
gagccagcaggtctattttgtggaa

SEQ ID NO: 294364 - DNA, 25 bp, Mus musculus
gagccagcaggtggagcacgccctg

SEQ ID NO: 294365 - DNA, 25 bp, Mus musculus
gagccagcataggtgcaacaagcaa

SEQ ID NO: 294366 - DNA, 25 bp, Mus musculus
gagccagcatgaatcagctgcccga

SEQ ID NO: 294367 - DNA, 25 bp, Mus musculus
gagccagcatgccttcctgggcgca

SEQ ID NO: 294368 - DNA, 25 bp, Mus musculus
gagccagcatgctcgtcaaggtgag

SEQ ID NO: 294369 - DNA, 25 bp, Mus musculus
gagccagccagccagggtcccaaag

SEQ ID NO: 294370 - DNA, 25 bp, Mus musculus
gagccagcctcccaggtccacttga

SEQ ID NO: 294371 - DNA, 25 bp, Mus musculus
gagccagcctggcgacccagtggaa

SEQ ID NO: 294372 - DNA, 25 bp, Mus musculus
gagccagcggatgaagctacccagc

SEQ ID NO: 294373 - DNA, 25 bp, Mus musculus
gagccagcttcagattcccaggaaa

SEQ ID NO: 294374 - DNA, 25 bp, Mus musculus
gagccagcttggtctgacagaagtt

SEQ ID NO: 294375 - DNA, 25 bp, Mus musculus
gagccaggaagtgactgtggactct

SEQ ID NO: 294376 - DNA, 25 bp, Mus musculus
gagccaggaccaaaggagccaaacc

SEQ ID NO: 294377 - DNA, 25 bp, Mus musculus
gagccaggaccaaagggaccacttt

SEQ ID NO: 294378 - DNA, 25 bp, Mus musculus
gagccaggaccactgctctgctgcc

SEQ ID NO: 294379 - DNA, 25 bp, Mus musculus
gagccaggaccactggttctacggg

SEQ ID NO: 294380 - DNA, 25 bp, Mus musculus
gagccaggaccaggctttcttgatc

SEQ ID NO: 294381 - DNA, 25 bp, Mus musculus
gagccaggagaaggctgctattttg

SEQ ID NO: 294382 - DNA, 25 bp, Mus musculus
gagccaggagaatggtccgtctccc

SEQ ID NO: 294383 - DNA, 25 bp, Mus musculus
gagccaggagagggctgctattttg

SEQ ID NO: 294384 - DNA, 25 bp, Mus musculus
gagccaggatgcgctcctccgcctc

SEQ ID NO: 294385 - DNA, 25 bp, Mus musculus
gagccaggcaggtgcttcagaactg

SEQ ID NO: 294386 - DNA, 25 bp, Mus musculus
gagccaggcatctatgttctgcggt

SEQ ID NO: 294387 - DNA, 25 bp, Mus musculus
gagccaggccaaggcatactttgag

SEQ ID NO: 294388 - DNA, 25 bp, Mus musculus
gagccaggccccgcaggtcaagacg

SEQ ID NO: 294389 - DNA, 25 bp, Mus musculus
gagccaggcccctagccaccttcta

SEQ ID NO: 294390 - DNA, 25 bp, Mus musculus
gagccaggcggagcacgccccagag

SEQ ID NO: 294391 - DNA, 25 bp, Mus musculus
gagccaggcgtggggccgcagcctc

SEQ ID NO: 294392 - DNA, 25 bp, Mus musculus
gagccaggctgtgctggccagctca

SEQ ID NO: 294393 - DNA, 25 bp, Mus musculus
gagccagggaaaaggtacaactgat

SEQ ID NO: 294394 - DNA, 25 bp, Mus musculus
gagccagggaagggcaatgcgagca

SEQ ID NO: 294395 - DNA, 25 bp, Mus musculus
gagccagtatgcaggtgtcactgaa

SEQ ID NO: 294396 - DNA, 25 bp, Mus musculus
gagccagtatgcaggttgtccttgt

SEQ ID NO: 294397 - DNA, 25 bp, Mus musculus
gagccagtccccctactgtgacaga

SEQ ID NO: 294398 - DNA, 25 bp, Mus musculus
gagccagtgcagcctggagatgccc

SEQ ID NO: 294399 - DNA, 25 bp, Mus musculus
gagccagtgcaggcaggatctctat

SEQ ID NO: 294400 - DNA, 25 bp, Mus musculus
gagccagtgcaggcgcctcattgtg

SEQ ID NO: 294401 - DNA, 25 bp, Mus musculus
gagccagtgcctggggttctgcagc

SEQ ID NO: 294402 - DNA, 25 bp, Mus musculus
gagccatagaggtggagtacatgtt

SEQ ID NO: 294403 - DNA, 25 bp, Mus musculus
gagccatcacaggccggatcccaga

SEQ ID NO: 294404 - DNA, 25 bp, Mus musculus
gagccatcaccaagcccccgaggca

SEQ ID NO: 294405 - DNA, 25 bp, Mus musculus
gagccatcaccaagtcagaaggtca

SEQ ID NO: 294406 - DNA, 25 bp, Mus musculus
gagccatcacccgaaacaggccacc

SEQ ID NO: 294407 - DNA, 25 bp, Mus musculus
gagccatcaggtcctaatcaaagtc

SEQ ID NO: 294408 - DNA, 25 bp, Mus musculus
gagccatcccaagaccctcctcatc

SEQ ID NO: 294409 - DNA, 25 bp, Mus musculus
gagccatcccagtgatgaatctggc

SEQ ID NO: 294410 - DNA, 25 bp, Mus musculus
gagccatcccagtgatggctaccat

SEQ ID NO: 294411 - DNA, 25 bp, Mus musculus
gagccatccgggaagggaaactgcc

SEQ ID NO: 294412 - DNA, 25 bp, Mus musculus
gagccatcggtacagggactgagac

SEQ ID NO: 294413 - DNA, 25 bp, Mus musculus
gagccatctacttgcaccggaagga

SEQ ID NO: 294414 - DNA, 25 bp, Mus musculus
gagccatctgggaaagatgtggacg

SEQ ID NO: 294415 - DNA, 25 bp, Mus musculus
gagccatctgggaagatgtctgcaa

SEQ ID NO: 294416 - DNA, 25 bp, Mus musculus
gagccatgaagcaggtggcaggtac

SEQ ID NO: 294417 - DNA, 25 bp, Mus musculus
gagccatgaagccgaggaaagcaga

SEQ ID NO: 294418 - DNA, 25 bp, Mus musculus
gagccatgaggtattactacaaacg

SEQ ID NO: 294419 - DNA, 25 bp, Mus musculus
gagccatggagatggagcagttgac

SEQ ID NO: 294420 - DNA, 25 bp, Mus musculus
gagccatggaggaggctacgcaagg

SEQ ID NO: 294421 - DNA, 25 bp, Mus musculus
gagccatggaggaggggccttcatg

SEQ ID NO: 294422 - DNA, 25 bp, Mus musculus
gagccatggggaagctctttgtggg

SEQ ID NO: 294423 - DNA, 25 bp, Mus musculus
gagccatgtagaaccaggcccaaca

SEQ ID NO: 294424 - DNA, 25 bp, Mus musculus
gagccattcagcctttggctacaat

SEQ ID NO: 294425 - DNA, 25 bp, Mus musculus
gagccatttagaaggtgtgccgatg

SEQ ID NO: 294426 - DNA, 25 bp, Mus musculus
gagcccaaaaagatggcacttccaa

SEQ ID NO: 294427 - DNA, 25 bp, Mus musculus
gagcccaaagcacccatgctggacg

SEQ ID NO: 294428 - DNA, 25 bp, Mus musculus
gagcccaaagggggaccaggctctg

SEQ ID NO: 294429 - DNA, 25 bp, Mus musculus
gagcccaacaaccaggtagctaagt

SEQ ID NO: 294430 - DNA, 25 bp, Mus musculus
gagcccaagatgtctgacagaacag

SEQ ID NO: 294431 - DNA, 25 bp, Mus musculus
gagcccaagatgtctgtatggggag

SEQ ID NO: 294432 - DNA, 25 bp, Mus musculus
gagcccacagcaacctcaagcccag

SEQ ID NO: 294433 - DNA, 25 bp, Mus musculus
gagcccacagccttctcatcattca

SEQ ID NO: 294434 - DNA, 25 bp, Mus musculus
gagcccactctggagccccatgtgg

SEQ ID NO: 294435 - DNA, 25 bp, Mus musculus
gagcccacttaaactccgaggtgac

SEQ ID NO: 294436 - DNA, 25 bp, Mus musculus
gagcccagaaatgtacggagtttga

SEQ ID NO: 294437 - DNA, 25 bp, Mus musculus
gagcccagaaattatttggtatgat

SEQ ID NO: 294438 - DNA, 25 bp, Mus musculus
gagcccagaaccaaggcaagaaggg

SEQ ID NO: 294439 - DNA, 25 bp, Mus musculus
gagcccagaaccaggccaagaaagg

SEQ ID NO: 294440 - DNA, 25 bp, Mus musculus
gagcccagaagatcgtgattttaaa

SEQ ID NO: 294441 - DNA, 25 bp, Mus musculus
gagcccagacagagaagagccatgg

SEQ ID NO: 294442 - DNA, 25 bp, Mus musculus
gagcccagagagaggtcatcttcca

SEQ ID NO: 294443 - DNA, 25 bp, Mus musculus
gagcccagaggcagactcacctcaa

SEQ ID NO: 294444 - DNA, 25 bp, Mus musculus
gagcccagcaccgatcggtcagcac

SEQ ID NO: 294445 - DNA, 25 bp, Mus musculus
gagcccagcagcgtaaacgaccccg

SEQ ID NO: 294446 - DNA, 25 bp, Mus musculus
gagcccagcgcgtggcatgaagcac

SEQ ID NO: 294447 - DNA, 25 bp, Mus musculus
gagcccagcgcgtgggacgaattca

SEQ ID NO: 294448 - DNA, 25 bp, Mus musculus
gagcccagctagccctcctgtaagt

SEQ ID NO: 294449 - DNA, 25 bp, Mus musculus
gagcccaggaccttgctgcaggcac

SEQ ID NO: 294450 - DNA, 25 bp, Mus musculus
gagcccagggaagtggctacagatg

SEQ ID NO: 294451 - DNA, 25 bp, Mus musculus
gagcccagtgagcacttgcaggtgg

SEQ ID NO: 294452 - DNA, 25 bp, Mus musculus
gagcccatatccatgttccagccca

SEQ ID NO: 294453 - DNA, 25 bp, Mus musculus
gagcccatcaggtggttgaagatgg

SEQ ID NO: 294454 - DNA, 25 bp, Mus musculus
gagcccatgagtggaaacaagttga

SEQ ID NO: 294455 - DNA, 25 bp, Mus musculus
gagcccatgatggcggagtgtctgg

SEQ ID NO: 294456 - DNA, 25 bp, Mus musculus
gagcccatggaaaagacgaagagag

SEQ ID NO: 294457 - DNA, 25 bp, Mus musculus
gagcccattgatgtcacagctaagc

SEQ ID NO: 294458 - DNA, 25 bp, Mus musculus
gagccccaagcaggtgaggaatttt

SEQ ID NO: 294459 - DNA, 25 bp, Mus musculus
gagccccacggatttcagtttttct

SEQ ID NO: 294460 - DNA, 25 bp, Mus musculus
gagccccagaagcagcccactgagt

SEQ ID NO: 294461 - DNA, 25 bp, Mus musculus
gagccccagaagcagtaccccaccc

SEQ ID NO: 294462 - DNA, 25 bp, Mus musculus
gagccccagagtggtaaacagctgg

SEQ ID NO: 294463 - DNA, 25 bp, Mus musculus
gagcccccaccagcttcccttcagg

SEQ ID NO: 294464 - DNA, 25 bp, Mus musculus
gagcccccaccaggcctcggtgtct

SEQ ID NO: 294465 - DNA, 25 bp, Mus musculus
gagcccccatgattcagtaacctac

SEQ ID NO: 294466 - DNA, 25 bp, Mus musculus
gagcccccatggctccatacccaaa

SEQ ID NO: 294467 - DNA, 25 bp, Mus musculus
gagcccccgcaggataaggaagcct

SEQ ID NO: 294468 - DNA, 25 bp, Mus musculus
gagcccccgcaggtgcgcttgagaa

SEQ ID NO: 294469 - DNA, 25 bp, Mus musculus
gagccccctctagtgagcactccca

SEQ ID NO: 294470 - DNA, 25 bp, Mus musculus
gagccccgaaggactgctgcagagc

SEQ ID NO: 294471 - DNA, 25 bp, Mus musculus
gagccccgaaggcacacatgatgtc

SEQ ID NO: 294472 - DNA, 25 bp, Mus musculus
gagccccgacccaggggagcagcgc

SEQ ID NO: 294473 - DNA, 25 bp, Mus musculus
gagccccgacccagtggctagacct

SEQ ID NO: 294474 - DNA, 25 bp, Mus musculus
gagccccgagaacgacccaggttca

SEQ ID NO: 294475 - DNA, 25 bp, Mus musculus
gagccccgagcccttccagcaggac

SEQ ID NO: 294476 - DNA, 25 bp, Mus musculus
gagccccgagctcctctaatttcag

SEQ ID NO: 294477 - DNA, 25 bp, Mus musculus
gagccccgaggcagaatctagatct

SEQ ID NO: 294478 - DNA, 25 bp, Mus musculus
gagccccgaggcagatgtgtccttc

SEQ ID NO: 294479 - DNA, 25 bp, Mus musculus
gagccccgaggcaggtctctgctga

SEQ ID NO: 294480 - DNA, 25 bp, Mus musculus
gagccccgatcttggtcattgcctt

SEQ ID NO: 294481 - DNA, 25 bp, Mus musculus
gagccccgcagggccagttcctgat

SEQ ID NO: 294482 - DNA, 25 bp, Mus musculus
gagccccgccccagaaacatcgaat

SEQ ID NO: 294483 - DNA, 25 bp, Mus musculus
gagccccgccccagtgcaaacagct

SEQ ID NO: 294484 - DNA, 25 bp, Mus musculus
gagccccggaggaggtgacagagtt

SEQ ID NO: 294485 - DNA, 25 bp, Mus musculus
gagccccggatggcatggaggagcc

SEQ ID NO: 294486 - DNA, 25 bp, Mus musculus
gagccccggatggccgggctcgtgg

SEQ ID NO: 294487 - DNA, 25 bp, Mus musculus
gagccccgggaaggaaaagcgcaat

SEQ ID NO: 294488 - DNA, 25 bp, Mus musculus
gagccccggtacatggagcttgtgg

SEQ ID NO: 294489 - DNA, 25 bp, Mus musculus
gagccccggtgccaaagcctgcgcg

SEQ ID NO: 294490 - DNA, 25 bp, Mus musculus
gagcccctactcatgatgacgtgtc

SEQ ID NO: 294491 - DNA, 25 bp, Mus musculus
gagcccctagtggcaagggaaaacg

SEQ ID NO: 294492 - DNA, 25 bp, Mus musculus
gagcccctcggatgttctctatgta

SEQ ID NO: 294493 - DNA, 25 bp, Mus musculus
gagcccctcgggccaatcccagtgg

SEQ ID NO: 294494 - DNA, 25 bp, Mus musculus
gagcccctcggtcttcaaagcttca

SEQ ID NO: 294495 - DNA, 25 bp, Mus musculus
gagcccctgggctggtggctctcga

SEQ ID NO: 294496 - DNA, 25 bp, Mus musculus
gagcccgaaggccgaatgttttggc

SEQ ID NO: 294497 - DNA, 25 bp, Mus musculus
gagcccgaaggccggtcgctgtggt

SEQ ID NO: 294498 - DNA, 25 bp, Mus musculus
gagcccgaccagaaccgggtggtgg

SEQ ID NO: 294499 - DNA, 25 bp, Mus musculus
gagcccgagacagggactattccaa

SEQ ID NO: 294500 - DNA, 25 bp, Mus musculus
gagcccgagaggagccacagacccg

SEQ ID NO: 294501 - DNA, 25 bp, Mus musculus
gagcccgagaggcccatctgaacag

SEQ ID NO: 294502 - DNA, 25 bp, Mus musculus
gagcccgagagtttccaaggagtct

SEQ ID NO: 294503 - DNA, 25 bp, Mus musculus
gagcccgcagtaacttggattccag

SEQ ID NO: 294504 - DNA, 25 bp, Mus musculus
gagcccgccccaaagcctgccgaca

SEQ ID NO: 294505 - DNA, 25 bp, Mus musculus
gagcccgcgaagctctcggagactg

SEQ ID NO: 294506 - DNA, 25 bp, Mus musculus
gagcccgcgaggtcactatcgtctg

SEQ ID NO: 294507 - DNA, 25 bp, Mus musculus
gagcccgcgcaggatccaagacact

SEQ ID NO: 294508 - DNA, 25 bp, Mus musculus
gagcccgcggcagatgaggaaaccc

SEQ ID NO: 294509 - DNA, 25 bp, Mus musculus
gagcccgcggcagggaatgattttg

SEQ ID NO: 294510 - DNA, 25 bp, Mus musculus
gagcccgctactttggtgacacaca

SEQ ID NO: 294511 - DNA, 25 bp, Mus musculus
gagcccggcaccaggcaatctttgg

SEQ ID NO: 294512 - DNA, 25 bp, Mus musculus
gagcccggcagatgcccccacgact

SEQ ID NO: 294513 - DNA, 25 bp, Mus musculus
gagcccggcagtcaggagtggcagg

SEQ ID NO: 294514 - DNA, 25 bp, Mus musculus
gagcccggctcaggacaatggattt

SEQ ID NO: 294515 - DNA, 25 bp, Mus musculus
gagcccgggcaggtaaatttaacac

SEQ ID NO: 294516 - DNA, 25 bp, Mus musculus
gagcccgggcggcaggacctgctag

SEQ ID NO: 294517 - DNA, 25 bp, Mus musculus
gagcccgtcagtgtgggtgctcttt

SEQ ID NO: 294518 - DNA, 25 bp, Mus musculus
gagcccgtggttgtgccccctctct

SEQ ID NO: 294519 - DNA, 25 bp, Mus musculus
gagccctcaacagagttcatgttct

SEQ ID NO: 294520 - DNA, 25 bp, Mus musculus
gagccctccatggacatagtcttga

SEQ ID NO: 294521 - DNA, 25 bp, Mus musculus
gagccctcctgcaagtttctccagg

SEQ ID NO: 294522 - DNA, 25 bp, Mus musculus
gagccctcggcgggcatggcccctg

SEQ ID NO: 294523 - DNA, 25 bp, Mus musculus
gagccctcggctgtagagagtcagt

SEQ ID NO: 294524 - DNA, 25 bp, Mus musculus
gagccctcttatgtcctcagagagt

SEQ ID NO: 294525 - DNA, 25 bp, Mus musculus
gagccctgaagattttctgcattta

SEQ ID NO: 294526 - DNA, 25 bp, Mus musculus
gagccctgagaaactgggtgctctt

SEQ ID NO: 294527 - DNA, 25 bp, Mus musculus
gagccctgcaggtactccctggcat

SEQ ID NO: 294528 - DNA, 25 bp, Mus musculus
gagccctgcgccaaaacgacacccc

SEQ ID NO: 294529 - DNA, 25 bp, Mus musculus
gagccctgctacattaataccctgg

SEQ ID NO: 294530 - DNA, 25 bp, Mus musculus
gagccctggaggagtctcagctagt

SEQ ID NO: 294531 - DNA, 25 bp, Mus musculus
gagccctggaggattaccaggcaat

SEQ ID NO: 294532 - DNA, 25 bp, Mus musculus
gagccctgtgcagatttccctcagg

SEQ ID NO: 294533 - DNA, 25 bp, Mus musculus
gagccctgtgcagccttgtgacaga

SEQ ID NO: 294534 - DNA, 25 bp, Mus musculus
gagccctttcttgcatttagtaaag

SEQ ID NO: 294535 - DNA, 25 bp, Mus musculus
gagccctttgaggacaccgctcagt

SEQ ID NO: 294536 - DNA, 25 bp, Mus musculus
gagccctttggatccagccatatta

SEQ ID NO: 294537 - DNA, 25 bp, Mus musculus
gagccgaaaccatgcatgggcgcct

SEQ ID NO: 294538 - DNA, 25 bp, Mus musculus
gagccgaagctaaccccccctggtg

SEQ ID NO: 294539 - DNA, 25 bp, Mus musculus
gagccgaagctcaatgacaatgtca

SEQ ID NO: 294540 - DNA, 25 bp, Mus musculus
gagccgaataagggaagaaaggaaa

SEQ ID NO: 294541 - DNA, 25 bp, Mus musculus
gagccgacagagcaagtgtttgccc

SEQ ID NO: 294542 - DNA, 25 bp, Mus musculus
gagccgacagagcttcgtccacaaa

SEQ ID NO: 294543 - DNA, 25 bp, Mus musculus
gagccgacccaggtctgtgcagacg

SEQ ID NO: 294544 - DNA, 25 bp, Mus musculus
gagccgactttgccagtatgttact

SEQ ID NO: 294545 - DNA, 25 bp, Mus musculus
gagccgagcaagacaatcctaacca

SEQ ID NO: 294546 - DNA, 25 bp, Mus musculus
gagccgagcagcggatcttcctcct

SEQ ID NO: 294547 - DNA, 25 bp, Mus musculus
gagccgagcagcggattggccaacg

SEQ ID NO: 294548 - DNA, 25 bp, Mus musculus
gagccgagccatgaggtattactac

SEQ ID NO: 294549 - DNA, 25 bp, Mus musculus
gagccgagcccggtccccagccaag

SEQ ID NO: 294550 - DNA, 25 bp, Mus musculus
gagccgagcccgtaggtgagcctga

SEQ ID NO: 294551 - DNA, 25 bp, Mus musculus
gagccgagctcagccaaccccacca

SEQ ID NO: 294552 - DNA, 25 bp, Mus musculus
gagccgagtctagagctcctccggg

SEQ ID NO: 294553 - DNA, 25 bp, Mus musculus
gagccgagtgatggggcgttgggcg

SEQ ID NO: 294554 - DNA, 25 bp, Mus musculus
gagccgcaaaggatgaaacgaggag

SEQ ID NO: 294555 - DNA, 25 bp, Mus musculus
gagccgcaagccagcacccacctgc

SEQ ID NO: 294556 - DNA, 25 bp, Mus musculus
gagccgcaagccaggacccacctgc

SEQ ID NO: 294557 - DNA, 25 bp, Mus musculus
gagccgcacggcggacaaatgaaga

SEQ ID NO: 294558 - DNA, 25 bp, Mus musculus
gagccgcacggcgggaatctcttcc

SEQ ID NO: 294559 - DNA, 25 bp, Mus musculus
gagccgcacgtgtcctgggtcatga

SEQ ID NO: 294560 - DNA, 25 bp, Mus musculus
gagccgcagaagtatgaggcttggg

SEQ ID NO: 294561 - DNA, 25 bp, Mus musculus
gagccgcagcatggagacaaaaaag

SEQ ID NO: 294562 - DNA, 25 bp, Mus musculus
gagccgcagcatgggaaattaagcg

SEQ ID NO: 294563 - DNA, 25 bp, Mus musculus
gagccgcagggtagaggcagtcatg

SEQ ID NO: 294564 - DNA, 25 bp, Mus musculus
gagccgcattaaggacagccttctg

SEQ ID NO: 294565 - DNA, 25 bp, Mus musculus
gagccgccaagtgcctgaagacctg

SEQ ID NO: 294566 - DNA, 25 bp, Mus musculus
gagccgccaccacggcgggcgtccg

SEQ ID NO: 294567 - DNA, 25 bp, Mus musculus
gagccgccagcgccgtccgtgacct

SEQ ID NO: 294568 - DNA, 25 bp, Mus musculus
gagccgcccggaggtgcttgaggcg

SEQ ID NO: 294569 - DNA, 25 bp, Mus musculus
gagccgccgcccaggtaactatagt

SEQ ID NO: 294570 - DNA, 25 bp, Mus musculus
gagccgccgcccaggttctgggaaa

SEQ ID NO: 294571 - DNA, 25 bp, Mus musculus
gagccgccgggagatgctgttgacg

SEQ ID NO: 294572 - DNA, 25 bp, Mus musculus
gagccgcgcgtgtctccacagaggc

SEQ ID NO: 294573 - DNA, 25 bp, Mus musculus
gagccgcgcttccgctccggccctc

SEQ ID NO: 294574 - DNA, 25 bp, Mus musculus
gagccgcggaggacgtggcctgggg

SEQ ID NO: 294575 - DNA, 25 bp, Mus musculus
gagccgcggatccgcatttgcaggc

SEQ ID NO: 294576 - DNA, 25 bp, Mus musculus
gagccgcgggttaccgtgcagacat

SEQ ID NO: 294577 - DNA, 25 bp, Mus musculus
gagccgcgtagactttaagaaacaa

SEQ ID NO: 294578 - DNA, 25 bp, Mus musculus
gagccgcgtgcgaggatgaaacgag

SEQ ID NO: 294579 - DNA, 25 bp, Mus musculus
gagccgctgcacgatttaccttcaa

SEQ ID NO: 294580 - DNA, 25 bp, Mus musculus
gagccgctggcttacagggttccag

SEQ ID NO: 294581 - DNA, 25 bp, Mus musculus
gagccgctttaggatcgctactctt

SEQ ID NO: 294582 - DNA, 25 bp, Mus musculus
gagccggaaaggcggaggccaggct

SEQ ID NO: 294583 - DNA, 25 bp, Mus musculus
gagccggacccctctgaccctctgg

SEQ ID NO: 294584 - DNA, 25 bp, Mus musculus
gagccggaccgattcagactcggac

SEQ ID NO: 294585 - DNA, 25 bp, Mus musculus
gagccggaccgccgcaaggtcatct

SEQ ID NO: 294586 - DNA, 25 bp, Mus musculus
gagccggagcctccggttaagcctg

SEQ ID NO: 294587 - DNA, 25 bp, Mus musculus
gagccggaggaagagggctgcctct

SEQ ID NO: 294588 - DNA, 25 bp, Mus musculus
gagccggagtccagggtctccatag

SEQ ID NO: 294589 - DNA, 25 bp, Mus musculus
gagccggagtccgtctacagagagc

SEQ ID NO: 294590 - DNA, 25 bp, Mus musculus
gagccggattcaggaggtggatgcc

SEQ ID NO: 294591 - DNA, 25 bp, Mus musculus
gagccggcagccatcatgttaagga

SEQ ID NO: 294592 - DNA, 25 bp, Mus musculus
gagccggcaggatttctccatatag

SEQ ID NO: 294593 - DNA, 25 bp, Mus musculus
gagccggcccgcgtacggcatccag

SEQ ID NO: 294594 - DNA, 25 bp, Mus musculus
gagccggcctaaaaggctgctcttt

SEQ ID NO: 294595 - DNA, 25 bp, Mus musculus
gagccggcctaaaagggctccttct

SEQ ID NO: 294596 - DNA, 25 bp, Mus musculus
gagccggccttcagcacacagcaca

SEQ ID NO: 294597 - DNA, 25 bp, Mus musculus
gagccggcgggaggctgacaatttc

SEQ ID NO: 294598 - DNA, 25 bp, Mus musculus
gagccggctgatctggaccccgagg

SEQ ID NO: 294599 - DNA, 25 bp, Mus musculus
gagccggctgatgccaagacggaag

SEQ ID NO: 294600 - DNA, 25 bp, Mus musculus
gagccgggaggctacagactacaag

SEQ ID NO: 294601 - DNA, 25 bp, Mus musculus
gagccgggcagcggcctggaggagg

SEQ ID NO: 294602 - DNA, 25 bp, Mus musculus
gagccggggaaaggtgctctcccag

SEQ ID NO: 294603 - DNA, 25 bp, Mus musculus
gagccggggaaaggtgtctaaggat

SEQ ID NO: 294604 - DNA, 25 bp, Mus musculus
gagccggggagccgggggcactatg

SEQ ID NO: 294605 - DNA, 25 bp, Mus musculus
gagccggggccgcaggaggcccagc

SEQ ID NO: 294606 - DNA, 25 bp, Mus musculus
gagccggggctcgatgtctacacta

SEQ ID NO: 294607 - DNA, 25 bp, Mus musculus
gagccgtcagcccagagctgattta

SEQ ID NO: 294608 - DNA, 25 bp, Mus musculus
gagccgtctctacttaagaagctct

SEQ ID NO: 294609 - DNA, 25 bp, Mus musculus
gagccgtctgaagaactgagtgtga

SEQ ID NO: 294610 - DNA, 25 bp, Mus musculus
gagccgtctgaagactgctctttga

SEQ ID NO: 294611 - DNA, 25 bp, Mus musculus
gagccgtctgggcaagcaggaggac

SEQ ID NO: 294612 - DNA, 25 bp, Mus musculus
gagccgtctggtgtggagggtgcag

SEQ ID NO: 294613 - DNA, 25 bp, Mus musculus
gagccgtgacggagatgctcacgta

SEQ ID NO: 294614 - DNA, 25 bp, Mus musculus
gagccgtgagccagcttcacctatc

SEQ ID NO: 294615 - DNA, 25 bp, Mus musculus
gagccgtgcaggcagcggctgcgta

SEQ ID NO: 294616 - DNA, 25 bp, Mus musculus
gagccgtgcagggttcactatcgtt

SEQ ID NO: 294617 - DNA, 25 bp, Mus musculus
gagccgtggatgagttttgaagtga

SEQ ID NO: 294618 - DNA, 25 bp, Mus musculus
gagcctaaagaacatcaaactgaag

SEQ ID NO: 294619 - DNA, 25 bp, Mus musculus
gagcctaacacaggtggtgaccgtt

SEQ ID NO: 294620 - DNA, 25 bp, Mus musculus
gagcctaagtcctggtacgccatac

SEQ ID NO: 294621 - DNA, 25 bp, Mus musculus
gagcctacccagagaactggcagaa

SEQ ID NO: 294622 - DNA, 25 bp, Mus musculus
gagcctacccagagataagaagcat

SEQ ID NO: 294623 - DNA, 25 bp, Mus musculus
gagcctacccgacagccccataagg

SEQ ID NO: 294624 - DNA, 25 bp, Mus musculus
gagcctacccgacaggaaggtctat

SEQ ID NO: 294625 - DNA, 25 bp, Mus musculus
gagcctactgaagatcgacttggag

SEQ ID NO: 294626 - DNA, 25 bp, Mus musculus
gagcctactgaaggcctcctcaaaa

SEQ ID NO: 294627 - DNA, 25 bp, Mus musculus
gagcctagacctgacgggacatcct

SEQ ID NO: 294628 - DNA, 25 bp, Mus musculus
gagcctagacctgtcagaggcctgt

SEQ ID NO: 294629 - DNA, 25 bp, Mus musculus
gagcctagaggagaaagtctcgcgg

SEQ ID NO: 294630 - DNA, 25 bp, Mus musculus
gagcctagccaaagatatgaggatc

SEQ ID NO: 294631 - DNA, 25 bp, Mus musculus
gagcctagctctcagagctcctcct

SEQ ID NO: 294632 - DNA, 25 bp, Mus musculus
gagcctagtactgccaaccccacgg

SEQ ID NO: 294633 - DNA, 25 bp, Mus musculus
gagcctagtactggaggagagttaa

SEQ ID NO: 294634 - DNA, 25 bp, Mus musculus
gagcctatgaagcaaccacatgaaa

SEQ ID NO: 294635 - DNA, 25 bp, Mus musculus
gagcctatgaaggaaccacatgaaa

SEQ ID NO: 294636 - DNA, 25 bp, Mus musculus
gagcctcaccccgagcaggggagat

SEQ ID NO: 294637 - DNA, 25 bp, Mus musculus
gagcctcacccgagcgcagaccctg

SEQ ID NO: 294638 - DNA, 25 bp, Mus musculus
gagcctcactggtgggtgtgcaaac

SEQ ID NO: 294639 - DNA, 25 bp, Mus musculus
gagcctcaggactcagagaggctga

SEQ ID NO: 294640 - DNA, 25 bp, Mus musculus
gagcctcagtacctggtactggtct

SEQ ID NO: 294641 - DNA, 25 bp, Mus musculus
gagcctcatggttcggagcgaccgt

SEQ ID NO: 294642 - DNA, 25 bp, Mus musculus
gagcctccagggacagtgtcttggt

SEQ ID NO: 294643 - DNA, 25 bp, Mus musculus
gagcctccagtgttgagtggagact

SEQ ID NO: 294644 - DNA, 25 bp, Mus musculus
gagcctcccaggaagagagggagaa

SEQ ID NO: 294645 - DNA, 25 bp, Mus musculus
gagcctcccgagcaccatcaatcag

SEQ ID NO: 294646 - DNA, 25 bp, Mus musculus
gagcctccggccaggcgagcagact

SEQ ID NO: 294647 - DNA, 25 bp, Mus musculus
gagcctccggggaccttcctggtgc

SEQ ID NO: 294648 - DNA, 25 bp, Mus musculus
gagcctccgggggtgtctctttgga

SEQ ID NO: 294649 - DNA, 25 bp, Mus musculus
gagcctcctgacatgatgtagctct

SEQ ID NO: 294650 - DNA, 25 bp, Mus musculus
gagcctcctggagctggtggagtac

SEQ ID NO: 294651 - DNA, 25 bp, Mus musculus
gagcctcctggatatatctattctt

SEQ ID NO: 294652 - DNA, 25 bp, Mus musculus
gagcctccttcaggcctcaggcttg

SEQ ID NO: 294653 - DNA, 25 bp, Mus musculus
gagcctcgcggcttgactaaaatgt

SEQ ID NO: 294654 - DNA, 25 bp, Mus musculus
gagcctcgtgatcaggaagaaaagc

SEQ ID NO: 294655 - DNA, 25 bp, Mus musculus
gagcctcgtgatcaggaggaatctg

SEQ ID NO: 294656 - DNA, 25 bp, Mus musculus
gagcctcgtgatcagtagcaagatt

SEQ ID NO: 294657 - DNA, 25 bp, Mus musculus
gagcctctaggccctaggaccatga

SEQ ID NO: 294658 - DNA, 25 bp, Mus musculus
gagcctctcagagataaaatcaaag

SEQ ID NO: 294659 - DNA, 25 bp, Mus musculus
gagcctcttaaggtcattttcttgg

SEQ ID NO: 294660 - DNA, 25 bp, Mus musculus
gagcctgaaaaatacattgccctag

SEQ ID NO: 294661 - DNA, 25 bp, Mus musculus
gagcctgaacagagagctgaaatta

SEQ ID NO: 294662 - DNA, 25 bp, Mus musculus
gagcctgaaccgcccgttgaccgag

SEQ ID NO: 294663 - DNA, 25 bp, Mus musculus
gagcctgaagaaaaagttaaactgg

SEQ ID NO: 294664 - DNA, 25 bp, Mus musculus
gagcctgaaggaagagagatatacg

SEQ ID NO: 294665 - DNA, 25 bp, Mus musculus
gagcctgaaggctagatatggattt

SEQ ID NO: 294666 - DNA, 25 bp, Mus musculus
gagcctgaaggttaaaatgagcttg

SEQ ID NO: 294667 - DNA, 25 bp, Mus musculus
gagcctgaagtggtgttcaacattc

SEQ ID NO: 294668 - DNA, 25 bp, Mus musculus
gagcctgacagaaggtctccgggca

SEQ ID NO: 294669 - DNA, 25 bp, Mus musculus
gagcctgatgaatgaggtgtgtact

SEQ ID NO: 294670 - DNA, 25 bp, Mus musculus
gagcctgatgtgaggctcctcatag

SEQ ID NO: 294671 - DNA, 25 bp, Mus musculus
gagcctgcaccagagcaatgttctt

SEQ ID NO: 294672 - DNA, 25 bp, Mus musculus
gagcctgcagcctgtggtatcctgt

SEQ ID NO: 294673 - DNA, 25 bp, Mus musculus
gagcctgcagtcaaaatcaagcact

SEQ ID NO: 294674 - DNA, 25 bp, Mus musculus
gagcctgcagtcaaatggatctggc

SEQ ID NO: 294675 - DNA, 25 bp, Mus musculus
gagcctgcagtccagagtggaccag

SEQ ID NO: 294676 - DNA, 25 bp, Mus musculus
gagcctgcagtccaggatagatatg

SEQ ID NO: 294677 - DNA, 25 bp, Mus musculus
gagcctgcagtccaggtcctgcgac

SEQ ID NO: 294678 - DNA, 25 bp, Mus musculus
gagcctgccaggctctagttcattg

SEQ ID NO: 294679 - DNA, 25 bp, Mus musculus
gagcctgcccaagtcttcaactgct

SEQ ID NO: 294680 - DNA, 25 bp, Mus musculus
gagcctgctggaaagagattgctct

SEQ ID NO: 294681 - DNA, 25 bp, Mus musculus
gagcctgctggcaatcatctgggga

SEQ ID NO: 294682 - DNA, 25 bp, Mus musculus
gagcctgctggccaaaataccgact

SEQ ID NO: 294683 - DNA, 25 bp, Mus musculus
gagcctgctggccaatgacactctg

SEQ ID NO: 294684 - DNA, 25 bp, Mus musculus
gagcctggaaaatgccatcgagaca

SEQ ID NO: 294685 - DNA, 25 bp, Mus musculus
gagcctggaatagagcaatcaagat

SEQ ID NO: 294686 - DNA, 25 bp, Mus musculus
gagcctggaccaatgggtccaattg

SEQ ID NO: 294687 - DNA, 25 bp, Mus musculus
gagcctggcaatggtctgccaggaa

SEQ ID NO: 294688 - DNA, 25 bp, Mus musculus
gagcctggccagggagaggagatcg

SEQ ID NO: 294689 - DNA, 25 bp, Mus musculus
gagcctggctggcacgttttgtgcc

SEQ ID NO: 294690 - DNA, 25 bp, Mus musculus
gagcctggcttctaataacatgctg

SEQ ID NO: 294691 - DNA, 25 bp, Mus musculus
gagcctgggaagagaagaaccaaag

SEQ ID NO: 294692 - DNA, 25 bp, Mus musculus
gagcctgggaagctccaggtgcggt

SEQ ID NO: 294693 - DNA, 25 bp, Mus musculus
gagcctgggccaagatgaaagcttg

SEQ ID NO: 294694 - DNA, 25 bp, Mus musculus
gagcctgggcggagccccttaggtg

SEQ ID NO: 294695 - DNA, 25 bp, Mus musculus
gagcctgggcggagtagcgctgggg

SEQ ID NO: 294696 - DNA, 25 bp, Mus musculus
gagcctggggcgaggaaccaccgac

SEQ ID NO: 294697 - DNA, 25 bp, Mus musculus
gagcctggggcggagtggcagccca

SEQ ID NO: 294698 - DNA, 25 bp, Mus musculus
gagcctggggcggtcagtttagaat

SEQ ID NO: 294699 - DNA, 25 bp, Mus musculus
gagcctggtcaggcagtccctcgag

SEQ ID NO: 294700 - DNA, 25 bp, Mus musculus
gagcctggtcaggtgaaagcagcca

SEQ ID NO: 294701 - DNA, 25 bp, Mus musculus
gagcctggtgtctctggtcccatgg

SEQ ID NO: 294702 - DNA, 25 bp, Mus musculus
gagcctgtagaccaggatggaaaca

SEQ ID NO: 294703 - DNA, 25 bp, Mus musculus
gagcctgtcatccagaatgccttat

SEQ ID NO: 294704 - DNA, 25 bp, Mus musculus
gagcctgtcatccagggcttcctac

SEQ ID NO: 294705 - DNA, 25 bp, Mus musculus
gagcctgtgagaaaactaactgctt

SEQ ID NO: 294706 - DNA, 25 bp, Mus musculus
gagcctgtgagcttcaaactggatt

SEQ ID NO: 294707 - DNA, 25 bp, Mus musculus
gagcctgtgcaagggcggcctgagc

SEQ ID NO: 294708 - DNA, 25 bp, Mus musculus
gagcctgtggcctaaatgtagaaaa

SEQ ID NO: 294709 - DNA, 25 bp, Mus musculus
gagcctgttacacagcccagggaat

SEQ ID NO: 294710 - DNA, 25 bp, Mus musculus
gagcctgttttggacccaacagact

SEQ ID NO: 294711 - DNA, 25 bp, Mus musculus
gagccttagaggcccacgaggcttc

SEQ ID NO: 294712 - DNA, 25 bp, Mus musculus
gagccttatacccggagagagaagc

SEQ ID NO: 294713 - DNA, 25 bp, Mus musculus
gagccttcaacctgacgctgtccat

SEQ ID NO: 294714 - DNA, 25 bp, Mus musculus
gagccttcaacctggatgccctcca

SEQ ID NO: 294715 - DNA, 25 bp, Mus musculus
gagccttcaagaagttgctctgggc

SEQ ID NO: 294716 - DNA, 25 bp, Mus musculus
gagccttccaaacagaacctttccc

SEQ ID NO: 294717 - DNA, 25 bp, Mus musculus
gagccttccaaacagtttcaaagag

SEQ ID NO: 294718 - DNA, 25 bp, Mus musculus
gagccttccagatacattgacatca

SEQ ID NO: 294719 - DNA, 25 bp, Mus musculus
gagccttccagatacgtcttccaag

SEQ ID NO: 294720 - DNA, 25 bp, Mus musculus
gagccttcctgagatactgcagcct

SEQ ID NO: 294721 - DNA, 25 bp, Mus musculus
gagccttcgagaggtgctgagcttg

SEQ ID NO: 294722 - DNA, 25 bp, Mus musculus
gagccttcgcgaggtggtggctgag

SEQ ID NO: 294723 - DNA, 25 bp, Mus musculus
gagccttctcctgaaacactgtgcc

SEQ ID NO: 294724 - DNA, 25 bp, Mus musculus
gagccttctggcagggtccctgcat

SEQ ID NO: 294725 - DNA, 25 bp, Mus musculus
gagccttgagatggcgttgacgttg

SEQ ID NO: 294726 - DNA, 25 bp, Mus musculus
gagccttgctcaggagtatcccggc

SEQ ID NO: 294727 - DNA, 25 bp, Mus musculus
gagccttgctcaggtttcccttcct

SEQ ID NO: 294728 - DNA, 25 bp, Mus musculus
gagccttggagagtctccaaggact

SEQ ID NO: 294729 - DNA, 25 bp, Mus musculus
gagccttggcctgtggtcaaaatcc

SEQ ID NO: 294730 - DNA, 25 bp, Mus musculus
gagcctttcccggtgggacgctcgt

SEQ ID NO: 294731 - DNA, 25 bp, Mus musculus
gagcctttcctactggctggaccca

SEQ ID NO: 294732 - DNA, 25 bp, Mus musculus
gagcctttggaaagtgacactgatg

SEQ ID NO: 294733 - DNA, 25 bp, Mus musculus
gagcctttgggaaggcgacagactt

SEQ ID NO: 294734 - DNA, 25 bp, Mus musculus
gagccttttgtgaagatcatcacag

SEQ ID NO: 294735 - DNA, 25 bp, Mus musculus
gagcctttttcaagaccaacagcaa

SEQ ID NO: 294736 - DNA, 25 bp, Mus musculus
gagcgaacgagtatcagcatgtgtt

SEQ ID NO: 294737 - DNA, 25 bp, Mus musculus
gagcgaagacgggagcgggagcagc

SEQ ID NO: 294738 - DNA, 25 bp, Mus musculus
gagcgaatggagggtggagcttttg

SEQ ID NO: 294739 - DNA, 25 bp, Mus musculus
gagcgacaaggtaaaagaagaaatg

SEQ ID NO: 294740 - DNA, 25 bp, Mus musculus
gagcgacaccaggaacaccggacag

SEQ ID NO: 294741 - DNA, 25 bp, Mus musculus
gagcgaccagagatgtggctttggg

SEQ ID NO: 294742 - DNA, 25 bp, Mus musculus
gagcgaccaggacaggattccatgg

SEQ ID NO: 294743 - DNA, 25 bp, Mus musculus
gagcgacccacacgtcaaactacaa

SEQ ID NO: 294744 - DNA, 25 bp, Mus musculus
gagcgaccctgacagagtcatgtgg

SEQ ID NO: 294745 - DNA, 25 bp, Mus musculus
gagcgaccgggtcatgtaggaaatt

SEQ ID NO: 294746 - DNA, 25 bp, Mus musculus
gagcgacctgtggaggcttggcaat

SEQ ID NO: 294747 - DNA, 25 bp, Mus musculus
gagcgacgtggaggaggtattcaca

SEQ ID NO: 294748 - DNA, 25 bp, Mus musculus
gagcgactcgatcccctgaacttac

SEQ ID NO: 294749 - DNA, 25 bp, Mus musculus
gagcgactcgttctgcctcccctag

SEQ ID NO: 294750 - DNA, 25 bp, Mus musculus
gagcgactgaggcaattaaaaaccc

SEQ ID NO: 294751 - DNA, 25 bp, Mus musculus
gagcgactgaggtctgccgacgggg

SEQ ID NO: 294752 - DNA, 25 bp, Mus musculus
gagcgactgcatcgtcaacgtgtgg

SEQ ID NO: 294753 - DNA, 25 bp, Mus musculus
gagcgagacaactggaacccacagt

SEQ ID NO: 294754 - DNA, 25 bp, Mus musculus
gagcgagaccctgatctgggggatg

SEQ ID NO: 294755 - DNA, 25 bp, Mus musculus
gagcgagagagggaactggaggagt

SEQ ID NO: 294756 - DNA, 25 bp, Mus musculus
gagcgagatgaagcacacaggcatt

SEQ ID NO: 294757 - DNA, 25 bp, Mus musculus
gagcgagcaaaaagatttaaggcaa

SEQ ID NO: 294758 - DNA, 25 bp, Mus musculus
gagcgagcaaaaagggcaacaatag

SEQ ID NO: 294759 - DNA, 25 bp, Mus musculus
gagcgagcccagcaggaagatgcat

SEQ ID NO: 294760 - DNA, 25 bp, Mus musculus
gagcgagcccaggcaagaagacagc

SEQ ID NO: 294761 - DNA, 25 bp, Mus musculus
gagcgagccgagctgtcacgaccgg

SEQ ID NO: 294762 - DNA, 25 bp, Mus musculus
gagcgagcgaagagagcaaagacca

SEQ ID NO: 294763 - DNA, 25 bp, Mus musculus
gagcgagcgcggggccgcaagcagt

SEQ ID NO: 294764 - DNA, 25 bp, Mus musculus
gagcgagcggatttgataatgggct

SEQ ID NO: 294765 - DNA, 25 bp, Mus musculus
gagcgagcggtcctaacatttaaaa

SEQ ID NO: 294766 - DNA, 25 bp, Mus musculus
gagcgagcggtcctagtcttctcag

SEQ ID NO: 294767 - DNA, 25 bp, Mus musculus
gagcgaggaaggcacctgatgcagt

SEQ ID NO: 294768 - DNA, 25 bp, Mus musculus
gagcgaggaagggatcgcttacact

SEQ ID NO: 294769 - DNA, 25 bp, Mus musculus
gagcgaggactgcaagctaccttgc

SEQ ID NO: 294770 - DNA, 25 bp, Mus musculus
gagcgaggactgcaagctgccctgc

SEQ ID NO: 294771 - DNA, 25 bp, Mus musculus
gagcgaggagacgagcaaaaatcaa

SEQ ID NO: 294772 - DNA, 25 bp, Mus musculus
gagcgaggaggtggaagatatcaac

SEQ ID NO: 294773 - DNA, 25 bp, Mus musculus
gagcgaggcgagcgtgcacagtgct

SEQ ID NO: 294774 - DNA, 25 bp, Mus musculus
gagcgaggcgaggcaccatgacaac

SEQ ID NO: 294775 - DNA, 25 bp, Mus musculus
gagcgaggctccaagggatttggtt

SEQ ID NO: 294776 - DNA, 25 bp, Mus musculus
gagcgaggctccaaggttaataatg

SEQ ID NO: 294777 - DNA, 25 bp, Mus musculus
gagcgaggtaaagaaatccaccgtc

SEQ ID NO: 294778 - DNA, 25 bp, Mus musculus
gagcgaggtgtgactgcaaagtggc

SEQ ID NO: 294779 - DNA, 25 bp, Mus musculus
gagcgagtcgaattggcagaggggg

SEQ ID NO: 294780 - DNA, 25 bp, Mus musculus
gagcgagttcaagaacctggacatc

SEQ ID NO: 294781 - DNA, 25 bp, Mus musculus
gagcgagttcaagctgatcatggct

SEQ ID NO: 294782 - DNA, 25 bp, Mus musculus
gagcgagttcaagggcagagaacat

SEQ ID NO: 294783 - DNA, 25 bp, Mus musculus
gagcgatacgacgaaatggtggaat

SEQ ID NO: 294784 - DNA, 25 bp, Mus musculus
gagcgatacgacggttgaaactgag

SEQ ID NO: 294785 - DNA, 25 bp, Mus musculus
gagcgatcagaggaacaaggagccc

SEQ ID NO: 294786 - DNA, 25 bp, Mus musculus
gagcgatccagtttgacgccgagtt

SEQ ID NO: 294787 - DNA, 25 bp, Mus musculus
gagcgatgtggtatgccctgatgtc

SEQ ID NO: 294788 - DNA, 25 bp, Mus musculus
gagcgatgtgtgatcttttggagtg

SEQ ID NO: 294789 - DNA, 25 bp, Mus musculus
gagcgatgtgtggtccttcggtgtg

SEQ ID NO: 294790 - DNA, 25 bp, Mus musculus
gagcgcacctgaggggaagattgct

SEQ ID NO: 294791 - DNA, 25 bp, Mus musculus
gagcgcacctggtgattttacccaa

SEQ ID NO: 294792 - DNA, 25 bp, Mus musculus
gagcgcacgaccggtggcttgttgg

SEQ ID NO: 294793 - DNA, 25 bp, Mus musculus
gagcgcagaaggctgagaccgctgc

SEQ ID NO: 294794 - DNA, 25 bp, Mus musculus
gagcgcagaggctggggacagtact

SEQ ID NO: 294795 - DNA, 25 bp, Mus musculus
gagcgcagcaaggtgtatgatgaaa

SEQ ID NO: 294796 - DNA, 25 bp, Mus musculus
gagcgcagcataatgctaaagaagt

SEQ ID NO: 294797 - DNA, 25 bp, Mus musculus
gagcgcagcttgggatcctggtatc

SEQ ID NO: 294798 - DNA, 25 bp, Mus musculus
gagcgcaggctgtactacgagggcc

SEQ ID NO: 294799 - DNA, 25 bp, Mus musculus
gagcgcagtgggagatttgaaaaat

SEQ ID NO: 294800 - DNA, 25 bp, Mus musculus
gagcgcagtgtgaaactggcccagg

SEQ ID NO: 294801 - DNA, 25 bp, Mus musculus
gagcgcatcaagacccttcgcaggt

SEQ ID NO: 294802 - DNA, 25 bp, Mus musculus
gagcgcatcaaggagctggagtcag

SEQ ID NO: 294803 - DNA, 25 bp, Mus musculus
gagcgcatcaaggggatatctagtt

SEQ ID NO: 294804 - DNA, 25 bp, Mus musculus
gagcgcatcagctgcagttaaagca

SEQ ID NO: 294805 - DNA, 25 bp, Mus musculus
gagcgcatcggcaagctggtcgttt

SEQ ID NO: 294806 - DNA, 25 bp, Mus musculus
gagcgcatgaggagccgagaggatg

SEQ ID NO: 294807 - DNA, 25 bp, Mus musculus
gagcgcatgcagagcagggtgggcc

SEQ ID NO: 294808 - DNA, 25 bp, Mus musculus
gagcgcatggtgcagtctgttgtct

SEQ ID NO: 294809 - DNA, 25 bp, Mus musculus
gagcgcattaggcggtgggtctcgg

SEQ ID NO: 294810 - DNA, 25 bp, Mus musculus
gagcgcattagggccaatgaggcga

SEQ ID NO: 294811 - DNA, 25 bp, Mus musculus
gagcgcattgaggaaagcgggactg

SEQ ID NO: 294812 - DNA, 25 bp, Mus musculus
gagcgccagagccggtggcggtggg

SEQ ID NO: 294813 - DNA, 25 bp, Mus musculus
gagcgcccagtctgatacacttttg

SEQ ID NO: 294814 - DNA, 25 bp, Mus musculus
gagcgcccgagcagcttggccgaca

SEQ ID NO: 294815 - DNA, 25 bp, Mus musculus
gagcgccctcagttgagccccacat

SEQ ID NO: 294816 - DNA, 25 bp, Mus musculus
gagcgccctgccaagattttcacct

SEQ ID NO: 294817 - DNA, 25 bp, Mus musculus
gagcgccgagtgcagagagcaaaga

SEQ ID NO: 294818 - DNA, 25 bp, Mus musculus
gagcgccgggagccggcaggcatgc

SEQ ID NO: 294819 - DNA, 25 bp, Mus musculus
gagcgcctcatcgggggcacagaga

SEQ ID NO: 294820 - DNA, 25 bp, Mus musculus
gagcgcctgtgtcaggagcatatgc

SEQ ID NO: 294821 - DNA, 25 bp, Mus musculus
gagcgcgagcgagcgtgacctacag

SEQ ID NO: 294822 - DNA, 25 bp, Mus musculus
gagcgcgcaccgggttacacaataa

SEQ ID NO: 294823 - DNA, 25 bp, Mus musculus
gagcgcggaggtgatgctagcgagg

SEQ ID NO: 294824 - DNA, 25 bp, Mus musculus
gagcgcggcagtggagctggcctga

SEQ ID NO: 294825 - DNA, 25 bp, Mus musculus
gagcgcggggccgcaagcagtgcaa

SEQ ID NO: 294826 - DNA, 25 bp, Mus musculus
gagcgcggggtcagcacatggtttg

SEQ ID NO: 294827 - DNA, 25 bp, Mus musculus
gagcgcgtctcagggaactgagccg

SEQ ID NO: 294828 - DNA, 25 bp, Mus musculus
gagcgctacaaagatgagcgggacc

SEQ ID NO: 294829 - DNA, 25 bp, Mus musculus
gagcgctacattgcccccacagtgc

SEQ ID NO: 294830 - DNA, 25 bp, Mus musculus
gagcgctacattggtcatcaaacag

SEQ ID NO: 294831 - DNA, 25 bp, Mus musculus
gagcgctcaggagaaatatgaacca

SEQ ID NO: 294832 - DNA, 25 bp, Mus musculus
gagcgctctgcgaccagctcccaag

SEQ ID NO: 294833 - DNA, 25 bp, Mus musculus
gagcgctgccagccggaacagtgag

SEQ ID NO: 294834 - DNA, 25 bp, Mus musculus
gagcgctgcctcagagcccaccgca

SEQ ID NO: 294835 - DNA, 25 bp, Mus musculus
gagcgctgcggcgtggagcaaaaca

SEQ ID NO: 294836 - DNA, 25 bp, Mus musculus
gagcgctgggcagggagatctgacg

SEQ ID NO: 294837 - DNA, 25 bp, Mus musculus
gagcgctttcaggcccgcacaggcg

SEQ ID NO: 294838 - DNA, 25 bp, Mus musculus
gagcgctttgtgcaggcccagagga

SEQ ID NO: 294839 - DNA, 25 bp, Mus musculus
gagcggaaactcacaggctaagctc

SEQ ID NO: 294840 - DNA, 25 bp, Mus musculus
gagcggaaactggatcgcttcaagc

SEQ ID NO: 294841 - DNA, 25 bp, Mus musculus
gagcggaagagccccagcgggaaga

SEQ ID NO: 294842 - DNA, 25 bp, Mus musculus
gagcggaatagagggaaacaggcca

SEQ ID NO: 294843 - DNA, 25 bp, Mus musculus
gagcggacaaggagatctgacgggc

SEQ ID NO: 294844 - DNA, 25 bp, Mus musculus
gagcggactcagacggtcagcgtca

SEQ ID NO: 294845 - DNA, 25 bp, Mus musculus
gagcggactggcttttatgaaacag

SEQ ID NO: 294846 - DNA, 25 bp, Mus musculus
gagcggagagcgacatgtccttccg

SEQ ID NO: 294847 - DNA, 25 bp, Mus musculus
gagcggagcagattgaggacataaa

SEQ ID NO: 294848 - DNA, 25 bp, Mus musculus
gagcggagcaggaaggagatgactc

SEQ ID NO: 294849 - DNA, 25 bp, Mus musculus
gagcggagccaacatcaacagaatc

SEQ ID NO: 294850 - DNA, 25 bp, Mus musculus
gagcggagccagcaagccccgccca

SEQ ID NO: 294851 - DNA, 25 bp, Mus musculus
gagcggagccccatcttgatatgga

SEQ ID NO: 294852 - DNA, 25 bp, Mus musculus
gagcggaggcaggcaaaacccacgg

SEQ ID NO: 294853 - DNA, 25 bp, Mus musculus
gagcggagttgagattcccaccctg

SEQ ID NO: 294854 - DNA, 25 bp, Mus musculus
gagcggatatgaccaagttttacag

SEQ ID NO: 294855 - DNA, 25 bp, Mus musculus
gagcggatatggtagccaaggagca

SEQ ID NO: 294856 - DNA, 25 bp, Mus musculus
gagcggatgctcacggaacgaatgt

SEQ ID NO: 294857 - DNA, 25 bp, Mus musculus
gagcggcaaaagagctttatggatt

SEQ ID NO: 294858 - DNA, 25 bp, Mus musculus
gagcggcaaaagagtgatagaagga

SEQ ID NO: 294859 - DNA, 25 bp, Mus musculus
gagcggcacatttgacctgctggaa

SEQ ID NO: 294860 - DNA, 25 bp, Mus musculus
gagcggcagaggagaaccctcttgg

SEQ ID NO: 294861 - DNA, 25 bp, Mus musculus
gagcggcaggtaactgtagctgtct

SEQ ID NO: 294862 - DNA, 25 bp, Mus musculus
gagcggccacggcagggttaacctc

SEQ ID NO: 294863 - DNA, 25 bp, Mus musculus
gagcggccagagtatggcttccatt

SEQ ID NO: 294864 - DNA, 25 bp, Mus musculus
gagcggccaggtgtaagagtgtttt

SEQ ID NO: 294865 - DNA, 25 bp, Mus musculus
gagcggccggaagatggcagacttt

SEQ ID NO: 294866 - DNA, 25 bp, Mus musculus
gagcggccggaaggagtggaatgtg

SEQ ID NO: 294867 - DNA, 25 bp, Mus musculus
gagcggccggaagtgttactgtgac

SEQ ID NO: 294868 - DNA, 25 bp, Mus musculus
gagcggccgtaaggattcacctgag

SEQ ID NO: 294869 - DNA, 25 bp, Mus musculus
gagcggccgtaagtttgctaactgt

SEQ ID NO: 294870 - DNA, 25 bp, Mus musculus
gagcggcctgagatccagagacaat

SEQ ID NO: 294871 - DNA, 25 bp, Mus musculus
gagcggcgagagtaatccatatgca

SEQ ID NO: 294872 - DNA, 25 bp, Mus musculus
gagcggcgaggccccactcctgaaa

SEQ ID NO: 294873 - DNA, 25 bp, Mus musculus
gagcggcgcgggtccaacccagact

SEQ ID NO: 294874 - DNA, 25 bp, Mus musculus
gagcggcgcggtccccagagccaga

SEQ ID NO: 294875 - DNA, 25 bp, Mus musculus
gagcggcgctcagagatggagagag

SEQ ID NO: 294876 - DNA, 25 bp, Mus musculus
gagcggcggaagggttaccctcgat

SEQ ID NO: 294877 - DNA, 25 bp, Mus musculus
gagcggcggaccgcagcagaagaag

SEQ ID NO: 294878 - DNA, 25 bp, Mus musculus
gagcggcggggtgaccatggaggag

SEQ ID NO: 294879 - DNA, 25 bp, Mus musculus
gagcggcggtggtgtgccaagtgtt

SEQ ID NO: 294880 - DNA, 25 bp, Mus musculus
gagcggcggtgtgatccattgtagg

SEQ ID NO: 294881 - DNA, 25 bp, Mus musculus
gagcggctcagagctaccaggagcc

SEQ ID NO: 294882 - DNA, 25 bp, Mus musculus
gagcggctcaggttccagctacggt

SEQ ID NO: 294883 - DNA, 25 bp, Mus musculus
gagcggctccggaaaatccactgtg

SEQ ID NO: 294884 - DNA, 25 bp, Mus musculus
gagcggctccggaaactgctcccca

SEQ ID NO: 294885 - DNA, 25 bp, Mus musculus
gagcggctgacagaaggacatttgg

SEQ ID NO: 294886 - DNA, 25 bp, Mus musculus
gagcggctgtatgtggacggatgac

SEQ ID NO: 294887 - DNA, 25 bp, Mus musculus
gagcgggaagctaagaaactgaggc

SEQ ID NO: 294888 - DNA, 25 bp, Mus musculus
gagcgggacgcaaaggaggaagcca

SEQ ID NO: 294889 - DNA, 25 bp, Mus musculus
gagcgggagaaggctctgtccaaca

SEQ ID NO: 294890 - DNA, 25 bp, Mus musculus
gagcgggagagacagctttttcctg

SEQ ID NO: 294891 - DNA, 25 bp, Mus musculus
gagcgggcaagtctgaccttcatca

SEQ ID NO: 294892 - DNA, 25 bp, Mus musculus
gagcgggcaagtctgccctgacggt

SEQ ID NO: 294893 - DNA, 25 bp, Mus musculus
gagcgggcaggatcctcttcgctgt

SEQ ID NO: 294894 - DNA, 25 bp, Mus musculus
gagcgggcaggggcctccctgtgga

SEQ ID NO: 294895 - DNA, 25 bp, Mus musculus
gagcggggccgtgaggaggataaaa

SEQ ID NO: 294896 - DNA, 25 bp, Mus musculus
gagcggggccgtgaggtatccagct

SEQ ID NO: 294897 - DNA, 25 bp, Mus musculus
gagcggggctcacgagaatcatcat

SEQ ID NO: 294898 - DNA, 25 bp, Mus musculus
gagcggggctcacgtttcagatgag

SEQ ID NO: 294899 - DNA, 25 bp, Mus musculus
gagcggggctgtggatctttccaga

SEQ ID NO: 294900 - DNA, 25 bp, Mus musculus
gagcgggggcagctccccaggcctc

SEQ ID NO: 294901 - DNA, 25 bp, Mus musculus
gagcgggggcgcggtctggaagctg

SEQ ID NO: 294902 - DNA, 25 bp, Mus musculus
gagcgggggtgagttgtcagtgggg

SEQ ID NO: 294903 - DNA, 25 bp, Mus musculus
gagcggggtgtgggccctcccaggc

SEQ ID NO: 294904 - DNA, 25 bp, Mus musculus
gagcggggtgtggggatttcgcttt

SEQ ID NO: 294905 - DNA, 25 bp, Mus musculus
gagcgggttgctgaggacaggaccc

SEQ ID NO: 294906 - DNA, 25 bp, Mus musculus
gagcggtagaggcaagagcttcact

SEQ ID NO: 294907 - DNA, 25 bp, Mus musculus
gagcggtagagggagttgcatggtg

SEQ ID NO: 294908 - DNA, 25 bp, Mus musculus
gagcggtaggagggaactgagccgt

SEQ ID NO: 294909 - DNA, 25 bp, Mus musculus
gagcggtccatgagcaatggcaaca

SEQ ID NO: 294910 - DNA, 25 bp, Mus musculus
gagcggtccatgagtgaattagtag

SEQ ID NO: 294911 - DNA, 25 bp, Mus musculus
gagcggtcctaacatttaaaaagca

SEQ ID NO: 294912 - DNA, 25 bp, Mus musculus
gagcggtcctacagttggggaatgg

SEQ ID NO: 294913 - DNA, 25 bp, Mus musculus
gagcggtcctagtcttctcagtaca

SEQ ID NO: 294914 - DNA, 25 bp, Mus musculus
gagcggtcggggctggtcaggacaa

SEQ ID NO: 294915 - DNA, 25 bp, Mus musculus
gagcggtgaagcggagccctgcagg

SEQ ID NO: 294916 - DNA, 25 bp, Mus musculus
gagcggtgaagcgggtcgccctccc

SEQ ID NO: 294917 - DNA, 25 bp, Mus musculus
gagcggtgagcgacatgtccttccg

SEQ ID NO: 294918 - DNA, 25 bp, Mus musculus
gagcggtgagcgacgggccgcattg

SEQ ID NO: 294919 - DNA, 25 bp, Mus musculus
gagcggtgtgctcggccatcgacaa

SEQ ID NO: 294920 - DNA, 25 bp, Mus musculus
gagcggtgtggtcattgggcttctg

SEQ ID NO: 294921 - DNA, 25 bp, Mus musculus
gagcggttgcagacggcacgaccat

SEQ ID NO: 294922 - DNA, 25 bp, Mus musculus
gagcggttgcaggcctggcgtccgc

SEQ ID NO: 294923 - DNA, 25 bp, Mus musculus
gagcggtttgccagggaaaatcata

SEQ ID NO: 294924 - DNA, 25 bp, Mus musculus
gagcggtttgccagggcgacggaac

SEQ ID NO: 294925 - DNA, 25 bp, Mus musculus
gagcggtttgccaggtcggatgatg

SEQ ID NO: 294926 - DNA, 25 bp, Mus musculus
gagcgtaaaaatgagtgaaaaagat

SEQ ID NO: 294927 - DNA, 25 bp, Mus musculus
gagcgtaaaaatggaaatgcttgat

SEQ ID NO: 294928 - DNA, 25 bp, Mus musculus
gagcgtacctgtgcccacatctgcc

SEQ ID NO: 294929 - DNA, 25 bp, Mus musculus
gagcgtatcccagaacaacctgcgg

SEQ ID NO: 294930 - DNA, 25 bp, Mus musculus
gagcgtcaagcagactcgccagtga

SEQ ID NO: 294931 - DNA, 25 bp, Mus musculus
gagcgtcaaggtgtgggataagagc

SEQ ID NO: 294932 - DNA, 25 bp, Mus musculus
gagcgtccatctgaagaaaaagaaa

SEQ ID NO: 294933 - DNA, 25 bp, Mus musculus
gagcgtccatctgacaatggattct

SEQ ID NO: 294934 - DNA, 25 bp, Mus musculus
gagcgtccatctgcaaggaccatgg

SEQ ID NO: 294935 - DNA, 25 bp, Mus musculus
gagcgtcctcatacacagcgtgcag

SEQ ID NO: 294936 - DNA, 25 bp, Mus musculus
gagcgtcctctcgagacatgaaaaa

SEQ ID NO: 294937 - DNA, 25 bp, Mus musculus
gagcgtcctctcggaggtaacagct

SEQ ID NO: 294938 - DNA, 25 bp, Mus musculus
gagcgtctatctgagatgccttatt

SEQ ID NO: 294939 - DNA, 25 bp, Mus musculus
gagcgtctcatgatggagagaagag

SEQ ID NO: 294940 - DNA, 25 bp, Mus musculus
gagcgtctgcaaagataaaagcttt

SEQ ID NO: 294941 - DNA, 25 bp, Mus musculus
gagcgtctggcaggtccaagggtag

SEQ ID NO: 294942 - DNA, 25 bp, Mus musculus
gagcgtcttggggggtgtgaagaag

SEQ ID NO: 294943 - DNA, 25 bp, Mus musculus
gagcgtgatctcggagtcctccggg

SEQ ID NO: 294944 - DNA, 25 bp, Mus musculus
gagcgtgatctcgggcaatggcagc

SEQ ID NO: 294945 - DNA, 25 bp, Mus musculus
gagcgtgccaagcaggcagctgtgt

SEQ ID NO: 294946 - DNA, 25 bp, Mus musculus
gagcgtgcgccaggtgtcttctgca

SEQ ID NO: 294947 - DNA, 25 bp, Mus musculus
gagcgtggagaaaaagcagcgatgc

SEQ ID NO: 294948 - DNA, 25 bp, Mus musculus
gagcgtggagaccatcttcaacaag

SEQ ID NO: 294949 - DNA, 25 bp, Mus musculus
gagcgtggagataacaaaacaggac

SEQ ID NO: 294950 - DNA, 25 bp, Mus musculus
gagcgtggcggacctcatccgcatc

SEQ ID NO: 294951 - DNA, 25 bp, Mus musculus
gagcgtgtccggccctgaacgccat

SEQ ID NO: 294952 - DNA, 25 bp, Mus musculus
gagcgtgtgttaagccatcaaacaa

SEQ ID NO: 294953 - DNA, 25 bp, Mus musculus
gagcgtgtgttaaggtctcattttt

SEQ ID NO: 294954 - DNA, 25 bp, Mus musculus
gagcgtgtgttaaggttaccaacat

SEQ ID NO: 294955 - DNA, 25 bp, Mus musculus
gagcgtgttctcccggacgagggat

SEQ ID NO: 294956 - DNA, 25 bp, Mus musculus
gagcgtgttggggacaaagagaaag

SEQ ID NO: 294957 - DNA, 25 bp, Mus musculus
gagcgttactgccgatgcaatgcca

SEQ ID NO: 294958 - DNA, 25 bp, Mus musculus
gagcgtttggaacacctttcccaag

SEQ ID NO: 294959 - DNA, 25 bp, Mus musculus
gagctaaacaagaatttaaagagga

SEQ ID NO: 294960 - DNA, 25 bp, Mus musculus
gagctaaagccgatgctcaggaaaa

SEQ ID NO: 294961 - DNA, 25 bp, Mus musculus
gagctaaagccgatggcttcgggag

SEQ ID NO: 294962 - DNA, 25 bp, Mus musculus
gagctaacctgagattacaagagcg

SEQ ID NO: 294963 - DNA, 25 bp, Mus musculus
gagctaacctgaggcatgtctaggc

SEQ ID NO: 294964 - DNA, 25 bp, Mus musculus
gagctaacgagatgaacgtgacgcc

SEQ ID NO: 294965 - DNA, 25 bp, Mus musculus
gagctaacgaggttgactgcctcct

SEQ ID NO: 294966 - DNA, 25 bp, Mus musculus
gagctaagaacggaaagaccaagaa

SEQ ID NO: 294967 - DNA, 25 bp, Mus musculus
gagctaagaataatagggcccagtg

SEQ ID NO: 294968 - DNA, 25 bp, Mus musculus
gagctaagccagtgggagtgtgcag

SEQ ID NO: 294969 - DNA, 25 bp, Mus musculus
gagctaagcccagatggctctgact

SEQ ID NO: 294970 - DNA, 25 bp, Mus musculus
gagctaaggaagggtcttctactta

SEQ ID NO: 294971 - DNA, 25 bp, Mus musculus
gagctaatacgagggagaagacacc

SEQ ID NO: 294972 - DNA, 25 bp, Mus musculus
gagctaatatcccaacggagtcctc

SEQ ID NO: 294973 - DNA, 25 bp, Mus musculus
gagctaatcctggaggtcctagaag

SEQ ID NO: 294974 - DNA, 25 bp, Mus musculus
gagctaatcctggagttagcagccc

SEQ ID NO: 294975 - DNA, 25 bp, Mus musculus
gagctacaagtattctgaggaagcc

SEQ ID NO: 294976 - DNA, 25 bp, Mus musculus
gagctacaatgcaacgtggccctga

SEQ ID NO: 294977 - DNA, 25 bp, Mus musculus
gagctacaggaatggagagtggcaa

SEQ ID NO: 294978 - DNA, 25 bp, Mus musculus
gagctacagtggcacctgacaaaaa

SEQ ID NO: 294979 - DNA, 25 bp, Mus musculus
gagctacatcaaaagaggcttccag

SEQ ID NO: 294980 - DNA, 25 bp, Mus musculus
gagctacatcaaaaggtacttcgag

SEQ ID NO: 294981 - DNA, 25 bp, Mus musculus
gagctacattgaggggtacgtgcca

SEQ ID NO: 294982 - DNA, 25 bp, Mus musculus
gagctacattgaggggtctgtgcac

SEQ ID NO: 294983 - DNA, 25 bp, Mus musculus
gagctaccagcggctctgctctgct

SEQ ID NO: 294984 - DNA, 25 bp, Mus musculus
gagctaccggagccgcatcaatgag

SEQ ID NO: 294985 - DNA, 25 bp, Mus musculus
gagctaccggaggtatggggcagat

SEQ ID NO: 294986 - DNA, 25 bp, Mus musculus
gagctaccgggacaagagtgaagcc

SEQ ID NO: 294987 - DNA, 25 bp, Mus musculus
gagctacggctgggttacccagtga

SEQ ID NO: 294988 - DNA, 25 bp, Mus musculus
gagctactcaggcctgcctactttg

SEQ ID NO: 294989 - DNA, 25 bp, Mus musculus
gagctactcaggtcaaggctttgac

SEQ ID NO: 294990 - DNA, 25 bp, Mus musculus
gagctactctccagggtcttcctgg

SEQ ID NO: 294991 - DNA, 25 bp, Mus musculus
gagctactgcagagccatcctgact

SEQ ID NO: 294992 - DNA, 25 bp, Mus musculus
gagctactggagaagccagatgccc

SEQ ID NO: 294993 - DNA, 25 bp, Mus musculus
gagctacttcccacccctgcctgct

SEQ ID NO: 294994 - DNA, 25 bp, Mus musculus
gagctacttgaaaagtaaagaacaa

SEQ ID NO: 294995 - DNA, 25 bp, Mus musculus
gagctagaaaagaaagtgagttcct

SEQ ID NO: 294996 - DNA, 25 bp, Mus musculus
gagctagacgccaaggttgtggagc

SEQ ID NO: 294997 - DNA, 25 bp, Mus musculus
gagctagagctgacgggggtggcac

SEQ ID NO: 294998 - DNA, 25 bp, Mus musculus
gagctagatgaggttgatatgtcag

SEQ ID NO: 294999 - DNA, 25 bp, Mus musculus
gagctagcagacatctctgtgagtg

SEQ ID NO: 295000 - DNA, 25 bp, Mus musculus
gagctagcagttccagtgcagactc

SEQ ID NO: 295001 - DNA, 25 bp, Mus musculus
gagctagcgggttatgcctccacct

SEQ ID NO: 295002 - DNA, 25 bp, Mus musculus
gagctaggaagaggtcagccatgtc

SEQ ID NO: 295003 - DNA, 25 bp, Mus musculus
gagctaggataacagtgacgtatga

SEQ ID NO: 295004 - DNA, 25 bp, Mus musculus
gagctagtgcaaaactgccagtgta

SEQ ID NO: 295005 - DNA, 25 bp, Mus musculus
gagctagtgtaaaagaaagatgatg

SEQ ID NO: 295006 - DNA, 25 bp, Mus musculus
gagctatcttataatctggaggctg

SEQ ID NO: 295007 - DNA, 25 bp, Mus musculus
gagctatcttgcagttcatggcatc

SEQ ID NO: 295008 - DNA, 25 bp, Mus musculus
gagctatgagtgcagaaaatattaa

SEQ ID NO: 295009 - DNA, 25 bp, Mus musculus
gagctatgagtgcagcgtgttaccc

SEQ ID NO: 295010 - DNA, 25 bp, Mus musculus
gagctatgagtgcagttttcagcag

SEQ ID NO: 295011 - DNA, 25 bp, Mus musculus
gagctatgctgcaggaaatgacctg

SEQ ID NO: 295012 - DNA, 25 bp, Mus musculus
gagctattgcacggatggtgaactt

SEQ ID NO: 295013 - DNA, 25 bp, Mus musculus
gagctattttggattactataagac

SEQ ID NO: 295014 - DNA, 25 bp, Mus musculus
gagctcaacaagactgcaagtggca

SEQ ID NO: 295015 - DNA, 25 bp, Mus musculus
gagctcaaccacttcggatatcatt

SEQ ID NO: 295016 - DNA, 25 bp, Mus musculus
gagctcaaggagtgtctagcccaca

SEQ ID NO: 295017 - DNA, 25 bp, Mus musculus
gagctcacacacagggcgtgcgcag

SEQ ID NO: 295018 - DNA, 25 bp, Mus musculus
gagctcacagcagagaaggagatgg

SEQ ID NO: 295019 - DNA, 25 bp, Mus musculus
gagctcacagctatccctctcacgg

SEQ ID NO: 295020 - DNA, 25 bp, Mus musculus
gagctcacaggagagaaggagatgg

SEQ ID NO: 295021 - DNA, 25 bp, Mus musculus
gagctcacatgaaaccaaagatgac

SEQ ID NO: 295022 - DNA, 25 bp, Mus musculus
gagctcaccaagctactccattccc

SEQ ID NO: 295023 - DNA, 25 bp, Mus musculus
gagctcactcaaggtaatagcgctc

SEQ ID NO: 295024 - DNA, 25 bp, Mus musculus
gagctcagacagtgggtgtccaccc

SEQ ID NO: 295025 - DNA, 25 bp, Mus musculus
gagctcagaccagatggccaagctg

SEQ ID NO: 295026 - DNA, 25 bp, Mus musculus
gagctcagagaaagcagaagatacc

SEQ ID NO: 295027 - DNA, 25 bp, Mus musculus
gagctcagagcagaaaacttatagc

SEQ ID NO: 295028 - DNA, 25 bp, Mus musculus
gagctcagaggagaattctgtggct

SEQ ID NO: 295029 - DNA, 25 bp, Mus musculus
gagctcagagggcgggatgtctctg

SEQ ID NO: 295030 - DNA, 25 bp, Mus musculus
gagctcagagggtgctctgtgtggc

SEQ ID NO: 295031 - DNA, 25 bp, Mus musculus
gagctcagaggtgttttctattacg

SEQ ID NO: 295032 - DNA, 25 bp, Mus musculus
gagctcagaggttgactcttcacca

SEQ ID NO: 295033 - DNA, 25 bp, Mus musculus
gagctcagcaaagaagttgggatat

SEQ ID NO: 295034 - DNA, 25 bp, Mus musculus
gagctcagcaagtattcgactcacc

SEQ ID NO: 295035 - DNA, 25 bp, Mus musculus
gagctcagcaatagtctggaagaaa

SEQ ID NO: 295036 - DNA, 25 bp, Mus musculus
gagctcagccacaggggcattagga

SEQ ID NO: 295037 - DNA, 25 bp, Mus musculus
gagctcagctatggagtcagtgact

SEQ ID NO: 295038 - DNA, 25 bp, Mus musculus
gagctcagctatggagtctgtatct

SEQ ID NO: 295039 - DNA, 25 bp, Mus musculus
gagctcagctgagcccagtccctgc

SEQ ID NO: 295040 - DNA, 25 bp, Mus musculus
gagctcagggtgaggcgacccctct

SEQ ID NO: 295041 - DNA, 25 bp, Mus musculus
gagctcagtcctagtactgatgtca

SEQ ID NO: 295042 - DNA, 25 bp, Mus musculus
gagctcagtcctagtaggagagatc

SEQ ID NO: 295043 - DNA, 25 bp, Mus musculus
gagctcagtggccctgctcttggac

SEQ ID NO: 295044 - DNA, 25 bp, Mus musculus
gagctcatacagagtccaggctgtc

SEQ ID NO: 295045 - DNA, 25 bp, Mus musculus
gagctcatacagtctcaacagatca

SEQ ID NO: 295046 - DNA, 25 bp, Mus musculus
gagctcatagaagttaatggaaccc

SEQ ID NO: 295047 - DNA, 25 bp, Mus musculus
gagctcatccaaggaggcgagtact

SEQ ID NO: 295048 - DNA, 25 bp, Mus musculus
gagctcatccaagtcctaccaggaa

SEQ ID NO: 295049 - DNA, 25 bp, Mus musculus
gagctcatcctagcaggtatgccac

SEQ ID NO: 295050 - DNA, 25 bp, Mus musculus
gagctcatcgagaaacatggcttag

SEQ ID NO: 295051 - DNA, 25 bp, Mus musculus
gagctcatcgaggagaatcagcgcc

SEQ ID NO: 295052 - DNA, 25 bp, Mus musculus
gagctcatgaaggagctctttgatc

SEQ ID NO: 295053 - DNA, 25 bp, Mus musculus
gagctcatgaaggctctggtctcag

SEQ ID NO: 295054 - DNA, 25 bp, Mus musculus
gagctcatggaagaggttcaaacct

SEQ ID NO: 295055 - DNA, 25 bp, Mus musculus
gagctcatggaagaggtttattaac

SEQ ID NO: 295056 - DNA, 25 bp, Mus musculus
gagctcatggagagagcagtagaga

SEQ ID NO: 295057 - DNA, 25 bp, Mus musculus
gagctcatggagcttgagatcttct

SEQ ID NO: 295058 - DNA, 25 bp, Mus musculus
gagctcatgggacaggtgaacacct

SEQ ID NO: 295059 - DNA, 25 bp, Mus musculus
gagctccaagaatggcgggcatatc

SEQ ID NO: 295060 - DNA, 25 bp, Mus musculus
gagctccaagagctgttagctgatc

SEQ ID NO: 295061 - DNA, 25 bp, Mus musculus
gagctccaaggatgctctggaggac

SEQ ID NO: 295062 - DNA, 25 bp, Mus musculus
gagctccaccatcatctggctatgt

SEQ ID NO: 295063 - DNA, 25 bp, Mus musculus
gagctccagcacgatggagaatagg

SEQ ID NO: 295064 - DNA, 25 bp, Mus musculus
gagctccaggtaagtgctggccatt

SEQ ID NO: 295065 - DNA, 25 bp, Mus musculus
gagctccagtgtagagggccaagtc

SEQ ID NO: 295066 - DNA, 25 bp, Mus musculus
gagctccagtgtagatttattttta

SEQ ID NO: 295067 - DNA, 25 bp, Mus musculus
gagctccagtgtaggctctcagaca

SEQ ID NO: 295068 - DNA, 25 bp, Mus musculus
gagctccagtgtaggtgttggaact

SEQ ID NO: 295069 - DNA, 25 bp, Mus musculus
gagctccatccccaggtgctgcttt

SEQ ID NO: 295070 - DNA, 25 bp, Mus musculus
gagctcccaaggtggatgaagactc

SEQ ID NO: 295071 - DNA, 25 bp, Mus musculus
gagctcccagacttcttcgagggca

SEQ ID NO: 295072 - DNA, 25 bp, Mus musculus
gagctccctgacaggcccgagccta

SEQ ID NO: 295073 - DNA, 25 bp, Mus musculus
gagctccctgacaggggagagcacc

SEQ ID NO: 295074 - DNA, 25 bp, Mus musculus
gagctccgactggaaataccagagg

SEQ ID NO: 295075 - DNA, 25 bp, Mus musculus
gagctccgactggagtctccaaaac

SEQ ID NO: 295076 - DNA, 25 bp, Mus musculus
gagctccgagaggagacattccaaa

SEQ ID NO: 295077 - DNA, 25 bp, Mus musculus
gagctccgagaggtagctctggctg

SEQ ID NO: 295078 - DNA, 25 bp, Mus musculus
gagctccgcaaagagaggcagatga

SEQ ID NO: 295079 - DNA, 25 bp, Mus musculus
gagctccgcaaagccaaatcaaata

SEQ ID NO: 295080 - DNA, 25 bp, Mus musculus
gagctccggcaaatcagccacacag

SEQ ID NO: 295081 - DNA, 25 bp, Mus musculus
gagctccgggactgaagtgtcctgg

SEQ ID NO: 295082 - DNA, 25 bp, Mus musculus
gagctccgggtctgaagtgtcctgg

SEQ ID NO: 295083 - DNA, 25 bp, Mus musculus
gagctcctcctctcggtacttctcc

SEQ ID NO: 295084 - DNA, 25 bp, Mus musculus
gagctcctcgagcctaacccaggga

SEQ ID NO: 295085 - DNA, 25 bp, Mus musculus
gagctcctcgctgtgatcactgctg

SEQ ID NO: 295086 - DNA, 25 bp, Mus musculus
gagctcctcttgagaatattctcct

SEQ ID NO: 295087 - DNA, 25 bp, Mus musculus
gagctcctcttgagcattgcgccag

SEQ ID NO: 295088 - DNA, 25 bp, Mus musculus
gagctcctgaaccagctggtccctg

SEQ ID NO: 295089 - DNA, 25 bp, Mus musculus
gagctccttacttcagaggagctgg

SEQ ID NO: 295090 - DNA, 25 bp, Mus musculus
gagctccttacttcagtacaggtca

SEQ ID NO: 295091 - DNA, 25 bp, Mus musculus
gagctcgaagcagaatcagagaagc

SEQ ID NO: 295092 - DNA, 25 bp, Mus musculus
gagctcgaatttaagcgtctagcca

SEQ ID NO: 295093 - DNA, 25 bp, Mus musculus
gagctcgccaaggctggctggctac

SEQ ID NO: 295094 - DNA, 25 bp, Mus musculus
gagctcgccccgagagactgaattc

SEQ ID NO: 295095 - DNA, 25 bp, Mus musculus
gagctcgcggcggatagaaggacaa

SEQ ID NO: 295096 - DNA, 25 bp, Mus musculus
gagctcgcggcgggtaccttaacat

SEQ ID NO: 295097 - DNA, 25 bp, Mus musculus
gagctcggagcaggctcaggccatc

SEQ ID NO: 295098 - DNA, 25 bp, Mus musculus
gagctcggcaggcatttcagggaag

SEQ ID NO: 295099 - DNA, 25 bp, Mus musculus
gagctcggccttccagttttacctg

SEQ ID NO: 295100 - DNA, 25 bp, Mus musculus
gagctcgggaaagccatgtggagat

SEQ ID NO: 295101 - DNA, 25 bp, Mus musculus
gagctcgggaggtacagtggtccca

SEQ ID NO: 295102 - DNA, 25 bp, Mus musculus
gagctcgggaggttcccgtgagaac

SEQ ID NO: 295103 - DNA, 25 bp, Mus musculus
gagctcgggcggggaccggagctga

SEQ ID NO: 295104 - DNA, 25 bp, Mus musculus
gagctcgttcaagagggagcccgcc

SEQ ID NO: 295105 - DNA, 25 bp, Mus musculus
gagctcgttcaagggggcgactttc

SEQ ID NO: 295106 - DNA, 25 bp, Mus musculus
gagctctaacaggacccaggtctcc

SEQ ID NO: 295107 - DNA, 25 bp, Mus musculus
gagctctaacagggcaggatggccc

SEQ ID NO: 295108 - DNA, 25 bp, Mus musculus
gagctctaccagaacctgacccggg

SEQ ID NO: 295109 - DNA, 25 bp, Mus musculus
gagctctatggccgagaaccagatt

SEQ ID NO: 295110 - DNA, 25 bp, Mus musculus
gagctctatggccgagaaccatatt

SEQ ID NO: 295111 - DNA, 25 bp, Mus musculus
gagctctcagaaggcaaatgtgccg

SEQ ID NO: 295112 - DNA, 25 bp, Mus musculus
gagctctcagaaggccaagttcgac

SEQ ID NO: 295113 - DNA, 25 bp, Mus musculus
gagctctcagcacgggggcgtgata

SEQ ID NO: 295114 - DNA, 25 bp, Mus musculus
gagctctcaggtactgtactgatga

SEQ ID NO: 295115 - DNA, 25 bp, Mus musculus
gagctctcaggttcctcagtggtgt

SEQ ID NO: 295116 - DNA, 25 bp, Mus musculus
gagctctccgccggctgattatgag

SEQ ID NO: 295117 - DNA, 25 bp, Mus musculus
gagctctctgacaggtgtccccaga

SEQ ID NO: 295118 - DNA, 25 bp, Mus musculus
gagctctctttcaacgctggagacg

SEQ ID NO: 295119 - DNA, 25 bp, Mus musculus
gagctctctttcaaggctggagacg

SEQ ID NO: 295120 - DNA, 25 bp, Mus musculus
gagctctgcaggggactccttttca

SEQ ID NO: 295121 - DNA, 25 bp, Mus musculus
gagctctggagttgctttttgcaat

SEQ ID NO: 295122 - DNA, 25 bp, Mus musculus
gagctctggagttggctgcaacagg

SEQ ID NO: 295123 - DNA, 25 bp, Mus musculus
gagctctgtgaaaggtaaccccagg

SEQ ID NO: 295124 - DNA, 25 bp, Mus musculus
gagctcttccaacacttcgacaaaa

SEQ ID NO: 295125 - DNA, 25 bp, Mus musculus
gagctcttcctgggcggcggccagc

SEQ ID NO: 295126 - DNA, 25 bp, Mus musculus
gagctcttcgtcaaggaaacctgca

SEQ ID NO: 295127 - DNA, 25 bp, Mus musculus
gagctcttcgtcaaggccggaagtg

SEQ ID NO: 295128 - DNA, 25 bp, Mus musculus
gagctcttctcagagaagaaaagcg

SEQ ID NO: 295129 - DNA, 25 bp, Mus musculus
gagctcttgaaggatctgcagcaga

SEQ ID NO: 295130 - DNA, 25 bp, Mus musculus
gagctcttgaccaagttccaggaag

SEQ ID NO: 295131 - DNA, 25 bp, Mus musculus
gagctcttggagatttttgcagctc

SEQ ID NO: 295132 - DNA, 25 bp, Mus musculus
gagctcttggtgtggacacttcccg

SEQ ID NO: 295133 - DNA, 25 bp, Mus musculus
gagctcttggtgtgggacgccccta

SEQ ID NO: 295134 - DNA, 25 bp, Mus musculus
gagctctttattctgtcaaccacag

SEQ ID NO: 295135 - DNA, 25 bp, Mus musculus
gagctctttctgagacaccccctgt

SEQ ID NO: 295136 - DNA, 25 bp, Mus musculus
gagctctttgatgacttgggtgtct

SEQ ID NO: 295137 - DNA, 25 bp, Mus musculus
gagctcttttctcagagcaacacgt

SEQ ID NO: 295138 - DNA, 25 bp, Mus musculus
gagctgaaacagggaccgcgtggcg

SEQ ID NO: 295139 - DNA, 25 bp, Mus musculus
gagctgaaagcactgacacacagtg

SEQ ID NO: 295140 - DNA, 25 bp, Mus musculus
gagctgaaagcagggtgtggacagg

SEQ ID NO: 295141 - DNA, 25 bp, Mus musculus
gagctgaaagggactgccctgtaca

SEQ ID NO: 295142 - DNA, 25 bp, Mus musculus
gagctgaacaagaagatctaccgca

SEQ ID NO: 295143 - DNA, 25 bp, Mus musculus
gagctgaacaagtactctacgcacc

SEQ ID NO: 295144 - DNA, 25 bp, Mus musculus
gagctgaaccaggccgcgttgtctg

SEQ ID NO: 295145 - DNA, 25 bp, Mus musculus
gagctgaactgagctgagctgggtg

SEQ ID NO: 295146 - DNA, 25 bp, Mus musculus
gagctgaagaaggcgccctttgtgg

SEQ ID NO: 295147 - DNA, 25 bp, Mus musculus
gagctgaagaaggtggctgctggga

SEQ ID NO: 295148 - DNA, 25 bp, Mus musculus
gagctgaaggacgagggccttgggt

SEQ ID NO: 295149 - DNA, 25 bp, Mus musculus
gagctgaaggctcgcaacaccaaga

SEQ ID NO: 295150 - DNA, 25 bp, Mus musculus
gagctgaagggaagtgaccaagcct

SEQ ID NO: 295151 - DNA, 25 bp, Mus musculus
gagctgaagggctctcctgctgcca

SEQ ID NO: 295152 - DNA, 25 bp, Mus musculus
gagctgaatgaaagggagaagaagg

SEQ ID NO: 295153 - DNA, 25 bp, Mus musculus
gagctgaattcagaggtggcgagtg

SEQ ID NO: 295154 - DNA, 25 bp, Mus musculus
gagctgacacctcagggcacacttg

SEQ ID NO: 295155 - DNA, 25 bp, Mus musculus
gagctgacacgctggagatggagtt

SEQ ID NO: 295156 - DNA, 25 bp, Mus musculus
gagctgacagacagtatctgaacac

SEQ ID NO: 295157 - DNA, 25 bp, Mus musculus
gagctgacagaccaagtctgctgaa

SEQ ID NO: 295158 - DNA, 25 bp, Mus musculus
gagctgacagagcttttcttcatgc

SEQ ID NO: 295159 - DNA, 25 bp, Mus musculus
gagctgacagatgaggaaactgagg

SEQ ID NO: 295160 - DNA, 25 bp, Mus musculus
gagctgacaggggttccacagcact

SEQ ID NO: 295161 - DNA, 25 bp, Mus musculus
gagctgacccaagccattttgagtg

SEQ ID NO: 295162 - DNA, 25 bp, Mus musculus
gagctgacctactaggtcactgccc

SEQ ID NO: 295163 - DNA, 25 bp, Mus musculus
gagctgacgcgggtgggtcatcgtg

SEQ ID NO: 295164 - DNA, 25 bp, Mus musculus
gagctgactactccagtcactgtgg

SEQ ID NO: 295165 - DNA, 25 bp, Mus musculus
gagctgactactccatgcggctctg

SEQ ID NO: 295166 - DNA, 25 bp, Mus musculus
gagctgagaggcaaacccgtggcag

SEQ ID NO: 295167 - DNA, 25 bp, Mus musculus
gagctgagagttcttccagatgagc

SEQ ID NO: 295168 - DNA, 25 bp, Mus musculus
gagctgagatactagtgactgctcc

SEQ ID NO: 295169 - DNA, 25 bp, Mus musculus
gagctgagattaaagacagctgcag

SEQ ID NO: 295170 - DNA, 25 bp, Mus musculus
gagctgagcacggagcctggtggag

SEQ ID NO: 295171 - DNA, 25 bp, Mus musculus
gagctgagctgcgaggggtcctgag

SEQ ID NO: 295172 - DNA, 25 bp, Mus musculus
gagctgagctggagagtcagtcctt

SEQ ID NO: 295173 - DNA, 25 bp, Mus musculus
gagctgagctggcaactattgatga

SEQ ID NO: 295174 - DNA, 25 bp, Mus musculus
gagctgagctgggagagtcagtcct

SEQ ID NO: 295175 - DNA, 25 bp, Mus musculus
gagctgagggagacgcactacttcg

SEQ ID NO: 295176 - DNA, 25 bp, Mus musculus
gagctgagtgcaagtgtcctgcagg

SEQ ID NO: 295177 - DNA, 25 bp, Mus musculus
gagctgatagaaacatctttctctg

SEQ ID NO: 295178 - DNA, 25 bp, Mus musculus
gagctgatcaaggaaccttctgtgg

SEQ ID NO: 295179 - DNA, 25 bp, Mus musculus
gagctgatcgatttgatctactgtg

SEQ ID NO: 295180 - DNA, 25 bp, Mus musculus
gagctgatctgcagactcagcctta

SEQ ID NO: 295181 - DNA, 25 bp, Mus musculus
gagctgatctgcagtcagcaactct

SEQ ID NO: 295182 - DNA, 25 bp, Mus musculus
gagctgatgaggatcctcagctcct

SEQ ID NO: 295183 - DNA, 25 bp, Mus musculus
gagctgatgtgtggagcctggctgt

SEQ ID NO: 295184 - DNA, 25 bp, Mus musculus
gagctgattgagaagctgggaggct

SEQ ID NO: 295185 - DNA, 25 bp, Mus musculus
gagctgcaaataacgtgaactgtgg

SEQ ID NO: 295186 - DNA, 25 bp, Mus musculus
gagctgcaagataagcagacagcta

SEQ ID NO: 295187 - DNA, 25 bp, Mus musculus
gagctgcaaggaactcattatacaa

SEQ ID NO: 295188 - DNA, 25 bp, Mus musculus
gagctgcacaagtcacgggtcacag

SEQ ID NO: 295189 - DNA, 25 bp, Mus musculus
gagctgcacgtcaggacaaagtggg

SEQ ID NO: 295190 - DNA, 25 bp, Mus musculus
gagctgcagaatgctggccttgcag

SEQ ID NO: 295191 - DNA, 25 bp, Mus musculus
gagctgcagaatggtaatacacagc

SEQ ID NO: 295192 - DNA, 25 bp, Mus musculus
gagctgcagagtgaaatgacactgc

SEQ ID NO: 295193 - DNA, 25 bp, Mus musculus
gagctgcagagtgagcaccaggttt

SEQ ID NO: 295194 - DNA, 25 bp, Mus musculus
gagctgcagcagaagattctctgtg

SEQ ID NO: 295195 - DNA, 25 bp, Mus musculus
gagctgcagcagatggagcagagga

SEQ ID NO: 295196 - DNA, 25 bp, Mus musculus
gagctgcagcaggagttaaaaataa

SEQ ID NO: 295197 - DNA, 25 bp, Mus musculus
gagctgcagcaggctgttctgcaga

SEQ ID NO: 295198 - DNA, 25 bp, Mus musculus
gagctgcaggagaagaggaggagag

SEQ ID NO: 295199 - DNA, 25 bp, Mus musculus
gagctgcaggagagcgcacacacgt

SEQ ID NO: 295200 - DNA, 25 bp, Mus musculus
gagctgccagaaaagcctttggctg

SEQ ID NO: 295201 - DNA, 25 bp, Mus musculus
gagctgccagcatttgacattgtgc

SEQ ID NO: 295202 - DNA, 25 bp, Mus musculus
gagctgcccaagaggtcactgagca

SEQ ID NO: 295203 - DNA, 25 bp, Mus musculus
gagctgcccacttgggaggcagagg

SEQ ID NO: 295204 - DNA, 25 bp, Mus musculus
gagctgcccagagacccttcggaag

SEQ ID NO: 295205 - DNA, 25 bp, Mus musculus
gagctgccccggttcagaaacttag

SEQ ID NO: 295206 - DNA, 25 bp, Mus musculus
gagctgcccgtggaggaggtggaca

SEQ ID NO: 295207 - DNA, 25 bp, Mus musculus
gagctgccgactagaagttatttta

SEQ ID NO: 295208 - DNA, 25 bp, Mus musculus
gagctgccgactatactgaagcaga

SEQ ID NO: 295209 - DNA, 25 bp, Mus musculus
gagctgccgactcctgatagaggaa

SEQ ID NO: 295210 - DNA, 25 bp, Mus musculus
gagctgccgacttaaccgtgtggaa

SEQ ID NO: 295211 - DNA, 25 bp, Mus musculus
gagctgccgcccctgctattacaag

SEQ ID NO: 295212 - DNA, 25 bp, Mus musculus
gagctgccgccttcagggccgacta

SEQ ID NO: 295213 - DNA, 25 bp, Mus musculus
gagctgccgtgggttgaaaaataca

SEQ ID NO: 295214 - DNA, 25 bp, Mus musculus
gagctgcctacagataccatggcgt

SEQ ID NO: 295215 - DNA, 25 bp, Mus musculus
gagctgcctacagctcagcagagaa

SEQ ID NO: 295216 - DNA, 25 bp, Mus musculus
gagctgcctacaggaaaaaaaatcc

SEQ ID NO: 295217 - DNA, 25 bp, Mus musculus
gagctgcctacaggtgactggatgg

SEQ ID NO: 295218 - DNA, 25 bp, Mus musculus
gagctgcctcagagtggggagtagt

SEQ ID NO: 295219 - DNA, 25 bp, Mus musculus
gagctgcctcaggctacaaggaagg

SEQ ID NO: 295220 - DNA, 25 bp, Mus musculus
gagctgcctgagcttcatgccctca

SEQ ID NO: 295221 - DNA, 25 bp, Mus musculus
gagctgccttgccttactcagacac

SEQ ID NO: 295222 - DNA, 25 bp, Mus musculus
gagctgccttttgacatcccagagg

SEQ ID NO: 295223 - DNA, 25 bp, Mus musculus
gagctgcgagaatgtctgaagggga

SEQ ID NO: 295224 - DNA, 25 bp, Mus musculus
gagctgcgagcagagggacctggga

SEQ ID NO: 295225 - DNA, 25 bp, Mus musculus
gagctgcgaggactgatgacagagg

SEQ ID NO: 295226 - DNA, 25 bp, Mus musculus
gagctgcgaggggtcctgagaagca

SEQ ID NO: 295227 - DNA, 25 bp, Mus musculus
gagctgcgagttacagaatgtctga

SEQ ID NO: 295228 - DNA, 25 bp, Mus musculus
gagctgcgagttacagatttatcag

SEQ ID NO: 295229 - DNA, 25 bp, Mus musculus
gagctgcgcgcgcagacttacactt

SEQ ID NO: 295230 - DNA, 25 bp, Mus musculus
gagctgcgcgcgcagagccaacaga

SEQ ID NO: 295231 - DNA, 25 bp, Mus musculus
gagctgcgcgcgcagccaaagtgta

SEQ ID NO: 295232 - DNA, 25 bp, Mus musculus
gagctgctacgatgcagacagacat

SEQ ID NO: 295233 - DNA, 25 bp, Mus musculus
gagctgctacgccacacagtctcat

SEQ ID NO: 295234 - DNA, 25 bp, Mus musculus
gagctgctagaaggctgaagaacct

SEQ ID NO: 295235 - DNA, 25 bp, Mus musculus
gagctgctagccattctctgaggat

SEQ ID NO: 295236 - DNA, 25 bp, Mus musculus
gagctgctagcccttctctgaggat

SEQ ID NO: 295237 - DNA, 25 bp, Mus musculus
gagctgctatacgaaggggctcctg

SEQ ID NO: 295238 - DNA, 25 bp, Mus musculus
gagctgctatgtggccaccctggag

SEQ ID NO: 295239 - DNA, 25 bp, Mus musculus
gagctgctccagagaatgacggaca

SEQ ID NO: 295240 - DNA, 25 bp, Mus musculus
gagctgctccaggagcctgaagcta

SEQ ID NO: 295241 - DNA, 25 bp, Mus musculus
gagctgctcccgtccccaccgacaa

SEQ ID NO: 295242 - DNA, 25 bp, Mus musculus
gagctgctctagcaccacatctgcc

SEQ ID NO: 295243 - DNA, 25 bp, Mus musculus
gagctgctctggttgaaggtttgaa

SEQ ID NO: 295244 - DNA, 25 bp, Mus musculus
gagctgctgacaggccgggtgacca

SEQ ID NO: 295245 - DNA, 25 bp, Mus musculus
gagctgctgagatcttagcctcctc

SEQ ID NO: 295246 - DNA, 25 bp, Mus musculus
gagctgctgaggaacttgtatgaaa

SEQ ID NO: 295247 - DNA, 25 bp, Mus musculus
gagctgctgagggagctgaatctga

SEQ ID NO: 295248 - DNA, 25 bp, Mus musculus
gagctgctgccagagggaaattgtg

SEQ ID NO: 295249 - DNA, 25 bp, Mus musculus
gagctgctgctcggagagcgggact

SEQ ID NO: 295250 - DNA, 25 bp, Mus musculus
gagctgctggacatgctgctggtca

SEQ ID NO: 295251 - DNA, 25 bp, Mus musculus
gagctgctggatgagattctggact

SEQ ID NO: 295252 - DNA, 25 bp, Mus musculus
gagctgctgggaaaggaaggattta

SEQ ID NO: 295253 - DNA, 25 bp, Mus musculus
gagctgctgggaagatgctaccaag

SEQ ID NO: 295254 - DNA, 25 bp, Mus musculus
gagctgctgggaaggatctggttct

SEQ ID NO: 295255 - DNA, 25 bp, Mus musculus
gagctgctgggaagggagagcacct

SEQ ID NO: 295256 - DNA, 25 bp, Mus musculus
gagctgctgtgctctcctgctatgc

SEQ ID NO: 295257 - DNA, 25 bp, Mus musculus
gagctgctgttccaggtgctgctgc

SEQ ID NO: 295258 - DNA, 25 bp, Mus musculus
gagctgcttcaggaattctctgatc

SEQ ID NO: 295259 - DNA, 25 bp, Mus musculus
gagctgcttccctctttccatgaag

SEQ ID NO: 295260 - DNA, 25 bp, Mus musculus
gagctgcttttaagtaacggcacag

SEQ ID NO: 295261 - DNA, 25 bp, Mus musculus
gagctggaacggctgctggtccagg

SEQ ID NO: 295262 - DNA, 25 bp, Mus musculus
gagctggaacggctggtggtgaggt

SEQ ID NO: 295263 - DNA, 25 bp, Mus musculus
gagctggaagatttcatcctgatgg

SEQ ID NO: 295264 - DNA, 25 bp, Mus musculus
gagctggaaggtcttgttgcagcat

SEQ ID NO: 295265 - DNA, 25 bp, Mus musculus
gagctggacacggctgtccagggca

SEQ ID NO: 295266 - DNA, 25 bp, Mus musculus
gagctggaccctgtggaagggcggc

SEQ ID NO: 295267 - DNA, 25 bp, Mus musculus
gagctggacgagaactacaatatgt

SEQ ID NO: 295268 - DNA, 25 bp, Mus musculus
gagctggacgctcggactgggctat

SEQ ID NO: 295269 - DNA, 25 bp, Mus musculus
gagctggacgggacctcattcctct

SEQ ID NO: 295270 - DNA, 25 bp, Mus musculus
gagctggactgttatccaactgagg

SEQ ID NO: 295271 - DNA, 25 bp, Mus musculus
gagctggagagaaaaatatcaggat

SEQ ID NO: 295272 - DNA, 25 bp, Mus musculus
gagctggagagacaaaagatagagg

SEQ ID NO: 295273 - DNA, 25 bp, Mus musculus
gagctggagaggaaagccatagagg

SEQ ID NO: 295274 - DNA, 25 bp, Mus musculus
gagctggagatcaggaggcgccagc

SEQ ID NO: 295275 - DNA, 25 bp, Mus musculus
gagctggagatcaggttcaatgctc

SEQ ID NO: 295276 - DNA, 25 bp, Mus musculus
gagctggagcagaggagataatcgg

SEQ ID NO: 295277 - DNA, 25 bp, Mus musculus
gagctggagcagaggagatcatcgg

SEQ ID NO: 295278 - DNA, 25 bp, Mus musculus
gagctggagcccctgaaagagatga

SEQ ID NO: 295279 - DNA, 25 bp, Mus musculus
gagctggaggcccaggtgcgcaagt

SEQ ID NO: 295280 - DNA, 25 bp, Mus musculus
gagctggaggcccctggcgaagggg

SEQ ID NO: 295281 - DNA, 25 bp, Mus musculus
gagctggagggctaaaaccgactct

SEQ ID NO: 295282 - DNA, 25 bp, Mus musculus
gagctggagtcacgggaagtcctgc

SEQ ID NO: 295283 - DNA, 25 bp, Mus musculus
gagctggatagagcggcagtacatc

SEQ ID NO: 295284 - DNA, 25 bp, Mus musculus
gagctggcaccagctgaggatggtt

SEQ ID NO: 295285 - DNA, 25 bp, Mus musculus
gagctggcactcagggagcatggca

SEQ ID NO: 295286 - DNA, 25 bp, Mus musculus
gagctggcagagtcccgttgccgag

SEQ ID NO: 295287 - DNA, 25 bp, Mus musculus
gagctggcagagtctaagtgttctg

SEQ ID NO: 295288 - DNA, 25 bp, Mus musculus
gagctggccactgtggtcaaagcac

SEQ ID NO: 295289 - DNA, 25 bp, Mus musculus
gagctggccactgtgtttacttatt

SEQ ID NO: 295290 - DNA, 25 bp, Mus musculus
gagctggccaggactgccgcttcgc

SEQ ID NO: 295291 - DNA, 25 bp, Mus musculus
gagctggcgggtgaaaattttgatc

SEQ ID NO: 295292 - DNA, 25 bp, Mus musculus
gagctggcggttttgtaccaatggc

SEQ ID NO: 295293 - DNA, 25 bp, Mus musculus
gagctggctgatagggtgggagagg

SEQ ID NO: 295294 - DNA, 25 bp, Mus musculus
gagctggctggaggcactttcccag

SEQ ID NO: 295295 - DNA, 25 bp, Mus musculus
gagctggctgggtttgactctgctg

SEQ ID NO: 295296 - DNA, 25 bp, Mus musculus
gagctggctggtgctggcatgaact

SEQ ID NO: 295297 - DNA, 25 bp, Mus musculus
gagctgggaagccctggcacaaaaa

SEQ ID NO: 295298 - DNA, 25 bp, Mus musculus
gagctgggacaggtggccctaagaa

SEQ ID NO: 295299 - DNA, 25 bp, Mus musculus
gagctgggacatgatgtgattaaga

SEQ ID NO: 295300 - DNA, 25 bp, Mus musculus
gagctgggacgagcggatacgggcc

SEQ ID NO: 295301 - DNA, 25 bp, Mus musculus
gagctgggagatcatcacagttgag

SEQ ID NO: 295302 - DNA, 25 bp, Mus musculus
gagctgggaggcccagccagcagaa

SEQ ID NO: 295303 - DNA, 25 bp, Mus musculus
gagctgggcgtggaagctatggagg

SEQ ID NO: 295304 - DNA, 25 bp, Mus musculus
gagctgggctacaaggtgaagaagc

SEQ ID NO: 295305 - DNA, 25 bp, Mus musculus
gagctgggctgcctgcctgcctgcc

SEQ ID NO: 295306 - DNA, 25 bp, Mus musculus
gagctgggcttggaggcaagggcag

SEQ ID NO: 295307 - DNA, 25 bp, Mus musculus
gagctggggaccgagccctctgatt

SEQ ID NO: 295308 - DNA, 25 bp, Mus musculus
gagctggggcccgagttctctgggc

SEQ ID NO: 295309 - DNA, 25 bp, Mus musculus
gagctgggtcaggtggccactctag

SEQ ID NO: 295310 - DNA, 25 bp, Mus musculus
gagctgggtgcagaaactggaaaca

SEQ ID NO: 295311 - DNA, 25 bp, Mus musculus
gagctgggttcgctcccagcaatgt

SEQ ID NO: 295312 - DNA, 25 bp, Mus musculus
gagctgggttcggtcccagcaatgt

SEQ ID NO: 295313 - DNA, 25 bp, Mus musculus
gagctggtacagtatgctgtgtccc

SEQ ID NO: 295314 - DNA, 25 bp, Mus musculus
gagctggtattccaggaatcatggc

SEQ ID NO: 295315 - DNA, 25 bp, Mus musculus
gagctggtcacaggagtcctttgga

SEQ ID NO: 295316 - DNA, 25 bp, Mus musculus
gagctggtcacaggtgcccagcaga

SEQ ID NO: 295317 - DNA, 25 bp, Mus musculus
gagctggtccgagggctactgacag

SEQ ID NO: 295318 - DNA, 25 bp, Mus musculus
gagctggtgtcactgcagatgagag

SEQ ID NO: 295319 - DNA, 25 bp, Mus musculus
gagctggtgtcagacatggctaaag

SEQ ID NO: 295320 - DNA, 25 bp, Mus musculus
gagctggtgtcagtctctgcttcct

SEQ ID NO: 295321 - DNA, 25 bp, Mus musculus
gagctggttaagagaaaatccctga

SEQ ID NO: 295322 - DNA, 25 bp, Mus musculus
gagctggttcttaagtcagagagcg

SEQ ID NO: 295323 - DNA, 25 bp, Mus musculus
gagctgtaaggccgtggcagagcag

SEQ ID NO: 295324 - DNA, 25 bp, Mus musculus
gagctgtaaggtgacagaagaccac

SEQ ID NO: 295325 - DNA, 25 bp, Mus musculus
gagctgtaagtgagcttcactagac

SEQ ID NO: 295326 - DNA, 25 bp, Mus musculus
gagctgtaatagttccgaggatgag

SEQ ID NO: 295327 - DNA, 25 bp, Mus musculus
gagctgtaattgtagctgatgaaga

SEQ ID NO: 295328 - DNA, 25 bp, Mus musculus
gagctgtaattgtaggtgccgcacc

SEQ ID NO: 295329 - DNA, 25 bp, Mus musculus
gagctgtacaaggtgctgagttccc

SEQ ID NO: 295330 - DNA, 25 bp, Mus musculus
gagctgtataaggtacatttgaaga

SEQ ID NO: 295331 - DNA, 25 bp, Mus musculus
gagctgtatgaggaagtaaagctct

SEQ ID NO: 295332 - DNA, 25 bp, Mus musculus
gagctgtatggaaagatggcctctg

SEQ ID NO: 295333 - DNA, 25 bp, Mus musculus
gagctgtcaaggccctgtggacaat

SEQ ID NO: 295334 - DNA, 25 bp, Mus musculus
gagctgtcactcagaagaaacccag

SEQ ID NO: 295335 - DNA, 25 bp, Mus musculus
gagctgtcactcaggtctgtggagg

SEQ ID NO: 295336 - DNA, 25 bp, Mus musculus
gagctgtcagggacggtcaagactc

SEQ ID NO: 295337 - DNA, 25 bp, Mus musculus
gagctgtccaatgacgaagctgcgg

SEQ ID NO: 295338 - DNA, 25 bp, Mus musculus
gagctgtccaatttttggcctttga

SEQ ID NO: 295339 - DNA, 25 bp, Mus musculus
gagctgtcggcattatgccagtaca

SEQ ID NO: 295340 - DNA, 25 bp, Mus musculus
gagctgtcgggagaaaattttgagc

SEQ ID NO: 295341 - DNA, 25 bp, Mus musculus
gagctgtgaatgtctgtgtcagcag

SEQ ID NO: 295342 - DNA, 25 bp, Mus musculus
gagctgtgagcaagtgaacacggat

SEQ ID NO: 295343 - DNA, 25 bp, Mus musculus
gagctgtgaggaatgagttcctgag

SEQ ID NO: 295344 - DNA, 25 bp, Mus musculus
gagctgtgaggacagaaaataatat

SEQ ID NO: 295345 - DNA, 25 bp, Mus musculus
gagctgtgaggcgcagcaagcacac

SEQ ID NO: 295346 - DNA, 25 bp, Mus musculus
gagctgtggaagagtccctgattgt

SEQ ID NO: 295347 - DNA, 25 bp, Mus musculus
gagctgtggcacacatcactcaact

SEQ ID NO: 295348 - DNA, 25 bp, Mus musculus
gagctgtgtaaaaagagtattacaa

SEQ ID NO: 295349 - DNA, 25 bp, Mus musculus
gagctgtgtaaaaaggaagtgttaa

SEQ ID NO: 295350 - DNA, 25 bp, Mus musculus
gagctgtgtggaaaaaatgtgggga

SEQ ID NO: 295351 - DNA, 25 bp, Mus musculus
gagctgtgtggtgacttaccaattt

SEQ ID NO: 295352 - DNA, 25 bp, Mus musculus
gagctgttacaggtactgcgaatga

SEQ ID NO: 295353 - DNA, 25 bp, Mus musculus
gagctgttacagtttttcagctgcc

SEQ ID NO: 295354 - DNA, 25 bp, Mus musculus
gagctgttcagaatgaattagcctg

SEQ ID NO: 295355 - DNA, 25 bp, Mus musculus
gagctgttcagacggtgcgcagtgc

SEQ ID NO: 295356 - DNA, 25 bp, Mus musculus
gagctgttcagagacagatggggct

SEQ ID NO: 295357 - DNA, 25 bp, Mus musculus
gagctgttcagagtaggtggcgatg

SEQ ID NO: 295358 - DNA, 25 bp, Mus musculus
gagctgttccaccaggctgggccgg

SEQ ID NO: 295359 - DNA, 25 bp, Mus musculus
gagctgttccaccagtatttgaggc

SEQ ID NO: 295360 - DNA, 25 bp, Mus musculus
gagctgttccagttacagattcatg

SEQ ID NO: 295361 - DNA, 25 bp, Mus musculus
gagctgttctgtatgcttcctgcgg

SEQ ID NO: 295362 - DNA, 25 bp, Mus musculus
gagctgttggacaagccccacgcaa

SEQ ID NO: 295363 - DNA, 25 bp, Mus musculus
gagctgttgggaagatttctgggct

SEQ ID NO: 295364 - DNA, 25 bp, Mus musculus
gagctgttgggaagggtctctcatt

SEQ ID NO: 295365 - DNA, 25 bp, Mus musculus
gagctgttgggcatggaaccatctg

SEQ ID NO: 295366 - DNA, 25 bp, Mus musculus
gagctgttgtgatctcagttcacgg

SEQ ID NO: 295367 - DNA, 25 bp, Mus musculus
gagcttaaagatcgatcccgcagaa

SEQ ID NO: 295368 - DNA, 25 bp, Mus musculus
gagcttaacaggcaaacattctgca

SEQ ID NO: 295369 - DNA, 25 bp, Mus musculus
gagcttaacagtttggaatggtcag

SEQ ID NO: 295370 - DNA, 25 bp, Mus musculus
gagcttacaaagaatggaattgcta

SEQ ID NO: 295371 - DNA, 25 bp, Mus musculus
gagcttacagacgggctgactcctc

SEQ ID NO: 295372 - DNA, 25 bp, Mus musculus
gagcttacagacgggctttgctgtt

SEQ ID NO: 295373 - DNA, 25 bp, Mus musculus
gagcttacataggtccccttcccct

SEQ ID NO: 295374 - DNA, 25 bp, Mus musculus
gagcttacatagtgcaactacagat

SEQ ID NO: 295375 - DNA, 25 bp, Mus musculus
gagcttaccaggaagcatctgtctg

SEQ ID NO: 295376 - DNA, 25 bp, Mus musculus
gagcttacggtcattcctgatcgga

SEQ ID NO: 295377 - DNA, 25 bp, Mus musculus
gagcttacgtagatgaagaacttcc

SEQ ID NO: 295378 - DNA, 25 bp, Mus musculus
gagcttacgtaggctccatggtgta

SEQ ID NO: 295379 - DNA, 25 bp, Mus musculus
gagcttactctcttagcagtgaagc

SEQ ID NO: 295380 - DNA, 25 bp, Mus musculus
gagcttactggccgcagcaagaaca

SEQ ID NO: 295381 - DNA, 25 bp, Mus musculus
gagcttactggcctttcaggcagca

SEQ ID NO: 295382 - DNA, 25 bp, Mus musculus
gagcttatcctggactgagctcctg

SEQ ID NO: 295383 - DNA, 25 bp, Mus musculus
gagcttcaaggccaggttgatggaa

SEQ ID NO: 295384 - DNA, 25 bp, Mus musculus
gagcttcagcaggcatccatcctgg

SEQ ID NO: 295385 - DNA, 25 bp, Mus musculus
gagcttcagcgagggaagcttcttg

SEQ ID NO: 295386 - DNA, 25 bp, Mus musculus
gagcttcatgggaggatccaaaggg

SEQ ID NO: 295387 - DNA, 25 bp, Mus musculus
gagcttccaaagccacccgcggtca

SEQ ID NO: 295388 - DNA, 25 bp, Mus musculus
gagcttccaaagcgcggctgggttc

SEQ ID NO: 295389 - DNA, 25 bp, Mus musculus
gagcttccacctagggactgccgct

SEQ ID NO: 295390 - DNA, 25 bp, Mus musculus
gagcttcccaggtctctttgagccc

SEQ ID NO: 295391 - DNA, 25 bp, Mus musculus
gagcttccctcggaggcacgcgcct

SEQ ID NO: 295392 - DNA, 25 bp, Mus musculus
gagcttccctcggagtacaacacag

SEQ ID NO: 295393 - DNA, 25 bp, Mus musculus
gagcttccgagcaggggaagagttg

SEQ ID NO: 295394 - DNA, 25 bp, Mus musculus
gagcttccgcaggcgccatggaaaa

SEQ ID NO: 295395 - DNA, 25 bp, Mus musculus
gagcttcctcttcagcagccgctct

SEQ ID NO: 295396 - DNA, 25 bp, Mus musculus
gagcttcctcttcgttattttaact

SEQ ID NO: 295397 - DNA, 25 bp, Mus musculus
gagcttcctgagcctcctctttcag

SEQ ID NO: 295398 - DNA, 25 bp, Mus musculus
gagcttcctgatgaagttatagtgc

SEQ ID NO: 295399 - DNA, 25 bp, Mus musculus
gagcttcctgatgaatgtcattggt

SEQ ID NO: 295400 - DNA, 25 bp, Mus musculus
gagcttcctgcagccaggtgggaag

SEQ ID NO: 295401 - DNA, 25 bp, Mus musculus
gagcttcctttgaggaggattctgg

SEQ ID NO: 295402 - DNA, 25 bp, Mus musculus
gagcttcgagaaggccaaagaatct

SEQ ID NO: 295403 - DNA, 25 bp, Mus musculus
gagcttcgcctgaaacctcagcttc

SEQ ID NO: 295404 - DNA, 25 bp, Mus musculus
gagcttctcagtagtgatcaagctc

SEQ ID NO: 295405 - DNA, 25 bp, Mus musculus
gagcttctccgagaacgggcagaga

SEQ ID NO: 295406 - DNA, 25 bp, Mus musculus
gagcttctcggtgtggatcatatgt

SEQ ID NO: 295407 - DNA, 25 bp, Mus musculus
gagcttctgcaaggttctgtccccc

SEQ ID NO: 295408 - DNA, 25 bp, Mus musculus
gagcttctggagaagctccagcacc

SEQ ID NO: 295409 - DNA, 25 bp, Mus musculus
gagcttctggggaaggtgcagctgg

SEQ ID NO: 295410 - DNA, 25 bp, Mus musculus
gagcttctgtgaagtcaccttaatt

SEQ ID NO: 295411 - DNA, 25 bp, Mus musculus
gagcttgagcagcatcagaaaagtt

SEQ ID NO: 295412 - DNA, 25 bp, Mus musculus
gagcttgagcagctgagtcccttcc

SEQ ID NO: 295413 - DNA, 25 bp, Mus musculus
gagcttgaggcgggcagggagctaa

SEQ ID NO: 295414 - DNA, 25 bp, Mus musculus
gagcttgatgcagaatccaaatcca

SEQ ID NO: 295415 - DNA, 25 bp, Mus musculus
gagcttgatgcagctgtggcagaag

SEQ ID NO: 295416 - DNA, 25 bp, Mus musculus
gagcttgcaggaataacagaagccc

SEQ ID NO: 295417 - DNA, 25 bp, Mus musculus
gagcttgcaggcatctagtcttgct

SEQ ID NO: 295418 - DNA, 25 bp, Mus musculus
gagcttgccctggtcaggcagcagt

SEQ ID NO: 295419 - DNA, 25 bp, Mus musculus
gagcttgctaagctacaagaagact

SEQ ID NO: 295420 - DNA, 25 bp, Mus musculus
gagcttgctaaggtggaagaagaaa

SEQ ID NO: 295421 - DNA, 25 bp, Mus musculus
gagcttgctaatgacggtgcaggca

SEQ ID NO: 295422 - DNA, 25 bp, Mus musculus
gagcttgctacaatgggtgacaagc

SEQ ID NO: 295423 - DNA, 25 bp, Mus musculus
gagcttgctggcaagagtattcagg

SEQ ID NO: 295424 - DNA, 25 bp, Mus musculus
gagcttgctggcaaggtggcgacct

SEQ ID NO: 295425 - DNA, 25 bp, Mus musculus
gagcttggagcagctgggaacactc

SEQ ID NO: 295426 - DNA, 25 bp, Mus musculus
gagcttggcagactgtataacaaag

SEQ ID NO: 295427 - DNA, 25 bp, Mus musculus
gagcttggttccagatgggtgtgtt

SEQ ID NO: 295428 - DNA, 25 bp, Mus musculus
gagcttggttccagggtgactgact

SEQ ID NO: 295429 - DNA, 25 bp, Mus musculus
gagcttgtaccaccggtaactaaat

SEQ ID NO: 295430 - DNA, 25 bp, Mus musculus
gagcttgtaccaccggtatccatgc

SEQ ID NO: 295431 - DNA, 25 bp, Mus musculus
gagcttgtcagaatcaggtctgata

SEQ ID NO: 295432 - DNA, 25 bp, Mus musculus
gagcttgtcagattcaggtctgata

SEQ ID NO: 295433 - DNA, 25 bp, Mus musculus
gagcttgtgcagccacgacccaccg

SEQ ID NO: 295434 - DNA, 25 bp, Mus musculus
gagcttgtgcaggtgacagcagcat

SEQ ID NO: 295435 - DNA, 25 bp, Mus musculus
gagctttactctggactttggagac

SEQ ID NO: 295436 - DNA, 25 bp, Mus musculus
gagctttagtgtagggccaagtcca

SEQ ID NO: 295437 - DNA, 25 bp, Mus musculus
gagctttagtgtataggggagcagg

SEQ ID NO: 295438 - DNA, 25 bp, Mus musculus
gagctttcaaagtgaaacctccaca

SEQ ID NO: 295439 - DNA, 25 bp, Mus musculus
gagctttcccatcagaaaccaactt

SEQ ID NO: 295440 - DNA, 25 bp, Mus musculus
gagctttcccgagacagcctgccag

SEQ ID NO: 295441 - DNA, 25 bp, Mus musculus
gagctttcctttgaagcacctaaag

SEQ ID NO: 295442 - DNA, 25 bp, Mus musculus
gagctttcggagcattttctgcagc

SEQ ID NO: 295443 - DNA, 25 bp, Mus musculus
gagctttgaatcgggaggaagcact

SEQ ID NO: 295444 - DNA, 25 bp, Mus musculus
gagctttgagatgggtaaccttttg

SEQ ID NO: 295445 - DNA, 25 bp, Mus musculus
gagctttgagatggtctgctttacg

SEQ ID NO: 295446 - DNA, 25 bp, Mus musculus
gagctttgaggaaagatcaaactca

SEQ ID NO: 295447 - DNA, 25 bp, Mus musculus
gagctttgaggaagttatcaacata

SEQ ID NO: 295448 - DNA, 25 bp, Mus musculus
gagctttgaggacctcatggaaccc

SEQ ID NO: 295449 - DNA, 25 bp, Mus musculus
gagctttgagttgctggttgttgga

SEQ ID NO: 295450 - DNA, 25 bp, Mus musculus
gagctttgatgctgcattccgtggt

SEQ ID NO: 295451 - DNA, 25 bp, Mus musculus
gagctttgccaggaatctggtctgt

SEQ ID NO: 295452 - DNA, 25 bp, Mus musculus
gagctttggagctgttggttttgac

SEQ ID NO: 295453 - DNA, 25 bp, Mus musculus
gagctttgggaccggttcggaccat

SEQ ID NO: 295454 - DNA, 25 bp, Mus musculus
gagctttgtcaagaacctacatgga

SEQ ID NO: 295455 - DNA, 25 bp, Mus musculus
gagctttgtcaagggctggggagca

SEQ ID NO: 295456 - DNA, 25 bp, Mus musculus
gagctttgttttttgccatctctgg

SEQ ID NO: 295457 - DNA, 25 bp, Mus musculus
gagcttttaaaaattgttgcttcct

SEQ ID NO: 295458 - DNA, 25 bp, Mus musculus
gagcttttcagcacctttggggaac

SEQ ID NO: 295459 - DNA, 25 bp, Mus musculus
gagcttttgcaggtggctttgcagc

SEQ ID NO: 295460 - DNA, 25 bp, Mus musculus
gagcttttgcggtttgtagtgcatc

SEQ ID NO: 295461 - DNA, 25 bp, Mus musculus
gagcttttgcgttcagttcggtggc

SEQ ID NO: 295462 - DNA, 25 bp, Mus musculus
gagctttttccaggatcccattgtt

SEQ ID NO: 295463 - DNA, 25 bp, Mus musculus
gaggaaaaacagagagagagaaaga

SEQ ID NO: 295464 - DNA, 25 bp, Mus musculus
gaggaaaaagagagaaaaggaacag

SEQ ID NO: 295465 - DNA, 25 bp, Mus musculus
gaggaaaaagcgaccagctacattt

SEQ ID NO: 295466 - DNA, 25 bp, Mus musculus
gaggaaaaagctcgccacccccatc

SEQ ID NO: 295467 - DNA, 25 bp, Mus musculus
gaggaaaaagttgccaggaaacaag

SEQ ID NO: 295468 - DNA, 25 bp, Mus musculus
gaggaaaagaaagagagttcgatgc

SEQ ID NO: 295469 - DNA, 25 bp, Mus musculus
gaggaaaagaaagctgttcagagct

SEQ ID NO: 295470 - DNA, 25 bp, Mus musculus
gaggaaaagaaagtctgccaaggca

SEQ ID NO: 295471 - DNA, 25 bp, Mus musculus
gaggaaaagcagacttgtgtcctgg

SEQ ID NO: 295472 - DNA, 25 bp, Mus musculus
gaggaaaagcagcagatataccaga

SEQ ID NO: 295473 - DNA, 25 bp, Mus musculus
gaggaaaaggaggagtcagacacag

SEQ ID NO: 295474 - DNA, 25 bp, Mus musculus
gaggaaaataaggtacttcaattta

SEQ ID NO: 295475 - DNA, 25 bp, Mus musculus
gaggaaaatccagttcacagtgtag

SEQ ID NO: 295476 - DNA, 25 bp, Mus musculus
gaggaaaatgggatggagacaacag

SEQ ID NO: 295477 - DNA, 25 bp, Mus musculus
gaggaaaatggtgaggaggttggac

SEQ ID NO: 295478 - DNA, 25 bp, Mus musculus
gaggaaacacaagagcaggcaaggc

SEQ ID NO: 295479 - DNA, 25 bp, Mus musculus
gaggaaacaggcactctcgatttgg

SEQ ID NO: 295480 - DNA, 25 bp, Mus musculus
gaggaaacaggccgaggaagatgca

SEQ ID NO: 295481 - DNA, 25 bp, Mus musculus
gaggaaacaggggaacacctctact

SEQ ID NO: 295482 - DNA, 25 bp, Mus musculus
gaggaaaccaggaatgggccttgac

SEQ ID NO: 295483 - DNA, 25 bp, Mus musculus
gaggaaacccagtcgcatagggcat

SEQ ID NO: 295484 - DNA, 25 bp, Mus musculus
gaggaaagacatgatactgtcagca

SEQ ID NO: 295485 - DNA, 25 bp, Mus musculus
gaggaaagaggaagaagtcgtcaca

SEQ ID NO: 295486 - DNA, 25 bp, Mus musculus
gaggaaagcacagagaccagctatg

SEQ ID NO: 295487 - DNA, 25 bp, Mus musculus
gaggaaagcacagggaagctgggaa

SEQ ID NO: 295488 - DNA, 25 bp, Mus musculus
gaggaaagcatgaagacgtggccat

SEQ ID NO: 295489 - DNA, 25 bp, Mus musculus
gaggaaagccagtaatggtcagcaa

SEQ ID NO: 295490 - DNA, 25 bp, Mus musculus
gaggaaagcctcagaaaccttgatt

SEQ ID NO: 295491 - DNA, 25 bp, Mus musculus
gaggaaagcctcagagccttttcag

SEQ ID NO: 295492 - DNA, 25 bp, Mus musculus
gaggaaagcgaactgacaagttgga

SEQ ID NO: 295493 - DNA, 25 bp, Mus musculus
gaggaaagcgaactgggttacattc

SEQ ID NO: 295494 - DNA, 25 bp, Mus musculus
gaggaaagcgaatctccccgaggtg

SEQ ID NO: 295495 - DNA, 25 bp, Mus musculus
gaggaaagcgtcaaaccggtgccca

SEQ ID NO: 295496 - DNA, 25 bp, Mus musculus
gaggaaagcgtcaaactccctgaat

SEQ ID NO: 295497 - DNA, 25 bp, Mus musculus
gaggaaatcaatcgcaagcaggact

SEQ ID NO: 295498 - DNA, 25 bp, Mus musculus
gaggaaatcagtgttgaagatgaag

SEQ ID NO: 295499 - DNA, 25 bp, Mus musculus
gaggaaatccaacagcttccccttg

SEQ ID NO: 295500 - DNA, 25 bp, Mus musculus
gaggaaatcttgcatctgaaagctg

SEQ ID NO: 295501 - DNA, 25 bp, Mus musculus
gaggaaatcttgcatgacaacctgg

SEQ ID NO: 295502 - DNA, 25 bp, Mus musculus
gaggaaatggaggcaagaagacagc

SEQ ID NO: 295503 - DNA, 25 bp, Mus musculus
gaggaaattacacctgctcctgagg

SEQ ID NO: 295504 - DNA, 25 bp, Mus musculus
gaggaaattcatagtgaccatcttt

SEQ ID NO: 295505 - DNA, 25 bp, Mus musculus
gaggaaattgatgagctccttcagg

SEQ ID NO: 295506 - DNA, 25 bp, Mus musculus
gaggaacaaaacagattaatagaga

SEQ ID NO: 295507 - DNA, 25 bp, Mus musculus
gaggaacaaaacaggcattggcaga

SEQ ID NO: 295508 - DNA, 25 bp, Mus musculus
gaggaacaaactggttattaaatag

SEQ ID NO: 295509 - DNA, 25 bp, Mus musculus
gaggaacaagattcgagagcaaaac

SEQ ID NO: 295510 - DNA, 25 bp, Mus musculus
gaggaacacagagttcagaaagaac

SEQ ID NO: 295511 - DNA, 25 bp, Mus musculus
gaggaacacaggattgagctgacct

SEQ ID NO: 295512 - DNA, 25 bp, Mus musculus
gaggaacagacacagctcacagact

SEQ ID NO: 295513 - DNA, 25 bp, Mus musculus
gaggaacagagaagctcccgtccgt

SEQ ID NO: 295514 - DNA, 25 bp, Mus musculus
gaggaacagctgggccctgtctcaa

SEQ ID NO: 295515 - DNA, 25 bp, Mus musculus
gaggaacatgccggagttctctggg

SEQ ID NO: 295516 - DNA, 25 bp, Mus musculus
gaggaacatgtaacaggtccactgc

SEQ ID NO: 295517 - DNA, 25 bp, Mus musculus
gaggaacattgtaaattcaagatgg

SEQ ID NO: 295518 - DNA, 25 bp, Mus musculus
gaggaaccactgaactggcattatg

SEQ ID NO: 295519 - DNA, 25 bp, Mus musculus
gaggaaccccggaagcacaaataca

SEQ ID NO: 295520 - DNA, 25 bp, Mus musculus
gaggaaccctgaaggatgatgactg

SEQ ID NO: 295521 - DNA, 25 bp, Mus musculus
gaggaaccctggggcatcccccgca

SEQ ID NO: 295522 - DNA, 25 bp, Mus musculus
gaggaacctttcacgatgacagaga

SEQ ID NO: 295523 - DNA, 25 bp, Mus musculus
gaggaacgagtgtggccagacgcca

SEQ ID NO: 295524 - DNA, 25 bp, Mus musculus
gaggaactatccgcaaagaagatat

SEQ ID NO: 295525 - DNA, 25 bp, Mus musculus
gaggaactatcggctctttctacac

SEQ ID NO: 295526 - DNA, 25 bp, Mus musculus
gaggaactatcgtcttgaagaacca

SEQ ID NO: 295527 - DNA, 25 bp, Mus musculus
gaggaactcccaggctatgaagaga

SEQ ID NO: 295528 - DNA, 25 bp, Mus musculus
gaggaactgagaagacattttcact

SEQ ID NO: 295529 - DNA, 25 bp, Mus musculus
gaggaactgattgacccttcccatg

SEQ ID NO: 295530 - DNA, 25 bp, Mus musculus
gaggaactgcctaaggagcctcaag

SEQ ID NO: 295531 - DNA, 25 bp, Mus musculus
gaggaactggacaaggccctgtgtg

SEQ ID NO: 295532 - DNA, 25 bp, Mus musculus
gaggaactgggaaagggagccttct

SEQ ID NO: 295533 - DNA, 25 bp, Mus musculus
gaggaacttaaaaaggagcttcgac

SEQ ID NO: 295534 - DNA, 25 bp, Mus musculus
gaggaacttaaggtgagggtggaac

SEQ ID NO: 295535 - DNA, 25 bp, Mus musculus
gaggaacttggagggccatggcgga

SEQ ID NO: 295536 - DNA, 25 bp, Mus musculus
gaggaagaaaagcactgcccctcga

SEQ ID NO: 295537 - DNA, 25 bp, Mus musculus
gaggaagaaaagtggccctgtctcc

SEQ ID NO: 295538 - DNA, 25 bp, Mus musculus
gaggaagaagaagaggcttctgtgt

SEQ ID NO: 295539 - DNA, 25 bp, Mus musculus
gaggaagaagacagatgagcttccc

SEQ ID NO: 295540 - DNA, 25 bp, Mus musculus
gaggaagaagacaggacaggaagct

SEQ ID NO: 295541 - DNA, 25 bp, Mus musculus
gaggaagaagacagttcaaaagacc

SEQ ID NO: 295542 - DNA, 25 bp, Mus musculus
gaggaagaagagtcaagcgaaggca

SEQ ID NO: 295543 - DNA, 25 bp, Mus musculus
gaggaagaagcgacttgaagagatt

SEQ ID NO: 295544 - DNA, 25 bp, Mus musculus
gaggaagaaggaggttccattttgg

SEQ ID NO: 295545 - DNA, 25 bp, Mus musculus
gaggaagaagtctgttcccagttct

SEQ ID NO: 295546 - DNA, 25 bp, Mus musculus
gaggaagacaggagtctgcggtgtt

SEQ ID NO: 295547 - DNA, 25 bp, Mus musculus
gaggaagacagggttccagtgatct

SEQ ID NO: 295548 - DNA, 25 bp, Mus musculus
gaggaagactctgcagcttcaacca

SEQ ID NO: 295549 - DNA, 25 bp, Mus musculus
gaggaagactgaaccagctctccag

SEQ ID NO: 295550 - DNA, 25 bp, Mus musculus
gaggaagagaaagggcggtctggtc

SEQ ID NO: 295551 - DNA, 25 bp, Mus musculus
gaggaagagaaggctgaggcagaca

SEQ ID NO: 295552 - DNA, 25 bp, Mus musculus
gaggaagagagacgggtccagtgaa

SEQ ID NO: 295553 - DNA, 25 bp, Mus musculus
gaggaagagcaaagaaatctgcagg

SEQ ID NO: 295554 - DNA, 25 bp, Mus musculus
gaggaagagcaatgtggactttgtg

SEQ ID NO: 295555 - DNA, 25 bp, Mus musculus
gaggaagagcagcagagtggtagga

SEQ ID NO: 295556 - DNA, 25 bp, Mus musculus
gaggaagagcagcagatcagaccta

SEQ ID NO: 295557 - DNA, 25 bp, Mus musculus
gaggaagagccggaatcggtgggac

SEQ ID NO: 295558 - DNA, 25 bp, Mus musculus
gaggaagaggaacacgcagcactgt

SEQ ID NO: 295559 - DNA, 25 bp, Mus musculus
gaggaagaggaggaggaggctccgc

SEQ ID NO: 295560 - DNA, 25 bp, Mus musculus
gaggaagatctaagtacaccaaatg

SEQ ID NO: 295561 - DNA, 25 bp, Mus musculus
gaggaagatgacagcctgtttgagc

SEQ ID NO: 295562 - DNA, 25 bp, Mus musculus
gaggaagatgaccgttcacctgcag

SEQ ID NO: 295563 - DNA, 25 bp, Mus musculus
gaggaagatgatgagtctgatgaca

SEQ ID NO: 295564 - DNA, 25 bp, Mus musculus
gaggaagatggaggttccattttgg

SEQ ID NO: 295565 - DNA, 25 bp, Mus musculus
gaggaagcacagaccagaagcccct

SEQ ID NO: 295566 - DNA, 25 bp, Mus musculus
gaggaagcacagctctggatgggtc

SEQ ID NO: 295567 - DNA, 25 bp, Mus musculus
gaggaagcactggaggaggcagatg

SEQ ID NO: 295568 - DNA, 25 bp, Mus musculus
gaggaagcactggcaaggggaccag

SEQ ID NO: 295569 - DNA, 25 bp, Mus musculus
gaggaagcagagggctgagcccccg

SEQ ID NO: 295570 - DNA, 25 bp, Mus musculus
gaggaagcagatataaagacttgaa

SEQ ID NO: 295571 - DNA, 25 bp, Mus musculus
gaggaagccaagaagaagctggctc

SEQ ID NO: 295572 - DNA, 25 bp, Mus musculus
gaggaagcccccaagttcctggcct

SEQ ID NO: 295573 - DNA, 25 bp, Mus musculus
gaggaagcctaaggatgatgctgtt

SEQ ID NO: 295574 - DNA, 25 bp, Mus musculus
gaggaagctgctgggcaccaagcca

SEQ ID NO: 295575 - DNA, 25 bp, Mus musculus
gaggaagcttcagcgacagcagtct

SEQ ID NO: 295576 - DNA, 25 bp, Mus musculus
gaggaaggaagaggtttatgggact

SEQ ID NO: 295577 - DNA, 25 bp, Mus musculus
gaggaaggcaaggccaagaacgccc

SEQ ID NO: 295578 - DNA, 25 bp, Mus musculus
gaggaaggcaggaaagaagaggtta

SEQ ID NO: 295579 - DNA, 25 bp, Mus musculus
gaggaaggcgaagatgagcgttcgg

SEQ ID NO: 295580 - DNA, 25 bp, Mus musculus
gaggaagtagacaatcctcctgatc

SEQ ID NO: 295581 - DNA, 25 bp, Mus musculus
gaggaagtagagccgccatgactac

SEQ ID NO: 295582 - DNA, 25 bp, Mus musculus
gaggaagtcaaaaggatcgtcagtg

SEQ ID NO: 295583 - DNA, 25 bp, Mus musculus
gaggaagtcagtgaaaaaaaattca

SEQ ID NO: 295584 - DNA, 25 bp, Mus musculus
gaggaagtcagtgaaaaaattgtac

SEQ ID NO: 295585 - DNA, 25 bp, Mus musculus
gaggaagtccggcagtaggacagtc

SEQ ID NO: 295586 - DNA, 25 bp, Mus musculus
gaggaagtctgcactggaaccacct

SEQ ID NO: 295587 - DNA, 25 bp, Mus musculus
gaggaagtctgcagtgccggtgccc

SEQ ID NO: 295588 - DNA, 25 bp, Mus musculus
gaggaagtgctggaaagcacagaac

SEQ ID NO: 295589 - DNA, 25 bp, Mus musculus
gaggaagtgctggttcctacagcac

SEQ ID NO: 295590 - DNA, 25 bp, Mus musculus
gaggaagtggagggactgaactttt

SEQ ID NO: 295591 - DNA, 25 bp, Mus musculus
gaggaagttcgtggaagggtggctg

SEQ ID NO: 295592 - DNA, 25 bp, Mus musculus
gaggaagttctacaggcacatcatc

SEQ ID NO: 295593 - DNA, 25 bp, Mus musculus
gaggaagttggttgggtgaatttca

SEQ ID NO: 295594 - DNA, 25 bp, Mus musculus
gaggaataaagaaaggtgaccagaa

SEQ ID NO: 295595 - DNA, 25 bp, Mus musculus
gaggaataagaccagatcatcttta

SEQ ID NO: 295596 - DNA, 25 bp, Mus musculus
gaggaataagatgaggtcctccacc

SEQ ID NO: 295597 - DNA, 25 bp, Mus musculus
gaggaatcagaatcagactggatct

SEQ ID NO: 295598 - DNA, 25 bp, Mus musculus
gaggaatcagcttaccaacaaaact

SEQ ID NO: 295599 - DNA, 25 bp, Mus musculus
gaggaatcagtattcgcctgggaat

SEQ ID NO: 295600 - DNA, 25 bp, Mus musculus
gaggaatcagttcacagcgctgtgt

SEQ ID NO: 295601 - DNA, 25 bp, Mus musculus
gaggaatccaacctcagtgcagaag

SEQ ID NO: 295602 - DNA, 25 bp, Mus musculus
gaggaatgctcgccaaaacaacttc

SEQ ID NO: 295603 - DNA, 25 bp, Mus musculus
gaggaatgctctctttggggtgttc

SEQ ID NO: 295604 - DNA, 25 bp, Mus musculus
gaggaatggagaacatcccaaccca

SEQ ID NO: 295605 - DNA, 25 bp, Mus musculus
gaggaatggaggtggacattgcatc

SEQ ID NO: 295606 - DNA, 25 bp, Mus musculus
gaggaatggcgtactcagttcgtgt

SEQ ID NO: 295607 - DNA, 25 bp, Mus musculus
gaggaatgggaaaagtacgagatga

SEQ ID NO: 295608 - DNA, 25 bp, Mus musculus
gaggaatggtcatgatggtaccagg

SEQ ID NO: 295609 - DNA, 25 bp, Mus musculus
gaggaatgtgatggttctccaggat

SEQ ID NO: 295610 - DNA, 25 bp, Mus musculus
gaggaatgtgcccctgtcccttcct

SEQ ID NO: 295611 - DNA, 25 bp, Mus musculus
gaggaattttatgctcgacgccaat

SEQ ID NO: 295612 - DNA, 25 bp, Mus musculus
gaggacaaaacaggaatggaagccc

SEQ ID NO: 295613 - DNA, 25 bp, Mus musculus
gaggacaaaacagtgaccaagaaga

SEQ ID NO: 295614 - DNA, 25 bp, Mus musculus
gaggacaaaaccaaggatgtggagt

SEQ ID NO: 295615 - DNA, 25 bp, Mus musculus
gaggacaaaccaaggctcatctgcg

SEQ ID NO: 295616 - DNA, 25 bp, Mus musculus
gaggacaaagaaatggtccttctcg

SEQ ID NO: 295617 - DNA, 25 bp, Mus musculus
gaggacaaagagaatgatggatata

SEQ ID NO: 295618 - DNA, 25 bp, Mus musculus
gaggacaaaggggagacaccattgg

SEQ ID NO: 295619 - DNA, 25 bp, Mus musculus
gaggacaaaggtcaagcaggtagag

SEQ ID NO: 295620 - DNA, 25 bp, Mus musculus
gaggacaaatgtaaggcaaatgacc

SEQ ID NO: 295621 - DNA, 25 bp, Mus musculus
gaggacaacatcaaggtgtctttgg

SEQ ID NO: 295622 - DNA, 25 bp, Mus musculus
gaggacaaccacagcgacccatacg

SEQ ID NO: 295623 - DNA, 25 bp, Mus musculus
gaggacaagaaggacctgagggacc

SEQ ID NO: 295624 - DNA, 25 bp, Mus musculus
gaggacaagaaggcacatgcaacta

SEQ ID NO: 295625 - DNA, 25 bp, Mus musculus
gaggacaagagcaacagtaccattc

SEQ ID NO: 295626 - DNA, 25 bp, Mus musculus
gaggacaagatgctcatgagcagcg

SEQ ID NO: 295627 - DNA, 25 bp, Mus musculus
gaggacaagattaggaatcagtggg

SEQ ID NO: 295628 - DNA, 25 bp, Mus musculus
gaggacaagggaccgtcacgacggc

SEQ ID NO: 295629 - DNA, 25 bp, Mus musculus
gaggacaataaggagaagaagaagc

SEQ ID NO: 295630 - DNA, 25 bp, Mus musculus
gaggacaatcgggtgatccaggagt

SEQ ID NO: 295631 - DNA, 25 bp, Mus musculus
gaggacaatgtctgttctgagtaca

SEQ ID NO: 295632 - DNA, 25 bp, Mus musculus
gaggacaatgttttgatgagtggtg

SEQ ID NO: 295633 - DNA, 25 bp, Mus musculus
gaggacacagagaagctcattgctg

SEQ ID NO: 295634 - DNA, 25 bp, Mus musculus
gaggacacagagctgtcccacattg

SEQ ID NO: 295635 - DNA, 25 bp, Mus musculus
gaggacacagagctgttgccaaaac

SEQ ID NO: 295636 - DNA, 25 bp, Mus musculus
gaggacacagattccttctggaacc

SEQ ID NO: 295637 - DNA, 25 bp, Mus musculus
gaggacaccaagggtccaccaacag

SEQ ID NO: 295638 - DNA, 25 bp, Mus musculus
gaggacacccaaggatgtgaatgag

SEQ ID NO: 295639 - DNA, 25 bp, Mus musculus
gaggacaccgcgcagatctcaagca

SEQ ID NO: 295640 - DNA, 25 bp, Mus musculus
gaggacactcaagtggctgatgtga

SEQ ID NO: 295641 - DNA, 25 bp, Mus musculus
gaggacactgaactcctacctggac

SEQ ID NO: 295642 - DNA, 25 bp, Mus musculus
gaggacactggtgttagaaatgaag

SEQ ID NO: 295643 - DNA, 25 bp, Mus musculus
gaggacagaaagctttttacctttg

SEQ ID NO: 295644 - DNA, 25 bp, Mus musculus
gaggacagaagagtgtgtttgacat

SEQ ID NO: 295645 - DNA, 25 bp, Mus musculus
gaggacagaagatacaatggagagg

SEQ ID NO: 295646 - DNA, 25 bp, Mus musculus
gaggacagacaagaaattgcaaatt

SEQ ID NO: 295647 - DNA, 25 bp, Mus musculus
gaggacagacctgcaaatctcccag

SEQ ID NO: 295648 - DNA, 25 bp, Mus musculus
gaggacagactggaggcattctgga

SEQ ID NO: 295649 - DNA, 25 bp, Mus musculus
gaggacagagccaccagccatgccc

SEQ ID NO: 295650 - DNA, 25 bp, Mus musculus
gaggacagagggataagaaaaataa

SEQ ID NO: 295651 - DNA, 25 bp, Mus musculus
gaggacagcagtaccagcgctgaag

SEQ ID NO: 295652 - DNA, 25 bp, Mus musculus
gaggacagcgactttgaagattctc

SEQ ID NO: 295653 - DNA, 25 bp, Mus musculus
gaggacagcggctggaatggtctga

SEQ ID NO: 295654 - DNA, 25 bp, Mus musculus
gaggacagctcaatcgagctgggag

SEQ ID NO: 295655 - DNA, 25 bp, Mus musculus
gaggacagctcagctgttgaatcac

SEQ ID NO: 295656 - DNA, 25 bp, Mus musculus
gaggacagcttgtcccaggtaaatc

SEQ ID NO: 295657 - DNA, 25 bp, Mus musculus
gaggacaggaaagattgttttctgc

SEQ ID NO: 295658 - DNA, 25 bp, Mus musculus
gaggacaggaaagcccatgttacca

SEQ ID NO: 295659 - DNA, 25 bp, Mus musculus
gaggacaggaaagggcactgtggag

SEQ ID NO: 295660 - DNA, 25 bp, Mus musculus
gaggacaggaaaggtgtactcgggc

SEQ ID NO: 295661 - DNA, 25 bp, Mus musculus
gaggacaggaattgtttgttcctta

SEQ ID NO: 295662 - DNA, 25 bp, Mus musculus
gaggacagtgtgaccgtaccgaccc

SEQ ID NO: 295663 - DNA, 25 bp, Mus musculus
gaggacatcattcagaaatggcaaa

SEQ ID NO: 295664 - DNA, 25 bp, Mus musculus
gaggacatcattcagggctgcaaaa

SEQ ID NO: 295665 - DNA, 25 bp, Mus musculus
gaggacatcgatccctttgacgtgg

SEQ ID NO: 295666 - DNA, 25 bp, Mus musculus
gaggacatctcacaaaaaacatcgg

SEQ ID NO: 295667 - DNA, 25 bp, Mus musculus
gaggacatgaccccctgcccggcgt

SEQ ID NO: 295668 - DNA, 25 bp, Mus musculus
gaggacatgacccggtctcaaggga

SEQ ID NO: 295669 - DNA, 25 bp, Mus musculus
gaggacatgtcgtccctaatgtgga

SEQ ID NO: 295670 - DNA, 25 bp, Mus musculus
gaggacatgtcgtgtttctttcagt

SEQ ID NO: 295671 - DNA, 25 bp, Mus musculus
gaggacattaagagtggaaagctga

SEQ ID NO: 295672 - DNA, 25 bp, Mus musculus
gaggacattaaggccacccgagacc

SEQ ID NO: 295673 - DNA, 25 bp, Mus musculus
gaggacattaggaaattagataggt

SEQ ID NO: 295674 - DNA, 25 bp, Mus musculus
gaggacattcaaagtaccattacta

SEQ ID NO: 295675 - DNA, 25 bp, Mus musculus
gaggacattcgccaatggcagtgcg

SEQ ID NO: 295676 - DNA, 25 bp, Mus musculus
gaggacattcgtctgtattcatgcc

SEQ ID NO: 295677 - DNA, 25 bp, Mus musculus
gaggaccaaggaagccgtgaaggca

SEQ ID NO: 295678 - DNA, 25 bp, Mus musculus
gaggaccaaggtgagcctgtgacta

SEQ ID NO: 295679 - DNA, 25 bp, Mus musculus
gaggaccagcgcaacaaaaagatcg

SEQ ID NO: 295680 - DNA, 25 bp, Mus musculus
gaggacccacagcgacccatacgtg

SEQ ID NO: 295681 - DNA, 25 bp, Mus musculus
gaggacccagtgacgggtgagcctg

SEQ ID NO: 295682 - DNA, 25 bp, Mus musculus
gaggaccccaaagtggttgatcggt

SEQ ID NO: 295683 - DNA, 25 bp, Mus musculus
gaggaccccacagtgcaagaatccc

SEQ ID NO: 295684 - DNA, 25 bp, Mus musculus
gaggaccccagccaggcccccagca

SEQ ID NO: 295685 - DNA, 25 bp, Mus musculus
gaggaccccagccaggtcagtggct

SEQ ID NO: 295686 - DNA, 25 bp, Mus musculus
gaggaccccgggttccagtgacagc

SEQ ID NO: 295687 - DNA, 25 bp, Mus musculus
gaggacccgcaaggttaataacttg

SEQ ID NO: 295688 - DNA, 25 bp, Mus musculus
gaggacccgcgagatgctgaggatg

SEQ ID NO: 295689 - DNA, 25 bp, Mus musculus
gaggaccctcaggtttgatgaagat

SEQ ID NO: 295690 - DNA, 25 bp, Mus musculus
gaggaccctgagcaggctcctgctg

SEQ ID NO: 295691 - DNA, 25 bp, Mus musculus
gaggaccctgctctgacgtatgact

SEQ ID NO: 295692 - DNA, 25 bp, Mus musculus
gaggaccctggggtcaagagtgtca

SEQ ID NO: 295693 - DNA, 25 bp, Mus musculus
gaggaccctgtgacgaaagaagaaa

SEQ ID NO: 295694 - DNA, 25 bp, Mus musculus
gaggaccgaggatccagatcgaggg

SEQ ID NO: 295695 - DNA, 25 bp, Mus musculus
gaggaccgaggcgttatcgaactcc

SEQ ID NO: 295696 - DNA, 25 bp, Mus musculus
gaggaccgccacgggaagaagcgca

SEQ ID NO: 295697 - DNA, 25 bp, Mus musculus
gaggaccgcgaagaggatgaacctt

SEQ ID NO: 295698 - DNA, 25 bp, Mus musculus
gaggaccgcgaaggtcatctaactt

SEQ ID NO: 295699 - DNA, 25 bp, Mus musculus
gaggacctaaaggagacttgggaga

SEQ ID NO: 295700 - DNA, 25 bp, Mus musculus
gaggacctaccatggggcgcagttc

SEQ ID NO: 295701 - DNA, 25 bp, Mus musculus
gaggacctccaagacagggtttttc

SEQ ID NO: 295702 - DNA, 25 bp, Mus musculus
gaggacctccaagcgctcatcgaca

SEQ ID NO: 295703 - DNA, 25 bp, Mus musculus
gaggacctgacgcaggcaaaaccca

SEQ ID NO: 295704 - DNA, 25 bp, Mus musculus
gaggacctgcaggctgtgtggagat

SEQ ID NO: 295705 - DNA, 25 bp, Mus musculus
gaggacctggaggaaattatggaag

SEQ ID NO: 295706 - DNA, 25 bp, Mus musculus
gaggacctggaggtggcaattttgg

SEQ ID NO: 295707 - DNA, 25 bp, Mus musculus
gaggaccttcggggctgggcttcaa

SEQ ID NO: 295708 - DNA, 25 bp, Mus musculus
gaggaccttcgggtaaatggccaag

SEQ ID NO: 295709 - DNA, 25 bp, Mus musculus
gaggaccttgagcagcccaaagaag

SEQ ID NO: 295710 - DNA, 25 bp, Mus musculus
gaggaccttgagcaggaggcttctc

SEQ ID NO: 295711 - DNA, 25 bp, Mus musculus
gaggaccttgcacgacctagtggtt

SEQ ID NO: 295712 - DNA, 25 bp, Mus musculus
gaggacgaaaccacgaaccgcatgc

SEQ ID NO: 295713 - DNA, 25 bp, Mus musculus
gaggacgaagtgtttgactttggcg

SEQ ID NO: 295714 - DNA, 25 bp, Mus musculus
gaggacgacccaggaagagaaagag

SEQ ID NO: 295715 - DNA, 25 bp, Mus musculus
gaggacgacccaggcaaagggaatt

SEQ ID NO: 295716 - DNA, 25 bp, Mus musculus
gaggacgactccttctatgaaatca

SEQ ID NO: 295717 - DNA, 25 bp, Mus musculus
gaggacgactgccccaagaggacct

SEQ ID NO: 295718 - DNA, 25 bp, Mus musculus
gaggacgactggcgaagcagtgccc

SEQ ID NO: 295719 - DNA, 25 bp, Mus musculus
gaggacgacttggagccccacgcaa

SEQ ID NO: 295720 - DNA, 25 bp, Mus musculus
gaggacgagagctctatttcagtgc

SEQ ID NO: 295721 - DNA, 25 bp, Mus musculus
gaggacgagagctctggtgcaagtg

SEQ ID NO: 295722 - DNA, 25 bp, Mus musculus
gaggacgagctaaagcggctgctgc

SEQ ID NO: 295723 - DNA, 25 bp, Mus musculus
gaggacgagctacagccctacacga

SEQ ID NO: 295724 - DNA, 25 bp, Mus musculus
gaggacgaggaagaggagaaaccaa

SEQ ID NO: 295725 - DNA, 25 bp, Mus musculus
gaggacgaggatgaggactcgtcca

SEQ ID NO: 295726 - DNA, 25 bp, Mus musculus
gaggacgatccactgcaacacaccc

SEQ ID NO: 295727 - DNA, 25 bp, Mus musculus
gaggacgcagaagagactgagagga

SEQ ID NO: 295728 - DNA, 25 bp, Mus musculus
gaggacgcagaagagcctaccgagg

SEQ ID NO: 295729 - DNA, 25 bp, Mus musculus
gaggacgcagaagagtttgactttg

SEQ ID NO: 295730 - DNA, 25 bp, Mus musculus
gaggacgcagagcttgttgatgttg

SEQ ID NO: 295731 - DNA, 25 bp, Mus musculus
gaggacgcgatagttctgacacaac

SEQ ID NO: 295732 - DNA, 25 bp, Mus musculus
gaggacgctgccggccatcgtcgtt

SEQ ID NO: 295733 - DNA, 25 bp, Mus musculus
gaggacgctgccgggtctcttccac

SEQ ID NO: 295734 - DNA, 25 bp, Mus musculus
gaggacggcatgccccccatcaaca

SEQ ID NO: 295735 - DNA, 25 bp, Mus musculus
gaggacggcatggagccgttggtat

SEQ ID NO: 295736 - DNA, 25 bp, Mus musculus
gaggacggcatgggctcaagcccct

SEQ ID NO: 295737 - DNA, 25 bp, Mus musculus
gaggacgggaaagaacacatgtcgg

SEQ ID NO: 295738 - DNA, 25 bp, Mus musculus
gaggacggggcttggcagagatgga

SEQ ID NO: 295739 - DNA, 25 bp, Mus musculus
gaggacggggcttgtgtgttgcata

SEQ ID NO: 295740 - DNA, 25 bp, Mus musculus
gaggacgtccaggagataattgtgt

SEQ ID NO: 295741 - DNA, 25 bp, Mus musculus
gaggacgtcccgcacgtagaagacc

SEQ ID NO: 295742 - DNA, 25 bp, Mus musculus
gaggacgtttgagcgaatctcatta

SEQ ID NO: 295743 - DNA, 25 bp, Mus musculus
gaggactaacactgtgtccgtgcga

SEQ ID NO: 295744 - DNA, 25 bp, Mus musculus
gaggactacaaacagtactttgtgt

SEQ ID NO: 295745 - DNA, 25 bp, Mus musculus
gaggactacatcgactccctgggct

SEQ ID NO: 295746 - DNA, 25 bp, Mus musculus
gaggactatcgataattccggcggg

SEQ ID NO: 295747 - DNA, 25 bp, Mus musculus
gaggactatggcaggttcaccggac

SEQ ID NO: 295748 - DNA, 25 bp, Mus musculus
gaggactatggcgtttactggcccc

SEQ ID NO: 295749 - DNA, 25 bp, Mus musculus
gaggactatggggtcacatatgact

SEQ ID NO: 295750 - DNA, 25 bp, Mus musculus
gaggactcaaggtaagaaatccagt

SEQ ID NO: 295751 - DNA, 25 bp, Mus musculus
gaggactcaagtttcagagtgataa

SEQ ID NO: 295752 - DNA, 25 bp, Mus musculus
gaggactcggaggcgggttcagccg

SEQ ID NO: 295753 - DNA, 25 bp, Mus musculus
gaggactgaatagttgcagtaaggt

SEQ ID NO: 295754 - DNA, 25 bp, Mus musculus
gaggactgaggggggtccgcctacc

SEQ ID NO: 295755 - DNA, 25 bp, Mus musculus
gaggactgagtcagccaaggtagcc

SEQ ID NO: 295756 - DNA, 25 bp, Mus musculus
gaggactgatgggatggctctgagc

SEQ ID NO: 295757 - DNA, 25 bp, Mus musculus
gaggactgcaagctaccttgcaacc

SEQ ID NO: 295758 - DNA, 25 bp, Mus musculus
gaggactgcaagctgccctgcaacc

SEQ ID NO: 295759 - DNA, 25 bp, Mus musculus
gaggactgccccaaggctgacttcc

SEQ ID NO: 295760 - DNA, 25 bp, Mus musculus
gaggactgccttcaggacgaatgct

SEQ ID NO: 295761 - DNA, 25 bp, Mus musculus
gaggactgcgggccttcatcaagta

SEQ ID NO: 295762 - DNA, 25 bp, Mus musculus
gaggactggcctggggtctacatca

SEQ ID NO: 295763 - DNA, 25 bp, Mus musculus
gaggactgggccccacaggatcgcc

SEQ ID NO: 295764 - DNA, 25 bp, Mus musculus
gaggactgtcctttcccatggccgg

SEQ ID NO: 295765 - DNA, 25 bp, Mus musculus
gaggactgtgagtgttcccaggagc

SEQ ID NO: 295766 - DNA, 25 bp, Mus musculus
gaggactgtgtgggtgaaagccggc

SEQ ID NO: 295767 - DNA, 25 bp, Mus musculus
gaggactgttatgaaagagaagatg

SEQ ID NO: 295768 - DNA, 25 bp, Mus musculus
gaggacttcaccatccacgaaaatg

SEQ ID NO: 295769 - DNA, 25 bp, Mus musculus
gaggacttcaggtatccgtggtcac

SEQ ID NO: 295770 - DNA, 25 bp, Mus musculus
gaggacttcaggtggaccagcacac

SEQ ID NO: 295771 - DNA, 25 bp, Mus musculus
gaggacttcagtgtgtctccaggct

SEQ ID NO: 295772 - DNA, 25 bp, Mus musculus
gaggacttccacaagaaatttgccc

SEQ ID NO: 295773 - DNA, 25 bp, Mus musculus
gaggacttccccacgatctccctgg

SEQ ID NO: 295774 - DNA, 25 bp, Mus musculus
gaggacttccccacggaagacggcg

SEQ ID NO: 295775 - DNA, 25 bp, Mus musculus
gaggacttctcaagatgaggttcca

SEQ ID NO: 295776 - DNA, 25 bp, Mus musculus
gaggacttctcaaggaatctgaatt

SEQ ID NO: 295777 - DNA, 25 bp, Mus musculus
gaggacttctcaagtctattgcatc

SEQ ID NO: 295778 - DNA, 25 bp, Mus musculus
gaggacttctcagagtctgtcccag

SEQ ID NO: 295779 - DNA, 25 bp, Mus musculus
gaggactttgaggacaatggtgaca

SEQ ID NO: 295780 - DNA, 25 bp, Mus musculus
gaggactttgcaactgctgctgaga

SEQ ID NO: 295781 - DNA, 25 bp, Mus musculus
gaggactttgccaggcgctgtgctt

SEQ ID NO: 295782 - DNA, 25 bp, Mus musculus
gaggagaaaacgatgggatattcag

SEQ ID NO: 295783 - DNA, 25 bp, Mus musculus
gaggagaaaacggcacacatgttgg

SEQ ID NO: 295784 - DNA, 25 bp, Mus musculus
gaggagaaacaggcaagtgctctcc

SEQ ID NO: 295785 - DNA, 25 bp, Mus musculus
gaggagaaaccaagacccagactta

SEQ ID NO: 295786 - DNA, 25 bp, Mus musculus
gaggagaaagaacgtttgctgaaga

SEQ ID NO: 295787 - DNA, 25 bp, Mus musculus
gaggagaaagagatgaaaccggctt

SEQ ID NO: 295788 - DNA, 25 bp, Mus musculus
gaggagaaagaggacagagctgctc

SEQ ID NO: 295789 - DNA, 25 bp, Mus musculus
gaggagaaagagggtggagaggtcg

SEQ ID NO: 295790 - DNA, 25 bp, Mus musculus
gaggagaaagggaagaaggcagagg

SEQ ID NO: 295791 - DNA, 25 bp, Mus musculus
gaggagaaatagaagaggagcctgc

SEQ ID NO: 295792 - DNA, 25 bp, Mus musculus
gaggagaaatagaagtggacgacaa

SEQ ID NO: 295793 - DNA, 25 bp, Mus musculus
gaggagaaatccaagcttttagcca

SEQ ID NO: 295794 - DNA, 25 bp, Mus musculus
gaggagaaattggtccttaccctat

SEQ ID NO: 295795 - DNA, 25 bp, Mus musculus
gaggagaacagtgccaggtcaccag

SEQ ID NO: 295796 - DNA, 25 bp, Mus musculus
gaggagaaccgggtgagccctattt

SEQ ID NO: 295797 - DNA, 25 bp, Mus musculus
gaggagaacgaggagatatccatca

SEQ ID NO: 295798 - DNA, 25 bp, Mus musculus
gaggagaactcaaggcttctagaga

SEQ ID NO: 295799 - DNA, 25 bp, Mus musculus
gaggagaactgcacagcgaaccccc

SEQ ID NO: 295800 - DNA, 25 bp, Mus musculus
gaggagaagaagaaggtagctacat

SEQ ID NO: 295801 - DNA, 25 bp, Mus musculus
gaggagaagagcagccagcacccaa

SEQ ID NO: 295802 - DNA, 25 bp, Mus musculus
gaggagaagagggtccacctggcat

SEQ ID NO: 295803 - DNA, 25 bp, Mus musculus
gaggagaagcagagcggaattccta

SEQ ID NO: 295804 - DNA, 25 bp, Mus musculus
gaggagaagctgcggcccaccagga

SEQ ID NO: 295805 - DNA, 25 bp, Mus musculus
gaggagaatggcccgccctcctcgc

SEQ ID NO: 295806 - DNA, 25 bp, Mus musculus
gaggagaatgtcccagaaatcctgg

SEQ ID NO: 295807 - DNA, 25 bp, Mus musculus
gaggagacaaaatgagtctggaatc

SEQ ID NO: 295808 - DNA, 25 bp, Mus musculus
gaggagacagacaccatccaacacg

SEQ ID NO: 295809 - DNA, 25 bp, Mus musculus
gaggagacagaggtattgacctcat

SEQ ID NO: 295810 - DNA, 25 bp, Mus musculus
gaggagacagatgtgaggtgagatg

SEQ ID NO: 295811 - DNA, 25 bp, Mus musculus
gaggagacaggaaggcgtagggaat

SEQ ID NO: 295812 - DNA, 25 bp, Mus musculus
gaggagaccaaactggatcccactg

SEQ ID NO: 295813 - DNA, 25 bp, Mus musculus
gaggagacgaaacagcttggattct

SEQ ID NO: 295814 - DNA, 25 bp, Mus musculus
gaggagacggtggtgaccatgaaag

SEQ ID NO: 295815 - DNA, 25 bp, Mus musculus
gaggagacttcaggctccaggatga

SEQ ID NO: 295816 - DNA, 25 bp, Mus musculus
gaggagagaaaagggagctgtgatt

SEQ ID NO: 295817 - DNA, 25 bp, Mus musculus
gaggagagaacttggagatctcatt

SEQ ID NO: 295818 - DNA, 25 bp, Mus musculus
gaggagagaagagaactatgagcag

SEQ ID NO: 295819 - DNA, 25 bp, Mus musculus
gaggagagaagcagaaaaaaaaatg

SEQ ID NO: 295820 - DNA, 25 bp, Mus musculus
gaggagagacaaggcaagaaataca

SEQ ID NO: 295821 - DNA, 25 bp, Mus musculus
gaggagagacaaggggatgacaatt

SEQ ID NO: 295822 - DNA, 25 bp, Mus musculus
gaggagagacgtggagaaatggggc

SEQ ID NO: 295823 - DNA, 25 bp, Mus musculus
gaggagagagaacctggtccacgtg

SEQ ID NO: 295824 - DNA, 25 bp, Mus musculus
gaggagagagaatgactctgtggtg

SEQ ID NO: 295825 - DNA, 25 bp, Mus musculus
gaggagagagagagaagagagagag

SEQ ID NO: 295826 - DNA, 25 bp, Mus musculus
gaggagagagagagagagagagaga

SEQ ID NO: 295827 - DNA, 25 bp, Mus musculus
gaggagagaggtacaatttcttcac

SEQ ID NO: 295828 - DNA, 25 bp, Mus musculus
gaggagagagtgttccagaaggaag

SEQ ID NO: 295829 - DNA, 25 bp, Mus musculus
gaggagagatcagtgttgaagatga

SEQ ID NO: 295830 - DNA, 25 bp, Mus musculus
gaggagagcaaaaagaatcgggttg

SEQ ID NO: 295831 - DNA, 25 bp, Mus musculus
gaggagagcaaaaagtttcgtgaac

SEQ ID NO: 295832 - DNA, 25 bp, Mus musculus
gaggagagcaaggataagcgccggg

SEQ ID NO: 295833 - DNA, 25 bp, Mus musculus
gaggagagccaggttctcgaggccc

SEQ ID NO: 295834 - DNA, 25 bp, Mus musculus
gaggagagctgaggcacctccaagt

SEQ ID NO: 295835 - DNA, 25 bp, Mus musculus
gaggagaggctggtgcacaaggtcc

SEQ ID NO: 295836 - DNA, 25 bp, Mus musculus
gaggagagggggaggcatttgcagg

SEQ ID NO: 295837 - DNA, 25 bp, Mus musculus
gaggagaggtgtgaaggcatttgtg

SEQ ID NO: 295838 - DNA, 25 bp, Mus musculus
gaggagagtcacagctaaagaacgc

SEQ ID NO: 295839 - DNA, 25 bp, Mus musculus
gaggagagtgaggaagaagacgatg

SEQ ID NO: 295840 - DNA, 25 bp, Mus musculus
gaggagataaagggcagtcattcaa

SEQ ID NO: 295841 - DNA, 25 bp, Mus musculus
gaggagataaaggggagatccctga

SEQ ID NO: 295842 - DNA, 25 bp, Mus musculus
gaggagatattggtccttcattcca

SEQ ID NO: 295843 - DNA, 25 bp, Mus musculus
gaggagatcaagaggatagataggt

SEQ ID NO: 295844 - DNA, 25 bp, Mus musculus
gaggagatcaaggacttgcaccaga

SEQ ID NO: 295845 - DNA, 25 bp, Mus musculus
gaggagatcaatcgggagttcctct

SEQ ID NO: 295846 - DNA, 25 bp, Mus musculus
gaggagatccaggagtggtacgagg

SEQ ID NO: 295847 - DNA, 25 bp, Mus musculus
gaggagatcgagggcctgatctcag

SEQ ID NO: 295848 - DNA, 25 bp, Mus musculus
gaggagatgagcaggagccggcccc

SEQ ID NO: 295849 - DNA, 25 bp, Mus musculus
gaggagatgcggtggacaccaaagt

SEQ ID NO: 295850 - DNA, 25 bp, Mus musculus
gaggagatgcggtggtggtacgcct

SEQ ID NO: 295851 - DNA, 25 bp, Mus musculus
gaggagatggacgtggatgagtgcc

SEQ ID NO: 295852 - DNA, 25 bp, Mus musculus
gaggagatggagcacgccccagaga

SEQ ID NO: 295853 - DNA, 25 bp, Mus musculus
gaggagatgggtggtggaagatacc

SEQ ID NO: 295854 - DNA, 25 bp, Mus musculus
gaggagcaaacggaagcgagaaaac

SEQ ID NO: 295855 - DNA, 25 bp, Mus musculus
gaggagcaacacagggactattcca

SEQ ID NO: 295856 - DNA, 25 bp, Mus musculus
gaggagcaacagcggcaacctttgg

SEQ ID NO: 295857 - DNA, 25 bp, Mus musculus
gaggagcaagatatctgttgcttcc

SEQ ID NO: 295858 - DNA, 25 bp, Mus musculus
gaggagcaattcaaggtattcacac

SEQ ID NO: 295859 - DNA, 25 bp, Mus musculus
gaggagcacaggaccatcagaatcc

SEQ ID NO: 295860 - DNA, 25 bp, Mus musculus
gaggagcacgataaggaagagcgga

SEQ ID NO: 295861 - DNA, 25 bp, Mus musculus
gaggagcagaggctgtgtgaaggcg

SEQ ID NO: 295862 - DNA, 25 bp, Mus musculus
gaggagcagctagagattgcgctgg

SEQ ID NO: 295863 - DNA, 25 bp, Mus musculus
gaggagcaggaaaaggtggtcacta

SEQ ID NO: 295864 - DNA, 25 bp, Mus musculus
gaggagcaggatgagagcagacact

SEQ ID NO: 295865 - DNA, 25 bp, Mus musculus
gaggagcaggatgaggaggaagatg

SEQ ID NO: 295866 - DNA, 25 bp, Mus musculus
gaggagcaggccaaggccaaggctg

SEQ ID NO: 295867 - DNA, 25 bp, Mus musculus
gaggagcagtgaaatatttcagcgg

SEQ ID NO: 295868 - DNA, 25 bp, Mus musculus
gaggagcagtgaggtaatgacagag

SEQ ID NO: 295869 - DNA, 25 bp, Mus musculus
gaggagcagttgtttgtctgccagg

SEQ ID NO: 295870 - DNA, 25 bp, Mus musculus
gaggagcatgcgcaggtggtggagc

SEQ ID NO: 295871 - DNA, 25 bp, Mus musculus
gaggagccaatatctatctactact

SEQ ID NO: 295872 - DNA, 25 bp, Mus musculus
gaggagccaccaggttgacagacaa

SEQ ID NO: 295873 - DNA, 25 bp, Mus musculus
gaggagccagtgcagcctggagatg

SEQ ID NO: 295874 - DNA, 25 bp, Mus musculus
gaggagccagtgcaggcaggatctc

SEQ ID NO: 295875 - DNA, 25 bp, Mus musculus
gaggagccagtgcaggcgcctcatt

SEQ ID NO: 295876 - DNA, 25 bp, Mus musculus
gaggagccatgaatgtatcattgat

SEQ ID NO: 295877 - DNA, 25 bp, Mus musculus
gaggagcccatatccatgttccagc

SEQ ID NO: 295878 - DNA, 25 bp, Mus musculus
gaggagcccctcggatgttctctat

SEQ ID NO: 295879 - DNA, 25 bp, Mus musculus
gaggagcctatgaacgaaccacatg

SEQ ID NO: 295880 - DNA, 25 bp, Mus musculus
gaggagcctatgaaggaaccacatg

SEQ ID NO: 295881 - DNA, 25 bp, Mus musculus
gaggagcctcgagcatttagctcct

SEQ ID NO: 295882 - DNA, 25 bp, Mus musculus
gaggagcctggccccttcatggctg

SEQ ID NO: 295883 - DNA, 25 bp, Mus musculus
gaggagcctgtagaccaggatggaa

SEQ ID NO: 295884 - DNA, 25 bp, Mus musculus
gaggagcgagcccagcaggaagatg

SEQ ID NO: 295885 - DNA, 25 bp, Mus musculus
gaggagcgagcccaggcaagaagac

SEQ ID NO: 295886 - DNA, 25 bp, Mus musculus
gaggagcgcaggggccccacctgtc

SEQ ID NO: 295887 - DNA, 25 bp, Mus musculus
gaggagcgcaggttgtgtcaccaac

SEQ ID NO: 295888 - DNA, 25 bp, Mus musculus
gaggagcggttgcagacggcacgac

SEQ ID NO: 295889 - DNA, 25 bp, Mus musculus
gaggagcggttgcaggcctggcgtc

SEQ ID NO: 295890 - DNA, 25 bp, Mus musculus
gaggagctaaagatccttcgtacct

SEQ ID NO: 295891 - DNA, 25 bp, Mus musculus
gaggagctaaagttctccctgggca

SEQ ID NO: 295892 - DNA, 25 bp, Mus musculus
gaggagctaatcagtgagatgattc

SEQ ID NO: 295893 - DNA, 25 bp, Mus musculus
gaggagctaattctgaagtccctac

SEQ ID NO: 295894 - DNA, 25 bp, Mus musculus
gaggagctagagaactacatggacc

SEQ ID NO: 295895 - DNA, 25 bp, Mus musculus
gaggagctcaacaagactgcaagtg

SEQ ID NO: 295896 - DNA, 25 bp, Mus musculus
gaggagctccgagaggagacattcc

SEQ ID NO: 295897 - DNA, 25 bp, Mus musculus
gaggagctccgagaggtagctctgg

SEQ ID NO: 295898 - DNA, 25 bp, Mus musculus
gaggagctctaccagaacctgaccc

SEQ ID NO: 295899 - DNA, 25 bp, Mus musculus
gaggagctctgggaacctcctctgg

SEQ ID NO: 295900 - DNA, 25 bp, Mus musculus
gaggagctctggggcccagcaacct

SEQ ID NO: 295901 - DNA, 25 bp, Mus musculus
gaggagctgaaagcactgacacaca

SEQ ID NO: 295902 - DNA, 25 bp, Mus musculus
gaggagctgaaagggactgccctgt

SEQ ID NO: 295903 - DNA, 25 bp, Mus musculus
gaggagctgaagaaggcgccctttg

SEQ ID NO: 295904 - DNA, 25 bp, Mus musculus
gaggagctgaagaaggtggctgctg

SEQ ID NO: 295905 - DNA, 25 bp, Mus musculus
gaggagctgacagatgaggaaactg

SEQ ID NO: 295906 - DNA, 25 bp, Mus musculus
gaggagctgaggagagaacattgaa

SEQ ID NO: 295907 - DNA, 25 bp, Mus musculus
gaggagctgagtgataacattcagc

SEQ ID NO: 295908 - DNA, 25 bp, Mus musculus
gaggagctgagtgattttgaggaag

SEQ ID NO: 295909 - DNA, 25 bp, Mus musculus
gaggagctgcacaagtcacgggtca

SEQ ID NO: 295910 - DNA, 25 bp, Mus musculus
gaggagctgccagaaaagcctttgg

SEQ ID NO: 295911 - DNA, 25 bp, Mus musculus
gaggagctgctgaggaacttgtatg

SEQ ID NO: 295912 - DNA, 25 bp, Mus musculus
gaggagctggaggttgcgagaacat

SEQ ID NO: 295913 - DNA, 25 bp, Mus musculus
gaggagctggcactgccctttttac

SEQ ID NO: 295914 - DNA, 25 bp, Mus musculus
gaggagctgggccaggagctgaagg

SEQ ID NO: 295915 - DNA, 25 bp, Mus musculus
gaggagctgggctttgactacggtg

SEQ ID NO: 295916 - DNA, 25 bp, Mus musculus
gaggagctgggtcaggtggccactc

SEQ ID NO: 295917 - DNA, 25 bp, Mus musculus
gaggagctgggtccatattgtggga

SEQ ID NO: 295918 - DNA, 25 bp, Mus musculus
gaggagctgggtgatggctgtgggc

SEQ ID NO: 295919 - DNA, 25 bp, Mus musculus
gaggagcttaacaggcaaacattct

SEQ ID NO: 295920 - DNA, 25 bp, Mus musculus
gaggagcttaacagtttggaatggt

SEQ ID NO: 295921 - DNA, 25 bp, Mus musculus
gaggagcttgaggcgggcagggagc

SEQ ID NO: 295922 - DNA, 25 bp, Mus musculus
gaggagctttgccaggaatctggtc

SEQ ID NO: 295923 - DNA, 25 bp, Mus musculus
gaggaggaaaagccgcacatgccta

SEQ ID NO: 295924 - DNA, 25 bp, Mus musculus
gaggaggaaaaggcatgaggatcgt

SEQ ID NO: 295925 - DNA, 25 bp, Mus musculus
gaggaggaacacagagttcagaaag

SEQ ID NO: 295926 - DNA, 25 bp, Mus musculus
gaggaggaacacaggattgagctga

SEQ ID NO: 295927 - DNA, 25 bp, Mus musculus
gaggaggaagaaaagcactgcccct

SEQ ID NO: 295928 - DNA, 25 bp, Mus musculus
gaggaggaagaaaagtggccctgtc

SEQ ID NO: 295929 - DNA, 25 bp, Mus musculus
gaggaggaagaaatggtccttctcg

SEQ ID NO: 295930 - DNA, 25 bp, Mus musculus
gaggaggaagaggctcacgaggccc

SEQ ID NO: 295931 - DNA, 25 bp, Mus musculus
gaggaggaagagttaacactcacga

SEQ ID NO: 295932 - DNA, 25 bp, Mus musculus
gaggaggaagatgaccgttcacctg

SEQ ID NO: 295933 - DNA, 25 bp, Mus musculus
gaggaggaaggcaaggccaagaacg

SEQ ID NO: 295934 - DNA, 25 bp, Mus musculus
gaggaggacaaagaaatggtccttc

SEQ ID NO: 295935 - DNA, 25 bp, Mus musculus
gaggaggacaaggagcgccatgaag

SEQ ID NO: 295936 - DNA, 25 bp, Mus musculus
gaggaggacaataaggagaagaaga

SEQ ID NO: 295937 - DNA, 25 bp, Mus musculus
gaggaggacactgaactcctacctg

SEQ ID NO: 295938 - DNA, 25 bp, Mus musculus
gaggaggacctgcaggctgtgtgga

SEQ ID NO: 295939 - DNA, 25 bp, Mus musculus
gaggaggacctggaggaaattatgg

SEQ ID NO: 295940 - DNA, 25 bp, Mus musculus
gaggaggacctggaggtggcaattt

SEQ ID NO: 295941 - DNA, 25 bp, Mus musculus
gaggaggacgagcaagaggaggcag

SEQ ID NO: 295942 - DNA, 25 bp, Mus musculus
gaggaggacggcatgccccccatca

SEQ ID NO: 295943 - DNA, 25 bp, Mus musculus
gaggaggacggcatggagccgttgg

SEQ ID NO: 295944 - DNA, 25 bp, Mus musculus
gaggaggacggcatgggctcaagcc

SEQ ID NO: 295945 - DNA, 25 bp, Mus musculus
gaggaggagaaagagggtggagagg

SEQ ID NO: 295946 - DNA, 25 bp, Mus musculus
gaggaggagacagatgtgaggtgag

SEQ ID NO: 295947 - DNA, 25 bp, Mus musculus
gaggaggagacaggaaggcgtaggg

SEQ ID NO: 295948 - DNA, 25 bp, Mus musculus
gaggaggagcaaacggaagcgagaa

SEQ ID NO: 295949 - DNA, 25 bp, Mus musculus
gaggaggagccggagccgttggtat

SEQ ID NO: 295950 - DNA, 25 bp, Mus musculus
gaggaggagctaaagatccttcgta

SEQ ID NO: 295951 - DNA, 25 bp, Mus musculus
gaggaggagctaaagttctccctgg

SEQ ID NO: 295952 - DNA, 25 bp, Mus musculus
gaggaggagctgcagttctccctgg

SEQ ID NO: 295953 - DNA, 25 bp, Mus musculus
gaggaggagctggagcacagccagg

SEQ ID NO: 295954 - DNA, 25 bp, Mus musculus
gaggaggaggaaaagccgcacatgc

SEQ ID NO: 295955 - DNA, 25 bp, Mus musculus
gaggaggaggagccggagccgttgg

SEQ ID NO: 295956 - DNA, 25 bp, Mus musculus
gaggaggaggaggaggaggctccgc

SEQ ID NO: 295957 - DNA, 25 bp, Mus musculus
gaggaggaggaggaggagtaggagg

SEQ ID NO: 295958 - DNA, 25 bp, Mus musculus
gaggaggaggaggaggctccgcccc

SEQ ID NO: 295959 - DNA, 25 bp, Mus musculus
gaggaggaggcgcgggctgtggagg

SEQ ID NO: 295960 - DNA, 25 bp, Mus musculus
gaggaggaggctgagatccagccgc

SEQ ID NO: 295961 - DNA, 25 bp, Mus musculus
gaggaggaggtcaaggccaagaacg

SEQ ID NO: 295962 - DNA, 25 bp, Mus musculus
gaggaggagtcagatgatctagcac

SEQ ID NO: 295963 - DNA, 25 bp, Mus musculus
gaggaggagtcagtgcaagggccat

SEQ ID NO: 295964 - DNA, 25 bp, Mus musculus
gaggaggatgaaggccattcaaact

SEQ ID NO: 295965 - DNA, 25 bp, Mus musculus
gaggaggatgaagggaaaatgttta

SEQ ID NO: 295966 - DNA, 25 bp, Mus musculus
gaggaggatgaggatggtgggcatt

SEQ ID NO: 295967 - DNA, 25 bp, Mus musculus
gaggaggatgaggattttgattggg

SEQ ID NO: 295968 - DNA, 25 bp, Mus musculus
gaggaggatgccctctgaagccaag

SEQ ID NO: 295969 - DNA, 25 bp, Mus musculus
gaggaggatggcttccgccttttct

SEQ ID NO: 295970 - DNA, 25 bp, Mus musculus
gaggaggatttgagttttaagctat

SEQ ID NO: 295971 - DNA, 25 bp, Mus musculus
gaggaggcaaagatttttatcaccg

SEQ ID NO: 295972 - DNA, 25 bp, Mus musculus
gaggaggcagaagcctcacaggcct

SEQ ID NO: 295973 - DNA, 25 bp, Mus musculus
gaggaggcagagcgcccgctgcact

SEQ ID NO: 295974 - DNA, 25 bp, Mus musculus
gaggaggcagagggaagacttgcca

SEQ ID NO: 295975 - DNA, 25 bp, Mus musculus
gaggaggcagtaggacttagaagag

SEQ ID NO: 295976 - DNA, 25 bp, Mus musculus
gaggaggccacagcaggtttccact

SEQ ID NO: 295977 - DNA, 25 bp, Mus musculus
gaggaggccgaagaagcacttaaag

SEQ ID NO: 295978 - DNA, 25 bp, Mus musculus
gaggaggccgaccagcccccgtcct

SEQ ID NO: 295979 - DNA, 25 bp, Mus musculus
gaggaggccgagaagtactctcaga

SEQ ID NO: 295980 - DNA, 25 bp, Mus musculus
gaggaggccgccaggctggctcagg

SEQ ID NO: 295981 - DNA, 25 bp, Mus musculus
gaggaggccgccaggttcacggctc

SEQ ID NO: 295982 - DNA, 25 bp, Mus musculus
gaggaggccgggccaaagtagagaa

SEQ ID NO: 295983 - DNA, 25 bp, Mus musculus
gaggaggccgggtccagatagtatc

SEQ ID NO: 295984 - DNA, 25 bp, Mus musculus
gaggaggccgggttcagattcagaa

SEQ ID NO: 295985 - DNA, 25 bp, Mus musculus
gaggaggcctcagattttacatgtg

SEQ ID NO: 295986 - DNA, 25 bp, Mus musculus
gaggaggcctcagttcctggcccca

SEQ ID NO: 295987 - DNA, 25 bp, Mus musculus
gaggaggcctcattgcatacatccc

SEQ ID NO: 295988 - DNA, 25 bp, Mus musculus
gaggaggcctcctcctggactgcca

SEQ ID NO: 295989 - DNA, 25 bp, Mus musculus
gaggaggccttctatcgaattcgct

SEQ ID NO: 295990 - DNA, 25 bp, Mus musculus
gaggaggcgcggcaggcggtgatac

SEQ ID NO: 295991 - DNA, 25 bp, Mus musculus
gaggaggcgcggcaggtggagggag

SEQ ID NO: 295992 - DNA, 25 bp, Mus musculus
gaggaggcgcgggctgtggaggagc

SEQ ID NO: 295993 - DNA, 25 bp, Mus musculus
gaggaggcgctgcgggtggcctgga

SEQ ID NO: 295994 - DNA, 25 bp, Mus musculus
gaggaggcggacgagcaaaaatcaa

SEQ ID NO: 295995 - DNA, 25 bp, Mus musculus
gaggaggctgagatccagccgcagc

SEQ ID NO: 295996 - DNA, 25 bp, Mus musculus
gaggagggaaatctggaactttgtt

SEQ ID NO: 295997 - DNA, 25 bp, Mus musculus
gaggagggaagatcctccctcatct

SEQ ID NO: 295998 - DNA, 25 bp, Mus musculus
gaggagggaaggacaggcctggcag

SEQ ID NO: 295999 - DNA, 25 bp, Mus musculus
gaggagggaaggggctggaaagtgc

SEQ ID NO: 296000 - DNA, 25 bp, Mus musculus
gaggagggagatggaaaagacatcc

SEQ ID NO: 296001 - DNA, 25 bp, Mus musculus
gaggagggagctgaggttttatctg

SEQ ID NO: 296002 - DNA, 25 bp, Mus musculus
gaggagggagtgacgtttgagtaca

SEQ ID NO: 296003 - DNA, 25 bp, Mus musculus
gaggagggcacagcatttgacattg

SEQ ID NO: 296004 - DNA, 25 bp, Mus musculus
gaggagggcagcagaaccagacatc

SEQ ID NO: 296005 - DNA, 25 bp, Mus musculus
gaggagggcaggaatcccagccatc

SEQ ID NO: 296006 - DNA, 25 bp, Mus musculus
gaggagggcatgggcaacaggacct

SEQ ID NO: 296007 - DNA, 25 bp, Mus musculus
gaggagggcatgggcgttaagatca

SEQ ID NO: 296008 - DNA, 25 bp, Mus musculus
gaggagggctcagatctggagctgc

SEQ ID NO: 296009 - DNA, 25 bp, Mus musculus
gaggagggggtaagggaggccgctc

SEQ ID NO: 296010 - DNA, 25 bp, Mus musculus
gaggaggggtggcggctcctccagg

SEQ ID NO: 296011 - DNA, 25 bp, Mus musculus
gaggagggttcagcccttcccctgg

SEQ ID NO: 296012 - DNA, 25 bp, Mus musculus
gaggagggttcagctcggatgtgga

SEQ ID NO: 296013 - DNA, 25 bp, Mus musculus
gaggaggtcaaggccaagaacgcgc

SEQ ID NO: 296014 - DNA, 25 bp, Mus musculus
gaggaggtcagaagattttgttgac

SEQ ID NO: 296015 - DNA, 25 bp, Mus musculus
gaggaggtcagaaggtgtgttatat

SEQ ID NO: 296016 - DNA, 25 bp, Mus musculus
gaggaggtgaggggacttcaaaaca

SEQ ID NO: 296017 - DNA, 25 bp, Mus musculus
gaggaggtgccacagccaccatgcc

SEQ ID NO: 296018 - DNA, 25 bp, Mus musculus
gaggaggtggaggacctcatggaac

SEQ ID NO: 296019 - DNA, 25 bp, Mus musculus
gaggaggtttctgaggtggagtctt

SEQ ID NO: 296020 - DNA, 25 bp, Mus musculus
gaggagtaagacgtcgcctcatctc

SEQ ID NO: 296021 - DNA, 25 bp, Mus musculus
gaggagtaagctggatggtccacct

SEQ ID NO: 296022 - DNA, 25 bp, Mus musculus
gaggagtaccaggagaccctgagca

SEQ ID NO: 296023 - DNA, 25 bp, Mus musculus
gaggagtaccaggaggagctggagt

SEQ ID NO: 296024 - DNA, 25 bp, Mus musculus
gaggagtacgaggagagagcaagag

SEQ ID NO: 296025 - DNA, 25 bp, Mus musculus
gaggagtacgaggaggaacaggaag

SEQ ID NO: 296026 - DNA, 25 bp, Mus musculus
gaggagtatgctcgggagcatggct

SEQ ID NO: 296027 - DNA, 25 bp, Mus musculus
gaggagtatggcagactgcacgggc

SEQ ID NO: 296028 - DNA, 25 bp, Mus musculus
gaggagtcagatgatctagcactaa

SEQ ID NO: 296029 - DNA, 25 bp, Mus musculus
gaggagtcagtgcaagggccatcac

SEQ ID NO: 296030 - DNA, 25 bp, Mus musculus
gaggagtcccggcgtggagcgttac

SEQ ID NO: 296031 - DNA, 25 bp, Mus musculus
gaggagtcccggctcatcactcttc

SEQ ID NO: 296032 - DNA, 25 bp, Mus musculus
gaggagtcggagatggcagccacag

SEQ ID NO: 296033 - DNA, 25 bp, Mus musculus
gaggagtctggctcgggtctttaac

SEQ ID NO: 296034 - DNA, 25 bp, Mus musculus
gaggagtctggtggaggctccaacc

SEQ ID NO: 296035 - DNA, 25 bp, Mus musculus
gaggagtcttcctgtagaaatgcct

SEQ ID NO: 296036 - DNA, 25 bp, Mus musculus
gaggagtgcaaaggcaagcagaagg

SEQ ID NO: 296037 - DNA, 25 bp, Mus musculus
gaggagtgcgcccgggagaaggaac

SEQ ID NO: 296038 - DNA, 25 bp, Mus musculus
gaggagtggagacgtcggatgcgcc

SEQ ID NO: 296039 - DNA, 25 bp, Mus musculus
gaggagtgtgaagagatccaggctt

SEQ ID NO: 296040 - DNA, 25 bp, Mus musculus
gaggagtgtgaggaggtaaatgaaa

SEQ ID NO: 296041 - DNA, 25 bp, Mus musculus
gaggagtgtgagggaggagataggt

SEQ ID NO: 296042 - DNA, 25 bp, Mus musculus
gaggagtgttgagagtcctttgctg

SEQ ID NO: 296043 - DNA, 25 bp, Mus musculus
gaggagttaatcttgtctcctcgaa

SEQ ID NO: 296044 - DNA, 25 bp, Mus musculus
gaggagttaatcttgtctcttctca

SEQ ID NO: 296045 - DNA, 25 bp, Mus musculus
gaggagttaatcttgtttgagtctt

SEQ ID NO: 296046 - DNA, 25 bp, Mus musculus
gaggagttcaacatagactacacga

SEQ ID NO: 296047 - DNA, 25 bp, Mus musculus
gaggagttcaaggacgacagccatg

SEQ ID NO: 296048 - DNA, 25 bp, Mus musculus
gaggagttgagttaaaagaagatgg

SEQ ID NO: 296049 - DNA, 25 bp, Mus musculus
gaggagttggaaaatcttcaagctt

SEQ ID NO: 296050 - DNA, 25 bp, Mus musculus
gaggataaaaagaaacggcggctgg

SEQ ID NO: 296051 - DNA, 25 bp, Mus musculus
gaggataaagaatgacagcccatat

SEQ ID NO: 296052 - DNA, 25 bp, Mus musculus
gaggataaattaggaatccccactg

SEQ ID NO: 296053 - DNA, 25 bp, Mus musculus
gaggatacagcaacttctaaggact

SEQ ID NO: 296054 - DNA, 25 bp, Mus musculus
gaggatacggttcggtcaccactca

SEQ ID NO: 296055 - DNA, 25 bp, Mus musculus
gaggatagaaagagctcagcagtca

SEQ ID NO: 296056 - DNA, 25 bp, Mus musculus
gaggatagaaccatcaggctgcagc

SEQ ID NO: 296057 - DNA, 25 bp, Mus musculus
gaggatagaaccgtgcgattgcaat

SEQ ID NO: 296058 - DNA, 25 bp, Mus musculus
gaggatagagcagctcagtcctccg

SEQ ID NO: 296059 - DNA, 25 bp, Mus musculus
gaggatagatgtgaggtcacctcag

SEQ ID NO: 296060 - DNA, 25 bp, Mus musculus
gaggatagccaggtcaaagcccagc

SEQ ID NO: 296061 - DNA, 25 bp, Mus musculus
gaggatagtgaagatgaagatgata

SEQ ID NO: 296062 - DNA, 25 bp, Mus musculus
gaggatatcaaagaggtagtagtct

SEQ ID NO: 296063 - DNA, 25 bp, Mus musculus
gaggatatcagaaggactcagtctc

SEQ ID NO: 296064 - DNA, 25 bp, Mus musculus
gaggatattggagctccagccacaa

SEQ ID NO: 296065 - DNA, 25 bp, Mus musculus
gaggatcaagacgaaactgcagcag

SEQ ID NO: 296066 - DNA, 25 bp, Mus musculus
gaggatcaagagttgaaagcgctgg

SEQ ID NO: 296067 - DNA, 25 bp, Mus musculus
gaggatcaaggaactgcattgggaa

SEQ ID NO: 296068 - DNA, 25 bp, Mus musculus
gaggatcacaagctgaagattccag

SEQ ID NO: 296069 - DNA, 25 bp, Mus musculus
gaggatcacagaaggtccctagcag

SEQ ID NO: 296070 - DNA, 25 bp, Mus musculus
gaggatcagacactgacaaagcaat

SEQ ID NO: 296071 - DNA, 25 bp, Mus musculus
gaggatcagacactggcactggtgg

SEQ ID NO: 296072 - DNA, 25 bp, Mus musculus
gaggatcagtggaagccaaggataa

SEQ ID NO: 296073 - DNA, 25 bp, Mus musculus
gaggatcagtggaaggcagttaaac

SEQ ID NO: 296074 - DNA, 25 bp, Mus musculus
gaggatcagtggaagtcttgaaata

SEQ ID NO: 296075 - DNA, 25 bp, Mus musculus
gaggatcatcagtttgttttctttg

SEQ ID NO: 296076 - DNA, 25 bp, Mus musculus
gaggatcatgacagaattccagagg

SEQ ID NO: 296077 - DNA, 25 bp, Mus musculus
gaggatccaacaggtgtgggcccct

SEQ ID NO: 296078 - DNA, 25 bp, Mus musculus
gaggatccagcaaccagacctcatg

SEQ ID NO: 296079 - DNA, 25 bp, Mus musculus
gaggatccaggagctcgaacagtca

SEQ ID NO: 296080 - DNA, 25 bp, Mus musculus
gaggatcccaggaaagaaaagtttc

SEQ ID NO: 296081 - DNA, 25 bp, Mus musculus
gaggatcccagtcaggaaccagcat

SEQ ID NO: 296082 - DNA, 25 bp, Mus musculus
gaggatcccgagggcatcagatccc

SEQ ID NO: 296083 - DNA, 25 bp, Mus musculus
gaggatcccgggcgtgattgagttt

SEQ ID NO: 296084 - DNA, 25 bp, Mus musculus
gaggatcctcaggaggaagaacctg

SEQ ID NO: 296085 - DNA, 25 bp, Mus musculus
gaggatcctccaggtggccacggtg

SEQ ID NO: 296086 - DNA, 25 bp, Mus musculus
gaggatcctccaggtggctttgctg

SEQ ID NO: 296087 - DNA, 25 bp, Mus musculus
gaggatcctgccagaggaagcccgt

SEQ ID NO: 296088 - DNA, 25 bp, Mus musculus
gaggatcgaagcggccttgggatgt

SEQ ID NO: 296089 - DNA, 25 bp, Mus musculus
gaggatcgattccgaatctgcctca

SEQ ID NO: 296090 - DNA, 25 bp, Mus musculus
gaggatcgattccgatttgtgctag

SEQ ID NO: 296091 - DNA, 25 bp, Mus musculus
gaggatctcagttcacatatggaga

SEQ ID NO: 296092 - DNA, 25 bp, Mus musculus
gaggatctctgggtctgaaaaggag

SEQ ID NO: 296093 - DNA, 25 bp, Mus musculus
gaggatctcttggccagagaacagc

SEQ ID NO: 296094 - DNA, 25 bp, Mus musculus
gaggatctcttggtaggccaggaaa

SEQ ID NO: 296095 - DNA, 25 bp, Mus musculus
gaggatcttcgggtatttggctccc

SEQ ID NO: 296096 - DNA, 25 bp, Mus musculus
gaggatgaagaaagaagcatcggtg

SEQ ID NO: 296097 - DNA, 25 bp, Mus musculus
gaggatgaagatgatgaggaagagg

SEQ ID NO: 296098 - DNA, 25 bp, Mus musculus
gaggatgaagccaggtaattcagag

SEQ ID NO: 296099 - DNA, 25 bp, Mus musculus
gaggatgaaggacggtggcgcctca

SEQ ID NO: 296100 - DNA, 25 bp, Mus musculus
gaggatgaaggactttacctcgctg

SEQ ID NO: 296101 - DNA, 25 bp, Mus musculus
gaggatgaaggccattcaaactcct

SEQ ID NO: 296102 - DNA, 25 bp, Mus musculus
gaggatgaagggaaaatgtttatag

SEQ ID NO: 296103 - DNA, 25 bp, Mus musculus
gaggatgaagtgaaacgcttcgtta

SEQ ID NO: 296104 - DNA, 25 bp, Mus musculus
gaggatgacactggacccccctttg

SEQ ID NO: 296105 - DNA, 25 bp, Mus musculus
gaggatgactacagcattacacccg

SEQ ID NO: 296106 - DNA, 25 bp, Mus musculus
gaggatgaggaagctctgtgaagtc

SEQ ID NO: 296107 - DNA, 25 bp, Mus musculus
gaggatgaggagaacaacgagaacg

SEQ ID NO: 296108 - DNA, 25 bp, Mus musculus
gaggatgaggaggaagtttacagta

SEQ ID NO: 296109 - DNA, 25 bp, Mus musculus
gaggatgaggatggtgggcattggg

SEQ ID NO: 296110 - DNA, 25 bp, Mus musculus
gaggatgaggattttgattgggtct

SEQ ID NO: 296111 - DNA, 25 bp, Mus musculus
gaggatgagtatgtgctggaggatc

SEQ ID NO: 296112 - DNA, 25 bp, Mus musculus
gaggatgataaagaggaagaagaaa

SEQ ID NO: 296113 - DNA, 25 bp, Mus musculus
gaggatgatattgggtttgatctgt

SEQ ID NO: 296114 - DNA, 25 bp, Mus musculus
gaggatgatcggggaatcatcactg

SEQ ID NO: 296115 - DNA, 25 bp, Mus musculus
gaggatgatgacaattttgaagaag

SEQ ID NO: 296116 - DNA, 25 bp, Mus musculus
gaggatgcacatagaagccgtatca

SEQ ID NO: 296117 - DNA, 25 bp, Mus musculus
gaggatgccaataaggctgtggaag

SEQ ID NO: 296118 - DNA, 25 bp, Mus musculus
gaggatgccagagcacagggcactc

SEQ ID NO: 296119 - DNA, 25 bp, Mus musculus
gaggatgccaggagctccggcccat

SEQ ID NO: 296120 - DNA, 25 bp, Mus musculus
gaggatgcgctgaggcccagtatag

SEQ ID NO: 296121 - DNA, 25 bp, Mus musculus
gaggatgctggctttttcacttgat

SEQ ID NO: 296122 - DNA, 25 bp, Mus musculus
gaggatgctgtcaaggcccgcctgg

SEQ ID NO: 296123 - DNA, 25 bp, Mus musculus
gaggatggatcagacagaaagtgtg

SEQ ID NO: 296124 - DNA, 25 bp, Mus musculus
gaggatggcagctcagctgttctgg

SEQ ID NO: 296125 - DNA, 25 bp, Mus musculus
gaggatggcagggccaggttgcttc

SEQ ID NO: 296126 - DNA, 25 bp, Mus musculus
gaggatggcagggtatttatgagcc

SEQ ID NO: 296127 - DNA, 25 bp, Mus musculus
gaggatggccagtggaagaaacact

SEQ ID NO: 296128 - DNA, 25 bp, Mus musculus
gaggatggcccaaagagggagcgga

SEQ ID NO: 296129 - DNA, 25 bp, Mus musculus
gaggatggcgaggaggatctgatgg

SEQ ID NO: 296130 - DNA, 25 bp, Mus musculus
gaggatggctccccttccaatgagc

SEQ ID NO: 296131 - DNA, 25 bp, Mus musculus
gaggatggctgttttaaaatcagtc

SEQ ID NO: 296132 - DNA, 25 bp, Mus musculus
gaggatgggctccccaggagatggc

SEQ ID NO: 296133 - DNA, 25 bp, Mus musculus
gaggatggggacgaaagcatccaca

SEQ ID NO: 296134 - DNA, 25 bp, Mus musculus
gaggatggtgtagcacatttccttc

SEQ ID NO: 296135 - DNA, 25 bp, Mus musculus
gaggatgtggagctggaccagatct

SEQ ID NO: 296136 - DNA, 25 bp, Mus musculus
gaggatgtgggccagctacctgggt

SEQ ID NO: 296137 - DNA, 25 bp, Mus musculus
gaggattactgtccagtttgatgtg

SEQ ID NO: 296138 - DNA, 25 bp, Mus musculus
gaggattattccagtacttccaggt

SEQ ID NO: 296139 - DNA, 25 bp, Mus musculus
gaggattcacacagattctggaaca

SEQ ID NO: 296140 - DNA, 25 bp, Mus musculus
gaggattcacgtatgggacccaggc

SEQ ID NO: 296141 - DNA, 25 bp, Mus musculus
gaggattcagacccgattagtggag

SEQ ID NO: 296142 - DNA, 25 bp, Mus musculus
gaggattccagtgtgacctgctgtc

SEQ ID NO: 296143 - DNA, 25 bp, Mus musculus
gaggattccagtgtgtgtttcctgg

SEQ ID NO: 296144 - DNA, 25 bp, Mus musculus
gaggattcccaagccatgtattctc

SEQ ID NO: 296145 - DNA, 25 bp, Mus musculus
gaggattcctcacaggaaagcaaag

SEQ ID NO: 296146 - DNA, 25 bp, Mus musculus
gaggattctgacatcctgcagagcc

SEQ ID NO: 296147 - DNA, 25 bp, Mus musculus
gaggattctgacattgatggcgagg

SEQ ID NO: 296148 - DNA, 25 bp, Mus musculus
gaggattgaccacaggaataactca

SEQ ID NO: 296149 - DNA, 25 bp, Mus musculus
gaggattgcgaggatcgccacgact

SEQ ID NO: 296150 - DNA, 25 bp, Mus musculus
gaggattgtgacctgcctgttcacc

SEQ ID NO: 296151 - DNA, 25 bp, Mus musculus
gaggatttagctggtccaaagcccc

SEQ ID NO: 296152 - DNA, 25 bp, Mus musculus
gaggatttcatcaagctcctggttg

SEQ ID NO: 296153 - DNA, 25 bp, Mus musculus
gaggatttcatcaaggctatggcaa

SEQ ID NO: 296154 - DNA, 25 bp, Mus musculus
gaggatttccccagccagatcttct

SEQ ID NO: 296155 - DNA, 25 bp, Mus musculus
gaggatttgaggcctacctaggact

SEQ ID NO: 296156 - DNA, 25 bp, Mus musculus
gaggatttgagttttaagctataac

SEQ ID NO: 296157 - DNA, 25 bp, Mus musculus
gaggatttgggatttagaattcccc

SEQ ID NO: 296158 - DNA, 25 bp, Mus musculus
gaggattttaaagacggctatggat

SEQ ID NO: 296159 - DNA, 25 bp, Mus musculus
gaggattttaaagagtattcaaatt

SEQ ID NO: 296160 - DNA, 25 bp, Mus musculus
gaggattttaaagtggacatcccag

SEQ ID NO: 296161 - DNA, 25 bp, Mus musculus
gaggattttctcagggaggcgcctt

SEQ ID NO: 296162 - DNA, 25 bp, Mus musculus
gaggattttctcaggggccgatcaa

SEQ ID NO: 296163 - DNA, 25 bp, Mus musculus
gaggattttgagatgtccatatgtg

SEQ ID NO: 296164 - DNA, 25 bp, Mus musculus
gaggcaaaagcagaaccgggatgga

SEQ ID NO: 296165 - DNA, 25 bp, Mus musculus
gaggcaaacagtggctctgaagcgg

SEQ ID NO: 296166 - DNA, 25 bp, Mus musculus
gaggcaaactcttcctaagaaacct

SEQ ID NO: 296167 - DNA, 25 bp, Mus musculus
gaggcaaagccggctccagccacaa

SEQ ID NO: 296168 - DNA, 25 bp, Mus musculus
gaggcaaagcgtagaatgagaagac

SEQ ID NO: 296169 - DNA, 25 bp, Mus musculus
gaggcaaagcgtagcttcatactag

SEQ ID NO: 296170 - DNA, 25 bp, Mus musculus
gaggcaaagcgtagcttgaagtcaa

SEQ ID NO: 296171 - DNA, 25 bp, Mus musculus
gaggcaaagctagacaagttggatg

SEQ ID NO: 296172 - DNA, 25 bp, Mus musculus
gaggcaaagctgaccagaaggaaaa

SEQ ID NO: 296173 - DNA, 25 bp, Mus musculus
gaggcaaatcagaatgagttgcaag

SEQ ID NO: 296174 - DNA, 25 bp, Mus musculus
gaggcaaatggaaggaaacttcatg

SEQ ID NO: 296175 - DNA, 25 bp, Mus musculus
gaggcaaatgtcagccatgcaagtg

SEQ ID NO: 296176 - DNA, 25 bp, Mus musculus
gaggcaacaggccaggaaggaaaaa

SEQ ID NO: 296177 - DNA, 25 bp, Mus musculus
gaggcaacatcagaaagtgactcag

SEQ ID NO: 296178 - DNA, 25 bp, Mus musculus
gaggcaacatcagaattggaaaagt

SEQ ID NO: 296179 - DNA, 25 bp, Mus musculus
gaggcaagacatgtaccagtgcttg

SEQ ID NO: 296180 - DNA, 25 bp, Mus musculus
gaggcaagatgcctttgcggggcct

SEQ ID NO: 296181 - DNA, 25 bp, Mus musculus
gaggcaagcagcaggggaccagcct

SEQ ID NO: 296182 - DNA, 25 bp, Mus musculus
gaggcaagctgagtcaaagcagcat

SEQ ID NO: 296183 - DNA, 25 bp, Mus musculus
gaggcaaggaagacatacatgggcc

SEQ ID NO: 296184 - DNA, 25 bp, Mus musculus
gaggcaaggagaggtacaaaatgaa

SEQ ID NO: 296185 - DNA, 25 bp, Mus musculus
gaggcaaggcaagaggaagaataca

SEQ ID NO: 296186 - DNA, 25 bp, Mus musculus
gaggcaaggcaagtacccagtggat

SEQ ID NO: 296187 - DNA, 25 bp, Mus musculus
gaggcaataaattggagagaggtca

SEQ ID NO: 296188 - DNA, 25 bp, Mus musculus
gaggcaatcaagtattctgagagaa

SEQ ID NO: 296189 - DNA, 25 bp, Mus musculus
gaggcaattgttatcccaactgtaa

SEQ ID NO: 296190 - DNA, 25 bp, Mus musculus
gaggcacaaggagcaagacccaaac

SEQ ID NO: 296191 - DNA, 25 bp, Mus musculus
gaggcacagaaccaaaggacacagc

SEQ ID NO: 296192 - DNA, 25 bp, Mus musculus
gaggcacagagaaagaatcatagca

SEQ ID NO: 296193 - DNA, 25 bp, Mus musculus
gaggcacagagatcaaaggcacagc

SEQ ID NO: 296194 - DNA, 25 bp, Mus musculus
gaggcacaggaaactggccaaggtg

SEQ ID NO: 296195 - DNA, 25 bp, Mus musculus
gaggcacagtggagttaccctgcat

SEQ ID NO: 296196 - DNA, 25 bp, Mus musculus
gaggcaccatgccggcccgcaggcc

SEQ ID NO: 296197 - DNA, 25 bp, Mus musculus
gaggcaccatgccgggtggatacct

SEQ ID NO: 296198 - DNA, 25 bp, Mus musculus
gaggcaccgaagagagtgtgaacat

SEQ ID NO: 296199 - DNA, 25 bp, Mus musculus
gaggcaccgcgatgtgctggctgct

SEQ ID NO: 296200 - DNA, 25 bp, Mus musculus
gaggcaccgcggaccgtctgggcag

SEQ ID NO: 296201 - DNA, 25 bp, Mus musculus
gaggcacgagcaagagtactgtttg

SEQ ID NO: 296202 - DNA, 25 bp, Mus musculus
gaggcacggagcacttgtctctgca

SEQ ID NO: 296203 - DNA, 25 bp, Mus musculus
gaggcagaaagaattgcctatcaga

SEQ ID NO: 296204 - DNA, 25 bp, Mus musculus
gaggcagaagaacctgtgctggctg

SEQ ID NO: 296205 - DNA, 25 bp, Mus musculus
gaggcagaagcctcacaggcctctg

SEQ ID NO: 296206 - DNA, 25 bp, Mus musculus
gaggcagaagtgctgtgtggtctcc

SEQ ID NO: 296207 - DNA, 25 bp, Mus musculus
gaggcagaagttgacccaccttccg

SEQ ID NO: 296208 - DNA, 25 bp, Mus musculus
gaggcagaatgctatcaaaagcccc

SEQ ID NO: 296209 - DNA, 25 bp, Mus musculus
gaggcagactggtgccctgggacaa

SEQ ID NO: 296210 - DNA, 25 bp, Mus musculus
gaggcagagatggacttcctgagga

SEQ ID NO: 296211 - DNA, 25 bp, Mus musculus
gaggcagagcagcaggtttccaggc

SEQ ID NO: 296212 - DNA, 25 bp, Mus musculus
gaggcagagcaggtgacggtgtggg

SEQ ID NO: 296213 - DNA, 25 bp, Mus musculus
gaggcagagcctgagatctggtggc

SEQ ID NO: 296214 - DNA, 25 bp, Mus musculus
gaggcagagcctgaggcccaggatg

SEQ ID NO: 296215 - DNA, 25 bp, Mus musculus
gaggcagagcctggatttatcgaat

SEQ ID NO: 296216 - DNA, 25 bp, Mus musculus
gaggcagagcctggtgctgatggga

SEQ ID NO: 296217 - DNA, 25 bp, Mus musculus
gaggcagaggaacgggtttccgctt

SEQ ID NO: 296218 - DNA, 25 bp, Mus musculus
gaggcagaggaggtagaggaggctt

SEQ ID NO: 296219 - DNA, 25 bp, Mus musculus
gaggcagagggaagacttgccagcc

SEQ ID NO: 296220 - DNA, 25 bp, Mus musculus
gaggcagagggtgctctggcctcta

SEQ ID NO: 296221 - DNA, 25 bp, Mus musculus
gaggcagataaagataatggaggtg

SEQ ID NO: 296222 - DNA, 25 bp, Mus musculus
gaggcagatcagcagggatggcaag

SEQ ID NO: 296223 - DNA, 25 bp, Mus musculus
gaggcagattgaacgcaagggggaa

SEQ ID NO: 296224 - DNA, 25 bp, Mus musculus
gaggcagcacacgagatttttatca

SEQ ID NO: 296225 - DNA, 25 bp, Mus musculus
gaggcagcagagaaccatgtgtgct

SEQ ID NO: 296226 - DNA, 25 bp, Mus musculus
gaggcagcagttgagaatcccagct

SEQ ID NO: 296227 - DNA, 25 bp, Mus musculus
gaggcagccacacgaatctgcagaa

SEQ ID NO: 296228 - DNA, 25 bp, Mus musculus
gaggcagccacacggaatacccgga

SEQ ID NO: 296229 - DNA, 25 bp, Mus musculus
gaggcagccacacggtgcagcacag

SEQ ID NO: 296230 - DNA, 25 bp, Mus musculus
gaggcagccagcaagtggatctggc

SEQ ID NO: 296231 - DNA, 25 bp, Mus musculus
gaggcagccaggagcccttgaaccc

SEQ ID NO: 296232 - DNA, 25 bp, Mus musculus
gaggcagcccagcagggcatcctgg

SEQ ID NO: 296233 - DNA, 25 bp, Mus musculus
gaggcagccgcacaggcagcatatc

SEQ ID NO: 296234 - DNA, 25 bp, Mus musculus
gaggcagcctaagggaggaatttgg

SEQ ID NO: 296235 - DNA, 25 bp, Mus musculus
gaggcagcgcaactacagggctgcc

SEQ ID NO: 296236 - DNA, 25 bp, Mus musculus
gaggcagcgcaactgctgcaggctc

SEQ ID NO: 296237 - DNA, 25 bp, Mus musculus
gaggcagcgggagctggaacagcag

SEQ ID NO: 296238 - DNA, 25 bp, Mus musculus
gaggcagcgggagggagctgaatct

SEQ ID NO: 296239 - DNA, 25 bp, Mus musculus
gaggcagctcgacagatgccaaagt

SEQ ID NO: 296240 - DNA, 25 bp, Mus musculus
gaggcagctcgacaggtgcagggcc

SEQ ID NO: 296241 - DNA, 25 bp, Mus musculus
gaggcagctgatgagggttctgggg

SEQ ID NO: 296242 - DNA, 25 bp, Mus musculus
gaggcaggaaggttcgttctcccag

SEQ ID NO: 296243 - DNA, 25 bp, Mus musculus
gaggcaggacggattctgatgcaat

SEQ ID NO: 296244 - DNA, 25 bp, Mus musculus
gaggcaggacggctgctgtgaaggg

SEQ ID NO: 296245 - DNA, 25 bp, Mus musculus
gaggcaggctgccccagcagttgtc

SEQ ID NO: 296246 - DNA, 25 bp, Mus musculus
gaggcagggactgggctgcaggtcc

SEQ ID NO: 296247 - DNA, 25 bp, Mus musculus
gaggcaggggcggaggatcaacgag

SEQ ID NO: 296248 - DNA, 25 bp, Mus musculus
gaggcaggtccaaggcttgagattt

SEQ ID NO: 296249 - DNA, 25 bp, Mus musculus
gaggcaggtgcaagctggccattct

SEQ ID NO: 296250 - DNA, 25 bp, Mus musculus
gaggcagtaggacttagaagagttc

SEQ ID NO: 296251 - DNA, 25 bp, Mus musculus
gaggcagtcttggattacctgttgc

SEQ ID NO: 296252 - DNA, 25 bp, Mus musculus
gaggcagtggcgagactgaaacagt

SEQ ID NO: 296253 - DNA, 25 bp, Mus musculus
gaggcagtggcgaggagtccgctca

SEQ ID NO: 296254 - DNA, 25 bp, Mus musculus
gaggcagtggcgaggtgagccatga

SEQ ID NO: 296255 - DNA, 25 bp, Mus musculus
gaggcagtggtggaggtcagagtca

SEQ ID NO: 296256 - DNA, 25 bp, Mus musculus
gaggcagtggtggaggtcagggtag

SEQ ID NO: 296257 - DNA, 25 bp, Mus musculus
gaggcagtttgaggagtgcatttcc

SEQ ID NO: 296258 - DNA, 25 bp, Mus musculus
gaggcatagctggtctgaagagcca

SEQ ID NO: 296259 - DNA, 25 bp, Mus musculus
gaggcatcaaaacaaatggcctcca

SEQ ID NO: 296260 - DNA, 25 bp, Mus musculus
gaggcatcaagagtcattcccgagc

SEQ ID NO: 296261 - DNA, 25 bp, Mus musculus
gaggcatcagatgcttataccatca

SEQ ID NO: 296262 - DNA, 25 bp, Mus musculus
gaggcatgggcttgtcaaaccagtc

SEQ ID NO: 296263 - DNA, 25 bp, Mus musculus
gaggcatgggtttgtcaaaccagtc

SEQ ID NO: 296264 - DNA, 25 bp, Mus musculus
gaggcatgtggctctggtttccagt

SEQ ID NO: 296265 - DNA, 25 bp, Mus musculus
gaggcatgttggagcctgctatggg

SEQ ID NO: 296266 - DNA, 25 bp, Mus musculus
gaggcatgttggagcttcaaggaga

SEQ ID NO: 296267 - DNA, 25 bp, Mus musculus
gaggcatgttggaggtaataaagct

SEQ ID NO: 296268 - DNA, 25 bp, Mus musculus
gaggcattgttcgaggaaatgctgt

SEQ ID NO: 296269 - DNA, 25 bp, Mus musculus
gaggcatttagagagacactgtact

SEQ ID NO: 296270 - DNA, 25 bp, Mus musculus
gaggccaaacagctcaggcctgcat

SEQ ID NO: 296271 - DNA, 25 bp, Mus musculus
gaggccaaagcaaaaatgaggagtg

SEQ ID NO: 296272 - DNA, 25 bp, Mus musculus
gaggccaaaggaaatttgtgagaat

SEQ ID NO: 296273 - DNA, 25 bp, Mus musculus
gaggccaaagtaacctcaggcttgg

SEQ ID NO: 296274 - DNA, 25 bp, Mus musculus
gaggccaacaagcaggatggacgac

SEQ ID NO: 296275 - DNA, 25 bp, Mus musculus
gaggccaaccgctatggattacagc

SEQ ID NO: 296276 - DNA, 25 bp, Mus musculus
gaggccaaccgtccagaaggatgca

SEQ ID NO: 296277 - DNA, 25 bp, Mus musculus
gaggccaaccgtgtgctgctgaaat

SEQ ID NO: 296278 - DNA, 25 bp, Mus musculus
gaggccaagcacgataaatacatgg

SEQ ID NO: 296279 - DNA, 25 bp, Mus musculus
gaggccaagcacgtggacgagaaaa

SEQ ID NO: 296280 - DNA, 25 bp, Mus musculus
gaggccaagctatggtccttcccaa

SEQ ID NO: 296281 - DNA, 25 bp, Mus musculus
gaggccaagctatgtttttgaggac

SEQ ID NO: 296282 - DNA, 25 bp, Mus musculus
gaggccaagttcaaggacagcagcc

SEQ ID NO: 296283 - DNA, 25 bp, Mus musculus
gaggccacaagatatcagtattacc

SEQ ID NO: 296284 - DNA, 25 bp, Mus musculus
gaggccacaagcctacttggaggaa

SEQ ID NO: 296285 - DNA, 25 bp, Mus musculus
gaggccacactgctatcatccagca

SEQ ID NO: 296286 - DNA, 25 bp, Mus musculus
gaggccacagcaggtttccactgtt

SEQ ID NO: 296287 - DNA, 25 bp, Mus musculus
gaggccacagctcggctcctgggca

SEQ ID NO: 296288 - DNA, 25 bp, Mus musculus
gaggccacaggattaccaccatgtt

SEQ ID NO: 296289 - DNA, 25 bp, Mus musculus
gaggccacgcatcctccacctgtcc

SEQ ID NO: 296290 - DNA, 25 bp, Mus musculus
gaggccagaagacaccagtgcaaga

SEQ ID NO: 296291 - DNA, 25 bp, Mus musculus
gaggccagacctcgggacagattgt

SEQ ID NO: 296292 - DNA, 25 bp, Mus musculus
gaggccagatgagctcctcttgcgg

SEQ ID NO: 296293 - DNA, 25 bp, Mus musculus
gaggccagcagcagaatcggaagac

SEQ ID NO: 296294 - DNA, 25 bp, Mus musculus
gaggccagccatagctcttggatgc

SEQ ID NO: 296295 - DNA, 25 bp, Mus musculus
gaggccagccggctacacagagaaa

SEQ ID NO: 296296 - DNA, 25 bp, Mus musculus
gaggccagcggggctggcgctgtga

SEQ ID NO: 296297 - DNA, 25 bp, Mus musculus
gaggccagcgggggctggcttacag

SEQ ID NO: 296298 - DNA, 25 bp, Mus musculus
gaggccaggcgggctgggaaggtgg

SEQ ID NO: 296299 - DNA, 25 bp, Mus musculus
gaggccaggtgagaaatgtctcagg

SEQ ID NO: 296300 - DNA, 25 bp, Mus musculus
gaggccagtacccaggtctgtgaac

SEQ ID NO: 296301 - DNA, 25 bp, Mus musculus
gaggccagttcctgagggcagtggc

SEQ ID NO: 296302 - DNA, 25 bp, Mus musculus
gaggccatacagctggtaaacacca

SEQ ID NO: 296303 - DNA, 25 bp, Mus musculus
gaggccataccctgttgtggcctct

SEQ ID NO: 296304 - DNA, 25 bp, Mus musculus
gaggccatccctgctgtgggcctcc

SEQ ID NO: 296305 - DNA, 25 bp, Mus musculus
gaggccatgaaaggaccccgagagg

SEQ ID NO: 296306 - DNA, 25 bp, Mus musculus
gaggccatgagagagatcccatggt

SEQ ID NO: 296307 - DNA, 25 bp, Mus musculus
gaggccatgagagaggactgcctcc

SEQ ID NO: 296308 - DNA, 25 bp, Mus musculus
gaggccatgagagaggtatatgcta

SEQ ID NO: 296309 - DNA, 25 bp, Mus musculus
gaggccatgagagtcctcgttgaaa

SEQ ID NO: 296310 - DNA, 25 bp, Mus musculus
gaggccatgagcataccaacatttt

SEQ ID NO: 296311 - DNA, 25 bp, Mus musculus
gaggccatgagcatccagaggttgt

SEQ ID NO: 296312 - DNA, 25 bp, Mus musculus
gaggccatgagcgtaatctgcagaa

SEQ ID NO: 296313 - DNA, 25 bp, Mus musculus
gaggccatggaacaggaggaagtga

SEQ ID NO: 296314 - DNA, 25 bp, Mus musculus
gaggccatggttaaaccatatgaga

SEQ ID NO: 296315 - DNA, 25 bp, Mus musculus
gaggccattgccaagaagaacgctg

SEQ ID NO: 296316 - DNA, 25 bp, Mus musculus
gaggccatttcaggtttggtatgcc

SEQ ID NO: 296317 - DNA, 25 bp, Mus musculus
gaggcccaagttgagttcatggcat

SEQ ID NO: 296318 - DNA, 25 bp, Mus musculus
gaggcccacctggagctacattgcc

SEQ ID NO: 296319 - DNA, 25 bp, Mus musculus
gaggcccaggacagctggatcgccg

SEQ ID NO: 296320 - DNA, 25 bp, Mus musculus
gaggcccaggctgagtaccagctcc

SEQ ID NO: 296321 - DNA, 25 bp, Mus musculus
gaggcccagggagagcagcaggagg

SEQ ID NO: 296322 - DNA, 25 bp, Mus musculus
gaggccccagggcaactgggtgaga

SEQ ID NO: 296323 - DNA, 25 bp, Mus musculus
gaggcccccaggattccccctctgt

SEQ ID NO: 296324 - DNA, 25 bp, Mus musculus
gaggcccccagtcagatctgtctcg

SEQ ID NO: 296325 - DNA, 25 bp, Mus musculus
gaggcccccagtcaggccggggctg

SEQ ID NO: 296326 - DNA, 25 bp, Mus musculus
gaggccccccagccaggatgatgtc

SEQ ID NO: 296327 - DNA, 25 bp, Mus musculus
gaggccccccagccagtgtgacccc

SEQ ID NO: 296328 - DNA, 25 bp, Mus musculus
gaggcccgagaaactgaaggagccc

SEQ ID NO: 296329 - DNA, 25 bp, Mus musculus
gaggcccgccaggaattgtggaggc

SEQ ID NO: 296330 - DNA, 25 bp, Mus musculus
gaggcccgccaggatatgaattggc

SEQ ID NO: 296331 - DNA, 25 bp, Mus musculus
gaggccctaatgacattatgcccta

SEQ ID NO: 296332 - DNA, 25 bp, Mus musculus
gaggccctcaagtctcacatcatgg

SEQ ID NO: 296333 - DNA, 25 bp, Mus musculus
gaggccctcgaatgtgccgttctct

SEQ ID NO: 296334 - DNA, 25 bp, Mus musculus
gaggccctgaccgattcacaatgac

SEQ ID NO: 296335 - DNA, 25 bp, Mus musculus
gaggccctgcagcagctgattagag

SEQ ID NO: 296336 - DNA, 25 bp, Mus musculus
gaggccctggatggggtggtgaagc

SEQ ID NO: 296337 - DNA, 25 bp, Mus musculus
gaggccctgggcaggctgctggttg

SEQ ID NO: 296338 - DNA, 25 bp, Mus musculus
gaggccctggtcacaggctctcctt

SEQ ID NO: 296339 - DNA, 25 bp, Mus musculus
gaggcccttcaagttttcctggagc

SEQ ID NO: 296340 - DNA, 25 bp, Mus musculus
gaggccgaaagtggggatgcaaact

SEQ ID NO: 296341 - DNA, 25 bp, Mus musculus
gaggccgaagcccccagttgtaccg

SEQ ID NO: 296342 - DNA, 25 bp, Mus musculus
gaggccgaatccctttctaaataaa

SEQ ID NO: 296343 - DNA, 25 bp, Mus musculus
gaggccgaccagcccccgtcctgcg

SEQ ID NO: 296344 - DNA, 25 bp, Mus musculus
gaggccgactgctcaccaggaccct

SEQ ID NO: 296345 - DNA, 25 bp, Mus musculus
gaggccgagaaggctgcatctgtct

SEQ ID NO: 296346 - DNA, 25 bp, Mus musculus
gaggccgagaagtactctcagaagg

SEQ ID NO: 296347 - DNA, 25 bp, Mus musculus
gaggccgagcagaaggagggagagt

SEQ ID NO: 296348 - DNA, 25 bp, Mus musculus
gaggccgagccaagaaactatgttc

SEQ ID NO: 296349 - DNA, 25 bp, Mus musculus
gaggccgagccaaggattttaaaca

SEQ ID NO: 296350 - DNA, 25 bp, Mus musculus
gaggccgagccaaggtgtgagatgc

SEQ ID NO: 296351 - DNA, 25 bp, Mus musculus
gaggccgaggacatatgggtgattt

SEQ ID NO: 296352 - DNA, 25 bp, Mus musculus
gaggccgagtgcaacatcctccgca

SEQ ID NO: 296353 - DNA, 25 bp, Mus musculus
gaggccgatcaggaggcaggttgtc

SEQ ID NO: 296354 - DNA, 25 bp, Mus musculus
gaggccgcagggttgcagaaactga

SEQ ID NO: 296355 - DNA, 25 bp, Mus musculus
gaggccgcaggttggtgttcgagga

SEQ ID NO: 296356 - DNA, 25 bp, Mus musculus
gaggccgccaggctggctcaggagg

SEQ ID NO: 296357 - DNA, 25 bp, Mus musculus
gaggccgccaggttcacggctcagc

SEQ ID NO: 296358 - DNA, 25 bp, Mus musculus
gaggccgccatgggtattaagagct

SEQ ID NO: 296359 - DNA, 25 bp, Mus musculus
gaggccggagacagtataacaaact

SEQ ID NO: 296360 - DNA, 25 bp, Mus musculus
gaggccggagaggagccgctgctgc

SEQ ID NO: 296361 - DNA, 25 bp, Mus musculus
gaggccggcccgaggcccggtcggt

SEQ ID NO: 296362 - DNA, 25 bp, Mus musculus
gaggccgtccacatgcttgtttatg

SEQ ID NO: 296363 - DNA, 25 bp, Mus musculus
gaggccgtgaagagtgagccggtgg

SEQ ID NO: 296364 - DNA, 25 bp, Mus musculus
gaggccgtgcggagctcttggatgc

SEQ ID NO: 296365 - DNA, 25 bp, Mus musculus
gaggccgtggttgtgattgaacggg

SEQ ID NO: 296366 - DNA, 25 bp, Mus musculus
gaggccgtggttgtgcatgggcgcc

SEQ ID NO: 296367 - DNA, 25 bp, Mus musculus
gaggcctaaggaatgattggatcca

SEQ ID NO: 296368 - DNA, 25 bp, Mus musculus
gaggcctaccaggtcagcttgcaag

SEQ ID NO: 296369 - DNA, 25 bp, Mus musculus
gaggcctatggagagttcctcacca

SEQ ID NO: 296370 - DNA, 25 bp, Mus musculus
gaggcctcaaaggttaaggagctga

SEQ ID NO: 296371 - DNA, 25 bp, Mus musculus
gaggcctcagattttacatgtgtgt

SEQ ID NO: 296372 - DNA, 25 bp, Mus musculus
gaggcctcagttcctggccccagaa

SEQ ID NO: 296373 - DNA, 25 bp, Mus musculus
gaggcctcatgatgcctggaatgat

SEQ ID NO: 296374 - DNA, 25 bp, Mus musculus
gaggcctcatgatggggcatcctgg

SEQ ID NO: 296375 - DNA, 25 bp, Mus musculus
gaggcctccacagagctggtggttc

SEQ ID NO: 296376 - DNA, 25 bp, Mus musculus
gaggcctccagcagataagagtaaa

SEQ ID NO: 296377 - DNA, 25 bp, Mus musculus
gaggcctccagcaggggctggattc

SEQ ID NO: 296378 - DNA, 25 bp, Mus musculus
gaggcctctgagatcgaggatgagg

SEQ ID NO: 296379 - DNA, 25 bp, Mus musculus
gaggcctgaaaagagattcatctgt

SEQ ID NO: 296380 - DNA, 25 bp, Mus musculus
gaggcctgaaaagagatttcgatag

SEQ ID NO: 296381 - DNA, 25 bp, Mus musculus
gaggcctgctgaccgacaggctctg

SEQ ID NO: 296382 - DNA, 25 bp, Mus musculus
gaggcctgctgaccgatttctgcat

SEQ ID NO: 296383 - DNA, 25 bp, Mus musculus
gaggcctgctgatgctcctgccagc

SEQ ID NO: 296384 - DNA, 25 bp, Mus musculus
gaggcctggcaggtcctgaaacacc

SEQ ID NO: 296385 - DNA, 25 bp, Mus musculus
gaggcctggcaggtgcccttctcca

SEQ ID NO: 296386 - DNA, 25 bp, Mus musculus
gaggcctgggaggcccggcacaagg

SEQ ID NO: 296387 - DNA, 25 bp, Mus musculus
gaggcctggggaaagcattgtggaa

SEQ ID NO: 296388 - DNA, 25 bp, Mus musculus
gaggccttcagccacatcccagagg

SEQ ID NO: 296389 - DNA, 25 bp, Mus musculus
gaggccttcagccggtttcaccgcg

SEQ ID NO: 296390 - DNA, 25 bp, Mus musculus
gaggccttcctcagcccaggtcctg

SEQ ID NO: 296391 - DNA, 25 bp, Mus musculus
gaggccttcctcagcgagctggagc

SEQ ID NO: 296392 - DNA, 25 bp, Mus musculus
gaggccttctatcgaattcgctcca

SEQ ID NO: 296393 - DNA, 25 bp, Mus musculus
gaggccttctggagcacatcttata

SEQ ID NO: 296394 - DNA, 25 bp, Mus musculus
gaggccttctgtcaggtgagcgtcc

SEQ ID NO: 296395 - DNA, 25 bp, Mus musculus
gaggccttgaaggatttagttgtct

SEQ ID NO: 296396 - DNA, 25 bp, Mus musculus
gaggccttgaagtgctttaggattt

SEQ ID NO: 296397 - DNA, 25 bp, Mus musculus
gaggccttgcaagcaaggtgcagag

SEQ ID NO: 296398 - DNA, 25 bp, Mus musculus
gaggccttgcaagctatgtctgagc

SEQ ID NO: 296399 - DNA, 25 bp, Mus musculus
gaggccttgcaaggggagagttaga

SEQ ID NO: 296400 - DNA, 25 bp, Mus musculus
gaggccttggaaggaggtgggcctc

SEQ ID NO: 296401 - DNA, 25 bp, Mus musculus
gaggccttggtcgatccactctctc

SEQ ID NO: 296402 - DNA, 25 bp, Mus musculus
gaggcctttcagcttcaagaaaaga

SEQ ID NO: 296403 - DNA, 25 bp, Mus musculus
gaggcctttcaggtctgcctcggcc

SEQ ID NO: 296404 - DNA, 25 bp, Mus musculus
gaggcctttcttagacacatgcagc

SEQ ID NO: 296405 - DNA, 25 bp, Mus musculus
gaggcgaaagagagccgggtcaaac

SEQ ID NO: 296406 - DNA, 25 bp, Mus musculus
gaggcgacagtacctggaggagctg

SEQ ID NO: 296407 - DNA, 25 bp, Mus musculus
gaggcgactgtggagtgtgcacagc

SEQ ID NO: 296408 - DNA, 25 bp, Mus musculus
gaggcgagaggccccacgcatgggc

SEQ ID NO: 296409 - DNA, 25 bp, Mus musculus
gaggcgagaggtgaaagagctggtc

SEQ ID NO: 296410 - DNA, 25 bp, Mus musculus
gaggcgagagttccagaaaccactt

SEQ ID NO: 296411 - DNA, 25 bp, Mus musculus
gaggcgagcagctggtggcccccga

SEQ ID NO: 296412 - DNA, 25 bp, Mus musculus
gaggcgagcagctgtggcccctcag

SEQ ID NO: 296413 - DNA, 25 bp, Mus musculus
gaggcgagcgggcttggctgagtag

SEQ ID NO: 296414 - DNA, 25 bp, Mus musculus
gaggcgcaaagactggcggaggcca

SEQ ID NO: 296415 - DNA, 25 bp, Mus musculus
gaggcgcacagcggggactcgaggc

SEQ ID NO: 296416 - DNA, 25 bp, Mus musculus
gaggcgcacagcggtaaaatgtcgg

SEQ ID NO: 296417 - DNA, 25 bp, Mus musculus
gaggcgcagcccgggtgcaattaaa

SEQ ID NO: 296418 - DNA, 25 bp, Mus musculus
gaggcgcaggcggaggtcagacctg

SEQ ID NO: 296419 - DNA, 25 bp, Mus musculus
gaggcgccacgacctgtgctaccag

SEQ ID NO: 296420 - DNA, 25 bp, Mus musculus
gaggcgccacggtagcgcctggcat

SEQ ID NO: 296421 - DNA, 25 bp, Mus musculus
gaggcgcccaaagtctcaggggcct

SEQ ID NO: 296422 - DNA, 25 bp, Mus musculus
gaggcgcccatgcagatggcctctg

SEQ ID NO: 296423 - DNA, 25 bp, Mus musculus
gaggcgcgaggccgcaaaacgggaa

SEQ ID NO: 296424 - DNA, 25 bp, Mus musculus
gaggcgcgaggggacaaaggcgttc

SEQ ID NO: 296425 - DNA, 25 bp, Mus musculus
gaggcgcgccggaagcccgacatcc

SEQ ID NO: 296426 - DNA, 25 bp, Mus musculus
gaggcgcggcaggcggtgatacttc

SEQ ID NO: 296427 - DNA, 25 bp, Mus musculus
gaggcgcggcaggtggagggagcgg

SEQ ID NO: 296428 - DNA, 25 bp, Mus musculus
gaggcgcggctgcagtctttaagaa

SEQ ID NO: 296429 - DNA, 25 bp, Mus musculus
gaggcgcgtgagacgcagaggcagg

SEQ ID NO: 296430 - DNA, 25 bp, Mus musculus
gaggcgcgtgagatgcccggaaccg

SEQ ID NO: 296431 - DNA, 25 bp, Mus musculus
gaggcgctcaagcggctcacccagg

SEQ ID NO: 296432 - DNA, 25 bp, Mus musculus
gaggcgctcccaggtaggtgagctc

SEQ ID NO: 296433 - DNA, 25 bp, Mus musculus
gaggcgctgcgggtggcctggagag

SEQ ID NO: 296434 - DNA, 25 bp, Mus musculus
gaggcgctgctttagagtctccaga

SEQ ID NO: 296435 - DNA, 25 bp, Mus musculus
gaggcgctgctttaggcccaggagg

SEQ ID NO: 296436 - DNA, 25 bp, Mus musculus
gaggcgcttctagtgccgcttctcg

SEQ ID NO: 296437 - DNA, 25 bp, Mus musculus
gaggcgcttggagaatggcagcagc

SEQ ID NO: 296438 - DNA, 25 bp, Mus musculus
gaggcgctttcaggtaaaatggaac

SEQ ID NO: 296439 - DNA, 25 bp, Mus musculus
gaggcggaagagcatctgatacgtc

SEQ ID NO: 296440 - DNA, 25 bp, Mus musculus
gaggcggaagaggtcaggaccccca

SEQ ID NO: 296441 - DNA, 25 bp, Mus musculus
gaggcggaccaagcacagcctcctc

SEQ ID NO: 296442 - DNA, 25 bp, Mus musculus
gaggcggacccaccctcagcgccac

SEQ ID NO: 296443 - DNA, 25 bp, Mus musculus
gaggcggacgcagaattcggcccct

SEQ ID NO: 296444 - DNA, 25 bp, Mus musculus
gaggcggacgcaggtccgctacaga

SEQ ID NO: 296445 - DNA, 25 bp, Mus musculus
gaggcggagaccagaaccccagctg

SEQ ID NO: 296446 - DNA, 25 bp, Mus musculus
gaggcggagtgaacgatcatgaagg

SEQ ID NO: 296447 - DNA, 25 bp, Mus musculus
gaggcggagtgggtgacccgggggt

SEQ ID NO: 296448 - DNA, 25 bp, Mus musculus
gaggcggagtggttctctttctgca

SEQ ID NO: 296449 - DNA, 25 bp, Mus musculus
gaggcggatctgggtacgcgtctac

SEQ ID NO: 296450 - DNA, 25 bp, Mus musculus
gaggcggattgcggccaagatcgca

SEQ ID NO: 296451 - DNA, 25 bp, Mus musculus
gaggcggcagctgcagcagcctcac

SEQ ID NO: 296452 - DNA, 25 bp, Mus musculus
gaggcggccaagggagcagccgccc

SEQ ID NO: 296453 - DNA, 25 bp, Mus musculus
gaggcggccagcggagagcaaagac

SEQ ID NO: 296454 - DNA, 25 bp, Mus musculus
gaggcggcgccacgagctggtgatt

SEQ ID NO: 296455 - DNA, 25 bp, Mus musculus
gaggcggcggagcagaaatagatga

SEQ ID NO: 296456 - DNA, 25 bp, Mus musculus
gaggcggcggagcagattcggaggc

SEQ ID NO: 296457 - DNA, 25 bp, Mus musculus
gaggcggctcaggtgttatagactg

SEQ ID NO: 296458 - DNA, 25 bp, Mus musculus
gaggcggctcaggtttctcccattt

SEQ ID NO: 296459 - DNA, 25 bp, Mus musculus
gaggcggctctagggcgtcccgggg

SEQ ID NO: 296460 - DNA, 25 bp, Mus musculus
gaggcggctctagggggccagagtt

SEQ ID NO: 296461 - DNA, 25 bp, Mus musculus
gaggcggctggcagaacttgatcac

SEQ ID NO: 296462 - DNA, 25 bp, Mus musculus
gaggcggctggcagctgcagaagag

SEQ ID NO: 296463 - DNA, 25 bp, Mus musculus
gaggcggtgtgaagtaagcaatggc

SEQ ID NO: 296464 - DNA, 25 bp, Mus musculus
gaggcggtttcaggacaatctctcc

SEQ ID NO: 296465 - DNA, 25 bp, Mus musculus
gaggcgtcccaggcctggaatgctt

SEQ ID NO: 296466 - DNA, 25 bp, Mus musculus
gaggcgtctaaagccattgaaaagg

SEQ ID NO: 296467 - DNA, 25 bp, Mus musculus
gaggcgtctaaagccgccctcacct

SEQ ID NO: 296468 - DNA, 25 bp, Mus musculus
gaggcgtgagcacctccgcacctgt

SEQ ID NO: 296469 - DNA, 25 bp, Mus musculus
gaggcgtgatcagaggtcaacagtc

SEQ ID NO: 296470 - DNA, 25 bp, Mus musculus
gaggcgtgatcaggggttcttattg

SEQ ID NO: 296471 - DNA, 25 bp, Mus musculus
gaggcgtgcagatccaagcaagctc

SEQ ID NO: 296472 - DNA, 25 bp, Mus musculus
gaggcgtgtctgagaaccttctccc

SEQ ID NO: 296473 - DNA, 25 bp, Mus musculus
gaggcgttcaagttaattatgacct

SEQ ID NO: 296474 - DNA, 25 bp, Mus musculus
gaggcgttcaagttaattctgtcag

SEQ ID NO: 296475 - DNA, 25 bp, Mus musculus
gaggctaacatggggttcggagcga

SEQ ID NO: 296476 - DNA, 25 bp, Mus musculus
gaggctaactgaggggttggcaaaa

SEQ ID NO: 296477 - DNA, 25 bp, Mus musculus
gaggctaaggggaggcccagcctcg

SEQ ID NO: 296478 - DNA, 25 bp, Mus musculus
gaggctaatgaggaagcattagggg

SEQ ID NO: 296479 - DNA, 25 bp, Mus musculus
gaggctaatgaggtttctggctccc

SEQ ID NO: 296480 - DNA, 25 bp, Mus musculus
gaggctacagtctgcctttcagtca

SEQ ID NO: 296481 - DNA, 25 bp, Mus musculus
gaggctacctctggggtgaatgaga

SEQ ID NO: 296482 - DNA, 25 bp, Mus musculus
gaggctagattgagatgagcagctc

SEQ ID NO: 296483 - DNA, 25 bp, Mus musculus
gaggctagtgggtcatcttggaaga

SEQ ID NO: 296484 - DNA, 25 bp, Mus musculus
gaggctagtggttacttacacattg

SEQ ID NO: 296485 - DNA, 25 bp, Mus musculus
gaggctagtggttacttacagttta

SEQ ID NO: 296486 - DNA, 25 bp, Mus musculus
gaggctataaggtacgaaaccagca

SEQ ID NO: 296487 - DNA, 25 bp, Mus musculus
gaggctataaggtccccagggagga

SEQ ID NO: 296488 - DNA, 25 bp, Mus musculus
gaggctatagaaaggctgaaggcac

SEQ ID NO: 296489 - DNA, 25 bp, Mus musculus
gaggctatagaaagggcgctttcgt

SEQ ID NO: 296490 - DNA, 25 bp, Mus musculus
gaggctatggaattggaagcctgcg

SEQ ID NO: 296491 - DNA, 25 bp, Mus musculus
gaggctattacgagtatggctacat

SEQ ID NO: 296492 - DNA, 25 bp, Mus musculus
gaggctcaagcactgctacaggagc

SEQ ID NO: 296493 - DNA, 25 bp, Mus musculus
gaggctcaagtgagggcattgccag

SEQ ID NO: 296494 - DNA, 25 bp, Mus musculus
gaggctcaagtgtgagggagatgaa

SEQ ID NO: 296495 - DNA, 25 bp, Mus musculus
gaggctcaccaggatgtcttccaag

SEQ ID NO: 296496 - DNA, 25 bp, Mus musculus
gaggctcagaaaggatgtcaaagtc

SEQ ID NO: 296497 - DNA, 25 bp, Mus musculus
gaggctcagcaggaaacaaggacca

SEQ ID NO: 296498 - DNA, 25 bp, Mus musculus
gaggctcagcagggtgctacagtgc

SEQ ID NO: 296499 - DNA, 25 bp, Mus musculus
gaggctcatctacaggtgccaagtc

SEQ ID NO: 296500 - DNA, 25 bp, Mus musculus
gaggctccaagggatttggtttcgt

SEQ ID NO: 296501 - DNA, 25 bp, Mus musculus
gaggctccaaggttaataatgcgac

SEQ ID NO: 296502 - DNA, 25 bp, Mus musculus
gaggctccacctaaaagtgctggac

SEQ ID NO: 296503 - DNA, 25 bp, Mus musculus
gaggctccagtcctgccaacccatc

SEQ ID NO: 296504 - DNA, 25 bp, Mus musculus
gaggctcctgagcagggacctgagg

SEQ ID NO: 296505 - DNA, 25 bp, Mus musculus
gaggctcctgagcaggtcttgggac

SEQ ID NO: 296506 - DNA, 25 bp, Mus musculus
gaggctcctgaggaagaagctgaga

SEQ ID NO: 296507 - DNA, 25 bp, Mus musculus
gaggctcctgatgcaccagattgta

SEQ ID NO: 296508 - DNA, 25 bp, Mus musculus
gaggctcctgatggtgcctgatggc

SEQ ID NO: 296509 - DNA, 25 bp, Mus musculus
gaggctcgatgaaaaacacaaaaga

SEQ ID NO: 296510 - DNA, 25 bp, Mus musculus
gaggctcgatggagaattttggttg

SEQ ID NO: 296511 - DNA, 25 bp, Mus musculus
gaggctcgcagaggcaggggtagag

SEQ ID NO: 296512 - DNA, 25 bp, Mus musculus
gaggctcgtcaggcacagaaggagc

SEQ ID NO: 296513 - DNA, 25 bp, Mus musculus
gaggctctacaggttttggctcacc

SEQ ID NO: 296514 - DNA, 25 bp, Mus musculus
gaggctctatgaaaaactgatgagc

SEQ ID NO: 296515 - DNA, 25 bp, Mus musculus
gaggctctatgaaaagtctgtcagt

SEQ ID NO: 296516 - DNA, 25 bp, Mus musculus
gaggctctcgagagaagcgagagaa

SEQ ID NO: 296517 - DNA, 25 bp, Mus musculus
gaggctctgactgttctctctcttg

SEQ ID NO: 296518 - DNA, 25 bp, Mus musculus
gaggctctgcagactgcacagaaga

SEQ ID NO: 296519 - DNA, 25 bp, Mus musculus
gaggctctgcagcatctcagctgcc

SEQ ID NO: 296520 - DNA, 25 bp, Mus musculus
gaggctctgcagcctgaagaacaga

SEQ ID NO: 296521 - DNA, 25 bp, Mus musculus
gaggctctggccaggttccgggaga

SEQ ID NO: 296522 - DNA, 25 bp, Mus musculus
gaggctcttcaggtgctccaatgag

SEQ ID NO: 296523 - DNA, 25 bp, Mus musculus
gaggctgaaaaagagctgcatgaga

SEQ ID NO: 296524 - DNA, 25 bp, Mus musculus
gaggctgaaaaagcaatacgaggat

SEQ ID NO: 296525 - DNA, 25 bp, Mus musculus
gaggctgaagagcagacttggaggt

SEQ ID NO: 296526 - DNA, 25 bp, Mus musculus
gaggctgaagaggaagaagagctgg

SEQ ID NO: 296527 - DNA, 25 bp, Mus musculus
gaggctgaatcagctcaaatctaat

SEQ ID NO: 296528 - DNA, 25 bp, Mus musculus
gaggctgaatgggagccatcgagag

SEQ ID NO: 296529 - DNA, 25 bp, Mus musculus
gaggctgacaaggacacctgctttg

SEQ ID NO: 296530 - DNA, 25 bp, Mus musculus
gaggctgacaaggctacagcggagc

SEQ ID NO: 296531 - DNA, 25 bp, Mus musculus
gaggctgacagacaagattgtaagg

SEQ ID NO: 296532 - DNA, 25 bp, Mus musculus
gaggctgacaggcggaacttgccaa

SEQ ID NO: 296533 - DNA, 25 bp, Mus musculus
gaggctgacaggtgagatctccaga

SEQ ID NO: 296534 - DNA, 25 bp, Mus musculus
gaggctgacatgtgcctgagcggag

SEQ ID NO: 296535 - DNA, 25 bp, Mus musculus
gaggctgacatgtggagcattggcg

SEQ ID NO: 296536 - DNA, 25 bp, Mus musculus
gaggctgactgggtttaccagcccc

SEQ ID NO: 296537 - DNA, 25 bp, Mus musculus
gaggctgagaaacagcacacagggc

SEQ ID NO: 296538 - DNA, 25 bp, Mus musculus
gaggctgagccgagagaagagccct

SEQ ID NO: 296539 - DNA, 25 bp, Mus musculus
gaggctgaggattttccatctttaa

SEQ ID NO: 296540 - DNA, 25 bp, Mus musculus
gaggctgatgaagccatcaaaggat

SEQ ID NO: 296541 - DNA, 25 bp, Mus musculus
gaggctgatgaaggacaaccctcca

SEQ ID NO: 296542 - DNA, 25 bp, Mus musculus
gaggctgatgaaggagcttgaagag

SEQ ID NO: 296543 - DNA, 25 bp, Mus musculus
gaggctgcaagaaaccttgtcacta

SEQ ID NO: 296544 - DNA, 25 bp, Mus musculus
gaggctgcaggatgatgcgattcat

SEQ ID NO: 296545 - DNA, 25 bp, Mus musculus
gaggctgcaggctacagaacctgaa

SEQ ID NO: 296546 - DNA, 25 bp, Mus musculus
gaggctgcaggtgccctacgttggc

SEQ ID NO: 296547 - DNA, 25 bp, Mus musculus
gaggctgccaacagcctatcttctt

SEQ ID NO: 296548 - DNA, 25 bp, Mus musculus
gaggctgccaacaggaggttctgca

SEQ ID NO: 296549 - DNA, 25 bp, Mus musculus
gaggctgccagattgtggctctgaa

SEQ ID NO: 296550 - DNA, 25 bp, Mus musculus
gaggctgcgtgcagattaccttatg

SEQ ID NO: 296551 - DNA, 25 bp, Mus musculus
gaggctgctgcaggttgctgagaaa

SEQ ID NO: 296552 - DNA, 25 bp, Mus musculus
gaggctgctgccaggaagaattcag

SEQ ID NO: 296553 - DNA, 25 bp, Mus musculus
gaggctgctggaggtctctcctggt

SEQ ID NO: 296554 - DNA, 25 bp, Mus musculus
gaggctgcttctttttaaagatgat

SEQ ID NO: 296555 - DNA, 25 bp, Mus musculus
gaggctgcttgggaaccaacagagg

SEQ ID NO: 296556 - DNA, 25 bp, Mus musculus
gaggctggagagtccttagccagga

SEQ ID NO: 296557 - DNA, 25 bp, Mus musculus
gaggctggaggcaccatgagccagg

SEQ ID NO: 296558 - DNA, 25 bp, Mus musculus
gaggctggagttggcgcgcaggcta

SEQ ID NO: 296559 - DNA, 25 bp, Mus musculus
gaggctggatggcagccatagattg

SEQ ID NO: 296560 - DNA, 25 bp, Mus musculus
gaggctggcagagcctcattaactt

SEQ ID NO: 296561 - DNA, 25 bp, Mus musculus
gaggctggcaggaaggccatattga

SEQ ID NO: 296562 - DNA, 25 bp, Mus musculus
gaggctggcaggaaggccatcttga

SEQ ID NO: 296563 - DNA, 25 bp, Mus musculus
gaggctgggaggagtgggaggtgct

SEQ ID NO: 296564 - DNA, 25 bp, Mus musculus
gaggctgggctggagaaagaggtat

SEQ ID NO: 296565 - DNA, 25 bp, Mus musculus
gaggctggggtgcagaatttctgaa

SEQ ID NO: 296566 - DNA, 25 bp, Mus musculus
gaggctgggtcgctaccaccagtgc

SEQ ID NO: 296567 - DNA, 25 bp, Mus musculus
gaggctggtcttcttctacatctcc

SEQ ID NO: 296568 - DNA, 25 bp, Mus musculus
gaggctggtgcacgaccttctgccc

SEQ ID NO: 296569 - DNA, 25 bp, Mus musculus
gaggctgtctctcagatgaccactc

SEQ ID NO: 296570 - DNA, 25 bp, Mus musculus
gaggctgtgacccaccaacatgacc

SEQ ID NO: 296571 - DNA, 25 bp, Mus musculus
gaggctgtgagaggcttcctcccca

SEQ ID NO: 296572 - DNA, 25 bp, Mus musculus
gaggctgtgagagtgaagccgccca

SEQ ID NO: 296573 - DNA, 25 bp, Mus musculus
gaggctgtgggtctgcagctgtgtt

SEQ ID NO: 296574 - DNA, 25 bp, Mus musculus
gaggcttacagatttgtgaaagaaa

SEQ ID NO: 296575 - DNA, 25 bp, Mus musculus
gaggcttacaggcggcagaagccta

SEQ ID NO: 296576 - DNA, 25 bp, Mus musculus
gaggcttatcggaagaaatggaagc

SEQ ID NO: 296577 - DNA, 25 bp, Mus musculus
gaggcttattccaggatggctaatc

SEQ ID NO: 296578 - DNA, 25 bp, Mus musculus
gaggcttccaaggctaaggtggcat

SEQ ID NO: 296579 - DNA, 25 bp, Mus musculus
gaggcttccagatgggaaccagggt

SEQ ID NO: 296580 - DNA, 25 bp, Mus musculus
gaggcttccagatggtcggcagtgg

SEQ ID NO: 296581 - DNA, 25 bp, Mus musculus
gaggcttccagctccagaaatcttg

SEQ ID NO: 296582 - DNA, 25 bp, Mus musculus
gaggcttccaggtcagaagcctttt

SEQ ID NO: 296583 - DNA, 25 bp, Mus musculus
gaggcttccgatcaattcgaagccg

SEQ ID NO: 296584 - DNA, 25 bp, Mus musculus
gaggcttccgatcaggagagaaaag

SEQ ID NO: 296585 - DNA, 25 bp, Mus musculus
gaggcttctgcacagacttggagca

SEQ ID NO: 296586 - DNA, 25 bp, Mus musculus
gaggcttgaagaaagaacaagttag

SEQ ID NO: 296587 - DNA, 25 bp, Mus musculus
gaggcttgctgacaagcccttcaaa

SEQ ID NO: 296588 - DNA, 25 bp, Mus musculus
gaggcttggagaatctccccgaggt

SEQ ID NO: 296589 - DNA, 25 bp, Mus musculus
gaggcttggagcaagatgagatgga

SEQ ID NO: 296590 - DNA, 25 bp, Mus musculus
gaggcttggcaggatgacatgcaca

SEQ ID NO: 296591 - DNA, 25 bp, Mus musculus
gaggcttggcagtttgcgtcctcgg

SEQ ID NO: 296592 - DNA, 25 bp, Mus musculus
gaggcttggggcaagatcgacatgc

SEQ ID NO: 296593 - DNA, 25 bp, Mus musculus
gaggcttggggcaaggtggatacga

SEQ ID NO: 296594 - DNA, 25 bp, Mus musculus
gaggcttggttgggaagtggattat

SEQ ID NO: 296595 - DNA, 25 bp, Mus musculus
gaggcttgtccagggtatcttattt

SEQ ID NO: 296596 - DNA, 25 bp, Mus musculus
gaggcttgtgggcagaagctgacgt

SEQ ID NO: 296597 - DNA, 25 bp, Mus musculus
gaggctttcaagctaactgatgatg

SEQ ID NO: 296598 - DNA, 25 bp, Mus musculus
gaggctttcgaggagaaaattctat

SEQ ID NO: 296599 - DNA, 25 bp, Mus musculus
gaggctttgagtcgctgggtttacc

SEQ ID NO: 296600 - DNA, 25 bp, Mus musculus
gaggctttggaggtagaggaggctt

SEQ ID NO: 296601 - DNA, 25 bp, Mus musculus
gaggctttggttttgttgagtttga

SEQ ID NO: 296602 - DNA, 25 bp, Mus musculus
gaggcttttggaagtgaagtttggt

SEQ ID NO: 296603 - DNA, 25 bp, Mus musculus
gaggctttttcagcttgcttcccag

SEQ ID NO: 296604 - DNA, 25 bp, Mus musculus
gaggctttttcaggaggcagtgact

SEQ ID NO: 296605 - DNA, 25 bp, Mus musculus
gagggaaaaatgccagatctctatg

SEQ ID NO: 296606 - DNA, 25 bp, Mus musculus
gagggaaatctggaactttgttgcc

SEQ ID NO: 296607 - DNA, 25 bp, Mus musculus
gagggaacgtggaggcccctttgtg

SEQ ID NO: 296608 - DNA, 25 bp, Mus musculus
gagggaactggtggaaactgaagtg

SEQ ID NO: 296609 - DNA, 25 bp, Mus musculus
gagggaagacaaggtgatgatgagc

SEQ ID NO: 296610 - DNA, 25 bp, Mus musculus
gagggaagagaaactgctcaggagg

SEQ ID NO: 296611 - DNA, 25 bp, Mus musculus
gagggaaggaaggcacagctgatga

SEQ ID NO: 296612 - DNA, 25 bp, Mus musculus
gagggaaggacaggcctggcagaac

SEQ ID NO: 296613 - DNA, 25 bp, Mus musculus
gagggaaggagcagcaagctggggc

SEQ ID NO: 296614 - DNA, 25 bp, Mus musculus
gagggaaggagcaggcctggcagaa

SEQ ID NO: 296615 - DNA, 25 bp, Mus musculus
gagggaagtctggaagaccaccaga

SEQ ID NO: 296616 - DNA, 25 bp, Mus musculus
gagggaatgtcagagatgggcgtgt

SEQ ID NO: 296617 - DNA, 25 bp, Mus musculus
gagggaatgtcagttcactcaccgc

SEQ ID NO: 296618 - DNA, 25 bp, Mus musculus
gagggaattgctcaggcgagagcag

SEQ ID NO: 296619 - DNA, 25 bp, Mus musculus
gagggacagcctggatacaggttca

SEQ ID NO: 296620 - DNA, 25 bp, Mus musculus
gagggacaggaggtcagtggagctc

SEQ ID NO: 296621 - DNA, 25 bp, Mus musculus
gagggacattgcacgtggtggtaat

SEQ ID NO: 296622 - DNA, 25 bp, Mus musculus
gagggaccagacaaaaagtcccaag

SEQ ID NO: 296623 - DNA, 25 bp, Mus musculus
gagggaccagtgacacaggaacaac

SEQ ID NO: 296624 - DNA, 25 bp, Mus musculus
gagggacccaggcattttcccgact

SEQ ID NO: 296625 - DNA, 25 bp, Mus musculus
gagggaccgatgaatccttcacacc

SEQ ID NO: 296626 - DNA, 25 bp, Mus musculus
gagggaccggacactggccaaaaga

SEQ ID NO: 296627 - DNA, 25 bp, Mus musculus
gagggacctcaaggaccttggtgtg

SEQ ID NO: 296628 - DNA, 25 bp, Mus musculus
gagggacggcagcccttggagttcc

SEQ ID NO: 296629 - DNA, 25 bp, Mus musculus
gagggacggcaggtttttctcactg

SEQ ID NO: 296630 - DNA, 25 bp, Mus musculus
gagggactacagtggacaaggcgtt

SEQ ID NO: 296631 - DNA, 25 bp, Mus musculus
gagggactcaacgctgcagccccag

SEQ ID NO: 296632 - DNA, 25 bp, Mus musculus
gagggactgcaggtgtgagagtgtc

SEQ ID NO: 296633 - DNA, 25 bp, Mus musculus
gagggactgctaggaagggacaaag

SEQ ID NO: 296634 - DNA, 25 bp, Mus musculus
gagggactgctaggcaaagaacgtt

SEQ ID NO: 296635 - DNA, 25 bp, Mus musculus
gagggactgggaagatggatgacat

SEQ ID NO: 296636 - DNA, 25 bp, Mus musculus
gagggactgggaagccagctagaca

SEQ ID NO: 296637 - DNA, 25 bp, Mus musculus
gagggactgtgagtgaccatgaaag

SEQ ID NO: 296638 - DNA, 25 bp, Mus musculus
gagggagaaatgggccagcaatgcc

SEQ ID NO: 296639 - DNA, 25 bp, Mus musculus
gagggagacagaagcaggtggcagg

SEQ ID NO: 296640 - DNA, 25 bp, Mus musculus
gagggagacagaaggaggtggtgga

SEQ ID NO: 296641 - DNA, 25 bp, Mus musculus
gagggagacagagcaggtggcagag

SEQ ID NO: 296642 - DNA, 25 bp, Mus musculus
gagggagacagaggcattcaaggtt

SEQ ID NO: 296643 - DNA, 25 bp, Mus musculus
gagggagaggagggtctggtcagct

SEQ ID NO: 296644 - DNA, 25 bp, Mus musculus
gagggagatgaagatggagttttcc

SEQ ID NO: 296645 - DNA, 25 bp, Mus musculus
gagggagatggaaaagacatccctg

SEQ ID NO: 296646 - DNA, 25 bp, Mus musculus
gagggagcaggaacctgtcacaggc

SEQ ID NO: 296647 - DNA, 25 bp, Mus musculus
gagggagccagcctggaggccggtc

SEQ ID NO: 296648 - DNA, 25 bp, Mus musculus
gagggagctagcaaaatcggaaatg

SEQ ID NO: 296649 - DNA, 25 bp, Mus musculus
gagggagctaggaggccacgcagtg

SEQ ID NO: 296650 - DNA, 25 bp, Mus musculus
gagggagctgaggttttatctgtgc

SEQ ID NO: 296651 - DNA, 25 bp, Mus musculus
gagggagctgctagccattctctga

SEQ ID NO: 296652 - DNA, 25 bp, Mus musculus
gagggagctgctagcccttctctga

SEQ ID NO: 296653 - DNA, 25 bp, Mus musculus
gagggaggaagatttgctcccagac

SEQ ID NO: 296654 - DNA, 25 bp, Mus musculus
gagggaggaccagcatttaagaaga

SEQ ID NO: 296655 - DNA, 25 bp, Mus musculus
gagggaggaccaggagggcactcct

SEQ ID NO: 296656 - DNA, 25 bp, Mus musculus
gagggaggagctttcatggatcgct

SEQ ID NO: 296657 - DNA, 25 bp, Mus musculus
gagggaggaggaacgctatcaagca

SEQ ID NO: 296658 - DNA, 25 bp, Mus musculus
gagggaggagtgtgtgctgtcagaa

SEQ ID NO: 296659 - DNA, 25 bp, Mus musculus
gagggagggaccagtgacacaggaa

SEQ ID NO: 296660 - DNA, 25 bp, Mus musculus
gagggagggagtgctacctgggaag

SEQ ID NO: 296661 - DNA, 25 bp, Mus musculus
gagggaggggctctgcctccttaca

SEQ ID NO: 296662 - DNA, 25 bp, Mus musculus
gagggagtagaggaacattgaccat

SEQ ID NO: 296663 - DNA, 25 bp, Mus musculus
gagggagtcggttctggccgagaag

SEQ ID NO: 296664 - DNA, 25 bp, Mus musculus
gagggagtgacgtttgagtacagtg

SEQ ID NO: 296665 - DNA, 25 bp, Mus musculus
gagggagtgctacctgggaagatcc

SEQ ID NO: 296666 - DNA, 25 bp, Mus musculus
gagggataataaagaagaagtacca

SEQ ID NO: 296667 - DNA, 25 bp, Mus musculus
gagggataataaagatatccaattg

SEQ ID NO: 296668 - DNA, 25 bp, Mus musculus
gagggatacagatgtatgagtctga

SEQ ID NO: 296669 - DNA, 25 bp, Mus musculus
gagggatacaggatggtgttgctga

SEQ ID NO: 296670 - DNA, 25 bp, Mus musculus
gagggatatcaagtttgcttgtcgg

SEQ ID NO: 296671 - DNA, 25 bp, Mus musculus
gagggatccttggatggtggcacca

SEQ ID NO: 296672 - DNA, 25 bp, Mus musculus
gagggatcggcattgcctgcaggtg

SEQ ID NO: 296673 - DNA, 25 bp, Mus musculus
gagggatgctcaaggacagtgctat

SEQ ID NO: 296674 - DNA, 25 bp, Mus musculus
gagggatgctgactgtgcaccatac

SEQ ID NO: 296675 - DNA, 25 bp, Mus musculus
gagggatggatgtgattttttcagc

SEQ ID NO: 296676 - DNA, 25 bp, Mus musculus
gagggatggcagaggagctggcttc

SEQ ID NO: 296677 - DNA, 25 bp, Mus musculus
gagggatggcaggctcaaagacttg

SEQ ID NO: 296678 - DNA, 25 bp, Mus musculus
gagggatggcaggtagaagaggcag

SEQ ID NO: 296679 - DNA, 25 bp, Mus musculus
gagggattaattcaggagtgggagg

SEQ ID NO: 296680 - DNA, 25 bp, Mus musculus
gagggattcagcacccggagcgtgc

SEQ ID NO: 296681 - DNA, 25 bp, Mus musculus
gagggattcaggggttccagtgtcc

SEQ ID NO: 296682 - DNA, 25 bp, Mus musculus
gagggcaaaatctgtctccagtaga

SEQ ID NO: 296683 - DNA, 25 bp, Mus musculus
gagggcaaaatctgtgagaaggacc

SEQ ID NO: 296684 - DNA, 25 bp, Mus musculus
gagggcaaaggtcccaatgctcgga

SEQ ID NO: 296685 - DNA, 25 bp, Mus musculus
gagggcaaatatggttatgtccttc

SEQ ID NO: 296686 - DNA, 25 bp, Mus musculus
gagggcaagaaagatgaacgagacc

SEQ ID NO: 296687 - DNA, 25 bp, Mus musculus
gagggcaagaaggctgcgaaaagac

SEQ ID NO: 296688 - DNA, 25 bp, Mus musculus
gagggcaagatcaagccccacctga

SEQ ID NO: 296689 - DNA, 25 bp, Mus musculus
gagggcacagcatttgacattgtgc

SEQ ID NO: 296690 - DNA, 25 bp, Mus musculus
gagggcacaggcggacctatgtggg

SEQ ID NO: 296691 - DNA, 25 bp, Mus musculus
gagggcacaggctggcaacatggct

SEQ ID NO: 296692 - DNA, 25 bp, Mus musculus
gagggcaccaagcactgaaaactga

SEQ ID NO: 296693 - DNA, 25 bp, Mus musculus
gagggcaccaggtcactacttcagt

SEQ ID NO: 296694 - DNA, 25 bp, Mus musculus
gagggcactaaaacggatggctctc

SEQ ID NO: 296695 - DNA, 25 bp, Mus musculus
gagggcagaaactggccagcaagcc

SEQ ID NO: 296696 - DNA, 25 bp, Mus musculus
gagggcagaaggaagaaaacggctc

SEQ ID NO: 296697 - DNA, 25 bp, Mus musculus
gagggcagaggctcagaggcacatc

SEQ ID NO: 296698 - DNA, 25 bp, Mus musculus
gagggcagcggccgtctgggctgag

SEQ ID NO: 296699 - DNA, 25 bp, Mus musculus
gagggcagcggttccttcctccaca

SEQ ID NO: 296700 - DNA, 25 bp, Mus musculus
gagggcataactgagaatatttata

SEQ ID NO: 296701 - DNA, 25 bp, Mus musculus
gagggcataactgttatagagaata

SEQ ID NO: 296702 - DNA, 25 bp, Mus musculus
gagggcatcaccatcgtggaagaca

SEQ ID NO: 296703 - DNA, 25 bp, Mus musculus
gagggcatcttgcagaggaggatga

SEQ ID NO: 296704 - DNA, 25 bp, Mus musculus
gagggcatgagcctcaagatggtgc

SEQ ID NO: 296705 - DNA, 25 bp, Mus musculus
gagggcatgagcgggactcgccatg

SEQ ID NO: 296706 - DNA, 25 bp, Mus musculus
gagggcatgggcaacaggacctgta

SEQ ID NO: 296707 - DNA, 25 bp, Mus musculus
gagggcatgggcgttaagatcatct

SEQ ID NO: 296708 - DNA, 25 bp, Mus musculus
gagggcattgacctagagactgatg

SEQ ID NO: 296709 - DNA, 25 bp, Mus musculus
gagggccaaaaaagtgtgcgctcac

SEQ ID NO: 296710 - DNA, 25 bp, Mus musculus
gagggccatcaagaatgactctgtg

SEQ ID NO: 296711 - DNA, 25 bp, Mus musculus
gagggccatcatcagctgcagttaa

SEQ ID NO: 296712 - DNA, 25 bp, Mus musculus
gagggccattcacaggcatcctaca

SEQ ID NO: 296713 - DNA, 25 bp, Mus musculus
gagggcccgttcagggctgggcttc

SEQ ID NO: 296714 - DNA, 25 bp, Mus musculus
gagggccgccgccaggtgtgcaaca

SEQ ID NO: 296715 - DNA, 25 bp, Mus musculus
gagggcctcgagaatggctctgaag

SEQ ID NO: 296716 - DNA, 25 bp, Mus musculus
gagggcctcgagctgaagggaacga

SEQ ID NO: 296717 - DNA, 25 bp, Mus musculus
gagggcctcggtcacccagctgggt

SEQ ID NO: 296718 - DNA, 25 bp, Mus musculus
gagggcctgaaggacctccacagga

SEQ ID NO: 296719 - DNA, 25 bp, Mus musculus
gagggccttcaggaagatgctacca

SEQ ID NO: 296720 - DNA, 25 bp, Mus musculus
gagggcgaatattcgcctcccacct

SEQ ID NO: 296721 - DNA, 25 bp, Mus musculus
gagggcgaattgtggagccccgggt

SEQ ID NO: 296722 - DNA, 25 bp, Mus musculus
gagggcgagcgggaacagaactcaa

SEQ ID NO: 296723 - DNA, 25 bp, Mus musculus
gagggcgagctccggaaaattgtgc

SEQ ID NO: 296724 - DNA, 25 bp, Mus musculus
gagggcgaggatcatctgtctggat

SEQ ID NO: 296725 - DNA, 25 bp, Mus musculus
gagggcgagtctcggcaaagtctac

SEQ ID NO: 296726 - DNA, 25 bp, Mus musculus
gagggcgagtctcgggactgaggct

SEQ ID NO: 296727 - DNA, 25 bp, Mus musculus
gagggcgcagacgagagtctcggcc

SEQ ID NO: 296728 - DNA, 25 bp, Mus musculus
gagggcgcggtgtggacaaatgtcg

SEQ ID NO: 296729 - DNA, 25 bp, Mus musculus
gagggcggaaggccaccaggccttg

SEQ ID NO: 296730 - DNA, 25 bp, Mus musculus
gagggcggcagacgccagtgctgta

SEQ ID NO: 296731 - DNA, 25 bp, Mus musculus
gagggcggcagcgtgcctgaagacc

SEQ ID NO: 296732 - DNA, 25 bp, Mus musculus
gagggcggggcagcctgatgaccgt

SEQ ID NO: 296733 - DNA, 25 bp, Mus musculus
gagggcgtgaaactgacaccccgga

SEQ ID NO: 296734 - DNA, 25 bp, Mus musculus
gagggctaggcctgcctgccccaac

SEQ ID NO: 296735 - DNA, 25 bp, Mus musculus
gagggctcaagtcgcaatgtgtctt

SEQ ID NO: 296736 - DNA, 25 bp, Mus musculus
gagggctcagatctggagctgctat

SEQ ID NO: 296737 - DNA, 25 bp, Mus musculus
gagggctcaggtggtggagaaaaat

SEQ ID NO: 296738 - DNA, 25 bp, Mus musculus
gagggctctacttctgttcgttaaa

SEQ ID NO: 296739 - DNA, 25 bp, Mus musculus
gagggctctagcttggacagcccca

SEQ ID NO: 296740 - DNA, 25 bp, Mus musculus
gagggctctagtgtcactgctcaga

SEQ ID NO: 296741 - DNA, 25 bp, Mus musculus
gagggctgaagagaatatccggtct

SEQ ID NO: 296742 - DNA, 25 bp, Mus musculus
gagggctgaagagtgatgacattac

SEQ ID NO: 296743 - DNA, 25 bp, Mus musculus
gagggctgaggtacagtcatgtcgg

SEQ ID NO: 296744 - DNA, 25 bp, Mus musculus
gagggctgcagtgtcctgctgggag

SEQ ID NO: 296745 - DNA, 25 bp, Mus musculus
gagggctggccgcattggtggaggt

SEQ ID NO: 296746 - DNA, 25 bp, Mus musculus
gagggctggccggattggtggaggt

SEQ ID NO: 296747 - DNA, 25 bp, Mus musculus
gagggctgtggagacaaatgaattc

SEQ ID NO: 296748 - DNA, 25 bp, Mus musculus
gagggctgtggaggaacgggatttt

SEQ ID NO: 296749 - DNA, 25 bp, Mus musculus
gagggcttccaaaccctgctcacac

SEQ ID NO: 296750 - DNA, 25 bp, Mus musculus
gagggcttccaaagggtcctctgca

SEQ ID NO: 296751 - DNA, 25 bp, Mus musculus
gagggcttgcggttccaaagggcct

SEQ ID NO: 296752 - DNA, 25 bp, Mus musculus
gagggctttccctgagaagcagctg

SEQ ID NO: 296753 - DNA, 25 bp, Mus musculus
gaggggaaaagttgctggaaaccat

SEQ ID NO: 296754 - DNA, 25 bp, Mus musculus
gaggggaaaatgcgtcccatgagaa

SEQ ID NO: 296755 - DNA, 25 bp, Mus musculus
gaggggaaaatggcattgtatcatc

SEQ ID NO: 296756 - DNA, 25 bp, Mus musculus
gaggggaaaatgttttcgcatttcc

SEQ ID NO: 296757 - DNA, 25 bp, Mus musculus
gaggggaaagaaagaatggaatcta

SEQ ID NO: 296758 - DNA, 25 bp, Mus musculus
gaggggaaagaaggaatcacaggcc

SEQ ID NO: 296759 - DNA, 25 bp, Mus musculus
gaggggaaagaggtgctggtggtta

SEQ ID NO: 296760 - DNA, 25 bp, Mus musculus
gaggggaacttccaggcacaaagta

SEQ ID NO: 296761 - DNA, 25 bp, Mus musculus
gaggggaagagatgcaattcgaagt

SEQ ID NO: 296762 - DNA, 25 bp, Mus musculus
gaggggacctgcactgtcacgcggt

SEQ ID NO: 296763 - DNA, 25 bp, Mus musculus
gaggggacctggagacagccttccc

SEQ ID NO: 296764 - DNA, 25 bp, Mus musculus
gaggggaccttccaggtgacgctga

SEQ ID NO: 296765 - DNA, 25 bp, Mus musculus
gaggggagaagtgatgccttattgg

SEQ ID NO: 296766 - DNA, 25 bp, Mus musculus
gaggggagaccggtttccaaggcaa

SEQ ID NO: 296767 - DNA, 25 bp, Mus musculus
gaggggagacgtggtactcagttcg

SEQ ID NO: 296768 - DNA, 25 bp, Mus musculus
gaggggagcactggactccttcagt

SEQ ID NO: 296769 - DNA, 25 bp, Mus musculus
gaggggagcactggccctgctccct

SEQ ID NO: 296770 - DNA, 25 bp, Mus musculus
gaggggagccagattatcacaaaga

SEQ ID NO: 296771 - DNA, 25 bp, Mus musculus
gaggggaggaaatgagaaagatgaa

SEQ ID NO: 296772 - DNA, 25 bp, Mus musculus
gaggggaggaagatggcactggatc

SEQ ID NO: 296773 - DNA, 25 bp, Mus musculus
gaggggaggaagcctagccgcccgc

SEQ ID NO: 296774 - DNA, 25 bp, Mus musculus
gaggggaggaaggcatcccccgcag

SEQ ID NO: 296775 - DNA, 25 bp, Mus musculus
gaggggatatggcatccagccagcg

SEQ ID NO: 296776 - DNA, 25 bp, Mus musculus
gaggggcaaaggagcatggcttgga

SEQ ID NO: 296777 - DNA, 25 bp, Mus musculus
gaggggcactgggtcgtcatgtcaa

SEQ ID NO: 296778 - DNA, 25 bp, Mus musculus
gaggggcagaggtagccattgcggg

SEQ ID NO: 296779 - DNA, 25 bp, Mus musculus
gaggggcaggtcaatagccttcctg

SEQ ID NO: 296780 - DNA, 25 bp, Mus musculus
gaggggcatccagataagatctgtg

SEQ ID NO: 296781 - DNA, 25 bp, Mus musculus
gaggggccccgcggcagactccggg

SEQ ID NO: 296782 - DNA, 25 bp, Mus musculus
gaggggccggggcctgtgcaggtga

SEQ ID NO: 296783 - DNA, 25 bp, Mus musculus
gaggggcctattaagctgatccaca

SEQ ID NO: 296784 - DNA, 25 bp, Mus musculus
gaggggcctattaagggctcgctgc

SEQ ID NO: 296785 - DNA, 25 bp, Mus musculus
gaggggcgctggcaccttcaaacac

SEQ ID NO: 296786 - DNA, 25 bp, Mus musculus
gaggggcgctgggctacgatggaag

SEQ ID NO: 296787 - DNA, 25 bp, Mus musculus
gaggggcggagctacagagactgca

SEQ ID NO: 296788 - DNA, 25 bp, Mus musculus
gaggggcggatacagagactgcaag

SEQ ID NO: 296789 - DNA, 25 bp, Mus musculus
gaggggcggccaggtccagcaccaa

SEQ ID NO: 296790 - DNA, 25 bp, Mus musculus
gaggggctgaggaaaggaaacctcg

SEQ ID NO: 296791 - DNA, 25 bp, Mus musculus
gaggggctgtcctgctaaggaagag

SEQ ID NO: 296792 - DNA, 25 bp, Mus musculus
gaggggcttcagacaccaatgactg

SEQ ID NO: 296793 - DNA, 25 bp, Mus musculus
gagggggaggcatttgcaggcccaa

SEQ ID NO: 296794 - DNA, 25 bp, Mus musculus
gagggggatgaagtcattgagaagt

SEQ ID NO: 296795 - DNA, 25 bp, Mus musculus
gagggggcaaggctctgctccccct

SEQ ID NO: 296796 - DNA, 25 bp, Mus musculus
gagggggcagaagaggaggtggctt

SEQ ID NO: 296797 - DNA, 25 bp, Mus musculus
gagggggcccagaaccagggcaaga

SEQ ID NO: 296798 - DNA, 25 bp, Mus musculus
gagggggctctgaggttgaactgga

SEQ ID NO: 296799 - DNA, 25 bp, Mus musculus
gagggggtaagggaggccgctcacg

SEQ ID NO: 296800 - DNA, 25 bp, Mus musculus
gagggggtcagctagaagagtcctt

SEQ ID NO: 296801 - DNA, 25 bp, Mus musculus
gagggggtccggatcaaaagcccca

SEQ ID NO: 296802 - DNA, 25 bp, Mus musculus
gaggggtgagctgaacccccgtttg

SEQ ID NO: 296803 - DNA, 25 bp, Mus musculus
gaggggtgaggagatttgaaaaatt

SEQ ID NO: 296804 - DNA, 25 bp, Mus musculus
gaggggtgagtgtggatctgcagca

SEQ ID NO: 296805 - DNA, 25 bp, Mus musculus
gaggggtgcaagaactgccccattg

SEQ ID NO: 296806 - DNA, 25 bp, Mus musculus
gaggggtgcaagggcttcttccgcc

SEQ ID NO: 296807 - DNA, 25 bp, Mus musculus
gaggggtggaaaatgacattcccat

SEQ ID NO: 296808 - DNA, 25 bp, Mus musculus
gaggggtggcggctcctccaggcgc

SEQ ID NO: 296809 - DNA, 25 bp, Mus musculus
gaggggttatctggccgttcctcag

SEQ ID NO: 296810 - DNA, 25 bp, Mus musculus
gaggggttggtgatggattcatggg

SEQ ID NO: 296811 - DNA, 25 bp, Mus musculus
gagggtaaggatcctgtttgaagac

SEQ ID NO: 296812 - DNA, 25 bp, Mus musculus
gagggtagagacggggccctagctg

SEQ ID NO: 296813 - DNA, 25 bp, Mus musculus
gagggtagcaggagctgcaaagttg

SEQ ID NO: 296814 - DNA, 25 bp, Mus musculus
gagggtatgagcgaagagaaagaca

SEQ ID NO: 296815 - DNA, 25 bp, Mus musculus
gagggtattcaaacacatagacatt

SEQ ID NO: 296816 - DNA, 25 bp, Mus musculus
gagggtcagagggacctctgttctc

SEQ ID NO: 296817 - DNA, 25 bp, Mus musculus
gagggtcatgacactgaacctgcag

SEQ ID NO: 296818 - DNA, 25 bp, Mus musculus
gagggtcattggaggccttgagaag

SEQ ID NO: 296819 - DNA, 25 bp, Mus musculus
gagggtcattggaggtgtccatcat

SEQ ID NO: 296820 - DNA, 25 bp, Mus musculus
gagggtccagactcgctttgaattc

SEQ ID NO: 296821 - DNA, 25 bp, Mus musculus
gagggtcccagagagctgatggcca

SEQ ID NO: 296822 - DNA, 25 bp, Mus musculus
gagggtccctaagagctctcttccg

SEQ ID NO: 296823 - DNA, 25 bp, Mus musculus
gagggtccgagattgtctaaagcca

SEQ ID NO: 296824 - DNA, 25 bp, Mus musculus
gagggtccgggttgtggatcattat

SEQ ID NO: 296825 - DNA, 25 bp, Mus musculus
gagggtcgagctgtcagagaagctt

SEQ ID NO: 296826 - DNA, 25 bp, Mus musculus
gagggtcgcgcagcgtgcagggtcg

SEQ ID NO: 296827 - DNA, 25 bp, Mus musculus
gagggtctctgagtggaggtgaagc

SEQ ID NO: 296828 - DNA, 25 bp, Mus musculus
gagggtctgcaggtcttgtagaaat

SEQ ID NO: 296829 - DNA, 25 bp, Mus musculus
gagggtgaagaaactgaaggctcag

SEQ ID NO: 296830 - DNA, 25 bp, Mus musculus
gagggtgaagcaggagcttctggaa

SEQ ID NO: 296831 - DNA, 25 bp, Mus musculus
gagggtgagtttgaaaccaggaaaa

SEQ ID NO: 296832 - DNA, 25 bp, Mus musculus
gagggtgcagcggccagaagatgca

SEQ ID NO: 296833 - DNA, 25 bp, Mus musculus
gagggtgccaaaaaggccaacaaga

SEQ ID NO: 296834 - DNA, 25 bp, Mus musculus
gagggtggaagggccagggaccaga

SEQ ID NO: 296835 - DNA, 25 bp, Mus musculus
gagggtggatcgagaacactgtagc

SEQ ID NO: 296836 - DNA, 25 bp, Mus musculus
gagggtggatcgagatggttgtgag

SEQ ID NO: 296837 - DNA, 25 bp, Mus musculus
gagggtgggattattagatttagag

SEQ ID NO: 296838 - DNA, 25 bp, Mus musculus
gagggtgtcaaccaggaacctggct

SEQ ID NO: 296839 - DNA, 25 bp, Mus musculus
gagggttatgataaggactatgtca

SEQ ID NO: 296840 - DNA, 25 bp, Mus musculus
gagggttatgataagtacatggaga

SEQ ID NO: 296841 - DNA, 25 bp, Mus musculus
gagggttcagcccttcccctgggga

SEQ ID NO: 296842 - DNA, 25 bp, Mus musculus
gagggttcagctcggatgtggaagg

SEQ ID NO: 296843 - DNA, 25 bp, Mus musculus
gagggttccctgatctatgaggact

SEQ ID NO: 296844 - DNA, 25 bp, Mus musculus
gagggttccttcaagagcatgctgg

SEQ ID NO: 296845 - DNA, 25 bp, Mus musculus
gagggttccttcaagggacttcctc

SEQ ID NO: 296846 - DNA, 25 bp, Mus musculus
gaggtaaagacagagctctgaaagg

SEQ ID NO: 296847 - DNA, 25 bp, Mus musculus
gaggtaaagacagtggattttgctg

SEQ ID NO: 296848 - DNA, 25 bp, Mus musculus
gaggtaagcgaagagaggaagcggg

SEQ ID NO: 296849 - DNA, 25 bp, Mus musculus
gaggtaatgattcagagacctgctt

SEQ ID NO: 296850 - DNA, 25 bp, Mus musculus
gaggtaatgattcagatatcctgtt

SEQ ID NO: 296851 - DNA, 25 bp, Mus musculus
gaggtaatgcctgtggtcgtcgtac

SEQ ID NO: 296852 - DNA, 25 bp, Mus musculus
gaggtaatgttgggaggaaagaaga

SEQ ID NO: 296853 - DNA, 25 bp, Mus musculus
gaggtacaagagggaagaagaagac

SEQ ID NO: 296854 - DNA, 25 bp, Mus musculus
gaggtacaaggtgaactgtggactt

SEQ ID NO: 296855 - DNA, 25 bp, Mus musculus
gaggtacacaggcgcaggtctgagc

SEQ ID NO: 296856 - DNA, 25 bp, Mus musculus
gaggtacagcacaataaaacccaag

SEQ ID NO: 296857 - DNA, 25 bp, Mus musculus
gaggtacaggctcaggaggcctttc

SEQ ID NO: 296858 - DNA, 25 bp, Mus musculus
gaggtaccatttccaaggccgtgca

SEQ ID NO: 296859 - DNA, 25 bp, Mus musculus
gaggtaccgcagaagttgcagaagc

SEQ ID NO: 296860 - DNA, 25 bp, Mus musculus
gaggtacggagctggtgggaggagt

SEQ ID NO: 296861 - DNA, 25 bp, Mus musculus
gaggtactctcttggacctatatcc

SEQ ID NO: 296862 - DNA, 25 bp, Mus musculus
gaggtactgcttccggtgtggagaa

SEQ ID NO: 296863 - DNA, 25 bp, Mus musculus
gaggtagaagaggaacgtacgaagg

SEQ ID NO: 296864 - DNA, 25 bp, Mus musculus
gaggtagagcttgggattttctttg

SEQ ID NO: 296865 - DNA, 25 bp, Mus musculus
gaggtagagcttggggttttatggc

SEQ ID NO: 296866 - DNA, 25 bp, Mus musculus
gaggtagagcttgggtggtcgttga

SEQ ID NO: 296867 - DNA, 25 bp, Mus musculus
gaggtagatgcaggagatcccccaa

SEQ ID NO: 296868 - DNA, 25 bp, Mus musculus
gaggtagcagagcagagagatcaat

SEQ ID NO: 296869 - DNA, 25 bp, Mus musculus
gaggtagcagagcaggggaagcact

SEQ ID NO: 296870 - DNA, 25 bp, Mus musculus
gaggtaggaagatgaggacctagtt

SEQ ID NO: 296871 - DNA, 25 bp, Mus musculus
gaggtagtcttgtcctgggtgggat

SEQ ID NO: 296872 - DNA, 25 bp, Mus musculus
gaggtatttccaatcccgctcaagg

SEQ ID NO: 296873 - DNA, 25 bp, Mus musculus
gaggtcaaagaggcgccagctgaca

SEQ ID NO: 296874 - DNA, 25 bp, Mus musculus
gaggtcaaatctcagagccccaagg

SEQ ID NO: 296875 - DNA, 25 bp, Mus musculus
gaggtcaacggctggacctgtttac

SEQ ID NO: 296876 - DNA, 25 bp, Mus musculus
gaggtcaagagtgggccatgaactg

SEQ ID NO: 296877 - DNA, 25 bp, Mus musculus
gaggtcaagccacagagcccaagat

SEQ ID NO: 296878 - DNA, 25 bp, Mus musculus
gaggtcaatgaggaagtaagtgcaa

SEQ ID NO: 296879 - DNA, 25 bp, Mus musculus
gaggtcaatgaggtggacatggaag

SEQ ID NO: 296880 - DNA, 25 bp, Mus musculus
gaggtcaatgggaagtcattcagct

SEQ ID NO: 296881 - DNA, 25 bp, Mus musculus
gaggtcacaacttctcacacatagt

SEQ ID NO: 296882 - DNA, 25 bp, Mus musculus
gaggtcacagatgaaattatggata

SEQ ID NO: 296883 - DNA, 25 bp, Mus musculus
gaggtcacagttgaaattatggata

SEQ ID NO: 296884 - DNA, 25 bp, Mus musculus
gaggtcacgtaaacagagagtggct

SEQ ID NO: 296885 - DNA, 25 bp, Mus musculus
gaggtcagaagattttgttgacctc

SEQ ID NO: 296886 - DNA, 25 bp, Mus musculus
gaggtcagaaggtgtgttatattga

SEQ ID NO: 296887 - DNA, 25 bp, Mus musculus
gaggtcagagacacctaccgctatg

SEQ ID NO: 296888 - DNA, 25 bp, Mus musculus
gaggtcagaggatgcaaagaaggga

SEQ ID NO: 296889 - DNA, 25 bp, Mus musculus
gaggtcagaggctgtcaaaatacaa

SEQ ID NO: 296890 - DNA, 25 bp, Mus musculus
gaggtcagccacagctgttctagct

SEQ ID NO: 296891 - DNA, 25 bp, Mus musculus
gaggtcaggaaagaatccaccttga

SEQ ID NO: 296892 - DNA, 25 bp, Mus musculus
gaggtcaggggggaggacctgtgtc

SEQ ID NO: 296893 - DNA, 25 bp, Mus musculus
gaggtcagtttttttgcattttgtt

SEQ ID NO: 296894 - DNA, 25 bp, Mus musculus
gaggtcatagcagggtgttcttctg

SEQ ID NO: 296895 - DNA, 25 bp, Mus musculus
gaggtcatctgagggaaagccaccc

SEQ ID NO: 296896 - DNA, 25 bp, Mus musculus
gaggtcatgactgccatttgcttca

SEQ ID NO: 296897 - DNA, 25 bp, Mus musculus
gaggtcatgactggggtgatctgct

SEQ ID NO: 296898 - DNA, 25 bp, Mus musculus
gaggtcatgctcaaggacatggcag

SEQ ID NO: 296899 - DNA, 25 bp, Mus musculus
gaggtcatggtgaaacatccaccag

SEQ ID NO: 296900 - DNA, 25 bp, Mus musculus
gaggtcatggtgaaacatgagctgc

SEQ ID NO: 296901 - DNA, 25 bp, Mus musculus
gaggtcattctgtcagacccgccag

SEQ ID NO: 296902 - DNA, 25 bp, Mus musculus
gaggtcattgaccagaccaccgctc

SEQ ID NO: 296903 - DNA, 25 bp, Mus musculus
gaggtcatttcaggggagcgtttgc

SEQ ID NO: 296904 - DNA, 25 bp, Mus musculus
gaggtccaagagaacagaaagagca

SEQ ID NO: 296905 - DNA, 25 bp, Mus musculus
gaggtccaagctcggacctcaggca

SEQ ID NO: 296906 - DNA, 25 bp, Mus musculus
gaggtccaccagatgctgagcaact

SEQ ID NO: 296907 - DNA, 25 bp, Mus musculus
gaggtccccaagagtgggccaagct

SEQ ID NO: 296908 - DNA, 25 bp, Mus musculus
gaggtccccaaggtatttctctgag

SEQ ID NO: 296909 - DNA, 25 bp, Mus musculus
gaggtccgagcacaccctgaaagcc

SEQ ID NO: 296910 - DNA, 25 bp, Mus musculus
gaggtccgaggcgagtgagctcagg

SEQ ID NO: 296911 - DNA, 25 bp, Mus musculus
gaggtccgagggtgacttcacctgg

SEQ ID NO: 296912 - DNA, 25 bp, Mus musculus
gaggtcctaacaagacagaactgca

SEQ ID NO: 296913 - DNA, 25 bp, Mus musculus
gaggtcctactggaacaaatgcttc

SEQ ID NO: 296914 - DNA, 25 bp, Mus musculus
gaggtcctcacctccttcacttggc

SEQ ID NO: 296915 - DNA, 25 bp, Mus musculus
gaggtcctcttggctcagctgaagg

SEQ ID NO: 296916 - DNA, 25 bp, Mus musculus
gaggtcctggagctgaacaaggagc

SEQ ID NO: 296917 - DNA, 25 bp, Mus musculus
gaggtcctgggctcttctctcacgt

SEQ ID NO: 296918 - DNA, 25 bp, Mus musculus
gaggtcgaactagaaaccagtgctg

SEQ ID NO: 296919 - DNA, 25 bp, Mus musculus
gaggtcgaactagaacaccagcagt

SEQ ID NO: 296920 - DNA, 25 bp, Mus musculus
gaggtcgagcccgtgacaccataga

SEQ ID NO: 296921 - DNA, 25 bp, Mus musculus
gaggtcggaggaggtgggcgttggg

SEQ ID NO: 296922 - DNA, 25 bp, Mus musculus
gaggtcggaggaggttgctgaacga

SEQ ID NO: 296923 - DNA, 25 bp, Mus musculus
gaggtcggcagaggtaaccatggag

SEQ ID NO: 296924 - DNA, 25 bp, Mus musculus
gaggtcggcctcgatgtggaggcca

SEQ ID NO: 296925 - DNA, 25 bp, Mus musculus
gaggtcggcctcgcaatacttcgtg

SEQ ID NO: 296926 - DNA, 25 bp, Mus musculus
gaggtcgtaaaaatgagcatctgta

SEQ ID NO: 296927 - DNA, 25 bp, Mus musculus
gaggtcgtaaaaattgaaatctctc

SEQ ID NO: 296928 - DNA, 25 bp, Mus musculus
gaggtcgtagtcaaggcacatccca

SEQ ID NO: 296929 - DNA, 25 bp, Mus musculus
gaggtctcactgctaataaagacaa

SEQ ID NO: 296930 - DNA, 25 bp, Mus musculus
gaggtctcactggttggcgcatcct

SEQ ID NO: 296931 - DNA, 25 bp, Mus musculus
gaggtctcgcagcacccagcaggct

SEQ ID NO: 296932 - DNA, 25 bp, Mus musculus
gaggtctgccaggatatagctcctc

SEQ ID NO: 296933 - DNA, 25 bp, Mus musculus
gaggtctgctcagaaaaaactggcc

SEQ ID NO: 296934 - DNA, 25 bp, Mus musculus
gaggtcttcaaggaaccagcacctg

SEQ ID NO: 296935 - DNA, 25 bp, Mus musculus
gaggtcttccagatcacagacctgt

SEQ ID NO: 296936 - DNA, 25 bp, Mus musculus
gaggtcttcgaaagaaccaagcagc

SEQ ID NO: 296937 - DNA, 25 bp, Mus musculus
gaggtcttcggccttcccaggacag

SEQ ID NO: 296938 - DNA, 25 bp, Mus musculus
gaggtcttgacagaggatctccctc

SEQ ID NO: 296939 - DNA, 25 bp, Mus musculus
gaggtcttggtccacagatgagcat

SEQ ID NO: 296940 - DNA, 25 bp, Mus musculus
gaggtgaaagaggtgacagctacta

SEQ ID NO: 296941 - DNA, 25 bp, Mus musculus
gaggtgaactcagacaaggtctggg

SEQ ID NO: 296942 - DNA, 25 bp, Mus musculus
gaggtgaactcaggttcttgctatg

SEQ ID NO: 296943 - DNA, 25 bp, Mus musculus
gaggtgaagagcaaatttgacgccg

SEQ ID NO: 296944 - DNA, 25 bp, Mus musculus
gaggtgaagcagaatgatatggaac

SEQ ID NO: 296945 - DNA, 25 bp, Mus musculus
gaggtgacaacgaaaatatctgcag

SEQ ID NO: 296946 - DNA, 25 bp, Mus musculus
gaggtgacacgtttcatcacttcat

SEQ ID NO: 296947 - DNA, 25 bp, Mus musculus
gaggtgacagatcccacaacgtctc

SEQ ID NO: 296948 - DNA, 25 bp, Mus musculus
gaggtgacatttgaaaatgtcaagg

SEQ ID NO: 296949 - DNA, 25 bp, Mus musculus
gaggtgaccagtgtgagaagaaacg

SEQ ID NO: 296950 - DNA, 25 bp, Mus musculus
gaggtgactccaaggacaagaccag

SEQ ID NO: 296951 - DNA, 25 bp, Mus musculus
gaggtgactgcccctgtcttaggaa

SEQ ID NO: 296952 - DNA, 25 bp, Mus musculus
gaggtgactgcggcgcaaccatgaa

SEQ ID NO: 296953 - DNA, 25 bp, Mus musculus
gaggtgactgtgtgtttgatcctga

SEQ ID NO: 296954 - DNA, 25 bp, Mus musculus
gaggtgagcacctgaagatggaaac

SEQ ID NO: 296955 - DNA, 25 bp, Mus musculus
gaggtgagctttgacgccgccaccc

SEQ ID NO: 296956 - DNA, 25 bp, Mus musculus
gaggtgagggggaggtccaacacaa

SEQ ID NO: 296957 - DNA, 25 bp, Mus musculus
gaggtgatcaaaggcattcctttgg

SEQ ID NO: 296958 - DNA, 25 bp, Mus musculus
gaggtgatcaaagggtgaagtcggt

SEQ ID NO: 296959 - DNA, 25 bp, Mus musculus
gaggtgatccgagatcgcctttgtt

SEQ ID NO: 296960 - DNA, 25 bp, Mus musculus
gaggtgattgaggacgcctcatgct

SEQ ID NO: 296961 - DNA, 25 bp, Mus musculus
gaggtgattggaggcctgggagctg

SEQ ID NO: 296962 - DNA, 25 bp, Mus musculus
gaggtgcacagaggcataatcaacc

SEQ ID NO: 296963 - DNA, 25 bp, Mus musculus
gaggtgcaccaaacaggaccagagt

SEQ ID NO: 296964 - DNA, 25 bp, Mus musculus
gaggtgcaccaaacccagctgtgtt

SEQ ID NO: 296965 - DNA, 25 bp, Mus musculus
gaggtgcaccaaacggttgcagacc

SEQ ID NO: 296966 - DNA, 25 bp, Mus musculus
gaggtgcacggctgtgtttggatga

SEQ ID NO: 296967 - DNA, 25 bp, Mus musculus
gaggtgcacgggtgacccagatatt

SEQ ID NO: 296968 - DNA, 25 bp, Mus musculus
gaggtgcagaaggtttttcaagaca

SEQ ID NO: 296969 - DNA, 25 bp, Mus musculus
gaggtgccacagccaccatgccaat

SEQ ID NO: 296970 - DNA, 25 bp, Mus musculus
gaggtgccagacgacctggaggaag

SEQ ID NO: 296971 - DNA, 25 bp, Mus musculus
gaggtgccagctacatcagaagatt

SEQ ID NO: 296972 - DNA, 25 bp, Mus musculus
gaggtgccaggatgaacagcagtac

SEQ ID NO: 296973 - DNA, 25 bp, Mus musculus
gaggtgccaggctggacccatgaga

SEQ ID NO: 296974 - DNA, 25 bp, Mus musculus
gaggtgccaggtatgcaaagtgcac

SEQ ID NO: 296975 - DNA, 25 bp, Mus musculus
gaggtgccaggtctgcaaagtgcac

SEQ ID NO: 296976 - DNA, 25 bp, Mus musculus
gaggtgccccgggtgaacgcggaga

SEQ ID NO: 296977 - DNA, 25 bp, Mus musculus
gaggtgcctccaagggttcccgtga

SEQ ID NO: 296978 - DNA, 25 bp, Mus musculus
gaggtgcctgggtccaagccggccc

SEQ ID NO: 296979 - DNA, 25 bp, Mus musculus
gaggtgcctgttaaagtccgcgggc

SEQ ID NO: 296980 - DNA, 25 bp, Mus musculus
gaggtgcgacaggtaaatttaacac

SEQ ID NO: 296981 - DNA, 25 bp, Mus musculus
gaggtgcgagccgtaacacaaggca

SEQ ID NO: 296982 - DNA, 25 bp, Mus musculus
gaggtgctgcccgagcacgcatgct

SEQ ID NO: 296983 - DNA, 25 bp, Mus musculus
gaggtgctgcccggaataacagaag

SEQ ID NO: 296984 - DNA, 25 bp, Mus musculus
gaggtggaaagctgctaacgaggct

SEQ ID NO: 296985 - DNA, 25 bp, Mus musculus
gaggtggaactcagagtttgctatt

SEQ ID NO: 296986 - DNA, 25 bp, Mus musculus
gaggtggaactcaggtagcactttg

SEQ ID NO: 296987 - DNA, 25 bp, Mus musculus
gaggtggacaaatccaggtggctcc

SEQ ID NO: 296988 - DNA, 25 bp, Mus musculus
gaggtggagaaggccaaggggaatc

SEQ ID NO: 296989 - DNA, 25 bp, Mus musculus
gaggtggagaaggccgagtacaaca

SEQ ID NO: 296990 - DNA, 25 bp, Mus musculus
gaggtggagcagccctgttcccttc

SEQ ID NO: 296991 - DNA, 25 bp, Mus musculus
gaggtggagcaggtgaggggtcggg

SEQ ID NO: 296992 - DNA, 25 bp, Mus musculus
gaggtggaggaaaatctgaatgagg

SEQ ID NO: 296993 - DNA, 25 bp, Mus musculus
gaggtggaggagatcctggtgctgc

SEQ ID NO: 296994 - DNA, 25 bp, Mus musculus
gaggtggaggagatgctgaccaaca

SEQ ID NO: 296995 - DNA, 25 bp, Mus musculus
gaggtggaggaggtggagtttgatg

SEQ ID NO: 296996 - DNA, 25 bp, Mus musculus
gaggtggaggatgacaaaatcccca

SEQ ID NO: 296997 - DNA, 25 bp, Mus musculus
gaggtggaggccaagcaggtgcagg

SEQ ID NO: 296998 - DNA, 25 bp, Mus musculus
gaggtggaggccaagggagaagcaa

SEQ ID NO: 296999 - DNA, 25 bp, Mus musculus
gaggtggaggccaaggggagtggag

SEQ ID NO: 297000 - DNA, 25 bp, Mus musculus
gaggtggatatgcaggtgcttcacc

SEQ ID NO: 297001 - DNA, 25 bp, Mus musculus
gaggtggatgcttctcttcaggcct

SEQ ID NO: 297002 - DNA, 25 bp, Mus musculus
gaggtggatgtgtgggtgcaggtgg

SEQ ID NO: 297003 - DNA, 25 bp, Mus musculus
gaggtggcaacgagtctccagttaa

SEQ ID NO: 297004 - DNA, 25 bp, Mus musculus
gaggtggcaaggtgcaaatagtcta

SEQ ID NO: 297005 - DNA, 25 bp, Mus musculus
gaggtggcaaggtgcagataattaa

SEQ ID NO: 297006 - DNA, 25 bp, Mus musculus
gaggtggcaatgccccagttccttc

SEQ ID NO: 297007 - DNA, 25 bp, Mus musculus
gaggtggcaatggaaaaagatcttc

SEQ ID NO: 297008 - DNA, 25 bp, Mus musculus
gaggtggcaatgttcagattcagaa

SEQ ID NO: 297009 - DNA, 25 bp, Mus musculus
gaggtggcacagcaggacgcagaga

SEQ ID NO: 297010 - DNA, 25 bp, Mus musculus
gaggtggcacggaggcaagaaggag

SEQ ID NO: 297011 - DNA, 25 bp, Mus musculus
gaggtggcagagtataaaggagggg

SEQ ID NO: 297012 - DNA, 25 bp, Mus musculus
gaggtggcaggccccactgaaactg

SEQ ID NO: 297013 - DNA, 25 bp, Mus musculus
gaggtggcagggttaaggcagcttc

SEQ ID NO: 297014 - DNA, 25 bp, Mus musculus
gaggtggcccaggtccctgtccgca

SEQ ID NO: 297015 - DNA, 25 bp, Mus musculus
gaggtggccgatgtgacagcatggg

SEQ ID NO: 297016 - DNA, 25 bp, Mus musculus
gaggtggccgctgaccagtgaagtc

SEQ ID NO: 297017 - DNA, 25 bp, Mus musculus
gaggtggccgtgggaccgtggctac

SEQ ID NO: 297018 - DNA, 25 bp, Mus musculus
gaggtggccttagagtttctgcgcc

SEQ ID NO: 297019 - DNA, 25 bp, Mus musculus
gaggtggcggagccgaatcctattc

SEQ ID NO: 297020 - DNA, 25 bp, Mus musculus
gaggtggctacgagataacagacaa

SEQ ID NO: 297021 - DNA, 25 bp, Mus musculus
gaggtggctgagagccgagccagac

SEQ ID NO: 297022 - DNA, 25 bp, Mus musculus
gaggtggctgagagtaaatgtgggg

SEQ ID NO: 297023 - DNA, 25 bp, Mus musculus
gaggtggctgtgtctttcagccctg

SEQ ID NO: 297024 - DNA, 25 bp, Mus musculus
gaggtgggccaggtccacctccacc

SEQ ID NO: 297025 - DNA, 25 bp, Mus musculus
gaggtggggcagatgcgaatgaaga

SEQ ID NO: 297026 - DNA, 25 bp, Mus musculus
gaggtggtaaaagagaagtccacac

SEQ ID NO: 297027 - DNA, 25 bp, Mus musculus
gaggtggtcagtgctcaagaaccta

SEQ ID NO: 297028 - DNA, 25 bp, Mus musculus
gaggtggtccgagaggtgtgctctg

SEQ ID NO: 297029 - DNA, 25 bp, Mus musculus
gaggtggtccgagttcccacgacag

SEQ ID NO: 297030 - DNA, 25 bp, Mus musculus
gaggtggtctacaagacagtagcca

SEQ ID NO: 297031 - DNA, 25 bp, Mus musculus
gaggtggtgcaggagatcccccaag

SEQ ID NO: 297032 - DNA, 25 bp, Mus musculus
gaggtggtggagaaggcttactgct

SEQ ID NO: 297033 - DNA, 25 bp, Mus musculus
gaggtgtagagaaagacatggagat

SEQ ID NO: 297034 - DNA, 25 bp, Mus musculus
gaggtgtcacgacgaggaacaagga

SEQ ID NO: 297035 - DNA, 25 bp, Mus musculus
gaggtgtccatttcgacttctctac

SEQ ID NO: 297036 - DNA, 25 bp, Mus musculus
gaggtgtcccaggaagtcacccggt

SEQ ID NO: 297037 - DNA, 25 bp, Mus musculus
gaggtgtgcaagaaactggtctttt

SEQ ID NO: 297038 - DNA, 25 bp, Mus musculus
gaggtgtggacacgttggtcagact

SEQ ID NO: 297039 - DNA, 25 bp, Mus musculus
gaggtgtgggacaaggttttgagca

SEQ ID NO: 297040 - DNA, 25 bp, Mus musculus
gaggtgtggtctcggattgggaaaa

SEQ ID NO: 297041 - DNA, 25 bp, Mus musculus
gaggtgtgttgaggtcattgcaaag

SEQ ID NO: 297042 - DNA, 25 bp, Mus musculus
gaggtgttcagctcctgcttctagg

SEQ ID NO: 297043 - DNA, 25 bp, Mus musculus
gaggtgttcagggaggcagatcaag

SEQ ID NO: 297044 - DNA, 25 bp, Mus musculus
gaggtgtttaaggagatgaaaccct

SEQ ID NO: 297045 - DNA, 25 bp, Mus musculus
gaggttaaagataacagtggaatag

SEQ ID NO: 297046 - DNA, 25 bp, Mus musculus
gaggttaaagcttctgccacacact

SEQ ID NO: 297047 - DNA, 25 bp, Mus musculus
gaggttacaatccggaaccagctat

SEQ ID NO: 297048 - DNA, 25 bp, Mus musculus
gaggttacaatccggtggcgtcccc

SEQ ID NO: 297049 - DNA, 25 bp, Mus musculus
gaggttacttttgaggatgtcaagc

SEQ ID NO: 297050 - DNA, 25 bp, Mus musculus
gaggttacttttggaaatacagttg

SEQ ID NO: 297051 - DNA, 25 bp, Mus musculus
gaggttatacagacagagggtaccc

SEQ ID NO: 297052 - DNA, 25 bp, Mus musculus
gaggttatcggcagcggagcaactg

SEQ ID NO: 297053 - DNA, 25 bp, Mus musculus
gaggttatcggtaaggcgagttcct

SEQ ID NO: 297054 - DNA, 25 bp, Mus musculus
gaggttcaaaaggatccagaagcac

SEQ ID NO: 297055 - DNA, 25 bp, Mus musculus
gaggttcaaaaggcacagtgacctg

SEQ ID NO: 297056 - DNA, 25 bp, Mus musculus
gaggttcagaagggccagctgacga

SEQ ID NO: 297057 - DNA, 25 bp, Mus musculus
gaggttcagggcagctctcagggcc

SEQ ID NO: 297058 - DNA, 25 bp, Mus musculus
gaggttccagatcacacaagagtct

SEQ ID NO: 297059 - DNA, 25 bp, Mus musculus
gaggttccagatggagctgaaagat

SEQ ID NO: 297060 - DNA, 25 bp, Mus musculus
gaggttccaggtgtgtgtgacggcc

SEQ ID NO: 297061 - DNA, 25 bp, Mus musculus
gaggttccagttaccagtaagattg

SEQ ID NO: 297062 - DNA, 25 bp, Mus musculus
gaggttccccagcagagatgaactg

SEQ ID NO: 297063 - DNA, 25 bp, Mus musculus
gaggttccccagtcaatcgcaggcc

SEQ ID NO: 297064 - DNA, 25 bp, Mus musculus
gaggttcctgatgatgatgaaccag

SEQ ID NO: 297065 - DNA, 25 bp, Mus musculus
gaggttcctgatggaaaaccaactc

SEQ ID NO: 297066 - DNA, 25 bp, Mus musculus
gaggttcctgatggtgttctccaaa

SEQ ID NO: 297067 - DNA, 25 bp, Mus musculus
gaggttcggattcaggcttgtgtgt

SEQ ID NO: 297068 - DNA, 25 bp, Mus musculus
gaggttcggattcaggtaatcgcca

SEQ ID NO: 297069 - DNA, 25 bp, Mus musculus
gaggttctctagggtgaagagatga

SEQ ID NO: 297070 - DNA, 25 bp, Mus musculus
gaggttctctagtctgcccgagagc

SEQ ID NO: 297071 - DNA, 25 bp, Mus musculus
gaggttctgaaacaggaaatccggc

SEQ ID NO: 297072 - DNA, 25 bp, Mus musculus
gaggttctgcagaccatgccgtcca

SEQ ID NO: 297073 - DNA, 25 bp, Mus musculus
gaggttgaagagaactctgataaga

SEQ ID NO: 297074 - DNA, 25 bp, Mus musculus
gaggttgaagagatgaaaagaaaat

SEQ ID NO: 297075 - DNA, 25 bp, Mus musculus
gaggttgaagagatttgacatcctc

SEQ ID NO: 297076 - DNA, 25 bp, Mus musculus
gaggttgacatgagtaacatacaag

SEQ ID NO: 297077 - DNA, 25 bp, Mus musculus
gaggttgagaaaggaactcaacaga

SEQ ID NO: 297078 - DNA, 25 bp, Mus musculus
gaggttgagaactgggcgtggaaaa

SEQ ID NO: 297079 - DNA, 25 bp, Mus musculus
gaggttgagacagcaacggtggaca

SEQ ID NO: 297080 - DNA, 25 bp, Mus musculus
gaggttgcaaattagtttcgtggtt

SEQ ID NO: 297081 - DNA, 25 bp, Mus musculus
gaggttgctgacgagatctggccgc

SEQ ID NO: 297082 - DNA, 25 bp, Mus musculus
gaggttggacccaggagccgggtgt

SEQ ID NO: 297083 - DNA, 25 bp, Mus musculus
gaggttggcaggccccctgcgcatc

SEQ ID NO: 297084 - DNA, 25 bp, Mus musculus
gaggttgtcagggttacagccactc

SEQ ID NO: 297085 - DNA, 25 bp, Mus musculus
gaggttgtggtgggacaaccctcca

SEQ ID NO: 297086 - DNA, 25 bp, Mus musculus
gaggttgttaagactactgggaatc

SEQ ID NO: 297087 - DNA, 25 bp, Mus musculus
gaggttgttaagatcctggaccgct

SEQ ID NO: 297088 - DNA, 25 bp, Mus musculus
gaggttgttaaggacaaagcaggac

SEQ ID NO: 297089 - DNA, 25 bp, Mus musculus
gaggttgttaaggacctcataagga

SEQ ID NO: 297090 - DNA, 25 bp, Mus musculus
gaggtttactgccggctcctgtaca

SEQ ID NO: 297091 - DNA, 25 bp, Mus musculus
gaggtttcacagagatgctgatgaa

SEQ ID NO: 297092 - DNA, 25 bp, Mus musculus
gaggtttcctttcaggatggcctca

SEQ ID NO: 297093 - DNA, 25 bp, Mus musculus
gaggtttctgaggtggagtctttca

SEQ ID NO: 297094 - DNA, 25 bp, Mus musculus
gaggtttcttctgatgaaagagaag

SEQ ID NO: 297095 - DNA, 25 bp, Mus musculus
gaggtttgagatggaagctctatcc

SEQ ID NO: 297096 - DNA, 25 bp, Mus musculus
gaggtttgctgttatttcgctgcag

SEQ ID NO: 297097 - DNA, 25 bp, Mus musculus
gaggtttgtgttaaggcctcacacc

SEQ ID NO: 297098 - DNA, 25 bp, Mus musculus
gaggttttgacaggactggaggacc

SEQ ID NO: 297099 - DNA, 25 bp, Mus musculus
gaggttttgttggtgtgcaacagaa

SEQ ID NO: 297100 - DNA, 25 bp, Mus musculus
gagtaaaaaagaatgcactgctccc

SEQ ID NO: 297101 - DNA, 25 bp, Mus musculus
gagtaaaagtgaaatgactgttccc

SEQ ID NO: 297102 - DNA, 25 bp, Mus musculus
gagtaaaatcgataaacaacccaga

SEQ ID NO: 297103 - DNA, 25 bp, Mus musculus
gagtaaacaagaattcctcagagag

SEQ ID NO: 297104 - DNA, 25 bp, Mus musculus
gagtaaacaagatctcgccctcctg

SEQ ID NO: 297105 - DNA, 25 bp, Mus musculus
gagtaaacgcaggtgacctggcctc

SEQ ID NO: 297106 - DNA, 25 bp, Mus musculus
gagtaaatatttgggcccagcaacc

SEQ ID NO: 297107 - DNA, 25 bp, Mus musculus
gagtaaatatttggtgctggtaact

SEQ ID NO: 297108 - DNA, 25 bp, Mus musculus
gagtaaatggaaggttgcttttaac

SEQ ID NO: 297109 - DNA, 25 bp, Mus musculus
gagtaaatgttagtgacagctagaa

SEQ ID NO: 297110 - DNA, 25 bp, Mus musculus
gagtaaattagcatatgtatatcaa

SEQ ID NO: 297111 - DNA, 25 bp, Mus musculus
gagtaaattcagatgggtggcctaa

SEQ ID NO: 297112 - DNA, 25 bp, Mus musculus
gagtaaattgtcagatactgctcat

SEQ ID NO: 297113 - DNA, 25 bp, Mus musculus
gagtaacagggattgccggaacttg

SEQ ID NO: 297114 - DNA, 25 bp, Mus musculus
gagtaacctggagtttctgacatga

SEQ ID NO: 297115 - DNA, 25 bp, Mus musculus
gagtaactagctttgcatcatgcct

SEQ ID NO: 297116 - DNA, 25 bp, Mus musculus
gagtaactgagttggcagatatccc

SEQ ID NO: 297117 - DNA, 25 bp, Mus musculus
gagtaagaaagagcccagtaagaga

SEQ ID NO: 297118 - DNA, 25 bp, Mus musculus
gagtaagaataaaagatgcctcagg

SEQ ID NO: 297119 - DNA, 25 bp, Mus musculus
gagtaagacaaacccaggagatgaa

SEQ ID NO: 297120 - DNA, 25 bp, Mus musculus
gagtaagacaattgcgtgaagaatt

SEQ ID NO: 297121 - DNA, 25 bp, Mus musculus
gagtaagaggaattctggctgaaag

SEQ ID NO: 297122 - DNA, 25 bp, Mus musculus
gagtaagcagaggagacctgccagg

SEQ ID NO: 297123 - DNA, 25 bp, Mus musculus
gagtaagccgagttctctagcctcc

SEQ ID NO: 297124 - DNA, 25 bp, Mus musculus
gagtaagctggatggtccacctcca

SEQ ID NO: 297125 - DNA, 25 bp, Mus musculus
gagtaagtccagatctgatttgtac

SEQ ID NO: 297126 - DNA, 25 bp, Mus musculus
gagtaagtcgaatctacaaaatggc

SEQ ID NO: 297127 - DNA, 25 bp, Mus musculus
gagtaagtgaggtccagggagggat

SEQ ID NO: 297128 - DNA, 25 bp, Mus musculus
gagtaagtgagtcctttcaggtctc

SEQ ID NO: 297129 - DNA, 25 bp, Mus musculus
gagtaatcagagagtgtcacgatgt

SEQ ID NO: 297130 - DNA, 25 bp, Mus musculus
gagtaatcctgtgtcttggtttgcg

SEQ ID NO: 297131 - DNA, 25 bp, Mus musculus
gagtaatgacagacattgagatatc

SEQ ID NO: 297132 - DNA, 25 bp, Mus musculus
gagtaatgacagctcagttcctagg

SEQ ID NO: 297133 - DNA, 25 bp, Mus musculus
gagtaatgacagctccttcctctac

SEQ ID NO: 297134 - DNA, 25 bp, Mus musculus
gagtaatgaggactctctgattctt

SEQ ID NO: 297135 - DNA, 25 bp, Mus musculus
gagtaatgcctggcacttctgtgat

SEQ ID NO: 297136 - DNA, 25 bp, Mus musculus
gagtaatgtcatggaattggggaat

SEQ ID NO: 297137 - DNA, 25 bp, Mus musculus
gagtacaaaaagctgtgagtaccag

SEQ ID NO: 297138 - DNA, 25 bp, Mus musculus
gagtacaaaaaggtgcatccaagca

SEQ ID NO: 297139 - DNA, 25 bp, Mus musculus
gagtacaaagcatacgaggaaacta

SEQ ID NO: 297140 - DNA, 25 bp, Mus musculus
gagtacaaagctcccaggaggcaaa

SEQ ID NO: 297141 - DNA, 25 bp, Mus musculus
gagtacaaaggcgtggtttctgtct

SEQ ID NO: 297142 - DNA, 25 bp, Mus musculus
gagtacaaagtgaaggaggagggcg

SEQ ID NO: 297143 - DNA, 25 bp, Mus musculus
gagtacacaatgggtaccccaatgg

SEQ ID NO: 297144 - DNA, 25 bp, Mus musculus
gagtacacagctccttccatccaag

SEQ ID NO: 297145 - DNA, 25 bp, Mus musculus
gagtacacaggtgtgtgccatcccg

SEQ ID NO: 297146 - DNA, 25 bp, Mus musculus
gagtacaccaccacgcccggcttag

SEQ ID NO: 297147 - DNA, 25 bp, Mus musculus
gagtacaccacggacaaggagccca

SEQ ID NO: 297148 - DNA, 25 bp, Mus musculus
gagtacactttcaaacttccaaagg

SEQ ID NO: 297149 - DNA, 25 bp, Mus musculus
gagtacagaggtgcaggtcctgcca

SEQ ID NO: 297150 - DNA, 25 bp, Mus musculus
gagtacagatatggagaaagagaaa

SEQ ID NO: 297151 - DNA, 25 bp, Mus musculus
gagtacagcacaggctaaataaaac

SEQ ID NO: 297152 - DNA, 25 bp, Mus musculus
gagtacagcacaggttaccagtgca

SEQ ID NO: 297153 - DNA, 25 bp, Mus musculus
gagtacagcacaggttgctggttgt

SEQ ID NO: 297154 - DNA, 25 bp, Mus musculus
gagtacaggtagggtttcgatgaga

SEQ ID NO: 297155 - DNA, 25 bp, Mus musculus
gagtacaggtctgtaccacaacacg

SEQ ID NO: 297156 - DNA, 25 bp, Mus musculus
gagtacagtaagggatgttctgata

SEQ ID NO: 297157 - DNA, 25 bp, Mus musculus
gagtacagtaagtactggctctgga

SEQ ID NO: 297158 - DNA, 25 bp, Mus musculus
gagtacagtaagttcatagacagag

SEQ ID NO: 297159 - DNA, 25 bp, Mus musculus
gagtacatatgagtcgaacaccaaa

SEQ ID NO: 297160 - DNA, 25 bp, Mus musculus
gagtacatcaagcgcgccaacagcc

SEQ ID NO: 297161 - DNA, 25 bp, Mus musculus
gagtacatgatccagagaggtgctc

SEQ ID NO: 297162 - DNA, 25 bp, Mus musculus
gagtacatggaggaggtgcggcggc

SEQ ID NO: 297163 - DNA, 25 bp, Mus musculus
gagtacatggggagatcctttctct

SEQ ID NO: 297164 - DNA, 25 bp, Mus musculus
gagtacatggggaggattcagtcct

SEQ ID NO: 297165 - DNA, 25 bp, Mus musculus
gagtacattattgagatgacacaga

SEQ ID NO: 297166 - DNA, 25 bp, Mus musculus
gagtacattattgaggccactgcag

SEQ ID NO: 297167 - DNA, 25 bp, Mus musculus
gagtaccacgagcagcccgaggagc

SEQ ID NO: 297168 - DNA, 25 bp, Mus musculus
gagtaccacgcggacatctatgaca

SEQ ID NO: 297169 - DNA, 25 bp, Mus musculus
gagtaccacgcgggggaagggctca

SEQ ID NO: 297170 - DNA, 25 bp, Mus musculus
gagtaccccaatcggatctgtgtaa

SEQ ID NO: 297171 - DNA, 25 bp, Mus musculus
gagtaccccaatcggggcaccacct

SEQ ID NO: 297172 - DNA, 25 bp, Mus musculus
gagtaccggcaaatggttgaaactg

SEQ ID NO: 297173 - DNA, 25 bp, Mus musculus
gagtacgaatttcagcgaggagagt

SEQ ID NO: 297174 - DNA, 25 bp, Mus musculus
gagtacgacatggctgccagaaaat

SEQ ID NO: 297175 - DNA, 25 bp, Mus musculus
gagtacgaggagagagcaagaggag

SEQ ID NO: 297176 - DNA, 25 bp, Mus musculus
gagtacgaggaggaacaggaaggta

SEQ ID NO: 297177 - DNA, 25 bp, Mus musculus
gagtacgcagtggaagcccacttca

SEQ ID NO: 297178 - DNA, 25 bp, Mus musculus
gagtacgccaggagtgagagagaga

SEQ ID NO: 297179 - DNA, 25 bp, Mus musculus
gagtacgcctgcagagcccacatgg

SEQ ID NO: 297180 - DNA, 25 bp, Mus musculus
gagtacgcctgcagtgctgtgaaga

SEQ ID NO: 297181 - DNA, 25 bp, Mus musculus
gagtactccacgttgcaggatctgt

SEQ ID NO: 297182 - DNA, 25 bp, Mus musculus
gagtactgagaggtagccagaaatg

SEQ ID NO: 297183 - DNA, 25 bp, Mus musculus
gagtactgatgctggggagaatccc

SEQ ID NO: 297184 - DNA, 25 bp, Mus musculus
gagtactgcaagattggcaaagaga

SEQ ID NO: 297185 - DNA, 25 bp, Mus musculus
gagtactgcagaaatatgccgagcg

SEQ ID NO: 297186 - DNA, 25 bp, Mus musculus
gagtactgcatcgcccttgactaca

SEQ ID NO: 297187 - DNA, 25 bp, Mus musculus
gagtactggcggtgtctctttggag

SEQ ID NO: 297188 - DNA, 25 bp, Mus musculus
gagtacttgagctaccaggagcccg

SEQ ID NO: 297189 - DNA, 25 bp, Mus musculus
gagtacttggccgagcagcctgcgc

SEQ ID NO: 297190 - DNA, 25 bp, Mus musculus
gagtacttgggaatcatgaccaaca

SEQ ID NO: 297191 - DNA, 25 bp, Mus musculus
gagtacttgggagctaggagaccat

SEQ ID NO: 297192 - DNA, 25 bp, Mus musculus
gagtactttggtcggtgtggtggct

SEQ ID NO: 297193 - DNA, 25 bp, Mus musculus
gagtagaaccaggggaaagcgcagc

SEQ ID NO: 297194 - DNA, 25 bp, Mus musculus
gagtagacacttgtggaaggaatct

SEQ ID NO: 297195 - DNA, 25 bp, Mus musculus
gagtagacaggctcctcatagtcct

SEQ ID NO: 297196 - DNA, 25 bp, Mus musculus
gagtagagaaaaggttttctgtcca

SEQ ID NO: 297197 - DNA, 25 bp, Mus musculus
gagtagagaaggtccatctctgtaa

SEQ ID NO: 297198 - DNA, 25 bp, Mus musculus
gagtagagacgccagttctacctcc

SEQ ID NO: 297199 - DNA, 25 bp, Mus musculus
gagtagagaggcgagggttgtgagc

SEQ ID NO: 297200 - DNA, 25 bp, Mus musculus
gagtagagagggtcctgagtgatgt

SEQ ID NO: 297201 - DNA, 25 bp, Mus musculus
gagtagaggcctttgtgaaaatgtc

SEQ ID NO: 297202 - DNA, 25 bp, Mus musculus
gagtagagggctaggcctgcctgcc

SEQ ID NO: 297203 - DNA, 25 bp, Mus musculus
gagtagatttagatgccagcacctg

SEQ ID NO: 297204 - DNA, 25 bp, Mus musculus
gagtagcaaaggaatgggacagaag

SEQ ID NO: 297205 - DNA, 25 bp, Mus musculus
gagtagcaaaggttcagcctatgga

SEQ ID NO: 297206 - DNA, 25 bp, Mus musculus
gagtagcaacaaaacgctgccgtcc

SEQ ID NO: 297207 - DNA, 25 bp, Mus musculus
gagtagcaacaaagagcagcggtca

SEQ ID NO: 297208 - DNA, 25 bp, Mus musculus
gagtagcaccaatgggcataggtgg

SEQ ID NO: 297209 - DNA, 25 bp, Mus musculus
gagtagcaggaggcgtccggtcgca

SEQ ID NO: 297210 - DNA, 25 bp, Mus musculus
gagtagccaatgatcatgaagaaga

SEQ ID NO: 297211 - DNA, 25 bp, Mus musculus
gagtagccaatgatttatctgtttt

SEQ ID NO: 297212 - DNA, 25 bp, Mus musculus
gagtagctatgaaggagatgaagag

SEQ ID NO: 297213 - DNA, 25 bp, Mus musculus
gagtagctatggacgtggaggacct

SEQ ID NO: 297214 - DNA, 25 bp, Mus musculus
gagtagctgggtatcatagttaatc

SEQ ID NO: 297215 - DNA, 25 bp, Mus musculus
gagtagcttcataatcctcagccca

SEQ ID NO: 297216 - DNA, 25 bp, Mus musculus
gagtagcttcatgctctctatctcc

SEQ ID NO: 297217 - DNA, 25 bp, Mus musculus
gagtaggcaaggaccccatgactca

SEQ ID NO: 297218 - DNA, 25 bp, Mus musculus
gagtaggccctattggagaccctgg

SEQ ID NO: 297219 - DNA, 25 bp, Mus musculus
gagtataagacagatttcttctgcc

SEQ ID NO: 297220 - DNA, 25 bp, Mus musculus
gagtataagacagtaagcgtcaccc

SEQ ID NO: 297221 - DNA, 25 bp, Mus musculus
gagtataagcaattaaccctgaatc

SEQ ID NO: 297222 - DNA, 25 bp, Mus musculus
gagtatacaagattatcctgtcctt

SEQ ID NO: 297223 - DNA, 25 bp, Mus musculus
gagtatacaaggtatcagtactttt

SEQ ID NO: 297224 - DNA, 25 bp, Mus musculus
gagtatacaggatcccaaactgtcc

SEQ ID NO: 297225 - DNA, 25 bp, Mus musculus
gagtatacaggtctgtgagtttcac

SEQ ID NO: 297226 - DNA, 25 bp, Mus musculus
gagtatagaggtgctccagaccagc

SEQ ID NO: 297227 - DNA, 25 bp, Mus musculus
gagtatagataaggtgaagaaactg

SEQ ID NO: 297228 - DNA, 25 bp, Mus musculus
gagtatagataagtgtcatatttga

SEQ ID NO: 297229 - DNA, 25 bp, Mus musculus
gagtatatcgcggacctgtactccg

SEQ ID NO: 297230 - DNA, 25 bp, Mus musculus
gagtatatgccagggggctctgtaa

SEQ ID NO: 297231 - DNA, 25 bp, Mus musculus
gagtatatgggaagtactggagaag

SEQ ID NO: 297232 - DNA, 25 bp, Mus musculus
gagtatatggggcagagcccgggct

SEQ ID NO: 297233 - DNA, 25 bp, Mus musculus
gagtatcacaccatagatgaccact

SEQ ID NO: 297234 - DNA, 25 bp, Mus musculus
gagtatccagagaaacatgactttg

SEQ ID NO: 297235 - DNA, 25 bp, Mus musculus
gagtatccgaggctggttatgacgg

SEQ ID NO: 297236 - DNA, 25 bp, Mus musculus
gagtatctaagagtgcttggctgtc

SEQ ID NO: 297237 - DNA, 25 bp, Mus musculus
gagtatctcagtggaggagaactat

SEQ ID NO: 297238 - DNA, 25 bp, Mus musculus
gagtatctggaagtacaaaggagca

SEQ ID NO: 297239 - DNA, 25 bp, Mus musculus
gagtatctggacatgtcctcacgta

SEQ ID NO: 297240 - DNA, 25 bp, Mus musculus
gagtatctggaggagctggaccaga

SEQ ID NO: 297241 - DNA, 25 bp, Mus musculus
gagtatctggctcagagacatgtcc

SEQ ID NO: 297242 - DNA, 25 bp, Mus musculus
gagtatctggttttaacagcgtatg

SEQ ID NO: 297243 - DNA, 25 bp, Mus musculus
gagtatcttgagttgaactacaggg

SEQ ID NO: 297244 - DNA, 25 bp, Mus musculus
gagtatctttaccttctacttccag

SEQ ID NO: 297245 - DNA, 25 bp, Mus musculus
gagtatctttccaagagctggagaa

SEQ ID NO: 297246 - DNA, 25 bp, Mus musculus
gagtatgaattggagctactgcttt

SEQ ID NO: 297247 - DNA, 25 bp, Mus musculus
gagtatgagaacttctatgcggatt

SEQ ID NO: 297248 - DNA, 25 bp, Mus musculus
gagtatgagggagccgtctaccctg

SEQ ID NO: 297249 - DNA, 25 bp, Mus musculus
gagtatgagtctcttcagcgtcaag

SEQ ID NO: 297250 - DNA, 25 bp, Mus musculus
gagtatgcacagggtatccagaagt

SEQ ID NO: 297251 - DNA, 25 bp, Mus musculus
gagtatgcaggtcctgatgaagttg

SEQ ID NO: 297252 - DNA, 25 bp, Mus musculus
gagtatgccagacagctgaggccca

SEQ ID NO: 297253 - DNA, 25 bp, Mus musculus
gagtatgccaggtactacatgaggc

SEQ ID NO: 297254 - DNA, 25 bp, Mus musculus
gagtatgctaagttctttgaaacca

SEQ ID NO: 297255 - DNA, 25 bp, Mus musculus
gagtatgctcgggagcatggcttgg

SEQ ID NO: 297256 - DNA, 25 bp, Mus musculus
gagtatggcagactgcacgggcgca

SEQ ID NO: 297257 - DNA, 25 bp, Mus musculus
gagtatgggcgggtaatctatgcca

SEQ ID NO: 297258 - DNA, 25 bp, Mus musculus
gagtatgtgaagagctggttttggg

SEQ ID NO: 297259 - DNA, 25 bp, Mus musculus
gagtatgtgaagaggtttgttgtct

SEQ ID NO: 297260 - DNA, 25 bp, Mus musculus
gagtatgtgcaccaggttggcagag

SEQ ID NO: 297261 - DNA, 25 bp, Mus musculus
gagtatgtgtcttcaccctgctgca

SEQ ID NO: 297262 - DNA, 25 bp, Mus musculus
gagtattaaaaatgatacatccata

SEQ ID NO: 297263 - DNA, 25 bp, Mus musculus
gagtattaattacagttctccaagc

SEQ ID NO: 297264 - DNA, 25 bp, Mus musculus
gagtattacaagcatccgatatcaa

SEQ ID NO: 297265 - DNA, 25 bp, Mus musculus
gagtattggaagcatagaaggccta

SEQ ID NO: 297266 - DNA, 25 bp, Mus musculus
gagtattgggaatattacagccaag

SEQ ID NO: 297267 - DNA, 25 bp, Mus musculus
gagtattgtggaggaattaattcga

SEQ ID NO: 297268 - DNA, 25 bp, Mus musculus
gagtatttgctggtgctgtagcccg

SEQ ID NO: 297269 - DNA, 25 bp, Mus musculus
gagtatttgtggtgataatgagtct

SEQ ID NO: 297270 - DNA, 25 bp, Mus musculus
gagtattttgatgttgccttcatca

SEQ ID NO: 297271 - DNA, 25 bp, Mus musculus
gagtattttggtataggcagagtgt

SEQ ID NO: 297272 - DNA, 25 bp, Mus musculus
gagtcaaaacagcagtgacagcagc

SEQ ID NO: 297273 - DNA, 25 bp, Mus musculus
gagtcaaaagagctttggcaccgac

SEQ ID NO: 297274 - DNA, 25 bp, Mus musculus
gagtcaaacgagtctcccattagaa

SEQ ID NO: 297275 - DNA, 25 bp, Mus musculus
gagtcaaacgccacatctacatcca

SEQ ID NO: 297276 - DNA, 25 bp, Mus musculus
gagtcaaagatgagattccatatta

SEQ ID NO: 297277 - DNA, 25 bp, Mus musculus
gagtcaaagccagggtctcttgtgg

SEQ ID NO: 297278 - DNA, 25 bp, Mus musculus
gagtcaaagccaggtgccagctggg

SEQ ID NO: 297279 - DNA, 25 bp, Mus musculus
gagtcaaagggctaacagaacaaga

SEQ ID NO: 297280 - DNA, 25 bp, Mus musculus
gagtcaaaggtccacgaaccagttc

SEQ ID NO: 297281 - DNA, 25 bp, Mus musculus
gagtcaacaaggtcccagtgaagaa

SEQ ID NO: 297282 - DNA, 25 bp, Mus musculus
gagtcaacaaggtgatcattggcac

SEQ ID NO: 297283 - DNA, 25 bp, Mus musculus
gagtcaacataatagcctgcttttt

SEQ ID NO: 297284 - DNA, 25 bp, Mus musculus
gagtcaacataataggtgagcacat

SEQ ID NO: 297285 - DNA, 25 bp, Mus musculus
gagtcaagagaatcggctatccatc

SEQ ID NO: 297286 - DNA, 25 bp, Mus musculus
gagtcaagagatcaggacttcccag

SEQ ID NO: 297287 - DNA, 25 bp, Mus musculus
gagtcaagagatgaagccaccccag

SEQ ID NO: 297288 - DNA, 25 bp, Mus musculus
gagtcaagagccttcgtgagccccg

SEQ ID NO: 297289 - DNA, 25 bp, Mus musculus
gagtcaagaggttctccccaatcgc

SEQ ID NO: 297290 - DNA, 25 bp, Mus musculus
gagtcaagagtcccctgtcgctcat

SEQ ID NO: 297291 - DNA, 25 bp, Mus musculus
gagtcaagcaggtctgcggagatta

SEQ ID NO: 297292 - DNA, 25 bp, Mus musculus
gagtcaatttcaggaaaatctgggt

SEQ ID NO: 297293 - DNA, 25 bp, Mus musculus
gagtcaatttcaggatactggctcg

SEQ ID NO: 297294 - DNA, 25 bp, Mus musculus
gagtcaatttcaggggctctctaaa

SEQ ID NO: 297295 - DNA, 25 bp, Mus musculus
gagtcacaaaaaaagattttggagt

SEQ ID NO: 297296 - DNA, 25 bp, Mus musculus
gagtcacaccaagattgtttattta

SEQ ID NO: 297297 - DNA, 25 bp, Mus musculus
gagtcacaccaagcaaaacaattgc

SEQ ID NO: 297298 - DNA, 25 bp, Mus musculus
gagtcacacgataagcccctggtcc

SEQ ID NO: 297299 - DNA, 25 bp, Mus musculus
gagtcacaggcctgagggccagccg

SEQ ID NO: 297300 - DNA, 25 bp, Mus musculus
gagtcaccaaatgaccccaagggtt

SEQ ID NO: 297301 - DNA, 25 bp, Mus musculus
gagtcaccaagccaggatcctgtcc

SEQ ID NO: 297302 - DNA, 25 bp, Mus musculus
gagtcaccaagccaggtggacttgt

SEQ ID NO: 297303 - DNA, 25 bp, Mus musculus
gagtcaccacactgctccgcaggag

SEQ ID NO: 297304 - DNA, 25 bp, Mus musculus
gagtcaccacggttcatggaaacct

SEQ ID NO: 297305 - DNA, 25 bp, Mus musculus
gagtcacctctgtctggtagcagcc

SEQ ID NO: 297306 - DNA, 25 bp, Mus musculus
gagtcacctgctgtaattggcaact

SEQ ID NO: 297307 - DNA, 25 bp, Mus musculus
gagtcactcaagagcctcatccccg

SEQ ID NO: 297308 - DNA, 25 bp, Mus musculus
gagtcactcaaggaggctgttgtgg

SEQ ID NO: 297309 - DNA, 25 bp, Mus musculus
gagtcacttgtgctgcttctcagga

SEQ ID NO: 297310 - DNA, 25 bp, Mus musculus
gagtcagaaaagttgtcctctctaa

SEQ ID NO: 297311 - DNA, 25 bp, Mus musculus
gagtcagaagcccatctcggtcact

SEQ ID NO: 297312 - DNA, 25 bp, Mus musculus
gagtcagaaggtgttgcagcccatc

SEQ ID NO: 297313 - DNA, 25 bp, Mus musculus
gagtcagaccagggagcccccgggc

SEQ ID NO: 297314 - DNA, 25 bp, Mus musculus
gagtcagagaggagggccaaggagg

SEQ ID NO: 297315 - DNA, 25 bp, Mus musculus
gagtcagagcacaggctcagaaatc

SEQ ID NO: 297316 - DNA, 25 bp, Mus musculus
gagtcagagcagcagaaactagaca

SEQ ID NO: 297317 - DNA, 25 bp, Mus musculus
gagtcagagcagcagacaccatgtg

SEQ ID NO: 297318 - DNA, 25 bp, Mus musculus
gagtcagagcagcagactcctccct

SEQ ID NO: 297319 - DNA, 25 bp, Mus musculus
gagtcagaggcccaggcctctcttt

SEQ ID NO: 297320 - DNA, 25 bp, Mus musculus
gagtcagagtatgagaaaataaagg

SEQ ID NO: 297321 - DNA, 25 bp, Mus musculus
gagtcagagtatgagaggctgttat

SEQ ID NO: 297322 - DNA, 25 bp, Mus musculus
gagtcagagtatgaggaagaagatt

SEQ ID NO: 297323 - DNA, 25 bp, Mus musculus
gagtcagagtatgagtttctcctca

SEQ ID NO: 297324 - DNA, 25 bp, Mus musculus
gagtcagagtcatgtatcgagtggc

SEQ ID NO: 297325 - DNA, 25 bp, Mus musculus
gagtcagattacagatcccaggcag

SEQ ID NO: 297326 - DNA, 25 bp, Mus musculus
gagtcagcaccagctcgcagtggtc

SEQ ID NO: 297327 - DNA, 25 bp, Mus musculus
gagtcagcaccagggattctgggca

SEQ ID NO: 297328 - DNA, 25 bp, Mus musculus
gagtcagccccagcctggtagggat

SEQ ID NO: 297329 - DNA, 25 bp, Mus musculus
gagtcaggaaaggaatcccaatctt

SEQ ID NO: 297330 - DNA, 25 bp, Mus musculus
gagtcaggaaaggcacatgaatgct

SEQ ID NO: 297331 - DNA, 25 bp, Mus musculus
gagtcaggaaaggtgccctgggaca

SEQ ID NO: 297332 - DNA, 25 bp, Mus musculus
gagtcaggattctcgatccagagac

SEQ ID NO: 297333 - DNA, 25 bp, Mus musculus
gagtcataagaagacacacacagga

SEQ ID NO: 297334 - DNA, 25 bp, Mus musculus
gagtcatacagaggtaccttccttg

SEQ ID NO: 297335 - DNA, 25 bp, Mus musculus
gagtcatacagaggttaaattaaaa

SEQ ID NO: 297336 - DNA, 25 bp, Mus musculus
gagtcataggaacagattgagaaat

SEQ ID NO: 297337 - DNA, 25 bp, Mus musculus
gagtcatcaacctaatgcctgaacc

SEQ ID NO: 297338 - DNA, 25 bp, Mus musculus
gagtcatcaagacttcataagggct

SEQ ID NO: 297339 - DNA, 25 bp, Mus musculus
gagtcatcaaggtaaaccgagagtg

SEQ ID NO: 297340 - DNA, 25 bp, Mus musculus
gagtcatcactgtcatccaggacat

SEQ ID NO: 297341 - DNA, 25 bp, Mus musculus
gagtcatcaggggtttcctgagatg

SEQ ID NO: 297342 - DNA, 25 bp, Mus musculus
gagtcatccttcgaggatgtctcgg

SEQ ID NO: 297343 - DNA, 25 bp, Mus musculus
gagtcatccttcgaggcttgctttg

SEQ ID NO: 297344 - DNA, 25 bp, Mus musculus
gagtcatctaggctaaaggacacag

SEQ ID NO: 297345 - DNA, 25 bp, Mus musculus
gagtcatgaaagaggctaccttaag

SEQ ID NO: 297346 - DNA, 25 bp, Mus musculus
gagtcatgagtccaaggagtctctc

SEQ ID NO: 297347 - DNA, 25 bp, Mus musculus
gagtcatgagtcgaaggagtctctc

SEQ ID NO: 297348 - DNA, 25 bp, Mus musculus
gagtcatgagtgcagaggggaacct

SEQ ID NO: 297349 - DNA, 25 bp, Mus musculus
gagtcatgcccagcttcccatcatc

SEQ ID NO: 297350 - DNA, 25 bp, Mus musculus
gagtcatgcccagggagtcccccca

SEQ ID NO: 297351 - DNA, 25 bp, Mus musculus
gagtcatgcctctgcagacgtggag

SEQ ID NO: 297352 - DNA, 25 bp, Mus musculus
gagtcatggacggtttgaagatcaa

SEQ ID NO: 297353 - DNA, 25 bp, Mus musculus
gagtcatggacgttcggggatgagg

SEQ ID NO: 297354 - DNA, 25 bp, Mus musculus
gagtcattaactccatgtaatcgtg

SEQ ID NO: 297355 - DNA, 25 bp, Mus musculus
gagtcattagagtgttcagtgtcaa

SEQ ID NO: 297356 - DNA, 25 bp, Mus musculus
gagtcattaggggccctgggaccca

SEQ ID NO: 297357 - DNA, 25 bp, Mus musculus
gagtcattcaaacctgaacgctgga

SEQ ID NO: 297358 - DNA, 25 bp, Mus musculus
gagtcattcaaacctgtggtttgct

SEQ ID NO: 297359 - DNA, 25 bp, Mus musculus
gagtcattcaagtttatctccggca

SEQ ID NO: 297360 - DNA, 25 bp, Mus musculus
gagtcattgaagacccaactccgaa

SEQ ID NO: 297361 - DNA, 25 bp, Mus musculus
gagtcattgattaggttatacctga

SEQ ID NO: 297362 - DNA, 25 bp, Mus musculus
gagtccaaaggatcagactgaacag

SEQ ID NO: 297363 - DNA, 25 bp, Mus musculus
gagtccaaagtttccattgggaaga

SEQ ID NO: 297364 - DNA, 25 bp, Mus musculus
gagtccaagaaaatatttcagatac

SEQ ID NO: 297365 - DNA, 25 bp, Mus musculus
gagtccaagtcagtttctgatgacc

SEQ ID NO: 297366 - DNA, 25 bp, Mus musculus
gagtccacaggcagatgaacacaat

SEQ ID NO: 297367 - DNA, 25 bp, Mus musculus
gagtccaccctgcacctggtccttc

SEQ ID NO: 297368 - DNA, 25 bp, Mus musculus
gagtccaccgatttactaaattatg

SEQ ID NO: 297369 - DNA, 25 bp, Mus musculus
gagtccaccgttatatttcagagcc

SEQ ID NO: 297370 - DNA, 25 bp, Mus musculus
gagtccacctgggatcatgggctct

SEQ ID NO: 297371 - DNA, 25 bp, Mus musculus
gagtccacttgtttggttgtggcct

SEQ ID NO: 297372 - DNA, 25 bp, Mus musculus
gagtccagaaagtcaacgcctcaag

SEQ ID NO: 297373 - DNA, 25 bp, Mus musculus
gagtccagcaagaggaccagagttc

SEQ ID NO: 297374 - DNA, 25 bp, Mus musculus
gagtccaggtgcagctgctggaccc

SEQ ID NO: 297375 - DNA, 25 bp, Mus musculus
gagtccaggtgttttggttcatctt

SEQ ID NO: 297376 - DNA, 25 bp, Mus musculus
gagtccagtttgggaagaaaggtgg

SEQ ID NO: 297377 - DNA, 25 bp, Mus musculus
gagtccagtttgggtgtctggagac

SEQ ID NO: 297378 - DNA, 25 bp, Mus musculus
gagtccataggctgtaccaactgtc

SEQ ID NO: 297379 - DNA, 25 bp, Mus musculus
gagtccatgagtttacaggaacaga

SEQ ID NO: 297380 - DNA, 25 bp, Mus musculus
gagtccattcgacaaagatgactac

SEQ ID NO: 297381 - DNA, 25 bp, Mus musculus
gagtcccaaaagaccatgtgaccca

SEQ ID NO: 297382 - DNA, 25 bp, Mus musculus
gagtcccaaaggatgcatgctgttc

SEQ ID NO: 297383 - DNA, 25 bp, Mus musculus
gagtcccaaagggtcttcagattac

SEQ ID NO: 297384 - DNA, 25 bp, Mus musculus
gagtcccaaaggtgtcctgcaggtc

SEQ ID NO: 297385 - DNA, 25 bp, Mus musculus
gagtcccaagagggggaatacctcc

SEQ ID NO: 297386 - DNA, 25 bp, Mus musculus
gagtcccaagccccacccacaaact

SEQ ID NO: 297387 - DNA, 25 bp, Mus musculus
gagtcccagaagaggacactacatg

SEQ ID NO: 297388 - DNA, 25 bp, Mus musculus
gagtcccagtgcaggatttactagg

SEQ ID NO: 297389 - DNA, 25 bp, Mus musculus
gagtcccagtgcagggataacaaca

SEQ ID NO: 297390 - DNA, 25 bp, Mus musculus
gagtccccaagaacacagccaaaag

SEQ ID NO: 297391 - DNA, 25 bp, Mus musculus
gagtccccaagcacggctggagcga

SEQ ID NO: 297392 - DNA, 25 bp, Mus musculus
gagtccccagtcaggtagcctttcc

SEQ ID NO: 297393 - DNA, 25 bp, Mus musculus
gagtccccagtgaaagcagaagata

SEQ ID NO: 297394 - DNA, 25 bp, Mus musculus
gagtccccgaggagatctcccctct

SEQ ID NO: 297395 - DNA, 25 bp, Mus musculus
gagtccccgaggagctacagtttta

SEQ ID NO: 297396 - DNA, 25 bp, Mus musculus
gagtcccctttaaggctccaggatg

SEQ ID NO: 297397 - DNA, 25 bp, Mus musculus
gagtcccgaaatggggttggtgtca

SEQ ID NO: 297398 - DNA, 25 bp, Mus musculus
gagtcccgaaggggacagcttcgtg

SEQ ID NO: 297399 - DNA, 25 bp, Mus musculus
gagtccctagaagcaagacgaccgt

SEQ ID NO: 297400 - DNA, 25 bp, Mus musculus
gagtccctagaggtgttggtggaat

SEQ ID NO: 297401 - DNA, 25 bp, Mus musculus
gagtccctgtgcgatgactgtaagg

SEQ ID NO: 297402 - DNA, 25 bp, Mus musculus
gagtccctgtgtgacctcttggttc

SEQ ID NO: 297403 - DNA, 25 bp, Mus musculus
gagtccgacggatcgctactcttag

SEQ ID NO: 297404 - DNA, 25 bp, Mus musculus
gagtccgagagttcaaaggtgaaga

SEQ ID NO: 297405 - DNA, 25 bp, Mus musculus
gagtccgaggactatgagaccacca

SEQ ID NO: 297406 - DNA, 25 bp, Mus musculus
gagtccgcatcagaggaaggagatg

SEQ ID NO: 297407 - DNA, 25 bp, Mus musculus
gagtccgcccgaagccctattctga

SEQ ID NO: 297408 - DNA, 25 bp, Mus musculus
gagtccgcccgaagcttggtgaggt

SEQ ID NO: 297409 - DNA, 25 bp, Mus musculus
gagtccgcccgaaggttaacaagcc

SEQ ID NO: 297410 - DNA, 25 bp, Mus musculus
gagtccgcgatggagaaaactttag

SEQ ID NO: 297411 - DNA, 25 bp, Mus musculus
gagtccgcgatggagagagaaaagg

SEQ ID NO: 297412 - DNA, 25 bp, Mus musculus
gagtccgggagactcgatctgccca

SEQ ID NO: 297413 - DNA, 25 bp, Mus musculus
gagtccggggaaaacagtaagaaga

SEQ ID NO: 297414 - DNA, 25 bp, Mus musculus
gagtccgtcacgctggcggtggtgt

SEQ ID NO: 297415 - DNA, 25 bp, Mus musculus
gagtccgtgctgagacgtcatcatg

SEQ ID NO: 297416 - DNA, 25 bp, Mus musculus
gagtcctatgcagaagaagtactac

SEQ ID NO: 297417 - DNA, 25 bp, Mus musculus
gagtcctatggtgaaggctgcattg

SEQ ID NO: 297418 - DNA, 25 bp, Mus musculus
gagtcctcaaactcactctgcagag

SEQ ID NO: 297419 - DNA, 25 bp, Mus musculus
gagtcctcaaagacaatgtgtctac

SEQ ID NO: 297420 - DNA, 25 bp, Mus musculus
gagtcctcacacagtgtccaacctg

SEQ ID NO: 297421 - DNA, 25 bp, Mus musculus
gagtcctcacagtgagtgatagctg

SEQ ID NO: 297422 - DNA, 25 bp, Mus musculus
gagtcctcagaatggcaatgttcct

SEQ ID NO: 297423 - DNA, 25 bp, Mus musculus
gagtcctcaggcacctccaagtgga

SEQ ID NO: 297424 - DNA, 25 bp, Mus musculus
gagtcctcaggccaatgtgctttgt

SEQ ID NO: 297425 - DNA, 25 bp, Mus musculus
gagtcctccccttcaaagctgtgtc

SEQ ID NO: 297426 - DNA, 25 bp, Mus musculus
gagtcctcctccacctaaggtggta

SEQ ID NO: 297427 - DNA, 25 bp, Mus musculus
gagtcctgtgagacagtgtttcttg

SEQ ID NO: 297428 - DNA, 25 bp, Mus musculus
gagtcctgtgagagatggatgtcct

SEQ ID NO: 297429 - DNA, 25 bp, Mus musculus
gagtccttaaaggtttatgggactg

SEQ ID NO: 297430 - DNA, 25 bp, Mus musculus
gagtccttatgacacgtccccatct

SEQ ID NO: 297431 - DNA, 25 bp, Mus musculus
gagtccttcccaggagtacacggtc

SEQ ID NO: 297432 - DNA, 25 bp, Mus musculus
gagtccttgatgtcggtggcgccca

SEQ ID NO: 297433 - DNA, 25 bp, Mus musculus
gagtcctttcagggcttcttcgtgt

SEQ ID NO: 297434 - DNA, 25 bp, Mus musculus
gagtcctttggcttcaccgctgatc

SEQ ID NO: 297435 - DNA, 25 bp, Mus musculus
gagtcgaaacattgtggatttcaaa

SEQ ID NO: 297436 - DNA, 25 bp, Mus musculus
gagtcgactatgtgtacaagaccga

SEQ ID NO: 297437 - DNA, 25 bp, Mus musculus
gagtcgacttcaggtacaggtccca

SEQ ID NO: 297438 - DNA, 25 bp, Mus musculus
gagtcgacttcaggtggtaagagaa

SEQ ID NO: 297439 - DNA, 25 bp, Mus musculus
gagtcgccatgcctacaacacagca

SEQ ID NO: 297440 - DNA, 25 bp, Mus musculus
gagtcgccatgtcaccccaggatga

SEQ ID NO: 297441 - DNA, 25 bp, Mus musculus
gagtcgccctagagttgaggccggc

SEQ ID NO: 297442 - DNA, 25 bp, Mus musculus
gagtcgccggaggacacagagctgc

SEQ ID NO: 297443 - DNA, 25 bp, Mus musculus
gagtcgcctcagaaaatgtatctcg

SEQ ID NO: 297444 - DNA, 25 bp, Mus musculus
gagtcgcctcgagaaccctgcacct

SEQ ID NO: 297445 - DNA, 25 bp, Mus musculus
gagtcgcctcgaggaagaaggcatt

SEQ ID NO: 297446 - DNA, 25 bp, Mus musculus
gagtcggacaataataaaagactag

SEQ ID NO: 297447 - DNA, 25 bp, Mus musculus
gagtcggagacccggatttcccagc

SEQ ID NO: 297448 - DNA, 25 bp, Mus musculus
gagtcggcagggctctgagtcagat

SEQ ID NO: 297449 - DNA, 25 bp, Mus musculus
gagtcggcagttgaaagtgggggtg

SEQ ID NO: 297450 - DNA, 25 bp, Mus musculus
gagtcggcctgcaggcctgtcgagg

SEQ ID NO: 297451 - DNA, 25 bp, Mus musculus
gagtcggcctgcaggtgcggaccta

SEQ ID NO: 297452 - DNA, 25 bp, Mus musculus
gagtcggcctgcagtttcaggcctg

SEQ ID NO: 297453 - DNA, 25 bp, Mus musculus
gagtcgggccggacagaacagtaaa

SEQ ID NO: 297454 - DNA, 25 bp, Mus musculus
gagtcgggctgatcgaaaaggactc

SEQ ID NO: 297455 - DNA, 25 bp, Mus musculus
gagtcgggctgatcgtgaccatctt

SEQ ID NO: 297456 - DNA, 25 bp, Mus musculus
gagtcggtgcttggctctggctgag

SEQ ID NO: 297457 - DNA, 25 bp, Mus musculus
gagtcgtgttggaaggtggcattga

SEQ ID NO: 297458 - DNA, 25 bp, Mus musculus
gagtcgttgaagagagttgtggtta

SEQ ID NO: 297459 - DNA, 25 bp, Mus musculus
gagtcgttgaaggtactagcaagat

SEQ ID NO: 297460 - DNA, 25 bp, Mus musculus
gagtctaaagggaagcgattataga

SEQ ID NO: 297461 - DNA, 25 bp, Mus musculus
gagtctaaggaggacaacatttcag

SEQ ID NO: 297462 - DNA, 25 bp, Mus musculus
gagtctaaggaggagaacatttcag

SEQ ID NO: 297463 - DNA, 25 bp, Mus musculus
gagtctacaggtttgtacagcgcaa

SEQ ID NO: 297464 - DNA, 25 bp, Mus musculus
gagtctaccatatttggtataaggg

SEQ ID NO: 297465 - DNA, 25 bp, Mus musculus
gagtctacccaaagtgatcaacttt

SEQ ID NO: 297466 - DNA, 25 bp, Mus musculus
gagtctagagctcctccgggatcta

SEQ ID NO: 297467 - DNA, 25 bp, Mus musculus
gagtctataaatttgcaagagccag

SEQ ID NO: 297468 - DNA, 25 bp, Mus musculus
gagtctatgtcagacagggaacaac

SEQ ID NO: 297469 - DNA, 25 bp, Mus musculus
gagtctcaaacaataggtgaccagt

SEQ ID NO: 297470 - DNA, 25 bp, Mus musculus
gagtctcaagagccaaggacatgaa

SEQ ID NO: 297471 - DNA, 25 bp, Mus musculus
gagtctcaaggctacatgtgagcga

SEQ ID NO: 297472 - DNA, 25 bp, Mus musculus
gagtctccacagattgacggcgggg

SEQ ID NO: 297473 - DNA, 25 bp, Mus musculus
gagtctccatcctgggttggctgat

SEQ ID NO: 297474 - DNA, 25 bp, Mus musculus
gagtctccattcaggagacattcca

SEQ ID NO: 297475 - DNA, 25 bp, Mus musculus
gagtctccattcagggttcccgggc

SEQ ID NO: 297476 - DNA, 25 bp, Mus musculus
gagtctcccagctccttcactcact

SEQ ID NO: 297477 - DNA, 25 bp, Mus musculus
gagtctcccaggaagatctgctatc

SEQ ID NO: 297478 - DNA, 25 bp, Mus musculus
gagtctccgacgggcactatgaacg

SEQ ID NO: 297479 - DNA, 25 bp, Mus musculus
gagtctccgggaacgtgccaataga

SEQ ID NO: 297480 - DNA, 25 bp, Mus musculus
gagtctccgggctttggcgttgttg

SEQ ID NO: 297481 - DNA, 25 bp, Mus musculus
gagtctccggggatgaattgtctgg

SEQ ID NO: 297482 - DNA, 25 bp, Mus musculus
gagtctcctgagagaaattttcctc

SEQ ID NO: 297483 - DNA, 25 bp, Mus musculus
gagtctcctgaggttcaggacctgc

SEQ ID NO: 297484 - DNA, 25 bp, Mus musculus
gagtctctcaagcgtcaagaactgg

SEQ ID NO: 297485 - DNA, 25 bp, Mus musculus
gagtctctccatcaggtttctttct

SEQ ID NO: 297486 - DNA, 25 bp, Mus musculus
gagtctctctgcaagatcatgctgg

SEQ ID NO: 297487 - DNA, 25 bp, Mus musculus
gagtctctcttccatgtctcccatc

SEQ ID NO: 297488 - DNA, 25 bp, Mus musculus
gagtctctgagtgaggagacccaga

SEQ ID NO: 297489 - DNA, 25 bp, Mus musculus
gagtctctggcgctgatcccactgc

SEQ ID NO: 297490 - DNA, 25 bp, Mus musculus
gagtctctggcggccccactgaaga

SEQ ID NO: 297491 - DNA, 25 bp, Mus musculus
gagtctctgggcacggaggtgccaa

SEQ ID NO: 297492 - DNA, 25 bp, Mus musculus
gagtctctgttccgaggagaagcct

SEQ ID NO: 297493 - DNA, 25 bp, Mus musculus
gagtctctgttccgtcacagtcacg

SEQ ID NO: 297494 - DNA, 25 bp, Mus musculus
gagtctgaagcaggaaggaacagct

SEQ ID NO: 297495 - DNA, 25 bp, Mus musculus
gagtctgaagcaggatctgaagaag

SEQ ID NO: 297496 - DNA, 25 bp, Mus musculus
gagtctgaagggattggagatagca

SEQ ID NO: 297497 - DNA, 25 bp, Mus musculus
gagtctgagagcccaccttctcccc

SEQ ID NO: 297498 - DNA, 25 bp, Mus musculus
gagtctgagaggcggaagaagctgc

SEQ ID NO: 297499 - DNA, 25 bp, Mus musculus
gagtctgatatctgctgcttccagc

SEQ ID NO: 297500 - DNA, 25 bp, Mus musculus
gagtctgccaaaattatggaccctg

SEQ ID NO: 297501 - DNA, 25 bp, Mus musculus
gagtctgctcagggcggcttcattt

SEQ ID NO: 297502 - DNA, 25 bp, Mus musculus
gagtctggacaacatgtgcatcgta

SEQ ID NO: 297503 - DNA, 25 bp, Mus musculus
gagtctggacaggtcacgctggagt

SEQ ID NO: 297504 - DNA, 25 bp, Mus musculus
gagtctggagccggtgagcctggag

SEQ ID NO: 297505 - DNA, 25 bp, Mus musculus
gagtctggaggagattggcatccag

SEQ ID NO: 297506 - DNA, 25 bp, Mus musculus
gagtctggaggaggttcttcgtgat

SEQ ID NO: 297507 - DNA, 25 bp, Mus musculus
gagtctggcaggagtgctcaccaag

SEQ ID NO: 297508 - DNA, 25 bp, Mus musculus
gagtctgtgaagagccacaatcatg

SEQ ID NO: 297509 - DNA, 25 bp, Mus musculus
gagtctgtgaaggagaagtttgaga

SEQ ID NO: 297510 - DNA, 25 bp, Mus musculus
gagtctgttcagactgtactccctc

SEQ ID NO: 297511 - DNA, 25 bp, Mus musculus
gagtcttagaagcagaatggaatga

SEQ ID NO: 297512 - DNA, 25 bp, Mus musculus
gagtcttcccaggatgagtctgact

SEQ ID NO: 297513 - DNA, 25 bp, Mus musculus
gagtcttcggggccctctgtcctgg

SEQ ID NO: 297514 - DNA, 25 bp, Mus musculus
gagtcttctctggcttttctcatgt

SEQ ID NO: 297515 - DNA, 25 bp, Mus musculus
gagtcttctctgtcacttgcctcgg

SEQ ID NO: 297516 - DNA, 25 bp, Mus musculus
gagtcttgggcctgggcccataccc

SEQ ID NO: 297517 - DNA, 25 bp, Mus musculus
gagtctttaaggagaaagcatccac

SEQ ID NO: 297518 - DNA, 25 bp, Mus musculus
gagtctttaagtggttctgtgtata

SEQ ID NO: 297519 - DNA, 25 bp, Mus musculus
gagtctttcacaagaggctccatag

SEQ ID NO: 297520 - DNA, 25 bp, Mus musculus
gagtctttcaggaagaagaccttcg

SEQ ID NO: 297521 - DNA, 25 bp, Mus musculus
gagtctttgcctaggttgagaacaa

SEQ ID NO: 297522 - DNA, 25 bp, Mus musculus
gagtgaaacacatcccaggcacccc

SEQ ID NO: 297523 - DNA, 25 bp, Mus musculus
gagtgaaatgtgcagattgtgggtt

SEQ ID NO: 297524 - DNA, 25 bp, Mus musculus
gagtgaacagtccctggatgacgcg

SEQ ID NO: 297525 - DNA, 25 bp, Mus musculus
gagtgaacattttcaagacatttga

SEQ ID NO: 297526 - DNA, 25 bp, Mus musculus
gagtgaacgtcacaggcatatatcg

SEQ ID NO: 297527 - DNA, 25 bp, Mus musculus
gagtgaactgaagttgaaaagagcg

SEQ ID NO: 297528 - DNA, 25 bp, Mus musculus
gagtgaactgcgggacatctatgac

SEQ ID NO: 297529 - DNA, 25 bp, Mus musculus
gagtgaactgcgggagtctttgtct

SEQ ID NO: 297530 - DNA, 25 bp, Mus musculus
gagtgaagaaatcttccatcctact

SEQ ID NO: 297531 - DNA, 25 bp, Mus musculus
gagtgaagaagaactcctacctgga

SEQ ID NO: 297532 - DNA, 25 bp, Mus musculus
gagtgaagaagcgagatcatcagta

SEQ ID NO: 297533 - DNA, 25 bp, Mus musculus
gagtgaagacggacaccatgatatc

SEQ ID NO: 297534 - DNA, 25 bp, Mus musculus
gagtgaagacggacagtgttacgaa

SEQ ID NO: 297535 - DNA, 25 bp, Mus musculus
gagtgaagagctctgcagttttgaa

SEQ ID NO: 297536 - DNA, 25 bp, Mus musculus
gagtgaagatagtttaggtcaaccc

SEQ ID NO: 297537 - DNA, 25 bp, Mus musculus
gagtgaagatgatcgtaatactttt

SEQ ID NO: 297538 - DNA, 25 bp, Mus musculus
gagtgaaggccggaggatggaacca

SEQ ID NO: 297539 - DNA, 25 bp, Mus musculus
gagtgaaggccggagttccctcaca

SEQ ID NO: 297540 - DNA, 25 bp, Mus musculus
gagtgaagttattcagaagagagcc

SEQ ID NO: 297541 - DNA, 25 bp, Mus musculus
gagtgaagttattcatgctcgattt

SEQ ID NO: 297542 - DNA, 25 bp, Mus musculus
gagtgaatatgttttgcattttctt

SEQ ID NO: 297543 - DNA, 25 bp, Mus musculus
gagtgaatgaaggctttaacagaaa

SEQ ID NO: 297544 - DNA, 25 bp, Mus musculus
gagtgaattagatataatgtttaat

SEQ ID NO: 297545 - DNA, 25 bp, Mus musculus
gagtgacaggggacccatgagcttc

SEQ ID NO: 297546 - DNA, 25 bp, Mus musculus
gagtgacatagagtgtgctgctctg

SEQ ID NO: 297547 - DNA, 25 bp, Mus musculus
gagtgacatatgcccccaaggtctc

SEQ ID NO: 297548 - DNA, 25 bp, Mus musculus
gagtgacatcctagacaacaacggg

SEQ ID NO: 297549 - DNA, 25 bp, Mus musculus
gagtgacatcgcatcggctcttaga

SEQ ID NO: 297550 - DNA, 25 bp, Mus musculus
gagtgacatcggcgccagagcttct

SEQ ID NO: 297551 - DNA, 25 bp, Mus musculus
gagtgacatggaagctatggataag

SEQ ID NO: 297552 - DNA, 25 bp, Mus musculus
gagtgacatggccgcagccacgccc

SEQ ID NO: 297553 - DNA, 25 bp, Mus musculus
gagtgacatgtgcgaccaagaccag

SEQ ID NO: 297554 - DNA, 25 bp, Mus musculus
gagtgaccagccgtgggaatggtgt

SEQ ID NO: 297555 - DNA, 25 bp, Mus musculus
gagtgaccagtggagtgaagccagc

SEQ ID NO: 297556 - DNA, 25 bp, Mus musculus
gagtgaccattgagcaagaactatg

SEQ ID NO: 297557 - DNA, 25 bp, Mus musculus
gagtgaccattgaggttatctggct

SEQ ID NO: 297558 - DNA, 25 bp, Mus musculus
gagtgactcaggaagccataatttg

SEQ ID NO: 297559 - DNA, 25 bp, Mus musculus
gagtgactccaggctgtccttgttg

SEQ ID NO: 297560 - DNA, 25 bp, Mus musculus
gagtgactctgccgaccccttcctg

SEQ ID NO: 297561 - DNA, 25 bp, Mus musculus
gagtgactctgctcttctagattat

SEQ ID NO: 297562 - DNA, 25 bp, Mus musculus
gagtgactgtatacgacatttcatt

SEQ ID NO: 297563 - DNA, 25 bp, Mus musculus
gagtgactgtgtaacggagcacctc

SEQ ID NO: 297564 - DNA, 25 bp, Mus musculus
gagtgactgttatatgcagcagaag

SEQ ID NO: 297565 - DNA, 25 bp, Mus musculus
gagtgacttccacaggacctataag

SEQ ID NO: 297566 - DNA, 25 bp, Mus musculus
gagtgagaaaaggatgattgagata

SEQ ID NO: 297567 - DNA, 25 bp, Mus musculus
gagtgagaaaaggccctcaacttcc

SEQ ID NO: 297568 - DNA, 25 bp, Mus musculus
gagtgagaaaggagacacggtctct

SEQ ID NO: 297569 - DNA, 25 bp, Mus musculus
gagtgagaaaggagacatggagtac

SEQ ID NO: 297570 - DNA, 25 bp, Mus musculus
gagtgagaaaggggacagtcaaaag

SEQ ID NO: 297571 - DNA, 25 bp, Mus musculus
gagtgagaacaggtcctatgagggc

SEQ ID NO: 297572 - DNA, 25 bp, Mus musculus
gagtgagaagattacgacgggcaga

SEQ ID NO: 297573 - DNA, 25 bp, Mus musculus
gagtgagaagcatttcttcacttcc

SEQ ID NO: 297574 - DNA, 25 bp, Mus musculus
gagtgagaaggagttgatgtgccgg

SEQ ID NO: 297575 - DNA, 25 bp, Mus musculus
gagtgagagcaagagatacttcaag

SEQ ID NO: 297576 - DNA, 25 bp, Mus musculus
gagtgagagccagtcgtttcagctc

SEQ ID NO: 297577 - DNA, 25 bp, Mus musculus
gagtgagatcgcagccttccctgtg

SEQ ID NO: 297578 - DNA, 25 bp, Mus musculus
gagtgagatcgtttcctcctcagat

SEQ ID NO: 297579 - DNA, 25 bp, Mus musculus
gagtgagattccctgttctgcagga

SEQ ID NO: 297580 - DNA, 25 bp, Mus musculus
gagtgagcacggatgaaaatttttc

SEQ ID NO: 297581 - DNA, 25 bp, Mus musculus
gagtgagcacggttatttttgaagt

SEQ ID NO: 297582 - DNA, 25 bp, Mus musculus
gagtgagcagccccacagtgaacac

SEQ ID NO: 297583 - DNA, 25 bp, Mus musculus
gagtgagcaggctcctgcaaaaaag

SEQ ID NO: 297584 - DNA, 25 bp, Mus musculus
gagtgagccccagaccacctcatcc

SEQ ID NO: 297585 - DNA, 25 bp, Mus musculus
gagtgagccccaggtctgtctccgt

SEQ ID NO: 297586 - DNA, 25 bp, Mus musculus
gagtgaggagtcaccactactttaa

SEQ ID NO: 297587 - DNA, 25 bp, Mus musculus
gagtgaggccacagtgtgtcagaaa

SEQ ID NO: 297588 - DNA, 25 bp, Mus musculus
gagtgaggtgggccagacatcagaa

SEQ ID NO: 297589 - DNA, 25 bp, Mus musculus
gagtgagtcaggaacaaagtattga

SEQ ID NO: 297590 - DNA, 25 bp, Mus musculus
gagtgagtgccaaggttcatatggg

SEQ ID NO: 297591 - DNA, 25 bp, Mus musculus
gagtgataacgaacggtaccatggt

SEQ ID NO: 297592 - DNA, 25 bp, Mus musculus
gagtgatacgcacagatcttgatat

SEQ ID NO: 297593 - DNA, 25 bp, Mus musculus
gagtgatagggtaaaatttatgaag

SEQ ID NO: 297594 - DNA, 25 bp, Mus musculus
gagtgatcacaggattgctgctgga

SEQ ID NO: 297595 - DNA, 25 bp, Mus musculus
gagtgatcacaggcctgggcatgtg

SEQ ID NO: 297596 - DNA, 25 bp, Mus musculus
gagtgatcacagggccaaaggcgac

SEQ ID NO: 297597 - DNA, 25 bp, Mus musculus
gagtgatcagggcaccctcagatca

SEQ ID NO: 297598 - DNA, 25 bp, Mus musculus
gagtgatcatgtgcctctcctttcc

SEQ ID NO: 297599 - DNA, 25 bp, Mus musculus
gagtgatccagtctgttgtctactg

SEQ ID NO: 297600 - DNA, 25 bp, Mus musculus
gagtgatgctgaccagcacgtaact

SEQ ID NO: 297601 - DNA, 25 bp, Mus musculus
gagtgatgctgaccgagatccctga

SEQ ID NO: 297602 - DNA, 25 bp, Mus musculus
gagtgatgcttattctttgggagcc

SEQ ID NO: 297603 - DNA, 25 bp, Mus musculus
gagtgatggaggacttctgtgtgtc

SEQ ID NO: 297604 - DNA, 25 bp, Mus musculus
gagtgatggagtcggctcttaaccg

SEQ ID NO: 297605 - DNA, 25 bp, Mus musculus
gagtgattacagagaattgtatttc

SEQ ID NO: 297606 - DNA, 25 bp, Mus musculus
gagtgattacagaggctttggtata

SEQ ID NO: 297607 - DNA, 25 bp, Mus musculus
gagtgattacagaggttgccatgaa

SEQ ID NO: 297608 - DNA, 25 bp, Mus musculus
gagtgattgacagggagggtgtgta

SEQ ID NO: 297609 - DNA, 25 bp, Mus musculus
gagtgatttaaaggatgacgagaag

SEQ ID NO: 297610 - DNA, 25 bp, Mus musculus
gagtgatttaggaatgttcttggga

SEQ ID NO: 297611 - DNA, 25 bp, Mus musculus
gagtgcaaagcagagacggtaacac

SEQ ID NO: 297612 - DNA, 25 bp, Mus musculus
gagtgcaactacagccttgatgacc

SEQ ID NO: 297613 - DNA, 25 bp, Mus musculus
gagtgcaagcagagagagaagacga

SEQ ID NO: 297614 - DNA, 25 bp, Mus musculus
gagtgcaagcagttgcacgtttgtg

SEQ ID NO: 297615 - DNA, 25 bp, Mus musculus
gagtgcaaggaaatccggacatcta

SEQ ID NO: 297616 - DNA, 25 bp, Mus musculus
gagtgcaatccagcccttacagagg

SEQ ID NO: 297617 - DNA, 25 bp, Mus musculus
gagtgcaatccaggtcctggaatcc

SEQ ID NO: 297618 - DNA, 25 bp, Mus musculus
gagtgcaatgcaggacagtggtgac

SEQ ID NO: 297619 - DNA, 25 bp, Mus musculus
gagtgcaatgcagtccgtggtggat

SEQ ID NO: 297620 - DNA, 25 bp, Mus musculus
gagtgcaccaaagaccgtggggcag

SEQ ID NO: 297621 - DNA, 25 bp, Mus musculus
gagtgcagagtaaatccctgtctca

SEQ ID NO: 297622 - DNA, 25 bp, Mus musculus
gagtgcagcattattgattgtggcc

SEQ ID NO: 297623 - DNA, 25 bp, Mus musculus
gagtgcagccaccaggacgcagaga

SEQ ID NO: 297624 - DNA, 25 bp, Mus musculus
gagtgcagccagcagcatgtgtttc

SEQ ID NO: 297625 - DNA, 25 bp, Mus musculus
gagtgcagcctcagccaagttgaag

SEQ ID NO: 297626 - DNA, 25 bp, Mus musculus
gagtgcagcgggagggcagcagagc

SEQ ID NO: 297627 - DNA, 25 bp, Mus musculus
gagtgcagtaagaaggaattagaaa

SEQ ID NO: 297628 - DNA, 25 bp, Mus musculus
gagtgcagtaagaaggaggataaaa

SEQ ID NO: 297629 - DNA, 25 bp, Mus musculus
gagtgcagttatatggtggtgacgt

SEQ ID NO: 297630 - DNA, 25 bp, Mus musculus
gagtgcatcaaacaagttgatcaag

SEQ ID NO: 297631 - DNA, 25 bp, Mus musculus
gagtgcatcaaacagtatgaagaag

SEQ ID NO: 297632 - DNA, 25 bp, Mus musculus
gagtgcatcacacgatttgtgaaaa

SEQ ID NO: 297633 - DNA, 25 bp, Mus musculus
gagtgcatcacacggctcattcacc

SEQ ID NO: 297634 - DNA, 25 bp, Mus musculus
gagtgcatcattcaggtttttcctg

SEQ ID NO: 297635 - DNA, 25 bp, Mus musculus
gagtgccaaaggtgtgactgcaatg

SEQ ID NO: 297636 - DNA, 25 bp, Mus musculus
gagtgccaaatggcccagcaaggac

SEQ ID NO: 297637 - DNA, 25 bp, Mus musculus
gagtgccaagatatcgatgagtgtg

SEQ ID NO: 297638 - DNA, 25 bp, Mus musculus
gagtgccaaggccggcagaggactg

SEQ ID NO: 297639 - DNA, 25 bp, Mus musculus
gagtgccaaggttcatatgggaagg

SEQ ID NO: 297640 - DNA, 25 bp, Mus musculus
gagtgccaagttatcgatgagtgtg

SEQ ID NO: 297641 - DNA, 25 bp, Mus musculus
gagtgccaatgaagaatctggtcca

SEQ ID NO: 297642 - DNA, 25 bp, Mus musculus
gagtgccacagctcctccctggccc

SEQ ID NO: 297643 - DNA, 25 bp, Mus musculus
gagtgccagcgaatggctattcaag

SEQ ID NO: 297644 - DNA, 25 bp, Mus musculus
gagtgccaggctgaacctgtggcgc

SEQ ID NO: 297645 - DNA, 25 bp, Mus musculus
gagtgccagtaaagcatatgggtga

SEQ ID NO: 297646 - DNA, 25 bp, Mus musculus
gagtgccatagaaggttaatggagt

SEQ ID NO: 297647 - DNA, 25 bp, Mus musculus
gagtgccatggattggcgtctctac

SEQ ID NO: 297648 - DNA, 25 bp, Mus musculus
gagtgcccaggcgaccacctccatt

SEQ ID NO: 297649 - DNA, 25 bp, Mus musculus
gagtgcctcagtgaagaaactgacg

SEQ ID NO: 297650 - DNA, 25 bp, Mus musculus
gagtgcctcagtgcttctacctggc

SEQ ID NO: 297651 - DNA, 25 bp, Mus musculus
gagtgcctcagtggtggtgagctct

SEQ ID NO: 297652 - DNA, 25 bp, Mus musculus
gagtgcctgagaggcgtccccattc

SEQ ID NO: 297653 - DNA, 25 bp, Mus musculus
gagtgcctgcaggatcggaacgtca

SEQ ID NO: 297654 - DNA, 25 bp, Mus musculus
gagtgcctgtgctggtggagtccag

SEQ ID NO: 297655 - DNA, 25 bp, Mus musculus
gagtgccttaaaagaaaccatggaa

SEQ ID NO: 297656 - DNA, 25 bp, Mus musculus
gagtgcgaccaacagaaaacaagca

SEQ ID NO: 297657 - DNA, 25 bp, Mus musculus
gagtgcgaccaacagattcctgttg

SEQ ID NO: 297658 - DNA, 25 bp, Mus musculus
gagtgcgagcagatgagggcgctgt

SEQ ID NO: 297659 - DNA, 25 bp, Mus musculus
gagtgcgagcgggttgctgttctgg

SEQ ID NO: 297660 - DNA, 25 bp, Mus musculus
gagtgcgcccgggagaaggaactca

SEQ ID NO: 297661 - DNA, 25 bp, Mus musculus
gagtgcgcggccgaggtacaatgtc

SEQ ID NO: 297662 - DNA, 25 bp, Mus musculus
gagtgcggacacccggcctggccat

SEQ ID NO: 297663 - DNA, 25 bp, Mus musculus
gagtgcggacgggaatctggtcggc

SEQ ID NO: 297664 - DNA, 25 bp, Mus musculus
gagtgcggagggcgggggcagagat

SEQ ID NO: 297665 - DNA, 25 bp, Mus musculus
gagtgcggagggggccccccagaag

SEQ ID NO: 297666 - DNA, 25 bp, Mus musculus
gagtgcgtccagtatcagcatgtgt

SEQ ID NO: 297667 - DNA, 25 bp, Mus musculus
gagtgcgtggaagagtccccaagag

SEQ ID NO: 297668 - DNA, 25 bp, Mus musculus
gagtgctacaccccctcacgcctca

SEQ ID NO: 297669 - DNA, 25 bp, Mus musculus
gagtgctccccaaagaccctctatg

SEQ ID NO: 297670 - DNA, 25 bp, Mus musculus
gagtgctgaagaggaagagcagaag

SEQ ID NO: 297671 - DNA, 25 bp, Mus musculus
gagtgctgaagccgagagaaatgtc

SEQ ID NO: 297672 - DNA, 25 bp, Mus musculus
gagtgctgaagccgggaggggcttt

SEQ ID NO: 297673 - DNA, 25 bp, Mus musculus
gagtgctgaagccgtaagggttgga

SEQ ID NO: 297674 - DNA, 25 bp, Mus musculus
gagtgctgcctgagccctaggacca

SEQ ID NO: 297675 - DNA, 25 bp, Mus musculus
gagtgctgcctgaggtagtgactgt

SEQ ID NO: 297676 - DNA, 25 bp, Mus musculus
gagtgctgcgacaaggcccttggac

SEQ ID NO: 297677 - DNA, 25 bp, Mus musculus
gagtgctggacaggccggggcccgc

SEQ ID NO: 297678 - DNA, 25 bp, Mus musculus
gagtgctgggagccgacagggagtt

SEQ ID NO: 297679 - DNA, 25 bp, Mus musculus
gagtgctgggagcctcttagctgct

SEQ ID NO: 297680 - DNA, 25 bp, Mus musculus
gagtgctgggatggggaacatgaca

SEQ ID NO: 297681 - DNA, 25 bp, Mus musculus
gagtgcttatcatcagcaacagcaa

SEQ ID NO: 297682 - DNA, 25 bp, Mus musculus
gagtgcttggcgcgaaaaggtggac

SEQ ID NO: 297683 - DNA, 25 bp, Mus musculus
gagtgcttggcgcgatatgctaatg

SEQ ID NO: 297684 - DNA, 25 bp, Mus musculus
gagtgcttggcgcggtgaaggcgat

SEQ ID NO: 297685 - DNA, 25 bp, Mus musculus
gagtgcttgttcaggtgtcctatgc

SEQ ID NO: 297686 - DNA, 25 bp, Mus musculus
gagtgctttccggaagattcatcgc

SEQ ID NO: 297687 - DNA, 25 bp, Mus musculus
gagtggaacagatcgctgtagtgcc

SEQ ID NO: 297688 - DNA, 25 bp, Mus musculus
gagtggaagagcggagactactgga

SEQ ID NO: 297689 - DNA, 25 bp, Mus musculus
gagtggaagaggaggaaactttggt

SEQ ID NO: 297690 - DNA, 25 bp, Mus musculus
gagtggaagaggaggaactatggtc

SEQ ID NO: 297691 - DNA, 25 bp, Mus musculus
gagtggaagaggaggaccatatggt

SEQ ID NO: 297692 - DNA, 25 bp, Mus musculus
gagtggaaggggttccatgatggag

SEQ ID NO: 297693 - DNA, 25 bp, Mus musculus
gagtggaagtgtgatcaggtgtaag

SEQ ID NO: 297694 - DNA, 25 bp, Mus musculus
gagtggaatgggatgagaaagatga

SEQ ID NO: 297695 - DNA, 25 bp, Mus musculus
gagtggaatggggatggcactggat

SEQ ID NO: 297696 - DNA, 25 bp, Mus musculus
gagtggaatggggcctagccgcccg

SEQ ID NO: 297697 - DNA, 25 bp, Mus musculus
gagtggaatgtcaagatgaagatga

SEQ ID NO: 297698 - DNA, 25 bp, Mus musculus
gagtggaatgtcaagatgttaacga

SEQ ID NO: 297699 - DNA, 25 bp, Mus musculus
gagtggacaggctgaatttgacaaa

SEQ ID NO: 297700 - DNA, 25 bp, Mus musculus
gagtggaccatcaaacagacctttg

SEQ ID NO: 297701 - DNA, 25 bp, Mus musculus
gagtggacccagaggagacttgtgc

SEQ ID NO: 297702 - DNA, 25 bp, Mus musculus
gagtggacccagccccgggaacacc

SEQ ID NO: 297703 - DNA, 25 bp, Mus musculus
gagtggacccagggctgttgggaga

SEQ ID NO: 297704 - DNA, 25 bp, Mus musculus
gagtggagaaaaacgaaaatcttca

SEQ ID NO: 297705 - DNA, 25 bp, Mus musculus
gagtggagaagagatgctggtccct

SEQ ID NO: 297706 - DNA, 25 bp, Mus musculus
gagtggagaagaggatgcccctgtg

SEQ ID NO: 297707 - DNA, 25 bp, Mus musculus
gagtggagaagtatattggattttc

SEQ ID NO: 297708 - DNA, 25 bp, Mus musculus
gagtggagctggacctcggcctagc

SEQ ID NO: 297709 - DNA, 25 bp, Mus musculus
gagtggagctggtctgggactgtgc

SEQ ID NO: 297710 - DNA, 25 bp, Mus musculus
gagtggaggagcagtgccctcagcc

SEQ ID NO: 297711 - DNA, 25 bp, Mus musculus
gagtggaggcgccactgcccacact

SEQ ID NO: 297712 - DNA, 25 bp, Mus musculus
gagtggagtggggacggcagcggct

SEQ ID NO: 297713 - DNA, 25 bp, Mus musculus
gagtggatgttcaattggcttcgtg

SEQ ID NO: 297714 - DNA, 25 bp, Mus musculus
gagtggcaccagtgggaggtctgga

SEQ ID NO: 297715 - DNA, 25 bp, Mus musculus
gagtggcagcaccgggctaaagaag

SEQ ID NO: 297716 - DNA, 25 bp, Mus musculus
gagtggcaggagaaacccaagcctg

SEQ ID NO: 297717 - DNA, 25 bp, Mus musculus
gagtggcaggagaagcgtagaccct

SEQ ID NO: 297718 - DNA, 25 bp, Mus musculus
gagtggcaggagccctggcctgaga

SEQ ID NO: 297719 - DNA, 25 bp, Mus musculus
gagtggcaggaggcctatgtgaacc

SEQ ID NO: 297720 - DNA, 25 bp, Mus musculus
gagtggcaggaggtccggagttcaa

SEQ ID NO: 297721 - DNA, 25 bp, Mus musculus
gagtggcatgttcccaaatagcttt

SEQ ID NO: 297722 - DNA, 25 bp, Mus musculus
gagtggcctcgcatggtcatggtca

SEQ ID NO: 297723 - DNA, 25 bp, Mus musculus
gagtggcctcggtgattgaagtgag

SEQ ID NO: 297724 - DNA, 25 bp, Mus musculus
gagtggccttgaacaggacaggccg

SEQ ID NO: 297725 - DNA, 25 bp, Mus musculus
gagtggctcacttgggtgctggtct

SEQ ID NO: 297726 - DNA, 25 bp, Mus musculus
gagtgggaagatgatcttcccaaac

SEQ ID NO: 297727 - DNA, 25 bp, Mus musculus
gagtgggaagcaaaggctcaagtca

SEQ ID NO: 297728 - DNA, 25 bp, Mus musculus
gagtgggagtgcagattgaaaaatg

SEQ ID NO: 297729 - DNA, 25 bp, Mus musculus
gagtgggccacttgcccatgttacc

SEQ ID NO: 297730 - DNA, 25 bp, Mus musculus
gagtggggaacaggtctttcatagt

SEQ ID NO: 297731 - DNA, 25 bp, Mus musculus
gagtgggggtaagggtggaatgtac

SEQ ID NO: 297732 - DNA, 25 bp, Mus musculus
gagtggggtcccgggctactcttcc

SEQ ID NO: 297733 - DNA, 25 bp, Mus musculus
gagtgggtacagagtataaaggagg

SEQ ID NO: 297734 - DNA, 25 bp, Mus musculus
gagtgggtaccaggcacaggctacc

SEQ ID NO: 297735 - DNA, 25 bp, Mus musculus
gagtgggtggagagcatggggggga

SEQ ID NO: 297736 - DNA, 25 bp, Mus musculus
gagtgggttctgcaggaggagtgat

SEQ ID NO: 297737 - DNA, 25 bp, Mus musculus
gagtggtaaaaagagctgtaataga

SEQ ID NO: 297738 - DNA, 25 bp, Mus musculus
gagtggtacgacatgacaatggatg

SEQ ID NO: 297739 - DNA, 25 bp, Mus musculus
gagtggtccatgtctctttctccag

SEQ ID NO: 297740 - DNA, 25 bp, Mus musculus
gagtggtctcagaagtgccttcaag

SEQ ID NO: 297741 - DNA, 25 bp, Mus musculus
gagtggtgaaggacctcagtgcaga

SEQ ID NO: 297742 - DNA, 25 bp, Mus musculus
gagtggtgcgaggaggtggagccta

SEQ ID NO: 297743 - DNA, 25 bp, Mus musculus
gagtggtggcctgtggtttatggtg

SEQ ID NO: 297744 - DNA, 25 bp, Mus musculus
gagtgtaaattccccttttatgctg

SEQ ID NO: 297745 - DNA, 25 bp, Mus musculus
gagtgtacagcgaccctagggtatg

SEQ ID NO: 297746 - DNA, 25 bp, Mus musculus
gagtgtacagggaccctagggtatg

SEQ ID NO: 297747 - DNA, 25 bp, Mus musculus
gagtgtacgaagcagctccttaatt

SEQ ID NO: 297748 - DNA, 25 bp, Mus musculus
gagtgtactgaggaaagcagaggag

SEQ ID NO: 297749 - DNA, 25 bp, Mus musculus
gagtgtactgaggcatatttaatta

SEQ ID NO: 297750 - DNA, 25 bp, Mus musculus
gagtgtactggatgtttgagacaga

SEQ ID NO: 297751 - DNA, 25 bp, Mus musculus
gagtgtagaattctcactggccggg

SEQ ID NO: 297752 - DNA, 25 bp, Mus musculus
gagtgtaggagaaggtccaacgggc

SEQ ID NO: 297753 - DNA, 25 bp, Mus musculus
gagtgtagtaggtctgttcctgcgc

SEQ ID NO: 297754 - DNA, 25 bp, Mus musculus
gagtgtatgagggccagaacgtctt

SEQ ID NO: 297755 - DNA, 25 bp, Mus musculus
gagtgtcaaaggatcaatgtgacca

SEQ ID NO: 297756 - DNA, 25 bp, Mus musculus
gagtgtcaaagtacttcaactcctg

SEQ ID NO: 297757 - DNA, 25 bp, Mus musculus
gagtgtcaagactgtgatttaccgc

SEQ ID NO: 297758 - DNA, 25 bp, Mus musculus
gagtgtcagagaaggtctcccatgt

SEQ ID NO: 297759 - DNA, 25 bp, Mus musculus
gagtgtcagccagggcggagctaca

SEQ ID NO: 297760 - DNA, 25 bp, Mus musculus
gagtgtcagctacgcaggaagggcc

SEQ ID NO: 297761 - DNA, 25 bp, Mus musculus
gagtgtcagctacgccgatcgggtc

SEQ ID NO: 297762 - DNA, 25 bp, Mus musculus
gagtgtccacagtacctgagaaagg

SEQ ID NO: 297763 - DNA, 25 bp, Mus musculus
gagtgtcctagaatcaataagcttg

SEQ ID NO: 297764 - DNA, 25 bp, Mus musculus
gagtgtcctaggtcttgagagagct

SEQ ID NO: 297765 - DNA, 25 bp, Mus musculus
gagtgtctcccaggctttgaagggc

SEQ ID NO: 297766 - DNA, 25 bp, Mus musculus
gagtgtctctgatcaagagcacctg

SEQ ID NO: 297767 - DNA, 25 bp, Mus musculus
gagtgtctggcaccgtggacttgct

SEQ ID NO: 297768 - DNA, 25 bp, Mus musculus
gagtgtcttaggttcttgtagtgct

SEQ ID NO: 297769 - DNA, 25 bp, Mus musculus
gagtgtcttttctatagatgcccaa

SEQ ID NO: 297770 - DNA, 25 bp, Mus musculus
gagtgtgaaaaaagtcattgaagag

SEQ ID NO: 297771 - DNA, 25 bp, Mus musculus
gagtgtgaactccagggaggttaga

SEQ ID NO: 297772 - DNA, 25 bp, Mus musculus
gagtgtgaagagatccaggcttaca

SEQ ID NO: 297773 - DNA, 25 bp, Mus musculus
gagtgtgacagtgattggaagtgcc

SEQ ID NO: 297774 - DNA, 25 bp, Mus musculus
gagtgtgacgacaagatttgaaaga

SEQ ID NO: 297775 - DNA, 25 bp, Mus musculus
gagtgtgagataacacgtatagggg

SEQ ID NO: 297776 - DNA, 25 bp, Mus musculus
gagtgtgagcctatccgcctccgac

SEQ ID NO: 297777 - DNA, 25 bp, Mus musculus
gagtgtgaggcatgggtgtcagtgc

SEQ ID NO: 297778 - DNA, 25 bp, Mus musculus
gagtgtgcgagcaggtagtcaatac

SEQ ID NO: 297779 - DNA, 25 bp, Mus musculus
gagtgtgcgcctgccccgcgagaaa

SEQ ID NO: 297780 - DNA, 25 bp, Mus musculus
gagtgtgcgctggaggtctaagccg

SEQ ID NO: 297781 - DNA, 25 bp, Mus musculus
gagtgtggaaacagaccacaggatg

SEQ ID NO: 297782 - DNA, 25 bp, Mus musculus
gagtgtggcagtagatgaagaacaa

SEQ ID NO: 297783 - DNA, 25 bp, Mus musculus
gagtgtgtctcaggtggtccacaag

SEQ ID NO: 297784 - DNA, 25 bp, Mus musculus
gagtgtgtgcaaatgacccaggatg

SEQ ID NO: 297785 - DNA, 25 bp, Mus musculus
gagtgtgtgcagcggggagagttag

SEQ ID NO: 297786 - DNA, 25 bp, Mus musculus
gagtgtgtgggaaagggccgatatg

SEQ ID NO: 297787 - DNA, 25 bp, Mus musculus
gagtgtgtgtcgtgctggtctgtgc

SEQ ID NO: 297788 - DNA, 25 bp, Mus musculus
gagtgtgtgtgtcagcggtctgagc

SEQ ID NO: 297789 - DNA, 25 bp, Mus musculus
gagtgtgttgatgtgaacgagtgtg

SEQ ID NO: 297790 - DNA, 25 bp, Mus musculus
gagtgtgttgttgtgaacgagtgtg

SEQ ID NO: 297791 - DNA, 25 bp, Mus musculus
gagtgttcagaaagcgctcctgtta

SEQ ID NO: 297792 - DNA, 25 bp, Mus musculus
gagtgttcggggttaactgctcttt

SEQ ID NO: 297793 - DNA, 25 bp, Mus musculus
gagtgttctgtgcaggtgcagacct

SEQ ID NO: 297794 - DNA, 25 bp, Mus musculus
gagtgttgaacagagaaattagccg

SEQ ID NO: 297795 - DNA, 25 bp, Mus musculus
gagtgttgagagtcctttgctgttt

SEQ ID NO: 297796 - DNA, 25 bp, Mus musculus
gagtgttggaatggtcagcctctca

SEQ ID NO: 297797 - DNA, 25 bp, Mus musculus
gagtgttggcgggccatcccagcat

SEQ ID NO: 297798 - DNA, 25 bp, Mus musculus
gagtgttgtgaggagtccatgaaga

SEQ ID NO: 297799 - DNA, 25 bp, Mus musculus
gagtgtttgctcagtgctggccttt

SEQ ID NO: 297800 - DNA, 25 bp, Mus musculus
gagtgtttggacggtgtgccggact

SEQ ID NO: 297801 - DNA, 25 bp, Mus musculus
gagtgttttcagaatggcttccttt

SEQ ID NO: 297802 - DNA, 25 bp, Mus musculus
gagtgttttctctcttttatttcag

SEQ ID NO: 297803 - DNA, 25 bp, Mus musculus
gagttaaaaatattgagactggaag

SEQ ID NO: 297804 - DNA, 25 bp, Mus musculus
gagttaaaaatattgggtatgaaag

SEQ ID NO: 297805 - DNA, 25 bp, Mus musculus
gagttaagagaggtaatagaattgc

SEQ ID NO: 297806 - DNA, 25 bp, Mus musculus
gagttaatcttgtctcctcgaagat

SEQ ID NO: 297807 - DNA, 25 bp, Mus musculus
gagttaatcttgtctcttctcacag

SEQ ID NO: 297808 - DNA, 25 bp, Mus musculus
gagttaatcttgtttgagtcttcag

SEQ ID NO: 297809 - DNA, 25 bp, Mus musculus
gagttaatgaggggtattcagagtg

SEQ ID NO: 297810 - DNA, 25 bp, Mus musculus
gagttacaccaactttctgggctaa

SEQ ID NO: 297811 - DNA, 25 bp, Mus musculus
gagttacaccaagtttctgggctaa

SEQ ID NO: 297812 - DNA, 25 bp, Mus musculus
gagttacagaaggtttggaggtacc

SEQ ID NO: 297813 - DNA, 25 bp, Mus musculus
gagttacaggggcccagactgatct

SEQ ID NO: 297814 - DNA, 25 bp, Mus musculus
gagttacagggtatttttcttactc

SEQ ID NO: 297815 - DNA, 25 bp, Mus musculus
gagttacatgtatgatttctgtaca

SEQ ID NO: 297816 - DNA, 25 bp, Mus musculus
gagttaccaagagtaaggacgagtc

SEQ ID NO: 297817 - DNA, 25 bp, Mus musculus
gagttaccgtaatggacggatcttt

SEQ ID NO: 297818 - DNA, 25 bp, Mus musculus
gagttacttagtggagagaacagat

SEQ ID NO: 297819 - DNA, 25 bp, Mus musculus
gagttacttagtggtgagacgtgga

SEQ ID NO: 297820 - DNA, 25 bp, Mus musculus
gagttagaaaagccatagattgtaa

SEQ ID NO: 297821 - DNA, 25 bp, Mus musculus
gagttagaaaagctatagagaagtc

SEQ ID NO: 297822 - DNA, 25 bp, Mus musculus
gagttagaagctctgaatgacaaaa

SEQ ID NO: 297823 - DNA, 25 bp, Mus musculus
gagttagagaaggctcatacaacac

SEQ ID NO: 297824 - DNA, 25 bp, Mus musculus
gagttagagacaaaggttctaatca

SEQ ID NO: 297825 - DNA, 25 bp, Mus musculus
gagttagagagagagagagagacaa

SEQ ID NO: 297826 - DNA, 25 bp, Mus musculus
gagttagccagaatggagaatggag

SEQ ID NO: 297827 - DNA, 25 bp, Mus musculus
gagttaggaaaggaaagcactgcca

SEQ ID NO: 297828 - DNA, 25 bp, Mus musculus
gagttagtggccagggttgaagaca

SEQ ID NO: 297829 - DNA, 25 bp, Mus musculus
gagttataccaaattcttctggaat

SEQ ID NO: 297830 - DNA, 25 bp, Mus musculus
gagttataccaaattgaaaagatat

SEQ ID NO: 297831 - DNA, 25 bp, Mus musculus
gagttatgatgaggccaagcacgtg

SEQ ID NO: 297832 - DNA, 25 bp, Mus musculus
gagttattaggatgcctggtgtgca

SEQ ID NO: 297833 - DNA, 25 bp, Mus musculus
gagttattaggcacatgactcaggg

SEQ ID NO: 297834 - DNA, 25 bp, Mus musculus
gagttatttagacaagatcctgagg

SEQ ID NO: 297835 - DNA, 25 bp, Mus musculus
gagttattttggggaaggatattca

SEQ ID NO: 297836 - DNA, 25 bp, Mus musculus
gagttcaaaaccaagattaattgcc

SEQ ID NO: 297837 - DNA, 25 bp, Mus musculus
gagttcaaacatacagctttgtacc

SEQ ID NO: 297838 - DNA, 25 bp, Mus musculus
gagttcaactgcgagatgaaatgga

SEQ ID NO: 297839 - DNA, 25 bp, Mus musculus
gagttcaaggccaagatccgggact

SEQ ID NO: 297840 - DNA, 25 bp, Mus musculus
gagttcaaggccaagggtctactat

SEQ ID NO: 297841 - DNA, 25 bp, Mus musculus
gagttcaatgagcggtttgagtggg

SEQ ID NO: 297842 - DNA, 25 bp, Mus musculus
gagttcacagaaacttcgtggcagc

SEQ ID NO: 297843 - DNA, 25 bp, Mus musculus
gagttcacagagcatgcaacccaca

SEQ ID NO: 297844 - DNA, 25 bp, Mus musculus
gagttcacagagttctcagtatgtg

SEQ ID NO: 297845 - DNA, 25 bp, Mus musculus
gagttcacagcatgaaggactttcg

SEQ ID NO: 297846 - DNA, 25 bp, Mus musculus
gagttcacagcgcactgtttgattg

SEQ ID NO: 297847 - DNA, 25 bp, Mus musculus
gagttcacccggaaggccctcaatg

SEQ ID NO: 297848 - DNA, 25 bp, Mus musculus
gagttcactgaacagacagctccga

SEQ ID NO: 297849 - DNA, 25 bp, Mus musculus
gagttcagaagaggatgactgagtg

SEQ ID NO: 297850 - DNA, 25 bp, Mus musculus
gagttcagagacctcaacgaatccg

SEQ ID NO: 297851 - DNA, 25 bp, Mus musculus
gagttcagcaagctttgcagccagc

SEQ ID NO: 297852 - DNA, 25 bp, Mus musculus
gagttcagcagaggagacagcagtg

SEQ ID NO: 297853 - DNA, 25 bp, Mus musculus
gagttcagtgacagattgctgttct

SEQ ID NO: 297854 - DNA, 25 bp, Mus musculus
gagttcagtgatgacttggatgttg

SEQ ID NO: 297855 - DNA, 25 bp, Mus musculus
gagttcatcacgactgtgcaacagc

SEQ ID NO: 297856 - DNA, 25 bp, Mus musculus
gagttcatcgatggctaaagtaaaa

SEQ ID NO: 297857 - DNA, 25 bp, Mus musculus
gagttcatcgatgtctacttcattg

SEQ ID NO: 297858 - DNA, 25 bp, Mus musculus
gagttcatgaaagatcgattatatt

SEQ ID NO: 297859 - DNA, 25 bp, Mus musculus
gagttcatgaaggaagcgggtgcag

SEQ ID NO: 297860 - DNA, 25 bp, Mus musculus
gagttcatgaaggaggatttcgatg

SEQ ID NO: 297861 - DNA, 25 bp, Mus musculus
gagttcatgacaagtgggccaatcc

SEQ ID NO: 297862 - DNA, 25 bp, Mus musculus
gagttcatgcactttgccacaggca

SEQ ID NO: 297863 - DNA, 25 bp, Mus musculus
gagttcattgcaattcttggccaca

SEQ ID NO: 297864 - DNA, 25 bp, Mus musculus
gagttccaagcagcatgggtcggag

SEQ ID NO: 297865 - DNA, 25 bp, Mus musculus
gagttccacacccaggttctgattg

SEQ ID NO: 297866 - DNA, 25 bp, Mus musculus
gagttccacagaggttctatggtac

SEQ ID NO: 297867 - DNA, 25 bp, Mus musculus
gagttccactgggctcccatcctgt

SEQ ID NO: 297868 - DNA, 25 bp, Mus musculus
gagttccagaagaagaaataaagtg

SEQ ID NO: 297869 - DNA, 25 bp, Mus musculus
gagttcccagatgaagaaactgaaa

SEQ ID NO: 297870 - DNA, 25 bp, Mus musculus
gagttcccagtcagacactgcatat

SEQ ID NO: 297871 - DNA, 25 bp, Mus musculus
gagttcccagtcagagctctgaaca

SEQ ID NO: 297872 - DNA, 25 bp, Mus musculus
gagttcccatgttgttgctggttgt

SEQ ID NO: 297873 - DNA, 25 bp, Mus musculus
gagttccctcctggccttcccagag

SEQ ID NO: 297874 - DNA, 25 bp, Mus musculus
gagttcccttctggccttcccagag

SEQ ID NO: 297875 - DNA, 25 bp, Mus musculus
gagttcctgaaggttgctagacctg

SEQ ID NO: 297876 - DNA, 25 bp, Mus musculus
gagttcgaataccggcatgtcatgt

SEQ ID NO: 297877 - DNA, 25 bp, Mus musculus
gagttcgaattgctctggcgttaaa

SEQ ID NO: 297878 - DNA, 25 bp, Mus musculus
gagttcgaattgttcactgaggaat

SEQ ID NO: 297879 - DNA, 25 bp, Mus musculus
gagttcgatgttcaggagcaggata

SEQ ID NO: 297880 - DNA, 25 bp, Mus musculus
gagttcgatgttcagggcaaccgtc

SEQ ID NO: 297881 - DNA, 25 bp, Mus musculus
gagttcgcaggagggcgaagagaaa

SEQ ID NO: 297882 - DNA, 25 bp, Mus musculus
gagttcgtgcccaaggttgtccaga

SEQ ID NO: 297883 - DNA, 25 bp, Mus musculus
gagttctaccgcagtggctgggcac

SEQ ID NO: 297884 - DNA, 25 bp, Mus musculus
gagttctccagagccaaggctgttg

SEQ ID NO: 297885 - DNA, 25 bp, Mus musculus
gagttctctagaaccaggcagcggg

SEQ ID NO: 297886 - DNA, 25 bp, Mus musculus
gagttctctctaaacctttgacatg

SEQ ID NO: 297887 - DNA, 25 bp, Mus musculus
gagttctctgtaagtgcctggtgaa

SEQ ID NO: 297888 - DNA, 25 bp, Mus musculus
gagttctgactgcgacatttacatt

SEQ ID NO: 297889 - DNA, 25 bp, Mus musculus
gagttctgactgcggttgaaatggg

SEQ ID NO: 297890 - DNA, 25 bp, Mus musculus
gagttctgccagtgtgattttgaca

SEQ ID NO: 297891 - DNA, 25 bp, Mus musculus
gagttctggctcagatgcgattcat

SEQ ID NO: 297892 - DNA, 25 bp, Mus musculus
gagttctgggagaacaaagtattga

SEQ ID NO: 297893 - DNA, 25 bp, Mus musculus
gagttctgttgcaagcctacttctc

SEQ ID NO: 297894 - DNA, 25 bp, Mus musculus
gagttctgttgcaaggtgatctctg

SEQ ID NO: 297895 - DNA, 25 bp, Mus musculus
gagttcttctggcaccagcccatca

SEQ ID NO: 297896 - DNA, 25 bp, Mus musculus
gagttcttgtgggaagcattcaact

SEQ ID NO: 297897 - DNA, 25 bp, Mus musculus
gagttcttgtgggggatgcttggcc

SEQ ID NO: 297898 - DNA, 25 bp, Mus musculus
gagttcttgtgggtggccatgcaga

SEQ ID NO: 297899 - DNA, 25 bp, Mus musculus
gagttcttgtttcaggaaatggctg

SEQ ID NO: 297900 - DNA, 25 bp, Mus musculus
gagttcttgtttcaggacttcctcc

SEQ ID NO: 297901 - DNA, 25 bp, Mus musculus
gagttctttctgaggtgtcagatgc

SEQ ID NO: 297902 - DNA, 25 bp, Mus musculus
gagttgaaagattcccccacagcgc

SEQ ID NO: 297903 - DNA, 25 bp, Mus musculus
gagttgaaaggagtgagcagcggcc

SEQ ID NO: 297904 - DNA, 25 bp, Mus musculus
gagttgaggcctgggtgtgcattat

SEQ ID NO: 297905 - DNA, 25 bp, Mus musculus
gagttgcaagaccatagtctgtgtg

SEQ ID NO: 297906 - DNA, 25 bp, Mus musculus
gagttgcacggatgttctgagcccc

SEQ ID NO: 297907 - DNA, 25 bp, Mus musculus
gagttgcagagaaccccaaaggtac

SEQ ID NO: 297908 - DNA, 25 bp, Mus musculus
gagttgcagagacctcagacagctc

SEQ ID NO: 297909 - DNA, 25 bp, Mus musculus
gagttgcagtcctatcttcagagcc

SEQ ID NO: 297910 - DNA, 25 bp, Mus musculus
gagttgccctgactctaccgcaccc

SEQ ID NO: 297911 - DNA, 25 bp, Mus musculus
gagttgcctacatgtagctgagacc

SEQ ID NO: 297912 - DNA, 25 bp, Mus musculus
gagttgcgagcgaatacaggaggag

SEQ ID NO: 297913 - DNA, 25 bp, Mus musculus
gagttgcgaggccaggtggttgcag

SEQ ID NO: 297914 - DNA, 25 bp, Mus musculus
gagttgctaaaactgccttggggtg

SEQ ID NO: 297915 - DNA, 25 bp, Mus musculus
gagttgctaaaagtgcctcctgaga

SEQ ID NO: 297916 - DNA, 25 bp, Mus musculus
gagttgctgctgattttcatttcct

SEQ ID NO: 297917 - DNA, 25 bp, Mus musculus
gagttgctgctggtgccagggtgtc

SEQ ID NO: 297918 - DNA, 25 bp, Mus musculus
gagttgctggaaaatctggatgact

SEQ ID NO: 297919 - DNA, 25 bp, Mus musculus
gagttgctggaacagattttctctg

SEQ ID NO: 297920 - DNA, 25 bp, Mus musculus
gagttgctgggagacattgggggac

SEQ ID NO: 297921 - DNA, 25 bp, Mus musculus
gagttggaaaaggagaagctacttg

SEQ ID NO: 297922 - DNA, 25 bp, Mus musculus
gagttggaagcctcgtcttccctgg

SEQ ID NO: 297923 - DNA, 25 bp, Mus musculus
gagttggaaggaaggcttgcaaaga

SEQ ID NO: 297924 - DNA, 25 bp, Mus musculus
gagttggaagggagctagctcatga

SEQ ID NO: 297925 - DNA, 25 bp, Mus musculus
gagttggaaggtcatagaactctgt

SEQ ID NO: 297926 - DNA, 25 bp, Mus musculus
gagttggaatcagggctacggctac

SEQ ID NO: 297927 - DNA, 25 bp, Mus musculus
gagttggagatgtgggctgcgaccc

SEQ ID NO: 297928 - DNA, 25 bp, Mus musculus
gagttggagatgtgtccagaccttt

SEQ ID NO: 297929 - DNA, 25 bp, Mus musculus
gagttggcaggaagaaaatgccgcc

SEQ ID NO: 297930 - DNA, 25 bp, Mus musculus
gagttggcaggaatagtgggcagcc

SEQ ID NO: 297931 - DNA, 25 bp, Mus musculus
gagttggcagtcacaaactcgcaga

SEQ ID NO: 297932 - DNA, 25 bp, Mus musculus
gagttggcgattagactctgccttc

SEQ ID NO: 297933 - DNA, 25 bp, Mus musculus
gagttggcgattagaggtctgacat

SEQ ID NO: 297934 - DNA, 25 bp, Mus musculus
gagttgggaagagtgccatgacaat

SEQ ID NO: 297935 - DNA, 25 bp, Mus musculus
gagttgggaagagtgtgtcctgagt

SEQ ID NO: 297936 - DNA, 25 bp, Mus musculus
gagttggtaaatgtttatggagccg

SEQ ID NO: 297937 - DNA, 25 bp, Mus musculus
gagttggtaatggagcccgagttcg

SEQ ID NO: 297938 - DNA, 25 bp, Mus musculus
gagttggtaggtgcgccaaacagtg

SEQ ID NO: 297939 - DNA, 25 bp, Mus musculus
gagttggtcaagtgcatcgaggagt

SEQ ID NO: 297940 - DNA, 25 bp, Mus musculus
gagttggtccatatatttcttctga

SEQ ID NO: 297941 - DNA, 25 bp, Mus musculus
gagttggtgaagaaacttgtggaaa

SEQ ID NO: 297942 - DNA, 25 bp, Mus musculus
gagttggtgtggaggctcatctcag

SEQ ID NO: 297943 - DNA, 25 bp, Mus musculus
gagttggtgtggaggggctcctctg

SEQ ID NO: 297944 - DNA, 25 bp, Mus musculus
gagttggttcaggtggaacatccag

SEQ ID NO: 297945 - DNA, 25 bp, Mus musculus
gagttggttcagtatcctgtggaac

SEQ ID NO: 297946 - DNA, 25 bp, Mus musculus
gagttgtcaggtaaagatgagcctt

SEQ ID NO: 297947 - DNA, 25 bp, Mus musculus
gagttgtccaagattttaccggaag

SEQ ID NO: 297948 - DNA, 25 bp, Mus musculus
gagttgtccaaggaatgtggcttcg

SEQ ID NO: 297949 - DNA, 25 bp, Mus musculus
gagttgtgaggagatcccccaagag

SEQ ID NO: 297950 - DNA, 25 bp, Mus musculus
gagttgtgatcttattaattggagg

SEQ ID NO: 297951 - DNA, 25 bp, Mus musculus
gagtttaaagatgtcattgtccctg

SEQ ID NO: 297952 - DNA, 25 bp, Mus musculus
gagtttaaagtgtcgtgttctgaaa

SEQ ID NO: 297953 - DNA, 25 bp, Mus musculus
gagtttacagagaggaccatctgcg

SEQ ID NO: 297954 - DNA, 25 bp, Mus musculus
gagtttatggatccgcctccgactc

SEQ ID NO: 297955 - DNA, 25 bp, Mus musculus
gagtttcaaggcaaacgaatgcacg

SEQ ID NO: 297956 - DNA, 25 bp, Mus musculus
gagtttcaaggcaaacgaatgcatg

SEQ ID NO: 297957 - DNA, 25 bp, Mus musculus
gagtttcaaggcagcagtgaatgca

SEQ ID NO: 297958 - DNA, 25 bp, Mus musculus
gagtttcaaggtgggatgtgtgtgg

SEQ ID NO: 297959 - DNA, 25 bp, Mus musculus
gagtttcacaagtggatagagagag

SEQ ID NO: 297960 - DNA, 25 bp, Mus musculus
gagtttcagccctcagtggaccctg

SEQ ID NO: 297961 - DNA, 25 bp, Mus musculus
gagtttccaaaagctcctggctaga

SEQ ID NO: 297962 - DNA, 25 bp, Mus musculus
gagtttccagagccctgaagacaag

SEQ ID NO: 297963 - DNA, 25 bp, Mus musculus
gagtttcccccacttacagactgaa

SEQ ID NO: 297964 - DNA, 25 bp, Mus musculus
gagtttcctagattgcttcctgagg

SEQ ID NO: 297965 - DNA, 25 bp, Mus musculus
gagtttcctctacagacagaccctg

SEQ ID NO: 297966 - DNA, 25 bp, Mus musculus
gagtttcctctacaggggacctggc

SEQ ID NO: 297967 - DNA, 25 bp, Mus musculus
gagtttcctggagaaggaacttggg

SEQ ID NO: 297968 - DNA, 25 bp, Mus musculus
gagtttcctgggagaaacactcatc

SEQ ID NO: 297969 - DNA, 25 bp, Mus musculus
gagtttcctgttcggaacctggact

SEQ ID NO: 297970 - DNA, 25 bp, Mus musculus
gagtttctagcctcaaagcggaggg

SEQ ID NO: 297971 - DNA, 25 bp, Mus musculus
gagtttctatgccgatcaaaaggaa

SEQ ID NO: 297972 - DNA, 25 bp, Mus musculus
gagtttctcagtgacatcactgagg

SEQ ID NO: 297973 - DNA, 25 bp, Mus musculus
gagtttctgcttgatgtcctagaag

SEQ ID NO: 297974 - DNA, 25 bp, Mus musculus
gagtttcttgtaatagggcccagtg

SEQ ID NO: 297975 - DNA, 25 bp, Mus musculus
gagtttctttctgcctgcacatttc

SEQ ID NO: 297976 - DNA, 25 bp, Mus musculus
gagtttcttttggaggtgcagtgta

SEQ ID NO: 297977 - DNA, 25 bp, Mus musculus
gagtttgaaaggatgtcttccaagc

SEQ ID NO: 297978 - DNA, 25 bp, Mus musculus
gagtttgacaagatgaatgaccagg

SEQ ID NO: 297979 - DNA, 25 bp, Mus musculus
gagtttgaggaggctcaacgcacag

SEQ ID NO: 297980 - DNA, 25 bp, Mus musculus
gagtttgcagaggatgacgtcagtg

SEQ ID NO: 297981 - DNA, 25 bp, Mus musculus
gagtttgcagaggtgctggaaatgg

SEQ ID NO: 297982 - DNA, 25 bp, Mus musculus
gagtttgcattccgcttgcttccca

SEQ ID NO: 297983 - DNA, 25 bp, Mus musculus
gagtttgccgcagccagccctctgc

SEQ ID NO: 297984 - DNA, 25 bp, Mus musculus
gagtttgccgcaggcccggcacagt

SEQ ID NO: 297985 - DNA, 25 bp, Mus musculus
gagtttgctcagaagtttacagagc

SEQ ID NO: 297986 - DNA, 25 bp, Mus musculus
gagtttggagagtggatggcaggag

SEQ ID NO: 297987 - DNA, 25 bp, Mus musculus
gagtttggcagagtatacgaagcag

SEQ ID NO: 297988 - DNA, 25 bp, Mus musculus
gagtttggcagtgtcaaaggtcccc

SEQ ID NO: 297989 - DNA, 25 bp, Mus musculus
gagtttgggagaccgagctcagcag

SEQ ID NO: 297990 - DNA, 25 bp, Mus musculus
gagtttggtctctggtggaattggg

SEQ ID NO: 297991 - DNA, 25 bp, Mus musculus
gagtttgtatcttcgggctcgctgc

SEQ ID NO: 297992 - DNA, 25 bp, Mus musculus
gagttttaggaaagatataccgcat

SEQ ID NO: 297993 - DNA, 25 bp, Mus musculus
gagttttatgagaggaacctgtctt

SEQ ID NO: 297994 - DNA, 25 bp, Mus musculus
gagttttatgagcagggcgatgaag

SEQ ID NO: 297995 - DNA, 25 bp, Mus musculus
gagttttcaatcccagttacatttc

SEQ ID NO: 297996 - DNA, 25 bp, Mus musculus
gagttttcaatcccagttatcttga

SEQ ID NO: 297997 - DNA, 25 bp, Mus musculus
gagttttctgccagattcaagaacc

SEQ ID NO: 297998 - DNA, 25 bp, Mus musculus
gagttttgaagcactaggttcacgc

SEQ ID NO: 297999 - DNA, 25 bp, Mus musculus
gagttttggccaagatccccagcct

SEQ ID NO: 298000 - DNA, 25 bp, Mus musculus
gagttttgtcaagacaatggattct

SEQ ID NO: 298001 - DNA, 25 bp, Mus musculus
gagttttgtgagcaccttcagcttt

SEQ ID NO: 298002 - DNA, 25 bp, Mus musculus
gagttttgtgcagagattaagcaca

SEQ ID NO: 298003 - DNA, 25 bp, Mus musculus
gagttttgttttgttatgaatgcag

SEQ ID NO: 298004 - DNA, 25 bp, Mus musculus
gagtttttagatattatgagaagaa

SEQ ID NO: 298005 - DNA, 25 bp, Mus musculus
gagtttttcacagatcactggtgtt

SEQ ID NO: 298006 - DNA, 25 bp, Mus musculus
gagtttttcacctatctgggggcac

SEQ ID NO: 298007 - DNA, 25 bp, Mus musculus
gataaaaaataaggctcatcctaaa

SEQ ID NO: 298008 - DNA, 25 bp, Mus musculus
gataaaaacagaaggcgaaggacga

SEQ ID NO: 298009 - DNA, 25 bp, Mus musculus
gataaaaagaaacggcggctggcaa

SEQ ID NO: 298010 - DNA, 25 bp, Mus musculus
gataaaaagcaggggttccttgtgg

SEQ ID NO: 298011 - DNA, 25 bp, Mus musculus
gataaaacatgctggaggcattcca

SEQ ID NO: 298012 - DNA, 25 bp, Mus musculus
gataaaacatggcattctgcatttg

SEQ ID NO: 298013 - DNA, 25 bp, Mus musculus
gataaaaccacgactccagatgtag

SEQ ID NO: 298014 - DNA, 25 bp, Mus musculus
gataaaaccaggtttgcttatgatg

SEQ ID NO: 298015 - DNA, 25 bp, Mus musculus
gataaaactggggttcgcaacgttc

SEQ ID NO: 298016 - DNA, 25 bp, Mus musculus
gataaaactgggtggtcatatgctt

SEQ ID NO: 298017 - DNA, 25 bp, Mus musculus
gataaaagcatcaggcaagaggcaa

SEQ ID NO: 298018 - DNA, 25 bp, Mus musculus
gataaaagcatcagttgtgactgtg

SEQ ID NO: 298019 - DNA, 25 bp, Mus musculus
gataaaagctgaagtgaagtctggc

SEQ ID NO: 298020 - DNA, 25 bp, Mus musculus
gataaaatcaagatgtctgttggtg

SEQ ID NO: 298021 - DNA, 25 bp, Mus musculus
gataaaatggagagaggtaagaagt

SEQ ID NO: 298022 - DNA, 25 bp, Mus musculus
gataaaatggagagtctggatgtgg

SEQ ID NO: 298023 - DNA, 25 bp, Mus musculus
gataaaattctggagctggaggaga

SEQ ID NO: 298024 - DNA, 25 bp, Mus musculus
gataaacagcaacgttttacaaacc

SEQ ID NO: 298025 - DNA, 25 bp, Mus musculus
gataaacccagctccctacactatc

SEQ ID NO: 298026 - DNA, 25 bp, Mus musculus
gataaacgagcaagcttctacatac

SEQ ID NO: 298027 - DNA, 25 bp, Mus musculus
gataaactcaaggaggcagagaccc

SEQ ID NO: 298028 - DNA, 25 bp, Mus musculus
gataaacttgaaagatgacagtccc

SEQ ID NO: 298029 - DNA, 25 bp, Mus musculus
gataaagatgttaggggagcttctg

SEQ ID NO: 298030 - DNA, 25 bp, Mus musculus
gataaagcacttggggccctagaga

SEQ ID NO: 298031 - DNA, 25 bp, Mus musculus
gataaagcagaggagactctaacac

SEQ ID NO: 298032 - DNA, 25 bp, Mus musculus
gataaagcgaggctgaaaggaaatg

SEQ ID NO: 298033 - DNA, 25 bp, Mus musculus
gataaagcgagtttcactttcaggc

SEQ ID NO: 298034 - DNA, 25 bp, Mus musculus
gataaaggaccctgatgctaagaag

SEQ ID NO: 298035 - DNA, 25 bp, Mus musculus
gataaaggagattgaggacggctgg

SEQ ID NO: 298036 - DNA, 25 bp, Mus musculus
gataaaggaggccttggaaatacag

SEQ ID NO: 298037 - DNA, 25 bp, Mus musculus
gataaagggtgaggtgtgccaaaga

SEQ ID NO: 298038 - DNA, 25 bp, Mus musculus
gataaagggtgagttttatgtgata

SEQ ID NO: 298039 - DNA, 25 bp, Mus musculus
gataaagttcacctcctggctatta

SEQ ID NO: 298040 - DNA, 25 bp, Mus musculus
gataaagttcacgtcctggctatta

SEQ ID NO: 298041 - DNA, 25 bp, Mus musculus
gataaagttttgagagaagcagaag

SEQ ID NO: 298042 - DNA, 25 bp, Mus musculus
gataaagtttttggaagctttgctg

SEQ ID NO: 298043 - DNA, 25 bp, Mus musculus
gataaagtttttggtatgctggtgt

SEQ ID NO: 298044 - DNA, 25 bp, Mus musculus
gataaataagagggcaatgcgagca

SEQ ID NO: 298045 - DNA, 25 bp, Mus musculus
gataaataattaaggaaagggctgt

SEQ ID NO: 298046 - DNA, 25 bp, Mus musculus
gataaataggagctccaccccaggc

SEQ ID NO: 298047 - DNA, 25 bp, Mus musculus
gataaatcagatgttttcggtgcag

SEQ ID NO: 298048 - DNA, 25 bp, Mus musculus
gataaatcagcttctctccacgata

SEQ ID NO: 298049 - DNA, 25 bp, Mus musculus
gataaatgaggacatagcattgttg

SEQ ID NO: 298050 - DNA, 25 bp, Mus musculus
gataacaaaaaggccctaggcctga

SEQ ID NO: 298051 - DNA, 25 bp, Mus musculus
gataacaaaaaggtgatgaaggact

SEQ ID NO: 298052 - DNA, 25 bp, Mus musculus
gataacaacgtctatttttattcca

SEQ ID NO: 298053 - DNA, 25 bp, Mus musculus
gataacaagaacactccagggtttc

SEQ ID NO: 298054 - DNA, 25 bp, Mus musculus
gataacacaggccatggcgcaggct

SEQ ID NO: 298055 - DNA, 25 bp, Mus musculus
gataacacaggtgccttcttcacaa

SEQ ID NO: 298056 - DNA, 25 bp, Mus musculus
gataacagagcaacccgatagcaga

SEQ ID NO: 298057 - DNA, 25 bp, Mus musculus
gataacagagcatacaagcaatgac

SEQ ID NO: 298058 - DNA, 25 bp, Mus musculus
gataacagagtcaatccccttctgc

SEQ ID NO: 298059 - DNA, 25 bp, Mus musculus
gataacagcaatggcctccaactgg

SEQ ID NO: 298060 - DNA, 25 bp, Mus musculus
gataacagcaatgggccaccagaat

SEQ ID NO: 298061 - DNA, 25 bp, Mus musculus
gataacatacccagtgccttgccat

SEQ ID NO: 298062 - DNA, 25 bp, Mus musculus
gataacatacccagtgtgtcatcaa

SEQ ID NO: 298063 - DNA, 25 bp, Mus musculus
gataacatgagcatcatcagctggt

SEQ ID NO: 298064 - DNA, 25 bp, Mus musculus
gataaccacggctctgaagcgtcac

SEQ ID NO: 298065 - DNA, 25 bp, Mus musculus
gataaccacgtctctgggtccttac

SEQ ID NO: 298066 - DNA, 25 bp, Mus musculus
gataacccaggctgcatgagtggtg

SEQ ID NO: 298067 - DNA, 25 bp, Mus musculus
gataacccggcactgaatgcacagg

SEQ ID NO: 298068 - DNA, 25 bp, Mus musculus
gataacctaagtaccagcagtgctg

SEQ ID NO: 298069 - DNA, 25 bp, Mus musculus
gataacgaacggtaccatggttgtt

SEQ ID NO: 298070 - DNA, 25 bp, Mus musculus
gataacggagttggtgaatgatacc

SEQ ID NO: 298071 - DNA, 25 bp, Mus musculus
gataacgtacacagatatgaggaat

SEQ ID NO: 298072 - DNA, 25 bp, Mus musculus
gataacgtacacaggtttgcagcta

SEQ ID NO: 298073 - DNA, 25 bp, Mus musculus
gataactacttgcagattctcttct

SEQ ID NO: 298074 - DNA, 25 bp, Mus musculus
gataactacttgcaggccacagaca

SEQ ID NO: 298075 - DNA, 25 bp, Mus musculus
gataactcaatgggatttggtgcag

SEQ ID NO: 298076 - DNA, 25 bp, Mus musculus
gataactcaattcctctattgtatg

SEQ ID NO: 298077 - DNA, 25 bp, Mus musculus
gataactcagcaggaactatgaatg

SEQ ID NO: 298078 - DNA, 25 bp, Mus musculus
gataactcggagcagaaatgcatcg

SEQ ID NO: 298079 - DNA, 25 bp, Mus musculus
gataactcggagcagatcggtgcag

SEQ ID NO: 298080 - DNA, 25 bp, Mus musculus
gataactctctggacgcccctgtga

SEQ ID NO: 298081 - DNA, 25 bp, Mus musculus
gataactgggaggatgagccccaag

SEQ ID NO: 298082 - DNA, 25 bp, Mus musculus
gataacttaaagagtatagaaatat

SEQ ID NO: 298083 - DNA, 25 bp, Mus musculus
gataacttctttgaggaggtattca

SEQ ID NO: 298084 - DNA, 25 bp, Mus musculus
gataagaaagatggcttgccagtag

SEQ ID NO: 298085 - DNA, 25 bp, Mus musculus
gataagaaatcttggccaggaccct

SEQ ID NO: 298086 - DNA, 25 bp, Mus musculus
gataagaaccagactgcagagaagg

SEQ ID NO: 298087 - DNA, 25 bp, Mus musculus
gataagaaccagagaaggaagaatt

SEQ ID NO: 298088 - DNA, 25 bp, Mus musculus
gataagaaccagtactgggttgaat

SEQ ID NO: 298089 - DNA, 25 bp, Mus musculus
gataagaatccatttgatgaagctc

SEQ ID NO: 298090 - DNA, 25 bp, Mus musculus
gataagacagatatgaaccgacacc

SEQ ID NO: 298091 - DNA, 25 bp, Mus musculus
gataagaccatcagattatgggaca

SEQ ID NO: 298092 - DNA, 25 bp, Mus musculus
gataagacccagcagaataactgcc

SEQ ID NO: 298093 - DNA, 25 bp, Mus musculus
gataagagatatgccagaatttcag

SEQ ID NO: 298094 - DNA, 25 bp, Mus musculus
gataagagcacagcttctccagcct

SEQ ID NO: 298095 - DNA, 25 bp, Mus musculus
gataagagcacagtgctggctgcga

SEQ ID NO: 298096 - DNA, 25 bp, Mus musculus
gataagagcgttctctggtgcaagt

SEQ ID NO: 298097 - DNA, 25 bp, Mus musculus
gataagagtgcagctcagagacatg

SEQ ID NO: 298098 - DNA, 25 bp, Mus musculus
gataagatcctctcggtaaatggcc

SEQ ID NO: 298099 - DNA, 25 bp, Mus musculus
gataagatgaaggctcacagcgagt

SEQ ID NO: 298100 - DNA, 25 bp, Mus musculus
gataagattgagaacctagctagca

SEQ ID NO: 298101 - DNA, 25 bp, Mus musculus
gataagcaatcaaagcttatttcca

SEQ ID NO: 298102 - DNA, 25 bp, Mus musculus
gataagcaatcaaaggtgagacgac

SEQ ID NO: 298103 - DNA, 25 bp, Mus musculus
gataagcaccggcctctggaaatgt

SEQ ID NO: 298104 - DNA, 25 bp, Mus musculus
gataagccatcaggtccatggagag

SEQ ID NO: 298105 - DNA, 25 bp, Mus musculus
gataagctaaaagaattgggatatg

SEQ ID NO: 298106 - DNA, 25 bp, Mus musculus
gataagctaaaagcatggctgctcg

SEQ ID NO: 298107 - DNA, 25 bp, Mus musculus
gataagctctgacttcagaacatga

SEQ ID NO: 298108 - DNA, 25 bp, Mus musculus
gataagctctggggatgaagagatg

SEQ ID NO: 298109 - DNA, 25 bp, Mus musculus
gataagctgtactacgtaaccacca

SEQ ID NO: 298110 - DNA, 25 bp, Mus musculus
gataaggaaaaggggctgtctacag

SEQ ID NO: 298111 - DNA, 25 bp, Mus musculus
gataaggagcagaatgagaagactt

SEQ ID NO: 298112 - DNA, 25 bp, Mus musculus
gataaggctcagagagtctgcagga

SEQ ID NO: 298113 - DNA, 25 bp, Mus musculus
gataagtatgggagtgaaggatata

SEQ ID NO: 298114 - DNA, 25 bp, Mus musculus
gataagtatgggtggtactgcagaa

SEQ ID NO: 298115 - DNA, 25 bp, Mus musculus
gataagtcagatgaatgagaacagc

SEQ ID NO: 298116 - DNA, 25 bp, Mus musculus
gataagttgtgtgccaccatttgaa

SEQ ID NO: 298117 - DNA, 25 bp, Mus musculus
gataagttgtgtgccattgctgctg

SEQ ID NO: 298118 - DNA, 25 bp, Mus musculus
gataagtttgaggtattctgctatg

SEQ ID NO: 298119 - DNA, 25 bp, Mus musculus
gataataaacaaatttctttcaact

SEQ ID NO: 298120 - DNA, 25 bp, Mus musculus
gataataaagaagaagtaccagctc

SEQ ID NO: 298121 - DNA, 25 bp, Mus musculus
gataataaagatatccaattgtccc

SEQ ID NO: 298122 - DNA, 25 bp, Mus musculus
gataataaaggtagtggatggctct

SEQ ID NO: 298123 - DNA, 25 bp, Mus musculus
gataataaagtacaaaatggttctt

SEQ ID NO: 298124 - DNA, 25 bp, Mus musculus
gataataccaggattgtctacaacc

SEQ ID NO: 298125 - DNA, 25 bp, Mus musculus
gataataccatccggttatgggata

SEQ ID NO: 298126 - DNA, 25 bp, Mus musculus
gataatagccagaacaaatataaag

SEQ ID NO: 298127 - DNA, 25 bp, Mus musculus
gataatatcttggctttcccccttg

SEQ ID NO: 298128 - DNA, 25 bp, Mus musculus
gataatccacagctacacacttgaa

SEQ ID NO: 298129 - DNA, 25 bp, Mus musculus
gataatccaccatgactggtggaag

SEQ ID NO: 298130 - DNA, 25 bp, Mus musculus
gataatccacttaaacatttaaaaa

SEQ ID NO: 298131 - DNA, 25 bp, Mus musculus
gataatctgtcacagaaagaaagac

SEQ ID NO: 298132 - DNA, 25 bp, Mus musculus
gataatctttcaaggaccctgattt

SEQ ID NO: 298133 - DNA, 25 bp, Mus musculus
gataatctttcaaggtttgaccaaa

SEQ ID NO: 298134 - DNA, 25 bp, Mus musculus
gataatgaaggaattgctatctttt

SEQ ID NO: 298135 - DNA, 25 bp, Mus musculus
gataatgatgggaagaaacctgatc

SEQ ID NO: 298136 - DNA, 25 bp, Mus musculus
gataatgatgggaaggacaaaccag

SEQ ID NO: 298137 - DNA, 25 bp, Mus musculus
gataatgcactttgtggagaagttt

SEQ ID NO: 298138 - DNA, 25 bp, Mus musculus
gataatggactaaacctctgaaact

SEQ ID NO: 298139 - DNA, 25 bp, Mus musculus
gataatggcagtggtcctacggctc

SEQ ID NO: 298140 - DNA, 25 bp, Mus musculus
gataatggcggggaagctcagttta

SEQ ID NO: 298141 - DNA, 25 bp, Mus musculus
gataatgtagagggtcctgttataa

SEQ ID NO: 298142 - DNA, 25 bp, Mus musculus
gataatgtagatgaaactgaaggct

SEQ ID NO: 298143 - DNA, 25 bp, Mus musculus
gataatgtagatgaggaagcaaggg

SEQ ID NO: 298144 - DNA, 25 bp, Mus musculus
gataattccaatgatgttgcaaaat

SEQ ID NO: 298145 - DNA, 25 bp, Mus musculus
gataatttcaatgtccttggctccc

SEQ ID NO: 298146 - DNA, 25 bp, Mus musculus
gatacaaaacaactgataaaagagt

SEQ ID NO: 298147 - DNA, 25 bp, Mus musculus
gatacaaaacgctgtaagccgtgcc

SEQ ID NO: 298148 - DNA, 25 bp, Mus musculus
gatacaaaagcacaaccagtgcccc

SEQ ID NO: 298149 - DNA, 25 bp, Mus musculus
gatacaaaagtaagaagttgttttc

SEQ ID NO: 298150 - DNA, 25 bp, Mus musculus
gatacaaacggtctccctgcaacag

SEQ ID NO: 298151 - DNA, 25 bp, Mus musculus
gatacaaatggaaactataagtaac

SEQ ID NO: 298152 - DNA, 25 bp, Mus musculus
gatacaacactggaagaaaatatcc

SEQ ID NO: 298153 - DNA, 25 bp, Mus musculus
gatacaacactggtgtgtcagtcac

SEQ ID NO: 298154 - DNA, 25 bp, Mus musculus
gatacaagcaggtttttctccagga

SEQ ID NO: 298155 - DNA, 25 bp, Mus musculus
gatacaagcgggctttgctgctgct

SEQ ID NO: 298156 - DNA, 25 bp, Mus musculus
gatacaagtgaccttattcaatccc

SEQ ID NO: 298157 - DNA, 25 bp, Mus musculus
gatacaatattagaaggaacaactg

SEQ ID NO: 298158 - DNA, 25 bp, Mus musculus
gatacaatttctggaaatgatatat

SEQ ID NO: 298159 - DNA, 25 bp, Mus musculus
gatacacaagacatttcgactttgg

SEQ ID NO: 298160 - DNA, 25 bp, Mus musculus
gatacacagagaacaaaggctcctt

SEQ ID NO: 298161 - DNA, 25 bp, Mus musculus
gatacacagagaagtatagaagaag

SEQ ID NO: 298162 - DNA, 25 bp, Mus musculus
gatacacagagagcgatacacacaa

SEQ ID NO: 298163 - DNA, 25 bp, Mus musculus
gatacacagagatatagtgctggcc

SEQ ID NO: 298164 - DNA, 25 bp, Mus musculus
gatacaccagttgtgacacaggatt

SEQ ID NO: 298165 - DNA, 25 bp, Mus musculus
gatacacgtgcaggtactgtggcaa

SEQ ID NO: 298166 - DNA, 25 bp, Mus musculus
gatacactacatacgatctcctcca

SEQ ID NO: 298167 - DNA, 25 bp, Mus musculus
gatacactataaggtttgctatgcg

SEQ ID NO: 298168 - DNA, 25 bp, Mus musculus
gatacagaaagagtctttctccttt

SEQ ID NO: 298169 - DNA, 25 bp, Mus musculus
gatacagacaggttaactgagggat

SEQ ID NO: 298170 - DNA, 25 bp, Mus musculus
gatacagagcgcctagatgatttcc

SEQ ID NO: 298171 - DNA, 25 bp, Mus musculus
gatacagatatggagtaacaactgt

SEQ ID NO: 298172 - DNA, 25 bp, Mus musculus
gatacagatatggagtatacaatag

SEQ ID NO: 298173 - DNA, 25 bp, Mus musculus
gatacagcaggtggggatgcgtcac

SEQ ID NO: 298174 - DNA, 25 bp, Mus musculus
gatacaggaagactccttctaatgg

SEQ ID NO: 298175 - DNA, 25 bp, Mus musculus
gatacatatgagtcaaacgttctag

SEQ ID NO: 298176 - DNA, 25 bp, Mus musculus
gatacatcaggaagtggcaaggcta

SEQ ID NO: 298177 - DNA, 25 bp, Mus musculus
gatacatcagggtcttggggctggt

SEQ ID NO: 298178 - DNA, 25 bp, Mus musculus
gatacatccaggtgcatggaggact

SEQ ID NO: 298179 - DNA, 25 bp, Mus musculus
gatacattctcaaggtttcttttac

SEQ ID NO: 298180 - DNA, 25 bp, Mus musculus
gatacatttaaaagctatgacttca

SEQ ID NO: 298181 - DNA, 25 bp, Mus musculus
gatacatttaaaaggccatatcaat

SEQ ID NO: 298182 - DNA, 25 bp, Mus musculus
gataccaaaaatagcgaccagttcg

SEQ ID NO: 298183 - DNA, 25 bp, Mus musculus
gataccaacaaggcaaagggtggtg

SEQ ID NO: 298184 - DNA, 25 bp, Mus musculus
gataccaacgtggtccactgacaaa

SEQ ID NO: 298185 - DNA, 25 bp, Mus musculus
gataccaagccatggtacactgtgg

SEQ ID NO: 298186 - DNA, 25 bp, Mus musculus
gataccaaggactgctacaccttac

SEQ ID NO: 298187 - DNA, 25 bp, Mus musculus
gataccaaggactggccttctcagt

SEQ ID NO: 298188 - DNA, 25 bp, Mus musculus
gataccagaatgaggatcccagaaa

SEQ ID NO: 298189 - DNA, 25 bp, Mus musculus
gataccagagatagagacaaaagac

SEQ ID NO: 298190 - DNA, 25 bp, Mus musculus
gataccagagtatacccgcaatggc

SEQ ID NO: 298191 - DNA, 25 bp, Mus musculus
gatacccaagagccagaaactccgg

SEQ ID NO: 298192 - DNA, 25 bp, Mus musculus
gatacccagagccctgcaactccca

SEQ ID NO: 298193 - DNA, 25 bp, Mus musculus
gatacccaggcctgattgtgggagc

SEQ ID NO: 298194 - DNA, 25 bp, Mus musculus
gatacccccgccacattgacagttc

SEQ ID NO: 298195 - DNA, 25 bp, Mus musculus
gatacccgacccgatttctctgtgt

SEQ ID NO: 298196 - DNA, 25 bp, Mus musculus
gatacccgacccggcaccagccaca

SEQ ID NO: 298197 - DNA, 25 bp, Mus musculus
gataccctgggcaggattcctatct

SEQ ID NO: 298198 - DNA, 25 bp, Mus musculus
gataccgtgagcaggtacctggagt

SEQ ID NO: 298199 - DNA, 25 bp, Mus musculus
gatacctcacaggacctggagttgc

SEQ ID NO: 298200 - DNA, 25 bp, Mus musculus
gatacctgaccacggtgattgggat

SEQ ID NO: 298201 - DNA, 25 bp, Mus musculus
gatacctgaccacggtttggctcct

SEQ ID NO: 298202 - DNA, 25 bp, Mus musculus
gatacctgagaattgattcatctgt

SEQ ID NO: 298203 - DNA, 25 bp, Mus musculus
gatacctgaggacacgagaggacac

SEQ ID NO: 298204 - DNA, 25 bp, Mus musculus
gataccttagttcagaatgtgattc

SEQ ID NO: 298205 - DNA, 25 bp, Mus musculus
gataccttagttcagatcctagccc

SEQ ID NO: 298206 - DNA, 25 bp, Mus musculus
gatacgaacgtggatgaggctgtag

SEQ ID NO: 298207 - DNA, 25 bp, Mus musculus
gatacgaagaggaatcttttgtgtt

SEQ ID NO: 298208 - DNA, 25 bp, Mus musculus
gatacgagcaatcatttccatgtgt

SEQ ID NO: 298209 - DNA, 25 bp, Mus musculus
gatacgagcagtagtaccgttgtca

SEQ ID NO: 298210 - DNA, 25 bp, Mus musculus
gatacgcacagatcttgatatggaa

SEQ ID NO: 298211 - DNA, 25 bp, Mus musculus
gatacgccacaagaactggaacaga

SEQ ID NO: 298212 - DNA, 25 bp, Mus musculus
gatacgccacaagtaatcagccagt

SEQ ID NO: 298213 - DNA, 25 bp, Mus musculus
gatacgcggcgagccggtgtgagaa

SEQ ID NO: 298214 - DNA, 25 bp, Mus musculus
gatacgcggcggcgcctgtgtctgg

SEQ ID NO: 298215 - DNA, 25 bp, Mus musculus
gatacgggattggcctagaaggagg

SEQ ID NO: 298216 - DNA, 25 bp, Mus musculus
gatacgggcgcgagggcgccgagcg

SEQ ID NO: 298217 - DNA, 25 bp, Mus musculus
gatacggttcggtcaccactcaaga

SEQ ID NO: 298218 - DNA, 25 bp, Mus musculus
gatacgttatgaaagacctgtgttg

SEQ ID NO: 298219 - DNA, 25 bp, Mus musculus
gatacgtttggaaagctggtctatg

SEQ ID NO: 298220 - DNA, 25 bp, Mus musculus
gatacgtttggaaatgttccttcat

SEQ ID NO: 298221 - DNA, 25 bp, Mus musculus
gatactaaaaggagacagtggaatc

SEQ ID NO: 298222 - DNA, 25 bp, Mus musculus
gatactaaaagtgaagcctgtctgc

SEQ ID NO: 298223 - DNA, 25 bp, Mus musculus
gatactattgttgcaatcatggcag

SEQ ID NO: 298224 - DNA, 25 bp, Mus musculus
gatactcaactcaaatattatgaga

SEQ ID NO: 298225 - DNA, 25 bp, Mus musculus
gatactcaactcaaatattttgaaa

SEQ ID NO: 298226 - DNA, 25 bp, Mus musculus
gatactcaactcaactctctgaaaa

SEQ ID NO: 298227 - DNA, 25 bp, Mus musculus
gatactccactcttggatatcacgt

SEQ ID NO: 298228 - DNA, 25 bp, Mus musculus
gatactccactcttggcaagtcggc

SEQ ID NO: 298229 - DNA, 25 bp, Mus musculus
gatactcgagccaggttctctccac

SEQ ID NO: 298230 - DNA, 25 bp, Mus musculus
gatactctcagagatgctggagtgt

SEQ ID NO: 298231 - DNA, 25 bp, Mus musculus
gatactgaagaaggacagctcctct

SEQ ID NO: 298232 - DNA, 25 bp, Mus musculus
gatactgcagagctacgagtctggt

SEQ ID NO: 298233 - DNA, 25 bp, Mus musculus
gatactgccacatgctgctggggcc

SEQ ID NO: 298234 - DNA, 25 bp, Mus musculus
gatactggaagaagccataatttgt

SEQ ID NO: 298235 - DNA, 25 bp, Mus musculus
gatactggagcttgcctctccacct

SEQ ID NO: 298236 - DNA, 25 bp, Mus musculus
gatactgtaaggtatgtcactggct

SEQ ID NO: 298237 - DNA, 25 bp, Mus musculus
gatactgtaagtgagggagctggct

SEQ ID NO: 298238 - DNA, 25 bp, Mus musculus
gatactgtggagactatgacagttt

SEQ ID NO: 298239 - DNA, 25 bp, Mus musculus
gatactgtggagggctccacctgaa

SEQ ID NO: 298240 - DNA, 25 bp, Mus musculus
gatacttacagattggccaggattc

SEQ ID NO: 298241 - DNA, 25 bp, Mus musculus
gatacttacaggagctgatcttttc

SEQ ID NO: 298242 - DNA, 25 bp, Mus musculus
gatacttacagtcacatgtggcctg

SEQ ID NO: 298243 - DNA, 25 bp, Mus musculus
gatacttccaatcacttccatgtgt

SEQ ID NO: 298244 - DNA, 25 bp, Mus musculus
gatacttctgtgagtgcaaagagct

SEQ ID NO: 298245 - DNA, 25 bp, Mus musculus
gatacttgacatagcctgcaggggt

SEQ ID NO: 298246 - DNA, 25 bp, Mus musculus
gatacttgcaagggtgactcaggag

SEQ ID NO: 298247 - DNA, 25 bp, Mus musculus
gatacttggacttgagcagcgacca

SEQ ID NO: 298248 - DNA, 25 bp, Mus musculus
gatactttaaagagaatgtggtctt

SEQ ID NO: 298249 - DNA, 25 bp, Mus musculus
gatactttaaagatgaaaactttat

SEQ ID NO: 298250 - DNA, 25 bp, Mus musculus
gatactttgtgaaggacatctttgg

SEQ ID NO: 298251 - DNA, 25 bp, Mus musculus
gatactttgtgaaggggcagcattt

SEQ ID NO: 298252 - DNA, 25 bp, Mus musculus
gatacttttggactgaccaaggcca

SEQ ID NO: 298253 - DNA, 25 bp, Mus musculus
gatagaagaagtgagctgaagaggc

SEQ ID NO: 298254 - DNA, 25 bp, Mus musculus
gatagaagagcttcggaaatgtgtg

SEQ ID NO: 298255 - DNA, 25 bp, Mus musculus
gatagaagagtggtagatgaccctg

SEQ ID NO: 298256 - DNA, 25 bp, Mus musculus
gatagaatagacaaggctttgatga

SEQ ID NO: 298257 - DNA, 25 bp, Mus musculus
gatagacacctgagatatcaagttc

SEQ ID NO: 298258 - DNA, 25 bp, Mus musculus
gatagacgtcaggtggccatcaaag

SEQ ID NO: 298259 - DNA, 25 bp, Mus musculus
gatagactaggatattttaaagaac

SEQ ID NO: 298260 - DNA, 25 bp, Mus musculus
gatagactaggttggtttgccatcc

SEQ ID NO: 298261 - DNA, 25 bp, Mus musculus
gatagactttgcagaaatgaagcag

SEQ ID NO: 298262 - DNA, 25 bp, Mus musculus
gatagagaaaaagtaaagacatttc

SEQ ID NO: 298263 - DNA, 25 bp, Mus musculus
gatagagaaaagtacaacagaatag

SEQ ID NO: 298264 - DNA, 25 bp, Mus musculus
gatagagaaagaaaaagtggagtac

SEQ ID NO: 298265 - DNA, 25 bp, Mus musculus
gatagagaaggtaaaggggaatgct

SEQ ID NO: 298266 - DNA, 25 bp, Mus musculus
gatagagattaaggagctatcgaag

SEQ ID NO: 298267 - DNA, 25 bp, Mus musculus
gatagagcagctcagtcctccgtga

SEQ ID NO: 298268 - DNA, 25 bp, Mus musculus
gatagagccagcacgcatttgatgg

SEQ ID NO: 298269 - DNA, 25 bp, Mus musculus
gatagagccagtatccatggaatgt

SEQ ID NO: 298270 - DNA, 25 bp, Mus musculus
gatagagcggggaaaaatggagtat

SEQ ID NO: 298271 - DNA, 25 bp, Mus musculus
gatagagtacttgagctaccaggag

SEQ ID NO: 298272 - DNA, 25 bp, Mus musculus
gatagagttgcaacatctcggatca

SEQ ID NO: 298273 - DNA, 25 bp, Mus musculus
gatagagtttcagatacaccaagta

SEQ ID NO: 298274 - DNA, 25 bp, Mus musculus
gatagagtttcagcacccacagagt

SEQ ID NO: 298275 - DNA, 25 bp, Mus musculus
gatagatccccacagactttgcaat

SEQ ID NO: 298276 - DNA, 25 bp, Mus musculus
gatagatccccagagactttgcaat

SEQ ID NO: 298277 - DNA, 25 bp, Mus musculus
gatagatgtgaggtcacctcagcac

SEQ ID NO: 298278 - DNA, 25 bp, Mus musculus
gatagattgatacagggacaagtga

SEQ ID NO: 298279 - DNA, 25 bp, Mus musculus
gatagatttggaagcaggaatgtct

SEQ ID NO: 298280 - DNA, 25 bp, Mus musculus
gatagcaaaactccaccagagaaga

SEQ ID NO: 298281 - DNA, 25 bp, Mus musculus
gatagcaacgggggcatctgcaacg

SEQ ID NO: 298282 - DNA, 25 bp, Mus musculus
gatagcaaggagaaagaaaagtcaa

SEQ ID NO: 298283 - DNA, 25 bp, Mus musculus
gatagcaaggagggattttgaactt

SEQ ID NO: 298284 - DNA, 25 bp, Mus musculus
gatagcaagggcaggactcctttac

SEQ ID NO: 298285 - DNA, 25 bp, Mus musculus
gatagcaccgtgaaggtctggacat

SEQ ID NO: 298286 - DNA, 25 bp, Mus musculus
gatagcagccaggggggagctgctg

SEQ ID NO: 298287 - DNA, 25 bp, Mus musculus
gatagcagcctggcccatctccgag

SEQ ID NO: 298288 - DNA, 25 bp, Mus musculus
gatagcagcttgggtcttgacgaag

SEQ ID NO: 298289 - DNA, 25 bp, Mus musculus
gatagcagtagtcctaccgggatat

SEQ ID NO: 298290 - DNA, 25 bp, Mus musculus
gatagcatacctgtatgaccggttg

SEQ ID NO: 298291 - DNA, 25 bp, Mus musculus
gatagcatcaggcgcgagcttcatt

SEQ ID NO: 298292 - DNA, 25 bp, Mus musculus
gatagccaagagaggtcactatggt

SEQ ID NO: 298293 - DNA, 25 bp, Mus musculus
gatagccaagagagttctgttggct

SEQ ID NO: 298294 - DNA, 25 bp, Mus musculus
gatagccatattgccctctgttttc

SEQ ID NO: 298295 - DNA, 25 bp, Mus musculus
gatagcctaggttcaaccaggccca

SEQ ID NO: 298296 - DNA, 25 bp, Mus musculus
gatagcctcgtggaactggaacaca

SEQ ID NO: 298297 - DNA, 25 bp, Mus musculus
gatagcctgggtttgtcactcttta

SEQ ID NO: 298298 - DNA, 25 bp, Mus musculus
gatagccttctgcaccaaggagatc

SEQ ID NO: 298299 - DNA, 25 bp, Mus musculus
gatagcgatgaggaagatgatgatg

SEQ ID NO: 298300 - DNA, 25 bp, Mus musculus
gatagcggagaaaattggagaggat

SEQ ID NO: 298301 - DNA, 25 bp, Mus musculus
gatagcgtcagcgggggaacagtac

SEQ ID NO: 298302 - DNA, 25 bp, Mus musculus
gatagctcagttgtggtagtgtgaa

SEQ ID NO: 298303 - DNA, 25 bp, Mus musculus
gatagctccctccgatgtcatatgc

SEQ ID NO: 298304 - DNA, 25 bp, Mus musculus
gatagctctccagacacaagcatct

SEQ ID NO: 298305 - DNA, 25 bp, Mus musculus
gatagctgaaaagaaagggccaaat

SEQ ID NO: 298306 - DNA, 25 bp, Mus musculus
gatagctgaaaaggtgtctctggtt

SEQ ID NO: 298307 - DNA, 25 bp, Mus musculus
gatagctgagagtcgacaattagaa

SEQ ID NO: 298308 - DNA, 25 bp, Mus musculus
gatagctgcagtagaaaaagttaag

SEQ ID NO: 298309 - DNA, 25 bp, Mus musculus
gatagctttccaggacaagaagatg

SEQ ID NO: 298310 - DNA, 25 bp, Mus musculus
gatagctttgataaatttgaattct

SEQ ID NO: 298311 - DNA, 25 bp, Mus musculus
gataggaagtatgaacatcatctca

SEQ ID NO: 298312 - DNA, 25 bp, Mus musculus
gataggaatacaacttctcgccgag

SEQ ID NO: 298313 - DNA, 25 bp, Mus musculus
gataggaatacaagagaggactaga

SEQ ID NO: 298314 - DNA, 25 bp, Mus musculus
gataggaatacaagttgactgcatt

SEQ ID NO: 298315 - DNA, 25 bp, Mus musculus
gataggacagaacaccacccaaaga

SEQ ID NO: 298316 - DNA, 25 bp, Mus musculus
gataggacagtgttcttcacaaaag

SEQ ID NO: 298317 - DNA, 25 bp, Mus musculus
gataggacatctgaaagctgagccc

SEQ ID NO: 298318 - DNA, 25 bp, Mus musculus
gataggagaaccaaaaataatctat

SEQ ID NO: 298319 - DNA, 25 bp, Mus musculus
gataggagaaccaaacaaatgaaga

SEQ ID NO: 298320 - DNA, 25 bp, Mus musculus
gataggagacgattgcagggatgat

SEQ ID NO: 298321 - DNA, 25 bp, Mus musculus
gataggaggctccctgctatgtgga

SEQ ID NO: 298322 - DNA, 25 bp, Mus musculus
gataggcagaagggaactgagccgt

SEQ ID NO: 298323 - DNA, 25 bp, Mus musculus
gataggcagagcagctccatcagca

SEQ ID NO: 298324 - DNA, 25 bp, Mus musculus
gataggcagaggtcagtaccatgaa

SEQ ID NO: 298325 - DNA, 25 bp, Mus musculus
gataggcagcatgtctgatgaaagt

SEQ ID NO: 298326 - DNA, 25 bp, Mus musculus
gataggcagcatttccagacagtca

SEQ ID NO: 298327 - DNA, 25 bp, Mus musculus
gataggcctgagacttccttaccga

SEQ ID NO: 298328 - DNA, 25 bp, Mus musculus
gataggctgcgatgggtggatgaga

SEQ ID NO: 298329 - DNA, 25 bp, Mus musculus
gataggcttggtgaatcacagacct

SEQ ID NO: 298330 - DNA, 25 bp, Mus musculus
gatagggaggaagcacctctgggag

SEQ ID NO: 298331 - DNA, 25 bp, Mus musculus
gataggtacagttctgacacaacac

SEQ ID NO: 298332 - DNA, 25 bp, Mus musculus
gataggtataatggcctcggccctg

SEQ ID NO: 298333 - DNA, 25 bp, Mus musculus
gataggtgacaaggaaggagctttg

SEQ ID NO: 298334 - DNA, 25 bp, Mus musculus
gatagtagaagagaaaactctctac

SEQ ID NO: 298335 - DNA, 25 bp, Mus musculus
gatagtagagaagtgattgtgaagc

SEQ ID NO: 298336 - DNA, 25 bp, Mus musculus
gatagtagagaagtgcctagacaag

SEQ ID NO: 298337 - DNA, 25 bp, Mus musculus
gatagtccagcagactgatacctcc

SEQ ID NO: 298338 - DNA, 25 bp, Mus musculus
gatagtccttgtgaggcccagcctc

SEQ ID NO: 298339 - DNA, 25 bp, Mus musculus
gatagtgacagtgacgatggggagg

SEQ ID NO: 298340 - DNA, 25 bp, Mus musculus
gatagtgatggggcagaagaaactc

SEQ ID NO: 298341 - DNA, 25 bp, Mus musculus
gatagtgcgtacagaagaactcctg

SEQ ID NO: 298342 - DNA, 25 bp, Mus musculus
gatagtgcgtacagagaacttaccg

SEQ ID NO: 298343 - DNA, 25 bp, Mus musculus
gatagtggaacgcagggatgccctg

SEQ ID NO: 298344 - DNA, 25 bp, Mus musculus
gatagtggagggtgtcccctgaact

SEQ ID NO: 298345 - DNA, 25 bp, Mus musculus
gatagtggcatgtgggcatcatcgc

SEQ ID NO: 298346 - DNA, 25 bp, Mus musculus
gatagtggcatgtggttcttcccga

SEQ ID NO: 298347 - DNA, 25 bp, Mus musculus
gatagtggtaaggccatcgaagacg

SEQ ID NO: 298348 - DNA, 25 bp, Mus musculus
gatagtggtaagtgcggctggctct

SEQ ID NO: 298349 - DNA, 25 bp, Mus musculus
gatagtgtggaaacctgctgcccca

SEQ ID NO: 298350 - DNA, 25 bp, Mus musculus
gatagtgtgggcctgccagctcccc

SEQ ID NO: 298351 - DNA, 25 bp, Mus musculus
gatagttaaagagggttgccccggc

SEQ ID NO: 298352 - DNA, 25 bp, Mus musculus
gatagttcaaatgcgcttaaaggat

SEQ ID NO: 298353 - DNA, 25 bp, Mus musculus
gatagtttctgaattagtgtccttc

SEQ ID NO: 298354 - DNA, 25 bp, Mus musculus
gatagtttgctgtagtaattcttca

SEQ ID NO: 298355 - DNA, 25 bp, Mus musculus
gatataaaattcacagaggagattc

SEQ ID NO: 298356 - DNA, 25 bp, Mus musculus
gatataaacctgaaggcatcagttt

SEQ ID NO: 298357 - DNA, 25 bp, Mus musculus
gatataaaggattctaaggtgaaga

SEQ ID NO: 298358 - DNA, 25 bp, Mus musculus
gatataaatgtcaggactcaggacg

SEQ ID NO: 298359 - DNA, 25 bp, Mus musculus
gatataattcaggttgatgaaaaaa

SEQ ID NO: 298360 - DNA, 25 bp, Mus musculus
gatataattcagtgactcactatgt

SEQ ID NO: 298361 - DNA, 25 bp, Mus musculus
gatatacagaccttactgtggcctc

SEQ ID NO: 298362 - DNA, 25 bp, Mus musculus
gatataccaggtgaacctgagtgct

SEQ ID NO: 298363 - DNA, 25 bp, Mus musculus
gatataccagtccggttctccacca

SEQ ID NO: 298364 - DNA, 25 bp, Mus musculus
gatatacgggctgattcgctactcg

SEQ ID NO: 298365 - DNA, 25 bp, Mus musculus
gatatacgggctggccaagcccaga

SEQ ID NO: 298366 - DNA, 25 bp, Mus musculus
gatatacgggctggtccaaaaggaa

SEQ ID NO: 298367 - DNA, 25 bp, Mus musculus
gatatactcaaagggcagcacatga

SEQ ID NO: 298368 - DNA, 25 bp, Mus musculus
gatatactcaaaggtgttggggcca

SEQ ID NO: 298369 - DNA, 25 bp, Mus musculus
gatatactcatctgccatggtgtgg

SEQ ID NO: 298370 - DNA, 25 bp, Mus musculus
gatatacttcagaatctgaccacag

SEQ ID NO: 298371 - DNA, 25 bp, Mus musculus
gatatacttcagctccaacagagga

SEQ ID NO: 298372 - DNA, 25 bp, Mus musculus
gatatacttcaggaactaattctga

SEQ ID NO: 298373 - DNA, 25 bp, Mus musculus
gatatagatttccttctgggttctc

SEQ ID NO: 298374 - DNA, 25 bp, Mus musculus
gatatatacagatttgcaacagcat

SEQ ID NO: 298375 - DNA, 25 bp, Mus musculus
gatatatactgaaatgactggaaag

SEQ ID NO: 298376 - DNA, 25 bp, Mus musculus
gatatatcacacaaaaattccagag

SEQ ID NO: 298377 - DNA, 25 bp, Mus musculus
gatatatcacacaaagacccacagt

SEQ ID NO: 298378 - DNA, 25 bp, Mus musculus
gatatatccgaaatggctaccaaga

SEQ ID NO: 298379 - DNA, 25 bp, Mus musculus
gatatatttttacagggaggagcct

SEQ ID NO: 298380 - DNA, 25 bp, Mus musculus
gatatcaaaaagggaatcttacttc

SEQ ID NO: 298381 - DNA, 25 bp, Mus musculus
gatatcaaagaggtagtagtctgga

SEQ ID NO: 298382 - DNA, 25 bp, Mus musculus
gatatcaaagctgccaacgtgctgc

SEQ ID NO: 298383 - DNA, 25 bp, Mus musculus
gatatcaacttgattcgaggaactg

SEQ ID NO: 298384 - DNA, 25 bp, Mus musculus
gatatcacaaatgttaactcattcc

SEQ ID NO: 298385 - DNA, 25 bp, Mus musculus
gatatcactctgggaggcccggtgc

SEQ ID NO: 298386 - DNA, 25 bp, Mus musculus
gatatcactctgttccatgccatgg

SEQ ID NO: 298387 - DNA, 25 bp, Mus musculus
gatatcagaatggtcatttatcaac

SEQ ID NO: 298388 - DNA, 25 bp, Mus musculus
gatatcagagatatcataggaccca

SEQ ID NO: 298389 - DNA, 25 bp, Mus musculus
gatatcagagatggacctgcaggtg

SEQ ID NO: 298390 - DNA, 25 bp, Mus musculus
gatatcatccgagttagaacaaatg

SEQ ID NO: 298391 - DNA, 25 bp, Mus musculus
gatatcatgagctttcccgaaagat

SEQ ID NO: 298392 - DNA, 25 bp, Mus musculus
gatatcatgaggtcggcagattcag

SEQ ID NO: 298393 - DNA, 25 bp, Mus musculus
gatatcccaagagggtgtagcccgg

SEQ ID NO: 298394 - DNA, 25 bp, Mus musculus
gatatcccagattttagaaaggaaa

SEQ ID NO: 298395 - DNA, 25 bp, Mus musculus
gatatcccaggtccaaatatcacac

SEQ ID NO: 298396 - DNA, 25 bp, Mus musculus
gatatccccaacacggtcggaaact

SEQ ID NO: 298397 - DNA, 25 bp, Mus musculus
gatatccctaagattttgttcctgg

SEQ ID NO: 298398 - DNA, 25 bp, Mus musculus
gatatcctcagtgtttgtgcctgtc

SEQ ID NO: 298399 - DNA, 25 bp, Mus musculus
gatatcgaaggatgttttatttccg

SEQ ID NO: 298400 - DNA, 25 bp, Mus musculus
gatatcgatggccgccctgtcaaag

SEQ ID NO: 298401 - DNA, 25 bp, Mus musculus
gatatcgccagtgatttccggtaca

SEQ ID NO: 298402 - DNA, 25 bp, Mus musculus
gatatcgcggcccaatggaagagaa

SEQ ID NO: 298403 - DNA, 25 bp, Mus musculus
gatatcgcgggacaggaacggtttg

SEQ ID NO: 298404 - DNA, 25 bp, Mus musculus
gatatcgtcccagttttcgcatacc

SEQ ID NO: 298405 - DNA, 25 bp, Mus musculus
gatatctaaagtggttccctcaacc

SEQ ID NO: 298406 - DNA, 25 bp, Mus musculus
gatatctacatatcaactcaacaag

SEQ ID NO: 298407 - DNA, 25 bp, Mus musculus
gatatctacctgcagagctttgtgg

SEQ ID NO: 298408 - DNA, 25 bp, Mus musculus
gatatctacctgcaggtcacccacg

SEQ ID NO: 298409 - DNA, 25 bp, Mus musculus
gatatctcagaaagtgtcaccgtgg

SEQ ID NO: 298410 - DNA, 25 bp, Mus musculus
gatatctcagcaaagctaccacgtt

SEQ ID NO: 298411 - DNA, 25 bp, Mus musculus
gatatctcagcaggtaaatgagaaa

SEQ ID NO: 298412 - DNA, 25 bp, Mus musculus
gatatctcagcaggtggcagctagt

SEQ ID NO: 298413 - DNA, 25 bp, Mus musculus
gatatctcttcaggtgccagcctca

SEQ ID NO: 298414 - DNA, 25 bp, Mus musculus
gatatctgaggttcccaatcaagga

SEQ ID NO: 298415 - DNA, 25 bp, Mus musculus
gatatcttactcagaaaaatttcct

SEQ ID NO: 298416 - DNA, 25 bp, Mus musculus
gatatcttactcagggcattacaca

SEQ ID NO: 298417 - DNA, 25 bp, Mus musculus
gatatcttctttctcatctttgggt

SEQ ID NO: 298418 - DNA, 25 bp, Mus musculus
gatatctttgaagaccttgctttta

SEQ ID NO: 298419 - DNA, 25 bp, Mus musculus
gatatctttgaagatgctgtcttca

SEQ ID NO: 298420 - DNA, 25 bp, Mus musculus
gatatctttgaaggacgtgtaattc

SEQ ID NO: 298421 - DNA, 25 bp, Mus musculus
gatatctttgaagtactaagtataa

SEQ ID NO: 298422 - DNA, 25 bp, Mus musculus
gatatctttgtatatgaggtgactg

SEQ ID NO: 298423 - DNA, 25 bp, Mus musculus
gatatgaacagctggccgactgctt

SEQ ID NO: 298424 - DNA, 25 bp, Mus musculus
gatatgaagcagattgattatacgg

SEQ ID NO: 298425 - DNA, 25 bp, Mus musculus
gatatgacagaagtctgcgtggtgg

SEQ ID NO: 298426 - DNA, 25 bp, Mus musculus
gatatgacttccatataagtttctt

SEQ ID NO: 298427 - DNA, 25 bp, Mus musculus
gatatgacttgggagaagagacttg

SEQ ID NO: 298428 - DNA, 25 bp, Mus musculus
gatatgacttgtttggatttagggt

SEQ ID NO: 298429 - DNA, 25 bp, Mus musculus
gatatgagaagtcaaactacaactc

SEQ ID NO: 298430 - DNA, 25 bp, Mus musculus
gatatgagcaaacgtatgcagagat

SEQ ID NO: 298431 - DNA, 25 bp, Mus musculus
gatatgagcatccagtgtatccaga

SEQ ID NO: 298432 - DNA, 25 bp, Mus musculus
gatatgaggagtcagtacaggctac

SEQ ID NO: 298433 - DNA, 25 bp, Mus musculus
gatatgatcaacgaagcaatggcac

SEQ ID NO: 298434 - DNA, 25 bp, Mus musculus
gatatgatgagaggccgggcccctc

SEQ ID NO: 298435 - DNA, 25 bp, Mus musculus
gatatgatgagaggcgacgtagtca

SEQ ID NO: 298436 - DNA, 25 bp, Mus musculus
gatatgatggtggctatggaggttt

SEQ ID NO: 298437 - DNA, 25 bp, Mus musculus
gatatgattccagatgcacgccatc

SEQ ID NO: 298438 - DNA, 25 bp, Mus musculus
gatatgattccaggctactagtcag

SEQ ID NO: 298439 - DNA, 25 bp, Mus musculus
gatatgattctgctgagcatttgct

SEQ ID NO: 298440 - DNA, 25 bp, Mus musculus
gatatgattctgctggtgtgggact

SEQ ID NO: 298441 - DNA, 25 bp, Mus musculus
gatatgcaaaccatgtttcctgaaa

SEQ ID NO: 298442 - DNA, 25 bp, Mus musculus
gatatgcaaatagagtaaaggagtt

SEQ ID NO: 298443 - DNA, 25 bp, Mus musculus
gatatgcaaatagggtgaaagaatt

SEQ ID NO: 298444 - DNA, 25 bp, Mus musculus
gatatgcaagctcttgaagacagtt

SEQ ID NO: 298445 - DNA, 25 bp, Mus musculus
gatatgcaagttttgattatgaaga

SEQ ID NO: 298446 - DNA, 25 bp, Mus musculus
gatatgcacagtggcttctattttg

SEQ ID NO: 298447 - DNA, 25 bp, Mus musculus
gatatgcagctgaggcgtaagttgg

SEQ ID NO: 298448 - DNA, 25 bp, Mus musculus
gatatgcagctgagtccacgtgaag

SEQ ID NO: 298449 - DNA, 25 bp, Mus musculus
gatatgctactgcaggtaaatgaga

SEQ ID NO: 298450 - DNA, 25 bp, Mus musculus
gatatgctcggactcaaccgtgaag

SEQ ID NO: 298451 - DNA, 25 bp, Mus musculus
gatatggacaggggatagcccacct

SEQ ID NO: 298452 - DNA, 25 bp, Mus musculus
gatatggattcagattactcgggac

SEQ ID NO: 298453 - DNA, 25 bp, Mus musculus
gatatggattcagggctgaggcact

SEQ ID NO: 298454 - DNA, 25 bp, Mus musculus
gatatggcacccgttattggaaata

SEQ ID NO: 298455 - DNA, 25 bp, Mus musculus
gatatggcaggatgttcaactaaaa

SEQ ID NO: 298456 - DNA, 25 bp, Mus musculus
gatatggcccacaaggaatgtgggt

SEQ ID NO: 298457 - DNA, 25 bp, Mus musculus
gatatggtcaaggcggagccagatg

SEQ ID NO: 298458 - DNA, 25 bp, Mus musculus
gatatgtaagacacctgtggatgac

SEQ ID NO: 298459 - DNA, 25 bp, Mus musculus
gatatgtaagtgctcttgtgaaagg

SEQ ID NO: 298460 - DNA, 25 bp, Mus musculus
gatatgtcagaggaggtggagccta

SEQ ID NO: 298461 - DNA, 25 bp, Mus musculus
gatatgtccctggatgatattatca

SEQ ID NO: 298462 - DNA, 25 bp, Mus musculus
gatatgtgacctgaaggagccaaca

SEQ ID NO: 298463 - DNA, 25 bp, Mus musculus
gatatgtgacctggactcagccttg

SEQ ID NO: 298464 - DNA, 25 bp, Mus musculus
gatatgtggggacatcagtgcagtt

SEQ ID NO: 298465 - DNA, 25 bp, Mus musculus
gatatgttattcagaggaccagagt

SEQ ID NO: 298466 - DNA, 25 bp, Mus musculus
gatatgtttagagcttcccccaccc

SEQ ID NO: 298467 - DNA, 25 bp, Mus musculus
gatattaaatgggacctacacactg

SEQ ID NO: 298468 - DNA, 25 bp, Mus musculus
gatattacttgtaaagatttgagaa

SEQ ID NO: 298469 - DNA, 25 bp, Mus musculus
gatattattgatacatccatggggt

SEQ ID NO: 298470 - DNA, 25 bp, Mus musculus
gatattattgatattgacccattga

SEQ ID NO: 298471 - DNA, 25 bp, Mus musculus
gatattcaagcgtctgttgcggttg

SEQ ID NO: 298472 - DNA, 25 bp, Mus musculus
gatattcaaggaacagcgtctgttg

SEQ ID NO: 298473 - DNA, 25 bp, Mus musculus
gatattcacaagagcgttataacct

SEQ ID NO: 298474 - DNA, 25 bp, Mus musculus
gatattccagcctcactgcagtgtt

SEQ ID NO: 298475 - DNA, 25 bp, Mus musculus
gatattccctgactgctgcccgaat

SEQ ID NO: 298476 - DNA, 25 bp, Mus musculus
gatattccctgatgttgcattgatg

SEQ ID NO: 298477 - DNA, 25 bp, Mus musculus
gatattcctaggaccttctaccgtt

SEQ ID NO: 298478 - DNA, 25 bp, Mus musculus
gatattcctccaaaatactgttcag

SEQ ID NO: 298479 - DNA, 25 bp, Mus musculus
gatattcctccaaagtgtgacttat

SEQ ID NO: 298480 - DNA, 25 bp, Mus musculus
gatattcctccatacgaacagcaag

SEQ ID NO: 298481 - DNA, 25 bp, Mus musculus
gatattcgtgagcgctctctgctct

SEQ ID NO: 298482 - DNA, 25 bp, Mus musculus
gatattcgtgagcggcaattcaaat

SEQ ID NO: 298483 - DNA, 25 bp, Mus musculus
gatattgagaccctacacttattca

SEQ ID NO: 298484 - DNA, 25 bp, Mus musculus
gatattgataaacgccaccgctccc

SEQ ID NO: 298485 - DNA, 25 bp, Mus musculus
gatattgataaagttcaacttcttg

SEQ ID NO: 298486 - DNA, 25 bp, Mus musculus
gatattgccagtgactacaaataca

SEQ ID NO: 298487 - DNA, 25 bp, Mus musculus
gatattggagctccagccacaatga

SEQ ID NO: 298488 - DNA, 25 bp, Mus musculus
gatattgtcaagaagcaagacttgg

SEQ ID NO: 298489 - DNA, 25 bp, Mus musculus
gatattgtcaaggaactgaaagaca

SEQ ID NO: 298490 - DNA, 25 bp, Mus musculus
gatattgtcagcaggttgatgcaag

SEQ ID NO: 298491 - DNA, 25 bp, Mus musculus
gatattgtcatatccaactgtgtta

SEQ ID NO: 298492 - DNA, 25 bp, Mus musculus
gatattgtgtagaatatatttgaaa

SEQ ID NO: 298493 - DNA, 25 bp, Mus musculus
gatatttaaagctgcaggcacacgg

SEQ ID NO: 298494 - DNA, 25 bp, Mus musculus
gatatttagaaggttctacttagcc

SEQ ID NO: 298495 - DNA, 25 bp, Mus musculus
gatatttcacggacgtcagggccgt

SEQ ID NO: 298496 - DNA, 25 bp, Mus musculus
gatatttgcaagatgagatgaacga

SEQ ID NO: 298497 - DNA, 25 bp, Mus musculus
gatatttgcgaacaaggagcaagca

SEQ ID NO: 298498 - DNA, 25 bp, Mus musculus
gatatttgctccgctttttgcaatg

SEQ ID NO: 298499 - DNA, 25 bp, Mus musculus
gatatttgtgaaaggcactgaagat

SEQ ID NO: 298500 - DNA, 25 bp, Mus musculus
gatattttcaggtgaaccagaacag

SEQ ID NO: 298501 - DNA, 25 bp, Mus musculus
gatattttctacagctctcaaccta

SEQ ID NO: 298502 - DNA, 25 bp, Mus musculus
gatcaaaaagacaggttagaaagct

SEQ ID NO: 298503 - DNA, 25 bp, Mus musculus
gatcaaaaagtttcagttcgttgtg

SEQ ID NO: 298504 - DNA, 25 bp, Mus musculus
gatcaaaacagaggtgcaaagaaat

SEQ ID NO: 298505 - DNA, 25 bp, Mus musculus
gatcaaaagatcaagggtgacagga

SEQ ID NO: 298506 - DNA, 25 bp, Mus musculus
gatcaaaagatcaaggtgatctacg

SEQ ID NO: 298507 - DNA, 25 bp, Mus musculus
gatcaaaagcaggttgtccagagct

SEQ ID NO: 298508 - DNA, 25 bp, Mus musculus
gatcaaaaggcctgaagcacgtaac

SEQ ID NO: 298509 - DNA, 25 bp, Mus musculus
gatcaaaatggctcgcgctgtatgt

SEQ ID NO: 298510 - DNA, 25 bp, Mus musculus
gatcaaacatatgctgagaaatcca

SEQ ID NO: 298511 - DNA, 25 bp, Mus musculus
gatcaaacatatggcacttcttgga

SEQ ID NO: 298512 - DNA, 25 bp, Mus musculus
gatcaaacatcggaagaactctcag

SEQ ID NO: 298513 - DNA, 25 bp, Mus musculus
gatcaaagagtgcagcatcgccctg

SEQ ID NO: 298514 - DNA, 25 bp, Mus musculus
gatcaaagagtgcagttttggttct

SEQ ID NO: 298515 - DNA, 25 bp, Mus musculus
gatcaaagcactggcgcctgcgctc

SEQ ID NO: 298516 - DNA, 25 bp, Mus musculus
gatcaaagcactgggggagctgctc

SEQ ID NO: 298517 - DNA, 25 bp, Mus musculus
gatcaaagcagtccggcatgaggat

SEQ ID NO: 298518 - DNA, 25 bp, Mus musculus
gatcaaagcattcgctatggagtta

SEQ ID NO: 298519 - DNA, 25 bp, Mus musculus
gatcaaagcctgcgacgtatgtgat

SEQ ID NO: 298520 - DNA, 25 bp, Mus musculus
gatcaaagcctgggacgtatgtgat

SEQ ID NO: 298521 - DNA, 25 bp, Mus musculus
gatcaaagtcagaagggcatcctgg

SEQ ID NO: 298522 - DNA, 25 bp, Mus musculus
gatcaaagtgagaggttcagacagt

SEQ ID NO: 298523 - DNA, 25 bp, Mus musculus
gatcaaagtgccagtgaaccccaga

SEQ ID NO: 298524 - DNA, 25 bp, Mus musculus
gatcaaagtggaaatggatccacct

SEQ ID NO: 298525 - DNA, 25 bp, Mus musculus
gatcaaatttgcaccccaggggtgg

SEQ ID NO: 298526 - DNA, 25 bp, Mus musculus
gatcaacaacaccaaggagtttatc

SEQ ID NO: 298527 - DNA, 25 bp, Mus musculus
gatcaacagtgagcaactgatggtg

SEQ ID NO: 298528 - DNA, 25 bp, Mus musculus
gatcaacccctagtggtgaccaaag

SEQ ID NO: 298529 - DNA, 25 bp, Mus musculus
gatcaacgaagcaatggcaccattg

SEQ ID NO: 298530 - DNA, 25 bp, Mus musculus
gatcaacgacaaggtggcccagctg

SEQ ID NO: 298531 - DNA, 25 bp, Mus musculus
gatcaacggggagaagtactgcggt

SEQ ID NO: 298532 - DNA, 25 bp, Mus musculus
gatcaactcaataaagccgttgtga

SEQ ID NO: 298533 - DNA, 25 bp, Mus musculus
gatcaactcagccggctcaacatta

SEQ ID NO: 298534 - DNA, 25 bp, Mus musculus
gatcaactctcatctgttctcagcc

SEQ ID NO: 298535 - DNA, 25 bp, Mus musculus
gatcaagaaaagaggagcgctggcc

SEQ ID NO: 298536 - DNA, 25 bp, Mus musculus
gatcaagaaggagctaattcgatga

SEQ ID NO: 298537 - DNA, 25 bp, Mus musculus
gatcaagagaatcgagcctagaata

SEQ ID NO: 298538 - DNA, 25 bp, Mus musculus
gatcaagatgatgaggctgagaagg

SEQ ID NO: 298539 - DNA, 25 bp, Mus musculus
gatcaagcgactgctctttacagcc

SEQ ID NO: 298540 - DNA, 25 bp, Mus musculus
gatcaagcgactgtttagctttttc

SEQ ID NO: 298541 - DNA, 25 bp, Mus musculus
gatcaagcgacttaaagaaggtcct

SEQ ID NO: 298542 - DNA, 25 bp, Mus musculus
gatcaagcgagactccctccaaccc

SEQ ID NO: 298543 - DNA, 25 bp, Mus musculus
gatcaagcgagatggccgccaagag

SEQ ID NO: 298544 - DNA, 25 bp, Mus musculus
gatcaagcgcagcgggagaacagtt

SEQ ID NO: 298545 - DNA, 25 bp, Mus musculus
gatcaaggaaccttctgtggatgag

SEQ ID NO: 298546 - DNA, 25 bp, Mus musculus
gatcaaggacctccaggacctcagg

SEQ ID NO: 298547 - DNA, 25 bp, Mus musculus
gatcaaggagaaaatacaactgtga

SEQ ID NO: 298548 - DNA, 25 bp, Mus musculus
gatcaaggcacaggatctagataaa

SEQ ID NO: 298549 - DNA, 25 bp, Mus musculus
gatcaagggcatccaccacggcccc

SEQ ID NO: 298550 - DNA, 25 bp, Mus musculus
gatcaaggtcagatctataccttcc

SEQ ID NO: 298551 - DNA, 25 bp, Mus musculus
gatcaagtgcctcagggcaccaccg

SEQ ID NO: 298552 - DNA, 25 bp, Mus musculus
gatcaagttactcaggggtggatga

SEQ ID NO: 298553 - DNA, 25 bp, Mus musculus
gatcaatatgagtggtactgcagaa

SEQ ID NO: 298554 - DNA, 25 bp, Mus musculus
gatcaatcaagatgactgtgatgag

SEQ ID NO: 298555 - DNA, 25 bp, Mus musculus
gatcaatcgggagttcctctgtgac

SEQ ID NO: 298556 - DNA, 25 bp, Mus musculus
gatcaatgctgaagaaagcgaaatc

SEQ ID NO: 298557 - DNA, 25 bp, Mus musculus
gatcaatgttaagggatcgcttaca

SEQ ID NO: 298558 - DNA, 25 bp, Mus musculus
gatcacaaagacctgtgcccctccg

SEQ ID NO: 298559 - DNA, 25 bp, Mus musculus
gatcacaaagtgagtttcctgcgca

SEQ ID NO: 298560 - DNA, 25 bp, Mus musculus
gatcacaacccagttcccacttgga

SEQ ID NO: 298561 - DNA, 25 bp, Mus musculus
gatcacaacccctgaccataggtca

SEQ ID NO: 298562 - DNA, 25 bp, Mus musculus
gatcacaacccctgggtggagttta

SEQ ID NO: 298563 - DNA, 25 bp, Mus musculus
gatcacaagtgtgtctcaaaagatt

SEQ ID NO: 298564 - DNA, 25 bp, Mus musculus
gatcacaccacagggctatgagaag

SEQ ID NO: 298565 - DNA, 25 bp, Mus musculus
gatcacaccacaggtcccaggagaa

SEQ ID NO: 298566 - DNA, 25 bp, Mus musculus
gatcacaccacagttgctaagggta

SEQ ID NO: 298567 - DNA, 25 bp, Mus musculus
gatcacactggatgcagcctaccac

SEQ ID NO: 298568 - DNA, 25 bp, Mus musculus
gatcacactggccaatgactgtgag

SEQ ID NO: 298569 - DNA, 25 bp, Mus musculus
gatcacagaaaagaaccggcactgt

SEQ ID NO: 298570 - DNA, 25 bp, Mus musculus
gatcacagaaaagggaacagagaga

SEQ ID NO: 298571 - DNA, 25 bp, Mus musculus
gatcacagaacttgacgtcagggcc

SEQ ID NO: 298572 - DNA, 25 bp, Mus musculus
gatcacagaacttgtgcaggtgttc

SEQ ID NO: 298573 - DNA, 25 bp, Mus musculus
gatcacagaaggtccctagcaggag

SEQ ID NO: 298574 - DNA, 25 bp, Mus musculus
gatcaccaaggccagcttttcctag

SEQ ID NO: 298575 - DNA, 25 bp, Mus musculus
gatcaccaggcagttgcccatggag

SEQ ID NO: 298576 - DNA, 25 bp, Mus musculus
gatcaccatcaatgagatcagtgaa

SEQ ID NO: 298577 - DNA, 25 bp, Mus musculus
gatcacccacgtctcttcaacagac

SEQ ID NO: 298578 - DNA, 25 bp, Mus musculus
gatcaccctggagacgactctagag

SEQ ID NO: 298579 - DNA, 25 bp, Mus musculus
gatcacccttcttagtatcctttag

SEQ ID NO: 298580 - DNA, 25 bp, Mus musculus
gatcacccttcttagtgggtcctgt

SEQ ID NO: 298581 - DNA, 25 bp, Mus musculus
gatcacctacgggccctatgccgtc

SEQ ID NO: 298582 - DNA, 25 bp, Mus musculus
gatcacctcagaggatacaagcagc

SEQ ID NO: 298583 - DNA, 25 bp, Mus musculus
gatcacctcagtggctctggagcaa

SEQ ID NO: 298584 - DNA, 25 bp, Mus musculus
gatcacctctaagagacgtggagct

SEQ ID NO: 298585 - DNA, 25 bp, Mus musculus
gatcacgaagcacagctgtgacgag

SEQ ID NO: 298586 - DNA, 25 bp, Mus musculus
gatcacgagaagaagagctgaaggg

SEQ ID NO: 298587 - DNA, 25 bp, Mus musculus
gatcacgagaagaaggtgatggatg

SEQ ID NO: 298588 - DNA, 25 bp, Mus musculus
gatcacgggacaaggtcccatctgc

SEQ ID NO: 298589 - DNA, 25 bp, Mus musculus
gatcacgggacaagttaattcagga

SEQ ID NO: 298590 - DNA, 25 bp, Mus musculus
gatcacgtccaagaatttcacccac

SEQ ID NO: 298591 - DNA, 25 bp, Mus musculus
gatcacgtccaaggtggctgtgcct

SEQ ID NO: 298592 - DNA, 25 bp, Mus musculus
gatcactatgatgcctgttcctgcc

SEQ ID NO: 298593 - DNA, 25 bp, Mus musculus
gatcactcaggagaagccctcgaag

SEQ ID NO: 298594 - DNA, 25 bp, Mus musculus
gatcactcaggaggttctgacggga

SEQ ID NO: 298595 - DNA, 25 bp, Mus musculus
gatcactcaggagttgcagctccac

SEQ ID NO: 298596 - DNA, 25 bp, Mus musculus
gatcactgcaaaatgaacccacagc

SEQ ID NO: 298597 - DNA, 25 bp, Mus musculus
gatcactgccaaggacgaaaagggg

SEQ ID NO: 298598 - DNA, 25 bp, Mus musculus
gatcactgtgaatggttaccatacc

SEQ ID NO: 298599 - DNA, 25 bp, Mus musculus
gatcacttcaagtgggtaaagcagg

SEQ ID NO: 298600 - DNA, 25 bp, Mus musculus
gatcagaaaatgagctctgttaagg

SEQ ID NO: 298601 - DNA, 25 bp, Mus musculus
gatcagaaacctgaacctgtggaca

SEQ ID NO: 298602 - DNA, 25 bp, Mus musculus
gatcagaaacctgatattcagacac

SEQ ID NO: 298603 - DNA, 25 bp, Mus musculus
gatcagaaagcctaggacctgcctt

SEQ ID NO: 298604 - DNA, 25 bp, Mus musculus
gatcagaaaggcagtttgtgcactt

SEQ ID NO: 298605 - DNA, 25 bp, Mus musculus
gatcagaaagggtgtgtgggatgac

SEQ ID NO: 298606 - DNA, 25 bp, Mus musculus
gatcagaagcaaggttttcgggttg

SEQ ID NO: 298607 - DNA, 25 bp, Mus musculus
gatcagaatcaaaaggtggcagatg

SEQ ID NO: 298608 - DNA, 25 bp, Mus musculus
gatcagacactgacaaagcaatacc

SEQ ID NO: 298609 - DNA, 25 bp, Mus musculus
gatcagacactggcactggtggggt

SEQ ID NO: 298610 - DNA, 25 bp, Mus musculus
gatcagacagaggactactgttgaa

SEQ ID NO: 298611 - DNA, 25 bp, Mus musculus
gatcagacaggaaaggatgtggccg

SEQ ID NO: 298612 - DNA, 25 bp, Mus musculus
gatcagaccacaggttctcccctat

SEQ ID NO: 298613 - DNA, 25 bp, Mus musculus
gatcagaccacaggtttgtccagag

SEQ ID NO: 298614 - DNA, 25 bp, Mus musculus
gatcagaccctggagccaccccgct

SEQ ID NO: 298615 - DNA, 25 bp, Mus musculus
gatcagaccttaggggacttacttc

SEQ ID NO: 298616 - DNA, 25 bp, Mus musculus
gatcagacgacctagagatgtggtc

SEQ ID NO: 298617 - DNA, 25 bp, Mus musculus
gatcagacgtcactggagttctttt

SEQ ID NO: 298618 - DNA, 25 bp, Mus musculus
gatcagagatggacagcagcatcac

SEQ ID NO: 298619 - DNA, 25 bp, Mus musculus
gatcagagatgttactctcgtccca

SEQ ID NO: 298620 - DNA, 25 bp, Mus musculus
gatcagagcgtcaaggtgtgggata

SEQ ID NO: 298621 - DNA, 25 bp, Mus musculus
gatcagaggaatggcgtactcagtt

SEQ ID NO: 298622 - DNA, 25 bp, Mus musculus
gatcagataaagcaaattaaaaagg

SEQ ID NO: 298623 - DNA, 25 bp, Mus musculus
gatcagatagtgccggcattggcat

SEQ ID NO: 298624 - DNA, 25 bp, Mus musculus
gatcagatccgtgccatcgctgaac

SEQ ID NO: 298625 - DNA, 25 bp, Mus musculus
gatcagattcaggcaacaatatctt

SEQ ID NO: 298626 - DNA, 25 bp, Mus musculus
gatcagattgaaaagcttactaagc

SEQ ID NO: 298627 - DNA, 25 bp, Mus musculus
gatcagatttaaaggttatagttat

SEQ ID NO: 298628 - DNA, 25 bp, Mus musculus
gatcagcaagcagcttcaggatctc

SEQ ID NO: 298629 - DNA, 25 bp, Mus musculus
gatcagcaagctgattaccaggaag

SEQ ID NO: 298630 - DNA, 25 bp, Mus musculus
gatcagcacatgggagtggtcacag

SEQ ID NO: 298631 - DNA, 25 bp, Mus musculus
gatcagcacatgggctttcccagtg

SEQ ID NO: 298632 - DNA, 25 bp, Mus musculus
gatcagcaccatgtcaaatcctctg

SEQ ID NO: 298633 - DNA, 25 bp, Mus musculus
gatcagcagagaactactttctcca

SEQ ID NO: 298634 - DNA, 25 bp, Mus musculus
gatcagcagaggtgctgttaccaga

SEQ ID NO: 298635 - DNA, 25 bp, Mus musculus
gatcagcagctgtggctaacttcga

SEQ ID NO: 298636 - DNA, 25 bp, Mus musculus
gatcagcaggtaattagtgaaatgg

SEQ ID NO: 298637 - DNA, 25 bp, Mus musculus
gatcagcatacaagggagactctgg

SEQ ID NO: 298638 - DNA, 25 bp, Mus musculus
gatcagcatagaagctgcgttggac

SEQ ID NO: 298639 - DNA, 25 bp, Mus musculus
gatcagcataggatcaagtagacat

SEQ ID NO: 298640 - DNA, 25 bp, Mus musculus
gatcagccctgagggcagagcagcc

SEQ ID NO: 298641 - DNA, 25 bp, Mus musculus
gatcagcctcaggaagaaactatca

SEQ ID NO: 298642 - DNA, 25 bp, Mus musculus
gatcagcctcaggaatacatcatgg

SEQ ID NO: 298643 - DNA, 25 bp, Mus musculus
gatcagcgacatcgatggagatggg

SEQ ID NO: 298644 - DNA, 25 bp, Mus musculus
gatcagcgtgggagctccgctttgg

SEQ ID NO: 298645 - DNA, 25 bp, Mus musculus
gatcagctcgagtgccatccgtgag

SEQ ID NO: 298646 - DNA, 25 bp, Mus musculus
gatcagctgctgagcagctgcagca

SEQ ID NO: 298647 - DNA, 25 bp, Mus musculus
gatcaggaagaagactgcccgtggt

SEQ ID NO: 298648 - DNA, 25 bp, Mus musculus
gatcaggaagatcctggcccgccca

SEQ ID NO: 298649 - DNA, 25 bp, Mus musculus
gatcaggacacacagacactgtcct

SEQ ID NO: 298650 - DNA, 25 bp, Mus musculus
gatcaggcaagcagctccagtcagt

SEQ ID NO: 298651 - DNA, 25 bp, Mus musculus
gatcaggcatccagtgagctgctta

SEQ ID NO: 298652 - DNA, 25 bp, Mus musculus
gatcaggggctggaaaacgagaaca

SEQ ID NO: 298653 - DNA, 25 bp, Mus musculus
gatcagggtcaagacaaatcttcct

SEQ ID NO: 298654 - DNA, 25 bp, Mus musculus
gatcagggtcaaggttgtagttccc

SEQ ID NO: 298655 - DNA, 25 bp, Mus musculus
gatcaggtccagggcaatggcagca

SEQ ID NO: 298656 - DNA, 25 bp, Mus musculus
gatcaggtctgaggatatgacatta

SEQ ID NO: 298657 - DNA, 25 bp, Mus musculus
gatcaggtgctaggttaaagatcga

SEQ ID NO: 298658 - DNA, 25 bp, Mus musculus
gatcaggtgggaggttgtgcccacc

SEQ ID NO: 298659 - DNA, 25 bp, Mus musculus
gatcagtatggtccatattgtggga

SEQ ID NO: 298660 - DNA, 25 bp, Mus musculus
gatcagtgaaaacctgcttgtttct

SEQ ID NO: 298661 - DNA, 25 bp, Mus musculus
gatcagtgagctcctgctgttctat

SEQ ID NO: 298662 - DNA, 25 bp, Mus musculus
gatcagtggaagccaaggataacct

SEQ ID NO: 298663 - DNA, 25 bp, Mus musculus
gatcagtggaaggcagttaaaccag

SEQ ID NO: 298664 - DNA, 25 bp, Mus musculus
gatcagtggaagtcttgaaatacag

SEQ ID NO: 298665 - DNA, 25 bp, Mus musculus
gatcagtgggaggaggaatttgaca

SEQ ID NO: 298666 - DNA, 25 bp, Mus musculus
gatcagtggtccagaccctcagtgc

SEQ ID NO: 298667 - DNA, 25 bp, Mus musculus
gatcagtggtccaggttctaagcgc

SEQ ID NO: 298668 - DNA, 25 bp, Mus musculus
gatcagtgtatcaggatgatgctgt

SEQ ID NO: 298669 - DNA, 25 bp, Mus musculus
gatcagtgtgagtatatacacttct

SEQ ID NO: 298670 - DNA, 25 bp, Mus musculus
gatcagttagaagctcttaaaaaac

SEQ ID NO: 298671 - DNA, 25 bp, Mus musculus
gatcagttatgagacttcagactgg

SEQ ID NO: 298672 - DNA, 25 bp, Mus musculus
gatcagttatggcagtaatggaact

SEQ ID NO: 298673 - DNA, 25 bp, Mus musculus
gatcagttatgtttttatttcaggg

SEQ ID NO: 298674 - DNA, 25 bp, Mus musculus
gatcataaacgacaggtgtgtggag

SEQ ID NO: 298675 - DNA, 25 bp, Mus musculus
gatcataaacgacaggtgtgttgaa

SEQ ID NO: 298676 - DNA, 25 bp, Mus musculus
gatcatatacaggagcagtacagtg

SEQ ID NO: 298677 - DNA, 25 bp, Mus musculus
gatcatcaagggccactccagaagt

SEQ ID NO: 298678 - DNA, 25 bp, Mus musculus
gatcatcaaggtggaaagagacatg

SEQ ID NO: 298679 - DNA, 25 bp, Mus musculus
gatcatcacaggagttggtgacaca

SEQ ID NO: 298680 - DNA, 25 bp, Mus musculus
gatcatcaggaggtgcttacatgtt

SEQ ID NO: 298681 - DNA, 25 bp, Mus musculus
gatcatccacagcagttgagtggtg

SEQ ID NO: 298682 - DNA, 25 bp, Mus musculus
gatcatccagcatgtgtctaacaag

SEQ ID NO: 298683 - DNA, 25 bp, Mus musculus
gatcatccagccctacatccagaac

SEQ ID NO: 298684 - DNA, 25 bp, Mus musculus
gatcatccattcaggcgtccgcgag

SEQ ID NO: 298685 - DNA, 25 bp, Mus musculus
gatcatcccagcctatgggaaggtg

SEQ ID NO: 298686 - DNA, 25 bp, Mus musculus
gatcatcccggcgcctccccatctg

SEQ ID NO: 298687 - DNA, 25 bp, Mus musculus
gatcatcccgggagttccgactctg

SEQ ID NO: 298688 - DNA, 25 bp, Mus musculus
gatcatcccggtatccctggaactg

SEQ ID NO: 298689 - DNA, 25 bp, Mus musculus
gatcatccggaagaagattcctttc

SEQ ID NO: 298690 - DNA, 25 bp, Mus musculus
gatcatccgggaggaactgcacggg

SEQ ID NO: 298691 - DNA, 25 bp, Mus musculus
gatcatcctttttataatcatgctg

SEQ ID NO: 298692 - DNA, 25 bp, Mus musculus
gatcatcgaaatgaagattggataa

SEQ ID NO: 298693 - DNA, 25 bp, Mus musculus
gatcatcgaaatgatgccagaattt

SEQ ID NO: 298694 - DNA, 25 bp, Mus musculus
gatcatcgaaatggaaatcagagat

SEQ ID NO: 298695 - DNA, 25 bp, Mus musculus
gatcatcgacccccttttgcaatgg

SEQ ID NO: 298696 - DNA, 25 bp, Mus musculus
gatcatctattagggcttatttcaa

SEQ ID NO: 298697 - DNA, 25 bp, Mus musculus
gatcatctcacaggttcaaaagagg

SEQ ID NO: 298698 - DNA, 25 bp, Mus musculus
gatcatctcacagtctgttgcaggg

SEQ ID NO: 298699 - DNA, 25 bp, Mus musculus
gatcatctcattgctaagaatgtgg

SEQ ID NO: 298700 - DNA, 25 bp, Mus musculus
gatcatctgcctcaggtcttcggat

SEQ ID NO: 298701 - DNA, 25 bp, Mus musculus
gatcatgaagacagtaaagactgta

SEQ ID NO: 298702 - DNA, 25 bp, Mus musculus
gatcatgaaggacatctgggttctt

SEQ ID NO: 298703 - DNA, 25 bp, Mus musculus
gatcatgaaggtacattttatactg

SEQ ID NO: 298704 - DNA, 25 bp, Mus musculus
gatcatgacagaattccagaggcaa

SEQ ID NO: 298705 - DNA, 25 bp, Mus musculus
gatcatgagaaggctgctttgatta

SEQ ID NO: 298706 - DNA, 25 bp, Mus musculus
gatcatgagacttagaatccttctg

SEQ ID NO: 298707 - DNA, 25 bp, Mus musculus
gatcatgagacttagtagctagaag

SEQ ID NO: 298708 - DNA, 25 bp, Mus musculus
gatcatggacggggcatttggcaca

SEQ ID NO: 298709 - DNA, 25 bp, Mus musculus
gatcatggagatgctccaagctgag

SEQ ID NO: 298710 - DNA, 25 bp, Mus musculus
gatcatggagtattgataacaacaa

SEQ ID NO: 298711 - DNA, 25 bp, Mus musculus
gatcatggtgcagtgctgttgaatt

SEQ ID NO: 298712 - DNA, 25 bp, Mus musculus
gatcatggttgcccccaaggtctct

SEQ ID NO: 298713 - DNA, 25 bp, Mus musculus
gatcatgtagggagcaacatccttt

SEQ ID NO: 298714 - DNA, 25 bp, Mus musculus
gatcatgtagggagtatgaaggtca

SEQ ID NO: 298715 - DNA, 25 bp, Mus musculus
gatcatgtcatcaggcagcctgatc

SEQ ID NO: 298716 - DNA, 25 bp, Mus musculus
gatcatgtgaggcacgtggacatct

SEQ ID NO: 298717 - DNA, 25 bp, Mus musculus
gatcatgttcaagaaatccttttat

SEQ ID NO: 298718 - DNA, 25 bp, Mus musculus
gatcatgttcaagaaatctgataga

SEQ ID NO: 298719 - DNA, 25 bp, Mus musculus
gatcatgttcaagaaatttgatgaa

SEQ ID NO: 298720 - DNA, 25 bp, Mus musculus
gatcatgttcaagaaccatgaacac

SEQ ID NO: 298721 - DNA, 25 bp, Mus musculus
gatcattaaggaacgagaactggag

SEQ ID NO: 298722 - DNA, 25 bp, Mus musculus
gatcattccaagaagaagcccggga

SEQ ID NO: 298723 - DNA, 25 bp, Mus musculus
gatcattctgacagctgtgaactgt

SEQ ID NO: 298724 - DNA, 25 bp, Mus musculus
gatcattgcagatgttcgagctgca

SEQ ID NO: 298725 - DNA, 25 bp, Mus musculus
gatcattgctcaagaccccggcagc

SEQ ID NO: 298726 - DNA, 25 bp, Mus musculus
gatcattgtccgtgcaaaactggtg

SEQ ID NO: 298727 - DNA, 25 bp, Mus musculus
gatcatttatggagggttcctggta

SEQ ID NO: 298728 - DNA, 25 bp, Mus musculus
gatcatttcaaccgaattggcaagg

SEQ ID NO: 298729 - DNA, 25 bp, Mus musculus
gatcatttttaagaggcaagaaaca

SEQ ID NO: 298730 - DNA, 25 bp, Mus musculus
gatcatttttctgacaagcaggtgg

SEQ ID NO: 298731 - DNA, 25 bp, Mus musculus
gatcatttttctggtgtgatcctgc

SEQ ID NO: 298732 - DNA, 25 bp, Mus musculus
gatccaaaaaggatacatgaggatc

SEQ ID NO: 298733 - DNA, 25 bp, Mus musculus
gatccaaaacacacagtgtatgaag

SEQ ID NO: 298734 - DNA, 25 bp, Mus musculus
gatccaaaatcaggtcacagacgaa

SEQ ID NO: 298735 - DNA, 25 bp, Mus musculus
gatccaaacgggaacaatataagca

SEQ ID NO: 298736 - DNA, 25 bp, Mus musculus
gatccaaagaggagatctttttgct

SEQ ID NO: 298737 - DNA, 25 bp, Mus musculus
gatccaaatcagacccggcactgat

SEQ ID NO: 298738 - DNA, 25 bp, Mus musculus
gatccaacagaccctcaggacttgt

SEQ ID NO: 298739 - DNA, 25 bp, Mus musculus
gatccaacaggtgtgggcccctcgc

SEQ ID NO: 298740 - DNA, 25 bp, Mus musculus
gatccaaccctcgaatcaacctacc

SEQ ID NO: 298741 - DNA, 25 bp, Mus musculus
gatccaacctttgccatgggccttg

SEQ ID NO: 298742 - DNA, 25 bp, Mus musculus
gatccaacgacaatcagcgccttgc

SEQ ID NO: 298743 - DNA, 25 bp, Mus musculus
gatccaacgacattgatacactaaa

SEQ ID NO: 298744 - DNA, 25 bp, Mus musculus
gatccaagagtcggccacaggttgt

SEQ ID NO: 298745 - DNA, 25 bp, Mus musculus
gatccaagggggtgcctgtgggccg

SEQ ID NO: 298746 - DNA, 25 bp, Mus musculus
gatccaagtgagttacaagacttaa

SEQ ID NO: 298747 - DNA, 25 bp, Mus musculus
gatccaatagagaggttgatgtttt

SEQ ID NO: 298748 - DNA, 25 bp, Mus musculus
gatccacaaagaggcggttacaggg

SEQ ID NO: 298749 - DNA, 25 bp, Mus musculus
gatccacaactgcaggctgtttggt

SEQ ID NO: 298750 - DNA, 25 bp, Mus musculus
gatccacaaggataggtcatgctgt

SEQ ID NO: 298751 - DNA, 25 bp, Mus musculus
gatccacacagcaggacagttgtcc

SEQ ID NO: 298752 - DNA, 25 bp, Mus musculus
gatccacacaggcgagaagcctcac

SEQ ID NO: 298753 - DNA, 25 bp, Mus musculus
gatccacagagatgtgaagccatcc

SEQ ID NO: 298754 - DNA, 25 bp, Mus musculus
gatccaccagcactgccccccaaac

SEQ ID NO: 298755 - DNA, 25 bp, Mus musculus
gatccaccaggtttgaggagttcct

SEQ ID NO: 298756 - DNA, 25 bp, Mus musculus
gatccacgaggacccgcctcgcatg

SEQ ID NO: 298757 - DNA, 25 bp, Mus musculus
gatccagaaaagctctccgtaaatt

SEQ ID NO: 298758 - DNA, 25 bp, Mus musculus
gatccagaaaagctgtcttcagaca

SEQ ID NO: 298759 - DNA, 25 bp, Mus musculus
gatccagaaagatcaagagcacctg

SEQ ID NO: 298760 - DNA, 25 bp, Mus musculus
gatccagaacctggagaatgtggtt

SEQ ID NO: 298761 - DNA, 25 bp, Mus musculus
gatccagaagcagaggacgttcgta

SEQ ID NO: 298762 - DNA, 25 bp, Mus musculus
gatccagaaggaactgactgattac

SEQ ID NO: 298763 - DNA, 25 bp, Mus musculus
gatccagaaggttgctttcactacc

SEQ ID NO: 298764 - DNA, 25 bp, Mus musculus
gatccagacaaccaggtcagaaaac

SEQ ID NO: 298765 - DNA, 25 bp, Mus musculus
gatccagacaacggccccacctgtc

SEQ ID NO: 298766 - DNA, 25 bp, Mus musculus
gatccagacacagatggaggtagtg

SEQ ID NO: 298767 - DNA, 25 bp, Mus musculus
gatccagacacaggcaactggcccg

SEQ ID NO: 298768 - DNA, 25 bp, Mus musculus
gatccagacctcaggtttaacacac

SEQ ID NO: 298769 - DNA, 25 bp, Mus musculus
gatccagacggccacccgagacctc

SEQ ID NO: 298770 - DNA, 25 bp, Mus musculus
gatccagcagttacacctggagcac

SEQ ID NO: 298771 - DNA, 25 bp, Mus musculus
gatccagccgagcccggtcttgcta

SEQ ID NO: 298772 - DNA, 25 bp, Mus musculus
gatccagccggttactctccaggac

SEQ ID NO: 298773 - DNA, 25 bp, Mus musculus
gatccagccttggatccaattatag

SEQ ID NO: 298774 - DNA, 25 bp, Mus musculus
gatccagctgatggtagaagagagt

SEQ ID NO: 298775 - DNA, 25 bp, Mus musculus
gatccagcttacattgcagttttag

SEQ ID NO: 298776 - DNA, 25 bp, Mus musculus
gatccagcttgtattgcagttttag

SEQ ID NO: 298777 - DNA, 25 bp, Mus musculus
gatccaggaaacaagaacgtatctc

SEQ ID NO: 298778 - DNA, 25 bp, Mus musculus
gatccaggacgaagggtcctgtgcg

SEQ ID NO: 298779 - DNA, 25 bp, Mus musculus
gatccaggagacaaattgagaccta

SEQ ID NO: 298780 - DNA, 25 bp, Mus musculus
gatccaggagacaagcatctaatga

SEQ ID NO: 298781 - DNA, 25 bp, Mus musculus
gatccaggagctggtggaagccatt

SEQ ID NO: 298782 - DNA, 25 bp, Mus musculus
gatccaggaggacttcttcctggca

SEQ ID NO: 298783 - DNA, 25 bp, Mus musculus
gatccagggcaagaaagtatccacg

SEQ ID NO: 298784 - DNA, 25 bp, Mus musculus
gatccagggcaaggtatgtcctctg

SEQ ID NO: 298785 - DNA, 25 bp, Mus musculus
gatccaggtggcacattggaagtta

SEQ ID NO: 298786 - DNA, 25 bp, Mus musculus
gatccagtaaagccaacaaattact

SEQ ID NO: 298787 - DNA, 25 bp, Mus musculus
gatccagtaaagtccaggtacatag

SEQ ID NO: 298788 - DNA, 25 bp, Mus musculus
gatccagtcaaggaggaggatgact

SEQ ID NO: 298789 - DNA, 25 bp, Mus musculus
gatccagtcaaggatgactatgacg

SEQ ID NO: 298790 - DNA, 25 bp, Mus musculus
gatccagtgaggcctcaggtccagg

SEQ ID NO: 298791 - DNA, 25 bp, Mus musculus
gatccagtgccagcccaggcctcca

SEQ ID NO: 298792 - DNA, 25 bp, Mus musculus
gatccagttattcagtggttctggg

SEQ ID NO: 298793 - DNA, 25 bp, Mus musculus
gatccagttattcagttcgttactg

SEQ ID NO: 298794 - DNA, 25 bp, Mus musculus
gatccagttcaggatgagatgctgg

SEQ ID NO: 298795 - DNA, 25 bp, Mus musculus
gatccatcaagtgggttcatgtact

SEQ ID NO: 298796 - DNA, 25 bp, Mus musculus
gatccatctcagggttctggctgct

SEQ ID NO: 298797 - DNA, 25 bp, Mus musculus
gatccatgaaaagcaagatgggcat

SEQ ID NO: 298798 - DNA, 25 bp, Mus musculus
gatccatgagaaattgttcccctcc

SEQ ID NO: 298799 - DNA, 25 bp, Mus musculus
gatccatgagaaggtactgaatgag

SEQ ID NO: 298800 - DNA, 25 bp, Mus musculus
gatccatgagtactacagcatgggc

SEQ ID NO: 298801 - DNA, 25 bp, Mus musculus
gatccatgtcccacaattctcgact

SEQ ID NO: 298802 - DNA, 25 bp, Mus musculus
gatccatgtcccacagtaacccctc

SEQ ID NO: 298803 - DNA, 25 bp, Mus musculus
gatccattcaaaggcattggccagg

SEQ ID NO: 298804 - DNA, 25 bp, Mus musculus
gatccattccggcgcccatggcgaa

SEQ ID NO: 298805 - DNA, 25 bp, Mus musculus
gatcccaaaattgctgtgatcgcct

SEQ ID NO: 298806 - DNA, 25 bp, Mus musculus
gatcccaacacccagcaagaagtct

SEQ ID NO: 298807 - DNA, 25 bp, Mus musculus
gatcccaagggttggcccctaggtg

SEQ ID NO: 298808 - DNA, 25 bp, Mus musculus
gatcccaatgctcggtccgcggagg

SEQ ID NO: 298809 - DNA, 25 bp, Mus musculus
gatcccacagatccaacttttacaa

SEQ ID NO: 298810 - DNA, 25 bp, Mus musculus
gatcccacagtgcaatttggtctga

SEQ ID NO: 298811 - DNA, 25 bp, Mus musculus
gatcccaccaaggtgaaggcccacg

SEQ ID NO: 298812 - DNA, 25 bp, Mus musculus
gatcccactctgaggagaagaattg

SEQ ID NO: 298813 - DNA, 25 bp, Mus musculus
gatcccactctgaggtccagagttc

SEQ ID NO: 298814 - DNA, 25 bp, Mus musculus
gatcccagagccaaaaaccaaagat

SEQ ID NO: 298815 - DNA, 25 bp, Mus musculus
gatcccagagccaaaacttccacgg

SEQ ID NO: 298816 - DNA, 25 bp, Mus musculus
gatcccagagctggtttggccctgg

SEQ ID NO: 298817 - DNA, 25 bp, Mus musculus
gatcccagcagcaagaaggtgacgg

SEQ ID NO: 298818 - DNA, 25 bp, Mus musculus
gatcccagcagcaagtgggcagaag

SEQ ID NO: 298819 - DNA, 25 bp, Mus musculus
gatcccagcagcattctgcagacct

SEQ ID NO: 298820 - DNA, 25 bp, Mus musculus
gatcccagccctcacctcctgtctc

SEQ ID NO: 298821 - DNA, 25 bp, Mus musculus
gatcccagccctgtccctaggaggg

SEQ ID NO: 298822 - DNA, 25 bp, Mus musculus
gatcccagcgaaaagcccattggaa

SEQ ID NO: 298823 - DNA, 25 bp, Mus musculus
gatcccaggaacaggtatacaagag

SEQ ID NO: 298824 - DNA, 25 bp, Mus musculus
gatcccaggaagctggagaaggggt

SEQ ID NO: 298825 - DNA, 25 bp, Mus musculus
gatcccaggaagctggtccagctca

SEQ ID NO: 298826 - DNA, 25 bp, Mus musculus
gatcccaggggaaggctactacatg

SEQ ID NO: 298827 - DNA, 25 bp, Mus musculus
gatcccagtgctgcacatgatggca

SEQ ID NO: 298828 - DNA, 25 bp, Mus musculus
gatcccagtgctgggtctcttttaa

SEQ ID NO: 298829 - DNA, 25 bp, Mus musculus
gatcccatctccgatggtggaacca

SEQ ID NO: 298830 - DNA, 25 bp, Mus musculus
gatcccatggaacaccccatgctta

SEQ ID NO: 298831 - DNA, 25 bp, Mus musculus
gatcccattggaaagatggtggaac

SEQ ID NO: 298832 - DNA, 25 bp, Mus musculus
gatccccaaggcgagttctggctgg

SEQ ID NO: 298833 - DNA, 25 bp, Mus musculus
gatccccaagggtgtgctggctgtg

SEQ ID NO: 298834 - DNA, 25 bp, Mus musculus
gatccccaagtgcctggctgagcgc

SEQ ID NO: 298835 - DNA, 25 bp, Mus musculus
gatccccaatgtggaaaccatcctt

SEQ ID NO: 298836 - DNA, 25 bp, Mus musculus
gatccccacaggagaaatgctcttc

SEQ ID NO: 298837 - DNA, 25 bp, Mus musculus
gatccccacaggtgatggacagaat

SEQ ID NO: 298838 - DNA, 25 bp, Mus musculus
gatccccagacagttacacgtctgc

SEQ ID NO: 298839 - DNA, 25 bp, Mus musculus
gatccccagacgagcaccaaggaaa

SEQ ID NO: 298840 - DNA, 25 bp, Mus musculus
gatccccagctgtgctcaggatgat

SEQ ID NO: 298841 - DNA, 25 bp, Mus musculus
gatccccatagcagacaacaacagt

SEQ ID NO: 298842 - DNA, 25 bp, Mus musculus
gatccccatagcaggggaagaagag

SEQ ID NO: 298843 - DNA, 25 bp, Mus musculus
gatccccatagcaggtattccagca

SEQ ID NO: 298844 - DNA, 25 bp, Mus musculus
gatccccatcgataggcccagcagc

SEQ ID NO: 298845 - DNA, 25 bp, Mus musculus
gatccccatcgataggctcaggtat

SEQ ID NO: 298846 - DNA, 25 bp, Mus musculus
gatccccatcgatagtgtgtgccct

SEQ ID NO: 298847 - DNA, 25 bp, Mus musculus
gatcccccaagagcaagagaagcag

SEQ ID NO: 298848 - DNA, 25 bp, Mus musculus
gatcccccaaggaagctctttgtgt

SEQ ID NO: 298849 - DNA, 25 bp, Mus musculus
gatcccccagagaggccaggctggg

SEQ ID NO: 298850 - DNA, 25 bp, Mus musculus
gatcccccagagagtcatggaccaa

SEQ ID NO: 298851 - DNA, 25 bp, Mus musculus
gatcccccaggcccggctctactct

SEQ ID NO: 298852 - DNA, 25 bp, Mus musculus
gatcccccagggtgaagcactggat

SEQ ID NO: 298853 - DNA, 25 bp, Mus musculus
gatcccccagggttgtgacttagaa

SEQ ID NO: 298854 - DNA, 25 bp, Mus musculus
gatcccccgaaataggctgctggca

SEQ ID NO: 298855 - DNA, 25 bp, Mus musculus
gatcccccgcagcgtttggaaaacg

SEQ ID NO: 298856 - DNA, 25 bp, Mus musculus
gatcccctcatgaaggaagtggaga

SEQ ID NO: 298857 - DNA, 25 bp, Mus musculus
gatcccctcatgaagggtacggatt

SEQ ID NO: 298858 - DNA, 25 bp, Mus musculus
gatcccctgaaacatgctggtgtct

SEQ ID NO: 298859 - DNA, 25 bp, Mus musculus
gatcccctgccccaggacttctctg

SEQ ID NO: 298860 - DNA, 25 bp, Mus musculus
gatcccctgggagtgggaggagtga

SEQ ID NO: 298861 - DNA, 25 bp, Mus musculus
gatccccttggaaagcttttatgaa

SEQ ID NO: 298862 - DNA, 25 bp, Mus musculus
gatcccgagaatacgcagaccaaac

SEQ ID NO: 298863 - DNA, 25 bp, Mus musculus
gatcccgatcaagatcatactctcc

SEQ ID NO: 298864 - DNA, 25 bp, Mus musculus
gatcccgctctccgtagtgaagctg

SEQ ID NO: 298865 - DNA, 25 bp, Mus musculus
gatcccgggataggcttctgtgtca

SEQ ID NO: 298866 - DNA, 25 bp, Mus musculus
gatcccgggcaggcagtatgggctt

SEQ ID NO: 298867 - DNA, 25 bp, Mus musculus
gatcccgtgaaggtgattcagacaa

SEQ ID NO: 298868 - DNA, 25 bp, Mus musculus
gatccctactccaaggtgaagcaga

SEQ ID NO: 298869 - DNA, 25 bp, Mus musculus
gatccctagataagaaagtctggat

SEQ ID NO: 298870 - DNA, 25 bp, Mus musculus
gatccctagatatgaaagtctggat

SEQ ID NO: 298871 - DNA, 25 bp, Mus musculus
gatccctccagcggaactggctcag

SEQ ID NO: 298872 - DNA, 25 bp, Mus musculus
gatccctccaggaggagcaggacaa

SEQ ID NO: 298873 - DNA, 25 bp, Mus musculus
gatccctctaaaagaagcgtgcaat

SEQ ID NO: 298874 - DNA, 25 bp, Mus musculus
gatccctctaaaagcttcctgcagt

SEQ ID NO: 298875 - DNA, 25 bp, Mus musculus
gatccctctcagccccctggtgctc

SEQ ID NO: 298876 - DNA, 25 bp, Mus musculus
gatccctctcaggtttacagcccca

SEQ ID NO: 298877 - DNA, 25 bp, Mus musculus
gatccctctgtgcactgagcagcct

SEQ ID NO: 298878 - DNA, 25 bp, Mus musculus
gatccctctgttttgccattgctgg

SEQ ID NO: 298879 - DNA, 25 bp, Mus musculus
gatccctgaattgacccagcccggg

SEQ ID NO: 298880 - DNA, 25 bp, Mus musculus
gatccctgcaaggaaagagtgccac

SEQ ID NO: 298881 - DNA, 25 bp, Mus musculus
gatccctgtaacagccaaacaccat

SEQ ID NO: 298882 - DNA, 25 bp, Mus musculus
gatccctgtaacaggaatgggctgc

SEQ ID NO: 298883 - DNA, 25 bp, Mus musculus
gatcccttcagagggacagaccacc

SEQ ID NO: 298884 - DNA, 25 bp, Mus musculus
gatccgagagactacaggagcccag

SEQ ID NO: 298885 - DNA, 25 bp, Mus musculus
gatccgagaggccttggaagctaac

SEQ ID NO: 298886 - DNA, 25 bp, Mus musculus
gatccgcaagctgccccccaagtgt

SEQ ID NO: 298887 - DNA, 25 bp, Mus musculus
gatccgcaagctgtctgatcagtgc

SEQ ID NO: 298888 - DNA, 25 bp, Mus musculus
gatccgcacgaaataaatcataatg

SEQ ID NO: 298889 - DNA, 25 bp, Mus musculus
gatccgcagtatgttccggaagctg

SEQ ID NO: 298890 - DNA, 25 bp, Mus musculus
gatccgcagtggtttctctgtatag

SEQ ID NO: 298891 - DNA, 25 bp, Mus musculus
gatccgccagtttacagacctgcag

SEQ ID NO: 298892 - DNA, 25 bp, Mus musculus
gatccgcccaagagctcaaagccca

SEQ ID NO: 298893 - DNA, 25 bp, Mus musculus
gatccgcccagtgggggcaggagga

SEQ ID NO: 298894 - DNA, 25 bp, Mus musculus
gatccgccccgcacagtatcagaaa

SEQ ID NO: 298895 - DNA, 25 bp, Mus musculus
gatccgcctccccgatcccgcccgg

SEQ ID NO: 298896 - DNA, 25 bp, Mus musculus
gatccgcctgctggacagcgtgctg

SEQ ID NO: 298897 - DNA, 25 bp, Mus musculus
gatccgcgtgggatccaaggactgt

SEQ ID NO: 298898 - DNA, 25 bp, Mus musculus
gatccggaaccagcctctgacctcc

SEQ ID NO: 298899 - DNA, 25 bp, Mus musculus
gatccggaacggtctgaaggtcact

SEQ ID NO: 298900 - DNA, 25 bp, Mus musculus
gatccggaacggtggttgtggaggc

SEQ ID NO: 298901 - DNA, 25 bp, Mus musculus
gatccggaagtaaaagccggaagag

SEQ ID NO: 298902 - DNA, 25 bp, Mus musculus
gatccggaagtataagccggaagag

SEQ ID NO: 298903 - DNA, 25 bp, Mus musculus
gatccggatggagcttttaaggaat

SEQ ID NO: 298904 - DNA, 25 bp, Mus musculus
gatccggatgggtatagtgccaaac

SEQ ID NO: 298905 - DNA, 25 bp, Mus musculus
gatccggcagcttaggttgtcctat

SEQ ID NO: 298906 - DNA, 25 bp, Mus musculus
gatccggcaggaattgaagttaaaa

SEQ ID NO: 298907 - DNA, 25 bp, Mus musculus
gatccggctgcaagatgagcctggg

SEQ ID NO: 298908 - DNA, 25 bp, Mus musculus
gatccggctgcaagggttgttaaac

SEQ ID NO: 298909 - DNA, 25 bp, Mus musculus
gatccgggacagaggaccaggagga

SEQ ID NO: 298910 - DNA, 25 bp, Mus musculus
gatccgggacagcaagaagttcctg

SEQ ID NO: 298911 - DNA, 25 bp, Mus musculus
gatccgggagaaggtcctgggcaag

SEQ ID NO: 298912 - DNA, 25 bp, Mus musculus
gatccgggagctggagtcctttgga

SEQ ID NO: 298913 - DNA, 25 bp, Mus musculus
gatccgggaggaacatcacaagtgc

SEQ ID NO: 298914 - DNA, 25 bp, Mus musculus
gatccggtcgagatgaccggttcga

SEQ ID NO: 298915 - DNA, 25 bp, Mus musculus
gatccgtaggaagaagtccctctcg

SEQ ID NO: 298916 - DNA, 25 bp, Mus musculus
gatccgtgaaggaagaggctgtggc

SEQ ID NO: 298917 - DNA, 25 bp, Mus musculus
gatccgtgacagactcaaactagaa

SEQ ID NO: 298918 - DNA, 25 bp, Mus musculus
gatccgtgacaggccctttgaacgg

SEQ ID NO: 298919 - DNA, 25 bp, Mus musculus
gatccgtggacaacctggacagctt

SEQ ID NO: 298920 - DNA, 25 bp, Mus musculus
gatccgtggggccaggcctcttagg

SEQ ID NO: 298921 - DNA, 25 bp, Mus musculus
gatccgtttacaggtgctgggcgtt

SEQ ID NO: 298922 - DNA, 25 bp, Mus musculus
gatccgtttacaggtggtggtcgct

SEQ ID NO: 298923 - DNA, 25 bp, Mus musculus
gatcctaaagtggccgtgcctgcag

SEQ ID NO: 298924 - DNA, 25 bp, Mus musculus
gatcctaagcaaaaggctgaggagc

SEQ ID NO: 298925 - DNA, 25 bp, Mus musculus
gatcctacagcttcacatggagtga

SEQ ID NO: 298926 - DNA, 25 bp, Mus musculus
gatcctcaaggggaaactgtttgat

SEQ ID NO: 298927 - DNA, 25 bp, Mus musculus
gatcctcatcccatgcttccaaact

SEQ ID NO: 298928 - DNA, 25 bp, Mus musculus
gatcctcatcggggtacttttgatg

SEQ ID NO: 298929 - DNA, 25 bp, Mus musculus
gatcctccaacaatcctccatgtga

SEQ ID NO: 298930 - DNA, 25 bp, Mus musculus
gatcctccaggtggccacggtgaag

SEQ ID NO: 298931 - DNA, 25 bp, Mus musculus
gatcctccagtgactccatcaaaga

SEQ ID NO: 298932 - DNA, 25 bp, Mus musculus
gatcctccagtgtctccagaacaag

SEQ ID NO: 298933 - DNA, 25 bp, Mus musculus
gatcctcccagccactggtgtgact

SEQ ID NO: 298934 - DNA, 25 bp, Mus musculus
gatcctcccagggttcactgatcac

SEQ ID NO: 298935 - DNA, 25 bp, Mus musculus
gatcctcccccaacactacaggcgc

SEQ ID NO: 298936 - DNA, 25 bp, Mus musculus
gatcctcccccatcactacaggcgc

SEQ ID NO: 298937 - DNA, 25 bp, Mus musculus
gatcctccgacagttcaaccagaca

SEQ ID NO: 298938 - DNA, 25 bp, Mus musculus
gatcctccgacagttcagtcaacag

SEQ ID NO: 298939 - DNA, 25 bp, Mus musculus
gatcctccgagagttctgtccttgg

SEQ ID NO: 298940 - DNA, 25 bp, Mus musculus
gatcctccggggcaacattttgatg

SEQ ID NO: 298941 - DNA, 25 bp, Mus musculus
gatcctccggggcatccagggaaat

SEQ ID NO: 298942 - DNA, 25 bp, Mus musculus
gatcctcgaaacagggtcacgtctc

SEQ ID NO: 298943 - DNA, 25 bp, Mus musculus
gatcctcgcctttggtaccacgtac

SEQ ID NO: 298944 - DNA, 25 bp, Mus musculus
gatcctcggcctggtcaccgaagtg

SEQ ID NO: 298945 - DNA, 25 bp, Mus musculus
gatcctctaagcaggtaaacgagtt

SEQ ID NO: 298946 - DNA, 25 bp, Mus musculus
gatcctctaagcaggtttctacccc

SEQ ID NO: 298947 - DNA, 25 bp, Mus musculus
gatcctctcaatgaattcctggagg

SEQ ID NO: 298948 - DNA, 25 bp, Mus musculus
gatcctctccaggacccaagtttct

SEQ ID NO: 298949 - DNA, 25 bp, Mus musculus
gatcctctcggtaaatggccaagat

SEQ ID NO: 298950 - DNA, 25 bp, Mus musculus
gatcctctgaacctgccgaattcga

SEQ ID NO: 298951 - DNA, 25 bp, Mus musculus
gatcctctgcactgctctcaggaga

SEQ ID NO: 298952 - DNA, 25 bp, Mus musculus
gatcctgaaaaatgtgggggttgct

SEQ ID NO: 298953 - DNA, 25 bp, Mus musculus
gatcctgaaaagtattgataatgag

SEQ ID NO: 298954 - DNA, 25 bp, Mus musculus
gatcctgaagactgctggagttaat

SEQ ID NO: 298955 - DNA, 25 bp, Mus musculus
gatcctgaagatgttgctgtgcatc

SEQ ID NO: 298956 - DNA, 25 bp, Mus musculus
gatcctgaagcattcgggaattaat

SEQ ID NO: 298957 - DNA, 25 bp, Mus musculus
gatcctgaagctgcgacaagggtct

SEQ ID NO: 298958 - DNA, 25 bp, Mus musculus
gatcctgacaagggcacgtggagat

SEQ ID NO: 298959 - DNA, 25 bp, Mus musculus
gatcctgacatgactgacttacagg

SEQ ID NO: 298960 - DNA, 25 bp, Mus musculus
gatcctgagaatgaatgaacaaaac

SEQ ID NO: 298961 - DNA, 25 bp, Mus musculus
gatcctgagaatggtctctctggga

SEQ ID NO: 298962 - DNA, 25 bp, Mus musculus
gatcctgagacaggctccgtccatg

SEQ ID NO: 298963 - DNA, 25 bp, Mus musculus
gatcctgagacttgttcaaggggag

SEQ ID NO: 298964 - DNA, 25 bp, Mus musculus
gatcctgataaacttcccacgacag

SEQ ID NO: 298965 - DNA, 25 bp, Mus musculus
gatcctgatctgtgtgggcgggtgc

SEQ ID NO: 298966 - DNA, 25 bp, Mus musculus
gatcctgattgagggccgcaaacag

SEQ ID NO: 298967 - DNA, 25 bp, Mus musculus
gatcctgccagaaccacctgtagct

SEQ ID NO: 298968 - DNA, 25 bp, Mus musculus
gatcctgccagaggaagcccgtgct

SEQ ID NO: 298969 - DNA, 25 bp, Mus musculus
gatcctgcccagtgttgaagaaatt

SEQ ID NO: 298970 - DNA, 25 bp, Mus musculus
gatcctgccggcgagtgaggaagtg

SEQ ID NO: 298971 - DNA, 25 bp, Mus musculus
gatcctgccggcgctctgaaatcac

SEQ ID NO: 298972 - DNA, 25 bp, Mus musculus
gatcctgccttgacactagttgctg

SEQ ID NO: 298973 - DNA, 25 bp, Mus musculus
gatcctgctggccagatagacagga

SEQ ID NO: 298974 - DNA, 25 bp, Mus musculus
gatcctggagcacttggaatctcag

SEQ ID NO: 298975 - DNA, 25 bp, Mus musculus
gatcctggaggctgttcatcagcag

SEQ ID NO: 298976 - DNA, 25 bp, Mus musculus
gatcctggaggtggccttagacatg

SEQ ID NO: 298977 - DNA, 25 bp, Mus musculus
gatcctggatctgagggaaatctgc

SEQ ID NO: 298978 - DNA, 25 bp, Mus musculus
gatcctgggctgggacgaagtagct

SEQ ID NO: 298979 - DNA, 25 bp, Mus musculus
gatcctgtaagactttaacccatga

SEQ ID NO: 298980 - DNA, 25 bp, Mus musculus
gatcctgtaaggcactggtgaagtg

SEQ ID NO: 298981 - DNA, 25 bp, Mus musculus
gatcctgtcgctgtggctacgtgtt

SEQ ID NO: 298982 - DNA, 25 bp, Mus musculus
gatcctgtggctaagtaagaaatcc

SEQ ID NO: 298983 - DNA, 25 bp, Mus musculus
gatcctgtggctaagtgactaataa

SEQ ID NO: 298984 - DNA, 25 bp, Mus musculus
gatcctgtggctaatcctgtctgta

SEQ ID NO: 298985 - DNA, 25 bp, Mus musculus
gatcctgtggctaatttcagagtga

SEQ ID NO: 298986 - DNA, 25 bp, Mus musculus
gatcctgtgtccctcatacaactag

SEQ ID NO: 298987 - DNA, 25 bp, Mus musculus
gatccttacatgcgctgtaagatga

SEQ ID NO: 298988 - DNA, 25 bp, Mus musculus
gatccttacatgctcctgaccactt

SEQ ID NO: 298989 - DNA, 25 bp, Mus musculus
gatccttaccagtgaggctgctgga

SEQ ID NO: 298990 - DNA, 25 bp, Mus musculus
gatccttaccagtgaggctgtgtct

SEQ ID NO: 298991 - DNA, 25 bp, Mus musculus
gatccttcacgttgggttcgccaag

SEQ ID NO: 298992 - DNA, 25 bp, Mus musculus
gatccttccaaaaggcccacagcag

SEQ ID NO: 298993 - DNA, 25 bp, Mus musculus
gatccttccaagactcagattagcc

SEQ ID NO: 298994 - DNA, 25 bp, Mus musculus
gatccttcgccacagaaatggcctc

SEQ ID NO: 298995 - DNA, 25 bp, Mus musculus
gatccttctgagagctgtccagctc

SEQ ID NO: 298996 - DNA, 25 bp, Mus musculus
gatccttctgagccaatagtaacca

SEQ ID NO: 298997 - DNA, 25 bp, Mus musculus
gatccttctttgttgggtgggacta

SEQ ID NO: 298998 - DNA, 25 bp, Mus musculus
gatccttggcagaagctctgcagat

SEQ ID NO: 298999 - DNA, 25 bp, Mus musculus
gatccttggcagaaggtagcacggc

SEQ ID NO: 299000 - DNA, 25 bp, Mus musculus
gatccttgtggacttctgggataca

SEQ ID NO: 299001 - DNA, 25 bp, Mus musculus
gatccttgtgggtatttgatgtcca

SEQ ID NO: 299002 - DNA, 25 bp, Mus musculus
gatcctttcacaggtgctgggcgtt

SEQ ID NO: 299003 - DNA, 25 bp, Mus musculus
gatcctttcaggagcccagctccca

SEQ ID NO: 299004 - DNA, 25 bp, Mus musculus
gatcctttcaggtgctgtaggagcc

SEQ ID NO: 299005 - DNA, 25 bp, Mus musculus
gatcctttcctaacgctgctgcatt

SEQ ID NO: 299006 - DNA, 25 bp, Mus musculus
gatcctttcggctgtcggcgagcca

SEQ ID NO: 299007 - DNA, 25 bp, Mus musculus
gatcctttgtgtggttcttcttgct

SEQ ID NO: 299008 - DNA, 25 bp, Mus musculus
gatcgaaataaattgaaaaacatgt

SEQ ID NO: 299009 - DNA, 25 bp, Mus musculus
gatcgaagagttagcaatagcgaag

SEQ ID NO: 299010 - DNA, 25 bp, Mus musculus
gatcgaagcggccttgggatgtctc

SEQ ID NO: 299011 - DNA, 25 bp, Mus musculus
gatcgaaggcctgcaagacgacaag

SEQ ID NO: 299012 - DNA, 25 bp, Mus musculus
gatcgaaggcctggtcattcaatat

SEQ ID NO: 299013 - DNA, 25 bp, Mus musculus
gatcgaatctacagggatgaatgga

SEQ ID NO: 299014 - DNA, 25 bp, Mus musculus
gatcgaatctacaggttatacaatg

SEQ ID NO: 299015 - DNA, 25 bp, Mus musculus
gatcgacaaccacagcaaacccttc

SEQ ID NO: 299016 - DNA, 25 bp, Mus musculus
gatcgacacaaatgaagaaaaaact

SEQ ID NO: 299017 - DNA, 25 bp, Mus musculus
gatcgacacaataaaattgaagagc

SEQ ID NO: 299018 - DNA, 25 bp, Mus musculus
gatcgacgacctccacaaggttctg

SEQ ID NO: 299019 - DNA, 25 bp, Mus musculus
gatcgacggcctggtagtattaaag

SEQ ID NO: 299020 - DNA, 25 bp, Mus musculus
gatcgagcaggtgaatgagcgagtc

SEQ ID NO: 299021 - DNA, 25 bp, Mus musculus
gatcgagcaggttcctcatgagggt

SEQ ID NO: 299022 - DNA, 25 bp, Mus musculus
gatcgaggcatggccagtaatgtta

SEQ ID NO: 299023 - DNA, 25 bp, Mus musculus
gatcgaggcatgggtgaacggcctt

SEQ ID NO: 299024 - DNA, 25 bp, Mus musculus
gatcgatactgtggagactatgaca

SEQ ID NO: 299025 - DNA, 25 bp, Mus musculus
gatcgatactgtggagggctccacc

SEQ ID NO: 299026 - DNA, 25 bp, Mus musculus
gatcgatgagctatgtgccaccttt

SEQ ID NO: 299027 - DNA, 25 bp, Mus musculus
gatcgatgagctttcactctactca

SEQ ID NO: 299028 - DNA, 25 bp, Mus musculus
gatcgatgaggaagggaacctgatt

SEQ ID NO: 299029 - DNA, 25 bp, Mus musculus
gatcgatgccagaaagaagagctga

SEQ ID NO: 299030 - DNA, 25 bp, Mus musculus
gatcgatgccagattttgcctcagt

SEQ ID NO: 299031 - DNA, 25 bp, Mus musculus
gatcgatgccaggtttcactttttc

SEQ ID NO: 299032 - DNA, 25 bp, Mus musculus
gatcgattccgaatctgcctcagcc

SEQ ID NO: 299033 - DNA, 25 bp, Mus musculus
gatcgattccgatttgtgctagtga

SEQ ID NO: 299034 - DNA, 25 bp, Mus musculus
gatcgcaagaaaaagtctgatgcca

SEQ ID NO: 299035 - DNA, 25 bp, Mus musculus
gatcgcagaggggacaatgccaagt

SEQ ID NO: 299036 - DNA, 25 bp, Mus musculus
gatcgcagtgcacagagcatatgaa

SEQ ID NO: 299037 - DNA, 25 bp, Mus musculus
gatcgccaagcggacccagccacct

SEQ ID NO: 299038 - DNA, 25 bp, Mus musculus
gatcgccaatggttggttttgaccc

SEQ ID NO: 299039 - DNA, 25 bp, Mus musculus
gatcgcccctaagccttcaagatgg

SEQ ID NO: 299040 - DNA, 25 bp, Mus musculus
gatcgcccctaaggtaagttctcgt

SEQ ID NO: 299041 - DNA, 25 bp, Mus musculus
gatcgcccggcaggcctatgagaag

SEQ ID NO: 299042 - DNA, 25 bp, Mus musculus
gatcgccggaaagagacacagcagt

SEQ ID NO: 299043 - DNA, 25 bp, Mus musculus
gatcgcctcaaggagtatgtctcca

SEQ ID NO: 299044 - DNA, 25 bp, Mus musculus
gatcgcctccagcctatttaagagt

SEQ ID NO: 299045 - DNA, 25 bp, Mus musculus
gatcgcctccaggccagcagcaaca

SEQ ID NO: 299046 - DNA, 25 bp, Mus musculus
gatcgcctgcagagaggaagacgac

SEQ ID NO: 299047 - DNA, 25 bp, Mus musculus
gatcgcctgcagggtgagttggtga

SEQ ID NO: 299048 - DNA, 25 bp, Mus musculus
gatcgcctgcatcgagggagtagaa

SEQ ID NO: 299049 - DNA, 25 bp, Mus musculus
gatcgcctgtagcaaagtccgaggt

SEQ ID NO: 299050 - DNA, 25 bp, Mus musculus
gatcgcgcgcgaggcggaggccagg

SEQ ID NO: 299051 - DNA, 25 bp, Mus musculus
gatcgcgtcccggcccagggccttg

SEQ ID NO: 299052 - DNA, 25 bp, Mus musculus
gatcgctgtccagctcgtagtgcat

SEQ ID NO: 299053 - DNA, 25 bp, Mus musculus
gatcgctgtccaggagctggagaag

SEQ ID NO: 299054 - DNA, 25 bp, Mus musculus
gatcgctgtgtctatcgtgcgggcc

SEQ ID NO: 299055 - DNA, 25 bp, Mus musculus
gatcgctgtgtctatgtgaagccat

SEQ ID NO: 299056 - DNA, 25 bp, Mus musculus
gatcgcttcaatgcaccgggtgctc

SEQ ID NO: 299057 - DNA, 25 bp, Mus musculus
gatcgcttctttgaggactccagat

SEQ ID NO: 299058 - DNA, 25 bp, Mus musculus
gatcgctttctgaatggtttggcta

SEQ ID NO: 299059 - DNA, 25 bp, Mus musculus
gatcggaacaagtctgggacctgtc

SEQ ID NO: 299060 - DNA, 25 bp, Mus musculus
gatcggaacaattggtacccttgtc

SEQ ID NO: 299061 - DNA, 25 bp, Mus musculus
gatcggaagagaccaagcaaaatga

SEQ ID NO: 299062 - DNA, 25 bp, Mus musculus
gatcggactaggtctgcctgggctt

SEQ ID NO: 299063 - DNA, 25 bp, Mus musculus
gatcggactagtggccacagttaag

SEQ ID NO: 299064 - DNA, 25 bp, Mus musculus
gatcggagccgcagcagttgcccca

SEQ ID NO: 299065 - DNA, 25 bp, Mus musculus
gatcggagtgccaagacacaagcat

SEQ ID NO: 299066 - DNA, 25 bp, Mus musculus
gatcggagtgccaattattctgttt

SEQ ID NO: 299067 - DNA, 25 bp, Mus musculus
gatcggccagtgagcccatcatctt

SEQ ID NO: 299068 - DNA, 25 bp, Mus musculus
gatcggccagtgccaaggcctggcc

SEQ ID NO: 299069 - DNA, 25 bp, Mus musculus
gatcggctacacagaagttcagttc

SEQ ID NO: 299070 - DNA, 25 bp, Mus musculus
gatcggctacacagatgttcactga

SEQ ID NO: 299071 - DNA, 25 bp, Mus musculus
gatcggctacacagtctgggtgttt

SEQ ID NO: 299072 - DNA, 25 bp, Mus musculus
gatcggctcattgaggtgaatgggc

SEQ ID NO: 299073 - DNA, 25 bp, Mus musculus
gatcggctccgagggagcagaaggc

SEQ ID NO: 299074 - DNA, 25 bp, Mus musculus
gatcggctccgaggtgggaaactac

SEQ ID NO: 299075 - DNA, 25 bp, Mus musculus
gatcggctctccgggtgtaaagatc

SEQ ID NO: 299076 - DNA, 25 bp, Mus musculus
gatcgggaacatggagcacatggct

SEQ ID NO: 299077 - DNA, 25 bp, Mus musculus
gatcgggcgagctgtaaaagctggc

SEQ ID NO: 299078 - DNA, 25 bp, Mus musculus
gatcgggctgcctggcgtggccgag

SEQ ID NO: 299079 - DNA, 25 bp, Mus musculus
gatcgggctgcctgtctccctccag

SEQ ID NO: 299080 - DNA, 25 bp, Mus musculus
gatcgggcttgggcccagagtatgt

SEQ ID NO: 299081 - DNA, 25 bp, Mus musculus
gatcggggcaggatggcagccacag

SEQ ID NO: 299082 - DNA, 25 bp, Mus musculus
gatcggttagagcagatggaagatt

SEQ ID NO: 299083 - DNA, 25 bp, Mus musculus
gatcgtagaggcggatcacattcca

SEQ ID NO: 299084 - DNA, 25 bp, Mus musculus
gatcgtagaggcggggctctgccac

SEQ ID NO: 299085 - DNA, 25 bp, Mus musculus
gatcgtaggggcgaggcacccaagc

SEQ ID NO: 299086 - DNA, 25 bp, Mus musculus
gatcgtcacccacagcaatgagagg

SEQ ID NO: 299087 - DNA, 25 bp, Mus musculus
gatcgtcatatcaggtaacgggcaa

SEQ ID NO: 299088 - DNA, 25 bp, Mus musculus
gatcgtccaaccttctgtgttagcg

SEQ ID NO: 299089 - DNA, 25 bp, Mus musculus
gatcgtccaagttgaaaggccactt

SEQ ID NO: 299090 - DNA, 25 bp, Mus musculus
gatcgtctgagtggagaacttcacc

SEQ ID NO: 299091 - DNA, 25 bp, Mus musculus
gatcgtgcccgatgaacgagaccgt

SEQ ID NO: 299092 - DNA, 25 bp, Mus musculus
gatcgtggcctggagcttaccagcc

SEQ ID NO: 299093 - DNA, 25 bp, Mus musculus
gatcgtggcctggagtgttgaagat

SEQ ID NO: 299094 - DNA, 25 bp, Mus musculus
gatcgtggtgacaagggcaacagca

SEQ ID NO: 299095 - DNA, 25 bp, Mus musculus
gatcgtggttacagagccgagcagt

SEQ ID NO: 299096 - DNA, 25 bp, Mus musculus
gatcgtggttacaggaaataatgaa

SEQ ID NO: 299097 - DNA, 25 bp, Mus musculus
gatcgtgtacagggtgaagttgatt

SEQ ID NO: 299098 - DNA, 25 bp, Mus musculus
gatcgtgtgcgggcatttcagggaa

SEQ ID NO: 299099 - DNA, 25 bp, Mus musculus
gatctaaaaaaccagatcatcacct

SEQ ID NO: 299100 - DNA, 25 bp, Mus musculus
gatctaacaaggagcgagattttga

SEQ ID NO: 299101 - DNA, 25 bp, Mus musculus
gatctaacaaggttcatttaattcc

SEQ ID NO: 299102 - DNA, 25 bp, Mus musculus
gatctaaccatataccagaggagga

SEQ ID NO: 299103 - DNA, 25 bp, Mus musculus
gatctaacccaggtgatgaagtctc

SEQ ID NO: 299104 - DNA, 25 bp, Mus musculus
gatctaatccagggtctgccgtcat

SEQ ID NO: 299105 - DNA, 25 bp, Mus musculus
gatctacactgttgttggccgcccc

SEQ ID NO: 299106 - DNA, 25 bp, Mus musculus
gatctacagaagagagacatctcct

SEQ ID NO: 299107 - DNA, 25 bp, Mus musculus
gatctaccaaagtctcactttatct

SEQ ID NO: 299108 - DNA, 25 bp, Mus musculus
gatctaccagcaaaatcttgctagt

SEQ ID NO: 299109 - DNA, 25 bp, Mus musculus
gatctaccagggatgagtttgtggg

SEQ ID NO: 299110 - DNA, 25 bp, Mus musculus
gatctactaagaaatgtcataaagg

SEQ ID NO: 299111 - DNA, 25 bp, Mus musculus
gatctactcctcagctggaattttg

SEQ ID NO: 299112 - DNA, 25 bp, Mus musculus
gatctacttcattgatcataatacg

SEQ ID NO: 299113 - DNA, 25 bp, Mus musculus
gatctagaagaagaagctgaagtca

SEQ ID NO: 299114 - DNA, 25 bp, Mus musculus
gatctagaatacctgaagaaaattc

SEQ ID NO: 299115 - DNA, 25 bp, Mus musculus
gatctataaaacatatttccagggt

SEQ ID NO: 299116 - DNA, 25 bp, Mus musculus
gatctatccaagcaggctgtcgctt

SEQ ID NO: 299117 - DNA, 25 bp, Mus musculus
gatctatgaatgcactgacactgaa

SEQ ID NO: 299118 - DNA, 25 bp, Mus musculus
gatctatgaggaaatgaataacagt

SEQ ID NO: 299119 - DNA, 25 bp, Mus musculus
gatctatgagttaaacgccaagcca

SEQ ID NO: 299120 - DNA, 25 bp, Mus musculus
gatctatgccgtggacaacaattac

SEQ ID NO: 299121 - DNA, 25 bp, Mus musculus
gatctatgccgtggatgaacggggt

SEQ ID NO: 299122 - DNA, 25 bp, Mus musculus
gatctattaaaagccccagaccctc

SEQ ID NO: 299123 - DNA, 25 bp, Mus musculus
gatctattaaaaggtcaccaccata

SEQ ID NO: 299124 - DNA, 25 bp, Mus musculus
gatctattttcaagaaagtgttgga

SEQ ID NO: 299125 - DNA, 25 bp, Mus musculus
gatctattttcggatgtacatgctg

SEQ ID NO: 299126 - DNA, 25 bp, Mus musculus
gatctcaaaggaaaaccagtggctg

SEQ ID NO: 299127 - DNA, 25 bp, Mus musculus
gatctcaaagggggaaaaaccaatg

SEQ ID NO: 299128 - DNA, 25 bp, Mus musculus
gatctcaaagtgagaaaacaagaaa

SEQ ID NO: 299129 - DNA, 25 bp, Mus musculus
gatctcaactgcaagatggccactg

SEQ ID NO: 299130 - DNA, 25 bp, Mus musculus
gatctcaactgcaagattgcccagc

SEQ ID NO: 299131 - DNA, 25 bp, Mus musculus
gatctcacaacgggcaccaccacaa

SEQ ID NO: 299132 - DNA, 25 bp, Mus musculus
gatctcaccagggcccagtcattta

SEQ ID NO: 299133 - DNA, 25 bp, Mus musculus
gatctcaccggcaaggtgatgcttc

SEQ ID NO: 299134 - DNA, 25 bp, Mus musculus
gatctcacgagacatatctgaagag

SEQ ID NO: 299135 - DNA, 25 bp, Mus musculus
gatctcacgagggagaaactgccta

SEQ ID NO: 299136 - DNA, 25 bp, Mus musculus
gatctcactcaggctcccatgtgtg

SEQ ID NO: 299137 - DNA, 25 bp, Mus musculus
gatctcactgtggtccagattatag

SEQ ID NO: 299138 - DNA, 25 bp, Mus musculus
gatctcagagggatttgacccattc

SEQ ID NO: 299139 - DNA, 25 bp, Mus musculus
gatctcagataataaccaaagagtg

SEQ ID NO: 299140 - DNA, 25 bp, Mus musculus
gatctcagcactgtgtgtcaccgtg

SEQ ID NO: 299141 - DNA, 25 bp, Mus musculus
gatctcaggacggagatgaacatct

SEQ ID NO: 299142 - DNA, 25 bp, Mus musculus
gatctcataagagaggagccaaaag

SEQ ID NO: 299143 - DNA, 25 bp, Mus musculus
gatctcatcaagaccctgaagacag

SEQ ID NO: 299144 - DNA, 25 bp, Mus musculus
gatctcatcaaggcacataccatgt

SEQ ID NO: 299145 - DNA, 25 bp, Mus musculus
gatctcatggagagtaaaagttggc

SEQ ID NO: 299146 - DNA, 25 bp, Mus musculus
gatctccaagacctcactatctcag

SEQ ID NO: 299147 - DNA, 25 bp, Mus musculus
gatctccaaggaccacaatgctgcc

SEQ ID NO: 299148 - DNA, 25 bp, Mus musculus
gatctccaaggactcaggcagctgg

SEQ ID NO: 299149 - DNA, 25 bp, Mus musculus
gatctccaatggactaaattcggag

SEQ ID NO: 299150 - DNA, 25 bp, Mus musculus
gatctccacttgggtgaaagacaag

SEQ ID NO: 299151 - DNA, 25 bp, Mus musculus
gatctccagagtgataatgtgtaca

SEQ ID NO: 299152 - DNA, 25 bp, Mus musculus
gatctccaggggagttttgtgctgc

SEQ ID NO: 299153 - DNA, 25 bp, Mus musculus
gatctccatcaaagaaattagccag

SEQ ID NO: 299154 - DNA, 25 bp, Mus musculus
gatctccatcaaaggacctgataga

SEQ ID NO: 299155 - DNA, 25 bp, Mus musculus
gatctccatgatggtggccagtaaa

SEQ ID NO: 299156 - DNA, 25 bp, Mus musculus
gatctccatgctggagaacataggt

SEQ ID NO: 299157 - DNA, 25 bp, Mus musculus
gatctcccaggagattggagaccga

SEQ ID NO: 299158 - DNA, 25 bp, Mus musculus
gatctcccaggctgtgacctctctt

SEQ ID NO: 299159 - DNA, 25 bp, Mus musculus
gatctccgaagatacttgaaccagt

SEQ ID NO: 299160 - DNA, 25 bp, Mus musculus
gatctccgagaaaattttgccaaag

SEQ ID NO: 299161 - DNA, 25 bp, Mus musculus
gatctccgccagaagcctgcatcct

SEQ ID NO: 299162 - DNA, 25 bp, Mus musculus
gatctcctaggagtgcgcgatgatt

SEQ ID NO: 299163 - DNA, 25 bp, Mus musculus
gatctcctaggtttcaggaatgggc

SEQ ID NO: 299164 - DNA, 25 bp, Mus musculus
gatctcctgggccctcaccagagca

SEQ ID NO: 299165 - DNA, 25 bp, Mus musculus
gatctccttatcaggacgcacatgc

SEQ ID NO: 299166 - DNA, 25 bp, Mus musculus
gatctccttccaaagaggatttgtt

SEQ ID NO: 299167 - DNA, 25 bp, Mus musculus
gatctcgaaacggtaataagccaga

SEQ ID NO: 299168 - DNA, 25 bp, Mus musculus
gatctcgaaacttcagaggatgaat

SEQ ID NO: 299169 - DNA, 25 bp, Mus musculus
gatctcgcctgtggttggtgacaaa

SEQ ID NO: 299170 - DNA, 25 bp, Mus musculus
gatctcgctcaagaagtcctgacat

SEQ ID NO: 299171 - DNA, 25 bp, Mus musculus
gatctctacagaggaaggcattact

SEQ ID NO: 299172 - DNA, 25 bp, Mus musculus
gatctctacaggtagggacccgaaa

SEQ ID NO: 299173 - DNA, 25 bp, Mus musculus
gatctctatggtcccttttggatat

SEQ ID NO: 299174 - DNA, 25 bp, Mus musculus
gatctctcagcaccatatcctctgc

SEQ ID NO: 299175 - DNA, 25 bp, Mus musculus
gatctctcaggggagacccagcggc

SEQ ID NO: 299176 - DNA, 25 bp, Mus musculus
gatctctcaggggatcatgagggac

SEQ ID NO: 299177 - DNA, 25 bp, Mus musculus
gatctctcaggtgccaacaggatcg

SEQ ID NO: 299178 - DNA, 25 bp, Mus musculus
gatctctcagtgtaccccgaaggtt

SEQ ID NO: 299179 - DNA, 25 bp, Mus musculus
gatctctccattcaggcacagatgc

SEQ ID NO: 299180 - DNA, 25 bp, Mus musculus
gatctctccattcaggtagtgactg

SEQ ID NO: 299181 - DNA, 25 bp, Mus musculus
gatctctctacagccctcagccaaa

SEQ ID NO: 299182 - DNA, 25 bp, Mus musculus
gatctctgaaactgatgcagtgacc

SEQ ID NO: 299183 - DNA, 25 bp, Mus musculus
gatctctgccagctttgtttactag

SEQ ID NO: 299184 - DNA, 25 bp, Mus musculus
gatctctggaagggtttctctgtat

SEQ ID NO: 299185 - DNA, 25 bp, Mus musculus
gatctctggaaggtgagcctcaggg

SEQ ID NO: 299186 - DNA, 25 bp, Mus musculus
gatctctggagattgtcctgcttta

SEQ ID NO: 299187 - DNA, 25 bp, Mus musculus
gatctctgtacgcatgtgacaccag

SEQ ID NO: 299188 - DNA, 25 bp, Mus musculus
gatctctgtggcaaggattaatgtc

SEQ ID NO: 299189 - DNA, 25 bp, Mus musculus
gatctctgtgtggagctggcctgaa

SEQ ID NO: 299190 - DNA, 25 bp, Mus musculus
gatctcttccaggaatgtctcgagg

SEQ ID NO: 299191 - DNA, 25 bp, Mus musculus
gatctcttggccagagaacagcttt

SEQ ID NO: 299192 - DNA, 25 bp, Mus musculus
gatctcttggtaggccaggaaatga

SEQ ID NO: 299193 - DNA, 25 bp, Mus musculus
gatctctttgggtccattttctagt

SEQ ID NO: 299194 - DNA, 25 bp, Mus musculus
gatctgaaagaggatatcaagttca

SEQ ID NO: 299195 - DNA, 25 bp, Mus musculus
gatctgaagaacgggtatggctttg

SEQ ID NO: 299196 - DNA, 25 bp, Mus musculus
gatctgaagaacggtctgttatgtt

SEQ ID NO: 299197 - DNA, 25 bp, Mus musculus
gatctgaagcctggttccctcaacc

SEQ ID NO: 299198 - DNA, 25 bp, Mus musculus
gatctgaagggcaaggaactaccgt

SEQ ID NO: 299199 - DNA, 25 bp, Mus musculus
gatctgaagggcaaggtgctcatct

SEQ ID NO: 299200 - DNA, 25 bp, Mus musculus
gatctgaataagtgcggacctatgg

SEQ ID NO: 299201 - DNA, 25 bp, Mus musculus
gatctgaattcaagggaaacaactg

SEQ ID NO: 299202 - DNA, 25 bp, Mus musculus
gatctgacaaggacccacattgtgg

SEQ ID NO: 299203 - DNA, 25 bp, Mus musculus
gatctgaccaaggtttggcctcaca

SEQ ID NO: 299204 - DNA, 25 bp, Mus musculus
gatctgacccaagagattgctatgg

SEQ ID NO: 299205 - DNA, 25 bp, Mus musculus
gatctgacccaagcttatgatggag

SEQ ID NO: 299206 - DNA, 25 bp, Mus musculus
gatctgacgcaagagcaggaatcca

SEQ ID NO: 299207 - DNA, 25 bp, Mus musculus
gatctgacttttagaaccagctcag

SEQ ID NO: 299208 - DNA, 25 bp, Mus musculus
gatctgagagataaggcacctccaa

SEQ ID NO: 299209 - DNA, 25 bp, Mus musculus
gatctgagaggcctctcctgcagcc

SEQ ID NO: 299210 - DNA, 25 bp, Mus musculus
gatctgagtcaggatgcgtacactg

SEQ ID NO: 299211 - DNA, 25 bp, Mus musculus
gatctgatcagaacaggacgcgggt

SEQ ID NO: 299212 - DNA, 25 bp, Mus musculus
gatctgatcaggtccagcctgatga

SEQ ID NO: 299213 - DNA, 25 bp, Mus musculus
gatctgatcagtctcggcatctctg

SEQ ID NO: 299214 - DNA, 25 bp, Mus musculus
gatctgcaaaatcatggaccaggcc

SEQ ID NO: 299215 - DNA, 25 bp, Mus musculus
gatctgcactgaacagtcaaattct

SEQ ID NO: 299216 - DNA, 25 bp, Mus musculus
gatctgcactgcagggttttggcga

SEQ ID NO: 299217 - DNA, 25 bp, Mus musculus
gatctgcattcacacaaatagcatg

SEQ ID NO: 299218 - DNA, 25 bp, Mus musculus
gatctgcattcacacaattaccaga

SEQ ID NO: 299219 - DNA, 25 bp, Mus musculus
gatctgcccagaggacgaggcggaa

SEQ ID NO: 299220 - DNA, 25 bp, Mus musculus
gatctgcctcagagaacatgagctg

SEQ ID NO: 299221 - DNA, 25 bp, Mus musculus
gatctgcctcagagcacctacgctt

SEQ ID NO: 299222 - DNA, 25 bp, Mus musculus
gatctgcctgccattgctgctgaca

SEQ ID NO: 299223 - DNA, 25 bp, Mus musculus
gatctgcctgcgatctagggcggcc

SEQ ID NO: 299224 - DNA, 25 bp, Mus musculus
gatctgcctggtacaactgtaaccg

SEQ ID NO: 299225 - DNA, 25 bp, Mus musculus
gatctgccttcagaaaaaatgctgt

SEQ ID NO: 299226 - DNA, 25 bp, Mus musculus
gatctgcgccccgggctccagcata

SEQ ID NO: 299227 - DNA, 25 bp, Mus musculus
gatctgctaaaagatttctgcatga

SEQ ID NO: 299228 - DNA, 25 bp, Mus musculus
gatctgctcatccgctcccatctcc

SEQ ID NO: 299229 - DNA, 25 bp, Mus musculus
gatctggaaaacaggcccacagaac

SEQ ID NO: 299230 - DNA, 25 bp, Mus musculus
gatctggaacagacacagcccttga

SEQ ID NO: 299231 - DNA, 25 bp, Mus musculus
gatctggaagagactttggccagtg

SEQ ID NO: 299232 - DNA, 25 bp, Mus musculus
gatctggaagatgaagtctatgcac

SEQ ID NO: 299233 - DNA, 25 bp, Mus musculus
gatctggaagtgccaaagtagaaga

SEQ ID NO: 299234 - DNA, 25 bp, Mus musculus
gatctggacctcacctccttatagc

SEQ ID NO: 299235 - DNA, 25 bp, Mus musculus
gatctggacttacaggtactatggg

SEQ ID NO: 299236 - DNA, 25 bp, Mus musculus
gatctggagcagcagcctcagggct

SEQ ID NO: 299237 - DNA, 25 bp, Mus musculus
gatctggagtgtgggccagacccat

SEQ ID NO: 299238 - DNA, 25 bp, Mus musculus
gatctggagttacggtgaaactaga

SEQ ID NO: 299239 - DNA, 25 bp, Mus musculus
gatctggataaaaaggtagcaacaa

SEQ ID NO: 299240 - DNA, 25 bp, Mus musculus
gatctggataaagagttcaggaagg

SEQ ID NO: 299241 - DNA, 25 bp, Mus musculus
gatctggatgacaagccaagcccga

SEQ ID NO: 299242 - DNA, 25 bp, Mus musculus
gatctggcactaacagaacctttag

SEQ ID NO: 299243 - DNA, 25 bp, Mus musculus
gatctggcaggccctcagaatatgg

SEQ ID NO: 299244 - DNA, 25 bp, Mus musculus
gatctggcaggggactctcctgctc

SEQ ID NO: 299245 - DNA, 25 bp, Mus musculus
gatctggcccagaggccaagtgaga

SEQ ID NO: 299246 - DNA, 25 bp, Mus musculus
gatctggcctggcgcttaatgaaaa

SEQ ID NO: 299247 - DNA, 25 bp, Mus musculus
gatctggcgacatgatatttgaagg

SEQ ID NO: 299248 - DNA, 25 bp, Mus musculus
gatctggcgggcaatggtgaatgag

SEQ ID NO: 299249 - DNA, 25 bp, Mus musculus
gatctggggcagaagattgctttgg

SEQ ID NO: 299250 - DNA, 25 bp, Mus musculus
gatctggggcagaagcgcattaaag

SEQ ID NO: 299251 - DNA, 25 bp, Mus musculus
gatctgggtggaaatggaatttatc

SEQ ID NO: 299252 - DNA, 25 bp, Mus musculus
gatctgtaactgaggctttaacaga

SEQ ID NO: 299253 - DNA, 25 bp, Mus musculus
gatctgtacaagggtgaaaaaggag

SEQ ID NO: 299254 - DNA, 25 bp, Mus musculus
gatctgtacctgcaactcaatcgtt

SEQ ID NO: 299255 - DNA, 25 bp, Mus musculus
gatctgtacctgcaagaagaaagtc

SEQ ID NO: 299256 - DNA, 25 bp, Mus musculus
gatctgtagcacccagttcttgcag

SEQ ID NO: 299257 - DNA, 25 bp, Mus musculus
gatctgtcacttgggagtttgccca

SEQ ID NO: 299258 - DNA, 25 bp, Mus musculus
gatctgtccccgaggctgcttatga

SEQ ID NO: 299259 - DNA, 25 bp, Mus musculus
gatctgtctcgagagctgaagacac

SEQ ID NO: 299260 - DNA, 25 bp, Mus musculus
gatctgtgacgggtttcgtgctacc

SEQ ID NO: 299261 - DNA, 25 bp, Mus musculus
gatctgtgaggaaggtctacgagtg

SEQ ID NO: 299262 - DNA, 25 bp, Mus musculus
gatctgtgattataaaagctttgat

SEQ ID NO: 299263 - DNA, 25 bp, Mus musculus
gatctgtgcacagactgactttgca

SEQ ID NO: 299264 - DNA, 25 bp, Mus musculus
gatctgtgccatgccaggtggttct

SEQ ID NO: 299265 - DNA, 25 bp, Mus musculus
gatctgttgaagagcaagttgctcc

SEQ ID NO: 299266 - DNA, 25 bp, Mus musculus
gatctgttttagcaatcccacaggg

SEQ ID NO: 299267 - DNA, 25 bp, Mus musculus
gatcttaaagagcaaatcccatatc

SEQ ID NO: 299268 - DNA, 25 bp, Mus musculus
gatcttaaaggttgccaggatgcat

SEQ ID NO: 299269 - DNA, 25 bp, Mus musculus
gatcttaactggagttggtcgaatt

SEQ ID NO: 299270 - DNA, 25 bp, Mus musculus
gatcttaagaaatgctgcggcacca

SEQ ID NO: 299271 - DNA, 25 bp, Mus musculus
gatcttaataatcctattgcagtga

SEQ ID NO: 299272 - DNA, 25 bp, Mus musculus
gatcttaccaagattctaaggtgaa

SEQ ID NO: 299273 - DNA, 25 bp, Mus musculus
gatcttacccaaagcccacctggaa

SEQ ID NO: 299274 - DNA, 25 bp, Mus musculus
gatcttacggagggctggatcgtga

SEQ ID NO: 299275 - DNA, 25 bp, Mus musculus
gatcttattccagtcccactcactt

SEQ ID NO: 299276 - DNA, 25 bp, Mus musculus
gatcttcaaggcctgggctgtggcc

SEQ ID NO: 299277 - DNA, 25 bp, Mus musculus
gatcttcacaggagagagactgaga

SEQ ID NO: 299278 - DNA, 25 bp, Mus musculus
gatcttcagagggttcccagcccca

SEQ ID NO: 299279 - DNA, 25 bp, Mus musculus
gatcttcagctacattttcagcttt

SEQ ID NO: 299280 - DNA, 25 bp, Mus musculus
gatcttcagggggtgattagtgtta

SEQ ID NO: 299281 - DNA, 25 bp, Mus musculus
gatcttcagtgcaaggatggaagga

SEQ ID NO: 299282 - DNA, 25 bp, Mus musculus
gatcttcagtgcaaggttatcctgc

SEQ ID NO: 299283 - DNA, 25 bp, Mus musculus
gatcttcagttttagatcaagaatg

SEQ ID NO: 299284 - DNA, 25 bp, Mus musculus
gatcttccaagattagaacacctag

SEQ ID NO: 299285 - DNA, 25 bp, Mus musculus
gatcttccagaccagggacggaaac

SEQ ID NO: 299286 - DNA, 25 bp, Mus musculus
gatcttcccgctctgtgaccagcct

SEQ ID NO: 299287 - DNA, 25 bp, Mus musculus
gatcttcccggttctcggactcccc

SEQ ID NO: 299288 - DNA, 25 bp, Mus musculus
gatcttcctgcaagaactgagcctg

SEQ ID NO: 299289 - DNA, 25 bp, Mus musculus
gatcttcctgcaagcagccttcaga

SEQ ID NO: 299290 - DNA, 25 bp, Mus musculus
gatcttcctgcaagggtggccatgg

SEQ ID NO: 299291 - DNA, 25 bp, Mus musculus
gatcttcctggacaaaccaattctt

SEQ ID NO: 299292 - DNA, 25 bp, Mus musculus
gatcttcgatttcaacagctttgag

SEQ ID NO: 299293 - DNA, 25 bp, Mus musculus
gatcttcgcggcggggtggcggtgg

SEQ ID NO: 299294 - DNA, 25 bp, Mus musculus
gatcttcgtactagaggctgctgtc

SEQ ID NO: 299295 - DNA, 25 bp, Mus musculus
gatcttcgtactagctcacttcatg

SEQ ID NO: 299296 - DNA, 25 bp, Mus musculus
gatcttcgtactagctcctggactt

SEQ ID NO: 299297 - DNA, 25 bp, Mus musculus
gatcttctaaagttgattgaatcaa

SEQ ID NO: 299298 - DNA, 25 bp, Mus musculus
gatcttctagtgaacagcgtcacgc

SEQ ID NO: 299299 - DNA, 25 bp, Mus musculus
gatcttctatggagagaaacaaccc

SEQ ID NO: 299300 - DNA, 25 bp, Mus musculus
gatcttctcagtcctagaccaaagc

SEQ ID NO: 299301 - DNA, 25 bp, Mus musculus
gatcttctgaaagctctgtacaact

SEQ ID NO: 299302 - DNA, 25 bp, Mus musculus
gatcttctgccatacccgcaaaaca

SEQ ID NO: 299303 - DNA, 25 bp, Mus musculus
gatcttctggagagaagtgtgctgg

SEQ ID NO: 299304 - DNA, 25 bp, Mus musculus
gatcttctggagagggcatcatggc

SEQ ID NO: 299305 - DNA, 25 bp, Mus musculus
gatcttcttaaggagagcgattcaa

SEQ ID NO: 299306 - DNA, 25 bp, Mus musculus
gatcttcttccagtgcaggtcctaa

SEQ ID NO: 299307 - DNA, 25 bp, Mus musculus
gatcttgaagccatgatcaaagctg

SEQ ID NO: 299308 - DNA, 25 bp, Mus musculus
gatcttgaaggataccagaatacca

SEQ ID NO: 299309 - DNA, 25 bp, Mus musculus
gatcttgataaaagtgaatttccta

SEQ ID NO: 299310 - DNA, 25 bp, Mus musculus
gatcttgataggatctgcttaaatg

SEQ ID NO: 299311 - DNA, 25 bp, Mus musculus
gatcttgatctaggccttcctatag

SEQ ID NO: 299312 - DNA, 25 bp, Mus musculus
gatcttgcaactccatctcggaaga

SEQ ID NO: 299313 - DNA, 25 bp, Mus musculus
gatcttgcaactgaatctgcctgta

SEQ ID NO: 299314 - DNA, 25 bp, Mus musculus
gatcttgcttagatggcaggttcag

SEQ ID NO: 299315 - DNA, 25 bp, Mus musculus
gatcttggaatacagtgccgtgatg

SEQ ID NO: 299316 - DNA, 25 bp, Mus musculus
gatcttggagaaaatcttggacctt

SEQ ID NO: 299317 - DNA, 25 bp, Mus musculus
gatcttggaggactccctgcagtga

SEQ ID NO: 299318 - DNA, 25 bp, Mus musculus
gatcttgtgagagggtctgcatttg

SEQ ID NO: 299319 - DNA, 25 bp, Mus musculus
gatctttaaaaggctactgaaagat

SEQ ID NO: 299320 - DNA, 25 bp, Mus musculus
gatctttaaagcgcagtgctaactt

SEQ ID NO: 299321 - DNA, 25 bp, Mus musculus
gatctttaaatatatttactggctc

SEQ ID NO: 299322 - DNA, 25 bp, Mus musculus
gatctttaatgcctctccagcttct

SEQ ID NO: 299323 - DNA, 25 bp, Mus musculus
gatctttccaaaagcaactgctttg

SEQ ID NO: 299324 - DNA, 25 bp, Mus musculus
gatctttccaaaagctcctgggacc

SEQ ID NO: 299325 - DNA, 25 bp, Mus musculus
gatctttccagttacaaatttccac

SEQ ID NO: 299326 - DNA, 25 bp, Mus musculus
gatctttcctggctagaccacattc

SEQ ID NO: 299327 - DNA, 25 bp, Mus musculus
gatctttcctggtccatcaacctgg

SEQ ID NO: 299328 - DNA, 25 bp, Mus musculus
gatctttctcagattccttgtaatg

SEQ ID NO: 299329 - DNA, 25 bp, Mus musculus
gatctttctggtaatccccggcagc

SEQ ID NO: 299330 - DNA, 25 bp, Mus musculus
gatctttgacaagcactataagact

SEQ ID NO: 299331 - DNA, 25 bp, Mus musculus
gatctttgagaatccccggcagccc

SEQ ID NO: 299332 - DNA, 25 bp, Mus musculus
gatcttttcgcagaagccacagaag

SEQ ID NO: 299333 - DNA, 25 bp, Mus musculus
gatctttttaaaaagtgtgttcaaa

SEQ ID NO: 299334 - DNA, 25 bp, Mus musculus
gatgaaaaacagggaagctgcccgg

SEQ ID NO: 299335 - DNA, 25 bp, Mus musculus
gatgaaaaacagggaagctgctaaa

SEQ ID NO: 299336 - DNA, 25 bp, Mus musculus
gatgaaaaacgtgaagcttccctca

SEQ ID NO: 299337 - DNA, 25 bp, Mus musculus
gatgaaaacaccaggcagtggtgga

SEQ ID NO: 299338 - DNA, 25 bp, Mus musculus
gatgaaaacccagtgagatgagtca

SEQ ID NO: 299339 - DNA, 25 bp, Mus musculus
gatgaaaaccgcagacctgtgttgc

SEQ ID NO: 299340 - DNA, 25 bp, Mus musculus
gatgaaaaccgcaggtatggcattt

SEQ ID NO: 299341 - DNA, 25 bp, Mus musculus
gatgaaaaccgcaggtgagaagaca

SEQ ID NO: 299342 - DNA, 25 bp, Mus musculus
gatgaaaacggaacaccagatgcat

SEQ ID NO: 299343 - DNA, 25 bp, Mus musculus
gatgaaaactacatggaatttctag

SEQ ID NO: 299344 - DNA, 25 bp, Mus musculus
gatgaaaagcctgacagaagtcgag

SEQ ID NO: 299345 - DNA, 25 bp, Mus musculus
gatgaaaagcctgctccaggtctgg

SEQ ID NO: 299346 - DNA, 25 bp, Mus musculus
gatgaaacaaagatgcccttagacc

SEQ ID NO: 299347 - DNA, 25 bp, Mus musculus
gatgaaacagcatcaaaagacgtac

SEQ ID NO: 299348 - DNA, 25 bp, Mus musculus
gatgaaacagtcaaaacaattcaca

SEQ ID NO: 299349 - DNA, 25 bp, Mus musculus
gatgaaacagtgaaaaccataaggg

SEQ ID NO: 299350 - DNA, 25 bp, Mus musculus
gatgaaaccttccgacttgtctcag

SEQ ID NO: 299351 - DNA, 25 bp, Mus musculus
gatgaaactgctgccacaggtgaca

SEQ ID NO: 299352 - DNA, 25 bp, Mus musculus
gatgaaagcagccatgtactcggtg

SEQ ID NO: 299353 - DNA, 25 bp, Mus musculus
gatgaaagcagtggtccatgccgtg

SEQ ID NO: 299354 - DNA, 25 bp, Mus musculus
gatgaaagggaggctacagacacac

SEQ ID NO: 299355 - DNA, 25 bp, Mus musculus
gatgaaaggggagggcactgacact

SEQ ID NO: 299356 - DNA, 25 bp, Mus musculus
gatgaaatagactctttcctacgaa

SEQ ID NO: 299357 - DNA, 25 bp, Mus musculus
gatgaaatattccaagttcagtggt

SEQ ID NO: 299358 - DNA, 25 bp, Mus musculus
gatgaaatcaagaatctcgatctgc

SEQ ID NO: 299359 - DNA, 25 bp, Mus musculus
gatgaaatcaaggaacaagcaatgg

SEQ ID NO: 299360 - DNA, 25 bp, Mus musculus
gatgaaatcaaggaagactcttcaa

SEQ ID NO: 299361 - DNA, 25 bp, Mus musculus
gatgaaatcaaggtaactatggatg

SEQ ID NO: 299362 - DNA, 25 bp, Mus musculus
gatgaaatcaaggttccgtgttgcc

SEQ ID NO: 299363 - DNA, 25 bp, Mus musculus
gatgaaatcaagtatgcaacccagc

SEQ ID NO: 299364 - DNA, 25 bp, Mus musculus
gatgaaatcacacaatatgtagctg

SEQ ID NO: 299365 - DNA, 25 bp, Mus musculus
gatgaaatcacacagttttcagata

SEQ ID NO: 299366 - DNA, 25 bp, Mus musculus
gatgaaatcacagaactagacaccc

SEQ ID NO: 299367 - DNA, 25 bp, Mus musculus
gatgaaatcacaggtcctgctgtct

SEQ ID NO: 299368 - DNA, 25 bp, Mus musculus
gatgaaatcccaggtgatgacacac

SEQ ID NO: 299369 - DNA, 25 bp, Mus musculus
gatgaaattgagcaactgaagcagc

SEQ ID NO: 299370 - DNA, 25 bp, Mus musculus
gatgaaattggacaggattggcccc

SEQ ID NO: 299371 - DNA, 25 bp, Mus musculus
gatgaaatttcaggtcacgttcatg

SEQ ID NO: 299372 - DNA, 25 bp, Mus musculus
gatgaacagaatgagatcatcgatg

SEQ ID NO: 299373 - DNA, 25 bp, Mus musculus
gatgaacagatttgccagggagatg

SEQ ID NO: 299374 - DNA, 25 bp, Mus musculus
gatgaacagcaattatagtgaacat

SEQ ID NO: 299375 - DNA, 25 bp, Mus musculus
gatgaacagttagaggaaagaacag

SEQ ID NO: 299376 - DNA, 25 bp, Mus musculus
gatgaacagttagaggttcgagaaa

SEQ ID NO: 299377 - DNA, 25 bp, Mus musculus
gatgaacatccagagccgtctgggt

SEQ ID NO: 299378 - DNA, 25 bp, Mus musculus
gatgaacatggaagggttattaatt

SEQ ID NO: 299379 - DNA, 25 bp, Mus musculus
gatgaacatggtgaagattcctgtg

SEQ ID NO: 299380 - DNA, 25 bp, Mus musculus
gatgaacctggaaggccaaatcctt

SEQ ID NO: 299381 - DNA, 25 bp, Mus musculus
gatgaactcagctctgatgtctcca

SEQ ID NO: 299382 - DNA, 25 bp, Mus musculus
gatgaactcctgaaagaaattcaag

SEQ ID NO: 299383 - DNA, 25 bp, Mus musculus
gatgaactgaggagacttcttcgag

SEQ ID NO: 299384 - DNA, 25 bp, Mus musculus
gatgaactgaggagggtggccaaac

SEQ ID NO: 299385 - DNA, 25 bp, Mus musculus
gatgaactgcctgacttgtgacacc

SEQ ID NO: 299386 - DNA, 25 bp, Mus musculus
gatgaactgcgcaggttacatccag

SEQ ID NO: 299387 - DNA, 25 bp, Mus musculus
gatgaacttgggaatgtacctgaac

SEQ ID NO: 299388 - DNA, 25 bp, Mus musculus
gatgaacttgggttttatgattccc

SEQ ID NO: 299389 - DNA, 25 bp, Mus musculus
gatgaacttggtaagttctcgtcca

SEQ ID NO: 299390 - DNA, 25 bp, Mus musculus
gatgaagaaaagcccctttcctcga

SEQ ID NO: 299391 - DNA, 25 bp, Mus musculus
gatgaagaaaagcgcagaagagcag

SEQ ID NO: 299392 - DNA, 25 bp, Mus musculus
gatgaagaacgagccctcgtgggta

SEQ ID NO: 299393 - DNA, 25 bp, Mus musculus
gatgaagaatctagagctgatcata

SEQ ID NO: 299394 - DNA, 25 bp, Mus musculus
gatgaagaatttgtggaagaggaga

SEQ ID NO: 299395 - DNA, 25 bp, Mus musculus
gatgaagacaaggtgctggtctcct

SEQ ID NO: 299396 - DNA, 25 bp, Mus musculus
gatgaagacagggaacagacatcct

SEQ ID NO: 299397 - DNA, 25 bp, Mus musculus
gatgaagacagttcagagtgcagtg

SEQ ID NO: 299398 - DNA, 25 bp, Mus musculus
gatgaagaccgggcatctggagatt

SEQ ID NO: 299399 - DNA, 25 bp, Mus musculus
gatgaagagaaatggttcccataac

SEQ ID NO: 299400 - DNA, 25 bp, Mus musculus
gatgaagagaggcatgttggagacc

SEQ ID NO: 299401 - DNA, 25 bp, Mus musculus
gatgaagaggagagtgatgctgttg

SEQ ID NO: 299402 - DNA, 25 bp, Mus musculus
gatgaagatcgctgagatccgaaag

SEQ ID NO: 299403 - DNA, 25 bp, Mus musculus
gatgaagatgtgaagatgatcagtg

SEQ ID NO: 299404 - DNA, 25 bp, Mus musculus
gatgaagattgaggagaagaaggtg

SEQ ID NO: 299405 - DNA, 25 bp, Mus musculus
gatgaagatttagagagttccagtg

SEQ ID NO: 299406 - DNA, 25 bp, Mus musculus
gatgaagcagaactgcggacatccc

SEQ ID NO: 299407 - DNA, 25 bp, Mus musculus
gatgaagcagtatcaggaggaaatc

SEQ ID NO: 299408 - DNA, 25 bp, Mus musculus
gatgaagcatgcggatccccggatc

SEQ ID NO: 299409 - DNA, 25 bp, Mus musculus
gatgaagcatgcggtttctgatgtc

SEQ ID NO: 299410 - DNA, 25 bp, Mus musculus
gatgaagccagaagatgtagctaaa

SEQ ID NO: 299411 - DNA, 25 bp, Mus musculus
gatgaagccagagatttaaggcaag

SEQ ID NO: 299412 - DNA, 25 bp, Mus musculus
gatgaagccagatgctgatgctgtt

SEQ ID NO: 299413 - DNA, 25 bp, Mus musculus
gatgaagccagcactagcaacaagc

SEQ ID NO: 299414 - DNA, 25 bp, Mus musculus
gatgaagccaggtaattcagagatc

SEQ ID NO: 299415 - DNA, 25 bp, Mus musculus
gatgaagccgcccatttcaatacaa

SEQ ID NO: 299416 - DNA, 25 bp, Mus musculus
gatgaagccggctacctctgtcgcg

SEQ ID NO: 299417 - DNA, 25 bp, Mus musculus
gatgaagctgagagcactctgtgga

SEQ ID NO: 299418 - DNA, 25 bp, Mus musculus
gatgaaggactttacctcgctgagc

SEQ ID NO: 299419 - DNA, 25 bp, Mus musculus
gatgaaggagaaggaggaggtaaaa

SEQ ID NO: 299420 - DNA, 25 bp, Mus musculus
gatgaaggagagcccatcgcacctc

SEQ ID NO: 299421 - DNA, 25 bp, Mus musculus
gatgaaggctagctacagtttctct

SEQ ID NO: 299422 - DNA, 25 bp, Mus musculus
gatgaaggcttgctacagtttctct

SEQ ID NO: 299423 - DNA, 25 bp, Mus musculus
gatgaagggcagagggaaggctcct

SEQ ID NO: 299424 - DNA, 25 bp, Mus musculus
gatgaagggcaggctccggcttcgt

SEQ ID NO: 299425 - DNA, 25 bp, Mus musculus
gatgaagtacaagaatcttatggca

SEQ ID NO: 299426 - DNA, 25 bp, Mus musculus
gatgaagtagacagcctgatgtgtg

SEQ ID NO: 299427 - DNA, 25 bp, Mus musculus
gatgaagtagacaggcattggacta

SEQ ID NO: 299428 - DNA, 25 bp, Mus musculus
gatgaagtcagagggtgctggtgac

SEQ ID NO: 299429 - DNA, 25 bp, Mus musculus
gatgaagtcctggcctgcagctgag

SEQ ID NO: 299430 - DNA, 25 bp, Mus musculus
gatgaagttagcaggagatgcgggc

SEQ ID NO: 299431 - DNA, 25 bp, Mus musculus
gatgaatatccagagactaagtctg

SEQ ID NO: 299432 - DNA, 25 bp, Mus musculus
gatgaatatgaaaaggtggacaagt

SEQ ID NO: 299433 - DNA, 25 bp, Mus musculus
gatgaatcacaggacctggagttgc

SEQ ID NO: 299434 - DNA, 25 bp, Mus musculus
gatgaatccgttcaggctgacggct

SEQ ID NO: 299435 - DNA, 25 bp, Mus musculus
gatgaatctttctgggtcagaaacg

SEQ ID NO: 299436 - DNA, 25 bp, Mus musculus
gatgaatgacgaataggtgaaggga

SEQ ID NO: 299437 - DNA, 25 bp, Mus musculus
gatgaatgcaggactgtctccttag

SEQ ID NO: 299438 - DNA, 25 bp, Mus musculus
gatgaatgcagtagaagccatgctg

SEQ ID NO: 299439 - DNA, 25 bp, Mus musculus
gatgaatggcaagtgactgtctgct

SEQ ID NO: 299440 - DNA, 25 bp, Mus musculus
gatgaatggcagtcactacagctac

SEQ ID NO: 299441 - DNA, 25 bp, Mus musculus
gatgaatgttccaagtaccccagca

SEQ ID NO: 299442 - DNA, 25 bp, Mus musculus
gatgaattacaggaaatgcttgatg

SEQ ID NO: 299443 - DNA, 25 bp, Mus musculus
gatgaattcaaggtggacattcgct

SEQ ID NO: 299444 - DNA, 25 bp, Mus musculus
gatgaatttaaggagattaatagag

SEQ ID NO: 299445 - DNA, 25 bp, Mus musculus
gatgaatttaaggagttcatcagcc

SEQ ID NO: 299446 - DNA, 25 bp, Mus musculus
gatgaatttcacaatactacctgtc

SEQ ID NO: 299447 - DNA, 25 bp, Mus musculus
gatgaatttcagactctgaattcgg

SEQ ID NO: 299448 - DNA, 25 bp, Mus musculus
gatgaatttcagagggccttcagcg

SEQ ID NO: 299449 - DNA, 25 bp, Mus musculus
gatgaatttcaggaatataccatgc

SEQ ID NO: 299450 - DNA, 25 bp, Mus musculus
gatgaatttgacttcttagcactta

SEQ ID NO: 299451 - DNA, 25 bp, Mus musculus
gatgacaaaaaggtttgcacctgac

SEQ ID NO: 299452 - DNA, 25 bp, Mus musculus
gatgacaaacaagctgctaactcag

SEQ ID NO: 299453 - DNA, 25 bp, Mus musculus
gatgacaaacaagctttgaaaagta

SEQ ID NO: 299454 - DNA, 25 bp, Mus musculus
gatgacaacccgatagaggagcata

SEQ ID NO: 299455 - DNA, 25 bp, Mus musculus
gatgacaactacgaaagagcctgtg

SEQ ID NO: 299456 - DNA, 25 bp, Mus musculus
gatgacaagacagttcccttcagca

SEQ ID NO: 299457 - DNA, 25 bp, Mus musculus
gatgacaagcaggtttgctgaggag

SEQ ID NO: 299458 - DNA, 25 bp, Mus musculus
gatgacaatgggggtgaagcttcta

SEQ ID NO: 299459 - DNA, 25 bp, Mus musculus
gatgacacagaccattctttaaaga

SEQ ID NO: 299460 - DNA, 25 bp, Mus musculus
gatgacacagattctgagctggggt

SEQ ID NO: 299461 - DNA, 25 bp, Mus musculus
gatgacacggagagaagattaagga

SEQ ID NO: 299462 - DNA, 25 bp, Mus musculus
gatgacactggacccccctttgtgt

SEQ ID NO: 299463 - DNA, 25 bp, Mus musculus
gatgacactggctgcggctggaagt

SEQ ID NO: 299464 - DNA, 25 bp, Mus musculus
gatgacagcaacagttagagatggt

SEQ ID NO: 299465 - DNA, 25 bp, Mus musculus
gatgacagcaacttcaaagctgtgt

SEQ ID NO: 299466 - DNA, 25 bp, Mus musculus
gatgacagcagaagtccataacttc

SEQ ID NO: 299467 - DNA, 25 bp, Mus musculus
gatgacagcagccttcaagggttcc

SEQ ID NO: 299468 - DNA, 25 bp, Mus musculus
gatgacagctatgtccccagtgacc

SEQ ID NO: 299469 - DNA, 25 bp, Mus musculus
gatgacagtatggaagggcctagtc

SEQ ID NO: 299470 - DNA, 25 bp, Mus musculus
gatgacagtgaagatccagccataa

SEQ ID NO: 299471 - DNA, 25 bp, Mus musculus
gatgacagtgaaggtatgctgcaag

SEQ ID NO: 299472 - DNA, 25 bp, Mus musculus
gatgacagtgaagtgtaacaactaa

SEQ ID NO: 299473 - DNA, 25 bp, Mus musculus
gatgacatcaacaaggtgtttgagt

SEQ ID NO: 299474 - DNA, 25 bp, Mus musculus
gatgacatcaagaagggagaagaaa

SEQ ID NO: 299475 - DNA, 25 bp, Mus musculus
gatgacatcagaaaattagaccgat

SEQ ID NO: 299476 - DNA, 25 bp, Mus musculus
gatgacatccctttcttgagatgct

SEQ ID NO: 299477 - DNA, 25 bp, Mus musculus
gatgacatcgggaggaatgctgtgg

SEQ ID NO: 299478 - DNA, 25 bp, Mus musculus
gatgacattcacctgctgtcttccc

SEQ ID NO: 299479 - DNA, 25 bp, Mus musculus
gatgacattccttcattagtgaaaa

SEQ ID NO: 299480 - DNA, 25 bp, Mus musculus
gatgacattgtagaaaaaatcgatg

SEQ ID NO: 299481 - DNA, 25 bp, Mus musculus
gatgacatttaccatatgacttttc

SEQ ID NO: 299482 - DNA, 25 bp, Mus musculus
gatgaccaaaagggcaacatccccg

SEQ ID NO: 299483 - DNA, 25 bp, Mus musculus
gatgaccaaacgttagaaaagtcct

SEQ ID NO: 299484 - DNA, 25 bp, Mus musculus
gatgaccaaggaggagcccctgccg

SEQ ID NO: 299485 - DNA, 25 bp, Mus musculus
gatgaccagagagtgatgtggagag

SEQ ID NO: 299486 - DNA, 25 bp, Mus musculus
gatgaccagagccccgggcctctgg

SEQ ID NO: 299487 - DNA, 25 bp, Mus musculus
gatgaccagagttacaagcaccttt

SEQ ID NO: 299488 - DNA, 25 bp, Mus musculus
gatgaccaggatctgacacacatga

SEQ ID NO: 299489 - DNA, 25 bp, Mus musculus
gatgacccaggagttgcaagcacat

SEQ ID NO: 299490 - DNA, 25 bp, Mus musculus
gatgaccccagtgtcctttatttct

SEQ ID NO: 299491 - DNA, 25 bp, Mus musculus
gatgacccccacgtgattccttaga

SEQ ID NO: 299492 - DNA, 25 bp, Mus musculus
gatgacccccacgtggaagaaaggt

SEQ ID NO: 299493 - DNA, 25 bp, Mus musculus
gatgacccctggaggaaactctgat

SEQ ID NO: 299494 - DNA, 25 bp, Mus musculus
gatgacccctggaggtggagacaga

SEQ ID NO: 299495 - DNA, 25 bp, Mus musculus
gatgacccggaggagagtccaccac

SEQ ID NO: 299496 - DNA, 25 bp, Mus musculus
gatgaccggaagtcactggtgacgc

SEQ ID NO: 299497 - DNA, 25 bp, Mus musculus
gatgaccgtaccaagggatagccca

SEQ ID NO: 299498 - DNA, 25 bp, Mus musculus
gatgaccgtgccgaacgtgctggcc

SEQ ID NO: 299499 - DNA, 25 bp, Mus musculus
gatgacctaatgcagtcatccttcc

SEQ ID NO: 299500 - DNA, 25 bp, Mus musculus
gatgacctaggaaacacactggaga

SEQ ID NO: 299501 - DNA, 25 bp, Mus musculus
gatgacctccaagggcccaatgtaa

SEQ ID NO: 299502 - DNA, 25 bp, Mus musculus
gatgacctgactgacccattgaaga

SEQ ID NO: 299503 - DNA, 25 bp, Mus musculus
gatgacctggaagacgagctctatg

SEQ ID NO: 299504 - DNA, 25 bp, Mus musculus
gatgacctggaagataaactgaagt

SEQ ID NO: 299505 - DNA, 25 bp, Mus musculus
gatgaccttgaagaggatcccagtc

SEQ ID NO: 299506 - DNA, 25 bp, Mus musculus
gatgacctttaagaggtgtgctgat

SEQ ID NO: 299507 - DNA, 25 bp, Mus musculus
gatgaccttttcggggtcatcttgg

SEQ ID NO: 299508 - DNA, 25 bp, Mus musculus
gatgacgacaagactggccaggtca

SEQ ID NO: 299509 - DNA, 25 bp, Mus musculus
gatgacgagaacagaaaatactctt

SEQ ID NO: 299510 - DNA, 25 bp, Mus musculus
gatgacgagctaaccttcttttaaa

SEQ ID NO: 299511 - DNA, 25 bp, Mus musculus
gatgacgagctctcttctcttccct

SEQ ID NO: 299512 - DNA, 25 bp, Mus musculus
gatgacgatagtggttccggaagcc

SEQ ID NO: 299513 - DNA, 25 bp, Mus musculus
gatgacgatggtctcccttctcagc

SEQ ID NO: 299514 - DNA, 25 bp, Mus musculus
gatgacgtctctaagtaacatacaa

SEQ ID NO: 299515 - DNA, 25 bp, Mus musculus
gatgacgtcttggctcatgctgcct

SEQ ID NO: 299516 - DNA, 25 bp, Mus musculus
gatgactaagatgctaaaaggattc

SEQ ID NO: 299517 - DNA, 25 bp, Mus musculus
gatgactacagcattacacccgtca

SEQ ID NO: 299518 - DNA, 25 bp, Mus musculus
gatgactatcgatgatgtgatgagt

SEQ ID NO: 299519 - DNA, 25 bp, Mus musculus
gatgactcaacgggggggcagtgcc

SEQ ID NO: 299520 - DNA, 25 bp, Mus musculus
gatgactcagaagaaaaaaagtatt

SEQ ID NO: 299521 - DNA, 25 bp, Mus musculus
gatgactcagaagctcttgtcctga

SEQ ID NO: 299522 - DNA, 25 bp, Mus musculus
gatgactccgaaccaactgtgagag

SEQ ID NO: 299523 - DNA, 25 bp, Mus musculus
gatgactcgaaggaacctaagtcat

SEQ ID NO: 299524 - DNA, 25 bp, Mus musculus
gatgactgaaatctacttaaaattc

SEQ ID NO: 299525 - DNA, 25 bp, Mus musculus
gatgactgaggtgcttcaccttttg

SEQ ID NO: 299526 - DNA, 25 bp, Mus musculus
gatgactgccttgggctggtgagat

SEQ ID NO: 299527 - DNA, 25 bp, Mus musculus
gatgactgtgtggtgtcgattgatg

SEQ ID NO: 299528 - DNA, 25 bp, Mus musculus
gatgactgtgtggttgcagaagctg

SEQ ID NO: 299529 - DNA, 25 bp, Mus musculus
gatgactgttaccaatgcaccttcc

SEQ ID NO: 299530 - DNA, 25 bp, Mus musculus
gatgacttaccgattctgttcccag

SEQ ID NO: 299531 - DNA, 25 bp, Mus musculus
gatgacttagaagacgagctgtatg

SEQ ID NO: 299532 - DNA, 25 bp, Mus musculus
gatgacttagaagagaaagtggccc

SEQ ID NO: 299533 - DNA, 25 bp, Mus musculus
gatgacttagaagataagtttcttt

SEQ ID NO: 299534 - DNA, 25 bp, Mus musculus
gatgacttagaagatcaactctacc

SEQ ID NO: 299535 - DNA, 25 bp, Mus musculus
gatgacttcagatggaggctggaca

SEQ ID NO: 299536 - DNA, 25 bp, Mus musculus
gatgacttccagaaggatctgaaag

SEQ ID NO: 299537 - DNA, 25 bp, Mus musculus
gatgacttccgggactcaccagctg

SEQ ID NO: 299538 - DNA, 25 bp, Mus musculus
gatgactttgaagatgaccgcaacc

SEQ ID NO: 299539 - DNA, 25 bp, Mus musculus
gatgagaaaaaggtcctggagtggg

SEQ ID NO: 299540 - DNA, 25 bp, Mus musculus
gatgagaaaactggggtaattgaac

SEQ ID NO: 299541 - DNA, 25 bp, Mus musculus
gatgagaaagatgtctcaaccctac

SEQ ID NO: 299542 - DNA, 25 bp, Mus musculus
gatgagaaaggaaatttcttggtcc

SEQ ID NO: 299543 - DNA, 25 bp, Mus musculus
gatgagaaaggggaggagcgctaca

SEQ ID NO: 299544 - DNA, 25 bp, Mus musculus
gatgagaaaggtcatttactacatg

SEQ ID NO: 299545 - DNA, 25 bp, Mus musculus
gatgagaaagttgatgaagatgagg

SEQ ID NO: 299546 - DNA, 25 bp, Mus musculus
gatgagaacagagagatggatgatc

SEQ ID NO: 299547 - DNA, 25 bp, Mus musculus
gatgagaacaggatggacagtctct

SEQ ID NO: 299548 - DNA, 25 bp, Mus musculus
gatgagaacagggtaggtgagctcc

SEQ ID NO: 299549 - DNA, 25 bp, Mus musculus
gatgagaaccggaagaaagccgaag

SEQ ID NO: 299550 - DNA, 25 bp, Mus musculus
gatgagaagcccaagctgcagacgg

SEQ ID NO: 299551 - DNA, 25 bp, Mus musculus
gatgagaataatctttgtgcgctct

SEQ ID NO: 299552 - DNA, 25 bp, Mus musculus
gatgagaataatgtttgctttgagt

SEQ ID NO: 299553 - DNA, 25 bp, Mus musculus
gatgagaatgacaggagccatccgc

SEQ ID NO: 299554 - DNA, 25 bp, Mus musculus
gatgagaattttacagaatcctgaa

SEQ ID NO: 299555 - DNA, 25 bp, Mus musculus
gatgagacaaagggagctgaaggtt

SEQ ID NO: 299556 - DNA, 25 bp, Mus musculus
gatgagacaagaagactgctggaca

SEQ ID NO: 299557 - DNA, 25 bp, Mus musculus
gatgagacaagatcttcaagcaact

SEQ ID NO: 299558 - DNA, 25 bp, Mus musculus
gatgagacagatggaccctcctcat

SEQ ID NO: 299559 - DNA, 25 bp, Mus musculus
gatgagacaggagacaatcaggctc

SEQ ID NO: 299560 - DNA, 25 bp, Mus musculus
gatgagaccacagatgccaattcat

SEQ ID NO: 299561 - DNA, 25 bp, Mus musculus
gatgagacccacatggaatggacct

SEQ ID NO: 299562 - DNA, 25 bp, Mus musculus
gatgagagaaaacttttatccatga

SEQ ID NO: 299563 - DNA, 25 bp, Mus musculus
gatgagagaaaaggcctgctggtga

SEQ ID NO: 299564 - DNA, 25 bp, Mus musculus
gatgagagcaccccgatcccagaga

SEQ ID NO: 299565 - DNA, 25 bp, Mus musculus
gatgagagctgtaatagttccgagg

SEQ ID NO: 299566 - DNA, 25 bp, Mus musculus
gatgagaggaacgagtgtggccaga

SEQ ID NO: 299567 - DNA, 25 bp, Mus musculus
gatgagaggatgcctcctggaacat

SEQ ID NO: 299568 - DNA, 25 bp, Mus musculus
gatgagagtgagagaggcatgaaag

SEQ ID NO: 299569 - DNA, 25 bp, Mus musculus
gatgagagttgtgaggagatccccc

SEQ ID NO: 299570 - DNA, 25 bp, Mus musculus
gatgagatacaagggtcaatataga

SEQ ID NO: 299571 - DNA, 25 bp, Mus musculus
gatgagatacaaggtgtagtggctg

SEQ ID NO: 299572 - DNA, 25 bp, Mus musculus
gatgagatctcccaggctgtgacct

SEQ ID NO: 299573 - DNA, 25 bp, Mus musculus
gatgagattctggtcattcgaaagg

SEQ ID NO: 299574 - DNA, 25 bp, Mus musculus
gatgagattgatgatgaatatgaag

SEQ ID NO: 299575 - DNA, 25 bp, Mus musculus
gatgagcaagatgaacgagaccgtg

SEQ ID NO: 299576 - DNA, 25 bp, Mus musculus
gatgagcaaggcgaacaactcgatc

SEQ ID NO: 299577 - DNA, 25 bp, Mus musculus
gatgagcaaggcgaacaactggaac

SEQ ID NO: 299578 - DNA, 25 bp, Mus musculus
gatgagcactctagttctgacagta

SEQ ID NO: 299579 - DNA, 25 bp, Mus musculus
gatgagcactcttgtccctttaaaa

SEQ ID NO: 299580 - DNA, 25 bp, Mus musculus
gatgagcaggagccggccccgtgac

SEQ ID NO: 299581 - DNA, 25 bp, Mus musculus
gatgagcagggcaatgttctgtctt

SEQ ID NO: 299582 - DNA, 25 bp, Mus musculus
gatgagccaaggcatagagatctct

SEQ ID NO: 299583 - DNA, 25 bp, Mus musculus
gatgagccagtcccgcatccttcag

SEQ ID NO: 299584 - DNA, 25 bp, Mus musculus
gatgagcccaaagcacccatgctgg

SEQ ID NO: 299585 - DNA, 25 bp, Mus musculus
gatgagcgagctggagcagaacttg

SEQ ID NO: 299586 - DNA, 25 bp, Mus musculus
gatgagcgcaggctgtactacgagg

SEQ ID NO: 299587 - DNA, 25 bp, Mus musculus
gatgagcgcattttaaagcccaact

SEQ ID NO: 299588 - DNA, 25 bp, Mus musculus
gatgagcggcaggttgggtcggaac

SEQ ID NO: 299589 - DNA, 25 bp, Mus musculus
gatgagctacttgaaaagtaaagaa

SEQ ID NO: 299590 - DNA, 25 bp, Mus musculus
gatgagctcaagactgaagtgtcct

SEQ ID NO: 299591 - DNA, 25 bp, Mus musculus
gatgagctcaagcgtttagcctggt

SEQ ID NO: 299592 - DNA, 25 bp, Mus musculus
gatgagctcaagggtttagcctggt

SEQ ID NO: 299593 - DNA, 25 bp, Mus musculus
gatgagctcaagtctgaagtgtcct

SEQ ID NO: 299594 - DNA, 25 bp, Mus musculus
gatgagctcatacagagtccaggct

SEQ ID NO: 299595 - DNA, 25 bp, Mus musculus
gatgagctcatacagtctcaacaga

SEQ ID NO: 299596 - DNA, 25 bp, Mus musculus
gatgagctcatggagagagcagtag

SEQ ID NO: 299597 - DNA, 25 bp, Mus musculus
gatgagctcatggagcttgagatct

SEQ ID NO: 299598 - DNA, 25 bp, Mus musculus
gatgagctggtgtcactgcagatga

SEQ ID NO: 299599 - DNA, 25 bp, Mus musculus
gatgagctgttacaggtactgcgaa

SEQ ID NO: 299600 - DNA, 25 bp, Mus musculus
gatgagctgttacagtttttcagct

SEQ ID NO: 299601 - DNA, 25 bp, Mus musculus
gatgagcttcctcttcagcagccgc

SEQ ID NO: 299602 - DNA, 25 bp, Mus musculus
gatgagcttcctcttcgttatttta

SEQ ID NO: 299603 - DNA, 25 bp, Mus musculus
gatgagcttgccctggtcaggcagc

SEQ ID NO: 299604 - DNA, 25 bp, Mus musculus
gatgaggaagaggaacacgcagcac

SEQ ID NO: 299605 - DNA, 25 bp, Mus musculus
gatgaggaagctctgtgaagtccag

SEQ ID NO: 299606 - DNA, 25 bp, Mus musculus
gatgaggaccaggtggtagttaata

SEQ ID NO: 299607 - DNA, 25 bp, Mus musculus
gatgaggagaaacaggcaagtgctc

SEQ ID NO: 299608 - DNA, 25 bp, Mus musculus
gatgaggagatcaagaggatagata

SEQ ID NO: 299609 - DNA, 25 bp, Mus musculus
gatgaggagatcaaggacttgcacc

SEQ ID NO: 299610 - DNA, 25 bp, Mus musculus
gatgaggagctggaggttgcgagaa

SEQ ID NO: 299611 - DNA, 25 bp, Mus musculus
gatgaggaggaagtttacagtagca

SEQ ID NO: 299612 - DNA, 25 bp, Mus musculus
gatgaggataaagaatgacagccca

SEQ ID NO: 299613 - DNA, 25 bp, Mus musculus
gatgaggatagggttgtcgatgagt

SEQ ID NO: 299614 - DNA, 25 bp, Mus musculus
gatgaggatgaagatgatgaggaag

SEQ ID NO: 299615 - DNA, 25 bp, Mus musculus
gatgaggcgaaggaaagctcacaac

SEQ ID NO: 299616 - DNA, 25 bp, Mus musculus
gatgaggcgagaggtgaaagagctg

SEQ ID NO: 299617 - DNA, 25 bp, Mus musculus
gatgaggctccagtcctgccaaccc

SEQ ID NO: 299618 - DNA, 25 bp, Mus musculus
gatgaggcttacagatttgtgaaag

SEQ ID NO: 299619 - DNA, 25 bp, Mus musculus
gatgaggcttacaggcggcagaagc

SEQ ID NO: 299620 - DNA, 25 bp, Mus musculus
gatgagggtaagtatcagatggaga

SEQ ID NO: 299621 - DNA, 25 bp, Mus musculus
gatgaggtccaggagatacttcaag

SEQ ID NO: 299622 - DNA, 25 bp, Mus musculus
gatgaggtccaggtgacaataaatt

SEQ ID NO: 299623 - DNA, 25 bp, Mus musculus
gatgaggtggaggagatgctgacca

SEQ ID NO: 299624 - DNA, 25 bp, Mus musculus
gatgaggtggaggaggtggagtttg

SEQ ID NO: 299625 - DNA, 25 bp, Mus musculus
gatgagtaagctcaatcagaacctc

SEQ ID NO: 299626 - DNA, 25 bp, Mus musculus
gatgagtacaaagcatacgaggaaa

SEQ ID NO: 299627 - DNA, 25 bp, Mus musculus
gatgagtacgccatgaacgacacca

SEQ ID NO: 299628 - DNA, 25 bp, Mus musculus
gatgagtacggtgggaatgctgaag

SEQ ID NO: 299629 - DNA, 25 bp, Mus musculus
gatgagtagcttcataatcctcagc

SEQ ID NO: 299630 - DNA, 25 bp, Mus musculus
gatgagtagcttcatgctctctatc

SEQ ID NO: 299631 - DNA, 25 bp, Mus musculus
gatgagtatgggaagagtcactcca

SEQ ID NO: 299632 - DNA, 25 bp, Mus musculus
gatgagtatgtgctggaggatctgg

SEQ ID NO: 299633 - DNA, 25 bp, Mus musculus
gatgagtcaagattactatgacatg

SEQ ID NO: 299634 - DNA, 25 bp, Mus musculus
gatgagtcaagccgagatgactgac

SEQ ID NO: 299635 - DNA, 25 bp, Mus musculus
gatgagtcacaattttatattggct

SEQ ID NO: 299636 - DNA, 25 bp, Mus musculus
gatgagtccaaattttatattggct

SEQ ID NO: 299637 - DNA, 25 bp, Mus musculus
gatgagtccaagttctatattggct

SEQ ID NO: 299638 - DNA, 25 bp, Mus musculus
gatgagtcggatgcagaggcctcca

SEQ ID NO: 299639 - DNA, 25 bp, Mus musculus
gatgagtctcaggaacctgacagaa

SEQ ID NO: 299640 - DNA, 25 bp, Mus musculus
gatgagtctcaggttccacgagtac

SEQ ID NO: 299641 - DNA, 25 bp, Mus musculus
gatgagtctctgagtgaggagaccc

SEQ ID NO: 299642 - DNA, 25 bp, Mus musculus
gatgagtctgaagggattggagata

SEQ ID NO: 299643 - DNA, 25 bp, Mus musculus
gatgagtgagatcgcagccttccct

SEQ ID NO: 299644 - DNA, 25 bp, Mus musculus
gatgagtgagatcgtttcctcctca

SEQ ID NO: 299645 - DNA, 25 bp, Mus musculus
gatgagtgatgaaaacaacgaattg

SEQ ID NO: 299646 - DNA, 25 bp, Mus musculus
gatgagtgatgctgcaggtgatttt

SEQ ID NO: 299647 - DNA, 25 bp, Mus musculus
gatgagtggatctccacttgggtta

SEQ ID NO: 299648 - DNA, 25 bp, Mus musculus
gatgagtggtacatatgacaatgga

SEQ ID NO: 299649 - DNA, 25 bp, Mus musculus
gatgagtggtacgacatgacaatgg

SEQ ID NO: 299650 - DNA, 25 bp, Mus musculus
gatgagttagagagagagagagaga

SEQ ID NO: 299651 - DNA, 25 bp, Mus musculus
gatgagttcaaggccttgctgtatc

SEQ ID NO: 299652 - DNA, 25 bp, Mus musculus
gatgagttcaaggtggtggtcgtgc

SEQ ID NO: 299653 - DNA, 25 bp, Mus musculus
gatgagttcattgcaattcttggcc

SEQ ID NO: 299654 - DNA, 25 bp, Mus musculus
gatgagttctcccataccctccaca

SEQ ID NO: 299655 - DNA, 25 bp, Mus musculus
gatgataaagagaaacttttagcgg

SEQ ID NO: 299656 - DNA, 25 bp, Mus musculus
gatgataaagagatgagacctgctc

SEQ ID NO: 299657 - DNA, 25 bp, Mus musculus
gatgataaagaggaagaagaaagaa

SEQ ID NO: 299658 - DNA, 25 bp, Mus musculus
gatgataacacctgctctcatcgct

SEQ ID NO: 299659 - DNA, 25 bp, Mus musculus
gatgataacagctgctctcatcgct

SEQ ID NO: 299660 - DNA, 25 bp, Mus musculus
gatgataatgagtattctagtcaag

SEQ ID NO: 299661 - DNA, 25 bp, Mus musculus
gatgatacagacgtcctacaaccag

SEQ ID NO: 299662 - DNA, 25 bp, Mus musculus
gatgatacctggaaaaatggtgaaa

SEQ ID NO: 299663 - DNA, 25 bp, Mus musculus
gatgatacttatgaccacggctctg

SEQ ID NO: 299664 - DNA, 25 bp, Mus musculus
gatgatagaatgttgctggtgaaga

SEQ ID NO: 299665 - DNA, 25 bp, Mus musculus
gatgatagcctcgtggaactggaac

SEQ ID NO: 299666 - DNA, 25 bp, Mus musculus
gatgatagcgatgaggaagatgatg

SEQ ID NO: 299667 - DNA, 25 bp, Mus musculus
gatgatagtagtgtcctggaggcca

SEQ ID NO: 299668 - DNA, 25 bp, Mus musculus
gatgatagtagttacacctctaagt

SEQ ID NO: 299669 - DNA, 25 bp, Mus musculus
gatgatatctttgtatatgaggtga

SEQ ID NO: 299670 - DNA, 25 bp, Mus musculus
gatgatattcaagcgtctgttgcgg

SEQ ID NO: 299671 - DNA, 25 bp, Mus musculus
gatgatattcaaggaacagcgtctg

SEQ ID NO: 299672 - DNA, 25 bp, Mus musculus
gatgatattgggtttgatctgtgga

SEQ ID NO: 299673 - DNA, 25 bp, Mus musculus
gatgatattggtgatgtaaccatta

SEQ ID NO: 299674 - DNA, 25 bp, Mus musculus
gatgatcaaaaccaggggctgtcag

SEQ ID NO: 299675 - DNA, 25 bp, Mus musculus
gatgatcaagggcatccaccacggc

SEQ ID NO: 299676 - DNA, 25 bp, Mus musculus
gatgatcaatggtcgtagttatgat

SEQ ID NO: 299677 - DNA, 25 bp, Mus musculus
gatgatcaattcgtagttatgatga

SEQ ID NO: 299678 - DNA, 25 bp, Mus musculus
gatgatcaggaatctagagaagcag

SEQ ID NO: 299679 - DNA, 25 bp, Mus musculus
gatgatccagaagcaacatggcttc

SEQ ID NO: 299680 - DNA, 25 bp, Mus musculus
gatgatccgagaggccttggaagct

SEQ ID NO: 299681 - DNA, 25 bp, Mus musculus
gatgatccgccagtttacagacctg

SEQ ID NO: 299682 - DNA, 25 bp, Mus musculus
gatgatcctgggctgggacgaagta

SEQ ID NO: 299683 - DNA, 25 bp, Mus musculus
gatgatcgtggaccctgccatcagc

SEQ ID NO: 299684 - DNA, 25 bp, Mus musculus
gatgatcgtggcgggatccgcagaa

SEQ ID NO: 299685 - DNA, 25 bp, Mus musculus
gatgatcgtggtttggcctggaacc

SEQ ID NO: 299686 - DNA, 25 bp, Mus musculus
gatgatctagtttgtttggtgtaca

SEQ ID NO: 299687 - DNA, 25 bp, Mus musculus
gatgatctatacctactcaggcctc

SEQ ID NO: 299688 - DNA, 25 bp, Mus musculus
gatgatctctgggacctggaattcg

SEQ ID NO: 299689 - DNA, 25 bp, Mus musculus
gatgatctggaagagactttggcca

SEQ ID NO: 299690 - DNA, 25 bp, Mus musculus
gatgatctggaagatgaagtctatg

SEQ ID NO: 299691 - DNA, 25 bp, Mus musculus
gatgatctggacgatgattctgaca

SEQ ID NO: 299692 - DNA, 25 bp, Mus musculus
gatgatcttgagtctgcaactgtgt

SEQ ID NO: 299693 - DNA, 25 bp, Mus musculus
gatgatcttggttttgagttctttg

SEQ ID NO: 299694 - DNA, 25 bp, Mus musculus
gatgatctttaagaatggtcctcct

SEQ ID NO: 299695 - DNA, 25 bp, Mus musculus
gatgatctttaagaatggtgacaag

SEQ ID NO: 299696 - DNA, 25 bp, Mus musculus
gatgatgaaaaacgtgaagcttccc

SEQ ID NO: 299697 - DNA, 25 bp, Mus musculus
gatgatgaaagccctctctatagcc

SEQ ID NO: 299698 - DNA, 25 bp, Mus musculus
gatgatgaagaccgggcatctggag

SEQ ID NO: 299699 - DNA, 25 bp, Mus musculus
gatgatgaagatcgctgagatccga

SEQ ID NO: 299700 - DNA, 25 bp, Mus musculus
gatgatgacaattttgaagaaggcg

SEQ ID NO: 299701 - DNA, 25 bp, Mus musculus
gatgatgacgatggtctcccttctc

SEQ ID NO: 299702 - DNA, 25 bp, Mus musculus
gatgatgactcgaaggaacctaagt

SEQ ID NO: 299703 - DNA, 25 bp, Mus musculus
gatgatgagcaggaaaagaagccgg

SEQ ID NO: 299704 - DNA, 25 bp, Mus musculus
gatgatgatcaggaatctagagaag

SEQ ID NO: 299705 - DNA, 25 bp, Mus musculus
gatgatgatgagaagggcaggtccc

SEQ ID NO: 299706 - DNA, 25 bp, Mus musculus
gatgatgatggaaaggaagaagaaa

SEQ ID NO: 299707 - DNA, 25 bp, Mus musculus
gatgatgatggtacaaaatgctagt

SEQ ID NO: 299708 - DNA, 25 bp, Mus musculus
gatgatgcaagggttctggaatact

SEQ ID NO: 299709 - DNA, 25 bp, Mus musculus
gatgatgcaatgagttccttcgggg

SEQ ID NO: 299710 - DNA, 25 bp, Mus musculus
gatgatgcagaacatgttggagcag

SEQ ID NO: 299711 - DNA, 25 bp, Mus musculus
gatgatgcagggccctggccacatt

SEQ ID NO: 299712 - DNA, 25 bp, Mus musculus
gatgatgccatagcatggaagactg

SEQ ID NO: 299713 - DNA, 25 bp, Mus musculus
gatgatgccatgtacgcgtctacag

SEQ ID NO: 299714 - DNA, 25 bp, Mus musculus
gatgatgcgggagggaccttgtgcc

SEQ ID NO: 299715 - DNA, 25 bp, Mus musculus
gatgatgcggggggcctggatcgtc

SEQ ID NO: 299716 - DNA, 25 bp, Mus musculus
gatgatgcgggtttctccggctgtc

SEQ ID NO: 299717 - DNA, 25 bp, Mus musculus
gatgatggaacaagacttgatttca

SEQ ID NO: 299718 - DNA, 25 bp, Mus musculus
gatgatggaacaagtgcatggagga

SEQ ID NO: 299719 - DNA, 25 bp, Mus musculus
gatgatggacaagaaaaagaataat

SEQ ID NO: 299720 - DNA, 25 bp, Mus musculus
gatgatggacaaggtggagtttgtc

SEQ ID NO: 299721 - DNA, 25 bp, Mus musculus
gatgatggacaggaaacagacagct

SEQ ID NO: 299722 - DNA, 25 bp, Mus musculus
gatgatggaccatgaagcaaagctg

SEQ ID NO: 299723 - DNA, 25 bp, Mus musculus
gatgatggagaggtggacatggaag

SEQ ID NO: 299724 - DNA, 25 bp, Mus musculus
gatgatggctgagatccggggttct

SEQ ID NO: 299725 - DNA, 25 bp, Mus musculus
gatgatggcttagatgaaatcatca

SEQ ID NO: 299726 - DNA, 25 bp, Mus musculus
gatgatgggtcctggagtgaaccca

SEQ ID NO: 299727 - DNA, 25 bp, Mus musculus
gatgatggtccctctggtcttgatg

SEQ ID NO: 299728 - DNA, 25 bp, Mus musculus
gatgatgtccaagtacaaatataga

SEQ ID NO: 299729 - DNA, 25 bp, Mus musculus
gatgatgtgctctgtgcagccctgg

SEQ ID NO: 299730 - DNA, 25 bp, Mus musculus
gatgatgttggtgatctgaaaacat

SEQ ID NO: 299731 - DNA, 25 bp, Mus musculus
gatgattaacctggtgctggatttc

SEQ ID NO: 299732 - DNA, 25 bp, Mus musculus
gatgattaaggactttctgagcccc

SEQ ID NO: 299733 - DNA, 25 bp, Mus musculus
gatgattcacagtggtaagattggt

SEQ ID NO: 299734 - DNA, 25 bp, Mus musculus
gatgattcagagccccagggcttcc

SEQ ID NO: 299735 - DNA, 25 bp, Mus musculus
gatgattgaggatgcaattcgaagt

SEQ ID NO: 299736 - DNA, 25 bp, Mus musculus
gatgatttcgatagcaatgcagttg

SEQ ID NO: 299737 - DNA, 25 bp, Mus musculus
gatgattttaatagctcgatgacct

SEQ ID NO: 299738 - DNA, 25 bp, Mus musculus
gatgattttaatagtgctagccatc

SEQ ID NO: 299739 - DNA, 25 bp, Mus musculus
gatgattttacactgtgctaccagt

SEQ ID NO: 299740 - DNA, 25 bp, Mus musculus
gatgattttacagtgtgctaccagt

SEQ ID NO: 299741 - DNA, 25 bp, Mus musculus
gatgattttggaagttgctttaaag

SEQ ID NO: 299742 - DNA, 25 bp, Mus musculus
gatgatttttttggaatgggcaaag

SEQ ID NO: 299743 - DNA, 25 bp, Mus musculus
gatgcaaaaaggtctgctgaagaca

SEQ ID NO: 299744 - DNA, 25 bp, Mus musculus
gatgcaaaatatcagctggtggctg

SEQ ID NO: 299745 - DNA, 25 bp, Mus musculus
gatgcaaaatatcagtctagccgca

SEQ ID NO: 299746 - DNA, 25 bp, Mus musculus
gatgcaaagcagaacaggggctacc

SEQ ID NO: 299747 - DNA, 25 bp, Mus musculus
gatgcaactgatgtttcccagaaaa

SEQ ID NO: 299748 - DNA, 25 bp, Mus musculus
gatgcaactgggaagagagcacagt

SEQ ID NO: 299749 - DNA, 25 bp, Mus musculus
gatgcaagccttcagaatctgggat

SEQ ID NO: 299750 - DNA, 25 bp, Mus musculus
gatgcaagccttcagacacctagat

SEQ ID NO: 299751 - DNA, 25 bp, Mus musculus
gatgcaaggcccatgtcttccctac

SEQ ID NO: 299752 - DNA, 25 bp, Mus musculus
gatgcaagtgggagaatccacctca

SEQ ID NO: 299753 - DNA, 25 bp, Mus musculus
gatgcaatcaaagttgtcctgggga

SEQ ID NO: 299754 - DNA, 25 bp, Mus musculus
gatgcaatgacggtgccccctacag

SEQ ID NO: 299755 - DNA, 25 bp, Mus musculus
gatgcaattcgggaggctttggagg

SEQ ID NO: 299756 - DNA, 25 bp, Mus musculus
gatgcaatttaaaattgtggtgggt

SEQ ID NO: 299757 - DNA, 25 bp, Mus musculus
gatgcacaaacaggcggaaattgtg

SEQ ID NO: 299758 - DNA, 25 bp, Mus musculus
gatgcacaaacagtgccccaggtac

SEQ ID NO: 299759 - DNA, 25 bp, Mus musculus
gatgcacaaggccacagatgactgc

SEQ ID NO: 299760 - DNA, 25 bp, Mus musculus
gatgcacaagttcatattctctctg

SEQ ID NO: 299761 - DNA, 25 bp, Mus musculus
gatgcacacagccaaccccaacaag

SEQ ID NO: 299762 - DNA, 25 bp, Mus musculus
gatgcacatagaagccgtatcaagg

SEQ ID NO: 299763 - DNA, 25 bp, Mus musculus
gatgcacctggaagatgctggagac

SEQ ID NO: 299764 - DNA, 25 bp, Mus musculus
gatgcacctggaaggtatgacatta

SEQ ID NO: 299765 - DNA, 25 bp, Mus musculus
gatgcacgggaaggaagtgggcagc

SEQ ID NO: 299766 - DNA, 25 bp, Mus musculus
gatgcactcagggtgactacaacca

SEQ ID NO: 299767 - DNA, 25 bp, Mus musculus
gatgcactcaggttgaaggtggagg

SEQ ID NO: 299768 - DNA, 25 bp, Mus musculus
gatgcactgaccctgcagttgggtg

SEQ ID NO: 299769 - DNA, 25 bp, Mus musculus
gatgcactgcagaaggctctgaagg

SEQ ID NO: 299770 - DNA, 25 bp, Mus musculus
gatgcactgtcagaacaagcctgcc

SEQ ID NO: 299771 - DNA, 25 bp, Mus musculus
gatgcactgtcaggttccgagtccg

SEQ ID NO: 299772 - DNA, 25 bp, Mus musculus
gatgcagaagaaacacatggtgatg

SEQ ID NO: 299773 - DNA, 25 bp, Mus musculus
gatgcagaagaaactcatggtgatg

SEQ ID NO: 299774 - DNA, 25 bp, Mus musculus
gatgcagaagacggacaagacgatg

SEQ ID NO: 299775 - DNA, 25 bp, Mus musculus
gatgcagaagtgtatgagagaggac

SEQ ID NO: 299776 - DNA, 25 bp, Mus musculus
gatgcagacaaagatggggcaaatc

SEQ ID NO: 299777 - DNA, 25 bp, Mus musculus
gatgcagacaggcttcgccggcagg

SEQ ID NO: 299778 - DNA, 25 bp, Mus musculus
gatgcagacagtgtggcatcagcta

SEQ ID NO: 299779 - DNA, 25 bp, Mus musculus
gatgcagaccacccaggctttaaag

SEQ ID NO: 299780 - DNA, 25 bp, Mus musculus
gatgcagaccatggggccgaggagg

SEQ ID NO: 299781 - DNA, 25 bp, Mus musculus
gatgcagacggagaagcagttcttc

SEQ ID NO: 299782 - DNA, 25 bp, Mus musculus
gatgcagactaaaggcatgcagtat

SEQ ID NO: 299783 - DNA, 25 bp, Mus musculus
gatgcagactaaaggtgttgacagc

SEQ ID NO: 299784 - DNA, 25 bp, Mus musculus
gatgcagacttccacagcacagccc

SEQ ID NO: 299785 - DNA, 25 bp, Mus musculus
gatgcagacttccgggtctgacaga

SEQ ID NO: 299786 - DNA, 25 bp, Mus musculus
gatgcagagactgtgctgtatctgg

SEQ ID NO: 299787 - DNA, 25 bp, Mus musculus
gatgcagagtcaaagatgttgatcc

SEQ ID NO: 299788 - DNA, 25 bp, Mus musculus
gatgcagatggtgaaagtgatgaaa

SEQ ID NO: 299789 - DNA, 25 bp, Mus musculus
gatgcagcacagcagatttaggacc

SEQ ID NO: 299790 - DNA, 25 bp, Mus musculus
gatgcagcacagcagggacagggtg

SEQ ID NO: 299791 - DNA, 25 bp, Mus musculus
gatgcagcatctgaggaacaagcaa

SEQ ID NO: 299792 - DNA, 25 bp, Mus musculus
gatgcagcatctgaggaagactctt

SEQ ID NO: 299793 - DNA, 25 bp, Mus musculus
gatgcagccgctggatccagccgca

SEQ ID NO: 299794 - DNA, 25 bp, Mus musculus
gatgcagcgcgcagacgggtccagt

SEQ ID NO: 299795 - DNA, 25 bp, Mus musculus
gatgcagcgcgcagcccctggagga

SEQ ID NO: 299796 - DNA, 25 bp, Mus musculus
gatgcagctccccaccacttacttg

SEQ ID NO: 299797 - DNA, 25 bp, Mus musculus
gatgcagctgcaaaggagggctgct

SEQ ID NO: 299798 - DNA, 25 bp, Mus musculus
gatgcagctgccatcaaacttcagg

SEQ ID NO: 299799 - DNA, 25 bp, Mus musculus
gatgcaggaagcgctgctccgaaag

SEQ ID NO: 299800 - DNA, 25 bp, Mus musculus
gatgcaggagaagattcgatgaaag

SEQ ID NO: 299801 - DNA, 25 bp, Mus musculus
gatgcaggagactgacggttctgtg

SEQ ID NO: 299802 - DNA, 25 bp, Mus musculus
gatgcaggaggattggaagctgacg

SEQ ID NO: 299803 - DNA, 25 bp, Mus musculus
gatgcaggagtgagattatatagta

SEQ ID NO: 299804 - DNA, 25 bp, Mus musculus
gatgcaggcacaagcctccattgag

SEQ ID NO: 299805 - DNA, 25 bp, Mus musculus
gatgcaggccgcattaggaggaaga

SEQ ID NO: 299806 - DNA, 25 bp, Mus musculus
gatgcagggctgctaaccccgagat

SEQ ID NO: 299807 - DNA, 25 bp, Mus musculus
gatgcagggctgctctagaagtcaa

SEQ ID NO: 299808 - DNA, 25 bp, Mus musculus
gatgcagtgcaggcaatacagagtg

SEQ ID NO: 299809 - DNA, 25 bp, Mus musculus
gatgcagtgtaaagattgcaaattc

SEQ ID NO: 299810 - DNA, 25 bp, Mus musculus
gatgcataaacaggctgagattgtg

SEQ ID NO: 299811 - DNA, 25 bp, Mus musculus
gatgcataaacaggctgagatttga

SEQ ID NO: 299812 - DNA, 25 bp, Mus musculus
gatgcataaggaaagacaagaaaat

SEQ ID NO: 299813 - DNA, 25 bp, Mus musculus
gatgcatcagaaaaggtgactaata

SEQ ID NO: 299814 - DNA, 25 bp, Mus musculus
gatgcatcattgtcgctgcccaggc

SEQ ID NO: 299815 - DNA, 25 bp, Mus musculus
gatgcatgaatatacagagtaagtc

SEQ ID NO: 299816 - DNA, 25 bp, Mus musculus
gatgcattcacagggtgatcttgtt

SEQ ID NO: 299817 - DNA, 25 bp, Mus musculus
gatgcattcaggggtgattcagaca

SEQ ID NO: 299818 - DNA, 25 bp, Mus musculus
gatgcattgctgaagatacgccaat

SEQ ID NO: 299819 - DNA, 25 bp, Mus musculus
gatgcattgctgaaggaatttgagc

SEQ ID NO: 299820 - DNA, 25 bp, Mus musculus
gatgcatttctcaggaaacacgatg

SEQ ID NO: 299821 - DNA, 25 bp, Mus musculus
gatgccaaatagaccttctggaccc

SEQ ID NO: 299822 - DNA, 25 bp, Mus musculus
gatgccaaattggatgaatatatcg

SEQ ID NO: 299823 - DNA, 25 bp, Mus musculus
gatgccaagaccagggacggtctga

SEQ ID NO: 299824 - DNA, 25 bp, Mus musculus
gatgccaagtttgagcatgccacca

SEQ ID NO: 299825 - DNA, 25 bp, Mus musculus
gatgccaagtttgagtctggagacg

SEQ ID NO: 299826 - DNA, 25 bp, Mus musculus
gatgccaataaggctgtggaagaaa

SEQ ID NO: 299827 - DNA, 25 bp, Mus musculus
gatgccacaaaaggagccataattc

SEQ ID NO: 299828 - DNA, 25 bp, Mus musculus
gatgccacacagaggacggctgaac

SEQ ID NO: 299829 - DNA, 25 bp, Mus musculus
gatgccacagcccgtgttcctcttt

SEQ ID NO: 299830 - DNA, 25 bp, Mus musculus
gatgccacagctcccaacccctcca

SEQ ID NO: 299831 - DNA, 25 bp, Mus musculus
gatgccacctaggtttgaagactcc

SEQ ID NO: 299832 - DNA, 25 bp, Mus musculus
gatgccactggtaagaccacactga

SEQ ID NO: 299833 - DNA, 25 bp, Mus musculus
gatgccactggtactggcatagcac

SEQ ID NO: 299834 - DNA, 25 bp, Mus musculus
gatgccacttccaaggtagcgttgg

SEQ ID NO: 299835 - DNA, 25 bp, Mus musculus
gatgccagagcatggggctctcttt

SEQ ID NO: 299836 - DNA, 25 bp, Mus musculus
gatgccagatgaggagtccctggtg

SEQ ID NO: 299837 - DNA, 25 bp, Mus musculus
gatgccagatgaggatcatggctgc

SEQ ID NO: 299838 - DNA, 25 bp, Mus musculus
gatgccagatgatcttcccccacca

SEQ ID NO: 299839 - DNA, 25 bp, Mus musculus
gatgccagccgatggaaaggtcaat

SEQ ID NO: 299840 - DNA, 25 bp, Mus musculus
gatgccagcgccgctttcccgaaag

SEQ ID NO: 299841 - DNA, 25 bp, Mus musculus
gatgccagttaatgcttcaaactgt

SEQ ID NO: 299842 - DNA, 25 bp, Mus musculus
gatgccatattgtttccatccttta

SEQ ID NO: 299843 - DNA, 25 bp, Mus musculus
gatgccatcagtgaatcaaaggata

SEQ ID NO: 299844 - DNA, 25 bp, Mus musculus
gatgccatcgatgccctcatgaaga

SEQ ID NO: 299845 - DNA, 25 bp, Mus musculus
gatgccatcgtgaccatgctcaagc

SEQ ID NO: 299846 - DNA, 25 bp, Mus musculus
gatgccatgaagccattttcagtca

SEQ ID NO: 299847 - DNA, 25 bp, Mus musculus
gatgccatggacgtgactgcacccc

SEQ ID NO: 299848 - DNA, 25 bp, Mus musculus
gatgccattccaggtaaatgggcca

SEQ ID NO: 299849 - DNA, 25 bp, Mus musculus
gatgcccaagagcgatctagggcgg

SEQ ID NO: 299850 - DNA, 25 bp, Mus musculus
gatgcccaaggcaacttaagggcta

SEQ ID NO: 299851 - DNA, 25 bp, Mus musculus
gatgcccaccagagcgagtacattg

SEQ ID NO: 299852 - DNA, 25 bp, Mus musculus
gatgcccaccagttgacagggctgg

SEQ ID NO: 299853 - DNA, 25 bp, Mus musculus
gatgcccacgtcaccctggtcttcc

SEQ ID NO: 299854 - DNA, 25 bp, Mus musculus
gatgcccactggacttcaggaacca

SEQ ID NO: 299855 - DNA, 25 bp, Mus musculus
gatgcccaggagaaactgggagctg

SEQ ID NO: 299856 - DNA, 25 bp, Mus musculus
gatgccccacttcagaaggcccgaa

SEQ ID NO: 299857 - DNA, 25 bp, Mus musculus
gatgccccacttcagtgtgtagaag

SEQ ID NO: 299858 - DNA, 25 bp, Mus musculus
gatgccccagctgaaaaaaaaccca

SEQ ID NO: 299859 - DNA, 25 bp, Mus musculus
gatgccccagctgagaaaaaacgca

SEQ ID NO: 299860 - DNA, 25 bp, Mus musculus
gatgccccaggaactggatgccttc

SEQ ID NO: 299861 - DNA, 25 bp, Mus musculus
gatgccccagttttataggcaatgc

SEQ ID NO: 299862 - DNA, 25 bp, Mus musculus
gatgcccccacttaatgcccaaagg

SEQ ID NO: 299863 - DNA, 25 bp, Mus musculus
gatgccctagtcctgcgcttctttc

SEQ ID NO: 299864 - DNA, 25 bp, Mus musculus
gatgccctgcaccactttgccagca

SEQ ID NO: 299865 - DNA, 25 bp, Mus musculus
gatgcccttttcccgtgtgttcagg

SEQ ID NO: 299866 - DNA, 25 bp, Mus musculus
gatgccgacttggacattgctgttg

SEQ ID NO: 299867 - DNA, 25 bp, Mus musculus
gatgccgcagggaagagcgggctaa

SEQ ID NO: 299868 - DNA, 25 bp, Mus musculus
gatgccgccacaaagaaaggaaaca

SEQ ID NO: 299869 - DNA, 25 bp, Mus musculus
gatgccgggatcaaggcagagatgc

SEQ ID NO: 299870 - DNA, 25 bp, Mus musculus
gatgccgtcctgcaccaacctgcga

SEQ ID NO: 299871 - DNA, 25 bp, Mus musculus
gatgccgtggaggaccccagcagca

SEQ ID NO: 299872 - DNA, 25 bp, Mus musculus
gatgccgttgactgtgtactcgatt

SEQ ID NO: 299873 - DNA, 25 bp, Mus musculus
gatgcctaccccaaaaattatggac

SEQ ID NO: 299874 - DNA, 25 bp, Mus musculus
gatgcctcacctgctccaggtttcc

SEQ ID NO: 299875 - DNA, 25 bp, Mus musculus
gatgcctcacctgggtgctacagaa

SEQ ID NO: 299876 - DNA, 25 bp, Mus musculus
gatgcctcaggttcaaccaggccca

SEQ ID NO: 299877 - DNA, 25 bp, Mus musculus
gatgcctccgctggaaaccatggcc

SEQ ID NO: 299878 - DNA, 25 bp, Mus musculus
gatgcctcggcggtgttcacctaca

SEQ ID NO: 299879 - DNA, 25 bp, Mus musculus
gatgcctctaaaaacccacaactcc

SEQ ID NO: 299880 - DNA, 25 bp, Mus musculus
gatgcctctaaaaagccacaactcc

SEQ ID NO: 299881 - DNA, 25 bp, Mus musculus
gatgcctcttacgtgtgttctcagg

SEQ ID NO: 299882 - DNA, 25 bp, Mus musculus
gatgcctgagggcaggatggcccag

SEQ ID NO: 299883 - DNA, 25 bp, Mus musculus
gatgcctgagtgccagtgcccgccc

SEQ ID NO: 299884 - DNA, 25 bp, Mus musculus
gatgcctgcaggatctgccactgtg

SEQ ID NO: 299885 - DNA, 25 bp, Mus musculus
gatgcctgcataaggttataagtac

SEQ ID NO: 299886 - DNA, 25 bp, Mus musculus
gatgcctgcataagtgagcaactgt

SEQ ID NO: 299887 - DNA, 25 bp, Mus musculus
gatgcctgccttgaggacgggcaga

SEQ ID NO: 299888 - DNA, 25 bp, Mus musculus
gatgcctgccttgaggctggctact

SEQ ID NO: 299889 - DNA, 25 bp, Mus musculus
gatgcctgggaggccatggaggaac

SEQ ID NO: 299890 - DNA, 25 bp, Mus musculus
gatgcctttgacgtcctattaccag

SEQ ID NO: 299891 - DNA, 25 bp, Mus musculus
gatgcgaagatagagatctggccgc

SEQ ID NO: 299892 - DNA, 25 bp, Mus musculus
gatgcgattcatctaaatggtgcca

SEQ ID NO: 299893 - DNA, 25 bp, Mus musculus
gatgcgcaagggctacgagggcctt

SEQ ID NO: 299894 - DNA, 25 bp, Mus musculus
gatgcgcaaggtatgaatgctgctg

SEQ ID NO: 299895 - DNA, 25 bp, Mus musculus
gatgcgccccagcgccctgtgtgtc

SEQ ID NO: 299896 - DNA, 25 bp, Mus musculus
gatgcgctgaggcccagtatagtgg

SEQ ID NO: 299897 - DNA, 25 bp, Mus musculus
gatgcggagtacatgaagcacacag

SEQ ID NO: 299898 - DNA, 25 bp, Mus musculus
gatgcgggagccaggagaacgggat

SEQ ID NO: 299899 - DNA, 25 bp, Mus musculus
gatgcgggagccagttccaggcgaa

SEQ ID NO: 299900 - DNA, 25 bp, Mus musculus
gatgcgggcgcaaggcctctctttc

SEQ ID NO: 299901 - DNA, 25 bp, Mus musculus
gatgcgggcgtcggttgggtttctc

SEQ ID NO: 299902 - DNA, 25 bp, Mus musculus
gatgcgtaggaagggtggtgctgat

SEQ ID NO: 299903 - DNA, 25 bp, Mus musculus
gatgcgtctaggtcttccaagttgc

SEQ ID NO: 299904 - DNA, 25 bp, Mus musculus
gatgcgtgccagggcgacagtggag

SEQ ID NO: 299905 - DNA, 25 bp, Mus musculus
gatgcgtggcggagatggcgcggcc

SEQ ID NO: 299906 - DNA, 25 bp, Mus musculus
gatgctaaatatgttctagaagccc

SEQ ID NO: 299907 - DNA, 25 bp, Mus musculus
gatgctaaggatgatctgatgatga

SEQ ID NO: 299908 - DNA, 25 bp, Mus musculus
gatgctaatgcactgtctcaaaatc

SEQ ID NO: 299909 - DNA, 25 bp, Mus musculus
gatgctaatggcccagatggagttc

SEQ ID NO: 299910 - DNA, 25 bp, Mus musculus
gatgctaatggcctctttatggcag

SEQ ID NO: 299911 - DNA, 25 bp, Mus musculus
gatgctaatggcctggtccagatcc

SEQ ID NO: 299912 - DNA, 25 bp, Mus musculus
gatgctacaggtaaagtccttttct

SEQ ID NO: 299913 - DNA, 25 bp, Mus musculus
gatgctaccggtactaaacagaccc

SEQ ID NO: 299914 - DNA, 25 bp, Mus musculus
gatgctacggaggtgccttagctgg

SEQ ID NO: 299915 - DNA, 25 bp, Mus musculus
gatgctactcaggggcagttggtga

SEQ ID NO: 299916 - DNA, 25 bp, Mus musculus
gatgctagaagaatataaaaatagt

SEQ ID NO: 299917 - DNA, 25 bp, Mus musculus
gatgctagaaggtcccttcagcaca

SEQ ID NO: 299918 - DNA, 25 bp, Mus musculus
gatgctagagaggaggtggctgaag

SEQ ID NO: 299919 - DNA, 25 bp, Mus musculus
gatgctagagcctcagtctgaaaac

SEQ ID NO: 299920 - DNA, 25 bp, Mus musculus
gatgctagaggtctgtgaggaacaa

SEQ ID NO: 299921 - DNA, 25 bp, Mus musculus
gatgctagctctggtacacctacac

SEQ ID NO: 299922 - DNA, 25 bp, Mus musculus
gatgctatgagctgatacaagtgat

SEQ ID NO: 299923 - DNA, 25 bp, Mus musculus
gatgctcacagagaacagtacactg

SEQ ID NO: 299924 - DNA, 25 bp, Mus musculus
gatgctcacaggaagttcattcaaa

SEQ ID NO: 299925 - DNA, 25 bp, Mus musculus
gatgctcacggaacgaatgttcagc

SEQ ID NO: 299926 - DNA, 25 bp, Mus musculus
gatgctcagacaaagatgggctaca

SEQ ID NO: 299927 - DNA, 25 bp, Mus musculus
gatgctcatggtagcgaccacctgc

SEQ ID NO: 299928 - DNA, 25 bp, Mus musculus
gatgctccagattctgtcccctctg

SEQ ID NO: 299929 - DNA, 25 bp, Mus musculus
gatgctccaggaggagcctgatctg

SEQ ID NO: 299930 - DNA, 25 bp, Mus musculus
gatgctcccaacaggttctgggcct

SEQ ID NO: 299931 - DNA, 25 bp, Mus musculus
gatgctcctccgggaagaatgggag

SEQ ID NO: 299932 - DNA, 25 bp, Mus musculus
gatgctcctccggtgccagtgacct

SEQ ID NO: 299933 - DNA, 25 bp, Mus musculus
gatgctcgggctgttgacagctaga

SEQ ID NO: 299934 - DNA, 25 bp, Mus musculus
gatgctcgtctgatgtcatggctcc

SEQ ID NO: 299935 - DNA, 25 bp, Mus musculus
gatgctcgtctgatgttcacctcac

SEQ ID NO: 299936 - DNA, 25 bp, Mus musculus
gatgctctcacaggtccgctacaga

SEQ ID NO: 299937 - DNA, 25 bp, Mus musculus
gatgctctcaggagttcctggtctg

SEQ ID NO: 299938 - DNA, 25 bp, Mus musculus
gatgctgaaactgatgccatgcaga

SEQ ID NO: 299939 - DNA, 25 bp, Mus musculus
gatgctgaaactgtatgccatgttc

SEQ ID NO: 299940 - DNA, 25 bp, Mus musculus
gatgctgaaattggatgcaaaacat

SEQ ID NO: 299941 - DNA, 25 bp, Mus musculus
gatgctgacaaagcaaatgaaaaga

SEQ ID NO: 299942 - DNA, 25 bp, Mus musculus
gatgctgacatggtcaaccagtaca

SEQ ID NO: 299943 - DNA, 25 bp, Mus musculus
gatgctgaccagatcgtgagacatg

SEQ ID NO: 299944 - DNA, 25 bp, Mus musculus
gatgctgaccagcacgtaacttcta

SEQ ID NO: 299945 - DNA, 25 bp, Mus musculus
gatgctgaccaggatcttcccaaca

SEQ ID NO: 299946 - DNA, 25 bp, Mus musculus
gatgctgaccgagatccctgacgac

SEQ ID NO: 299947 - DNA, 25 bp, Mus musculus
gatgctgacggtcacagagctgctg

SEQ ID NO: 299948 - DNA, 25 bp, Mus musculus
gatgctgagcgaggagtgactgcaa

SEQ ID NO: 299949 - DNA, 25 bp, Mus musculus
gatgctgaggacatcgtgaacacag

SEQ ID NO: 299950 - DNA, 25 bp, Mus musculus
gatgctgaggatattgtaggcactc

SEQ ID NO: 299951 - DNA, 25 bp, Mus musculus
gatgctgagggcactctgaggccag

SEQ ID NO: 299952 - DNA, 25 bp, Mus musculus
gatgctgagggtggttagaaagctg

SEQ ID NO: 299953 - DNA, 25 bp, Mus musculus
gatgctgatccagtgaagtcgagtt

SEQ ID NO: 299954 - DNA, 25 bp, Mus musculus
gatgctgatcctatggtgaatcccc

SEQ ID NO: 299955 - DNA, 25 bp, Mus musculus
gatgctgatgagttcttgaccatga

SEQ ID NO: 299956 - DNA, 25 bp, Mus musculus
gatgctgatggcaatggcaccattg

SEQ ID NO: 299957 - DNA, 25 bp, Mus musculus
gatgctgatggcaatgggaccattg

SEQ ID NO: 299958 - DNA, 25 bp, Mus musculus
gatgctgcagaatatgtgtacatgt

SEQ ID NO: 299959 - DNA, 25 bp, Mus musculus
gatgctgcaggcaccagaaagcatc

SEQ ID NO: 299960 - DNA, 25 bp, Mus musculus
gatgctgcaggtctgggaaggcccc

SEQ ID NO: 299961 - DNA, 25 bp, Mus musculus
gatgctgcaggttactcggcggccg

SEQ ID NO: 299962 - DNA, 25 bp, Mus musculus
gatgctgcattctggcgcctagtga

SEQ ID NO: 299963 - DNA, 25 bp, Mus musculus
gatgctgccaattttgagcagttcc

SEQ ID NO: 299964 - DNA, 25 bp, Mus musculus
gatgctgccaatttttgacaacaga

SEQ ID NO: 299965 - DNA, 25 bp, Mus musculus
gatgctgccagctggacaggcctga

SEQ ID NO: 299966 - DNA, 25 bp, Mus musculus
gatgctgccaggagacgctctgtct

SEQ ID NO: 299967 - DNA, 25 bp, Mus musculus
gatgctgcctcaggtacctttgacc

SEQ ID NO: 299968 - DNA, 25 bp, Mus musculus
gatgctgcctcagtttgacagcagt

SEQ ID NO: 299969 - DNA, 25 bp, Mus musculus
gatgctgccttttcctgggatcagc

SEQ ID NO: 299970 - DNA, 25 bp, Mus musculus
gatgctgcgaagctgatggtgcctc

SEQ ID NO: 299971 - DNA, 25 bp, Mus musculus
gatgctgctacgaaatccatacttg

SEQ ID NO: 299972 - DNA, 25 bp, Mus musculus
gatgctgctacgaggaggaagatgg

SEQ ID NO: 299973 - DNA, 25 bp, Mus musculus
gatgctggagctctcttgagtcatg

SEQ ID NO: 299974 - DNA, 25 bp, Mus musculus
gatgctggaggtcacatctgtcaaa

SEQ ID NO: 299975 - DNA, 25 bp, Mus musculus
gatgctggaggtgagccttcccggt

SEQ ID NO: 299976 - DNA, 25 bp, Mus musculus
gatgctggatttatgataaagctgc

SEQ ID NO: 299977 - DNA, 25 bp, Mus musculus
gatgctggcaggtatctgtgtgact

SEQ ID NO: 299978 - DNA, 25 bp, Mus musculus
gatgctggccaagttcagcaagaag

SEQ ID NO: 299979 - DNA, 25 bp, Mus musculus
gatgctggccagccggtttaagcag

SEQ ID NO: 299980 - DNA, 25 bp, Mus musculus
gatgctggctttttcacttgatacc

SEQ ID NO: 299981 - DNA, 25 bp, Mus musculus
gatgctgggtggagagatcattcct

SEQ ID NO: 299982 - DNA, 25 bp, Mus musculus
gatgctggtcacgagctcttctgat

SEQ ID NO: 299983 - DNA, 25 bp, Mus musculus
gatgctggtcacgaggtaaccatct

SEQ ID NO: 299984 - DNA, 25 bp, Mus musculus
gatgctgtagagagacaatgtctat

SEQ ID NO: 299985 - DNA, 25 bp, Mus musculus
gatgctgtcaaggcccgcctggctg

SEQ ID NO: 299986 - DNA, 25 bp, Mus musculus
gatgctgtcagggatggtgaagagc

SEQ ID NO: 299987 - DNA, 25 bp, Mus musculus
gatgctgtccactttgatcttcatg

SEQ ID NO: 299988 - DNA, 25 bp, Mus musculus
gatgctgtcggtggctacagatgtc

SEQ ID NO: 299989 - DNA, 25 bp, Mus musculus
gatgctgtctatgtactgtgctact

SEQ ID NO: 299990 - DNA, 25 bp, Mus musculus
gatgctgtgctgggtcacttttcat

SEQ ID NO: 299991 - DNA, 25 bp, Mus musculus
gatgctgttattctggtatgggacg

SEQ ID NO: 299992 - DNA, 25 bp, Mus musculus
gatgctgtttgagcgatttattgcc

SEQ ID NO: 299993 - DNA, 25 bp, Mus musculus
gatgcttacagctcaaaggtgacac

SEQ ID NO: 299994 - DNA, 25 bp, Mus musculus
gatgcttaggagagtgacagctaga

SEQ ID NO: 299995 - DNA, 25 bp, Mus musculus
gatgcttcagagaaggacagtgtcc

SEQ ID NO: 299996 - DNA, 25 bp, Mus musculus
gatgcttcagagaaggatgggggaa

SEQ ID NO: 299997 - DNA, 25 bp, Mus musculus
gatgcttcagatacgggaagccagg

SEQ ID NO: 299998 - DNA, 25 bp, Mus musculus
gatgcttcagattctgaagggagtg

SEQ ID NO: 299999 - DNA, 25 bp, Mus musculus
gatgcttcagcaggagctgctaagt

SEQ ID NO: 300000 - DNA, 25 bp, Mus musculus
gatgcttcagctgagtgtgacagat

SEQ ID NO: 300001 - DNA, 25 bp, Mus musculus
gatgcttcagctgggtggcacagtg

SEQ ID NO: 300002 - DNA, 25 bp, Mus musculus
gatgcttcaggactctctgattctt

SEQ ID NO: 300003 - DNA, 25 bp, Mus musculus
gatgcttcctttctagtgagtgcca

SEQ ID NO: 300004 - DNA, 25 bp, Mus musculus
gatgcttcggcaggttttgtcgcta

SEQ ID NO: 300005 - DNA, 25 bp, Mus musculus
gatgcttctgtactcacttctgctg

SEQ ID NO: 300006 - DNA, 25 bp, Mus musculus
gatgcttctgtggcctacctgttta

SEQ ID NO: 300007 - DNA, 25 bp, Mus musculus
gatgcttcttcagtacaggctatgt

SEQ ID NO: 300008 - DNA, 25 bp, Mus musculus
gatgcttgagaagatgaggtgaaca

SEQ ID NO: 300009 - DNA, 25 bp, Mus musculus
gatgcttgcatcgggattctgtaac

SEQ ID NO: 300010 - DNA, 25 bp, Mus musculus
gatgcttgcatcggggtcagtggat

SEQ ID NO: 300011 - DNA, 25 bp, Mus musculus
gatgcttgccacagagcccttgctt

SEQ ID NO: 300012 - DNA, 25 bp, Mus musculus
gatgcttgccacaggagacgtggct

SEQ ID NO: 300013 - DNA, 25 bp, Mus musculus
gatgcttgccagggtgacagtgggg

SEQ ID NO: 300014 - DNA, 25 bp, Mus musculus
gatgcttgccagtgggggaccgctt

SEQ ID NO: 300015 - DNA, 25 bp, Mus musculus
gatgcttgcgctccgcaagccccgc

SEQ ID NO: 300016 - DNA, 25 bp, Mus musculus
gatgcttgcggaatgcagcccgcac

SEQ ID NO: 300017 - DNA, 25 bp, Mus musculus
gatgcttgcgtgcaatgctcacccc

SEQ ID NO: 300018 - DNA, 25 bp, Mus musculus
gatgcttgctgaacccccacagaac

SEQ ID NO: 300019 - DNA, 25 bp, Mus musculus
gatgcttgtcccctgctctgccgca

SEQ ID NO: 300020 - DNA, 25 bp, Mus musculus
gatgctttaaaagcaaggatcatgg

SEQ ID NO: 300021 - DNA, 25 bp, Mus musculus
gatgctttaaaaggaaaatacatag

SEQ ID NO: 300022 - DNA, 25 bp, Mus musculus
gatgctttccctaacatcgagaagg

SEQ ID NO: 300023 - DNA, 25 bp, Mus musculus
gatgctttggtaagctgcgatattt

SEQ ID NO: 300024 - DNA, 25 bp, Mus musculus
gatgcttttcctggagagcctgaca

SEQ ID NO: 300025 - DNA, 25 bp, Mus musculus
gatggaaaaaagggaacgaagagct

SEQ ID NO: 300026 - DNA, 25 bp, Mus musculus
gatggaaaaaagggtggccggcaag

SEQ ID NO: 300027 - DNA, 25 bp, Mus musculus
gatggaaaagcaaaaggtggcgcgt

SEQ ID NO: 300028 - DNA, 25 bp, Mus musculus
gatggaaaagcacctggatgcttta

SEQ ID NO: 300029 - DNA, 25 bp, Mus musculus
gatggaaaagcgaggaggcggctca

SEQ ID NO: 300030 - DNA, 25 bp, Mus musculus
gatggaaaagctggtggacaataac

SEQ ID NO: 300031 - DNA, 25 bp, Mus musculus
gatggaaaaggtggcgcgttacttc

SEQ ID NO: 300032 - DNA, 25 bp, Mus musculus
gatggaaaatgaagatgctagaaaa

SEQ ID NO: 300033 - DNA, 25 bp, Mus musculus
gatggaaaatgaaggttgcacgatt

SEQ ID NO: 300034 - DNA, 25 bp, Mus musculus
gatggaaaccagcaggtgcagcagg

SEQ ID NO: 300035 - DNA, 25 bp, Mus musculus
gatggaaaccaggacaagaagacag

SEQ ID NO: 300036 - DNA, 25 bp, Mus musculus
gatggaacaagacttgatttcattg

SEQ ID NO: 300037 - DNA, 25 bp, Mus musculus
gatggaacaagtaaggatagatggg

SEQ ID NO: 300038 - DNA, 25 bp, Mus musculus
gatggaacaagtgcatggaggactg

SEQ ID NO: 300039 - DNA, 25 bp, Mus musculus
gatggaaccgggcgcagcgcgttta

SEQ ID NO: 300040 - DNA, 25 bp, Mus musculus
gatggaacctgttcgatttctcggt

SEQ ID NO: 300041 - DNA, 25 bp, Mus musculus
gatggaacggtgaaggtgtggaatg

SEQ ID NO: 300042 - DNA, 25 bp, Mus musculus
gatggaagaaaagttcctagtctcc

SEQ ID NO: 300043 - DNA, 25 bp, Mus musculus
gatggaagaagccctctgggcgtgg

SEQ ID NO: 300044 - DNA, 25 bp, Mus musculus
gatggaagcagggaggctgcaaagg

SEQ ID NO: 300045 - DNA, 25 bp, Mus musculus
gatggaaggggtgaccactgactgg

SEQ ID NO: 300046 - DNA, 25 bp, Mus musculus
gatggaagtgtccaggtgtaaccag

SEQ ID NO: 300047 - DNA, 25 bp, Mus musculus
gatggaagttgactgagcacgtgag

SEQ ID NO: 300048 - DNA, 25 bp, Mus musculus
gatggaatcctcagctgtcgagaaa

SEQ ID NO: 300049 - DNA, 25 bp, Mus musculus
gatggaatcctcaggtatcagagaa

SEQ ID NO: 300050 - DNA, 25 bp, Mus musculus
gatggaatcctcaggttcctgccct

SEQ ID NO: 300051 - DNA, 25 bp, Mus musculus
gatggaatctgtctctctcctctct

SEQ ID NO: 300052 - DNA, 25 bp, Mus musculus
gatggaatggaaggccttgttaccc

SEQ ID NO: 300053 - DNA, 25 bp, Mus musculus
gatggaatggataatcaaggaggat

SEQ ID NO: 300054 - DNA, 25 bp, Mus musculus
gatggaatgtgagatatgatgaatg

SEQ ID NO: 300055 - DNA, 25 bp, Mus musculus
gatggaattataagtactattaatc

SEQ ID NO: 300056 - DNA, 25 bp, Mus musculus
gatggaattcctgggcatccagggc

SEQ ID NO: 300057 - DNA, 25 bp, Mus musculus
gatggacaaagctggtcagtacact

SEQ ID NO: 300058 - DNA, 25 bp, Mus musculus
gatggacaagaaaaagaataatctc

SEQ ID NO: 300059 - DNA, 25 bp, Mus musculus
gatggacaagctcctagatcttgat

SEQ ID NO: 300060 - DNA, 25 bp, Mus musculus
gatggacaagctccttccagtgaca

SEQ ID NO: 300061 - DNA, 25 bp, Mus musculus
gatggacaaggtggagtttgtccat

SEQ ID NO: 300062 - DNA, 25 bp, Mus musculus
gatggacaatcagcgcctgttggtc

SEQ ID NO: 300063 - DNA, 25 bp, Mus musculus
gatggacaatcagggtctatctaca

SEQ ID NO: 300064 - DNA, 25 bp, Mus musculus
gatggacacggtggatggagcgaga

SEQ ID NO: 300065 - DNA, 25 bp, Mus musculus
gatggacagcgagcagtgttgcctc

SEQ ID NO: 300066 - DNA, 25 bp, Mus musculus
gatggacagcgaggcatgctacacc

SEQ ID NO: 300067 - DNA, 25 bp, Mus musculus
gatggacatatcaattactgggatt

SEQ ID NO: 300068 - DNA, 25 bp, Mus musculus
gatggacatatcatcataccccaca

SEQ ID NO: 300069 - DNA, 25 bp, Mus musculus
gatggaccaaacacgtgaagaagag

SEQ ID NO: 300070 - DNA, 25 bp, Mus musculus
gatggaccaagggccaagtgtggat

SEQ ID NO: 300071 - DNA, 25 bp, Mus musculus
gatggaccatgaagcaaagctgctg

SEQ ID NO: 300072 - DNA, 25 bp, Mus musculus
gatggacccaggtaaacagttgcca

SEQ ID NO: 300073 - DNA, 25 bp, Mus musculus
gatggacccaggttactccagtgag

SEQ ID NO: 300074 - DNA, 25 bp, Mus musculus
gatggaccccagatgcaccatgggc

SEQ ID NO: 300075 - DNA, 25 bp, Mus musculus
gatggacctgaagggcatgttcctg

SEQ ID NO: 300076 - DNA, 25 bp, Mus musculus
gatggaccttcccctgtctctgcac

SEQ ID NO: 300077 - DNA, 25 bp, Mus musculus
gatggacgagacaaactgccagaaa

SEQ ID NO: 300078 - DNA, 25 bp, Mus musculus
gatggacgagacaaagtgctgctgt

SEQ ID NO: 300079 - DNA, 25 bp, Mus musculus
gatggagaacaggatgaagaagaga

SEQ ID NO: 300080 - DNA, 25 bp, Mus musculus
gatggagaaggaaaaacacagccaa

SEQ ID NO: 300081 - DNA, 25 bp, Mus musculus
gatggagaatggtaccgcgcccggg

SEQ ID NO: 300082 - DNA, 25 bp, Mus musculus
gatggagacagagtggtgattagaa

SEQ ID NO: 300083 - DNA, 25 bp, Mus musculus
gatggagacccattgtgccccaatt

SEQ ID NO: 300084 - DNA, 25 bp, Mus musculus
gatggagacgagggctcttgtgtta

SEQ ID NO: 300085 - DNA, 25 bp, Mus musculus
gatggagagaagcaggaggatcatg

SEQ ID NO: 300086 - DNA, 25 bp, Mus musculus
gatggagagcagattgaaggtgctc

SEQ ID NO: 300087 - DNA, 25 bp, Mus musculus
gatggagaggatcgcccccaccccg

SEQ ID NO: 300088 - DNA, 25 bp, Mus musculus
gatggagatgagaagaagccgggcc

SEQ ID NO: 300089 - DNA, 25 bp, Mus musculus
gatggagatgcgctccctcctttaa

SEQ ID NO: 300090 - DNA, 25 bp, Mus musculus
gatggagatggggtcctaaaggaaa

SEQ ID NO: 300091 - DNA, 25 bp, Mus musculus
gatggagcaagtgatgacagactct

SEQ ID NO: 300092 - DNA, 25 bp, Mus musculus
gatggagccaaacatttctcgggat

SEQ ID NO: 300093 - DNA, 25 bp, Mus musculus
gatggagccaaagaatgaataaaat

SEQ ID NO: 300094 - DNA, 25 bp, Mus musculus
gatggagccagagaacctacaacaa

SEQ ID NO: 300095 - DNA, 25 bp, Mus musculus
gatggagccccacggatttcagttt

SEQ ID NO: 300096 - DNA, 25 bp, Mus musculus
gatggagctctatggccgagaacca

SEQ ID NO: 300097 - DNA, 25 bp, Mus musculus
gatggaggacaagagcaacagtacc

SEQ ID NO: 300098 - DNA, 25 bp, Mus musculus
gatggaggacaagattaggaatcag

SEQ ID NO: 300099 - DNA, 25 bp, Mus musculus
gatggaggagagggctctgctctga

SEQ ID NO: 300100 - DNA, 25 bp, Mus musculus
gatggaggagggaagagtctgagga

SEQ ID NO: 300101 - DNA, 25 bp, Mus musculus
gatggaggagtcttctatgagtgct

SEQ ID NO: 300102 - DNA, 25 bp, Mus musculus
gatggaggtagaaaatcttctggaa

SEQ ID NO: 300103 - DNA, 25 bp, Mus musculus
gatggagtcggctcttaaccggctc

SEQ ID NO: 300104 - DNA, 25 bp, Mus musculus
gatggagtctctggagcagcgtgcc

SEQ ID NO: 300105 - DNA, 25 bp, Mus musculus
gatggagtgaagtgcctcagagcgc

SEQ ID NO: 300106 - DNA, 25 bp, Mus musculus
gatggagtgtaactggcggcccctg

SEQ ID NO: 300107 - DNA, 25 bp, Mus musculus
gatggagtgtaagtggcggcccctg

SEQ ID NO: 300108 - DNA, 25 bp, Mus musculus
gatggagttggacattggtgcccag

SEQ ID NO: 300109 - DNA, 25 bp, Mus musculus
gatggatacagccttccagagattg

SEQ ID NO: 300110 - DNA, 25 bp, Mus musculus
gatggatatagacaacagaaagcct

SEQ ID NO: 300111 - DNA, 25 bp, Mus musculus
gatggatcagacagaaagtgtggag

SEQ ID NO: 300112 - DNA, 25 bp, Mus musculus
gatggatcataattgggtttcttct

SEQ ID NO: 300113 - DNA, 25 bp, Mus musculus
gatggatccctctatgctgtgggat

SEQ ID NO: 300114 - DNA, 25 bp, Mus musculus
gatggatgaggaagacatggggatg

SEQ ID NO: 300115 - DNA, 25 bp, Mus musculus
gatggatgattaaggactttctgag

SEQ ID NO: 300116 - DNA, 25 bp, Mus musculus
gatggatgctgccagctggacaggc

SEQ ID NO: 300117 - DNA, 25 bp, Mus musculus
gatggatggaaggggtgaccactga

SEQ ID NO: 300118 - DNA, 25 bp, Mus musculus
gatggatggagagaatgccacggtc

SEQ ID NO: 300119 - DNA, 25 bp, Mus musculus
gatggatggagaggttacagctgtg

SEQ ID NO: 300120 - DNA, 25 bp, Mus musculus
gatggattgtcgcgatagagtacaa

SEQ ID NO: 300121 - DNA, 25 bp, Mus musculus
gatggattgtgtgagagattggtgt

SEQ ID NO: 300122 - DNA, 25 bp, Mus musculus
gatggatttcaaatctaaagcggga

SEQ ID NO: 300123 - DNA, 25 bp, Mus musculus
gatggatttgacggagccacggccg

SEQ ID NO: 300124 - DNA, 25 bp, Mus musculus
gatggattttaagggtctcacacca

SEQ ID NO: 300125 - DNA, 25 bp, Mus musculus
gatggattttaaggtgagactgtgg

SEQ ID NO: 300126 - DNA, 25 bp, Mus musculus
gatggcaaaagtttcttctgggacc

SEQ ID NO: 300127 - DNA, 25 bp, Mus musculus
gatggcaaagcaacagaaaagtaac

SEQ ID NO: 300128 - DNA, 25 bp, Mus musculus
gatggcaaaggaagactccctgata

SEQ ID NO: 300129 - DNA, 25 bp, Mus musculus
gatggcaaattttggtgctggggac

SEQ ID NO: 300130 - DNA, 25 bp, Mus musculus
gatggcaaggagctttggaacctcc

SEQ ID NO: 300131 - DNA, 25 bp, Mus musculus
gatggcaatgccaggtggcccagag

SEQ ID NO: 300132 - DNA, 25 bp, Mus musculus
gatggcaatgccaggttgaacgaca

SEQ ID NO: 300133 - DNA, 25 bp, Mus musculus
gatggcacagaagatgctgacaaat

SEQ ID NO: 300134 - DNA, 25 bp, Mus musculus
gatggcacaggagctgatacaagtg

SEQ ID NO: 300135 - DNA, 25 bp, Mus musculus
gatggcactgattggtgctgtcaga

SEQ ID NO: 300136 - DNA, 25 bp, Mus musculus
gatggcactgcagctgctcctggca

SEQ ID NO: 300137 - DNA, 25 bp, Mus musculus
gatggcagagagtgcagcagctgcc

SEQ ID NO: 300138 - DNA, 25 bp, Mus musculus
gatggcagagctcgtcagtgtctac

SEQ ID NO: 300139 - DNA, 25 bp, Mus musculus
gatggcagagtgttcaacttctgta

SEQ ID NO: 300140 - DNA, 25 bp, Mus musculus
gatggcagtggagcaaataagaggg

SEQ ID NO: 300141 - DNA, 25 bp, Mus musculus
gatggcatcaagttcatgggcggtg

SEQ ID NO: 300142 - DNA, 25 bp, Mus musculus
gatggcatcacctttattgacagta

SEQ ID NO: 300143 - DNA, 25 bp, Mus musculus
gatggcatgtggctcctacccaggt

SEQ ID NO: 300144 - DNA, 25 bp, Mus musculus
gatggcatgtggctcgacatgaacg

SEQ ID NO: 300145 - DNA, 25 bp, Mus musculus
gatggcattgatggtgaccgaggtc

SEQ ID NO: 300146 - DNA, 25 bp, Mus musculus
gatggccaaaacaagagttcaagtc

SEQ ID NO: 300147 - DNA, 25 bp, Mus musculus
gatggccaagggcactcaacgcttc

SEQ ID NO: 300148 - DNA, 25 bp, Mus musculus
gatggccaagtcaagctgtgatagc

SEQ ID NO: 300149 - DNA, 25 bp, Mus musculus
gatggccaccagaagattcagaatg

SEQ ID NO: 300150 - DNA, 25 bp, Mus musculus
gatggccaggcctagccaggtgtag

SEQ ID NO: 300151 - DNA, 25 bp, Mus musculus
gatggccatggtcaagaaaaaaaat

SEQ ID NO: 300152 - DNA, 25 bp, Mus musculus
gatggcccaaagagggagcggaagc

SEQ ID NO: 300153 - DNA, 25 bp, Mus musculus
gatggcccaggtacttcaatttagc

SEQ ID NO: 300154 - DNA, 25 bp, Mus musculus
gatggcccccatggttcagcatggg

SEQ ID NO: 300155 - DNA, 25 bp, Mus musculus
gatggcccctgttggcatcctcaaa

SEQ ID NO: 300156 - DNA, 25 bp, Mus musculus
gatggccggggcgaggttctctcca

SEQ ID NO: 300157 - DNA, 25 bp, Mus musculus
gatggcctcacagatccgtgaagag

SEQ ID NO: 300158 - DNA, 25 bp, Mus musculus
gatggcctctgcaggtggcgacctg

SEQ ID NO: 300159 - DNA, 25 bp, Mus musculus
gatggcctgtctcagatgtcttcag

SEQ ID NO: 300160 - DNA, 25 bp, Mus musculus
gatggcctttaccagcctgccgaca

SEQ ID NO: 300161 - DNA, 25 bp, Mus musculus
gatggcctttaccaggacagccact

SEQ ID NO: 300162 - DNA, 25 bp, Mus musculus
gatggcctttaccagggtctcagca

SEQ ID NO: 300163 - DNA, 25 bp, Mus musculus
gatggcgacgatttccagagcagga

SEQ ID NO: 300164 - DNA, 25 bp, Mus musculus
gatggcgactgttgccctctatacc

SEQ ID NO: 300165 - DNA, 25 bp, Mus musculus
gatggcgaggaggatctgatggaca

SEQ ID NO: 300166 - DNA, 25 bp, Mus musculus
gatggcgagtggaaggtcctcatca

SEQ ID NO: 300167 - DNA, 25 bp, Mus musculus
gatggcgagtggaagtcgtggaaga

SEQ ID NO: 300168 - DNA, 25 bp, Mus musculus
gatggcgctggcgatggagacctgg

SEQ ID NO: 300169 - DNA, 25 bp, Mus musculus
gatggcggacagtttcctgtggcct

SEQ ID NO: 300170 - DNA, 25 bp, Mus musculus
gatggcggaggaggagttctccaac

SEQ ID NO: 300171 - DNA, 25 bp, Mus musculus
gatggcggccgaggtctgactgggc

SEQ ID NO: 300172 - DNA, 25 bp, Mus musculus
gatggcgggcaacagttcactgagg

SEQ ID NO: 300173 - DNA, 25 bp, Mus musculus
gatggcgggccggactatgcaagct

SEQ ID NO: 300174 - DNA, 25 bp, Mus musculus
gatggcgggccgggtttctgttgat

SEQ ID NO: 300175 - DNA, 25 bp, Mus musculus
gatggcggtgtcaagaaaaggaagt

SEQ ID NO: 300176 - DNA, 25 bp, Mus musculus
gatggcggtgtcaagccacagagca

SEQ ID NO: 300177 - DNA, 25 bp, Mus musculus
gatggcggtgtcaaggaaccacaaa

SEQ ID NO: 300178 - DNA, 25 bp, Mus musculus
gatggcgtgacctcctcttgcttct

SEQ ID NO: 300179 - DNA, 25 bp, Mus musculus
gatggctaagtgggccctgcattat

SEQ ID NO: 300180 - DNA, 25 bp, Mus musculus
gatggctacagggtttatttggtca

SEQ ID NO: 300181 - DNA, 25 bp, Mus musculus
gatggctacggaatgtcacttgcag

SEQ ID NO: 300182 - DNA, 25 bp, Mus musculus
gatggctacggccatctttttttgc

SEQ ID NO: 300183 - DNA, 25 bp, Mus musculus
gatggctatccagatattgctgttg

SEQ ID NO: 300184 - DNA, 25 bp, Mus musculus
gatggctattcggagaataatgttt

SEQ ID NO: 300185 - DNA, 25 bp, Mus musculus
gatggctcagtgggctccgtgaaga

SEQ ID NO: 300186 - DNA, 25 bp, Mus musculus
gatggctcatcagctggctctgtcc

SEQ ID NO: 300187 - DNA, 25 bp, Mus musculus
gatggctgacagatctcggcaaaag

SEQ ID NO: 300188 - DNA, 25 bp, Mus musculus
gatggctgacagcttggatctgtct

SEQ ID NO: 300189 - DNA, 25 bp, Mus musculus
gatggctgatgaggtataccaagac

SEQ ID NO: 300190 - DNA, 25 bp, Mus musculus
gatggctgggccctgtttttgggaa

SEQ ID NO: 300191 - DNA, 25 bp, Mus musculus
gatggctgtatttgaaaaaactggc

SEQ ID NO: 300192 - DNA, 25 bp, Mus musculus
gatggctgtatttggaatgggctgc

SEQ ID NO: 300193 - DNA, 25 bp, Mus musculus
gatggcttaacagaacaggagtgtg

SEQ ID NO: 300194 - DNA, 25 bp, Mus musculus
gatggcttagatgaaatcatcatgg

SEQ ID NO: 300195 - DNA, 25 bp, Mus musculus
gatggcttcacctgggagaagagag

SEQ ID NO: 300196 - DNA, 25 bp, Mus musculus
gatggcttctctctcggtggagaca

SEQ ID NO: 300197 - DNA, 25 bp, Mus musculus
gatggcttctctcttccacttgtag

SEQ ID NO: 300198 - DNA, 25 bp, Mus musculus
gatggcttgcagcggtcaagtcatg

SEQ ID NO: 300199 - DNA, 25 bp, Mus musculus
gatggcttgcaggggtcaagtcatg

SEQ ID NO: 300200 - DNA, 25 bp, Mus musculus
gatggctttagcaagagcatggtca

SEQ ID NO: 300201 - DNA, 25 bp, Mus musculus
gatggctttagcaaggcccgcggcc

SEQ ID NO: 300202 - DNA, 25 bp, Mus musculus
gatggcttttatgatcattttaagc

SEQ ID NO: 300203 - DNA, 25 bp, Mus musculus
gatgggaaaggtgactctggcacca

SEQ ID NO: 300204 - DNA, 25 bp, Mus musculus
gatgggaagaaaattgcagcctgga

SEQ ID NO: 300205 - DNA, 25 bp, Mus musculus
gatgggaagatggaccggcagatgt

SEQ ID NO: 300206 - DNA, 25 bp, Mus musculus
gatgggaagcaggtacccacccgga

SEQ ID NO: 300207 - DNA, 25 bp, Mus musculus
gatgggaaggaaaaagtgtgagcgc

SEQ ID NO: 300208 - DNA, 25 bp, Mus musculus
gatgggaagggaaaatgaacaagca

SEQ ID NO: 300209 - DNA, 25 bp, Mus musculus
gatgggaaggtggcagtgaacctgg

SEQ ID NO: 300210 - DNA, 25 bp, Mus musculus
gatgggacccaggctgccctgccct

SEQ ID NO: 300211 - DNA, 25 bp, Mus musculus
gatgggagaagagacaattgggaag

SEQ ID NO: 300212 - DNA, 25 bp, Mus musculus
gatgggagacaatcccagctggcta

SEQ ID NO: 300213 - DNA, 25 bp, Mus musculus
gatgggagaccgggtgacactggac

SEQ ID NO: 300214 - DNA, 25 bp, Mus musculus
gatgggagacctggaaccctacatg

SEQ ID NO: 300215 - DNA, 25 bp, Mus musculus
gatgggagacgatctggacgtggta

SEQ ID NO: 300216 - DNA, 25 bp, Mus musculus
gatgggagcacagaggggaaggccc

SEQ ID NO: 300217 - DNA, 25 bp, Mus musculus
gatgggagcacagtgtgcagcttgc

SEQ ID NO: 300218 - DNA, 25 bp, Mus musculus
gatgggagcagcatgggatcccgga

SEQ ID NO: 300219 - DNA, 25 bp, Mus musculus
gatgggagcctctttttcctgcaat

SEQ ID NO: 300220 - DNA, 25 bp, Mus musculus
gatgggagtgaggtgacttctgtga

SEQ ID NO: 300221 - DNA, 25 bp, Mus musculus
gatgggatccagagggctgactctg

SEQ ID NO: 300222 - DNA, 25 bp, Mus musculus
gatgggatccctgctttgtggaagg

SEQ ID NO: 300223 - DNA, 25 bp, Mus musculus
gatgggatgcctggattctgcacga

SEQ ID NO: 300224 - DNA, 25 bp, Mus musculus
gatgggattcagaagataattggag

SEQ ID NO: 300225 - DNA, 25 bp, Mus musculus
gatgggattgatgatgattctgatg

SEQ ID NO: 300226 - DNA, 25 bp, Mus musculus
gatgggcaaggctgggtgggtgaag

SEQ ID NO: 300227 - DNA, 25 bp, Mus musculus
gatgggcaagggtgaggaggggtac

SEQ ID NO: 300228 - DNA, 25 bp, Mus musculus
gatgggcaaggtatcaatctattca

SEQ ID NO: 300229 - DNA, 25 bp, Mus musculus
gatgggcagctgagattcctgctgc

SEQ ID NO: 300230 - DNA, 25 bp, Mus musculus
gatgggcagctgaggtgtgactttg

SEQ ID NO: 300231 - DNA, 25 bp, Mus musculus
gatgggcatgtgcgggtctatgaat

SEQ ID NO: 300232 - DNA, 25 bp, Mus musculus
gatgggccacgctctgtgcaccgag

SEQ ID NO: 300233 - DNA, 25 bp, Mus musculus
gatgggccacggaactcatcttcga

SEQ ID NO: 300234 - DNA, 25 bp, Mus musculus
gatgggcccacctcctggcatgcgg

SEQ ID NO: 300235 - DNA, 25 bp, Mus musculus
gatgggccgccagaattcagtagct

SEQ ID NO: 300236 - DNA, 25 bp, Mus musculus
gatgggcctgaggctcttcgcggca

SEQ ID NO: 300237 - DNA, 25 bp, Mus musculus
gatgggcggagatctgagtgcccgt

SEQ ID NO: 300238 - DNA, 25 bp, Mus musculus
gatgggctatgacagccagcccgct

SEQ ID NO: 300239 - DNA, 25 bp, Mus musculus
gatgggctccccaggagatggcctg

SEQ ID NO: 300240 - DNA, 25 bp, Mus musculus
gatgggctctgaagggtacaccatg

SEQ ID NO: 300241 - DNA, 25 bp, Mus musculus
gatgggctctgaagggtggaataag

SEQ ID NO: 300242 - DNA, 25 bp, Mus musculus
gatgggctgcagggacctcccgggt

SEQ ID NO: 300243 - DNA, 25 bp, Mus musculus
gatgggctttctcagggctctggcg

SEQ ID NO: 300244 - DNA, 25 bp, Mus musculus
gatggggacgaaagcatccacaaac

SEQ ID NO: 300245 - DNA, 25 bp, Mus musculus
gatggggagagttggagtttggagc

SEQ ID NO: 300246 - DNA, 25 bp, Mus musculus
gatggggagtaaagacctgttgtac

SEQ ID NO: 300247 - DNA, 25 bp, Mus musculus
gatggggagtaaagtggcagacctg

SEQ ID NO: 300248 - DNA, 25 bp, Mus musculus
gatgggggccatctcacccatggct

SEQ ID NO: 300249 - DNA, 25 bp, Mus musculus
gatggggtaaagataaacaacaaag

SEQ ID NO: 300250 - DNA, 25 bp, Mus musculus
gatggggtaaaggagtcaactgaga

SEQ ID NO: 300251 - DNA, 25 bp, Mus musculus
gatggggtcccaggaggagtgggag

SEQ ID NO: 300252 - DNA, 25 bp, Mus musculus
gatggggtcccagggatccgtttca

SEQ ID NO: 300253 - DNA, 25 bp, Mus musculus
gatgggtagtgatgtaagcggtaac

SEQ ID NO: 300254 - DNA, 25 bp, Mus musculus
gatgggtcatgcagccctcaggaag

SEQ ID NO: 300255 - DNA, 25 bp, Mus musculus
gatgggtcatggaactcatcttcga

SEQ ID NO: 300256 - DNA, 25 bp, Mus musculus
gatgggtcctggagtgaacccaaca

SEQ ID NO: 300257 - DNA, 25 bp, Mus musculus
gatgggtggaggcaaagacacttgt

SEQ ID NO: 300258 - DNA, 25 bp, Mus musculus
gatggtaaaaatactggctcgaata

SEQ ID NO: 300259 - DNA, 25 bp, Mus musculus
gatggtacctacccagcgtccccat

SEQ ID NO: 300260 - DNA, 25 bp, Mus musculus
gatggtagaaccagacgatggaggc

SEQ ID NO: 300261 - DNA, 25 bp, Mus musculus
gatggtagacggggtattgaagggc

SEQ ID NO: 300262 - DNA, 25 bp, Mus musculus
gatggtagccgctgccgtgacttac

SEQ ID NO: 300263 - DNA, 25 bp, Mus musculus
gatggtagccggaagctgtgctgaa

SEQ ID NO: 300264 - DNA, 25 bp, Mus musculus
gatggtcaaggttgttcctacatgt

SEQ ID NO: 300265 - DNA, 25 bp, Mus musculus
gatggtcaggtgtgacagacatcac

SEQ ID NO: 300266 - DNA, 25 bp, Mus musculus
gatggtccaaagggcaacccaggtc

SEQ ID NO: 300267 - DNA, 25 bp, Mus musculus
gatggtccaatttgtctagtgctgg

SEQ ID NO: 300268 - DNA, 25 bp, Mus musculus
gatggtcccaaaggtgcagctggcc

SEQ ID NO: 300269 - DNA, 25 bp, Mus musculus
gatggtccctctggtcttgatggtc

SEQ ID NO: 300270 - DNA, 25 bp, Mus musculus
gatggtcgaggacttgcactaagaa

SEQ ID NO: 300271 - DNA, 25 bp, Mus musculus
gatggtctccgacatcaacaatgga

SEQ ID NO: 300272 - DNA, 25 bp, Mus musculus
gatggtctggagcaagcccacaccg

SEQ ID NO: 300273 - DNA, 25 bp, Mus musculus
gatggtgaaccgggtgaccctggtg

SEQ ID NO: 300274 - DNA, 25 bp, Mus musculus
gatggtgaagatcccatacatcacc

SEQ ID NO: 300275 - DNA, 25 bp, Mus musculus
gatggtgaaggagacaaaattctac

SEQ ID NO: 300276 - DNA, 25 bp, Mus musculus
gatggtgaattgggatgatgaggaa

SEQ ID NO: 300277 - DNA, 25 bp, Mus musculus
gatggtgacggggatcgaaacatga

SEQ ID NO: 300278 - DNA, 25 bp, Mus musculus
gatggtgagaagggagaggctggtc

SEQ ID NO: 300279 - DNA, 25 bp, Mus musculus
gatggtgatggaaagctgagcccag

SEQ ID NO: 300280 - DNA, 25 bp, Mus musculus
gatggtgcacgcctctgcctcccga

SEQ ID NO: 300281 - DNA, 25 bp, Mus musculus
gatggtgcagattccatggagagtc

SEQ ID NO: 300282 - DNA, 25 bp, Mus musculus
gatggtgcaggacatgggggccgga

SEQ ID NO: 300283 - DNA, 25 bp, Mus musculus
gatggtgctcagggtacagcatgtt

SEQ ID NO: 300284 - DNA, 25 bp, Mus musculus
gatggtgctctgggtttcctgtggc

SEQ ID NO: 300285 - DNA, 25 bp, Mus musculus
gatggtgcttcggtacctgggccag

SEQ ID NO: 300286 - DNA, 25 bp, Mus musculus
gatggtggcaggtgactccagctcc

SEQ ID NO: 300287 - DNA, 25 bp, Mus musculus
gatggtggcaggtgggacctgacca

SEQ ID NO: 300288 - DNA, 25 bp, Mus musculus
gatggtggccacctgggtgcagtgt

SEQ ID NO: 300289 - DNA, 25 bp, Mus musculus
gatggtggccagggttttaatgtag

SEQ ID NO: 300290 - DNA, 25 bp, Mus musculus
gatggtggtaggcaggttgttcgta

SEQ ID NO: 300291 - DNA, 25 bp, Mus musculus
gatggtggtgagtgcctatgaagtc

SEQ ID NO: 300292 - DNA, 25 bp, Mus musculus
gatggtggtggacagggaatgtacg

SEQ ID NO: 300293 - DNA, 25 bp, Mus musculus
gatggtggtggacagtgcctatgaa

SEQ ID NO: 300294 - DNA, 25 bp, Mus musculus
gatggtgtagcacatttccttctgg

SEQ ID NO: 300295 - DNA, 25 bp, Mus musculus
gatggtgtgaagaaaagaaagtcca

SEQ ID NO: 300296 - DNA, 25 bp, Mus musculus
gatggtgtgaaggaatcttctgaga

SEQ ID NO: 300297 - DNA, 25 bp, Mus musculus
gatggtgtgactgagttggccgccc

SEQ ID NO: 300298 - DNA, 25 bp, Mus musculus
gatggttcaagtgggtgttccagtg

SEQ ID NO: 300299 - DNA, 25 bp, Mus musculus
gatggttcaagtgttcctgtccaca

SEQ ID NO: 300300 - DNA, 25 bp, Mus musculus
gatggttcctcagaaaatgaagtcc

SEQ ID NO: 300301 - DNA, 25 bp, Mus musculus
gatggttcctcagagccgagcaatg

SEQ ID NO: 300302 - DNA, 25 bp, Mus musculus
gatggttctaggctttgatgacagt

SEQ ID NO: 300303 - DNA, 25 bp, Mus musculus
gatggttgaaatagaattgatggaa

SEQ ID NO: 300304 - DNA, 25 bp, Mus musculus
gatggttgaaatagagggaccagtc

SEQ ID NO: 300305 - DNA, 25 bp, Mus musculus
gatggttttacggagtaagccatga

SEQ ID NO: 300306 - DNA, 25 bp, Mus musculus
gatgtaaccatagatcgcaagccat

SEQ ID NO: 300307 - DNA, 25 bp, Mus musculus
gatgtaaccataggcccgaggacgg

SEQ ID NO: 300308 - DNA, 25 bp, Mus musculus
gatgtaactgcttggacccttctga

SEQ ID NO: 300309 - DNA, 25 bp, Mus musculus
gatgtaagctgcagagaagctagaa

SEQ ID NO: 300310 - DNA, 25 bp, Mus musculus
gatgtaatggacgggcattttgttc

SEQ ID NO: 300311 - DNA, 25 bp, Mus musculus
gatgtacaaaacgcccattttcctg

SEQ ID NO: 300312 - DNA, 25 bp, Mus musculus
gatgtacaaataaaagtcttactcc

SEQ ID NO: 300313 - DNA, 25 bp, Mus musculus
gatgtacaagaaagggaagatgaag

SEQ ID NO: 300314 - DNA, 25 bp, Mus musculus
gatgtacagaaagagtatgaaaaga

SEQ ID NO: 300315 - DNA, 25 bp, Mus musculus
gatgtacagaagcagattaagcaca

SEQ ID NO: 300316 - DNA, 25 bp, Mus musculus
gatgtacagaagtttgcccggctct

SEQ ID NO: 300317 - DNA, 25 bp, Mus musculus
gatgtaccagaagactctaacagga

SEQ ID NO: 300318 - DNA, 25 bp, Mus musculus
gatgtaccaggaaacatccgagcct

SEQ ID NO: 300319 - DNA, 25 bp, Mus musculus
gatgtaccagggagtggctggatga

SEQ ID NO: 300320 - DNA, 25 bp, Mus musculus
gatgtaccaggtgatttcagactgg

SEQ ID NO: 300321 - DNA, 25 bp, Mus musculus
gatgtaccgactttcacgatatgtg

SEQ ID NO: 300322 - DNA, 25 bp, Mus musculus
gatgtacgaggaccatcccacacag

SEQ ID NO: 300323 - DNA, 25 bp, Mus musculus
gatgtacgagggaaggatcatcgaa

SEQ ID NO: 300324 - DNA, 25 bp, Mus musculus
gatgtactgaaggtctttgacgatg

SEQ ID NO: 300325 - DNA, 25 bp, Mus musculus
gatgtactggacaaacaaacaaaca

SEQ ID NO: 300326 - DNA, 25 bp, Mus musculus
gatgtacttcaggccacagacttcc

SEQ ID NO: 300327 - DNA, 25 bp, Mus musculus
gatgtagaaaagaagctcaataaag

SEQ ID NO: 300328 - DNA, 25 bp, Mus musculus
gatgtagaaacaaggtgctctgttg

SEQ ID NO: 300329 - DNA, 25 bp, Mus musculus
gatgtagaacctgccctctgaccgt

SEQ ID NO: 300330 - DNA, 25 bp, Mus musculus
gatgtagagaaggccatcgcccact

SEQ ID NO: 300331 - DNA, 25 bp, Mus musculus
gatgtagcaggcgccctggaggact

SEQ ID NO: 300332 - DNA, 25 bp, Mus musculus
gatgtagcaggcgcgcggtgacatt

SEQ ID NO: 300333 - DNA, 25 bp, Mus musculus
gatgtatacgacgacccgtctcgat

SEQ ID NO: 300334 - DNA, 25 bp, Mus musculus
gatgtatacgacgactcgtccgtct

SEQ ID NO: 300335 - DNA, 25 bp, Mus musculus
gatgtatacgacgatgttgagactg

SEQ ID NO: 300336 - DNA, 25 bp, Mus musculus
gatgtatatacaggaaaactcctcc

SEQ ID NO: 300337 - DNA, 25 bp, Mus musculus
gatgtatcagattcagctactagtg

SEQ ID NO: 300338 - DNA, 25 bp, Mus musculus
gatgtatcagggtaagacatacaac

SEQ ID NO: 300339 - DNA, 25 bp, Mus musculus
gatgtatccaggctcacccagactt

SEQ ID NO: 300340 - DNA, 25 bp, Mus musculus
gatgtatccaggtcacccagatctc

SEQ ID NO: 300341 - DNA, 25 bp, Mus musculus
gatgtatgaggcttcctgcgggcac

SEQ ID NO: 300342 - DNA, 25 bp, Mus musculus
gatgtattggctggatcccaagtct

SEQ ID NO: 300343 - DNA, 25 bp, Mus musculus
gatgtatttgtggggtaatcaggaa

SEQ ID NO: 300344 - DNA, 25 bp, Mus musculus
gatgtcaacagccgcctggtttacc

SEQ ID NO: 300345 - DNA, 25 bp, Mus musculus
gatgtcaacagccggtgataactcc

SEQ ID NO: 300346 - DNA, 25 bp, Mus musculus
gatgtcaaccgacccccaggctcaa

SEQ ID NO: 300347 - DNA, 25 bp, Mus musculus
gatgtcaatatgaagagtaaagatg

SEQ ID NO: 300348 - DNA, 25 bp, Mus musculus
gatgtcaatcacaacttgaaagatg

SEQ ID NO: 300349 - DNA, 25 bp, Mus musculus
gatgtcacaggttaaagaaactctt

SEQ ID NO: 300350 - DNA, 25 bp, Mus musculus
gatgtcacagtaccgtcacctccaa

SEQ ID NO: 300351 - DNA, 25 bp, Mus musculus
gatgtcacctcggctaaggatgggg

SEQ ID NO: 300352 - DNA, 25 bp, Mus musculus
gatgtcactccagagaaattcccaa

SEQ ID NO: 300353 - DNA, 25 bp, Mus musculus
gatgtcactccagaggccacaaaag

SEQ ID NO: 300354 - DNA, 25 bp, Mus musculus
gatgtcacttgtgactgaggctcca

SEQ ID NO: 300355 - DNA, 25 bp, Mus musculus
gatgtcagatattgttgttgttaca

SEQ ID NO: 300356 - DNA, 25 bp, Mus musculus
gatgtcaggccggaggctcctgtag

SEQ ID NO: 300357 - DNA, 25 bp, Mus musculus
gatgtcagggaggtataagtgctac

SEQ ID NO: 300358 - DNA, 25 bp, Mus musculus
gatgtcagtcaggggacgtggaaca

SEQ ID NO: 300359 - DNA, 25 bp, Mus musculus
gatgtcagttctgtgaacagatgtg

SEQ ID NO: 300360 - DNA, 25 bp, Mus musculus
gatgtcatccaggaggtggagtatg

SEQ ID NO: 300361 - DNA, 25 bp, Mus musculus
gatgtcatgcaagcatttgacatgc

SEQ ID NO: 300362 - DNA, 25 bp, Mus musculus
gatgtcatgcaaggttcaaagggat

SEQ ID NO: 300363 - DNA, 25 bp, Mus musculus
gatgtcatgcaagtttgtatgccgg

SEQ ID NO: 300364 - DNA, 25 bp, Mus musculus
gatgtcatgctgtgtgcaggagaga

SEQ ID NO: 300365 - DNA, 25 bp, Mus musculus
gatgtcatgttgtgtgcaggagaga

SEQ ID NO: 300366 - DNA, 25 bp, Mus musculus
gatgtcatttgaagctgaggaggat

SEQ ID NO: 300367 - DNA, 25 bp, Mus musculus
gatgtcatttgggaggactcagaag

SEQ ID NO: 300368 - DNA, 25 bp, Mus musculus
gatgtccaagcccccaccttctggc

SEQ ID NO: 300369 - DNA, 25 bp, Mus musculus
gatgtccaaggtcagagtacacctg

SEQ ID NO: 300370 - DNA, 25 bp, Mus musculus
gatgtccaagtacaaatatagagat

SEQ ID NO: 300371 - DNA, 25 bp, Mus musculus
gatgtccaagtttggcaatgaggag

SEQ ID NO: 300372 - DNA, 25 bp, Mus musculus
gatgtccaccatggtaggtgagctc

SEQ ID NO: 300373 - DNA, 25 bp, Mus musculus
gatgtccatgaggcctgtcccaggc

SEQ ID NO: 300374 - DNA, 25 bp, Mus musculus
gatgtcccagcaacattttgatggc

SEQ ID NO: 300375 - DNA, 25 bp, Mus musculus
gatgtccccaagaggtacttttctc

SEQ ID NO: 300376 - DNA, 25 bp, Mus musculus
gatgtccgagaggtcattgctagaa

SEQ ID NO: 300377 - DNA, 25 bp, Mus musculus
gatgtcctatatgaactgagaaaca

SEQ ID NO: 300378 - DNA, 25 bp, Mus musculus
gatgtcctcaacaaggacctgatgc

SEQ ID NO: 300379 - DNA, 25 bp, Mus musculus
gatgtcctcggtgactcagaagaag

SEQ ID NO: 300380 - DNA, 25 bp, Mus musculus
gatgtcctgcctgacctgcaggaag

SEQ ID NO: 300381 - DNA, 25 bp, Mus musculus
gatgtcctgggtcatggtagtatca

SEQ ID NO: 300382 - DNA, 25 bp, Mus musculus
gatgtcctgtggaggaaattgtgtc

SEQ ID NO: 300383 - DNA, 25 bp, Mus musculus
gatgtcgcagggacactgggttccc

SEQ ID NO: 300384 - DNA, 25 bp, Mus musculus
gatgtcgccagcgcccctccagcag

SEQ ID NO: 300385 - DNA, 25 bp, Mus musculus
gatgtcgttgaacggtcaccacacc

SEQ ID NO: 300386 - DNA, 25 bp, Mus musculus
gatgtctagaagctctaggaatgat

SEQ ID NO: 300387 - DNA, 25 bp, Mus musculus
gatgtctatttggagtgtctaaaac

SEQ ID NO: 300388 - DNA, 25 bp, Mus musculus
gatgtctcacaatgccatcaggttt

SEQ ID NO: 300389 - DNA, 25 bp, Mus musculus
gatgtctcacaatggagatcagaac

SEQ ID NO: 300390 - DNA, 25 bp, Mus musculus
gatgtctcagctggacaaaccatct

SEQ ID NO: 300391 - DNA, 25 bp, Mus musculus
gatgtctcagctgggtactctcaag

SEQ ID NO: 300392 - DNA, 25 bp, Mus musculus
gatgtctccagaacacttcagttat

SEQ ID NO: 300393 - DNA, 25 bp, Mus musculus
gatgtctctgcaccatcggtttgta

SEQ ID NO: 300394 - DNA, 25 bp, Mus musculus
gatgtctgacgaggtgttccacgac

SEQ ID NO: 300395 - DNA, 25 bp, Mus musculus
gatgtctgccctggatgacttgaaa

SEQ ID NO: 300396 - DNA, 25 bp, Mus musculus
gatgtctggaagccatgactgttcc

SEQ ID NO: 300397 - DNA, 25 bp, Mus musculus
gatgtctgtgagcagtctcgaatgg

SEQ ID NO: 300398 - DNA, 25 bp, Mus musculus
gatgtcttagatcagaaaagattcg

SEQ ID NO: 300399 - DNA, 25 bp, Mus musculus
gatgtcttagatcagaggcggcaga

SEQ ID NO: 300400 - DNA, 25 bp, Mus musculus
gatgtctttgcaaggtattgtcgcc

SEQ ID NO: 300401 - DNA, 25 bp, Mus musculus
gatgtgaaagatgcaggtgatgaaa

SEQ ID NO: 300402 - DNA, 25 bp, Mus musculus
gatgtgaaagcacaggtggacgtgc

SEQ ID NO: 300403 - DNA, 25 bp, Mus musculus
gatgtgaaaggtgatgaaagggaag

SEQ ID NO: 300404 - DNA, 25 bp, Mus musculus
gatgtgaacaagatgacggtcagcg

SEQ ID NO: 300405 - DNA, 25 bp, Mus musculus
gatgtgaatatcagacatgtacatg

SEQ ID NO: 300406 - DNA, 25 bp, Mus musculus
gatgtgaatatcaggacaatgggct

SEQ ID NO: 300407 - DNA, 25 bp, Mus musculus
gatgtgaccagatgcatattcctgg

SEQ ID NO: 300408 - DNA, 25 bp, Mus musculus
gatgtgaccagctcattgcctgagg

SEQ ID NO: 300409 - DNA, 25 bp, Mus musculus
gatgtgaccaggagatggctggcag

SEQ ID NO: 300410 - DNA, 25 bp, Mus musculus
gatgtgaccaggcctgaagggaaag

SEQ ID NO: 300411 - DNA, 25 bp, Mus musculus
gatgtgaccaggtggccttgaactc

SEQ ID NO: 300412 - DNA, 25 bp, Mus musculus
gatgtgaccatcaggtactgcaggg

SEQ ID NO: 300413 - DNA, 25 bp, Mus musculus
gatgtgacctctgccatgccatgat

SEQ ID NO: 300414 - DNA, 25 bp, Mus musculus
gatgtgagcaggaggcctctgaaga

SEQ ID NO: 300415 - DNA, 25 bp, Mus musculus
gatgtgagtggcgttatatgaatac

SEQ ID NO: 300416 - DNA, 25 bp, Mus musculus
gatgtgatgacaggaaattgtttac

SEQ ID NO: 300417 - DNA, 25 bp, Mus musculus
gatgtgatggaggatgtggtggagg

SEQ ID NO: 300418 - DNA, 25 bp, Mus musculus
gatgtgattctcaagctgggaagtc

SEQ ID NO: 300419 - DNA, 25 bp, Mus musculus
gatgtgcacaggacattgccctaaa

SEQ ID NO: 300420 - DNA, 25 bp, Mus musculus
gatgtgcacaggctacattgctggc

SEQ ID NO: 300421 - DNA, 25 bp, Mus musculus
gatgtgcacatgctggtagctgagc

SEQ ID NO: 300422 - DNA, 25 bp, Mus musculus
gatgtgcagaggtccctgctggaga

SEQ ID NO: 300423 - DNA, 25 bp, Mus musculus
gatgtgcagcgccgagtacaacagg

SEQ ID NO: 300424 - DNA, 25 bp, Mus musculus
gatgtgcagtattcccccacagcgc

SEQ ID NO: 300425 - DNA, 25 bp, Mus musculus
gatgtgccaagtaatgtatatttac

SEQ ID NO: 300426 - DNA, 25 bp, Mus musculus
gatgtgccagaacaagctgtttgag

SEQ ID NO: 300427 - DNA, 25 bp, Mus musculus
gatgtgccctcagccccccagcact

SEQ ID NO: 300428 - DNA, 25 bp, Mus musculus
gatgtgcgagattgtgaagggaagg

SEQ ID NO: 300429 - DNA, 25 bp, Mus musculus
gatgtgcgagggaaggttgtgaaga

SEQ ID NO: 300430 - DNA, 25 bp, Mus musculus
gatgtgctagaacagaaactgcagt

SEQ ID NO: 300431 - DNA, 25 bp, Mus musculus
gatgtgcttctgagaagaggccgaa

SEQ ID NO: 300432 - DNA, 25 bp, Mus musculus
gatgtgcttctgatgatgagagtaa

SEQ ID NO: 300433 - DNA, 25 bp, Mus musculus
gatgtggaaaggaaaatagaaattg

SEQ ID NO: 300434 - DNA, 25 bp, Mus musculus
gatgtggaagattttaattcctttt

SEQ ID NO: 300435 - DNA, 25 bp, Mus musculus
gatgtggacgcctctgcccatttca

SEQ ID NO: 300436 - DNA, 25 bp, Mus musculus
gatgtggacgcttctgccagactct

SEQ ID NO: 300437 - DNA, 25 bp, Mus musculus
gatgtggacggccgagctctgcttc

SEQ ID NO: 300438 - DNA, 25 bp, Mus musculus
gatgtggagactggcacccagctgg

SEQ ID NO: 300439 - DNA, 25 bp, Mus musculus
gatgtggagaggtggagaatctaaa

SEQ ID NO: 300440 - DNA, 25 bp, Mus musculus
gatgtggagatgacttggactgatg

SEQ ID NO: 300441 - DNA, 25 bp, Mus musculus
gatgtggagatggagtatacaatgg

SEQ ID NO: 300442 - DNA, 25 bp, Mus musculus
gatgtggagcggccaaccccaacaa

SEQ ID NO: 300443 - DNA, 25 bp, Mus musculus
gatgtggatgacagacacccctgca

SEQ ID NO: 300444 - DNA, 25 bp, Mus musculus
gatgtggatgacagagcagagcctg

SEQ ID NO: 300445 - DNA, 25 bp, Mus musculus
gatgtggatggcgagaaataccaga

SEQ ID NO: 300446 - DNA, 25 bp, Mus musculus
gatgtggatgggtgaacgagcgtca

SEQ ID NO: 300447 - DNA, 25 bp, Mus musculus
gatgtggatgggttgacgagcgtca

SEQ ID NO: 300448 - DNA, 25 bp, Mus musculus
gatgtggcagcacagatacctttat

SEQ ID NO: 300449 - DNA, 25 bp, Mus musculus
gatgtggcccaagataaagactgag

SEQ ID NO: 300450 - DNA, 25 bp, Mus musculus
gatgtggcccaaggacactcctcct

SEQ ID NO: 300451 - DNA, 25 bp, Mus musculus
gatgtggcctgcccagagtgacctc

SEQ ID NO: 300452 - DNA, 25 bp, Mus musculus
gatgtgggaacaggtgtcacagcac

SEQ ID NO: 300453 - DNA, 25 bp, Mus musculus
gatgtgggagaccactgggacacca

SEQ ID NO: 300454 - DNA, 25 bp, Mus musculus
gatgtgggaggtacgtgggagcaag

SEQ ID NO: 300455 - DNA, 25 bp, Mus musculus
gatgtgggccagctacctgggtgct

SEQ ID NO: 300456 - DNA, 25 bp, Mus musculus
gatgtgggtccaggctctggacctg

SEQ ID NO: 300457 - DNA, 25 bp, Mus musculus
gatgtgggttatgttcagggcatgt

SEQ ID NO: 300458 - DNA, 25 bp, Mus musculus
gatgtggtagagaaggcagaagaat

SEQ ID NO: 300459 - DNA, 25 bp, Mus musculus
gatgtggtcgagaaaagacaactga

SEQ ID NO: 300460 - DNA, 25 bp, Mus musculus
gatgtggtcgagttgcagtaatgtg

SEQ ID NO: 300461 - DNA, 25 bp, Mus musculus
gatgtggtgatggtacaccaggggt

SEQ ID NO: 300462 - DNA, 25 bp, Mus musculus
gatgtgtaaaatctgggggttacaa

SEQ ID NO: 300463 - DNA, 25 bp, Mus musculus
gatgtgtaaaatctgtgcactgagg

SEQ ID NO: 300464 - DNA, 25 bp, Mus musculus
gatgtgtaagcttatcacagttcag

SEQ ID NO: 300465 - DNA, 25 bp, Mus musculus
gatgtgtaccagatgacagaaggca

SEQ ID NO: 300466 - DNA, 25 bp, Mus musculus
gatgtgtaggggagctgtcccgacc

SEQ ID NO: 300467 - DNA, 25 bp, Mus musculus
gatgtgtatagcgagatctttgcaa

SEQ ID NO: 300468 - DNA, 25 bp, Mus musculus
gatgtgtctgagctgtccagctcgc

SEQ ID NO: 300469 - DNA, 25 bp, Mus musculus
gatgtgtgagccagagaagccatcc

SEQ ID NO: 300470 - DNA, 25 bp, Mus musculus
gatgtgtgagccaggtacattcttt

SEQ ID NO: 300471 - DNA, 25 bp, Mus musculus
gatgtgtgcctgtaatgaatggtat

SEQ ID NO: 300472 - DNA, 25 bp, Mus musculus
gatgtgttaatgatgttgcttttct

SEQ ID NO: 300473 - DNA, 25 bp, Mus musculus
gatgtgttcagaatgatgatgccaa

SEQ ID NO: 300474 - DNA, 25 bp, Mus musculus
gatgtgttcagtctgggtctcacca

SEQ ID NO: 300475 - DNA, 25 bp, Mus musculus
gatgtgtttggactcacacacgaga

SEQ ID NO: 300476 - DNA, 25 bp, Mus musculus
gatgtgtttggggaggcagatgcga

SEQ ID NO: 300477 - DNA, 25 bp, Mus musculus
gatgtgttttcagtggataatgaaa

SEQ ID NO: 300478 - DNA, 25 bp, Mus musculus
gatgttaaaatcaagatctctgctc

SEQ ID NO: 300479 - DNA, 25 bp, Mus musculus
gatgttaaagctgtctgctcccagg

SEQ ID NO: 300480 - DNA, 25 bp, Mus musculus
gatgttacggaggacccgagtcaga

SEQ ID NO: 300481 - DNA, 25 bp, Mus musculus
gatgttagaagatggctccgagcga

SEQ ID NO: 300482 - DNA, 25 bp, Mus musculus
gatgttatcaagaaaaagaataaac

SEQ ID NO: 300483 - DNA, 25 bp, Mus musculus
gatgttatccaggccctggacctca

SEQ ID NO: 300484 - DNA, 25 bp, Mus musculus
gatgttatccaggctccctgtccat

SEQ ID NO: 300485 - DNA, 25 bp, Mus musculus
gatgttatctcactatcctttgtga

SEQ ID NO: 300486 - DNA, 25 bp, Mus musculus
gatgttatggagggagtgaagccag

SEQ ID NO: 300487 - DNA, 25 bp, Mus musculus
gatgttcaaattggggaatggcggt

SEQ ID NO: 300488 - DNA, 25 bp, Mus musculus
gatgttcaagacgcaagtgggacgt

SEQ ID NO: 300489 - DNA, 25 bp, Mus musculus
gatgttcacaagagcgttataacct

SEQ ID NO: 300490 - DNA, 25 bp, Mus musculus
gatgttcacttcaggtattgacctc

SEQ ID NO: 300491 - DNA, 25 bp, Mus musculus
gatgttcacttcaggtgtggacctc

SEQ ID NO: 300492 - DNA, 25 bp, Mus musculus
gatgttcatgataggagacaaattc

SEQ ID NO: 300493 - DNA, 25 bp, Mus musculus
gatgttcatgggactttcagttacc

SEQ ID NO: 300494 - DNA, 25 bp, Mus musculus
gatgttccactcgctctttgccatt

SEQ ID NO: 300495 - DNA, 25 bp, Mus musculus
gatgttccactcggatcaagtttgt

SEQ ID NO: 300496 - DNA, 25 bp, Mus musculus
gatgttccagaagaagctggttagt

SEQ ID NO: 300497 - DNA, 25 bp, Mus musculus
gatgttccagaggaggtactacaag

SEQ ID NO: 300498 - DNA, 25 bp, Mus musculus
gatgttccaggagggagtatgattt

SEQ ID NO: 300499 - DNA, 25 bp, Mus musculus
gatgttcgacttcaggtctgtggcc

SEQ ID NO: 300500 - DNA, 25 bp, Mus musculus
gatgttctaacactgctgcgaccat

SEQ ID NO: 300501 - DNA, 25 bp, Mus musculus
gatgttctttatagacagacgcctg

SEQ ID NO: 300502 - DNA, 25 bp, Mus musculus
gatgttctttatagtgaggctatgg

SEQ ID NO: 300503 - DNA, 25 bp, Mus musculus
gatgttgaaagatgatgccacagag

SEQ ID NO: 300504 - DNA, 25 bp, Mus musculus
gatgttgaaatggaatacactatgg

SEQ ID NO: 300505 - DNA, 25 bp, Mus musculus
gatgttgaagctatggtaaaagttt

SEQ ID NO: 300506 - DNA, 25 bp, Mus musculus
gatgttgaggttctctgctgcccta

SEQ ID NO: 300507 - DNA, 25 bp, Mus musculus
gatgttgctgaggggcggcctgagc

SEQ ID NO: 300508 - DNA, 25 bp, Mus musculus
gatgttggcccagaggcagcttcca

SEQ ID NO: 300509 - DNA, 25 bp, Mus musculus
gatgttggcccagtgtcaccagact

SEQ ID NO: 300510 - DNA, 25 bp, Mus musculus
gatgttggctgaatgtttgttaact

SEQ ID NO: 300511 - DNA, 25 bp, Mus musculus
gatgttgggaatgtccggcggtttc

SEQ ID NO: 300512 - DNA, 25 bp, Mus musculus
gatgttgtccctgacaggtttggcc

SEQ ID NO: 300513 - DNA, 25 bp, Mus musculus
gatgttgtgaggctggtggaggagg

SEQ ID NO: 300514 - DNA, 25 bp, Mus musculus
gatgttgtgccacaggcttacagtg

SEQ ID NO: 300515 - DNA, 25 bp, Mus musculus
gatgttgtgccacaggtgtcttatg

SEQ ID NO: 300516 - DNA, 25 bp, Mus musculus
gatgttgttgctggagacaaccgga

SEQ ID NO: 300517 - DNA, 25 bp, Mus musculus
gatgttgtttttcatctagataaaa

SEQ ID NO: 300518 - DNA, 25 bp, Mus musculus
gatgtttaacagtattgcagaaacg

SEQ ID NO: 300519 - DNA, 25 bp, Mus musculus
gatgtttacaagtatgagaccagcg

SEQ ID NO: 300520 - DNA, 25 bp, Mus musculus
gatgtttccaagaaggtcacagaac

SEQ ID NO: 300521 - DNA, 25 bp, Mus musculus
gatgtttccaagtttggtgtgattt

SEQ ID NO: 300522 - DNA, 25 bp, Mus musculus
gatgtttccaggaaatgcccatgga

SEQ ID NO: 300523 - DNA, 25 bp, Mus musculus
gatgtttccaggagccctgacatac

SEQ ID NO: 300524 - DNA, 25 bp, Mus musculus
gatgtttccagggctgcacagagaa

SEQ ID NO: 300525 - DNA, 25 bp, Mus musculus
gatgtttcccagaatcatacgatga

SEQ ID NO: 300526 - DNA, 25 bp, Mus musculus
gatgtttcctgagatgtaaagaaag

SEQ ID NO: 300527 - DNA, 25 bp, Mus musculus
gatgtttcctgaggctactgaaaga

SEQ ID NO: 300528 - DNA, 25 bp, Mus musculus
gatgtttcctgtctagtgagtgcca

SEQ ID NO: 300529 - DNA, 25 bp, Mus musculus
gatgtttcctgtctggtgagtgtca

SEQ ID NO: 300530 - DNA, 25 bp, Mus musculus
gatgtttgccaaggggaacttcccc

SEQ ID NO: 300531 - DNA, 25 bp, Mus musculus
gatgtttgttggattcagtccttct

SEQ ID NO: 300532 - DNA, 25 bp, Mus musculus
gatgttttccaggaggtggtgtggt

SEQ ID NO: 300533 - DNA, 25 bp, Mus musculus
gatgttttcgaaggcagtataattc

SEQ ID NO: 300534 - DNA, 25 bp, Mus musculus
gatgttttcgaaggcatgcttgtag

SEQ ID NO: 300535 - DNA, 25 bp, Mus musculus
gatgttttctctgacagctgtcatc

SEQ ID NO: 300536 - DNA, 25 bp, Mus musculus
gatgttttgggtcgcagacactttg

SEQ ID NO: 300537 - DNA, 25 bp, Mus musculus
gattaaaaaggatcagttcttaaga

SEQ ID NO: 300538 - DNA, 25 bp, Mus musculus
gattaaaaagggccaaatccttgta

SEQ ID NO: 300539 - DNA, 25 bp, Mus musculus
gattaaaaagtgcctgcacccgctt

SEQ ID NO: 300540 - DNA, 25 bp, Mus musculus
gattaaacaagccgctgcgcctgtc

SEQ ID NO: 300541 - DNA, 25 bp, Mus musculus
gattaaacaaggctggagccagtta

SEQ ID NO: 300542 - DNA, 25 bp, Mus musculus
gattaaagacttaggaagaagacta

SEQ ID NO: 300543 - DNA, 25 bp, Mus musculus
gattaaagacttaggtgggtcggtg

SEQ ID NO: 300544 - DNA, 25 bp, Mus musculus
gattaaagcaaaaagtcaaagcttt

SEQ ID NO: 300545 - DNA, 25 bp, Mus musculus
gattaaagcccagattcagtttgct

SEQ ID NO: 300546 - DNA, 25 bp, Mus musculus
gattaaagtgaggaataagactgtc

SEQ ID NO: 300547 - DNA, 25 bp, Mus musculus
gattaaatgagaataaggctcaagg

SEQ ID NO: 300548 - DNA, 25 bp, Mus musculus
gattaaatttccaaggcccgagaat

SEQ ID NO: 300549 - DNA, 25 bp, Mus musculus
gattaacaagaagattgacctgaag

SEQ ID NO: 300550 - DNA, 25 bp, Mus musculus
gattaacaagaagatttacaagatt

SEQ ID NO: 300551 - DNA, 25 bp, Mus musculus
gattaacctggtgctggatttctag

SEQ ID NO: 300552 - DNA, 25 bp, Mus musculus
gattaagaaacaaacggctcttgct

SEQ ID NO: 300553 - DNA, 25 bp, Mus musculus
gattaagacataggtggcaggatcc

SEQ ID NO: 300554 - DNA, 25 bp, Mus musculus
gattaagtagaagaactatactatg

SEQ ID NO: 300555 - DNA, 25 bp, Mus musculus
gattaataaaaagacctcacagtgg

SEQ ID NO: 300556 - DNA, 25 bp, Mus musculus
gattaataaccagctggttgatcag

SEQ ID NO: 300557 - DNA, 25 bp, Mus musculus
gattaatcccttctcctgagctaca

SEQ ID NO: 300558 - DNA, 25 bp, Mus musculus
gattaatgacgctggtgaaatacag

SEQ ID NO: 300559 - DNA, 25 bp, Mus musculus
gattaatgctgtaggcaccagacct

SEQ ID NO: 300560 - DNA, 25 bp, Mus musculus
gattaatggcacagacgcagcctcc

SEQ ID NO: 300561 - DNA, 25 bp, Mus musculus
gattaattcaggagtgggaggtgct

SEQ ID NO: 300562 - DNA, 25 bp, Mus musculus
gattaatttgaagggtgattcagaa

SEQ ID NO: 300563 - DNA, 25 bp, Mus musculus
gattacaaactgagtagcactcagc

SEQ ID NO: 300564 - DNA, 25 bp, Mus musculus
gattacaagaccataccactctcct

SEQ ID NO: 300565 - DNA, 25 bp, Mus musculus
gattacaagaccatgtttatgtctg

SEQ ID NO: 300566 - DNA, 25 bp, Mus musculus
gattacaagactccactgcaaaatt

SEQ ID NO: 300567 - DNA, 25 bp, Mus musculus
gattacaatgcaagaaatcctacct

SEQ ID NO: 300568 - DNA, 25 bp, Mus musculus
gattacagagaattgtatttctttc

SEQ ID NO: 300569 - DNA, 25 bp, Mus musculus
gattacagaggctttggtataggat

SEQ ID NO: 300570 - DNA, 25 bp, Mus musculus
gattacagaggttgccatgaagtgt

SEQ ID NO: 300571 - DNA, 25 bp, Mus musculus
gattacatacttctacactccagaa

SEQ ID NO: 300572 - DNA, 25 bp, Mus musculus
gattacatagccaacaaggagagcc

SEQ ID NO: 300573 - DNA, 25 bp, Mus musculus
gattacataggttttactatatata

SEQ ID NO: 300574 - DNA, 25 bp, Mus musculus
gattacatagtgtatcccctactct

SEQ ID NO: 300575 - DNA, 25 bp, Mus musculus
gattaccacaaatactggatgtaaa

SEQ ID NO: 300576 - DNA, 25 bp, Mus musculus
gattaccatgtgctgcacaatcctg

SEQ ID NO: 300577 - DNA, 25 bp, Mus musculus
gattacccactcagaaaagcggcct

SEQ ID NO: 300578 - DNA, 25 bp, Mus musculus
gattacccccaagtgctgcaggagg

SEQ ID NO: 300579 - DNA, 25 bp, Mus musculus
gattaccgaaggcaaatggaaaaat

SEQ ID NO: 300580 - DNA, 25 bp, Mus musculus
gattacctggaaagagctgttatta

SEQ ID NO: 300581 - DNA, 25 bp, Mus musculus
gattacctggaaaggtggtggtggc

SEQ ID NO: 300582 - DNA, 25 bp, Mus musculus
gattaccttaccagttttacaggaa

SEQ ID NO: 300583 - DNA, 25 bp, Mus musculus
gattacgccaggtggtgccacagag

SEQ ID NO: 300584 - DNA, 25 bp, Mus musculus
gattacgcctttgagatggctgtct

SEQ ID NO: 300585 - DNA, 25 bp, Mus musculus
gattacgtgggacgagtccggctgc

SEQ ID NO: 300586 - DNA, 25 bp, Mus musculus
gattactaaggacaacatagaaaag

SEQ ID NO: 300587 - DNA, 25 bp, Mus musculus
gattactatcccgagaaagcctaca

SEQ ID NO: 300588 - DNA, 25 bp, Mus musculus
gattactatcccgaggcccgagtcc

SEQ ID NO: 300589 - DNA, 25 bp, Mus musculus
gattactctaaggccttcctcctgc

SEQ ID NO: 300590 - DNA, 25 bp, Mus musculus
gattactctgagagagtcagtcctt

SEQ ID NO: 300591 - DNA, 25 bp, Mus musculus
gattacttaaaaagagtgtgtaagc

SEQ ID NO: 300592 - DNA, 25 bp, Mus musculus
gattacttcataaatatccttttat

SEQ ID NO: 300593 - DNA, 25 bp, Mus musculus
gattacttctgtgtactgccttctg

SEQ ID NO: 300594 - DNA, 25 bp, Mus musculus
gattacttctgtgtagtagtttaca

SEQ ID NO: 300595 - DNA, 25 bp, Mus musculus
gattactttgaataccctggagcag

SEQ ID NO: 300596 - DNA, 25 bp, Mus musculus
gattactttgagcgtcgagcagaac

SEQ ID NO: 300597 - DNA, 25 bp, Mus musculus
gattactttgagtttgctgggggaa

SEQ ID NO: 300598 - DNA, 25 bp, Mus musculus
gattactttggccgttgtgcccgct

SEQ ID NO: 300599 - DNA, 25 bp, Mus musculus
gattagacctggttggctcaaaaac

SEQ ID NO: 300600 - DNA, 25 bp, Mus musculus
gattagagaggctgtgtcccattgt

SEQ ID NO: 300601 - DNA, 25 bp, Mus musculus
gattagcaccaggaatgtcactgtc

SEQ ID NO: 300602 - DNA, 25 bp, Mus musculus
gattagcagaagctcacgctcgcct

SEQ ID NO: 300603 - DNA, 25 bp, Mus musculus
gattagctctgccccaggcctcctc

SEQ ID NO: 300604 - DNA, 25 bp, Mus musculus
gattaggaggagagcaattatgaag

SEQ ID NO: 300605 - DNA, 25 bp, Mus musculus
gattaggccgcggaggtcacaggct

SEQ ID NO: 300606 - DNA, 25 bp, Mus musculus
gattaggctcccgagttctacacag

SEQ ID NO: 300607 - DNA, 25 bp, Mus musculus
gattagtggccaggtcctgctctct

SEQ ID NO: 300608 - DNA, 25 bp, Mus musculus
gattagttttaaggccgaagtcaat

SEQ ID NO: 300609 - DNA, 25 bp, Mus musculus
gattagttttaagtatggcgcccag

SEQ ID NO: 300610 - DNA, 25 bp, Mus musculus
gattataacttgcagattctgcttc

SEQ ID NO: 300611 - DNA, 25 bp, Mus musculus
gattataccggctgcagtacctcag

SEQ ID NO: 300612 - DNA, 25 bp, Mus musculus
gattataccggggcccagtcattta

SEQ ID NO: 300613 - DNA, 25 bp, Mus musculus
gattatactttaagaggctggattg

SEQ ID NO: 300614 - DNA, 25 bp, Mus musculus
gattatagaaaaggtcattttgagt

SEQ ID NO: 300615 - DNA, 25 bp, Mus musculus
gattatagatgcttatgtggatatg

SEQ ID NO: 300616 - DNA, 25 bp, Mus musculus
gattatagcaatcagcagagtggtt

SEQ ID NO: 300617 - DNA, 25 bp, Mus musculus
gattatagcagtgatcccgcttcga

SEQ ID NO: 300618 - DNA, 25 bp, Mus musculus
gattatcactcagataacccttcct

SEQ ID NO: 300619 - DNA, 25 bp, Mus musculus
gattatcactcaggcccaggcctgg

SEQ ID NO: 300620 - DNA, 25 bp, Mus musculus
gattatcactgcgagatgagctttg

SEQ ID NO: 300621 - DNA, 25 bp, Mus musculus
gattatcactgcgagctgcttgaca

SEQ ID NO: 300622 - DNA, 25 bp, Mus musculus
gattatccagagacagcccaaaact

SEQ ID NO: 300623 - DNA, 25 bp, Mus musculus
gattatccagaggagacagcactct

SEQ ID NO: 300624 - DNA, 25 bp, Mus musculus
gattatccagagtcctattgtcgat

SEQ ID NO: 300625 - DNA, 25 bp, Mus musculus
gattatccagagtggagctgtaata

SEQ ID NO: 300626 - DNA, 25 bp, Mus musculus
gattatccagggaaaggaagatgat

SEQ ID NO: 300627 - DNA, 25 bp, Mus musculus
gattatcgggctcagcgttgttcag

SEQ ID NO: 300628 - DNA, 25 bp, Mus musculus
gattatcggggaagcgtttctctct

SEQ ID NO: 300629 - DNA, 25 bp, Mus musculus
gattatctgaagagcccagagcgtt

SEQ ID NO: 300630 - DNA, 25 bp, Mus musculus
gattatctgaaggcctgggagctgc

SEQ ID NO: 300631 - DNA, 25 bp, Mus musculus
gattatctttataggctgaaggcgg

SEQ ID NO: 300632 - DNA, 25 bp, Mus musculus
gattatgccctgcaggtcaatgtga

SEQ ID NO: 300633 - DNA, 25 bp, Mus musculus
gattattatgctttctcccagatgg

SEQ ID NO: 300634 - DNA, 25 bp, Mus musculus
gattattcagaagcagaacagagtg

SEQ ID NO: 300635 - DNA, 25 bp, Mus musculus
gattattccagtacttccaggtggc

SEQ ID NO: 300636 - DNA, 25 bp, Mus musculus
gattattggagccccagaacgagga

SEQ ID NO: 300637 - DNA, 25 bp, Mus musculus
gattatttagcacaggtgatgaaca

SEQ ID NO: 300638 - DNA, 25 bp, Mus musculus
gattattttcaataatggacgctgt

SEQ ID NO: 300639 - DNA, 25 bp, Mus musculus
gattatttttaagaggcaagaaaca

SEQ ID NO: 300640 - DNA, 25 bp, Mus musculus
gattcaaaaggataaaccagaaacc

SEQ ID NO: 300641 - DNA, 25 bp, Mus musculus
gattcaaaaggatggccaggctttt

SEQ ID NO: 300642 - DNA, 25 bp, Mus musculus
gattcaacagatgtctttcaacaac

SEQ ID NO: 300643 - DNA, 25 bp, Mus musculus
gattcaacaggcaatcgagattatg

SEQ ID NO: 300644 - DNA, 25 bp, Mus musculus
gattcaaccacaatgacggattcca

SEQ ID NO: 300645 - DNA, 25 bp, Mus musculus
gattcaagagaaaagaaccaagaaa

SEQ ID NO: 300646 - DNA, 25 bp, Mus musculus
gattcaaggaggcttggcaaattgt

SEQ ID NO: 300647 - DNA, 25 bp, Mus musculus
gattcaattttgaaatgtgctgctc

SEQ ID NO: 300648 - DNA, 25 bp, Mus musculus
gattcacacagattctggaacaaga

SEQ ID NO: 300649 - DNA, 25 bp, Mus musculus
gattcacatcgagaaagcctttgag

SEQ ID NO: 300650 - DNA, 25 bp, Mus musculus
gattcacatcgagctggagtacctc

SEQ ID NO: 300651 - DNA, 25 bp, Mus musculus
gattcaccgtatggctccatggtgt

SEQ ID NO: 300652 - DNA, 25 bp, Mus musculus
gattcactgaaaggtcgttgctcca

SEQ ID NO: 300653 - DNA, 25 bp, Mus musculus
gattcactgagctcctgcaaaaaag

SEQ ID NO: 300654 - DNA, 25 bp, Mus musculus
gattcacttgctgtaagaactaaaa

SEQ ID NO: 300655 - DNA, 25 bp, Mus musculus
gattcacttggcttgttacatgagc

SEQ ID NO: 300656 - DNA, 25 bp, Mus musculus
gattcagaaactgtacggacatggc

SEQ ID NO: 300657 - DNA, 25 bp, Mus musculus
gattcagaaagattccaggttgact

SEQ ID NO: 300658 - DNA, 25 bp, Mus musculus
gattcagaagaataccacaaccgct

SEQ ID NO: 300659 - DNA, 25 bp, Mus musculus
gattcagaagatgatttttggtgac

SEQ ID NO: 300660 - DNA, 25 bp, Mus musculus
gattcagaaggacattaacgagctg

SEQ ID NO: 300661 - DNA, 25 bp, Mus musculus
gattcagacccgattagtggagtac

SEQ ID NO: 300662 - DNA, 25 bp, Mus musculus
gattcagagccaggttgtaaaagtt

SEQ ID NO: 300663 - DNA, 25 bp, Mus musculus
gattcagagtttgaactctcttgct

SEQ ID NO: 300664 - DNA, 25 bp, Mus musculus
gattcagagtttgaatctgtcgggg

SEQ ID NO: 300665 - DNA, 25 bp, Mus musculus
gattcagatgtaccctcctgaaaag

SEQ ID NO: 300666 - DNA, 25 bp, Mus musculus
gattcagcagcaggtccaggggcag

SEQ ID NO: 300667 - DNA, 25 bp, Mus musculus
gattcagcatttaagcaaaactggc

SEQ ID NO: 300668 - DNA, 25 bp, Mus musculus
gattcagctcaaggctgtcaagtcc

SEQ ID NO: 300669 - DNA, 25 bp, Mus musculus
gattcagctcccaggttgaagaaat

SEQ ID NO: 300670 - DNA, 25 bp, Mus musculus
gattcaggaatggagactttggaga

SEQ ID NO: 300671 - DNA, 25 bp, Mus musculus
gattcaggagctgctactcaggtgc

SEQ ID NO: 300672 - DNA, 25 bp, Mus musculus
gattcaggctcggtcttttccgggc

SEQ ID NO: 300673 - DNA, 25 bp, Mus musculus
gattcaggctggaaaggagctggag

SEQ ID NO: 300674 - DNA, 25 bp, Mus musculus
gattcaggcttccagttcacgtgga

SEQ ID NO: 300675 - DNA, 25 bp, Mus musculus
gattcagtgcttttaatcagcttaa

SEQ ID NO: 300676 - DNA, 25 bp, Mus musculus
gattcagtggggctccacctgttcc

SEQ ID NO: 300677 - DNA, 25 bp, Mus musculus
gattcagtgggggagtttgtgacat

SEQ ID NO: 300678 - DNA, 25 bp, Mus musculus
gattcagtgggggatttccaatttc

SEQ ID NO: 300679 - DNA, 25 bp, Mus musculus
gattcagtttctttagaatgtgata

SEQ ID NO: 300680 - DNA, 25 bp, Mus musculus
gattcatcacagagccggctgatct

SEQ ID NO: 300681 - DNA, 25 bp, Mus musculus
gattcatcagaacaggagtaagcat

SEQ ID NO: 300682 - DNA, 25 bp, Mus musculus
gattcatcagacacctgctgtccat

SEQ ID NO: 300683 - DNA, 25 bp, Mus musculus
gattcatctaaatggtgccatgaca

SEQ ID NO: 300684 - DNA, 25 bp, Mus musculus
gattcatctagaggttttacagaca

SEQ ID NO: 300685 - DNA, 25 bp, Mus musculus
gattcatctagagtacaaaacagga

SEQ ID NO: 300686 - DNA, 25 bp, Mus musculus
gattcatgaaagtcctgaagtgtga

SEQ ID NO: 300687 - DNA, 25 bp, Mus musculus
gattcatgaagaaggctggatacca

SEQ ID NO: 300688 - DNA, 25 bp, Mus musculus
gattcatgactcaggcccacaatgt

SEQ ID NO: 300689 - DNA, 25 bp, Mus musculus
gattcatgagccatcaaagagagga

SEQ ID NO: 300690 - DNA, 25 bp, Mus musculus
gattcatggtactgctgtattttca

SEQ ID NO: 300691 - DNA, 25 bp, Mus musculus
gattcatgtccaaagggctcccaga

SEQ ID NO: 300692 - DNA, 25 bp, Mus musculus
gattccaaaatgccattctagttcg

SEQ ID NO: 300693 - DNA, 25 bp, Mus musculus
gattccaactaaaaataggaaatct

SEQ ID NO: 300694 - DNA, 25 bp, Mus musculus
gattccaactaagagttggccatgg

SEQ ID NO: 300695 - DNA, 25 bp, Mus musculus
gattccaagcctgaggactgggaca

SEQ ID NO: 300696 - DNA, 25 bp, Mus musculus
gattccaagcctgaggactgggatg

SEQ ID NO: 300697 - DNA, 25 bp, Mus musculus
gattccaagctaccacagtgaactg

SEQ ID NO: 300698 - DNA, 25 bp, Mus musculus
gattccaagctcctactactcaggg

SEQ ID NO: 300699 - DNA, 25 bp, Mus musculus
gattccaaggagattgccctctatg

SEQ ID NO: 300700 - DNA, 25 bp, Mus musculus
gattccaaggagccagaaatcatag

SEQ ID NO: 300701 - DNA, 25 bp, Mus musculus
gattccacaggcaatccagatcatg

SEQ ID NO: 300702 - DNA, 25 bp, Mus musculus
gattccaccagcaggttcagcagct

SEQ ID NO: 300703 - DNA, 25 bp, Mus musculus
gattccaccagtggacagaggggac

SEQ ID NO: 300704 - DNA, 25 bp, Mus musculus
gattccacgtgcgtgcttcttgcca

SEQ ID NO: 300705 - DNA, 25 bp, Mus musculus
gattccactagggctattctcctga

SEQ ID NO: 300706 - DNA, 25 bp, Mus musculus
gattccagaacttgccatcaatgcc

SEQ ID NO: 300707 - DNA, 25 bp, Mus musculus
gattccagaaggagaaaaaaaagca

SEQ ID NO: 300708 - DNA, 25 bp, Mus musculus
gattccagagtgtgtgggtttcaac

SEQ ID NO: 300709 - DNA, 25 bp, Mus musculus
gattccagcagtcaggctgggacaa

SEQ ID NO: 300710 - DNA, 25 bp, Mus musculus
gattccagccagaccagcggagtcg

SEQ ID NO: 300711 - DNA, 25 bp, Mus musculus
gattccagcgtctcaaagggtaaaa

SEQ ID NO: 300712 - DNA, 25 bp, Mus musculus
gattccagcgtttcatgaaccatcg

SEQ ID NO: 300713 - DNA, 25 bp, Mus musculus
gattccaggtcagtgcttcgcaaga

SEQ ID NO: 300714 - DNA, 25 bp, Mus musculus
gattccagtgtgacctgctgtctac

SEQ ID NO: 300715 - DNA, 25 bp, Mus musculus
gattccagtgtgtgtttcctggctg

SEQ ID NO: 300716 - DNA, 25 bp, Mus musculus
gattccattctttgtggtcgctaca

SEQ ID NO: 300717 - DNA, 25 bp, Mus musculus
gattccattcttttgttggggatgg

SEQ ID NO: 300718 - DNA, 25 bp, Mus musculus
gattccccgctgtcctacagtctgc

SEQ ID NO: 300719 - DNA, 25 bp, Mus musculus
gattcccctggatcattcggacaaa

SEQ ID NO: 300720 - DNA, 25 bp, Mus musculus
gattccgaagcacctttggggaact

SEQ ID NO: 300721 - DNA, 25 bp, Mus musculus
gattccgatttgggacgaggaccta

SEQ ID NO: 300722 - DNA, 25 bp, Mus musculus
gattcctacccatgttcctgaatgt

SEQ ID NO: 300723 - DNA, 25 bp, Mus musculus
gattcctaggaagaggatgtacatg

SEQ ID NO: 300724 - DNA, 25 bp, Mus musculus
gattcctcacaggaaagcaaagatt

SEQ ID NO: 300725 - DNA, 25 bp, Mus musculus
gattcctcagacaggcttccataca

SEQ ID NO: 300726 - DNA, 25 bp, Mus musculus
gattcctcagacagtgaaaacaaag

SEQ ID NO: 300727 - DNA, 25 bp, Mus musculus
gattcctcagggcatcgtgaagctg

SEQ ID NO: 300728 - DNA, 25 bp, Mus musculus
gattcctcagttccaccagaggagc

SEQ ID NO: 300729 - DNA, 25 bp, Mus musculus
gattcctcccagatgatgggcgtcg

SEQ ID NO: 300730 - DNA, 25 bp, Mus musculus
gattcctctgaggatgacaaggagt

SEQ ID NO: 300731 - DNA, 25 bp, Mus musculus
gattcctctggaaagccccggcagc

SEQ ID NO: 300732 - DNA, 25 bp, Mus musculus
gattcctgagatgaccacagggccc

SEQ ID NO: 300733 - DNA, 25 bp, Mus musculus
gattcctgaggaacagcgcatcgcc

SEQ ID NO: 300734 - DNA, 25 bp, Mus musculus
gattcctgccagggtgactctgatg

SEQ ID NO: 300735 - DNA, 25 bp, Mus musculus
gattcctgccagggtgactctggtg

SEQ ID NO: 300736 - DNA, 25 bp, Mus musculus
gattcctgccaggtgactctggtgg

SEQ ID NO: 300737 - DNA, 25 bp, Mus musculus
gattcctggtataactatggtatcg

SEQ ID NO: 300738 - DNA, 25 bp, Mus musculus
gattcctgtgcaatgaccggggtcg

SEQ ID NO: 300739 - DNA, 25 bp, Mus musculus
gattccttaactcatgcagatgtca

SEQ ID NO: 300740 - DNA, 25 bp, Mus musculus
gattccttaactgcaacaagttttt

SEQ ID NO: 300741 - DNA, 25 bp, Mus musculus
gattccttacagtgtcctagatgat

SEQ ID NO: 300742 - DNA, 25 bp, Mus musculus
gattccttgtccagattatgaagta

SEQ ID NO: 300743 - DNA, 25 bp, Mus musculus
gattccttgtccagtggttttaggt

SEQ ID NO: 300744 - DNA, 25 bp, Mus musculus
gattcgagaggttccgtgaggagga

SEQ ID NO: 300745 - DNA, 25 bp, Mus musculus
gattcgagcacatgtaatagcgctc

SEQ ID NO: 300746 - DNA, 25 bp, Mus musculus
gattcgagcacatgtttaggtaata

SEQ ID NO: 300747 - DNA, 25 bp, Mus musculus
gattcgagcgacttcggagcacaat

SEQ ID NO: 300748 - DNA, 25 bp, Mus musculus
gattcgagcggggttccttgtggag

SEQ ID NO: 300749 - DNA, 25 bp, Mus musculus
gattcgcccagagtttgggaaatgg

SEQ ID NO: 300750 - DNA, 25 bp, Mus musculus
gattcgctccggtgtaatggatagg

SEQ ID NO: 300751 - DNA, 25 bp, Mus musculus
gattcggctgctgaactaagaactg

SEQ ID NO: 300752 - DNA, 25 bp, Mus musculus
gattcgtcccctcaggatcgccacg

SEQ ID NO: 300753 - DNA, 25 bp, Mus musculus
gattcgttaagagaggagaactttg

SEQ ID NO: 300754 - DNA, 25 bp, Mus musculus
gattctaaaaggaatattattggcg

SEQ ID NO: 300755 - DNA, 25 bp, Mus musculus
gattctaaactaggtcatgtggtaa

SEQ ID NO: 300756 - DNA, 25 bp, Mus musculus
gattctaagactcaggtaacagttc

SEQ ID NO: 300757 - DNA, 25 bp, Mus musculus
gattctaagcagaagcaccgagtgg

SEQ ID NO: 300758 - DNA, 25 bp, Mus musculus
gattctacaaagctgggcatggaag

SEQ ID NO: 300759 - DNA, 25 bp, Mus musculus
gattctacaagcaagacccaagagt

SEQ ID NO: 300760 - DNA, 25 bp, Mus musculus
gattctacaagcaaggagttacacc

SEQ ID NO: 300761 - DNA, 25 bp, Mus musculus
gattctacgatgagtgtaaacgaag

SEQ ID NO: 300762 - DNA, 25 bp, Mus musculus
gattctactcagcttcagaggatga

SEQ ID NO: 300763 - DNA, 25 bp, Mus musculus
gattctactgaggtgtaaactcttc

SEQ ID NO: 300764 - DNA, 25 bp, Mus musculus
gattctataggagctgagacccttc

SEQ ID NO: 300765 - DNA, 25 bp, Mus musculus
gattctatctcaaagcaagccccgc

SEQ ID NO: 300766 - DNA, 25 bp, Mus musculus
gattctatgctaggtattctctgaa

SEQ ID NO: 300767 - DNA, 25 bp, Mus musculus
gattctcaagctgggaagtcatcaa

SEQ ID NO: 300768 - DNA, 25 bp, Mus musculus
gattctcagagttctgaacttcagc

SEQ ID NO: 300769 - DNA, 25 bp, Mus musculus
gattctcagttcagcgtcgccaaca

SEQ ID NO: 300770 - DNA, 25 bp, Mus musculus
gattctcagttttcgcatcaaggtg

SEQ ID NO: 300771 - DNA, 25 bp, Mus musculus
gattctcatcgcttttatgaaacag

SEQ ID NO: 300772 - DNA, 25 bp, Mus musculus
gattctccacagtcactggagagtc

SEQ ID NO: 300773 - DNA, 25 bp, Mus musculus
gattctccacagtcgctggagagtc

SEQ ID NO: 300774 - DNA, 25 bp, Mus musculus
gattctccatggagcttggagctgc

SEQ ID NO: 300775 - DNA, 25 bp, Mus musculus
gattctccatggaggcaagatgaat

SEQ ID NO: 300776 - DNA, 25 bp, Mus musculus
gattctccgcggaggaccctaggaa

SEQ ID NO: 300777 - DNA, 25 bp, Mus musculus
gattctccgcggaggtattacttgg

SEQ ID NO: 300778 - DNA, 25 bp, Mus musculus
gattctcgacatagatatcccaatg

SEQ ID NO: 300779 - DNA, 25 bp, Mus musculus
gattctcgacataggtgcactgcat

SEQ ID NO: 300780 - DNA, 25 bp, Mus musculus
gattctcgaggctaaaaagaaaaag

SEQ ID NO: 300781 - DNA, 25 bp, Mus musculus
gattctcgggaggatccgagcgtgc

SEQ ID NO: 300782 - DNA, 25 bp, Mus musculus
gattctcgggaggtggctgtctgcc

SEQ ID NO: 300783 - DNA, 25 bp, Mus musculus
gattctcttgccattcattgacagc

SEQ ID NO: 300784 - DNA, 25 bp, Mus musculus
gattctcttggattgttcatcacct

SEQ ID NO: 300785 - DNA, 25 bp, Mus musculus
gattctgacatcctgcagagcctat

SEQ ID NO: 300786 - DNA, 25 bp, Mus musculus
gattctgacattgatggcgaggctg

SEQ ID NO: 300787 - DNA, 25 bp, Mus musculus
gattctgacccatgcttctctgctc

SEQ ID NO: 300788 - DNA, 25 bp, Mus musculus
gattctgatcaacaggtctccattt

SEQ ID NO: 300789 - DNA, 25 bp, Mus musculus
gattctgattgtggaagcttacccc

SEQ ID NO: 300790 - DNA, 25 bp, Mus musculus
gattctgcatggctgatccttcctt

SEQ ID NO: 300791 - DNA, 25 bp, Mus musculus
gattctgcctttgggctgtaccttg

SEQ ID NO: 300792 - DNA, 25 bp, Mus musculus
gattctgctgagcatttgctagctg

SEQ ID NO: 300793 - DNA, 25 bp, Mus musculus
gattctgctggtgtgggacttgacg

SEQ ID NO: 300794 - DNA, 25 bp, Mus musculus
gattctgcttatggcgtgcgcaggg

SEQ ID NO: 300795 - DNA, 25 bp, Mus musculus
gattctgcttatgtgcttctgggtc

SEQ ID NO: 300796 - DNA, 25 bp, Mus musculus
gattctggaaaacagatttattctt

SEQ ID NO: 300797 - DNA, 25 bp, Mus musculus
gattctggaagccaactgggtggtg

SEQ ID NO: 300798 - DNA, 25 bp, Mus musculus
gattctggaagccaagaaagccctc

SEQ ID NO: 300799 - DNA, 25 bp, Mus musculus
gattctgggaggctccccagcacag

SEQ ID NO: 300800 - DNA, 25 bp, Mus musculus
gattctggtggctttgatgaactag

SEQ ID NO: 300801 - DNA, 25 bp, Mus musculus
gattctggtggtggacttctcaaac

SEQ ID NO: 300802 - DNA, 25 bp, Mus musculus
gattctgtggaactagtcttgcaaa

SEQ ID NO: 300803 - DNA, 25 bp, Mus musculus
gattcttaagagaatacggacgggc

SEQ ID NO: 300804 - DNA, 25 bp, Mus musculus
gattcttaagagcatggataagaat

SEQ ID NO: 300805 - DNA, 25 bp, Mus musculus
gattcttagaagggctggaaaaagg

SEQ ID NO: 300806 - DNA, 25 bp, Mus musculus
gattcttagcaagggtctgtcaccg

SEQ ID NO: 300807 - DNA, 25 bp, Mus musculus
gattcttcagcacaggggatgaaca

SEQ ID NO: 300808 - DNA, 25 bp, Mus musculus
gattcttcaggaacaagatcctggt

SEQ ID NO: 300809 - DNA, 25 bp, Mus musculus
gattcttcaggtctatggaaatgca

SEQ ID NO: 300810 - DNA, 25 bp, Mus musculus
gattcttccttgaaatttgccttgc

SEQ ID NO: 300811 - DNA, 25 bp, Mus musculus
gattcttctcaatgtaaatttaaca

SEQ ID NO: 300812 - DNA, 25 bp, Mus musculus
gattcttgaatgcaccttatagcca

SEQ ID NO: 300813 - DNA, 25 bp, Mus musculus
gattctttgaagatgttccctcagc

SEQ ID NO: 300814 - DNA, 25 bp, Mus musculus
gattctttgggaatgccctctacgc

SEQ ID NO: 300815 - DNA, 25 bp, Mus musculus
gattctttgtagccggggacgatcc

SEQ ID NO: 300816 - DNA, 25 bp, Mus musculus
gattcttttgtcaaggactgtgaat

SEQ ID NO: 300817 - DNA, 25 bp, Mus musculus
gattcttttgtcaaggatggtgagg

SEQ ID NO: 300818 - DNA, 25 bp, Mus musculus
gattgaaaagcttactaagcacctt

SEQ ID NO: 300819 - DNA, 25 bp, Mus musculus
gattgaaagctacgggaaagaaagc

SEQ ID NO: 300820 - DNA, 25 bp, Mus musculus
gattgaaagctgaaaggaagttctt

SEQ ID NO: 300821 - DNA, 25 bp, Mus musculus
gattgaacaaagaccggcaactatc

SEQ ID NO: 300822 - DNA, 25 bp, Mus musculus
gattgaactcatcaagatgtttgac

SEQ ID NO: 300823 - DNA, 25 bp, Mus musculus
gattgaacttcgtgggcatcgatta

SEQ ID NO: 300824 - DNA, 25 bp, Mus musculus
gattgaagagtcttttcacagagcc

SEQ ID NO: 300825 - DNA, 25 bp, Mus musculus
gattgaagtagaggcaccagactcc

SEQ ID NO: 300826 - DNA, 25 bp, Mus musculus
gattgaagtgtatccctgggaagat

SEQ ID NO: 300827 - DNA, 25 bp, Mus musculus
gattgacaaggttttacttgtaatg

SEQ ID NO: 300828 - DNA, 25 bp, Mus musculus
gattgacacctcaggtggacccctt

SEQ ID NO: 300829 - DNA, 25 bp, Mus musculus
gattgacagagactctttcaagcat

SEQ ID NO: 300830 - DNA, 25 bp, Mus musculus
gattgacagagagccccttccaact

SEQ ID NO: 300831 - DNA, 25 bp, Mus musculus
gattgaccacaggaataactcaacc

SEQ ID NO: 300832 - DNA, 25 bp, Mus musculus
gattgacctaacaaatgtcgagtgg

SEQ ID NO: 300833 - DNA, 25 bp, Mus musculus
gattgagaagctgggaggctggaat

SEQ ID NO: 300834 - DNA, 25 bp, Mus musculus
gattgagaaggtcatagaagagctt

SEQ ID NO: 300835 - DNA, 25 bp, Mus musculus
gattgagaaggtgggaggctggaat

SEQ ID NO: 300836 - DNA, 25 bp, Mus musculus
gattgagagagcgagagttactacc

SEQ ID NO: 300837 - DNA, 25 bp, Mus musculus
gattgagagagcgaggttgcacata

SEQ ID NO: 300838 - DNA, 25 bp, Mus musculus
gattgagcactccttctggagatcc

SEQ ID NO: 300839 - DNA, 25 bp, Mus musculus
gattgagcaggtttaccgacaagac

SEQ ID NO: 300840 - DNA, 25 bp, Mus musculus
gattgagcatccttgcagctggcca

SEQ ID NO: 300841 - DNA, 25 bp, Mus musculus
gattgagcggtcctcgtctttcagc

SEQ ID NO: 300842 - DNA, 25 bp, Mus musculus
gattgagctcacatgaaaccaaaga

SEQ ID NO: 300843 - DNA, 25 bp, Mus musculus
gattgaggctgggaggagtgggagg

SEQ ID NO: 300844 - DNA, 25 bp, Mus musculus
gattgagggcctcgagaatggctct

SEQ ID NO: 300845 - DNA, 25 bp, Mus musculus
gattgataataccaggattgtctac

SEQ ID NO: 300846 - DNA, 25 bp, Mus musculus
gattgataatcctgctaccagccga

SEQ ID NO: 300847 - DNA, 25 bp, Mus musculus
gattgatacagggacaagtgaccag

SEQ ID NO: 300848 - DNA, 25 bp, Mus musculus
gattgatcacagttttcattgaaaa

SEQ ID NO: 300849 - DNA, 25 bp, Mus musculus
gattgatgtggccagcctgcggaca

SEQ ID NO: 300850 - DNA, 25 bp, Mus musculus
gattgattgctgcagtgtgaaaaac

SEQ ID NO: 300851 - DNA, 25 bp, Mus musculus
gattgcaaaggtcatttggtgtcta

SEQ ID NO: 300852 - DNA, 25 bp, Mus musculus
gattgcagagaacaatgacctactc

SEQ ID NO: 300853 - DNA, 25 bp, Mus musculus
gattgcagaggcccagcagctcatc

SEQ ID NO: 300854 - DNA, 25 bp, Mus musculus
gattgcagagtgaaccatgagccag

SEQ ID NO: 300855 - DNA, 25 bp, Mus musculus
gattgcatctttatggaaagagtat

SEQ ID NO: 300856 - DNA, 25 bp, Mus musculus
gattgcattaggaaagaatgtttcc

SEQ ID NO: 300857 - DNA, 25 bp, Mus musculus
gattgcattctacaggcggcagaaa

SEQ ID NO: 300858 - DNA, 25 bp, Mus musculus
gattgccaaccagacgtaccaccag

SEQ ID NO: 300859 - DNA, 25 bp, Mus musculus
gattgccaagaacggtatttgaata

SEQ ID NO: 300860 - DNA, 25 bp, Mus musculus
gattgccagaggcatgaatcctaca

SEQ ID NO: 300861 - DNA, 25 bp, Mus musculus
gattgccaggcccgacgactctttg

SEQ ID NO: 300862 - DNA, 25 bp, Mus musculus
gattgccagtgatatacatggagat

SEQ ID NO: 300863 - DNA, 25 bp, Mus musculus
gattgcccaatgagctgctaagtcg

SEQ ID NO: 300864 - DNA, 25 bp, Mus musculus
gattgcccaggatgccctgaagttc

SEQ ID NO: 300865 - DNA, 25 bp, Mus musculus
gattgcccaggttcgcggcaaggcc

SEQ ID NO: 300866 - DNA, 25 bp, Mus musculus
gattgccctcacgatcaacaaggca

SEQ ID NO: 300867 - DNA, 25 bp, Mus musculus
gattgccctcacgcataaaaataag

SEQ ID NO: 300868 - DNA, 25 bp, Mus musculus
gattgccctcatttgagaacaagac

SEQ ID NO: 300869 - DNA, 25 bp, Mus musculus
gattgccctgagaattcatataaac

SEQ ID NO: 300870 - DNA, 25 bp, Mus musculus
gattgccctgagagagaattctgtg

SEQ ID NO: 300871 - DNA, 25 bp, Mus musculus
gattgccctggatcgtgcagaaaga

SEQ ID NO: 300872 - DNA, 25 bp, Mus musculus
gattgccgggagccaccatgttcaa

SEQ ID NO: 300873 - DNA, 25 bp, Mus musculus
gattgccgggagctgaccggaagaa

SEQ ID NO: 300874 - DNA, 25 bp, Mus musculus
gattgcctcttctagtctcaacaga

SEQ ID NO: 300875 - DNA, 25 bp, Mus musculus
gattgcctggagagtgtgaaggatt

SEQ ID NO: 300876 - DNA, 25 bp, Mus musculus
gattgccttagccaagagctgtccc

SEQ ID NO: 300877 - DNA, 25 bp, Mus musculus
gattgccttcaaggacctactgaaa

SEQ ID NO: 300878 - DNA, 25 bp, Mus musculus
gattgccttttcccagtgttgtgca

SEQ ID NO: 300879 - DNA, 25 bp, Mus musculus
gattgcgcaggccttcagaagtatt

SEQ ID NO: 300880 - DNA, 25 bp, Mus musculus
gattgctaaaagtactattaatcct

SEQ ID NO: 300881 - DNA, 25 bp, Mus musculus
gattgctaaagaccagagtaatgcg

SEQ ID NO: 300882 - DNA, 25 bp, Mus musculus
gattgctaaagcagtgggaactcac

SEQ ID NO: 300883 - DNA, 25 bp, Mus musculus
gattgctaagatcccaccaaatatt

SEQ ID NO: 300884 - DNA, 25 bp, Mus musculus
gattgctaaggttgagggcaaagga

SEQ ID NO: 300885 - DNA, 25 bp, Mus musculus
gattgctcacgtatcacgacatcgg

SEQ ID NO: 300886 - DNA, 25 bp, Mus musculus
gattgctcagaaaaagatcattcag

SEQ ID NO: 300887 - DNA, 25 bp, Mus musculus
gattgctcagaacttctcggtatcc

SEQ ID NO: 300888 - DNA, 25 bp, Mus musculus
gattgctcagctgccttggctgtcg

SEQ ID NO: 300889 - DNA, 25 bp, Mus musculus
gattgctcagggcattgaaaacata

SEQ ID NO: 300890 - DNA, 25 bp, Mus musculus
gattgctccaagtaaggcccccata

SEQ ID NO: 300891 - DNA, 25 bp, Mus musculus
gattgctctaagaagctgatggtcc

SEQ ID NO: 300892 - DNA, 25 bp, Mus musculus
gattgctgcagtgtgaaaaactcaa

SEQ ID NO: 300893 - DNA, 25 bp, Mus musculus
gattgctgccagcataagacagtga

SEQ ID NO: 300894 - DNA, 25 bp, Mus musculus
gattgctgctgcaggttaccaacat

SEQ ID NO: 300895 - DNA, 25 bp, Mus musculus
gattgctgtggacagacgcctgcag

SEQ ID NO: 300896 - DNA, 25 bp, Mus musculus
gattgctgttaatactgtggatttc

SEQ ID NO: 300897 - DNA, 25 bp, Mus musculus
gattgctgttaatagtgtccctttt

SEQ ID NO: 300898 - DNA, 25 bp, Mus musculus
gattgcttgccttccagacctatcc

SEQ ID NO: 300899 - DNA, 25 bp, Mus musculus
gattgctttggcctggagagagaca

SEQ ID NO: 300900 - DNA, 25 bp, Mus musculus
gattggaaaagcgcagcctggaggc

SEQ ID NO: 300901 - DNA, 25 bp, Mus musculus
gattggaaaggttccaggatggctt

SEQ ID NO: 300902 - DNA, 25 bp, Mus musculus
gattggaagaaatcaagaagttggt

SEQ ID NO: 300903 - DNA, 25 bp, Mus musculus
gattggaagaagaatgaagacctga

SEQ ID NO: 300904 - DNA, 25 bp, Mus musculus
gattggaagagcaggggaaggaagc

SEQ ID NO: 300905 - DNA, 25 bp, Mus musculus
gattggaatgaccgagagtgggacc

SEQ ID NO: 300906 - DNA, 25 bp, Mus musculus
gattggacaagaggtgcaccatgga

SEQ ID NO: 300907 - DNA, 25 bp, Mus musculus
gattggacagcctgccgggcctcca

SEQ ID NO: 300908 - DNA, 25 bp, Mus musculus
gattggacaggcatcaagattcttc

SEQ ID NO: 300909 - DNA, 25 bp, Mus musculus
gattggactcgagctcagagctctg

SEQ ID NO: 300910 - DNA, 25 bp, Mus musculus
gattggactcgagtgtgacagttgt

SEQ ID NO: 300911 - DNA, 25 bp, Mus musculus
gattggataaggaggatttcagggt

SEQ ID NO: 300912 - DNA, 25 bp, Mus musculus
gattggatcccaaaattcccagtta

SEQ ID NO: 300913 - DNA, 25 bp, Mus musculus
gattggcaagcagtggtgacgtatg

SEQ ID NO: 300914 - DNA, 25 bp, Mus musculus
gattggcacctggggtggaggcagg

SEQ ID NO: 300915 - DNA, 25 bp, Mus musculus
gattggcagacttcttctcctcgga

SEQ ID NO: 300916 - DNA, 25 bp, Mus musculus
gattggcagagaagcttaagtgtga

SEQ ID NO: 300917 - DNA, 25 bp, Mus musculus
gattggcagagaaggcagtattgca

SEQ ID NO: 300918 - DNA, 25 bp, Mus musculus
gattggccatgtgttcaagcgctgt

SEQ ID NO: 300919 - DNA, 25 bp, Mus musculus
gattggccgagagatgaaaaatgat

SEQ ID NO: 300920 - DNA, 25 bp, Mus musculus
gattggccgagaggcaagaagagag

SEQ ID NO: 300921 - DNA, 25 bp, Mus musculus
gattggccgggctggtccctctgtc

SEQ ID NO: 300922 - DNA, 25 bp, Mus musculus
gattggccggtacaagcttcctgac

SEQ ID NO: 300923 - DNA, 25 bp, Mus musculus
gattggcctgctgaggactggctgc

SEQ ID NO: 300924 - DNA, 25 bp, Mus musculus
gattggcctggcaggcccttttagc

SEQ ID NO: 300925 - DNA, 25 bp, Mus musculus
gattggcgttttagtgaacaacgtg

SEQ ID NO: 300926 - DNA, 25 bp, Mus musculus
gattggctccagagctctctgtggt

SEQ ID NO: 300927 - DNA, 25 bp, Mus musculus
gattggctgccagtagataaaagat

SEQ ID NO: 300928 - DNA, 25 bp, Mus musculus
gattggctgccagtcttcaattagt

SEQ ID NO: 300929 - DNA, 25 bp, Mus musculus
gattggctgtagtttccagagtctg

SEQ ID NO: 300930 - DNA, 25 bp, Mus musculus
gattggcttccaggaggcaggcaat

SEQ ID NO: 300931 - DNA, 25 bp, Mus musculus
gattgggaagaaaaagaagaggagc

SEQ ID NO: 300932 - DNA, 25 bp, Mus musculus
gattgggaagagaacagacaaggtg

SEQ ID NO: 300933 - DNA, 25 bp, Mus musculus
gattgggaagggctcctgtgctagt

SEQ ID NO: 300934 - DNA, 25 bp, Mus musculus
gattgggaaggtggccttagtagaa

SEQ ID NO: 300935 - DNA, 25 bp, Mus musculus
gattgggaaggtttggcctggaacc

SEQ ID NO: 300936 - DNA, 25 bp, Mus musculus
gattgggaatagaaggctatcctac

SEQ ID NO: 300937 - DNA, 25 bp, Mus musculus
gattgggcacctcgagaagcctgta

SEQ ID NO: 300938 - DNA, 25 bp, Mus musculus
gattgggcacctcgattgcagcccg

SEQ ID NO: 300939 - DNA, 25 bp, Mus musculus
gattgggctaggaaggttctgtttg

SEQ ID NO: 300940 - DNA, 25 bp, Mus musculus
gattgggctctatgaaccagacttg

SEQ ID NO: 300941 - DNA, 25 bp, Mus musculus
gattggggacacggcatcctttgaa

SEQ ID NO: 300942 - DNA, 25 bp, Mus musculus
gattggggagggttttgaatcctgt

SEQ ID NO: 300943 - DNA, 25 bp, Mus musculus
gattgggggcagcaactcttacaaa

SEQ ID NO: 300944 - DNA, 25 bp, Mus musculus
gattgggtttatgcagaactctcag

SEQ ID NO: 300945 - DNA, 25 bp, Mus musculus
gattgggtttgaactcggagagtaa

SEQ ID NO: 300946 - DNA, 25 bp, Mus musculus
gattggtgcaggagaatttggagaa

SEQ ID NO: 300947 - DNA, 25 bp, Mus musculus
gattggttatgtcacaaacataaac

SEQ ID NO: 300948 - DNA, 25 bp, Mus musculus
gattggttatgtggcagcagaagaa

SEQ ID NO: 300949 - DNA, 25 bp, Mus musculus
gattggttcaaggagtcctttggga

SEQ ID NO: 300950 - DNA, 25 bp, Mus musculus
gattgtaaaccggaagaagttcaga

SEQ ID NO: 300951 - DNA, 25 bp, Mus musculus
gattgtaaagcgtgaagacagctgc

SEQ ID NO: 300952 - DNA, 25 bp, Mus musculus
gattgtaaagggtctcctgtgagca

SEQ ID NO: 300953 - DNA, 25 bp, Mus musculus
gattgtaaagtgatggttcatgacc

SEQ ID NO: 300954 - DNA, 25 bp, Mus musculus
gattgtaagaaaagtgatgctgcat

SEQ ID NO: 300955 - DNA, 25 bp, Mus musculus
gattgtaagcggacatcagaaaagt

SEQ ID NO: 300956 - DNA, 25 bp, Mus musculus
gattgtagaacttcaatgcaggagg

SEQ ID NO: 300957 - DNA, 25 bp, Mus musculus
gattgtagagatcagctcgaacggg

SEQ ID NO: 300958 - DNA, 25 bp, Mus musculus
gattgtagagttcaggatggctttg

SEQ ID NO: 300959 - DNA, 25 bp, Mus musculus
gattgtagcaaggtatggtgcggat

SEQ ID NO: 300960 - DNA, 25 bp, Mus musculus
gattgtagctgaggttcgttccacc

SEQ ID NO: 300961 - DNA, 25 bp, Mus musculus
gattgtatacaaaagcacaaaaggc

SEQ ID NO: 300962 - DNA, 25 bp, Mus musculus
gattgtatacaaaagtcaggttttc

SEQ ID NO: 300963 - DNA, 25 bp, Mus musculus
gattgtcaagagcaactgcaatgta

SEQ ID NO: 300964 - DNA, 25 bp, Mus musculus
gattgtcaagatgaaatgtcctgat

SEQ ID NO: 300965 - DNA, 25 bp, Mus musculus
gattgtcactggggtgcggctacca

SEQ ID NO: 300966 - DNA, 25 bp, Mus musculus
gattgtcactgggttttacctgctg

SEQ ID NO: 300967 - DNA, 25 bp, Mus musculus
gattgtccagacggctgctcttccc

SEQ ID NO: 300968 - DNA, 25 bp, Mus musculus
gattgtcccgaaagggtctcctgta

SEQ ID NO: 300969 - DNA, 25 bp, Mus musculus
gattgtcccgatgtgaaacattttt

SEQ ID NO: 300970 - DNA, 25 bp, Mus musculus
gattgtcgagacgtgcgaccgcatt

SEQ ID NO: 300971 - DNA, 25 bp, Mus musculus
gattgtcgcaaagagctcaccgagc

SEQ ID NO: 300972 - DNA, 25 bp, Mus musculus
gattgtcgcaaagagggtttctctg

SEQ ID NO: 300973 - DNA, 25 bp, Mus musculus
gattgtcgcaaagagtgtggggaga

SEQ ID NO: 300974 - DNA, 25 bp, Mus musculus
gattgtctggagatggctgcagcaa

SEQ ID NO: 300975 - DNA, 25 bp, Mus musculus
gattgtcttcctagccacgagtcta

SEQ ID NO: 300976 - DNA, 25 bp, Mus musculus
gattgtcttgagctggaagccggtt

SEQ ID NO: 300977 - DNA, 25 bp, Mus musculus
gattgtcttgagctggcccatcatg

SEQ ID NO: 300978 - DNA, 25 bp, Mus musculus
gattgtgaaaacattcgtatagcta

SEQ ID NO: 300979 - DNA, 25 bp, Mus musculus
gattgtgaagccaccagcatctgct

SEQ ID NO: 300980 - DNA, 25 bp, Mus musculus
gattgtgaagccagtattccccttc

SEQ ID NO: 300981 - DNA, 25 bp, Mus musculus
gattgtgagcggaaaagtgtacctg

SEQ ID NO: 300982 - DNA, 25 bp, Mus musculus
gattgtgatatcgtgtcccgagatg

SEQ ID NO: 300983 - DNA, 25 bp, Mus musculus
gattgtgccaaagataaatttgaaa

SEQ ID NO: 300984 - DNA, 25 bp, Mus musculus
gattgtggaaggggaggagcgctac

SEQ ID NO: 300985 - DNA, 25 bp, Mus musculus
gattgtggaggagggggatatgaaa

SEQ ID NO: 300986 - DNA, 25 bp, Mus musculus
gattgtggcaggacgaagaatgacc

SEQ ID NO: 300987 - DNA, 25 bp, Mus musculus
gattgtggcaggtatcacgagcatt

SEQ ID NO: 300988 - DNA, 25 bp, Mus musculus
gattgtgggcaggatatttgtgttt

SEQ ID NO: 300989 - DNA, 25 bp, Mus musculus
gattgtggtaacaaataacaaaggt

SEQ ID NO: 300990 - DNA, 25 bp, Mus musculus
gattgtggtgacactgcaaatggat

SEQ ID NO: 300991 - DNA, 25 bp, Mus musculus
gattgtgtcgaacaaatagtggaga

SEQ ID NO: 300992 - DNA, 25 bp, Mus musculus
gattgtgtcggacggtgggagtgga

SEQ ID NO: 300993 - DNA, 25 bp, Mus musculus
gattgtgtctgaggtcaactgaagc

SEQ ID NO: 300994 - DNA, 25 bp, Mus musculus
gattgtgtgagagattggtgtcctt

SEQ ID NO: 300995 - DNA, 25 bp, Mus musculus
gattgtgtgtctggcttatggtagc

SEQ ID NO: 300996 - DNA, 25 bp, Mus musculus
gattgtgtgtctgggagaagatgac

SEQ ID NO: 300997 - DNA, 25 bp, Mus musculus
gattgttcagcaggtcagggtttgg

SEQ ID NO: 300998 - DNA, 25 bp, Mus musculus
gattgttctattaggtcatgacgca

SEQ ID NO: 300999 - DNA, 25 bp, Mus musculus
gattgttgaagatataattgacact

SEQ ID NO: 301000 - DNA, 25 bp, Mus musculus
gattgttggataaaagcttataccc

SEQ ID NO: 301001 - DNA, 25 bp, Mus musculus
gattgttgggttcagatacaggagc

SEQ ID NO: 301002 - DNA, 25 bp, Mus musculus
gattgtttttcctggtgtgacttat

SEQ ID NO: 301003 - DNA, 25 bp, Mus musculus
gattgtttttgctgatgggaacttt

SEQ ID NO: 301004 - DNA, 25 bp, Mus musculus
gattgtttttgctgatttctaagtt

SEQ ID NO: 301005 - DNA, 25 bp, Mus musculus
gatttaaaaggtatgggtgagagca

SEQ ID NO: 301006 - DNA, 25 bp, Mus musculus
gatttaaataataggtggttagcca

SEQ ID NO: 301007 - DNA, 25 bp, Mus musculus
gatttaacacaggtgtgatcctgct

SEQ ID NO: 301008 - DNA, 25 bp, Mus musculus
gatttaaccagagctgtctgtctag

SEQ ID NO: 301009 - DNA, 25 bp, Mus musculus
gatttaaccaggtgccagatttact

SEQ ID NO: 301010 - DNA, 25 bp, Mus musculus
gatttaaccattcaaaatgtaggcc

SEQ ID NO: 301011 - DNA, 25 bp, Mus musculus
gatttaaccgtgagataccagagag

SEQ ID NO: 301012 - DNA, 25 bp, Mus musculus
gatttaagattgagatttttttgat

SEQ ID NO: 301013 - DNA, 25 bp, Mus musculus
gatttaataactggcatcctcgtgt

SEQ ID NO: 301014 - DNA, 25 bp, Mus musculus
gatttaatggttgctctctgaaaac

SEQ ID NO: 301015 - DNA, 25 bp, Mus musculus
gatttacagaagataacaaagttgt

SEQ ID NO: 301016 - DNA, 25 bp, Mus musculus
gatttacagaagtgctaggcctggt

SEQ ID NO: 301017 - DNA, 25 bp, Mus musculus
gatttacagaagtggacaagaagcc

SEQ ID NO: 301018 - DNA, 25 bp, Mus musculus
gatttacagctagttcatcactatt

SEQ ID NO: 301019 - DNA, 25 bp, Mus musculus
gatttacctctgggacaaggacaaa

SEQ ID NO: 301020 - DNA, 25 bp, Mus musculus
gatttacctttgcagaaagaagaat

SEQ ID NO: 301021 - DNA, 25 bp, Mus musculus
gatttacgacaaatgtgtgccaaag

SEQ ID NO: 301022 - DNA, 25 bp, Mus musculus
gatttagaagatcttttacaggatg

SEQ ID NO: 301023 - DNA, 25 bp, Mus musculus
gatttagaagatgatggtgaggatg

SEQ ID NO: 301024 - DNA, 25 bp, Mus musculus
gatttagacttggagatcccttcca

SEQ ID NO: 301025 - DNA, 25 bp, Mus musculus
gatttagctggggaggaagagacag

SEQ ID NO: 301026 - DNA, 25 bp, Mus musculus
gatttagctggggggccgaggggca

SEQ ID NO: 301027 - DNA, 25 bp, Mus musculus
gatttaggaatgttcttgggagtcg

SEQ ID NO: 301028 - DNA, 25 bp, Mus musculus
gatttagtatcaaaacttctctatt

SEQ ID NO: 301029 - DNA, 25 bp, Mus musculus
gatttagtctggcgtgtgcagcctg

SEQ ID NO: 301030 - DNA, 25 bp, Mus musculus
gatttataaaaatggtgtcctttgg

SEQ ID NO: 301031 - DNA, 25 bp, Mus musculus
gatttatcactagaggtcgatcgcg

SEQ ID NO: 301032 - DNA, 25 bp, Mus musculus
gatttatccaggtgtgaaattgaaa

SEQ ID NO: 301033 - DNA, 25 bp, Mus musculus
gatttatgacaaagatcagttcatg

SEQ ID NO: 301034 - DNA, 25 bp, Mus musculus
gatttatggagtgtttgatgagaaa

SEQ ID NO: 301035 - DNA, 25 bp, Mus musculus
gatttattattcggcatacccatgt

SEQ ID NO: 301036 - DNA, 25 bp, Mus musculus
gatttattgttgattcttccaagaa

SEQ ID NO: 301037 - DNA, 25 bp, Mus musculus
gatttcaacagacaggtggaggaag

SEQ ID NO: 301038 - DNA, 25 bp, Mus musculus
gatttcaacttccgcctggactagc

SEQ ID NO: 301039 - DNA, 25 bp, Mus musculus
gatttcaattaaggtattaagtcat

SEQ ID NO: 301040 - DNA, 25 bp, Mus musculus
gatttcacagagacagccattctgc

SEQ ID NO: 301041 - DNA, 25 bp, Mus musculus
gatttcacagggggttcaccgtctc

SEQ ID NO: 301042 - DNA, 25 bp, Mus musculus
gatttcacctcccagatcttctccc

SEQ ID NO: 301043 - DNA, 25 bp, Mus musculus
gatttcagaatgctccccgggagac

SEQ ID NO: 301044 - DNA, 25 bp, Mus musculus
gatttcagacatagtcacagcccag

SEQ ID NO: 301045 - DNA, 25 bp, Mus musculus
gatttcagattgccagatcagtata

SEQ ID NO: 301046 - DNA, 25 bp, Mus musculus
gatttcagattggtggaccttcctc

SEQ ID NO: 301047 - DNA, 25 bp, Mus musculus
gatttcagtgtcagacttaaatgga

SEQ ID NO: 301048 - DNA, 25 bp, Mus musculus
gatttcatcaactatcatgcttcgg

SEQ ID NO: 301049 - DNA, 25 bp, Mus musculus
gatttcatcaagctcctggttgaag

SEQ ID NO: 301050 - DNA, 25 bp, Mus musculus
gatttcatcaaggctatggcaatat

SEQ ID NO: 301051 - DNA, 25 bp, Mus musculus
gatttcatgtttgagatcagtcgtc

SEQ ID NO: 301052 - DNA, 25 bp, Mus musculus
gatttcattgaggagtttgacaatt

SEQ ID NO: 301053 - DNA, 25 bp, Mus musculus
gatttccaagcaatgtggtacacgg

SEQ ID NO: 301054 - DNA, 25 bp, Mus musculus
gatttccacagtcttgctctagcta

SEQ ID NO: 301055 - DNA, 25 bp, Mus musculus
gatttccacagtgttgctctagcta

SEQ ID NO: 301056 - DNA, 25 bp, Mus musculus
gatttccagaggataacgaaaagag

SEQ ID NO: 301057 - DNA, 25 bp, Mus musculus
gatttccagccgtggtcaagttcac

SEQ ID NO: 301058 - DNA, 25 bp, Mus musculus
gatttcccagaccacgaactgtcta

SEQ ID NO: 301059 - DNA, 25 bp, Mus musculus
gatttcccagcacagcaagctgacg

SEQ ID NO: 301060 - DNA, 25 bp, Mus musculus
gatttcccagcagagcaagctgacg

SEQ ID NO: 301061 - DNA, 25 bp, Mus musculus
gatttcccagggatccggcactggg

SEQ ID NO: 301062 - DNA, 25 bp, Mus musculus
gatttcccaggtaagcttcaagctg

SEQ ID NO: 301063 - DNA, 25 bp, Mus musculus
gatttccccagccagatcttctgga

SEQ ID NO: 301064 - DNA, 25 bp, Mus musculus
gatttccctggcctcagaaacactt

SEQ ID NO: 301065 - DNA, 25 bp, Mus musculus
gatttccctggcttcccctccagcc

SEQ ID NO: 301066 - DNA, 25 bp, Mus musculus
gatttccgaaggtacattttatact

SEQ ID NO: 301067 - DNA, 25 bp, Mus musculus
gatttcctacagggaaatcagtcag

SEQ ID NO: 301068 - DNA, 25 bp, Mus musculus
gatttcctacaggtggggctttaat

SEQ ID NO: 301069 - DNA, 25 bp, Mus musculus
gatttcctctccaagcttttcatcc

SEQ ID NO: 301070 - DNA, 25 bp, Mus musculus
gatttcctctccacccatctgctgg

SEQ ID NO: 301071 - DNA, 25 bp, Mus musculus
gatttcctggattctcaggactcgg

SEQ ID NO: 301072 - DNA, 25 bp, Mus musculus
gatttcgaccaggaaaaaatcctgc

SEQ ID NO: 301073 - DNA, 25 bp, Mus musculus
gatttcgaccagttaccttactctg

SEQ ID NO: 301074 - DNA, 25 bp, Mus musculus
gatttcgaggggagggagacgatgg

SEQ ID NO: 301075 - DNA, 25 bp, Mus musculus
gatttcgatagcaatgcagttgctg

SEQ ID NO: 301076 - DNA, 25 bp, Mus musculus
gatttcgttctgtgatgccagcaga

SEQ ID NO: 301077 - DNA, 25 bp, Mus musculus
gatttctaagcattccatattggaa

SEQ ID NO: 301078 - DNA, 25 bp, Mus musculus
gatttctaaggcttcagaagaggtg

SEQ ID NO: 301079 - DNA, 25 bp, Mus musculus
gatttctagcgtatatggaggaacg

SEQ ID NO: 301080 - DNA, 25 bp, Mus musculus
gatttctcatgaagccattgatctt

SEQ ID NO: 301081 - DNA, 25 bp, Mus musculus
gatttctccatcaaaccccggcagc

SEQ ID NO: 301082 - DNA, 25 bp, Mus musculus
gatttctgaaggggcttgtcaatga

SEQ ID NO: 301083 - DNA, 25 bp, Mus musculus
gatttctgaattgaggattaagctt

SEQ ID NO: 301084 - DNA, 25 bp, Mus musculus
gatttctggagccctgctttaaggc

SEQ ID NO: 301085 - DNA, 25 bp, Mus musculus
gatttctggcaaaagatgcttgcat

SEQ ID NO: 301086 - DNA, 25 bp, Mus musculus
gatttcttagctgagatagaagctt

SEQ ID NO: 301087 - DNA, 25 bp, Mus musculus
gatttcttcaagcacaagtatcaga

SEQ ID NO: 301088 - DNA, 25 bp, Mus musculus
gatttcttcaaggccaagaagatag

SEQ ID NO: 301089 - DNA, 25 bp, Mus musculus
gatttcttcattgagactggacaat

SEQ ID NO: 301090 - DNA, 25 bp, Mus musculus
gatttcttcccaggagaaatatgaa

SEQ ID NO: 301091 - DNA, 25 bp, Mus musculus
gatttcttgacaggcatcctcgtgt

SEQ ID NO: 301092 - DNA, 25 bp, Mus musculus
gatttctttagcaagagcagtatat

SEQ ID NO: 301093 - DNA, 25 bp, Mus musculus
gatttgaaaatcgaatctctagggc

SEQ ID NO: 301094 - DNA, 25 bp, Mus musculus
gatttgaaaatcgatcttctttcag

SEQ ID NO: 301095 - DNA, 25 bp, Mus musculus
gatttgaaaatcggttagtccttca

SEQ ID NO: 301096 - DNA, 25 bp, Mus musculus
gatttgaaagagctgaatgataaga

SEQ ID NO: 301097 - DNA, 25 bp, Mus musculus
gatttgaacactgatatagaaaatc

SEQ ID NO: 301098 - DNA, 25 bp, Mus musculus
gatttgagccgaggattaacacctg

SEQ ID NO: 301099 - DNA, 25 bp, Mus musculus
gatttgaggtccaagctcggacctc

SEQ ID NO: 301100 - DNA, 25 bp, Mus musculus
gatttgagtggaatgcgctcttcgt

SEQ ID NO: 301101 - DNA, 25 bp, Mus musculus
gatttgatagacgtgaacgaagctt

SEQ ID NO: 301102 - DNA, 25 bp, Mus musculus
gatttgatgctgtgcaaagtgcaca

SEQ ID NO: 301103 - DNA, 25 bp, Mus musculus
gatttgatgctgtggacaaggtctc

SEQ ID NO: 301104 - DNA, 25 bp, Mus musculus
gatttgatgctgtggactgtgtttg

SEQ ID NO: 301105 - DNA, 25 bp, Mus musculus
gatttgcaagacagttcggcatggg

SEQ ID NO: 301106 - DNA, 25 bp, Mus musculus
gatttgcaagggagttgatttacta

SEQ ID NO: 301107 - DNA, 25 bp, Mus musculus
gatttgcacctgcggacggcatcgc

SEQ ID NO: 301108 - DNA, 25 bp, Mus musculus
gatttgcacctgcggctctatcaga

SEQ ID NO: 301109 - DNA, 25 bp, Mus musculus
gatttgcacctgcgggtcagattat

SEQ ID NO: 301110 - DNA, 25 bp, Mus musculus
gatttgcactgtgtgaccagcccat

SEQ ID NO: 301111 - DNA, 25 bp, Mus musculus
gatttgccaactgtttctatactga

SEQ ID NO: 301112 - DNA, 25 bp, Mus musculus
gatttgccaagaggagctctggcta

SEQ ID NO: 301113 - DNA, 25 bp, Mus musculus
gatttgccaatgcccagcagaggag

SEQ ID NO: 301114 - DNA, 25 bp, Mus musculus
gatttgctcaaaccagaacttgttc

SEQ ID NO: 301115 - DNA, 25 bp, Mus musculus
gatttgctgagaggttttctcaaga

SEQ ID NO: 301116 - DNA, 25 bp, Mus musculus
gatttgctgagagtgctcacaggct

SEQ ID NO: 301117 - DNA, 25 bp, Mus musculus
gatttgctggtgaaggttcaattgt

SEQ ID NO: 301118 - DNA, 25 bp, Mus musculus
gatttgctggtgaagttatgtaatc

SEQ ID NO: 301119 - DNA, 25 bp, Mus musculus
gatttggaagaagagaaccacaaac

SEQ ID NO: 301120 - DNA, 25 bp, Mus musculus
gatttggaagagacctcaattattg

SEQ ID NO: 301121 - DNA, 25 bp, Mus musculus
gatttggaagatggagaactctcag

SEQ ID NO: 301122 - DNA, 25 bp, Mus musculus
gatttggaagcaggaatgtctgacc

SEQ ID NO: 301123 - DNA, 25 bp, Mus musculus
gatttggaaggaagttctcctcgga

SEQ ID NO: 301124 - DNA, 25 bp, Mus musculus
gatttggaagggtggatgtcactga

SEQ ID NO: 301125 - DNA, 25 bp, Mus musculus
gatttggaagtcaagaagttttctt

SEQ ID NO: 301126 - DNA, 25 bp, Mus musculus
gatttggaataattgatgtgactga

SEQ ID NO: 301127 - DNA, 25 bp, Mus musculus
gatttggaatattcgatgttacaga

SEQ ID NO: 301128 - DNA, 25 bp, Mus musculus
gatttggacagcttccttgtgactc

SEQ ID NO: 301129 - DNA, 25 bp, Mus musculus
gatttggacagtttccagcaggagc

SEQ ID NO: 301130 - DNA, 25 bp, Mus musculus
gatttggagaggtacaactgatgag

SEQ ID NO: 301131 - DNA, 25 bp, Mus musculus
gatttggagtagatcaatccccttc

SEQ ID NO: 301132 - DNA, 25 bp, Mus musculus
gatttggcaatgatggaagcaattt

SEQ ID NO: 301133 - DNA, 25 bp, Mus musculus
gatttggcaatgatggtggctatgg

SEQ ID NO: 301134 - DNA, 25 bp, Mus musculus
gatttggcaatgatggtggttatgg

SEQ ID NO: 301135 - DNA, 25 bp, Mus musculus
gatttggcacatacgtgcagttctc

SEQ ID NO: 301136 - DNA, 25 bp, Mus musculus
gatttggctcatcaggaggactgac

SEQ ID NO: 301137 - DNA, 25 bp, Mus musculus
gatttggctcatcagttggcagttc

SEQ ID NO: 301138 - DNA, 25 bp, Mus musculus
gatttgggcacgatgtataccaggt

SEQ ID NO: 301139 - DNA, 25 bp, Mus musculus
gatttgggcacggactgtcagggca

SEQ ID NO: 301140 - DNA, 25 bp, Mus musculus
gatttgggctgctggcaactatcga

SEQ ID NO: 301141 - DNA, 25 bp, Mus musculus
gatttggttcagagtcttttacatg

SEQ ID NO: 301142 - DNA, 25 bp, Mus musculus
gatttggttcagagttgtcctgggg

SEQ ID NO: 301143 - DNA, 25 bp, Mus musculus
gatttgtacaaaagccctatagtcg

SEQ ID NO: 301144 - DNA, 25 bp, Mus musculus
gatttgtacaaaaggttgaagaaat

SEQ ID NO: 301145 - DNA, 25 bp, Mus musculus
gatttgtagaactagtccttatcgg

SEQ ID NO: 301146 - DNA, 25 bp, Mus musculus
gatttgtagaactatgcattttgca

SEQ ID NO: 301147 - DNA, 25 bp, Mus musculus
gatttgtcccatggccttctttcta

SEQ ID NO: 301148 - DNA, 25 bp, Mus musculus
gatttgtgaagaaacccccagttgt

SEQ ID NO: 301149 - DNA, 25 bp, Mus musculus
gatttgtgaagatatagatgagtgc

SEQ ID NO: 301150 - DNA, 25 bp, Mus musculus
gatttgtgaaggtatccgcccccag

SEQ ID NO: 301151 - DNA, 25 bp, Mus musculus
gatttgtgaaggtttcagaggatta

SEQ ID NO: 301152 - DNA, 25 bp, Mus musculus
gatttgtgacgcgggatggtcactc

SEQ ID NO: 301153 - DNA, 25 bp, Mus musculus
gatttgtgtgctcgaaaattggagt

SEQ ID NO: 301154 - DNA, 25 bp, Mus musculus
gattttaaaaggaaacagacagctg

SEQ ID NO: 301155 - DNA, 25 bp, Mus musculus
gattttaaagacggctatggatgtt

SEQ ID NO: 301156 - DNA, 25 bp, Mus musculus
gattttaaagagtattcaaattgcc

SEQ ID NO: 301157 - DNA, 25 bp, Mus musculus
gattttaaagagttgattccagaat

SEQ ID NO: 301158 - DNA, 25 bp, Mus musculus
gattttaaagtggacatcccagaaa

SEQ ID NO: 301159 - DNA, 25 bp, Mus musculus
gattttaaatttcagattttatcat

SEQ ID NO: 301160 - DNA, 25 bp, Mus musculus
gattttaatagctcgatgacctcac

SEQ ID NO: 301161 - DNA, 25 bp, Mus musculus
gattttaatagtgctagccatcgct

SEQ ID NO: 301162 - DNA, 25 bp, Mus musculus
gattttacagagtgctaccagtata

SEQ ID NO: 301163 - DNA, 25 bp, Mus musculus
gattttacagtgtgctaccagtata

SEQ ID NO: 301164 - DNA, 25 bp, Mus musculus
gattttagaaggccccaggacacat

SEQ ID NO: 301165 - DNA, 25 bp, Mus musculus
gattttagacatagtagcaacccag

SEQ ID NO: 301166 - DNA, 25 bp, Mus musculus
gattttagcagcttcttactgtgtt

SEQ ID NO: 301167 - DNA, 25 bp, Mus musculus
gattttagcaggtgaatatgaccat

SEQ ID NO: 301168 - DNA, 25 bp, Mus musculus
gattttatgatgagtgtaaaagaag

SEQ ID NO: 301169 - DNA, 25 bp, Mus musculus
gattttatgatgagtgtttatcacc

SEQ ID NO: 301170 - DNA, 25 bp, Mus musculus
gattttatgccagagatttcagaag

SEQ ID NO: 301171 - DNA, 25 bp, Mus musculus
gattttatgctttaggtgaaggcga

SEQ ID NO: 301172 - DNA, 25 bp, Mus musculus
gattttatgtggggagagaaaagaa

SEQ ID NO: 301173 - DNA, 25 bp, Mus musculus
gattttcagggcattgtgcttcttc

SEQ ID NO: 301174 - DNA, 25 bp, Mus musculus
gattttccacggaagagtaaagaca

SEQ ID NO: 301175 - DNA, 25 bp, Mus musculus
gattttcccgaatactcctcaagca

SEQ ID NO: 301176 - DNA, 25 bp, Mus musculus
gattttcctagctgggctatggagt

SEQ ID NO: 301177 - DNA, 25 bp, Mus musculus
gattttcgcaactgcgcaaaccatg

SEQ ID NO: 301178 - DNA, 25 bp, Mus musculus
gattttcggcaaggatgagccccaa

SEQ ID NO: 301179 - DNA, 25 bp, Mus musculus
gattttcggcaagggcgtctactgg

SEQ ID NO: 301180 - DNA, 25 bp, Mus musculus
gattttctcacaaacattaaccagg

SEQ ID NO: 301181 - DNA, 25 bp, Mus musculus
gattttctcacaataggtgaccttc

SEQ ID NO: 301182 - DNA, 25 bp, Mus musculus
gattttctcacatcttggaggagga

SEQ ID NO: 301183 - DNA, 25 bp, Mus musculus
gattttctcagggaggcgccttgtc

SEQ ID NO: 301184 - DNA, 25 bp, Mus musculus
gattttctcaggggccgatcaacag

SEQ ID NO: 301185 - DNA, 25 bp, Mus musculus
gattttctcctatggctgtcttcag

SEQ ID NO: 301186 - DNA, 25 bp, Mus musculus
gattttctcctatgggtatggccga

SEQ ID NO: 301187 - DNA, 25 bp, Mus musculus
gattttctggataagagtgcctcgg

SEQ ID NO: 301188 - DNA, 25 bp, Mus musculus
gattttctggataagcccacctgga

SEQ ID NO: 301189 - DNA, 25 bp, Mus musculus
gattttctggataaggtgcttctgt

SEQ ID NO: 301190 - DNA, 25 bp, Mus musculus
gattttctggatgagaattggcaag

SEQ ID NO: 301191 - DNA, 25 bp, Mus musculus
gattttcttggggacagtgaaatgc

SEQ ID NO: 301192 - DNA, 25 bp, Mus musculus
gattttgaaagacaagaagctgatc

SEQ ID NO: 301193 - DNA, 25 bp, Mus musculus
gattttgacaaagagcctgactctg

SEQ ID NO: 301194 - DNA, 25 bp, Mus musculus
gattttgagaaggtcatcttggaag

SEQ ID NO: 301195 - DNA, 25 bp, Mus musculus
gattttgagatgtccatatgtggtt

SEQ ID NO: 301196 - DNA, 25 bp, Mus musculus
gattttgctctgatggttggcactg

SEQ ID NO: 301197 - DNA, 25 bp, Mus musculus
gattttgtagaggagctccaagtat

SEQ ID NO: 301198 - DNA, 25 bp, Mus musculus
gatttttaatagatggagagcatcc

SEQ ID NO: 301199 - DNA, 25 bp, Mus musculus
gatttttacatggacttgacatcag

SEQ ID NO: 301200 - DNA, 25 bp, Mus musculus
gatttttagatatgcttggcctgtg

SEQ ID NO: 301201 - DNA, 25 bp, Mus musculus
gatttttcagaaagtaaacgaagca

SEQ ID NO: 301202 - DNA, 25 bp, Mus musculus
gatttttcaggcccaatgatgatca

SEQ ID NO: 301203 - DNA, 25 bp, Mus musculus
gatttttcaggggatgtttcggaag

SEQ ID NO: 301204 - DNA, 25 bp, Mus musculus
gatttttcggaagacagcgtggaag

SEQ ID NO: 301205 - DNA, 25 bp, Mus musculus
gatttttctagcaagttgcgaatca

SEQ ID NO: 301206 - DNA, 25 bp, Mus musculus
gatttttctaggacatgtatgcatc

SEQ ID NO: 301207 - DNA, 25 bp, Mus musculus
gatttttctcagtaccaacaaaagc

SEQ ID NO: 301208 - DNA, 25 bp, Mus musculus
gatttttctgggattgggtcgaaaa

SEQ ID NO: 301209 - DNA, 25 bp, Mus musculus
gatttttctgggcccctgatgattg

SEQ ID NO: 301210 - DNA, 25 bp, Mus musculus
gatttttgagaactgatagtgcatc

SEQ ID NO: 301211 - DNA, 25 bp, Mus musculus
gattttttcagtattggaaaagtga

SEQ ID NO: 301212 - DNA, 25 bp, Mus musculus
gattttttgcaggcatcacagactg

SEQ ID NO: 301213 - DNA, 25 bp, Mus musculus
gatttttttattaagctctgattca

SEQ ID NO: 301214 - DNA, 25 bp, Mus musculus
gatttttttattaaggtggccatgc

SEQ ID NO: 301215 - DNA, 25 bp, Mus musculus
gatttttttctatctgcccgcggta

SEQ ID NO: 301216 - DNA, 25 bp, Mus musculus
gatttttttggaatgggcaaagaag

SEQ ID NO: 301217 - DNA, 25 bp, Mus musculus
gcaaaaaaagtggacgctcagggta

SEQ ID NO: 301218 - DNA, 25 bp, Mus musculus
gcaaaaacaaagctcctgggctcca

SEQ ID NO: 301219 - DNA, 25 bp, Mus musculus
gcaaaaacaaatcattgcaacgatg

SEQ ID NO: 301220 - DNA, 25 bp, Mus musculus
gcaaaaacacagaatctgctggatg

SEQ ID NO: 301221 - DNA, 25 bp, Mus musculus
gcaaaaacacaggcagagctcagat

SEQ ID NO: 301222 - DNA, 25 bp, Mus musculus
gcaaaaacagatgtggaaagagcac

SEQ ID NO: 301223 - DNA, 25 bp, Mus musculus
gcaaaaacagctcaatgacagtcac

SEQ ID NO: 301224 - DNA, 25 bp, Mus musculus
gcaaaaacagctctgtccaaagctc

SEQ ID NO: 301225 - DNA, 25 bp, Mus musculus
gcaaaaacatagccaaggacatgaa

SEQ ID NO: 301226 - DNA, 25 bp, Mus musculus
gcaaaaaccatgccttttgcctttc

SEQ ID NO: 301227 - DNA, 25 bp, Mus musculus
gcaaaaaccatgtgtgagtgttatg

SEQ ID NO: 301228 - DNA, 25 bp, Mus musculus
gcaaaaagcaggcctgttgctgggg

SEQ ID NO: 301229 - DNA, 25 bp, Mus musculus
gcaaaaagggcatcctggtcaacat

SEQ ID NO: 301230 - DNA, 25 bp, Mus musculus
gcaaaacagaaacgttcctgagact

SEQ ID NO: 301231 - DNA, 25 bp, Mus musculus
gcaaaacaggccaggtggccttgct

SEQ ID NO: 301232 - DNA, 25 bp, Mus musculus
gcaaaacattttgagcgttggtgtt

SEQ ID NO: 301233 - DNA, 25 bp, Mus musculus
gcaaaacattttgaggactactgtt

SEQ ID NO: 301234 - DNA, 25 bp, Mus musculus
gcaaaaccaaggactctgcttttga

SEQ ID NO: 301235 - DNA, 25 bp, Mus musculus
gcaaaaccaaggagcgcttctggga

SEQ ID NO: 301236 - DNA, 25 bp, Mus musculus
gcaaaaccaaggctgagccgagcta

SEQ ID NO: 301237 - DNA, 25 bp, Mus musculus
gcaaaaccaaggctgaggcgagcca

SEQ ID NO: 301238 - DNA, 25 bp, Mus musculus
gcaaaaccaagttcttgacatcttc

SEQ ID NO: 301239 - DNA, 25 bp, Mus musculus
gcaaaaccaggtgcagatccctgct

SEQ ID NO: 301240 - DNA, 25 bp, Mus musculus
gcaaaaccatcccaggtgacaccgc

SEQ ID NO: 301241 - DNA, 25 bp, Mus musculus
gcaaaacccaaagccctttgccatg

SEQ ID NO: 301242 - DNA, 25 bp, Mus musculus
gcaaaacccaggcaagtgctctcca

SEQ ID NO: 301243 - DNA, 25 bp, Mus musculus
gcaaaactgaaggatctgaaccaat

SEQ ID NO: 301244 - DNA, 25 bp, Mus musculus
gcaaaactgaaggatggcgtggttc

SEQ ID NO: 301245 - DNA, 25 bp, Mus musculus
gcaaaactgagtgaccttcagaatg

SEQ ID NO: 301246 - DNA, 25 bp, Mus musculus
gcaaaagaaaagatgagaggctgta

SEQ ID NO: 301247 - DNA, 25 bp, Mus musculus
gcaaaagaagagcagggctgtgtct

SEQ ID NO: 301248 - DNA, 25 bp, Mus musculus
gcaaaagagcaccagcacagctgat

SEQ ID NO: 301249 - DNA, 25 bp, Mus musculus
gcaaaagcagaaccgggatggaccc

SEQ ID NO: 301250 - DNA, 25 bp, Mus musculus
gcaaaagcagattttatcatgtggg

SEQ ID NO: 301251 - DNA, 25 bp, Mus musculus
gcaaaagcagctacctgtttgcagt

SEQ ID NO: 301252 - DNA, 25 bp, Mus musculus
gcaaaagcaggcggaacatgttccc

SEQ ID NO: 301253 - DNA, 25 bp, Mus musculus
gcaaaagcaggtacctgtttgcagt

SEQ ID NO: 301254 - DNA, 25 bp, Mus musculus
gcaaaagccacccgaatggctgttg

SEQ ID NO: 301255 - DNA, 25 bp, Mus musculus
gcaaaagccagagcccaggctgtcc

SEQ ID NO: 301256 - DNA, 25 bp, Mus musculus
gcaaaagccagtgggaagagcatgg

SEQ ID NO: 301257 - DNA, 25 bp, Mus musculus
gcaaaagccagtgttggaggtgagc

SEQ ID NO: 301258 - DNA, 25 bp, Mus musculus
gcaaaagccgaggctctgctaaggc

SEQ ID NO: 301259 - DNA, 25 bp, Mus musculus
gcaaaagcgctgcagctattatctg

SEQ ID NO: 301260 - DNA, 25 bp, Mus musculus
gcaaaagctaaggatgaccagactc

SEQ ID NO: 301261 - DNA, 25 bp, Mus musculus
gcaaaagctcagagggaagctcaca

SEQ ID NO: 301262 - DNA, 25 bp, Mus musculus
gcaaaagctcagagggaattgaagt

SEQ ID NO: 301263 - DNA, 25 bp, Mus musculus
gcaaaagctggtgcaacacgtggtg

SEQ ID NO: 301264 - DNA, 25 bp, Mus musculus
gcaaaaggaaagaaccagatttctg

SEQ ID NO: 301265 - DNA, 25 bp, Mus musculus
gcaaaaggaaagaatcttctcaaaa

SEQ ID NO: 301266 - DNA, 25 bp, Mus musculus
gcaaaaggacaggatgtagatatga

SEQ ID NO: 301267 - DNA, 25 bp, Mus musculus
gcaaaaggagcaggtgcttttggat

SEQ ID NO: 301268 - DNA, 25 bp, Mus musculus
gcaaaaggcaaagatgcagctgtgt

SEQ ID NO: 301269 - DNA, 25 bp, Mus musculus
gcaaaaggcagagggacagttaaag

SEQ ID NO: 301270 - DNA, 25 bp, Mus musculus
gcaaaagtgacgtgtgggcttttgg

SEQ ID NO: 301271 - DNA, 25 bp, Mus musculus
gcaaaagtgagtggagctcctctgg

SEQ ID NO: 301272 - DNA, 25 bp, Mus musculus
gcaaaatactcacagaaagaagaat

SEQ ID NO: 301273 - DNA, 25 bp, Mus musculus
gcaaaatagaagaggtagtagaaga

SEQ ID NO: 301274 - DNA, 25 bp, Mus musculus
gcaaaatagcgatgtctggaataaa

SEQ ID NO: 301275 - DNA, 25 bp, Mus musculus
gcaaaatagcggtcacacaactggc

SEQ ID NO: 301276 - DNA, 25 bp, Mus musculus
gcaaaatatcagctggtggctggca

SEQ ID NO: 301277 - DNA, 25 bp, Mus musculus
gcaaaatatcagtctagccgcagac

SEQ ID NO: 301278 - DNA, 25 bp, Mus musculus
gcaaaatctcaaattgctcttaaac

SEQ ID NO: 301279 - DNA, 25 bp, Mus musculus
gcaaaatgaaaagatgaaaacttta

SEQ ID NO: 301280 - DNA, 25 bp, Mus musculus
gcaaaatgagccgcacggaaggaaa

SEQ ID NO: 301281 - DNA, 25 bp, Mus musculus
gcaaaatgctgcaagcaccttctag

SEQ ID NO: 301282 - DNA, 25 bp, Mus musculus
gcaaaatgctgcaagtatagaacat

SEQ ID NO: 301283 - DNA, 25 bp, Mus musculus
gcaaaatggcaggagctcgacgcca

SEQ ID NO: 301284 - DNA, 25 bp, Mus musculus
gcaaaatgggagccaggagtccttc

SEQ ID NO: 301285 - DNA, 25 bp, Mus musculus
gcaaaatgtggattttgttgacctc

SEQ ID NO: 301286 - DNA, 25 bp, Mus musculus
gcaaaattcagaatgggctgtatgg

SEQ ID NO: 301287 - DNA, 25 bp, Mus musculus
gcaaacaaaaaatgcagagagaaat

SEQ ID NO: 301288 - DNA, 25 bp, Mus musculus
gcaaacaacagggcagcagaagaag

SEQ ID NO: 301289 - DNA, 25 bp, Mus musculus
gcaaacaacagggtggcagacgaag

SEQ ID NO: 301290 - DNA, 25 bp, Mus musculus
gcaaacacaggtgaaaatctggttt

SEQ ID NO: 301291 - DNA, 25 bp, Mus musculus
gcaaacacatgaaggttcatgaatc

SEQ ID NO: 301292 - DNA, 25 bp, Mus musculus
gcaaacacatgaagtgttgtcctgc

SEQ ID NO: 301293 - DNA, 25 bp, Mus musculus
gcaaacacctccctctcccagtaca

SEQ ID NO: 301294 - DNA, 25 bp, Mus musculus
gcaaacactgtctagcaccatcaaa

SEQ ID NO: 301295 - DNA, 25 bp, Mus musculus
gcaaacacttgaaacagttccctgg

SEQ ID NO: 301296 - DNA, 25 bp, Mus musculus
gcaaacacttgaaaccagcgtgcag

SEQ ID NO: 301297 - DNA, 25 bp, Mus musculus
gcaaacagaaaactcagaactttcg

SEQ ID NO: 301298 - DNA, 25 bp, Mus musculus
gcaaacagacagtgattgtatgtga

SEQ ID NO: 301299 - DNA, 25 bp, Mus musculus
gcaaacagtcagtgtgaatttgaaa

SEQ ID NO: 301300 - DNA, 25 bp, Mus musculus
gcaaacagttccaggaagggaacat

SEQ ID NO: 301301 - DNA, 25 bp, Mus musculus
gcaaacagttccagtcactattacc

SEQ ID NO: 301302 - DNA, 25 bp, Mus musculus
gcaaacataatgtgaccccatctct

SEQ ID NO: 301303 - DNA, 25 bp, Mus musculus
gcaaacatgacctggctcacctacc

SEQ ID NO: 301304 - DNA, 25 bp, Mus musculus
gcaaacatggcagcagagtcactcg

SEQ ID NO: 301305 - DNA, 25 bp, Mus musculus
gcaaacatggcaggctctacacaga

SEQ ID NO: 301306 - DNA, 25 bp, Mus musculus
gcaaaccacagaagacagttgctca

SEQ ID NO: 301307 - DNA, 25 bp, Mus musculus
gcaaaccacagaaggccctgacccc

SEQ ID NO: 301308 - DNA, 25 bp, Mus musculus
gcaaaccacagaaggtgcagacctc

SEQ ID NO: 301309 - DNA, 25 bp, Mus musculus
gcaaaccactggatatattgggttg

SEQ ID NO: 301310 - DNA, 25 bp, Mus musculus
gcaaaccactggggagtagagcaag

SEQ ID NO: 301311 - DNA, 25 bp, Mus musculus
gcaaaccagcaagctcctgggcctg

SEQ ID NO: 301312 - DNA, 25 bp, Mus musculus
gcaaaccagcaagtgcgactgtatc

SEQ ID NO: 301313 - DNA, 25 bp, Mus musculus
gcaaaccatgacatgtactatgcgt

SEQ ID NO: 301314 - DNA, 25 bp, Mus musculus
gcaaaccatgatctcaagaccagag

SEQ ID NO: 301315 - DNA, 25 bp, Mus musculus
gcaaaccatgcctcaatctaggtgg

SEQ ID NO: 301316 - DNA, 25 bp, Mus musculus
gcaaaccatgttccggcttttcccc

SEQ ID NO: 301317 - DNA, 25 bp, Mus musculus
gcaaaccattcaaaatacaagtcct

SEQ ID NO: 301318 - DNA, 25 bp, Mus musculus
gcaaaccattcaaatcctggttgaa

SEQ ID NO: 301319 - DNA, 25 bp, Mus musculus
gcaaaccattcagtttgcaggagac

SEQ ID NO: 301320 - DNA, 25 bp, Mus musculus
gcaaacccaaagagatgtggttgct

SEQ ID NO: 301321 - DNA, 25 bp, Mus musculus
gcaaacccaggaagagcggtcgaga

SEQ ID NO: 301322 - DNA, 25 bp, Mus musculus
gcaaacccaggagacacaccctgag

SEQ ID NO: 301323 - DNA, 25 bp, Mus musculus
gcaaacccagttgagcaaaaagaag

SEQ ID NO: 301324 - DNA, 25 bp, Mus musculus
gcaaaccccagatatccagcttgtc

SEQ ID NO: 301325 - DNA, 25 bp, Mus musculus
gcaaaccctatgtttgatgaccctg

SEQ ID NO: 301326 - DNA, 25 bp, Mus musculus
gcaaaccctgtccaggtagctctgg

SEQ ID NO: 301327 - DNA, 25 bp, Mus musculus
gcaaacccttgtgaactgaagaata

SEQ ID NO: 301328 - DNA, 25 bp, Mus musculus
gcaaaccggcagaagagcctagatt

SEQ ID NO: 301329 - DNA, 25 bp, Mus musculus
gcaaaccggcagaagcttcaaactc

SEQ ID NO: 301330 - DNA, 25 bp, Mus musculus
gcaaacctctgaagagttacatgct

SEQ ID NO: 301331 - DNA, 25 bp, Mus musculus
gcaaacctctgcggcggtatctgac

SEQ ID NO: 301332 - DNA, 25 bp, Mus musculus
gcaaacggtcttccgacatagactg

SEQ ID NO: 301333 - DNA, 25 bp, Mus musculus
gcaaacgtccagcgtttggagcagg

SEQ ID NO: 301334 - DNA, 25 bp, Mus musculus
gcaaacgtccaggagcaggcctcgt

SEQ ID NO: 301335 - DNA, 25 bp, Mus musculus
gcaaactaacaaggacaatcagtac

SEQ ID NO: 301336 - DNA, 25 bp, Mus musculus
gcaaactaacaaggatattacaaat

SEQ ID NO: 301337 - DNA, 25 bp, Mus musculus
gcaaactatactgagatcgccttac

SEQ ID NO: 301338 - DNA, 25 bp, Mus musculus
gcaaactcaagatgctgatcatatg

SEQ ID NO: 301339 - DNA, 25 bp, Mus musculus
gcaaactcagagggccccccccaca

SEQ ID NO: 301340 - DNA, 25 bp, Mus musculus
gcaaactcaggagaggaaacgaggc

SEQ ID NO: 301341 - DNA, 25 bp, Mus musculus
gcaaactcctcaagggttggtggtc

SEQ ID NO: 301342 - DNA, 25 bp, Mus musculus
gcaaactcgccacagagctcagcag

SEQ ID NO: 301343 - DNA, 25 bp, Mus musculus
gcaaactcttcctaagaaacctcac

SEQ ID NO: 301344 - DNA, 25 bp, Mus musculus
gcaaactgttctgcggtggagggag

SEQ ID NO: 301345 - DNA, 25 bp, Mus musculus
gcaaactgttctgtggtggttccac

SEQ ID NO: 301346 - DNA, 25 bp, Mus musculus
gcaaacttgcagtatgatgatggca

SEQ ID NO: 301347 - DNA, 25 bp, Mus musculus
gcaaactttatgatcctggggcaga

SEQ ID NO: 301348 - DNA, 25 bp, Mus musculus
gcaaacttttatggccttgaactca

SEQ ID NO: 301349 - DNA, 25 bp, Mus musculus
gcaaagaaaatagctccggtacctc

SEQ ID NO: 301350 - DNA, 25 bp, Mus musculus
gcaaagaaaggcctcctggaacatg

SEQ ID NO: 301351 - DNA, 25 bp, Mus musculus
gcaaagaaagttgcaaaaatcttgg

SEQ ID NO: 301352 - DNA, 25 bp, Mus musculus
gcaaagaaagttgcaaatgattcat

SEQ ID NO: 301353 - DNA, 25 bp, Mus musculus
gcaaagaagaaaaaagattataaga

SEQ ID NO: 301354 - DNA, 25 bp, Mus musculus
gcaaagaagaaaaggaagagcatgg

SEQ ID NO: 301355 - DNA, 25 bp, Mus musculus
gcaaagaagaaaaggaatagtctca

SEQ ID NO: 301356 - DNA, 25 bp, Mus musculus
gcaaagaagggacaggtgccattga

SEQ ID NO: 301357 - DNA, 25 bp, Mus musculus
gcaaagaagggacaggtgtatcatc

SEQ ID NO: 301358 - DNA, 25 bp, Mus musculus
gcaaagaatggggtaaccatagaga

SEQ ID NO: 301359 - DNA, 25 bp, Mus musculus
gcaaagacaagacagagagtggagg

SEQ ID NO: 301360 - DNA, 25 bp, Mus musculus
gcaaagacaagacagggtgttgacg

SEQ ID NO: 301361 - DNA, 25 bp, Mus musculus
gcaaagacaaggaggcagaagatgg

SEQ ID NO: 301362 - DNA, 25 bp, Mus musculus
gcaaagacaggagggagaaagagag

SEQ ID NO: 301363 - DNA, 25 bp, Mus musculus
gcaaagacctggaggattacctgtt

SEQ ID NO: 301364 - DNA, 25 bp, Mus musculus
gcaaagacggaaggactggaaatgg

SEQ ID NO: 301365 - DNA, 25 bp, Mus musculus
gcaaagactggcggaggccaggctc

SEQ ID NO: 301366 - DNA, 25 bp, Mus musculus
gcaaagagaaagaaaaatttcctat

SEQ ID NO: 301367 - DNA, 25 bp, Mus musculus
gcaaagagaaagggaaaaactctca

SEQ ID NO: 301368 - DNA, 25 bp, Mus musculus
gcaaagagaacttggtctctgggcc

SEQ ID NO: 301369 - DNA, 25 bp, Mus musculus
gcaaagagatggagtcatgcacttc

SEQ ID NO: 301370 - DNA, 25 bp, Mus musculus
gcaaagagcttgagttcatcacgct

SEQ ID NO: 301371 - DNA, 25 bp, Mus musculus
gcaaagaggaaaagagtgtttgagc

SEQ ID NO: 301372 - DNA, 25 bp, Mus musculus
gcaaagaggaaaggagttctctgaa

SEQ ID NO: 301373 - DNA, 25 bp, Mus musculus
gcaaagaggaacagagtgtttgagc

SEQ ID NO: 301374 - DNA, 25 bp, Mus musculus
gcaaagaggtgcaggcggctggagg

SEQ ID NO: 301375 - DNA, 25 bp, Mus musculus
gcaaagaggtgcaggctggttcgag

SEQ ID NO: 301376 - DNA, 25 bp, Mus musculus
gcaaagagtcagacatttacattgt

SEQ ID NO: 301377 - DNA, 25 bp, Mus musculus
gcaaagagtgagttggcttcagctg

SEQ ID NO: 301378 - DNA, 25 bp, Mus musculus
gcaaagatacccaagagccagaaac

SEQ ID NO: 301379 - DNA, 25 bp, Mus musculus
gcaaagatccagacaaggagggcat

SEQ ID NO: 301380 - DNA, 25 bp, Mus musculus
gcaaagatgtacagctgggtccttg

SEQ ID NO: 301381 - DNA, 25 bp, Mus musculus
gcaaagatgtacaggggtggcaaaa

SEQ ID NO: 301382 - DNA, 25 bp, Mus musculus
gcaaagatgtcagtgctctcttccc

SEQ ID NO: 301383 - DNA, 25 bp, Mus musculus
gcaaagattgtgtgctgttccacct

SEQ ID NO: 301384 - DNA, 25 bp, Mus musculus
gcaaagcaacaggtttcagatagaa

SEQ ID NO: 301385 - DNA, 25 bp, Mus musculus
gcaaagcaagagattcgagtaagag

SEQ ID NO: 301386 - DNA, 25 bp, Mus musculus
gcaaagcagagacggtaacacggtt

SEQ ID NO: 301387 - DNA, 25 bp, Mus musculus
gcaaagcagcaaataaccacatttt

SEQ ID NO: 301388 - DNA, 25 bp, Mus musculus
gcaaagcagcaatcccatatgacaa

SEQ ID NO: 301389 - DNA, 25 bp, Mus musculus
gcaaagcattagaagtcttcccaga

SEQ ID NO: 301390 - DNA, 25 bp, Mus musculus
gcaaagccaagatctccaagccagc

SEQ ID NO: 301391 - DNA, 25 bp, Mus musculus
gcaaagccaagatgtttgaagctag

SEQ ID NO: 301392 - DNA, 25 bp, Mus musculus
gcaaagccacaagtgcctccaaaac

SEQ ID NO: 301393 - DNA, 25 bp, Mus musculus
gcaaagccgaagagtgtaggcttgt

SEQ ID NO: 301394 - DNA, 25 bp, Mus musculus
gcaaagccggctccagccacaatga

SEQ ID NO: 301395 - DNA, 25 bp, Mus musculus
gcaaagcgaggcagttgttctccat

SEQ ID NO: 301396 - DNA, 25 bp, Mus musculus
gcaaagcgtagaatgagaagacttt

SEQ ID NO: 301397 - DNA, 25 bp, Mus musculus
gcaaagcgtagcttcatactaggga

SEQ ID NO: 301398 - DNA, 25 bp, Mus musculus
gcaaagcgtagcttgaagtcaatgg

SEQ ID NO: 301399 - DNA, 25 bp, Mus musculus
gcaaagcgtctggcagcagaagatg

SEQ ID NO: 301400 - DNA, 25 bp, Mus musculus
gcaaagctagacaagttggatggct

SEQ ID NO: 301401 - DNA, 25 bp, Mus musculus
gcaaagctcaggaacggcgagaaga

SEQ ID NO: 301402 - DNA, 25 bp, Mus musculus
gcaaagctcaggctctcatgcagcc

SEQ ID NO: 301403 - DNA, 25 bp, Mus musculus
gcaaagctccacaggggatctttcc

SEQ ID NO: 301404 - DNA, 25 bp, Mus musculus
gcaaagctgaaggctccgagtacca

SEQ ID NO: 301405 - DNA, 25 bp, Mus musculus
gcaaagctgaccagaaggaaaagag

SEQ ID NO: 301406 - DNA, 25 bp, Mus musculus
gcaaagctttggagggctccactct

SEQ ID NO: 301407 - DNA, 25 bp, Mus musculus
gcaaaggaaacgatggatctgggga

SEQ ID NO: 301408 - DNA, 25 bp, Mus musculus
gcaaaggaaacggtgcctcctcctg

SEQ ID NO: 301409 - DNA, 25 bp, Mus musculus
gcaaaggaagatttgatgaaaaaga

SEQ ID NO: 301410 - DNA, 25 bp, Mus musculus
gcaaaggaagccaagatttctcagc

SEQ ID NO: 301411 - DNA, 25 bp, Mus musculus
gcaaaggaagctcaatgacagtcac

SEQ ID NO: 301412 - DNA, 25 bp, Mus musculus
gcaaaggactgtggtcaatgtgcgg

SEQ ID NO: 301413 - DNA, 25 bp, Mus musculus
gcaaaggatctagatgagaatgaag

SEQ ID NO: 301414 - DNA, 25 bp, Mus musculus
gcaaaggcaaagactctgagcagga

SEQ ID NO: 301415 - DNA, 25 bp, Mus musculus
gcaaaggcagacgtattgcagactg

SEQ ID NO: 301416 - DNA, 25 bp, Mus musculus
gcaaaggcatcatggctcacctgtg

SEQ ID NO: 301417 - DNA, 25 bp, Mus musculus
gcaaaggccctggggaatgtatcat

SEQ ID NO: 301418 - DNA, 25 bp, Mus musculus
gcaaaggcctaacatttggaaggct

SEQ ID NO: 301419 - DNA, 25 bp, Mus musculus
gcaaaggcctaacctccaaaagtat

SEQ ID NO: 301420 - DNA, 25 bp, Mus musculus
gcaaaggcctgaatcaggtctgctg

SEQ ID NO: 301421 - DNA, 25 bp, Mus musculus
gcaaaggcttttggggcaggggctg

SEQ ID NO: 301422 - DNA, 25 bp, Mus musculus
gcaaaggcttttggggctgactttg

SEQ ID NO: 301423 - DNA, 25 bp, Mus musculus
gcaaagggagcttggcatggatccc

SEQ ID NO: 301424 - DNA, 25 bp, Mus musculus
gcaaagggcaagaccaaaaacctca

SEQ ID NO: 301425 - DNA, 25 bp, Mus musculus
gcaaaggtaaccagagcgagcaccg

SEQ ID NO: 301426 - DNA, 25 bp, Mus musculus
gcaaaggtgggttccagcactgctg

SEQ ID NO: 301427 - DNA, 25 bp, Mus musculus
gcaaaggtgtgccccagctcctggc

SEQ ID NO: 301428 - DNA, 25 bp, Mus musculus
gcaaagtaaaaacaaatataaagcc

SEQ ID NO: 301429 - DNA, 25 bp, Mus musculus
gcaaagtaatatctccatctctgtt

SEQ ID NO: 301430 - DNA, 25 bp, Mus musculus
gcaaagtacaggtgttgctggagga

SEQ ID NO: 301431 - DNA, 25 bp, Mus musculus
gcaaagtacgcaagatgaacactac

SEQ ID NO: 301432 - DNA, 25 bp, Mus musculus
gcaaagtatgatgatataagcttac

SEQ ID NO: 301433 - DNA, 25 bp, Mus musculus
gcaaagtgatagaaaagcttggctt

SEQ ID NO: 301434 - DNA, 25 bp, Mus musculus
gcaaagtgcagagatccgtggacag

SEQ ID NO: 301435 - DNA, 25 bp, Mus musculus
gcaaagtgcagaggattcctacgag

SEQ ID NO: 301436 - DNA, 25 bp, Mus musculus
gcaaagtgcagaggttcaaggcaac

SEQ ID NO: 301437 - DNA, 25 bp, Mus musculus
gcaaagtgctcaggaagtctaaagc

SEQ ID NO: 301438 - DNA, 25 bp, Mus musculus
gcaaagtggacagtcccaccgtcac

SEQ ID NO: 301439 - DNA, 25 bp, Mus musculus
gcaaagtggccaggagcttgcaagt

SEQ ID NO: 301440 - DNA, 25 bp, Mus musculus
gcaaataatcagagctgagggaata

SEQ ID NO: 301441 - DNA, 25 bp, Mus musculus
gcaaataatcagaggtatgccttca

SEQ ID NO: 301442 - DNA, 25 bp, Mus musculus
gcaaataccgtaggtggtcaactat

SEQ ID NO: 301443 - DNA, 25 bp, Mus musculus
gcaaatacttaacgtctcattcttg

SEQ ID NO: 301444 - DNA, 25 bp, Mus musculus
gcaaatagtgaaagtcctcaggact

SEQ ID NO: 301445 - DNA, 25 bp, Mus musculus
gcaaatatgaggagcaccagctagc

SEQ ID NO: 301446 - DNA, 25 bp, Mus musculus
gcaaatatgcaacacagatatgtag

SEQ ID NO: 301447 - DNA, 25 bp, Mus musculus
gcaaatatggttttgctgtacagag

SEQ ID NO: 301448 - DNA, 25 bp, Mus musculus
gcaaatcagaatgagttgcaagcac

SEQ ID NO: 301449 - DNA, 25 bp, Mus musculus
gcaaatccagaggatctctctcaac

SEQ ID NO: 301450 - DNA, 25 bp, Mus musculus
gcaaatccagaggtgaaaatccagg

SEQ ID NO: 301451 - DNA, 25 bp, Mus musculus
gcaaatcctagagagcctttccacg

SEQ ID NO: 301452 - DNA, 25 bp, Mus musculus
gcaaatccttcctgaaacttcatgg

SEQ ID NO: 301453 - DNA, 25 bp, Mus musculus
gcaaatcggggcggtgtgaatgaca

SEQ ID NO: 301454 - DNA, 25 bp, Mus musculus
gcaaatctgtcaggtatacagatat

SEQ ID NO: 301455 - DNA, 25 bp, Mus musculus
gcaaatgaaattggacaggtccttc

SEQ ID NO: 301456 - DNA, 25 bp, Mus musculus
gcaaatgaacaagctgagtatgagt

SEQ ID NO: 301457 - DNA, 25 bp, Mus musculus
gcaaatgagggcgaacagctaatcc

SEQ ID NO: 301458 - DNA, 25 bp, Mus musculus
gcaaatgattcggatatcaggatag

SEQ ID NO: 301459 - DNA, 25 bp, Mus musculus
gcaaatgattcgtccaaggcggttg

SEQ ID NO: 301460 - DNA, 25 bp, Mus musculus
gcaaatgcacccaaattaaaacggc

SEQ ID NO: 301461 - DNA, 25 bp, Mus musculus
gcaaatgcgaagggtatgtcggaga

SEQ ID NO: 301462 - DNA, 25 bp, Mus musculus
gcaaatgcgaagtgtgcaagtatgt

SEQ ID NO: 301463 - DNA, 25 bp, Mus musculus
gcaaatgctggaactgcagcagttg

SEQ ID NO: 301464 - DNA, 25 bp, Mus musculus
gcaaatggaaggaaacttcatggct

SEQ ID NO: 301465 - DNA, 25 bp, Mus musculus
gcaaatggaggaaaggttacagcag

SEQ ID NO: 301466 - DNA, 25 bp, Mus musculus
gcaaatggatccttgctaatttgaa

SEQ ID NO: 301467 - DNA, 25 bp, Mus musculus
gcaaatggcgaaagtcctaggtggg

SEQ ID NO: 301468 - DNA, 25 bp, Mus musculus
gcaaatgtcagccatgcaagtgcaa

SEQ ID NO: 301469 - DNA, 25 bp, Mus musculus
gcaaatgtcccaggccgctagtcag

SEQ ID NO: 301470 - DNA, 25 bp, Mus musculus
gcaaatgtcccagggcggcaatctg

SEQ ID NO: 301471 - DNA, 25 bp, Mus musculus
gcaaatgtccctccacctcctggca

SEQ ID NO: 301472 - DNA, 25 bp, Mus musculus
gcaaatgtgaaacgctaccattgtg

SEQ ID NO: 301473 - DNA, 25 bp, Mus musculus
gcaaatgtgaaaggctaccttggac

SEQ ID NO: 301474 - DNA, 25 bp, Mus musculus
gcaaatgtgaaaggctggcacagaa

SEQ ID NO: 301475 - DNA, 25 bp, Mus musculus
gcaaatgtgagaatgaaactttgct

SEQ ID NO: 301476 - DNA, 25 bp, Mus musculus
gcaaatgtgagttgtctgttgatgg

SEQ ID NO: 301477 - DNA, 25 bp, Mus musculus
gcaaattaacagagtgtccaagcac

SEQ ID NO: 301478 - DNA, 25 bp, Mus musculus
gcaaattacctgagcacccagttga

SEQ ID NO: 301479 - DNA, 25 bp, Mus musculus
gcaaattcagatataaaaagatctt

SEQ ID NO: 301480 - DNA, 25 bp, Mus musculus
gcaaattcagctaataattttcaag

SEQ ID NO: 301481 - DNA, 25 bp, Mus musculus
gcaaattccaccccggccccagctg

SEQ ID NO: 301482 - DNA, 25 bp, Mus musculus
gcaaattcccaggtgaagcctttga

SEQ ID NO: 301483 - DNA, 25 bp, Mus musculus
gcaaattgacaaccaatatcagtct

SEQ ID NO: 301484 - DNA, 25 bp, Mus musculus
gcaaattgacaaccagacacgcata

SEQ ID NO: 301485 - DNA, 25 bp, Mus musculus
gcaaattggctgagctccccttggc

SEQ ID NO: 301486 - DNA, 25 bp, Mus musculus
gcaaatttacagagcagcatggccc

SEQ ID NO: 301487 - DNA, 25 bp, Mus musculus
gcaaatttccagaaatcaacactat

SEQ ID NO: 301488 - DNA, 25 bp, Mus musculus
gcaaatttccagggctatgtgcttc

SEQ ID NO: 301489 - DNA, 25 bp, Mus musculus
gcaaattttggtgctggggacattg

SEQ ID NO: 301490 - DNA, 25 bp, Mus musculus
gcaacaaacaattcctccatctgct

SEQ ID NO: 301491 - DNA, 25 bp, Mus musculus
gcaacaacaagggaagtactccgca

SEQ ID NO: 301492 - DNA, 25 bp, Mus musculus
gcaacaacaagggagctcactcagt

SEQ ID NO: 301493 - DNA, 25 bp, Mus musculus
gcaacaacagccatgggttctccga

SEQ ID NO: 301494 - DNA, 25 bp, Mus musculus
gcaacaacaggtgactgtggtctgc

SEQ ID NO: 301495 - DNA, 25 bp, Mus musculus
gcaacaaccttgaccttattcaatc

SEQ ID NO: 301496 - DNA, 25 bp, Mus musculus
gcaacaagaaggtgacactggccaa

SEQ ID NO: 301497 - DNA, 25 bp, Mus musculus
gcaacaatactcagggaggagactc

SEQ ID NO: 301498 - DNA, 25 bp, Mus musculus
gcaacaatagaattttcatttcttc

SEQ ID NO: 301499 - DNA, 25 bp, Mus musculus
gcaacaataggtgttgactttaagg

SEQ ID NO: 301500 - DNA, 25 bp, Mus musculus
gcaacaatgcaggggttgacaactt

SEQ ID NO: 301501 - DNA, 25 bp, Mus musculus
gcaacaatgtgacagtccatatgtt

SEQ ID NO: 301502 - DNA, 25 bp, Mus musculus
gcaacacaagatttccacccagata

SEQ ID NO: 301503 - DNA, 25 bp, Mus musculus
gcaacacaaggaggcatggtccagg

SEQ ID NO: 301504 - DNA, 25 bp, Mus musculus
gcaacacaaggctgtgtctctccat

SEQ ID NO: 301505 - DNA, 25 bp, Mus musculus
gcaacacatctgctctcctctgatg

SEQ ID NO: 301506 - DNA, 25 bp, Mus musculus
gcaacaccctgggaaatgtgtgtct

SEQ ID NO: 301507 - DNA, 25 bp, Mus musculus
gcaacaccctgggcattggggcttt

SEQ ID NO: 301508 - DNA, 25 bp, Mus musculus
gcaacaccctgggttttagatgcct

SEQ ID NO: 301509 - DNA, 25 bp, Mus musculus
gcaacacctcgaaggaatggaagaa

SEQ ID NO: 301510 - DNA, 25 bp, Mus musculus
gcaacacctcgaaggtacacaactg

SEQ ID NO: 301511 - DNA, 25 bp, Mus musculus
gcaacacctctactgccgcccacgg

SEQ ID NO: 301512 - DNA, 25 bp, Mus musculus
gcaacacgccctgaaccgcttgggt

SEQ ID NO: 301513 - DNA, 25 bp, Mus musculus
gcaacactcaaagattgacatggta

SEQ ID NO: 301514 - DNA, 25 bp, Mus musculus
gcaacactcaaaggagttgcaagca

SEQ ID NO: 301515 - DNA, 25 bp, Mus musculus
gcaacactggccggacccacattgt

SEQ ID NO: 301516 - DNA, 25 bp, Mus musculus
gcaacactgggtaacctccgtgctt

SEQ ID NO: 301517 - DNA, 25 bp, Mus musculus
gcaacagaatatcacatacacaaaa

SEQ ID NO: 301518 - DNA, 25 bp, Mus musculus
gcaacagaatatcagatacacaaaa

SEQ ID NO: 301519 - DNA, 25 bp, Mus musculus
gcaacagagagaaggcttcgtgagc

SEQ ID NO: 301520 - DNA, 25 bp, Mus musculus
gcaacagagagaagggcccgagggc

SEQ ID NO: 301521 - DNA, 25 bp, Mus musculus
gcaacagagtggatcacattccagg

SEQ ID NO: 301522 - DNA, 25 bp, Mus musculus
gcaacagatccaggttcaggggcac

SEQ ID NO: 301523 - DNA, 25 bp, Mus musculus
gcaacagatgcgaacatgtggatga

SEQ ID NO: 301524 - DNA, 25 bp, Mus musculus
gcaacagatgcgaagatgtggatga

SEQ ID NO: 301525 - DNA, 25 bp, Mus musculus
gcaacagcaaggtgcacatgtatga

SEQ ID NO: 301526 - DNA, 25 bp, Mus musculus
gcaacagcaagtgctgacagtagag

SEQ ID NO: 301527 - DNA, 25 bp, Mus musculus
gcaacagcagcagtgtgaggatgac

SEQ ID NO: 301528 - DNA, 25 bp, Mus musculus
gcaacagcagcttcgagagctgtgc

SEQ ID NO: 301529 - DNA, 25 bp, Mus musculus
gcaacagcaggcccagcctgcagga

SEQ ID NO: 301530 - DNA, 25 bp, Mus musculus
gcaacagcagggttctggctgcttt

SEQ ID NO: 301531 - DNA, 25 bp, Mus musculus
gcaacagccatggcttctccatgat

SEQ ID NO: 301532 - DNA, 25 bp, Mus musculus
gcaacagcctgggcatatggcctcc

SEQ ID NO: 301533 - DNA, 25 bp, Mus musculus
gcaacagcgatggtgagaaggccac

SEQ ID NO: 301534 - DNA, 25 bp, Mus musculus
gcaacagcgcgggatgggggcacag

SEQ ID NO: 301535 - DNA, 25 bp, Mus musculus
gcaacaggaactttgcatcatgcct

SEQ ID NO: 301536 - DNA, 25 bp, Mus musculus
gcaacaggaggacttcaaggaggca

SEQ ID NO: 301537 - DNA, 25 bp, Mus musculus
gcaacaggccaggaaggaaaaacag

SEQ ID NO: 301538 - DNA, 25 bp, Mus musculus
gcaacaggctaggtgctggtgttga

SEQ ID NO: 301539 - DNA, 25 bp, Mus musculus
gcaacaggctaggttgcaggaagca

SEQ ID NO: 301540 - DNA, 25 bp, Mus musculus
gcaacaggcttaggtgccacattct

SEQ ID NO: 301541 - DNA, 25 bp, Mus musculus
gcaacaggtgtgaacaggttccacc

SEQ ID NO: 301542 - DNA, 25 bp, Mus musculus
gcaacagtaccctcggcgcttgttc

SEQ ID NO: 301543 - DNA, 25 bp, Mus musculus
gcaacagttggcatccagcattcgg

SEQ ID NO: 301544 - DNA, 25 bp, Mus musculus
gcaacagttgggttctccccaggga

SEQ ID NO: 301545 - DNA, 25 bp, Mus musculus
gcaacagttggtcccatgcatcatt

SEQ ID NO: 301546 - DNA, 25 bp, Mus musculus
gcaacatacaggttaccaaagtgac

SEQ ID NO: 301547 - DNA, 25 bp, Mus musculus
gcaacataccagaatccacacaggc

SEQ ID NO: 301548 - DNA, 25 bp, Mus musculus
gcaacataccagagtcctctgatgg

SEQ ID NO: 301549 - DNA, 25 bp, Mus musculus
gcaacatacgtgatggaccaagagt

SEQ ID NO: 301550 - DNA, 25 bp, Mus musculus
gcaacatcacagcaaagtctcgact

SEQ ID NO: 301551 - DNA, 25 bp, Mus musculus
gcaacatcacaggtggtagcaggaa

SEQ ID NO: 301552 - DNA, 25 bp, Mus musculus
gcaacatcacagttcatagccagag

SEQ ID NO: 301553 - DNA, 25 bp, Mus musculus
gcaacatcagaaagtgactcagacc

SEQ ID NO: 301554 - DNA, 25 bp, Mus musculus
gcaacatcagaattggaaaagtcag

SEQ ID NO: 301555 - DNA, 25 bp, Mus musculus
gcaacatcaggtctcggacaaaatg

SEQ ID NO: 301556 - DNA, 25 bp, Mus musculus
gcaacatcatcagacttgcgtgcgg

SEQ ID NO: 301557 - DNA, 25 bp, Mus musculus
gcaacatcatcagatagagactagc

SEQ ID NO: 301558 - DNA, 25 bp, Mus musculus
gcaacatcccagccaaagcaaaatc

SEQ ID NO: 301559 - DNA, 25 bp, Mus musculus
gcaacatccttcaagactgcaggca

SEQ ID NO: 301560 - DNA, 25 bp, Mus musculus
gcaacatccttcaaggtctgtgatt

SEQ ID NO: 301561 - DNA, 25 bp, Mus musculus
gcaacatgaaatgtgtctaaaccac

SEQ ID NO: 301562 - DNA, 25 bp, Mus musculus
gcaacatgaaggtcatgtaggaaat

SEQ ID NO: 301563 - DNA, 25 bp, Mus musculus
gcaacatgacatagatcctataagg

SEQ ID NO: 301564 - DNA, 25 bp, Mus musculus
gcaacatgacatagggtacatgtgg

SEQ ID NO: 301565 - DNA, 25 bp, Mus musculus
gcaacatgcacagcctatttaagag

SEQ ID NO: 301566 - DNA, 25 bp, Mus musculus
gcaacatgctcaagccaaaccaaca

SEQ ID NO: 301567 - DNA, 25 bp, Mus musculus
gcaacatggaagtgaaggatgcgaa

SEQ ID NO: 301568 - DNA, 25 bp, Mus musculus
gcaacatggcactgggtggtgaaag

SEQ ID NO: 301569 - DNA, 25 bp, Mus musculus
gcaacatggctgagcctttcagtgc

SEQ ID NO: 301570 - DNA, 25 bp, Mus musculus
gcaacatggctgagtgctacggagc

SEQ ID NO: 301571 - DNA, 25 bp, Mus musculus
gcaaccaaatcaagggccgatgatg

SEQ ID NO: 301572 - DNA, 25 bp, Mus musculus
gcaaccaaggagtcaaatattggag

SEQ ID NO: 301573 - DNA, 25 bp, Mus musculus
gcaaccacagaaggttatagaagct

SEQ ID NO: 301574 - DNA, 25 bp, Mus musculus
gcaaccacagggactggaaatggca

SEQ ID NO: 301575 - DNA, 25 bp, Mus musculus
gcaaccagagcacctgtctcctgtc

SEQ ID NO: 301576 - DNA, 25 bp, Mus musculus
gcaaccagcgaccagatgaccaatg

SEQ ID NO: 301577 - DNA, 25 bp, Mus musculus
gcaaccagcgaccagtcttgtgcca

SEQ ID NO: 301578 - DNA, 25 bp, Mus musculus
gcaaccaggcaccaggcaccaacag

SEQ ID NO: 301579 - DNA, 25 bp, Mus musculus
gcaaccagtgtgtggatgtggacga

SEQ ID NO: 301580 - DNA, 25 bp, Mus musculus
gcaaccagtgtgtggcccgccacct

SEQ ID NO: 301581 - DNA, 25 bp, Mus musculus
gcaacccacgcaagatggctgccag

SEQ ID NO: 301582 - DNA, 25 bp, Mus musculus
gcaacccagagaccttccccttgcg

SEQ ID NO: 301583 - DNA, 25 bp, Mus musculus
gcaacccatgagcatccaggtgatc

SEQ ID NO: 301584 - DNA, 25 bp, Mus musculus
gcaaccccaaatctgtgctgaagag

SEQ ID NO: 301585 - DNA, 25 bp, Mus musculus
gcaaccccagattccagaggggtga

SEQ ID NO: 301586 - DNA, 25 bp, Mus musculus
gcaaccccagcccgcacccggaaga

SEQ ID NO: 301587 - DNA, 25 bp, Mus musculus
gcaacccccggagtttcaagccaca

SEQ ID NO: 301588 - DNA, 25 bp, Mus musculus
gcaacccgaagcagaagcaggtatt

SEQ ID NO: 301589 - DNA, 25 bp, Mus musculus
gcaaccctccaacatattcgattct

SEQ ID NO: 301590 - DNA, 25 bp, Mus musculus
gcaaccctgataatggcagcccagc

SEQ ID NO: 301591 - DNA, 25 bp, Mus musculus
gcaaccctggagctgccgcagtggc

SEQ ID NO: 301592 - DNA, 25 bp, Mus musculus
gcaaccgaagctgacattatctcta

SEQ ID NO: 301593 - DNA, 25 bp, Mus musculus
gcaaccgcaggactactggtgccta

SEQ ID NO: 301594 - DNA, 25 bp, Mus musculus
gcaaccgcgccatggtctgccagga

SEQ ID NO: 301595 - DNA, 25 bp, Mus musculus
gcaaccgcgccatgtgatctcagcg

SEQ ID NO: 301596 - DNA, 25 bp, Mus musculus
gcaaccgtgcaggactagcctgaga

SEQ ID NO: 301597 - DNA, 25 bp, Mus musculus
gcaacctagccaagtgcattgttgg

SEQ ID NO: 301598 - DNA, 25 bp, Mus musculus
gcaacctcataaaggttgacctatc

SEQ ID NO: 301599 - DNA, 25 bp, Mus musculus
gcaacctcatacattaaagtgatgg

SEQ ID NO: 301600 - DNA, 25 bp, Mus musculus
gcaacctcatccctggcagcccctt

SEQ ID NO: 301601 - DNA, 25 bp, Mus musculus
gcaacctcatttccctgactgaaca

SEQ ID NO: 301602 - DNA, 25 bp, Mus musculus
gcaacctccaaagatggaaaagccg

SEQ ID NO: 301603 - DNA, 25 bp, Mus musculus
gcaacctccaagcctgaagggcacg

SEQ ID NO: 301604 - DNA, 25 bp, Mus musculus
gcaacctccaaggagtgtctaaaac

SEQ ID NO: 301605 - DNA, 25 bp, Mus musculus
gcaacctcttggaaaggtatgctga

SEQ ID NO: 301606 - DNA, 25 bp, Mus musculus
gcaacctgccgaataaggccagcag

SEQ ID NO: 301607 - DNA, 25 bp, Mus musculus
gcaacctgccgagaaacccttttga

SEQ ID NO: 301608 - DNA, 25 bp, Mus musculus
gcaacctgctgaatttgttggagct

SEQ ID NO: 301609 - DNA, 25 bp, Mus musculus
gcaacctgctggccgtggagactgc

SEQ ID NO: 301610 - DNA, 25 bp, Mus musculus
gcaaccttgacgcatcgtggctgag

SEQ ID NO: 301611 - DNA, 25 bp, Mus musculus
gcaacctttctagatgatttaagcc

SEQ ID NO: 301612 - DNA, 25 bp, Mus musculus
gcaacctttgacctgggaattcctc

SEQ ID NO: 301613 - DNA, 25 bp, Mus musculus
gcaacctttggtagagaccttttcc

SEQ ID NO: 301614 - DNA, 25 bp, Mus musculus
gcaacgaaagatgtgatacaaagct

SEQ ID NO: 301615 - DNA, 25 bp, Mus musculus
gcaacgaaagctcctgcaaagcagc

SEQ ID NO: 301616 - DNA, 25 bp, Mus musculus
gcaacgaaaggtctccgggcacaat

SEQ ID NO: 301617 - DNA, 25 bp, Mus musculus
gcaacgaatccttagtggccaatag

SEQ ID NO: 301618 - DNA, 25 bp, Mus musculus
gcaacgacccccagggagaggcaga

SEQ ID NO: 301619 - DNA, 25 bp, Mus musculus
gcaacgagcggaggaggtcccaggt

SEQ ID NO: 301620 - DNA, 25 bp, Mus musculus
gcaacgaggtgcactgccaacctag

SEQ ID NO: 301621 - DNA, 25 bp, Mus musculus
gcaacgagtgcaaggctgatataga

SEQ ID NO: 301622 - DNA, 25 bp, Mus musculus
gcaacgagtgcaaggtttgactttt

SEQ ID NO: 301623 - DNA, 25 bp, Mus musculus
gcaacgatagtatttttgacagtga

SEQ ID NO: 301624 - DNA, 25 bp, Mus musculus
gcaacgattcaagctcttgcttcta

SEQ ID NO: 301625 - DNA, 25 bp, Mus musculus
gcaacgattcaaggaggagccccga

SEQ ID NO: 301626 - DNA, 25 bp, Mus musculus
gcaacgcacgacgcagtggaagaac

SEQ ID NO: 301627 - DNA, 25 bp, Mus musculus
gcaacgccacttgaccaaatgtgat

SEQ ID NO: 301628 - DNA, 25 bp, Mus musculus
gcaacgcccagagagatgtcttcaa

SEQ ID NO: 301629 - DNA, 25 bp, Mus musculus
gcaacgcgtttgggtctcttacaaa

SEQ ID NO: 301630 - DNA, 25 bp, Mus musculus
gcaacgctaggttcggagcgaccgt

SEQ ID NO: 301631 - DNA, 25 bp, Mus musculus
gcaacgctgaagaagatcggtcagc

SEQ ID NO: 301632 - DNA, 25 bp, Mus musculus
gcaacgctgaagaagattcgccggt

SEQ ID NO: 301633 - DNA, 25 bp, Mus musculus
gcaacggacagctcggattctgaag

SEQ ID NO: 301634 - DNA, 25 bp, Mus musculus
gcaacggacaggagacctgaactat

SEQ ID NO: 301635 - DNA, 25 bp, Mus musculus
gcaacggcaaggtggttgctgtata

SEQ ID NO: 301636 - DNA, 25 bp, Mus musculus
gcaacggcagctggaaccaccatct

SEQ ID NO: 301637 - DNA, 25 bp, Mus musculus
gcaacggcagctggcctcctatgct

SEQ ID NO: 301638 - DNA, 25 bp, Mus musculus
gcaacggccccagaaattactgtgc

SEQ ID NO: 301639 - DNA, 25 bp, Mus musculus
gcaacggccccagaagctgactgcg

SEQ ID NO: 301640 - DNA, 25 bp, Mus musculus
gcaacggccctgattgaagatattt

SEQ ID NO: 301641 - DNA, 25 bp, Mus musculus
gcaacggcgcctcggctggacattg

SEQ ID NO: 301642 - DNA, 25 bp, Mus musculus
gcaacggcgcctcggtggagtctta

SEQ ID NO: 301643 - DNA, 25 bp, Mus musculus
gcaacggtgcggcagcgtgcttccg

SEQ ID NO: 301644 - DNA, 25 bp, Mus musculus
gcaacgtaatgcctcagttccactg

SEQ ID NO: 301645 - DNA, 25 bp, Mus musculus
gcaacgtcagggctacacatctttc

SEQ ID NO: 301646 - DNA, 25 bp, Mus musculus
gcaacgtcaggtaagaatgacaaca

SEQ ID NO: 301647 - DNA, 25 bp, Mus musculus
gcaacgtgatcaaaggtatgagggt

SEQ ID NO: 301648 - DNA, 25 bp, Mus musculus
gcaacgtgatggagctggtggggag

SEQ ID NO: 301649 - DNA, 25 bp, Mus musculus
gcaacgtggaaatacttcggatatc

SEQ ID NO: 301650 - DNA, 25 bp, Mus musculus
gcaacgtggggttgagactcacaca

SEQ ID NO: 301651 - DNA, 25 bp, Mus musculus
gcaacgtttccaggtatgagatgta

SEQ ID NO: 301652 - DNA, 25 bp, Mus musculus
gcaacgtttccagtgcaaacatact

SEQ ID NO: 301653 - DNA, 25 bp, Mus musculus
gcaactaaaatcagcaccgtgcgag

SEQ ID NO: 301654 - DNA, 25 bp, Mus musculus
gcaactacagccttgatgaccaccc

SEQ ID NO: 301655 - DNA, 25 bp, Mus musculus
gcaactactggcacgatcctcacca

SEQ ID NO: 301656 - DNA, 25 bp, Mus musculus
gcaactatcagcccttgtttcttct

SEQ ID NO: 301657 - DNA, 25 bp, Mus musculus
gcaactatcaggctcggaacttcct

SEQ ID NO: 301658 - DNA, 25 bp, Mus musculus
gcaactatgacgctgatttccaaag

SEQ ID NO: 301659 - DNA, 25 bp, Mus musculus
gcaactcaaggatggatgccctgag

SEQ ID NO: 301660 - DNA, 25 bp, Mus musculus
gcaactcaaggtaggtgtacatgac

SEQ ID NO: 301661 - DNA, 25 bp, Mus musculus
gcaactcaaggtcctttcccataac

SEQ ID NO: 301662 - DNA, 25 bp, Mus musculus
gcaactcaaggtctaaggtacaaat

SEQ ID NO: 301663 - DNA, 25 bp, Mus musculus
gcaactcagacaaagctaaaaatat

SEQ ID NO: 301664 - DNA, 25 bp, Mus musculus
gcaactccatctttggtctggctcc

SEQ ID NO: 301665 - DNA, 25 bp, Mus musculus
gcaactccgacatcgatcctgcagt

SEQ ID NO: 301666 - DNA, 25 bp, Mus musculus
gcaactccgacatcggcagacagac

SEQ ID NO: 301667 - DNA, 25 bp, Mus musculus
gcaactccgacatcgtgatccgggc

SEQ ID NO: 301668 - DNA, 25 bp, Mus musculus
gcaactccgagtttgtggggacatc

SEQ ID NO: 301669 - DNA, 25 bp, Mus musculus
gcaactcctatataagtaactttga

SEQ ID NO: 301670 - DNA, 25 bp, Mus musculus
gcaactccttatgaagtggcagtga

SEQ ID NO: 301671 - DNA, 25 bp, Mus musculus
gcaactcggacctggatgctaaaag

SEQ ID NO: 301672 - DNA, 25 bp, Mus musculus
gcaactcggacctggtcataagggc

SEQ ID NO: 301673 - DNA, 25 bp, Mus musculus
gcaactctcatgcacttcccagtca

SEQ ID NO: 301674 - DNA, 25 bp, Mus musculus
gcaactctcatgcagttcccagtca

SEQ ID NO: 301675 - DNA, 25 bp, Mus musculus
gcaactctgcggcacatggtgatga

SEQ ID NO: 301676 - DNA, 25 bp, Mus musculus
gcaactcttattgggctgtgcctaa

SEQ ID NO: 301677 - DNA, 25 bp, Mus musculus
gcaactcttattgttggaaatctac

SEQ ID NO: 301678 - DNA, 25 bp, Mus musculus
gcaactgaagactgtcactagatgc

SEQ ID NO: 301679 - DNA, 25 bp, Mus musculus
gcaactgacaagatttagccttcag

SEQ ID NO: 301680 - DNA, 25 bp, Mus musculus
gcaactgacaaggtattcatgctag

SEQ ID NO: 301681 - DNA, 25 bp, Mus musculus
gcaactgagaacaaagcaacaagca

SEQ ID NO: 301682 - DNA, 25 bp, Mus musculus
gcaactgagaacaaagcaacaataa

SEQ ID NO: 301683 - DNA, 25 bp, Mus musculus
gcaactgagaggggagcaaattttg

SEQ ID NO: 301684 - DNA, 25 bp, Mus musculus
gcaactgcagaacggatcgagcgtt

SEQ ID NO: 301685 - DNA, 25 bp, Mus musculus
gcaactgcagatgacctcctcctgg

SEQ ID NO: 301686 - DNA, 25 bp, Mus musculus
gcaactgcaggacagtctccgtaag

SEQ ID NO: 301687 - DNA, 25 bp, Mus musculus
gcaactgcaggtggaagagctgttg

SEQ ID NO: 301688 - DNA, 25 bp, Mus musculus
gcaactgccaagagtctgacagcaa

SEQ ID NO: 301689 - DNA, 25 bp, Mus musculus
gcaactgccaggagaatcccagtga

SEQ ID NO: 301690 - DNA, 25 bp, Mus musculus
gcaactggaatgaggccctgctccc

SEQ ID NO: 301691 - DNA, 25 bp, Mus musculus
gcaactggcaagcctctatggaagg

SEQ ID NO: 301692 - DNA, 25 bp, Mus musculus
gcaactggcaagtttacaggctggt

SEQ ID NO: 301693 - DNA, 25 bp, Mus musculus
gcaactgtagacctggccttccctc

SEQ ID NO: 301694 - DNA, 25 bp, Mus musculus
gcaactgtggaagattcttgacaag

SEQ ID NO: 301695 - DNA, 25 bp, Mus musculus
gcaactgtgtggacatcaacgaatg

SEQ ID NO: 301696 - DNA, 25 bp, Mus musculus
gcaacttacaggaagttgtgccagc

SEQ ID NO: 301697 - DNA, 25 bp, Mus musculus
gcaacttacaggaggttgtgccagc

SEQ ID NO: 301698 - DNA, 25 bp, Mus musculus
gcaacttaccagacttggtggttct

SEQ ID NO: 301699 - DNA, 25 bp, Mus musculus
gcaacttaccaggtggatcccactg

SEQ ID NO: 301700 - DNA, 25 bp, Mus musculus
gcaacttatccagatcacctcagca

SEQ ID NO: 301701 - DNA, 25 bp, Mus musculus
gcaacttcctttcacgtgactgact

SEQ ID NO: 301702 - DNA, 25 bp, Mus musculus
gcaacttcgtcgttccgccgccacc

SEQ ID NO: 301703 - DNA, 25 bp, Mus musculus
gcaacttcgtgcaggtgacccggtt

SEQ ID NO: 301704 - DNA, 25 bp, Mus musculus
gcaacttctagccctgctgtcctcc

SEQ ID NO: 301705 - DNA, 25 bp, Mus musculus
gcaacttgagagctttggatataca

SEQ ID NO: 301706 - DNA, 25 bp, Mus musculus
gcaactttaagatggagccagatcc

SEQ ID NO: 301707 - DNA, 25 bp, Mus musculus
gcaactttgcggagatgatgatgga

SEQ ID NO: 301708 - DNA, 25 bp, Mus musculus
gcaactttgcgggtgagatggattc

SEQ ID NO: 301709 - DNA, 25 bp, Mus musculus
gcaactttgtggacctctgcagggc

SEQ ID NO: 301710 - DNA, 25 bp, Mus musculus
gcaagaaaaagtctgatgccaacgc

SEQ ID NO: 301711 - DNA, 25 bp, Mus musculus
gcaagaaaagaaagaatgcgtccac

SEQ ID NO: 301712 - DNA, 25 bp, Mus musculus
gcaagaaaaggaaggaactcaagtt

SEQ ID NO: 301713 - DNA, 25 bp, Mus musculus
gcaagaaaaggactggacagactat

SEQ ID NO: 301714 - DNA, 25 bp, Mus musculus
gcaagaaaaggctcatgtgttttcc

SEQ ID NO: 301715 - DNA, 25 bp, Mus musculus
gcaagaaagcaaaagaggagtggtt

SEQ ID NO: 301716 - DNA, 25 bp, Mus musculus
gcaagaaagcaaaagggaagaagga

SEQ ID NO: 301717 - DNA, 25 bp, Mus musculus
gcaagaaagctcaggaagtggaggt

SEQ ID NO: 301718 - DNA, 25 bp, Mus musculus
gcaagaaatgggaaccccaacagtg

SEQ ID NO: 301719 - DNA, 25 bp, Mus musculus
gcaagaaatgtatatgcccccaagc

SEQ ID NO: 301720 - DNA, 25 bp, Mus musculus
gcaagaaatttgccgaggccttggg

SEQ ID NO: 301721 - DNA, 25 bp, Mus musculus
gcaagaaatttggtgtccagggaag

SEQ ID NO: 301722 - DNA, 25 bp, Mus musculus
gcaagaacaacgaagagcaagctga

SEQ ID NO: 301723 - DNA, 25 bp, Mus musculus
gcaagaacacatacagtgtcttcaa

SEQ ID NO: 301724 - DNA, 25 bp, Mus musculus
gcaagaacaccttcagtgagatgat

SEQ ID NO: 301725 - DNA, 25 bp, Mus musculus
gcaagaacactgtcttcaagatcca

SEQ ID NO: 301726 - DNA, 25 bp, Mus musculus
gcaagaaccggagacaatcaggctc

SEQ ID NO: 301727 - DNA, 25 bp, Mus musculus
gcaagaaccgttctcaagaaccctg

SEQ ID NO: 301728 - DNA, 25 bp, Mus musculus
gcaagaactccagtgtttcccgaga

SEQ ID NO: 301729 - DNA, 25 bp, Mus musculus
gcaagaagaaagagaagcagggtcc

SEQ ID NO: 301730 - DNA, 25 bp, Mus musculus
gcaagaagaacaaggatgtccccgt

SEQ ID NO: 301731 - DNA, 25 bp, Mus musculus
gcaagaagaagaaggtgccatcagc

SEQ ID NO: 301732 - DNA, 25 bp, Mus musculus
gcaagaagaagcaccccactggcta

SEQ ID NO: 301733 - DNA, 25 bp, Mus musculus
gcaagaaggaagcaggaggtgactt

SEQ ID NO: 301734 - DNA, 25 bp, Mus musculus
gcaagaaggaggaacaagaatttgt

SEQ ID NO: 301735 - DNA, 25 bp, Mus musculus
gcaagaaggaggttatgaatgaagt

SEQ ID NO: 301736 - DNA, 25 bp, Mus musculus
gcaagaaggtgaaagacactcgtaa

SEQ ID NO: 301737 - DNA, 25 bp, Mus musculus
gcaagaaggtgaaagtctcacacag

SEQ ID NO: 301738 - DNA, 25 bp, Mus musculus
gcaagaagtcctgccacactggggt

SEQ ID NO: 301739 - DNA, 25 bp, Mus musculus
gcaagaagtggaggcaggactctga

SEQ ID NO: 301740 - DNA, 25 bp, Mus musculus
gcaagaatacaggtatggttttcta

SEQ ID NO: 301741 - DNA, 25 bp, Mus musculus
gcaagaatatttaaaaacatatgac

SEQ ID NO: 301742 - DNA, 25 bp, Mus musculus
gcaagaatcaaacatttttaagaca

SEQ ID NO: 301743 - DNA, 25 bp, Mus musculus
gcaagaatctgaggcctgtgagaag

SEQ ID NO: 301744 - DNA, 25 bp, Mus musculus
gcaagaatgggataatactgtgaat

SEQ ID NO: 301745 - DNA, 25 bp, Mus musculus
gcaagaattaagtcagtggtgcagt

SEQ ID NO: 301746 - DNA, 25 bp, Mus musculus
gcaagaattgagagacatctcctgt

SEQ ID NO: 301747 - DNA, 25 bp, Mus musculus
gcaagacatacaggtgtaaggtctg

SEQ ID NO: 301748 - DNA, 25 bp, Mus musculus
gcaagacatgcagcctctatttaag

SEQ ID NO: 301749 - DNA, 25 bp, Mus musculus
gcaagacatgtaccagtgcttggtt

SEQ ID NO: 301750 - DNA, 25 bp, Mus musculus
gcaagaccaagatcaccgatgtgat

SEQ ID NO: 301751 - DNA, 25 bp, Mus musculus
gcaagaccacaacagcatgtagttc

SEQ ID NO: 301752 - DNA, 25 bp, Mus musculus
gcaagaccatgactggccaaaacac

SEQ ID NO: 301753 - DNA, 25 bp, Mus musculus
gcaagacccagatcctctcttctcc

SEQ ID NO: 301754 - DNA, 25 bp, Mus musculus
gcaagacccaggacctgttccgcag

SEQ ID NO: 301755 - DNA, 25 bp, Mus musculus
gcaagaccggcttctcctcggacca

SEQ ID NO: 301756 - DNA, 25 bp, Mus musculus
gcaagacctggccagtatattattc

SEQ ID NO: 301757 - DNA, 25 bp, Mus musculus
gcaagacgtcgtgtggcatgtgggc

SEQ ID NO: 301758 - DNA, 25 bp, Mus musculus
gcaagactaggtttgccagatctgc

SEQ ID NO: 301759 - DNA, 25 bp, Mus musculus
gcaagactgactccgtatgaggttg

SEQ ID NO: 301760 - DNA, 25 bp, Mus musculus
gcaagagaagagacactgcagcgga

SEQ ID NO: 301761 - DNA, 25 bp, Mus musculus
gcaagagacggaagaacgagccatg

SEQ ID NO: 301762 - DNA, 25 bp, Mus musculus
gcaagagagaaagaatctggaggtg

SEQ ID NO: 301763 - DNA, 25 bp, Mus musculus
gcaagagcaaaatgtttcaaatgta

SEQ ID NO: 301764 - DNA, 25 bp, Mus musculus
gcaagagcagtttgacaacttaaac

SEQ ID NO: 301765 - DNA, 25 bp, Mus musculus
gcaagagccagcagcagcagcagca

SEQ ID NO: 301766 - DNA, 25 bp, Mus musculus
gcaagagcgatgtggtatgccctga

SEQ ID NO: 301767 - DNA, 25 bp, Mus musculus
gcaagagcgatgtgtggtccttcgg

SEQ ID NO: 301768 - DNA, 25 bp, Mus musculus
gcaagagcgcagatctcccctagcc

SEQ ID NO: 301769 - DNA, 25 bp, Mus musculus
gcaagagcgcaggtccaacttcagt

SEQ ID NO: 301770 - DNA, 25 bp, Mus musculus
gcaagagctctcagcacgggggcgt

SEQ ID NO: 301771 - DNA, 25 bp, Mus musculus
gcaagagctctcaggtactgtactg

SEQ ID NO: 301772 - DNA, 25 bp, Mus musculus
gcaagagctctcaggttcctcagtg

SEQ ID NO: 301773 - DNA, 25 bp, Mus musculus
gcaagagctttctatccaaggagac

SEQ ID NO: 301774 - DNA, 25 bp, Mus musculus
gcaagaggagccatgaatgtatcat

SEQ ID NO: 301775 - DNA, 25 bp, Mus musculus
gcaagaggatgagatcgactggggt

SEQ ID NO: 301776 - DNA, 25 bp, Mus musculus
gcaagaggcaagacctggggatctg

SEQ ID NO: 301777 - DNA, 25 bp, Mus musculus
gcaagaggcacaggctcgaagcacc

SEQ ID NO: 301778 - DNA, 25 bp, Mus musculus
gcaagagtaatgaggactctctgat

SEQ ID NO: 301779 - DNA, 25 bp, Mus musculus
gcaagagtgagggtgatctgcaatt

SEQ ID NO: 301780 - DNA, 25 bp, Mus musculus
gcaagatacacggcatcatcgcaga

SEQ ID NO: 301781 - DNA, 25 bp, Mus musculus
gcaagatacagccctgctggtagct

SEQ ID NO: 301782 - DNA, 25 bp, Mus musculus
gcaagatactgggatctcgctggaa

SEQ ID NO: 301783 - DNA, 25 bp, Mus musculus
gcaagatactggggtctcactatgc

SEQ ID NO: 301784 - DNA, 25 bp, Mus musculus
gcaagatatggaggccaggaaacaa

SEQ ID NO: 301785 - DNA, 25 bp, Mus musculus
gcaagatcaaagcctcagcgttctc

SEQ ID NO: 301786 - DNA, 25 bp, Mus musculus
gcaagatcaagccccacctgatgag

SEQ ID NO: 301787 - DNA, 25 bp, Mus musculus
gcaagatcaaggcattatgttatca

SEQ ID NO: 301788 - DNA, 25 bp, Mus musculus
gcaagatcacttcaagtgggtaaag

SEQ ID NO: 301789 - DNA, 25 bp, Mus musculus
gcaagatccgagccttcatcctccc

SEQ ID NO: 301790 - DNA, 25 bp, Mus musculus
gcaagatcctgcttgagaaaagcac

SEQ ID NO: 301791 - DNA, 25 bp, Mus musculus
gcaagatctctgccaatccatagta

SEQ ID NO: 301792 - DNA, 25 bp, Mus musculus
gcaagatctctggcaatccatagta

SEQ ID NO: 301793 - DNA, 25 bp, Mus musculus
gcaagatctgcccagaggacgaggc

SEQ ID NO: 301794 - DNA, 25 bp, Mus musculus
gcaagatgaggagcctcagagacaa

SEQ ID NO: 301795 - DNA, 25 bp, Mus musculus
gcaagatgaggcagagaaggttgat

SEQ ID NO: 301796 - DNA, 25 bp, Mus musculus
gcaagatgcaggccccttcccagtg

SEQ ID NO: 301797 - DNA, 25 bp, Mus musculus
gcaagatgcgccagcgcactgccaa

SEQ ID NO: 301798 - DNA, 25 bp, Mus musculus
gcaagatgctaggcaagtcttggaa

SEQ ID NO: 301799 - DNA, 25 bp, Mus musculus
gcaagatggaagaaaatctgggttt

SEQ ID NO: 301800 - DNA, 25 bp, Mus musculus
gcaagatggaagggctctctaaata

SEQ ID NO: 301801 - DNA, 25 bp, Mus musculus
gcaagatgtggaaaaagccaaacct

SEQ ID NO: 301802 - DNA, 25 bp, Mus musculus
gcaagatgtggaaaaagccacaaat

SEQ ID NO: 301803 - DNA, 25 bp, Mus musculus
gcaagatgtggcaatccccagagag

SEQ ID NO: 301804 - DNA, 25 bp, Mus musculus
gcaagattaaagctaaggaatattg

SEQ ID NO: 301805 - DNA, 25 bp, Mus musculus
gcaagattaaaggaaccaatgaaga

SEQ ID NO: 301806 - DNA, 25 bp, Mus musculus
gcaagattgctccaagtaaggcccc

SEQ ID NO: 301807 - DNA, 25 bp, Mus musculus
gcaagatttggacgacagtgatcac

SEQ ID NO: 301808 - DNA, 25 bp, Mus musculus
gcaagcaagaacaaggatgagagcg

SEQ ID NO: 301809 - DNA, 25 bp, Mus musculus
gcaagcaagcagacttgtccttctc

SEQ ID NO: 301810 - DNA, 25 bp, Mus musculus
gcaagcaaggggaagggaggagcat

SEQ ID NO: 301811 - DNA, 25 bp, Mus musculus
gcaagcaatacaaagcttcaagaaa

SEQ ID NO: 301812 - DNA, 25 bp, Mus musculus
gcaagcaatacaaagtacctacgca

SEQ ID NO: 301813 - DNA, 25 bp, Mus musculus
gcaagcacagacaaagtggacacca

SEQ ID NO: 301814 - DNA, 25 bp, Mus musculus
gcaagcacatcgtatggcgcccaga

SEQ ID NO: 301815 - DNA, 25 bp, Mus musculus
gcaagcacgatctggagatgaaacc

SEQ ID NO: 301816 - DNA, 25 bp, Mus musculus
gcaagcacgatctggatatgatgaa

SEQ ID NO: 301817 - DNA, 25 bp, Mus musculus
gcaagcacgtggttgaagacttgat

SEQ ID NO: 301818 - DNA, 25 bp, Mus musculus
gcaagcactatcccgctcgggcaaa

SEQ ID NO: 301819 - DNA, 25 bp, Mus musculus
gcaagcagaacctggattcagatgg

SEQ ID NO: 301820 - DNA, 25 bp, Mus musculus
gcaagcagaacctgggggctaaact

SEQ ID NO: 301821 - DNA, 25 bp, Mus musculus
gcaagcagactaggaatctcgatct

SEQ ID NO: 301822 - DNA, 25 bp, Mus musculus
gcaagcagcaggagaaaaaaatgct

SEQ ID NO: 301823 - DNA, 25 bp, Mus musculus
gcaagcagcaggagacagtgacccg

SEQ ID NO: 301824 - DNA, 25 bp, Mus musculus
gcaagcagcaggagatgaggcccgc

SEQ ID NO: 301825 - DNA, 25 bp, Mus musculus
gcaagcagcaggggaccagcctcat

SEQ ID NO: 301826 - DNA, 25 bp, Mus musculus
gcaagcagcctccgaaagagcccag

SEQ ID NO: 301827 - DNA, 25 bp, Mus musculus
gcaagcaggaggcagacaaaaagtc

SEQ ID NO: 301828 - DNA, 25 bp, Mus musculus
gcaagcagtcccggctgagtttgaa

SEQ ID NO: 301829 - DNA, 25 bp, Mus musculus
gcaagcagtgggaacagcgcttctg

SEQ ID NO: 301830 - DNA, 25 bp, Mus musculus
gcaagcatccagagcaagaagagta

SEQ ID NO: 301831 - DNA, 25 bp, Mus musculus
gcaagcatccagggcttatcagagc

SEQ ID NO: 301832 - DNA, 25 bp, Mus musculus
gcaagcatcttctggtaaatccatt

SEQ ID NO: 301833 - DNA, 25 bp, Mus musculus
gcaagcattcagctccctgcccccc

SEQ ID NO: 301834 - DNA, 25 bp, Mus musculus
gcaagccaagcagtctctggtccca

SEQ ID NO: 301835 - DNA, 25 bp, Mus musculus
gcaagccaaggtgaaacttcagccc

SEQ ID NO: 301836 - DNA, 25 bp, Mus musculus
gcaagccaaggttacctctggaacc

SEQ ID NO: 301837 - DNA, 25 bp, Mus musculus
gcaagccacgagaggtgagggagtt

SEQ ID NO: 301838 - DNA, 25 bp, Mus musculus
gcaagccactgatgcttctctgcga

SEQ ID NO: 301839 - DNA, 25 bp, Mus musculus
gcaagccagaacagcaccgggttgt

SEQ ID NO: 301840 - DNA, 25 bp, Mus musculus
gcaagccagagggcacccacaaaac

SEQ ID NO: 301841 - DNA, 25 bp, Mus musculus
gcaagccagaggtgtttgggaacaa

SEQ ID NO: 301842 - DNA, 25 bp, Mus musculus
gcaagccaggacccacctgcacatc

SEQ ID NO: 301843 - DNA, 25 bp, Mus musculus
gcaagccaggtcccacctgcacatc

SEQ ID NO: 301844 - DNA, 25 bp, Mus musculus
gcaagccagtctggagttggtgtgg

SEQ ID NO: 301845 - DNA, 25 bp, Mus musculus
gcaagccatcagaaggagtgaaaag

SEQ ID NO: 301846 - DNA, 25 bp, Mus musculus
gcaagccatcaggaaatcccttgag

SEQ ID NO: 301847 - DNA, 25 bp, Mus musculus
gcaagccatctaagcccagagtgac

SEQ ID NO: 301848 - DNA, 25 bp, Mus musculus
gcaagcccaagtatgatcagggagt

SEQ ID NO: 301849 - DNA, 25 bp, Mus musculus
gcaagccccaagaggatgattattg

SEQ ID NO: 301850 - DNA, 25 bp, Mus musculus
gcaagcccctgccgacacccatcgg

SEQ ID NO: 301851 - DNA, 25 bp, Mus musculus
gcaagcccctgcgacacctgcggct

SEQ ID NO: 301852 - DNA, 25 bp, Mus musculus
gcaagccctgagcttgtcccactgt

SEQ ID NO: 301853 - DNA, 25 bp, Mus musculus
gcaagccctggctgcttttagaaat

SEQ ID NO: 301854 - DNA, 25 bp, Mus musculus
gcaagccctgtgagcactctgactc

SEQ ID NO: 301855 - DNA, 25 bp, Mus musculus
gcaagccctgtgaggacctggaacg

SEQ ID NO: 301856 - DNA, 25 bp, Mus musculus
gcaagccctgtgaggttgaacttcc

SEQ ID NO: 301857 - DNA, 25 bp, Mus musculus
gcaagccgggaagcctatcctctac

SEQ ID NO: 301858 - DNA, 25 bp, Mus musculus
gcaagccggtggcccagcctgcagc

SEQ ID NO: 301859 - DNA, 25 bp, Mus musculus
gcaagcctcaagacgaaagtaggtg

SEQ ID NO: 301860 - DNA, 25 bp, Mus musculus
gcaagcctgagcctgaagagacttg

SEQ ID NO: 301861 - DNA, 25 bp, Mus musculus
gcaagccttcagaatctgggatact

SEQ ID NO: 301862 - DNA, 25 bp, Mus musculus
gcaagccttcagacacctagatgtt

SEQ ID NO: 301863 - DNA, 25 bp, Mus musculus
gcaagcgactccgattctgacagtg

SEQ ID NO: 301864 - DNA, 25 bp, Mus musculus
gcaagcgcaccagagaatccgtgac

SEQ ID NO: 301865 - DNA, 25 bp, Mus musculus
gcaagcgctgtgcaggggagcaccg

SEQ ID NO: 301866 - DNA, 25 bp, Mus musculus
gcaagcggccgaccttgcacttgac

SEQ ID NO: 301867 - DNA, 25 bp, Mus musculus
gcaagcggccggcttcctttctgac

SEQ ID NO: 301868 - DNA, 25 bp, Mus musculus
gcaagcgggtcaagttacagatttg

SEQ ID NO: 301869 - DNA, 25 bp, Mus musculus
gcaagcgtctaaagcttcaagttat

SEQ ID NO: 301870 - DNA, 25 bp, Mus musculus
gcaagcgtctaaaggaaattgatgg

SEQ ID NO: 301871 - DNA, 25 bp, Mus musculus
gcaagcgtttgcaggccatcgaaga

SEQ ID NO: 301872 - DNA, 25 bp, Mus musculus
gcaagctaacgcctactctgtatgt

SEQ ID NO: 301873 - DNA, 25 bp, Mus musculus
gcaagctagtgagcagtgggaagag

SEQ ID NO: 301874 - DNA, 25 bp, Mus musculus
gcaagctcaacaaggctctccagag

SEQ ID NO: 301875 - DNA, 25 bp, Mus musculus
gcaagctcagatgtatagactcacc

SEQ ID NO: 301876 - DNA, 25 bp, Mus musculus
gcaagctctccccgatggctcattg

SEQ ID NO: 301877 - DNA, 25 bp, Mus musculus
gcaagctctccccggattgacttgg

SEQ ID NO: 301878 - DNA, 25 bp, Mus musculus
gcaagctctccccgtctaaaagttg

SEQ ID NO: 301879 - DNA, 25 bp, Mus musculus
gcaagctctggaggttgctgaacga

SEQ ID NO: 301880 - DNA, 25 bp, Mus musculus
gcaagctgaagagagagagaagaca

SEQ ID NO: 301881 - DNA, 25 bp, Mus musculus
gcaagctgcaggttgcttctataac

SEQ ID NO: 301882 - DNA, 25 bp, Mus musculus
gcaagctgctcgactggctggtgga

SEQ ID NO: 301883 - DNA, 25 bp, Mus musculus
gcaagctggaagaagagacttttca

SEQ ID NO: 301884 - DNA, 25 bp, Mus musculus
gcaagctggaagaagctgggagggc

SEQ ID NO: 301885 - DNA, 25 bp, Mus musculus
gcaagctggaagctgaaattaaaaa

SEQ ID NO: 301886 - DNA, 25 bp, Mus musculus
gcaagctggaaggggctgcagtgct

SEQ ID NO: 301887 - DNA, 25 bp, Mus musculus
gcaagctggtgaagagcatattccg

SEQ ID NO: 301888 - DNA, 25 bp, Mus musculus
gcaagcttccctgtttttagcaacc

SEQ ID NO: 301889 - DNA, 25 bp, Mus musculus
gcaagcttcggaggggaaaatggaa

SEQ ID NO: 301890 - DNA, 25 bp, Mus musculus
gcaagctttttagatgggagaccgt

SEQ ID NO: 301891 - DNA, 25 bp, Mus musculus
gcaaggaaaggctcctagaaggtga

SEQ ID NO: 301892 - DNA, 25 bp, Mus musculus
gcaaggaaatccggacatctatgac

SEQ ID NO: 301893 - DNA, 25 bp, Mus musculus
gcaaggaaatctgggtcttcggatc

SEQ ID NO: 301894 - DNA, 25 bp, Mus musculus
gcaaggaaccagaggaattctggaa

SEQ ID NO: 301895 - DNA, 25 bp, Mus musculus
gcaaggaagcagagatgcccggaac

SEQ ID NO: 301896 - DNA, 25 bp, Mus musculus
gcaaggaaggaatggtgagccttcc

SEQ ID NO: 301897 - DNA, 25 bp, Mus musculus
gcaaggaaggagaccggggaatcaa

SEQ ID NO: 301898 - DNA, 25 bp, Mus musculus
gcaaggaagtgggaggcagttctgc

SEQ ID NO: 301899 - DNA, 25 bp, Mus musculus
gcaaggaagtggtataatggccgga

SEQ ID NO: 301900 - DNA, 25 bp, Mus musculus
gcaaggacacagggtctcttacaaa

SEQ ID NO: 301901 - DNA, 25 bp, Mus musculus
gcaaggacagtactctcccatggct

SEQ ID NO: 301902 - DNA, 25 bp, Mus musculus
gcaaggacagtctcatgcttgcatg

SEQ ID NO: 301903 - DNA, 25 bp, Mus musculus
gcaaggacccaagcaaccgacgccg

SEQ ID NO: 301904 - DNA, 25 bp, Mus musculus
gcaaggacctactaagatcgagagc

SEQ ID NO: 301905 - DNA, 25 bp, Mus musculus
gcaaggacgaactcatcaagtagac

SEQ ID NO: 301906 - DNA, 25 bp, Mus musculus
gcaaggagaagctggtccctccagg

SEQ ID NO: 301907 - DNA, 25 bp, Mus musculus
gcaaggagaggtacaaaatgaagcc

SEQ ID NO: 301908 - DNA, 25 bp, Mus musculus
gcaaggagatgctgtggggcctgta

SEQ ID NO: 301909 - DNA, 25 bp, Mus musculus
gcaaggagatggaatccaagtgaat

SEQ ID NO: 301910 - DNA, 25 bp, Mus musculus
gcaaggagatggtggggctgcgaca

SEQ ID NO: 301911 - DNA, 25 bp, Mus musculus
gcaaggagatgttgtctgtaggtgg

SEQ ID NO: 301912 - DNA, 25 bp, Mus musculus
gcaaggagcggcacatttgacctgc

SEQ ID NO: 301913 - DNA, 25 bp, Mus musculus
gcaaggagctagactctgaggacca

SEQ ID NO: 301914 - DNA, 25 bp, Mus musculus
gcaaggagctagactctgagtacag

SEQ ID NO: 301915 - DNA, 25 bp, Mus musculus
gcaaggagctgcaggagaagaggag

SEQ ID NO: 301916 - DNA, 25 bp, Mus musculus
gcaaggaggaggagggcagaaggct

SEQ ID NO: 301917 - DNA, 25 bp, Mus musculus
gcaaggaggaggagtcaagttggac

SEQ ID NO: 301918 - DNA, 25 bp, Mus musculus
gcaaggaggagtcatctctcatgga

SEQ ID NO: 301919 - DNA, 25 bp, Mus musculus
gcaaggaggagtgttgagtggagac

SEQ ID NO: 301920 - DNA, 25 bp, Mus musculus
gcaaggagttgaaagattcccccac

SEQ ID NO: 301921 - DNA, 25 bp, Mus musculus
gcaaggagttgaaaggagtgagcag

SEQ ID NO: 301922 - DNA, 25 bp, Mus musculus
gcaaggatagcatccatgtcttaca

SEQ ID NO: 301923 - DNA, 25 bp, Mus musculus
gcaaggatagggagcgcctcatcta

SEQ ID NO: 301924 - DNA, 25 bp, Mus musculus
gcaaggatggtgagctccctgtgga

SEQ ID NO: 301925 - DNA, 25 bp, Mus musculus
gcaaggattccagccccagtctctg

SEQ ID NO: 301926 - DNA, 25 bp, Mus musculus
gcaaggcaaagtttgaaactgctct

SEQ ID NO: 301927 - DNA, 25 bp, Mus musculus
gcaaggcaaatctcatataaaacag

SEQ ID NO: 301928 - DNA, 25 bp, Mus musculus
gcaaggcaagaggaagaatacaaaa

SEQ ID NO: 301929 - DNA, 25 bp, Mus musculus
gcaaggcaagtacccagtggattgg

SEQ ID NO: 301930 - DNA, 25 bp, Mus musculus
gcaaggcaatacgtgtcatagaatg

SEQ ID NO: 301931 - DNA, 25 bp, Mus musculus
gcaaggcatggaactcagtggctcc

SEQ ID NO: 301932 - DNA, 25 bp, Mus musculus
gcaaggcatggcccagttcaatttg

SEQ ID NO: 301933 - DNA, 25 bp, Mus musculus
gcaaggccaagagcacggacgagca

SEQ ID NO: 301934 - DNA, 25 bp, Mus musculus
gcaaggccaagctattacaagccag

SEQ ID NO: 301935 - DNA, 25 bp, Mus musculus
gcaaggccagatgctgaaattaccc

SEQ ID NO: 301936 - DNA, 25 bp, Mus musculus
gcaaggccagatggatgctgttcga

SEQ ID NO: 301937 - DNA, 25 bp, Mus musculus
gcaaggccagatgtgatgctgttgt

SEQ ID NO: 301938 - DNA, 25 bp, Mus musculus
gcaaggccaggaggaagaaaattat

SEQ ID NO: 301939 - DNA, 25 bp, Mus musculus
gcaaggccaggaggaggacccaggt

SEQ ID NO: 301940 - DNA, 25 bp, Mus musculus
gcaaggccaggcggaaaaagtggat

SEQ ID NO: 301941 - DNA, 25 bp, Mus musculus
gcaaggccaggcggaaggtgatgtt

SEQ ID NO: 301942 - DNA, 25 bp, Mus musculus
gcaaggccagtggatgcgcctatgt

SEQ ID NO: 301943 - DNA, 25 bp, Mus musculus
gcaaggcccatgtcttccctacacc

SEQ ID NO: 301944 - DNA, 25 bp, Mus musculus
gcaaggccccagccaagccgcaatg

SEQ ID NO: 301945 - DNA, 25 bp, Mus musculus
gcaaggccctagcagatgaaaaacg

SEQ ID NO: 301946 - DNA, 25 bp, Mus musculus
gcaaggccggcatcgccgcttacaa

SEQ ID NO: 301947 - DNA, 25 bp, Mus musculus
gcaaggcctcaagttgggatatcta

SEQ ID NO: 301948 - DNA, 25 bp, Mus musculus
gcaaggcctcgaaccgccgtccctc

SEQ ID NO: 301949 - DNA, 25 bp, Mus musculus
gcaaggcctcgtcattgtgacagaa

SEQ ID NO: 301950 - DNA, 25 bp, Mus musculus
gcaaggcctggacgaaaaccacgag

SEQ ID NO: 301951 - DNA, 25 bp, Mus musculus
gcaaggcctggacgacgctgagcag

SEQ ID NO: 301952 - DNA, 25 bp, Mus musculus
gcaaggcgagagggtatcccaggag

SEQ ID NO: 301953 - DNA, 25 bp, Mus musculus
gcaaggcgcaccgcaaagatgtgaa

SEQ ID NO: 301954 - DNA, 25 bp, Mus musculus
gcaaggcggtggggtaagtgtggac

SEQ ID NO: 301955 - DNA, 25 bp, Mus musculus
gcaaggctacggaggctatggggca

SEQ ID NO: 301956 - DNA, 25 bp, Mus musculus
gcaaggctggagcggaagggtttgt

SEQ ID NO: 301957 - DNA, 25 bp, Mus musculus
gcaaggctgtgtatacagttttgca

SEQ ID NO: 301958 - DNA, 25 bp, Mus musculus
gcaagggaacccaaggcctggcaga

SEQ ID NO: 301959 - DNA, 25 bp, Mus musculus
gcaagggatacccggcgtaatctca

SEQ ID NO: 301960 - DNA, 25 bp, Mus musculus
gcaagggcaagggttcttggcccag

SEQ ID NO: 301961 - DNA, 25 bp, Mus musculus
gcaagggcaaggtgctggctcagca

SEQ ID NO: 301962 - DNA, 25 bp, Mus musculus
gcaagggcaggactcctttacactt

SEQ ID NO: 301963 - DNA, 25 bp, Mus musculus
gcaaggggagactggccaatcacaa

SEQ ID NO: 301964 - DNA, 25 bp, Mus musculus
gcaagggttcacaggcacactggca

SEQ ID NO: 301965 - DNA, 25 bp, Mus musculus
gcaaggtaagctctgaggatgagga

SEQ ID NO: 301966 - DNA, 25 bp, Mus musculus
gcaaggtcaggacccagctgtggct

SEQ ID NO: 301967 - DNA, 25 bp, Mus musculus
gcaaggtgaccagggtattcctggt

SEQ ID NO: 301968 - DNA, 25 bp, Mus musculus
gcaaggtgacctgtgacatccggct

SEQ ID NO: 301969 - DNA, 25 bp, Mus musculus
gcaaggtgacctgtgatggggaaac

SEQ ID NO: 301970 - DNA, 25 bp, Mus musculus
gcaaggtgaggagtactgaaccttc

SEQ ID NO: 301971 - DNA, 25 bp, Mus musculus
gcaaggttcctgccgctaacgtcct

SEQ ID NO: 301972 - DNA, 25 bp, Mus musculus
gcaaggttgcagcacgcagcagaac

SEQ ID NO: 301973 - DNA, 25 bp, Mus musculus
gcaagtaatcggagaggtattcttg

SEQ ID NO: 301974 - DNA, 25 bp, Mus musculus
gcaagtaatcggtggcaattatgga

SEQ ID NO: 301975 - DNA, 25 bp, Mus musculus
gcaagtacactcaggctgaagctct

SEQ ID NO: 301976 - DNA, 25 bp, Mus musculus
gcaagtacactcaggctgagggtaa

SEQ ID NO: 301977 - DNA, 25 bp, Mus musculus
gcaagtacctggcttcctgtgtcca

SEQ ID NO: 301978 - DNA, 25 bp, Mus musculus
gcaagtacctggtctggtcactcga

SEQ ID NO: 301979 - DNA, 25 bp, Mus musculus
gcaagtaccttgggatcagagggct

SEQ ID NO: 301980 - DNA, 25 bp, Mus musculus
gcaagtaccttgggggccggcacat

SEQ ID NO: 301981 - DNA, 25 bp, Mus musculus
gcaagtagctgatattgacgggcag

SEQ ID NO: 301982 - DNA, 25 bp, Mus musculus
gcaagtataggacaacctcaagtct

SEQ ID NO: 301983 - DNA, 25 bp, Mus musculus
gcaagtattaccgtaataaaagagc

SEQ ID NO: 301984 - DNA, 25 bp, Mus musculus
gcaagtcaatcaggcgacggtgtgg

SEQ ID NO: 301985 - DNA, 25 bp, Mus musculus
gcaagtcagaaggcttcggagttgg

SEQ ID NO: 301986 - DNA, 25 bp, Mus musculus
gcaagtcagaagttttggggttaca

SEQ ID NO: 301987 - DNA, 25 bp, Mus musculus
gcaagtcatgtcattgtgcttcttc

SEQ ID NO: 301988 - DNA, 25 bp, Mus musculus
gcaagtccagcctgctcctgaggtt

SEQ ID NO: 301989 - DNA, 25 bp, Mus musculus
gcaagtccctcagggtgatgtgaac

SEQ ID NO: 301990 - DNA, 25 bp, Mus musculus
gcaagtccttcagagaaacagcagc

SEQ ID NO: 301991 - DNA, 25 bp, Mus musculus
gcaagtcgaaaagatatcccctgta

SEQ ID NO: 301992 - DNA, 25 bp, Mus musculus
gcaagtctccaggtgctgctgggga

SEQ ID NO: 301993 - DNA, 25 bp, Mus musculus
gcaagtgagtccgatgccttacggt

SEQ ID NO: 301994 - DNA, 25 bp, Mus musculus
gcaagtgagtccgcaccttcagggt

SEQ ID NO: 301995 - DNA, 25 bp, Mus musculus
gcaagtgagtgacagagcctccagg

SEQ ID NO: 301996 - DNA, 25 bp, Mus musculus
gcaagtgatggagactcagaaagcc

SEQ ID NO: 301997 - DNA, 25 bp, Mus musculus
gcaagtgcaagcaatagctgtctgc

SEQ ID NO: 301998 - DNA, 25 bp, Mus musculus
gcaagtgcaaggcaaaggcagagca

SEQ ID NO: 301999 - DNA, 25 bp, Mus musculus
gcaagtgcaaggtttctgaaagaca

SEQ ID NO: 302000 - DNA, 25 bp, Mus musculus
gcaagtgccaattcctgaatgccac

SEQ ID NO: 302001 - DNA, 25 bp, Mus musculus
gcaagtgctcaggaagactcttcaa

SEQ ID NO: 302002 - DNA, 25 bp, Mus musculus
gcaagtgctcaggaggccatgacac

SEQ ID NO: 302003 - DNA, 25 bp, Mus musculus
gcaagtgctccggccattccagctt

SEQ ID NO: 302004 - DNA, 25 bp, Mus musculus
gcaagtgctggaacacctgctgaag

SEQ ID NO: 302005 - DNA, 25 bp, Mus musculus
gcaagtggaccagcagcagcagcag

SEQ ID NO: 302006 - DNA, 25 bp, Mus musculus
gcaagtggaccaggactaccttatt

SEQ ID NO: 302007 - DNA, 25 bp, Mus musculus
gcaagtggaggatccattttctcaa

SEQ ID NO: 302008 - DNA, 25 bp, Mus musculus
gcaagtggaggtgaagtatttgact

SEQ ID NO: 302009 - DNA, 25 bp, Mus musculus
gcaagtggcaggattctgaatcagg

SEQ ID NO: 302010 - DNA, 25 bp, Mus musculus
gcaagtggctgagtatctccagaca

SEQ ID NO: 302011 - DNA, 25 bp, Mus musculus
gcaagtgggagaatccacctcattg

SEQ ID NO: 302012 - DNA, 25 bp, Mus musculus
gcaagtggtccctgagttcgtcaat

SEQ ID NO: 302013 - DNA, 25 bp, Mus musculus
gcaagtgtctgaacgagaagaactt

SEQ ID NO: 302014 - DNA, 25 bp, Mus musculus
gcaagtgttcaaagggctgaacgac

SEQ ID NO: 302015 - DNA, 25 bp, Mus musculus
gcaagttaaaaggaacttctgcagg

SEQ ID NO: 302016 - DNA, 25 bp, Mus musculus
gcaagttaactgctcttcagggcaa

SEQ ID NO: 302017 - DNA, 25 bp, Mus musculus
gcaagttcacagatgtgaccttgag

SEQ ID NO: 302018 - DNA, 25 bp, Mus musculus
gcaagttccagaacctgggtgtggt

SEQ ID NO: 302019 - DNA, 25 bp, Mus musculus
gcaagttcctatgtcacctccaagt

SEQ ID NO: 302020 - DNA, 25 bp, Mus musculus
gcaagttgtttaacggtagcgcctg

SEQ ID NO: 302021 - DNA, 25 bp, Mus musculus
gcaagtttgactggagacagcagta

SEQ ID NO: 302022 - DNA, 25 bp, Mus musculus
gcaagtttgactgggccatgccgct

SEQ ID NO: 302023 - DNA, 25 bp, Mus musculus
gcaataaactacagactccatgaat

SEQ ID NO: 302024 - DNA, 25 bp, Mus musculus
gcaataaatatgcttcatcttcagc

SEQ ID NO: 302025 - DNA, 25 bp, Mus musculus
gcaataacagtgactggtcctattt

SEQ ID NO: 302026 - DNA, 25 bp, Mus musculus
gcaataaggaacaggacggacggaa

SEQ ID NO: 302027 - DNA, 25 bp, Mus musculus
gcaataaggaacagtcagagctaag

SEQ ID NO: 302028 - DNA, 25 bp, Mus musculus
gcaataaggagaggatggctgtgct

SEQ ID NO: 302029 - DNA, 25 bp, Mus musculus
gcaataatctatagaccatggagca

SEQ ID NO: 302030 - DNA, 25 bp, Mus musculus
gcaataatctgaagaccatggagca

SEQ ID NO: 302031 - DNA, 25 bp, Mus musculus
gcaataatggaagtgggaagagtgc

SEQ ID NO: 302032 - DNA, 25 bp, Mus musculus
gcaatacaaagcttcaagaaaaatt

SEQ ID NO: 302033 - DNA, 25 bp, Mus musculus
gcaatacaaagtacctacgcatgct

SEQ ID NO: 302034 - DNA, 25 bp, Mus musculus
gcaataccaatagagggggctactg

SEQ ID NO: 302035 - DNA, 25 bp, Mus musculus
gcaataccaatatagggggctactg

SEQ ID NO: 302036 - DNA, 25 bp, Mus musculus
gcaataccctcacaaccccggctac

SEQ ID NO: 302037 - DNA, 25 bp, Mus musculus
gcaatacctggcgccagagcttctg

SEQ ID NO: 302038 - DNA, 25 bp, Mus musculus
gcaatacgctacacgactggcccag

SEQ ID NO: 302039 - DNA, 25 bp, Mus musculus
gcaatacgtgtcatagaatgtcgta

SEQ ID NO: 302040 - DNA, 25 bp, Mus musculus
gcaatataaggcacaatggaaggtc

SEQ ID NO: 302041 - DNA, 25 bp, Mus musculus
gcaatatcatgattgaccccgtcct

SEQ ID NO: 302042 - DNA, 25 bp, Mus musculus
gcaatatgactgaaacggcatggac

SEQ ID NO: 302043 - DNA, 25 bp, Mus musculus
gcaatatgactgcccgaagcctttc

SEQ ID NO: 302044 - DNA, 25 bp, Mus musculus
gcaatattaaagtaccaaccaaaaa

SEQ ID NO: 302045 - DNA, 25 bp, Mus musculus
gcaatatttttgaaggttaatatcc

SEQ ID NO: 302046 - DNA, 25 bp, Mus musculus
gcaatatttttgaagtatgcgagca

SEQ ID NO: 302047 - DNA, 25 bp, Mus musculus
gcaatcaaagcttatttccaaagaa

SEQ ID NO: 302048 - DNA, 25 bp, Mus musculus
gcaatcaaaggtgagacgacaagaa

SEQ ID NO: 302049 - DNA, 25 bp, Mus musculus
gcaatcaaagttgtcctggggaagg

SEQ ID NO: 302050 - DNA, 25 bp, Mus musculus
gcaatcacaggtggatacccttcgc

SEQ ID NO: 302051 - DNA, 25 bp, Mus musculus
gcaatcacatgtatgtctctgccct

SEQ ID NO: 302052 - DNA, 25 bp, Mus musculus
gcaatcactccccagccgtgggaat

SEQ ID NO: 302053 - DNA, 25 bp, Mus musculus
gcaatcagagaaaggtttaacatct

SEQ ID NO: 302054 - DNA, 25 bp, Mus musculus
gcaatcagcctgttgttgctcacca

SEQ ID NO: 302055 - DNA, 25 bp, Mus musculus
gcaatcatcaggagcaaagagccca

SEQ ID NO: 302056 - DNA, 25 bp, Mus musculus
gcaatcattcccaagaatctgggtg

SEQ ID NO: 302057 - DNA, 25 bp, Mus musculus
gcaatcattcccaagacaagcagta

SEQ ID NO: 302058 - DNA, 25 bp, Mus musculus
gcaatcattcccaagcatccagcgt

SEQ ID NO: 302059 - DNA, 25 bp, Mus musculus
gcaatccatgagatcagggcactga

SEQ ID NO: 302060 - DNA, 25 bp, Mus musculus
gcaatcccactgtgcaaactctggc

SEQ ID NO: 302061 - DNA, 25 bp, Mus musculus
gcaatcccatctgcttcgagagctg

SEQ ID NO: 302062 - DNA, 25 bp, Mus musculus
gcaatctatgattcctgtgttgaat

SEQ ID NO: 302063 - DNA, 25 bp, Mus musculus
gcaatctcaacaggacaagaaaaga

SEQ ID NO: 302064 - DNA, 25 bp, Mus musculus
gcaatctcaacaggtttatttattt

SEQ ID NO: 302065 - DNA, 25 bp, Mus musculus
gcaatctcagagctaagtaaaaacc

SEQ ID NO: 302066 - DNA, 25 bp, Mus musculus
gcaatctcagggttttggcaaggag

SEQ ID NO: 302067 - DNA, 25 bp, Mus musculus
gcaatctcagtttgtgactctgttc

SEQ ID NO: 302068 - DNA, 25 bp, Mus musculus
gcaatctctgcacctttggggaact

SEQ ID NO: 302069 - DNA, 25 bp, Mus musculus
gcaatctcttagtgagaagccagtg

SEQ ID NO: 302070 - DNA, 25 bp, Mus musculus
gcaatctcttagtgataacaaagat

SEQ ID NO: 302071 - DNA, 25 bp, Mus musculus
gcaatctgagctgccgaacaaaaaa

SEQ ID NO: 302072 - DNA, 25 bp, Mus musculus
gcaatcttaaagatgaggtcctgta

SEQ ID NO: 302073 - DNA, 25 bp, Mus musculus
gcaatcttaaagatggaggcgccga

SEQ ID NO: 302074 - DNA, 25 bp, Mus musculus
gcaatcttaaagatggcttgtccat

SEQ ID NO: 302075 - DNA, 25 bp, Mus musculus
gcaatcttaaagatgggggctgagg

SEQ ID NO: 302076 - DNA, 25 bp, Mus musculus
gcaatcttaacaattcaggccaaac

SEQ ID NO: 302077 - DNA, 25 bp, Mus musculus
gcaatcttccctggcacagaaacat

SEQ ID NO: 302078 - DNA, 25 bp, Mus musculus
gcaatgaagctacgccaatcaaaac

SEQ ID NO: 302079 - DNA, 25 bp, Mus musculus
gcaatgaagctacgtcgacgcataa

SEQ ID NO: 302080 - DNA, 25 bp, Mus musculus
gcaatgacattggtccctatggtga

SEQ ID NO: 302081 - DNA, 25 bp, Mus musculus
gcaatgacggtgccccctacagcca

SEQ ID NO: 302082 - DNA, 25 bp, Mus musculus
gcaatgactgggaaactactataga

SEQ ID NO: 302083 - DNA, 25 bp, Mus musculus
gcaatgactggtgtccactcccagg

SEQ ID NO: 302084 - DNA, 25 bp, Mus musculus
gcaatgactgtcattttagtgaatt

SEQ ID NO: 302085 - DNA, 25 bp, Mus musculus
gcaatgagaatgattcccttcaggc

SEQ ID NO: 302086 - DNA, 25 bp, Mus musculus
gcaatgaggccggcgtcctccgccc

SEQ ID NO: 302087 - DNA, 25 bp, Mus musculus
gcaatgagggctggagtggcaaaac

SEQ ID NO: 302088 - DNA, 25 bp, Mus musculus
gcaatgatattgacttagaaggttt

SEQ ID NO: 302089 - DNA, 25 bp, Mus musculus
gcaatgatgaccaggatctgacaca

SEQ ID NO: 302090 - DNA, 25 bp, Mus musculus
gcaatgattattgggtgtgcattat

SEQ ID NO: 302091 - DNA, 25 bp, Mus musculus
gcaatgcaaaacttgcagtaatgtg

SEQ ID NO: 302092 - DNA, 25 bp, Mus musculus
gcaatgcaaataagtgaaaaggaag

SEQ ID NO: 302093 - DNA, 25 bp, Mus musculus
gcaatgcaaatgggaacaactgtat

SEQ ID NO: 302094 - DNA, 25 bp, Mus musculus
gcaatgccagaggagtctaagtctc

SEQ ID NO: 302095 - DNA, 25 bp, Mus musculus
gcaatgccagaggagtctaatgact

SEQ ID NO: 302096 - DNA, 25 bp, Mus musculus
gcaatgccagagtctgttataatgc

SEQ ID NO: 302097 - DNA, 25 bp, Mus musculus
gcaatgccaggtggcccagagtggt

SEQ ID NO: 302098 - DNA, 25 bp, Mus musculus
gcaatgccaggttgaacgacatgtg

SEQ ID NO: 302099 - DNA, 25 bp, Mus musculus
gcaatgccagtgccttcgtgcatcg

SEQ ID NO: 302100 - DNA, 25 bp, Mus musculus
gcaatgccagttttcccatgaccct

SEQ ID NO: 302101 - DNA, 25 bp, Mus musculus
gcaatgcccctgttggaattcgaca

SEQ ID NO: 302102 - DNA, 25 bp, Mus musculus
gcaatgcttctgattcttataaaca

SEQ ID NO: 302103 - DNA, 25 bp, Mus musculus
gcaatgcttctggtgaccttgggga

SEQ ID NO: 302104 - DNA, 25 bp, Mus musculus
gcaatggaagggcagcagagctttg

SEQ ID NO: 302105 - DNA, 25 bp, Mus musculus
gcaatggaatcctctggcaagcgcg

SEQ ID NO: 302106 - DNA, 25 bp, Mus musculus
gcaatggacagatgtccactcccga

SEQ ID NO: 302107 - DNA, 25 bp, Mus musculus
gcaatggacttcaggcaatccaaaa

SEQ ID NO: 302108 - DNA, 25 bp, Mus musculus
gcaatggagaaaaagtaaatataat

SEQ ID NO: 302109 - DNA, 25 bp, Mus musculus
gcaatggagaaaacttctaaagatg

SEQ ID NO: 302110 - DNA, 25 bp, Mus musculus
gcaatggagaaaatttgccttgaat

SEQ ID NO: 302111 - DNA, 25 bp, Mus musculus
gcaatggcagaaagaactcacggct

SEQ ID NO: 302112 - DNA, 25 bp, Mus musculus
gcaatggcagaacacaagaattaat

SEQ ID NO: 302113 - DNA, 25 bp, Mus musculus
gcaatggcagcctggactgcatcct

SEQ ID NO: 302114 - DNA, 25 bp, Mus musculus
gcaatggcaggcctagccagcatga

SEQ ID NO: 302115 - DNA, 25 bp, Mus musculus
gcaatggcaggtgctgacctgagct

SEQ ID NO: 302116 - DNA, 25 bp, Mus musculus
gcaatggcaggttttactgcaatca

SEQ ID NO: 302117 - DNA, 25 bp, Mus musculus
gcaatggcagtctgttccggtacat

SEQ ID NO: 302118 - DNA, 25 bp, Mus musculus
gcaatggcagtgagcaccactctgt

SEQ ID NO: 302119 - DNA, 25 bp, Mus musculus
gcaatggctaaaactgtgcagttgt

SEQ ID NO: 302120 - DNA, 25 bp, Mus musculus
gcaatggctcagggccatcgaagac

SEQ ID NO: 302121 - DNA, 25 bp, Mus musculus
gcaatggcttcgcaggctgcatgct

SEQ ID NO: 302122 - DNA, 25 bp, Mus musculus
gcaatggctttgcgggctgcgtgca

SEQ ID NO: 302123 - DNA, 25 bp, Mus musculus
gcaatgggatgttggcctgatgccc

SEQ ID NO: 302124 - DNA, 25 bp, Mus musculus
gcaatgggatgttgggtgtttgaag

SEQ ID NO: 302125 - DNA, 25 bp, Mus musculus
gcaatgtatccaagggagcccagga

SEQ ID NO: 302126 - DNA, 25 bp, Mus musculus
gcaatgtcaggcgtccgacctccca

SEQ ID NO: 302127 - DNA, 25 bp, Mus musculus
gcaatgtccaggaccgcattggtcg

SEQ ID NO: 302128 - DNA, 25 bp, Mus musculus
gcaatgtggaaatctctcaggagaa

SEQ ID NO: 302129 - DNA, 25 bp, Mus musculus
gcaatgtggaaatgtgttctgccca

SEQ ID NO: 302130 - DNA, 25 bp, Mus musculus
gcaatgtggaaattttatagaacaa

SEQ ID NO: 302131 - DNA, 25 bp, Mus musculus
gcaatgtggacctggccatgggcaa

SEQ ID NO: 302132 - DNA, 25 bp, Mus musculus
gcaatgtggagaaggtgaaatttat

SEQ ID NO: 302133 - DNA, 25 bp, Mus musculus
gcaatgtgtgggttgaatttactaa

SEQ ID NO: 302134 - DNA, 25 bp, Mus musculus
gcaatgtgttcagcccgcatgccct

SEQ ID NO: 302135 - DNA, 25 bp, Mus musculus
gcaattacaaaggtggctttgacac

SEQ ID NO: 302136 - DNA, 25 bp, Mus musculus
gcaattacagaaggtcaccagaaag

SEQ ID NO: 302137 - DNA, 25 bp, Mus musculus
gcaattcaaggtattcacactgccc

SEQ ID NO: 302138 - DNA, 25 bp, Mus musculus
gcaattcagaaagagagtcctgttg

SEQ ID NO: 302139 - DNA, 25 bp, Mus musculus
gcaattcagaatgtctctcatgtta

SEQ ID NO: 302140 - DNA, 25 bp, Mus musculus
gcaattcagaatgttgttcagatgt

SEQ ID NO: 302141 - DNA, 25 bp, Mus musculus
gcaattcagtgaggccttggaaact

SEQ ID NO: 302142 - DNA, 25 bp, Mus musculus
gcaattcagtgaggtcaaaggactg

SEQ ID NO: 302143 - DNA, 25 bp, Mus musculus
gcaattccatggctgcagaagagga

SEQ ID NO: 302144 - DNA, 25 bp, Mus musculus
gcaattccatggtactctttgatca

SEQ ID NO: 302145 - DNA, 25 bp, Mus musculus
gcaattcccaccaaatatacgagcc

SEQ ID NO: 302146 - DNA, 25 bp, Mus musculus
gcaattcccttaggaacctcctctg

SEQ ID NO: 302147 - DNA, 25 bp, Mus musculus
gcaattccttggggtaatgatgtgg

SEQ ID NO: 302148 - DNA, 25 bp, Mus musculus
gcaattcgtgcaccgtaacgtacct

SEQ ID NO: 302149 - DNA, 25 bp, Mus musculus
gcaattctccccaggaaaatacaga

SEQ ID NO: 302150 - DNA, 25 bp, Mus musculus
gcaattctgttcaggaggaagcaga

SEQ ID NO: 302151 - DNA, 25 bp, Mus musculus
gcaattgaaatcacagctcccgagg

SEQ ID NO: 302152 - DNA, 25 bp, Mus musculus
gcaattgaaatcagggaagctgctc

SEQ ID NO: 302153 - DNA, 25 bp, Mus musculus
gcaattgcaggactctgatggggaa

SEQ ID NO: 302154 - DNA, 25 bp, Mus musculus
gcaattgccaaggcaggtgcagtga

SEQ ID NO: 302155 - DNA, 25 bp, Mus musculus
gcaattgcgagctctgcaggagcgg

SEQ ID NO: 302156 - DNA, 25 bp, Mus musculus
gcaattgctcaggagcacagcgagc

SEQ ID NO: 302157 - DNA, 25 bp, Mus musculus
gcaattggaaagacagtgatgtgac

SEQ ID NO: 302158 - DNA, 25 bp, Mus musculus
gcaattggaaaggtatctggccagg

SEQ ID NO: 302159 - DNA, 25 bp, Mus musculus
gcaattggaagaaaggtggtggtgt

SEQ ID NO: 302160 - DNA, 25 bp, Mus musculus
gcaattggactcaagcggatagcca

SEQ ID NO: 302161 - DNA, 25 bp, Mus musculus
gcaattggcacacactggttctgga

SEQ ID NO: 302162 - DNA, 25 bp, Mus musculus
gcaattggcgaggactttgtgttgc

SEQ ID NO: 302163 - DNA, 25 bp, Mus musculus
gcaattgttatcccaactgtaaatt

SEQ ID NO: 302164 - DNA, 25 bp, Mus musculus
gcaatttaaaattgtggtgggttgt

SEQ ID NO: 302165 - DNA, 25 bp, Mus musculus
gcaatttcaaggcaactttccaccg

SEQ ID NO: 302166 - DNA, 25 bp, Mus musculus
gcaatttctttccaagtccttcttt

SEQ ID NO: 302167 - DNA, 25 bp, Mus musculus
gcaatttggaagggaggtcctggcc

SEQ ID NO: 302168 - DNA, 25 bp, Mus musculus
gcacaaaaagaaatggtgacattcc

SEQ ID NO: 302169 - DNA, 25 bp, Mus musculus
gcacaaaacgagatctggcagacct

SEQ ID NO: 302170 - DNA, 25 bp, Mus musculus
gcacaaaacgagtgacgagtatctg

SEQ ID NO: 302171 - DNA, 25 bp, Mus musculus
gcacaaaagagacgggaaaagaagg

SEQ ID NO: 302172 - DNA, 25 bp, Mus musculus
gcacaaaagagacgggatcttatcc

SEQ ID NO: 302173 - DNA, 25 bp, Mus musculus
gcacaaaatatgggccaaatgaaaa

SEQ ID NO: 302174 - DNA, 25 bp, Mus musculus
gcacaaacaaatgacatgtttttca

SEQ ID NO: 302175 - DNA, 25 bp, Mus musculus
gcacaaacagagcagctctggctcc

SEQ ID NO: 302176 - DNA, 25 bp, Mus musculus
gcacaaacagaggcaaatattgtgg

SEQ ID NO: 302177 - DNA, 25 bp, Mus musculus
gcacaaacaggccaaactcaaagag

SEQ ID NO: 302178 - DNA, 25 bp, Mus musculus
gcacaaacaggcggaaattgtgaag

SEQ ID NO: 302179 - DNA, 25 bp, Mus musculus
gcacaaacagtgccccaggtactga

SEQ ID NO: 302180 - DNA, 25 bp, Mus musculus
gcacaaacgagctccttatgtctcc

SEQ ID NO: 302181 - DNA, 25 bp, Mus musculus
gcacaaacgaggggaatatattaaa

SEQ ID NO: 302182 - DNA, 25 bp, Mus musculus
gcacaaacgccagacgtgaaaaatg

SEQ ID NO: 302183 - DNA, 25 bp, Mus musculus
gcacaaacgggagagcaaccttcca

SEQ ID NO: 302184 - DNA, 25 bp, Mus musculus
gcacaaactacacggaagaaaagca

SEQ ID NO: 302185 - DNA, 25 bp, Mus musculus
gcacaaagaaagcaactgggacaaa

SEQ ID NO: 302186 - DNA, 25 bp, Mus musculus
gcacaaagcagatttcaggtatata

SEQ ID NO: 302187 - DNA, 25 bp, Mus musculus
gcacaaagcagtgtggtcatcccac

SEQ ID NO: 302188 - DNA, 25 bp, Mus musculus
gcacaaagtttggaggccacctatg

SEQ ID NO: 302189 - DNA, 25 bp, Mus musculus
gcacaaagtttggagtttgttgaag

SEQ ID NO: 302190 - DNA, 25 bp, Mus musculus
gcacaaataaaaaaattcatctaca

SEQ ID NO: 302191 - DNA, 25 bp, Mus musculus
gcacaaataatagtgcttacagaca

SEQ ID NO: 302192 - DNA, 25 bp, Mus musculus
gcacaaatcaaaaggtgtgatcctt

SEQ ID NO: 302193 - DNA, 25 bp, Mus musculus
gcacaaatcaaggcatgctgtgaga

SEQ ID NO: 302194 - DNA, 25 bp, Mus musculus
gcacaaatcaaggtgacaaaagaac

SEQ ID NO: 302195 - DNA, 25 bp, Mus musculus
gcacaaattaatcacaatatcgcca

SEQ ID NO: 302196 - DNA, 25 bp, Mus musculus
gcacaacaatctagagcccttactc

SEQ ID NO: 302197 - DNA, 25 bp, Mus musculus
gcacaacacaatggaagtcgatggc

SEQ ID NO: 302198 - DNA, 25 bp, Mus musculus
gcacaacagaaggagctccatctgt

SEQ ID NO: 302199 - DNA, 25 bp, Mus musculus
gcacaacagaatgcacgtagaaaat

SEQ ID NO: 302200 - DNA, 25 bp, Mus musculus
gcacaacagagacacagtgtcgtaa

SEQ ID NO: 302201 - DNA, 25 bp, Mus musculus
gcacaacagtggggtgagtttaagg

SEQ ID NO: 302202 - DNA, 25 bp, Mus musculus
gcacaaccagcagaaaacatggtgg

SEQ ID NO: 302203 - DNA, 25 bp, Mus musculus
gcacaaccagcagaatgtggctgct

SEQ ID NO: 302204 - DNA, 25 bp, Mus musculus
gcacaacccgcggggcgccctgcat

SEQ ID NO: 302205 - DNA, 25 bp, Mus musculus
gcacaaccttcgagtcctcaaatgc

SEQ ID NO: 302206 - DNA, 25 bp, Mus musculus
gcacaactcaagcctaccaccactg

SEQ ID NO: 302207 - DNA, 25 bp, Mus musculus
gcacaactcaaggtgaaatttgaag

SEQ ID NO: 302208 - DNA, 25 bp, Mus musculus
gcacaactcctggtcatctagtagc

SEQ ID NO: 302209 - DNA, 25 bp, Mus musculus
gcacaactctagagaagtttattga

SEQ ID NO: 302210 - DNA, 25 bp, Mus musculus
gcacaacttcaatgaattcctgttc

SEQ ID NO: 302211 - DNA, 25 bp, Mus musculus
gcacaagaaaaggctgcagaagagg

SEQ ID NO: 302212 - DNA, 25 bp, Mus musculus
gcacaagaagatctctcgtctgctc

SEQ ID NO: 302213 - DNA, 25 bp, Mus musculus
gcacaagacaagatctggagcaccc

SEQ ID NO: 302214 - DNA, 25 bp, Mus musculus
gcacaagacgatacagcacgggcag

SEQ ID NO: 302215 - DNA, 25 bp, Mus musculus
gcacaagacggatcttgaaacagga

SEQ ID NO: 302216 - DNA, 25 bp, Mus musculus
gcacaagagaatcagctgatgttcc

SEQ ID NO: 302217 - DNA, 25 bp, Mus musculus
gcacaagagaatgagctgatgttcc

SEQ ID NO: 302218 - DNA, 25 bp, Mus musculus
gcacaagattttagtttgggatcaa

SEQ ID NO: 302219 - DNA, 25 bp, Mus musculus
gcacaagcaaagaccggtgtgtgat

SEQ ID NO: 302220 - DNA, 25 bp, Mus musculus
gcacaagcaaaggaaagaggccgag

SEQ ID NO: 302221 - DNA, 25 bp, Mus musculus
gcacaagcaaagtggtagtgtgaag

SEQ ID NO: 302222 - DNA, 25 bp, Mus musculus
gcacaagcaagagtaaaaagaagaa

SEQ ID NO: 302223 - DNA, 25 bp, Mus musculus
gcacaagcagccaggccccatgaag

SEQ ID NO: 302224 - DNA, 25 bp, Mus musculus
gcacaagccagggcccatcactctg

SEQ ID NO: 302225 - DNA, 25 bp, Mus musculus
gcacaagcccaaggctgctgacaag

SEQ ID NO: 302226 - DNA, 25 bp, Mus musculus
gcacaagcgagggaagctaacagcc

SEQ ID NO: 302227 - DNA, 25 bp, Mus musculus
gcacaagctgacaggaagactcttc

SEQ ID NO: 302228 - DNA, 25 bp, Mus musculus
gcacaagctgacaggttgccatgcc

SEQ ID NO: 302229 - DNA, 25 bp, Mus musculus
gcacaagctgctgagactataagcg

SEQ ID NO: 302230 - DNA, 25 bp, Mus musculus
gcacaagctgctgagatggctccga

SEQ ID NO: 302231 - DNA, 25 bp, Mus musculus
gcacaagctgctgagtgaagagaga

SEQ ID NO: 302232 - DNA, 25 bp, Mus musculus
gcacaaggcatgtgaagccagtgaa

SEQ ID NO: 302233 - DNA, 25 bp, Mus musculus
gcacaaggccccgaaatgggaccct

SEQ ID NO: 302234 - DNA, 25 bp, Mus musculus
gcacaaggtgggccgagacatcttg

SEQ ID NO: 302235 - DNA, 25 bp, Mus musculus
gcacaagtacacgacagacggcaac

SEQ ID NO: 302236 - DNA, 25 bp, Mus musculus
gcacaagtacacggaaatgtgtcat

SEQ ID NO: 302237 - DNA, 25 bp, Mus musculus
gcacaagtgctgagagctaagtgat

SEQ ID NO: 302238 - DNA, 25 bp, Mus musculus
gcacaatattccaacggtgcccctt

SEQ ID NO: 302239 - DNA, 25 bp, Mus musculus
gcacaatcaagtctaaactagagtc

SEQ ID NO: 302240 - DNA, 25 bp, Mus musculus
gcacaatcagagccttggctgttac

SEQ ID NO: 302241 - DNA, 25 bp, Mus musculus
gcacaatcagagctattctcaagct

SEQ ID NO: 302242 - DNA, 25 bp, Mus musculus
gcacaatcaggcgacaggtgaacag

SEQ ID NO: 302243 - DNA, 25 bp, Mus musculus
gcacaatcaggtggaaacttcacag

SEQ ID NO: 302244 - DNA, 25 bp, Mus musculus
gcacaatcaggtggccaataggttg

SEQ ID NO: 302245 - DNA, 25 bp, Mus musculus
gcacaatcaggtgggagaaaaaaca

SEQ ID NO: 302246 - DNA, 25 bp, Mus musculus
gcacaatcaggttcttgagaggaag

SEQ ID NO: 302247 - DNA, 25 bp, Mus musculus
gcacaatcctgagaggaagatccaa

SEQ ID NO: 302248 - DNA, 25 bp, Mus musculus
gcacaatcctgaggtgaagaggaag

SEQ ID NO: 302249 - DNA, 25 bp, Mus musculus
gcacaatcgagagcagcaaaagcga

SEQ ID NO: 302250 - DNA, 25 bp, Mus musculus
gcacaatcgagatcctgcctcagag

SEQ ID NO: 302251 - DNA, 25 bp, Mus musculus
gcacaatctcagaatggcttcacac

SEQ ID NO: 302252 - DNA, 25 bp, Mus musculus
gcacaatcttacaagaagtaaagct

SEQ ID NO: 302253 - DNA, 25 bp, Mus musculus
gcacaatcttacaagaatgcagaag

SEQ ID NO: 302254 - DNA, 25 bp, Mus musculus
gcacaatgcgaccttcttcgggaat

SEQ ID NO: 302255 - DNA, 25 bp, Mus musculus
gcacaatttcaccgtattagaaaga

SEQ ID NO: 302256 - DNA, 25 bp, Mus musculus
gcacaatttcacggtattagaaaga

SEQ ID NO: 302257 - DNA, 25 bp, Mus musculus
gcacaatttttaggccccgtcattg

SEQ ID NO: 302258 - DNA, 25 bp, Mus musculus
gcacacaaaagcaaatcactgaagg

SEQ ID NO: 302259 - DNA, 25 bp, Mus musculus
gcacacaaaatgtaggtggatgaag

SEQ ID NO: 302260 - DNA, 25 bp, Mus musculus
gcacacaagcggatgaaggttaaga

SEQ ID NO: 302261 - DNA, 25 bp, Mus musculus
gcacacaagtataaggtgatgttcc

SEQ ID NO: 302262 - DNA, 25 bp, Mus musculus
gcacacaatctgccattatttgcat

SEQ ID NO: 302263 - DNA, 25 bp, Mus musculus
gcacacacaaggccaggagcatcat

SEQ ID NO: 302264 - DNA, 25 bp, Mus musculus
gcacacacaagggctgggtatggtc

SEQ ID NO: 302265 - DNA, 25 bp, Mus musculus
gcacacacacagcgattgagtcctg

SEQ ID NO: 302266 - DNA, 25 bp, Mus musculus
gcacacacacagggattgagtcctg

SEQ ID NO: 302267 - DNA, 25 bp, Mus musculus
gcacacacagacactggatccctac

SEQ ID NO: 302268 - DNA, 25 bp, Mus musculus
gcacacacaggggcagttccagaag

SEQ ID NO: 302269 - DNA, 25 bp, Mus musculus
gcacacaccctaaggtaaaagttgg

SEQ ID NO: 302270 - DNA, 25 bp, Mus musculus
gcacacaccctaagtatttagaaat

SEQ ID NO: 302271 - DNA, 25 bp, Mus musculus
gcacacacgaccttggacgtaccat

SEQ ID NO: 302272 - DNA, 25 bp, Mus musculus
gcacacactccagaggtacaagcgc

SEQ ID NO: 302273 - DNA, 25 bp, Mus musculus
gcacacagaagtccctgagctcagc

SEQ ID NO: 302274 - DNA, 25 bp, Mus musculus
gcacacagacacaagatggaatata

SEQ ID NO: 302275 - DNA, 25 bp, Mus musculus
gcacacagacctatgcttggatgca

SEQ ID NO: 302276 - DNA, 25 bp, Mus musculus
gcacacagagcaggtcatacctcac

SEQ ID NO: 302277 - DNA, 25 bp, Mus musculus
gcacacagagcagtacctcaaatcg

SEQ ID NO: 302278 - DNA, 25 bp, Mus musculus
gcacacagtagacactacttcatcc

SEQ ID NO: 302279 - DNA, 25 bp, Mus musculus
gcacacagtggatgaagaagagaag

SEQ ID NO: 302280 - DNA, 25 bp, Mus musculus
gcacacagtggtaccgttttgcaga

SEQ ID NO: 302281 - DNA, 25 bp, Mus musculus
gcacacatacacgcccgaatggctg

SEQ ID NO: 302282 - DNA, 25 bp, Mus musculus
gcacacatcctcaggaaagctgtgg

SEQ ID NO: 302283 - DNA, 25 bp, Mus musculus
gcacacatcctcaggagccagggaa

SEQ ID NO: 302284 - DNA, 25 bp, Mus musculus
gcacacatgaaacagtttgtagtgc

SEQ ID NO: 302285 - DNA, 25 bp, Mus musculus
gcacacatggacaggtgacgccatc

SEQ ID NO: 302286 - DNA, 25 bp, Mus musculus
gcacacatggatgaaaattcaggac

SEQ ID NO: 302287 - DNA, 25 bp, Mus musculus
gcacaccaacctatgaaaactctct

SEQ ID NO: 302288 - DNA, 25 bp, Mus musculus
gcacaccactgcagtgtttgtaagc

SEQ ID NO: 302289 - DNA, 25 bp, Mus musculus
gcacaccatgaaggaagccaaggac

SEQ ID NO: 302290 - DNA, 25 bp, Mus musculus
gcacacccagcagcccgagcaacac

SEQ ID NO: 302291 - DNA, 25 bp, Mus musculus
gcacaccgagatatgaggatcaatg

SEQ ID NO: 302292 - DNA, 25 bp, Mus musculus
gcacaccgcagggagaaaactggtt

SEQ ID NO: 302293 - DNA, 25 bp, Mus musculus
gcacaccggagtgcaatcaaaacca

SEQ ID NO: 302294 - DNA, 25 bp, Mus musculus
gcacaccggagtggtgacaaatgga

SEQ ID NO: 302295 - DNA, 25 bp, Mus musculus
gcacacctagtcagtccccagttgt

SEQ ID NO: 302296 - DNA, 25 bp, Mus musculus
gcacacctcatgagctggctgcctg

SEQ ID NO: 302297 - DNA, 25 bp, Mus musculus
gcacacgcaggtgcctcctcctgga

SEQ ID NO: 302298 - DNA, 25 bp, Mus musculus
gcacacggaagtgaatccagcagct

SEQ ID NO: 302299 - DNA, 25 bp, Mus musculus
gcacacggaagtgatcagctctgaa

SEQ ID NO: 302300 - DNA, 25 bp, Mus musculus
gcacacggacaccgggattatgtcc

SEQ ID NO: 302301 - DNA, 25 bp, Mus musculus
gcacacggcagccggttgcctcttc

SEQ ID NO: 302302 - DNA, 25 bp, Mus musculus
gcacacggcagtgactgatcacaca

SEQ ID NO: 302303 - DNA, 25 bp, Mus musculus
gcacacggttggataaacctgactc

SEQ ID NO: 302304 - DNA, 25 bp, Mus musculus
gcacacgtgctcagagcagagcctc

SEQ ID NO: 302305 - DNA, 25 bp, Mus musculus
gcacacgtgctcagccctttgttca

SEQ ID NO: 302306 - DNA, 25 bp, Mus musculus
gcacactaccagctggcctataggt

SEQ ID NO: 302307 - DNA, 25 bp, Mus musculus
gcacactaccagctgggtaacgaca

SEQ ID NO: 302308 - DNA, 25 bp, Mus musculus
gcacactagtgcctgataagccaaa

SEQ ID NO: 302309 - DNA, 25 bp, Mus musculus
gcacactggaaacaaatgagatatt

SEQ ID NO: 302310 - DNA, 25 bp, Mus musculus
gcacactggaaacaagataaaacaa

SEQ ID NO: 302311 - DNA, 25 bp, Mus musculus
gcacactggagaatcgaggaaaact

SEQ ID NO: 302312 - DNA, 25 bp, Mus musculus
gcacactggccatgaacgtcctgtt

SEQ ID NO: 302313 - DNA, 25 bp, Mus musculus
gcacacttacgtccacgccacgctg

SEQ ID NO: 302314 - DNA, 25 bp, Mus musculus
gcacacttgttgtttacctgctgcc

SEQ ID NO: 302315 - DNA, 25 bp, Mus musculus
gcacagaaaaagagaagctgatggt

SEQ ID NO: 302316 - DNA, 25 bp, Mus musculus
gcacagaaaacccagccagtggttt

SEQ ID NO: 302317 - DNA, 25 bp, Mus musculus
gcacagaaagactaccaccatacct

SEQ ID NO: 302318 - DNA, 25 bp, Mus musculus
gcacagaaagccaggggctgggttg

SEQ ID NO: 302319 - DNA, 25 bp, Mus musculus
gcacagaaagggagagtcctgcatg

SEQ ID NO: 302320 - DNA, 25 bp, Mus musculus
gcacagaaccaaaggacacagctgc

SEQ ID NO: 302321 - DNA, 25 bp, Mus musculus
gcacagaagggaaggtgggctacga

SEQ ID NO: 302322 - DNA, 25 bp, Mus musculus
gcacagaagggactggacccataca

SEQ ID NO: 302323 - DNA, 25 bp, Mus musculus
gcacagaagggactgtcaactcttg

SEQ ID NO: 302324 - DNA, 25 bp, Mus musculus
gcacagaataaacacactgtgacag

SEQ ID NO: 302325 - DNA, 25 bp, Mus musculus
gcacagaataaacagactgtgacag

SEQ ID NO: 302326 - DNA, 25 bp, Mus musculus
gcacagaatcccagtctcctcacta

SEQ ID NO: 302327 - DNA, 25 bp, Mus musculus
gcacagaatcccagtggggaaacgg

SEQ ID NO: 302328 - DNA, 25 bp, Mus musculus
gcacagaattctcaggaacatcatg

SEQ ID NO: 302329 - DNA, 25 bp, Mus musculus
gcacagacaaagtggacaccatggt

SEQ ID NO: 302330 - DNA, 25 bp, Mus musculus
gcacagacaggagcatgcaaaacaa

SEQ ID NO: 302331 - DNA, 25 bp, Mus musculus
gcacagacaggagcatgcattcttt

SEQ ID NO: 302332 - DNA, 25 bp, Mus musculus
gcacagacatccctgactaaggctg

SEQ ID NO: 302333 - DNA, 25 bp, Mus musculus
gcacagacatgatggtgggcattgg

SEQ ID NO: 302334 - DNA, 25 bp, Mus musculus
gcacagacatggagtcagtgacttt

SEQ ID NO: 302335 - DNA, 25 bp, Mus musculus
gcacagaccaggtgattgtgcagag

SEQ ID NO: 302336 - DNA, 25 bp, Mus musculus
gcacagaccagtacatgacaatgga

SEQ ID NO: 302337 - DNA, 25 bp, Mus musculus
gcacagacccgaagtgtggagtccc

SEQ ID NO: 302338 - DNA, 25 bp, Mus musculus
gcacagacccgttcacgaaccagaa

SEQ ID NO: 302339 - DNA, 25 bp, Mus musculus
gcacagacccgttccaggaggcagc

SEQ ID NO: 302340 - DNA, 25 bp, Mus musculus
gcacagacctcctgatcacttgtac

SEQ ID NO: 302341 - DNA, 25 bp, Mus musculus
gcacagacgagctgttcaaggagag

SEQ ID NO: 302342 - DNA, 25 bp, Mus musculus
gcacagacgattcctcagatgttgg

SEQ ID NO: 302343 - DNA, 25 bp, Mus musculus
gcacagagaagccaggttacaaact

SEQ ID NO: 302344 - DNA, 25 bp, Mus musculus
gcacagagagaattttgttcaggct

SEQ ID NO: 302345 - DNA, 25 bp, Mus musculus
gcacagagattcaggttctccccta

SEQ ID NO: 302346 - DNA, 25 bp, Mus musculus
gcacagatatctttccatctgtgtc

SEQ ID NO: 302347 - DNA, 25 bp, Mus musculus
gcacagatcttcaaggcctgggctg

SEQ ID NO: 302348 - DNA, 25 bp, Mus musculus
gcacagatgagacgggcatagaaca

SEQ ID NO: 302349 - DNA, 25 bp, Mus musculus
gcacagatgagacgggtattgaacg

SEQ ID NO: 302350 - DNA, 25 bp, Mus musculus
gcacagatggatacagccttccaga

SEQ ID NO: 302351 - DNA, 25 bp, Mus musculus
gcacagatggccaagggcactcaac

SEQ ID NO: 302352 - DNA, 25 bp, Mus musculus
gcacagatggccaagtcaagctgtg

SEQ ID NO: 302353 - DNA, 25 bp, Mus musculus
gcacagatgtcaggagccctgtcct

SEQ ID NO: 302354 - DNA, 25 bp, Mus musculus
gcacagatgtcagggttgtacctga

SEQ ID NO: 302355 - DNA, 25 bp, Mus musculus
gcacagatgtcaggtttatgcgcat

SEQ ID NO: 302356 - DNA, 25 bp, Mus musculus
gcacagatgtcagtcatcttcctct

SEQ ID NO: 302357 - DNA, 25 bp, Mus musculus
gcacagcaaacagagccctttgcca

SEQ ID NO: 302358 - DNA, 25 bp, Mus musculus
gcacagcaaagcgccaggctccgat

SEQ ID NO: 302359 - DNA, 25 bp, Mus musculus
gcacagcaacgctaggttcggagcg

SEQ ID NO: 302360 - DNA, 25 bp, Mus musculus
gcacagcaactaggcatgaagcact

SEQ ID NO: 302361 - DNA, 25 bp, Mus musculus
gcacagcaactttctccggctgtct

SEQ ID NO: 302362 - DNA, 25 bp, Mus musculus
gcacagcaagagtgctgtcgactgt

SEQ ID NO: 302363 - DNA, 25 bp, Mus musculus
gcacagcactgccagggggaagggc

SEQ ID NO: 302364 - DNA, 25 bp, Mus musculus
gcacagcagaggtggaaaatggttg

SEQ ID NO: 302365 - DNA, 25 bp, Mus musculus
gcacagcaggagatagggtttcaag

SEQ ID NO: 302366 - DNA, 25 bp, Mus musculus
gcacagcaggagttcaagaacgcca

SEQ ID NO: 302367 - DNA, 25 bp, Mus musculus
gcacagcatgagaaactctctggag

SEQ ID NO: 302368 - DNA, 25 bp, Mus musculus
gcacagcatgatcaacaggccccca

SEQ ID NO: 302369 - DNA, 25 bp, Mus musculus
gcacagccatcttgcttcctcacaa

SEQ ID NO: 302370 - DNA, 25 bp, Mus musculus
gcacagccatgctgtcaatcaactg

SEQ ID NO: 302371 - DNA, 25 bp, Mus musculus
gcacagccatggcgcccaggaggac

SEQ ID NO: 302372 - DNA, 25 bp, Mus musculus
gcacagccatggcggccaggaggac

SEQ ID NO: 302373 - DNA, 25 bp, Mus musculus
gcacagcccaaaggtcctctgacac

SEQ ID NO: 302374 - DNA, 25 bp, Mus musculus
gcacagcccaaagtctgacactaca

SEQ ID NO: 302375 - DNA, 25 bp, Mus musculus
gcacagcccaaggaggctcgaagca

SEQ ID NO: 302376 - DNA, 25 bp, Mus musculus
gcacagccccaggccagcagaggag

SEQ ID NO: 302377 - DNA, 25 bp, Mus musculus
gcacagccccagtgctctctctgtg

SEQ ID NO: 302378 - DNA, 25 bp, Mus musculus
gcacagcccccactatcttgcctca

SEQ ID NO: 302379 - DNA, 25 bp, Mus musculus
gcacagcccccactcactcgcctcg

SEQ ID NO: 302380 - DNA, 25 bp, Mus musculus
gcacagcccccactgtccaggtgct

SEQ ID NO: 302381 - DNA, 25 bp, Mus musculus
gcacagcccccagctcgtagtgcat

SEQ ID NO: 302382 - DNA, 25 bp, Mus musculus
gcacagccctggctgggggatgggc

SEQ ID NO: 302383 - DNA, 25 bp, Mus musculus
gcacagccgaggagggatccaagaa

SEQ ID NO: 302384 - DNA, 25 bp, Mus musculus
gcacagccgaggagggtatttcctg

SEQ ID NO: 302385 - DNA, 25 bp, Mus musculus
gcacagccgggttccatgatggagt

SEQ ID NO: 302386 - DNA, 25 bp, Mus musculus
gcacagccggtgctggagactgaat

SEQ ID NO: 302387 - DNA, 25 bp, Mus musculus
gcacagcctaagatggtcactcgga

SEQ ID NO: 302388 - DNA, 25 bp, Mus musculus
gcacagcctagcgggtgcaaagaaa

SEQ ID NO: 302389 - DNA, 25 bp, Mus musculus
gcacagcctctacccccttcctgcc

SEQ ID NO: 302390 - DNA, 25 bp, Mus musculus
gcacagcctgctcttcctcctggcc

SEQ ID NO: 302391 - DNA, 25 bp, Mus musculus
gcacagcctgtgtggctcaagtggc

SEQ ID NO: 302392 - DNA, 25 bp, Mus musculus
gcacagcctgtgtgggcctgggact

SEQ ID NO: 302393 - DNA, 25 bp, Mus musculus
gcacagcgacccagcgtctgatggc

SEQ ID NO: 302394 - DNA, 25 bp, Mus musculus
gcacagcgtacagatgaaaaggggt

SEQ ID NO: 302395 - DNA, 25 bp, Mus musculus
gcacagcgtacaggctcaggaaaca

SEQ ID NO: 302396 - DNA, 25 bp, Mus musculus
gcacagcgtggtcacctccagcccc

SEQ ID NO: 302397 - DNA, 25 bp, Mus musculus
gcacagctaaagtgtatactcctga

SEQ ID NO: 302398 - DNA, 25 bp, Mus musculus
gcacagctaccgaggagagagtcag

SEQ ID NO: 302399 - DNA, 25 bp, Mus musculus
gcacagctaccgaggtgctgcagga

SEQ ID NO: 302400 - DNA, 25 bp, Mus musculus
gcacagctccgggaggcctttgaag

SEQ ID NO: 302401 - DNA, 25 bp, Mus musculus
gcacagctcctgtccaggagatggc

SEQ ID NO: 302402 - DNA, 25 bp, Mus musculus
gcacagctgcggatcaccagaccat

SEQ ID NO: 302403 - DNA, 25 bp, Mus musculus
gcacagctggaacagtggccgcacg

SEQ ID NO: 302404 - DNA, 25 bp, Mus musculus
gcacagctggctggaccagatctgc

SEQ ID NO: 302405 - DNA, 25 bp, Mus musculus
gcacagctgtcaccaacattaccac

SEQ ID NO: 302406 - DNA, 25 bp, Mus musculus
gcacagctgtcacctacattaccac

SEQ ID NO: 302407 - DNA, 25 bp, Mus musculus
gcacagcttcagaacaaaagtccag

SEQ ID NO: 302408 - DNA, 25 bp, Mus musculus
gcacagcttcagattccatcaatct

SEQ ID NO: 302409 - DNA, 25 bp, Mus musculus
gcacaggaaactggccaaggtggag

SEQ ID NO: 302410 - DNA, 25 bp, Mus musculus
gcacaggaaagaagattcttgacaa

SEQ ID NO: 302411 - DNA, 25 bp, Mus musculus
gcacaggaagattcatgagatattt

SEQ ID NO: 302412 - DNA, 25 bp, Mus musculus
gcacaggaagggactgagactatgg

SEQ ID NO: 302413 - DNA, 25 bp, Mus musculus
gcacaggagaagggagttggcagta

SEQ ID NO: 302414 - DNA, 25 bp, Mus musculus
gcacaggagaaggtgaaggagggaa

SEQ ID NO: 302415 - DNA, 25 bp, Mus musculus
gcacaggattgaggtccagaaggat

SEQ ID NO: 302416 - DNA, 25 bp, Mus musculus
gcacaggccttgggctggagcaccc

SEQ ID NO: 302417 - DNA, 25 bp, Mus musculus
gcacaggctaggtatgacggagaga

SEQ ID NO: 302418 - DNA, 25 bp, Mus musculus
gcacaggctccaggctgttggaaag

SEQ ID NO: 302419 - DNA, 25 bp, Mus musculus
gcacagggaggcagtttgcagggac

SEQ ID NO: 302420 - DNA, 25 bp, Mus musculus
gcacaggggatgatgagacagaaga

SEQ ID NO: 302421 - DNA, 25 bp, Mus musculus
gcacagggtggagcatctgatgaca

SEQ ID NO: 302422 - DNA, 25 bp, Mus musculus
gcacaggtccagagcatggggggga

SEQ ID NO: 302423 - DNA, 25 bp, Mus musculus
gcacaggtggcaaagaaccagcatt

SEQ ID NO: 302424 - DNA, 25 bp, Mus musculus
gcacagtaaaggtctgtggaggaag

SEQ ID NO: 302425 - DNA, 25 bp, Mus musculus
gcacagtcaaatcagatgcccccac

SEQ ID NO: 302426 - DNA, 25 bp, Mus musculus
gcacagtcaaggagctgggcaacag

SEQ ID NO: 302427 - DNA, 25 bp, Mus musculus
gcacagtcctcggaggagtatatat

SEQ ID NO: 302428 - DNA, 25 bp, Mus musculus
gcacagtcggagccagggagagcgg

SEQ ID NO: 302429 - DNA, 25 bp, Mus musculus
gcacagtgaaggcagtcggagcagt

SEQ ID NO: 302430 - DNA, 25 bp, Mus musculus
gcacagtgagcaggggtgactactt

SEQ ID NO: 302431 - DNA, 25 bp, Mus musculus
gcacagtgcccacccatcactcagc

SEQ ID NO: 302432 - DNA, 25 bp, Mus musculus
gcacagtgcccctgcttgttctcca

SEQ ID NO: 302433 - DNA, 25 bp, Mus musculus
gcacagtggagttaccctgcatctg

SEQ ID NO: 302434 - DNA, 25 bp, Mus musculus
gcacagtggatgttcctccatttgg

SEQ ID NO: 302435 - DNA, 25 bp, Mus musculus
gcacagtggtgacaggctccatcca

SEQ ID NO: 302436 - DNA, 25 bp, Mus musculus
gcacagtgtgcgaagatgtggatga

SEQ ID NO: 302437 - DNA, 25 bp, Mus musculus
gcacagttatggtgtgggagatccc

SEQ ID NO: 302438 - DNA, 25 bp, Mus musculus
gcacagttggccgatatgaaaatcc

SEQ ID NO: 302439 - DNA, 25 bp, Mus musculus
gcacagttggttttgaagaaaggct

SEQ ID NO: 302440 - DNA, 25 bp, Mus musculus
gcacataaaaaggagacagagtcag

SEQ ID NO: 302441 - DNA, 25 bp, Mus musculus
gcacataaaaaggctgagaaggcag

SEQ ID NO: 302442 - DNA, 25 bp, Mus musculus
gcacataaagaaaatataaacacca

SEQ ID NO: 302443 - DNA, 25 bp, Mus musculus
gcacataaagaaaatgcagcgttcc

SEQ ID NO: 302444 - DNA, 25 bp, Mus musculus
gcacataatggaagggccatgccac

SEQ ID NO: 302445 - DNA, 25 bp, Mus musculus
gcacatacagggagcctgctttggt

SEQ ID NO: 302446 - DNA, 25 bp, Mus musculus
gcacatacccaggatcaaaacccta

SEQ ID NO: 302447 - DNA, 25 bp, Mus musculus
gcacatacccaggttgctgccttga

SEQ ID NO: 302448 - DNA, 25 bp, Mus musculus
gcacatagaccagcgctcctccaga

SEQ ID NO: 302449 - DNA, 25 bp, Mus musculus
gcacatatgaggtgcttgagcaggc

SEQ ID NO: 302450 - DNA, 25 bp, Mus musculus
gcacatatgagtgttttaaaatgcc

SEQ ID NO: 302451 - DNA, 25 bp, Mus musculus
gcacatcaagacctgtgttcctgtg

SEQ ID NO: 302452 - DNA, 25 bp, Mus musculus
gcacatcaaggaacttctagccata

SEQ ID NO: 302453 - DNA, 25 bp, Mus musculus
gcacatcaaggtccctttgtgtgcc

SEQ ID NO: 302454 - DNA, 25 bp, Mus musculus
gcacatcaagttacaacaggaactt

SEQ ID NO: 302455 - DNA, 25 bp, Mus musculus
gcacatcaagtttcagccctaccac

SEQ ID NO: 302456 - DNA, 25 bp, Mus musculus
gcacatcaagtttctgccctaccac

SEQ ID NO: 302457 - DNA, 25 bp, Mus musculus
gcacatcagctgcacctcagtcccc

SEQ ID NO: 302458 - DNA, 25 bp, Mus musculus
gcacatcagctggtcctatgtatgg

SEQ ID NO: 302459 - DNA, 25 bp, Mus musculus
gcacatccaaagacacttcctctct

SEQ ID NO: 302460 - DNA, 25 bp, Mus musculus
gcacatccaacagagcccagcagca

SEQ ID NO: 302461 - DNA, 25 bp, Mus musculus
gcacatccgagatgatgggcgtcgg

SEQ ID NO: 302462 - DNA, 25 bp, Mus musculus
gcacatcctccggactctaatgagc

SEQ ID NO: 302463 - DNA, 25 bp, Mus musculus
gcacatcgctcgaggaatcaaaagt

SEQ ID NO: 302464 - DNA, 25 bp, Mus musculus
gcacatctctgatgtggaaggggag

SEQ ID NO: 302465 - DNA, 25 bp, Mus musculus
gcacatcttcaggactcggaaggtg

SEQ ID NO: 302466 - DNA, 25 bp, Mus musculus
gcacatgagctgggctgtagcagtg

SEQ ID NO: 302467 - DNA, 25 bp, Mus musculus
gcacatgataggctatgatagaagg

SEQ ID NO: 302468 - DNA, 25 bp, Mus musculus
gcacatgccaggggatgccccatac

SEQ ID NO: 302469 - DNA, 25 bp, Mus musculus
gcacatgcctgtctggaaacaacct

SEQ ID NO: 302470 - DNA, 25 bp, Mus musculus
gcacatgctgattttgggcatcacc

SEQ ID NO: 302471 - DNA, 25 bp, Mus musculus
gcacatggaaggcctgggagggtac

SEQ ID NO: 302472 - DNA, 25 bp, Mus musculus
gcacatggaccagttggaggtgggc

SEQ ID NO: 302473 - DNA, 25 bp, Mus musculus
gcacatggagaggaaactgtcagca

SEQ ID NO: 302474 - DNA, 25 bp, Mus musculus
gcacatggagagggctcctcgctgt

SEQ ID NO: 302475 - DNA, 25 bp, Mus musculus
gcacatggattcttggcacttgatg

SEQ ID NO: 302476 - DNA, 25 bp, Mus musculus
gcacatgtcagatactttggcaaaa

SEQ ID NO: 302477 - DNA, 25 bp, Mus musculus
gcacatgtgtagggtgtgtgaggac

SEQ ID NO: 302478 - DNA, 25 bp, Mus musculus
gcacatgtgtggcaggggagccttc

SEQ ID NO: 302479 - DNA, 25 bp, Mus musculus
gcacatgtttcagaaatgaagcaga

SEQ ID NO: 302480 - DNA, 25 bp, Mus musculus
gcacatgtttcagccggataccaac

SEQ ID NO: 302481 - DNA, 25 bp, Mus musculus
gcacattacaaggacatgggcaagt

SEQ ID NO: 302482 - DNA, 25 bp, Mus musculus
gcacattagctcggttatgtacaaa

SEQ ID NO: 302483 - DNA, 25 bp, Mus musculus
gcacattagctcggttttgtacaaa

SEQ ID NO: 302484 - DNA, 25 bp, Mus musculus
gcacattatagtggaacaccagtac

SEQ ID NO: 302485 - DNA, 25 bp, Mus musculus
gcacattcaaggacatcgaggaagt

SEQ ID NO: 302486 - DNA, 25 bp, Mus musculus
gcacattcaaggactgggctgacgc

SEQ ID NO: 302487 - DNA, 25 bp, Mus musculus
gcacattcaccaggtgcactgcctg

SEQ ID NO: 302488 - DNA, 25 bp, Mus musculus
gcacattcagaaacgcatcccactg

SEQ ID NO: 302489 - DNA, 25 bp, Mus musculus
gcacattcaggagtgtgttccagag

SEQ ID NO: 302490 - DNA, 25 bp, Mus musculus
gcacattgtcggtgtacttgggaga

SEQ ID NO: 302491 - DNA, 25 bp, Mus musculus
gcacatttccagcgttcccaggctc

SEQ ID NO: 302492 - DNA, 25 bp, Mus musculus
gcacatttccagcgttcccatgccc

SEQ ID NO: 302493 - DNA, 25 bp, Mus musculus
gcacatttgaagacatgctccagct

SEQ ID NO: 302494 - DNA, 25 bp, Mus musculus
gcacatttttcgacatccgcagaca

SEQ ID NO: 302495 - DNA, 25 bp, Mus musculus
gcaccaaaccggattgagtttatct

SEQ ID NO: 302496 - DNA, 25 bp, Mus musculus
gcaccaaaccgggtgaggcacagag

SEQ ID NO: 302497 - DNA, 25 bp, Mus musculus
gcaccaaactactaaaggtgttaaa

SEQ ID NO: 302498 - DNA, 25 bp, Mus musculus
gcaccaaactccatagattgtaagc

SEQ ID NO: 302499 - DNA, 25 bp, Mus musculus
gcaccaaactgcttgatttaaattt

SEQ ID NO: 302500 - DNA, 25 bp, Mus musculus
gcaccaaagaccgtggggcagttaa

SEQ ID NO: 302501 - DNA, 25 bp, Mus musculus
gcaccaaatgactcgaccgatcatc

SEQ ID NO: 302502 - DNA, 25 bp, Mus musculus
gcaccaacaaagttattcatggtgg

SEQ ID NO: 302503 - DNA, 25 bp, Mus musculus
gcaccaacagcgccaggcagcacga

SEQ ID NO: 302504 - DNA, 25 bp, Mus musculus
gcaccaacaggcctgatgggaccac

SEQ ID NO: 302505 - DNA, 25 bp, Mus musculus
gcaccaacaggggagtatgtgctca

SEQ ID NO: 302506 - DNA, 25 bp, Mus musculus
gcaccaaccaccaggggacctatgt

SEQ ID NO: 302507 - DNA, 25 bp, Mus musculus
gcaccaaccaccagttcctggcctt

SEQ ID NO: 302508 - DNA, 25 bp, Mus musculus
gcaccaacgccagaaggaagaggca

SEQ ID NO: 302509 - DNA, 25 bp, Mus musculus
gcaccaagaaattcattcctgagtt

SEQ ID NO: 302510 - DNA, 25 bp, Mus musculus
gcaccaagaagctgcagcaataccc

SEQ ID NO: 302511 - DNA, 25 bp, Mus musculus
gcaccaagcagccttctctccgtgg

SEQ ID NO: 302512 - DNA, 25 bp, Mus musculus
gcaccaaggagcaggtcatgcttct

SEQ ID NO: 302513 - DNA, 25 bp, Mus musculus
gcaccaaggaggagacagcctgtgc

SEQ ID NO: 302514 - DNA, 25 bp, Mus musculus
gcaccaataaaatggatcttcattg

SEQ ID NO: 302515 - DNA, 25 bp, Mus musculus
gcaccaataaaattggtgttccccc

SEQ ID NO: 302516 - DNA, 25 bp, Mus musculus
gcaccaatgtgagatctggcgggag

SEQ ID NO: 302517 - DNA, 25 bp, Mus musculus
gcaccaatgtgagcacacagcatgt

SEQ ID NO: 302518 - DNA, 25 bp, Mus musculus
gcaccaccaggaagggtgttaggag

SEQ ID NO: 302519 - DNA, 25 bp, Mus musculus
gcaccacctgttccagaagttggca

SEQ ID NO: 302520 - DNA, 25 bp, Mus musculus
gcaccacgagatgtgtgttaaagga

SEQ ID NO: 302521 - DNA, 25 bp, Mus musculus
gcaccacgagcagataagaggagtc

SEQ ID NO: 302522 - DNA, 25 bp, Mus musculus
gcaccacgagcagttgttccaagtt

SEQ ID NO: 302523 - DNA, 25 bp, Mus musculus
gcaccacgaggatcagaacttatct

SEQ ID NO: 302524 - DNA, 25 bp, Mus musculus
gcaccactctcgggaagttattgga

SEQ ID NO: 302525 - DNA, 25 bp, Mus musculus
gcaccactgctgcgcaaggtatacc

SEQ ID NO: 302526 - DNA, 25 bp, Mus musculus
gcaccactggcaagatgtgctagtt

SEQ ID NO: 302527 - DNA, 25 bp, Mus musculus
gcaccactggcaaggctggtacaag

SEQ ID NO: 302528 - DNA, 25 bp, Mus musculus
gcaccagaagagatcctggctaaga

SEQ ID NO: 302529 - DNA, 25 bp, Mus musculus
gcaccagaagcagccaggcttctct

SEQ ID NO: 302530 - DNA, 25 bp, Mus musculus
gcaccagaagcagccatggaccctc

SEQ ID NO: 302531 - DNA, 25 bp, Mus musculus
gcaccagaatggcatccaggtgatc

SEQ ID NO: 302532 - DNA, 25 bp, Mus musculus
gcaccagacaagatgatagtagctg

SEQ ID NO: 302533 - DNA, 25 bp, Mus musculus
gcaccagatcagaatttcagcatat

SEQ ID NO: 302534 - DNA, 25 bp, Mus musculus
gcaccagatgccagcatgttgatga

SEQ ID NO: 302535 - DNA, 25 bp, Mus musculus
gcaccagatgccaggatgttgatga

SEQ ID NO: 302536 - DNA, 25 bp, Mus musculus
gcaccagcaagctgagttcctaccc

SEQ ID NO: 302537 - DNA, 25 bp, Mus musculus
gcaccagcagcacgcaggacttccc

SEQ ID NO: 302538 - DNA, 25 bp, Mus musculus
gcaccagcagcacggaggacttccc

SEQ ID NO: 302539 - DNA, 25 bp, Mus musculus
gcaccagcatttggtataggaggga

SEQ ID NO: 302540 - DNA, 25 bp, Mus musculus
gcaccagccctttgcttatgggaca

SEQ ID NO: 302541 - DNA, 25 bp, Mus musculus
gcaccagcgcagggaatggatacgg

SEQ ID NO: 302542 - DNA, 25 bp, Mus musculus
gcaccagcgtacagattgcatctgg

SEQ ID NO: 302543 - DNA, 25 bp, Mus musculus
gcaccagctatagacccatgcttgt

SEQ ID NO: 302544 - DNA, 25 bp, Mus musculus
gcaccagctgatcctgataccgcta

SEQ ID NO: 302545 - DNA, 25 bp, Mus musculus
gcaccaggaacacctgctgacctct

SEQ ID NO: 302546 - DNA, 25 bp, Mus musculus
gcaccaggaacacctttatctgaat

SEQ ID NO: 302547 - DNA, 25 bp, Mus musculus
gcaccaggacttggagagctgtcac

SEQ ID NO: 302548 - DNA, 25 bp, Mus musculus
gcaccaggatatgagtgttttatgg

SEQ ID NO: 302549 - DNA, 25 bp, Mus musculus
gcaccaggcaccaggtcctgtttat

SEQ ID NO: 302550 - DNA, 25 bp, Mus musculus
gcaccaggcagtgagatgtccctag

SEQ ID NO: 302551 - DNA, 25 bp, Mus musculus
gcaccaggcctggaagcaccagcct

SEQ ID NO: 302552 - DNA, 25 bp, Mus musculus
gcaccaggcctggggtccccttcct

SEQ ID NO: 302553 - DNA, 25 bp, Mus musculus
gcaccagtagcagtgtcagtgtgca

SEQ ID NO: 302554 - DNA, 25 bp, Mus musculus
gcaccagtcacagtttgtggggaca

SEQ ID NO: 302555 - DNA, 25 bp, Mus musculus
gcaccagtcgcggacagtggcaacc

SEQ ID NO: 302556 - DNA, 25 bp, Mus musculus
gcaccagtctcacagccgagggttg

SEQ ID NO: 302557 - DNA, 25 bp, Mus musculus
gcaccagtctctcaccatgtccaaa

SEQ ID NO: 302558 - DNA, 25 bp, Mus musculus
gcaccagtctgcgttaagcatctga

SEQ ID NO: 302559 - DNA, 25 bp, Mus musculus
gcaccagtgtttatggcttgaagat

SEQ ID NO: 302560 - DNA, 25 bp, Mus musculus
gcaccatacagaaatatgatcctcc

SEQ ID NO: 302561 - DNA, 25 bp, Mus musculus
gcaccatacaggatactgggaacct

SEQ ID NO: 302562 - DNA, 25 bp, Mus musculus
gcaccatcaatggtgcagtgcagtt

SEQ ID NO: 302563 - DNA, 25 bp, Mus musculus
gcaccatcaatgttgcctaatggga

SEQ ID NO: 302564 - DNA, 25 bp, Mus musculus
gcaccatcacaccaccagtcccgct

SEQ ID NO: 302565 - DNA, 25 bp, Mus musculus
gcaccatcaccaaaaatgggtacaa

SEQ ID NO: 302566 - DNA, 25 bp, Mus musculus
gcaccatcaccaagctcctccagac

SEQ ID NO: 302567 - DNA, 25 bp, Mus musculus
gcaccatcaccaagtcggatgctct

SEQ ID NO: 302568 - DNA, 25 bp, Mus musculus
gcaccatcagggtatatccgaatag

SEQ ID NO: 302569 - DNA, 25 bp, Mus musculus
gcaccatccagagagatgccaaagg

SEQ ID NO: 302570 - DNA, 25 bp, Mus musculus
gcaccatctgaaggacaaggagctc

SEQ ID NO: 302571 - DNA, 25 bp, Mus musculus
gcaccatcttcaccatggaaaagaa

SEQ ID NO: 302572 - DNA, 25 bp, Mus musculus
gcaccatgcaggctgtcttctcgtc

SEQ ID NO: 302573 - DNA, 25 bp, Mus musculus
gcaccatgccggcccgcaggcccaa

SEQ ID NO: 302574 - DNA, 25 bp, Mus musculus
gcaccatgccgggtggataccttgg

SEQ ID NO: 302575 - DNA, 25 bp, Mus musculus
gcaccatgctgaaaagagcaaggaa

SEQ ID NO: 302576 - DNA, 25 bp, Mus musculus
gcaccatgggaccctctagagtaat

SEQ ID NO: 302577 - DNA, 25 bp, Mus musculus
gcaccatggggtgcagggaagggga

SEQ ID NO: 302578 - DNA, 25 bp, Mus musculus
gcaccatgtgtgagcacgtgaatga

SEQ ID NO: 302579 - DNA, 25 bp, Mus musculus
gcaccatgtgtgaggacgtgaatga

SEQ ID NO: 302580 - DNA, 25 bp, Mus musculus
gcaccattaatctgtacccgcttac

SEQ ID NO: 302581 - DNA, 25 bp, Mus musculus
gcaccatttgtggggcggatgtctg

SEQ ID NO: 302582 - DNA, 25 bp, Mus musculus
gcaccatttgtggggtctcaaagca

SEQ ID NO: 302583 - DNA, 25 bp, Mus musculus
gcacccaaatagcgctggcgtggat

SEQ ID NO: 302584 - DNA, 25 bp, Mus musculus
gcacccaaatgcctggggaggataa

SEQ ID NO: 302585 - DNA, 25 bp, Mus musculus
gcacccaaatgttgataaaaatggt

SEQ ID NO: 302586 - DNA, 25 bp, Mus musculus
gcacccaactatactgtcactgccc

SEQ ID NO: 302587 - DNA, 25 bp, Mus musculus
gcacccacactgcactgcagaaggg

SEQ ID NO: 302588 - DNA, 25 bp, Mus musculus
gcacccacactgctgagaagccatt

SEQ ID NO: 302589 - DNA, 25 bp, Mus musculus
gcacccacactggactgcagaaggg

SEQ ID NO: 302590 - DNA, 25 bp, Mus musculus
gcacccacactggtgagaagccatt

SEQ ID NO: 302591 - DNA, 25 bp, Mus musculus
gcacccaccaggaagtacccagcga

SEQ ID NO: 302592 - DNA, 25 bp, Mus musculus
gcacccagaaggacctcttaaagtg

SEQ ID NO: 302593 - DNA, 25 bp, Mus musculus
gcacccagaaggcaagatcctcatc

SEQ ID NO: 302594 - DNA, 25 bp, Mus musculus
gcacccagaggcatcagaaaagttc

SEQ ID NO: 302595 - DNA, 25 bp, Mus musculus
gcacccagaggtccatggctgggga

SEQ ID NO: 302596 - DNA, 25 bp, Mus musculus
gcacccagctcagtggatctggcga

SEQ ID NO: 302597 - DNA, 25 bp, Mus musculus
gcacccagggaaaagttattaaatg

SEQ ID NO: 302598 - DNA, 25 bp, Mus musculus
gcacccaggttcaggaataagactg

SEQ ID NO: 302599 - DNA, 25 bp, Mus musculus
gcacccagttaaatcatcgggttat

SEQ ID NO: 302600 - DNA, 25 bp, Mus musculus
gcacccatacaggtagtgctgccct

SEQ ID NO: 302601 - DNA, 25 bp, Mus musculus
gcacccatcagaagcaagacgaccg

SEQ ID NO: 302602 - DNA, 25 bp, Mus musculus
gcaccccacgatggtacctcacact

SEQ ID NO: 302603 - DNA, 25 bp, Mus musculus
gcaccccacggacagacagctgttt

SEQ ID NO: 302604 - DNA, 25 bp, Mus musculus
gcaccccagagcgaagaggagcata

SEQ ID NO: 302605 - DNA, 25 bp, Mus musculus
gcaccccagagcgaatggcggaggc

SEQ ID NO: 302606 - DNA, 25 bp, Mus musculus
gcaccccccaaggatcgtgaactgg

SEQ ID NO: 302607 - DNA, 25 bp, Mus musculus
gcacccccgcttcggtactctaaca

SEQ ID NO: 302608 - DNA, 25 bp, Mus musculus
gcacccccgcttcggtatgactcaa

SEQ ID NO: 302609 - DNA, 25 bp, Mus musculus
gcaccccggccccagctgagtgatc

SEQ ID NO: 302610 - DNA, 25 bp, Mus musculus
gcaccccggccccagggctggctgt

SEQ ID NO: 302611 - DNA, 25 bp, Mus musculus
gcacccctacagccccagctaacca

SEQ ID NO: 302612 - DNA, 25 bp, Mus musculus
gcacccctacaggatggtcagaaca

SEQ ID NO: 302613 - DNA, 25 bp, Mus musculus
gcacccctacaggtctgtctgacct

SEQ ID NO: 302614 - DNA, 25 bp, Mus musculus
gcacccctacagtcagggtttctat

SEQ ID NO: 302615 - DNA, 25 bp, Mus musculus
gcacccctacagtgttctcaacatt

SEQ ID NO: 302616 - DNA, 25 bp, Mus musculus
gcacccctactctttctgacctgtg

SEQ ID NO: 302617 - DNA, 25 bp, Mus musculus
gcacccctgagtacttggctccaga

SEQ ID NO: 302618 - DNA, 25 bp, Mus musculus
gcacccctgccagataatcagcctt

SEQ ID NO: 302619 - DNA, 25 bp, Mus musculus
gcacccctgccagtctcctggctgc

SEQ ID NO: 302620 - DNA, 25 bp, Mus musculus
gcacccctttatcacggtatcagag

SEQ ID NO: 302621 - DNA, 25 bp, Mus musculus
gcacccctttatcagggtatcagag

SEQ ID NO: 302622 - DNA, 25 bp, Mus musculus
gcacccctttgagcccgctgtgagg

SEQ ID NO: 302623 - DNA, 25 bp, Mus musculus
gcacccctttgtactatgcctgcct

SEQ ID NO: 302624 - DNA, 25 bp, Mus musculus
gcacccgaaacgcgcacgcggctgg

SEQ ID NO: 302625 - DNA, 25 bp, Mus musculus
gcacccgagctaggggaagacaccc

SEQ ID NO: 302626 - DNA, 25 bp, Mus musculus
gcacccgcaaagcctccaggtgagg

SEQ ID NO: 302627 - DNA, 25 bp, Mus musculus
gcacccgccgaggtatttcaacaat

SEQ ID NO: 302628 - DNA, 25 bp, Mus musculus
gcacccgccgctcgccggccctgct

SEQ ID NO: 302629 - DNA, 25 bp, Mus musculus
gcacccgccgctcggttacctgcct

SEQ ID NO: 302630 - DNA, 25 bp, Mus musculus
gcacccgtaggacagattgcatctg

SEQ ID NO: 302631 - DNA, 25 bp, Mus musculus
gcaccctcaaaccaggtgatcatgc

SEQ ID NO: 302632 - DNA, 25 bp, Mus musculus
gcaccctcagcagtcccgtctactc

SEQ ID NO: 302633 - DNA, 25 bp, Mus musculus
gcaccctcagggaacagaagtcaag

SEQ ID NO: 302634 - DNA, 25 bp, Mus musculus
gcaccctctgatactccagatccaa

SEQ ID NO: 302635 - DNA, 25 bp, Mus musculus
gcaccctctgattgctaaagaagaa

SEQ ID NO: 302636 - DNA, 25 bp, Mus musculus
gcaccctgaagcaatcccacaggga

SEQ ID NO: 302637 - DNA, 25 bp, Mus musculus
gcaccctgaggagcaccactcccat

SEQ ID NO: 302638 - DNA, 25 bp, Mus musculus
gcaccctgcttatgaaagccatcac

SEQ ID NO: 302639 - DNA, 25 bp, Mus musculus
gcaccctgcttatgagtcagcagtg

SEQ ID NO: 302640 - DNA, 25 bp, Mus musculus
gcaccctggcgggaggcgcaacagc

SEQ ID NO: 302641 - DNA, 25 bp, Mus musculus
gcaccctggcgggagggctcaggat

SEQ ID NO: 302642 - DNA, 25 bp, Mus musculus
gcacccttacaaaggtgaccgggct

SEQ ID NO: 302643 - DNA, 25 bp, Mus musculus
gcacccttcagtacaagcccaccac

SEQ ID NO: 302644 - DNA, 25 bp, Mus musculus
gcacccttcccgctggctgtaattc

SEQ ID NO: 302645 - DNA, 25 bp, Mus musculus
gcacccttgcatcctctaccccctc

SEQ ID NO: 302646 - DNA, 25 bp, Mus musculus
gcaccgaagagagtgtgaacatggc

SEQ ID NO: 302647 - DNA, 25 bp, Mus musculus
gcaccgaagaggctaaccattttga

SEQ ID NO: 302648 - DNA, 25 bp, Mus musculus
gcaccgaatgcacaatctctgctgt

SEQ ID NO: 302649 - DNA, 25 bp, Mus musculus
gcaccgagagtgttgagggcgaggc

SEQ ID NO: 302650 - DNA, 25 bp, Mus musculus
gcaccgaggagagcactgcctgcac

SEQ ID NO: 302651 - DNA, 25 bp, Mus musculus
gcaccgaggagagccggatggcgca

SEQ ID NO: 302652 - DNA, 25 bp, Mus musculus
gcaccgaggcaaatacctcgctatt

SEQ ID NO: 302653 - DNA, 25 bp, Mus musculus
gcaccgaggcaaatcctggatggta

SEQ ID NO: 302654 - DNA, 25 bp, Mus musculus
gcaccgaggcaatctacgggctggt

SEQ ID NO: 302655 - DNA, 25 bp, Mus musculus
gcaccgagtggcagtgatcatgggc

SEQ ID NO: 302656 - DNA, 25 bp, Mus musculus
gcaccgatcgtgtatgacggagaga

SEQ ID NO: 302657 - DNA, 25 bp, Mus musculus
gcaccgatggagggtccgaagtaca

SEQ ID NO: 302658 - DNA, 25 bp, Mus musculus
gcaccgcaaatgagagtcagtcctt

SEQ ID NO: 302659 - DNA, 25 bp, Mus musculus
gcaccgcagacagacctcaagtact

SEQ ID NO: 302660 - DNA, 25 bp, Mus musculus
gcaccgccacacagacagatgatgc

SEQ ID NO: 302661 - DNA, 25 bp, Mus musculus
gcaccgcggaggctctgcagaagct

SEQ ID NO: 302662 - DNA, 25 bp, Mus musculus
gcaccgctacagggcattaggagac

SEQ ID NO: 302663 - DNA, 25 bp, Mus musculus
gcaccgctgatttaggaggacaggt

SEQ ID NO: 302664 - DNA, 25 bp, Mus musculus
gcaccggaacaggttcaagttcttt

SEQ ID NO: 302665 - DNA, 25 bp, Mus musculus
gcaccggacgccgagatgctccaga

SEQ ID NO: 302666 - DNA, 25 bp, Mus musculus
gcaccggagtcatgggggtctgctg

SEQ ID NO: 302667 - DNA, 25 bp, Mus musculus
gcaccggcctgacggaatgtatcct

SEQ ID NO: 302668 - DNA, 25 bp, Mus musculus
gcaccggcctgacgttatacaaaag

SEQ ID NO: 302669 - DNA, 25 bp, Mus musculus
gcaccggcgcgtaagcaatggcttc

SEQ ID NO: 302670 - DNA, 25 bp, Mus musculus
gcaccggcttctgccccccactgcc

SEQ ID NO: 302671 - DNA, 25 bp, Mus musculus
gcaccggcttctggaagtcacctgg

SEQ ID NO: 302672 - DNA, 25 bp, Mus musculus
gcaccggtaaaggtagctggagtta

SEQ ID NO: 302673 - DNA, 25 bp, Mus musculus
gcaccgtcaggctcaagtccacccc

SEQ ID NO: 302674 - DNA, 25 bp, Mus musculus
gcaccgtgaaggtctggacatgcta

SEQ ID NO: 302675 - DNA, 25 bp, Mus musculus
gcaccgtgacaagggtgaagatggg

SEQ ID NO: 302676 - DNA, 25 bp, Mus musculus
gcaccgtgacatggggggatggaca

SEQ ID NO: 302677 - DNA, 25 bp, Mus musculus
gcaccgtgagcgcctatgacttggt

SEQ ID NO: 302678 - DNA, 25 bp, Mus musculus
gcaccgtgcctccaggaataacagg

SEQ ID NO: 302679 - DNA, 25 bp, Mus musculus
gcaccgtgcctccaggagacacaaa

SEQ ID NO: 302680 - DNA, 25 bp, Mus musculus
gcaccgtggaggcccccgtcctgcg

SEQ ID NO: 302681 - DNA, 25 bp, Mus musculus
gcaccgtgtcgcgtcaagatggggt

SEQ ID NO: 302682 - DNA, 25 bp, Mus musculus
gcaccgtgtcgcgtgagatctccag

SEQ ID NO: 302683 - DNA, 25 bp, Mus musculus
gcaccgtgtttgaggccttattcag

SEQ ID NO: 302684 - DNA, 25 bp, Mus musculus
gcaccgttaagacagtgggttgtat

SEQ ID NO: 302685 - DNA, 25 bp, Mus musculus
gcacctaaagcatgcgaggtccttc

SEQ ID NO: 302686 - DNA, 25 bp, Mus musculus
gcacctaaagcatgtttctctagag

SEQ ID NO: 302687 - DNA, 25 bp, Mus musculus
gcacctaagggcagccagtccatca

SEQ ID NO: 302688 - DNA, 25 bp, Mus musculus
gcacctaagggtgctggagagtctg

SEQ ID NO: 302689 - DNA, 25 bp, Mus musculus
gcacctaatgccacagagcaacaac

SEQ ID NO: 302690 - DNA, 25 bp, Mus musculus
gcacctacaaaaaagtctgttgcaa

SEQ ID NO: 302691 - DNA, 25 bp, Mus musculus
gcacctaccaaactggcattatgga

SEQ ID NO: 302692 - DNA, 25 bp, Mus musculus
gcacctacctggcaggccatggctc

SEQ ID NO: 302693 - DNA, 25 bp, Mus musculus
gcacctacggcccagaccaccggca

SEQ ID NO: 302694 - DNA, 25 bp, Mus musculus
gcacctacgggctgactcctcacta

SEQ ID NO: 302695 - DNA, 25 bp, Mus musculus
gcacctacgtgctgaagtatgccgc

SEQ ID NO: 302696 - DNA, 25 bp, Mus musculus
gcacctacgtttgttgaaggagctg

SEQ ID NO: 302697 - DNA, 25 bp, Mus musculus
gcacctagagacaagtaagcagctg

SEQ ID NO: 302698 - DNA, 25 bp, Mus musculus
gcacctatagatggcattcgctcat

SEQ ID NO: 302699 - DNA, 25 bp, Mus musculus
gcacctatagtgtctataatataaa

SEQ ID NO: 302700 - DNA, 25 bp, Mus musculus
gcacctatatcctgaataaaaagtc

SEQ ID NO: 302701 - DNA, 25 bp, Mus musculus
gcacctatatcgagcttcttcctcc

SEQ ID NO: 302702 - DNA, 25 bp, Mus musculus
gcacctatgagagtcatcagagagt

SEQ ID NO: 302703 - DNA, 25 bp, Mus musculus
gcacctatgagtacttacagctacg

SEQ ID NO: 302704 - DNA, 25 bp, Mus musculus
gcacctattatggtaactttcggcc

SEQ ID NO: 302705 - DNA, 25 bp, Mus musculus
gcacctcaagagggagagaaaatga

SEQ ID NO: 302706 - DNA, 25 bp, Mus musculus
gcacctcaagaggtacctaagagta

SEQ ID NO: 302707 - DNA, 25 bp, Mus musculus
gcacctccaggacgtgtctcccact

SEQ ID NO: 302708 - DNA, 25 bp, Mus musculus
gcacctccaggacgtttctaagctg

SEQ ID NO: 302709 - DNA, 25 bp, Mus musculus
gcacctcccacacaggcgctctgaa

SEQ ID NO: 302710 - DNA, 25 bp, Mus musculus
gcacctcccaggaccccaagacact

SEQ ID NO: 302711 - DNA, 25 bp, Mus musculus
gcacctcctccagggagtgagtgct

SEQ ID NO: 302712 - DNA, 25 bp, Mus musculus
gcacctcctgattccactgtatcag

SEQ ID NO: 302713 - DNA, 25 bp, Mus musculus
gcacctcctgtgctttcgttggggc

SEQ ID NO: 302714 - DNA, 25 bp, Mus musculus
gcacctctccagattcactaaaaac

SEQ ID NO: 302715 - DNA, 25 bp, Mus musculus
gcacctctccagcgttccctgctgg

SEQ ID NO: 302716 - DNA, 25 bp, Mus musculus
gcacctctccagtctctagataagg

SEQ ID NO: 302717 - DNA, 25 bp, Mus musculus
gcacctctcgggacggagatactac

SEQ ID NO: 302718 - DNA, 25 bp, Mus musculus
gcacctctcgggacgggccctggtg

SEQ ID NO: 302719 - DNA, 25 bp, Mus musculus
gcacctctcgggacggttcaatgta

SEQ ID NO: 302720 - DNA, 25 bp, Mus musculus
gcacctctggaaggggcgtatgatc

SEQ ID NO: 302721 - DNA, 25 bp, Mus musculus
gcacctctggaggctcctgctcctc

SEQ ID NO: 302722 - DNA, 25 bp, Mus musculus
gcacctctgggaggacactgtgtgg

SEQ ID NO: 302723 - DNA, 25 bp, Mus musculus
gcacctctgggagtttgtcctgggc

SEQ ID NO: 302724 - DNA, 25 bp, Mus musculus
gcacctctgtggaggaaatcctgaa

SEQ ID NO: 302725 - DNA, 25 bp, Mus musculus
gcacctgaaaacagcaatgcaggga

SEQ ID NO: 302726 - DNA, 25 bp, Mus musculus
gcacctgacaaaggttctgggagag

SEQ ID NO: 302727 - DNA, 25 bp, Mus musculus
gcacctgacagtgaggatccaaagg

SEQ ID NO: 302728 - DNA, 25 bp, Mus musculus
gcacctgaggacaaagtctggagct

SEQ ID NO: 302729 - DNA, 25 bp, Mus musculus
gcacctgcacacataacaccaatga

SEQ ID NO: 302730 - DNA, 25 bp, Mus musculus
gcacctgcaccatcgccaagaacag

SEQ ID NO: 302731 - DNA, 25 bp, Mus musculus
gcacctgcagactctgcagaggcag

SEQ ID NO: 302732 - DNA, 25 bp, Mus musculus
gcacctgcagcctgctccccaggga

SEQ ID NO: 302733 - DNA, 25 bp, Mus musculus
gcacctgccaatgttctctcgggag

SEQ ID NO: 302734 - DNA, 25 bp, Mus musculus
gcacctgccaggccacagacctccc

SEQ ID NO: 302735 - DNA, 25 bp, Mus musculus
gcacctgccaggtaagaagaaaata

SEQ ID NO: 302736 - DNA, 25 bp, Mus musculus
gcacctgccggctgcgaccgagggc

SEQ ID NO: 302737 - DNA, 25 bp, Mus musculus
gcacctgcctcctcagaagactcag

SEQ ID NO: 302738 - DNA, 25 bp, Mus musculus
gcacctgcgagcaagggtctctgat

SEQ ID NO: 302739 - DNA, 25 bp, Mus musculus
gcacctgcgagcaaggtccttccat

SEQ ID NO: 302740 - DNA, 25 bp, Mus musculus
gcacctgcggacggcatcgctgtcc

SEQ ID NO: 302741 - DNA, 25 bp, Mus musculus
gcacctgcggctctatcagaacttt

SEQ ID NO: 302742 - DNA, 25 bp, Mus musculus
gcacctgcgggtcagattatcgccc

SEQ ID NO: 302743 - DNA, 25 bp, Mus musculus
gcacctggaagaccgatgctgtgac

SEQ ID NO: 302744 - DNA, 25 bp, Mus musculus
gcacctggaagatgctggagaccat

SEQ ID NO: 302745 - DNA, 25 bp, Mus musculus
gcacctggaagctgtggtgtacctg

SEQ ID NO: 302746 - DNA, 25 bp, Mus musculus
gcacctggaaggcctccccaggaga

SEQ ID NO: 302747 - DNA, 25 bp, Mus musculus
gcacctggaaggtatgacattatga

SEQ ID NO: 302748 - DNA, 25 bp, Mus musculus
gcacctggaagtcccctcctggcca

SEQ ID NO: 302749 - DNA, 25 bp, Mus musculus
gcacctggaagtcttccccaggcca

SEQ ID NO: 302750 - DNA, 25 bp, Mus musculus
gcacctggagatctgcctgtcaatg

SEQ ID NO: 302751 - DNA, 25 bp, Mus musculus
gcacctggatgcaccctgctcttca

SEQ ID NO: 302752 - DNA, 25 bp, Mus musculus
gcacctggatgcattttgttcccaa

SEQ ID NO: 302753 - DNA, 25 bp, Mus musculus
gcacctggctgagttcactcacgtg

SEQ ID NO: 302754 - DNA, 25 bp, Mus musculus
gcacctggggcagggaagaggtgcc

SEQ ID NO: 302755 - DNA, 25 bp, Mus musculus
gcacctggtcagtgagcctggaggc

SEQ ID NO: 302756 - DNA, 25 bp, Mus musculus
gcacctggtgctaagggtgaagctg

SEQ ID NO: 302757 - DNA, 25 bp, Mus musculus
gcacctgtcagaaccacccccgcca

SEQ ID NO: 302758 - DNA, 25 bp, Mus musculus
gcacctgtcagacaccactaactgt

SEQ ID NO: 302759 - DNA, 25 bp, Mus musculus
gcacctgtcagacgagaagaacggg

SEQ ID NO: 302760 - DNA, 25 bp, Mus musculus
gcacctgtccaggcgtttcttttga

SEQ ID NO: 302761 - DNA, 25 bp, Mus musculus
gcacctgtgagcaggagccagagga

SEQ ID NO: 302762 - DNA, 25 bp, Mus musculus
gcacctgtgctcaagttactgggcc

SEQ ID NO: 302763 - DNA, 25 bp, Mus musculus
gcacctgttacctgggcccccagat

SEQ ID NO: 302764 - DNA, 25 bp, Mus musculus
gcaccttaggagtgtaaagagctgg

SEQ ID NO: 302765 - DNA, 25 bp, Mus musculus
gcaccttcaagctggatcttctatc

SEQ ID NO: 302766 - DNA, 25 bp, Mus musculus
gcaccttcaagctgggtgcgcatgg

SEQ ID NO: 302767 - DNA, 25 bp, Mus musculus
gcaccttcagaggcagagagagatc

SEQ ID NO: 302768 - DNA, 25 bp, Mus musculus
gcaccttcagctacatcaggtagtt

SEQ ID NO: 302769 - DNA, 25 bp, Mus musculus
gcaccttcagctatctaacttcact

SEQ ID NO: 302770 - DNA, 25 bp, Mus musculus
gcaccttcccacagcatcgccaaat

SEQ ID NO: 302771 - DNA, 25 bp, Mus musculus
gcaccttcccacaggtctgcctctc

SEQ ID NO: 302772 - DNA, 25 bp, Mus musculus
gcaccttccggcagaaaggtgttgg

SEQ ID NO: 302773 - DNA, 25 bp, Mus musculus
gcaccttcctccggcatgagatcgc

SEQ ID NO: 302774 - DNA, 25 bp, Mus musculus
gcaccttcctcctgcaacagaatgg

SEQ ID NO: 302775 - DNA, 25 bp, Mus musculus
gcaccttgaagatccttcgtaccta

SEQ ID NO: 302776 - DNA, 25 bp, Mus musculus
gcaccttggacaaagtctcgactgc

SEQ ID NO: 302777 - DNA, 25 bp, Mus musculus
gcaccttggagaagattgctggcct

SEQ ID NO: 302778 - DNA, 25 bp, Mus musculus
gcaccttggagagaatatgtttgac

SEQ ID NO: 302779 - DNA, 25 bp, Mus musculus
gcaccttggagccgggagttgatac

SEQ ID NO: 302780 - DNA, 25 bp, Mus musculus
gcaccttggccaccacacagagtca

SEQ ID NO: 302781 - DNA, 25 bp, Mus musculus
gcaccttggccaccactcctaatag

SEQ ID NO: 302782 - DNA, 25 bp, Mus musculus
gcaccttggccaccagagatcgaga

SEQ ID NO: 302783 - DNA, 25 bp, Mus musculus
gcaccttggccaccattgcaagtac

SEQ ID NO: 302784 - DNA, 25 bp, Mus musculus
gcaccttggccaccattgcctcaac

SEQ ID NO: 302785 - DNA, 25 bp, Mus musculus
gcaccttgggccagattgtgtcaca

SEQ ID NO: 302786 - DNA, 25 bp, Mus musculus
gcaccttgggccaggctgctgtaga

SEQ ID NO: 302787 - DNA, 25 bp, Mus musculus
gcaccttggtggaacactctggacg

SEQ ID NO: 302788 - DNA, 25 bp, Mus musculus
gcacctttagagggtctgatatgcc

SEQ ID NO: 302789 - DNA, 25 bp, Mus musculus
gcacctttcagggaagccagctgca

SEQ ID NO: 302790 - DNA, 25 bp, Mus musculus
gcacctttcctcagatttcctccct

SEQ ID NO: 302791 - DNA, 25 bp, Mus musculus
gcacctttctcagtacattcgctca

SEQ ID NO: 302792 - DNA, 25 bp, Mus musculus
gcacctttggaaggttattatgttg

SEQ ID NO: 302793 - DNA, 25 bp, Mus musculus
gcacgaaagtgagggaagactcccg

SEQ ID NO: 302794 - DNA, 25 bp, Mus musculus
gcacgaaagttgcaggatgtgtttg

SEQ ID NO: 302795 - DNA, 25 bp, Mus musculus
gcacgaaatgaggacaagctactgc

SEQ ID NO: 302796 - DNA, 25 bp, Mus musculus
gcacgaagaagactggaaacagcaa

SEQ ID NO: 302797 - DNA, 25 bp, Mus musculus
gcacgaagaagcctcagcaaaagaa

SEQ ID NO: 302798 - DNA, 25 bp, Mus musculus
gcacgaagcaataagtcctatgaat

SEQ ID NO: 302799 - DNA, 25 bp, Mus musculus
gcacgaagtagtttttgacagaaaa

SEQ ID NO: 302800 - DNA, 25 bp, Mus musculus
gcacgaagtcacgagcttcgttacc

SEQ ID NO: 302801 - DNA, 25 bp, Mus musculus
gcacgaattgcagcatttgctgatg

SEQ ID NO: 302802 - DNA, 25 bp, Mus musculus
gcacgacaggaaatgcttgccccta

SEQ ID NO: 302803 - DNA, 25 bp, Mus musculus
gcacgacaggaaatggctctctgct

SEQ ID NO: 302804 - DNA, 25 bp, Mus musculus
gcacgaccggtggcttgttggcaga

SEQ ID NO: 302805 - DNA, 25 bp, Mus musculus
gcacgaccgtccggtgcgtataact

SEQ ID NO: 302806 - DNA, 25 bp, Mus musculus
gcacgaccgtccggtgttctggctg

SEQ ID NO: 302807 - DNA, 25 bp, Mus musculus
gcacgactccgtgaacgctctcact

SEQ ID NO: 302808 - DNA, 25 bp, Mus musculus
gcacgactgctgatgaagtgactga

SEQ ID NO: 302809 - DNA, 25 bp, Mus musculus
gcacgacttggctctgctgcgcctg

SEQ ID NO: 302810 - DNA, 25 bp, Mus musculus
gcacgagaacagcgactactgtgaa

SEQ ID NO: 302811 - DNA, 25 bp, Mus musculus
gcacgagacagaagcaccattgcaa

SEQ ID NO: 302812 - DNA, 25 bp, Mus musculus
gcacgagaggacaatagccttaaag

SEQ ID NO: 302813 - DNA, 25 bp, Mus musculus
gcacgagcaagagtactgtttggca

SEQ ID NO: 302814 - DNA, 25 bp, Mus musculus
gcacgaggagtcttcctgtagaaat

SEQ ID NO: 302815 - DNA, 25 bp, Mus musculus
gcacgagggcgcggtgtggacaaat

SEQ ID NO: 302816 - DNA, 25 bp, Mus musculus
gcacgagtccggggaagtgtgttta

SEQ ID NO: 302817 - DNA, 25 bp, Mus musculus
gcacgataaggaagagcggatccgt

SEQ ID NO: 302818 - DNA, 25 bp, Mus musculus
gcacgatcctgacatgactgactta

SEQ ID NO: 302819 - DNA, 25 bp, Mus musculus
gcacgatctggagatgaaaccaata

SEQ ID NO: 302820 - DNA, 25 bp, Mus musculus
gcacgatctggatatgatgaatgga

SEQ ID NO: 302821 - DNA, 25 bp, Mus musculus
gcacgatgaacttggtaagttctcg

SEQ ID NO: 302822 - DNA, 25 bp, Mus musculus
gcacgatgtaaccagcctcaggagt

SEQ ID NO: 302823 - DNA, 25 bp, Mus musculus
gcacgcaactgatttagatgaaaaa

SEQ ID NO: 302824 - DNA, 25 bp, Mus musculus
gcacgcacaggaaatcccaatggca

SEQ ID NO: 302825 - DNA, 25 bp, Mus musculus
gcacgcacctggaagggtctgttcc

SEQ ID NO: 302826 - DNA, 25 bp, Mus musculus
gcacgcaggatggacctctctacgt

SEQ ID NO: 302827 - DNA, 25 bp, Mus musculus
gcacgcaggatgtgtatccatcgag

SEQ ID NO: 302828 - DNA, 25 bp, Mus musculus
gcacgccacaggactacagtgggag

SEQ ID NO: 302829 - DNA, 25 bp, Mus musculus
gcacgccatgtatgtttccaccggc

SEQ ID NO: 302830 - DNA, 25 bp, Mus musculus
gcacgcccattcaggtgcgctgctc

SEQ ID NO: 302831 - DNA, 25 bp, Mus musculus
gcacgccgccagagacggcaaagag

SEQ ID NO: 302832 - DNA, 25 bp, Mus musculus
gcacgccgggcaggcctcagcattt

SEQ ID NO: 302833 - DNA, 25 bp, Mus musculus
gcacgccgtggtgcgcagttcctgg

SEQ ID NO: 302834 - DNA, 25 bp, Mus musculus
gcacgcctacagcttcctggtggct

SEQ ID NO: 302835 - DNA, 25 bp, Mus musculus
gcacgcgaggagcatgtcatgttgc

SEQ ID NO: 302836 - DNA, 25 bp, Mus musculus
gcacgcgcttgccgacccttcccgg

SEQ ID NO: 302837 - DNA, 25 bp, Mus musculus
gcacgcggaaagagaactagatcag

SEQ ID NO: 302838 - DNA, 25 bp, Mus musculus
gcacgcggcggcccgacgctgcggc

SEQ ID NO: 302839 - DNA, 25 bp, Mus musculus
gcacgcggctggttggcgagaatct

SEQ ID NO: 302840 - DNA, 25 bp, Mus musculus
gcacgcggctggttgggaatgtgac

SEQ ID NO: 302841 - DNA, 25 bp, Mus musculus
gcacgcgggagaggtaaggctgacc

SEQ ID NO: 302842 - DNA, 25 bp, Mus musculus
gcacgcgggagagttttctctgtca

SEQ ID NO: 302843 - DNA, 25 bp, Mus musculus
gcacgcggtcagaactgtgccggat

SEQ ID NO: 302844 - DNA, 25 bp, Mus musculus
gcacgcgtgagcatgcgctacgtcg

SEQ ID NO: 302845 - DNA, 25 bp, Mus musculus
gcacgctcaggaacaagaatttgtt

SEQ ID NO: 302846 - DNA, 25 bp, Mus musculus
gcacgctgatgaccctgactatata

SEQ ID NO: 302847 - DNA, 25 bp, Mus musculus
gcacgctgatgaccgacccttgggt

SEQ ID NO: 302848 - DNA, 25 bp, Mus musculus
gcacgctgatgtgggtgtagcactc

SEQ ID NO: 302849 - DNA, 25 bp, Mus musculus
gcacgcttgatgtggggcctgcgcg

SEQ ID NO: 302850 - DNA, 25 bp, Mus musculus
gcacggaccgaaagtgagaagcaac

SEQ ID NO: 302851 - DNA, 25 bp, Mus musculus
gcacggagagaagaaaccaaaacca

SEQ ID NO: 302852 - DNA, 25 bp, Mus musculus
gcacggagtggactgctggatccct

SEQ ID NO: 302853 - DNA, 25 bp, Mus musculus
gcacggagtgtctcgctgtcactga

SEQ ID NO: 302854 - DNA, 25 bp, Mus musculus
gcacggagtgtgatcgtttggaaaa

SEQ ID NO: 302855 - DNA, 25 bp, Mus musculus
gcacggcaacagatttctttctttc

SEQ ID NO: 302856 - DNA, 25 bp, Mus musculus
gcacggcaacaggcctgatgggatt

SEQ ID NO: 302857 - DNA, 25 bp, Mus musculus
gcacggcaagtgctggaacacctgc

SEQ ID NO: 302858 - DNA, 25 bp, Mus musculus
gcacggcactgccactgattccagg

SEQ ID NO: 302859 - DNA, 25 bp, Mus musculus
gcacggcatctataatgtcacccag

SEQ ID NO: 302860 - DNA, 25 bp, Mus musculus
gcacggcatctatgcggagctgacc

SEQ ID NO: 302861 - DNA, 25 bp, Mus musculus
gcacggcatctatgtacgtgccctg

SEQ ID NO: 302862 - DNA, 25 bp, Mus musculus
gcacggcccaggccgcccaaaccca

SEQ ID NO: 302863 - DNA, 25 bp, Mus musculus
gcacggcgggagggagcccagagga

SEQ ID NO: 302864 - DNA, 25 bp, Mus musculus
gcacggctccagaaagatgacagga

SEQ ID NO: 302865 - DNA, 25 bp, Mus musculus
gcacggctcgggacggagatgaaac

SEQ ID NO: 302866 - DNA, 25 bp, Mus musculus
gcacggctcgggacggttcagtgta

SEQ ID NO: 302867 - DNA, 25 bp, Mus musculus
gcacgggaaagaaaacaaacattac

SEQ ID NO: 302868 - DNA, 25 bp, Mus musculus
gcacgggaaagaaacactcatcatt

SEQ ID NO: 302869 - DNA, 25 bp, Mus musculus
gcacgggaaaggccggatggaccaa

SEQ ID NO: 302870 - DNA, 25 bp, Mus musculus
gcacgggaaggaagtgggcagcatc

SEQ ID NO: 302871 - DNA, 25 bp, Mus musculus
gcacgggaaggcagaagaaatactt

SEQ ID NO: 302872 - DNA, 25 bp, Mus musculus
gcacgggcaccccagctggagtcct

SEQ ID NO: 302873 - DNA, 25 bp, Mus musculus
gcacgggcaccccaggaatgcacca

SEQ ID NO: 302874 - DNA, 25 bp, Mus musculus
gcacgggcgaccagccaggtcccag

SEQ ID NO: 302875 - DNA, 25 bp, Mus musculus
gcacgggcgaccaggacctataaga

SEQ ID NO: 302876 - DNA, 25 bp, Mus musculus
gcacgggctacaggttgcgttacag

SEQ ID NO: 302877 - DNA, 25 bp, Mus musculus
gcacggggcaatacaatgaggagac

SEQ ID NO: 302878 - DNA, 25 bp, Mus musculus
gcacggggcaatacattgctatagc

SEQ ID NO: 302879 - DNA, 25 bp, Mus musculus
gcacggggtagtgatccattgtagg

SEQ ID NO: 302880 - DNA, 25 bp, Mus musculus
gcacgggtgagtttcacggagaaat

SEQ ID NO: 302881 - DNA, 25 bp, Mus musculus
gcacggtgaagatctggaacaacga

SEQ ID NO: 302882 - DNA, 25 bp, Mus musculus
gcacggtgaatccaggtttgatctg

SEQ ID NO: 302883 - DNA, 25 bp, Mus musculus
gcacggtggattgattcgttctccc

SEQ ID NO: 302884 - DNA, 25 bp, Mus musculus
gcacggtggtttgaggtcctccaga

SEQ ID NO: 302885 - DNA, 25 bp, Mus musculus
gcacggttagtgctggattcgagtt

SEQ ID NO: 302886 - DNA, 25 bp, Mus musculus
gcacggttcagatcctgagggaaga

SEQ ID NO: 302887 - DNA, 25 bp, Mus musculus
gcacggttcagcaactgcgctccaa

SEQ ID NO: 302888 - DNA, 25 bp, Mus musculus
gcacggttgcccaggtgacagatta

SEQ ID NO: 302889 - DNA, 25 bp, Mus musculus
gcacgtacaagagagaaatgtcttc

SEQ ID NO: 302890 - DNA, 25 bp, Mus musculus
gcacgtagtggacaagctactgcag

SEQ ID NO: 302891 - DNA, 25 bp, Mus musculus
gcacgtagtggtcacaggaggctcc

SEQ ID NO: 302892 - DNA, 25 bp, Mus musculus
gcacgtcaaccaggaaaccaaaaag

SEQ ID NO: 302893 - DNA, 25 bp, Mus musculus
gcacgtcgacgacagggaacgaatg

SEQ ID NO: 302894 - DNA, 25 bp, Mus musculus
gcacgtctacaagacgctgaaggac

SEQ ID NO: 302895 - DNA, 25 bp, Mus musculus
gcacgtctacaaggccatgacgttg

SEQ ID NO: 302896 - DNA, 25 bp, Mus musculus
gcacgtctcagaaggtggacactgc

SEQ ID NO: 302897 - DNA, 25 bp, Mus musculus
gcacgtctgcagctggtgagccgcg

SEQ ID NO: 302898 - DNA, 25 bp, Mus musculus
gcacgtctgccagtgcgaccagtac

SEQ ID NO: 302899 - DNA, 25 bp, Mus musculus
gcacgtctttgaccatccatgggaa

SEQ ID NO: 302900 - DNA, 25 bp, Mus musculus
gcacgtctttgacttattggtgcag

SEQ ID NO: 302901 - DNA, 25 bp, Mus musculus
gcacgtgacagtgggctccctgctg

SEQ ID NO: 302902 - DNA, 25 bp, Mus musculus
gcacgtgcagcgcccacaggcccgc

SEQ ID NO: 302903 - DNA, 25 bp, Mus musculus
gcacgtgcagggtccccgacaacaa

SEQ ID NO: 302904 - DNA, 25 bp, Mus musculus
gcacgtgcatagatacctgctgctg

SEQ ID NO: 302905 - DNA, 25 bp, Mus musculus
gcacgtgctgcaaggtgatgaagtc

SEQ ID NO: 302906 - DNA, 25 bp, Mus musculus
gcacgtggaacaagtgctagccatt

SEQ ID NO: 302907 - DNA, 25 bp, Mus musculus
gcacgtggctgttttgcccattgga

SEQ ID NO: 302908 - DNA, 25 bp, Mus musculus
gcacgtggggaatgggagaagagtt

SEQ ID NO: 302909 - DNA, 25 bp, Mus musculus
gcacgtggggaatgggagaagatgc

SEQ ID NO: 302910 - DNA, 25 bp, Mus musculus
gcacgtgtgggatctttctcaagtg

SEQ ID NO: 302911 - DNA, 25 bp, Mus musculus
gcactaaaacggatggctctccaac

SEQ ID NO: 302912 - DNA, 25 bp, Mus musculus
gcactaacaggaatgcagaaacaaa

SEQ ID NO: 302913 - DNA, 25 bp, Mus musculus
gcactaagaaggagaagaccaccag

SEQ ID NO: 302914 - DNA, 25 bp, Mus musculus
gcactaatcaggaaaatggcagaca

SEQ ID NO: 302915 - DNA, 25 bp, Mus musculus
gcactaatgagatggatcccccgga

SEQ ID NO: 302916 - DNA, 25 bp, Mus musculus
gcactacacagcagcgtaccccgca

SEQ ID NO: 302917 - DNA, 25 bp, Mus musculus
gcactacacagccattaggaaccag

SEQ ID NO: 302918 - DNA, 25 bp, Mus musculus
gcactacacagcctccagccctggt

SEQ ID NO: 302919 - DNA, 25 bp, Mus musculus
gcactacacaggacaccaaggactt

SEQ ID NO: 302920 - DNA, 25 bp, Mus musculus
gcactacacgtacgtgaaggaattc

SEQ ID NO: 302921 - DNA, 25 bp, Mus musculus
gcactacagactgcagttctatatg

SEQ ID NO: 302922 - DNA, 25 bp, Mus musculus
gcactaccaggaagacatgggatct

SEQ ID NO: 302923 - DNA, 25 bp, Mus musculus
gcactacccaggaaaatggcagaca

SEQ ID NO: 302924 - DNA, 25 bp, Mus musculus
gcactaccctggctgtatcaacctc

SEQ ID NO: 302925 - DNA, 25 bp, Mus musculus
gcactacgagctcagaaacaaatac

SEQ ID NO: 302926 - DNA, 25 bp, Mus musculus
gcactacgagctcagaatattattg

SEQ ID NO: 302927 - DNA, 25 bp, Mus musculus
gcactacgagctcaggtcctgaact

SEQ ID NO: 302928 - DNA, 25 bp, Mus musculus
gcactacgagtaccggcatgtcatg

SEQ ID NO: 302929 - DNA, 25 bp, Mus musculus
gcactacgcgggtgacttcacctgg

SEQ ID NO: 302930 - DNA, 25 bp, Mus musculus
gcactagaattaaaggtttgggatc

SEQ ID NO: 302931 - DNA, 25 bp, Mus musculus
gcactagatatcaaaatcgggtcat

SEQ ID NO: 302932 - DNA, 25 bp, Mus musculus
gcactagatatcaatctgtggttct

SEQ ID NO: 302933 - DNA, 25 bp, Mus musculus
gcactagcaggtatggcggctctga

SEQ ID NO: 302934 - DNA, 25 bp, Mus musculus
gcactagcagttgctcaaatgctct

SEQ ID NO: 302935 - DNA, 25 bp, Mus musculus
gcactagctagtccgtgtactttgt

SEQ ID NO: 302936 - DNA, 25 bp, Mus musculus
gcactagctcttcagctctggggac

SEQ ID NO: 302937 - DNA, 25 bp, Mus musculus
gcactagctcttcaggactgggcag

SEQ ID NO: 302938 - DNA, 25 bp, Mus musculus
gcactaggataacaggtccagttgt

SEQ ID NO: 302939 - DNA, 25 bp, Mus musculus
gcactagggaaggtcccggatgttg

SEQ ID NO: 302940 - DNA, 25 bp, Mus musculus
gcactataaagtcgtaaaatatgaa

SEQ ID NO: 302941 - DNA, 25 bp, Mus musculus
gcactatcccgctcgggcaaagtct

SEQ ID NO: 302942 - DNA, 25 bp, Mus musculus
gcactatcgaagttgagaataccac

SEQ ID NO: 302943 - DNA, 25 bp, Mus musculus
gcactatgagtctacctgaaggact

SEQ ID NO: 302944 - DNA, 25 bp, Mus musculus
gcactatgccaaaaataaagcagtt

SEQ ID NO: 302945 - DNA, 25 bp, Mus musculus
gcactatgggaaagagattctgaaa

SEQ ID NO: 302946 - DNA, 25 bp, Mus musculus
gcactatgggagaaataccgacagt

SEQ ID NO: 302947 - DNA, 25 bp, Mus musculus
gcactattaaggaggccttgtcagt

SEQ ID NO: 302948 - DNA, 25 bp, Mus musculus
gcactcaaatgaacatggttggtgc

SEQ ID NO: 302949 - DNA, 25 bp, Mus musculus
gcactcaactggctcgggagccttt

SEQ ID NO: 302950 - DNA, 25 bp, Mus musculus
gcactcaagcaacagcaaatgaagc

SEQ ID NO: 302951 - DNA, 25 bp, Mus musculus
gcactcaaggcagcccctgttacag

SEQ ID NO: 302952 - DNA, 25 bp, Mus musculus
gcactcacagcagggaccctgggtg

SEQ ID NO: 302953 - DNA, 25 bp, Mus musculus
gcactcaccactttgccctgttctt

SEQ ID NO: 302954 - DNA, 25 bp, Mus musculus
gcactcactgtcctgagagggttgt

SEQ ID NO: 302955 - DNA, 25 bp, Mus musculus
gcactcactgtgacgagggtggctc

SEQ ID NO: 302956 - DNA, 25 bp, Mus musculus
gcactcactgtgagcacagcggcta

SEQ ID NO: 302957 - DNA, 25 bp, Mus musculus
gcactcagaaagaagctagacgaaa

SEQ ID NO: 302958 - DNA, 25 bp, Mus musculus
gcactcagaattccgggagtgatcg

SEQ ID NO: 302959 - DNA, 25 bp, Mus musculus
gcactcagacagatggtgcagagga

SEQ ID NO: 302960 - DNA, 25 bp, Mus musculus
gcactcagcctggaggacacagagc

SEQ ID NO: 302961 - DNA, 25 bp, Mus musculus
gcactcaggagacagggaagaagcc

SEQ ID NO: 302962 - DNA, 25 bp, Mus musculus
gcactcatcatggtggacaatgcca

SEQ ID NO: 302963 - DNA, 25 bp, Mus musculus
gcactcatccagctcttcttacatc

SEQ ID NO: 302964 - DNA, 25 bp, Mus musculus
gcactcatgggtggaggtgggaaag

SEQ ID NO: 302965 - DNA, 25 bp, Mus musculus
gcactcccactgggtgtggagtgtg

SEQ ID NO: 302966 - DNA, 25 bp, Mus musculus
gcactccgccaagtggtttgctggt

SEQ ID NO: 302967 - DNA, 25 bp, Mus musculus
gcactccgcgtgcggtttctagagc

SEQ ID NO: 302968 - DNA, 25 bp, Mus musculus
gcactcctattcagaccctcagtgc

SEQ ID NO: 302969 - DNA, 25 bp, Mus musculus
gcactcctggtggtgaccgcaggga

SEQ ID NO: 302970 - DNA, 25 bp, Mus musculus
gcactcctggtggtgcgtcttctgg

SEQ ID NO: 302971 - DNA, 25 bp, Mus musculus
gcactcgagacgggccattgctcct

SEQ ID NO: 302972 - DNA, 25 bp, Mus musculus
gcactcgcagaacaccagcctcatc

SEQ ID NO: 302973 - DNA, 25 bp, Mus musculus
gcactcggatcaaacagggttcctc

SEQ ID NO: 302974 - DNA, 25 bp, Mus musculus
gcactcggatcaatgcacaaagaag

SEQ ID NO: 302975 - DNA, 25 bp, Mus musculus
gcactcgggaaacaggacccagcca

SEQ ID NO: 302976 - DNA, 25 bp, Mus musculus
gcactcgggaggcagaggcaggcgg

SEQ ID NO: 302977 - DNA, 25 bp, Mus musculus
gcactcgtgtccgacttcagaggat

SEQ ID NO: 302978 - DNA, 25 bp, Mus musculus
gcactcgtgtccgatttattaacct

SEQ ID NO: 302979 - DNA, 25 bp, Mus musculus
gcactctatgttttctcagtgccca

SEQ ID NO: 302980 - DNA, 25 bp, Mus musculus
gcactctcagctccagctagaagat

SEQ ID NO: 302981 - DNA, 25 bp, Mus musculus
gcactctcagctgagcagcaagaac

SEQ ID NO: 302982 - DNA, 25 bp, Mus musculus
gcactctcagctgctttgctgctgc

SEQ ID NO: 302983 - DNA, 25 bp, Mus musculus
gcactctcaggctaccggctctctg

SEQ ID NO: 302984 - DNA, 25 bp, Mus musculus
gcactctccaaccagccaatagtta

SEQ ID NO: 302985 - DNA, 25 bp, Mus musculus
gcactctccaaccagttacagttag

SEQ ID NO: 302986 - DNA, 25 bp, Mus musculus
gcactctcctccaggcacaactgtg

SEQ ID NO: 302987 - DNA, 25 bp, Mus musculus
gcactctgagatcttggcatataca

SEQ ID NO: 302988 - DNA, 25 bp, Mus musculus
gcactctgcgaagggaaatgctcat

SEQ ID NO: 302989 - DNA, 25 bp, Mus musculus
gcactctggctgggcgctcaccctc

SEQ ID NO: 302990 - DNA, 25 bp, Mus musculus
gcactctgggacccgaacaatttcg

SEQ ID NO: 302991 - DNA, 25 bp, Mus musculus
gcactctgtgggtcatttctctgca

SEQ ID NO: 302992 - DNA, 25 bp, Mus musculus
gcactcttcatggcgaagaagaaga

SEQ ID NO: 302993 - DNA, 25 bp, Mus musculus
gcactgaaaagaggacagaactaga

SEQ ID NO: 302994 - DNA, 25 bp, Mus musculus
gcactgaaaagggttcccagcccca

SEQ ID NO: 302995 - DNA, 25 bp, Mus musculus
gcactgaaataaccagctttcactc

SEQ ID NO: 302996 - DNA, 25 bp, Mus musculus
gcactgaaccgctggttgggtgaac

SEQ ID NO: 302997 - DNA, 25 bp, Mus musculus
gcactgaagatgaaccggaagtatg

SEQ ID NO: 302998 - DNA, 25 bp, Mus musculus
gcactgaagtggactgcctgcgagc

SEQ ID NO: 302999 - DNA, 25 bp, Mus musculus
gcactgaattcaaaggaggttcatg

SEQ ID NO: 303000 - DNA, 25 bp, Mus musculus
gcactgacatggttcctgccatctc

SEQ ID NO: 303001 - DNA, 25 bp, Mus musculus
gcactgactcctgagatcatgaagg

SEQ ID NO: 303002 - DNA, 25 bp, Mus musculus
gcactgacttcaatggggttgcggc

SEQ ID NO: 303003 - DNA, 25 bp, Mus musculus
gcactgagacagggctttctgaggg

SEQ ID NO: 303004 - DNA, 25 bp, Mus musculus
gcactgagcgggaactgagccgtgg

SEQ ID NO: 303005 - DNA, 25 bp, Mus musculus
gcactgagctctgggatcagtttga

SEQ ID NO: 303006 - DNA, 25 bp, Mus musculus
gcactgaggtgagggaaccagacct

SEQ ID NO: 303007 - DNA, 25 bp, Mus musculus
gcactgagtaggcagaaaacttctt

SEQ ID NO: 303008 - DNA, 25 bp, Mus musculus
gcactgatatcaggaggagccatgg

SEQ ID NO: 303009 - DNA, 25 bp, Mus musculus
gcactgatgaggacagctcagatgg

SEQ ID NO: 303010 - DNA, 25 bp, Mus musculus
gcactgatgaggattctcaggacag

SEQ ID NO: 303011 - DNA, 25 bp, Mus musculus
gcactgatggaggagacacgggcca

SEQ ID NO: 303012 - DNA, 25 bp, Mus musculus
gcactgatggccggggacctgaaga

SEQ ID NO: 303013 - DNA, 25 bp, Mus musculus
gcactgatgggaaggtggcagtgaa

SEQ ID NO: 303014 - DNA, 25 bp, Mus musculus
gcactgattggtgctgtcagatgca

SEQ ID NO: 303015 - DNA, 25 bp, Mus musculus
gcactgcaaagctggaatgaagtat

SEQ ID NO: 303016 - DNA, 25 bp, Mus musculus
gcactgcaagaaaacgaggaggaca

SEQ ID NO: 303017 - DNA, 25 bp, Mus musculus
gcactgcaagatctagatggcgccc

SEQ ID NO: 303018 - DNA, 25 bp, Mus musculus
gcactgcacaattgagggttgcccc

SEQ ID NO: 303019 - DNA, 25 bp, Mus musculus
gcactgcacaattgctcactatttg

SEQ ID NO: 303020 - DNA, 25 bp, Mus musculus
gcactgcaccatcgagggctgtcct

SEQ ID NO: 303021 - DNA, 25 bp, Mus musculus
gcactgcaccatcgctcactatctg

SEQ ID NO: 303022 - DNA, 25 bp, Mus musculus
gcactgcagaaggctctgaaggacc

SEQ ID NO: 303023 - DNA, 25 bp, Mus musculus
gcactgcagcttcaggatttctacc

SEQ ID NO: 303024 - DNA, 25 bp, Mus musculus
gcactgcagggttttggcgaccctg

SEQ ID NO: 303025 - DNA, 25 bp, Mus musculus
gcactgcatgagaaactctctggag

SEQ ID NO: 303026 - DNA, 25 bp, Mus musculus
gcactgcatttggtggagtgtgaca

SEQ ID NO: 303027 - DNA, 25 bp, Mus musculus
gcactgccaacagatctacacacaa

SEQ ID NO: 303028 - DNA, 25 bp, Mus musculus
gcactgccaacagggtgcatcgctt

SEQ ID NO: 303029 - DNA, 25 bp, Mus musculus
gcactgccaaggagtgtggggccga

SEQ ID NO: 303030 - DNA, 25 bp, Mus musculus
gcactgccaaggtttcctgcctttg

SEQ ID NO: 303031 - DNA, 25 bp, Mus musculus
gcactgccaccgcgttcacattctc

SEQ ID NO: 303032 - DNA, 25 bp, Mus musculus
gcactgccaccgctcacgaagttgg

SEQ ID NO: 303033 - DNA, 25 bp, Mus musculus
gcactgccagcacggggtctggacc

SEQ ID NO: 303034 - DNA, 25 bp, Mus musculus
gcactgccccaaggtgaagaactga

SEQ ID NO: 303035 - DNA, 25 bp, Mus musculus
gcactgcctagagacttcctgcttg

SEQ ID NO: 303036 - DNA, 25 bp, Mus musculus
gcactgcctgtgaacacttggatga

SEQ ID NO: 303037 - DNA, 25 bp, Mus musculus
gcactgcctgtgaagacttggatga

SEQ ID NO: 303038 - DNA, 25 bp, Mus musculus
gcactgctagggctctgtgccgagg

SEQ ID NO: 303039 - DNA, 25 bp, Mus musculus
gcactgctcatgggggcacctatga

SEQ ID NO: 303040 - DNA, 25 bp, Mus musculus
gcactgctccatgctggcagaagac

SEQ ID NO: 303041 - DNA, 25 bp, Mus musculus
gcactgctctcaatgcaggtcaatg

SEQ ID NO: 303042 - DNA, 25 bp, Mus musculus
gcactgctgtgcttatggcaaaccc

SEQ ID NO: 303043 - DNA, 25 bp, Mus musculus
gcactggaagtaaagcttgttttca

SEQ ID NO: 303044 - DNA, 25 bp, Mus musculus
gcactggacttgctgaaacctggtc

SEQ ID NO: 303045 - DNA, 25 bp, Mus musculus
gcactggagagaaacttgatgggaa

SEQ ID NO: 303046 - DNA, 25 bp, Mus musculus
gcactggagagaccagccacgatgc

SEQ ID NO: 303047 - DNA, 25 bp, Mus musculus
gcactggagctacaggctggtaaga

SEQ ID NO: 303048 - DNA, 25 bp, Mus musculus
gcactggaggagttgtaatggctcc

SEQ ID NO: 303049 - DNA, 25 bp, Mus musculus
gcactggagggtgaggctctgggtg

SEQ ID NO: 303050 - DNA, 25 bp, Mus musculus
gcactggaggttccaataccaacaa

SEQ ID NO: 303051 - DNA, 25 bp, Mus musculus
gcactggcaaccagcatctgatgac

SEQ ID NO: 303052 - DNA, 25 bp, Mus musculus
gcactggcaaccaggaagctgccct

SEQ ID NO: 303053 - DNA, 25 bp, Mus musculus
gcactggcacgaaatcctagtttcg

SEQ ID NO: 303054 - DNA, 25 bp, Mus musculus
gcactggcagaagctcttggcattt

SEQ ID NO: 303055 - DNA, 25 bp, Mus musculus
gcactggcaggcctgtacggagatc

SEQ ID NO: 303056 - DNA, 25 bp, Mus musculus
gcactggcaggctgaagatggaaac

SEQ ID NO: 303057 - DNA, 25 bp, Mus musculus
gcactggcagggctggtctacaact

SEQ ID NO: 303058 - DNA, 25 bp, Mus musculus
gcactggcaggtccaggaggtccag

SEQ ID NO: 303059 - DNA, 25 bp, Mus musculus
gcactggcaggtgcaggacgttgtc

SEQ ID NO: 303060 - DNA, 25 bp, Mus musculus
gcactggcaggtgtcagcggaaact

SEQ ID NO: 303061 - DNA, 25 bp, Mus musculus
gcactggccccgggccctcagcatc

SEQ ID NO: 303062 - DNA, 25 bp, Mus musculus
gcactggccctctctggggggtcac

SEQ ID NO: 303063 - DNA, 25 bp, Mus musculus
gcactggccgtaaatggttcagact

SEQ ID NO: 303064 - DNA, 25 bp, Mus musculus
gcactggcctcgatctactccccgg

SEQ ID NO: 303065 - DNA, 25 bp, Mus musculus
gcactggctaagagctgcttttaga

SEQ ID NO: 303066 - DNA, 25 bp, Mus musculus
gcactggctgaaggtaccttaacat

SEQ ID NO: 303067 - DNA, 25 bp, Mus musculus
gcactgggaaatatggctttgtaat

SEQ ID NO: 303068 - DNA, 25 bp, Mus musculus
gcactgggaaggcttgtcgcttact

SEQ ID NO: 303069 - DNA, 25 bp, Mus musculus
gcactgggattaaaaagaatggaat

SEQ ID NO: 303070 - DNA, 25 bp, Mus musculus
gcactgggattaaagggcatgaatc

SEQ ID NO: 303071 - DNA, 25 bp, Mus musculus
gcactgggctataagacccagttgt

SEQ ID NO: 303072 - DNA, 25 bp, Mus musculus
gcactgggctataaggatgtctccc

SEQ ID NO: 303073 - DNA, 25 bp, Mus musculus
gcactgggtatctctctttctcttt

SEQ ID NO: 303074 - DNA, 25 bp, Mus musculus
gcactgggtattttcttgttacctc

SEQ ID NO: 303075 - DNA, 25 bp, Mus musculus
gcactggttccataggtgcggctct

SEQ ID NO: 303076 - DNA, 25 bp, Mus musculus
gcactggtttatcgggaccagaata

SEQ ID NO: 303077 - DNA, 25 bp, Mus musculus
gcactgtaacgagcgcttgtacagg

SEQ ID NO: 303078 - DNA, 25 bp, Mus musculus
gcactgtacagacagtggatttgga

SEQ ID NO: 303079 - DNA, 25 bp, Mus musculus
gcactgtcaagcggaagatggagaa

SEQ ID NO: 303080 - DNA, 25 bp, Mus musculus
gcactgtcaagcttctcatgctgcc

SEQ ID NO: 303081 - DNA, 25 bp, Mus musculus
gcactgtcaaggatgtgtttgagtt

SEQ ID NO: 303082 - DNA, 25 bp, Mus musculus
gcactgtcagaacaagcctgccatc

SEQ ID NO: 303083 - DNA, 25 bp, Mus musculus
gcactgtcagagagtggggacagct

SEQ ID NO: 303084 - DNA, 25 bp, Mus musculus
gcactgtcagatgtagaaatccctg

SEQ ID NO: 303085 - DNA, 25 bp, Mus musculus
gcactgtcagcagcattccttgccc

SEQ ID NO: 303086 - DNA, 25 bp, Mus musculus
gcactgtcaggtaaatccatttctg

SEQ ID NO: 303087 - DNA, 25 bp, Mus musculus
gcactgtcaggttccgagtccgagg

SEQ ID NO: 303088 - DNA, 25 bp, Mus musculus
gcactgtgattaaagccatcatgtt

SEQ ID NO: 303089 - DNA, 25 bp, Mus musculus
gcactgtgccttcaggctcacccag

SEQ ID NO: 303090 - DNA, 25 bp, Mus musculus
gcactgtgcgagaaaaagcggatgg

SEQ ID NO: 303091 - DNA, 25 bp, Mus musculus
gcactgtgcgaggcatgctgcccca

SEQ ID NO: 303092 - DNA, 25 bp, Mus musculus
gcactgtgcggcgagaaggactcca

SEQ ID NO: 303093 - DNA, 25 bp, Mus musculus
gcactgtgcggcgagacacaccaga

SEQ ID NO: 303094 - DNA, 25 bp, Mus musculus
gcactgtgcggcgagatcccacggg

SEQ ID NO: 303095 - DNA, 25 bp, Mus musculus
gcactgtggatggaccagggaaaga

SEQ ID NO: 303096 - DNA, 25 bp, Mus musculus
gcactgtggatgggtcagggaaaga

SEQ ID NO: 303097 - DNA, 25 bp, Mus musculus
gcactgtgggccagatctgccacct

SEQ ID NO: 303098 - DNA, 25 bp, Mus musculus
gcactgtggtccgagggctgctgga

SEQ ID NO: 303099 - DNA, 25 bp, Mus musculus
gcactgtggtgacaggcattgagat

SEQ ID NO: 303100 - DNA, 25 bp, Mus musculus
gcactgtggttggctgggacccacg

SEQ ID NO: 303101 - DNA, 25 bp, Mus musculus
gcactgtggttggtgagcggggcac

SEQ ID NO: 303102 - DNA, 25 bp, Mus musculus
gcactgtgtcttcagtaaatgaagc

SEQ ID NO: 303103 - DNA, 25 bp, Mus musculus
gcactgtgtgaccagcccatcaaaa

SEQ ID NO: 303104 - DNA, 25 bp, Mus musculus
gcactgtgtgtggagtgctgacaga

SEQ ID NO: 303105 - DNA, 25 bp, Mus musculus
gcactgtgtgtggcatattctcatc

SEQ ID NO: 303106 - DNA, 25 bp, Mus musculus
gcactgttaacaggcagcaaacaga

SEQ ID NO: 303107 - DNA, 25 bp, Mus musculus
gcacttaacaggacaagctctgact

SEQ ID NO: 303108 - DNA, 25 bp, Mus musculus
gcacttagcatgatgacttgctcat

SEQ ID NO: 303109 - DNA, 25 bp, Mus musculus
gcacttaggagcagttctccgacct

SEQ ID NO: 303110 - DNA, 25 bp, Mus musculus
gcacttagttggtcgaccgcccctg

SEQ ID NO: 303111 - DNA, 25 bp, Mus musculus
gcacttatcggaaatggtgaagcaa

SEQ ID NO: 303112 - DNA, 25 bp, Mus musculus
gcacttatgaaggtccttcagtagc

SEQ ID NO: 303113 - DNA, 25 bp, Mus musculus
gcacttatgtgatccgtgatgagtg

SEQ ID NO: 303114 - DNA, 25 bp, Mus musculus
gcacttcaaaaaagatggtttttga

SEQ ID NO: 303115 - DNA, 25 bp, Mus musculus
gcacttcaaccagcgaattcagctt

SEQ ID NO: 303116 - DNA, 25 bp, Mus musculus
gcacttcaaccagtgtttgtcagca

SEQ ID NO: 303117 - DNA, 25 bp, Mus musculus
gcacttcaagatgtatcgcctgagc

SEQ ID NO: 303118 - DNA, 25 bp, Mus musculus
gcacttcacaagaaattaccatggt

SEQ ID NO: 303119 - DNA, 25 bp, Mus musculus
gcacttcagaggctgggcaaagtcc

SEQ ID NO: 303120 - DNA, 25 bp, Mus musculus
gcacttcaggaagctgatgaagagt

SEQ ID NO: 303121 - DNA, 25 bp, Mus musculus
gcacttcatcaaagagtgtggcctg

SEQ ID NO: 303122 - DNA, 25 bp, Mus musculus
gcacttcatcaataggaagaagaga

SEQ ID NO: 303123 - DNA, 25 bp, Mus musculus
gcacttcatcaatatgaagagtgtc

SEQ ID NO: 303124 - DNA, 25 bp, Mus musculus
gcacttccacagatctgcagactct

SEQ ID NO: 303125 - DNA, 25 bp, Mus musculus
gcacttccagatctctgacatctac

SEQ ID NO: 303126 - DNA, 25 bp, Mus musculus
gcacttccatgaaggcattgtcgcc

SEQ ID NO: 303127 - DNA, 25 bp, Mus musculus
gcacttccatgaaggcctgcgggcc

SEQ ID NO: 303128 - DNA, 25 bp, Mus musculus
gcacttccatgaaggcgagcctgtc

SEQ ID NO: 303129 - DNA, 25 bp, Mus musculus
gcacttccattatcggaatgtgcgg

SEQ ID NO: 303130 - DNA, 25 bp, Mus musculus
gcacttcccctcctgaagctgattg

SEQ ID NO: 303131 - DNA, 25 bp, Mus musculus
gcacttccggcagctccgtaaccgc

SEQ ID NO: 303132 - DNA, 25 bp, Mus musculus
gcacttcctgaaagatgatggcgtg

SEQ ID NO: 303133 - DNA, 25 bp, Mus musculus
gcacttcctgagctttctatcggaa

SEQ ID NO: 303134 - DNA, 25 bp, Mus musculus
gcacttcctgaggatgttgatccag

SEQ ID NO: 303135 - DNA, 25 bp, Mus musculus
gcacttcggcaagttggagtgctta

SEQ ID NO: 303136 - DNA, 25 bp, Mus musculus
gcacttcgggaccaggtctcctgtt

SEQ ID NO: 303137 - DNA, 25 bp, Mus musculus
gcacttcggggaggacagggtaaca

SEQ ID NO: 303138 - DNA, 25 bp, Mus musculus
gcacttcggggaggtggccaagcag

SEQ ID NO: 303139 - DNA, 25 bp, Mus musculus
gcacttgaacagatggggtgtttgt

SEQ ID NO: 303140 - DNA, 25 bp, Mus musculus
gcacttgaacagattcattatgtct

SEQ ID NO: 303141 - DNA, 25 bp, Mus musculus
gcacttggcagaatcgtatggaagc

SEQ ID NO: 303142 - DNA, 25 bp, Mus musculus
gcacttggctagctgcacatcccta

SEQ ID NO: 303143 - DNA, 25 bp, Mus musculus
gcacttggtgagagccctgaagaca

SEQ ID NO: 303144 - DNA, 25 bp, Mus musculus
gcactttacaggtggctttgcagct

SEQ ID NO: 303145 - DNA, 25 bp, Mus musculus
gcactttgaaagggagaagacaccc

SEQ ID NO: 303146 - DNA, 25 bp, Mus musculus
gcactttgaaagtattgagcaagtg

SEQ ID NO: 303147 - DNA, 25 bp, Mus musculus
gcactttgaagagaattgttgtgtg

SEQ ID NO: 303148 - DNA, 25 bp, Mus musculus
gcactttgaagaggtgtgagtgttg

SEQ ID NO: 303149 - DNA, 25 bp, Mus musculus
gcactttgaagagtatcacagacat

SEQ ID NO: 303150 - DNA, 25 bp, Mus musculus
gcactttgagaaaggtttgcagcta

SEQ ID NO: 303151 - DNA, 25 bp, Mus musculus
gcactttggtaaacttcctacagcg

SEQ ID NO: 303152 - DNA, 25 bp, Mus musculus
gcacttttcaacagattttgttcct

SEQ ID NO: 303153 - DNA, 25 bp, Mus musculus
gcacttttcctttgatcgctgccag

SEQ ID NO: 303154 - DNA, 25 bp, Mus musculus
gcacttttcctttgatctctgacca

SEQ ID NO: 303155 - DNA, 25 bp, Mus musculus
gcacttttcgcggattctttgggag

SEQ ID NO: 303156 - DNA, 25 bp, Mus musculus
gcacttttgaaatggccatgaagaa

SEQ ID NO: 303157 - DNA, 25 bp, Mus musculus
gcagaaaaaaaggtttatgaagctg

SEQ ID NO: 303158 - DNA, 25 bp, Mus musculus
gcagaaaaagacggcctgtcaggac

SEQ ID NO: 303159 - DNA, 25 bp, Mus musculus
gcagaaaaagcttcaaactctccag

SEQ ID NO: 303160 - DNA, 25 bp, Mus musculus
gcagaaaaaggagcaggtaggggac

SEQ ID NO: 303161 - DNA, 25 bp, Mus musculus
gcagaaaaatacccaaagcacctca

SEQ ID NO: 303162 - DNA, 25 bp, Mus musculus
gcagaaaaccggttgctgtggttcc

SEQ ID NO: 303163 - DNA, 25 bp, Mus musculus
gcagaaaacctgcagtgtcttaaaa

SEQ ID NO: 303164 - DNA, 25 bp, Mus musculus
gcagaaaatcaaactgcagcttgct

SEQ ID NO: 303165 - DNA, 25 bp, Mus musculus
gcagaaaatggaagagacctgtggg

SEQ ID NO: 303166 - DNA, 25 bp, Mus musculus
gcagaaacagacatggcaagtgtcc

SEQ ID NO: 303167 - DNA, 25 bp, Mus musculus
gcagaaacagagatagccagcagga

SEQ ID NO: 303168 - DNA, 25 bp, Mus musculus
gcagaaacagagtgctactgtctaa

SEQ ID NO: 303169 - DNA, 25 bp, Mus musculus
gcagaaacatcgagagatccggggt

SEQ ID NO: 303170 - DNA, 25 bp, Mus musculus
gcagaaacccccagcctccagtgat

SEQ ID NO: 303171 - DNA, 25 bp, Mus musculus
gcagaaaccgtaaaagccttgatag

SEQ ID NO: 303172 - DNA, 25 bp, Mus musculus
gcagaaactactgcggctcaggata

SEQ ID NO: 303173 - DNA, 25 bp, Mus musculus
gcagaaactcaaggctcctgactat

SEQ ID NO: 303174 - DNA, 25 bp, Mus musculus
gcagaaactggccagcaagcctgcc

SEQ ID NO: 303175 - DNA, 25 bp, Mus musculus
gcagaaagaaaagcccttatgttag

SEQ ID NO: 303176 - DNA, 25 bp, Mus musculus
gcagaaagactggagagaagctgaa

SEQ ID NO: 303177 - DNA, 25 bp, Mus musculus
gcagaaagagacagtgcattctgtg

SEQ ID NO: 303178 - DNA, 25 bp, Mus musculus
gcagaaagagacagtgtgggacttc

SEQ ID NO: 303179 - DNA, 25 bp, Mus musculus
gcagaaagagactaacggttatgac

SEQ ID NO: 303180 - DNA, 25 bp, Mus musculus
gcagaaagagatctatcaagtccag

SEQ ID NO: 303181 - DNA, 25 bp, Mus musculus
gcagaaagagcacagagaaccccag

SEQ ID NO: 303182 - DNA, 25 bp, Mus musculus
gcagaaagagctcagggactgcagt

SEQ ID NO: 303183 - DNA, 25 bp, Mus musculus
gcagaaagaggagttcgtgagtgtc

SEQ ID NO: 303184 - DNA, 25 bp, Mus musculus
gcagaaagaggtacataatgctgga

SEQ ID NO: 303185 - DNA, 25 bp, Mus musculus
gcagaaagaggtagaagaaagacca

SEQ ID NO: 303186 - DNA, 25 bp, Mus musculus
gcagaaagaggtgaaaaaactgcag

SEQ ID NO: 303187 - DNA, 25 bp, Mus musculus
gcagaaagagtaaataacagatgcg

SEQ ID NO: 303188 - DNA, 25 bp, Mus musculus
gcagaaagatagaagctagaaactc

SEQ ID NO: 303189 - DNA, 25 bp, Mus musculus
gcagaaagcaaaaaattgcaaattc

SEQ ID NO: 303190 - DNA, 25 bp, Mus musculus
gcagaaagcaggattcctctactac

SEQ ID NO: 303191 - DNA, 25 bp, Mus musculus
gcagaaagcaggccgtctactgtgt

SEQ ID NO: 303192 - DNA, 25 bp, Mus musculus
gcagaaagcagggctgactgtgaat

SEQ ID NO: 303193 - DNA, 25 bp, Mus musculus
gcagaaagcaggtcatccgggtggt

SEQ ID NO: 303194 - DNA, 25 bp, Mus musculus
gcagaaagcagtgagtacggctcca

SEQ ID NO: 303195 - DNA, 25 bp, Mus musculus
gcagaaagtgggtttcccgtctttg

SEQ ID NO: 303196 - DNA, 25 bp, Mus musculus
gcagaaatccactagactctggaac

SEQ ID NO: 303197 - DNA, 25 bp, Mus musculus
gcagaaatccactaggagacttaat

SEQ ID NO: 303198 - DNA, 25 bp, Mus musculus
gcagaaattgaagagagagaagcgc

SEQ ID NO: 303199 - DNA, 25 bp, Mus musculus
gcagaaatttacctaaagcctttca

SEQ ID NO: 303200 - DNA, 25 bp, Mus musculus
gcagaacaagagccccttcctctgc

SEQ ID NO: 303201 - DNA, 25 bp, Mus musculus
gcagaacacaagggcaagatcatca

SEQ ID NO: 303202 - DNA, 25 bp, Mus musculus
gcagaacacagcggagatccagcac

SEQ ID NO: 303203 - DNA, 25 bp, Mus musculus
gcagaacacaggtgttgaatcataa

SEQ ID NO: 303204 - DNA, 25 bp, Mus musculus
gcagaacagaccagagatgggcagc

SEQ ID NO: 303205 - DNA, 25 bp, Mus musculus
gcagaacagattcagagcctctctc

SEQ ID NO: 303206 - DNA, 25 bp, Mus musculus
gcagaacagattcagcagcagcaac

SEQ ID NO: 303207 - DNA, 25 bp, Mus musculus
gcagaacatcccagattgctgaagc

SEQ ID NO: 303208 - DNA, 25 bp, Mus musculus
gcagaacatcccagcccactggttt

SEQ ID NO: 303209 - DNA, 25 bp, Mus musculus
gcagaacattggagccatgtcaagc

SEQ ID NO: 303210 - DNA, 25 bp, Mus musculus
gcagaaccaggtggagaatctaaag

SEQ ID NO: 303211 - DNA, 25 bp, Mus musculus
gcagaaccatactatgcattatcca

SEQ ID NO: 303212 - DNA, 25 bp, Mus musculus
gcagaaccatactatttgcttttgc

SEQ ID NO: 303213 - DNA, 25 bp, Mus musculus
gcagaacccaagaggctggggtctc

SEQ ID NO: 303214 - DNA, 25 bp, Mus musculus
gcagaaccctcagtgattgtgtgtc

SEQ ID NO: 303215 - DNA, 25 bp, Mus musculus
gcagaaccgtcggcgagctgaagcg

SEQ ID NO: 303216 - DNA, 25 bp, Mus musculus
gcagaacctgaggcactgaaagaaa

SEQ ID NO: 303217 - DNA, 25 bp, Mus musculus
gcagaacctggaagctatgctctac

SEQ ID NO: 303218 - DNA, 25 bp, Mus musculus
gcagaacctggattcagatggtcca

SEQ ID NO: 303219 - DNA, 25 bp, Mus musculus
gcagaacctggccaagatcctgcgc

SEQ ID NO: 303220 - DNA, 25 bp, Mus musculus
gcagaacctgggccgcatgtatctc

SEQ ID NO: 303221 - DNA, 25 bp, Mus musculus
gcagaacctgggggctaaactctca

SEQ ID NO: 303222 - DNA, 25 bp, Mus musculus
gcagaacctgtcaggaccaccaatg

SEQ ID NO: 303223 - DNA, 25 bp, Mus musculus
gcagaacctgtcaggatataaatga

SEQ ID NO: 303224 - DNA, 25 bp, Mus musculus
gcagaacgaggcaaagacaagaaag

SEQ ID NO: 303225 - DNA, 25 bp, Mus musculus
gcagaacgaggttgtgaaccatggc

SEQ ID NO: 303226 - DNA, 25 bp, Mus musculus
gcagaacgcatcccacagctggtgg

SEQ ID NO: 303227 - DNA, 25 bp, Mus musculus
gcagaacgctgctcatttgaagaca

SEQ ID NO: 303228 - DNA, 25 bp, Mus musculus
gcagaacgctgcttgtgaatggctg

SEQ ID NO: 303229 - DNA, 25 bp, Mus musculus
gcagaactacctggacttccaccgc

SEQ ID NO: 303230 - DNA, 25 bp, Mus musculus
gcagaactacctgggtctcagcctg

SEQ ID NO: 303231 - DNA, 25 bp, Mus musculus
gcagaactcaagcagctggtggccc

SEQ ID NO: 303232 - DNA, 25 bp, Mus musculus
gcagaactgggattgtctttctgag

SEQ ID NO: 303233 - DNA, 25 bp, Mus musculus
gcagaactgggggatgcagagagca

SEQ ID NO: 303234 - DNA, 25 bp, Mus musculus
gcagaactggttcttccccagaggg

SEQ ID NO: 303235 - DNA, 25 bp, Mus musculus
gcagaacttgcggtcttagagcctt

SEQ ID NO: 303236 - DNA, 25 bp, Mus musculus
gcagaagaaaagactggacaatctg

SEQ ID NO: 303237 - DNA, 25 bp, Mus musculus
gcagaagaaacacatggtgatgtgg

SEQ ID NO: 303238 - DNA, 25 bp, Mus musculus
gcagaagaaacagatggtgatgtgg

SEQ ID NO: 303239 - DNA, 25 bp, Mus musculus
gcagaagaaaccttgttccccctca

SEQ ID NO: 303240 - DNA, 25 bp, Mus musculus
gcagaagaaaggggctcgctcccac

SEQ ID NO: 303241 - DNA, 25 bp, Mus musculus
gcagaagacagtgcatttgcagggc

SEQ ID NO: 303242 - DNA, 25 bp, Mus musculus
gcagaagacagtgctcttactggcc

SEQ ID NO: 303243 - DNA, 25 bp, Mus musculus
gcagaagacccaagcttggatctag

SEQ ID NO: 303244 - DNA, 25 bp, Mus musculus
gcagaagaggagagtgataatgaac

SEQ ID NO: 303245 - DNA, 25 bp, Mus musculus
gcagaagaggatcctgggcatgctt

SEQ ID NO: 303246 - DNA, 25 bp, Mus musculus
gcagaagagtgaccaaatgacccag

SEQ ID NO: 303247 - DNA, 25 bp, Mus musculus
gcagaagagtgggacggctgttctc

SEQ ID NO: 303248 - DNA, 25 bp, Mus musculus
gcagaagatctatctaagtaagaag

SEQ ID NO: 303249 - DNA, 25 bp, Mus musculus
gcagaagatgctaggagttaaccag

SEQ ID NO: 303250 - DNA, 25 bp, Mus musculus
gcagaagatgctagggtaataatct

SEQ ID NO: 303251 - DNA, 25 bp, Mus musculus
gcagaagattaaggacctggagcag

SEQ ID NO: 303252 - DNA, 25 bp, Mus musculus
gcagaagcaaagagaaccaacttct

SEQ ID NO: 303253 - DNA, 25 bp, Mus musculus
gcagaagcaaagagcgtgctaatgc

SEQ ID NO: 303254 - DNA, 25 bp, Mus musculus
gcagaagcaaagagggaagaagaca

SEQ ID NO: 303255 - DNA, 25 bp, Mus musculus
gcagaagcaaaggtctcagccagtc

SEQ ID NO: 303256 - DNA, 25 bp, Mus musculus
gcagaagcaaattgtggaccgggtc

SEQ ID NO: 303257 - DNA, 25 bp, Mus musculus
gcagaagcaacagcagaagcaggta

SEQ ID NO: 303258 - DNA, 25 bp, Mus musculus
gcagaagcaagaggaagaggagcag

SEQ ID NO: 303259 - DNA, 25 bp, Mus musculus
gcagaagcaagatcccaaaaggata

SEQ ID NO: 303260 - DNA, 25 bp, Mus musculus
gcagaagcaagtgttttgcctgtgt

SEQ ID NO: 303261 - DNA, 25 bp, Mus musculus
gcagaagcacagaactgctgagtgc

SEQ ID NO: 303262 - DNA, 25 bp, Mus musculus
gcagaagcacagatccatgcatgac

SEQ ID NO: 303263 - DNA, 25 bp, Mus musculus
gcagaagcacagggcatctgttatg

SEQ ID NO: 303264 - DNA, 25 bp, Mus musculus
gcagaagcactccataaactaaagc

SEQ ID NO: 303265 - DNA, 25 bp, Mus musculus
gcagaagcactccatgtgtgtctga

SEQ ID NO: 303266 - DNA, 25 bp, Mus musculus
gcagaagcagaaagaagaagaagcc

SEQ ID NO: 303267 - DNA, 25 bp, Mus musculus
gcagaagcagtggctctagtctggc

SEQ ID NO: 303268 - DNA, 25 bp, Mus musculus
gcagaagcagtgggtacaaacaaat

SEQ ID NO: 303269 - DNA, 25 bp, Mus musculus
gcagaagcatcaagatgacttacaa

SEQ ID NO: 303270 - DNA, 25 bp, Mus musculus
gcagaagccatggctcggatggcgt

SEQ ID NO: 303271 - DNA, 25 bp, Mus musculus
gcagaagctggaagatgaagaaaag

SEQ ID NO: 303272 - DNA, 25 bp, Mus musculus
gcagaagctgggtgccattgtggct

SEQ ID NO: 303273 - DNA, 25 bp, Mus musculus
gcagaaggaatccaacgatgcagat

SEQ ID NO: 303274 - DNA, 25 bp, Mus musculus
gcagaaggagacaggagtcatccag

SEQ ID NO: 303275 - DNA, 25 bp, Mus musculus
gcagaaggagaccagagcctcagct

SEQ ID NO: 303276 - DNA, 25 bp, Mus musculus
gcagaaggagctcaggggctggagt

SEQ ID NO: 303277 - DNA, 25 bp, Mus musculus
gcagaaggcaaggttcggctcctgg

SEQ ID NO: 303278 - DNA, 25 bp, Mus musculus
gcagaaggcaatgaaggaaaccaaa

SEQ ID NO: 303279 - DNA, 25 bp, Mus musculus
gcagaaggcaatggaatgatctcat

SEQ ID NO: 303280 - DNA, 25 bp, Mus musculus
gcagaaggcacagatggacagatgg

SEQ ID NO: 303281 - DNA, 25 bp, Mus musculus
gcagaaggcacaggtgaaggagaca

SEQ ID NO: 303282 - DNA, 25 bp, Mus musculus
gcagaaggcccagctctgataagat

SEQ ID NO: 303283 - DNA, 25 bp, Mus musculus
gcagaaggcccaggtcgtggacttc

SEQ ID NO: 303284 - DNA, 25 bp, Mus musculus
gcagaaggcccaggtggctttcatg

SEQ ID NO: 303285 - DNA, 25 bp, Mus musculus
gcagaagggttaggatgatgctgtt

SEQ ID NO: 303286 - DNA, 25 bp, Mus musculus
gcagaaggtattgtcatcactagcc

SEQ ID NO: 303287 - DNA, 25 bp, Mus musculus
gcagaaggtgatgtgggtcctcccc

SEQ ID NO: 303288 - DNA, 25 bp, Mus musculus
gcagaagtagagaaggatgtccatg

SEQ ID NO: 303289 - DNA, 25 bp, Mus musculus
gcagaagtcagaaattacacttgtg

SEQ ID NO: 303290 - DNA, 25 bp, Mus musculus
gcagaagtcgacagagcacactcct

SEQ ID NO: 303291 - DNA, 25 bp, Mus musculus
gcagaagtgcaggtattggttttcg

SEQ ID NO: 303292 - DNA, 25 bp, Mus musculus
gcagaagtggacttgatccctgctg

SEQ ID NO: 303293 - DNA, 25 bp, Mus musculus
gcagaagttgctcaagatgctgagt

SEQ ID NO: 303294 - DNA, 25 bp, Mus musculus
gcagaataaaaggtgccacaggcac

SEQ ID NO: 303295 - DNA, 25 bp, Mus musculus
gcagaataccaaccacagccacagt

SEQ ID NO: 303296 - DNA, 25 bp, Mus musculus
gcagaatatcgaacaaaagacgagg

SEQ ID NO: 303297 - DNA, 25 bp, Mus musculus
gcagaatatcgaacctcacatgagc

SEQ ID NO: 303298 - DNA, 25 bp, Mus musculus
gcagaatatgaagagcgggcagcta

SEQ ID NO: 303299 - DNA, 25 bp, Mus musculus
gcagaatatgaaggcatgatgggtg

SEQ ID NO: 303300 - DNA, 25 bp, Mus musculus
gcagaatatgaaggtgtgatgaatc

SEQ ID NO: 303301 - DNA, 25 bp, Mus musculus
gcagaatatggagggccccatggtg

SEQ ID NO: 303302 - DNA, 25 bp, Mus musculus
gcagaatattctaagatgctcctgc

SEQ ID NO: 303303 - DNA, 25 bp, Mus musculus
gcagaatcacagatggaacaatgtt

SEQ ID NO: 303304 - DNA, 25 bp, Mus musculus
gcagaatcatagggagaggcggtga

SEQ ID NO: 303305 - DNA, 25 bp, Mus musculus
gcagaatcatcgagaaacctgaaaa

SEQ ID NO: 303306 - DNA, 25 bp, Mus musculus
gcagaatcattcaggtctgtctatc

SEQ ID NO: 303307 - DNA, 25 bp, Mus musculus
gcagaatcattcagtcttccgtgtc

SEQ ID NO: 303308 - DNA, 25 bp, Mus musculus
gcagaatctggaggctggtgaggca

SEQ ID NO: 303309 - DNA, 25 bp, Mus musculus
gcagaatctgtggctgaattacaca

SEQ ID NO: 303310 - DNA, 25 bp, Mus musculus
gcagaatgagaatgtgattctgctt

SEQ ID NO: 303311 - DNA, 25 bp, Mus musculus
gcagaatgcagagtacagttgtgaa

SEQ ID NO: 303312 - DNA, 25 bp, Mus musculus
gcagaatgcagcagtttgcaaagca

SEQ ID NO: 303313 - DNA, 25 bp, Mus musculus
gcagaatgcaggtggaccctcagaa

SEQ ID NO: 303314 - DNA, 25 bp, Mus musculus
gcagaatgcaggtgtaatgtctttg

SEQ ID NO: 303315 - DNA, 25 bp, Mus musculus
gcagaatgctatcaaaagccccagg

SEQ ID NO: 303316 - DNA, 25 bp, Mus musculus
gcagaatggaagcagatcctgcctc

SEQ ID NO: 303317 - DNA, 25 bp, Mus musculus
gcagaatgtgataggtttgccagat

SEQ ID NO: 303318 - DNA, 25 bp, Mus musculus
gcagaattctgaagaggacagctct

SEQ ID NO: 303319 - DNA, 25 bp, Mus musculus
gcagaattctgagatcttgagttca

SEQ ID NO: 303320 - DNA, 25 bp, Mus musculus
gcagaattctggttttggtaaaact

SEQ ID NO: 303321 - DNA, 25 bp, Mus musculus
gcagaattgaaaagtttctagatgt

SEQ ID NO: 303322 - DNA, 25 bp, Mus musculus
gcagacaaacatggggtcccagcaa

SEQ ID NO: 303323 - DNA, 25 bp, Mus musculus
gcagacaaacatgggtttaggcaag

SEQ ID NO: 303324 - DNA, 25 bp, Mus musculus
gcagacaaagatggggcaaatctac

SEQ ID NO: 303325 - DNA, 25 bp, Mus musculus
gcagacaacggttggcatcgaacac

SEQ ID NO: 303326 - DNA, 25 bp, Mus musculus
gcagacaacgttcactttaattgag

SEQ ID NO: 303327 - DNA, 25 bp, Mus musculus
gcagacaactgaaggctgcccgaga

SEQ ID NO: 303328 - DNA, 25 bp, Mus musculus
gcagacaagccaagaatgtgctgat

SEQ ID NO: 303329 - DNA, 25 bp, Mus musculus
gcagacaagggttctccagaccagc

SEQ ID NO: 303330 - DNA, 25 bp, Mus musculus
gcagacacagatgacgctcctgtcc

SEQ ID NO: 303331 - DNA, 25 bp, Mus musculus
gcagacacagattcaaaataaacca

SEQ ID NO: 303332 - DNA, 25 bp, Mus musculus
gcagacacagggctctgctctgaag

SEQ ID NO: 303333 - DNA, 25 bp, Mus musculus
gcagacacagtccggttctccacca

SEQ ID NO: 303334 - DNA, 25 bp, Mus musculus
gcagacacccaagagacacagtctg

SEQ ID NO: 303335 - DNA, 25 bp, Mus musculus
gcagacagaacggtcattgattaca

SEQ ID NO: 303336 - DNA, 25 bp, Mus musculus
gcagacagaacggttgattacaacg

SEQ ID NO: 303337 - DNA, 25 bp, Mus musculus
gcagacagagaacggggagttggct

SEQ ID NO: 303338 - DNA, 25 bp, Mus musculus
gcagacagagaatggggagctgtcc

SEQ ID NO: 303339 - DNA, 25 bp, Mus musculus
gcagacagagaggctccgcaggagg

SEQ ID NO: 303340 - DNA, 25 bp, Mus musculus
gcagacagatgccccaacaagggag

SEQ ID NO: 303341 - DNA, 25 bp, Mus musculus
gcagacagcaacgcagtacttcatc

SEQ ID NO: 303342 - DNA, 25 bp, Mus musculus
gcagacagcatcaggattgctgaaa

SEQ ID NO: 303343 - DNA, 25 bp, Mus musculus
gcagacagccaagggatttgaatta

SEQ ID NO: 303344 - DNA, 25 bp, Mus musculus
gcagacaggtaacagtgtcagctga

SEQ ID NO: 303345 - DNA, 25 bp, Mus musculus
gcagacagtcttcggacatagactg

SEQ ID NO: 303346 - DNA, 25 bp, Mus musculus
gcagacatcagaaaccttacaatct

SEQ ID NO: 303347 - DNA, 25 bp, Mus musculus
gcagacatcagataatggaggtgac

SEQ ID NO: 303348 - DNA, 25 bp, Mus musculus
gcagacatcctcatgatctcggacc

SEQ ID NO: 303349 - DNA, 25 bp, Mus musculus
gcagacatcctcatgtatgtggtca

SEQ ID NO: 303350 - DNA, 25 bp, Mus musculus
gcagacatgaaggcctttgttgaaa

SEQ ID NO: 303351 - DNA, 25 bp, Mus musculus
gcagacatggcggagtcttctgagt

SEQ ID NO: 303352 - DNA, 25 bp, Mus musculus
gcagacattaccaatggacgcatcg

SEQ ID NO: 303353 - DNA, 25 bp, Mus musculus
gcagacatttatggtggttatgctg

SEQ ID NO: 303354 - DNA, 25 bp, Mus musculus
gcagacatttctggggacacccaga

SEQ ID NO: 303355 - DNA, 25 bp, Mus musculus
gcagacattttagcaggttttctga

SEQ ID NO: 303356 - DNA, 25 bp, Mus musculus
gcagaccaaaagcccttgccagagt

SEQ ID NO: 303357 - DNA, 25 bp, Mus musculus
gcagaccaacttgagaattggacag

SEQ ID NO: 303358 - DNA, 25 bp, Mus musculus
gcagaccaacttgagagtgacttct

SEQ ID NO: 303359 - DNA, 25 bp, Mus musculus
gcagaccaaggtggaattcccagag

SEQ ID NO: 303360 - DNA, 25 bp, Mus musculus
gcagaccaaggtggaattccctgag

SEQ ID NO: 303361 - DNA, 25 bp, Mus musculus
gcagaccaagttccagaatctactg

SEQ ID NO: 303362 - DNA, 25 bp, Mus musculus
gcagaccacaaagctagggaagaag

SEQ ID NO: 303363 - DNA, 25 bp, Mus musculus
gcagaccacccaggctttaaagatc

SEQ ID NO: 303364 - DNA, 25 bp, Mus musculus
gcagaccagcagactgtaaaacaga

SEQ ID NO: 303365 - DNA, 25 bp, Mus musculus
gcagaccagcagactttctcctgtc

SEQ ID NO: 303366 - DNA, 25 bp, Mus musculus
gcagaccatcatgcacatccaggac

SEQ ID NO: 303367 - DNA, 25 bp, Mus musculus
gcagaccatctccggtcctggctta

SEQ ID NO: 303368 - DNA, 25 bp, Mus musculus
gcagaccatggggccgaggaggaca

SEQ ID NO: 303369 - DNA, 25 bp, Mus musculus
gcagaccatggtgagcccattggcc

SEQ ID NO: 303370 - DNA, 25 bp, Mus musculus
gcagacccaagacaagttcgagaaa

SEQ ID NO: 303371 - DNA, 25 bp, Mus musculus
gcagacccacaggaaacaccagctg

SEQ ID NO: 303372 - DNA, 25 bp, Mus musculus
gcagacccagtctaaaatcgatgtc

SEQ ID NO: 303373 - DNA, 25 bp, Mus musculus
gcagacccagtctaacacagaggag

SEQ ID NO: 303374 - DNA, 25 bp, Mus musculus
gcagaccccgcagctcttggcaagt

SEQ ID NO: 303375 - DNA, 25 bp, Mus musculus
gcagaccccgcaggagacatatgaa

SEQ ID NO: 303376 - DNA, 25 bp, Mus musculus
gcagaccccggaaagccagaacctc

SEQ ID NO: 303377 - DNA, 25 bp, Mus musculus
gcagacccgagttgaaaaatctgga

SEQ ID NO: 303378 - DNA, 25 bp, Mus musculus
gcagacccgggcagatatcaagaaa

SEQ ID NO: 303379 - DNA, 25 bp, Mus musculus
gcagaccgtggatgggagggcccca

SEQ ID NO: 303380 - DNA, 25 bp, Mus musculus
gcagacctcaccgacacactggatg

SEQ ID NO: 303381 - DNA, 25 bp, Mus musculus
gcagacctcaccttcctcacaggtc

SEQ ID NO: 303382 - DNA, 25 bp, Mus musculus
gcagacctctgacaaacagttgctc

SEQ ID NO: 303383 - DNA, 25 bp, Mus musculus
gcagacctctgacaaggatgagagc

SEQ ID NO: 303384 - DNA, 25 bp, Mus musculus
gcagacctctgagcgaacatcccaa

SEQ ID NO: 303385 - DNA, 25 bp, Mus musculus
gcagacctgagtgaggtagataaag

SEQ ID NO: 303386 - DNA, 25 bp, Mus musculus
gcagacctgccaggacgctgagcct

SEQ ID NO: 303387 - DNA, 25 bp, Mus musculus
gcagacctgccaggtgtcaccatgc

SEQ ID NO: 303388 - DNA, 25 bp, Mus musculus
gcagacctgctggggtgacagtcca

SEQ ID NO: 303389 - DNA, 25 bp, Mus musculus
gcagacctgggactggctgtgatgc

SEQ ID NO: 303390 - DNA, 25 bp, Mus musculus
gcagacgaagttccgacagcagccc

SEQ ID NO: 303391 - DNA, 25 bp, Mus musculus
gcagacgaccagaagagagccaagc

SEQ ID NO: 303392 - DNA, 25 bp, Mus musculus
gcagacgatgttgaatgacaaagaa

SEQ ID NO: 303393 - DNA, 25 bp, Mus musculus
gcagacgcaccagctcccttccccg

SEQ ID NO: 303394 - DNA, 25 bp, Mus musculus
gcagacgcaccagggggactccctg

SEQ ID NO: 303395 - DNA, 25 bp, Mus musculus
gcagacgcaccaggtcacacacaca

SEQ ID NO: 303396 - DNA, 25 bp, Mus musculus
gcagacgcagcttcggcttcattaa

SEQ ID NO: 303397 - DNA, 25 bp, Mus musculus
gcagacgcttccattgtctaaagcc

SEQ ID NO: 303398 - DNA, 25 bp, Mus musculus
gcagacggccatggaaccacaaacc

SEQ ID NO: 303399 - DNA, 25 bp, Mus musculus
gcagacggcggccagcatcaggaag

SEQ ID NO: 303400 - DNA, 25 bp, Mus musculus
gcagacggctccagattactacaag

SEQ ID NO: 303401 - DNA, 25 bp, Mus musculus
gcagacggtgcaaccaggtacacgg

SEQ ID NO: 303402 - DNA, 25 bp, Mus musculus
gcagacggtggaaattgacaacttg

SEQ ID NO: 303403 - DNA, 25 bp, Mus musculus
gcagacgtagagggatttaaagacc

SEQ ID NO: 303404 - DNA, 25 bp, Mus musculus
gcagacgtgttcaattttcacagct

SEQ ID NO: 303405 - DNA, 25 bp, Mus musculus
gcagacgtgttcacattctggtggt

SEQ ID NO: 303406 - DNA, 25 bp, Mus musculus
gcagacgtgttcagattccagcatt

SEQ ID NO: 303407 - DNA, 25 bp, Mus musculus
gcagactaaaggcatgcagtatggt

SEQ ID NO: 303408 - DNA, 25 bp, Mus musculus
gcagactaaaggtgttgacagctct

SEQ ID NO: 303409 - DNA, 25 bp, Mus musculus
gcagactaagcaggtggaagaacta

SEQ ID NO: 303410 - DNA, 25 bp, Mus musculus
gcagactacagcggtcagcagagca

SEQ ID NO: 303411 - DNA, 25 bp, Mus musculus
gcagactacctccaggtcggagtga

SEQ ID NO: 303412 - DNA, 25 bp, Mus musculus
gcagactacctccaggtggttgttg

SEQ ID NO: 303413 - DNA, 25 bp, Mus musculus
gcagactcagcccgtcacaatcatt

SEQ ID NO: 303414 - DNA, 25 bp, Mus musculus
gcagactcagctgtgctggatgccc

SEQ ID NO: 303415 - DNA, 25 bp, Mus musculus
gcagactcaggcacctctgtcagcc

SEQ ID NO: 303416 - DNA, 25 bp, Mus musculus
gcagactcatggctgggctctacaa

SEQ ID NO: 303417 - DNA, 25 bp, Mus musculus
gcagactctgtccagccagctggcg

SEQ ID NO: 303418 - DNA, 25 bp, Mus musculus
gcagactcttggagaaaatccaagt

SEQ ID NO: 303419 - DNA, 25 bp, Mus musculus
gcagactcttggagctggaagagaa

SEQ ID NO: 303420 - DNA, 25 bp, Mus musculus
gcagactgcagcctaggatgtcagg

SEQ ID NO: 303421 - DNA, 25 bp, Mus musculus
gcagactgcaggaaactacaacctt

SEQ ID NO: 303422 - DNA, 25 bp, Mus musculus
gcagactgcagtttcaggtcagagt

SEQ ID NO: 303423 - DNA, 25 bp, Mus musculus
gcagactgcggtgaggggagccgag

SEQ ID NO: 303424 - DNA, 25 bp, Mus musculus
gcagactgctgccaggtggagagag

SEQ ID NO: 303425 - DNA, 25 bp, Mus musculus
gcagactggaggacggaaaccactg

SEQ ID NO: 303426 - DNA, 25 bp, Mus musculus
gcagactgtgcagagccaatatgaa

SEQ ID NO: 303427 - DNA, 25 bp, Mus musculus
gcagactgtgcagaggttcacctgg

SEQ ID NO: 303428 - DNA, 25 bp, Mus musculus
gcagacttccacagcacagcccccg

SEQ ID NO: 303429 - DNA, 25 bp, Mus musculus
gcagacttcccagctctcttctcct

SEQ ID NO: 303430 - DNA, 25 bp, Mus musculus
gcagacttcccagggctatacatcc

SEQ ID NO: 303431 - DNA, 25 bp, Mus musculus
gcagacttccgggtctgacagagct

SEQ ID NO: 303432 - DNA, 25 bp, Mus musculus
gcagacttcttctcctcggaccaga

SEQ ID NO: 303433 - DNA, 25 bp, Mus musculus
gcagactttgacgagatcatcagtg

SEQ ID NO: 303434 - DNA, 25 bp, Mus musculus
gcagactttgacgagtgaggagaga

SEQ ID NO: 303435 - DNA, 25 bp, Mus musculus
gcagagaaaagcaagtgctgtcttc

SEQ ID NO: 303436 - DNA, 25 bp, Mus musculus
gcagagaaagccgagtccatctacc

SEQ ID NO: 303437 - DNA, 25 bp, Mus musculus
gcagagaaatggagagaagcccggg

SEQ ID NO: 303438 - DNA, 25 bp, Mus musculus
gcagagaactacttgtctacccaca

SEQ ID NO: 303439 - DNA, 25 bp, Mus musculus
gcagagaagaaaaggagttggaacc

SEQ ID NO: 303440 - DNA, 25 bp, Mus musculus
gcagagaaggaggccgcatccacgc

SEQ ID NO: 303441 - DNA, 25 bp, Mus musculus
gcagagaaggctcagtgccatggag

SEQ ID NO: 303442 - DNA, 25 bp, Mus musculus
gcagagaaggctcagtgctgtatgc

SEQ ID NO: 303443 - DNA, 25 bp, Mus musculus
gcagagaatgagaaaatgaaaattg

SEQ ID NO: 303444 - DNA, 25 bp, Mus musculus
gcagagaatggagcctgtgaccttt

SEQ ID NO: 303445 - DNA, 25 bp, Mus musculus
gcagagaatgtggacatctcgtggt

SEQ ID NO: 303446 - DNA, 25 bp, Mus musculus
gcagagacaaattgaacaagaaaaa

SEQ ID NO: 303447 - DNA, 25 bp, Mus musculus
gcagagacagaggaggccatgtcag

SEQ ID NO: 303448 - DNA, 25 bp, Mus musculus
gcagagacagatttgatcaaaaaac

SEQ ID NO: 303449 - DNA, 25 bp, Mus musculus
gcagagacagcaggattttcgaaaa

SEQ ID NO: 303450 - DNA, 25 bp, Mus musculus
gcagagacaggagctgctgctggag

SEQ ID NO: 303451 - DNA, 25 bp, Mus musculus
gcagagacaggtactgagttcaaat

SEQ ID NO: 303452 - DNA, 25 bp, Mus musculus
gcagagaccccgatcctcgtgggac

SEQ ID NO: 303453 - DNA, 25 bp, Mus musculus
gcagagaccccggaccaatctccgc

SEQ ID NO: 303454 - DNA, 25 bp, Mus musculus
gcagagaccccgggtccagcaccaa

SEQ ID NO: 303455 - DNA, 25 bp, Mus musculus
gcagagaccgctacatcagaagatt

SEQ ID NO: 303456 - DNA, 25 bp, Mus musculus
gcagagactggacgcggattctgat

SEQ ID NO: 303457 - DNA, 25 bp, Mus musculus
gcagagactggactacgagagtaaa

SEQ ID NO: 303458 - DNA, 25 bp, Mus musculus
gcagagactgtgagccaaaaagcag

SEQ ID NO: 303459 - DNA, 25 bp, Mus musculus
gcagagagaagccggcctctggtgc

SEQ ID NO: 303460 - DNA, 25 bp, Mus musculus
gcagagagaagccggttatacaatg

SEQ ID NO: 303461 - DNA, 25 bp, Mus musculus
gcagagagacacagtgccctctccc

SEQ ID NO: 303462 - DNA, 25 bp, Mus musculus
gcagagagagggagttgaggataca

SEQ ID NO: 303463 - DNA, 25 bp, Mus musculus
gcagagagaggttaccctgcatctg

SEQ ID NO: 303464 - DNA, 25 bp, Mus musculus
gcagagagagttggatgaaaaatct

SEQ ID NO: 303465 - DNA, 25 bp, Mus musculus
gcagagagatgactggtctggttca

SEQ ID NO: 303466 - DNA, 25 bp, Mus musculus
gcagagagatgagcatccagctcag

SEQ ID NO: 303467 - DNA, 25 bp, Mus musculus
gcagagagcaacaggagcaccaggc

SEQ ID NO: 303468 - DNA, 25 bp, Mus musculus
gcagagagctcaggtttggaggaga

SEQ ID NO: 303469 - DNA, 25 bp, Mus musculus
gcagagagctctggcgcaacagcgt

SEQ ID NO: 303470 - DNA, 25 bp, Mus musculus
gcagagaggagcttggctttgatct

SEQ ID NO: 303471 - DNA, 25 bp, Mus musculus
gcagagaggtccaggatgccttatc

SEQ ID NO: 303472 - DNA, 25 bp, Mus musculus
gcagagagtaagaactgtgccaagt

SEQ ID NO: 303473 - DNA, 25 bp, Mus musculus
gcagagagtcaggaacgtggaagtg

SEQ ID NO: 303474 - DNA, 25 bp, Mus musculus
gcagagataagcagagtccagttca

SEQ ID NO: 303475 - DNA, 25 bp, Mus musculus
gcagagatacatcaggaagtggcaa

SEQ ID NO: 303476 - DNA, 25 bp, Mus musculus
gcagagatacatcagggtcttgggg

SEQ ID NO: 303477 - DNA, 25 bp, Mus musculus
gcagagatagagaaggtaaagggga

SEQ ID NO: 303478 - DNA, 25 bp, Mus musculus
gcagagatcagatagtgccggcatt

SEQ ID NO: 303479 - DNA, 25 bp, Mus musculus
gcagagatcgggttctgcggggagt

SEQ ID NO: 303480 - DNA, 25 bp, Mus musculus
gcagagatctcggcacaacggtcgt

SEQ ID NO: 303481 - DNA, 25 bp, Mus musculus
gcagagatctcgggtgagcacctgc

SEQ ID NO: 303482 - DNA, 25 bp, Mus musculus
gcagagatggaatggataatcaagg

SEQ ID NO: 303483 - DNA, 25 bp, Mus musculus
gcagagatggttggcctgctatgtg

SEQ ID NO: 303484 - DNA, 25 bp, Mus musculus
gcagagattgcccaggttcgcggca

SEQ ID NO: 303485 - DNA, 25 bp, Mus musculus
gcagagcaaaagactgggaacctac

SEQ ID NO: 303486 - DNA, 25 bp, Mus musculus
gcagagcaaaagggaagcagtgctt

SEQ ID NO: 303487 - DNA, 25 bp, Mus musculus
gcagagcaagaaggtcagtcaggag

SEQ ID NO: 303488 - DNA, 25 bp, Mus musculus
gcagagcaagagacgaattatcaat

SEQ ID NO: 303489 - DNA, 25 bp, Mus musculus
gcagagcaagatctggtgctttggc

SEQ ID NO: 303490 - DNA, 25 bp, Mus musculus
gcagagcaagccactcaggctctct

SEQ ID NO: 303491 - DNA, 25 bp, Mus musculus
gcagagcaaggtggagctcacctgt

SEQ ID NO: 303492 - DNA, 25 bp, Mus musculus
gcagagcacacagagccatgaggct

SEQ ID NO: 303493 - DNA, 25 bp, Mus musculus
gcagagcacatgctgattttgggca

SEQ ID NO: 303494 - DNA, 25 bp, Mus musculus
gcagagcacccagaggtccatggct

SEQ ID NO: 303495 - DNA, 25 bp, Mus musculus
gcagagcagatgggatgagccggca

SEQ ID NO: 303496 - DNA, 25 bp, Mus musculus
gcagagcagcaggtttccaggcaac

SEQ ID NO: 303497 - DNA, 25 bp, Mus musculus
gcagagcagctacgagacgctctgt

SEQ ID NO: 303498 - DNA, 25 bp, Mus musculus
gcagagcagctactaagcgactctc

SEQ ID NO: 303499 - DNA, 25 bp, Mus musculus
gcagagcaggatgcccggggcatgg

SEQ ID NO: 303500 - DNA, 25 bp, Mus musculus
gcagagcaggccaaggagatccagc

SEQ ID NO: 303501 - DNA, 25 bp, Mus musculus
gcagagcaggcgggactgtcctgtg

SEQ ID NO: 303502 - DNA, 25 bp, Mus musculus
gcagagcagggatcagtggtgaact

SEQ ID NO: 303503 - DNA, 25 bp, Mus musculus
gcagagcaggtgaagagaaggagga

SEQ ID NO: 303504 - DNA, 25 bp, Mus musculus
gcagagcatggtctagtctcctgag

SEQ ID NO: 303505 - DNA, 25 bp, Mus musculus
gcagagcatggtggagctgaaggta

SEQ ID NO: 303506 - DNA, 25 bp, Mus musculus
gcagagccaagcacttacgcctggt

SEQ ID NO: 303507 - DNA, 25 bp, Mus musculus
gcagagccacggtcaagatgctgaa

SEQ ID NO: 303508 - DNA, 25 bp, Mus musculus
gcagagccagagaatgttgctgagg

SEQ ID NO: 303509 - DNA, 25 bp, Mus musculus
gcagagccagagccagctgacctca

SEQ ID NO: 303510 - DNA, 25 bp, Mus musculus
gcagagccagagtctgcagacaatg

SEQ ID NO: 303511 - DNA, 25 bp, Mus musculus
gcagagccaggctagtgaaccggag

SEQ ID NO: 303512 - DNA, 25 bp, Mus musculus
gcagagccagtgagccctgcctagc

SEQ ID NO: 303513 - DNA, 25 bp, Mus musculus
gcagagccatctacttgcaccggaa

SEQ ID NO: 303514 - DNA, 25 bp, Mus musculus
gcagagccatggacaaggaatatgt

SEQ ID NO: 303515 - DNA, 25 bp, Mus musculus
gcagagcccacagcaacctcaagcc

SEQ ID NO: 303516 - DNA, 25 bp, Mus musculus
gcagagcccacttaaactccgaggt

SEQ ID NO: 303517 - DNA, 25 bp, Mus musculus
gcagagcctgagatctggtggctct

SEQ ID NO: 303518 - DNA, 25 bp, Mus musculus
gcagagcctgaggcccaggatgggt

SEQ ID NO: 303519 - DNA, 25 bp, Mus musculus
gcagagcctggatttatcgaattat

SEQ ID NO: 303520 - DNA, 25 bp, Mus musculus
gcagagcctggctggcacgttttgt

SEQ ID NO: 303521 - DNA, 25 bp, Mus musculus
gcagagcctggtgctgatgggaacc

SEQ ID NO: 303522 - DNA, 25 bp, Mus musculus
gcagagcgacaggctccgtgaagac

SEQ ID NO: 303523 - DNA, 25 bp, Mus musculus
gcagagcgagatcaagaaatccacc

SEQ ID NO: 303524 - DNA, 25 bp, Mus musculus
gcagagcgaggggtccgtctcccag

SEQ ID NO: 303525 - DNA, 25 bp, Mus musculus
gcagagcgaggtaaagaaatccacc

SEQ ID NO: 303526 - DNA, 25 bp, Mus musculus
gcagagcgcgggtgatgtgaacaga

SEQ ID NO: 303527 - DNA, 25 bp, Mus musculus
gcagagcgggcgatactgcagcctc

SEQ ID NO: 303528 - DNA, 25 bp, Mus musculus
gcagagctaaacaagaatttaaaga

SEQ ID NO: 303529 - DNA, 25 bp, Mus musculus
gcagagctaaagggtttggatccag

SEQ ID NO: 303530 - DNA, 25 bp, Mus musculus
gcagagctagaaaagaaagtgagtt

SEQ ID NO: 303531 - DNA, 25 bp, Mus musculus
gcagagctagaggtcacctggagga

SEQ ID NO: 303532 - DNA, 25 bp, Mus musculus
gcagagctcagaggagaattctgtg

SEQ ID NO: 303533 - DNA, 25 bp, Mus musculus
gcagagctcagagggtgctctgtgt

SEQ ID NO: 303534 - DNA, 25 bp, Mus musculus
gcagagctcaggatttctggtaggt

SEQ ID NO: 303535 - DNA, 25 bp, Mus musculus
gcagagctgaagaaggttatgagaa

SEQ ID NO: 303536 - DNA, 25 bp, Mus musculus
gcagagctgcccagagacccttcgg

SEQ ID NO: 303537 - DNA, 25 bp, Mus musculus
gcagagctgctctagcaccacatct

SEQ ID NO: 303538 - DNA, 25 bp, Mus musculus
gcagagctgtaaggccgtggcagag

SEQ ID NO: 303539 - DNA, 25 bp, Mus musculus
gcagagctgtcagtgacccaccctc

SEQ ID NO: 303540 - DNA, 25 bp, Mus musculus
gcagagcttaagccaatccatggcc

SEQ ID NO: 303541 - DNA, 25 bp, Mus musculus
gcagagcttcgagcttccattaagg

SEQ ID NO: 303542 - DNA, 25 bp, Mus musculus
gcagaggaagacgttcacagcctgg

SEQ ID NO: 303543 - DNA, 25 bp, Mus musculus
gcagaggaagctgaaccaataacgt

SEQ ID NO: 303544 - DNA, 25 bp, Mus musculus
gcagaggaccaaggaagccgtgaag

SEQ ID NO: 303545 - DNA, 25 bp, Mus musculus
gcagaggactgggccccacaggatc

SEQ ID NO: 303546 - DNA, 25 bp, Mus musculus
gcagaggactgtatgaacgaggctc

SEQ ID NO: 303547 - DNA, 25 bp, Mus musculus
gcagaggagaacgcggtgtgtgagt

SEQ ID NO: 303548 - DNA, 25 bp, Mus musculus
gcagaggagatgggtggtggaagat

SEQ ID NO: 303549 - DNA, 25 bp, Mus musculus
gcagaggagcctggccccttcatgg

SEQ ID NO: 303550 - DNA, 25 bp, Mus musculus
gcagaggaggaggtcacgctcacgc

SEQ ID NO: 303551 - DNA, 25 bp, Mus musculus
gcagaggaggtgttactagtacaga

SEQ ID NO: 303552 - DNA, 25 bp, Mus musculus
gcagaggataagtactctcagaagg

SEQ ID NO: 303553 - DNA, 25 bp, Mus musculus
gcagaggattcccaagccatgtatt

SEQ ID NO: 303554 - DNA, 25 bp, Mus musculus
gcagaggcaccgcgatgtgctggct

SEQ ID NO: 303555 - DNA, 25 bp, Mus musculus
gcagaggcaccgcggaccgtctggg

SEQ ID NO: 303556 - DNA, 25 bp, Mus musculus
gcagaggcaggcgtgcccacacttt

SEQ ID NO: 303557 - DNA, 25 bp, Mus musculus
gcagaggccagagctattaagaatg

SEQ ID NO: 303558 - DNA, 25 bp, Mus musculus
gcagaggccgtgcggagctcttgga

SEQ ID NO: 303559 - DNA, 25 bp, Mus musculus
gcagaggcctgcctcaaaatgcagc

SEQ ID NO: 303560 - DNA, 25 bp, Mus musculus
gcagaggcgatgctttttaaattgg

SEQ ID NO: 303561 - DNA, 25 bp, Mus musculus
gcagaggcgtaacgtgatgtcctct

SEQ ID NO: 303562 - DNA, 25 bp, Mus musculus
gcagaggctgacaaggctacagcgg

SEQ ID NO: 303563 - DNA, 25 bp, Mus musculus
gcagaggctgacaggcggaacttgc

SEQ ID NO: 303564 - DNA, 25 bp, Mus musculus
gcagaggctggggacagtacttatt

SEQ ID NO: 303565 - DNA, 25 bp, Mus musculus
gcagagggaaggcctggccttgatg

SEQ ID NO: 303566 - DNA, 25 bp, Mus musculus
gcagagggaaggtgaccaaccactt

SEQ ID NO: 303567 - DNA, 25 bp, Mus musculus
gcagagggagcaggaacctgtcaca

SEQ ID NO: 303568 - DNA, 25 bp, Mus musculus
gcagagggtcgaatcaacacctttg

SEQ ID NO: 303569 - DNA, 25 bp, Mus musculus
gcagaggtaggaagatgaggaccta

SEQ ID NO: 303570 - DNA, 25 bp, Mus musculus
gcagaggtccagacgtcgcctcatc

SEQ ID NO: 303571 - DNA, 25 bp, Mus musculus
gcagaggtcttccagatcacagacc

SEQ ID NO: 303572 - DNA, 25 bp, Mus musculus
gcagaggtgaagggaagacaaaggt

SEQ ID NO: 303573 - DNA, 25 bp, Mus musculus
gcagaggtgacagatcccacaacgt

SEQ ID NO: 303574 - DNA, 25 bp, Mus musculus
gcagaggtgcagaaggtttttcaag

SEQ ID NO: 303575 - DNA, 25 bp, Mus musculus
gcagaggtggtcagtgctcaagaac

SEQ ID NO: 303576 - DNA, 25 bp, Mus musculus
gcagaggtgtcccaggaagtcaccc

SEQ ID NO: 303577 - DNA, 25 bp, Mus musculus
gcagaggtgtggacacgttggtcag

SEQ ID NO: 303578 - DNA, 25 bp, Mus musculus
gcagaggttccccagcagagatgaa

SEQ ID NO: 303579 - DNA, 25 bp, Mus musculus
gcagaggttccccagtcaatcgcag

SEQ ID NO: 303580 - DNA, 25 bp, Mus musculus
gcagagtaaaagtgaaatgactgtt

SEQ ID NO: 303581 - DNA, 25 bp, Mus musculus
gcagagtaatgctccaagtatgtta

SEQ ID NO: 303582 - DNA, 25 bp, Mus musculus
gcagagtacaaggtggtaaatctgt

SEQ ID NO: 303583 - DNA, 25 bp, Mus musculus
gcagagtacaggtggagtttcgatg

SEQ ID NO: 303584 - DNA, 25 bp, Mus musculus
gcagagtatctttaccttctacttc

SEQ ID NO: 303585 - DNA, 25 bp, Mus musculus
gcagagtcaaaacagcagtgacagc

SEQ ID NO: 303586 - DNA, 25 bp, Mus musculus
gcagagtcaaagatgttgatcctgt

SEQ ID NO: 303587 - DNA, 25 bp, Mus musculus
gcagagtcaggagcgcagggcagag

SEQ ID NO: 303588 - DNA, 25 bp, Mus musculus
gcagagtcagggaccaggactgagt

SEQ ID NO: 303589 - DNA, 25 bp, Mus musculus
gcagagtctagccaccaagatccag

SEQ ID NO: 303590 - DNA, 25 bp, Mus musculus
gcagagtctgtactcccacaatcta

SEQ ID NO: 303591 - DNA, 25 bp, Mus musculus
gcagagtctgtgcggtgaccacaca

SEQ ID NO: 303592 - DNA, 25 bp, Mus musculus
gcagagtgaaaacacttcagctaat

SEQ ID NO: 303593 - DNA, 25 bp, Mus musculus
gcagagtgacatggaagctatggat

SEQ ID NO: 303594 - DNA, 25 bp, Mus musculus
gcagagtgacatggccgcagccacg

SEQ ID NO: 303595 - DNA, 25 bp, Mus musculus
gcagagtgacatgtgcgaccaagac

SEQ ID NO: 303596 - DNA, 25 bp, Mus musculus
gcagagtgagcagccccacagtgaa

SEQ ID NO: 303597 - DNA, 25 bp, Mus musculus
gcagagtgatgtcaagtacaaatct

SEQ ID NO: 303598 - DNA, 25 bp, Mus musculus
gcagagtgcagtattgtggaatgtg

SEQ ID NO: 303599 - DNA, 25 bp, Mus musculus
gcagagtgctgatcagggcactgac

SEQ ID NO: 303600 - DNA, 25 bp, Mus musculus
gcagagtggaagtgtgatcaggtgt

SEQ ID NO: 303601 - DNA, 25 bp, Mus musculus
gcagagtggcagcacgatggtccta

SEQ ID NO: 303602 - DNA, 25 bp, Mus musculus
gcagagtggcatggaaggtgaagga

SEQ ID NO: 303603 - DNA, 25 bp, Mus musculus
gcagagtgtacaccgaccctagggt

SEQ ID NO: 303604 - DNA, 25 bp, Mus musculus
gcagagtgtacagcgaccctagggt

SEQ ID NO: 303605 - DNA, 25 bp, Mus musculus
gcagagtgtatgagggccagaacgt

SEQ ID NO: 303606 - DNA, 25 bp, Mus musculus
gcagagttctctctaaacctttgac

SEQ ID NO: 303607 - DNA, 25 bp, Mus musculus
gcagataaagataatggaggtgact

SEQ ID NO: 303608 - DNA, 25 bp, Mus musculus
gcagataagaagggcaggattctgg

SEQ ID NO: 303609 - DNA, 25 bp, Mus musculus
gcagatacaaaagcacaaccagtgc

SEQ ID NO: 303610 - DNA, 25 bp, Mus musculus
gcagatacaaaagtaagaagttgtt

SEQ ID NO: 303611 - DNA, 25 bp, Mus musculus
gcagatacaggatcacttctgtatg

SEQ ID NO: 303612 - DNA, 25 bp, Mus musculus
gcagataccgggcccaacgaaggag

SEQ ID NO: 303613 - DNA, 25 bp, Mus musculus
gcagataccgggtggggacgacgag

SEQ ID NO: 303614 - DNA, 25 bp, Mus musculus
gcagatagcagtagtcctaccggga

SEQ ID NO: 303615 - DNA, 25 bp, Mus musculus
gcagatagtttctgaattagtgtcc

SEQ ID NO: 303616 - DNA, 25 bp, Mus musculus
gcagatatcggcacaacgatggcca

SEQ ID NO: 303617 - DNA, 25 bp, Mus musculus
gcagatatgacttgggagaagagac

SEQ ID NO: 303618 - DNA, 25 bp, Mus musculus
gcagatatgacttgtttggatttag

SEQ ID NO: 303619 - DNA, 25 bp, Mus musculus
gcagatattttgcttttagatactc

SEQ ID NO: 303620 - DNA, 25 bp, Mus musculus
gcagatcaagaattttctgaattcc

SEQ ID NO: 303621 - DNA, 25 bp, Mus musculus
gcagatcaatgaaattggagatctg

SEQ ID NO: 303622 - DNA, 25 bp, Mus musculus
gcagatcacagacactgcagaagga

SEQ ID NO: 303623 - DNA, 25 bp, Mus musculus
gcagatcagagattgttattgacgg

SEQ ID NO: 303624 - DNA, 25 bp, Mus musculus
gcagatcagaggttgagcttgttca

SEQ ID NO: 303625 - DNA, 25 bp, Mus musculus
gcagatccaatactgcagcaatggc

SEQ ID NO: 303626 - DNA, 25 bp, Mus musculus
gcagatccaatcacgagaccaggcc

SEQ ID NO: 303627 - DNA, 25 bp, Mus musculus
gcagatccaggagctggtggaagcc

SEQ ID NO: 303628 - DNA, 25 bp, Mus musculus
gcagatccaggaggacttcttcctg

SEQ ID NO: 303629 - DNA, 25 bp, Mus musculus
gcagatccctctcagccccctggtg

SEQ ID NO: 303630 - DNA, 25 bp, Mus musculus
gcagatccctctcaggtttacagcc

SEQ ID NO: 303631 - DNA, 25 bp, Mus musculus
gcagatccggagtagcccctggaac

SEQ ID NO: 303632 - DNA, 25 bp, Mus musculus
gcagatccggcgaatacaggaggag

SEQ ID NO: 303633 - DNA, 25 bp, Mus musculus
gcagatcctctgatggagccagaga

SEQ ID NO: 303634 - DNA, 25 bp, Mus musculus
gcagatcctgacaagggcacgtgga

SEQ ID NO: 303635 - DNA, 25 bp, Mus musculus
gcagatctctcaggggagacccagc

SEQ ID NO: 303636 - DNA, 25 bp, Mus musculus
gcagatctctcaggggatcatgagg

SEQ ID NO: 303637 - DNA, 25 bp, Mus musculus
gcagatcttccaagattagaacacc

SEQ ID NO: 303638 - DNA, 25 bp, Mus musculus
gcagatcttgaggttacggaaacag

SEQ ID NO: 303639 - DNA, 25 bp, Mus musculus
gcagatgaagatctcaggcccatgg

SEQ ID NO: 303640 - DNA, 25 bp, Mus musculus
gcagatgacagggcggaacttgcca

SEQ ID NO: 303641 - DNA, 25 bp, Mus musculus
gcagatgaccagcaaactcacccag

SEQ ID NO: 303642 - DNA, 25 bp, Mus musculus
gcagatgaccggaagtcactggtga

SEQ ID NO: 303643 - DNA, 25 bp, Mus musculus
gcagatgagaggatgcctcctggaa

SEQ ID NO: 303644 - DNA, 25 bp, Mus musculus
gcagatgaggagaaaaagttacgtc

SEQ ID NO: 303645 - DNA, 25 bp, Mus musculus
gcagatgataatgagtattctagtc

SEQ ID NO: 303646 - DNA, 25 bp, Mus musculus
gcagatgatctttaagaatggtcct

SEQ ID NO: 303647 - DNA, 25 bp, Mus musculus
gcagatgatctttaagaatggtgac

SEQ ID NO: 303648 - DNA, 25 bp, Mus musculus
gcagatgatggacaggaaacagaca

SEQ ID NO: 303649 - DNA, 25 bp, Mus musculus
gcagatgatggctctgtggccttgt

SEQ ID NO: 303650 - DNA, 25 bp, Mus musculus
gcagatgatgggagaattctgtggc

SEQ ID NO: 303651 - DNA, 25 bp, Mus musculus
gcagatgatgggtgcagtttgagag

SEQ ID NO: 303652 - DNA, 25 bp, Mus musculus
gcagatgcacagatttgacataatt

SEQ ID NO: 303653 - DNA, 25 bp, Mus musculus
gcagatgccccaaatattcttacaa

SEQ ID NO: 303654 - DNA, 25 bp, Mus musculus
gcagatgcccgacactccagaagaa

SEQ ID NO: 303655 - DNA, 25 bp, Mus musculus
gcagatgcccggatgctgatgtacc

SEQ ID NO: 303656 - DNA, 25 bp, Mus musculus
gcagatgccgacttggacattgctg

SEQ ID NO: 303657 - DNA, 25 bp, Mus musculus
gcagatgcgggaggggaaaatggaa

SEQ ID NO: 303658 - DNA, 25 bp, Mus musculus
gcagatgctaaatatgttctagaag

SEQ ID NO: 303659 - DNA, 25 bp, Mus musculus
gcagatgctaaggatgatctgatga

SEQ ID NO: 303660 - DNA, 25 bp, Mus musculus
gcagatgctcagcaaccagacctca

SEQ ID NO: 303661 - DNA, 25 bp, Mus musculus
gcagatgctcaggtatgggcttatt

SEQ ID NO: 303662 - DNA, 25 bp, Mus musculus
gcagatgctcgggctgtcatttcgc

SEQ ID NO: 303663 - DNA, 25 bp, Mus musculus
gcagatgctggacatccaggcagaa

SEQ ID NO: 303664 - DNA, 25 bp, Mus musculus
gcagatggaaaccagcaggtgcagc

SEQ ID NO: 303665 - DNA, 25 bp, Mus musculus
gcagatggaaaccaggacaagaaga

SEQ ID NO: 303666 - DNA, 25 bp, Mus musculus
gcagatggaaagatgacatcgttct

SEQ ID NO: 303667 - DNA, 25 bp, Mus musculus
gcagatggaaaggtcgtgtcttatg

SEQ ID NO: 303668 - DNA, 25 bp, Mus musculus
gcagatggaattataagtactatta

SEQ ID NO: 303669 - DNA, 25 bp, Mus musculus
gcagatggaattcctgggcatccag

SEQ ID NO: 303670 - DNA, 25 bp, Mus musculus
gcagatggcaaagcaacagaaaagt

SEQ ID NO: 303671 - DNA, 25 bp, Mus musculus
gcagatggcaaaggaagactccctg

SEQ ID NO: 303672 - DNA, 25 bp, Mus musculus
gcagatggctaggagtaaaaatggc

SEQ ID NO: 303673 - DNA, 25 bp, Mus musculus
gcagatggctagggaatgtggagct

SEQ ID NO: 303674 - DNA, 25 bp, Mus musculus
gcagatgggagcctctttttcctgc

SEQ ID NO: 303675 - DNA, 25 bp, Mus musculus
gcagatggtctggtgtagccgtcct

SEQ ID NO: 303676 - DNA, 25 bp, Mus musculus
gcagatgtagttcatcctatctaag

SEQ ID NO: 303677 - DNA, 25 bp, Mus musculus
gcagatgtccctgtccattgccctc

SEQ ID NO: 303678 - DNA, 25 bp, Mus musculus
gcagatgtgttcagaatgatgatgc

SEQ ID NO: 303679 - DNA, 25 bp, Mus musculus
gcagatgtgttcagtctgggtctca

SEQ ID NO: 303680 - DNA, 25 bp, Mus musculus
gcagatgtttccaagaaggtcacag

SEQ ID NO: 303681 - DNA, 25 bp, Mus musculus
gcagattaacagagactctgcagat

SEQ ID NO: 303682 - DNA, 25 bp, Mus musculus
gcagattcaaagttcacagtcagac

SEQ ID NO: 303683 - DNA, 25 bp, Mus musculus
gcagattcaaatgaccagcagttat

SEQ ID NO: 303684 - DNA, 25 bp, Mus musculus
gcagattcagcacagagctgatgag

SEQ ID NO: 303685 - DNA, 25 bp, Mus musculus
gcagattcaggtgattctcgggccc

SEQ ID NO: 303686 - DNA, 25 bp, Mus musculus
gcagattccccgctgtcctacagtc

SEQ ID NO: 303687 - DNA, 25 bp, Mus musculus
gcagattcgcagaatagcagagaaa

SEQ ID NO: 303688 - DNA, 25 bp, Mus musculus
gcagattctcgaggctaaaaagaaa

SEQ ID NO: 303689 - DNA, 25 bp, Mus musculus
gcagattgaacgcaagggggaagca

SEQ ID NO: 303690 - DNA, 25 bp, Mus musculus
gcagattgcagagttcaaagaagct

SEQ ID NO: 303691 - DNA, 25 bp, Mus musculus
gcagattgcccaatgagctgctaag

SEQ ID NO: 303692 - DNA, 25 bp, Mus musculus
gcagattgccctggatcgtgcagaa

SEQ ID NO: 303693 - DNA, 25 bp, Mus musculus
gcagattgctcacgtatcacgacat

SEQ ID NO: 303694 - DNA, 25 bp, Mus musculus
gcagattggttcaaggagtcctttg

SEQ ID NO: 303695 - DNA, 25 bp, Mus musculus
gcagatttaaagaacccaatatggc

SEQ ID NO: 303696 - DNA, 25 bp, Mus musculus
gcagatttaagattattaaaaactg

SEQ ID NO: 303697 - DNA, 25 bp, Mus musculus
gcagatttagctggggaggaagaga

SEQ ID NO: 303698 - DNA, 25 bp, Mus musculus
gcagatttagctggggggccgaggg

SEQ ID NO: 303699 - DNA, 25 bp, Mus musculus
gcagatttcattgaggagtttgaca

SEQ ID NO: 303700 - DNA, 25 bp, Mus musculus
gcagatttccctggcctcagaaaca

SEQ ID NO: 303701 - DNA, 25 bp, Mus musculus
gcagatttccctggcttcccctcca

SEQ ID NO: 303702 - DNA, 25 bp, Mus musculus
gcagatttccgaaggtacattttat

SEQ ID NO: 303703 - DNA, 25 bp, Mus musculus
gcagatttggatgactttttttcct

SEQ ID NO: 303704 - DNA, 25 bp, Mus musculus
gcagatttgggacacagcaggccag

SEQ ID NO: 303705 - DNA, 25 bp, Mus musculus
gcagatttgggattttgaacttctg

SEQ ID NO: 303706 - DNA, 25 bp, Mus musculus
gcagattttaaactgtttcagaaag

SEQ ID NO: 303707 - DNA, 25 bp, Mus musculus
gcagattttagcagcttcttactgt

SEQ ID NO: 303708 - DNA, 25 bp, Mus musculus
gcagattttagcaggtgaatatgac

SEQ ID NO: 303709 - DNA, 25 bp, Mus musculus
gcagattttgaggtattcgtggagt

SEQ ID NO: 303710 - DNA, 25 bp, Mus musculus
gcagattttgaggtcttgccgtgga

SEQ ID NO: 303711 - DNA, 25 bp, Mus musculus
gcagcaaaaggtctccatagaacat

SEQ ID NO: 303712 - DNA, 25 bp, Mus musculus
gcagcaaaatggcccaccaagaaaa

SEQ ID NO: 303713 - DNA, 25 bp, Mus musculus
gcagcaaaatggtaaccctggcact

SEQ ID NO: 303714 - DNA, 25 bp, Mus musculus
gcagcaaacataatgtgaccccatc

SEQ ID NO: 303715 - DNA, 25 bp, Mus musculus
gcagcaaacgatcatcccagcagcc

SEQ ID NO: 303716 - DNA, 25 bp, Mus musculus
gcagcaaatgattcggatatcagga

SEQ ID NO: 303717 - DNA, 25 bp, Mus musculus
gcagcaaatgattcgtccaaggcgg

SEQ ID NO: 303718 - DNA, 25 bp, Mus musculus
gcagcaacaaggcgggaggaagcac

SEQ ID NO: 303719 - DNA, 25 bp, Mus musculus
gcagcaacaatagaattttcatttc

SEQ ID NO: 303720 - DNA, 25 bp, Mus musculus
gcagcaacaataggtgttgacttta

SEQ ID NO: 303721 - DNA, 25 bp, Mus musculus
gcagcaacagcaggcccagcctgca

SEQ ID NO: 303722 - DNA, 25 bp, Mus musculus
gcagcaacagttggcatccagcatt

SEQ ID NO: 303723 - DNA, 25 bp, Mus musculus
gcagcaacagttgggttctccccag

SEQ ID NO: 303724 - DNA, 25 bp, Mus musculus
gcagcaacagttggtcccatgcatc

SEQ ID NO: 303725 - DNA, 25 bp, Mus musculus
gcagcaaccaagctgtgattggact

SEQ ID NO: 303726 - DNA, 25 bp, Mus musculus
gcagcaaccaaggagacagtgatgg

SEQ ID NO: 303727 - DNA, 25 bp, Mus musculus
gcagcaaccaaggagtcaaatattg

SEQ ID NO: 303728 - DNA, 25 bp, Mus musculus
gcagcaaccatgcgtgagtgcatct

SEQ ID NO: 303729 - DNA, 25 bp, Mus musculus
gcagcaaccccagattccagagggg

SEQ ID NO: 303730 - DNA, 25 bp, Mus musculus
gcagcaacctgctgaatttgttgga

SEQ ID NO: 303731 - DNA, 25 bp, Mus musculus
gcagcaacctgctggccgtggagac

SEQ ID NO: 303732 - DNA, 25 bp, Mus musculus
gcagcaacgcccagagagatgtctt

SEQ ID NO: 303733 - DNA, 25 bp, Mus musculus
gcagcaacggtgcggcagcgtgctt

SEQ ID NO: 303734 - DNA, 25 bp, Mus musculus
gcagcaagaacaccttcagtgagat

SEQ ID NO: 303735 - DNA, 25 bp, Mus musculus
gcagcaagagttccactgttgtggc

SEQ ID NO: 303736 - DNA, 25 bp, Mus musculus
gcagcaagatcctgcttgagaaaag

SEQ ID NO: 303737 - DNA, 25 bp, Mus musculus
gcagcaagcaggaggcagacaaaaa

SEQ ID NO: 303738 - DNA, 25 bp, Mus musculus
gcagcaagcggccgaccttgcactt

SEQ ID NO: 303739 - DNA, 25 bp, Mus musculus
gcagcaagcggccggcttcctttct

SEQ ID NO: 303740 - DNA, 25 bp, Mus musculus
gcagcaagctagtgagcagtgggaa

SEQ ID NO: 303741 - DNA, 25 bp, Mus musculus
gcagcaaggagctggaagacatgaa

SEQ ID NO: 303742 - DNA, 25 bp, Mus musculus
gcagcaaggcctcaagttgggatat

SEQ ID NO: 303743 - DNA, 25 bp, Mus musculus
gcagcaataccctgcagcaagggga

SEQ ID NO: 303744 - DNA, 25 bp, Mus musculus
gcagcaatgatattgacttagaagg

SEQ ID NO: 303745 - DNA, 25 bp, Mus musculus
gcagcaatggagcttggcatggatc

SEQ ID NO: 303746 - DNA, 25 bp, Mus musculus
gcagcaatggaggaattttgacaac

SEQ ID NO: 303747 - DNA, 25 bp, Mus musculus
gcagcaatggaggcaggtggaagag

SEQ ID NO: 303748 - DNA, 25 bp, Mus musculus
gcagcacaacccttccaggcagaca

SEQ ID NO: 303749 - DNA, 25 bp, Mus musculus
gcagcacaagcgagggaagctaaca

SEQ ID NO: 303750 - DNA, 25 bp, Mus musculus
gcagcacaaggccgaggccgtggcc

SEQ ID NO: 303751 - DNA, 25 bp, Mus musculus
gcagcacaatattccaacggtgccc

SEQ ID NO: 303752 - DNA, 25 bp, Mus musculus
gcagcacaatcgagagcagcaaaag

SEQ ID NO: 303753 - DNA, 25 bp, Mus musculus
gcagcacaatcgagatcctgcctca

SEQ ID NO: 303754 - DNA, 25 bp, Mus musculus
gcagcacacgagatttttatcaccg

SEQ ID NO: 303755 - DNA, 25 bp, Mus musculus
gcagcacagcagatttaggaccgat

SEQ ID NO: 303756 - DNA, 25 bp, Mus musculus
gcagcacagcagggacagggtggtg

SEQ ID NO: 303757 - DNA, 25 bp, Mus musculus
gcagcaccaaggaaacgtgtccccg

SEQ ID NO: 303758 - DNA, 25 bp, Mus musculus
gcagcaccaagtgtgggttgttttt

SEQ ID NO: 303759 - DNA, 25 bp, Mus musculus
gcagcaccagaaataccggtatcag

SEQ ID NO: 303760 - DNA, 25 bp, Mus musculus
gcagcaccagatttcaatgggagaa

SEQ ID NO: 303761 - DNA, 25 bp, Mus musculus
gcagcaccagggcctgtccaccaga

SEQ ID NO: 303762 - DNA, 25 bp, Mus musculus
gcagcaccctgacacccagggctca

SEQ ID NO: 303763 - DNA, 25 bp, Mus musculus
gcagcaccctgccagtggcccagct

SEQ ID NO: 303764 - DNA, 25 bp, Mus musculus
gcagcaccggcgtgttgcccaccaa

SEQ ID NO: 303765 - DNA, 25 bp, Mus musculus
gcagcaccgggctaaagaagcccag

SEQ ID NO: 303766 - DNA, 25 bp, Mus musculus
gcagcacctctggaggctcctgctc

SEQ ID NO: 303767 - DNA, 25 bp, Mus musculus
gcagcacctgatagctcgggaggct

SEQ ID NO: 303768 - DNA, 25 bp, Mus musculus
gcagcacctggctgactgccttcgt

SEQ ID NO: 303769 - DNA, 25 bp, Mus musculus
gcagcacgagaacagcgactactgt

SEQ ID NO: 303770 - DNA, 25 bp, Mus musculus
gcagcacgagcgggtattcccctac

SEQ ID NO: 303771 - DNA, 25 bp, Mus musculus
gcagcacgcaactgatttagatgaa

SEQ ID NO: 303772 - DNA, 25 bp, Mus musculus
gcagcacgccatcaatgatgatgtt

SEQ ID NO: 303773 - DNA, 25 bp, Mus musculus
gcagcacgccgggcaggcctcagca

SEQ ID NO: 303774 - DNA, 25 bp, Mus musculus
gcagcacgccgtatgtgcaggagtt

SEQ ID NO: 303775 - DNA, 25 bp, Mus musculus
gcagcacgcttgatgtggggcctgc

SEQ ID NO: 303776 - DNA, 25 bp, Mus musculus
gcagcacggatgatgttgcctccag

SEQ ID NO: 303777 - DNA, 25 bp, Mus musculus
gcagcactacacagcagcgtacccc

SEQ ID NO: 303778 - DNA, 25 bp, Mus musculus
gcagcactacacagcctccagccct

SEQ ID NO: 303779 - DNA, 25 bp, Mus musculus
gcagcactacacgtacctgaaggaa

SEQ ID NO: 303780 - DNA, 25 bp, Mus musculus
gcagcactaccctggctgtatcaac

SEQ ID NO: 303781 - DNA, 25 bp, Mus musculus
gcagcactgcaggagcctgtgacct

SEQ ID NO: 303782 - DNA, 25 bp, Mus musculus
gcagcactgcggagagccagctgct

SEQ ID NO: 303783 - DNA, 25 bp, Mus musculus
gcagcactgcggagttgagagctgc

SEQ ID NO: 303784 - DNA, 25 bp, Mus musculus
gcagcactggattcccggtcgggtg

SEQ ID NO: 303785 - DNA, 25 bp, Mus musculus
gcagcactggcaggtgcaggacgtt

SEQ ID NO: 303786 - DNA, 25 bp, Mus musculus
gcagcactggcaggtgtcagcggaa

SEQ ID NO: 303787 - DNA, 25 bp, Mus musculus
gcagcacttcaagatgtatcgcctg

SEQ ID NO: 303788 - DNA, 25 bp, Mus musculus
gcagcacttcagtgctgtcttcctg

SEQ ID NO: 303789 - DNA, 25 bp, Mus musculus
gcagcactttgaaagggagaagaca

SEQ ID NO: 303790 - DNA, 25 bp, Mus musculus
gcagcactttgaaagtattgagcaa

SEQ ID NO: 303791 - DNA, 25 bp, Mus musculus
gcagcagaaaccgtaaaagccttga

SEQ ID NO: 303792 - DNA, 25 bp, Mus musculus
gcagcagaaagagactaacggttat

SEQ ID NO: 303793 - DNA, 25 bp, Mus musculus
gcagcagaaagagatctatcaagtc

SEQ ID NO: 303794 - DNA, 25 bp, Mus musculus
gcagcagaaagagccgtctctcagg

SEQ ID NO: 303795 - DNA, 25 bp, Mus musculus
gcagcagaaagaggtagaagaaaga

SEQ ID NO: 303796 - DNA, 25 bp, Mus musculus
gcagcagaaagatagaagctagaaa

SEQ ID NO: 303797 - DNA, 25 bp, Mus musculus
gcagcagaacctggaagctatgctc

SEQ ID NO: 303798 - DNA, 25 bp, Mus musculus
gcagcagaagattctctgtggcaag

SEQ ID NO: 303799 - DNA, 25 bp, Mus musculus
gcagcagacacccaagagacacagt

SEQ ID NO: 303800 - DNA, 25 bp, Mus musculus
gcagcagactcgtctcaaggagctg

SEQ ID NO: 303801 - DNA, 25 bp, Mus musculus
gcagcagagaagaaagcccgctggg

SEQ ID NO: 303802 - DNA, 25 bp, Mus musculus
gcagcagagaagggcggtgctggtg

SEQ ID NO: 303803 - DNA, 25 bp, Mus musculus
gcagcagagactggacgcggattct

SEQ ID NO: 303804 - DNA, 25 bp, Mus musculus
gcagcagagactggactacgagagt

SEQ ID NO: 303805 - DNA, 25 bp, Mus musculus
gcagcagaggaagacgttcacagcc

SEQ ID NO: 303806 - DNA, 25 bp, Mus musculus
gcagcagatagtttcttaatgagtc

SEQ ID NO: 303807 - DNA, 25 bp, Mus musculus
gcagcagatgttcaagtttggacga

SEQ ID NO: 303808 - DNA, 25 bp, Mus musculus
gcagcagattaacagagactctgca

SEQ ID NO: 303809 - DNA, 25 bp, Mus musculus
gcagcagcaaagtctgcatctggcg

SEQ ID NO: 303810 - DNA, 25 bp, Mus musculus
gcagcagcaacctcattgggcgcta

SEQ ID NO: 303811 - DNA, 25 bp, Mus musculus
gcagcagcaccagatttcaatggga

SEQ ID NO: 303812 - DNA, 25 bp, Mus musculus
gcagcagcaccagggcctgtccacc

SEQ ID NO: 303813 - DNA, 25 bp, Mus musculus
gcagcagcagaaacagcccccacat

SEQ ID NO: 303814 - DNA, 25 bp, Mus musculus
gcagcagcagaaggtttgatgagcc

SEQ ID NO: 303815 - DNA, 25 bp, Mus musculus
gcagcagcagactcaagaatgaata

SEQ ID NO: 303816 - DNA, 25 bp, Mus musculus
gcagcagcagcaacagcaacagcaa

SEQ ID NO: 303817 - DNA, 25 bp, Mus musculus
gcagcagcagcagaaacagccccca

SEQ ID NO: 303818 - DNA, 25 bp, Mus musculus
gcagcagcagcagactcaagaatga

SEQ ID NO: 303819 - DNA, 25 bp, Mus musculus
gcagcagcagcagcagcagcagcag

SEQ ID NO: 303820 - DNA, 25 bp, Mus musculus
gcagcagcagcagccagtttctgat

SEQ ID NO: 303821 - DNA, 25 bp, Mus musculus
gcagcagcagcagggatggctcgga

SEQ ID NO: 303822 - DNA, 25 bp, Mus musculus
gcagcagcagcagggctctaccact

SEQ ID NO: 303823 - DNA, 25 bp, Mus musculus
gcagcagcagccagtttctgatgcc

SEQ ID NO: 303824 - DNA, 25 bp, Mus musculus
gcagcagcaggagaggctacagcag

SEQ ID NO: 303825 - DNA, 25 bp, Mus musculus
gcagcagcaggaggtgtatggtgcg

SEQ ID NO: 303826 - DNA, 25 bp, Mus musculus
gcagcagcagggatggctcggatgt

SEQ ID NO: 303827 - DNA, 25 bp, Mus musculus
gcagcagcagggctctaccactcaa

SEQ ID NO: 303828 - DNA, 25 bp, Mus musculus
gcagcagcagtaggcactggtgaaa

SEQ ID NO: 303829 - DNA, 25 bp, Mus musculus
gcagcagcagttgcaacaacctcag

SEQ ID NO: 303830 - DNA, 25 bp, Mus musculus
gcagcagcattagattgtcttcgat

SEQ ID NO: 303831 - DNA, 25 bp, Mus musculus
gcagcagccaaggacacttagcctg

SEQ ID NO: 303832 - DNA, 25 bp, Mus musculus
gcagcagccagggccggccctcgaa

SEQ ID NO: 303833 - DNA, 25 bp, Mus musculus
gcagcagccagggtcggccctcgaa

SEQ ID NO: 303834 - DNA, 25 bp, Mus musculus
gcagcagcccatacaatcctcctga

SEQ ID NO: 303835 - DNA, 25 bp, Mus musculus
gcagcagccctggtgtctgagagca

SEQ ID NO: 303836 - DNA, 25 bp, Mus musculus
gcagcagccctgtttgatctgtgga

SEQ ID NO: 303837 - DNA, 25 bp, Mus musculus
gcagcagccggaggggcacacaaag

SEQ ID NO: 303838 - DNA, 25 bp, Mus musculus
gcagcagccggaggtgtgtttcata

SEQ ID NO: 303839 - DNA, 25 bp, Mus musculus
gcagcagccggagtttgaagaggac

SEQ ID NO: 303840 - DNA, 25 bp, Mus musculus
gcagcagcctgaaaatgccacctcg

SEQ ID NO: 303841 - DNA, 25 bp, Mus musculus
gcagcagcctttggcctctctgtcc

SEQ ID NO: 303842 - DNA, 25 bp, Mus musculus
gcagcagcctttggtgcgcccggca

SEQ ID NO: 303843 - DNA, 25 bp, Mus musculus
gcagcagcgaaatgaccagcccatc

SEQ ID NO: 303844 - DNA, 25 bp, Mus musculus
gcagcagcgaaatggttgtactttc

SEQ ID NO: 303845 - DNA, 25 bp, Mus musculus
gcagcagcgagaatgcttcgtggca

SEQ ID NO: 303846 - DNA, 25 bp, Mus musculus
gcagcagcgcaagaccttcacagcc

SEQ ID NO: 303847 - DNA, 25 bp, Mus musculus
gcagcagcgcagcctcaggctggct

SEQ ID NO: 303848 - DNA, 25 bp, Mus musculus
gcagcagcggcaggaaaagcccaga

SEQ ID NO: 303849 - DNA, 25 bp, Mus musculus
gcagcagcggcaggaggatgagtct

SEQ ID NO: 303850 - DNA, 25 bp, Mus musculus
gcagcagctctgacagttccaggag

SEQ ID NO: 303851 - DNA, 25 bp, Mus musculus
gcagcagcttagagaagctgatggt

SEQ ID NO: 303852 - DNA, 25 bp, Mus musculus
gcagcagcttagggatacaagttga

SEQ ID NO: 303853 - DNA, 25 bp, Mus musculus
gcagcagcttggtctgggaacgtaa

SEQ ID NO: 303854 - DNA, 25 bp, Mus musculus
gcagcaggaagaatttcagcatatg

SEQ ID NO: 303855 - DNA, 25 bp, Mus musculus
gcagcaggaaggtgctgtataatgt

SEQ ID NO: 303856 - DNA, 25 bp, Mus musculus
gcagcaggaagtgaggtggaagaaa

SEQ ID NO: 303857 - DNA, 25 bp, Mus musculus
gcagcaggagacagtgacccgcctg

SEQ ID NO: 303858 - DNA, 25 bp, Mus musculus
gcagcaggagaggctacagcaggag

SEQ ID NO: 303859 - DNA, 25 bp, Mus musculus
gcagcaggagatgaggcccgccctt

SEQ ID NO: 303860 - DNA, 25 bp, Mus musculus
gcagcaggaggatatggctcggcca

SEQ ID NO: 303861 - DNA, 25 bp, Mus musculus
gcagcaggatcagatgcgatacaac

SEQ ID NO: 303862 - DNA, 25 bp, Mus musculus
gcagcaggatcaggagctggtgggg

SEQ ID NO: 303863 - DNA, 25 bp, Mus musculus
gcagcaggcagccagcccagtgggc

SEQ ID NO: 303864 - DNA, 25 bp, Mus musculus
gcagcaggccgcgctagaaaatgct

SEQ ID NO: 303865 - DNA, 25 bp, Mus musculus
gcagcaggccgggggacagtaaatc

SEQ ID NO: 303866 - DNA, 25 bp, Mus musculus
gcagcaggcgttgcagaaactgagg

SEQ ID NO: 303867 - DNA, 25 bp, Mus musculus
gcagcaggctctattcccaactttc

SEQ ID NO: 303868 - DNA, 25 bp, Mus musculus
gcagcaggctcttgcatcccctcag

SEQ ID NO: 303869 - DNA, 25 bp, Mus musculus
gcagcagggaagttggggggactct

SEQ ID NO: 303870 - DNA, 25 bp, Mus musculus
gcagcaggggccctccctgaccctg

SEQ ID NO: 303871 - DNA, 25 bp, Mus musculus
gcagcaggtgcgagaacgcaacctg

SEQ ID NO: 303872 - DNA, 25 bp, Mus musculus
gcagcaggtggcagagaaggaagcc

SEQ ID NO: 303873 - DNA, 25 bp, Mus musculus
gcagcaggttcctgtgtggtgggga

SEQ ID NO: 303874 - DNA, 25 bp, Mus musculus
gcagcagtatgccttcctcaagccc

SEQ ID NO: 303875 - DNA, 25 bp, Mus musculus
gcagcagtcccgttctgcagacctc

SEQ ID NO: 303876 - DNA, 25 bp, Mus musculus
gcagcagtgacagtgagagcgggtc

SEQ ID NO: 303877 - DNA, 25 bp, Mus musculus
gcagcagtgtgaagggctcaggatg

SEQ ID NO: 303878 - DNA, 25 bp, Mus musculus
gcagcagttgagaatcccagctggc

SEQ ID NO: 303879 - DNA, 25 bp, Mus musculus
gcagcagttgcaggaatctcagcaa

SEQ ID NO: 303880 - DNA, 25 bp, Mus musculus
gcagcataatgctaaagaagtaaac

SEQ ID NO: 303881 - DNA, 25 bp, Mus musculus
gcagcatacaaggtcaacatggcca

SEQ ID NO: 303882 - DNA, 25 bp, Mus musculus
gcagcatataacaggaacggtcatc

SEQ ID NO: 303883 - DNA, 25 bp, Mus musculus
gcagcatataacaggaatttctctt

SEQ ID NO: 303884 - DNA, 25 bp, Mus musculus
gcagcatcacaggaggcacctcacc

SEQ ID NO: 303885 - DNA, 25 bp, Mus musculus
gcagcatcagcccccggcagcagca

SEQ ID NO: 303886 - DNA, 25 bp, Mus musculus
gcagcatcatattgaacgagaaaaa

SEQ ID NO: 303887 - DNA, 25 bp, Mus musculus
gcagcatccagtgttgcctgtgcct

SEQ ID NO: 303888 - DNA, 25 bp, Mus musculus
gcagcatccagttcgtgaagagagt

SEQ ID NO: 303889 - DNA, 25 bp, Mus musculus
gcagcatcctgagcgcgagaacttt

SEQ ID NO: 303890 - DNA, 25 bp, Mus musculus
gcagcatctgaggaacaagcaatgg

SEQ ID NO: 303891 - DNA, 25 bp, Mus musculus
gcagcatctgaggaagactcttcaa

SEQ ID NO: 303892 - DNA, 25 bp, Mus musculus
gcagcatcttcggcttcagtgtgtg

SEQ ID NO: 303893 - DNA, 25 bp, Mus musculus
gcagcatgaaaggatcttctacctg

SEQ ID NO: 303894 - DNA, 25 bp, Mus musculus
gcagcatgcactgcgcaatgagctc

SEQ ID NO: 303895 - DNA, 25 bp, Mus musculus
gcagcatgcagggctttcagataaa

SEQ ID NO: 303896 - DNA, 25 bp, Mus musculus
gcagcatgcagggtaagcgcaaagc

SEQ ID NO: 303897 - DNA, 25 bp, Mus musculus
gcagcatggaactaagctctggggt

SEQ ID NO: 303898 - DNA, 25 bp, Mus musculus
gcagcatggaagtgtgattttaaaa

SEQ ID NO: 303899 - DNA, 25 bp, Mus musculus
gcagcatggaagtgttctgtacctc

SEQ ID NO: 303900 - DNA, 25 bp, Mus musculus
gcagcatggcctcagaagctcgaag

SEQ ID NO: 303901 - DNA, 25 bp, Mus musculus
gcagcattagaggagctgaccaagg

SEQ ID NO: 303902 - DNA, 25 bp, Mus musculus
gcagcattcaggtcaaggaagctga

SEQ ID NO: 303903 - DNA, 25 bp, Mus musculus
gcagcattctcctggtgcagatcac

SEQ ID NO: 303904 - DNA, 25 bp, Mus musculus
gcagcattgtccaggagcgcccctt

SEQ ID NO: 303905 - DNA, 25 bp, Mus musculus
gcagccaaacagcccatcacggtgc

SEQ ID NO: 303906 - DNA, 25 bp, Mus musculus
gcagccaaacatgatactggatgat

SEQ ID NO: 303907 - DNA, 25 bp, Mus musculus
gcagccaaagggtggataccctggg

SEQ ID NO: 303908 - DNA, 25 bp, Mus musculus
gcagccaacaagatgtcatggcacc

SEQ ID NO: 303909 - DNA, 25 bp, Mus musculus
gcagccaacaaggacaaagtcggtg

SEQ ID NO: 303910 - DNA, 25 bp, Mus musculus
gcagccaacgggattggtcgcctgg

SEQ ID NO: 303911 - DNA, 25 bp, Mus musculus
gcagccaagccgcaggcatgaggtg

SEQ ID NO: 303912 - DNA, 25 bp, Mus musculus
gcagccaagctcagagtgcctgctc

SEQ ID NO: 303913 - DNA, 25 bp, Mus musculus
gcagccaaggaaaggtaccgagctt

SEQ ID NO: 303914 - DNA, 25 bp, Mus musculus
gcagccaaggacacttagcctgtga

SEQ ID NO: 303915 - DNA, 25 bp, Mus musculus
gcagccaaggcatgagacactgccc

SEQ ID NO: 303916 - DNA, 25 bp, Mus musculus
gcagccaaggcatggtcttttccct

SEQ ID NO: 303917 - DNA, 25 bp, Mus musculus
gcagccaagtggaccattgacctga

SEQ ID NO: 303918 - DNA, 25 bp, Mus musculus
gcagccaagtggaccccacagagca

SEQ ID NO: 303919 - DNA, 25 bp, Mus musculus
gcagccaattgcctgtgatggtgtg

SEQ ID NO: 303920 - DNA, 25 bp, Mus musculus
gcagccacacagagccagacctaga

SEQ ID NO: 303921 - DNA, 25 bp, Mus musculus
gcagccacacgaatctgcagaagaa

SEQ ID NO: 303922 - DNA, 25 bp, Mus musculus
gcagccacacggaatacccggaggc

SEQ ID NO: 303923 - DNA, 25 bp, Mus musculus
gcagccacacggtgcagcacagtgc

SEQ ID NO: 303924 - DNA, 25 bp, Mus musculus
gcagccacagagggagggagcttga

SEQ ID NO: 303925 - DNA, 25 bp, Mus musculus
gcagccacagcgggcagctcagtgg

SEQ ID NO: 303926 - DNA, 25 bp, Mus musculus
gcagccaccaaggacggaattaaag

SEQ ID NO: 303927 - DNA, 25 bp, Mus musculus
gcagccaccaagtgctgagggttat

SEQ ID NO: 303928 - DNA, 25 bp, Mus musculus
gcagccaccagaggatgacagagga

SEQ ID NO: 303929 - DNA, 25 bp, Mus musculus
gcagccaccagaggtgatccaacag

SEQ ID NO: 303930 - DNA, 25 bp, Mus musculus
gcagccaccccgaggtcaggacgac

SEQ ID NO: 303931 - DNA, 25 bp, Mus musculus
gcagccaccgcacctgcgggaggca

SEQ ID NO: 303932 - DNA, 25 bp, Mus musculus
gcagccaccgcgctcatgcgtgctc

SEQ ID NO: 303933 - DNA, 25 bp, Mus musculus
gcagccacgatgagtgaacagagta

SEQ ID NO: 303934 - DNA, 25 bp, Mus musculus
gcagccactgcaaggggagcagcgc

SEQ ID NO: 303935 - DNA, 25 bp, Mus musculus
gcagccactgggttgccaagaagtt

SEQ ID NO: 303936 - DNA, 25 bp, Mus musculus
gcagccagaacccgattcatcagtg

SEQ ID NO: 303937 - DNA, 25 bp, Mus musculus
gcagccagaagaatatccagttatg

SEQ ID NO: 303938 - DNA, 25 bp, Mus musculus
gcagccagagagggaaactgaggct

SEQ ID NO: 303939 - DNA, 25 bp, Mus musculus
gcagccagagcttgtccaggtgact

SEQ ID NO: 303940 - DNA, 25 bp, Mus musculus
gcagccagaggagtatctgattaca

SEQ ID NO: 303941 - DNA, 25 bp, Mus musculus
gcagccagaggggctcggtctctga

SEQ ID NO: 303942 - DNA, 25 bp, Mus musculus
gcagccagcaagtggatctggcgag

SEQ ID NO: 303943 - DNA, 25 bp, Mus musculus
gcagccagcacatctcagccagtga

SEQ ID NO: 303944 - DNA, 25 bp, Mus musculus
gcagccagcagcatgtgtttcagtg

SEQ ID NO: 303945 - DNA, 25 bp, Mus musculus
gcagccagcagccagaaatctcata

SEQ ID NO: 303946 - DNA, 25 bp, Mus musculus
gcagccagccaggcctgtccaccat

SEQ ID NO: 303947 - DNA, 25 bp, Mus musculus
gcagccagctgacgctgagagggcc

SEQ ID NO: 303948 - DNA, 25 bp, Mus musculus
gcagccaggacacagaccgtgctgg

SEQ ID NO: 303949 - DNA, 25 bp, Mus musculus
gcagccaggcgatgacgtggtctcc

SEQ ID NO: 303950 - DNA, 25 bp, Mus musculus
gcagccaggcgcaacctgcgggagg

SEQ ID NO: 303951 - DNA, 25 bp, Mus musculus
gcagccaggggggagctgctgcagt

SEQ ID NO: 303952 - DNA, 25 bp, Mus musculus
gcagccagggtcggccctcgaacat

SEQ ID NO: 303953 - DNA, 25 bp, Mus musculus
gcagccagtaacagcacccaggcag

SEQ ID NO: 303954 - DNA, 25 bp, Mus musculus
gcagccagtccaggcgcctctagca

SEQ ID NO: 303955 - DNA, 25 bp, Mus musculus
gcagccatgagcgagacggtcatct

SEQ ID NO: 303956 - DNA, 25 bp, Mus musculus
gcagccatgaggcggcaggccctgc

SEQ ID NO: 303957 - DNA, 25 bp, Mus musculus
gcagccatggtgaaggtgtttagct

SEQ ID NO: 303958 - DNA, 25 bp, Mus musculus
gcagccattaaagatttcattatga

SEQ ID NO: 303959 - DNA, 25 bp, Mus musculus
gcagcccaagaagaaccaagagccg

SEQ ID NO: 303960 - DNA, 25 bp, Mus musculus
gcagcccaagaagacgcaaatccag

SEQ ID NO: 303961 - DNA, 25 bp, Mus musculus
gcagcccaagagactgaattccctc

SEQ ID NO: 303962 - DNA, 25 bp, Mus musculus
gcagcccaagcagctggagattcac

SEQ ID NO: 303963 - DNA, 25 bp, Mus musculus
gcagcccaaggagatacagaattaa

SEQ ID NO: 303964 - DNA, 25 bp, Mus musculus
gcagcccaaggaggctccgccccca

SEQ ID NO: 303965 - DNA, 25 bp, Mus musculus
gcagcccaaggattccagctttctc

SEQ ID NO: 303966 - DNA, 25 bp, Mus musculus
gcagcccaagtctttgcagattctt

SEQ ID NO: 303967 - DNA, 25 bp, Mus musculus
gcagcccacacaggtgatccagcag

SEQ ID NO: 303968 - DNA, 25 bp, Mus musculus
gcagcccagaagggtgtgcagatta

SEQ ID NO: 303969 - DNA, 25 bp, Mus musculus
gcagcccagacccaagaccatttcc

SEQ ID NO: 303970 - DNA, 25 bp, Mus musculus
gcagcccagacccaagactctccct

SEQ ID NO: 303971 - DNA, 25 bp, Mus musculus
gcagcccagaccctacaagtacccc

SEQ ID NO: 303972 - DNA, 25 bp, Mus musculus
gcagcccagcagggcatcctggccc

SEQ ID NO: 303973 - DNA, 25 bp, Mus musculus
gcagcccaggatcaaagaatcccga

SEQ ID NO: 303974 - DNA, 25 bp, Mus musculus
gcagcccaggggaacggggggtcta

SEQ ID NO: 303975 - DNA, 25 bp, Mus musculus
gcagcccaggggtggaggagaagcg

SEQ ID NO: 303976 - DNA, 25 bp, Mus musculus
gcagcccagtgcaggcctgccaaca

SEQ ID NO: 303977 - DNA, 25 bp, Mus musculus
gcagcccagtgcaggcctgccactg

SEQ ID NO: 303978 - DNA, 25 bp, Mus musculus
gcagcccagtggtatgacctgatgg

SEQ ID NO: 303979 - DNA, 25 bp, Mus musculus
gcagcccatccgctgagttcctgag

SEQ ID NO: 303980 - DNA, 25 bp, Mus musculus
gcagccccacattcaacccatgggg

SEQ ID NO: 303981 - DNA, 25 bp, Mus musculus
gcagccccacattcaactccagcgc

SEQ ID NO: 303982 - DNA, 25 bp, Mus musculus
gcagccccagagctgaactcccacc

SEQ ID NO: 303983 - DNA, 25 bp, Mus musculus
gcagccccagggcctgcttccgaga

SEQ ID NO: 303984 - DNA, 25 bp, Mus musculus
gcagcccccgcagggagctccgctt

SEQ ID NO: 303985 - DNA, 25 bp, Mus musculus
gcagccccgaggataatagaatctg

SEQ ID NO: 303986 - DNA, 25 bp, Mus musculus
gcagccccgcgaatgctgctgctag

SEQ ID NO: 303987 - DNA, 25 bp, Mus musculus
gcagccccgcgagttgcacgatttc

SEQ ID NO: 303988 - DNA, 25 bp, Mus musculus
gcagccccgcgatgtggccgtggct

SEQ ID NO: 303989 - DNA, 25 bp, Mus musculus
gcagcccctgaccagttagtcctct

SEQ ID NO: 303990 - DNA, 25 bp, Mus musculus
gcagcccctgtccaggtgattgagg

SEQ ID NO: 303991 - DNA, 25 bp, Mus musculus
gcagcccctgttctggtgattgagg

SEQ ID NO: 303992 - DNA, 25 bp, Mus musculus
gcagccccttgagtatggcaagaag

SEQ ID NO: 303993 - DNA, 25 bp, Mus musculus
gcagcccgagctacttccccacgag

SEQ ID NO: 303994 - DNA, 25 bp, Mus musculus
gcagcccgagggatgagtttgtggg

SEQ ID NO: 303995 - DNA, 25 bp, Mus musculus
gcagcccgcgggggagccgccgcct

SEQ ID NO: 303996 - DNA, 25 bp, Mus musculus
gcagcccgggaaagaacgcacagtg

SEQ ID NO: 303997 - DNA, 25 bp, Mus musculus
gcagccctctgccagagcacaagag

SEQ ID NO: 303998 - DNA, 25 bp, Mus musculus
gcagccctgctgctagtaacgaagg

SEQ ID NO: 303999 - DNA, 25 bp, Mus musculus
gcagccctggtgtctgagagcaagg

SEQ ID NO: 304000 - DNA, 25 bp, Mus musculus
gcagcccttgtgcagcacttagcta

SEQ ID NO: 304001 - DNA, 25 bp, Mus musculus
gcagcccttgtgcaggaagcatgca

SEQ ID NO: 304002 - DNA, 25 bp, Mus musculus
gcagccgacagcagctcctgagaaa

SEQ ID NO: 304003 - DNA, 25 bp, Mus musculus
gcagccgacagcagtaatctacagt

SEQ ID NO: 304004 - DNA, 25 bp, Mus musculus
gcagccgacgatacagacggcagcg

SEQ ID NO: 304005 - DNA, 25 bp, Mus musculus
gcagccgacggaggacccgctctct

SEQ ID NO: 304006 - DNA, 25 bp, Mus musculus
gcagccgacggcaccagagtttttc

SEQ ID NO: 304007 - DNA, 25 bp, Mus musculus
gcagccgagagtacaaacaggccat

SEQ ID NO: 304008 - DNA, 25 bp, Mus musculus
gcagccgatccagggagaagtcaat

SEQ ID NO: 304009 - DNA, 25 bp, Mus musculus
gcagccgatccaggtcccggtcctt

SEQ ID NO: 304010 - DNA, 25 bp, Mus musculus
gcagccgcaaacagggcctggatcc

SEQ ID NO: 304011 - DNA, 25 bp, Mus musculus
gcagccgcaaagaatggctatacac

SEQ ID NO: 304012 - DNA, 25 bp, Mus musculus
gcagccgcacaggcagcatatctag

SEQ ID NO: 304013 - DNA, 25 bp, Mus musculus
gcagccgccagaagcggctttagcc

SEQ ID NO: 304014 - DNA, 25 bp, Mus musculus
gcagccgccaggccagaagcggact

SEQ ID NO: 304015 - DNA, 25 bp, Mus musculus
gcagccgcccgcctggacaggatgt

SEQ ID NO: 304016 - DNA, 25 bp, Mus musculus
gcagccgcccggccatctgcttcac

SEQ ID NO: 304017 - DNA, 25 bp, Mus musculus
gcagccgcccgggacaggccatctg

SEQ ID NO: 304018 - DNA, 25 bp, Mus musculus
gcagccgccgcggaggtctttggcc

SEQ ID NO: 304019 - DNA, 25 bp, Mus musculus
gcagccgctaccccggaagaccagc

SEQ ID NO: 304020 - DNA, 25 bp, Mus musculus
gcagccgctacgaccccatccctgt

SEQ ID NO: 304021 - DNA, 25 bp, Mus musculus
gcagccgctctgaggtcgaatggta

SEQ ID NO: 304022 - DNA, 25 bp, Mus musculus
gcagccgctggatccagccgcagcc

SEQ ID NO: 304023 - DNA, 25 bp, Mus musculus
gcagccggaggggcacacaaagaaa

SEQ ID NO: 304024 - DNA, 25 bp, Mus musculus
gcagccggaggtgtgtttcataggc

SEQ ID NO: 304025 - DNA, 25 bp, Mus musculus
gcagccggagtttgaagaggacatt

SEQ ID NO: 304026 - DNA, 25 bp, Mus musculus
gcagccggatcccagggcctagtaa

SEQ ID NO: 304027 - DNA, 25 bp, Mus musculus
gcagccggcaggaccagtggctgct

SEQ ID NO: 304028 - DNA, 25 bp, Mus musculus
gcagccggcatatcattgcttattc

SEQ ID NO: 304029 - DNA, 25 bp, Mus musculus
gcagccggcatatccctgattgtcc

SEQ ID NO: 304030 - DNA, 25 bp, Mus musculus
gcagccggcggcacgatgccggtgc

SEQ ID NO: 304031 - DNA, 25 bp, Mus musculus
gcagccgggcaggtttgccaagctg

SEQ ID NO: 304032 - DNA, 25 bp, Mus musculus
gcagccgtgacggagatttcttgac

SEQ ID NO: 304033 - DNA, 25 bp, Mus musculus
gcagccgtgcagagaaaatttcctg

SEQ ID NO: 304034 - DNA, 25 bp, Mus musculus
gcagccgtgcagagatcctgtacat

SEQ ID NO: 304035 - DNA, 25 bp, Mus musculus
gcagcctaaggactaacggttatga

SEQ ID NO: 304036 - DNA, 25 bp, Mus musculus
gcagcctaagggaggaatttggcta

SEQ ID NO: 304037 - DNA, 25 bp, Mus musculus
gcagcctaagggcacagcccgagct

SEQ ID NO: 304038 - DNA, 25 bp, Mus musculus
gcagcctacccaaggaaactgccag

SEQ ID NO: 304039 - DNA, 25 bp, Mus musculus
gcagcctcactctagggtgaagcct

SEQ ID NO: 304040 - DNA, 25 bp, Mus musculus
gcagcctcagcaaagaagagtcgag

SEQ ID NO: 304041 - DNA, 25 bp, Mus musculus
gcagcctcagccaagttgaagttca

SEQ ID NO: 304042 - DNA, 25 bp, Mus musculus
gcagcctccaggaggcaaggatcgg

SEQ ID NO: 304043 - DNA, 25 bp, Mus musculus
gcagcctcccagagatcctcttccc

SEQ ID NO: 304044 - DNA, 25 bp, Mus musculus
gcagcctccccgactcggccatcga

SEQ ID NO: 304045 - DNA, 25 bp, Mus musculus
gcagcctccgaaagagcccagtgaa

SEQ ID NO: 304046 - DNA, 25 bp, Mus musculus
gcagcctccggctggcttaactctc

SEQ ID NO: 304047 - DNA, 25 bp, Mus musculus
gcagcctccgggacccccgaggctg

SEQ ID NO: 304048 - DNA, 25 bp, Mus musculus
gcagcctcgggttcctccatctcca

SEQ ID NO: 304049 - DNA, 25 bp, Mus musculus
gcagcctctgtacacgtccggatag

SEQ ID NO: 304050 - DNA, 25 bp, Mus musculus
gcagcctcttcaagccctctccagg

SEQ ID NO: 304051 - DNA, 25 bp, Mus musculus
gcagcctcttctctgagtttctcag

SEQ ID NO: 304052 - DNA, 25 bp, Mus musculus
gcagcctcttctctgtgcctttctt

SEQ ID NO: 304053 - DNA, 25 bp, Mus musculus
gcagcctctttgactatgaacaaca

SEQ ID NO: 304054 - DNA, 25 bp, Mus musculus
gcagcctctttgggttcgtttccat

SEQ ID NO: 304055 - DNA, 25 bp, Mus musculus
gcagcctgaaaatgccacctcggct

SEQ ID NO: 304056 - DNA, 25 bp, Mus musculus
gcagcctgagcctcgttccagggtc

SEQ ID NO: 304057 - DNA, 25 bp, Mus musculus
gcagcctgccaagtttgatgaagcg

SEQ ID NO: 304058 - DNA, 25 bp, Mus musculus
gcagcctggagcattgctgaatatg

SEQ ID NO: 304059 - DNA, 25 bp, Mus musculus
gcagcctggccagcattcaggagct

SEQ ID NO: 304060 - DNA, 25 bp, Mus musculus
gcagcctggtacccccttgcagaag

SEQ ID NO: 304061 - DNA, 25 bp, Mus musculus
gcagcctgtaagcccagcactatgg

SEQ ID NO: 304062 - DNA, 25 bp, Mus musculus
gcagcctgtaagcccagcatgtgca

SEQ ID NO: 304063 - DNA, 25 bp, Mus musculus
gcagcctgtaagttcttgcagatac

SEQ ID NO: 304064 - DNA, 25 bp, Mus musculus
gcagcctgtataagagccctgaaga

SEQ ID NO: 304065 - DNA, 25 bp, Mus musculus
gcagcctgtataaggtaggtgcacg

SEQ ID NO: 304066 - DNA, 25 bp, Mus musculus
gcagcctgtcaacaatggctcaaca

SEQ ID NO: 304067 - DNA, 25 bp, Mus musculus
gcagcctgtcaagaatatcgccaac

SEQ ID NO: 304068 - DNA, 25 bp, Mus musculus
gcagcctgtgcagtggcactccaaa

SEQ ID NO: 304069 - DNA, 25 bp, Mus musculus
gcagcctgtggggacaggttgcagc

SEQ ID NO: 304070 - DNA, 25 bp, Mus musculus
gcagcctgtggttgcagctcctcgt

SEQ ID NO: 304071 - DNA, 25 bp, Mus musculus
gcagcctgttcaagaaatcaacatg

SEQ ID NO: 304072 - DNA, 25 bp, Mus musculus
gcagcctgttcaaggttcgcccaga

SEQ ID NO: 304073 - DNA, 25 bp, Mus musculus
gcagccttacactacttctaaagat

SEQ ID NO: 304074 - DNA, 25 bp, Mus musculus
gcagccttagtcctgtcccccagct

SEQ ID NO: 304075 - DNA, 25 bp, Mus musculus
gcagccttcaggctcagttctgaca

SEQ ID NO: 304076 - DNA, 25 bp, Mus musculus
gcagccttcgccatgtccttatgtg

SEQ ID NO: 304077 - DNA, 25 bp, Mus musculus
gcagccttgagtgagcataatgaag

SEQ ID NO: 304078 - DNA, 25 bp, Mus musculus
gcagccttgagtgaggcatttcatg

SEQ ID NO: 304079 - DNA, 25 bp, Mus musculus
gcagcctttaccagccctttgggag

SEQ ID NO: 304080 - DNA, 25 bp, Mus musculus
gcagcctttgctttgacactggcca

SEQ ID NO: 304081 - DNA, 25 bp, Mus musculus
gcagcctttggcctctctgtcccta

SEQ ID NO: 304082 - DNA, 25 bp, Mus musculus
gcagcctttggtgcgcccggcataa

SEQ ID NO: 304083 - DNA, 25 bp, Mus musculus
gcagcgaaatgaccagcccatcaaa

SEQ ID NO: 304084 - DNA, 25 bp, Mus musculus
gcagcgaaatggttgtactttcccc

SEQ ID NO: 304085 - DNA, 25 bp, Mus musculus
gcagcgaaatggttgtactttctcc

SEQ ID NO: 304086 - DNA, 25 bp, Mus musculus
gcagcgacaagatgcctggccgagt

SEQ ID NO: 304087 - DNA, 25 bp, Mus musculus
gcagcgacacttgtccttcacacac

SEQ ID NO: 304088 - DNA, 25 bp, Mus musculus
gcagcgacagccaggtatgccatca

SEQ ID NO: 304089 - DNA, 25 bp, Mus musculus
gcagcgacgaggttcagattctgga

SEQ ID NO: 304090 - DNA, 25 bp, Mus musculus
gcagcgactaagcaggaagggatgg

SEQ ID NO: 304091 - DNA, 25 bp, Mus musculus
gcagcgactggctctggtccttcac

SEQ ID NO: 304092 - DNA, 25 bp, Mus musculus
gcagcgagacttgcaaaaggtgctg

SEQ ID NO: 304093 - DNA, 25 bp, Mus musculus
gcagcgagaggtggaggtagaggta

SEQ ID NO: 304094 - DNA, 25 bp, Mus musculus
gcagcgagcagatgtctcatttccg

SEQ ID NO: 304095 - DNA, 25 bp, Mus musculus
gcagcgagcgagtggtgatcatgtg

SEQ ID NO: 304096 - DNA, 25 bp, Mus musculus
gcagcgagcggagagtcatggatgc

SEQ ID NO: 304097 - DNA, 25 bp, Mus musculus
gcagcgagcggggtgctgagttctg

SEQ ID NO: 304098 - DNA, 25 bp, Mus musculus
gcagcgagctgaaattctgtcccct

SEQ ID NO: 304099 - DNA, 25 bp, Mus musculus
gcagcgaggagggctaccagttccc

SEQ ID NO: 304100 - DNA, 25 bp, Mus musculus
gcagcgaggccgagatctgtcgctt

SEQ ID NO: 304101 - DNA, 25 bp, Mus musculus
gcagcgagggcgaggatcatctgtc

SEQ ID NO: 304102 - DNA, 25 bp, Mus musculus
gcagcgagtcagtaccatctgccag

SEQ ID NO: 304103 - DNA, 25 bp, Mus musculus
gcagcgagtggcagagttgcacagc

SEQ ID NO: 304104 - DNA, 25 bp, Mus musculus
gcagcgatacgcttgcctggttcca

SEQ ID NO: 304105 - DNA, 25 bp, Mus musculus
gcagcgatacggctttggaccttga

SEQ ID NO: 304106 - DNA, 25 bp, Mus musculus
gcagcgataggaaggacctggatca

SEQ ID NO: 304107 - DNA, 25 bp, Mus musculus
gcagcgataggcttcattctcattc

SEQ ID NO: 304108 - DNA, 25 bp, Mus musculus
gcagcgatagggcttacccactctt

SEQ ID NO: 304109 - DNA, 25 bp, Mus musculus
gcagcgataggtcacttgcccagat

SEQ ID NO: 304110 - DNA, 25 bp, Mus musculus
gcagcgatcaggtaatagtgcagcg

SEQ ID NO: 304111 - DNA, 25 bp, Mus musculus
gcagcgatgggccagggctttgacc

SEQ ID NO: 304112 - DNA, 25 bp, Mus musculus
gcagcgattcaagaatttgcatcat

SEQ ID NO: 304113 - DNA, 25 bp, Mus musculus
gcagcgattcaagagtgcactcttc

SEQ ID NO: 304114 - DNA, 25 bp, Mus musculus
gcagcgcaagaccttcacagcctgg

SEQ ID NO: 304115 - DNA, 25 bp, Mus musculus
gcagcgcactctgagatcttggcat

SEQ ID NO: 304116 - DNA, 25 bp, Mus musculus
gcagcgccaagtgagagtcagcttg

SEQ ID NO: 304117 - DNA, 25 bp, Mus musculus
gcagcgccagtggctccgcgggccg

SEQ ID NO: 304118 - DNA, 25 bp, Mus musculus
gcagcgcccggacgtcctccccaac

SEQ ID NO: 304119 - DNA, 25 bp, Mus musculus
gcagcgccgatgccgcctgcagaat

SEQ ID NO: 304120 - DNA, 25 bp, Mus musculus
gcagcgccgcacaggtcccacacag

SEQ ID NO: 304121 - DNA, 25 bp, Mus musculus
gcagcgcctggagcatgcagccaag

SEQ ID NO: 304122 - DNA, 25 bp, Mus musculus
gcagcgcgcagacgggtccagtgaa

SEQ ID NO: 304123 - DNA, 25 bp, Mus musculus
gcagcgcgcagcccctggaggaagt

SEQ ID NO: 304124 - DNA, 25 bp, Mus musculus
gcagcgcgcgcagagacactgtact

SEQ ID NO: 304125 - DNA, 25 bp, Mus musculus
gcagcgcgcggacagagacactgta

SEQ ID NO: 304126 - DNA, 25 bp, Mus musculus
gcagcgcgcggccaggtgagttgga

SEQ ID NO: 304127 - DNA, 25 bp, Mus musculus
gcagcgcggcaggccgcggtagcgg

SEQ ID NO: 304128 - DNA, 25 bp, Mus musculus
gcagcgcggcgaaagaaagatcaca

SEQ ID NO: 304129 - DNA, 25 bp, Mus musculus
gcagcgcggcggaggttgccccgga

SEQ ID NO: 304130 - DNA, 25 bp, Mus musculus
gcagcgcgggccggtgtacattggt

SEQ ID NO: 304131 - DNA, 25 bp, Mus musculus
gcagcgctagatggaggtgaattgt

SEQ ID NO: 304132 - DNA, 25 bp, Mus musculus
gcagcgctagcctaaattgtataga

SEQ ID NO: 304133 - DNA, 25 bp, Mus musculus
gcagcgctatgcttggcgcaaacgc

SEQ ID NO: 304134 - DNA, 25 bp, Mus musculus
gcagcgctatgtgatgtacaaagcc

SEQ ID NO: 304135 - DNA, 25 bp, Mus musculus
gcagcgctcacgggaaccagtgacc

SEQ ID NO: 304136 - DNA, 25 bp, Mus musculus
gcagcgctccggaccctggctgggc

SEQ ID NO: 304137 - DNA, 25 bp, Mus musculus
gcagcgctccggtggaatgaacctt

SEQ ID NO: 304138 - DNA, 25 bp, Mus musculus
gcagcgctcgaaagaatagactttt

SEQ ID NO: 304139 - DNA, 25 bp, Mus musculus
gcagcggaagaaatggcaaaatgtc

SEQ ID NO: 304140 - DNA, 25 bp, Mus musculus
gcagcggaagaccagactctgagaa

SEQ ID NO: 304141 - DNA, 25 bp, Mus musculus
gcagcggaagcatggaaactagaga

SEQ ID NO: 304142 - DNA, 25 bp, Mus musculus
gcagcggaagcgagtgggcgtgtgg

SEQ ID NO: 304143 - DNA, 25 bp, Mus musculus
gcagcggagaagtggatgtcgcgtg

SEQ ID NO: 304144 - DNA, 25 bp, Mus musculus
gcagcggagaagtggtgaaggcctt

SEQ ID NO: 304145 - DNA, 25 bp, Mus musculus
gcagcggcacggcggagggaggaaa

SEQ ID NO: 304146 - DNA, 25 bp, Mus musculus
gcagcggcacggcgggagtcagcat

SEQ ID NO: 304147 - DNA, 25 bp, Mus musculus
gcagcggcacggcggggatcccact

SEQ ID NO: 304148 - DNA, 25 bp, Mus musculus
gcagcggcacggcgggtttcaaatg

SEQ ID NO: 304149 - DNA, 25 bp, Mus musculus
gcagcggcaggaggatgagtctgag

SEQ ID NO: 304150 - DNA, 25 bp, Mus musculus
gcagcggcatgaagatgagctaaga

SEQ ID NO: 304151 - DNA, 25 bp, Mus musculus
gcagcggcatggtgatgaatctttc

SEQ ID NO: 304152 - DNA, 25 bp, Mus musculus
gcagcggccacaggccactgcagag

SEQ ID NO: 304153 - DNA, 25 bp, Mus musculus
gcagcggcctcaaggtctgaggcgt

SEQ ID NO: 304154 - DNA, 25 bp, Mus musculus
gcagcggcctcaaggttggagacca

SEQ ID NO: 304155 - DNA, 25 bp, Mus musculus
gcagcggcctcaagtgaccttgcaa

SEQ ID NO: 304156 - DNA, 25 bp, Mus musculus
gcagcggcctcaggtccattcagaa

SEQ ID NO: 304157 - DNA, 25 bp, Mus musculus
gcagcggcgagtgggaaagacaaga

SEQ ID NO: 304158 - DNA, 25 bp, Mus musculus
gcagcggcgcaggttgccccggagg

SEQ ID NO: 304159 - DNA, 25 bp, Mus musculus
gcagcggcgctggtacaaagtaaga

SEQ ID NO: 304160 - DNA, 25 bp, Mus musculus
gcagcggcggcagaaatgatggaag

SEQ ID NO: 304161 - DNA, 25 bp, Mus musculus
gcagcggctgctcagagtatagaaa

SEQ ID NO: 304162 - DNA, 25 bp, Mus musculus
gcagcggctgctcaggtccaatcag

SEQ ID NO: 304163 - DNA, 25 bp, Mus musculus
gcagcggcttcctctggggggtcac

SEQ ID NO: 304164 - DNA, 25 bp, Mus musculus
gcagcgggagctggaacagcagctg

SEQ ID NO: 304165 - DNA, 25 bp, Mus musculus
gcagcgggagggagctgaatctgag

SEQ ID NO: 304166 - DNA, 25 bp, Mus musculus
gcagcgggagggcagcagagctttg

SEQ ID NO: 304167 - DNA, 25 bp, Mus musculus
gcagcgggcaccagtgagatcccat

SEQ ID NO: 304168 - DNA, 25 bp, Mus musculus
gcagcgggccagctacgaatacatg

SEQ ID NO: 304169 - DNA, 25 bp, Mus musculus
gcagcgggccaggaatgagatcagg

SEQ ID NO: 304170 - DNA, 25 bp, Mus musculus
gcagcgggcgacaggaagaactagg

SEQ ID NO: 304171 - DNA, 25 bp, Mus musculus
gcagcgggcgacaggtggtttcact

SEQ ID NO: 304172 - DNA, 25 bp, Mus musculus
gcagcgggctagcgcatttcagatc

SEQ ID NO: 304173 - DNA, 25 bp, Mus musculus
gcagcggggagaggggcgtagtggc

SEQ ID NO: 304174 - DNA, 25 bp, Mus musculus
gcagcggggcctgcggctcgacggg

SEQ ID NO: 304175 - DNA, 25 bp, Mus musculus
gcagcgggtttcgacttctcgccga

SEQ ID NO: 304176 - DNA, 25 bp, Mus musculus
gcagcgggtttgggtctgtacacat

SEQ ID NO: 304177 - DNA, 25 bp, Mus musculus
gcagcggttttgcgaaggatgcacc

SEQ ID NO: 304178 - DNA, 25 bp, Mus musculus
gcagcggttttgcgccccctcctct

SEQ ID NO: 304179 - DNA, 25 bp, Mus musculus
gcagcgtcaggggacagaccaccgg

SEQ ID NO: 304180 - DNA, 25 bp, Mus musculus
gcagcgtcatggagatgctcagacc

SEQ ID NO: 304181 - DNA, 25 bp, Mus musculus
gcagcgtccagcgtgcgcccctcca

SEQ ID NO: 304182 - DNA, 25 bp, Mus musculus
gcagcgtccttgagctgaggctgca

SEQ ID NO: 304183 - DNA, 25 bp, Mus musculus
gcagcgtgaacacagaaatcccttc

SEQ ID NO: 304184 - DNA, 25 bp, Mus musculus
gcagcgtgaacacagggggcttccg

SEQ ID NO: 304185 - DNA, 25 bp, Mus musculus
gcagcgtgaacacagtaacctcagt

SEQ ID NO: 304186 - DNA, 25 bp, Mus musculus
gcagcgtgaaggaaatggaatttat

SEQ ID NO: 304187 - DNA, 25 bp, Mus musculus
gcagcgtgagccagtgggtgtttga

SEQ ID NO: 304188 - DNA, 25 bp, Mus musculus
gcagcgtgagcggagagtgaagtgt

SEQ ID NO: 304189 - DNA, 25 bp, Mus musculus
gcagcgtgaggtcctggtattttgg

SEQ ID NO: 304190 - DNA, 25 bp, Mus musculus
gcagcgttcgaggagcgacacaacg

SEQ ID NO: 304191 - DNA, 25 bp, Mus musculus
gcagcgttcgaggtcgtgagtcagc

SEQ ID NO: 304192 - DNA, 25 bp, Mus musculus
gcagctaaagactgtttttgttaat

SEQ ID NO: 304193 - DNA, 25 bp, Mus musculus
gcagctaaagagaggatcaccttac

SEQ ID NO: 304194 - DNA, 25 bp, Mus musculus
gcagctaaagatgaacatgaaacag

SEQ ID NO: 304195 - DNA, 25 bp, Mus musculus
gcagctaacaggattggtatcattg

SEQ ID NO: 304196 - DNA, 25 bp, Mus musculus
gcagctaagagccaggtaatttcta

SEQ ID NO: 304197 - DNA, 25 bp, Mus musculus
gcagctacaggagtcatggctggct

SEQ ID NO: 304198 - DNA, 25 bp, Mus musculus
gcagctaccccaacaatgcaccttc

SEQ ID NO: 304199 - DNA, 25 bp, Mus musculus
gcagctaccccaacaggccccgggt

SEQ ID NO: 304200 - DNA, 25 bp, Mus musculus
gcagctacgccaggcacaaatatgc

SEQ ID NO: 304201 - DNA, 25 bp, Mus musculus
gcagctactcaggcagatccgtttt

SEQ ID NO: 304202 - DNA, 25 bp, Mus musculus
gcagctactcaggcagtatctccag

SEQ ID NO: 304203 - DNA, 25 bp, Mus musculus
gcagctacttggttccctgccgctc

SEQ ID NO: 304204 - DNA, 25 bp, Mus musculus
gcagctagaagggaagtctcagcgc

SEQ ID NO: 304205 - DNA, 25 bp, Mus musculus
gcagctagaatgcactggggctgct

SEQ ID NO: 304206 - DNA, 25 bp, Mus musculus
gcagctagagacagtccgagaactc

SEQ ID NO: 304207 - DNA, 25 bp, Mus musculus
gcagctagagagaattccagaattg

SEQ ID NO: 304208 - DNA, 25 bp, Mus musculus
gcagctagagaggacccttatggtg

SEQ ID NO: 304209 - DNA, 25 bp, Mus musculus
gcagctagagattgcgctggctcca

SEQ ID NO: 304210 - DNA, 25 bp, Mus musculus
gcagctagagcgacagcagttggaa

SEQ ID NO: 304211 - DNA, 25 bp, Mus musculus
gcagctagcaggtgccttccaacct

SEQ ID NO: 304212 - DNA, 25 bp, Mus musculus
gcagctagctggatcaccgacaacc

SEQ ID NO: 304213 - DNA, 25 bp, Mus musculus
gcagctagctggttgcagaggtttt

SEQ ID NO: 304214 - DNA, 25 bp, Mus musculus
gcagctagtcttttaatggagaatg

SEQ ID NO: 304215 - DNA, 25 bp, Mus musculus
gcagctagtcttttaggtaagaagt

SEQ ID NO: 304216 - DNA, 25 bp, Mus musculus
gcagctatgtcaaagataagtgttt

SEQ ID NO: 304217 - DNA, 25 bp, Mus musculus
gcagctcaacaaggagctggtgatt

SEQ ID NO: 304218 - DNA, 25 bp, Mus musculus
gcagctcaacatgtatggcttccga

SEQ ID NO: 304219 - DNA, 25 bp, Mus musculus
gcagctcaacatgtctcattcagtt

SEQ ID NO: 304220 - DNA, 25 bp, Mus musculus
gcagctcaaggaggctcaacgcaca

SEQ ID NO: 304221 - DNA, 25 bp, Mus musculus
gcagctcacctccgctgcctgcctt

SEQ ID NO: 304222 - DNA, 25 bp, Mus musculus
gcagctcagtcactcagctgcagca

SEQ ID NO: 304223 - DNA, 25 bp, Mus musculus
gcagctcatattaaggaggccttgt

SEQ ID NO: 304224 - DNA, 25 bp, Mus musculus
gcagctccacacaatatgacgtgtt

SEQ ID NO: 304225 - DNA, 25 bp, Mus musculus
gcagctccaggtataatggccggac

SEQ ID NO: 304226 - DNA, 25 bp, Mus musculus
gcagctcccaggaggttcatgagtt

SEQ ID NO: 304227 - DNA, 25 bp, Mus musculus
gcagctccccctcagatccaacact

SEQ ID NO: 304228 - DNA, 25 bp, Mus musculus
gcagctccccctcagggatccgtga

SEQ ID NO: 304229 - DNA, 25 bp, Mus musculus
gcagctcccctcgaagcagcaccgg

SEQ ID NO: 304230 - DNA, 25 bp, Mus musculus
gcagctcccggaaagtgaattatac

SEQ ID NO: 304231 - DNA, 25 bp, Mus musculus
gcagctccctagaagatggattcat

SEQ ID NO: 304232 - DNA, 25 bp, Mus musculus
gcagctccctagaagggcaacaacc

SEQ ID NO: 304233 - DNA, 25 bp, Mus musculus
gcagctccgagagcaggtctgggga

SEQ ID NO: 304234 - DNA, 25 bp, Mus musculus
gcagctccgagaggtcctggcccag

SEQ ID NO: 304235 - DNA, 25 bp, Mus musculus
gcagctcctcaccgcagcaccccca

SEQ ID NO: 304236 - DNA, 25 bp, Mus musculus
gcagctcctcaccggaacaaggagc

SEQ ID NO: 304237 - DNA, 25 bp, Mus musculus
gcagctcctccggcactttgacaca

SEQ ID NO: 304238 - DNA, 25 bp, Mus musculus
gcagctcctccggtacaaggttctg

SEQ ID NO: 304239 - DNA, 25 bp, Mus musculus
gcagctcctgaatgtacccctctag

SEQ ID NO: 304240 - DNA, 25 bp, Mus musculus
gcagctcctgacaaacgtcctggaa

SEQ ID NO: 304241 - DNA, 25 bp, Mus musculus
gcagctcgaacgatcgccggggctc

SEQ ID NO: 304242 - DNA, 25 bp, Mus musculus
gcagctcgacagatgccaaagtctg

SEQ ID NO: 304243 - DNA, 25 bp, Mus musculus
gcagctcgacaggtgcagggccctg

SEQ ID NO: 304244 - DNA, 25 bp, Mus musculus
gcagctctacccactccgagcaagc

SEQ ID NO: 304245 - DNA, 25 bp, Mus musculus
gcagctctattggctaatgggccaa

SEQ ID NO: 304246 - DNA, 25 bp, Mus musculus
gcagctctccagtgtggatgccacc

SEQ ID NO: 304247 - DNA, 25 bp, Mus musculus
gcagctctcgcagagacgtggagct

SEQ ID NO: 304248 - DNA, 25 bp, Mus musculus
gcagctctctcaggagttaaaaata

SEQ ID NO: 304249 - DNA, 25 bp, Mus musculus
gcagctctgacagttccaggaggca

SEQ ID NO: 304250 - DNA, 25 bp, Mus musculus
gcagctctgcagccccatgtgcatg

SEQ ID NO: 304251 - DNA, 25 bp, Mus musculus
gcagctctgcagtatgctgaccctg

SEQ ID NO: 304252 - DNA, 25 bp, Mus musculus
gcagctctgtgctgtattttcatct

SEQ ID NO: 304253 - DNA, 25 bp, Mus musculus
gcagctctgtggtttgggctcagtt

SEQ ID NO: 304254 - DNA, 25 bp, Mus musculus
gcagctcttagagattcccaccctg

SEQ ID NO: 304255 - DNA, 25 bp, Mus musculus
gcagctctttagggttctactttac

SEQ ID NO: 304256 - DNA, 25 bp, Mus musculus
gcagctgaaggtgatcaactgggag

SEQ ID NO: 304257 - DNA, 25 bp, Mus musculus
gcagctgacaggattcagtttgcct

SEQ ID NO: 304258 - DNA, 25 bp, Mus musculus
gcagctgacccagatatatttgtat

SEQ ID NO: 304259 - DNA, 25 bp, Mus musculus
gcagctgacccaggacatttgacac

SEQ ID NO: 304260 - DNA, 25 bp, Mus musculus
gcagctgacccagtttgctgagaag

SEQ ID NO: 304261 - DNA, 25 bp, Mus musculus
gcagctgacccgactcagccttatg

SEQ ID NO: 304262 - DNA, 25 bp, Mus musculus
gcagctgagcctccccctgcaggag

SEQ ID NO: 304263 - DNA, 25 bp, Mus musculus
gcagctgaggcagagaaaaggcagg

SEQ ID NO: 304264 - DNA, 25 bp, Mus musculus
gcagctgaggcagggtcagaaagca

SEQ ID NO: 304265 - DNA, 25 bp, Mus musculus
gcagctgaggggtaatcaggaagca

SEQ ID NO: 304266 - DNA, 25 bp, Mus musculus
gcagctgatgagggttctggggaca

SEQ ID NO: 304267 - DNA, 25 bp, Mus musculus
gcagctgatggagagaggtgccagc

SEQ ID NO: 304268 - DNA, 25 bp, Mus musculus
gcagctgatggagagttatttgctt

SEQ ID NO: 304269 - DNA, 25 bp, Mus musculus
gcagctgcaaaggagggctgctggc

SEQ ID NO: 304270 - DNA, 25 bp, Mus musculus
gcagctgcaaggcaggttggcgtgg

SEQ ID NO: 304271 - DNA, 25 bp, Mus musculus
gcagctgcagcagggctcatggcag

SEQ ID NO: 304272 - DNA, 25 bp, Mus musculus
gcagctgcagcctgacagagctgac

SEQ ID NO: 304273 - DNA, 25 bp, Mus musculus
gcagctgcagctcctcctaggtgct

SEQ ID NO: 304274 - DNA, 25 bp, Mus musculus
gcagctgcaggcaaaatgaaggatc

SEQ ID NO: 304275 - DNA, 25 bp, Mus musculus
gcagctgcagggaggggaactacat

SEQ ID NO: 304276 - DNA, 25 bp, Mus musculus
gcagctgcatgtgctccctctctat

SEQ ID NO: 304277 - DNA, 25 bp, Mus musculus
gcagctgccaatgggattggtcgcc

SEQ ID NO: 304278 - DNA, 25 bp, Mus musculus
gcagctgccagactctgatagactt

SEQ ID NO: 304279 - DNA, 25 bp, Mus musculus
gcagctgccatgactcagtcggctg

SEQ ID NO: 304280 - DNA, 25 bp, Mus musculus
gcagctgccatgggaattcctcaag

SEQ ID NO: 304281 - DNA, 25 bp, Mus musculus
gcagctgccgataagtacgccctgg

SEQ ID NO: 304282 - DNA, 25 bp, Mus musculus
gcagctgcgaccttgccctcctgcg

SEQ ID NO: 304283 - DNA, 25 bp, Mus musculus
gcagctgcgaggctctacacagaga

SEQ ID NO: 304284 - DNA, 25 bp, Mus musculus
gcagctgcgatgagcttaaaagatg

SEQ ID NO: 304285 - DNA, 25 bp, Mus musculus
gcagctgcgctgggttgtggcagca

SEQ ID NO: 304286 - DNA, 25 bp, Mus musculus
gcagctgctcaaggactcggagact

SEQ ID NO: 304287 - DNA, 25 bp, Mus musculus
gcagctgctcaaggtactccaggac

SEQ ID NO: 304288 - DNA, 25 bp, Mus musculus
gcagctgctgaaggaagcaatgtga

SEQ ID NO: 304289 - DNA, 25 bp, Mus musculus
gcagctgctgaccacactgggtccc

SEQ ID NO: 304290 - DNA, 25 bp, Mus musculus
gcagctgctgaccctgagcaatgag

SEQ ID NO: 304291 - DNA, 25 bp, Mus musculus
gcagctgctgattgggaacaagtca

SEQ ID NO: 304292 - DNA, 25 bp, Mus musculus
gcagctgctgctgagtgagcgggtg

SEQ ID NO: 304293 - DNA, 25 bp, Mus musculus
gcagctgctggagaggttatcaatg

SEQ ID NO: 304294 - DNA, 25 bp, Mus musculus
gcagctgctggcaggctgcatgctc

SEQ ID NO: 304295 - DNA, 25 bp, Mus musculus
gcagctggacagggtccgcaagcag

SEQ ID NO: 304296 - DNA, 25 bp, Mus musculus
gcagctggaggtggtcaagctgcca

SEQ ID NO: 304297 - DNA, 25 bp, Mus musculus
gcagctggaggtgtggaacaccagc

SEQ ID NO: 304298 - DNA, 25 bp, Mus musculus
gcagctggagtcaagggagatcgtg

SEQ ID NO: 304299 - DNA, 25 bp, Mus musculus
gcagctggagttgaactttctagat

SEQ ID NO: 304300 - DNA, 25 bp, Mus musculus
gcagctggatgaagatgggtttgtg

SEQ ID NO: 304301 - DNA, 25 bp, Mus musculus
gcagctggcccaggcctccaggact

SEQ ID NO: 304302 - DNA, 25 bp, Mus musculus
gcagctggccgagaaaaacgggtat

SEQ ID NO: 304303 - DNA, 25 bp, Mus musculus
gcagctggccgaggaacacctgctg

SEQ ID NO: 304304 - DNA, 25 bp, Mus musculus
gcagctggctaagaatgtgactgtg

SEQ ID NO: 304305 - DNA, 25 bp, Mus musculus
gcagctgggaaagggagcctttact

SEQ ID NO: 304306 - DNA, 25 bp, Mus musculus
gcagctgggagagacttcataaggg

SEQ ID NO: 304307 - DNA, 25 bp, Mus musculus
gcagctgggcccagaccctggccta

SEQ ID NO: 304308 - DNA, 25 bp, Mus musculus
gcagctggggccttggtgttgggag

SEQ ID NO: 304309 - DNA, 25 bp, Mus musculus
gcagctgggtgataggtgaccatgg

SEQ ID NO: 304310 - DNA, 25 bp, Mus musculus
gcagctggtggagcactacaccaca

SEQ ID NO: 304311 - DNA, 25 bp, Mus musculus
gcagctggtggaggcatggctggaa

SEQ ID NO: 304312 - DNA, 25 bp, Mus musculus
gcagctgtaaggagcttcaccctga

SEQ ID NO: 304313 - DNA, 25 bp, Mus musculus
gcagctgtcaaggaactgaatgcca

SEQ ID NO: 304314 - DNA, 25 bp, Mus musculus
gcagctgtccagcaggccacgattg

SEQ ID NO: 304315 - DNA, 25 bp, Mus musculus
gcagctgtgaaaagccattggcaca

SEQ ID NO: 304316 - DNA, 25 bp, Mus musculus
gcagctgtgaaaagggtcaagcagt

SEQ ID NO: 304317 - DNA, 25 bp, Mus musculus
gcagctgtggggttccacagcactg

SEQ ID NO: 304318 - DNA, 25 bp, Mus musculus
gcagctgtgtgatgattgaagatta

SEQ ID NO: 304319 - DNA, 25 bp, Mus musculus
gcagctgttcttgcgacatttgtga

SEQ ID NO: 304320 - DNA, 25 bp, Mus musculus
gcagcttagatggcaggcatgcccc

SEQ ID NO: 304321 - DNA, 25 bp, Mus musculus
gcagcttcaggaccacagccacttt

SEQ ID NO: 304322 - DNA, 25 bp, Mus musculus
gcagcttcaggatttctaccacgaa

SEQ ID NO: 304323 - DNA, 25 bp, Mus musculus
gcagcttcatcaggaatggccttga

SEQ ID NO: 304324 - DNA, 25 bp, Mus musculus
gcagcttcatcaggagcaagagcag

SEQ ID NO: 304325 - DNA, 25 bp, Mus musculus
gcagcttcatgaagaacatatgaca

SEQ ID NO: 304326 - DNA, 25 bp, Mus musculus
gcagcttcatgagtttaaattcctg

SEQ ID NO: 304327 - DNA, 25 bp, Mus musculus
gcagcttccagaaccacgtcaacct

SEQ ID NO: 304328 - DNA, 25 bp, Mus musculus
gcagcttccagatttgtctcaaagt

SEQ ID NO: 304329 - DNA, 25 bp, Mus musculus
gcagcttccaggcgtccgcgagttc

SEQ ID NO: 304330 - DNA, 25 bp, Mus musculus
gcagcttcctgagtggtatccttgg

SEQ ID NO: 304331 - DNA, 25 bp, Mus musculus
gcagcttcgagaagtacgatgaaga

SEQ ID NO: 304332 - DNA, 25 bp, Mus musculus
gcagcttctcctgggagggtcatct

SEQ ID NO: 304333 - DNA, 25 bp, Mus musculus
gcagcttctcctgggttggattgat

SEQ ID NO: 304334 - DNA, 25 bp, Mus musculus
gcagcttctcctggtggaccacaga

SEQ ID NO: 304335 - DNA, 25 bp, Mus musculus
gcagcttgaaaatgcagaacagctt

SEQ ID NO: 304336 - DNA, 25 bp, Mus musculus
gcagcttggagccggaagctggact

SEQ ID NO: 304337 - DNA, 25 bp, Mus musculus
gcagcttggatggagaggttggtac

SEQ ID NO: 304338 - DNA, 25 bp, Mus musculus
gcagcttggatggagcgtcagtgag

SEQ ID NO: 304339 - DNA, 25 bp, Mus musculus
gcagcttgggatcctggtatctcag

SEQ ID NO: 304340 - DNA, 25 bp, Mus musculus
gcagctttctcccaggtgctcacca

SEQ ID NO: 304341 - DNA, 25 bp, Mus musculus
gcagctttgcagcatgctcacgcac

SEQ ID NO: 304342 - DNA, 25 bp, Mus musculus
gcagctttgttgagaaggagcgcca

SEQ ID NO: 304343 - DNA, 25 bp, Mus musculus
gcaggaaaacattgctgatagccca

SEQ ID NO: 304344 - DNA, 25 bp, Mus musculus
gcaggaaaagagttcctggtctgag

SEQ ID NO: 304345 - DNA, 25 bp, Mus musculus
gcaggaaaaggtggtcactaactgc

SEQ ID NO: 304346 - DNA, 25 bp, Mus musculus
gcaggaaaatgggaagacagatgtc

SEQ ID NO: 304347 - DNA, 25 bp, Mus musculus
gcaggaaacaagattatccagctga

SEQ ID NO: 304348 - DNA, 25 bp, Mus musculus
gcaggaaacagttacctgcagaatg

SEQ ID NO: 304349 - DNA, 25 bp, Mus musculus
gcaggaaactggagtgtgggttcgc

SEQ ID NO: 304350 - DNA, 25 bp, Mus musculus
gcaggaaagaacaagagacatgttt

SEQ ID NO: 304351 - DNA, 25 bp, Mus musculus
gcaggaaagcagaaaaccgtcaagg

SEQ ID NO: 304352 - DNA, 25 bp, Mus musculus
gcaggaaagcgaggatgagaagcag

SEQ ID NO: 304353 - DNA, 25 bp, Mus musculus
gcaggaaagttccaggggaacatag

SEQ ID NO: 304354 - DNA, 25 bp, Mus musculus
gcaggaacacacagtggggagggga

SEQ ID NO: 304355 - DNA, 25 bp, Mus musculus
gcaggaacagggtcaagtcctccat

SEQ ID NO: 304356 - DNA, 25 bp, Mus musculus
gcaggaacagggtttaatgtggaga

SEQ ID NO: 304357 - DNA, 25 bp, Mus musculus
gcaggaaccaatgagacaccatgat

SEQ ID NO: 304358 - DNA, 25 bp, Mus musculus
gcaggaaccaatggagccattccgt

SEQ ID NO: 304359 - DNA, 25 bp, Mus musculus
gcaggaaccaggttggtctggggtg

SEQ ID NO: 304360 - DNA, 25 bp, Mus musculus
gcaggaaccagttggaaggacctgg

SEQ ID NO: 304361 - DNA, 25 bp, Mus musculus
gcaggaactaaatcttccatccgag

SEQ ID NO: 304362 - DNA, 25 bp, Mus musculus
gcaggaactcaaggaatgactattc

SEQ ID NO: 304363 - DNA, 25 bp, Mus musculus
gcaggaactcaagggagctaagaag

SEQ ID NO: 304364 - DNA, 25 bp, Mus musculus
gcaggaactcaagttgaccgccttg

SEQ ID NO: 304365 - DNA, 25 bp, Mus musculus
gcaggaactcaggtggccactctag

SEQ ID NO: 304366 - DNA, 25 bp, Mus musculus
gcaggaactgtgtggacgacccccc

SEQ ID NO: 304367 - DNA, 25 bp, Mus musculus
gcaggaagatttccgaactgaaaga

SEQ ID NO: 304368 - DNA, 25 bp, Mus musculus
gcaggaagcacgggggtaccattcc

SEQ ID NO: 304369 - DNA, 25 bp, Mus musculus
gcaggaagcacgggtggctgcaaga

SEQ ID NO: 304370 - DNA, 25 bp, Mus musculus
gcaggaagccagatatctcacagac

SEQ ID NO: 304371 - DNA, 25 bp, Mus musculus
gcaggaagccagcgagtcatcctcc

SEQ ID NO: 304372 - DNA, 25 bp, Mus musculus
gcaggaagcctgtgcccagtatagt

SEQ ID NO: 304373 - DNA, 25 bp, Mus musculus
gcaggaagcgctgctccgaaagaca

SEQ ID NO: 304374 - DNA, 25 bp, Mus musculus
gcaggaagctcagatgctgcagttc

SEQ ID NO: 304375 - DNA, 25 bp, Mus musculus
gcaggaagctgggccggcacatggg

SEQ ID NO: 304376 - DNA, 25 bp, Mus musculus
gcaggaaggaggatgctgtccttac

SEQ ID NO: 304377 - DNA, 25 bp, Mus musculus
gcaggaagtgaggtggaagaaaagt

SEQ ID NO: 304378 - DNA, 25 bp, Mus musculus
gcaggaagtgccagcatcacaacga

SEQ ID NO: 304379 - DNA, 25 bp, Mus musculus
gcaggaagtgccaggatcacaacga

SEQ ID NO: 304380 - DNA, 25 bp, Mus musculus
gcaggaatcagccatgcatcatcaa

SEQ ID NO: 304381 - DNA, 25 bp, Mus musculus
gcaggaatgaaagatttatgataaa

SEQ ID NO: 304382 - DNA, 25 bp, Mus musculus
gcaggaatgaaaggtttcaacagct

SEQ ID NO: 304383 - DNA, 25 bp, Mus musculus
gcaggaattccgggtcagctgctac

SEQ ID NO: 304384 - DNA, 25 bp, Mus musculus
gcaggacaaagaccaaggattactg

SEQ ID NO: 304385 - DNA, 25 bp, Mus musculus
gcaggacaaagagactgcatcgacg

SEQ ID NO: 304386 - DNA, 25 bp, Mus musculus
gcaggacaaagcatgtggggcagtg

SEQ ID NO: 304387 - DNA, 25 bp, Mus musculus
gcaggacaaaggagtctcacctgaa

SEQ ID NO: 304388 - DNA, 25 bp, Mus musculus
gcaggacaagaaggcaaattagatt

SEQ ID NO: 304389 - DNA, 25 bp, Mus musculus
gcaggacacactccacgcagtatga

SEQ ID NO: 304390 - DNA, 25 bp, Mus musculus
gcaggacacgaaaactgtccttggg

SEQ ID NO: 304391 - DNA, 25 bp, Mus musculus
gcaggacagctgtggagctggcctg

SEQ ID NO: 304392 - DNA, 25 bp, Mus musculus
gcaggacagggaggtactgatacta

SEQ ID NO: 304393 - DNA, 25 bp, Mus musculus
gcaggacagggaggttccagaatac

SEQ ID NO: 304394 - DNA, 25 bp, Mus musculus
gcaggacagtcatggtggaccagca

SEQ ID NO: 304395 - DNA, 25 bp, Mus musculus
gcaggacagtgacagcatcacggct

SEQ ID NO: 304396 - DNA, 25 bp, Mus musculus
gcaggacatagaaattgcttttcta

SEQ ID NO: 304397 - DNA, 25 bp, Mus musculus
gcaggacataggttgaatgctatgt

SEQ ID NO: 304398 - DNA, 25 bp, Mus musculus
gcaggacatgaaacagtacctttga

SEQ ID NO: 304399 - DNA, 25 bp, Mus musculus
gcaggacatgaagctacagtcgttg

SEQ ID NO: 304400 - DNA, 25 bp, Mus musculus
gcaggacatgatagacggcttgaag

SEQ ID NO: 304401 - DNA, 25 bp, Mus musculus
gcaggaccaagctggcaagcgcgcc

SEQ ID NO: 304402 - DNA, 25 bp, Mus musculus
gcaggaccaaggatcagacaagggt

SEQ ID NO: 304403 - DNA, 25 bp, Mus musculus
gcaggaccacagaactacagctgaa

SEQ ID NO: 304404 - DNA, 25 bp, Mus musculus
gcaggaccacagttatatatcttca

SEQ ID NO: 304405 - DNA, 25 bp, Mus musculus
gcaggaccaccaagacatccaggag

SEQ ID NO: 304406 - DNA, 25 bp, Mus musculus
gcaggaccaccaagactcacaccct

SEQ ID NO: 304407 - DNA, 25 bp, Mus musculus
gcaggaccagagggtcctcctggtg

SEQ ID NO: 304408 - DNA, 25 bp, Mus musculus
gcaggaccaggcaggagtacctgga

SEQ ID NO: 304409 - DNA, 25 bp, Mus musculus
gcaggaccaggcagtacacctatgg

SEQ ID NO: 304410 - DNA, 25 bp, Mus musculus
gcaggaccaggcggttgtggatctc

SEQ ID NO: 304411 - DNA, 25 bp, Mus musculus
gcaggaccaggtgtcatttggaacc

SEQ ID NO: 304412 - DNA, 25 bp, Mus musculus
gcaggaccaggtgtctgatctggac

SEQ ID NO: 304413 - DNA, 25 bp, Mus musculus
gcaggacccggaactgaaagcaaaa

SEQ ID NO: 304414 - DNA, 25 bp, Mus musculus
gcaggaccctcgaccgtttccagga

SEQ ID NO: 304415 - DNA, 25 bp, Mus musculus
gcaggaccctcgacgccttattcag

SEQ ID NO: 304416 - DNA, 25 bp, Mus musculus
gcaggaccctgtgagctcggtcgag

SEQ ID NO: 304417 - DNA, 25 bp, Mus musculus
gcaggaccgagacagctccttccgc

SEQ ID NO: 304418 - DNA, 25 bp, Mus musculus
gcaggacctgaaaggattaataggc

SEQ ID NO: 304419 - DNA, 25 bp, Mus musculus
gcaggacctgaaatttcagattgga

SEQ ID NO: 304420 - DNA, 25 bp, Mus musculus
gcaggacgcccaggaactgtatgag

SEQ ID NO: 304421 - DNA, 25 bp, Mus musculus
gcaggacgcccaggtctttcaacac

SEQ ID NO: 304422 - DNA, 25 bp, Mus musculus
gcaggacggagcatggttggagcct

SEQ ID NO: 304423 - DNA, 25 bp, Mus musculus
gcaggacgtggtgacagagttagtc

SEQ ID NO: 304424 - DNA, 25 bp, Mus musculus
gcaggactacatgctcacagttacg

SEQ ID NO: 304425 - DNA, 25 bp, Mus musculus
gcaggactccagagatcccgatgtg

SEQ ID NO: 304426 - DNA, 25 bp, Mus musculus
gcaggactcggatgaggccatcctc

SEQ ID NO: 304427 - DNA, 25 bp, Mus musculus
gcaggactgaggaagccagctttgt

SEQ ID NO: 304428 - DNA, 25 bp, Mus musculus
gcaggactgaggtcctctttcagct

SEQ ID NO: 304429 - DNA, 25 bp, Mus musculus
gcaggagaaaagaataaatgaagaa

SEQ ID NO: 304430 - DNA, 25 bp, Mus musculus
gcaggagaagaaccaccaccaacca

SEQ ID NO: 304431 - DNA, 25 bp, Mus musculus
gcaggagaagagtatcgatgatgat

SEQ ID NO: 304432 - DNA, 25 bp, Mus musculus
gcaggagaagatcacaagagggaag

SEQ ID NO: 304433 - DNA, 25 bp, Mus musculus
gcaggagaagatggtggatcgcact

SEQ ID NO: 304434 - DNA, 25 bp, Mus musculus
gcaggagaagcacatcatgcaacga

SEQ ID NO: 304435 - DNA, 25 bp, Mus musculus
gcaggagaaggaagaacaaaaaacc

SEQ ID NO: 304436 - DNA, 25 bp, Mus musculus
gcaggagaaggaggtggtggagaag

SEQ ID NO: 304437 - DNA, 25 bp, Mus musculus
gcaggagaatactataaggcaagaa

SEQ ID NO: 304438 - DNA, 25 bp, Mus musculus
gcaggagaatactatatgtggagac

SEQ ID NO: 304439 - DNA, 25 bp, Mus musculus
gcaggagaatactattgagtcagac

SEQ ID NO: 304440 - DNA, 25 bp, Mus musculus
gcaggagaatgactggtgggtgtgc

SEQ ID NO: 304441 - DNA, 25 bp, Mus musculus
gcaggagacaagaacttcatcactg

SEQ ID NO: 304442 - DNA, 25 bp, Mus musculus
gcaggagacccacagtatcagaaat

SEQ ID NO: 304443 - DNA, 25 bp, Mus musculus
gcaggagagattgttgacgctgctg

SEQ ID NO: 304444 - DNA, 25 bp, Mus musculus
gcaggagagcgagatttcaacaaga

SEQ ID NO: 304445 - DNA, 25 bp, Mus musculus
gcaggagagcgagtctgcggtgtgg

SEQ ID NO: 304446 - DNA, 25 bp, Mus musculus
gcaggagagcgtgaaagagttccta

SEQ ID NO: 304447 - DNA, 25 bp, Mus musculus
gcaggagagctgggtcgcccaatga

SEQ ID NO: 304448 - DNA, 25 bp, Mus musculus
gcaggagaggtttggagaagcctga

SEQ ID NO: 304449 - DNA, 25 bp, Mus musculus
gcaggagaggtttgggaaaagcttg

SEQ ID NO: 304450 - DNA, 25 bp, Mus musculus
gcaggagatcagggtctgatgtttg

SEQ ID NO: 304451 - DNA, 25 bp, Mus musculus
gcaggagatcctcctagcccacaga

SEQ ID NO: 304452 - DNA, 25 bp, Mus musculus
gcaggagatcgcaggggtgccttct

SEQ ID NO: 304453 - DNA, 25 bp, Mus musculus
gcaggagatgcctgatcaacatgac

SEQ ID NO: 304454 - DNA, 25 bp, Mus musculus
gcaggagatgcttggtactacatga

SEQ ID NO: 304455 - DNA, 25 bp, Mus musculus
gcaggagatggacttccagctgccc

SEQ ID NO: 304456 - DNA, 25 bp, Mus musculus
gcaggagcagcctgagagggacttc

SEQ ID NO: 304457 - DNA, 25 bp, Mus musculus
gcaggagcagctgacaggtctgatc

SEQ ID NO: 304458 - DNA, 25 bp, Mus musculus
gcaggagcaggccaacgagggcatc

SEQ ID NO: 304459 - DNA, 25 bp, Mus musculus
gcaggagccaaggagatcgttgtcc

SEQ ID NO: 304460 - DNA, 25 bp, Mus musculus
gcaggagccagggatgccctgctgg

SEQ ID NO: 304461 - DNA, 25 bp, Mus musculus
gcaggagcccaacttgcaggtggac

SEQ ID NO: 304462 - DNA, 25 bp, Mus musculus
gcaggagccgaaatgtctcaggctg

SEQ ID NO: 304463 - DNA, 25 bp, Mus musculus
gcaggagccgagtctccttatatat

SEQ ID NO: 304464 - DNA, 25 bp, Mus musculus
gcaggagccgatcccttttcaaagc

SEQ ID NO: 304465 - DNA, 25 bp, Mus musculus
gcaggagcgcaggttcctcatgagg

SEQ ID NO: 304466 - DNA, 25 bp, Mus musculus
gcaggagcgcatgaggagccgagag

SEQ ID NO: 304467 - DNA, 25 bp, Mus musculus
gcaggagcgtggattggtgaccagg

SEQ ID NO: 304468 - DNA, 25 bp, Mus musculus
gcaggagctacggaggaggcaaaaa

SEQ ID NO: 304469 - DNA, 25 bp, Mus musculus
gcaggagctacggatagcgaggttg

SEQ ID NO: 304470 - DNA, 25 bp, Mus musculus
gcaggagctgacattcacactcttc

SEQ ID NO: 304471 - DNA, 25 bp, Mus musculus
gcaggagctgagctgtagccctcat

SEQ ID NO: 304472 - DNA, 25 bp, Mus musculus
gcaggagctgctttttaaattggcc

SEQ ID NO: 304473 - DNA, 25 bp, Mus musculus
gcaggagctgtctgaggaggacaaa

SEQ ID NO: 304474 - DNA, 25 bp, Mus musculus
gcaggaggaaaggacccaggagagc

SEQ ID NO: 304475 - DNA, 25 bp, Mus musculus
gcaggaggaagcaactgatggtgtc

SEQ ID NO: 304476 - DNA, 25 bp, Mus musculus
gcaggaggacgaggtgctgctggtg

SEQ ID NO: 304477 - DNA, 25 bp, Mus musculus
gcaggaggagcagacgggcagcggg

SEQ ID NO: 304478 - DNA, 25 bp, Mus musculus
gcaggaggagcaggatatcctcact

SEQ ID NO: 304479 - DNA, 25 bp, Mus musculus
gcaggaggaggagcatatgctggta

SEQ ID NO: 304480 - DNA, 25 bp, Mus musculus
gcaggaggattactgtccagtttga

SEQ ID NO: 304481 - DNA, 25 bp, Mus musculus
gcaggaggcagaaaggatgagcgca

SEQ ID NO: 304482 - DNA, 25 bp, Mus musculus
gcaggaggcaggtcattcattcaac

SEQ ID NO: 304483 - DNA, 25 bp, Mus musculus
gcaggaggccacaagatatcagtat

SEQ ID NO: 304484 - DNA, 25 bp, Mus musculus
gcaggaggccacaagcctacttgga

SEQ ID NO: 304485 - DNA, 25 bp, Mus musculus
gcaggaggccatggttaaaccatat

SEQ ID NO: 304486 - DNA, 25 bp, Mus musculus
gcaggaggcccaagcctttccacgt

SEQ ID NO: 304487 - DNA, 25 bp, Mus musculus
gcaggaggcccaatgattagcattt

SEQ ID NO: 304488 - DNA, 25 bp, Mus musculus
gcaggaggcgcgaggggacaaaggc

SEQ ID NO: 304489 - DNA, 25 bp, Mus musculus
gcaggaggctcaggattcagactcg

SEQ ID NO: 304490 - DNA, 25 bp, Mus musculus
gcaggaggctggagagtccttagcc

SEQ ID NO: 304491 - DNA, 25 bp, Mus musculus
gcaggagggacagcgtccgatgcaa

SEQ ID NO: 304492 - DNA, 25 bp, Mus musculus
gcaggagggacccaggcattttccc

SEQ ID NO: 304493 - DNA, 25 bp, Mus musculus
gcaggagggtatgagcgaagagaaa

SEQ ID NO: 304494 - DNA, 25 bp, Mus musculus
gcaggagtacaagagccagatgaag

SEQ ID NO: 304495 - DNA, 25 bp, Mus musculus
gcaggagtacaaggccaagctacaa

SEQ ID NO: 304496 - DNA, 25 bp, Mus musculus
gcaggagtcccagatccagtatgta

SEQ ID NO: 304497 - DNA, 25 bp, Mus musculus
gcaggagtcccagttcttgcttcag

SEQ ID NO: 304498 - DNA, 25 bp, Mus musculus
gcaggagtgaacagtccctggatga

SEQ ID NO: 304499 - DNA, 25 bp, Mus musculus
gcaggagtgtgaggcatgggtgtca

SEQ ID NO: 304500 - DNA, 25 bp, Mus musculus
gcaggagttgaggacctgtttactg

SEQ ID NO: 304501 - DNA, 25 bp, Mus musculus
gcaggatactatgtatataacaggc

SEQ ID NO: 304502 - DNA, 25 bp, Mus musculus
gcaggatagtgacagtgacgatggg

SEQ ID NO: 304503 - DNA, 25 bp, Mus musculus
gcaggatataaagaaaccagaccgt

SEQ ID NO: 304504 - DNA, 25 bp, Mus musculus
gcaggatataaagaccgtgatgact

SEQ ID NO: 304505 - DNA, 25 bp, Mus musculus
gcaggatcacgctcctcctaggtgc

SEQ ID NO: 304506 - DNA, 25 bp, Mus musculus
gcaggatcacggcaaaatgaaggat

SEQ ID NO: 304507 - DNA, 25 bp, Mus musculus
gcaggatcagatgcgatacaaccag

SEQ ID NO: 304508 - DNA, 25 bp, Mus musculus
gcaggatcaggagctggtggggagt

SEQ ID NO: 304509 - DNA, 25 bp, Mus musculus
gcaggatcctccgagagttctgtcc

SEQ ID NO: 304510 - DNA, 25 bp, Mus musculus
gcaggatcgcatgggctaccagctg

SEQ ID NO: 304511 - DNA, 25 bp, Mus musculus
gcaggatcttaaagagcaaatccca

SEQ ID NO: 304512 - DNA, 25 bp, Mus musculus
gcaggatgagagcagacactgcagc

SEQ ID NO: 304513 - DNA, 25 bp, Mus musculus
gcaggatgaggaggaagatgaggtg

SEQ ID NO: 304514 - DNA, 25 bp, Mus musculus
gcaggatgagtgggatgcagtcatg

SEQ ID NO: 304515 - DNA, 25 bp, Mus musculus
gcaggatgagtggggttggccgaat

SEQ ID NO: 304516 - DNA, 25 bp, Mus musculus
gcaggatgatgtctggcaggactga

SEQ ID NO: 304517 - DNA, 25 bp, Mus musculus
gcaggatgattgaggatgcaattcg

SEQ ID NO: 304518 - DNA, 25 bp, Mus musculus
gcaggatgcagagggacgccctgac

SEQ ID NO: 304519 - DNA, 25 bp, Mus musculus
gcaggatgcagaggttcgccatcga

SEQ ID NO: 304520 - DNA, 25 bp, Mus musculus
gcaggatgcaggagttcctcaggtc

SEQ ID NO: 304521 - DNA, 25 bp, Mus musculus
gcaggatgcaggctggggctgtctc

SEQ ID NO: 304522 - DNA, 25 bp, Mus musculus
gcaggatgcaggtcaactgaagctg

SEQ ID NO: 304523 - DNA, 25 bp, Mus musculus
gcaggatgcgaagaaagccttcaat

SEQ ID NO: 304524 - DNA, 25 bp, Mus musculus
gcaggatgcttaggacctgatattt

SEQ ID NO: 304525 - DNA, 25 bp, Mus musculus
gcaggatggaagagaagctgaagaa

SEQ ID NO: 304526 - DNA, 25 bp, Mus musculus
gcaggatggccagacgggcagcggg

SEQ ID NO: 304527 - DNA, 25 bp, Mus musculus
gcaggatggccagctaccatatttg

SEQ ID NO: 304528 - DNA, 25 bp, Mus musculus
gcaggatggccaggatatcctcact

SEQ ID NO: 304529 - DNA, 25 bp, Mus musculus
gcaggatggccagtttgtcccttta

SEQ ID NO: 304530 - DNA, 25 bp, Mus musculus
gcaggatggtctccgacatcaacaa

SEQ ID NO: 304531 - DNA, 25 bp, Mus musculus
gcaggatgtgccagaacaagctgtt

SEQ ID NO: 304532 - DNA, 25 bp, Mus musculus
gcaggattacaggactggatcctgt

SEQ ID NO: 304533 - DNA, 25 bp, Mus musculus
gcaggattacaggcgaccccctcgg

SEQ ID NO: 304534 - DNA, 25 bp, Mus musculus
gcaggattcaccatgactctgctgc

SEQ ID NO: 304535 - DNA, 25 bp, Mus musculus
gcaggattcacgttggtgaccagat

SEQ ID NO: 304536 - DNA, 25 bp, Mus musculus
gcaggattgcattaggaaagaatgt

SEQ ID NO: 304537 - DNA, 25 bp, Mus musculus
gcaggattgggaagaaaaagaagag

SEQ ID NO: 304538 - DNA, 25 bp, Mus musculus
gcaggattgggaagggctcctgtgc

SEQ ID NO: 304539 - DNA, 25 bp, Mus musculus
gcaggattgtagcctctatcacacg

SEQ ID NO: 304540 - DNA, 25 bp, Mus musculus
gcaggatttcatgtttgagatcagt

SEQ ID NO: 304541 - DNA, 25 bp, Mus musculus
gcaggcaaaactgagtgaccttcag

SEQ ID NO: 304542 - DNA, 25 bp, Mus musculus
gcaggcaaaggtgtgccccagctcc

SEQ ID NO: 304543 - DNA, 25 bp, Mus musculus
gcaggcaaaggttcagaacttagaa

SEQ ID NO: 304544 - DNA, 25 bp, Mus musculus
gcaggcaacagatcagcacggcccc

SEQ ID NO: 304545 - DNA, 25 bp, Mus musculus
gcaggcacaagcctccattgagggc

SEQ ID NO: 304546 - DNA, 25 bp, Mus musculus
gcaggcacacgcaggtgcctcctcc

SEQ ID NO: 304547 - DNA, 25 bp, Mus musculus
gcaggcaccatgggaccctctagag

SEQ ID NO: 304548 - DNA, 25 bp, Mus musculus
gcaggcaccatggggtgcagggaag

SEQ ID NO: 304549 - DNA, 25 bp, Mus musculus
gcaggcaccgaggtggtttgtgcac

SEQ ID NO: 304550 - DNA, 25 bp, Mus musculus
gcaggcacgcagggcagaagtcgtg

SEQ ID NO: 304551 - DNA, 25 bp, Mus musculus
gcaggcactgcacgagtctgagatt

SEQ ID NO: 304552 - DNA, 25 bp, Mus musculus
gcaggcactggtgtaatggataggt

SEQ ID NO: 304553 - DNA, 25 bp, Mus musculus
gcaggcagagacgatagattgctaa

SEQ ID NO: 304554 - DNA, 25 bp, Mus musculus
gcaggcagaggcagatatcaagaaa

SEQ ID NO: 304555 - DNA, 25 bp, Mus musculus
gcaggcagcaaaaggtctccataga

SEQ ID NO: 304556 - DNA, 25 bp, Mus musculus
gcaggcagccagcccagtgggcagc

SEQ ID NO: 304557 - DNA, 25 bp, Mus musculus
gcaggcaggagctgctttttaaatt

SEQ ID NO: 304558 - DNA, 25 bp, Mus musculus
gcaggcaggaggtggtggagttgtt

SEQ ID NO: 304559 - DNA, 25 bp, Mus musculus
gcaggcaggggggacctgaaccacg

SEQ ID NO: 304560 - DNA, 25 bp, Mus musculus
gcaggcagtcagagaatttaagaag

SEQ ID NO: 304561 - DNA, 25 bp, Mus musculus
gcaggcagtcagagatttgattgag

SEQ ID NO: 304562 - DNA, 25 bp, Mus musculus
gcaggcagtctctgggttcagacaa

SEQ ID NO: 304563 - DNA, 25 bp, Mus musculus
gcaggcatacaggcaaagcgagtgg

SEQ ID NO: 304564 - DNA, 25 bp, Mus musculus
gcaggcatacaggcctagctctgct

SEQ ID NO: 304565 - DNA, 25 bp, Mus musculus
gcaggcatatgcttccttggggact

SEQ ID NO: 304566 - DNA, 25 bp, Mus musculus
gcaggcatatgcttcggagactcgg

SEQ ID NO: 304567 - DNA, 25 bp, Mus musculus
gcaggcatattttggaaaccagtaa

SEQ ID NO: 304568 - DNA, 25 bp, Mus musculus
gcaggcatattttggttcttcatgc

SEQ ID NO: 304569 - DNA, 25 bp, Mus musculus
gcaggcatccaagcatttgtggtcc

SEQ ID NO: 304570 - DNA, 25 bp, Mus musculus
gcaggcatccagggccttttgctcg

SEQ ID NO: 304571 - DNA, 25 bp, Mus musculus
gcaggcatccgggtgatcatggtga

SEQ ID NO: 304572 - DNA, 25 bp, Mus musculus
gcaggcatgacaggagctggagaag

SEQ ID NO: 304573 - DNA, 25 bp, Mus musculus
gcaggcatgaggtgttctggctgat

SEQ ID NO: 304574 - DNA, 25 bp, Mus musculus
gcaggcatgggtaggatttgcggga

SEQ ID NO: 304575 - DNA, 25 bp, Mus musculus
gcaggcatggtttggatttgcggga

SEQ ID NO: 304576 - DNA, 25 bp, Mus musculus
gcaggcattgacccttcttggagct

SEQ ID NO: 304577 - DNA, 25 bp, Mus musculus
gcaggcattgaccgctcatcctaaa

SEQ ID NO: 304578 - DNA, 25 bp, Mus musculus
gcaggccaagcaggcttgtgatgcc

SEQ ID NO: 304579 - DNA, 25 bp, Mus musculus
gcaggccaaggccaaggctgccggt

SEQ ID NO: 304580 - DNA, 25 bp, Mus musculus
gcaggccaagttggtggaaggccgg

SEQ ID NO: 304581 - DNA, 25 bp, Mus musculus
gcaggccacaggcaatgtgagcatc

SEQ ID NO: 304582 - DNA, 25 bp, Mus musculus
gcaggccatcctgggttgctcttct

SEQ ID NO: 304583 - DNA, 25 bp, Mus musculus
gcaggcccaagcctccattgagggt

SEQ ID NO: 304584 - DNA, 25 bp, Mus musculus
gcaggcccaaggtctccatggtggg

SEQ ID NO: 304585 - DNA, 25 bp, Mus musculus
gcaggcccccacagccgtgtttgac

SEQ ID NO: 304586 - DNA, 25 bp, Mus musculus
gcaggcccccacagtttgtatctac

SEQ ID NO: 304587 - DNA, 25 bp, Mus musculus
gcaggccctactgggggtgaacctg

SEQ ID NO: 304588 - DNA, 25 bp, Mus musculus
gcaggccgagatcaagatgctgtca

SEQ ID NO: 304589 - DNA, 25 bp, Mus musculus
gcaggccgagcaggtccttgaagta

SEQ ID NO: 304590 - DNA, 25 bp, Mus musculus
gcaggccgcattaggaggaagagac

SEQ ID NO: 304591 - DNA, 25 bp, Mus musculus
gcaggccgcattgctgctcagagga

SEQ ID NO: 304592 - DNA, 25 bp, Mus musculus
gcaggccgcgctagaaaatgctact

SEQ ID NO: 304593 - DNA, 25 bp, Mus musculus
gcaggccgcggagcaaccgaagaac

SEQ ID NO: 304594 - DNA, 25 bp, Mus musculus
gcaggccgctgtctgagcgcaggct

SEQ ID NO: 304595 - DNA, 25 bp, Mus musculus
gcaggccgggcccgaaccctcttgg

SEQ ID NO: 304596 - DNA, 25 bp, Mus musculus
gcaggccgggcccgggccaccaagc

SEQ ID NO: 304597 - DNA, 25 bp, Mus musculus
gcaggcctaggagatgcaagttgtt

SEQ ID NO: 304598 - DNA, 25 bp, Mus musculus
gcaggcctaggaggggcgtccaaag

SEQ ID NO: 304599 - DNA, 25 bp, Mus musculus
gcaggcctctgaggccttcttgcta

SEQ ID NO: 304600 - DNA, 25 bp, Mus musculus
gcaggcctgtgataagacgctgtcc

SEQ ID NO: 304601 - DNA, 25 bp, Mus musculus
gcaggcctgtgctcatatgaaatcc

SEQ ID NO: 304602 - DNA, 25 bp, Mus musculus
gcaggcctttgagttgtccagggaa

SEQ ID NO: 304603 - DNA, 25 bp, Mus musculus
gcaggcctttgctggagcatgttcg

SEQ ID NO: 304604 - DNA, 25 bp, Mus musculus
gcaggcctttgggaaggaatgttcc

SEQ ID NO: 304605 - DNA, 25 bp, Mus musculus
gcaggcgcgaggttctgcagacccc

SEQ ID NO: 304606 - DNA, 25 bp, Mus musculus
gcaggcgcgcagtgaaagccggcgg

SEQ ID NO: 304607 - DNA, 25 bp, Mus musculus
gcaggcgcgcgagaagctcgcgctg

SEQ ID NO: 304608 - DNA, 25 bp, Mus musculus
gcaggcgcttgcagaaggggcgcct

SEQ ID NO: 304609 - DNA, 25 bp, Mus musculus
gcaggcgcttgcaggcatgacgagt

SEQ ID NO: 304610 - DNA, 25 bp, Mus musculus
gcaggcggaaagtatccattatgat

SEQ ID NO: 304611 - DNA, 25 bp, Mus musculus
gcaggcggaggtgcgtggtccaacg

SEQ ID NO: 304612 - DNA, 25 bp, Mus musculus
gcaggcggattcgggttcgggagca

SEQ ID NO: 304613 - DNA, 25 bp, Mus musculus
gcaggcgtgaggaaactgctgtcat

SEQ ID NO: 304614 - DNA, 25 bp, Mus musculus
gcaggctacagtcagttctacagca

SEQ ID NO: 304615 - DNA, 25 bp, Mus musculus
gcaggctacagtgactttttcacag

SEQ ID NO: 304616 - DNA, 25 bp, Mus musculus
gcaggctacatggggttgacctgta

SEQ ID NO: 304617 - DNA, 25 bp, Mus musculus
gcaggctacgaatttaaagaggacg

SEQ ID NO: 304618 - DNA, 25 bp, Mus musculus
gcaggctaggtatctccggtttagg

SEQ ID NO: 304619 - DNA, 25 bp, Mus musculus
gcaggctatggagagagtatgctgg

SEQ ID NO: 304620 - DNA, 25 bp, Mus musculus
gcaggctcaagaaatagccagacaa

SEQ ID NO: 304621 - DNA, 25 bp, Mus musculus
gcaggctcacgctctcaccactgag

SEQ ID NO: 304622 - DNA, 25 bp, Mus musculus
gcaggctcagagatgggcccagtgc

SEQ ID NO: 304623 - DNA, 25 bp, Mus musculus
gcaggctcagcaaatgacaagattg

SEQ ID NO: 304624 - DNA, 25 bp, Mus musculus
gcaggctcagctgcaggctgtgaca

SEQ ID NO: 304625 - DNA, 25 bp, Mus musculus
gcaggctcaggactggaggaccgac

SEQ ID NO: 304626 - DNA, 25 bp, Mus musculus
gcaggctcaggccaccccacatcat

SEQ ID NO: 304627 - DNA, 25 bp, Mus musculus
gcaggctcaggctaccgagtctatt

SEQ ID NO: 304628 - DNA, 25 bp, Mus musculus
gcaggctccacggcaatagacccag

SEQ ID NO: 304629 - DNA, 25 bp, Mus musculus
gcaggctccagaatggagctgcgac

SEQ ID NO: 304630 - DNA, 25 bp, Mus musculus
gcaggctccaggtacacctggtgag

SEQ ID NO: 304631 - DNA, 25 bp, Mus musculus
gcaggctcgagcagagtccgtctcc

SEQ ID NO: 304632 - DNA, 25 bp, Mus musculus
gcaggctcgggaaaagttagcttta

SEQ ID NO: 304633 - DNA, 25 bp, Mus musculus
gcaggctctgtcccaggtaaatcac

SEQ ID NO: 304634 - DNA, 25 bp, Mus musculus
gcaggctgacattgattctgggctg

SEQ ID NO: 304635 - DNA, 25 bp, Mus musculus
gcaggctgcagctgcccaggccaag

SEQ ID NO: 304636 - DNA, 25 bp, Mus musculus
gcaggctgcaggagctcttagggaa

SEQ ID NO: 304637 - DNA, 25 bp, Mus musculus
gcaggctgcaggtaactagttctcc

SEQ ID NO: 304638 - DNA, 25 bp, Mus musculus
gcaggctgtatgggtctgacagaag

SEQ ID NO: 304639 - DNA, 25 bp, Mus musculus
gcaggctgtcaaaggggagaagctg

SEQ ID NO: 304640 - DNA, 25 bp, Mus musculus
gcaggctgtcagatttatgcaggac

SEQ ID NO: 304641 - DNA, 25 bp, Mus musculus
gcaggctgtcagctcgttcgtgtct

SEQ ID NO: 304642 - DNA, 25 bp, Mus musculus
gcaggctgttcagagtcatgcagtt

SEQ ID NO: 304643 - DNA, 25 bp, Mus musculus
gcaggcttatgctttgatccagtgt

SEQ ID NO: 304644 - DNA, 25 bp, Mus musculus
gcaggcttcaagcaagtaaaggccg

SEQ ID NO: 304645 - DNA, 25 bp, Mus musculus
gcaggcttcctggtagtcccatatt

SEQ ID NO: 304646 - DNA, 25 bp, Mus musculus
gcaggcttttgagagctgtctctct

SEQ ID NO: 304647 - DNA, 25 bp, Mus musculus
gcagggaaaccataacgtcaaactc

SEQ ID NO: 304648 - DNA, 25 bp, Mus musculus
gcagggaaatggaaacacttgcaga

SEQ ID NO: 304649 - DNA, 25 bp, Mus musculus
gcagggaaatggaaagtccctgaca

SEQ ID NO: 304650 - DNA, 25 bp, Mus musculus
gcagggaacgccaattctaacggca

SEQ ID NO: 304651 - DNA, 25 bp, Mus musculus
gcagggaacgcctcgggggtgtctg

SEQ ID NO: 304652 - DNA, 25 bp, Mus musculus
gcagggaagcctggacccccaggtc

SEQ ID NO: 304653 - DNA, 25 bp, Mus musculus
gcagggaaggcttgccactttccta

SEQ ID NO: 304654 - DNA, 25 bp, Mus musculus
gcagggaataagcagcctcaaaatg

SEQ ID NO: 304655 - DNA, 25 bp, Mus musculus
gcagggacactttacagggagactc

SEQ ID NO: 304656 - DNA, 25 bp, Mus musculus
gcagggaccaggccctctgccaacc

SEQ ID NO: 304657 - DNA, 25 bp, Mus musculus
gcagggaccatggttggggtgcttc

SEQ ID NO: 304658 - DNA, 25 bp, Mus musculus
gcagggactgggctgcaggtcctgg

SEQ ID NO: 304659 - DNA, 25 bp, Mus musculus
gcagggactggtccagcacctgcta

SEQ ID NO: 304660 - DNA, 25 bp, Mus musculus
gcagggacttacaaagagctttctg

SEQ ID NO: 304661 - DNA, 25 bp, Mus musculus
gcagggagatcggctttgaattcat

SEQ ID NO: 304662 - DNA, 25 bp, Mus musculus
gcagggagcacagaacctttgacat

SEQ ID NO: 304663 - DNA, 25 bp, Mus musculus
gcagggagcacagctcatcctgtgc

SEQ ID NO: 304664 - DNA, 25 bp, Mus musculus
gcagggagcaggatatggttactgg

SEQ ID NO: 304665 - DNA, 25 bp, Mus musculus
gcagggagccgcagggtagaggcag

SEQ ID NO: 304666 - DNA, 25 bp, Mus musculus
gcagggagcgagagtgtgaacatgg

SEQ ID NO: 304667 - DNA, 25 bp, Mus musculus
gcagggaggcaatggcagctacaat

SEQ ID NO: 304668 - DNA, 25 bp, Mus musculus
gcagggatgaaggacacagggactg

SEQ ID NO: 304669 - DNA, 25 bp, Mus musculus
gcagggatgaaggtctgtcagtttg

SEQ ID NO: 304670 - DNA, 25 bp, Mus musculus
gcagggattcttcaggaacaagatc

SEQ ID NO: 304671 - DNA, 25 bp, Mus musculus
gcagggatttgcttcaacctggctc

SEQ ID NO: 304672 - DNA, 25 bp, Mus musculus
gcagggatttgtttcgcctgcagct

SEQ ID NO: 304673 - DNA, 25 bp, Mus musculus
gcagggcaagatccggactcttcag

SEQ ID NO: 304674 - DNA, 25 bp, Mus musculus
gcagggcaatgttctgtcttcccca

SEQ ID NO: 304675 - DNA, 25 bp, Mus musculus
gcagggcacccgccaacatgagtct

SEQ ID NO: 304676 - DNA, 25 bp, Mus musculus
gcagggcagcgaggttgtaagtgtc

SEQ ID NO: 304677 - DNA, 25 bp, Mus musculus
gcagggcagcgattgtaagtgtctt

SEQ ID NO: 304678 - DNA, 25 bp, Mus musculus
gcagggcagggaagaagtacgagaa

SEQ ID NO: 304679 - DNA, 25 bp, Mus musculus
gcagggcatcaagaagtcaacaaaa

SEQ ID NO: 304680 - DNA, 25 bp, Mus musculus
gcagggcatcaagtattggctggat

SEQ ID NO: 304681 - DNA, 25 bp, Mus musculus
gcagggcatcagtgatatgtcaaga

SEQ ID NO: 304682 - DNA, 25 bp, Mus musculus
gcagggcatcagtgctaatggaggt

SEQ ID NO: 304683 - DNA, 25 bp, Mus musculus
gcagggcatggcagagcaccttaag

SEQ ID NO: 304684 - DNA, 25 bp, Mus musculus
gcagggcatggcagagctccaggcc

SEQ ID NO: 304685 - DNA, 25 bp, Mus musculus
gcagggccagaaggagctcccagcg

SEQ ID NO: 304686 - DNA, 25 bp, Mus musculus
gcagggccagaaggtgatggtgcag

SEQ ID NO: 304687 - DNA, 25 bp, Mus musculus
gcagggccagatgtagtgctgagca

SEQ ID NO: 304688 - DNA, 25 bp, Mus musculus
gcagggccagcattgagattgacca

SEQ ID NO: 304689 - DNA, 25 bp, Mus musculus
gcagggccagtgctgagcagcggct

SEQ ID NO: 304690 - DNA, 25 bp, Mus musculus
gcagggcccaggaattgcattgggc

SEQ ID NO: 304691 - DNA, 25 bp, Mus musculus
gcagggccctcaggaacaatggccc

SEQ ID NO: 304692 - DNA, 25 bp, Mus musculus
gcagggccctcaggccagggggaag

SEQ ID NO: 304693 - DNA, 25 bp, Mus musculus
gcagggccgaggcccgatttcccgc

SEQ ID NO: 304694 - DNA, 25 bp, Mus musculus
gcagggccggctgcacaatctgcct

SEQ ID NO: 304695 - DNA, 25 bp, Mus musculus
gcagggccggctgtgtggcctcttc

SEQ ID NO: 304696 - DNA, 25 bp, Mus musculus
gcagggcctgctcaggctgtggctt

SEQ ID NO: 304697 - DNA, 25 bp, Mus musculus
gcagggcgccgggcttcttcacaaa

SEQ ID NO: 304698 - DNA, 25 bp, Mus musculus
gcagggcgcctagcgctttgagctt

SEQ ID NO: 304699 - DNA, 25 bp, Mus musculus
gcagggctaacttcccgctcggccc

SEQ ID NO: 304700 - DNA, 25 bp, Mus musculus
gcagggctgagagatgggaaagagg

SEQ ID NO: 304701 - DNA, 25 bp, Mus musculus
gcagggctgctaaccccgagatgcc

SEQ ID NO: 304702 - DNA, 25 bp, Mus musculus
gcagggctgctctagaagtcaagag

SEQ ID NO: 304703 - DNA, 25 bp, Mus musculus
gcagggctgtggcctggagatgccc

SEQ ID NO: 304704 - DNA, 25 bp, Mus musculus
gcagggcttaccaggtgtccctgga

SEQ ID NO: 304705 - DNA, 25 bp, Mus musculus
gcagggcttgctgttctcctcttgc

SEQ ID NO: 304706 - DNA, 25 bp, Mus musculus
gcaggggaatatggctctggcccac

SEQ ID NO: 304707 - DNA, 25 bp, Mus musculus
gcaggggacaagatcacctttgtgg

SEQ ID NO: 304708 - DNA, 25 bp, Mus musculus
gcaggggacgatgaggacctcgacc

SEQ ID NO: 304709 - DNA, 25 bp, Mus musculus
gcaggggaggcaggtatggatgtat

SEQ ID NO: 304710 - DNA, 25 bp, Mus musculus
gcaggggattgattatgagaagatc

SEQ ID NO: 304711 - DNA, 25 bp, Mus musculus
gcaggggcaagctggacccccaaac

SEQ ID NO: 304712 - DNA, 25 bp, Mus musculus
gcaggggccctaaataaaagcctga

SEQ ID NO: 304713 - DNA, 25 bp, Mus musculus
gcaggggcctcaggtggatgaaact

SEQ ID NO: 304714 - DNA, 25 bp, Mus musculus
gcaggggcggaggatcaacgaggat

SEQ ID NO: 304715 - DNA, 25 bp, Mus musculus
gcaggggctgcaggggacacccgtc

SEQ ID NO: 304716 - DNA, 25 bp, Mus musculus
gcaggggctgccggggtagctcgcg

SEQ ID NO: 304717 - DNA, 25 bp, Mus musculus
gcaggggctggctgaatcatgatga

SEQ ID NO: 304718 - DNA, 25 bp, Mus musculus
gcagggggacaaggttggggaggcg

SEQ ID NO: 304719 - DNA, 25 bp, Mus musculus
gcaggggtgccctgtggtaagcgag

SEQ ID NO: 304720 - DNA, 25 bp, Mus musculus
gcaggggtttcaggcagaaaatgta

SEQ ID NO: 304721 - DNA, 25 bp, Mus musculus
gcaggggtttcaggtctgcattaca

SEQ ID NO: 304722 - DNA, 25 bp, Mus musculus
gcagggtaccgcgagatactactcg

SEQ ID NO: 304723 - DNA, 25 bp, Mus musculus
gcagggtatttgtaaagatgagccc

SEQ ID NO: 304724 - DNA, 25 bp, Mus musculus
gcagggtcacctctggaagcaaagc

SEQ ID NO: 304725 - DNA, 25 bp, Mus musculus
gcagggtcacctctggggcccagga

SEQ ID NO: 304726 - DNA, 25 bp, Mus musculus
gcagggtcacctctgttggcgaatg

SEQ ID NO: 304727 - DNA, 25 bp, Mus musculus
gcagggtcactacagtgacagagat

SEQ ID NO: 304728 - DNA, 25 bp, Mus musculus
gcagggtcagaccacacccgtgacc

SEQ ID NO: 304729 - DNA, 25 bp, Mus musculus
gcagggtcagggactcatgcagtgg

SEQ ID NO: 304730 - DNA, 25 bp, Mus musculus
gcagggtccctttgcacttggaatc

SEQ ID NO: 304731 - DNA, 25 bp, Mus musculus
gcagggtctcaataggtcttgtgtg

SEQ ID NO: 304732 - DNA, 25 bp, Mus musculus
gcagggtgaaaggggaacatctcaa

SEQ ID NO: 304733 - DNA, 25 bp, Mus musculus
gcagggtgaaagggtgggatgctat

SEQ ID NO: 304734 - DNA, 25 bp, Mus musculus
gcagggtgtggtgtgtcctctggtc

SEQ ID NO: 304735 - DNA, 25 bp, Mus musculus
gcagggttccggaaggttccatgat

SEQ ID NO: 304736 - DNA, 25 bp, Mus musculus
gcaggtaaagtaccaaatatgcccc

SEQ ID NO: 304737 - DNA, 25 bp, Mus musculus
gcaggtaaggtaagatctcaagcat

SEQ ID NO: 304738 - DNA, 25 bp, Mus musculus
gcaggtaattaacgagatggtgcgg

SEQ ID NO: 304739 - DNA, 25 bp, Mus musculus
gcaggtaattagtgaaatggttaag

SEQ ID NO: 304740 - DNA, 25 bp, Mus musculus
gcaggtaattgcgctccagatgaaa

SEQ ID NO: 304741 - DNA, 25 bp, Mus musculus
gcaggtagccaagcttgaggcggcc

SEQ ID NO: 304742 - DNA, 25 bp, Mus musculus
gcaggtaggcctcgggacggcctca

SEQ ID NO: 304743 - DNA, 25 bp, Mus musculus
gcaggtatccatgcggctgtgtgga

SEQ ID NO: 304744 - DNA, 25 bp, Mus musculus
gcaggtatcgaggaattctatacct

SEQ ID NO: 304745 - DNA, 25 bp, Mus musculus
gcaggtcaaccagggaaaatgccaa

SEQ ID NO: 304746 - DNA, 25 bp, Mus musculus
gcaggtcaatagccttcctgggagc

SEQ ID NO: 304747 - DNA, 25 bp, Mus musculus
gcaggtcatcaccaccggcgcctgt

SEQ ID NO: 304748 - DNA, 25 bp, Mus musculus
gcaggtcattggcgacagggttccc

SEQ ID NO: 304749 - DNA, 25 bp, Mus musculus
gcaggtcattggggttccccagtgg

SEQ ID NO: 304750 - DNA, 25 bp, Mus musculus
gcaggtccaaggcttgagattttta

SEQ ID NO: 304751 - DNA, 25 bp, Mus musculus
gcaggtccagttggaaatgaaatgt

SEQ ID NO: 304752 - DNA, 25 bp, Mus musculus
gcaggtccattgggcatcatgaagc

SEQ ID NO: 304753 - DNA, 25 bp, Mus musculus
gcaggtcccaagggtgcccctggag

SEQ ID NO: 304754 - DNA, 25 bp, Mus musculus
gcaggtcccaggtatgaataccact

SEQ ID NO: 304755 - DNA, 25 bp, Mus musculus
gcaggtcccagttgtactgcagcca

SEQ ID NO: 304756 - DNA, 25 bp, Mus musculus
gcaggtccgcaaagagaaaagatga

SEQ ID NO: 304757 - DNA, 25 bp, Mus musculus
gcaggtccgcaaagctccttctggc

SEQ ID NO: 304758 - DNA, 25 bp, Mus musculus
gcaggtccgcaaagtggcatggatg

SEQ ID NO: 304759 - DNA, 25 bp, Mus musculus
gcaggtccttgaaatcaagatgctg

SEQ ID NO: 304760 - DNA, 25 bp, Mus musculus
gcaggtctcaaaagcgctcctggag

SEQ ID NO: 304761 - DNA, 25 bp, Mus musculus
gcaggtctctactgcctacaagaag

SEQ ID NO: 304762 - DNA, 25 bp, Mus musculus
gcaggtctctactgcctatgtgaaa

SEQ ID NO: 304763 - DNA, 25 bp, Mus musculus
gcaggtctctgaaggaacagtctga

SEQ ID NO: 304764 - DNA, 25 bp, Mus musculus
gcaggtctgatccaggggcaggtga

SEQ ID NO: 304765 - DNA, 25 bp, Mus musculus
gcaggtctgatccagtctgcctgga

SEQ ID NO: 304766 - DNA, 25 bp, Mus musculus
gcaggtctgttctgactgctgcagc

SEQ ID NO: 304767 - DNA, 25 bp, Mus musculus
gcaggtcttgccaaggtgattcctc

SEQ ID NO: 304768 - DNA, 25 bp, Mus musculus
gcaggtcttgtgagtaacatttcac

SEQ ID NO: 304769 - DNA, 25 bp, Mus musculus
gcaggtgaaaagaagaccttgtcct

SEQ ID NO: 304770 - DNA, 25 bp, Mus musculus
gcaggtgaagctcagaaacttgatt

SEQ ID NO: 304771 - DNA, 25 bp, Mus musculus
gcaggtgaaggacagcaaccatctg

SEQ ID NO: 304772 - DNA, 25 bp, Mus musculus
gcaggtgaaggcctatgagaagcag

SEQ ID NO: 304773 - DNA, 25 bp, Mus musculus
gcaggtgacagacacatctggtcac

SEQ ID NO: 304774 - DNA, 25 bp, Mus musculus
gcaggtgacaggttgctttgaagga

SEQ ID NO: 304775 - DNA, 25 bp, Mus musculus
gcaggtgacgctgggttgccccgga

SEQ ID NO: 304776 - DNA, 25 bp, Mus musculus
gcaggtgactccaggagcagttcct

SEQ ID NO: 304777 - DNA, 25 bp, Mus musculus
gcaggtgagaggccacgattgctgc

SEQ ID NO: 304778 - DNA, 25 bp, Mus musculus
gcaggtgagccaggcaccttttgtg

SEQ ID NO: 304779 - DNA, 25 bp, Mus musculus
gcaggtgagggggtcggggtttgcc

SEQ ID NO: 304780 - DNA, 25 bp, Mus musculus
gcaggtgagtggatgatcacttgat

SEQ ID NO: 304781 - DNA, 25 bp, Mus musculus
gcaggtgcaaagagctgaggacctg

SEQ ID NO: 304782 - DNA, 25 bp, Mus musculus
gcaggtgcgagaacgcaacctgaac

SEQ ID NO: 304783 - DNA, 25 bp, Mus musculus
gcaggtgctgcaggttcttctgaat

SEQ ID NO: 304784 - DNA, 25 bp, Mus musculus
gcaggtgctgcagtctcaggactca

SEQ ID NO: 304785 - DNA, 25 bp, Mus musculus
gcaggtgcttctggtaacccaggga

SEQ ID NO: 304786 - DNA, 25 bp, Mus musculus
gcaggtggagtgcaggccctgcagg

SEQ ID NO: 304787 - DNA, 25 bp, Mus musculus
gcaggtggatctgttacccacaggt

SEQ ID NO: 304788 - DNA, 25 bp, Mus musculus
gcaggtggatgatctggagggatcc

SEQ ID NO: 304789 - DNA, 25 bp, Mus musculus
gcaggtggatggagtgggtaacttc

SEQ ID NO: 304790 - DNA, 25 bp, Mus musculus
gcaggtggatggagttcgacagaac

SEQ ID NO: 304791 - DNA, 25 bp, Mus musculus
gcaggtggcaacgctgacagagcgg

SEQ ID NO: 304792 - DNA, 25 bp, Mus musculus
gcaggtggcagagaaggaagccaag

SEQ ID NO: 304793 - DNA, 25 bp, Mus musculus
gcaggtggcagttttaggttctgat

SEQ ID NO: 304794 - DNA, 25 bp, Mus musculus
gcaggtggctgaggtaccacgtaca

SEQ ID NO: 304795 - DNA, 25 bp, Mus musculus
gcaggtgggattggaattgtaccca

SEQ ID NO: 304796 - DNA, 25 bp, Mus musculus
gcaggtggtcaggacaggtacagca

SEQ ID NO: 304797 - DNA, 25 bp, Mus musculus
gcaggtggtcaggcctataccattc

SEQ ID NO: 304798 - DNA, 25 bp, Mus musculus
gcaggtggtcagttgaccaagctgc

SEQ ID NO: 304799 - DNA, 25 bp, Mus musculus
gcaggtggtgagcgccgagcagaag

SEQ ID NO: 304800 - DNA, 25 bp, Mus musculus
gcaggtgtactgtggttcactacaa

SEQ ID NO: 304801 - DNA, 25 bp, Mus musculus
gcaggtgtccctgccgtgtgtctgc

SEQ ID NO: 304802 - DNA, 25 bp, Mus musculus
gcaggtgtgtatgctaatgggaatg

SEQ ID NO: 304803 - DNA, 25 bp, Mus musculus
gcaggtgtttcacagggtcaggtac

SEQ ID NO: 304804 - DNA, 25 bp, Mus musculus
gcaggttccagacaatcctcctgat

SEQ ID NO: 304805 - DNA, 25 bp, Mus musculus
gcaggttccagctctcccaggaaac

SEQ ID NO: 304806 - DNA, 25 bp, Mus musculus
gcaggttcctgcctaccactgttcc

SEQ ID NO: 304807 - DNA, 25 bp, Mus musculus
gcaggttcctgcctgtgacatggac

SEQ ID NO: 304808 - DNA, 25 bp, Mus musculus
gcaggttcctgtgtggtggggacca

SEQ ID NO: 304809 - DNA, 25 bp, Mus musculus
gcaggtttagaagacagcgtggaag

SEQ ID NO: 304810 - DNA, 25 bp, Mus musculus
gcaggtttgagatgttctcaaacag

SEQ ID NO: 304811 - DNA, 25 bp, Mus musculus
gcagtaaagattgctgctagagcat

SEQ ID NO: 304812 - DNA, 25 bp, Mus musculus
gcagtaaagcttgtgaaggcgctgg

SEQ ID NO: 304813 - DNA, 25 bp, Mus musculus
gcagtaacaacggcctcagcatcct

SEQ ID NO: 304814 - DNA, 25 bp, Mus musculus
gcagtaactggcaagaagacagcaa

SEQ ID NO: 304815 - DNA, 25 bp, Mus musculus
gcagtaagaaggaattagaaagtaa

SEQ ID NO: 304816 - DNA, 25 bp, Mus musculus
gcagtaagaaggaggataaaattca

SEQ ID NO: 304817 - DNA, 25 bp, Mus musculus
gcagtaagcagcttaacaggagcat

SEQ ID NO: 304818 - DNA, 25 bp, Mus musculus
gcagtaattccgaaatcaacatgca

SEQ ID NO: 304819 - DNA, 25 bp, Mus musculus
gcagtaattccgagtcctgaagaaa

SEQ ID NO: 304820 - DNA, 25 bp, Mus musculus
gcagtacaaacctctttctcatcat

SEQ ID NO: 304821 - DNA, 25 bp, Mus musculus
gcagtacaaagagtacttttgagga

SEQ ID NO: 304822 - DNA, 25 bp, Mus musculus
gcagtacaatgagaaaaaaagacat

SEQ ID NO: 304823 - DNA, 25 bp, Mus musculus
gcagtacaatgagattctgatatct

SEQ ID NO: 304824 - DNA, 25 bp, Mus musculus
gcagtaccagtttgctagtggtgcc

SEQ ID NO: 304825 - DNA, 25 bp, Mus musculus
gcagtacccaggacactgtggtcac

SEQ ID NO: 304826 - DNA, 25 bp, Mus musculus
gcagtaccgagaggtcgactcatgg

SEQ ID NO: 304827 - DNA, 25 bp, Mus musculus
gcagtacctgaagggaaccccaata

SEQ ID NO: 304828 - DNA, 25 bp, Mus musculus
gcagtacctgaaggtggagagctgt

SEQ ID NO: 304829 - DNA, 25 bp, Mus musculus
gcagtactgactcaggctctggggg

SEQ ID NO: 304830 - DNA, 25 bp, Mus musculus
gcagtactgactcagtatgaagagc

SEQ ID NO: 304831 - DNA, 25 bp, Mus musculus
gcagtactgtgaaagagttgttatt

SEQ ID NO: 304832 - DNA, 25 bp, Mus musculus
gcagtactgtgaaagatatgaattt

SEQ ID NO: 304833 - DNA, 25 bp, Mus musculus
gcagtacttcaagagcctgcacagg

SEQ ID NO: 304834 - DNA, 25 bp, Mus musculus
gcagtagatgaagtgccagaaccag

SEQ ID NO: 304835 - DNA, 25 bp, Mus musculus
gcagtagcagtaataggaaagccgc

SEQ ID NO: 304836 - DNA, 25 bp, Mus musculus
gcagtagcagtaattggaaagccgc

SEQ ID NO: 304837 - DNA, 25 bp, Mus musculus
gcagtagccaattacagaatctggg

SEQ ID NO: 304838 - DNA, 25 bp, Mus musculus
gcagtagcgagccacaggttgtgtt

SEQ ID NO: 304839 - DNA, 25 bp, Mus musculus
gcagtagcggaaagctgagcagcaa

SEQ ID NO: 304840 - DNA, 25 bp, Mus musculus
gcagtagctcagcttcttcagctga

SEQ ID NO: 304841 - DNA, 25 bp, Mus musculus
gcagtagctcaggaatgtcaagtga

SEQ ID NO: 304842 - DNA, 25 bp, Mus musculus
gcagtagcttaatagttgaaccaag

SEQ ID NO: 304843 - DNA, 25 bp, Mus musculus
gcagtaggtatcagggtggactcag

SEQ ID NO: 304844 - DNA, 25 bp, Mus musculus
gcagtaggtcccttcccactgacct

SEQ ID NO: 304845 - DNA, 25 bp, Mus musculus
gcagtagtccaacatgcctttgagt

SEQ ID NO: 304846 - DNA, 25 bp, Mus musculus
gcagtagtccaactgattagaattt

SEQ ID NO: 304847 - DNA, 25 bp, Mus musculus
gcagtagtccaagatgcctttgagt

SEQ ID NO: 304848 - DNA, 25 bp, Mus musculus
gcagtagtccaagtgattagaattt

SEQ ID NO: 304849 - DNA, 25 bp, Mus musculus
gcagtagtttgatgagtcttgattg

SEQ ID NO: 304850 - DNA, 25 bp, Mus musculus
gcagtatagctccccgaaagaaaag

SEQ ID NO: 304851 - DNA, 25 bp, Mus musculus
gcagtatcacagcctgaagctggag

SEQ ID NO: 304852 - DNA, 25 bp, Mus musculus
gcagtatgagatgggggaatgcacc

SEQ ID NO: 304853 - DNA, 25 bp, Mus musculus
gcagtatgagatggggtcacctcca

SEQ ID NO: 304854 - DNA, 25 bp, Mus musculus
gcagtatggaaatagtttcttggat

SEQ ID NO: 304855 - DNA, 25 bp, Mus musculus
gcagtatggaaatgtcctaccctag

SEQ ID NO: 304856 - DNA, 25 bp, Mus musculus
gcagtatggaagtggcttggctgag

SEQ ID NO: 304857 - DNA, 25 bp, Mus musculus
gcagtatggaagtgtttgccgaaga

SEQ ID NO: 304858 - DNA, 25 bp, Mus musculus
gcagtatggaagttcccagaaatcc

SEQ ID NO: 304859 - DNA, 25 bp, Mus musculus
gcagtatggaattcttcctttgcag

SEQ ID NO: 304860 - DNA, 25 bp, Mus musculus
gcagtatggacagcattgggccctc

SEQ ID NO: 304861 - DNA, 25 bp, Mus musculus
gcagtatggagagcatcgagattga

SEQ ID NO: 304862 - DNA, 25 bp, Mus musculus
gcagtatgttgatgcaacgtgtaac

SEQ ID NO: 304863 - DNA, 25 bp, Mus musculus
gcagtatgttgatggagatcagtgt

SEQ ID NO: 304864 - DNA, 25 bp, Mus musculus
gcagtattagtgctacagcctgctg

SEQ ID NO: 304865 - DNA, 25 bp, Mus musculus
gcagtattggcaagaaccgagctca

SEQ ID NO: 304866 - DNA, 25 bp, Mus musculus
gcagtattggcaagagtccagaaaa

SEQ ID NO: 304867 - DNA, 25 bp, Mus musculus
gcagtcaaaaatctggtagtgcaac

SEQ ID NO: 304868 - DNA, 25 bp, Mus musculus
gcagtcaacttacagaactatgtag

SEQ ID NO: 304869 - DNA, 25 bp, Mus musculus
gcagtcaacttacagcatctgctgg

SEQ ID NO: 304870 - DNA, 25 bp, Mus musculus
gcagtcaagaaagcctgtaccccag

SEQ ID NO: 304871 - DNA, 25 bp, Mus musculus
gcagtcaagaaaggacatctgattt

SEQ ID NO: 304872 - DNA, 25 bp, Mus musculus
gcagtcaagaaagtcatcagcagga

SEQ ID NO: 304873 - DNA, 25 bp, Mus musculus
gcagtcaagccggtgtcctgggtca

SEQ ID NO: 304874 - DNA, 25 bp, Mus musculus
gcagtcaaggaaaagagttaccgtc

SEQ ID NO: 304875 - DNA, 25 bp, Mus musculus
gcagtcaagtgccgtgcagctggcc

SEQ ID NO: 304876 - DNA, 25 bp, Mus musculus
gcagtcacagaatgatgtgagccct

SEQ ID NO: 304877 - DNA, 25 bp, Mus musculus
gcagtcacaggtggataccctccgt

SEQ ID NO: 304878 - DNA, 25 bp, Mus musculus
gcagtcacaggttggatgaaaaatc

SEQ ID NO: 304879 - DNA, 25 bp, Mus musculus
gcagtcaccgccaccccgggaccca

SEQ ID NO: 304880 - DNA, 25 bp, Mus musculus
gcagtcaccgccggcccagtgctcc

SEQ ID NO: 304881 - DNA, 25 bp, Mus musculus
gcagtcaccgcctaatagggcccag

SEQ ID NO: 304882 - DNA, 25 bp, Mus musculus
gcagtcagagaatttaagaagtgca

SEQ ID NO: 304883 - DNA, 25 bp, Mus musculus
gcagtcagagagaacgtgaggctaa

SEQ ID NO: 304884 - DNA, 25 bp, Mus musculus
gcagtcagagagactcaagaacgtg

SEQ ID NO: 304885 - DNA, 25 bp, Mus musculus
gcagtcagagatttgattgagcact

SEQ ID NO: 304886 - DNA, 25 bp, Mus musculus
gcagtcagagccggcttcggagttg

SEQ ID NO: 304887 - DNA, 25 bp, Mus musculus
gcagtcagcaaacaaaaccgggggt

SEQ ID NO: 304888 - DNA, 25 bp, Mus musculus
gcagtcagcaaccaccctcccctga

SEQ ID NO: 304889 - DNA, 25 bp, Mus musculus
gcagtcagctgacactgtagctcag

SEQ ID NO: 304890 - DNA, 25 bp, Mus musculus
gcagtcaggtggaggctgcctccac

SEQ ID NO: 304891 - DNA, 25 bp, Mus musculus
gcagtcagtcttacaatacggactc

SEQ ID NO: 304892 - DNA, 25 bp, Mus musculus
gcagtccaagaaaacatcgctctca

SEQ ID NO: 304893 - DNA, 25 bp, Mus musculus
gcagtccaagatctgatgttttgat

SEQ ID NO: 304894 - DNA, 25 bp, Mus musculus
gcagtccaagcgctctctcagattc

SEQ ID NO: 304895 - DNA, 25 bp, Mus musculus
gcagtccagttcgataccgttcctg

SEQ ID NO: 304896 - DNA, 25 bp, Mus musculus
gcagtccagttcgatttgatatcct

SEQ ID NO: 304897 - DNA, 25 bp, Mus musculus
gcagtcccaggaggatctcccagaa

SEQ ID NO: 304898 - DNA, 25 bp, Mus musculus
gcagtcccccctagccagcggaagg

SEQ ID NO: 304899 - DNA, 25 bp, Mus musculus
gcagtcccccctcaggacattcaga

SEQ ID NO: 304900 - DNA, 25 bp, Mus musculus
gcagtcccccctgaatgggtcccta

SEQ ID NO: 304901 - DNA, 25 bp, Mus musculus
gcagtccctgcaggtgaagaagact

SEQ ID NO: 304902 - DNA, 25 bp, Mus musculus
gcagtccgaggtcgccatggatcgg

SEQ ID NO: 304903 - DNA, 25 bp, Mus musculus
gcagtccgcaggtctttggccagta

SEQ ID NO: 304904 - DNA, 25 bp, Mus musculus
gcagtccgtgctcaaatgagaaaag

SEQ ID NO: 304905 - DNA, 25 bp, Mus musculus
gcagtccgtgctcaagatcaaagaa

SEQ ID NO: 304906 - DNA, 25 bp, Mus musculus
gcagtcctaaatggtggccctccga

SEQ ID NO: 304907 - DNA, 25 bp, Mus musculus
gcagtcctaggactgcatttaccca

SEQ ID NO: 304908 - DNA, 25 bp, Mus musculus
gcagtcctagggcctggtggcctcc

SEQ ID NO: 304909 - DNA, 25 bp, Mus musculus
gcagtcctaggtgaagaagactcat

SEQ ID NO: 304910 - DNA, 25 bp, Mus musculus
gcagtcctcgaggagatcccagcca

SEQ ID NO: 304911 - DNA, 25 bp, Mus musculus
gcagtcctggcagactgtaccatca

SEQ ID NO: 304912 - DNA, 25 bp, Mus musculus
gcagtcctggcagagacagagatgg

SEQ ID NO: 304913 - DNA, 25 bp, Mus musculus
gcagtcgaaagaggcagacatcgac

SEQ ID NO: 304914 - DNA, 25 bp, Mus musculus
gcagtcgcagcagaaactggaggta

SEQ ID NO: 304915 - DNA, 25 bp, Mus musculus
gcagtcgcagcagctaacagagaag

SEQ ID NO: 304916 - DNA, 25 bp, Mus musculus
gcagtcgctcctatggcatgtgggc

SEQ ID NO: 304917 - DNA, 25 bp, Mus musculus
gcagtcggagaaaagggagaacctg

SEQ ID NO: 304918 - DNA, 25 bp, Mus musculus
gcagtcggtttaaagcggggatctg

SEQ ID NO: 304919 - DNA, 25 bp, Mus musculus
gcagtcgtctcctggccagagttcc

SEQ ID NO: 304920 - DNA, 25 bp, Mus musculus
gcagtcgtctcctgggacagaagat

SEQ ID NO: 304921 - DNA, 25 bp, Mus musculus
gcagtcgtgaggtaccgaaagaagg

SEQ ID NO: 304922 - DNA, 25 bp, Mus musculus
gcagtctaaggtgtctgaacacact

SEQ ID NO: 304923 - DNA, 25 bp, Mus musculus
gcagtctatagcacgaccccttatc

SEQ ID NO: 304924 - DNA, 25 bp, Mus musculus
gcagtctatagcacggtaacacaag

SEQ ID NO: 304925 - DNA, 25 bp, Mus musculus
gcagtctatgctggaaacagctttc

SEQ ID NO: 304926 - DNA, 25 bp, Mus musculus
gcagtctatgggacgcctcagaaat

SEQ ID NO: 304927 - DNA, 25 bp, Mus musculus
gcagtctcaccttgtctgtctgcag

SEQ ID NO: 304928 - DNA, 25 bp, Mus musculus
gcagtctcagcagaggtggaaagta

SEQ ID NO: 304929 - DNA, 25 bp, Mus musculus
gcagtctcctctcagcaaagctgtt

SEQ ID NO: 304930 - DNA, 25 bp, Mus musculus
gcagtctcctggcagccaaccaatg

SEQ ID NO: 304931 - DNA, 25 bp, Mus musculus
gcagtctctgggttcagacaatgaa

SEQ ID NO: 304932 - DNA, 25 bp, Mus musculus
gcagtctgacctctacaagaagact

SEQ ID NO: 304933 - DNA, 25 bp, Mus musculus
gcagtctgaggcctctggggacctg

SEQ ID NO: 304934 - DNA, 25 bp, Mus musculus
gcagtctggcaaaggccaaggaagt

SEQ ID NO: 304935 - DNA, 25 bp, Mus musculus
gcagtctgggctgctggctctacat

SEQ ID NO: 304936 - DNA, 25 bp, Mus musculus
gcagtctgtgcacttagtagaaaat

SEQ ID NO: 304937 - DNA, 25 bp, Mus musculus
gcagtctgtgtccaggcttcagaag

SEQ ID NO: 304938 - DNA, 25 bp, Mus musculus
gcagtctgttagcgagttccagaat

SEQ ID NO: 304939 - DNA, 25 bp, Mus musculus
gcagtcttcaaaagagtgttgaagt

SEQ ID NO: 304940 - DNA, 25 bp, Mus musculus
gcagtcttcaaaagtgaggaagaaa

SEQ ID NO: 304941 - DNA, 25 bp, Mus musculus
gcagtcttcatctgactctggctcc

SEQ ID NO: 304942 - DNA, 25 bp, Mus musculus
gcagtcttctcgatctttgggacca

SEQ ID NO: 304943 - DNA, 25 bp, Mus musculus
gcagtcttgcagggtcagtcatatc

SEQ ID NO: 304944 - DNA, 25 bp, Mus musculus
gcagtctttacccagcctccataga

SEQ ID NO: 304945 - DNA, 25 bp, Mus musculus
gcagtgaaacagctgggtgttaacc

SEQ ID NO: 304946 - DNA, 25 bp, Mus musculus
gcagtgaaagcaatgacatttcttc

SEQ ID NO: 304947 - DNA, 25 bp, Mus musculus
gcagtgacagtgagagcgggtccgg

SEQ ID NO: 304948 - DNA, 25 bp, Mus musculus
gcagtgaccaacattgatcgcccta

SEQ ID NO: 304949 - DNA, 25 bp, Mus musculus
gcagtgaccacaggacaggattatg

SEQ ID NO: 304950 - DNA, 25 bp, Mus musculus
gcagtgaccaccattcctgcgccca

SEQ ID NO: 304951 - DNA, 25 bp, Mus musculus
gcagtgaccagaacatcaaactgaa

SEQ ID NO: 304952 - DNA, 25 bp, Mus musculus
gcagtgaccagggtgccacaactca

SEQ ID NO: 304953 - DNA, 25 bp, Mus musculus
gcagtgacgtgggctggcgcttgtt

SEQ ID NO: 304954 - DNA, 25 bp, Mus musculus
gcagtgacgtggtgggaagaggtgc

SEQ ID NO: 304955 - DNA, 25 bp, Mus musculus
gcagtgactcagacatggaaaccag

SEQ ID NO: 304956 - DNA, 25 bp, Mus musculus
gcagtgactcagctattcgtcttca

SEQ ID NO: 304957 - DNA, 25 bp, Mus musculus
gcagtgactcatgagaaaagagaag

SEQ ID NO: 304958 - DNA, 25 bp, Mus musculus
gcagtgactcatgaggctcatccag

SEQ ID NO: 304959 - DNA, 25 bp, Mus musculus
gcagtgagccaccaggagaggaaac

SEQ ID NO: 304960 - DNA, 25 bp, Mus musculus
gcagtgagcgaaagactttactgga

SEQ ID NO: 304961 - DNA, 25 bp, Mus musculus
gcagtgagcgagatgcagcaccgag

SEQ ID NO: 304962 - DNA, 25 bp, Mus musculus
gcagtgaggcagaggtcccgtcagg

SEQ ID NO: 304963 - DNA, 25 bp, Mus musculus
gcagtgagtggctggattcctatct

SEQ ID NO: 304964 - DNA, 25 bp, Mus musculus
gcagtgatatacaggtggaatgaca

SEQ ID NO: 304965 - DNA, 25 bp, Mus musculus
gcagtgatctctcaggtgccaacag

SEQ ID NO: 304966 - DNA, 25 bp, Mus musculus
gcagtgatggtaagcttctctctaa

SEQ ID NO: 304967 - DNA, 25 bp, Mus musculus
gcagtgcaaaggtgattcttactgg

SEQ ID NO: 304968 - DNA, 25 bp, Mus musculus
gcagtgcaagacagcacaccctaaa

SEQ ID NO: 304969 - DNA, 25 bp, Mus musculus
gcagtgcaaggtgtccgcaaatatg

SEQ ID NO: 304970 - DNA, 25 bp, Mus musculus
gcagtgcacagagcatatgaaactt

SEQ ID NO: 304971 - DNA, 25 bp, Mus musculus
gcagtgcagcaggttcaccgtctcc

SEQ ID NO: 304972 - DNA, 25 bp, Mus musculus
gcagtgcaggaaagacatggaaggc

SEQ ID NO: 304973 - DNA, 25 bp, Mus musculus
gcagtgcaggaaagatggccctgca

SEQ ID NO: 304974 - DNA, 25 bp, Mus musculus
gcagtgcaggaagaacagaggcgtg

SEQ ID NO: 304975 - DNA, 25 bp, Mus musculus
gcagtgcaggggtacgcacgcggtc

SEQ ID NO: 304976 - DNA, 25 bp, Mus musculus
gcagtgccagccggactcctccacc

SEQ ID NO: 304977 - DNA, 25 bp, Mus musculus
gcagtgccagggaggtgtgaatgag

SEQ ID NO: 304978 - DNA, 25 bp, Mus musculus
gcagtgcccagacctgtgttacatt

SEQ ID NO: 304979 - DNA, 25 bp, Mus musculus
gcagtgccccgggagagacggagat

SEQ ID NO: 304980 - DNA, 25 bp, Mus musculus
gcagtgcccgaattgagagaaaaat

SEQ ID NO: 304981 - DNA, 25 bp, Mus musculus
gcagtgccgaaagtggctatgcaat

SEQ ID NO: 304982 - DNA, 25 bp, Mus musculus
gcagtgcctaccaggtgctgaggat

SEQ ID NO: 304983 - DNA, 25 bp, Mus musculus
gcagtgcctaccaggtgtccgtaaa

SEQ ID NO: 304984 - DNA, 25 bp, Mus musculus
gcagtgcctttgaggtcaatcttgg

SEQ ID NO: 304985 - DNA, 25 bp, Mus musculus
gcagtgcgaaagagaacctgctcct

SEQ ID NO: 304986 - DNA, 25 bp, Mus musculus
gcagtgcgaaagagattacaggaca

SEQ ID NO: 304987 - DNA, 25 bp, Mus musculus
gcagtgcggacctaaataacgagcc

SEQ ID NO: 304988 - DNA, 25 bp, Mus musculus
gcagtgcggaccttcactacttcga

SEQ ID NO: 304989 - DNA, 25 bp, Mus musculus
gcagtgcggcagccgtggtcatagt

SEQ ID NO: 304990 - DNA, 25 bp, Mus musculus
gcagtgctaatctaggtcttgccgt

SEQ ID NO: 304991 - DNA, 25 bp, Mus musculus
gcagtgctaattcaggtcttgccgt

SEQ ID NO: 304992 - DNA, 25 bp, Mus musculus
gcagtgctagttgggtgcaaagctt

SEQ ID NO: 304993 - DNA, 25 bp, Mus musculus
gcagtgctcagtgtggctgaggaag

SEQ ID NO: 304994 - DNA, 25 bp, Mus musculus
gcagtgctcataggaattcactgtg

SEQ ID NO: 304995 - DNA, 25 bp, Mus musculus
gcagtgctgctgaagaggcagagga

SEQ ID NO: 304996 - DNA, 25 bp, Mus musculus
gcagtgcttagagaacgatgtggac

SEQ ID NO: 304997 - DNA, 25 bp, Mus musculus
gcagtgcttagctcttctgtcggaa

SEQ ID NO: 304998 - DNA, 25 bp, Mus musculus
gcagtgcttattatgctggataata

SEQ ID NO: 304999 - DNA, 25 bp, Mus musculus
gcagtgcttcctcgagaagccaaca

SEQ ID NO: 305000 - DNA, 25 bp, Mus musculus
gcagtgcttcctcgatgagatcgtg

SEQ ID NO: 305001 - DNA, 25 bp, Mus musculus
gcagtgcttctgtgaaagaattgaa

SEQ ID NO: 305002 - DNA, 25 bp, Mus musculus
gcagtggaagcagagtcggagcaga

SEQ ID NO: 305003 - DNA, 25 bp, Mus musculus
gcagtggaagccagctttttgatca

SEQ ID NO: 305004 - DNA, 25 bp, Mus musculus
gcagtggaaggcaaagagaaacaga

SEQ ID NO: 305005 - DNA, 25 bp, Mus musculus
gcagtggacagaagatttcctctga

SEQ ID NO: 305006 - DNA, 25 bp, Mus musculus
gcagtggacgcgaggtacaacgcct

SEQ ID NO: 305007 - DNA, 25 bp, Mus musculus
gcagtggacgcgagtttcggaccca

SEQ ID NO: 305008 - DNA, 25 bp, Mus musculus
gcagtggagactgagcaaatcggcc

SEQ ID NO: 305009 - DNA, 25 bp, Mus musculus
gcagtggagactggtcttgctttgt

SEQ ID NO: 305010 - DNA, 25 bp, Mus musculus
gcagtggaggaagcacctcccacta

SEQ ID NO: 305011 - DNA, 25 bp, Mus musculus
gcagtggaggaagctcatctacgga

SEQ ID NO: 305012 - DNA, 25 bp, Mus musculus
gcagtggagggccctgtctgtactg

SEQ ID NO: 305013 - DNA, 25 bp, Mus musculus
gcagtggatgagcaacatgttctgc

SEQ ID NO: 305014 - DNA, 25 bp, Mus musculus
gcagtggatgatgagtctgactatc

SEQ ID NO: 305015 - DNA, 25 bp, Mus musculus
gcagtggatggaagacagcgagcgc

SEQ ID NO: 305016 - DNA, 25 bp, Mus musculus
gcagtggcactgtcctcccagtggc

SEQ ID NO: 305017 - DNA, 25 bp, Mus musculus
gcagtggcagagaagggcaaacatt

SEQ ID NO: 305018 - DNA, 25 bp, Mus musculus
gcagtggccagacaggtggagtcac

SEQ ID NO: 305019 - DNA, 25 bp, Mus musculus
gcagtggcccagctgctgtcaacaa

SEQ ID NO: 305020 - DNA, 25 bp, Mus musculus
gcagtggcgaaggcgaatctggttt

SEQ ID NO: 305021 - DNA, 25 bp, Mus musculus
gcagtggcgagactgaaacagtccc

SEQ ID NO: 305022 - DNA, 25 bp, Mus musculus
gcagtggcgaggagtccgctcagaa

SEQ ID NO: 305023 - DNA, 25 bp, Mus musculus
gcagtggcgaggccatggtggcgtg

SEQ ID NO: 305024 - DNA, 25 bp, Mus musculus
gcagtggcgaggtgagccatgatgg

SEQ ID NO: 305025 - DNA, 25 bp, Mus musculus
gcagtggcgcaggatggcgcagaag

SEQ ID NO: 305026 - DNA, 25 bp, Mus musculus
gcagtggcgcagttttactttcaag

SEQ ID NO: 305027 - DNA, 25 bp, Mus musculus
gcagtggcgccgtccagaggaccag

SEQ ID NO: 305028 - DNA, 25 bp, Mus musculus
gcagtggcggagcaggggaagagac

SEQ ID NO: 305029 - DNA, 25 bp, Mus musculus
gcagtggctcaagaccctgaaggct

SEQ ID NO: 305030 - DNA, 25 bp, Mus musculus
gcagtggctcaaggctatcgaggag

SEQ ID NO: 305031 - DNA, 25 bp, Mus musculus
gcagtggctcagctctgccatttcc

SEQ ID NO: 305032 - DNA, 25 bp, Mus musculus
gcagtggctggcatgctacaaatga

SEQ ID NO: 305033 - DNA, 25 bp, Mus musculus
gcagtgggaaagggagtcatgtggc

SEQ ID NO: 305034 - DNA, 25 bp, Mus musculus
gcagtgggagaaagatgatgacata

SEQ ID NO: 305035 - DNA, 25 bp, Mus musculus
gcagtgggcagtacactgcctcagg

SEQ ID NO: 305036 - DNA, 25 bp, Mus musculus
gcagtgggcagtacattgccattac

SEQ ID NO: 305037 - DNA, 25 bp, Mus musculus
gcagtggtccagggatgaactgtga

SEQ ID NO: 305038 - DNA, 25 bp, Mus musculus
gcagtggtgatgctgtcatcaaggc

SEQ ID NO: 305039 - DNA, 25 bp, Mus musculus
gcagtggtggaggtcagagtcagag

SEQ ID NO: 305040 - DNA, 25 bp, Mus musculus
gcagtggtggaggtcagggtagtac

SEQ ID NO: 305041 - DNA, 25 bp, Mus musculus
gcagtggttcttcaggcgtggctcc

SEQ ID NO: 305042 - DNA, 25 bp, Mus musculus
gcagtggttcttcaggtacatggct

SEQ ID NO: 305043 - DNA, 25 bp, Mus musculus
gcagtggttcttcaggtcagaagga

SEQ ID NO: 305044 - DNA, 25 bp, Mus musculus
gcagtggttgggaactgtgaagcag

SEQ ID NO: 305045 - DNA, 25 bp, Mus musculus
gcagtgtaaacaattagatttagag

SEQ ID NO: 305046 - DNA, 25 bp, Mus musculus
gcagtgtaaagatattgatgaatgt

SEQ ID NO: 305047 - DNA, 25 bp, Mus musculus
gcagtgtaaagattgcaaattcaac

SEQ ID NO: 305048 - DNA, 25 bp, Mus musculus
gcagtgtaatgatcgatgaagatat

SEQ ID NO: 305049 - DNA, 25 bp, Mus musculus
gcagtgtagggtaaacacaagacgt

SEQ ID NO: 305050 - DNA, 25 bp, Mus musculus
gcagtgtcagtgctgccctaggaga

SEQ ID NO: 305051 - DNA, 25 bp, Mus musculus
gcagtgtcagtgggttatttcgctg

SEQ ID NO: 305052 - DNA, 25 bp, Mus musculus
gcagtgtcagttcctttctagattc

SEQ ID NO: 305053 - DNA, 25 bp, Mus musculus
gcagtgtccatgctcttttgtgact

SEQ ID NO: 305054 - DNA, 25 bp, Mus musculus
gcagtgtcccaatccgggctgtgga

SEQ ID NO: 305055 - DNA, 25 bp, Mus musculus
gcagtgtccccaccttcaaacacct

SEQ ID NO: 305056 - DNA, 25 bp, Mus musculus
gcagtgtcctggccaagggccggaa

SEQ ID NO: 305057 - DNA, 25 bp, Mus musculus
gcagtgtctgaaatgacacggagag

SEQ ID NO: 305058 - DNA, 25 bp, Mus musculus
gcagtgtgaagggctcaggatgcta

SEQ ID NO: 305059 - DNA, 25 bp, Mus musculus
gcagtgtgagctagcccttcttcaa

SEQ ID NO: 305060 - DNA, 25 bp, Mus musculus
gcagtgtgagtgatttccggtgtct

SEQ ID NO: 305061 - DNA, 25 bp, Mus musculus
gcagtgtgattgggagaaaccactg

SEQ ID NO: 305062 - DNA, 25 bp, Mus musculus
gcagtgtgcagatttgtgaataaac

SEQ ID NO: 305063 - DNA, 25 bp, Mus musculus
gcagtgtggaagtctggtcatctga

SEQ ID NO: 305064 - DNA, 25 bp, Mus musculus
gcagtgtggaagttctgcaactgtg

SEQ ID NO: 305065 - DNA, 25 bp, Mus musculus
gcagtgtggctagcaagctgcctcg

SEQ ID NO: 305066 - DNA, 25 bp, Mus musculus
gcagtgtggtgactgttggtcctgt

SEQ ID NO: 305067 - DNA, 25 bp, Mus musculus
gcagtgtgtgaagcaaggagaactc

SEQ ID NO: 305068 - DNA, 25 bp, Mus musculus
gcagtgtgtggcacctctgcagtgg

SEQ ID NO: 305069 - DNA, 25 bp, Mus musculus
gcagtgttgcatgatcaaaaggaaa

SEQ ID NO: 305070 - DNA, 25 bp, Mus musculus
gcagtgtttctagaggcctcaaaca

SEQ ID NO: 305071 - DNA, 25 bp, Mus musculus
gcagtgttttcagggccctcagccg

SEQ ID NO: 305072 - DNA, 25 bp, Mus musculus
gcagttaaagaggtgaactgccctc

SEQ ID NO: 305073 - DNA, 25 bp, Mus musculus
gcagttaaagctccctcttgatgtg

SEQ ID NO: 305074 - DNA, 25 bp, Mus musculus
gcagttaaaggatggttcctatcat

SEQ ID NO: 305075 - DNA, 25 bp, Mus musculus
gcagttaaccagtgctgagcctacc

SEQ ID NO: 305076 - DNA, 25 bp, Mus musculus
gcagttaagagaacagcacattagt

SEQ ID NO: 305077 - DNA, 25 bp, Mus musculus
gcagttaagaggatcgctgcagagc

SEQ ID NO: 305078 - DNA, 25 bp, Mus musculus
gcagttaagtcaggaaaccaagcgc

SEQ ID NO: 305079 - DNA, 25 bp, Mus musculus
gcagttaattgagtgtgttctcagg

SEQ ID NO: 305080 - DNA, 25 bp, Mus musculus
gcagttacgtaggtctggtcagcta

SEQ ID NO: 305081 - DNA, 25 bp, Mus musculus
gcagttagaactcaggcaggaagag

SEQ ID NO: 305082 - DNA, 25 bp, Mus musculus
gcagttagacttgcaagcacctttc

SEQ ID NO: 305083 - DNA, 25 bp, Mus musculus
gcagttagcagtcaaactcagcaac

SEQ ID NO: 305084 - DNA, 25 bp, Mus musculus
gcagttagcagtcaatatatggact

SEQ ID NO: 305085 - DNA, 25 bp, Mus musculus
gcagttatatcaggggtcggcacaa

SEQ ID NO: 305086 - DNA, 25 bp, Mus musculus
gcagttatatggtggtgacgtatgc

SEQ ID NO: 305087 - DNA, 25 bp, Mus musculus
gcagttatgcagaacttgtcacaaa

SEQ ID NO: 305088 - DNA, 25 bp, Mus musculus
gcagttcaagcaaatggtattcatg

SEQ ID NO: 305089 - DNA, 25 bp, Mus musculus
gcagttcaagccaaccatctgccac

SEQ ID NO: 305090 - DNA, 25 bp, Mus musculus
gcagttcaaggagatgccagaccag

SEQ ID NO: 305091 - DNA, 25 bp, Mus musculus
gcagttcaaggcaataaaagcgaaa

SEQ ID NO: 305092 - DNA, 25 bp, Mus musculus
gcagttcaagggctaacttaaagag

SEQ ID NO: 305093 - DNA, 25 bp, Mus musculus
gcagttcacgattctcgagcaggtg

SEQ ID NO: 305094 - DNA, 25 bp, Mus musculus
gcagttcagggaagaatcggtttct

SEQ ID NO: 305095 - DNA, 25 bp, Mus musculus
gcagttcagtagctatgagccagaa

SEQ ID NO: 305096 - DNA, 25 bp, Mus musculus
gcagttccaggaggaggacttcatc

SEQ ID NO: 305097 - DNA, 25 bp, Mus musculus
gcagttccaggtccctgagggtctg

SEQ ID NO: 305098 - DNA, 25 bp, Mus musculus
gcagttccagtcagctgcgggcagc

SEQ ID NO: 305099 - DNA, 25 bp, Mus musculus
gcagttccattgactaggccagggt

SEQ ID NO: 305100 - DNA, 25 bp, Mus musculus
gcagttccgaaagaagtggaataag

SEQ ID NO: 305101 - DNA, 25 bp, Mus musculus
gcagttccgaaagatgtggaataag

SEQ ID NO: 305102 - DNA, 25 bp, Mus musculus
gcagttcgcaccacccctgccactg

SEQ ID NO: 305103 - DNA, 25 bp, Mus musculus
gcagttcgcagaacagaaactggac

SEQ ID NO: 305104 - DNA, 25 bp, Mus musculus
gcagttcggctacaggagatccagt

SEQ ID NO: 305105 - DNA, 25 bp, Mus musculus
gcagttctatatgctgtctcctaag

SEQ ID NO: 305106 - DNA, 25 bp, Mus musculus
gcagttctatatgttcgcatggacg

SEQ ID NO: 305107 - DNA, 25 bp, Mus musculus
gcagttctcaggaggggtcatctcc

SEQ ID NO: 305108 - DNA, 25 bp, Mus musculus
gcagttctcgttgtgaaaatgtcca

SEQ ID NO: 305109 - DNA, 25 bp, Mus musculus
gcagttcttaacaggcacgtgacac

SEQ ID NO: 305110 - DNA, 25 bp, Mus musculus
gcagttcttcaccagcccagagaac

SEQ ID NO: 305111 - DNA, 25 bp, Mus musculus
gcagttgaaaggagaggatgcttaa

SEQ ID NO: 305112 - DNA, 25 bp, Mus musculus
gcagttgaccccaggccctgcaggt

SEQ ID NO: 305113 - DNA, 25 bp, Mus musculus
gcagttgcaaggactggaccagttt

SEQ ID NO: 305114 - DNA, 25 bp, Mus musculus
gcagttgcaaggtaacctccgtgct

SEQ ID NO: 305115 - DNA, 25 bp, Mus musculus
gcagttgcagctctaagaacaggtg

SEQ ID NO: 305116 - DNA, 25 bp, Mus musculus
gcagttgcaggaatctcagcaaatg

SEQ ID NO: 305117 - DNA, 25 bp, Mus musculus
gcagttgcaggtttcttcgggtagc

SEQ ID NO: 305118 - DNA, 25 bp, Mus musculus
gcagttgcctcagcaccaaggagat

SEQ ID NO: 305119 - DNA, 25 bp, Mus musculus
gcagttgcgggagtgggaggtgctg

SEQ ID NO: 305120 - DNA, 25 bp, Mus musculus
gcagttgctccccagccctgaggtg

SEQ ID NO: 305121 - DNA, 25 bp, Mus musculus
gcagttggggaccagagttggcctg

SEQ ID NO: 305122 - DNA, 25 bp, Mus musculus
gcagttgtccagagccaccagccat

SEQ ID NO: 305123 - DNA, 25 bp, Mus musculus
gcagttgtgtgactatgcaagctgc

SEQ ID NO: 305124 - DNA, 25 bp, Mus musculus
gcagttgtttgacttaccatgctcg

SEQ ID NO: 305125 - DNA, 25 bp, Mus musculus
gcagttgtttgtctgccaggaactt

SEQ ID NO: 305126 - DNA, 25 bp, Mus musculus
gcagtttaaaaacggcgtggagccc

SEQ ID NO: 305127 - DNA, 25 bp, Mus musculus
gcagtttccggagggactcaaagct

SEQ ID NO: 305128 - DNA, 25 bp, Mus musculus
gcagtttgaaagggtacagtaagcg

SEQ ID NO: 305129 - DNA, 25 bp, Mus musculus
gcagtttgaaatctgatggttacca

SEQ ID NO: 305130 - DNA, 25 bp, Mus musculus
gcagtttgaggagtgcatttcccag

SEQ ID NO: 305131 - DNA, 25 bp, Mus musculus
gcagtttgccatgaagcggctgctg

SEQ ID NO: 305132 - DNA, 25 bp, Mus musculus
gcagtttgggatgaatgccagctct

SEQ ID NO: 305133 - DNA, 25 bp, Mus musculus
gcagttttaaaagcaagtctgcgtg

SEQ ID NO: 305134 - DNA, 25 bp, Mus musculus
gcagttttaaaagcctggctccgtg

SEQ ID NO: 305135 - DNA, 25 bp, Mus musculus
gcagttttaaaagtccagccatttc

SEQ ID NO: 305136 - DNA, 25 bp, Mus musculus
gcagttttgaaggctctgctaaggc

SEQ ID NO: 305137 - DNA, 25 bp, Mus musculus
gcagttttgaggcaagaaatctcaa

SEQ ID NO: 305138 - DNA, 25 bp, Mus musculus
gcagttttgggggctcgccatacga

SEQ ID NO: 305139 - DNA, 25 bp, Mus musculus
gcagttttttgcatgttacatggaa

SEQ ID NO: 305140 - DNA, 25 bp, Mus musculus
gcataaaagaatgatgccagcatgt

SEQ ID NO: 305141 - DNA, 25 bp, Mus musculus
gcataaacaggctgagattgtgaaa

SEQ ID NO: 305142 - DNA, 25 bp, Mus musculus
gcataaacaggctgagatttgagat

SEQ ID NO: 305143 - DNA, 25 bp, Mus musculus
gcataaagaaggaatcacccacttg

SEQ ID NO: 305144 - DNA, 25 bp, Mus musculus
gcataaagatagatgtgctaacgaa

SEQ ID NO: 305145 - DNA, 25 bp, Mus musculus
gcataaattgaatctgtataaactg

SEQ ID NO: 305146 - DNA, 25 bp, Mus musculus
gcataacctgcaaacactgcccccc

SEQ ID NO: 305147 - DNA, 25 bp, Mus musculus
gcataactcaggtccaaaggccaag

SEQ ID NO: 305148 - DNA, 25 bp, Mus musculus
gcataacttcagaaggaataaaagc

SEQ ID NO: 305149 - DNA, 25 bp, Mus musculus
gcataacttcctgagaaggacttga

SEQ ID NO: 305150 - DNA, 25 bp, Mus musculus
gcataagaggcggtgactccatacc

SEQ ID NO: 305151 - DNA, 25 bp, Mus musculus
gcataaggccaaggtttcctttgcc

SEQ ID NO: 305152 - DNA, 25 bp, Mus musculus
gcataaggccacatgttttatggct

SEQ ID NO: 305153 - DNA, 25 bp, Mus musculus
gcataaggtataaggcttgctcttc

SEQ ID NO: 305154 - DNA, 25 bp, Mus musculus
gcataatattacgcaacatatgaaa

SEQ ID NO: 305155 - DNA, 25 bp, Mus musculus
gcataatccagccctctaataaagc

SEQ ID NO: 305156 - DNA, 25 bp, Mus musculus
gcataatcttggtggagaaactctt

SEQ ID NO: 305157 - DNA, 25 bp, Mus musculus
gcataattcagaaaatcagaaaatg

SEQ ID NO: 305158 - DNA, 25 bp, Mus musculus
gcatacacaggaaagggctgtgagg

SEQ ID NO: 305159 - DNA, 25 bp, Mus musculus
gcatacagaaccgaggtagtcaaga

SEQ ID NO: 305160 - DNA, 25 bp, Mus musculus
gcataccaaatcagcagaaatggag

SEQ ID NO: 305161 - DNA, 25 bp, Mus musculus
gcataccggccaggtgtatgatgaa

SEQ ID NO: 305162 - DNA, 25 bp, Mus musculus
gcatacctgtggcagcaccgggact

SEQ ID NO: 305163 - DNA, 25 bp, Mus musculus
gcatacctgtggtctcaccagctca

SEQ ID NO: 305164 - DNA, 25 bp, Mus musculus
gcatacggtggtgcaatctgccagc

SEQ ID NO: 305165 - DNA, 25 bp, Mus musculus
gcatacggtggtgcacctcgcctgc

SEQ ID NO: 305166 - DNA, 25 bp, Mus musculus
gcatacggtggtgcaggctctcctt

SEQ ID NO: 305167 - DNA, 25 bp, Mus musculus
gcatactacaggatctatgggcagg

SEQ ID NO: 305168 - DNA, 25 bp, Mus musculus
gcatactcacgtgaatgatggcact

SEQ ID NO: 305169 - DNA, 25 bp, Mus musculus
gcatactcagcgagagaagcgggac

SEQ ID NO: 305170 - DNA, 25 bp, Mus musculus
gcatactgcagtgcttaaatgtaaa

SEQ ID NO: 305171 - DNA, 25 bp, Mus musculus
gcatactgctcaatccatcgagaca

SEQ ID NO: 305172 - DNA, 25 bp, Mus musculus
gcatactggaaaaggtgtactttgt

SEQ ID NO: 305173 - DNA, 25 bp, Mus musculus
gcatactgttgagcctgagaaatgc

SEQ ID NO: 305174 - DNA, 25 bp, Mus musculus
gcatagaccaggtgagacggaaggc

SEQ ID NO: 305175 - DNA, 25 bp, Mus musculus
gcatagacttcaggaataaagtggt

SEQ ID NO: 305176 - DNA, 25 bp, Mus musculus
gcatagcagagctacccagctgggt

SEQ ID NO: 305177 - DNA, 25 bp, Mus musculus
gcatagctctgtggagcgaccctgt

SEQ ID NO: 305178 - DNA, 25 bp, Mus musculus
gcataggacattttccttcccgtcg

SEQ ID NO: 305179 - DNA, 25 bp, Mus musculus
gcatagtcactaaggagatgttaga

SEQ ID NO: 305180 - DNA, 25 bp, Mus musculus
gcatagtgaagggcgagcttcacaa

SEQ ID NO: 305181 - DNA, 25 bp, Mus musculus
gcatagtggagtcccagaggcacca

SEQ ID NO: 305182 - DNA, 25 bp, Mus musculus
gcatagtttagggtgtctagcccac

SEQ ID NO: 305183 - DNA, 25 bp, Mus musculus
gcatagtttttctgatggtctgcag

SEQ ID NO: 305184 - DNA, 25 bp, Mus musculus
gcatataaaatagaaatgtgaatcc

SEQ ID NO: 305185 - DNA, 25 bp, Mus musculus
gcatataaactggcgagatgtccct

SEQ ID NO: 305186 - DNA, 25 bp, Mus musculus
gcatataacaggaacggtcatcaaa

SEQ ID NO: 305187 - DNA, 25 bp, Mus musculus
gcatataacaggaatttctcttgga

SEQ ID NO: 305188 - DNA, 25 bp, Mus musculus
gcatataaggagaagtgcccggctc

SEQ ID NO: 305189 - DNA, 25 bp, Mus musculus
gcatataaggagcttttcatcctta

SEQ ID NO: 305190 - DNA, 25 bp, Mus musculus
gcatataattcattttgaccagcct

SEQ ID NO: 305191 - DNA, 25 bp, Mus musculus
gcatatactaggtcctgtgggaatg

SEQ ID NO: 305192 - DNA, 25 bp, Mus musculus
gcatataggcatagactacttttaa

SEQ ID NO: 305193 - DNA, 25 bp, Mus musculus
gcatatcaagaatgctgtgaacctg

SEQ ID NO: 305194 - DNA, 25 bp, Mus musculus
gcatatcccagatgctcatctttgg

SEQ ID NO: 305195 - DNA, 25 bp, Mus musculus
gcatatctaccaggtaagattaaaa

SEQ ID NO: 305196 - DNA, 25 bp, Mus musculus
gcatatctaggggagtatgtgctca

SEQ ID NO: 305197 - DNA, 25 bp, Mus musculus
gcatatctgagattcagtttgctga

SEQ ID NO: 305198 - DNA, 25 bp, Mus musculus
gcatatctggccagaaatggcctcc

SEQ ID NO: 305199 - DNA, 25 bp, Mus musculus
gcatatgacatagcttgtgacgaat

SEQ ID NO: 305200 - DNA, 25 bp, Mus musculus
gcatatgagcagatgaaacggcttg

SEQ ID NO: 305201 - DNA, 25 bp, Mus musculus
gcatatgcagaagagaagaaaaatt

SEQ ID NO: 305202 - DNA, 25 bp, Mus musculus
gcatatgcagaagagttagcaaaac

SEQ ID NO: 305203 - DNA, 25 bp, Mus musculus
gcatatgcgctggtggacgcagacg

SEQ ID NO: 305204 - DNA, 25 bp, Mus musculus
gcatatgcgctggttccagatgcct

SEQ ID NO: 305205 - DNA, 25 bp, Mus musculus
gcatatgctgatcctgggcataact

SEQ ID NO: 305206 - DNA, 25 bp, Mus musculus
gcatatgcttccttggggactgatc

SEQ ID NO: 305207 - DNA, 25 bp, Mus musculus
gcatatgcttcggagactcgggcgg

SEQ ID NO: 305208 - DNA, 25 bp, Mus musculus
gcatatggaaaatgattcaaggcct

SEQ ID NO: 305209 - DNA, 25 bp, Mus musculus
gcatatggaaaatggtgttgctgtc

SEQ ID NO: 305210 - DNA, 25 bp, Mus musculus
gcatatggaaaatgtttcaacctgg

SEQ ID NO: 305211 - DNA, 25 bp, Mus musculus
gcatatggagggagcctggaggatg

SEQ ID NO: 305212 - DNA, 25 bp, Mus musculus
gcatatgtacaggcagaccgaaggc

SEQ ID NO: 305213 - DNA, 25 bp, Mus musculus
gcatatgtacagtcccagaagtatc

SEQ ID NO: 305214 - DNA, 25 bp, Mus musculus
gcatatgttcaatttgaggatgttc

SEQ ID NO: 305215 - DNA, 25 bp, Mus musculus
gcatattcaaaaaggtatctggagg

SEQ ID NO: 305216 - DNA, 25 bp, Mus musculus
gcatattcaaaaagtatgtttcatt

SEQ ID NO: 305217 - DNA, 25 bp, Mus musculus
gcatattcagggtgacggcctctct

SEQ ID NO: 305218 - DNA, 25 bp, Mus musculus
gcatattccagatgttctgatggca

SEQ ID NO: 305219 - DNA, 25 bp, Mus musculus
gcatattgggaacgaccaaggactc

SEQ ID NO: 305220 - DNA, 25 bp, Mus musculus
gcatatttgagggattttatatatg

SEQ ID NO: 305221 - DNA, 25 bp, Mus musculus
gcatattttggaaaccagtaaagtg

SEQ ID NO: 305222 - DNA, 25 bp, Mus musculus
gcatattttggttcttcatgctttg

SEQ ID NO: 305223 - DNA, 25 bp, Mus musculus
gcatattttgtgagttcaaaattgg

SEQ ID NO: 305224 - DNA, 25 bp, Mus musculus
gcatcaaaacaaatggcctccacct

SEQ ID NO: 305225 - DNA, 25 bp, Mus musculus
gcatcaaacaagttgatcaagagct

SEQ ID NO: 305226 - DNA, 25 bp, Mus musculus
gcatcaaacaatttgtcgtcctact

SEQ ID NO: 305227 - DNA, 25 bp, Mus musculus
gcatcaaacagtatgaagaagaaaa

SEQ ID NO: 305228 - DNA, 25 bp, Mus musculus
gcatcaaacatggaggaatcgtctt

SEQ ID NO: 305229 - DNA, 25 bp, Mus musculus
gcatcaaagggatggttcaggctgt

SEQ ID NO: 305230 - DNA, 25 bp, Mus musculus
gcatcaacagagaggtgataggtgc

SEQ ID NO: 305231 - DNA, 25 bp, Mus musculus
gcatcaacagagaggtttatttcct

SEQ ID NO: 305232 - DNA, 25 bp, Mus musculus
gcatcaaccatagggttctacagtg

SEQ ID NO: 305233 - DNA, 25 bp, Mus musculus
gcatcaacccactgggtggctttgt

SEQ ID NO: 305234 - DNA, 25 bp, Mus musculus
gcatcaaccctgagacagctcttct

SEQ ID NO: 305235 - DNA, 25 bp, Mus musculus
gcatcaaccctgagtgccaggaccc

SEQ ID NO: 305236 - DNA, 25 bp, Mus musculus
gcatcaactgcagccaggctatgct

SEQ ID NO: 305237 - DNA, 25 bp, Mus musculus
gcatcaagaaaggctccgtgctgcc

SEQ ID NO: 305238 - DNA, 25 bp, Mus musculus
gcatcaagaatgaagtgtatcccct

SEQ ID NO: 305239 - DNA, 25 bp, Mus musculus
gcatcaagcacggcacagtttgtct

SEQ ID NO: 305240 - DNA, 25 bp, Mus musculus
gcatcaaggagacatcaacaaggat

SEQ ID NO: 305241 - DNA, 25 bp, Mus musculus
gcatcaaggagcaggacatcaacaa

SEQ ID NO: 305242 - DNA, 25 bp, Mus musculus
gcatcaaggagctcccctcccaccc

SEQ ID NO: 305243 - DNA, 25 bp, Mus musculus
gcatcaaggcctcaggtggagccag

SEQ ID NO: 305244 - DNA, 25 bp, Mus musculus
gcatcaaggtacttgtgtcagatgc

SEQ ID NO: 305245 - DNA, 25 bp, Mus musculus
gcatcaatcatggaaaggatttggt

SEQ ID NO: 305246 - DNA, 25 bp, Mus musculus
gcatcaatctgcagaagcggcctct

SEQ ID NO: 305247 - DNA, 25 bp, Mus musculus
gcatcaatgctgttttctactattc

SEQ ID NO: 305248 - DNA, 25 bp, Mus musculus
gcatcacaaacacagacattcccag

SEQ ID NO: 305249 - DNA, 25 bp, Mus musculus
gcatcacaaacacagaggagcttaa

SEQ ID NO: 305250 - DNA, 25 bp, Mus musculus
gcatcacaccagatgctgccagccc

SEQ ID NO: 305251 - DNA, 25 bp, Mus musculus
gcatcacaccagggagcaggatcac

SEQ ID NO: 305252 - DNA, 25 bp, Mus musculus
gcatcacacgatttgtgaaaacatc

SEQ ID NO: 305253 - DNA, 25 bp, Mus musculus
gcatcacacggctcattcacctaaa

SEQ ID NO: 305254 - DNA, 25 bp, Mus musculus
gcatcacagatggcctgcaatgcct

SEQ ID NO: 305255 - DNA, 25 bp, Mus musculus
gcatcacagtgacagggcccaatgt

SEQ ID NO: 305256 - DNA, 25 bp, Mus musculus
gcatcacatgaccagtggctgctct

SEQ ID NO: 305257 - DNA, 25 bp, Mus musculus
gcatcaccacgatcagagtgatgtg

SEQ ID NO: 305258 - DNA, 25 bp, Mus musculus
gcatcaccagcagtgcccggggtct

SEQ ID NO: 305259 - DNA, 25 bp, Mus musculus
gcatcaccctgacaaaggagacaac

SEQ ID NO: 305260 - DNA, 25 bp, Mus musculus
gcatcaccgcggtgggtgatgtctt

SEQ ID NO: 305261 - DNA, 25 bp, Mus musculus
gcatcacctatgacgagtccatgct

SEQ ID NO: 305262 - DNA, 25 bp, Mus musculus
gcatcactaggaacagcatctgatg

SEQ ID NO: 305263 - DNA, 25 bp, Mus musculus
gcatcactcaaggagaagctgtgtg

SEQ ID NO: 305264 - DNA, 25 bp, Mus musculus
gcatcactgttgctcacctttcaac

SEQ ID NO: 305265 - DNA, 25 bp, Mus musculus
gcatcagaaaaggtgactaataaac

SEQ ID NO: 305266 - DNA, 25 bp, Mus musculus
gcatcagaaaggcaacatgtcggca

SEQ ID NO: 305267 - DNA, 25 bp, Mus musculus
gcatcagaagccggggagtcccatg

SEQ ID NO: 305268 - DNA, 25 bp, Mus musculus
gcatcagacagggcaacgtttcata

SEQ ID NO: 305269 - DNA, 25 bp, Mus musculus
gcatcagacatggattgcagtgctc

SEQ ID NO: 305270 - DNA, 25 bp, Mus musculus
gcatcagagaggatgtaacttatcc

SEQ ID NO: 305271 - DNA, 25 bp, Mus musculus
gcatcagagagggaagaaaatggag

SEQ ID NO: 305272 - DNA, 25 bp, Mus musculus
gcatcagcaaggtactgccctttcc

SEQ ID NO: 305273 - DNA, 25 bp, Mus musculus
gcatcagcacgaatggtgcagtctt

SEQ ID NO: 305274 - DNA, 25 bp, Mus musculus
gcatcagcagtgatgatcttttctc

SEQ ID NO: 305275 - DNA, 25 bp, Mus musculus
gcatcagccgtggatgaacaggccg

SEQ ID NO: 305276 - DNA, 25 bp, Mus musculus
gcatcagcgggcaaatcatttagct

SEQ ID NO: 305277 - DNA, 25 bp, Mus musculus
gcatcaggaccaagcccttcccctg

SEQ ID NO: 305278 - DNA, 25 bp, Mus musculus
gcatcaggactctcaggtaaatgca

SEQ ID NO: 305279 - DNA, 25 bp, Mus musculus
gcatcagggtcacagaaaccggcga

SEQ ID NO: 305280 - DNA, 25 bp, Mus musculus
gcatcagggtcacaggctctgtggg

SEQ ID NO: 305281 - DNA, 25 bp, Mus musculus
gcatcaggtcctggatgaacgagac

SEQ ID NO: 305282 - DNA, 25 bp, Mus musculus
gcatcaggtctccttcccttgaaca

SEQ ID NO: 305283 - DNA, 25 bp, Mus musculus
gcatcagtatacatgggagactctg

SEQ ID NO: 305284 - DNA, 25 bp, Mus musculus
gcatcagtgactgtagtctgacatc

SEQ ID NO: 305285 - DNA, 25 bp, Mus musculus
gcatcagtggatcgatatcaacaac

SEQ ID NO: 305286 - DNA, 25 bp, Mus musculus
gcatcagtttagtgctgacagtaga

SEQ ID NO: 305287 - DNA, 25 bp, Mus musculus
gcatcataaagccaggcagtgaagc

SEQ ID NO: 305288 - DNA, 25 bp, Mus musculus
gcatcatacaagtttgtgtggccat

SEQ ID NO: 305289 - DNA, 25 bp, Mus musculus
gcatcatacagaccagagggattat

SEQ ID NO: 305290 - DNA, 25 bp, Mus musculus
gcatcatagccaaggaaggtggggt

SEQ ID NO: 305291 - DNA, 25 bp, Mus musculus
gcatcatagccaaggtggacggtat

SEQ ID NO: 305292 - DNA, 25 bp, Mus musculus
gcatcatattgaacgagaaaaagac

SEQ ID NO: 305293 - DNA, 25 bp, Mus musculus
gcatcatcaactctatattagctca

SEQ ID NO: 305294 - DNA, 25 bp, Mus musculus
gcatcatcaagaagagcctccccag

SEQ ID NO: 305295 - DNA, 25 bp, Mus musculus
gcatcatcaagaaggtgcaggtggt

SEQ ID NO: 305296 - DNA, 25 bp, Mus musculus
gcatcatcaatccaaacatctgtgg

SEQ ID NO: 305297 - DNA, 25 bp, Mus musculus
gcatcatcataaatgttaaaattct

SEQ ID NO: 305298 - DNA, 25 bp, Mus musculus
gcatcatccccaggcgctttgccct

SEQ ID NO: 305299 - DNA, 25 bp, Mus musculus
gcatcatcctgacaggtgctgagtt

SEQ ID NO: 305300 - DNA, 25 bp, Mus musculus
gcatcatcctggtgttcctgctggc

SEQ ID NO: 305301 - DNA, 25 bp, Mus musculus
gcatcatccttagcagggagaagaa

SEQ ID NO: 305302 - DNA, 25 bp, Mus musculus
gcatcatcgaagctcccatctccag

SEQ ID NO: 305303 - DNA, 25 bp, Mus musculus
gcatcatcgaagtggaaaacatggc

SEQ ID NO: 305304 - DNA, 25 bp, Mus musculus
gcatcatctaccctgaggagaatga

SEQ ID NO: 305305 - DNA, 25 bp, Mus musculus
gcatcatgatatccgagtggtgaat

SEQ ID NO: 305306 - DNA, 25 bp, Mus musculus
gcatcatgctgagcacttttgtgta

SEQ ID NO: 305307 - DNA, 25 bp, Mus musculus
gcatcattcaggtttttcctgatga

SEQ ID NO: 305308 - DNA, 25 bp, Mus musculus
gcatcatttaatggtcaggggagta

SEQ ID NO: 305309 - DNA, 25 bp, Mus musculus
gcatcatttgaacaatgcccagcgc

SEQ ID NO: 305310 - DNA, 25 bp, Mus musculus
gcatcatttgactgaggaccattta

SEQ ID NO: 305311 - DNA, 25 bp, Mus musculus
gcatcatttgtaccatctgtaccgt

SEQ ID NO: 305312 - DNA, 25 bp, Mus musculus
gcatccaagaaagatcgctcctttg

SEQ ID NO: 305313 - DNA, 25 bp, Mus musculus
gcatccaagggccaggagactgttc

SEQ ID NO: 305314 - DNA, 25 bp, Mus musculus
gcatccaagtgccaggtacaaccag

SEQ ID NO: 305315 - DNA, 25 bp, Mus musculus
gcatccacaccgccgtgacgtctta

SEQ ID NO: 305316 - DNA, 25 bp, Mus musculus
gcatccacaccgcttgcttgggtcc

SEQ ID NO: 305317 - DNA, 25 bp, Mus musculus
gcatccacagagcttggctgaagag

SEQ ID NO: 305318 - DNA, 25 bp, Mus musculus
gcatccacagtggagatccagacag

SEQ ID NO: 305319 - DNA, 25 bp, Mus musculus
gcatccacgcacatgaggaagcagc

SEQ ID NO: 305320 - DNA, 25 bp, Mus musculus
gcatccacggaagaagtgccttccc

SEQ ID NO: 305321 - DNA, 25 bp, Mus musculus
gcatccacggaggaggagctgatcc

SEQ ID NO: 305322 - DNA, 25 bp, Mus musculus
gcatccacggaggccctgcccagga

SEQ ID NO: 305323 - DNA, 25 bp, Mus musculus
gcatccacggccatgggttctccga

SEQ ID NO: 305324 - DNA, 25 bp, Mus musculus
gcatccagaacaatggagacaccaa

SEQ ID NO: 305325 - DNA, 25 bp, Mus musculus
gcatccagaggatgctgcccagaaa

SEQ ID NO: 305326 - DNA, 25 bp, Mus musculus
gcatccagaggtctggtagcagcct

SEQ ID NO: 305327 - DNA, 25 bp, Mus musculus
gcatccagcagaggaaaggagagtg

SEQ ID NO: 305328 - DNA, 25 bp, Mus musculus
gcatccagcagaggtgcagttaaaa

SEQ ID NO: 305329 - DNA, 25 bp, Mus musculus
gcatccaggaacctctcctcctggc

SEQ ID NO: 305330 - DNA, 25 bp, Mus musculus
gcatccagggatgcaggcagcctct

SEQ ID NO: 305331 - DNA, 25 bp, Mus musculus
gcatccagggatgttaattttacac

SEQ ID NO: 305332 - DNA, 25 bp, Mus musculus
gcatccatctacaggcctgtccact

SEQ ID NO: 305333 - DNA, 25 bp, Mus musculus
gcatccatgcagtattcaagagaca

SEQ ID NO: 305334 - DNA, 25 bp, Mus musculus
gcatccatgttcgacaccacgcccc

SEQ ID NO: 305335 - DNA, 25 bp, Mus musculus
gcatccatgttcgagtgctaaggat

SEQ ID NO: 305336 - DNA, 25 bp, Mus musculus
gcatcccacagggtggtcatgatca

SEQ ID NO: 305337 - DNA, 25 bp, Mus musculus
gcatcccaccaccgggtgtgatgaa

SEQ ID NO: 305338 - DNA, 25 bp, Mus musculus
gcatcccagctggaagcaggagagg

SEQ ID NO: 305339 - DNA, 25 bp, Mus musculus
gcatcccagctgtcgctgactcccc

SEQ ID NO: 305340 - DNA, 25 bp, Mus musculus
gcatccccatcaagaaatctgaccc

SEQ ID NO: 305341 - DNA, 25 bp, Mus musculus
gcatcccccggaatggtgaagtgtg

SEQ ID NO: 305342 - DNA, 25 bp, Mus musculus
gcatcccctaggacccccactcagg

SEQ ID NO: 305343 - DNA, 25 bp, Mus musculus
gcatcccctagggagctccgggagc

SEQ ID NO: 305344 - DNA, 25 bp, Mus musculus
gcatcccgactgtgatctgtgagtc

SEQ ID NO: 305345 - DNA, 25 bp, Mus musculus
gcatcccgagatgacacgaatttat

SEQ ID NO: 305346 - DNA, 25 bp, Mus musculus
gcatcccgaggtgtttacaattgaa

SEQ ID NO: 305347 - DNA, 25 bp, Mus musculus
gcatcccgtttcaagaaagtatgag

SEQ ID NO: 305348 - DNA, 25 bp, Mus musculus
gcatccctaccattctgtccggtcg

SEQ ID NO: 305349 - DNA, 25 bp, Mus musculus
gcatccctgagaacacaccagtggg

SEQ ID NO: 305350 - DNA, 25 bp, Mus musculus
gcatccctgaggtcttccacaccca

SEQ ID NO: 305351 - DNA, 25 bp, Mus musculus
gcatccctgcaggggcctgtgtatg

SEQ ID NO: 305352 - DNA, 25 bp, Mus musculus
gcatccctggaccaggtgaaaaaag

SEQ ID NO: 305353 - DNA, 25 bp, Mus musculus
gcatccctgtggcaggtgaccttgg

SEQ ID NO: 305354 - DNA, 25 bp, Mus musculus
gcatccctgtggcagtggaggtgaa

SEQ ID NO: 305355 - DNA, 25 bp, Mus musculus
gcatcccttgaggagttaccaaata

SEQ ID NO: 305356 - DNA, 25 bp, Mus musculus
gcatccgaccagacagatggatacc

SEQ ID NO: 305357 - DNA, 25 bp, Mus musculus
gcatccgaccagcttttttaaacag

SEQ ID NO: 305358 - DNA, 25 bp, Mus musculus
gcatccgaccaggatggcttcccca

SEQ ID NO: 305359 - DNA, 25 bp, Mus musculus
gcatccgagggcggtggaggaacag

SEQ ID NO: 305360 - DNA, 25 bp, Mus musculus
gcatccgccacgccgtctgggtaca

SEQ ID NO: 305361 - DNA, 25 bp, Mus musculus
gcatccgggactaggctctgtaggc

SEQ ID NO: 305362 - DNA, 25 bp, Mus musculus
gcatccgtaagggcaccagcgtcta

SEQ ID NO: 305363 - DNA, 25 bp, Mus musculus
gcatccgtatcaactcaacaaggac

SEQ ID NO: 305364 - DNA, 25 bp, Mus musculus
gcatccgtatcaagacatgttcagc

SEQ ID NO: 305365 - DNA, 25 bp, Mus musculus
gcatccgtatcaagacatgttcagt

SEQ ID NO: 305366 - DNA, 25 bp, Mus musculus
gcatccgtgaggtatttgaatatca

SEQ ID NO: 305367 - DNA, 25 bp, Mus musculus
gcatcctaaatcagctgctgaaatc

SEQ ID NO: 305368 - DNA, 25 bp, Mus musculus
gcatcctaaatcaggtcatggtttt

SEQ ID NO: 305369 - DNA, 25 bp, Mus musculus
gcatcctaggccagtctccctatga

SEQ ID NO: 305370 - DNA, 25 bp, Mus musculus
gcatcctcaagaggaagcccgtgct

SEQ ID NO: 305371 - DNA, 25 bp, Mus musculus
gcatcctcaaggacacccagttgca

SEQ ID NO: 305372 - DNA, 25 bp, Mus musculus
gcatcctcagctctgggccccagaa

SEQ ID NO: 305373 - DNA, 25 bp, Mus musculus
gcatcctccaagaggcggagtcgcc

SEQ ID NO: 305374 - DNA, 25 bp, Mus musculus
gcatcctctcctggtggagagagcc

SEQ ID NO: 305375 - DNA, 25 bp, Mus musculus
gcatcctctctgaggtgacccctac

SEQ ID NO: 305376 - DNA, 25 bp, Mus musculus
gcatcctgaaagatcttggtgggct

SEQ ID NO: 305377 - DNA, 25 bp, Mus musculus
gcatcctgaaagggctgtgcggaca

SEQ ID NO: 305378 - DNA, 25 bp, Mus musculus
gcatcctgaagaagcacgcccactg

SEQ ID NO: 305379 - DNA, 25 bp, Mus musculus
gcatcctgagcgcgagaactttcaa

SEQ ID NO: 305380 - DNA, 25 bp, Mus musculus
gcatcctgccagccaggagacacaa

SEQ ID NO: 305381 - DNA, 25 bp, Mus musculus
gcatcctgccgtggtgaaggcattt

SEQ ID NO: 305382 - DNA, 25 bp, Mus musculus
gcatcctggcaggggacccagccgt

SEQ ID NO: 305383 - DNA, 25 bp, Mus musculus
gcatcctggtccagggctaagtctg

SEQ ID NO: 305384 - DNA, 25 bp, Mus musculus
gcatcctggtttgggtccgtgttca

SEQ ID NO: 305385 - DNA, 25 bp, Mus musculus
gcatcctgtcccgaaacaagccttc

SEQ ID NO: 305386 - DNA, 25 bp, Mus musculus
gcatcctgttgcgcagcgtctcctg

SEQ ID NO: 305387 - DNA, 25 bp, Mus musculus
gcatccttatcagacgaaagagcct

SEQ ID NO: 305388 - DNA, 25 bp, Mus musculus
gcatccttcaggtctccagatgagg

SEQ ID NO: 305389 - DNA, 25 bp, Mus musculus
gcatccttcgaatgctgactccctt

SEQ ID NO: 305390 - DNA, 25 bp, Mus musculus
gcatccttgactccaagcggggctc

SEQ ID NO: 305391 - DNA, 25 bp, Mus musculus
gcatccttgctattgctcctgggcc

SEQ ID NO: 305392 - DNA, 25 bp, Mus musculus
gcatcgaagcgtttgatgactccgg

SEQ ID NO: 305393 - DNA, 25 bp, Mus musculus
gcatcgaagcgtttgcaatcccgga

SEQ ID NO: 305394 - DNA, 25 bp, Mus musculus
gcatcgaagcgtttggctccttccg

SEQ ID NO: 305395 - DNA, 25 bp, Mus musculus
gcatcgaccgcaaggtcaactcctg

SEQ ID NO: 305396 - DNA, 25 bp, Mus musculus
gcatcgacttcaaggacacagcagg

SEQ ID NO: 305397 - DNA, 25 bp, Mus musculus
gcatcgactttgaaggacaaattgc

SEQ ID NO: 305398 - DNA, 25 bp, Mus musculus
gcatcgactttgaaggtccttgctg

SEQ ID NO: 305399 - DNA, 25 bp, Mus musculus
gcatcgagaggagtggctcaggagt

SEQ ID NO: 305400 - DNA, 25 bp, Mus musculus
gcatcgagctggaatacgtctacaa

SEQ ID NO: 305401 - DNA, 25 bp, Mus musculus
gcatcgagggggctacccgactctt

SEQ ID NO: 305402 - DNA, 25 bp, Mus musculus
gcatcgatttgactttattgactac

SEQ ID NO: 305403 - DNA, 25 bp, Mus musculus
gcatcgcaaggaaactcattttcag

SEQ ID NO: 305404 - DNA, 25 bp, Mus musculus
gcatcgcaaggcctctgcaggtgtc

SEQ ID NO: 305405 - DNA, 25 bp, Mus musculus
gcatcgcaagggtactggcggagga

SEQ ID NO: 305406 - DNA, 25 bp, Mus musculus
gcatcgcacagctctatggtatcgc

SEQ ID NO: 305407 - DNA, 25 bp, Mus musculus
gcatcgcacaggaagggactgagac

SEQ ID NO: 305408 - DNA, 25 bp, Mus musculus
gcatcgcagagttgacatcctgctg

SEQ ID NO: 305409 - DNA, 25 bp, Mus musculus
gcatcgcaggacacgaaaactgtcc

SEQ ID NO: 305410 - DNA, 25 bp, Mus musculus
gcatcgccgaaaagaaatggaagat

SEQ ID NO: 305411 - DNA, 25 bp, Mus musculus
gcatcgcctgcagggcatggaacaa

SEQ ID NO: 305412 - DNA, 25 bp, Mus musculus
gcatcgcggaggatcggtcatggga

SEQ ID NO: 305413 - DNA, 25 bp, Mus musculus
gcatcgcggggtggcgggacgggat

SEQ ID NO: 305414 - DNA, 25 bp, Mus musculus
gcatcgctggtgaggaaccacagcg

SEQ ID NO: 305415 - DNA, 25 bp, Mus musculus
gcatcgctggtgggggcgctcctgg

SEQ ID NO: 305416 - DNA, 25 bp, Mus musculus
gcatcgcttagcagacgcttaaagg

SEQ ID NO: 305417 - DNA, 25 bp, Mus musculus
gcatcggaaccatggctagcctctg

SEQ ID NO: 305418 - DNA, 25 bp, Mus musculus
gcatcggaaccatgtgaaaccttcc

SEQ ID NO: 305419 - DNA, 25 bp, Mus musculus
gcatcggaagcctggacaaactact

SEQ ID NO: 305420 - DNA, 25 bp, Mus musculus
gcatcggatgctggggctgcacgaa

SEQ ID NO: 305421 - DNA, 25 bp, Mus musculus
gcatcggcaagctggtcgtttgatg

SEQ ID NO: 305422 - DNA, 25 bp, Mus musculus
gcatcggcaggacagcagcgctctc

SEQ ID NO: 305423 - DNA, 25 bp, Mus musculus
gcatcggggacaagggtgacaaggg

SEQ ID NO: 305424 - DNA, 25 bp, Mus musculus
gcatcggtgcccctgaccccatgac

SEQ ID NO: 305425 - DNA, 25 bp, Mus musculus
gcatcggtggcggaagctggaatgc

SEQ ID NO: 305426 - DNA, 25 bp, Mus musculus
gcatcgtcaagaccactgggaggca

SEQ ID NO: 305427 - DNA, 25 bp, Mus musculus
gcatcgtcaagagccgcctgcacca

SEQ ID NO: 305428 - DNA, 25 bp, Mus musculus
gcatcgtcacatgatcatggatata

SEQ ID NO: 305429 - DNA, 25 bp, Mus musculus
gcatcgtcagacagcacatcgtcag

SEQ ID NO: 305430 - DNA, 25 bp, Mus musculus
gcatcgtcagacagctacagcacat

SEQ ID NO: 305431 - DNA, 25 bp, Mus musculus
gcatcgtcccagcggctgaccaagg

SEQ ID NO: 305432 - DNA, 25 bp, Mus musculus
gcatcgtgaaggagatgctccgctg

SEQ ID NO: 305433 - DNA, 25 bp, Mus musculus
gcatcgtgcaccgcctgacccccag

SEQ ID NO: 305434 - DNA, 25 bp, Mus musculus
gcatcgtgcaccgggatttaaagtt

SEQ ID NO: 305435 - DNA, 25 bp, Mus musculus
gcatcgtgctccagtgtggcgctga

SEQ ID NO: 305436 - DNA, 25 bp, Mus musculus
gcatcgtggaagccttgccatgcag

SEQ ID NO: 305437 - DNA, 25 bp, Mus musculus
gcatcgtggaagtggaaaacccagg

SEQ ID NO: 305438 - DNA, 25 bp, Mus musculus
gcatcgtgggagggaatagccagag

SEQ ID NO: 305439 - DNA, 25 bp, Mus musculus
gcatcgttcttccacccaaggaccc

SEQ ID NO: 305440 - DNA, 25 bp, Mus musculus
gcatcgttcttccagccaaggaccc

SEQ ID NO: 305441 - DNA, 25 bp, Mus musculus
gcatcgttcttgctggtgcactgcc

SEQ ID NO: 305442 - DNA, 25 bp, Mus musculus
gcatctaatatgaaggaagtactta

SEQ ID NO: 305443 - DNA, 25 bp, Mus musculus
gcatctaattcagatcatgattctg

SEQ ID NO: 305444 - DNA, 25 bp, Mus musculus
gcatctacaaggctcacttgtatag

SEQ ID NO: 305445 - DNA, 25 bp, Mus musculus
gcatctacaagggcgccaaagcatg

SEQ ID NO: 305446 - DNA, 25 bp, Mus musculus
gcatctacgacaggctcatcagcgg

SEQ ID NO: 305447 - DNA, 25 bp, Mus musculus
gcatctacttacggctggcccgctc

SEQ ID NO: 305448 - DNA, 25 bp, Mus musculus
gcatctacttcagctgcgtgcagaa

SEQ ID NO: 305449 - DNA, 25 bp, Mus musculus
gcatctaggaggctttgatgaggcc

SEQ ID NO: 305450 - DNA, 25 bp, Mus musculus
gcatctagtaatgacaagccctcat

SEQ ID NO: 305451 - DNA, 25 bp, Mus musculus
gcatctagtgcaggtgagtgcagga

SEQ ID NO: 305452 - DNA, 25 bp, Mus musculus
gcatctagtttgactaccaaaggag

SEQ ID NO: 305453 - DNA, 25 bp, Mus musculus
gcatctatacaggtgacctcttggt

SEQ ID NO: 305454 - DNA, 25 bp, Mus musculus
gcatctatagcctggctcggttctc

SEQ ID NO: 305455 - DNA, 25 bp, Mus musculus
gcatctatcaagggagcaccatcat

SEQ ID NO: 305456 - DNA, 25 bp, Mus musculus
gcatctatgaggagaaccatggctc

SEQ ID NO: 305457 - DNA, 25 bp, Mus musculus
gcatctatgctaccctaggaaggag

SEQ ID NO: 305458 - DNA, 25 bp, Mus musculus
gcatctattgattagtacaaacagg

SEQ ID NO: 305459 - DNA, 25 bp, Mus musculus
gcatctcaagaacactcaccagtct

SEQ ID NO: 305460 - DNA, 25 bp, Mus musculus
gcatctcaagagttctatccaggac

SEQ ID NO: 305461 - DNA, 25 bp, Mus musculus
gcatctcaagcaaaacgaagagatg

SEQ ID NO: 305462 - DNA, 25 bp, Mus musculus
gcatctcaagcccaagcagtagctg

SEQ ID NO: 305463 - DNA, 25 bp, Mus musculus
gcatctcaagcctccagaggtgaag

SEQ ID NO: 305464 - DNA, 25 bp, Mus musculus
gcatctcaagcctccggtcagcggc

SEQ ID NO: 305465 - DNA, 25 bp, Mus musculus
gcatctcacaagttagccctagaac

SEQ ID NO: 305466 - DNA, 25 bp, Mus musculus
gcatctcactgcaatgcctgtcacc

SEQ ID NO: 305467 - DNA, 25 bp, Mus musculus
gcatctcactggtggagctggcaac

SEQ ID NO: 305468 - DNA, 25 bp, Mus musculus
gcatctcagcaagatggagcgggta

SEQ ID NO: 305469 - DNA, 25 bp, Mus musculus
gcatctcagcaaggtgatctgggga

SEQ ID NO: 305470 - DNA, 25 bp, Mus musculus
gcatctcagctgcctttggcaacct

SEQ ID NO: 305471 - DNA, 25 bp, Mus musculus
gcatctccaggtcccacctgctcgc

SEQ ID NO: 305472 - DNA, 25 bp, Mus musculus
gcatctcgacagcgcggagacgcgt

SEQ ID NO: 305473 - DNA, 25 bp, Mus musculus
gcatctctcggattgggctatccca

SEQ ID NO: 305474 - DNA, 25 bp, Mus musculus
gcatctctgagctcatgacccatat

SEQ ID NO: 305475 - DNA, 25 bp, Mus musculus
gcatctctgaggtccgatctgaccg

SEQ ID NO: 305476 - DNA, 25 bp, Mus musculus
gcatctgaagaggtggccatggccc

SEQ ID NO: 305477 - DNA, 25 bp, Mus musculus
gcatctgaaggtctgccttgaccat

SEQ ID NO: 305478 - DNA, 25 bp, Mus musculus
gcatctgagaacggtgatgctagcg

SEQ ID NO: 305479 - DNA, 25 bp, Mus musculus
gcatctgagagcaaccaggacctga

SEQ ID NO: 305480 - DNA, 25 bp, Mus musculus
gcatctgagaggtggactctgtgcc

SEQ ID NO: 305481 - DNA, 25 bp, Mus musculus
gcatctgagccttctaggaaagatg

SEQ ID NO: 305482 - DNA, 25 bp, Mus musculus
gcatctgagtgatataaaaacaact

SEQ ID NO: 305483 - DNA, 25 bp, Mus musculus
gcatctgatgatggtcgggtgagag

SEQ ID NO: 305484 - DNA, 25 bp, Mus musculus
gcatctgcaaggaaggttggcagcg

SEQ ID NO: 305485 - DNA, 25 bp, Mus musculus
gcatctgccaacagacccagtgttg

SEQ ID NO: 305486 - DNA, 25 bp, Mus musculus
gcatctgccaacaggaatgggtagg

SEQ ID NO: 305487 - DNA, 25 bp, Mus musculus
gcatctgccagaaagtgacagcatc

SEQ ID NO: 305488 - DNA, 25 bp, Mus musculus
gcatctgcctcattgtacaagtctc

SEQ ID NO: 305489 - DNA, 25 bp, Mus musculus
gcatctgcctgcaccgtactagctg

SEQ ID NO: 305490 - DNA, 25 bp, Mus musculus
gcatctgcctgctgggctcagtggc

SEQ ID NO: 305491 - DNA, 25 bp, Mus musculus
gcatctggaaagacaggagcttatc

SEQ ID NO: 305492 - DNA, 25 bp, Mus musculus
gcatctggaaaggtttccaaaatgc

SEQ ID NO: 305493 - DNA, 25 bp, Mus musculus
gcatctggaagtgagagttcattgt

SEQ ID NO: 305494 - DNA, 25 bp, Mus musculus
gcatctggagaccaggttctctgcc

SEQ ID NO: 305495 - DNA, 25 bp, Mus musculus
gcatctgggaagaagccaccatggg

SEQ ID NO: 305496 - DNA, 25 bp, Mus musculus
gcatctggttttaggtccagcgagc

SEQ ID NO: 305497 - DNA, 25 bp, Mus musculus
gcatctgtaacatcttctcacatca

SEQ ID NO: 305498 - DNA, 25 bp, Mus musculus
gcatctgtaatagcaggatgctggt

SEQ ID NO: 305499 - DNA, 25 bp, Mus musculus
gcatctgtaataggtgtgtgctgaa

SEQ ID NO: 305500 - DNA, 25 bp, Mus musculus
gcatctgtgagatggcagcctactt

SEQ ID NO: 305501 - DNA, 25 bp, Mus musculus
gcatctgtgcagggtgatagcacac

SEQ ID NO: 305502 - DNA, 25 bp, Mus musculus
gcatctgtgggcatgtatttaattt

SEQ ID NO: 305503 - DNA, 25 bp, Mus musculus
gcatctgtggtggttctttcagcta

SEQ ID NO: 305504 - DNA, 25 bp, Mus musculus
gcatctgttgaattgtggaacaagc

SEQ ID NO: 305505 - DNA, 25 bp, Mus musculus
gcatctgttgacttgactgaaaact

SEQ ID NO: 305506 - DNA, 25 bp, Mus musculus
gcatctgttgggccagagggcatca

SEQ ID NO: 305507 - DNA, 25 bp, Mus musculus
gcatcttatctctgtgtgtgccgac

SEQ ID NO: 305508 - DNA, 25 bp, Mus musculus
gcatcttcaactccgagctggaatt

SEQ ID NO: 305509 - DNA, 25 bp, Mus musculus
gcatcttcaggcttctcggctgatt

SEQ ID NO: 305510 - DNA, 25 bp, Mus musculus
gcatcttccagtcaaaagaatcctc

SEQ ID NO: 305511 - DNA, 25 bp, Mus musculus
gcatcttcggcttcagtgtgtgata

SEQ ID NO: 305512 - DNA, 25 bp, Mus musculus
gcatcttctctgcagaccggcccaa

SEQ ID NO: 305513 - DNA, 25 bp, Mus musculus
gcatcttctggtaaatccatttctg

SEQ ID NO: 305514 - DNA, 25 bp, Mus musculus
gcatcttgaaggtaagtgacctgcg

SEQ ID NO: 305515 - DNA, 25 bp, Mus musculus
gcatcttgacaagacagaggagggc

SEQ ID NO: 305516 - DNA, 25 bp, Mus musculus
gcatcttgcagaagaacatgtttgg

SEQ ID NO: 305517 - DNA, 25 bp, Mus musculus
gcatcttgcagaagagtcaggagct

SEQ ID NO: 305518 - DNA, 25 bp, Mus musculus
gcatcttgcagaccatgctcaagct

SEQ ID NO: 305519 - DNA, 25 bp, Mus musculus
gcatcttgcagaggaggatgactct

SEQ ID NO: 305520 - DNA, 25 bp, Mus musculus
gcatcttgctcctgcactggtgcag

SEQ ID NO: 305521 - DNA, 25 bp, Mus musculus
gcatcttggctggtggctaccaagg

SEQ ID NO: 305522 - DNA, 25 bp, Mus musculus
gcatcttgggagaagtatgcttcca

SEQ ID NO: 305523 - DNA, 25 bp, Mus musculus
gcatcttgggagaagtttcttctag

SEQ ID NO: 305524 - DNA, 25 bp, Mus musculus
gcatctttagagcaggtttaaacgc

SEQ ID NO: 305525 - DNA, 25 bp, Mus musculus
gcatctttatggaaagagtatggca

SEQ ID NO: 305526 - DNA, 25 bp, Mus musculus
gcatctttcatgataaaggtgatca

SEQ ID NO: 305527 - DNA, 25 bp, Mus musculus
gcatctttccttcggacgctgaacc

SEQ ID NO: 305528 - DNA, 25 bp, Mus musculus
gcatctttggaatgcacaagcccag

SEQ ID NO: 305529 - DNA, 25 bp, Mus musculus
gcatgaaaaggcccttgctgctgga

SEQ ID NO: 305530 - DNA, 25 bp, Mus musculus
gcatgaaactcgactccagggaagt

SEQ ID NO: 305531 - DNA, 25 bp, Mus musculus
gcatgaaaggatcttctacctgctg

SEQ ID NO: 305532 - DNA, 25 bp, Mus musculus
gcatgaaaggcacatacttggtaca

SEQ ID NO: 305533 - DNA, 25 bp, Mus musculus
gcatgaaccaagatgaatgagcgcc

SEQ ID NO: 305534 - DNA, 25 bp, Mus musculus
gcatgaaccaagatgctgtgcagaa

SEQ ID NO: 305535 - DNA, 25 bp, Mus musculus
gcatgaacgggtgtgactctctttt

SEQ ID NO: 305536 - DNA, 25 bp, Mus musculus
gcatgaagaaaggctacagcaggag

SEQ ID NO: 305537 - DNA, 25 bp, Mus musculus
gcatgaagaagcctccaggactgag

SEQ ID NO: 305538 - DNA, 25 bp, Mus musculus
gcatgaagacaaatcagagcgagag

SEQ ID NO: 305539 - DNA, 25 bp, Mus musculus
gcatgaagacataccgacgcttgct

SEQ ID NO: 305540 - DNA, 25 bp, Mus musculus
gcatgaagaccaacagaacttgacg

SEQ ID NO: 305541 - DNA, 25 bp, Mus musculus
gcatgaagcggtgttcgaggaatat

SEQ ID NO: 305542 - DNA, 25 bp, Mus musculus
gcatgaagctgagtgaagatggcac

SEQ ID NO: 305543 - DNA, 25 bp, Mus musculus
gcatgaaggcagagttctttgcaga

SEQ ID NO: 305544 - DNA, 25 bp, Mus musculus
gcatgaagtagacaccatccatgtg

SEQ ID NO: 305545 - DNA, 25 bp, Mus musculus
gcatgaagtagagaccatccatgtg

SEQ ID NO: 305546 - DNA, 25 bp, Mus musculus
gcatgaagtcccagtggccagtgaa

SEQ ID NO: 305547 - DNA, 25 bp, Mus musculus
gcatgaagttgcaagaagacaccct

SEQ ID NO: 305548 - DNA, 25 bp, Mus musculus
gcatgaagttgccagaaggagaagc

SEQ ID NO: 305549 - DNA, 25 bp, Mus musculus
gcatgaatatacagagtaagtctca

SEQ ID NO: 305550 - DNA, 25 bp, Mus musculus
gcatgaatcttcaggggctggctgt

SEQ ID NO: 305551 - DNA, 25 bp, Mus musculus
gcatgacaaccagggtggtgccccc

SEQ ID NO: 305552 - DNA, 25 bp, Mus musculus
gcatgacaccatgcctgctgacaag

SEQ ID NO: 305553 - DNA, 25 bp, Mus musculus
gcatgacactaaacatggagtggat

SEQ ID NO: 305554 - DNA, 25 bp, Mus musculus
gcatgaccaagatgccaaagacccg

SEQ ID NO: 305555 - DNA, 25 bp, Mus musculus
gcatgaccaaggtacttcctggact

SEQ ID NO: 305556 - DNA, 25 bp, Mus musculus
gcatgaccaagttcatgaagcctgg

SEQ ID NO: 305557 - DNA, 25 bp, Mus musculus
gcatgaccagtgtagtccatggaag

SEQ ID NO: 305558 - DNA, 25 bp, Mus musculus
gcatgacctcaccgactctgcaaag

SEQ ID NO: 305559 - DNA, 25 bp, Mus musculus
gcatgacctcaccgtgatcaacttt

SEQ ID NO: 305560 - DNA, 25 bp, Mus musculus
gcatgacgtgttcgagaaccgttac

SEQ ID NO: 305561 - DNA, 25 bp, Mus musculus
gcatgagacacacgcgcttgttctc

SEQ ID NO: 305562 - DNA, 25 bp, Mus musculus
gcatgagacgggaagctgtacagag

SEQ ID NO: 305563 - DNA, 25 bp, Mus musculus
gcatgagcaagcacgtcgcgtttgg

SEQ ID NO: 305564 - DNA, 25 bp, Mus musculus
gcatgagcagaaagatcagtatgca

SEQ ID NO: 305565 - DNA, 25 bp, Mus musculus
gcatgagcagaaaggacaaagccca

SEQ ID NO: 305566 - DNA, 25 bp, Mus musculus
gcatgagcaggctactgccctgtga

SEQ ID NO: 305567 - DNA, 25 bp, Mus musculus
gcatgagcagtaccccctggccttt

SEQ ID NO: 305568 - DNA, 25 bp, Mus musculus
gcatgagcagtcgatggctgtgtac

SEQ ID NO: 305569 - DNA, 25 bp, Mus musculus
gcatgagcctcagggccccttaggc

SEQ ID NO: 305570 - DNA, 25 bp, Mus musculus
gcatgagcggatatgaccaagtttt

SEQ ID NO: 305571 - DNA, 25 bp, Mus musculus
gcatgagcggatatggtagccaagg

SEQ ID NO: 305572 - DNA, 25 bp, Mus musculus
gcatgagctccaagagctgttagct

SEQ ID NO: 305573 - DNA, 25 bp, Mus musculus
gcatgaggaaagacatgatactgtc

SEQ ID NO: 305574 - DNA, 25 bp, Mus musculus
gcatgaggagaagcctatgggaagg

SEQ ID NO: 305575 - DNA, 25 bp, Mus musculus
gcatgaggagctgaggagagaacat

SEQ ID NO: 305576 - DNA, 25 bp, Mus musculus
gcatgaggctgctggcgttccccga

SEQ ID NO: 305577 - DNA, 25 bp, Mus musculus
gcatgagggaggagtgtgtgctgtc

SEQ ID NO: 305578 - DNA, 25 bp, Mus musculus
gcatgagtggagccagagaacagct

SEQ ID NO: 305579 - DNA, 25 bp, Mus musculus
gcatgagttctgaatgtgatgttgg

SEQ ID NO: 305580 - DNA, 25 bp, Mus musculus
gcatgatatagataccaagtggtag

SEQ ID NO: 305581 - DNA, 25 bp, Mus musculus
gcatgatataggacagaaattggga

SEQ ID NO: 305582 - DNA, 25 bp, Mus musculus
gcatgatatggttccttgttcccat

SEQ ID NO: 305583 - DNA, 25 bp, Mus musculus
gcatgatcttgctattgaagtggac

SEQ ID NO: 305584 - DNA, 25 bp, Mus musculus
gcatgatctttagaagactgctgga

SEQ ID NO: 305585 - DNA, 25 bp, Mus musculus
gcatgatgagaaaggggaggagcgc

SEQ ID NO: 305586 - DNA, 25 bp, Mus musculus
gcatgatgcagaggccaagaagata

SEQ ID NO: 305587 - DNA, 25 bp, Mus musculus
gcatgatgccccagcaaacacaatt

SEQ ID NO: 305588 - DNA, 25 bp, Mus musculus
gcatgatgccccaggaaacacaatt

SEQ ID NO: 305589 - DNA, 25 bp, Mus musculus
gcatgatgcggagaatataggcaaa

SEQ ID NO: 305590 - DNA, 25 bp, Mus musculus
gcatgatgtgaggcactaagtgacc

SEQ ID NO: 305591 - DNA, 25 bp, Mus musculus
gcatgatgttcaaacacttcgacaa

SEQ ID NO: 305592 - DNA, 25 bp, Mus musculus
gcatgcacaggaaaagttattgatg

SEQ ID NO: 305593 - DNA, 25 bp, Mus musculus
gcatgcacatgtctcgaattatcaa

SEQ ID NO: 305594 - DNA, 25 bp, Mus musculus
gcatgcactaggaggaatttggcta

SEQ ID NO: 305595 - DNA, 25 bp, Mus musculus
gcatgcagaacagtcacagcggagt

SEQ ID NO: 305596 - DNA, 25 bp, Mus musculus
gcatgcagagacagatttgatcaaa

SEQ ID NO: 305597 - DNA, 25 bp, Mus musculus
gcatgcagagcagggtgggccagcg

SEQ ID NO: 305598 - DNA, 25 bp, Mus musculus
gcatgcagatggagatgcagcctta

SEQ ID NO: 305599 - DNA, 25 bp, Mus musculus
gcatgcagatgggggcagagatgca

SEQ ID NO: 305600 - DNA, 25 bp, Mus musculus
gcatgcagcaatgttgctttgtgtt

SEQ ID NO: 305601 - DNA, 25 bp, Mus musculus
gcatgcagcacccaatgatgatcat

SEQ ID NO: 305602 - DNA, 25 bp, Mus musculus
gcatgcagcaccctgccagtggccc

SEQ ID NO: 305603 - DNA, 25 bp, Mus musculus
gcatgcagcacctgatagctcggga

SEQ ID NO: 305604 - DNA, 25 bp, Mus musculus
gcatgcagcgactggctctggtcct

SEQ ID NO: 305605 - DNA, 25 bp, Mus musculus
gcatgcagtattagtgctacagcct

SEQ ID NO: 305606 - DNA, 25 bp, Mus musculus
gcatgcagtcagacttctccaaggt

SEQ ID NO: 305607 - DNA, 25 bp, Mus musculus
gcatgcagtcagtgcagcccttcgc

SEQ ID NO: 305608 - DNA, 25 bp, Mus musculus
gcatgcagttaagagaacagcacat

SEQ ID NO: 305609 - DNA, 25 bp, Mus musculus
gcatgcagttaagaggatcgctgca

SEQ ID NO: 305610 - DNA, 25 bp, Mus musculus
gcatgcatgcatgtggtcaacctgt

SEQ ID NO: 305611 - DNA, 25 bp, Mus musculus
gcatgcatgtccaggttctcacgcg

SEQ ID NO: 305612 - DNA, 25 bp, Mus musculus
gcatgccaaattagtgcatgaagtt

SEQ ID NO: 305613 - DNA, 25 bp, Mus musculus
gcatgccaaggaggagtcagacaca

SEQ ID NO: 305614 - DNA, 25 bp, Mus musculus
gcatgccaaggaggtgagacggaag

SEQ ID NO: 305615 - DNA, 25 bp, Mus musculus
gcatgccagaaggaggcggcgctct

SEQ ID NO: 305616 - DNA, 25 bp, Mus musculus
gcatgccaggcaagaaaaggaacac

SEQ ID NO: 305617 - DNA, 25 bp, Mus musculus
gcatgccatcactggccgagctctg

SEQ ID NO: 305618 - DNA, 25 bp, Mus musculus
gcatgccatcgctgcattctgctct

SEQ ID NO: 305619 - DNA, 25 bp, Mus musculus
gcatgcccagctcaagaaggggaac

SEQ ID NO: 305620 - DNA, 25 bp, Mus musculus
gcatgcccaggctcctgctcctcaa

SEQ ID NO: 305621 - DNA, 25 bp, Mus musculus
gcatgccctgggagacggggttgac

SEQ ID NO: 305622 - DNA, 25 bp, Mus musculus
gcatgccgagatggcacgttttgtg

SEQ ID NO: 305623 - DNA, 25 bp, Mus musculus
gcatgcctgtgctagacagtgtgct

SEQ ID NO: 305624 - DNA, 25 bp, Mus musculus
gcatgcgcaggtggtggagctggtc

SEQ ID NO: 305625 - DNA, 25 bp, Mus musculus
gcatgcggacaggcctgagtacttc

SEQ ID NO: 305626 - DNA, 25 bp, Mus musculus
gcatgcggacaggccttgttttcat

SEQ ID NO: 305627 - DNA, 25 bp, Mus musculus
gcatgcgtcagtggtcgcagacact

SEQ ID NO: 305628 - DNA, 25 bp, Mus musculus
gcatgcgtgatctgggtactgtggc

SEQ ID NO: 305629 - DNA, 25 bp, Mus musculus
gcatgctaatagaagtagtccccac

SEQ ID NO: 305630 - DNA, 25 bp, Mus musculus
gcatgctaataggccaggtggttgc

SEQ ID NO: 305631 - DNA, 25 bp, Mus musculus
gcatgctaatagggaagaccgggcc

SEQ ID NO: 305632 - DNA, 25 bp, Mus musculus
gcatgctcatggtgggcagcaatgc

SEQ ID NO: 305633 - DNA, 25 bp, Mus musculus
gcatgctcggggggaaggcccaaac

SEQ ID NO: 305634 - DNA, 25 bp, Mus musculus
gcatgctctacgagaaataccgaca

SEQ ID NO: 305635 - DNA, 25 bp, Mus musculus
gcatgctgatgccattctatttatt

SEQ ID NO: 305636 - DNA, 25 bp, Mus musculus
gcatgctgatgccttagacttgcag

SEQ ID NO: 305637 - DNA, 25 bp, Mus musculus
gcatgctgccagggcaccagcgtct

SEQ ID NO: 305638 - DNA, 25 bp, Mus musculus
gcatgctgccccagggttcttttag

SEQ ID NO: 305639 - DNA, 25 bp, Mus musculus
gcatgctgccccaggttgtgtggag

SEQ ID NO: 305640 - DNA, 25 bp, Mus musculus
gcatgctggagaatcttctctgtcc

SEQ ID NO: 305641 - DNA, 25 bp, Mus musculus
gcatgctggaggtacgctggatcgc

SEQ ID NO: 305642 - DNA, 25 bp, Mus musculus
gcatgctggcgatgcccctagacct

SEQ ID NO: 305643 - DNA, 25 bp, Mus musculus
gcatgctgggatagctcaggttttc

SEQ ID NO: 305644 - DNA, 25 bp, Mus musculus
gcatgctggtcaaagatgacctgga

SEQ ID NO: 305645 - DNA, 25 bp, Mus musculus
gcatgcttctgcccaggtgagaggt

SEQ ID NO: 305646 - DNA, 25 bp, Mus musculus
gcatgctttagagtgatgatgactg

SEQ ID NO: 305647 - DNA, 25 bp, Mus musculus
gcatgctttcatgagcatgtttttg

SEQ ID NO: 305648 - DNA, 25 bp, Mus musculus
gcatggaaacaggtttaatcttgtt

SEQ ID NO: 305649 - DNA, 25 bp, Mus musculus
gcatggaaacagtcaccaaggagct

SEQ ID NO: 305650 - DNA, 25 bp, Mus musculus
gcatggaaaggaagttggcagtatc

SEQ ID NO: 305651 - DNA, 25 bp, Mus musculus
gcatggaactaagctctggggtctg

SEQ ID NO: 305652 - DNA, 25 bp, Mus musculus
gcatggaagccaaggtgaaagccgc

SEQ ID NO: 305653 - DNA, 25 bp, Mus musculus
gcatggaaggcatgggtcccgagca

SEQ ID NO: 305654 - DNA, 25 bp, Mus musculus
gcatggaagtgtgattttaaaaatg

SEQ ID NO: 305655 - DNA, 25 bp, Mus musculus
gcatggaagtgttctgtacctcact

SEQ ID NO: 305656 - DNA, 25 bp, Mus musculus
gcatggaccagctccatttctgaca

SEQ ID NO: 305657 - DNA, 25 bp, Mus musculus
gcatggaccatggtggagtttggga

SEQ ID NO: 305658 - DNA, 25 bp, Mus musculus
gcatggacccgatagcctcggccct

SEQ ID NO: 305659 - DNA, 25 bp, Mus musculus
gcatggacgagatggcagttgagtt

SEQ ID NO: 305660 - DNA, 25 bp, Mus musculus
gcatggagccagaccactcggccct

SEQ ID NO: 305661 - DNA, 25 bp, Mus musculus
gcatggagtacgtgtttgactacga

SEQ ID NO: 305662 - DNA, 25 bp, Mus musculus
gcatggagtatcaggatgctgtgcg

SEQ ID NO: 305663 - DNA, 25 bp, Mus musculus
gcatggatatgaggtccagagattc

SEQ ID NO: 305664 - DNA, 25 bp, Mus musculus
gcatggatctgcctgcgatctaggg

SEQ ID NO: 305665 - DNA, 25 bp, Mus musculus
gcatggatctgcctggtacaactgt

SEQ ID NO: 305666 - DNA, 25 bp, Mus musculus
gcatggatgaagaactcgacagccc

SEQ ID NO: 305667 - DNA, 25 bp, Mus musculus
gcatggatgaaggcaagctacagtt

SEQ ID NO: 305668 - DNA, 25 bp, Mus musculus
gcatggatgaaggctagctacagtt

SEQ ID NO: 305669 - DNA, 25 bp, Mus musculus
gcatggatgagttggcagagttggg

SEQ ID NO: 305670 - DNA, 25 bp, Mus musculus
gcatggatggagtgacggatgacga

SEQ ID NO: 305671 - DNA, 25 bp, Mus musculus
gcatggattcagaaaattaatgagt

SEQ ID NO: 305672 - DNA, 25 bp, Mus musculus
gcatggcacccaggcacggagggag

SEQ ID NO: 305673 - DNA, 25 bp, Mus musculus
gcatggcacccaggcgcgaagggag

SEQ ID NO: 305674 - DNA, 25 bp, Mus musculus
gcatggcacccaggtacgcagggaa

SEQ ID NO: 305675 - DNA, 25 bp, Mus musculus
gcatggcagagcaccttaaggatgt

SEQ ID NO: 305676 - DNA, 25 bp, Mus musculus
gcatggcagagctccaggccgggcc

SEQ ID NO: 305677 - DNA, 25 bp, Mus musculus
gcatggcagaggctcctcttccaga

SEQ ID NO: 305678 - DNA, 25 bp, Mus musculus
gcatggccgaccgcattccagagga

SEQ ID NO: 305679 - DNA, 25 bp, Mus musculus
gcatggcctcagaagctcgaagcgg

SEQ ID NO: 305680 - DNA, 25 bp, Mus musculus
gcatggctagctcgtgtgccgtgca

SEQ ID NO: 305681 - DNA, 25 bp, Mus musculus
gcatggctcaggaattttattgagc

SEQ ID NO: 305682 - DNA, 25 bp, Mus musculus
gcatggctcaggcaagtcttctggc

SEQ ID NO: 305683 - DNA, 25 bp, Mus musculus
gcatggcttaaacgccataacccag

SEQ ID NO: 305684 - DNA, 25 bp, Mus musculus
gcatggcttttgcaggtctgacagc

SEQ ID NO: 305685 - DNA, 25 bp, Mus musculus
gcatgggaagcaaatgaagaagcac

SEQ ID NO: 305686 - DNA, 25 bp, Mus musculus
gcatgggagagttgcagcttcatat

SEQ ID NO: 305687 - DNA, 25 bp, Mus musculus
gcatgggaggaagggagatataaac

SEQ ID NO: 305688 - DNA, 25 bp, Mus musculus
gcatgggatacatgccttctgccag

SEQ ID NO: 305689 - DNA, 25 bp, Mus musculus
gcatgggatatgaggtgcagcagaa

SEQ ID NO: 305690 - DNA, 25 bp, Mus musculus
gcatgggatggagagtctgtattgt

SEQ ID NO: 305691 - DNA, 25 bp, Mus musculus
gcatgggatgggggacagctgttgt

SEQ ID NO: 305692 - DNA, 25 bp, Mus musculus
gcatgggcacagtgaccccagtttt

SEQ ID NO: 305693 - DNA, 25 bp, Mus musculus
gcatgggcagacacagccctggacc

SEQ ID NO: 305694 - DNA, 25 bp, Mus musculus
gcatgggcagaggtatatgtggttg

SEQ ID NO: 305695 - DNA, 25 bp, Mus musculus
gcatgggctacatgccctcagccag

SEQ ID NO: 305696 - DNA, 25 bp, Mus musculus
gcatgggctacatggcctcttcctg

SEQ ID NO: 305697 - DNA, 25 bp, Mus musculus
gcatgggctacattgcacacttgaa

SEQ ID NO: 305698 - DNA, 25 bp, Mus musculus
gcatgggctctttgggtatgtgcag

SEQ ID NO: 305699 - DNA, 25 bp, Mus musculus
gcatgggcttgtcaaaccagtccag

SEQ ID NO: 305700 - DNA, 25 bp, Mus musculus
gcatggggcagccaggctggggatg

SEQ ID NO: 305701 - DNA, 25 bp, Mus musculus
gcatggggcagccagtcttcctgtc

SEQ ID NO: 305702 - DNA, 25 bp, Mus musculus
gcatggggcggcgtcgcggctttac

SEQ ID NO: 305703 - DNA, 25 bp, Mus musculus
gcatgggtcaggttttctactattc

SEQ ID NO: 305704 - DNA, 25 bp, Mus musculus
gcatgggtttgtcaaaccagtccag

SEQ ID NO: 305705 - DNA, 25 bp, Mus musculus
gcatggtagaaagatctaaaggggt

SEQ ID NO: 305706 - DNA, 25 bp, Mus musculus
gcatggtagaaaggcctttgtagat

SEQ ID NO: 305707 - DNA, 25 bp, Mus musculus
gcatggtagttacagccaacggtaa

SEQ ID NO: 305708 - DNA, 25 bp, Mus musculus
gcatggtagttacaggtcataaaag

SEQ ID NO: 305709 - DNA, 25 bp, Mus musculus
gcatggtataaggatgacatcgttc

SEQ ID NO: 305710 - DNA, 25 bp, Mus musculus
gcatggtgaacgcttctagggacct

SEQ ID NO: 305711 - DNA, 25 bp, Mus musculus
gcatggtgaacgggacctattaaaa

SEQ ID NO: 305712 - DNA, 25 bp, Mus musculus
gcatggtgacatggtcccggaagat

SEQ ID NO: 305713 - DNA, 25 bp, Mus musculus
gcatggtgcagtctgttgtctactg

SEQ ID NO: 305714 - DNA, 25 bp, Mus musculus
gcatggtgttatcaagctgaggatt

SEQ ID NO: 305715 - DNA, 25 bp, Mus musculus
gcatggttaaccagagtcctggatg

SEQ ID NO: 305716 - DNA, 25 bp, Mus musculus
gcatggttcctgctctgcacctcag

SEQ ID NO: 305717 - DNA, 25 bp, Mus musculus
gcatggtttggatttgcgggaacgc

SEQ ID NO: 305718 - DNA, 25 bp, Mus musculus
gcatgtacactaaggtaagaaatcc

SEQ ID NO: 305719 - DNA, 25 bp, Mus musculus
gcatgtagagtgatcgatggctgcg

SEQ ID NO: 305720 - DNA, 25 bp, Mus musculus
gcatgtagatatggcagacgaggca

SEQ ID NO: 305721 - DNA, 25 bp, Mus musculus
gcatgtatccagaggatgttgggca

SEQ ID NO: 305722 - DNA, 25 bp, Mus musculus
gcatgtcacagagcacttttaataa

SEQ ID NO: 305723 - DNA, 25 bp, Mus musculus
gcatgtcacagagcagaatgattgg

SEQ ID NO: 305724 - DNA, 25 bp, Mus musculus
gcatgtcaccctgatggtgcccctt

SEQ ID NO: 305725 - DNA, 25 bp, Mus musculus
gcatgtcaccctgccgtggatgctg

SEQ ID NO: 305726 - DNA, 25 bp, Mus musculus
gcatgtcaccctggactggtggcct

SEQ ID NO: 305727 - DNA, 25 bp, Mus musculus
gcatgtcaccctgtgctgaaggctg

SEQ ID NO: 305728 - DNA, 25 bp, Mus musculus
gcatgtcatctacatagaccagccc

SEQ ID NO: 305729 - DNA, 25 bp, Mus musculus
gcatgtcatctacatagaccaggac

SEQ ID NO: 305730 - DNA, 25 bp, Mus musculus
gcatgtccagctgcccgagagattt

SEQ ID NO: 305731 - DNA, 25 bp, Mus musculus
gcatgtccaggttctcacgcggttt

SEQ ID NO: 305732 - DNA, 25 bp, Mus musculus
gcatgtcggctaccttgagaggcag

SEQ ID NO: 305733 - DNA, 25 bp, Mus musculus
gcatgtctaagccaatcaaagttgt

SEQ ID NO: 305734 - DNA, 25 bp, Mus musculus
gcatgtctacaagcatttgtcaagg

SEQ ID NO: 305735 - DNA, 25 bp, Mus musculus
gcatgtctcagagcttggatctgtc

SEQ ID NO: 305736 - DNA, 25 bp, Mus musculus
gcatgtctgacctgtcaaactgggc

SEQ ID NO: 305737 - DNA, 25 bp, Mus musculus
gcatgtgaaagactggaagaagcgc

SEQ ID NO: 305738 - DNA, 25 bp, Mus musculus
gcatgtgaaagccctctcaccagca

SEQ ID NO: 305739 - DNA, 25 bp, Mus musculus
gcatgtgacagacctcactcacagc

SEQ ID NO: 305740 - DNA, 25 bp, Mus musculus
gcatgtgacagataattcacagaac

SEQ ID NO: 305741 - DNA, 25 bp, Mus musculus
gcatgtgacctctctatcacggact

SEQ ID NO: 305742 - DNA, 25 bp, Mus musculus
gcatgtgactcaagctcgtgtggcc

SEQ ID NO: 305743 - DNA, 25 bp, Mus musculus
gcatgtgcgggtctatgaatgagcc

SEQ ID NO: 305744 - DNA, 25 bp, Mus musculus
gcatgtggagaagtctggtgcctct

SEQ ID NO: 305745 - DNA, 25 bp, Mus musculus
gcatgtggctcgacatgaacgaacc

SEQ ID NO: 305746 - DNA, 25 bp, Mus musculus
gcatgtgggccgtttctgcttccct

SEQ ID NO: 305747 - DNA, 25 bp, Mus musculus
gcatgtggggccaggtgtcctgtcc

SEQ ID NO: 305748 - DNA, 25 bp, Mus musculus
gcatgtggtcaaggacttaatgggc

SEQ ID NO: 305749 - DNA, 25 bp, Mus musculus
gcatgtggtcaaggttcttgcagaa

SEQ ID NO: 305750 - DNA, 25 bp, Mus musculus
gcatgtgtaggacccagccacctcc

SEQ ID NO: 305751 - DNA, 25 bp, Mus musculus
gcatgtgtcatctttccaaagaaca

SEQ ID NO: 305752 - DNA, 25 bp, Mus musculus
gcatgtgtccatcctgtcctcagcc

SEQ ID NO: 305753 - DNA, 25 bp, Mus musculus
gcatgtgtggctgacctgatcgcct

SEQ ID NO: 305754 - DNA, 25 bp, Mus musculus
gcatgttcttggaaacctgatatct

SEQ ID NO: 305755 - DNA, 25 bp, Mus musculus
gcatgttgcggctgaagaacgggaa

SEQ ID NO: 305756 - DNA, 25 bp, Mus musculus
gcatgttgcggctgagtggagattc

SEQ ID NO: 305757 - DNA, 25 bp, Mus musculus
gcatgttggaagttcccatggccgg

SEQ ID NO: 305758 - DNA, 25 bp, Mus musculus
gcatgttggagcctgctatgggatg

SEQ ID NO: 305759 - DNA, 25 bp, Mus musculus
gcatgttggagcttcaaggagaaac

SEQ ID NO: 305760 - DNA, 25 bp, Mus musculus
gcatgttggaggtaataaagctctt

SEQ ID NO: 305761 - DNA, 25 bp, Mus musculus
gcatgttgtcagggcctaagatcac

SEQ ID NO: 305762 - DNA, 25 bp, Mus musculus
gcatgttgtcaggggaagagatggc

SEQ ID NO: 305763 - DNA, 25 bp, Mus musculus
gcatgttgtccggcattggaagaag

SEQ ID NO: 305764 - DNA, 25 bp, Mus musculus
gcatgtttacagtggccggcctcat

SEQ ID NO: 305765 - DNA, 25 bp, Mus musculus
gcatgtttacagttaggtgacagca

SEQ ID NO: 305766 - DNA, 25 bp, Mus musculus
gcatgtttattagtggaatctttgg

SEQ ID NO: 305767 - DNA, 25 bp, Mus musculus
gcatgtttcaggtggtttgttgaag

SEQ ID NO: 305768 - DNA, 25 bp, Mus musculus
gcatgtttggaaaggatcgtgaact

SEQ ID NO: 305769 - DNA, 25 bp, Mus musculus
gcattaaacaggacattcaccttgc

SEQ ID NO: 305770 - DNA, 25 bp, Mus musculus
gcattaaatcagcaagccccgccca

SEQ ID NO: 305771 - DNA, 25 bp, Mus musculus
gcattaaatgccaaacacactggct

SEQ ID NO: 305772 - DNA, 25 bp, Mus musculus
gcattaaatgccaatccttcccagt

SEQ ID NO: 305773 - DNA, 25 bp, Mus musculus
gcattaacaggagaagggaagaaat

SEQ ID NO: 305774 - DNA, 25 bp, Mus musculus
gcattaataacagaagaaattaaag

SEQ ID NO: 305775 - DNA, 25 bp, Mus musculus
gcattaattcaaaaaagatcattca

SEQ ID NO: 305776 - DNA, 25 bp, Mus musculus
gcattacaagcccacagagcagttc

SEQ ID NO: 305777 - DNA, 25 bp, Mus musculus
gcattacaagccttcccgctccatc

SEQ ID NO: 305778 - DNA, 25 bp, Mus musculus
gcattacaggaagggtctgcttggt

SEQ ID NO: 305779 - DNA, 25 bp, Mus musculus
gcattacaggaaggtgtcagacaaa

SEQ ID NO: 305780 - DNA, 25 bp, Mus musculus
gcattacctggttcataagccagaa

SEQ ID NO: 305781 - DNA, 25 bp, Mus musculus
gcattaccttggttctgaccagaaa

SEQ ID NO: 305782 - DNA, 25 bp, Mus musculus
gcattacgtcatgtactatgagatg

SEQ ID NO: 305783 - DNA, 25 bp, Mus musculus
gcattactaatcaaaatacgcctac

SEQ ID NO: 305784 - DNA, 25 bp, Mus musculus
gcattactaatcaaagtggacccaa

SEQ ID NO: 305785 - DNA, 25 bp, Mus musculus
gcattactcagagaaagctgatggt

SEQ ID NO: 305786 - DNA, 25 bp, Mus musculus
gcattactcagagagagccgcaggt

SEQ ID NO: 305787 - DNA, 25 bp, Mus musculus
gcattagaaaagaatctaaagggat

SEQ ID NO: 305788 - DNA, 25 bp, Mus musculus
gcattagatatgactgaaatggcaa

SEQ ID NO: 305789 - DNA, 25 bp, Mus musculus
gcattagatgaagaattcatcctac

SEQ ID NO: 305790 - DNA, 25 bp, Mus musculus
gcattagcagcattcacagctctga

SEQ ID NO: 305791 - DNA, 25 bp, Mus musculus
gcattagcagggttggtttccccca

SEQ ID NO: 305792 - DNA, 25 bp, Mus musculus
gcattagtgggtttgatgaccctgt

SEQ ID NO: 305793 - DNA, 25 bp, Mus musculus
gcattatcaacgagtactgtattgg

SEQ ID NO: 305794 - DNA, 25 bp, Mus musculus
gcattatccactcaattttaaagaa

SEQ ID NO: 305795 - DNA, 25 bp, Mus musculus
gcattatctggtgaccatctcggtg

SEQ ID NO: 305796 - DNA, 25 bp, Mus musculus
gcattatggactggcatgcacacaa

SEQ ID NO: 305797 - DNA, 25 bp, Mus musculus
gcattatgtctggatctcttagagc

SEQ ID NO: 305798 - DNA, 25 bp, Mus musculus
gcattatgtgatggctgcaccccat

SEQ ID NO: 305799 - DNA, 25 bp, Mus musculus
gcattatgtgatgtactacgagatg

SEQ ID NO: 305800 - DNA, 25 bp, Mus musculus
gcattcacagacacggctaaggaag

SEQ ID NO: 305801 - DNA, 25 bp, Mus musculus
gcattcacagggtacagatttattt

SEQ ID NO: 305802 - DNA, 25 bp, Mus musculus
gcattcagaagatgacttacaagat

SEQ ID NO: 305803 - DNA, 25 bp, Mus musculus
gcattcagacaagattttcgaaaat

SEQ ID NO: 305804 - DNA, 25 bp, Mus musculus
gcattcagaggtggggtaagtgcct

SEQ ID NO: 305805 - DNA, 25 bp, Mus musculus
gcattcaggggtgattcagacaagt

SEQ ID NO: 305806 - DNA, 25 bp, Mus musculus
gcattcagtgaaggatttgaacttt

SEQ ID NO: 305807 - DNA, 25 bp, Mus musculus
gcattcatgcggaaagacgtgcgag

SEQ ID NO: 305808 - DNA, 25 bp, Mus musculus
gcattcatgcggatgcgttttgact

SEQ ID NO: 305809 - DNA, 25 bp, Mus musculus
gcattccagaaagtatgcagccctg

SEQ ID NO: 305810 - DNA, 25 bp, Mus musculus
gcattccagaaagtatgcagccctt

SEQ ID NO: 305811 - DNA, 25 bp, Mus musculus
gcattccccaatggtccatttactc

SEQ ID NO: 305812 - DNA, 25 bp, Mus musculus
gcattccccggaagacgaagagccg

SEQ ID NO: 305813 - DNA, 25 bp, Mus musculus
gcattccccggaagcactctgacac

SEQ ID NO: 305814 - DNA, 25 bp, Mus musculus
gcattcctggaacagactaaggctg

SEQ ID NO: 305815 - DNA, 25 bp, Mus musculus
gcattcctttggcttccctcatcag

SEQ ID NO: 305816 - DNA, 25 bp, Mus musculus
gcattcgcaaaggaacgggagatgg

SEQ ID NO: 305817 - DNA, 25 bp, Mus musculus
gcattcgcaaaggacgcatggaata

SEQ ID NO: 305818 - DNA, 25 bp, Mus musculus
gcattcgccgagcactagcgctggg

SEQ ID NO: 305819 - DNA, 25 bp, Mus musculus
gcattcgccgagccgagatactact

SEQ ID NO: 305820 - DNA, 25 bp, Mus musculus
gcattctacaggcggcagaaacagc

SEQ ID NO: 305821 - DNA, 25 bp, Mus musculus
gcattctaccccagacaagaataag

SEQ ID NO: 305822 - DNA, 25 bp, Mus musculus
gcattctaccccagttcccaaagtg

SEQ ID NO: 305823 - DNA, 25 bp, Mus musculus
gcattctcagcatggtgagacacaa

SEQ ID NO: 305824 - DNA, 25 bp, Mus musculus
gcattctccattccatttctgggct

SEQ ID NO: 305825 - DNA, 25 bp, Mus musculus
gcattctcctggtgcagatcactgg

SEQ ID NO: 305826 - DNA, 25 bp, Mus musculus
gcattctgcaagtgggtgggaccat

SEQ ID NO: 305827 - DNA, 25 bp, Mus musculus
gcattctggctgcagcagtgaaggc

SEQ ID NO: 305828 - DNA, 25 bp, Mus musculus
gcattctgggggtcaaccggatgca

SEQ ID NO: 305829 - DNA, 25 bp, Mus musculus
gcattcttaatttaccgagagaaag

SEQ ID NO: 305830 - DNA, 25 bp, Mus musculus
gcattcttcaagagtttatccatgc

SEQ ID NO: 305831 - DNA, 25 bp, Mus musculus
gcattcttcccttagaccgtcacga

SEQ ID NO: 305832 - DNA, 25 bp, Mus musculus
gcattgacataggctcgttcaggcc

SEQ ID NO: 305833 - DNA, 25 bp, Mus musculus
gcattgacatagggaacgtctagct

SEQ ID NO: 305834 - DNA, 25 bp, Mus musculus
gcattgagacgtccgagatacccgt

SEQ ID NO: 305835 - DNA, 25 bp, Mus musculus
gcattgagcagttggtaagtggaga

SEQ ID NO: 305836 - DNA, 25 bp, Mus musculus
gcattgaggcaaagaacctagccag

SEQ ID NO: 305837 - DNA, 25 bp, Mus musculus
gcattgatagacagatcctacttct

SEQ ID NO: 305838 - DNA, 25 bp, Mus musculus
gcattgatgaccagagttacaagca

SEQ ID NO: 305839 - DNA, 25 bp, Mus musculus
gcattgatgcgtgcagggcgacagt

SEQ ID NO: 305840 - DNA, 25 bp, Mus musculus
gcattgatgggaagaaccagcaaga

SEQ ID NO: 305841 - DNA, 25 bp, Mus musculus
gcattgattaatggaccacagacca

SEQ ID NO: 305842 - DNA, 25 bp, Mus musculus
gcattgcacaagaaaagaaggctgc

SEQ ID NO: 305843 - DNA, 25 bp, Mus musculus
gcattgcagacctgggactggctgt

SEQ ID NO: 305844 - DNA, 25 bp, Mus musculus
gcattgcatgcagcgtgcagggtcg

SEQ ID NO: 305845 - DNA, 25 bp, Mus musculus
gcattgccaaggcgttcgtgcctcc

SEQ ID NO: 305846 - DNA, 25 bp, Mus musculus
gcattgccaataaagttctttgtga

SEQ ID NO: 305847 - DNA, 25 bp, Mus musculus
gcattgccaataaatcagagtcctc

SEQ ID NO: 305848 - DNA, 25 bp, Mus musculus
gcattgccatggaccgctcctttga

SEQ ID NO: 305849 - DNA, 25 bp, Mus musculus
gcattgcccaggtgaaaatccaggg

SEQ ID NO: 305850 - DNA, 25 bp, Mus musculus
gcattgcccaggtgcactggagtgg

SEQ ID NO: 305851 - DNA, 25 bp, Mus musculus
gcattgcccgcccatgtgcctcctc

SEQ ID NO: 305852 - DNA, 25 bp, Mus musculus
gcattgcctgctccccacactcctg

SEQ ID NO: 305853 - DNA, 25 bp, Mus musculus
gcattgctaaaagaggcatccacca

SEQ ID NO: 305854 - DNA, 25 bp, Mus musculus
gcattgctctccagtccctgccgcc

SEQ ID NO: 305855 - DNA, 25 bp, Mus musculus
gcattgctgaagatacgccaatgtc

SEQ ID NO: 305856 - DNA, 25 bp, Mus musculus
gcattgctgaaggaatttgagcagt

SEQ ID NO: 305857 - DNA, 25 bp, Mus musculus
gcattgctgaccaaggagagagatg

SEQ ID NO: 305858 - DNA, 25 bp, Mus musculus
gcattgctgaccaaggcattggaat

SEQ ID NO: 305859 - DNA, 25 bp, Mus musculus
gcattgctgaggttgaaaatgagga

SEQ ID NO: 305860 - DNA, 25 bp, Mus musculus
gcattgctgtctctgaaaaatgaat

SEQ ID NO: 305861 - DNA, 25 bp, Mus musculus
gcattgcttacaagattccgggctt

SEQ ID NO: 305862 - DNA, 25 bp, Mus musculus
gcattgcttacaaggccacagtgaa

SEQ ID NO: 305863 - DNA, 25 bp, Mus musculus
gcattggaactgaggatttctcagc

SEQ ID NO: 305864 - DNA, 25 bp, Mus musculus
gcattggaagagtgtatcctcagag

SEQ ID NO: 305865 - DNA, 25 bp, Mus musculus
gcattggacagattgtccttctgaa

SEQ ID NO: 305866 - DNA, 25 bp, Mus musculus
gcattggaccagttttcagagctga

SEQ ID NO: 305867 - DNA, 25 bp, Mus musculus
gcattggatcttctgcgtgctggtc

SEQ ID NO: 305868 - DNA, 25 bp, Mus musculus
gcattggatcttttgggatgactgg

SEQ ID NO: 305869 - DNA, 25 bp, Mus musculus
gcattggcggaggtgtggacctcgt

SEQ ID NO: 305870 - DNA, 25 bp, Mus musculus
gcattggcgtcccccatccacctga

SEQ ID NO: 305871 - DNA, 25 bp, Mus musculus
gcattgggattccaggcatagtcag

SEQ ID NO: 305872 - DNA, 25 bp, Mus musculus
gcattggtctcatctgccatggtga

SEQ ID NO: 305873 - DNA, 25 bp, Mus musculus
gcattggtctcatctgtctgcaatc

SEQ ID NO: 305874 - DNA, 25 bp, Mus musculus
gcattggtgatgttatctatgcggg

SEQ ID NO: 305875 - DNA, 25 bp, Mus musculus
gcattgtaactctggttttcttatc

SEQ ID NO: 305876 - DNA, 25 bp, Mus musculus
gcattgtacagaggcctatggattt

SEQ ID NO: 305877 - DNA, 25 bp, Mus musculus
gcattgtacagagggatgaaatgca

SEQ ID NO: 305878 - DNA, 25 bp, Mus musculus
gcattgtaggagcagtttctccacc

SEQ ID NO: 305879 - DNA, 25 bp, Mus musculus
gcattgtccaggagcgccccttgtg

SEQ ID NO: 305880 - DNA, 25 bp, Mus musculus
gcattgtgaaagctcgtccctgccc

SEQ ID NO: 305881 - DNA, 25 bp, Mus musculus
gcattgtgaaagggcagcggagcct

SEQ ID NO: 305882 - DNA, 25 bp, Mus musculus
gcattgtgagagctgtggaacgacg

SEQ ID NO: 305883 - DNA, 25 bp, Mus musculus
gcattgtgagagtgaaaagcttttg

SEQ ID NO: 305884 - DNA, 25 bp, Mus musculus
gcattgtgaggggagctgttgtgga

SEQ ID NO: 305885 - DNA, 25 bp, Mus musculus
gcattgtgaggggtgttctgtagtg

SEQ ID NO: 305886 - DNA, 25 bp, Mus musculus
gcattgttatccagatggtttcaag

SEQ ID NO: 305887 - DNA, 25 bp, Mus musculus
gcattgttcgaggaaatgctgtcat

SEQ ID NO: 305888 - DNA, 25 bp, Mus musculus
gcatttaaatcgttctgatgaacaa

SEQ ID NO: 305889 - DNA, 25 bp, Mus musculus
gcatttaatgcctcctgcctgtcct

SEQ ID NO: 305890 - DNA, 25 bp, Mus musculus
gcatttacacccagcaatcccagga

SEQ ID NO: 305891 - DNA, 25 bp, Mus musculus
gcatttaccgctcccctgagaacac

SEQ ID NO: 305892 - DNA, 25 bp, Mus musculus
gcatttaccgctcccctggttctgg

SEQ ID NO: 305893 - DNA, 25 bp, Mus musculus
gcatttactgagaaacatggtgaag

SEQ ID NO: 305894 - DNA, 25 bp, Mus musculus
gcatttagaatgcacaaaacaactt

SEQ ID NO: 305895 - DNA, 25 bp, Mus musculus
gcatttagagagacactgtactaca

SEQ ID NO: 305896 - DNA, 25 bp, Mus musculus
gcatttcaagacccactccctctcc

SEQ ID NO: 305897 - DNA, 25 bp, Mus musculus
gcatttcaaggagaaatacccagat

SEQ ID NO: 305898 - DNA, 25 bp, Mus musculus
gcatttcaagggtctcatataccct

SEQ ID NO: 305899 - DNA, 25 bp, Mus musculus
gcatttcaatacgcgctaccctgat

SEQ ID NO: 305900 - DNA, 25 bp, Mus musculus
gcatttcacagctattgtccaggga

SEQ ID NO: 305901 - DNA, 25 bp, Mus musculus
gcatttcagcagagactaaaggaga

SEQ ID NO: 305902 - DNA, 25 bp, Mus musculus
gcatttccggaatgcaggtttcaaa

SEQ ID NO: 305903 - DNA, 25 bp, Mus musculus
gcatttcctcacaacaaacaattgt

SEQ ID NO: 305904 - DNA, 25 bp, Mus musculus
gcatttcctcacctccatctgctaa

SEQ ID NO: 305905 - DNA, 25 bp, Mus musculus
gcatttcctggcagcactgtccatc

SEQ ID NO: 305906 - DNA, 25 bp, Mus musculus
gcatttcctggcagcctcgggatgg

SEQ ID NO: 305907 - DNA, 25 bp, Mus musculus
gcatttctacagaacctgctttcag

SEQ ID NO: 305908 - DNA, 25 bp, Mus musculus
gcatttctatcgcaggcacatcaat

SEQ ID NO: 305909 - DNA, 25 bp, Mus musculus
gcatttctatcgcatgaagataagc

SEQ ID NO: 305910 - DNA, 25 bp, Mus musculus
gcatttctatcgggttcatagtggc

SEQ ID NO: 305911 - DNA, 25 bp, Mus musculus
gcatttctatcggtatccgccccca

SEQ ID NO: 305912 - DNA, 25 bp, Mus musculus
gcatttctcaaaaactgttctgcaa

SEQ ID NO: 305913 - DNA, 25 bp, Mus musculus
gcatttctcaaatcatctgaaaagg

SEQ ID NO: 305914 - DNA, 25 bp, Mus musculus
gcatttctcaggaaacacgatgggc

SEQ ID NO: 305915 - DNA, 25 bp, Mus musculus
gcatttctcttgtgatgaggagact

SEQ ID NO: 305916 - DNA, 25 bp, Mus musculus
gcatttctcttgtgctgccacaggt

SEQ ID NO: 305917 - DNA, 25 bp, Mus musculus
gcatttgagacagttccgacgagat

SEQ ID NO: 305918 - DNA, 25 bp, Mus musculus
gcatttgagtgacaaagtctacagg

SEQ ID NO: 305919 - DNA, 25 bp, Mus musculus
gcatttgattaaagcaccgtgaaga

SEQ ID NO: 305920 - DNA, 25 bp, Mus musculus
gcatttgcaggtcgctatgcatttc

SEQ ID NO: 305921 - DNA, 25 bp, Mus musculus
gcatttgcgttctcaggatccaaag

SEQ ID NO: 305922 - DNA, 25 bp, Mus musculus
gcatttgcgttctcgagcttcatgg

SEQ ID NO: 305923 - DNA, 25 bp, Mus musculus
gcatttgctgttctgtgattcttac

SEQ ID NO: 305924 - DNA, 25 bp, Mus musculus
gcatttggaatctcaaggatgtcac

SEQ ID NO: 305925 - DNA, 25 bp, Mus musculus
gcatttggaggagtatagaacattg

SEQ ID NO: 305926 - DNA, 25 bp, Mus musculus
gcatttggatgaggatggaagactg

SEQ ID NO: 305927 - DNA, 25 bp, Mus musculus
gcatttggcagagagcactccccat

SEQ ID NO: 305928 - DNA, 25 bp, Mus musculus
gcatttggcataattccaagaaaca

SEQ ID NO: 305929 - DNA, 25 bp, Mus musculus
gcatttggtgttcccttgccaagaa

SEQ ID NO: 305930 - DNA, 25 bp, Mus musculus
gcatttgtataagagagttctggag

SEQ ID NO: 305931 - DNA, 25 bp, Mus musculus
gcatttgtataaggtactgggaaga

SEQ ID NO: 305932 - DNA, 25 bp, Mus musculus
gcatttgtcctgggaacagaaattc

SEQ ID NO: 305933 - DNA, 25 bp, Mus musculus
gcatttgtgacaaagcccaatggcg

SEQ ID NO: 305934 - DNA, 25 bp, Mus musculus
gcattttaaggaagatccttggaaa

SEQ ID NO: 305935 - DNA, 25 bp, Mus musculus
gcattttaaggagcataaacatctg

SEQ ID NO: 305936 - DNA, 25 bp, Mus musculus
gcattttaaggagtgcatgcgggag

SEQ ID NO: 305937 - DNA, 25 bp, Mus musculus
gcattttactccagatggcagactt

SEQ ID NO: 305938 - DNA, 25 bp, Mus musculus
gcattttactccagccctggctgtc

SEQ ID NO: 305939 - DNA, 25 bp, Mus musculus
gcattttcacagggaacaagtttac

SEQ ID NO: 305940 - DNA, 25 bp, Mus musculus
gcattttcacgacatccatggggtg

SEQ ID NO: 305941 - DNA, 25 bp, Mus musculus
gcattttcctgaagataggacggga

SEQ ID NO: 305942 - DNA, 25 bp, Mus musculus
gcattttctagaaaatggaactatc

SEQ ID NO: 305943 - DNA, 25 bp, Mus musculus
gcattttctagatggaagctctatc

SEQ ID NO: 305944 - DNA, 25 bp, Mus musculus
gcattttctggggaatgaattccac

SEQ ID NO: 305945 - DNA, 25 bp, Mus musculus
gcattttcttggggctccagccttc

SEQ ID NO: 305946 - DNA, 25 bp, Mus musculus
gcattttgagaaagcaattgagctg

SEQ ID NO: 305947 - DNA, 25 bp, Mus musculus
gcattttgaggctaagacccttcgg

SEQ ID NO: 305948 - DNA, 25 bp, Mus musculus
gcattttgaggctatcagtgacgag

SEQ ID NO: 305949 - DNA, 25 bp, Mus musculus
gcattttgaggttttctctgtgtag

SEQ ID NO: 305950 - DNA, 25 bp, Mus musculus
gcattttgccggaacccagataatg

SEQ ID NO: 305951 - DNA, 25 bp, Mus musculus
gcatttttcaataatgtatatttac

SEQ ID NO: 305952 - DNA, 25 bp, Mus musculus
gcatttttcaggtcacctgccctgg

SEQ ID NO: 305953 - DNA, 25 bp, Mus musculus
gcatttttcagtccaaagaatcatc

SEQ ID NO: 305954 - DNA, 25 bp, Mus musculus
gcatttttgacagagctgtcgcagc

SEQ ID NO: 305955 - DNA, 25 bp, Mus musculus
gccaaaaaaaggagctgggggacag

SEQ ID NO: 305956 - DNA, 25 bp, Mus musculus
gccaaaaagagcttggacagagtgg

SEQ ID NO: 305957 - DNA, 25 bp, Mus musculus
gccaaaaagagtgtgcaaagaccca

SEQ ID NO: 305958 - DNA, 25 bp, Mus musculus
gccaaaaaggagaactacctctcgg

SEQ ID NO: 305959 - DNA, 25 bp, Mus musculus
gccaaaaaggaggtcctgagttcaa

SEQ ID NO: 305960 - DNA, 25 bp, Mus musculus
gccaaaaatcgagaatttatagcta

SEQ ID NO: 305961 - DNA, 25 bp, Mus musculus
gccaaaacagatgaagaaccacctc

SEQ ID NO: 305962 - DNA, 25 bp, Mus musculus
gccaaaaccctgaggccacaagaag

SEQ ID NO: 305963 - DNA, 25 bp, Mus musculus
gccaaaaccctgctatcttccagat

SEQ ID NO: 305964 - DNA, 25 bp, Mus musculus
gccaaaataaaggattcacagaaat

SEQ ID NO: 305965 - DNA, 25 bp, Mus musculus
gccaaaataatgacaccattctaat

SEQ ID NO: 305966 - DNA, 25 bp, Mus musculus
gccaaaatcatgctgacacccagtg

SEQ ID NO: 305967 - DNA, 25 bp, Mus musculus
gccaaaatgatgaagaaaatactca

SEQ ID NO: 305968 - DNA, 25 bp, Mus musculus
gccaaaatgatggatgcatccctaa

SEQ ID NO: 305969 - DNA, 25 bp, Mus musculus
gccaaaattagatcatagcagtctg

SEQ ID NO: 305970 - DNA, 25 bp, Mus musculus
gccaaaattgaagagaatcaaaagg

SEQ ID NO: 305971 - DNA, 25 bp, Mus musculus
gccaaaattgccaagcctgtctcgc

SEQ ID NO: 305972 - DNA, 25 bp, Mus musculus
gccaaaattgccaaggcagaagagg

SEQ ID NO: 305973 - DNA, 25 bp, Mus musculus
gccaaacaaagagagctggaaagtc

SEQ ID NO: 305974 - DNA, 25 bp, Mus musculus
gccaaacaagtgcgctctgaaaacc

SEQ ID NO: 305975 - DNA, 25 bp, Mus musculus
gccaaacaagtgcggtaattaccct

SEQ ID NO: 305976 - DNA, 25 bp, Mus musculus
gccaaacatgatactggatgatgga

SEQ ID NO: 305977 - DNA, 25 bp, Mus musculus
gccaaacccaaactggatcctctga

SEQ ID NO: 305978 - DNA, 25 bp, Mus musculus
gccaaacccaaggaggcggatgagt

SEQ ID NO: 305979 - DNA, 25 bp, Mus musculus
gccaaaccccaagaatctcgagaag

SEQ ID NO: 305980 - DNA, 25 bp, Mus musculus
gccaaaccccaaggagcggctgcaa

SEQ ID NO: 305981 - DNA, 25 bp, Mus musculus
gccaaactaggaaatgccgcttggg

SEQ ID NO: 305982 - DNA, 25 bp, Mus musculus
gccaaactcaaggaccaggcagcta

SEQ ID NO: 305983 - DNA, 25 bp, Mus musculus
gccaaactcaagttttggcaaggag

SEQ ID NO: 305984 - DNA, 25 bp, Mus musculus
gccaaactctggtggataccctccg

SEQ ID NO: 305985 - DNA, 25 bp, Mus musculus
gccaaactctggttcttctggttct

SEQ ID NO: 305986 - DNA, 25 bp, Mus musculus
gccaaactgctcaggaataaagctg

SEQ ID NO: 305987 - DNA, 25 bp, Mus musculus
gccaaacttcaagaagcatacagtt

SEQ ID NO: 305988 - DNA, 25 bp, Mus musculus
gccaaacttcaagaagtaccagtac

SEQ ID NO: 305989 - DNA, 25 bp, Mus musculus
gccaaacttttccagtgtgtccatt

SEQ ID NO: 305990 - DNA, 25 bp, Mus musculus
gccaaagaaaaaggaagactccaca

SEQ ID NO: 305991 - DNA, 25 bp, Mus musculus
gccaaagaagattcccagcgacacc

SEQ ID NO: 305992 - DNA, 25 bp, Mus musculus
gccaaagaagattgcagagttcaat

SEQ ID NO: 305993 - DNA, 25 bp, Mus musculus
gccaaagaagctcctatgctgttca

SEQ ID NO: 305994 - DNA, 25 bp, Mus musculus
gccaaagaaggctcggcgcatcccc

SEQ ID NO: 305995 - DNA, 25 bp, Mus musculus
gccaaagaagtatccgagttccagg

SEQ ID NO: 305996 - DNA, 25 bp, Mus musculus
gccaaagaccctatcgtcaacgtgt

SEQ ID NO: 305997 - DNA, 25 bp, Mus musculus
gccaaagacccttctggagaggtgt

SEQ ID NO: 305998 - DNA, 25 bp, Mus musculus
gccaaagaccttgagttgctggaac

SEQ ID NO: 305999 - DNA, 25 bp, Mus musculus
gccaaagactgcagagaacttcaga

SEQ ID NO: 306000 - DNA, 25 bp, Mus musculus
gccaaagagaagcagcttgtgaaaa

SEQ ID NO: 306001 - DNA, 25 bp, Mus musculus
gccaaagaggagatatttggaccag

SEQ ID NO: 306002 - DNA, 25 bp, Mus musculus
gccaaagagtggagttggagaaaac

SEQ ID NO: 306003 - DNA, 25 bp, Mus musculus
gccaaagagtggtgggcttatgcta

SEQ ID NO: 306004 - DNA, 25 bp, Mus musculus
gccaaagcaaaaatgaggagtggga

SEQ ID NO: 306005 - DNA, 25 bp, Mus musculus
gccaaagcaaggacgtccacgtctg

SEQ ID NO: 306006 - DNA, 25 bp, Mus musculus
gccaaagcacatgctccatttgctc

SEQ ID NO: 306007 - DNA, 25 bp, Mus musculus
gccaaagcagcttcctgccagaccc

SEQ ID NO: 306008 - DNA, 25 bp, Mus musculus
gccaaagcagggctgcaggtggagt

SEQ ID NO: 306009 - DNA, 25 bp, Mus musculus
gccaaagccctgaatggcttcaccc

SEQ ID NO: 306010 - DNA, 25 bp, Mus musculus
gccaaagcctacagacacagaggcc

SEQ ID NO: 306011 - DNA, 25 bp, Mus musculus
gccaaagcgagaagactgagaaaag

SEQ ID NO: 306012 - DNA, 25 bp, Mus musculus
gccaaagctgaatcgcggctggagt

SEQ ID NO: 306013 - DNA, 25 bp, Mus musculus
gccaaagctgagagacacagaagga

SEQ ID NO: 306014 - DNA, 25 bp, Mus musculus
gccaaaggatccgctggtgctcctg

SEQ ID NO: 306015 - DNA, 25 bp, Mus musculus
gccaaaggccccacaggctctgcag

SEQ ID NO: 306016 - DNA, 25 bp, Mus musculus
gccaaaggctatagggtcggtgatg

SEQ ID NO: 306017 - DNA, 25 bp, Mus musculus
gccaaaggctgcagatgcagccggt

SEQ ID NO: 306018 - DNA, 25 bp, Mus musculus
gccaaaggctgcagctcttaaccgg

SEQ ID NO: 306019 - DNA, 25 bp, Mus musculus
gccaaaggtaccagtggctacctcc

SEQ ID NO: 306020 - DNA, 25 bp, Mus musculus
gccaaagtgaagccgaagaagctga

SEQ ID NO: 306021 - DNA, 25 bp, Mus musculus
gccaaataagaacaactaggctgat

SEQ ID NO: 306022 - DNA, 25 bp, Mus musculus
gccaaataagacagtgaaatcggct

SEQ ID NO: 306023 - DNA, 25 bp, Mus musculus
gccaaatccccagtgaatggaactc

SEQ ID NO: 306024 - DNA, 25 bp, Mus musculus
gccaaatccttcgcgtctcagaata

SEQ ID NO: 306025 - DNA, 25 bp, Mus musculus
gccaaatctaaactgacccccgtca

SEQ ID NO: 306026 - DNA, 25 bp, Mus musculus
gccaaatctaaactggatcgaagta

SEQ ID NO: 306027 - DNA, 25 bp, Mus musculus
gccaaatcttctcagatcatagcag

SEQ ID NO: 306028 - DNA, 25 bp, Mus musculus
gccaaattaaatgccttgatgggaa

SEQ ID NO: 306029 - DNA, 25 bp, Mus musculus
gccaaattagtgcaggaaaacccaa

SEQ ID NO: 306030 - DNA, 25 bp, Mus musculus
gccaaattagtgcatgaagttgcca

SEQ ID NO: 306031 - DNA, 25 bp, Mus musculus
gccaaattcactgctttctgtgaga

SEQ ID NO: 306032 - DNA, 25 bp, Mus musculus
gccaaattcactgtatataaaatcc

SEQ ID NO: 306033 - DNA, 25 bp, Mus musculus
gccaacaaatgcctcaaggagaagc

SEQ ID NO: 306034 - DNA, 25 bp, Mus musculus
gccaacaagcaggatggacgacaga

SEQ ID NO: 306035 - DNA, 25 bp, Mus musculus
gccaacaatcctactccaggtctgg

SEQ ID NO: 306036 - DNA, 25 bp, Mus musculus
gccaacaatgtagagatcccctatt

SEQ ID NO: 306037 - DNA, 25 bp, Mus musculus
gccaacacaaagatgggtgttacga

SEQ ID NO: 306038 - DNA, 25 bp, Mus musculus
gccaacacagcagcaccataggttc

SEQ ID NO: 306039 - DNA, 25 bp, Mus musculus
gccaacacagcaggtcatcaccatc

SEQ ID NO: 306040 - DNA, 25 bp, Mus musculus
gccaacaccctgggaaacaagggag

SEQ ID NO: 306041 - DNA, 25 bp, Mus musculus
gccaacagctccagcagagtcaggg

SEQ ID NO: 306042 - DNA, 25 bp, Mus musculus
gccaacagctgaacctgaatctcct

SEQ ID NO: 306043 - DNA, 25 bp, Mus musculus
gccaacaggaatgatccaagcagcc

SEQ ID NO: 306044 - DNA, 25 bp, Mus musculus
gccaacatcaaactgtgctccctta

SEQ ID NO: 306045 - DNA, 25 bp, Mus musculus
gccaacatcaaagtgtgctccctta

SEQ ID NO: 306046 - DNA, 25 bp, Mus musculus
gccaacatgtcaggggagctgaagg

SEQ ID NO: 306047 - DNA, 25 bp, Mus musculus
gccaaccagacatgccatgtcggac

SEQ ID NO: 306048 - DNA, 25 bp, Mus musculus
gccaaccagcggaaatgtgagcgtg

SEQ ID NO: 306049 - DNA, 25 bp, Mus musculus
gccaaccagtctgcctaactctgtg

SEQ ID NO: 306050 - DNA, 25 bp, Mus musculus
gccaacccagaggagatgctgtcta

SEQ ID NO: 306051 - DNA, 25 bp, Mus musculus
gccaacccagaggagggagtgagct

SEQ ID NO: 306052 - DNA, 25 bp, Mus musculus
gccaacccagatcaggcgtcagaat

SEQ ID NO: 306053 - DNA, 25 bp, Mus musculus
gccaacccagatggcaagaagaagg

SEQ ID NO: 306054 - DNA, 25 bp, Mus musculus
gccaaccccataggaggccgctacg

SEQ ID NO: 306055 - DNA, 25 bp, Mus musculus
gccaacctcgtgaggactctcatta

SEQ ID NO: 306056 - DNA, 25 bp, Mus musculus
gccaacctcgtgagttacaggactc

SEQ ID NO: 306057 - DNA, 25 bp, Mus musculus
gccaacggcgagaagggagaagtcg

SEQ ID NO: 306058 - DNA, 25 bp, Mus musculus
gccaacgtcaagaagagtggtctta

SEQ ID NO: 306059 - DNA, 25 bp, Mus musculus
gccaacgtcaagaaggagatccagc

SEQ ID NO: 306060 - DNA, 25 bp, Mus musculus
gccaacgtgagagtcattcagaatt

SEQ ID NO: 306061 - DNA, 25 bp, Mus musculus
gccaacgtgagggagcctgtatatg

SEQ ID NO: 306062 - DNA, 25 bp, Mus musculus
gccaactacatcgacatttggctgt

SEQ ID NO: 306063 - DNA, 25 bp, Mus musculus
gccaactacatcgacggctaccaga

SEQ ID NO: 306064 - DNA, 25 bp, Mus musculus
gccaactatgacttttgccaaggag

SEQ ID NO: 306065 - DNA, 25 bp, Mus musculus
gccaactcaacatgtatggttttcg

SEQ ID NO: 306066 - DNA, 25 bp, Mus musculus
gccaactcataaattatatgcagga

SEQ ID NO: 306067 - DNA, 25 bp, Mus musculus
gccaactcataaattgttggggttt

SEQ ID NO: 306068 - DNA, 25 bp, Mus musculus
gccaactccgacgtgtggagaggat

SEQ ID NO: 306069 - DNA, 25 bp, Mus musculus
gccaactcctagctacaggcggcca

SEQ ID NO: 306070 - DNA, 25 bp, Mus musculus
gccaactcctttggactggtgcagt

SEQ ID NO: 306071 - DNA, 25 bp, Mus musculus
gccaactcgtttgtagggacagtga

SEQ ID NO: 306072 - DNA, 25 bp, Mus musculus
gccaactctcctctgctaagtatgg

SEQ ID NO: 306073 - DNA, 25 bp, Mus musculus
gccaactgagaggactggctgcccc

SEQ ID NO: 306074 - DNA, 25 bp, Mus musculus
gccaactgcgggaaggagctaactg

SEQ ID NO: 306075 - DNA, 25 bp, Mus musculus
gccaactgctacaggaggaaccccc

SEQ ID NO: 306076 - DNA, 25 bp, Mus musculus
gccaactggcaggggacatgaagca

SEQ ID NO: 306077 - DNA, 25 bp, Mus musculus
gccaactggcaggtatttgacatac

SEQ ID NO: 306078 - DNA, 25 bp, Mus musculus
gccaactggcgacaggcccacatgc

SEQ ID NO: 306079 - DNA, 25 bp, Mus musculus
gccaactggcgacaggctctgatgg

SEQ ID NO: 306080 - DNA, 25 bp, Mus musculus
gccaagaaacgagagcttaaagaag

SEQ ID NO: 306081 - DNA, 25 bp, Mus musculus
gccaagaaactaggactaactgaag

SEQ ID NO: 306082 - DNA, 25 bp, Mus musculus
gccaagaaatcattcatcgacccag

SEQ ID NO: 306083 - DNA, 25 bp, Mus musculus
gccaagaacggtatttgaatatcat

SEQ ID NO: 306084 - DNA, 25 bp, Mus musculus
gccaagaagaacaaagctgtatgtg

SEQ ID NO: 306085 - DNA, 25 bp, Mus musculus
gccaagaagaactttcattttcagg

SEQ ID NO: 306086 - DNA, 25 bp, Mus musculus
gccaagaagacatccctgaagtcag

SEQ ID NO: 306087 - DNA, 25 bp, Mus musculus
gccaagaagatagatcctggatgac

SEQ ID NO: 306088 - DNA, 25 bp, Mus musculus
gccaagaagcaggctcgcagccttc

SEQ ID NO: 306089 - DNA, 25 bp, Mus musculus
gccaagaaggggatgaggtgttgat

SEQ ID NO: 306090 - DNA, 25 bp, Mus musculus
gccaagaagggttgagattgagaag

SEQ ID NO: 306091 - DNA, 25 bp, Mus musculus
gccaagaagtcagactgtgttgtca

SEQ ID NO: 306092 - DNA, 25 bp, Mus musculus
gccaagaagtcaggacaaaagactg

SEQ ID NO: 306093 - DNA, 25 bp, Mus musculus
gccaagaagttccaacctagatact

SEQ ID NO: 306094 - DNA, 25 bp, Mus musculus
gccaagaagttccaagaccccagat

SEQ ID NO: 306095 - DNA, 25 bp, Mus musculus
gccaagacatactccagtgattttg

SEQ ID NO: 306096 - DNA, 25 bp, Mus musculus
gccaagacatagctcattctggagt

SEQ ID NO: 306097 - DNA, 25 bp, Mus musculus
gccaagacatagtcttgccatgtag

SEQ ID NO: 306098 - DNA, 25 bp, Mus musculus
gccaagacattgagggtcacttttc

SEQ ID NO: 306099 - DNA, 25 bp, Mus musculus
gccaagaccaggaacagcctcatgc

SEQ ID NO: 306100 - DNA, 25 bp, Mus musculus
gccaagaccagggacggtctgactc

SEQ ID NO: 306101 - DNA, 25 bp, Mus musculus
gccaagaccaggtggcaggtatttc

SEQ ID NO: 306102 - DNA, 25 bp, Mus musculus
gccaagaccagtgaggtctggtatg

SEQ ID NO: 306103 - DNA, 25 bp, Mus musculus
gccaagaccggacagggtctcatgg

SEQ ID NO: 306104 - DNA, 25 bp, Mus musculus
gccaagaccggggatcccaacaagc

SEQ ID NO: 306105 - DNA, 25 bp, Mus musculus
gccaagacgaagaatggatacacag

SEQ ID NO: 306106 - DNA, 25 bp, Mus musculus
gccaagactatgcgcaagaaaggaa

SEQ ID NO: 306107 - DNA, 25 bp, Mus musculus
gccaagagacagaggctgcttggtg

SEQ ID NO: 306108 - DNA, 25 bp, Mus musculus
gccaagagacagaggctgctttggg

SEQ ID NO: 306109 - DNA, 25 bp, Mus musculus
gccaagagacgaaagacaatgcagg

SEQ ID NO: 306110 - DNA, 25 bp, Mus musculus
gccaagagacgaaagctccggtctg

SEQ ID NO: 306111 - DNA, 25 bp, Mus musculus
gccaagagagcaaaggcttatttca

SEQ ID NO: 306112 - DNA, 25 bp, Mus musculus
gccaagagaggtcactatggtgctt

SEQ ID NO: 306113 - DNA, 25 bp, Mus musculus
gccaagagagttctgttggctcatg

SEQ ID NO: 306114 - DNA, 25 bp, Mus musculus
gccaagagctcagctttgggattcc

SEQ ID NO: 306115 - DNA, 25 bp, Mus musculus
gccaagaggagggggcatgaatcct

SEQ ID NO: 306116 - DNA, 25 bp, Mus musculus
gccaagaggaggggttatcatgctt

SEQ ID NO: 306117 - DNA, 25 bp, Mus musculus
gccaagagtgagagtggatcatgac

SEQ ID NO: 306118 - DNA, 25 bp, Mus musculus
gccaagagtgccaggctgaacctgt

SEQ ID NO: 306119 - DNA, 25 bp, Mus musculus
gccaagataaataggtgaggctgct

SEQ ID NO: 306120 - DNA, 25 bp, Mus musculus
gccaagataaatagttcaattatca

SEQ ID NO: 306121 - DNA, 25 bp, Mus musculus
gccaagatacaggaagactccttct

SEQ ID NO: 306122 - DNA, 25 bp, Mus musculus
gccaagatcatgggtgtggctggag

SEQ ID NO: 306123 - DNA, 25 bp, Mus musculus
gccaagatctggtggatcgcactcg

SEQ ID NO: 306124 - DNA, 25 bp, Mus musculus
gccaagatcttgatccagttttttg

SEQ ID NO: 306125 - DNA, 25 bp, Mus musculus
gccaagatggctccagctccagctg

SEQ ID NO: 306126 - DNA, 25 bp, Mus musculus
gccaagatgggtgctcacagtactg

SEQ ID NO: 306127 - DNA, 25 bp, Mus musculus
gccaagattaagagctgggccagca

SEQ ID NO: 306128 - DNA, 25 bp, Mus musculus
gccaagattagattgctttattcac

SEQ ID NO: 306129 - DNA, 25 bp, Mus musculus
gccaagatttggattcaagtcaatc

SEQ ID NO: 306130 - DNA, 25 bp, Mus musculus
gccaagcaaggaagcctgctgacag

SEQ ID NO: 306131 - DNA, 25 bp, Mus musculus
gccaagcaataaaattcatataaac

SEQ ID NO: 306132 - DNA, 25 bp, Mus musculus
gccaagcacacagttcctagtcact

SEQ ID NO: 306133 - DNA, 25 bp, Mus musculus
gccaagcacatcaaggaacagagag

SEQ ID NO: 306134 - DNA, 25 bp, Mus musculus
gccaagcagactgggattgtcttga

SEQ ID NO: 306135 - DNA, 25 bp, Mus musculus
gccaagcagcagatgcatattgact

SEQ ID NO: 306136 - DNA, 25 bp, Mus musculus
gccaagcagcatgcactgcgcaatg

SEQ ID NO: 306137 - DNA, 25 bp, Mus musculus
gccaagcaggacagagaagaaggtg

SEQ ID NO: 306138 - DNA, 25 bp, Mus musculus
gccaagcagggactggaatacgcta

SEQ ID NO: 306139 - DNA, 25 bp, Mus musculus
gccaagcaggggtttgatttcctct

SEQ ID NO: 306140 - DNA, 25 bp, Mus musculus
gccaagcagtggaggctctttgccg

SEQ ID NO: 306141 - DNA, 25 bp, Mus musculus
gccaagcatcaggtgtggagggtgc

SEQ ID NO: 306142 - DNA, 25 bp, Mus musculus
gccaagcatccaaatatccagggta

SEQ ID NO: 306143 - DNA, 25 bp, Mus musculus
gccaagcatccagaaggacattccc

SEQ ID NO: 306144 - DNA, 25 bp, Mus musculus
gccaagccatgaggcaagaaactac

SEQ ID NO: 306145 - DNA, 25 bp, Mus musculus
gccaagccatgctggccaagacgga

SEQ ID NO: 306146 - DNA, 25 bp, Mus musculus
gccaagcccatgtaaaacagactag

SEQ ID NO: 306147 - DNA, 25 bp, Mus musculus
gccaagccccctcttgaattttctg

SEQ ID NO: 306148 - DNA, 25 bp, Mus musculus
gccaagcccgaggtctcctctgatg

SEQ ID NO: 306149 - DNA, 25 bp, Mus musculus
gccaagccgaggtatctccagacag

SEQ ID NO: 306150 - DNA, 25 bp, Mus musculus
gccaagccgagtgccaggtcaccag

SEQ ID NO: 306151 - DNA, 25 bp, Mus musculus
gccaagccgcaggcatgaggtgaac

SEQ ID NO: 306152 - DNA, 25 bp, Mus musculus
gccaagccgctgcccagactacagc

SEQ ID NO: 306153 - DNA, 25 bp, Mus musculus
gccaagcgaagagacagggcagggc

SEQ ID NO: 306154 - DNA, 25 bp, Mus musculus
gccaagcgctacactcaagatgaca

SEQ ID NO: 306155 - DNA, 25 bp, Mus musculus
gccaagcgctcaggctcagtttatg

SEQ ID NO: 306156 - DNA, 25 bp, Mus musculus
gccaagcgctcagtttagcgtgcaa

SEQ ID NO: 306157 - DNA, 25 bp, Mus musculus
gccaagcggagagaggtcttatcag

SEQ ID NO: 306158 - DNA, 25 bp, Mus musculus
gccaagcgtgcatggttctgcagct

SEQ ID NO: 306159 - DNA, 25 bp, Mus musculus
gccaagctatggtccttcccaaact

SEQ ID NO: 306160 - DNA, 25 bp, Mus musculus
gccaagctatgtttttgaggacaag

SEQ ID NO: 306161 - DNA, 25 bp, Mus musculus
gccaagctcaagcaggtgttgcagg

SEQ ID NO: 306162 - DNA, 25 bp, Mus musculus
gccaagctcaatggctacacggatg

SEQ ID NO: 306163 - DNA, 25 bp, Mus musculus
gccaagctcagagtgcctgctcact

SEQ ID NO: 306164 - DNA, 25 bp, Mus musculus
gccaagctcatggccagggcattgt

SEQ ID NO: 306165 - DNA, 25 bp, Mus musculus
gccaagctcatgggccctgcaccct

SEQ ID NO: 306166 - DNA, 25 bp, Mus musculus
gccaagctcatgggtacttccgcca

SEQ ID NO: 306167 - DNA, 25 bp, Mus musculus
gccaagctctacaaggtctccaacg

SEQ ID NO: 306168 - DNA, 25 bp, Mus musculus
gccaagctgaggcggggcatcgtga

SEQ ID NO: 306169 - DNA, 25 bp, Mus musculus
gccaagctggagaaattttcctcgg

SEQ ID NO: 306170 - DNA, 25 bp, Mus musculus
gccaagctggagaatggcaaagcgc

SEQ ID NO: 306171 - DNA, 25 bp, Mus musculus
gccaagctgtgcggatgccgggaga

SEQ ID NO: 306172 - DNA, 25 bp, Mus musculus
gccaagcttaagcaaagtgagaaga

SEQ ID NO: 306173 - DNA, 25 bp, Mus musculus
gccaagcttaagctatgtacttaag

SEQ ID NO: 306174 - DNA, 25 bp, Mus musculus
gccaagcttaaggccttggaagatc

SEQ ID NO: 306175 - DNA, 25 bp, Mus musculus
gccaagcttgcccagtatgtgggat

SEQ ID NO: 306176 - DNA, 25 bp, Mus musculus
gccaaggaaagcaaggaatcttcaa

SEQ ID NO: 306177 - DNA, 25 bp, Mus musculus
gccaaggaaagcaaggcatgccgct

SEQ ID NO: 306178 - DNA, 25 bp, Mus musculus
gccaaggaaaggtaccgagcttatg

SEQ ID NO: 306179 - DNA, 25 bp, Mus musculus
gccaaggaagccaattaaaatgctc

SEQ ID NO: 306180 - DNA, 25 bp, Mus musculus
gccaaggaaggagggtctctaatct

SEQ ID NO: 306181 - DNA, 25 bp, Mus musculus
gccaaggaaggcaccagacctgttg

SEQ ID NO: 306182 - DNA, 25 bp, Mus musculus
gccaaggacaagaaacatctttctc

SEQ ID NO: 306183 - DNA, 25 bp, Mus musculus
gccaaggacaagagtttcttggatc

SEQ ID NO: 306184 - DNA, 25 bp, Mus musculus
gccaaggacaggctgagggtatcgc

SEQ ID NO: 306185 - DNA, 25 bp, Mus musculus
gccaaggacgaggaacctagtaaca

SEQ ID NO: 306186 - DNA, 25 bp, Mus musculus
gccaaggagaacagcatgttgtttt

SEQ ID NO: 306187 - DNA, 25 bp, Mus musculus
gccaaggagaaccaggagctctggt

SEQ ID NO: 306188 - DNA, 25 bp, Mus musculus
gccaaggagcccaggccggctcaac

SEQ ID NO: 306189 - DNA, 25 bp, Mus musculus
gccaaggagctcttcctgggcctct

SEQ ID NO: 306190 - DNA, 25 bp, Mus musculus
gccaaggaggagaagtataaagagc

SEQ ID NO: 306191 - DNA, 25 bp, Mus musculus
gccaaggagggggctgagaaaataa

SEQ ID NO: 306192 - DNA, 25 bp, Mus musculus
gccaaggaggtccagctgctcggca

SEQ ID NO: 306193 - DNA, 25 bp, Mus musculus
gccaaggaggtccagctgttcatga

SEQ ID NO: 306194 - DNA, 25 bp, Mus musculus
gccaaggagtgggtatggaggagcg

SEQ ID NO: 306195 - DNA, 25 bp, Mus musculus
gccaaggatccagacttggagaaga

SEQ ID NO: 306196 - DNA, 25 bp, Mus musculus
gccaaggatgctgggaagtccgtgg

SEQ ID NO: 306197 - DNA, 25 bp, Mus musculus
gccaaggcaacggccacgtacccca

SEQ ID NO: 306198 - DNA, 25 bp, Mus musculus
gccaaggcaaggggatgaaagcttg

SEQ ID NO: 306199 - DNA, 25 bp, Mus musculus
gccaaggcagaggttgtatggagag

SEQ ID NO: 306200 - DNA, 25 bp, Mus musculus
gccaaggcagccttggctggtcgtt

SEQ ID NO: 306201 - DNA, 25 bp, Mus musculus
gccaaggcaggatggaaccgcgcca

SEQ ID NO: 306202 - DNA, 25 bp, Mus musculus
gccaaggcaggctgtcaggttgtag

SEQ ID NO: 306203 - DNA, 25 bp, Mus musculus
gccaaggcaggtgatttggagttcc

SEQ ID NO: 306204 - DNA, 25 bp, Mus musculus
gccaaggcatgagacactgccccag

SEQ ID NO: 306205 - DNA, 25 bp, Mus musculus
gccaaggcatggtcttttccctagg

SEQ ID NO: 306206 - DNA, 25 bp, Mus musculus
gccaaggcctgtggcatcctgcctg

SEQ ID NO: 306207 - DNA, 25 bp, Mus musculus
gccaaggcctgtggtatcctgcctg

SEQ ID NO: 306208 - DNA, 25 bp, Mus musculus
gccaaggcgtgattaaggttgagga

SEQ ID NO: 306209 - DNA, 25 bp, Mus musculus
gccaaggctgccgctctggcccaca

SEQ ID NO: 306210 - DNA, 25 bp, Mus musculus
gccaaggcttaggcatcgtcttcag

SEQ ID NO: 306211 - DNA, 25 bp, Mus musculus
gccaagggcacaagctcctgacgag

SEQ ID NO: 306212 - DNA, 25 bp, Mus musculus
gccaagggcacaagctgagcggggc

SEQ ID NO: 306213 - DNA, 25 bp, Mus musculus
gccaagggcaggcatcagaaacaca

SEQ ID NO: 306214 - DNA, 25 bp, Mus musculus
gccaagggccttttggtctggaagc

SEQ ID NO: 306215 - DNA, 25 bp, Mus musculus
gccaaggtcgagcaggagcatagaa

SEQ ID NO: 306216 - DNA, 25 bp, Mus musculus
gccaaggtcgtccaatgccgagacc

SEQ ID NO: 306217 - DNA, 25 bp, Mus musculus
gccaaggtcgtccagctgaagaacc

SEQ ID NO: 306218 - DNA, 25 bp, Mus musculus
gccaaggtcgtccatgctggagtta

SEQ ID NO: 306219 - DNA, 25 bp, Mus musculus
gccaagtacacagtgtgtgattcag

SEQ ID NO: 306220 - DNA, 25 bp, Mus musculus
gccaagtacagacttctggaggatt

SEQ ID NO: 306221 - DNA, 25 bp, Mus musculus
gccaagtaccacagggagtcccccc

SEQ ID NO: 306222 - DNA, 25 bp, Mus musculus
gccaagtatctcagaaagacccaaa

SEQ ID NO: 306223 - DNA, 25 bp, Mus musculus
gccaagtatctcagattgaagacca

SEQ ID NO: 306224 - DNA, 25 bp, Mus musculus
gccaagtctacaggtggtgtctacc

SEQ ID NO: 306225 - DNA, 25 bp, Mus musculus
gccaagtctcgggtggatgaaactc

SEQ ID NO: 306226 - DNA, 25 bp, Mus musculus
gccaagtctgtgaggctgggaccca

SEQ ID NO: 306227 - DNA, 25 bp, Mus musculus
gccaagtgagagtcagcttgcgaag

SEQ ID NO: 306228 - DNA, 25 bp, Mus musculus
gccaagtgccagaacaccaagctgg

SEQ ID NO: 306229 - DNA, 25 bp, Mus musculus
gccaagtgctcaagtatgatgactt

SEQ ID NO: 306230 - DNA, 25 bp, Mus musculus
gccaagtggaccattgacctgaaga

SEQ ID NO: 306231 - DNA, 25 bp, Mus musculus
gccaagtggaccccacagagcagag

SEQ ID NO: 306232 - DNA, 25 bp, Mus musculus
gccaagttcaaatgagacatcctat

SEQ ID NO: 306233 - DNA, 25 bp, Mus musculus
gccaagttcaacttcgctagttgat

SEQ ID NO: 306234 - DNA, 25 bp, Mus musculus
gccaagttcaagagagcaggcaagg

SEQ ID NO: 306235 - DNA, 25 bp, Mus musculus
gccaagttcaagcggtatgaatatc

SEQ ID NO: 306236 - DNA, 25 bp, Mus musculus
gccaagttcaaggacagcagcctgg

SEQ ID NO: 306237 - DNA, 25 bp, Mus musculus
gccaagtttgagcatgccaccagcc

SEQ ID NO: 306238 - DNA, 25 bp, Mus musculus
gccaagtttgagtctggagacgtga

SEQ ID NO: 306239 - DNA, 25 bp, Mus musculus
gccaataactatgcctgtggttgag

SEQ ID NO: 306240 - DNA, 25 bp, Mus musculus
gccaataagaagttgtgaagttatc

SEQ ID NO: 306241 - DNA, 25 bp, Mus musculus
gccaataagctacaggagcttcaag

SEQ ID NO: 306242 - DNA, 25 bp, Mus musculus
gccaataaggatcgcctgaattctg

SEQ ID NO: 306243 - DNA, 25 bp, Mus musculus
gccaatagagttgcttcacgtctta

SEQ ID NO: 306244 - DNA, 25 bp, Mus musculus
gccaatatctatctactactctgaa

SEQ ID NO: 306245 - DNA, 25 bp, Mus musculus
gccaatatgaatatgtatgtgtttt

SEQ ID NO: 306246 - DNA, 25 bp, Mus musculus
gccaatatgaatattagtgaactta

SEQ ID NO: 306247 - DNA, 25 bp, Mus musculus
gccaatatgaatattgctggcctat

SEQ ID NO: 306248 - DNA, 25 bp, Mus musculus
gccaatattttcgagcattactgta

SEQ ID NO: 306249 - DNA, 25 bp, Mus musculus
gccaatcagggtccctgagttggaa

SEQ ID NO: 306250 - DNA, 25 bp, Mus musculus
gccaatccaatgaagccctcttatt

SEQ ID NO: 306251 - DNA, 25 bp, Mus musculus
gccaatccaatgaaggaaaaggtgc

SEQ ID NO: 306252 - DNA, 25 bp, Mus musculus
gccaatctgccaagagacaaacaga

SEQ ID NO: 306253 - DNA, 25 bp, Mus musculus
gccaatctgccaagtggtccagtgt

SEQ ID NO: 306254 - DNA, 25 bp, Mus musculus
gccaatgaaacttccatagagactg

SEQ ID NO: 306255 - DNA, 25 bp, Mus musculus
gccaatgaaagctcaaaacattcaa

SEQ ID NO: 306256 - DNA, 25 bp, Mus musculus
gccaatgaaagctgacttaaaaaca

SEQ ID NO: 306257 - DNA, 25 bp, Mus musculus
gccaatgaagaatctggtccaggcc

SEQ ID NO: 306258 - DNA, 25 bp, Mus musculus
gccaatgaagaccctggtcttttgt

SEQ ID NO: 306259 - DNA, 25 bp, Mus musculus
gccaatgaagctctgatgcgctctg

SEQ ID NO: 306260 - DNA, 25 bp, Mus musculus
gccaatgagaaagagaaaactgcca

SEQ ID NO: 306261 - DNA, 25 bp, Mus musculus
gccaatgagagaggacacaatgtag

SEQ ID NO: 306262 - DNA, 25 bp, Mus musculus
gccaatgccaacgccacgccttctc

SEQ ID NO: 306263 - DNA, 25 bp, Mus musculus
gccaatgccatgctggtgccagtgc

SEQ ID NO: 306264 - DNA, 25 bp, Mus musculus
gccaatgcgaacgacttcttcgcca

SEQ ID NO: 306265 - DNA, 25 bp, Mus musculus
gccaatgctgagagcaactgtgggt

SEQ ID NO: 306266 - DNA, 25 bp, Mus musculus
gccaatgctgaggatgcccaagaat

SEQ ID NO: 306267 - DNA, 25 bp, Mus musculus
gccaatggaagcagaaaattgtgca

SEQ ID NO: 306268 - DNA, 25 bp, Mus musculus
gccaatggaggtcctgcaccagatg

SEQ ID NO: 306269 - DNA, 25 bp, Mus musculus
gccaatggagtggagattgtggacc

SEQ ID NO: 306270 - DNA, 25 bp, Mus musculus
gccaatggccaaatcaaagaaatcg

SEQ ID NO: 306271 - DNA, 25 bp, Mus musculus
gccaatggctacatttgtcctctct

SEQ ID NO: 306272 - DNA, 25 bp, Mus musculus
gccaatgtggacaaggtattctttg

SEQ ID NO: 306273 - DNA, 25 bp, Mus musculus
gccaatgtggacaaggtcattgtgc

SEQ ID NO: 306274 - DNA, 25 bp, Mus musculus
gccaatgtgggaagcaaagctgctg

SEQ ID NO: 306275 - DNA, 25 bp, Mus musculus
gccaatgtgtccgacttcccggaga

SEQ ID NO: 306276 - DNA, 25 bp, Mus musculus
gccaattactgagcaaattgctgtt

SEQ ID NO: 306277 - DNA, 25 bp, Mus musculus
gccaattatacaactgctgacaagt

SEQ ID NO: 306278 - DNA, 25 bp, Mus musculus
gccaattcccttggatttcagtttt

SEQ ID NO: 306279 - DNA, 25 bp, Mus musculus
gccaattctcccacacagatctggc

SEQ ID NO: 306280 - DNA, 25 bp, Mus musculus
gccaattctggaccaccaaggcctt

SEQ ID NO: 306281 - DNA, 25 bp, Mus musculus
gccaattgaggtcatgatgaatgag

SEQ ID NO: 306282 - DNA, 25 bp, Mus musculus
gccaattgcctgtgatggtgtggat

SEQ ID NO: 306283 - DNA, 25 bp, Mus musculus
gccaatttgggcaccctaagatgag

SEQ ID NO: 306284 - DNA, 25 bp, Mus musculus
gccaatttgggcactgcagcctgtc

SEQ ID NO: 306285 - DNA, 25 bp, Mus musculus
gccacaaaaagccagcaccaagtga

SEQ ID NO: 306286 - DNA, 25 bp, Mus musculus
gccacaaaaagccagggatggctgt

SEQ ID NO: 306287 - DNA, 25 bp, Mus musculus
gccacaaaaggagccataattccac

SEQ ID NO: 306288 - DNA, 25 bp, Mus musculus
gccacaaacaaaagtgtttacaatt

SEQ ID NO: 306289 - DNA, 25 bp, Mus musculus
gccacaaaggtagctacttggtgag

SEQ ID NO: 306290 - DNA, 25 bp, Mus musculus
gccacaaagtcaaaggtggcagggc

SEQ ID NO: 306291 - DNA, 25 bp, Mus musculus
gccacaaatgaaggagcccattgaa

SEQ ID NO: 306292 - DNA, 25 bp, Mus musculus
gccacaaattatgtgagtgactggt

SEQ ID NO: 306293 - DNA, 25 bp, Mus musculus
gccacaacaccaaactttaagaagc

SEQ ID NO: 306294 - DNA, 25 bp, Mus musculus
gccacaacagaaagcctaaaactaa

SEQ ID NO: 306295 - DNA, 25 bp, Mus musculus
gccacaaccacctggcgctggttac

SEQ ID NO: 306296 - DNA, 25 bp, Mus musculus
gccacaaccgcggaagaaaacggct

SEQ ID NO: 306297 - DNA, 25 bp, Mus musculus
gccacaactgaccaggacaagagtg

SEQ ID NO: 306298 - DNA, 25 bp, Mus musculus
gccacaagagataagatgaaagatg

SEQ ID NO: 306299 - DNA, 25 bp, Mus musculus
gccacaagccaagaaagctcgctta

SEQ ID NO: 306300 - DNA, 25 bp, Mus musculus
gccacaagccaaggacctctaattt

SEQ ID NO: 306301 - DNA, 25 bp, Mus musculus
gccacaagcctgtcgcacgagtctg

SEQ ID NO: 306302 - DNA, 25 bp, Mus musculus
gccacaagcctgtcggggtgaatcg

SEQ ID NO: 306303 - DNA, 25 bp, Mus musculus
gccacaagcgctgagtgaaaatgtg

SEQ ID NO: 306304 - DNA, 25 bp, Mus musculus
gccacaaggagagaactgcccagca

SEQ ID NO: 306305 - DNA, 25 bp, Mus musculus
gccacacagcacaggtgtaacgagt

SEQ ID NO: 306306 - DNA, 25 bp, Mus musculus
gccacacatggaagcatggaatcag

SEQ ID NO: 306307 - DNA, 25 bp, Mus musculus
gccacacatggaaggaaaggacttc

SEQ ID NO: 306308 - DNA, 25 bp, Mus musculus
gccacaccaaggtgttcttcaaggc

SEQ ID NO: 306309 - DNA, 25 bp, Mus musculus
gccacaccacccagactatgaaatc

SEQ ID NO: 306310 - DNA, 25 bp, Mus musculus
gccacaccatataccgaagcaaagg

SEQ ID NO: 306311 - DNA, 25 bp, Mus musculus
gccacaccatatataaactacactc

SEQ ID NO: 306312 - DNA, 25 bp, Mus musculus
gccacacccaaggaggccaaaaaag

SEQ ID NO: 306313 - DNA, 25 bp, Mus musculus
gccacacccaaggagggtcaaaagg

SEQ ID NO: 306314 - DNA, 25 bp, Mus musculus
gccacacccaggagcatgttaatga

SEQ ID NO: 306315 - DNA, 25 bp, Mus musculus
gccacaccggacggtgggattgtgc

SEQ ID NO: 306316 - DNA, 25 bp, Mus musculus
gccacaccggacgtgggaagctgct

SEQ ID NO: 306317 - DNA, 25 bp, Mus musculus
gccacacgagaccctggctgggcat

SEQ ID NO: 306318 - DNA, 25 bp, Mus musculus
gccacacgtgaccagtatggcaaga

SEQ ID NO: 306319 - DNA, 25 bp, Mus musculus
gccacactcaccaggcacttgtgga

SEQ ID NO: 306320 - DNA, 25 bp, Mus musculus
gccacactcagggcaggaggacctg

SEQ ID NO: 306321 - DNA, 25 bp, Mus musculus
gccacactcagggcgcttattcggc

SEQ ID NO: 306322 - DNA, 25 bp, Mus musculus
gccacactcgctggagctggtggag

SEQ ID NO: 306323 - DNA, 25 bp, Mus musculus
gccacactctctcaaattgcctatc

SEQ ID NO: 306324 - DNA, 25 bp, Mus musculus
gccacactgctatcatccagcaggt

SEQ ID NO: 306325 - DNA, 25 bp, Mus musculus
gccacactggggtagcctttgtgaa

SEQ ID NO: 306326 - DNA, 25 bp, Mus musculus
gccacactgtgggaggaccatcctt

SEQ ID NO: 306327 - DNA, 25 bp, Mus musculus
gccacacttaggcatcctacatcaa

SEQ ID NO: 306328 - DNA, 25 bp, Mus musculus
gccacacttcacaaggatggaatag

SEQ ID NO: 306329 - DNA, 25 bp, Mus musculus
gccacacttggaggtgaaatcgccc

SEQ ID NO: 306330 - DNA, 25 bp, Mus musculus
gccacagaacagagggggaagaaac

SEQ ID NO: 306331 - DNA, 25 bp, Mus musculus
gccacagaagaggccagatatcaca

SEQ ID NO: 306332 - DNA, 25 bp, Mus musculus
gccacagaagcagtgagtacaacac

SEQ ID NO: 306333 - DNA, 25 bp, Mus musculus
gccacagaagcagtggtatttatga

SEQ ID NO: 306334 - DNA, 25 bp, Mus musculus
gccacagacaatcctatggtctttg

SEQ ID NO: 306335 - DNA, 25 bp, Mus musculus
gccacagacagggccactgccggtg

SEQ ID NO: 306336 - DNA, 25 bp, Mus musculus
gccacagagagcaaggtcgccgctg

SEQ ID NO: 306337 - DNA, 25 bp, Mus musculus
gccacagagtgagagaatagaaccc

SEQ ID NO: 306338 - DNA, 25 bp, Mus musculus
gccacagagtgagttactagagccc

SEQ ID NO: 306339 - DNA, 25 bp, Mus musculus
gccacagcagaaagctggtttattg

SEQ ID NO: 306340 - DNA, 25 bp, Mus musculus
gccacagcagcagcgcaacgaagtt

SEQ ID NO: 306341 - DNA, 25 bp, Mus musculus
gccacagcatgcgggaggaggactt

SEQ ID NO: 306342 - DNA, 25 bp, Mus musculus
gccacagccaaccagatacccataa

SEQ ID NO: 306343 - DNA, 25 bp, Mus musculus
gccacagccaatcagataattctga

SEQ ID NO: 306344 - DNA, 25 bp, Mus musculus
gccacagccaccaaggtgacagctt

SEQ ID NO: 306345 - DNA, 25 bp, Mus musculus
gccacagccagaagttgaaatggaa

SEQ ID NO: 306346 - DNA, 25 bp, Mus musculus
gccacagccaggatatccctgtgat

SEQ ID NO: 306347 - DNA, 25 bp, Mus musculus
gccacagcccgccggtggcagctga

SEQ ID NO: 306348 - DNA, 25 bp, Mus musculus
gccacagcccttcagccagtactgt

SEQ ID NO: 306349 - DNA, 25 bp, Mus musculus
gccacagccgcgaccatagtctgtg

SEQ ID NO: 306350 - DNA, 25 bp, Mus musculus
gccacagccgcgcctggtgcagcca

SEQ ID NO: 306351 - DNA, 25 bp, Mus musculus
gccacagcctgggtgcctatagcat

SEQ ID NO: 306352 - DNA, 25 bp, Mus musculus
gccacagcggccccgtgtctgaaga

SEQ ID NO: 306353 - DNA, 25 bp, Mus musculus
gccacagctcctccctggcccatag

SEQ ID NO: 306354 - DNA, 25 bp, Mus musculus
gccacagctcggctcctgggcagcg

SEQ ID NO: 306355 - DNA, 25 bp, Mus musculus
gccacagctcggtcgtccagtcctt

SEQ ID NO: 306356 - DNA, 25 bp, Mus musculus
gccacagctgctaactctcttctgg

SEQ ID NO: 306357 - DNA, 25 bp, Mus musculus
gccacaggatgaaataacagttact

SEQ ID NO: 306358 - DNA, 25 bp, Mus musculus
gccacaggatgatggcagtgaaatt

SEQ ID NO: 306359 - DNA, 25 bp, Mus musculus
gccacaggattaccaccatgttcaa

SEQ ID NO: 306360 - DNA, 25 bp, Mus musculus
gccacagggtgcaagatgatgactt

SEQ ID NO: 306361 - DNA, 25 bp, Mus musculus
gccacagggtgcaagccagcccttc

SEQ ID NO: 306362 - DNA, 25 bp, Mus musculus
gccacagtcatggccttccctccgg

SEQ ID NO: 306363 - DNA, 25 bp, Mus musculus
gccacagtgaaaaaagcaactatag

SEQ ID NO: 306364 - DNA, 25 bp, Mus musculus
gccacagtgaaggagcagattataa

SEQ ID NO: 306365 - DNA, 25 bp, Mus musculus
gccacagtgtgtcaggcattcgggg

SEQ ID NO: 306366 - DNA, 25 bp, Mus musculus
gccacagttcgcagatacacttttg

SEQ ID NO: 306367 - DNA, 25 bp, Mus musculus
gccacagttcgcaggaggcagagta

SEQ ID NO: 306368 - DNA, 25 bp, Mus musculus
gccacagtttctcccatccccacct

SEQ ID NO: 306369 - DNA, 25 bp, Mus musculus
gccacagtttcttggtctggaataa

SEQ ID NO: 306370 - DNA, 25 bp, Mus musculus
gccacatagaaggctctcagcacca

SEQ ID NO: 306371 - DNA, 25 bp, Mus musculus
gccacatcagagagtgtccaggtta

SEQ ID NO: 306372 - DNA, 25 bp, Mus musculus
gccacatcatgacaagaaaaagact

SEQ ID NO: 306373 - DNA, 25 bp, Mus musculus
gccacatcattcaaatattggagat

SEQ ID NO: 306374 - DNA, 25 bp, Mus musculus
gccacatcctgtgccaataacttcg

SEQ ID NO: 306375 - DNA, 25 bp, Mus musculus
gccacatcgcaaggggctccacggg

SEQ ID NO: 306376 - DNA, 25 bp, Mus musculus
gccacatgcagcagggtggaagccc

SEQ ID NO: 306377 - DNA, 25 bp, Mus musculus
gccacatggccaaggaaaattgtcc

SEQ ID NO: 306378 - DNA, 25 bp, Mus musculus
gccacatggccaagggactaaagaa

SEQ ID NO: 306379 - DNA, 25 bp, Mus musculus
gccacatgtacaaggactcacacac

SEQ ID NO: 306380 - DNA, 25 bp, Mus musculus
gccacatgtacatatgaaacctgcc

SEQ ID NO: 306381 - DNA, 25 bp, Mus musculus
gccacatgtacatatggtcgacccc

SEQ ID NO: 306382 - DNA, 25 bp, Mus musculus
gccacattagcccaggtatccatgc

SEQ ID NO: 306383 - DNA, 25 bp, Mus musculus
gccacattctgattcaaagaataca

SEQ ID NO: 306384 - DNA, 25 bp, Mus musculus
gccacattctgtaccaaggaagaga

SEQ ID NO: 306385 - DNA, 25 bp, Mus musculus
gccacatttgccaaaaagcagggcc

SEQ ID NO: 306386 - DNA, 25 bp, Mus musculus
gccaccaaaaaggaatcactgggcc

SEQ ID NO: 306387 - DNA, 25 bp, Mus musculus
gccaccaaaatgaaggaagctctga

SEQ ID NO: 306388 - DNA, 25 bp, Mus musculus
gccaccaaagagagacctcctaagc

SEQ ID NO: 306389 - DNA, 25 bp, Mus musculus
gccaccaaagcgatgttaaagaagc

SEQ ID NO: 306390 - DNA, 25 bp, Mus musculus
gccaccaaaggagtaacctatcttt

SEQ ID NO: 306391 - DNA, 25 bp, Mus musculus
gccaccaaaggtcgggtcattccag

SEQ ID NO: 306392 - DNA, 25 bp, Mus musculus
gccaccaaaggttacagagaatatg

SEQ ID NO: 306393 - DNA, 25 bp, Mus musculus
gccaccaaccagattctcagccacc

SEQ ID NO: 306394 - DNA, 25 bp, Mus musculus
gccaccaagcagaaacagcacctct

SEQ ID NO: 306395 - DNA, 25 bp, Mus musculus
gccaccaagcaggagattacctgga

SEQ ID NO: 306396 - DNA, 25 bp, Mus musculus
gccaccaatcaaagcaagctcatgt

SEQ ID NO: 306397 - DNA, 25 bp, Mus musculus
gccaccaatgtcaggttgaaaactg

SEQ ID NO: 306398 - DNA, 25 bp, Mus musculus
gccaccaatgtcagtgtgcgggatg

SEQ ID NO: 306399 - DNA, 25 bp, Mus musculus
gccaccacacccgagcagtatataa

SEQ ID NO: 306400 - DNA, 25 bp, Mus musculus
gccaccacagtgactcatctgcccc

SEQ ID NO: 306401 - DNA, 25 bp, Mus musculus
gccaccaccacctcctcgccctcat

SEQ ID NO: 306402 - DNA, 25 bp, Mus musculus
gccaccaccaggaacttcctgtaga

SEQ ID NO: 306403 - DNA, 25 bp, Mus musculus
gccaccaccgctgacgatgcagatc

SEQ ID NO: 306404 - DNA, 25 bp, Mus musculus
gccaccaccgctggatgcagatctt

SEQ ID NO: 306405 - DNA, 25 bp, Mus musculus
gccaccacctggaactggtgagcag

SEQ ID NO: 306406 - DNA, 25 bp, Mus musculus
gccaccactcaggagcccttgccca

SEQ ID NO: 306407 - DNA, 25 bp, Mus musculus
gccaccactcctctggatcccagag

SEQ ID NO: 306408 - DNA, 25 bp, Mus musculus
gccaccagaagattcagaatgtgta

SEQ ID NO: 306409 - DNA, 25 bp, Mus musculus
gccaccagaatcaagttccttacag

SEQ ID NO: 306410 - DNA, 25 bp, Mus musculus
gccaccagagagctgtgcctgagat

SEQ ID NO: 306411 - DNA, 25 bp, Mus musculus
gccaccagaggatgacagaggagtt

SEQ ID NO: 306412 - DNA, 25 bp, Mus musculus
gccaccagaggtgatccaacagtat

SEQ ID NO: 306413 - DNA, 25 bp, Mus musculus
gccaccagcagccaggccaaaaaag

SEQ ID NO: 306414 - DNA, 25 bp, Mus musculus
gccaccagcaggccgaggaaagcag

SEQ ID NO: 306415 - DNA, 25 bp, Mus musculus
gccaccatatcagccattgaagcca

SEQ ID NO: 306416 - DNA, 25 bp, Mus musculus
gccaccatccgtgactgtcctggaa

SEQ ID NO: 306417 - DNA, 25 bp, Mus musculus
gccaccatcgtaggttctgtacctc

SEQ ID NO: 306418 - DNA, 25 bp, Mus musculus
gccaccatgccgatcaataagtcgg

SEQ ID NO: 306419 - DNA, 25 bp, Mus musculus
gccaccatggtgaagatttacccaa

SEQ ID NO: 306420 - DNA, 25 bp, Mus musculus
gccaccatggtgaagctaatctgga

SEQ ID NO: 306421 - DNA, 25 bp, Mus musculus
gccaccatttggcttcattaaaaaa

SEQ ID NO: 306422 - DNA, 25 bp, Mus musculus
gccacccaagttggagtcattcgat

SEQ ID NO: 306423 - DNA, 25 bp, Mus musculus
gccacccatagtgggccaaagagat

SEQ ID NO: 306424 - DNA, 25 bp, Mus musculus
gccacccatgctttctggatcattc

SEQ ID NO: 306425 - DNA, 25 bp, Mus musculus
gccaccccagacccaagaatcttta

SEQ ID NO: 306426 - DNA, 25 bp, Mus musculus
gccaccccctgtatccctctgaaga

SEQ ID NO: 306427 - DNA, 25 bp, Mus musculus
gccaccccgaggtcaggacgaccac

SEQ ID NO: 306428 - DNA, 25 bp, Mus musculus
gccaccccgtgtcctatgcaccagc

SEQ ID NO: 306429 - DNA, 25 bp, Mus musculus
gccacccctcaagacggaggaggac

SEQ ID NO: 306430 - DNA, 25 bp, Mus musculus
gccacccctcaaggagcacttcaat

SEQ ID NO: 306431 - DNA, 25 bp, Mus musculus
gccacccctgggactagctcaggcc

SEQ ID NO: 306432 - DNA, 25 bp, Mus musculus
gccacccctgggcaggtgttttagc

SEQ ID NO: 306433 - DNA, 25 bp, Mus musculus
gccaccccttaaatgtaggtataag

SEQ ID NO: 306434 - DNA, 25 bp, Mus musculus
gccaccccttcctgcaaggccatca

SEQ ID NO: 306435 - DNA, 25 bp, Mus musculus
gccacccgacagggccgcagcctcg

SEQ ID NO: 306436 - DNA, 25 bp, Mus musculus
gccacccgacccagttaatctctca

SEQ ID NO: 306437 - DNA, 25 bp, Mus musculus
gccacccgagcaagatcaacgagga

SEQ ID NO: 306438 - DNA, 25 bp, Mus musculus
gccacccgcaagcccattacttcac

SEQ ID NO: 306439 - DNA, 25 bp, Mus musculus
gccacccggagccgttatcctaggc

SEQ ID NO: 306440 - DNA, 25 bp, Mus musculus
gccaccctaaaaggaagtgctgcat

SEQ ID NO: 306441 - DNA, 25 bp, Mus musculus
gccaccctccagggatacggacaga

SEQ ID NO: 306442 - DNA, 25 bp, Mus musculus
gccaccctctatcagcaggaatcca

SEQ ID NO: 306443 - DNA, 25 bp, Mus musculus
gccaccctgtactgcattaacttca

SEQ ID NO: 306444 - DNA, 25 bp, Mus musculus
gccaccctgtactgtgacaagggca

SEQ ID NO: 306445 - DNA, 25 bp, Mus musculus
gccacccttgaaggtgaacaaggca

SEQ ID NO: 306446 - DNA, 25 bp, Mus musculus
gccaccgaacacagtgaggatgcca

SEQ ID NO: 306447 - DNA, 25 bp, Mus musculus
gccaccgacaaggtacaaccacgtt

SEQ ID NO: 306448 - DNA, 25 bp, Mus musculus
gccaccgccgcggcatggatgggca

SEQ ID NO: 306449 - DNA, 25 bp, Mus musculus
gccaccgcgcaggcttgacatctag

SEQ ID NO: 306450 - DNA, 25 bp, Mus musculus
gccaccgcttgaatctccccgaggt

SEQ ID NO: 306451 - DNA, 25 bp, Mus musculus
gccaccggaagccaggactccccgc

SEQ ID NO: 306452 - DNA, 25 bp, Mus musculus
gccaccggaagccaggctgggtcct

SEQ ID NO: 306453 - DNA, 25 bp, Mus musculus
gccaccggacagcattcacaacgac

SEQ ID NO: 306454 - DNA, 25 bp, Mus musculus
gccaccggacagcccaacggtagcg

SEQ ID NO: 306455 - DNA, 25 bp, Mus musculus
gccaccggcaggggactttgtgcag

SEQ ID NO: 306456 - DNA, 25 bp, Mus musculus
gccaccggggaaaggaatggatggc

SEQ ID NO: 306457 - DNA, 25 bp, Mus musculus
gccaccggggaaagggatgattctg

SEQ ID NO: 306458 - DNA, 25 bp, Mus musculus
gccaccgtgtgacttctcagacttt

SEQ ID NO: 306459 - DNA, 25 bp, Mus musculus
gccacctaaggtgacaaaagaacta

SEQ ID NO: 306460 - DNA, 25 bp, Mus musculus
gccacctactggacccttttgtgga

SEQ ID NO: 306461 - DNA, 25 bp, Mus musculus
gccacctacttgctggggcttcacg

SEQ ID NO: 306462 - DNA, 25 bp, Mus musculus
gccacctcacgaggttcctggacat

SEQ ID NO: 306463 - DNA, 25 bp, Mus musculus
gccacctcaggatggtagagcactg

SEQ ID NO: 306464 - DNA, 25 bp, Mus musculus
gccacctccaagaatggtggcatct

SEQ ID NO: 306465 - DNA, 25 bp, Mus musculus
gccacctccaagtcagcctccaaga

SEQ ID NO: 306466 - DNA, 25 bp, Mus musculus
gccacctccagtcgcagatatggcc

SEQ ID NO: 306467 - DNA, 25 bp, Mus musculus
gccacctctaaaggaggaagatgag

SEQ ID NO: 306468 - DNA, 25 bp, Mus musculus
gccacctctacaagtgacatcttga

SEQ ID NO: 306469 - DNA, 25 bp, Mus musculus
gccacctctgcgatgctcaaaacat

SEQ ID NO: 306470 - DNA, 25 bp, Mus musculus
gccacctcttctgtggttggagact

SEQ ID NO: 306471 - DNA, 25 bp, Mus musculus
gccacctcttctgttggccgtgttt

SEQ ID NO: 306472 - DNA, 25 bp, Mus musculus
gccacctgacaggtcacaaccatgt

SEQ ID NO: 306473 - DNA, 25 bp, Mus musculus
gccacctgagaaaagaaaagaagag

SEQ ID NO: 306474 - DNA, 25 bp, Mus musculus
gccacctgagaagagaagagaagag

SEQ ID NO: 306475 - DNA, 25 bp, Mus musculus
gccacctgagagatctcaggtttga

SEQ ID NO: 306476 - DNA, 25 bp, Mus musculus
gccacctgagcctgctgctccagcc

SEQ ID NO: 306477 - DNA, 25 bp, Mus musculus
gccacctgaggcctcccagcatagc

SEQ ID NO: 306478 - DNA, 25 bp, Mus musculus
gccacctgcaaggttcactttaatt

SEQ ID NO: 306479 - DNA, 25 bp, Mus musculus
gccacctgccaagactgtggccgca

SEQ ID NO: 306480 - DNA, 25 bp, Mus musculus
gccacctgcgagcccactcggctga

SEQ ID NO: 306481 - DNA, 25 bp, Mus musculus
gccacctgctccagcggggactctg

SEQ ID NO: 306482 - DNA, 25 bp, Mus musculus
gccaccttcagaatgaagaggaata

SEQ ID NO: 306483 - DNA, 25 bp, Mus musculus
gccaccttcagtgattttataggtc

SEQ ID NO: 306484 - DNA, 25 bp, Mus musculus
gccaccttcggcactgcagtaactt

SEQ ID NO: 306485 - DNA, 25 bp, Mus musculus
gccaccttctaacagtgctgctgaa

SEQ ID NO: 306486 - DNA, 25 bp, Mus musculus
gccaccttgactcagtacgtcaagt

SEQ ID NO: 306487 - DNA, 25 bp, Mus musculus
gccaccttgtgtgtggaatgtcatt

SEQ ID NO: 306488 - DNA, 25 bp, Mus musculus
gccacctttgaagactcggtgtgga

SEQ ID NO: 306489 - DNA, 25 bp, Mus musculus
gccacctttgaggaaaccaggaaaa

SEQ ID NO: 306490 - DNA, 25 bp, Mus musculus
gccaccttttattctctcttgccta

SEQ ID NO: 306491 - DNA, 25 bp, Mus musculus
gccacgaagccagaaggaggctcgc

SEQ ID NO: 306492 - DNA, 25 bp, Mus musculus
gccacgacggcacagagctcctggc

SEQ ID NO: 306493 - DNA, 25 bp, Mus musculus
gccacgagaacgtcattgggctact

SEQ ID NO: 306494 - DNA, 25 bp, Mus musculus
gccacgagaactggacatttggtcc

SEQ ID NO: 306495 - DNA, 25 bp, Mus musculus
gccacgagagagctgcaagacctca

SEQ ID NO: 306496 - DNA, 25 bp, Mus musculus
gccacgagaggtgagggagtttaac

SEQ ID NO: 306497 - DNA, 25 bp, Mus musculus
gccacgatgagtgaacagagtatct

SEQ ID NO: 306498 - DNA, 25 bp, Mus musculus
gccacgatgtgtggaaattctctgc

SEQ ID NO: 306499 - DNA, 25 bp, Mus musculus
gccacgcactgcaagaaaacgagga

SEQ ID NO: 306500 - DNA, 25 bp, Mus musculus
gccacgcactgcaagatctagatgg

SEQ ID NO: 306501 - DNA, 25 bp, Mus musculus
gccacgcagactagcatttcagatc

SEQ ID NO: 306502 - DNA, 25 bp, Mus musculus
gccacgcatcctccacctgtccctc

SEQ ID NO: 306503 - DNA, 25 bp, Mus musculus
gccacgccagagtttctcaggaata

SEQ ID NO: 306504 - DNA, 25 bp, Mus musculus
gccacgccagcttagagtgcgatgc

SEQ ID NO: 306505 - DNA, 25 bp, Mus musculus
gccacgcccccggatgatggtcact

SEQ ID NO: 306506 - DNA, 25 bp, Mus musculus
gccacgccgatccggtaatatcctt

SEQ ID NO: 306507 - DNA, 25 bp, Mus musculus
gccacgcgcctcagagtttgctatt

SEQ ID NO: 306508 - DNA, 25 bp, Mus musculus
gccacgcgcctcaggtagcactttg

SEQ ID NO: 306509 - DNA, 25 bp, Mus musculus
gccacgcggcacagcccatgcagcc

SEQ ID NO: 306510 - DNA, 25 bp, Mus musculus
gccacgctactcagggatgttccct

SEQ ID NO: 306511 - DNA, 25 bp, Mus musculus
gccacgctactctgggcctcaggag

SEQ ID NO: 306512 - DNA, 25 bp, Mus musculus
gccacgctatggacgcactgacata

SEQ ID NO: 306513 - DNA, 25 bp, Mus musculus
gccacgctatgggattccaacctcc

SEQ ID NO: 306514 - DNA, 25 bp, Mus musculus
gccacgctgccataatgaagaagaa

SEQ ID NO: 306515 - DNA, 25 bp, Mus musculus
gccacgcttagactagctgtgttac

SEQ ID NO: 306516 - DNA, 25 bp, Mus musculus
gccacggaatccagatggtgaactg

SEQ ID NO: 306517 - DNA, 25 bp, Mus musculus
gccacggaatccaggagtacaagaa

SEQ ID NO: 306518 - DNA, 25 bp, Mus musculus
gccacggaatccaggcacatggata

SEQ ID NO: 306519 - DNA, 25 bp, Mus musculus
gccacggagaggagggagggagcca

SEQ ID NO: 306520 - DNA, 25 bp, Mus musculus
gccacggaggatgaggatgaggaag

SEQ ID NO: 306521 - DNA, 25 bp, Mus musculus
gccacggaggatgtcccgcatggtt

SEQ ID NO: 306522 - DNA, 25 bp, Mus musculus
gccacggagttctggaagaccgctg

SEQ ID NO: 306523 - DNA, 25 bp, Mus musculus
gccacggatggaggaggagacaaca

SEQ ID NO: 306524 - DNA, 25 bp, Mus musculus
gccacggcagggttaacctctgctt

SEQ ID NO: 306525 - DNA, 25 bp, Mus musculus
gccacggccatggggtctgtgacag

SEQ ID NO: 306526 - DNA, 25 bp, Mus musculus
gccacggcctgtgagctggatctca

SEQ ID NO: 306527 - DNA, 25 bp, Mus musculus
gccacggctgagttaagaatcatgg

SEQ ID NO: 306528 - DNA, 25 bp, Mus musculus
gccacgggaacggagtgtgcaattc

SEQ ID NO: 306529 - DNA, 25 bp, Mus musculus
gccacgggcgaggacctatatccag

SEQ ID NO: 306530 - DNA, 25 bp, Mus musculus
gccacggggacaggcaagtacattg

SEQ ID NO: 306531 - DNA, 25 bp, Mus musculus
gccacgtacctagaacaccacgctg

SEQ ID NO: 306532 - DNA, 25 bp, Mus musculus
gccacgtcaagactctggaagctgt

SEQ ID NO: 306533 - DNA, 25 bp, Mus musculus
gccacgtcaagatgtcacgtgacca

SEQ ID NO: 306534 - DNA, 25 bp, Mus musculus
gccacgtctctgtggacacagaagc

SEQ ID NO: 306535 - DNA, 25 bp, Mus musculus
gccacgtgagagggtcgttgctcca

SEQ ID NO: 306536 - DNA, 25 bp, Mus musculus
gccacgtgagaggttggtactaaga

SEQ ID NO: 306537 - DNA, 25 bp, Mus musculus
gccacgtgcaggaaacatccgagcc

SEQ ID NO: 306538 - DNA, 25 bp, Mus musculus
gccacgttgccgacttcctggtggc

SEQ ID NO: 306539 - DNA, 25 bp, Mus musculus
gccacgttgccgagaacctgccaga

SEQ ID NO: 306540 - DNA, 25 bp, Mus musculus
gccacgttgccgattttgtcctgga

SEQ ID NO: 306541 - DNA, 25 bp, Mus musculus
gccactaaatagtgaggatgacccg

SEQ ID NO: 306542 - DNA, 25 bp, Mus musculus
gccactaccgacatctagagcctgt

SEQ ID NO: 306543 - DNA, 25 bp, Mus musculus
gccactaccgcacggactcccgtgg

SEQ ID NO: 306544 - DNA, 25 bp, Mus musculus
gccactacctacagcggcagaaccc

SEQ ID NO: 306545 - DNA, 25 bp, Mus musculus
gccactagacggttcttcatgagaa

SEQ ID NO: 306546 - DNA, 25 bp, Mus musculus
gccactagtcggaggtgtatcgtta

SEQ ID NO: 306547 - DNA, 25 bp, Mus musculus
gccactagtcggagttacagccgct

SEQ ID NO: 306548 - DNA, 25 bp, Mus musculus
gccactattgagcatgacctcctgc

SEQ ID NO: 306549 - DNA, 25 bp, Mus musculus
gccactcaaggttttgaggacttcg

SEQ ID NO: 306550 - DNA, 25 bp, Mus musculus
gccactcacgacggctccagggaac

SEQ ID NO: 306551 - DNA, 25 bp, Mus musculus
gccactcattcagggagtgttgtga

SEQ ID NO: 306552 - DNA, 25 bp, Mus musculus
gccactccagctcccggcaacttct

SEQ ID NO: 306553 - DNA, 25 bp, Mus musculus
gccactccctacaagtccctgagtt

SEQ ID NO: 306554 - DNA, 25 bp, Mus musculus
gccactccctaccgaggatgcttga

SEQ ID NO: 306555 - DNA, 25 bp, Mus musculus
gccactccctctggctctctcaaaa

SEQ ID NO: 306556 - DNA, 25 bp, Mus musculus
gccactcggctgcacatcgcaacga

SEQ ID NO: 306557 - DNA, 25 bp, Mus musculus
gccactcggctgcagatcgcaacga

SEQ ID NO: 306558 - DNA, 25 bp, Mus musculus
gccactctagcagtgttccgaatgc

SEQ ID NO: 306559 - DNA, 25 bp, Mus musculus
gccactctcagagttttgtacactc

SEQ ID NO: 306560 - DNA, 25 bp, Mus musculus
gccactctgggaggagcctgagttt

SEQ ID NO: 306561 - DNA, 25 bp, Mus musculus
gccactgaaagactcgccagtgatg

SEQ ID NO: 306562 - DNA, 25 bp, Mus musculus
gccactgaagactgagataccagag

SEQ ID NO: 306563 - DNA, 25 bp, Mus musculus
gccactgaccgagaagtgcccccgc

SEQ ID NO: 306564 - DNA, 25 bp, Mus musculus
gccactgacggaccagagtgagggc

SEQ ID NO: 306565 - DNA, 25 bp, Mus musculus
gccactgagaccccgagtggaaagc

SEQ ID NO: 306566 - DNA, 25 bp, Mus musculus
gccactgaggatgacatccgtggac

SEQ ID NO: 306567 - DNA, 25 bp, Mus musculus
gccactgataccatcctcatccctt

SEQ ID NO: 306568 - DNA, 25 bp, Mus musculus
gccactgatgcttctctgcgaggga

SEQ ID NO: 306569 - DNA, 25 bp, Mus musculus
gccactgcaaggggagcagcgcggt

SEQ ID NO: 306570 - DNA, 25 bp, Mus musculus
gccactgcacagattgcatctgggt

SEQ ID NO: 306571 - DNA, 25 bp, Mus musculus
gccactgccaggtcagatgctgctg

SEQ ID NO: 306572 - DNA, 25 bp, Mus musculus
gccactgccagtggccaaacgaaag

SEQ ID NO: 306573 - DNA, 25 bp, Mus musculus
gccactgcgcgccggagcctggcga

SEQ ID NO: 306574 - DNA, 25 bp, Mus musculus
gccactgcgcgcgcccggcatgcct

SEQ ID NO: 306575 - DNA, 25 bp, Mus musculus
gccactgcgtctcttggcctgtgga

SEQ ID NO: 306576 - DNA, 25 bp, Mus musculus
gccactgctccagggatccagaagg

SEQ ID NO: 306577 - DNA, 25 bp, Mus musculus
gccactgcttggcctgtccactggg

SEQ ID NO: 306578 - DNA, 25 bp, Mus musculus
gccactgctttgcctgtaccccagt

SEQ ID NO: 306579 - DNA, 25 bp, Mus musculus
gccactggagaggaactgtccgact

SEQ ID NO: 306580 - DNA, 25 bp, Mus musculus
gccactggagcagggtcggtgatgg

SEQ ID NO: 306581 - DNA, 25 bp, Mus musculus
gccactgggacaggacctctggaag

SEQ ID NO: 306582 - DNA, 25 bp, Mus musculus
gccactgggacagggatcatagacg

SEQ ID NO: 306583 - DNA, 25 bp, Mus musculus
gccactgggagtgaggcccagcctg

SEQ ID NO: 306584 - DNA, 25 bp, Mus musculus
gccactggtcaaggcaactattggc

SEQ ID NO: 306585 - DNA, 25 bp, Mus musculus
gccactgtaccaaggcagctcaggc

SEQ ID NO: 306586 - DNA, 25 bp, Mus musculus
gccactgtaccaagtgcagctcagt

SEQ ID NO: 306587 - DNA, 25 bp, Mus musculus
gccactgtcacggtctgtctgacac

SEQ ID NO: 306588 - DNA, 25 bp, Mus musculus
gccactgtcagaagagaaaactgcc

SEQ ID NO: 306589 - DNA, 25 bp, Mus musculus
gccactgtcagagctaaacagaaag

SEQ ID NO: 306590 - DNA, 25 bp, Mus musculus
gccactgtgagcttcaacctggctc

SEQ ID NO: 306591 - DNA, 25 bp, Mus musculus
gccactgtggccaggtccttcattc

SEQ ID NO: 306592 - DNA, 25 bp, Mus musculus
gccactgtttccgagaagagtagca

SEQ ID NO: 306593 - DNA, 25 bp, Mus musculus
gccactgtttccgagggtcagataa

SEQ ID NO: 306594 - DNA, 25 bp, Mus musculus
gccacttactacaatttctgaagtg

SEQ ID NO: 306595 - DNA, 25 bp, Mus musculus
gccacttcaggatacatcagagaag

SEQ ID NO: 306596 - DNA, 25 bp, Mus musculus
gccacttcaggtaaaatatagtttg

SEQ ID NO: 306597 - DNA, 25 bp, Mus musculus
gccacttccaaggtagcgttggtat

SEQ ID NO: 306598 - DNA, 25 bp, Mus musculus
gccacttctcaggcctacagggtgg

SEQ ID NO: 306599 - DNA, 25 bp, Mus musculus
gccacttgcaggagttcgaggaggg

SEQ ID NO: 306600 - DNA, 25 bp, Mus musculus
gccacttgcaggctgtggggtcgtg

SEQ ID NO: 306601 - DNA, 25 bp, Mus musculus
gccactttcagacctagatacttgt

SEQ ID NO: 306602 - DNA, 25 bp, Mus musculus
gccactttccaaggaatttgaagcc

SEQ ID NO: 306603 - DNA, 25 bp, Mus musculus
gccactttccagccttccccgaggt

SEQ ID NO: 306604 - DNA, 25 bp, Mus musculus
gccactttccaggtgacatatcagc

SEQ ID NO: 306605 - DNA, 25 bp, Mus musculus
gccactttgggaggggggatcgcag

SEQ ID NO: 306606 - DNA, 25 bp, Mus musculus
gccacttttgaacgggacagctttg

SEQ ID NO: 306607 - DNA, 25 bp, Mus musculus
gccagaaaagagctggactacagaa

SEQ ID NO: 306608 - DNA, 25 bp, Mus musculus
gccagaaacacagatttaccttatg

SEQ ID NO: 306609 - DNA, 25 bp, Mus musculus
gccagaaacacagggggtgcagctt

SEQ ID NO: 306610 - DNA, 25 bp, Mus musculus
gccagaaacagacagctctgtcttc

SEQ ID NO: 306611 - DNA, 25 bp, Mus musculus
gccagaaacagatctggagaattga

SEQ ID NO: 306612 - DNA, 25 bp, Mus musculus
gccagaaacagcatgccagaattcc

SEQ ID NO: 306613 - DNA, 25 bp, Mus musculus
gccagaaacatgtaggcctcattca

SEQ ID NO: 306614 - DNA, 25 bp, Mus musculus
gccagaaagtactggatccactgga

SEQ ID NO: 306615 - DNA, 25 bp, Mus musculus
gccagaaatggggctggtgtcattt

SEQ ID NO: 306616 - DNA, 25 bp, Mus musculus
gccagaaattggggttgatcgcctt

SEQ ID NO: 306617 - DNA, 25 bp, Mus musculus
gccagaacagatagtcgtacaagca

SEQ ID NO: 306618 - DNA, 25 bp, Mus musculus
gccagaacagcaccgggttgtagtc

SEQ ID NO: 306619 - DNA, 25 bp, Mus musculus
gccagaacccagctaacagagaagt

SEQ ID NO: 306620 - DNA, 25 bp, Mus musculus
gccagaacccgattcatcagtggga

SEQ ID NO: 306621 - DNA, 25 bp, Mus musculus
gccagaacccgcctagtgatgagga

SEQ ID NO: 306622 - DNA, 25 bp, Mus musculus
gccagaacccgtcttttcatctcag

SEQ ID NO: 306623 - DNA, 25 bp, Mus musculus
gccagaactacccagccacttactg

SEQ ID NO: 306624 - DNA, 25 bp, Mus musculus
gccagaactacccaggctccttcta

SEQ ID NO: 306625 - DNA, 25 bp, Mus musculus
gccagaagaagagtcgaaaggacaa

SEQ ID NO: 306626 - DNA, 25 bp, Mus musculus
gccagaagaagcgagtacttactct

SEQ ID NO: 306627 - DNA, 25 bp, Mus musculus
gccagaagaattgtgtctggaattc

SEQ ID NO: 306628 - DNA, 25 bp, Mus musculus
gccagaagactagattgaggaggag

SEQ ID NO: 306629 - DNA, 25 bp, Mus musculus
gccagaagactagccgccgtgccac

SEQ ID NO: 306630 - DNA, 25 bp, Mus musculus
gccagaagagatcctcagctctctc

SEQ ID NO: 306631 - DNA, 25 bp, Mus musculus
gccagaagagccatggcgagtgccc

SEQ ID NO: 306632 - DNA, 25 bp, Mus musculus
gccagaagcaaacgatggaggctct

SEQ ID NO: 306633 - DNA, 25 bp, Mus musculus
gccagaagcaaagggtgtgagttca

SEQ ID NO: 306634 - DNA, 25 bp, Mus musculus
gccagaagctgaacttcactggacc

SEQ ID NO: 306635 - DNA, 25 bp, Mus musculus
gccagaaggactcagatacctgatg

SEQ ID NO: 306636 - DNA, 25 bp, Mus musculus
gccagaaggactcaggctcaaaatg

SEQ ID NO: 306637 - DNA, 25 bp, Mus musculus
gccagaaggaggcggcgctctcgca

SEQ ID NO: 306638 - DNA, 25 bp, Mus musculus
gccagaatacaatattggccagcct

SEQ ID NO: 306639 - DNA, 25 bp, Mus musculus
gccagaatagaaggccgttgactac

SEQ ID NO: 306640 - DNA, 25 bp, Mus musculus
gccagaattactgcatctcccctca

SEQ ID NO: 306641 - DNA, 25 bp, Mus musculus
gccagacaatgagaggccttcagtt

SEQ ID NO: 306642 - DNA, 25 bp, Mus musculus
gccagacacattgatttgaaaccac

SEQ ID NO: 306643 - DNA, 25 bp, Mus musculus
gccagacacattgtcataacttcct

SEQ ID NO: 306644 - DNA, 25 bp, Mus musculus
gccagacacattgtgaactgccctc

SEQ ID NO: 306645 - DNA, 25 bp, Mus musculus
gccagacacccagaggctggtccag

SEQ ID NO: 306646 - DNA, 25 bp, Mus musculus
gccagacactacagggctcccagtt

SEQ ID NO: 306647 - DNA, 25 bp, Mus musculus
gccagacactacaggtaacaggatt

SEQ ID NO: 306648 - DNA, 25 bp, Mus musculus
gccagacagaaacgggacttatctg

SEQ ID NO: 306649 - DNA, 25 bp, Mus musculus
gccagacagacaggcttttgaggct

SEQ ID NO: 306650 - DNA, 25 bp, Mus musculus
gccagacagacgggtccacctcagg

SEQ ID NO: 306651 - DNA, 25 bp, Mus musculus
gccagaccaggatcaagttactggt

SEQ ID NO: 306652 - DNA, 25 bp, Mus musculus
gccagaccagttccaagaattaccc

SEQ ID NO: 306653 - DNA, 25 bp, Mus musculus
gccagaccccagcctatggtatcgc

SEQ ID NO: 306654 - DNA, 25 bp, Mus musculus
gccagacccggcatcaggaagatga

SEQ ID NO: 306655 - DNA, 25 bp, Mus musculus
gccagaccgagatgccttggatgag

SEQ ID NO: 306656 - DNA, 25 bp, Mus musculus
gccagaccgaggatcaaccattcct

SEQ ID NO: 306657 - DNA, 25 bp, Mus musculus
gccagaccgcggcgggcaggaagac

SEQ ID NO: 306658 - DNA, 25 bp, Mus musculus
gccagaccgcgggcagcgtggacat

SEQ ID NO: 306659 - DNA, 25 bp, Mus musculus
gccagacctcgggacagattgtgat

SEQ ID NO: 306660 - DNA, 25 bp, Mus musculus
gccagactacctgaagaaacagcaa

SEQ ID NO: 306661 - DNA, 25 bp, Mus musculus
gccagactacctgactctttgagat

SEQ ID NO: 306662 - DNA, 25 bp, Mus musculus
gccagactcagacacaacaacagat

SEQ ID NO: 306663 - DNA, 25 bp, Mus musculus
gccagactcaggtatctgctataga

SEQ ID NO: 306664 - DNA, 25 bp, Mus musculus
gccagactgcaaaggtgaccagagc

SEQ ID NO: 306665 - DNA, 25 bp, Mus musculus
gccagacttaaagatttcacaggtc

SEQ ID NO: 306666 - DNA, 25 bp, Mus musculus
gccagacttaaagtggcccagacgt

SEQ ID NO: 306667 - DNA, 25 bp, Mus musculus
gccagagaaggaaaaggaaacacaa

SEQ ID NO: 306668 - DNA, 25 bp, Mus musculus
gccagagaaggaacatggcttccat

SEQ ID NO: 306669 - DNA, 25 bp, Mus musculus
gccagagaaggtgcttgacatcctc

SEQ ID NO: 306670 - DNA, 25 bp, Mus musculus
gccagagaagtctttctgtcttgtc

SEQ ID NO: 306671 - DNA, 25 bp, Mus musculus
gccagagaagtgtgtgacaacttgg

SEQ ID NO: 306672 - DNA, 25 bp, Mus musculus
gccagagacacaggaacctgaggag

SEQ ID NO: 306673 - DNA, 25 bp, Mus musculus
gccagagaccgagggagggagccat

SEQ ID NO: 306674 - DNA, 25 bp, Mus musculus
gccagagagatgggtgtgattgctg

SEQ ID NO: 306675 - DNA, 25 bp, Mus musculus
gccagagagttgccggctgaatttg

SEQ ID NO: 306676 - DNA, 25 bp, Mus musculus
gccagagatacccaggggccatact

SEQ ID NO: 306677 - DNA, 25 bp, Mus musculus
gccagagatagccgactgcagatga

SEQ ID NO: 306678 - DNA, 25 bp, Mus musculus
gccagagatagccgggcatcagcag

SEQ ID NO: 306679 - DNA, 25 bp, Mus musculus
gccagagatgtcaagaaaaatcagg

SEQ ID NO: 306680 - DNA, 25 bp, Mus musculus
gccagagatgtcaaggggagagacc

SEQ ID NO: 306681 - DNA, 25 bp, Mus musculus
gccagagcaaagtaaagacatttcc

SEQ ID NO: 306682 - DNA, 25 bp, Mus musculus
gccagagcacagaggcgccgagcgc

SEQ ID NO: 306683 - DNA, 25 bp, Mus musculus
gccagagcaccctggactacattgc

SEQ ID NO: 306684 - DNA, 25 bp, Mus musculus
gccagagcactatgacccctcccag

SEQ ID NO: 306685 - DNA, 25 bp, Mus musculus
gccagagcagaagtcagcatccagt

SEQ ID NO: 306686 - DNA, 25 bp, Mus musculus
gccagagcagagaggaggtggacca

SEQ ID NO: 306687 - DNA, 25 bp, Mus musculus
gccagagcagatgaagtgagagaca

SEQ ID NO: 306688 - DNA, 25 bp, Mus musculus
gccagagcagcagggccctgttctc

SEQ ID NO: 306689 - DNA, 25 bp, Mus musculus
gccagagcagccaacatgagtctgt

SEQ ID NO: 306690 - DNA, 25 bp, Mus musculus
gccagagcaggctccttaggcttat

SEQ ID NO: 306691 - DNA, 25 bp, Mus musculus
gccagagcatggggctctctttgga

SEQ ID NO: 306692 - DNA, 25 bp, Mus musculus
gccagagccggtggcggtgggatcc

SEQ ID NO: 306693 - DNA, 25 bp, Mus musculus
gccagagcgtttggaacacctttcc

SEQ ID NO: 306694 - DNA, 25 bp, Mus musculus
gccagagcttctcggtgtggatcat

SEQ ID NO: 306695 - DNA, 25 bp, Mus musculus
gccagaggcagagtgaagaaatcga

SEQ ID NO: 306696 - DNA, 25 bp, Mus musculus
gccagaggcaggcaatgatacagga

SEQ ID NO: 306697 - DNA, 25 bp, Mus musculus
gccagaggcaggtaacctcggccgg

SEQ ID NO: 306698 - DNA, 25 bp, Mus musculus
gccagagggagccgtgtgcccagcc

SEQ ID NO: 306699 - DNA, 25 bp, Mus musculus
gccagagggaggcttcagttgtgtt

SEQ ID NO: 306700 - DNA, 25 bp, Mus musculus
gccagaggtgccaggtctgcaaagt

SEQ ID NO: 306701 - DNA, 25 bp, Mus musculus
gccagagtacgggcgtcctagtgtg

SEQ ID NO: 306702 - DNA, 25 bp, Mus musculus
gccagagtgagaaggagttgatgtg

SEQ ID NO: 306703 - DNA, 25 bp, Mus musculus
gccagagtgcagcattattgattgt

SEQ ID NO: 306704 - DNA, 25 bp, Mus musculus
gccagagttacaggaacgtcatcca

SEQ ID NO: 306705 - DNA, 25 bp, Mus musculus
gccagagttcccagatgaagaaact

SEQ ID NO: 306706 - DNA, 25 bp, Mus musculus
gccagataaaggatgccccaggtga

SEQ ID NO: 306707 - DNA, 25 bp, Mus musculus
gccagataccaggttgctggtgacc

SEQ ID NO: 306708 - DNA, 25 bp, Mus musculus
gccagataccctaactcagattagc

SEQ ID NO: 306709 - DNA, 25 bp, Mus musculus
gccagatacttcactcgctcgaaga

SEQ ID NO: 306710 - DNA, 25 bp, Mus musculus
gccagatctaggcagtgcacagccg

SEQ ID NO: 306711 - DNA, 25 bp, Mus musculus
gccagatctagtgctcacatggtct

SEQ ID NO: 306712 - DNA, 25 bp, Mus musculus
gccagatgaacagggagcattggcg

SEQ ID NO: 306713 - DNA, 25 bp, Mus musculus
gccagatgaacagttaatgtctgat

SEQ ID NO: 306714 - DNA, 25 bp, Mus musculus
gccagatgaagatgactgtcagatt

SEQ ID NO: 306715 - DNA, 25 bp, Mus musculus
gccagatgacatccctttcttgaga

SEQ ID NO: 306716 - DNA, 25 bp, Mus musculus
gccagatgagctcctcttgcggctg

SEQ ID NO: 306717 - DNA, 25 bp, Mus musculus
gccagatgaggatcatggctgctgt

SEQ ID NO: 306718 - DNA, 25 bp, Mus musculus
gccagatgcctgggccgatgatgca

SEQ ID NO: 306719 - DNA, 25 bp, Mus musculus
gccagatgcctgggcctaaccatat

SEQ ID NO: 306720 - DNA, 25 bp, Mus musculus
gccagatgctaggcatgaggtgaac

SEQ ID NO: 306721 - DNA, 25 bp, Mus musculus
gccagatgtcaagaaagcgtgtacc

SEQ ID NO: 306722 - DNA, 25 bp, Mus musculus
gccagatgtcaagatatctgtttca

SEQ ID NO: 306723 - DNA, 25 bp, Mus musculus
gccagatgtgaaagatgcaggtgat

SEQ ID NO: 306724 - DNA, 25 bp, Mus musculus
gccagatgtgaaaggtgatgaaagg

SEQ ID NO: 306725 - DNA, 25 bp, Mus musculus
gccagatgttttaatggctgttagc

SEQ ID NO: 306726 - DNA, 25 bp, Mus musculus
gccagattgggcctgtcccaggctc

SEQ ID NO: 306727 - DNA, 25 bp, Mus musculus
gccagattttcagggcattgtgctt

SEQ ID NO: 306728 - DNA, 25 bp, Mus musculus
gccagcaaatagatcagagccactg

SEQ ID NO: 306729 - DNA, 25 bp, Mus musculus
gccagcaaatagttccagggtcaca

SEQ ID NO: 306730 - DNA, 25 bp, Mus musculus
gccagcaaatgcacccaaattaaaa

SEQ ID NO: 306731 - DNA, 25 bp, Mus musculus
gccagcaacacaacaacattttttc

SEQ ID NO: 306732 - DNA, 25 bp, Mus musculus
gccagcaagatgatgactctgctgc

SEQ ID NO: 306733 - DNA, 25 bp, Mus musculus
gccagcaatgaggtaccatggttgt

SEQ ID NO: 306734 - DNA, 25 bp, Mus musculus
gccagcaatgaggtggctcacaact

SEQ ID NO: 306735 - DNA, 25 bp, Mus musculus
gccagcacaaacaggccaaactcaa

SEQ ID NO: 306736 - DNA, 25 bp, Mus musculus
gccagcacaagaaccaggcagataa

SEQ ID NO: 306737 - DNA, 25 bp, Mus musculus
gccagcacatctcagccagtgagga

SEQ ID NO: 306738 - DNA, 25 bp, Mus musculus
gccagcacatctgcagagaaaaccg

SEQ ID NO: 306739 - DNA, 25 bp, Mus musculus
gccagcaccagcactgccccccaaa

SEQ ID NO: 306740 - DNA, 25 bp, Mus musculus
gccagcacccaagcaaacactttta

SEQ ID NO: 306741 - DNA, 25 bp, Mus musculus
gccagcacccaggccctgtccagca

SEQ ID NO: 306742 - DNA, 25 bp, Mus musculus
gccagcacccgccgccgctcctctt

SEQ ID NO: 306743 - DNA, 25 bp, Mus musculus
gccagcacccggctacctgaggaca

SEQ ID NO: 306744 - DNA, 25 bp, Mus musculus
gccagcacccgggctgtggctgtac

SEQ ID NO: 306745 - DNA, 25 bp, Mus musculus
gccagcaccttctgcttcccggact

SEQ ID NO: 306746 - DNA, 25 bp, Mus musculus
gccagcacgctcaggaacaagaatt

SEQ ID NO: 306747 - DNA, 25 bp, Mus musculus
gccagcactattaaggaggccttgt

SEQ ID NO: 306748 - DNA, 25 bp, Mus musculus
gccagcactggcaggctgaagatgg

SEQ ID NO: 306749 - DNA, 25 bp, Mus musculus
gccagcagaaaccacagatgacatc

SEQ ID NO: 306750 - DNA, 25 bp, Mus musculus
gccagcagaagatgatgactattct

SEQ ID NO: 306751 - DNA, 25 bp, Mus musculus
gccagcagaagattctactcaacat

SEQ ID NO: 306752 - DNA, 25 bp, Mus musculus
gccagcagacagctcccaacccctc

SEQ ID NO: 306753 - DNA, 25 bp, Mus musculus
gccagcagagaagagtccagacaga

SEQ ID NO: 306754 - DNA, 25 bp, Mus musculus
gccagcagagaaggtgacagaaggt

SEQ ID NO: 306755 - DNA, 25 bp, Mus musculus
gccagcagcagaatcggaagactct

SEQ ID NO: 306756 - DNA, 25 bp, Mus musculus
gccagcagcagatagtttcttaatg

SEQ ID NO: 306757 - DNA, 25 bp, Mus musculus
gccagcagcagatcccagagtccca

SEQ ID NO: 306758 - DNA, 25 bp, Mus musculus
gccagcagcagattttgtggcccta

SEQ ID NO: 306759 - DNA, 25 bp, Mus musculus
gccagcagcatggctacaaaatgca

SEQ ID NO: 306760 - DNA, 25 bp, Mus musculus
gccagcagccagaaatctcataagc

SEQ ID NO: 306761 - DNA, 25 bp, Mus musculus
gccagcagccagaatgaaggcttga

SEQ ID NO: 306762 - DNA, 25 bp, Mus musculus
gccagcagccagatgaaggtctgac

SEQ ID NO: 306763 - DNA, 25 bp, Mus musculus
gccagcagcccagagcaatcaggtg

SEQ ID NO: 306764 - DNA, 25 bp, Mus musculus
gccagcagcccagatctactcttca

SEQ ID NO: 306765 - DNA, 25 bp, Mus musculus
gccagcagcccagcccactgagtgt

SEQ ID NO: 306766 - DNA, 25 bp, Mus musculus
gccagcagcccagggttggaagctg

SEQ ID NO: 306767 - DNA, 25 bp, Mus musculus
gccagcaggcggaggtgcgtggtcc

SEQ ID NO: 306768 - DNA, 25 bp, Mus musculus
gccagcagtctgtatgaggattgtg

SEQ ID NO: 306769 - DNA, 25 bp, Mus musculus
gccagcatagagggactcatgggcc

SEQ ID NO: 306770 - DNA, 25 bp, Mus musculus
gccagcataggtgcaacaagcaaca

SEQ ID NO: 306771 - DNA, 25 bp, Mus musculus
gccagcatcagggagcctgtatatg

SEQ ID NO: 306772 - DNA, 25 bp, Mus musculus
gccagcatcatgatatccgagtggt

SEQ ID NO: 306773 - DNA, 25 bp, Mus musculus
gccagcatcttccagtcaaaagaat

SEQ ID NO: 306774 - DNA, 25 bp, Mus musculus
gccagcattgagattgaccagaagc

SEQ ID NO: 306775 - DNA, 25 bp, Mus musculus
gccagcatttttcaggtcacctgcc

SEQ ID NO: 306776 - DNA, 25 bp, Mus musculus
gccagcatttttcagtccaaagaat

SEQ ID NO: 306777 - DNA, 25 bp, Mus musculus
gccagccaaagctgaatcgcggctg

SEQ ID NO: 306778 - DNA, 25 bp, Mus musculus
gccagccaaagctgagagacacaga

SEQ ID NO: 306779 - DNA, 25 bp, Mus musculus
gccagccaacggaggccggctggca

SEQ ID NO: 306780 - DNA, 25 bp, Mus musculus
gccagccaagaagaagatgaagctc

SEQ ID NO: 306781 - DNA, 25 bp, Mus musculus
gccagccaagggcaggcatcagaaa

SEQ ID NO: 306782 - DNA, 25 bp, Mus musculus
gccagccaaggtggggctgcagttg

SEQ ID NO: 306783 - DNA, 25 bp, Mus musculus
gccagccacaggcccaggccttgtc

SEQ ID NO: 306784 - DNA, 25 bp, Mus musculus
gccagccacctattgacccaaggat

SEQ ID NO: 306785 - DNA, 25 bp, Mus musculus
gccagccactcacaacccctggcct

SEQ ID NO: 306786 - DNA, 25 bp, Mus musculus
gccagccactcagaacccctggcct

SEQ ID NO: 306787 - DNA, 25 bp, Mus musculus
gccagccagaacccgcctagtgatg

SEQ ID NO: 306788 - DNA, 25 bp, Mus musculus
gccagccagaacccgtcttttcatc

SEQ ID NO: 306789 - DNA, 25 bp, Mus musculus
gccagccagccagggtcccaaaggc

SEQ ID NO: 306790 - DNA, 25 bp, Mus musculus
gccagccaggattggatccagtgtg

SEQ ID NO: 306791 - DNA, 25 bp, Mus musculus
gccagccaggcctgcagcatcaatc

SEQ ID NO: 306792 - DNA, 25 bp, Mus musculus
gccagccaggcctgtccaccatcac

SEQ ID NO: 306793 - DNA, 25 bp, Mus musculus
gccagccatgctgagcaagctcatg

SEQ ID NO: 306794 - DNA, 25 bp, Mus musculus
gccagcccaaagaggatctaagcca

SEQ ID NO: 306795 - DNA, 25 bp, Mus musculus
gccagcccaaccatgctgctgaacc

SEQ ID NO: 306796 - DNA, 25 bp, Mus musculus
gccagcccaacctggctcggaagag

SEQ ID NO: 306797 - DNA, 25 bp, Mus musculus
gccagcccagggcaaacgctacaag

SEQ ID NO: 306798 - DNA, 25 bp, Mus musculus
gccagcccaggggcacctacccgcg

SEQ ID NO: 306799 - DNA, 25 bp, Mus musculus
gccagcccaggtgcatacacagaca

SEQ ID NO: 306800 - DNA, 25 bp, Mus musculus
gccagcccaggttttacttggggtc

SEQ ID NO: 306801 - DNA, 25 bp, Mus musculus
gccagcccagtgaccaatgggaaca

SEQ ID NO: 306802 - DNA, 25 bp, Mus musculus
gccagccccacgggtctcagaggtg

SEQ ID NO: 306803 - DNA, 25 bp, Mus musculus
gccagcccccaaccatcaaatcggg

SEQ ID NO: 306804 - DNA, 25 bp, Mus musculus
gccagccctgagcaggagtctgcag

SEQ ID NO: 306805 - DNA, 25 bp, Mus musculus
gccagccctgctctcggagactgga

SEQ ID NO: 306806 - DNA, 25 bp, Mus musculus
gccagcccttcactggccccttcat

SEQ ID NO: 306807 - DNA, 25 bp, Mus musculus
gccagccgaccaggaactaggaagt

SEQ ID NO: 306808 - DNA, 25 bp, Mus musculus
gccagccgaccgaggatttggagtt

SEQ ID NO: 306809 - DNA, 25 bp, Mus musculus
gccagccgatggaaaggtcaattta

SEQ ID NO: 306810 - DNA, 25 bp, Mus musculus
gccagccgcacctacgagctcctgg

SEQ ID NO: 306811 - DNA, 25 bp, Mus musculus
gccagccgccacaggaactggtgtg

SEQ ID NO: 306812 - DNA, 25 bp, Mus musculus
gccagccgccacaggtcctgttgag

SEQ ID NO: 306813 - DNA, 25 bp, Mus musculus
gccagcctatacaaggctggacgta

SEQ ID NO: 306814 - DNA, 25 bp, Mus musculus
gccagcctattcttttacttttgga

SEQ ID NO: 306815 - DNA, 25 bp, Mus musculus
gccagcctcccaggtccacttgaag

SEQ ID NO: 306816 - DNA, 25 bp, Mus musculus
gccagcctcctgggtgttctcttcc

SEQ ID NO: 306817 - DNA, 25 bp, Mus musculus
gccagcctcctgggttggctgcaag

SEQ ID NO: 306818 - DNA, 25 bp, Mus musculus
gccagcctctgaaactagacaccat

SEQ ID NO: 306819 - DNA, 25 bp, Mus musculus
gccagcctgacatgggattctctcc

SEQ ID NO: 306820 - DNA, 25 bp, Mus musculus
gccagcctgacatgggcctccttga

SEQ ID NO: 306821 - DNA, 25 bp, Mus musculus
gccagcctgagcgagccagaggaag

SEQ ID NO: 306822 - DNA, 25 bp, Mus musculus
gccagcctggagaggtccatatcct

SEQ ID NO: 306823 - DNA, 25 bp, Mus musculus
gccagcctggcacggatgcttgcag

SEQ ID NO: 306824 - DNA, 25 bp, Mus musculus
gccagcctgtccagcaccatggctg

SEQ ID NO: 306825 - DNA, 25 bp, Mus musculus
gccagcgccgctttcccgaaagatt

SEQ ID NO: 306826 - DNA, 25 bp, Mus musculus
gccagcgccgtccgtgacctcgtga

SEQ ID NO: 306827 - DNA, 25 bp, Mus musculus
gccagcggatccgggagcctgagcc

SEQ ID NO: 306828 - DNA, 25 bp, Mus musculus
gccagcggcaagatgtcattgatca

SEQ ID NO: 306829 - DNA, 25 bp, Mus musculus
gccagcggcaaggtgcgccgtcatg

SEQ ID NO: 306830 - DNA, 25 bp, Mus musculus
gccagcggccgggggaacacacccg

SEQ ID NO: 306831 - DNA, 25 bp, Mus musculus
gccagcggcgcagaaacatctgtgg

SEQ ID NO: 306832 - DNA, 25 bp, Mus musculus
gccagcggcgcaggtgattcctcct

SEQ ID NO: 306833 - DNA, 25 bp, Mus musculus
gccagcgggaccaagactccacttc

SEQ ID NO: 306834 - DNA, 25 bp, Mus musculus
gccagcgggaccaaggttatttcgt

SEQ ID NO: 306835 - DNA, 25 bp, Mus musculus
gccagcgggagaccgggtcccagca

SEQ ID NO: 306836 - DNA, 25 bp, Mus musculus
gccagcgtagaagatccaggtgctg

SEQ ID NO: 306837 - DNA, 25 bp, Mus musculus
gccagcgtagagaaggctggcaaga

SEQ ID NO: 306838 - DNA, 25 bp, Mus musculus
gccagcgtcctaacgggcaatgtca

SEQ ID NO: 306839 - DNA, 25 bp, Mus musculus
gccagcgtggggaaacctgctcggt

SEQ ID NO: 306840 - DNA, 25 bp, Mus musculus
gccagcgtggggtctgagatcccaa

SEQ ID NO: 306841 - DNA, 25 bp, Mus musculus
gccagctaaaggtatgctaacagaa

SEQ ID NO: 306842 - DNA, 25 bp, Mus musculus
gccagctacagatgcagactcagcc

SEQ ID NO: 306843 - DNA, 25 bp, Mus musculus
gccagctcaaagctgtgtgtcaacc

SEQ ID NO: 306844 - DNA, 25 bp, Mus musculus
gccagctcagaggcaggtttttccc

SEQ ID NO: 306845 - DNA, 25 bp, Mus musculus
gccagctcaggagcgccccacccat

SEQ ID NO: 306846 - DNA, 25 bp, Mus musculus
gccagctcaggcaccttaaggatgt

SEQ ID NO: 306847 - DNA, 25 bp, Mus musculus
gccagctccaggtcacaggatgctg

SEQ ID NO: 306848 - DNA, 25 bp, Mus musculus
gccagctcccggttgcttcctagaa

SEQ ID NO: 306849 - DNA, 25 bp, Mus musculus
gccagctccggaactctgtggaact

SEQ ID NO: 306850 - DNA, 25 bp, Mus musculus
gccagctccgggcatgggatatcac

SEQ ID NO: 306851 - DNA, 25 bp, Mus musculus
gccagctcgctgagcctgttcctgc

SEQ ID NO: 306852 - DNA, 25 bp, Mus musculus
gccagctctcaccgagcgcagcctt

SEQ ID NO: 306853 - DNA, 25 bp, Mus musculus
gccagctgaaggctctgtgggtgag

SEQ ID NO: 306854 - DNA, 25 bp, Mus musculus
gccagctgacagatggcgttgacgt

SEQ ID NO: 306855 - DNA, 25 bp, Mus musculus
gccagctgacgctgagagggccttg

SEQ ID NO: 306856 - DNA, 25 bp, Mus musculus
gccagctgagcaattgtgttcggag

SEQ ID NO: 306857 - DNA, 25 bp, Mus musculus
gccagctgatcgctggtgttcgaca

SEQ ID NO: 306858 - DNA, 25 bp, Mus musculus
gccagctgcagacgaagcttcttcc

SEQ ID NO: 306859 - DNA, 25 bp, Mus musculus
gccagctgcagagaatgttgctgag

SEQ ID NO: 306860 - DNA, 25 bp, Mus musculus
gccagctgcagagcgaagtcaccct

SEQ ID NO: 306861 - DNA, 25 bp, Mus musculus
gccagctgcagctgctgataaagat

SEQ ID NO: 306862 - DNA, 25 bp, Mus musculus
gccagctgcaggccacaggcaggat

SEQ ID NO: 306863 - DNA, 25 bp, Mus musculus
gccagctgcaggtggtggctgagcc

SEQ ID NO: 306864 - DNA, 25 bp, Mus musculus
gccagctgccggactgccctccagg

SEQ ID NO: 306865 - DNA, 25 bp, Mus musculus
gccagctgcctgagggtacaagttc

SEQ ID NO: 306866 - DNA, 25 bp, Mus musculus
gccagctgctgacagtatccctgga

SEQ ID NO: 306867 - DNA, 25 bp, Mus musculus
gccagctgctgagaacccaatatgg

SEQ ID NO: 306868 - DNA, 25 bp, Mus musculus
gccagctggagacctccacacagca

SEQ ID NO: 306869 - DNA, 25 bp, Mus musculus
gccagctggagagtaggtggcattg

SEQ ID NO: 306870 - DNA, 25 bp, Mus musculus
gccagctgggagggcgtggagctgg

SEQ ID NO: 306871 - DNA, 25 bp, Mus musculus
gccagctggtggaggaggaagtgaa

SEQ ID NO: 306872 - DNA, 25 bp, Mus musculus
gccagcttagagtgcgatgcggtga

SEQ ID NO: 306873 - DNA, 25 bp, Mus musculus
gccagcttcagattcccaggaaaac

SEQ ID NO: 306874 - DNA, 25 bp, Mus musculus
gccagcttcctgcttcagtaacttg

SEQ ID NO: 306875 - DNA, 25 bp, Mus musculus
gccagcttgctgccacagctgccac

SEQ ID NO: 306876 - DNA, 25 bp, Mus musculus
gccagcttgcttgaaactttgggaa

SEQ ID NO: 306877 - DNA, 25 bp, Mus musculus
gccagcttgcttggctgaagccaac

SEQ ID NO: 306878 - DNA, 25 bp, Mus musculus
gccagcttggaggcgaatgaagtgt

SEQ ID NO: 306879 - DNA, 25 bp, Mus musculus
gccagcttgtgcggctagaagagga

SEQ ID NO: 306880 - DNA, 25 bp, Mus musculus
gccagcttgtgcgtgatattgtggt

SEQ ID NO: 306881 - DNA, 25 bp, Mus musculus
gccagctttcgacccggattctcaa

SEQ ID NO: 306882 - DNA, 25 bp, Mus musculus
gccagctttggaatctctgttggaa

SEQ ID NO: 306883 - DNA, 25 bp, Mus musculus
gccagctttggcactttctaggtaa

SEQ ID NO: 306884 - DNA, 25 bp, Mus musculus
gccagctttggggggctggctgtgg

SEQ ID NO: 306885 - DNA, 25 bp, Mus musculus
gccaggaaaagaaggtgggcgactg

SEQ ID NO: 306886 - DNA, 25 bp, Mus musculus
gccaggaaaagaagttctgggagtc

SEQ ID NO: 306887 - DNA, 25 bp, Mus musculus
gccaggaaaataagcaaaaattccc

SEQ ID NO: 306888 - DNA, 25 bp, Mus musculus
gccaggaaaataaggtgttttcacg

SEQ ID NO: 306889 - DNA, 25 bp, Mus musculus
gccaggaaaataagttctgaaaatc

SEQ ID NO: 306890 - DNA, 25 bp, Mus musculus
gccaggaaatgcaggttttccttac

SEQ ID NO: 306891 - DNA, 25 bp, Mus musculus
gccaggaaccaagaatgcttttggg

SEQ ID NO: 306892 - DNA, 25 bp, Mus musculus
gccaggaacggagggcatggctgcc

SEQ ID NO: 306893 - DNA, 25 bp, Mus musculus
gccaggaacggagttatggcattcc

SEQ ID NO: 306894 - DNA, 25 bp, Mus musculus
gccaggaacgtctttggaaagtcag

SEQ ID NO: 306895 - DNA, 25 bp, Mus musculus
gccaggaactacgagcgcgaggtag

SEQ ID NO: 306896 - DNA, 25 bp, Mus musculus
gccaggaagaaaggaaaatcagagg

SEQ ID NO: 306897 - DNA, 25 bp, Mus musculus
gccaggaatgccatttatgtcgtgt

SEQ ID NO: 306898 - DNA, 25 bp, Mus musculus
gccaggaatggacatttggtcagcg

SEQ ID NO: 306899 - DNA, 25 bp, Mus musculus
gccaggaatgtaataacatgctgta

SEQ ID NO: 306900 - DNA, 25 bp, Mus musculus
gccaggacacagaccgtgctggaat

SEQ ID NO: 306901 - DNA, 25 bp, Mus musculus
gccaggacaccaagagggaagctgc

SEQ ID NO: 306902 - DNA, 25 bp, Mus musculus
gccaggacaccagctgaggagggca

SEQ ID NO: 306903 - DNA, 25 bp, Mus musculus
gccaggaccaaaggagccaaaccag

SEQ ID NO: 306904 - DNA, 25 bp, Mus musculus
gccaggaccaaagggaccactttcc

SEQ ID NO: 306905 - DNA, 25 bp, Mus musculus
gccaggaccactgctctgctgcctg

SEQ ID NO: 306906 - DNA, 25 bp, Mus musculus
gccaggaccactggttctacgggtg

SEQ ID NO: 306907 - DNA, 25 bp, Mus musculus
gccaggaccaggctttcttgatcat

SEQ ID NO: 306908 - DNA, 25 bp, Mus musculus
gccaggaccccacctggattccgag

SEQ ID NO: 306909 - DNA, 25 bp, Mus musculus
gccaggacctgtgtgctcccacaca

SEQ ID NO: 306910 - DNA, 25 bp, Mus musculus
gccaggacgacggcccttcaaattg

SEQ ID NO: 306911 - DNA, 25 bp, Mus musculus
gccaggacggaataggaaccaagat

SEQ ID NO: 306912 - DNA, 25 bp, Mus musculus
gccaggacggggagacccatataat

SEQ ID NO: 306913 - DNA, 25 bp, Mus musculus
gccaggacgtggctccttccagcct

SEQ ID NO: 306914 - DNA, 25 bp, Mus musculus
gccaggactcggaagtggacagtgg

SEQ ID NO: 306915 - DNA, 25 bp, Mus musculus
gccaggagaatggtccgtctcccag

SEQ ID NO: 306916 - DNA, 25 bp, Mus musculus
gccaggagacacgagattccgggga

SEQ ID NO: 306917 - DNA, 25 bp, Mus musculus
gccaggagacacgggacgctgtatc

SEQ ID NO: 306918 - DNA, 25 bp, Mus musculus
gccaggagagaggggagaaagggga

SEQ ID NO: 306919 - DNA, 25 bp, Mus musculus
gccaggagagggctgctattttgat

SEQ ID NO: 306920 - DNA, 25 bp, Mus musculus
gccaggagcacagatctgggagccg

SEQ ID NO: 306921 - DNA, 25 bp, Mus musculus
gccaggagcagaggctcatctacct

SEQ ID NO: 306922 - DNA, 25 bp, Mus musculus
gccaggagcagagggggatgcccca

SEQ ID NO: 306923 - DNA, 25 bp, Mus musculus
gccaggagcagctggctgcagagct

SEQ ID NO: 306924 - DNA, 25 bp, Mus musculus
gccaggagggacgattctgacgttg

SEQ ID NO: 306925 - DNA, 25 bp, Mus musculus
gccaggagggctcgctcgaagagcc

SEQ ID NO: 306926 - DNA, 25 bp, Mus musculus
gccaggaggtttactgccggctcct

SEQ ID NO: 306927 - DNA, 25 bp, Mus musculus
gccaggagtgaagaccttgcacttg

SEQ ID NO: 306928 - DNA, 25 bp, Mus musculus
gccaggagtgagaagacataattcc

SEQ ID NO: 306929 - DNA, 25 bp, Mus musculus
gccaggagttctaggaaacagctca

SEQ ID NO: 306930 - DNA, 25 bp, Mus musculus
gccaggagttctagggtatccctcc

SEQ ID NO: 306931 - DNA, 25 bp, Mus musculus
gccaggatcgaaagccagcctgctc

SEQ ID NO: 306932 - DNA, 25 bp, Mus musculus
gccaggatctatgaggaaatgaata

SEQ ID NO: 306933 - DNA, 25 bp, Mus musculus
gccaggatctatgagttaaacgcca

SEQ ID NO: 306934 - DNA, 25 bp, Mus musculus
gccaggatctcttgcctcaatcaag

SEQ ID NO: 306935 - DNA, 25 bp, Mus musculus
gccaggatgcgctcctccgcctctg

SEQ ID NO: 306936 - DNA, 25 bp, Mus musculus
gccaggcaaggcgggcatctcctcc

SEQ ID NO: 306937 - DNA, 25 bp, Mus musculus
gccaggcaaggcgttcacagacgag

SEQ ID NO: 306938 - DNA, 25 bp, Mus musculus
gccaggcaagtggaggatccatttt

SEQ ID NO: 306939 - DNA, 25 bp, Mus musculus
gccaggcagtgaaggaccgtgcagg

SEQ ID NO: 306940 - DNA, 25 bp, Mus musculus
gccaggcagtgaaggcccttgctgc

SEQ ID NO: 306941 - DNA, 25 bp, Mus musculus
gccaggcagttcaaggcaataaaag

SEQ ID NO: 306942 - DNA, 25 bp, Mus musculus
gccaggcagttcaagggctaactta

SEQ ID NO: 306943 - DNA, 25 bp, Mus musculus
gccaggcatctatgttctgcggttc

SEQ ID NO: 306944 - DNA, 25 bp, Mus musculus
gccaggccaaggcatactttgagaa

SEQ ID NO: 306945 - DNA, 25 bp, Mus musculus
gccaggccactcaggatcggaacgt

SEQ ID NO: 306946 - DNA, 25 bp, Mus musculus
gccaggccagaaatcacaaacttcg

SEQ ID NO: 306947 - DNA, 25 bp, Mus musculus
gccaggccagcagccctagctagca

SEQ ID NO: 306948 - DNA, 25 bp, Mus musculus
gccaggccagcagcttcaccaatct

SEQ ID NO: 306949 - DNA, 25 bp, Mus musculus
gccaggccatgccatgggttctctc

SEQ ID NO: 306950 - DNA, 25 bp, Mus musculus
gccaggcccaagacatccaggccag

SEQ ID NO: 306951 - DNA, 25 bp, Mus musculus
gccaggccccgcaggtcaagacggc

SEQ ID NO: 306952 - DNA, 25 bp, Mus musculus
gccaggcccctagccaccttctagc

SEQ ID NO: 306953 - DNA, 25 bp, Mus musculus
gccaggcccttcgggagcagatggt

SEQ ID NO: 306954 - DNA, 25 bp, Mus musculus
gccaggccgcaggcatcaatacttg

SEQ ID NO: 306955 - DNA, 25 bp, Mus musculus
gccaggcgcaacctgcgggaggcaa

SEQ ID NO: 306956 - DNA, 25 bp, Mus musculus
gccaggcgcggcgggatatgtggta

SEQ ID NO: 306957 - DNA, 25 bp, Mus musculus
gccaggcgctagagctagtctaccc

SEQ ID NO: 306958 - DNA, 25 bp, Mus musculus
gccaggcgctagaggtgacccttcc

SEQ ID NO: 306959 - DNA, 25 bp, Mus musculus
gccaggcgtcccaaaaagcctctaa

SEQ ID NO: 306960 - DNA, 25 bp, Mus musculus
gccaggcgtggggccgcagcctcgt

SEQ ID NO: 306961 - DNA, 25 bp, Mus musculus
gccaggctcagccgagatgccgcgc

SEQ ID NO: 306962 - DNA, 25 bp, Mus musculus
gccaggctgaggagggaggagcagg

SEQ ID NO: 306963 - DNA, 25 bp, Mus musculus
gccaggctgtgctggccagctcagc

SEQ ID NO: 306964 - DNA, 25 bp, Mus musculus
gccaggcttaacagagccatcgtga

SEQ ID NO: 306965 - DNA, 25 bp, Mus musculus
gccaggcttgtagaaaatgatgtag

SEQ ID NO: 306966 - DNA, 25 bp, Mus musculus
gccagggaaaaggtacaactgatga

SEQ ID NO: 306967 - DNA, 25 bp, Mus musculus
gccagggaaatacagttattcatgg

SEQ ID NO: 306968 - DNA, 25 bp, Mus musculus
gccagggaagagagagagagagaga

SEQ ID NO: 306969 - DNA, 25 bp, Mus musculus
gccagggaaggctccccagaggtcc

SEQ ID NO: 306970 - DNA, 25 bp, Mus musculus
gccagggacgcgcggtgagccccag

SEQ ID NO: 306971 - DNA, 25 bp, Mus musculus
gccagggagacaaggcggactattt

SEQ ID NO: 306972 - DNA, 25 bp, Mus musculus
gccagggagatgccattgggtacct

SEQ ID NO: 306973 - DNA, 25 bp, Mus musculus
gccagggaggatggctgatcatatg

SEQ ID NO: 306974 - DNA, 25 bp, Mus musculus
gccagggaggatgggaaaacctgga

SEQ ID NO: 306975 - DNA, 25 bp, Mus musculus
gccagggagtgggagattactacaa

SEQ ID NO: 306976 - DNA, 25 bp, Mus musculus
gccagggagtgggaggtagtgtcgg

SEQ ID NO: 306977 - DNA, 25 bp, Mus musculus
gccagggagtgtggtcttctcagtt

SEQ ID NO: 306978 - DNA, 25 bp, Mus musculus
gccagggatctctctctccaccccc

SEQ ID NO: 306979 - DNA, 25 bp, Mus musculus
gccagggatctgatgcgggctcctg

SEQ ID NO: 306980 - DNA, 25 bp, Mus musculus
gccagggcaaggaggtcagacctga

SEQ ID NO: 306981 - DNA, 25 bp, Mus musculus
gccagggccaggtcctgtgcgcagg

SEQ ID NO: 306982 - DNA, 25 bp, Mus musculus
gccagggccattgtgacttcttcgt

SEQ ID NO: 306983 - DNA, 25 bp, Mus musculus
gccagggctcaggagctccttcctg

SEQ ID NO: 306984 - DNA, 25 bp, Mus musculus
gccagggctctccgaacctagctag

SEQ ID NO: 306985 - DNA, 25 bp, Mus musculus
gccagggctctccgagaccgaagcc

SEQ ID NO: 306986 - DNA, 25 bp, Mus musculus
gccagggctctccggcgcatctccc

SEQ ID NO: 306987 - DNA, 25 bp, Mus musculus
gccagggctgaggcttgttccccct

SEQ ID NO: 306988 - DNA, 25 bp, Mus musculus
gccagggcttcccagacactccgtg

SEQ ID NO: 306989 - DNA, 25 bp, Mus musculus
gccagggcttcccagagaagcgatg

SEQ ID NO: 306990 - DNA, 25 bp, Mus musculus
gccagggcttcccaggatctggaga

SEQ ID NO: 306991 - DNA, 25 bp, Mus musculus
gccaggggccccagcccctctggtt

SEQ ID NO: 306992 - DNA, 25 bp, Mus musculus
gccaggggcgagagggagctgctgc

SEQ ID NO: 306993 - DNA, 25 bp, Mus musculus
gccagggggctgacggacgagtccg

SEQ ID NO: 306994 - DNA, 25 bp, Mus musculus
gccagggggctgacggtcgaagaaa

SEQ ID NO: 306995 - DNA, 25 bp, Mus musculus
gccaggggttgaagacgttgatgtc

SEQ ID NO: 306996 - DNA, 25 bp, Mus musculus
gccagggtcactgtgactccagctc

SEQ ID NO: 306997 - DNA, 25 bp, Mus musculus
gccagggtgatcgaggggctgacat

SEQ ID NO: 306998 - DNA, 25 bp, Mus musculus
gccagggtgtgcaagggcgaccagg

SEQ ID NO: 306999 - DNA, 25 bp, Mus musculus
gccaggtaaagcctgccgggagtga

SEQ ID NO: 307000 - DNA, 25 bp, Mus musculus
gccaggtaccaggatttccaatttc

SEQ ID NO: 307001 - DNA, 25 bp, Mus musculus
gccaggtaccaggcatacttctccg

SEQ ID NO: 307002 - DNA, 25 bp, Mus musculus
gccaggtacctgatgtgatggtggt

SEQ ID NO: 307003 - DNA, 25 bp, Mus musculus
gccaggtacctgggagcccgaacca

SEQ ID NO: 307004 - DNA, 25 bp, Mus musculus
gccaggtataaaagcttatgcactg

SEQ ID NO: 307005 - DNA, 25 bp, Mus musculus
gccaggtattgagacaatgatggtg

SEQ ID NO: 307006 - DNA, 25 bp, Mus musculus
gccaggtccagaacggaggttccac

SEQ ID NO: 307007 - DNA, 25 bp, Mus musculus
gccaggtccagctggacccccaaac

SEQ ID NO: 307008 - DNA, 25 bp, Mus musculus
gccaggtcgtggggttgtgctgggc

SEQ ID NO: 307009 - DNA, 25 bp, Mus musculus
gccaggtgaacaatgcagcagcaag

SEQ ID NO: 307010 - DNA, 25 bp, Mus musculus
gccaggtgagaaatgtctcaggctg

SEQ ID NO: 307011 - DNA, 25 bp, Mus musculus
gccaggtgaggctccatcaaggtgg

SEQ ID NO: 307012 - DNA, 25 bp, Mus musculus
gccaggtgcaccagcgagcctgtca

SEQ ID NO: 307013 - DNA, 25 bp, Mus musculus
gccaggtgccccagataagccaaag

SEQ ID NO: 307014 - DNA, 25 bp, Mus musculus
gccaggtggtcatcaacggctcaga

SEQ ID NO: 307015 - DNA, 25 bp, Mus musculus
gccaggtggtgatctgcgaccagta

SEQ ID NO: 307016 - DNA, 25 bp, Mus musculus
gccaggttatacaggacattgccct

SEQ ID NO: 307017 - DNA, 25 bp, Mus musculus
gccaggtttctttcagcctccagga

SEQ ID NO: 307018 - DNA, 25 bp, Mus musculus
gccagtaaagcagtggtggcagcaa

SEQ ID NO: 307019 - DNA, 25 bp, Mus musculus
gccagtaaagcagttttcctttgga

SEQ ID NO: 307020 - DNA, 25 bp, Mus musculus
gccagtaaagcatatgggtgatttt

SEQ ID NO: 307021 - DNA, 25 bp, Mus musculus
gccagtaacagcacccaggcagaca

SEQ ID NO: 307022 - DNA, 25 bp, Mus musculus
gccagtaacaggcacatccaggacc

SEQ ID NO: 307023 - DNA, 25 bp, Mus musculus
gccagtaatacattcaaactacaac

SEQ ID NO: 307024 - DNA, 25 bp, Mus musculus
gccagtacccaggtctgtgaactcg

SEQ ID NO: 307025 - DNA, 25 bp, Mus musculus
gccagtactgtggtggcttcagtaa

SEQ ID NO: 307026 - DNA, 25 bp, Mus musculus
gccagtagcaaggaggccaatgccc

SEQ ID NO: 307027 - DNA, 25 bp, Mus musculus
gccagtagcaagttgcaggaggcca

SEQ ID NO: 307028 - DNA, 25 bp, Mus musculus
gccagtagggggtacagtcctcagg

SEQ ID NO: 307029 - DNA, 25 bp, Mus musculus
gccagtatgcaggtgtcactgaact

SEQ ID NO: 307030 - DNA, 25 bp, Mus musculus
gccagtatgcaggttgtccttgttc

SEQ ID NO: 307031 - DNA, 25 bp, Mus musculus
gccagtatggagacacggactattt

SEQ ID NO: 307032 - DNA, 25 bp, Mus musculus
gccagtatggagatcctcaccacga

SEQ ID NO: 307033 - DNA, 25 bp, Mus musculus
gccagtatttcaggagcctctttca

SEQ ID NO: 307034 - DNA, 25 bp, Mus musculus
gccagtatttcaggcaggcaacctt

SEQ ID NO: 307035 - DNA, 25 bp, Mus musculus
gccagtcaagatagccagccctgga

SEQ ID NO: 307036 - DNA, 25 bp, Mus musculus
gccagtcaagggacgcaagcgccgc

SEQ ID NO: 307037 - DNA, 25 bp, Mus musculus
gccagtcaatcaggaatgtcaagtg

SEQ ID NO: 307038 - DNA, 25 bp, Mus musculus
gccagtcactttcctaaccgcacag

SEQ ID NO: 307039 - DNA, 25 bp, Mus musculus
gccagtcactttcctaccagcaatg

SEQ ID NO: 307040 - DNA, 25 bp, Mus musculus
gccagtcagaatacagtttggtcag

SEQ ID NO: 307041 - DNA, 25 bp, Mus musculus
gccagtcagccaggttcaataagca

SEQ ID NO: 307042 - DNA, 25 bp, Mus musculus
gccagtccaattcagccaccagcac

SEQ ID NO: 307043 - DNA, 25 bp, Mus musculus
gccagtccaattcaggcatggtcca

SEQ ID NO: 307044 - DNA, 25 bp, Mus musculus
gccagtccaggcgcctctagcagcc

SEQ ID NO: 307045 - DNA, 25 bp, Mus musculus
gccagtccatcaccaagaacaagaa

SEQ ID NO: 307046 - DNA, 25 bp, Mus musculus
gccagtccccctactgtgacagata

SEQ ID NO: 307047 - DNA, 25 bp, Mus musculus
gccagtcctacagtgtctacagcta

SEQ ID NO: 307048 - DNA, 25 bp, Mus musculus
gccagtcctagaggccgggataact

SEQ ID NO: 307049 - DNA, 25 bp, Mus musculus
gccagtcctgtggtagaagaaagac

SEQ ID NO: 307050 - DNA, 25 bp, Mus musculus
gccagtccttggcagcaggaggagc

SEQ ID NO: 307051 - DNA, 25 bp, Mus musculus
gccagtctacaatcggtggagacac

SEQ ID NO: 307052 - DNA, 25 bp, Mus musculus
gccagtctcagatgatacaactctt

SEQ ID NO: 307053 - DNA, 25 bp, Mus musculus
gccagtctcagattgttatagatga

SEQ ID NO: 307054 - DNA, 25 bp, Mus musculus
gccagtctgaccgagtcagcaggac

SEQ ID NO: 307055 - DNA, 25 bp, Mus musculus
gccagtctggagttggtgtggacct

SEQ ID NO: 307056 - DNA, 25 bp, Mus musculus
gccagtctgggggaggaaagaccac

SEQ ID NO: 307057 - DNA, 25 bp, Mus musculus
gccagtgaaccggttccacttgaaa

SEQ ID NO: 307058 - DNA, 25 bp, Mus musculus
gccagtgaagtgataagttgcaagg

SEQ ID NO: 307059 - DNA, 25 bp, Mus musculus
gccagtgacacccgtgccggcatag

SEQ ID NO: 307060 - DNA, 25 bp, Mus musculus
gccagtgatatacatggagatgact

SEQ ID NO: 307061 - DNA, 25 bp, Mus musculus
gccagtgatgagatgccatccacca

SEQ ID NO: 307062 - DNA, 25 bp, Mus musculus
gccagtgcaagaatggccatttgtg

SEQ ID NO: 307063 - DNA, 25 bp, Mus musculus
gccagtgcaagatgaagcactgatt

SEQ ID NO: 307064 - DNA, 25 bp, Mus musculus
gccagtgcacaagtgcacttaatgc

SEQ ID NO: 307065 - DNA, 25 bp, Mus musculus
gccagtgcagcctggagatgcccaa

SEQ ID NO: 307066 - DNA, 25 bp, Mus musculus
gccagtgcaggcaggatctctatca

SEQ ID NO: 307067 - DNA, 25 bp, Mus musculus
gccagtgcaggcgcctcattgtgag

SEQ ID NO: 307068 - DNA, 25 bp, Mus musculus
gccagtgcccccaccggatgcagaa

SEQ ID NO: 307069 - DNA, 25 bp, Mus musculus
gccagtgcccccaggcttcccccca

SEQ ID NO: 307070 - DNA, 25 bp, Mus musculus
gccagtgcctggggttctgcagctt

SEQ ID NO: 307071 - DNA, 25 bp, Mus musculus
gccagtggaccctcatgacctactt

SEQ ID NO: 307072 - DNA, 25 bp, Mus musculus
gccagtggacgactctcaggcacag

SEQ ID NO: 307073 - DNA, 25 bp, Mus musculus
gccagtggagaagatctcttcactg

SEQ ID NO: 307074 - DNA, 25 bp, Mus musculus
gccagtgggacccagcatgctggcg

SEQ ID NO: 307075 - DNA, 25 bp, Mus musculus
gccagtggtggagccttcccatcag

SEQ ID NO: 307076 - DNA, 25 bp, Mus musculus
gccagtgtcaggtcaattaccatgc

SEQ ID NO: 307077 - DNA, 25 bp, Mus musculus
gccagtgtctcaggaatgtcaagtg

SEQ ID NO: 307078 - DNA, 25 bp, Mus musculus
gccagtgtctcaggcggcttggatt

SEQ ID NO: 307079 - DNA, 25 bp, Mus musculus
gccagtgtctcaggtgactcaagta

SEQ ID NO: 307080 - DNA, 25 bp, Mus musculus
gccagtgtctcaggtgactccaatg

SEQ ID NO: 307081 - DNA, 25 bp, Mus musculus
gccagtgtgcgcagcctggaagggc

SEQ ID NO: 307082 - DNA, 25 bp, Mus musculus
gccagtgtgcgcagcttgcttctcc

SEQ ID NO: 307083 - DNA, 25 bp, Mus musculus
gccagtgtgttaagccaaatttacg

SEQ ID NO: 307084 - DNA, 25 bp, Mus musculus
gccagtgtgttaagtattttggaaa

SEQ ID NO: 307085 - DNA, 25 bp, Mus musculus
gccagtgttcacactacctttctga

SEQ ID NO: 307086 - DNA, 25 bp, Mus musculus
gccagtgttgctgagattgccaaaa

SEQ ID NO: 307087 - DNA, 25 bp, Mus musculus
gccagtgtttgaatgaccttctttt

SEQ ID NO: 307088 - DNA, 25 bp, Mus musculus
gccagttaatgcttcaaactgttcc

SEQ ID NO: 307089 - DNA, 25 bp, Mus musculus
gccagttcagcttccaaaggccttt

SEQ ID NO: 307090 - DNA, 25 bp, Mus musculus
gccagttcaggatttccacttaaac

SEQ ID NO: 307091 - DNA, 25 bp, Mus musculus
gccagttcctgagggcagtggctca

SEQ ID NO: 307092 - DNA, 25 bp, Mus musculus
gccagttctatgatggagaatccgg

SEQ ID NO: 307093 - DNA, 25 bp, Mus musculus
gccagttcttcagtgctgagcctac

SEQ ID NO: 307094 - DNA, 25 bp, Mus musculus
gccagttgcaagtattccccttcca

SEQ ID NO: 307095 - DNA, 25 bp, Mus musculus
gccagttgcctctcagtttcagcct

SEQ ID NO: 307096 - DNA, 25 bp, Mus musculus
gccagttgggctgtgactcgaggcg

SEQ ID NO: 307097 - DNA, 25 bp, Mus musculus
gccagttggggtgctgtggacaggg

SEQ ID NO: 307098 - DNA, 25 bp, Mus musculus
gccagtttagaggtctttcagcaag

SEQ ID NO: 307099 - DNA, 25 bp, Mus musculus
gccagtttagaggttatctggaata

SEQ ID NO: 307100 - DNA, 25 bp, Mus musculus
gccagtttttccaccgctctccagc

SEQ ID NO: 307101 - DNA, 25 bp, Mus musculus
gccataaagaggaaaccactgagaa

SEQ ID NO: 307102 - DNA, 25 bp, Mus musculus
gccataaagaggaaccaggccattt

SEQ ID NO: 307103 - DNA, 25 bp, Mus musculus
gccataacctacacagcgtacggca

SEQ ID NO: 307104 - DNA, 25 bp, Mus musculus
gccataacggtggggtttgcaatag

SEQ ID NO: 307105 - DNA, 25 bp, Mus musculus
gccataagtgaagagagaagtttat

SEQ ID NO: 307106 - DNA, 25 bp, Mus musculus
gccataatgacaagtaccaggtgtg

SEQ ID NO: 307107 - DNA, 25 bp, Mus musculus
gccatacagctggtaaacaccagag

SEQ ID NO: 307108 - DNA, 25 bp, Mus musculus
gccatacatagggaaaggcaggagc

SEQ ID NO: 307109 - DNA, 25 bp, Mus musculus
gccatacatccggggactgagtggg

SEQ ID NO: 307110 - DNA, 25 bp, Mus musculus
gccatacccaatcagggggagatct

SEQ ID NO: 307111 - DNA, 25 bp, Mus musculus
gccatacccaatcaggtgatccgca

SEQ ID NO: 307112 - DNA, 25 bp, Mus musculus
gccatacccagcctggtctatacag

SEQ ID NO: 307113 - DNA, 25 bp, Mus musculus
gccataccctgttgtggcctcttcc

SEQ ID NO: 307114 - DNA, 25 bp, Mus musculus
gccatacggacacatgtgctgaagc

SEQ ID NO: 307115 - DNA, 25 bp, Mus musculus
gccatacggacttggacattaaggc

SEQ ID NO: 307116 - DNA, 25 bp, Mus musculus
gccatacggagtgagcctgtgacta

SEQ ID NO: 307117 - DNA, 25 bp, Mus musculus
gccatactatctatgcaaaagtaga

SEQ ID NO: 307118 - DNA, 25 bp, Mus musculus
gccatactatgatccctcaagaaca

SEQ ID NO: 307119 - DNA, 25 bp, Mus musculus
gccatactgaagctgacattatctc

SEQ ID NO: 307120 - DNA, 25 bp, Mus musculus
gccatagaaggttaatggagtgttt

SEQ ID NO: 307121 - DNA, 25 bp, Mus musculus
gccatagagaatcaggctgtcacca

SEQ ID NO: 307122 - DNA, 25 bp, Mus musculus
gccataggtaacattgccaagactt

SEQ ID NO: 307123 - DNA, 25 bp, Mus musculus
gccatagtgataagcaccctgtgac

SEQ ID NO: 307124 - DNA, 25 bp, Mus musculus
gccatagtgggacaatatcccagcc

SEQ ID NO: 307125 - DNA, 25 bp, Mus musculus
gccatatatgcagagatgagccgcc

SEQ ID NO: 307126 - DNA, 25 bp, Mus musculus
gccatatcatctcagatggaggctg

SEQ ID NO: 307127 - DNA, 25 bp, Mus musculus
gccatatccttccagatgtatcggg

SEQ ID NO: 307128 - DNA, 25 bp, Mus musculus
gccatatccttccagatgtatctgg

SEQ ID NO: 307129 - DNA, 25 bp, Mus musculus
gccatatccttccaggagtttatca

SEQ ID NO: 307130 - DNA, 25 bp, Mus musculus
gccatatgcagcagatttttatcat

SEQ ID NO: 307131 - DNA, 25 bp, Mus musculus
gccatatgcagcaggggggagcacc

SEQ ID NO: 307132 - DNA, 25 bp, Mus musculus
gccatattcagcagatttgtgaaaa

SEQ ID NO: 307133 - DNA, 25 bp, Mus musculus
gccatattcaggcaaatgctgaact

SEQ ID NO: 307134 - DNA, 25 bp, Mus musculus
gccatattcccgtggcatctttctt

SEQ ID NO: 307135 - DNA, 25 bp, Mus musculus
gccatattgacacacatgcgggtgg

SEQ ID NO: 307136 - DNA, 25 bp, Mus musculus
gccatattgccaatggtgcagccgg

SEQ ID NO: 307137 - DNA, 25 bp, Mus musculus
gccatatttagattataaaaaagaa

SEQ ID NO: 307138 - DNA, 25 bp, Mus musculus
gccatatttagcattcccgtcaata

SEQ ID NO: 307139 - DNA, 25 bp, Mus musculus
gccatcaaacaggttactatgaaaa

SEQ ID NO: 307140 - DNA, 25 bp, Mus musculus
gccatcaaacagtcaaaatatctgt

SEQ ID NO: 307141 - DNA, 25 bp, Mus musculus
gccatcaaccaggaaagccgggtga

SEQ ID NO: 307142 - DNA, 25 bp, Mus musculus
gccatcaactacaagctgtatcttt

SEQ ID NO: 307143 - DNA, 25 bp, Mus musculus
gccatcaactacaagggcccaccct

SEQ ID NO: 307144 - DNA, 25 bp, Mus musculus
gccatcaactggaccctcattcatg

SEQ ID NO: 307145 - DNA, 25 bp, Mus musculus
gccatcaagcagggtttcaaagata

SEQ ID NO: 307146 - DNA, 25 bp, Mus musculus
gccatcaaggtagaggcccctaaca

SEQ ID NO: 307147 - DNA, 25 bp, Mus musculus
gccatcaatgttggccccacgggta

SEQ ID NO: 307148 - DNA, 25 bp, Mus musculus
gccatcaatgttggtggtggcttcc

SEQ ID NO: 307149 - DNA, 25 bp, Mus musculus
gccatcacacacacttccttcccat

SEQ ID NO: 307150 - DNA, 25 bp, Mus musculus
gccatcacacacagatctcagtaag

SEQ ID NO: 307151 - DNA, 25 bp, Mus musculus
gccatcacagatgccgcaatgatgg

SEQ ID NO: 307152 - DNA, 25 bp, Mus musculus
gccatcacaggccggatcccagata

SEQ ID NO: 307153 - DNA, 25 bp, Mus musculus
gccatcacaggcttctgtgtcagtc

SEQ ID NO: 307154 - DNA, 25 bp, Mus musculus
gccatcaccaagatgacacttggga

SEQ ID NO: 307155 - DNA, 25 bp, Mus musculus
gccatcaccaagcccccgaggcatg

SEQ ID NO: 307156 - DNA, 25 bp, Mus musculus
gccatcaccaaggaagatttggaaa

SEQ ID NO: 307157 - DNA, 25 bp, Mus musculus
gccatcaccaaggatcagttcatgt

SEQ ID NO: 307158 - DNA, 25 bp, Mus musculus
gccatcaccaagtcagaaggtcagt

SEQ ID NO: 307159 - DNA, 25 bp, Mus musculus
gccatcaccagggtgtttccacagg

SEQ ID NO: 307160 - DNA, 25 bp, Mus musculus
gccatcacccgaaacaggccaccat

SEQ ID NO: 307161 - DNA, 25 bp, Mus musculus
gccatcacctatgagacactaaagt

SEQ ID NO: 307162 - DNA, 25 bp, Mus musculus
gccatcacctatgagagcggagaag

SEQ ID NO: 307163 - DNA, 25 bp, Mus musculus
gccatcacctatgagatggtagaag

SEQ ID NO: 307164 - DNA, 25 bp, Mus musculus
gccatcaccttggcatttagtaaga

SEQ ID NO: 307165 - DNA, 25 bp, Mus musculus
gccatcactctcaacctgctgtcgc

SEQ ID NO: 307166 - DNA, 25 bp, Mus musculus
gccatcactctccggatgttgggaa

SEQ ID NO: 307167 - DNA, 25 bp, Mus musculus
gccatcactgatgtgtccttccggc

SEQ ID NO: 307168 - DNA, 25 bp, Mus musculus
gccatcactgcttcaccacgaccac

SEQ ID NO: 307169 - DNA, 25 bp, Mus musculus
gccatcactggccgagctctgcttc

SEQ ID NO: 307170 - DNA, 25 bp, Mus musculus
gccatcagacactggtgaggagcat

SEQ ID NO: 307171 - DNA, 25 bp, Mus musculus
gccatcagacatattggctggatcc

SEQ ID NO: 307172 - DNA, 25 bp, Mus musculus
gccatcagagagacatcttctctgt

SEQ ID NO: 307173 - DNA, 25 bp, Mus musculus
gccatcagccaggtcaggaatctac

SEQ ID NO: 307174 - DNA, 25 bp, Mus musculus
gccatcagcccaggatgctatctcc

SEQ ID NO: 307175 - DNA, 25 bp, Mus musculus
gccatcagcccaggcgattaaatcc

SEQ ID NO: 307176 - DNA, 25 bp, Mus musculus
gccatcaggaagggatgcggtaaaa

SEQ ID NO: 307177 - DNA, 25 bp, Mus musculus
gccatcagggaagatacattgtgtg

SEQ ID NO: 307178 - DNA, 25 bp, Mus musculus
gccatcagggaagcttccctgttga

SEQ ID NO: 307179 - DNA, 25 bp, Mus musculus
gccatcagtcctctacgaatgtcca

SEQ ID NO: 307180 - DNA, 25 bp, Mus musculus
gccatcagtgaatcaaaggataaat

SEQ ID NO: 307181 - DNA, 25 bp, Mus musculus
gccatcataggtacccaggatattg

SEQ ID NO: 307182 - DNA, 25 bp, Mus musculus
gccatcatcacaggtattccagcat

SEQ ID NO: 307183 - DNA, 25 bp, Mus musculus
gccatcatcagatggcaaggtcagc

SEQ ID NO: 307184 - DNA, 25 bp, Mus musculus
gccatcatcagctctaggagttcca

SEQ ID NO: 307185 - DNA, 25 bp, Mus musculus
gccatcatcgaacagactcaccacc

SEQ ID NO: 307186 - DNA, 25 bp, Mus musculus
gccatcatcgaacagttcatgcaac

SEQ ID NO: 307187 - DNA, 25 bp, Mus musculus
gccatcatcggagaagcttctgaga

SEQ ID NO: 307188 - DNA, 25 bp, Mus musculus
gccatcatcggcgctggcgagaacc

SEQ ID NO: 307189 - DNA, 25 bp, Mus musculus
gccatcatgcgcccgaatgacagtc

SEQ ID NO: 307190 - DNA, 25 bp, Mus musculus
gccatcattgcaatctccacatggt

SEQ ID NO: 307191 - DNA, 25 bp, Mus musculus
gccatcattgcagctgtgatcactg

SEQ ID NO: 307192 - DNA, 25 bp, Mus musculus
gccatcattggaaagatctataccc

SEQ ID NO: 307193 - DNA, 25 bp, Mus musculus
gccatccaaggatgaggccatcctc

SEQ ID NO: 307194 - DNA, 25 bp, Mus musculus
gccatccacacgttccgccaggtac

SEQ ID NO: 307195 - DNA, 25 bp, Mus musculus
gccatccacccggctgccaataact

SEQ ID NO: 307196 - DNA, 25 bp, Mus musculus
gccatccagaggcagctgcgagctt

SEQ ID NO: 307197 - DNA, 25 bp, Mus musculus
gccatccagctcactactgtaacag

SEQ ID NO: 307198 - DNA, 25 bp, Mus musculus
gccatccatcgcaagtccacttgat

SEQ ID NO: 307199 - DNA, 25 bp, Mus musculus
gccatccatgacaaggagtatgtca

SEQ ID NO: 307200 - DNA, 25 bp, Mus musculus
gccatccatgccagtttgccttcta

SEQ ID NO: 307201 - DNA, 25 bp, Mus musculus
gccatcccaaccgagatcctatgat

SEQ ID NO: 307202 - DNA, 25 bp, Mus musculus
gccatcccaagaccctcctcatccg

SEQ ID NO: 307203 - DNA, 25 bp, Mus musculus
gccatcccactattggctttggacc

SEQ ID NO: 307204 - DNA, 25 bp, Mus musculus
gccatcccagccaatggcagcccca

SEQ ID NO: 307205 - DNA, 25 bp, Mus musculus
gccatcccagccaccctgggcggaa

SEQ ID NO: 307206 - DNA, 25 bp, Mus musculus
gccatcccagggaacaggaagaaga

SEQ ID NO: 307207 - DNA, 25 bp, Mus musculus
gccatcccagtgatgaatctggcta

SEQ ID NO: 307208 - DNA, 25 bp, Mus musculus
gccatcccagtgatggctaccatag

SEQ ID NO: 307209 - DNA, 25 bp, Mus musculus
gccatcccatcacctggaacaacct

SEQ ID NO: 307210 - DNA, 25 bp, Mus musculus
gccatccccagaggattatcacaaa

SEQ ID NO: 307211 - DNA, 25 bp, Mus musculus
gccatccccagccctattcaggtta

SEQ ID NO: 307212 - DNA, 25 bp, Mus musculus
gccatccccagccctcaacttaatg

SEQ ID NO: 307213 - DNA, 25 bp, Mus musculus
gccatcccccgcttgaaagatgcca

SEQ ID NO: 307214 - DNA, 25 bp, Mus musculus
gccatcccgaggcagaaatgtctgc

SEQ ID NO: 307215 - DNA, 25 bp, Mus musculus
gccatcccgagggagaaatgtctgc

SEQ ID NO: 307216 - DNA, 25 bp, Mus musculus
gccatccctgctgtgggcctccctg

SEQ ID NO: 307217 - DNA, 25 bp, Mus musculus
gccatccctggatgtcagtgctctt

SEQ ID NO: 307218 - DNA, 25 bp, Mus musculus
gccatccgagcagtggcaaagcaac

SEQ ID NO: 307219 - DNA, 25 bp, Mus musculus
gccatccgcgccaagaacatttaaa

SEQ ID NO: 307220 - DNA, 25 bp, Mus musculus
gccatccggagccagaatgacagcc

SEQ ID NO: 307221 - DNA, 25 bp, Mus musculus
gccatccggagccaggtcatccacg

SEQ ID NO: 307222 - DNA, 25 bp, Mus musculus
gccatccgggaagggaaactgcccg

SEQ ID NO: 307223 - DNA, 25 bp, Mus musculus
gccatccggttgttgccgaatacac

SEQ ID NO: 307224 - DNA, 25 bp, Mus musculus
gccatcctcagagatggccgccaag

SEQ ID NO: 307225 - DNA, 25 bp, Mus musculus
gccatcctcaggtgagactttcaaa

SEQ ID NO: 307226 - DNA, 25 bp, Mus musculus
gccatcctcaggtgtgtggtagaag

SEQ ID NO: 307227 - DNA, 25 bp, Mus musculus
gccatcctcaggttcaggcagctgc

SEQ ID NO: 307228 - DNA, 25 bp, Mus musculus
gccatcctcggtttctacttattct

SEQ ID NO: 307229 - DNA, 25 bp, Mus musculus
gccatcctggcgatcattacagggg

SEQ ID NO: 307230 - DNA, 25 bp, Mus musculus
gccatcctggcggggaattctaccg

SEQ ID NO: 307231 - DNA, 25 bp, Mus musculus
gccatcctgggttgctcttctggtg

SEQ ID NO: 307232 - DNA, 25 bp, Mus musculus
gccatccttgaaattttctgaattc

SEQ ID NO: 307233 - DNA, 25 bp, Mus musculus
gccatccttgaatgtccagtttcag

SEQ ID NO: 307234 - DNA, 25 bp, Mus musculus
gccatccttgctcggcgtcctaccc

SEQ ID NO: 307235 - DNA, 25 bp, Mus musculus
gccatccttggtgaggctttccctg

SEQ ID NO: 307236 - DNA, 25 bp, Mus musculus
gccatccttgtcgctgcggatggga

SEQ ID NO: 307237 - DNA, 25 bp, Mus musculus
gccatcgaaagaacttgtcaatgtc

SEQ ID NO: 307238 - DNA, 25 bp, Mus musculus
gccatcgagcaggtattcccaagcc

SEQ ID NO: 307239 - DNA, 25 bp, Mus musculus
gccatcgagcaggtgtcaccggatg

SEQ ID NO: 307240 - DNA, 25 bp, Mus musculus
gccatcgaggaggtgtaccacagca

SEQ ID NO: 307241 - DNA, 25 bp, Mus musculus
gccatcgatgacgtgaaaagacacc

SEQ ID NO: 307242 - DNA, 25 bp, Mus musculus
gccatcgatgcagtgaagcctggtg

SEQ ID NO: 307243 - DNA, 25 bp, Mus musculus
gccatcgctgcattctgctctggcc

SEQ ID NO: 307244 - DNA, 25 bp, Mus musculus
gccatcggacctgatttcaagtcca

SEQ ID NO: 307245 - DNA, 25 bp, Mus musculus
gccatcggacctgctatctgatgtc

SEQ ID NO: 307246 - DNA, 25 bp, Mus musculus
gccatcggatcaatggctctgcctg

SEQ ID NO: 307247 - DNA, 25 bp, Mus musculus
gccatcggccaggtttggccgtcgt

SEQ ID NO: 307248 - DNA, 25 bp, Mus musculus
gccatcggccagtgggatctggtgt

SEQ ID NO: 307249 - DNA, 25 bp, Mus musculus
gccatcggtacagggactgagacta

SEQ ID NO: 307250 - DNA, 25 bp, Mus musculus
gccatcgtaggtgccgatccccttg

SEQ ID NO: 307251 - DNA, 25 bp, Mus musculus
gccatcgttaaggtcttccatggtg

SEQ ID NO: 307252 - DNA, 25 bp, Mus musculus
gccatctaagcccagagtgacctcc

SEQ ID NO: 307253 - DNA, 25 bp, Mus musculus
gccatctacaggctgtttgattatc

SEQ ID NO: 307254 - DNA, 25 bp, Mus musculus
gccatctacagtggctacagctttg

SEQ ID NO: 307255 - DNA, 25 bp, Mus musculus
gccatctacgaggtagatgcacggg

SEQ ID NO: 307256 - DNA, 25 bp, Mus musculus
gccatctacgaggttcccaaagagg

SEQ ID NO: 307257 - DNA, 25 bp, Mus musculus
gccatctacttgcaccggaaggaat

SEQ ID NO: 307258 - DNA, 25 bp, Mus musculus
gccatctagcactaagagcggcgct

SEQ ID NO: 307259 - DNA, 25 bp, Mus musculus
gccatctagctaatggggtagctgg

SEQ ID NO: 307260 - DNA, 25 bp, Mus musculus
gccatctagtgctcttcctcctggc

SEQ ID NO: 307261 - DNA, 25 bp, Mus musculus
gccatctcagctgtggtcctctaac

SEQ ID NO: 307262 - DNA, 25 bp, Mus musculus
gccatctcaggtgagttggagtgag

SEQ ID NO: 307263 - DNA, 25 bp, Mus musculus
gccatctcaggtgttcctgtataaa

SEQ ID NO: 307264 - DNA, 25 bp, Mus musculus
gccatctcaggttgtactttctcca

SEQ ID NO: 307265 - DNA, 25 bp, Mus musculus
gccatctccagacagataccagaag

SEQ ID NO: 307266 - DNA, 25 bp, Mus musculus
gccatctgccggctctgggggacct

SEQ ID NO: 307267 - DNA, 25 bp, Mus musculus
gccatctgccgggaaggaagcacag

SEQ ID NO: 307268 - DNA, 25 bp, Mus musculus
gccatctggcaaagggtatacctgg

SEQ ID NO: 307269 - DNA, 25 bp, Mus musculus
gccatctgggaagatgtctgcaata

SEQ ID NO: 307270 - DNA, 25 bp, Mus musculus
gccatctgtactgtgtacagtgctt

SEQ ID NO: 307271 - DNA, 25 bp, Mus musculus
gccatctgtgcaggtcctacggctc

SEQ ID NO: 307272 - DNA, 25 bp, Mus musculus
gccatctgtgggagtatgtcatggc

SEQ ID NO: 307273 - DNA, 25 bp, Mus musculus
gccatcttccccaggttctccaagc

SEQ ID NO: 307274 - DNA, 25 bp, Mus musculus
gccatcttgtggggatctacttcac

SEQ ID NO: 307275 - DNA, 25 bp, Mus musculus
gccatcttgtgggggtcttctgggt

SEQ ID NO: 307276 - DNA, 25 bp, Mus musculus
gccatctttgaaatgcccatttggg

SEQ ID NO: 307277 - DNA, 25 bp, Mus musculus
gccatctttgatcgggtgctgacag

SEQ ID NO: 307278 - DNA, 25 bp, Mus musculus
gccatctttgatcggtccctctcca

SEQ ID NO: 307279 - DNA, 25 bp, Mus musculus
gccatgaaacccaattccaaatcta

SEQ ID NO: 307280 - DNA, 25 bp, Mus musculus
gccatgaaaggaacagagtgggtgg

SEQ ID NO: 307281 - DNA, 25 bp, Mus musculus
gccatgaaaggaccccgagaggaga

SEQ ID NO: 307282 - DNA, 25 bp, Mus musculus
gccatgaaaggcgttaagcatctga

SEQ ID NO: 307283 - DNA, 25 bp, Mus musculus
gccatgaaatggccctgcggattgt

SEQ ID NO: 307284 - DNA, 25 bp, Mus musculus
gccatgaacgcccgggcctggaagc

SEQ ID NO: 307285 - DNA, 25 bp, Mus musculus
gccatgaagaacaattgccagccat

SEQ ID NO: 307286 - DNA, 25 bp, Mus musculus
gccatgaagaacgtgaccgagctga

SEQ ID NO: 307287 - DNA, 25 bp, Mus musculus
gccatgaagaacttccacaggagag

SEQ ID NO: 307288 - DNA, 25 bp, Mus musculus
gccatgaagcacgagaacgaggccc

SEQ ID NO: 307289 - DNA, 25 bp, Mus musculus
gccatgaagcaggtggcaggtacca

SEQ ID NO: 307290 - DNA, 25 bp, Mus musculus
gccatgaagtgggctttgttatcca

SEQ ID NO: 307291 - DNA, 25 bp, Mus musculus
gccatgacaagatcgtgattgtgct

SEQ ID NO: 307292 - DNA, 25 bp, Mus musculus
gccatgacagatcagacctactgtg

SEQ ID NO: 307293 - DNA, 25 bp, Mus musculus
gccatgaccaaggacaaacagaaga

SEQ ID NO: 307294 - DNA, 25 bp, Mus musculus
gccatgaccacagctgttggtctga

SEQ ID NO: 307295 - DNA, 25 bp, Mus musculus
gccatgaccccagtgaccgtctggt

SEQ ID NO: 307296 - DNA, 25 bp, Mus musculus
gccatgaccggatttaattggtgat

SEQ ID NO: 307297 - DNA, 25 bp, Mus musculus
gccatgaccggcttccttcaataag

SEQ ID NO: 307298 - DNA, 25 bp, Mus musculus
gccatgactattctcccggggccgc

SEQ ID NO: 307299 - DNA, 25 bp, Mus musculus
gccatgactttggcaccaggaagcc

SEQ ID NO: 307300 - DNA, 25 bp, Mus musculus
gccatgagagagatcccatggtttc

SEQ ID NO: 307301 - DNA, 25 bp, Mus musculus
gccatgagagaggactgcctccaga

SEQ ID NO: 307302 - DNA, 25 bp, Mus musculus
gccatgagagaggtatatgctatga

SEQ ID NO: 307303 - DNA, 25 bp, Mus musculus
gccatgagagttgactctgtgcaga

SEQ ID NO: 307304 - DNA, 25 bp, Mus musculus
gccatgagagttgggcacttgctgg

SEQ ID NO: 307305 - DNA, 25 bp, Mus musculus
gccatgagcaaagaggtgcaagatc

SEQ ID NO: 307306 - DNA, 25 bp, Mus musculus
gccatgaggtcacgtaaacagagag

SEQ ID NO: 307307 - DNA, 25 bp, Mus musculus
gccatgagtcagaagcccatctcgg

SEQ ID NO: 307308 - DNA, 25 bp, Mus musculus
gccatgagtcagaaggtgttgcagc

SEQ ID NO: 307309 - DNA, 25 bp, Mus musculus
gccatgagttcgagcccgccggagt

SEQ ID NO: 307310 - DNA, 25 bp, Mus musculus
gccatgatccagagtcaggtgtggc

SEQ ID NO: 307311 - DNA, 25 bp, Mus musculus
gccatgatggctgaccatgatgtgc

SEQ ID NO: 307312 - DNA, 25 bp, Mus musculus
gccatgatggttactaactttcaga

SEQ ID NO: 307313 - DNA, 25 bp, Mus musculus
gccatgattagagggggacatgtca

SEQ ID NO: 307314 - DNA, 25 bp, Mus musculus
gccatgatttatgggctcattgttg

SEQ ID NO: 307315 - DNA, 25 bp, Mus musculus
gccatgatttatgtttgagattgct

SEQ ID NO: 307316 - DNA, 25 bp, Mus musculus
gccatgcaaactcgccctgggcagt

SEQ ID NO: 307317 - DNA, 25 bp, Mus musculus
gccatgcacggagttgtgggaccgt

SEQ ID NO: 307318 - DNA, 25 bp, Mus musculus
gccatgcaggatgccagccccgcct

SEQ ID NO: 307319 - DNA, 25 bp, Mus musculus
gccatgcagtgtgtggcacctctgc

SEQ ID NO: 307320 - DNA, 25 bp, Mus musculus
gccatgccaattgaggtcatgatga

SEQ ID NO: 307321 - DNA, 25 bp, Mus musculus
gccatgccaggaactccatggcggc

SEQ ID NO: 307322 - DNA, 25 bp, Mus musculus
gccatgccaggaggaaaggggaagg

SEQ ID NO: 307323 - DNA, 25 bp, Mus musculus
gccatgccaggtatgcaggacatgc

SEQ ID NO: 307324 - DNA, 25 bp, Mus musculus
gccatgccaggtgtgtttgatcaca

SEQ ID NO: 307325 - DNA, 25 bp, Mus musculus
gccatgctcattgtgattatgtggg

SEQ ID NO: 307326 - DNA, 25 bp, Mus musculus
gccatgctcattgtggtactgatag

SEQ ID NO: 307327 - DNA, 25 bp, Mus musculus
gccatgctccgaaagcatgtggaat

SEQ ID NO: 307328 - DNA, 25 bp, Mus musculus
gccatgctcgtgggctccctgctgg

SEQ ID NO: 307329 - DNA, 25 bp, Mus musculus
gccatgctctataaggatgttcgca

SEQ ID NO: 307330 - DNA, 25 bp, Mus musculus
gccatgctctctggtcttgtgcaac

SEQ ID NO: 307331 - DNA, 25 bp, Mus musculus
gccatgctctgcgttgctgctctcc

SEQ ID NO: 307332 - DNA, 25 bp, Mus musculus
gccatgctgagcaagctcatgttgg

SEQ ID NO: 307333 - DNA, 25 bp, Mus musculus
gccatgctgcaggtgctgggcccca

SEQ ID NO: 307334 - DNA, 25 bp, Mus musculus
gccatgctgtccagagatgggtggc

SEQ ID NO: 307335 - DNA, 25 bp, Mus musculus
gccatgctgtgccttgcacaacccg

SEQ ID NO: 307336 - DNA, 25 bp, Mus musculus
gccatgctgttctgaatgaagggac

SEQ ID NO: 307337 - DNA, 25 bp, Mus musculus
gccatgcttcctctaacagcagcgt

SEQ ID NO: 307338 - DNA, 25 bp, Mus musculus
gccatggaacaggaggaagtgaaca

SEQ ID NO: 307339 - DNA, 25 bp, Mus musculus
gccatggaatccacagttgatgatg

SEQ ID NO: 307340 - DNA, 25 bp, Mus musculus
gccatggaatccctttcagaaatca

SEQ ID NO: 307341 - DNA, 25 bp, Mus musculus
gccatggaatccgataaagataaag

SEQ ID NO: 307342 - DNA, 25 bp, Mus musculus
gccatggagatggagcagttgacct

SEQ ID NO: 307343 - DNA, 25 bp, Mus musculus
gccatggagctctttctacctccag

SEQ ID NO: 307344 - DNA, 25 bp, Mus musculus
gccatggaggaggagagtataaagg

SEQ ID NO: 307345 - DNA, 25 bp, Mus musculus
gccatggaggaggctacgcaagggc

SEQ ID NO: 307346 - DNA, 25 bp, Mus musculus
gccatggaggaggggccttcatgat

SEQ ID NO: 307347 - DNA, 25 bp, Mus musculus
gccatggagttaagcacggaaataa

SEQ ID NO: 307348 - DNA, 25 bp, Mus musculus
gccatggagttaagtggctaaaagc

SEQ ID NO: 307349 - DNA, 25 bp, Mus musculus
gccatggatggcggggatctgatga

SEQ ID NO: 307350 - DNA, 25 bp, Mus musculus
gccatggatggtgttgttacagatc

SEQ ID NO: 307351 - DNA, 25 bp, Mus musculus
gccatggatgtccagctggctaacc

SEQ ID NO: 307352 - DNA, 25 bp, Mus musculus
gccatggatgttggcaaggcccgag

SEQ ID NO: 307353 - DNA, 25 bp, Mus musculus
gccatggcagcaaacccctccccct

SEQ ID NO: 307354 - DNA, 25 bp, Mus musculus
gccatggcagcaaagatccctcccc

SEQ ID NO: 307355 - DNA, 25 bp, Mus musculus
gccatggcgaaccaggtgatcaggt

SEQ ID NO: 307356 - DNA, 25 bp, Mus musculus
gccatggcgcctgtgaaaaagcttg

SEQ ID NO: 307357 - DNA, 25 bp, Mus musculus
gccatggcgctccagactgtaccca

SEQ ID NO: 307358 - DNA, 25 bp, Mus musculus
gccatggcgctccagaggctggagg

SEQ ID NO: 307359 - DNA, 25 bp, Mus musculus
gccatggcgctccagggacctctga

SEQ ID NO: 307360 - DNA, 25 bp, Mus musculus
gccatggcgctccaggtgcccatca

SEQ ID NO: 307361 - DNA, 25 bp, Mus musculus
gccatggcggccaggaggacacatg

SEQ ID NO: 307362 - DNA, 25 bp, Mus musculus
gccatggcggctctacagccagaat

SEQ ID NO: 307363 - DNA, 25 bp, Mus musculus
gccatggcggctctaggctccagca

SEQ ID NO: 307364 - DNA, 25 bp, Mus musculus
gccatggcgggcaggaggacacatg

SEQ ID NO: 307365 - DNA, 25 bp, Mus musculus
gccatggcggggcccctaacggcta

SEQ ID NO: 307366 - DNA, 25 bp, Mus musculus
gccatggctcgcaggtttgcctgca

SEQ ID NO: 307367 - DNA, 25 bp, Mus musculus
gccatggctctgcaggtagccagaa

SEQ ID NO: 307368 - DNA, 25 bp, Mus musculus
gccatggctgacaagatcctgaggg

SEQ ID NO: 307369 - DNA, 25 bp, Mus musculus
gccatggctgagactctgaagactc

SEQ ID NO: 307370 - DNA, 25 bp, Mus musculus
gccatgggaaacctgaatctgtatc

SEQ ID NO: 307371 - DNA, 25 bp, Mus musculus
gccatgggctcccggccccgtgggg

SEQ ID NO: 307372 - DNA, 25 bp, Mus musculus
gccatgggctgaactacgctgccat

SEQ ID NO: 307373 - DNA, 25 bp, Mus musculus
gccatggggcaggcagtgacgcgcc

SEQ ID NO: 307374 - DNA, 25 bp, Mus musculus
gccatggtgaaggtgtttagctctg

SEQ ID NO: 307375 - DNA, 25 bp, Mus musculus
gccatggttggcaggtgaatttgga

SEQ ID NO: 307376 - DNA, 25 bp, Mus musculus
gccatgtaagcagctgtccggcaga

SEQ ID NO: 307377 - DNA, 25 bp, Mus musculus
gccatgtacccagaggatcattaca

SEQ ID NO: 307378 - DNA, 25 bp, Mus musculus
gccatgtacccccatgcccggttac

SEQ ID NO: 307379 - DNA, 25 bp, Mus musculus
gccatgtacccgcacgtgacacaag

SEQ ID NO: 307380 - DNA, 25 bp, Mus musculus
gccatgtacgagctggtggtgattt

SEQ ID NO: 307381 - DNA, 25 bp, Mus musculus
gccatgtataaagatgtggtgaagg

SEQ ID NO: 307382 - DNA, 25 bp, Mus musculus
gccatgtataaagttctagatgtgg

SEQ ID NO: 307383 - DNA, 25 bp, Mus musculus
gccatgtatgtttccaccggctccc

SEQ ID NO: 307384 - DNA, 25 bp, Mus musculus
gccatgtattccccgtgaatccctt

SEQ ID NO: 307385 - DNA, 25 bp, Mus musculus
gccatgtcaaaaaggtatggttccg

SEQ ID NO: 307386 - DNA, 25 bp, Mus musculus
gccatgtcactcacccccaattcca

SEQ ID NO: 307387 - DNA, 25 bp, Mus musculus
gccatgtcagccagtataatgtttg

SEQ ID NO: 307388 - DNA, 25 bp, Mus musculus
gccatgtccaagcggggtgccacgg

SEQ ID NO: 307389 - DNA, 25 bp, Mus musculus
gccatgtctccatgtcttcctccaa

SEQ ID NO: 307390 - DNA, 25 bp, Mus musculus
gccatgtctgcaagcatcctggtca

SEQ ID NO: 307391 - DNA, 25 bp, Mus musculus
gccatgtggactggcaggctgtggg

SEQ ID NO: 307392 - DNA, 25 bp, Mus musculus
gccatgtggttcatcggctggactg

SEQ ID NO: 307393 - DNA, 25 bp, Mus musculus
gccatgtgtttgagatcctgtcaaa

SEQ ID NO: 307394 - DNA, 25 bp, Mus musculus
gccatgttactgcacgaccacagga

SEQ ID NO: 307395 - DNA, 25 bp, Mus musculus
gccatgttactggagtgccgatggc

SEQ ID NO: 307396 - DNA, 25 bp, Mus musculus
gccatgttcctagagtacaacaaag

SEQ ID NO: 307397 - DNA, 25 bp, Mus musculus
gccatgttgcagaggttctcaggac

SEQ ID NO: 307398 - DNA, 25 bp, Mus musculus
gccatgttggatgccgccttggacc

SEQ ID NO: 307399 - DNA, 25 bp, Mus musculus
gccattaaacatgcccactgtcacg

SEQ ID NO: 307400 - DNA, 25 bp, Mus musculus
gccattaaagatttcattatgaaag

SEQ ID NO: 307401 - DNA, 25 bp, Mus musculus
gccattaacaaggaccctgcagtgg

SEQ ID NO: 307402 - DNA, 25 bp, Mus musculus
gccattaacaaggagacgactgcac

SEQ ID NO: 307403 - DNA, 25 bp, Mus musculus
gccattacaaacagtggccagtttc

SEQ ID NO: 307404 - DNA, 25 bp, Mus musculus
gccattactcgcagggcaacaaaga

SEQ ID NO: 307405 - DNA, 25 bp, Mus musculus
gccattactcgcagtgagatgagtc

SEQ ID NO: 307406 - DNA, 25 bp, Mus musculus
gccattactgctgacctcaggatgt

SEQ ID NO: 307407 - DNA, 25 bp, Mus musculus
gccattagagagaggcaggagtacg

SEQ ID NO: 307408 - DNA, 25 bp, Mus musculus
gccattatacaaatgtcggagtctt

SEQ ID NO: 307409 - DNA, 25 bp, Mus musculus
gccattatggagcagagaatgacgg

SEQ ID NO: 307410 - DNA, 25 bp, Mus musculus
gccattattgctttcgaggacgcgg

SEQ ID NO: 307411 - DNA, 25 bp, Mus musculus
gccattcaagtggcagccacagcag

SEQ ID NO: 307412 - DNA, 25 bp, Mus musculus
gccattcacaagaattggcctacag

SEQ ID NO: 307413 - DNA, 25 bp, Mus musculus
gccattcacaagctaattctgatca

SEQ ID NO: 307414 - DNA, 25 bp, Mus musculus
gccattcacacaggccgatacaaag

SEQ ID NO: 307415 - DNA, 25 bp, Mus musculus
gccattcacaggcatcctacatcaa

SEQ ID NO: 307416 - DNA, 25 bp, Mus musculus
gccattcagaagatgcaaccctgag

SEQ ID NO: 307417 - DNA, 25 bp, Mus musculus
gccattcagcctttggctacaatgg

SEQ ID NO: 307418 - DNA, 25 bp, Mus musculus
gccattcatctctggtcttgacgaa

SEQ ID NO: 307419 - DNA, 25 bp, Mus musculus
gccattccaggtaaatgggccagcc

SEQ ID NO: 307420 - DNA, 25 bp, Mus musculus
gccattcctagtccaattcaggtta

SEQ ID NO: 307421 - DNA, 25 bp, Mus musculus
gccattcggacccagtcgacctgat

SEQ ID NO: 307422 - DNA, 25 bp, Mus musculus
gccattcggcaaagatgacagaagg

SEQ ID NO: 307423 - DNA, 25 bp, Mus musculus
gccattctaacagcctgcagactgc

SEQ ID NO: 307424 - DNA, 25 bp, Mus musculus
gccattctagatgtgaaggcaccat

SEQ ID NO: 307425 - DNA, 25 bp, Mus musculus
gccattctcaatggaaatatggaaa

SEQ ID NO: 307426 - DNA, 25 bp, Mus musculus
gccattctcaatgggaaaaagagct

SEQ ID NO: 307427 - DNA, 25 bp, Mus musculus
gccattctcagcaggccgcagatca

SEQ ID NO: 307428 - DNA, 25 bp, Mus musculus
gccattctcaggaaaactactcagc

SEQ ID NO: 307429 - DNA, 25 bp, Mus musculus
gccattctgattgggactggaaaag

SEQ ID NO: 307430 - DNA, 25 bp, Mus musculus
gccattctgattggggtactggaaa

SEQ ID NO: 307431 - DNA, 25 bp, Mus musculus
gccattctgcttagcctgctgaggc

SEQ ID NO: 307432 - DNA, 25 bp, Mus musculus
gccattctgcttagtgcctgcacgt

SEQ ID NO: 307433 - DNA, 25 bp, Mus musculus
gccattgaaacggataaggaaggcg

SEQ ID NO: 307434 - DNA, 25 bp, Mus musculus
gccattgaaacgggatgggaactct

SEQ ID NO: 307435 - DNA, 25 bp, Mus musculus
gccattgaagctgaagaagatgctg

SEQ ID NO: 307436 - DNA, 25 bp, Mus musculus
gccattgaagtgtggggctttgggt

SEQ ID NO: 307437 - DNA, 25 bp, Mus musculus
gccattgaatatagacctgaaaacc

SEQ ID NO: 307438 - DNA, 25 bp, Mus musculus
gccattgaatatgagatgtgcataa

SEQ ID NO: 307439 - DNA, 25 bp, Mus musculus
gccattgaatatgaggtgtcagctg

SEQ ID NO: 307440 - DNA, 25 bp, Mus musculus
gccattgagctcaagaaaccacagt

SEQ ID NO: 307441 - DNA, 25 bp, Mus musculus
gccattgaggacccggagctagaag

SEQ ID NO: 307442 - DNA, 25 bp, Mus musculus
gccattgccaagaagaacgctgtgg

SEQ ID NO: 307443 - DNA, 25 bp, Mus musculus
gccattgccagagatccttgtgtgt

SEQ ID NO: 307444 - DNA, 25 bp, Mus musculus
gccattgccgtgcaggcagccagct

SEQ ID NO: 307445 - DNA, 25 bp, Mus musculus
gccattgctcaaggctgccttagac

SEQ ID NO: 307446 - DNA, 25 bp, Mus musculus
gccattgctgctgattactctgtat

SEQ ID NO: 307447 - DNA, 25 bp, Mus musculus
gccattgctttaaggacctgcagga

SEQ ID NO: 307448 - DNA, 25 bp, Mus musculus
gccattggaggagtctgcggtgttg

SEQ ID NO: 307449 - DNA, 25 bp, Mus musculus
gccattggcaggttgtccgattgct

SEQ ID NO: 307450 - DNA, 25 bp, Mus musculus
gccattggtgagctgaaaaatgaat

SEQ ID NO: 307451 - DNA, 25 bp, Mus musculus
gccattggtgagtatggcccacccc

SEQ ID NO: 307452 - DNA, 25 bp, Mus musculus
gccattgtcgagggggtggcaccga

SEQ ID NO: 307453 - DNA, 25 bp, Mus musculus
gccattgtcgaggtgtcaagctctc

SEQ ID NO: 307454 - DNA, 25 bp, Mus musculus
gccattgttaagaccgagaattcat

SEQ ID NO: 307455 - DNA, 25 bp, Mus musculus
gccattgttactgttacagatttgg

SEQ ID NO: 307456 - DNA, 25 bp, Mus musculus
gccattgttcaggctccaggccggg

SEQ ID NO: 307457 - DNA, 25 bp, Mus musculus
gccatttacagggggtgatgtgcaa

SEQ ID NO: 307458 - DNA, 25 bp, Mus musculus
gccatttacagttgtaacagttgga

SEQ ID NO: 307459 - DNA, 25 bp, Mus musculus
gccatttactttgggtcactgccca

SEQ ID NO: 307460 - DNA, 25 bp, Mus musculus
gccatttagaaggtgtgccgatgct

SEQ ID NO: 307461 - DNA, 25 bp, Mus musculus
gccatttcagcaggatagtcattgc

SEQ ID NO: 307462 - DNA, 25 bp, Mus musculus
gccatttcagcaggttcaggcgcag

SEQ ID NO: 307463 - DNA, 25 bp, Mus musculus
gccatttcaggtttggtatgcctca

SEQ ID NO: 307464 - DNA, 25 bp, Mus musculus
gccatttccaagcgcctgagaagaa

SEQ ID NO: 307465 - DNA, 25 bp, Mus musculus
gccatttccacatagtgctggggat

SEQ ID NO: 307466 - DNA, 25 bp, Mus musculus
gccatttccacatagttcagcaatc

SEQ ID NO: 307467 - DNA, 25 bp, Mus musculus
gccatttgtgagactcgccccaccc

SEQ ID NO: 307468 - DNA, 25 bp, Mus musculus
gccattttaaataggttgtaggaag

SEQ ID NO: 307469 - DNA, 25 bp, Mus musculus
gccattttcaatgggaaagcgagct

SEQ ID NO: 307470 - DNA, 25 bp, Mus musculus
gccattttcggctggacgtcgactg

SEQ ID NO: 307471 - DNA, 25 bp, Mus musculus
gccattttctaggaaacctcgtgtt

SEQ ID NO: 307472 - DNA, 25 bp, Mus musculus
gccatttttacaaggcatcaaggag

SEQ ID NO: 307473 - DNA, 25 bp, Mus musculus
gccatttttcaaggaagagaagtgg

SEQ ID NO: 307474 - DNA, 25 bp, Mus musculus
gcccaaaacagactgagaatgaagc

SEQ ID NO: 307475 - DNA, 25 bp, Mus musculus
gcccaaaagaaaggctgaaggggat

SEQ ID NO: 307476 - DNA, 25 bp, Mus musculus
gcccaaacacacaccagtcatcttc

SEQ ID NO: 307477 - DNA, 25 bp, Mus musculus
gcccaaacagcaagcgcctgtgaga

SEQ ID NO: 307478 - DNA, 25 bp, Mus musculus
gcccaaaccaacaggtgtgcccaag

SEQ ID NO: 307479 - DNA, 25 bp, Mus musculus
gcccaaaccatagagagacactacg

SEQ ID NO: 307480 - DNA, 25 bp, Mus musculus
gcccaaacgtgtgcccaattacctg

SEQ ID NO: 307481 - DNA, 25 bp, Mus musculus
gcccaaagaagacacccatataatg

SEQ ID NO: 307482 - DNA, 25 bp, Mus musculus
gcccaaagagatgaagttggcgctc

SEQ ID NO: 307483 - DNA, 25 bp, Mus musculus
gcccaaaggacagaataatcctcag

SEQ ID NO: 307484 - DNA, 25 bp, Mus musculus
gcccaaaggacagctggctgtatag

SEQ ID NO: 307485 - DNA, 25 bp, Mus musculus
gcccaaaggcatcagatttcgtgga

SEQ ID NO: 307486 - DNA, 25 bp, Mus musculus
gcccaaaggtcctctgacactacaa

SEQ ID NO: 307487 - DNA, 25 bp, Mus musculus
gcccaaagtcagtcgaaacgttgaa

SEQ ID NO: 307488 - DNA, 25 bp, Mus musculus
gcccaaagtcagtgaacttctgggt

SEQ ID NO: 307489 - DNA, 25 bp, Mus musculus
gcccaaatgactaagtacctacagt

SEQ ID NO: 307490 - DNA, 25 bp, Mus musculus
gcccaaatgactaagttacagtgct

SEQ ID NO: 307491 - DNA, 25 bp, Mus musculus
gcccaacaaaaagttgattcaccaa

SEQ ID NO: 307492 - DNA, 25 bp, Mus musculus
gcccaacaaccaggtagctaagtgg

SEQ ID NO: 307493 - DNA, 25 bp, Mus musculus
gcccaacaaggcacctcccacgtat

SEQ ID NO: 307494 - DNA, 25 bp, Mus musculus
gcccaacacagagggtgaacagcca

SEQ ID NO: 307495 - DNA, 25 bp, Mus musculus
gcccaacacagtggggctgtggtca

SEQ ID NO: 307496 - DNA, 25 bp, Mus musculus
gcccaacaccagaactattgtccca

SEQ ID NO: 307497 - DNA, 25 bp, Mus musculus
gcccaacagagagggcccccagcat

SEQ ID NO: 307498 - DNA, 25 bp, Mus musculus
gcccaacatcatgaaagccaagaag

SEQ ID NO: 307499 - DNA, 25 bp, Mus musculus
gcccaaccatgctgctgaaccgaat

SEQ ID NO: 307500 - DNA, 25 bp, Mus musculus
gcccaacccagtgacaatgcccctg

SEQ ID NO: 307501 - DNA, 25 bp, Mus musculus
gcccaaccccaggcacagctgactt

SEQ ID NO: 307502 - DNA, 25 bp, Mus musculus
gcccaaccctcagacgtttaataag

SEQ ID NO: 307503 - DNA, 25 bp, Mus musculus
gcccaaccctcagaggtttaataag

SEQ ID NO: 307504 - DNA, 25 bp, Mus musculus
gcccaacctcagcaaagccagtggc

SEQ ID NO: 307505 - DNA, 25 bp, Mus musculus
gcccaacctcagcacttttctgtac

SEQ ID NO: 307506 - DNA, 25 bp, Mus musculus
gcccaacctggctcggaagaggagc

SEQ ID NO: 307507 - DNA, 25 bp, Mus musculus
gcccaacgcaaatctggtgcaataa

SEQ ID NO: 307508 - DNA, 25 bp, Mus musculus
gcccaacgcctctagtaaccctgac

SEQ ID NO: 307509 - DNA, 25 bp, Mus musculus
gcccaacgctagaacatacaacatc

SEQ ID NO: 307510 - DNA, 25 bp, Mus musculus
gcccaagaaaaaggtgcgcatggtg

SEQ ID NO: 307511 - DNA, 25 bp, Mus musculus
gcccaagaaaggtggcaggagatcg

SEQ ID NO: 307512 - DNA, 25 bp, Mus musculus
gcccaagaacccaggtggaaagcac

SEQ ID NO: 307513 - DNA, 25 bp, Mus musculus
gcccaagaagaaccaagagccggag

SEQ ID NO: 307514 - DNA, 25 bp, Mus musculus
gcccaagaagacgcaaatccagatc

SEQ ID NO: 307515 - DNA, 25 bp, Mus musculus
gcccaagaagcgtgggaccttcatt

SEQ ID NO: 307516 - DNA, 25 bp, Mus musculus
gcccaagaaggtggagtttgtccat

SEQ ID NO: 307517 - DNA, 25 bp, Mus musculus
gcccaagacacagataagccaggac

SEQ ID NO: 307518 - DNA, 25 bp, Mus musculus
gcccaagacacccaggccagccacg

SEQ ID NO: 307519 - DNA, 25 bp, Mus musculus
gcccaagacatccaggccagccacg

SEQ ID NO: 307520 - DNA, 25 bp, Mus musculus
gcccaagaccagctcacggatgatt

SEQ ID NO: 307521 - DNA, 25 bp, Mus musculus
gcccaagagcacacattgaaaaggg

SEQ ID NO: 307522 - DNA, 25 bp, Mus musculus
gcccaagaggaagaagtccaggagg

SEQ ID NO: 307523 - DNA, 25 bp, Mus musculus
gcccaagaggaagaggaagtccaag

SEQ ID NO: 307524 - DNA, 25 bp, Mus musculus
gcccaagaggtcactgagcactggc

SEQ ID NO: 307525 - DNA, 25 bp, Mus musculus
gcccaagataaggatggtagaggtg

SEQ ID NO: 307526 - DNA, 25 bp, Mus musculus
gcccaagataaggcactcctgcaga

SEQ ID NO: 307527 - DNA, 25 bp, Mus musculus
gcccaagatgagcagctgtggcggc

SEQ ID NO: 307528 - DNA, 25 bp, Mus musculus
gcccaagatgtcgccctgatgattc

SEQ ID NO: 307529 - DNA, 25 bp, Mus musculus
gcccaagatgtctgacagaacagta

SEQ ID NO: 307530 - DNA, 25 bp, Mus musculus
gcccaagatgtctgtatggggagag

SEQ ID NO: 307531 - DNA, 25 bp, Mus musculus
gcccaagattagaaggacctcttcc

SEQ ID NO: 307532 - DNA, 25 bp, Mus musculus
gcccaagcagctggagattcacgta

SEQ ID NO: 307533 - DNA, 25 bp, Mus musculus
gcccaagcggacaagtattccacca

SEQ ID NO: 307534 - DNA, 25 bp, Mus musculus
gcccaagctaaaggagctgaatctg

SEQ ID NO: 307535 - DNA, 25 bp, Mus musculus
gcccaagctgcaccaggaggcggtg

SEQ ID NO: 307536 - DNA, 25 bp, Mus musculus
gcccaaggagaatgaccccagactg

SEQ ID NO: 307537 - DNA, 25 bp, Mus musculus
gcccaaggaggctcgaagcaccaac

SEQ ID NO: 307538 - DNA, 25 bp, Mus musculus
gcccaaggagtgggggtgggcttag

SEQ ID NO: 307539 - DNA, 25 bp, Mus musculus
gcccaaggagttctggcaggtggct

SEQ ID NO: 307540 - DNA, 25 bp, Mus musculus
gcccaaggccacagccaggagaaac

SEQ ID NO: 307541 - DNA, 25 bp, Mus musculus
gcccaagtatgcaggctgctcgtca

SEQ ID NO: 307542 - DNA, 25 bp, Mus musculus
gcccaagtatgcagtgctcgatgaa

SEQ ID NO: 307543 - DNA, 25 bp, Mus musculus
gcccaagtgaacaagaactggaatg

SEQ ID NO: 307544 - DNA, 25 bp, Mus musculus
gcccaagtggaaagctgcggctgct

SEQ ID NO: 307545 - DNA, 25 bp, Mus musculus
gcccaagttgagttcatggcatctc

SEQ ID NO: 307546 - DNA, 25 bp, Mus musculus
gcccaataaggcacctcccacctat

SEQ ID NO: 307547 - DNA, 25 bp, Mus musculus
gcccaatgaatccccagcttcacac

SEQ ID NO: 307548 - DNA, 25 bp, Mus musculus
gcccaattccaagagatatgtccgg

SEQ ID NO: 307549 - DNA, 25 bp, Mus musculus
gcccaattctggcaggaagcagtga

SEQ ID NO: 307550 - DNA, 25 bp, Mus musculus
gcccaattctggcaggacatgaagc

SEQ ID NO: 307551 - DNA, 25 bp, Mus musculus
gcccaattctggcaggtagtgctgc

SEQ ID NO: 307552 - DNA, 25 bp, Mus musculus
gcccaattctgggacactcactctt

SEQ ID NO: 307553 - DNA, 25 bp, Mus musculus
gcccaattgtcttgcttcattaaaa

SEQ ID NO: 307554 - DNA, 25 bp, Mus musculus
gcccaattgtcttgcttcattaaca

SEQ ID NO: 307555 - DNA, 25 bp, Mus musculus
gcccaattgttatggctttgagtgc

SEQ ID NO: 307556 - DNA, 25 bp, Mus musculus
gcccacaacgctgcttctgaaccag

SEQ ID NO: 307557 - DNA, 25 bp, Mus musculus
gcccacacagggtgtgtccccagga

SEQ ID NO: 307558 - DNA, 25 bp, Mus musculus
gcccacacaggtgatccagcagccc

SEQ ID NO: 307559 - DNA, 25 bp, Mus musculus
gcccacacaggttctgcagtacagc

SEQ ID NO: 307560 - DNA, 25 bp, Mus musculus
gcccacaccactggtgatccagcag

SEQ ID NO: 307561 - DNA, 25 bp, Mus musculus
gcccacaccaggatgcaggcagcct

SEQ ID NO: 307562 - DNA, 25 bp, Mus musculus
gcccacacccacagggctgtccccc

SEQ ID NO: 307563 - DNA, 25 bp, Mus musculus
gcccacaccccaggaagtcagaggc

SEQ ID NO: 307564 - DNA, 25 bp, Mus musculus
gcccacacgctgattctctacctga

SEQ ID NO: 307565 - DNA, 25 bp, Mus musculus
gcccacacgctgcaggtgctgttat

SEQ ID NO: 307566 - DNA, 25 bp, Mus musculus
gcccacactggcagccaccaccaag

SEQ ID NO: 307567 - DNA, 25 bp, Mus musculus
gcccacactggccgccactgggaag

SEQ ID NO: 307568 - DNA, 25 bp, Mus musculus
gcccacagacaggtggtggctggcc

SEQ ID NO: 307569 - DNA, 25 bp, Mus musculus
gcccacagcagagtctgtgcgcccc

SEQ ID NO: 307570 - DNA, 25 bp, Mus musculus
gcccacaggcgcaagaaaagagaag

SEQ ID NO: 307571 - DNA, 25 bp, Mus musculus
gcccacagtgccaagatttttttcg

SEQ ID NO: 307572 - DNA, 25 bp, Mus musculus
gcccacagtgccaaggtcaaaattg

SEQ ID NO: 307573 - DNA, 25 bp, Mus musculus
gcccacagtgggggctgaagaatac

SEQ ID NO: 307574 - DNA, 25 bp, Mus musculus
gcccacagtggttctcactgtggat

SEQ ID NO: 307575 - DNA, 25 bp, Mus musculus
gcccacatagagaaggtgacagatg

SEQ ID NO: 307576 - DNA, 25 bp, Mus musculus
gcccacattccagggccctctgcct

SEQ ID NO: 307577 - DNA, 25 bp, Mus musculus
gcccaccacacctgtctcctccttc

SEQ ID NO: 307578 - DNA, 25 bp, Mus musculus
gcccacccaggaaatcctgaagaag

SEQ ID NO: 307579 - DNA, 25 bp, Mus musculus
gcccacccaggaatccatcagcacc

SEQ ID NO: 307580 - DNA, 25 bp, Mus musculus
gcccacccctcaggtgttacatgta

SEQ ID NO: 307581 - DNA, 25 bp, Mus musculus
gcccacccggtgtgacttctttaag

SEQ ID NO: 307582 - DNA, 25 bp, Mus musculus
gcccaccctgtcagaagcccagagg

SEQ ID NO: 307583 - DNA, 25 bp, Mus musculus
gcccaccctgtcaggccttgccagc

SEQ ID NO: 307584 - DNA, 25 bp, Mus musculus
gcccaccgaggccagggactcagcg

SEQ ID NO: 307585 - DNA, 25 bp, Mus musculus
gcccaccggctggaggcatcatgac

SEQ ID NO: 307586 - DNA, 25 bp, Mus musculus
gcccacctacaggatgtcaatcggg

SEQ ID NO: 307587 - DNA, 25 bp, Mus musculus
gcccacctatccacccatgaaccca

SEQ ID NO: 307588 - DNA, 25 bp, Mus musculus
gcccacctgcaagacagccccggat

SEQ ID NO: 307589 - DNA, 25 bp, Mus musculus
gcccacctgcaagctacagacagcc

SEQ ID NO: 307590 - DNA, 25 bp, Mus musculus
gcccacctggacaggacaatgtatc

SEQ ID NO: 307591 - DNA, 25 bp, Mus musculus
gcccacctggagctacattgcctcc

SEQ ID NO: 307592 - DNA, 25 bp, Mus musculus
gcccaccttctgaagattccgagag

SEQ ID NO: 307593 - DNA, 25 bp, Mus musculus
gcccacctttgagatgacagagaca

SEQ ID NO: 307594 - DNA, 25 bp, Mus musculus
gcccacctttgagtgactgccagga

SEQ ID NO: 307595 - DNA, 25 bp, Mus musculus
gcccacgactgcactgggccctgct

SEQ ID NO: 307596 - DNA, 25 bp, Mus musculus
gcccacgcaggatcatgtgttcaac

SEQ ID NO: 307597 - DNA, 25 bp, Mus musculus
gcccacgccggtgtctgcagctacc

SEQ ID NO: 307598 - DNA, 25 bp, Mus musculus
gcccacgccgtatatcaaggccttt

SEQ ID NO: 307599 - DNA, 25 bp, Mus musculus
gcccacgcctgtgtaggcttgtgac

SEQ ID NO: 307600 - DNA, 25 bp, Mus musculus
gcccacgcgcagcaacacctccaga

SEQ ID NO: 307601 - DNA, 25 bp, Mus musculus
gcccacgcgcagcgctgtgtagttc

SEQ ID NO: 307602 - DNA, 25 bp, Mus musculus
gcccacggacgaccatgacacccga

SEQ ID NO: 307603 - DNA, 25 bp, Mus musculus
gcccacggtcctgaggtccacctcc

SEQ ID NO: 307604 - DNA, 25 bp, Mus musculus
gcccacgtacctcaggctcatgtac

SEQ ID NO: 307605 - DNA, 25 bp, Mus musculus
gcccacgtacctcagtacaagccca

SEQ ID NO: 307606 - DNA, 25 bp, Mus musculus
gcccacgtacctcagttctggctca

SEQ ID NO: 307607 - DNA, 25 bp, Mus musculus
gcccacgtcaccctggtcttcctcc

SEQ ID NO: 307608 - DNA, 25 bp, Mus musculus
gcccacgtccgtcaggtatttgtca

SEQ ID NO: 307609 - DNA, 25 bp, Mus musculus
gcccacgtgtgcagggtcctgtggg

SEQ ID NO: 307610 - DNA, 25 bp, Mus musculus
gcccacgttgggatctgaaccaatg

SEQ ID NO: 307611 - DNA, 25 bp, Mus musculus
gcccactcagtgaatggcattactg

SEQ ID NO: 307612 - DNA, 25 bp, Mus musculus
gcccactctacagcttggccagcaa

SEQ ID NO: 307613 - DNA, 25 bp, Mus musculus
gcccactctacaggttcacctggtc

SEQ ID NO: 307614 - DNA, 25 bp, Mus musculus
gcccactctggagccccatgtggaa

SEQ ID NO: 307615 - DNA, 25 bp, Mus musculus
gcccactcttcagttctgagaagaa

SEQ ID NO: 307616 - DNA, 25 bp, Mus musculus
gcccactgcatcaacacaaacttga

SEQ ID NO: 307617 - DNA, 25 bp, Mus musculus
gcccactgccagacccaggcacccc

SEQ ID NO: 307618 - DNA, 25 bp, Mus musculus
gcccactgccatgagagctgtttga

SEQ ID NO: 307619 - DNA, 25 bp, Mus musculus
gcccactgccatgtcccagtatgag

SEQ ID NO: 307620 - DNA, 25 bp, Mus musculus
gcccactgccggatcctaataacta

SEQ ID NO: 307621 - DNA, 25 bp, Mus musculus
gcccactggcctcttcaggtggagc

SEQ ID NO: 307622 - DNA, 25 bp, Mus musculus
gcccactgtgctaagaggtccagca

SEQ ID NO: 307623 - DNA, 25 bp, Mus musculus
gcccactgtgctaagtgacattgac

SEQ ID NO: 307624 - DNA, 25 bp, Mus musculus
gcccacttaaactccgaggtgactc

SEQ ID NO: 307625 - DNA, 25 bp, Mus musculus
gcccacttgggaggcagaggccatc

SEQ ID NO: 307626 - DNA, 25 bp, Mus musculus
gcccactttcagagcaccccccggc

SEQ ID NO: 307627 - DNA, 25 bp, Mus musculus
gcccactttcagagccctccaactc

SEQ ID NO: 307628 - DNA, 25 bp, Mus musculus
gcccagaaaagcggtttccaacttg

SEQ ID NO: 307629 - DNA, 25 bp, Mus musculus
gcccagaaaagcttccgtagtgtgt

SEQ ID NO: 307630 - DNA, 25 bp, Mus musculus
gcccagaaacttcaggaggagttag

SEQ ID NO: 307631 - DNA, 25 bp, Mus musculus
gcccagaaagaactagaagaacaga

SEQ ID NO: 307632 - DNA, 25 bp, Mus musculus
gcccagaaaggatgtataataaaag

SEQ ID NO: 307633 - DNA, 25 bp, Mus musculus
gcccagaaagtgcttctctccttgg

SEQ ID NO: 307634 - DNA, 25 bp, Mus musculus
gcccagaaagtggtcacgcccgggt

SEQ ID NO: 307635 - DNA, 25 bp, Mus musculus
gcccagaaatgtacggagtttgaag

SEQ ID NO: 307636 - DNA, 25 bp, Mus musculus
gcccagaaattatttggtatgatca

SEQ ID NO: 307637 - DNA, 25 bp, Mus musculus
gcccagaaccaggccaagaaaggag

SEQ ID NO: 307638 - DNA, 25 bp, Mus musculus
gcccagaaccaggcccctaatcaag

SEQ ID NO: 307639 - DNA, 25 bp, Mus musculus
gcccagaaccagggcaaaaaggcag

SEQ ID NO: 307640 - DNA, 25 bp, Mus musculus
gcccagaacgtcaaggcaatcctta

SEQ ID NO: 307641 - DNA, 25 bp, Mus musculus
gcccagaacgtcaagggtgagtcag

SEQ ID NO: 307642 - DNA, 25 bp, Mus musculus
gcccagaactaaagaatgaagtctt

SEQ ID NO: 307643 - DNA, 25 bp, Mus musculus
gcccagaagaatatgctggaccgct

SEQ ID NO: 307644 - DNA, 25 bp, Mus musculus
gcccagaagatcgtgattttaaaaa

SEQ ID NO: 307645 - DNA, 25 bp, Mus musculus
gcccagaagcacagcaagaaggccg

SEQ ID NO: 307646 - DNA, 25 bp, Mus musculus
gcccagaagcaggtactctatctac

SEQ ID NO: 307647 - DNA, 25 bp, Mus musculus
gcccagaaggagatccttaagctgt

SEQ ID NO: 307648 - DNA, 25 bp, Mus musculus
gcccagaaggaggtcaagatggggt

SEQ ID NO: 307649 - DNA, 25 bp, Mus musculus
gcccagaagtaccattcccggagca

SEQ ID NO: 307650 - DNA, 25 bp, Mus musculus
gcccagaatcctgggccaccaattc

SEQ ID NO: 307651 - DNA, 25 bp, Mus musculus
gcccagaatttgaggtctttaagtg

SEQ ID NO: 307652 - DNA, 25 bp, Mus musculus
gcccagacagagaagagccatggag

SEQ ID NO: 307653 - DNA, 25 bp, Mus musculus
gcccagacagtgactcaggtgcaga

SEQ ID NO: 307654 - DNA, 25 bp, Mus musculus
gcccagacccaagaccatttcccag

SEQ ID NO: 307655 - DNA, 25 bp, Mus musculus
gcccagacccaagactctccctctg

SEQ ID NO: 307656 - DNA, 25 bp, Mus musculus
gcccagaccctgaaggagctgcctc

SEQ ID NO: 307657 - DNA, 25 bp, Mus musculus
gcccagacgaattggaatcccagtc

SEQ ID NO: 307658 - DNA, 25 bp, Mus musculus
gcccagacgcacgaagctctttgtg

SEQ ID NO: 307659 - DNA, 25 bp, Mus musculus
gcccagacttccacacgcgcacgga

SEQ ID NO: 307660 - DNA, 25 bp, Mus musculus
gcccagagagaggtcatcttccatg

SEQ ID NO: 307661 - DNA, 25 bp, Mus musculus
gcccagagagaggtcttttggctgt

SEQ ID NO: 307662 - DNA, 25 bp, Mus musculus
gcccagagagcccaggcttacagtg

SEQ ID NO: 307663 - DNA, 25 bp, Mus musculus
gcccagagatggactccagattcca

SEQ ID NO: 307664 - DNA, 25 bp, Mus musculus
gcccagagatgggcacctccgtctg

SEQ ID NO: 307665 - DNA, 25 bp, Mus musculus
gcccagagcaatagactgatgatgc

SEQ ID NO: 307666 - DNA, 25 bp, Mus musculus
gcccagagcacaggggcctggatcg

SEQ ID NO: 307667 - DNA, 25 bp, Mus musculus
gcccagagctagatttgtcaaatcc

SEQ ID NO: 307668 - DNA, 25 bp, Mus musculus
gcccagagctccgggctcaagtcca

SEQ ID NO: 307669 - DNA, 25 bp, Mus musculus
gcccagaggagaaattgtgaaaatg

SEQ ID NO: 307670 - DNA, 25 bp, Mus musculus
gcccagaggagcaagatatctgttg

SEQ ID NO: 307671 - DNA, 25 bp, Mus musculus
gcccagaggagtaccctcacctgaa

SEQ ID NO: 307672 - DNA, 25 bp, Mus musculus
gcccagaggcagactcacctcaacc

SEQ ID NO: 307673 - DNA, 25 bp, Mus musculus
gcccagaggctcagggtccggaccg

SEQ ID NO: 307674 - DNA, 25 bp, Mus musculus
gcccagagtaggaggtggtgcccat

SEQ ID NO: 307675 - DNA, 25 bp, Mus musculus
gcccagagtgaacctgtgagaagac

SEQ ID NO: 307676 - DNA, 25 bp, Mus musculus
gcccagatcaaatcgtgtccagccc

SEQ ID NO: 307677 - DNA, 25 bp, Mus musculus
gcccagatcaactattagacatgtt

SEQ ID NO: 307678 - DNA, 25 bp, Mus musculus
gcccagatctccatgctggagaaca

SEQ ID NO: 307679 - DNA, 25 bp, Mus musculus
gcccagattaaagtcaaataattta

SEQ ID NO: 307680 - DNA, 25 bp, Mus musculus
gcccagattaagtctcctgaaaggt

SEQ ID NO: 307681 - DNA, 25 bp, Mus musculus
gcccagcaaaaatcccaggatcacc

SEQ ID NO: 307682 - DNA, 25 bp, Mus musculus
gcccagcaaaaatgggggcagccac

SEQ ID NO: 307683 - DNA, 25 bp, Mus musculus
gcccagcaagattctgtgatgagga

SEQ ID NO: 307684 - DNA, 25 bp, Mus musculus
gcccagcaaggaacaccagtgtact

SEQ ID NO: 307685 - DNA, 25 bp, Mus musculus
gcccagcaaggaccgccttcaacaa

SEQ ID NO: 307686 - DNA, 25 bp, Mus musculus
gcccagcaatggcaattggcatcct

SEQ ID NO: 307687 - DNA, 25 bp, Mus musculus
gcccagcacacaggaggtctggcat

SEQ ID NO: 307688 - DNA, 25 bp, Mus musculus
gcccagcacagcatgagaaactctc

SEQ ID NO: 307689 - DNA, 25 bp, Mus musculus
gcccagcaccgatcggtcagcacct

SEQ ID NO: 307690 - DNA, 25 bp, Mus musculus
gcccagcactgcatgagaaactctc

SEQ ID NO: 307691 - DNA, 25 bp, Mus musculus
gcccagcactggggatgtccagctc

SEQ ID NO: 307692 - DNA, 25 bp, Mus musculus
gcccagcagctacattttcttaaaa

SEQ ID NO: 307693 - DNA, 25 bp, Mus musculus
gcccagcagctctactgacagtctt

SEQ ID NO: 307694 - DNA, 25 bp, Mus musculus
gcccagcagtattcctcctgcttct

SEQ ID NO: 307695 - DNA, 25 bp, Mus musculus
gcccagcagtgcatcctgcctctgc

SEQ ID NO: 307696 - DNA, 25 bp, Mus musculus
gcccagcagtgcccgaattgagaga

SEQ ID NO: 307697 - DNA, 25 bp, Mus musculus
gcccagcatgtccagctgcccgaga

SEQ ID NO: 307698 - DNA, 25 bp, Mus musculus
gcccagcatttgggggagagcacgg

SEQ ID NO: 307699 - DNA, 25 bp, Mus musculus
gcccagccaggagagaatctgggag

SEQ ID NO: 307700 - DNA, 25 bp, Mus musculus
gcccagccaggagctatcctctgaa

SEQ ID NO: 307701 - DNA, 25 bp, Mus musculus
gcccagccaggtagccatcccttgg

SEQ ID NO: 307702 - DNA, 25 bp, Mus musculus
gcccagccaggttttcaggcttgga

SEQ ID NO: 307703 - DNA, 25 bp, Mus musculus
gcccagcccctggttccacaccctc

SEQ ID NO: 307704 - DNA, 25 bp, Mus musculus
gcccagcccctgtgccgggagcccg

SEQ ID NO: 307705 - DNA, 25 bp, Mus musculus
gcccagcccggtcaagcaggtagag

SEQ ID NO: 307706 - DNA, 25 bp, Mus musculus
gcccagccctgagggccatggcgga

SEQ ID NO: 307707 - DNA, 25 bp, Mus musculus
gcccagccctgctcctgccatgccc

SEQ ID NO: 307708 - DNA, 25 bp, Mus musculus
gcccagccgctatggagatggaaac

SEQ ID NO: 307709 - DNA, 25 bp, Mus musculus
gcccagcctacggttgtctaccgga

SEQ ID NO: 307710 - DNA, 25 bp, Mus musculus
gcccagcctacgtggtgaagatgga

SEQ ID NO: 307711 - DNA, 25 bp, Mus musculus
gcccagcctcaagctcccagggctt

SEQ ID NO: 307712 - DNA, 25 bp, Mus musculus
gcccagcctcaagggcttgccaaca

SEQ ID NO: 307713 - DNA, 25 bp, Mus musculus
gcccagcctcaaggtgagcaaagca

SEQ ID NO: 307714 - DNA, 25 bp, Mus musculus
gcccagcctcaggtcacgcccgggt

SEQ ID NO: 307715 - DNA, 25 bp, Mus musculus
gcccagcctccaaaagccctgccct

SEQ ID NO: 307716 - DNA, 25 bp, Mus musculus
gcccagcgagcgctgcgaagctggg

SEQ ID NO: 307717 - DNA, 25 bp, Mus musculus
gcccagcgcagccatggagccccgc

SEQ ID NO: 307718 - DNA, 25 bp, Mus musculus
gcccagcgcgtggcatgaagcacta

SEQ ID NO: 307719 - DNA, 25 bp, Mus musculus
gcccagcgcgtgggacgaattcata

SEQ ID NO: 307720 - DNA, 25 bp, Mus musculus
gcccagcgcttcagcaccgcacagt

SEQ ID NO: 307721 - DNA, 25 bp, Mus musculus
gcccagcgcttcagggagcgacagg

SEQ ID NO: 307722 - DNA, 25 bp, Mus musculus
gcccagctacccttcctgcacccag

SEQ ID NO: 307723 - DNA, 25 bp, Mus musculus
gcccagctagccctcctgtaagtaa

SEQ ID NO: 307724 - DNA, 25 bp, Mus musculus
gcccagctagctgtgcgcagttcct

SEQ ID NO: 307725 - DNA, 25 bp, Mus musculus
gcccagctcacgagacagggcaggg

SEQ ID NO: 307726 - DNA, 25 bp, Mus musculus
gcccagctctggacgctatgctgcg

SEQ ID NO: 307727 - DNA, 25 bp, Mus musculus
gcccagctctgggatgggttgaaga

SEQ ID NO: 307728 - DNA, 25 bp, Mus musculus
gcccagctctggggagaactctgat

SEQ ID NO: 307729 - DNA, 25 bp, Mus musculus
gcccagctctggggagaatgtactg

SEQ ID NO: 307730 - DNA, 25 bp, Mus musculus
gcccagctgagcacgttgagccacg

SEQ ID NO: 307731 - DNA, 25 bp, Mus musculus
gcccagctgctcccggcaggaaaag

SEQ ID NO: 307732 - DNA, 25 bp, Mus musculus
gcccaggaaaccaggaatgacacgg

SEQ ID NO: 307733 - DNA, 25 bp, Mus musculus
gcccaggaaagagcccaagatgatt

SEQ ID NO: 307734 - DNA, 25 bp, Mus musculus
gcccaggaaagtttctatgttgtct

SEQ ID NO: 307735 - DNA, 25 bp, Mus musculus
gcccaggaaccagtaattccacgat

SEQ ID NO: 307736 - DNA, 25 bp, Mus musculus
gcccaggaaccgcgtctcttgcaaa

SEQ ID NO: 307737 - DNA, 25 bp, Mus musculus
gcccaggaagaaacatgtatcatgg

SEQ ID NO: 307738 - DNA, 25 bp, Mus musculus
gcccaggaagaagaatgtcccttct

SEQ ID NO: 307739 - DNA, 25 bp, Mus musculus
gcccaggacactgccactgcacagc

SEQ ID NO: 307740 - DNA, 25 bp, Mus musculus
gcccaggacagaggattccctgtct

SEQ ID NO: 307741 - DNA, 25 bp, Mus musculus
gcccaggacagaggcttccccacct

SEQ ID NO: 307742 - DNA, 25 bp, Mus musculus
gcccaggacagctggatcgccgggg

SEQ ID NO: 307743 - DNA, 25 bp, Mus musculus
gcccaggaccttgctgcaggcacct

SEQ ID NO: 307744 - DNA, 25 bp, Mus musculus
gcccaggagaaactgggagctgaaa

SEQ ID NO: 307745 - DNA, 25 bp, Mus musculus
gcccaggagaaagctattacaagcc

SEQ ID NO: 307746 - DNA, 25 bp, Mus musculus
gcccaggagacacatcaagttggac

SEQ ID NO: 307747 - DNA, 25 bp, Mus musculus
gcccaggagagcaggtcggcagctc

SEQ ID NO: 307748 - DNA, 25 bp, Mus musculus
gcccaggagagtgagccaaggagat

SEQ ID NO: 307749 - DNA, 25 bp, Mus musculus
gcccaggagagtgaggtgctggtaa

SEQ ID NO: 307750 - DNA, 25 bp, Mus musculus
gcccaggagcaggtgtagctacttc

SEQ ID NO: 307751 - DNA, 25 bp, Mus musculus
gcccaggagccctgccacattgtcc

SEQ ID NO: 307752 - DNA, 25 bp, Mus musculus
gcccaggagccctgtgcttgatggg

SEQ ID NO: 307753 - DNA, 25 bp, Mus musculus
gcccaggagtgcagtatctctcctc

SEQ ID NO: 307754 - DNA, 25 bp, Mus musculus
gcccaggataaagcgattgtccagg

SEQ ID NO: 307755 - DNA, 25 bp, Mus musculus
gcccaggatgcggggtaccgaatgt

SEQ ID NO: 307756 - DNA, 25 bp, Mus musculus
gcccaggatgtggctggaccgcttc

SEQ ID NO: 307757 - DNA, 25 bp, Mus musculus
gcccaggcaactgcgcagttcctgg

SEQ ID NO: 307758 - DNA, 25 bp, Mus musculus
gcccaggcactcagagaatgggaca

SEQ ID NO: 307759 - DNA, 25 bp, Mus musculus
gcccaggcactcagtttttcagttc

SEQ ID NO: 307760 - DNA, 25 bp, Mus musculus
gcccaggcccaaatgtaccgtctaa

SEQ ID NO: 307761 - DNA, 25 bp, Mus musculus
gcccaggcccaccctgcaactccca

SEQ ID NO: 307762 - DNA, 25 bp, Mus musculus
gcccaggcccattattgtgatcact

SEQ ID NO: 307763 - DNA, 25 bp, Mus musculus
gcccaggccgcccaaacccaagcat

SEQ ID NO: 307764 - DNA, 25 bp, Mus musculus
gcccaggccgggaggcccagatggg

SEQ ID NO: 307765 - DNA, 25 bp, Mus musculus
gcccaggccggtcccggatgttgcg

SEQ ID NO: 307766 - DNA, 25 bp, Mus musculus
gcccaggcctccagttctcccaggc

SEQ ID NO: 307767 - DNA, 25 bp, Mus musculus
gcccaggcctgcgggtggacaaatc

SEQ ID NO: 307768 - DNA, 25 bp, Mus musculus
gcccaggcctggcttcttcacaaaa

SEQ ID NO: 307769 - DNA, 25 bp, Mus musculus
gcccaggccttaaggctgccctgcc

SEQ ID NO: 307770 - DNA, 25 bp, Mus musculus
gcccaggcgagcgggctaaccattt

SEQ ID NO: 307771 - DNA, 25 bp, Mus musculus
gcccaggcgaggcactgggctccct

SEQ ID NO: 307772 - DNA, 25 bp, Mus musculus
gcccaggcggatggcacccttatca

SEQ ID NO: 307773 - DNA, 25 bp, Mus musculus
gcccaggcgtagaccccgactgcag

SEQ ID NO: 307774 - DNA, 25 bp, Mus musculus
gcccaggcgtcgggattatcgtggc

SEQ ID NO: 307775 - DNA, 25 bp, Mus musculus
gcccaggctgagtaccagctccaag

SEQ ID NO: 307776 - DNA, 25 bp, Mus musculus
gcccaggctgtgggtcctcccagga

SEQ ID NO: 307777 - DNA, 25 bp, Mus musculus
gcccagggaagtggctacagatgtc

SEQ ID NO: 307778 - DNA, 25 bp, Mus musculus
gcccagggaccagcctgcactggat

SEQ ID NO: 307779 - DNA, 25 bp, Mus musculus
gcccagggaccagtagaacaacagt

SEQ ID NO: 307780 - DNA, 25 bp, Mus musculus
gcccagggagagcagcaggaggaca

SEQ ID NO: 307781 - DNA, 25 bp, Mus musculus
gcccagggcgcaagtgtgagccact

SEQ ID NO: 307782 - DNA, 25 bp, Mus musculus
gcccaggggagatgtataccaggtg

SEQ ID NO: 307783 - DNA, 25 bp, Mus musculus
gcccaggggcaggatggtgttgctg

SEQ ID NO: 307784 - DNA, 25 bp, Mus musculus
gcccaggggttagtgtggagaggat

SEQ ID NO: 307785 - DNA, 25 bp, Mus musculus
gcccaggtacaagatcaagtctcca

SEQ ID NO: 307786 - DNA, 25 bp, Mus musculus
gcccaggtcaaggactatgagaaag

SEQ ID NO: 307787 - DNA, 25 bp, Mus musculus
gcccaggtcaaggagtccatgaaga

SEQ ID NO: 307788 - DNA, 25 bp, Mus musculus
gcccaggtcaaggatgataatgggg

SEQ ID NO: 307789 - DNA, 25 bp, Mus musculus
gcccaggtccatggtaccaaccaaa

SEQ ID NO: 307790 - DNA, 25 bp, Mus musculus
gcccaggtgagtcagcagattcaca

SEQ ID NO: 307791 - DNA, 25 bp, Mus musculus
gcccaggttctcagagccatcgtgg

SEQ ID NO: 307792 - DNA, 25 bp, Mus musculus
gcccagtcaccgacatgtgagccac

SEQ ID NO: 307793 - DNA, 25 bp, Mus musculus
gcccagtcactgcaggaagtatttg

SEQ ID NO: 307794 - DNA, 25 bp, Mus musculus
gcccagtccaaaagagtacacacga

SEQ ID NO: 307795 - DNA, 25 bp, Mus musculus
gcccagtcccgaagatccgcctccg

SEQ ID NO: 307796 - DNA, 25 bp, Mus musculus
gcccagtcctgcagagtagagctct

SEQ ID NO: 307797 - DNA, 25 bp, Mus musculus
gcccagtcctgcagccctctctcct

SEQ ID NO: 307798 - DNA, 25 bp, Mus musculus
gcccagtctgatacacttttggcgt

SEQ ID NO: 307799 - DNA, 25 bp, Mus musculus
gcccagtgaccaatgggaacagtcc

SEQ ID NO: 307800 - DNA, 25 bp, Mus musculus
gcccagtgagcacttgcaggtggac

SEQ ID NO: 307801 - DNA, 25 bp, Mus musculus
gcccagtgcagcaggccacgcgggg

SEQ ID NO: 307802 - DNA, 25 bp, Mus musculus
gcccagtgcagcgctgtagcatcct

SEQ ID NO: 307803 - DNA, 25 bp, Mus musculus
gcccagtgcaggcctgccaacatcc

SEQ ID NO: 307804 - DNA, 25 bp, Mus musculus
gcccagtgcaggcctgccactggtg

SEQ ID NO: 307805 - DNA, 25 bp, Mus musculus
gcccagtgcgactgaagcgaaggct

SEQ ID NO: 307806 - DNA, 25 bp, Mus musculus
gcccagtggcaaaccgggaataatt

SEQ ID NO: 307807 - DNA, 25 bp, Mus musculus
gcccagtgttcctttgaagaccctg

SEQ ID NO: 307808 - DNA, 25 bp, Mus musculus
gcccagtgttctggtacccactgtg

SEQ ID NO: 307809 - DNA, 25 bp, Mus musculus
gcccagtgttctggtacgctccgga

SEQ ID NO: 307810 - DNA, 25 bp, Mus musculus
gcccagtgttgtcactggacctatt

SEQ ID NO: 307811 - DNA, 25 bp, Mus musculus
gcccagttcagagttccagggaccc

SEQ ID NO: 307812 - DNA, 25 bp, Mus musculus
gcccagttcagctggcatctgaccc

SEQ ID NO: 307813 - DNA, 25 bp, Mus musculus
gcccagttcctgagcggcatcccag

SEQ ID NO: 307814 - DNA, 25 bp, Mus musculus
gcccagtttgcaggagcattaagaa

SEQ ID NO: 307815 - DNA, 25 bp, Mus musculus
gcccagtttgccactgcgctggaat

SEQ ID NO: 307816 - DNA, 25 bp, Mus musculus
gcccagttttctcaggaaattgggc

SEQ ID NO: 307817 - DNA, 25 bp, Mus musculus
gcccataacgtgtttcatcccctga

SEQ ID NO: 307818 - DNA, 25 bp, Mus musculus
gcccataggcctggtcagaaagagt

SEQ ID NO: 307819 - DNA, 25 bp, Mus musculus
gcccatatcaagaagccctggctgt

SEQ ID NO: 307820 - DNA, 25 bp, Mus musculus
gcccatatcaagaaggagtttgaca

SEQ ID NO: 307821 - DNA, 25 bp, Mus musculus
gcccatatccatgttccagcccatc

SEQ ID NO: 307822 - DNA, 25 bp, Mus musculus
gcccatatgcagaagttgctctggg

SEQ ID NO: 307823 - DNA, 25 bp, Mus musculus
gcccatcaagataagtgggcagaga

SEQ ID NO: 307824 - DNA, 25 bp, Mus musculus
gcccatcaagggaaaactcgatgcc

SEQ ID NO: 307825 - DNA, 25 bp, Mus musculus
gcccatcaccaagaacaagaaaaca

SEQ ID NO: 307826 - DNA, 25 bp, Mus musculus
gcccatcacctgagggccaacgagg

SEQ ID NO: 307827 - DNA, 25 bp, Mus musculus
gcccatcagaagttttcctgacttc

SEQ ID NO: 307828 - DNA, 25 bp, Mus musculus
gcccatcagagagccctctccaggc

SEQ ID NO: 307829 - DNA, 25 bp, Mus musculus
gcccatcagcaccagggacccaggg

SEQ ID NO: 307830 - DNA, 25 bp, Mus musculus
gcccatcagcaccctccagcacgga

SEQ ID NO: 307831 - DNA, 25 bp, Mus musculus
gcccatcagcaccggccccccactt

SEQ ID NO: 307832 - DNA, 25 bp, Mus musculus
gcccatcatcagtttttccagaggc

SEQ ID NO: 307833 - DNA, 25 bp, Mus musculus
gcccatccaggccaggctgggcagc

SEQ ID NO: 307834 - DNA, 25 bp, Mus musculus
gcccatccgctgagttcctgagcat

SEQ ID NO: 307835 - DNA, 25 bp, Mus musculus
gcccatccgctgtgctttgacctcg

SEQ ID NO: 307836 - DNA, 25 bp, Mus musculus
gcccatccttaccctatccagcaat

SEQ ID NO: 307837 - DNA, 25 bp, Mus musculus
gcccatcgatcagatgttgctttgt

SEQ ID NO: 307838 - DNA, 25 bp, Mus musculus
gcccatcgatcaggcccaatgatga

SEQ ID NO: 307839 - DNA, 25 bp, Mus musculus
gcccatcgatcaggtcaactttgta

SEQ ID NO: 307840 - DNA, 25 bp, Mus musculus
gcccatctcaaagaaaaaatggcag

SEQ ID NO: 307841 - DNA, 25 bp, Mus musculus
gcccatctcagagaggaaactgagg

SEQ ID NO: 307842 - DNA, 25 bp, Mus musculus
gcccatctcaggagcaggcgagcag

SEQ ID NO: 307843 - DNA, 25 bp, Mus musculus
gcccatctcccagactgataatggt

SEQ ID NO: 307844 - DNA, 25 bp, Mus musculus
gcccatgaaaaacccgtctcgatac

SEQ ID NO: 307845 - DNA, 25 bp, Mus musculus
gcccatgaaaaatttggaaatcggt

SEQ ID NO: 307846 - DNA, 25 bp, Mus musculus
gcccatgaaccgcacttgctagtgt

SEQ ID NO: 307847 - DNA, 25 bp, Mus musculus
gcccatgaagcaagcttgggcaact

SEQ ID NO: 307848 - DNA, 25 bp, Mus musculus
gcccatgacaagctccaccgcacag

SEQ ID NO: 307849 - DNA, 25 bp, Mus musculus
gcccatgagcagatgaacgaattcc

SEQ ID NO: 307850 - DNA, 25 bp, Mus musculus
gcccatgagcagggtgtccctgtat

SEQ ID NO: 307851 - DNA, 25 bp, Mus musculus
gcccatgagctagggcacgttctca

SEQ ID NO: 307852 - DNA, 25 bp, Mus musculus
gcccatgatcaccagtgattcaggc

SEQ ID NO: 307853 - DNA, 25 bp, Mus musculus
gcccatgatggcggagtgtctggaa

SEQ ID NO: 307854 - DNA, 25 bp, Mus musculus
gcccatgatgggcctggtttggagt

SEQ ID NO: 307855 - DNA, 25 bp, Mus musculus
gcccatgcagatggcctctgcacaa

SEQ ID NO: 307856 - DNA, 25 bp, Mus musculus
gcccatgccctgtgatcagaccacc

SEQ ID NO: 307857 - DNA, 25 bp, Mus musculus
gcccatggaaaagacgaagagagta

SEQ ID NO: 307858 - DNA, 25 bp, Mus musculus
gcccatggaggtcctgtccagagtg

SEQ ID NO: 307859 - DNA, 25 bp, Mus musculus
gcccatggcgaccagtacaaggcca

SEQ ID NO: 307860 - DNA, 25 bp, Mus musculus
gcccatgtaccaagtgtccccaagg

SEQ ID NO: 307861 - DNA, 25 bp, Mus musculus
gcccatgtcaagaggcctcacacct

SEQ ID NO: 307862 - DNA, 25 bp, Mus musculus
gcccatgtcagtatttcctaaatga

SEQ ID NO: 307863 - DNA, 25 bp, Mus musculus
gcccatgtccatccctatcatccca

SEQ ID NO: 307864 - DNA, 25 bp, Mus musculus
gcccatgtgaccctgctgacatcac

SEQ ID NO: 307865 - DNA, 25 bp, Mus musculus
gcccatgttggaggacaagacattt

SEQ ID NO: 307866 - DNA, 25 bp, Mus musculus
gcccatgttggagggagttaaatac

SEQ ID NO: 307867 - DNA, 25 bp, Mus musculus
gcccattaaagctcagagccggcca

SEQ ID NO: 307868 - DNA, 25 bp, Mus musculus
gcccattaaagctcagtaccgcaca

SEQ ID NO: 307869 - DNA, 25 bp, Mus musculus
gcccattaaggtgaacctcctcgtt

SEQ ID NO: 307870 - DNA, 25 bp, Mus musculus
gcccattcaaccatggatgtgtaag

SEQ ID NO: 307871 - DNA, 25 bp, Mus musculus
gcccattcaggtgcgctgctcagac

SEQ ID NO: 307872 - DNA, 25 bp, Mus musculus
gcccattccagctgtcgcagagatg

SEQ ID NO: 307873 - DNA, 25 bp, Mus musculus
gcccattctcagcatcatgctggga

SEQ ID NO: 307874 - DNA, 25 bp, Mus musculus
gcccattcttaagattcctttgaga

SEQ ID NO: 307875 - DNA, 25 bp, Mus musculus
gcccattgatgtcacagctaagctt

SEQ ID NO: 307876 - DNA, 25 bp, Mus musculus
gcccattgcctcagcaactatcaga

SEQ ID NO: 307877 - DNA, 25 bp, Mus musculus
gcccattgcctcagcctctccaacc

SEQ ID NO: 307878 - DNA, 25 bp, Mus musculus
gcccattggaaacaggttcagacaa

SEQ ID NO: 307879 - DNA, 25 bp, Mus musculus
gcccattgtcaggtgcgtgaagctg

SEQ ID NO: 307880 - DNA, 25 bp, Mus musculus
gccccaaaattaggctgcgggacaa

SEQ ID NO: 307881 - DNA, 25 bp, Mus musculus
gccccaaagagggtcttgagagcag

SEQ ID NO: 307882 - DNA, 25 bp, Mus musculus
gccccaaaggagggaccgctgacaa

SEQ ID NO: 307883 - DNA, 25 bp, Mus musculus
gccccaaatctgcagatctcatagg

SEQ ID NO: 307884 - DNA, 25 bp, Mus musculus
gccccaaatctgcagatgtgaatcc

SEQ ID NO: 307885 - DNA, 25 bp, Mus musculus
gccccaacagaagctgacatcatgt

SEQ ID NO: 307886 - DNA, 25 bp, Mus musculus
gccccaacagaagctgcatgtctgc

SEQ ID NO: 307887 - DNA, 25 bp, Mus musculus
gccccaacagcgggccacagattgt

SEQ ID NO: 307888 - DNA, 25 bp, Mus musculus
gccccaacagcgggtctggaggagg

SEQ ID NO: 307889 - DNA, 25 bp, Mus musculus
gccccaaccagaccgtggacatgct

SEQ ID NO: 307890 - DNA, 25 bp, Mus musculus
gccccaactgaggaatggatacaga

SEQ ID NO: 307891 - DNA, 25 bp, Mus musculus
gccccaactgtggaatggatacaga

SEQ ID NO: 307892 - DNA, 25 bp, Mus musculus
gccccaagatgaggacgctcgcaca

SEQ ID NO: 307893 - DNA, 25 bp, Mus musculus
gccccaagcacaaggtgagactgtg

SEQ ID NO: 307894 - DNA, 25 bp, Mus musculus
gccccaagcaggtgaggaattttaa

SEQ ID NO: 307895 - DNA, 25 bp, Mus musculus
gccccaagttcccagcaagccccgc

SEQ ID NO: 307896 - DNA, 25 bp, Mus musculus
gccccaatcaggaaattaccggacg

SEQ ID NO: 307897 - DNA, 25 bp, Mus musculus
gccccaatgtatctggtgaccacat

SEQ ID NO: 307898 - DNA, 25 bp, Mus musculus
gccccacaaagaattccagaggcaa

SEQ ID NO: 307899 - DNA, 25 bp, Mus musculus
gccccacaagatccgtgtgaatgca

SEQ ID NO: 307900 - DNA, 25 bp, Mus musculus
gccccacaaggacctgctctccttg

SEQ ID NO: 307901 - DNA, 25 bp, Mus musculus
gccccacaccccgtgacccgcaggg

SEQ ID NO: 307902 - DNA, 25 bp, Mus musculus
gccccacaggaaaggaatggagagt

SEQ ID NO: 307903 - DNA, 25 bp, Mus musculus
gccccacaggaaagtacctggccag

SEQ ID NO: 307904 - DNA, 25 bp, Mus musculus
gccccacattcaacccatggggccg

SEQ ID NO: 307905 - DNA, 25 bp, Mus musculus
gccccacattcaactccagcgccgt

SEQ ID NO: 307906 - DNA, 25 bp, Mus musculus
gccccaccaagctcagtaacaagtc

SEQ ID NO: 307907 - DNA, 25 bp, Mus musculus
gccccaccagaaaacgaggaggaca

SEQ ID NO: 307908 - DNA, 25 bp, Mus musculus
gccccacctgatgagccaggtctgg

SEQ ID NO: 307909 - DNA, 25 bp, Mus musculus
gccccacgaactgggtgactttgcc

SEQ ID NO: 307910 - DNA, 25 bp, Mus musculus
gccccacgaactgggtgcagccctg

SEQ ID NO: 307911 - DNA, 25 bp, Mus musculus
gccccacgccaggattacatcttct

SEQ ID NO: 307912 - DNA, 25 bp, Mus musculus
gccccacggagctcgtaccctacgg

SEQ ID NO: 307913 - DNA, 25 bp, Mus musculus
gccccacggctggggactccttttc

SEQ ID NO: 307914 - DNA, 25 bp, Mus musculus
gccccactaagattgaagattatga

SEQ ID NO: 307915 - DNA, 25 bp, Mus musculus
gccccactagagtgcggccaaggat

SEQ ID NO: 307916 - DNA, 25 bp, Mus musculus
gccccactattggcttaagtttgct

SEQ ID NO: 307917 - DNA, 25 bp, Mus musculus
gccccactattggggcatctttcat

SEQ ID NO: 307918 - DNA, 25 bp, Mus musculus
gccccactccaggatcttttcccca

SEQ ID NO: 307919 - DNA, 25 bp, Mus musculus
gccccactccaggcacactggcaac

SEQ ID NO: 307920 - DNA, 25 bp, Mus musculus
gccccactgtaaggcagtggaactc

SEQ ID NO: 307921 - DNA, 25 bp, Mus musculus
gccccacttcagaaggcccgaaagg

SEQ ID NO: 307922 - DNA, 25 bp, Mus musculus
gccccacttcagtgtgtagaaggcc

SEQ ID NO: 307923 - DNA, 25 bp, Mus musculus
gccccagaagcagcccactgagtct

SEQ ID NO: 307924 - DNA, 25 bp, Mus musculus
gccccagaagcagtaccccacccca

SEQ ID NO: 307925 - DNA, 25 bp, Mus musculus
gccccagacaggttcagaacttaga

SEQ ID NO: 307926 - DNA, 25 bp, Mus musculus
gccccagactggtgaatgagagtga

SEQ ID NO: 307927 - DNA, 25 bp, Mus musculus
gccccagcagatggtaacaaaagat

SEQ ID NO: 307928 - DNA, 25 bp, Mus musculus
gccccagcaggcagctgccagaccc

SEQ ID NO: 307929 - DNA, 25 bp, Mus musculus
gccccagccacagatgaacgagacc

SEQ ID NO: 307930 - DNA, 25 bp, Mus musculus
gccccagcctccaccatgccaatca

SEQ ID NO: 307931 - DNA, 25 bp, Mus musculus
gccccagcctcgtgcccagcagcag

SEQ ID NO: 307932 - DNA, 25 bp, Mus musculus
gccccagcgaacatgctcactgttg

SEQ ID NO: 307933 - DNA, 25 bp, Mus musculus
gccccagcgaacatggcctcaggag

SEQ ID NO: 307934 - DNA, 25 bp, Mus musculus
gccccagcgagacagaggcttacat

SEQ ID NO: 307935 - DNA, 25 bp, Mus musculus
gccccagcgagagctagctgagcca

SEQ ID NO: 307936 - DNA, 25 bp, Mus musculus
gccccagcgagtccttcggggagcc

SEQ ID NO: 307937 - DNA, 25 bp, Mus musculus
gccccagcgattctgaaggtgaaga

SEQ ID NO: 307938 - DNA, 25 bp, Mus musculus
gccccagcggaggaggttgtaagca

SEQ ID NO: 307939 - DNA, 25 bp, Mus musculus
gccccagcggatcctgagagaaggc

SEQ ID NO: 307940 - DNA, 25 bp, Mus musculus
gccccagctcttcaggttgatcgcc

SEQ ID NO: 307941 - DNA, 25 bp, Mus musculus
gccccagctgctgcccccttatcgc

SEQ ID NO: 307942 - DNA, 25 bp, Mus musculus
gccccagctggtgcccccttatcgc

SEQ ID NO: 307943 - DNA, 25 bp, Mus musculus
gccccagctgtggggcagttttggc

SEQ ID NO: 307944 - DNA, 25 bp, Mus musculus
gccccagctgtttcagccatggctg

SEQ ID NO: 307945 - DNA, 25 bp, Mus musculus
gccccaggagacctaggcagactga

SEQ ID NO: 307946 - DNA, 25 bp, Mus musculus
gccccaggagaggactcttcccccc

SEQ ID NO: 307947 - DNA, 25 bp, Mus musculus
gccccaggagccctcccaggcccaa

SEQ ID NO: 307948 - DNA, 25 bp, Mus musculus
gccccaggagtttcctgaagtcgtc

SEQ ID NO: 307949 - DNA, 25 bp, Mus musculus
gccccaggccagcaggtgtacagtg

SEQ ID NO: 307950 - DNA, 25 bp, Mus musculus
gccccaggccagcagtgggctctgg

SEQ ID NO: 307951 - DNA, 25 bp, Mus musculus
gccccaggccgtgaatgaccagtgc

SEQ ID NO: 307952 - DNA, 25 bp, Mus musculus
gccccaggccgtggactaaagacca

SEQ ID NO: 307953 - DNA, 25 bp, Mus musculus
gccccaggcgggatccgggagacac

SEQ ID NO: 307954 - DNA, 25 bp, Mus musculus
gccccagggaagaggaacagctcag

SEQ ID NO: 307955 - DNA, 25 bp, Mus musculus
gccccagggcaaggattctgtaccc

SEQ ID NO: 307956 - DNA, 25 bp, Mus musculus
gccccagggcaaggtggctgccttt

SEQ ID NO: 307957 - DNA, 25 bp, Mus musculus
gccccagtgacacacgttcagcggt

SEQ ID NO: 307958 - DNA, 25 bp, Mus musculus
gccccagtgacacaggttcagcggt

SEQ ID NO: 307959 - DNA, 25 bp, Mus musculus
gccccagtgagacagtcatcgctcc

SEQ ID NO: 307960 - DNA, 25 bp, Mus musculus
gccccagtgagacagtgggggatct

SEQ ID NO: 307961 - DNA, 25 bp, Mus musculus
gccccagtgcagattaaggttgagg

SEQ ID NO: 307962 - DNA, 25 bp, Mus musculus
gccccagtgccagtggcatcaaata

SEQ ID NO: 307963 - DNA, 25 bp, Mus musculus
gccccagtgccgtttgattttacac

SEQ ID NO: 307964 - DNA, 25 bp, Mus musculus
gccccagtgtctgcgagcccagatg

SEQ ID NO: 307965 - DNA, 25 bp, Mus musculus
gccccagtgtctgcgatggttgtga

SEQ ID NO: 307966 - DNA, 25 bp, Mus musculus
gccccatacacaggggtctgtatga

SEQ ID NO: 307967 - DNA, 25 bp, Mus musculus
gccccatcagaccagaagctgacca

SEQ ID NO: 307968 - DNA, 25 bp, Mus musculus
gccccatcagaccaggccagctgtt

SEQ ID NO: 307969 - DNA, 25 bp, Mus musculus
gccccatcatgctggggaaacaact

SEQ ID NO: 307970 - DNA, 25 bp, Mus musculus
gccccatcatgctgggtggaagtga

SEQ ID NO: 307971 - DNA, 25 bp, Mus musculus
gccccatccagaggccatggacgga

SEQ ID NO: 307972 - DNA, 25 bp, Mus musculus
gccccatcctcaggctgcgctacat

SEQ ID NO: 307973 - DNA, 25 bp, Mus musculus
gccccatctaagcagccttcctgca

SEQ ID NO: 307974 - DNA, 25 bp, Mus musculus
gccccatctaagcaggtggcccgac

SEQ ID NO: 307975 - DNA, 25 bp, Mus musculus
gccccatctttacatatctacgcct

SEQ ID NO: 307976 - DNA, 25 bp, Mus musculus
gccccatctttacatctggctgagc

SEQ ID NO: 307977 - DNA, 25 bp, Mus musculus
gccccatgaaagaggcgccagccac

SEQ ID NO: 307978 - DNA, 25 bp, Mus musculus
gccccatgacatcagcagcggacag

SEQ ID NO: 307979 - DNA, 25 bp, Mus musculus
gccccatgactctagccagcagggc

SEQ ID NO: 307980 - DNA, 25 bp, Mus musculus
gccccatgatgatactgaggacagc

SEQ ID NO: 307981 - DNA, 25 bp, Mus musculus
gccccatgatgatcgcaaaagatgc

SEQ ID NO: 307982 - DNA, 25 bp, Mus musculus
gccccatgatggcttcttttcttca

SEQ ID NO: 307983 - DNA, 25 bp, Mus musculus
gccccatggctcgggactcggccag

SEQ ID NO: 307984 - DNA, 25 bp, Mus musculus
gccccattgaggtgaccagaatgga

SEQ ID NO: 307985 - DNA, 25 bp, Mus musculus
gccccatttacagggagaagctggg

SEQ ID NO: 307986 - DNA, 25 bp, Mus musculus
gccccatttccctggcaggttcacc

SEQ ID NO: 307987 - DNA, 25 bp, Mus musculus
gccccattttgacaccatttggagg

SEQ ID NO: 307988 - DNA, 25 bp, Mus musculus
gcccccaaagatcatccagctcctg

SEQ ID NO: 307989 - DNA, 25 bp, Mus musculus
gcccccaaagctcctgtgccaggtt

SEQ ID NO: 307990 - DNA, 25 bp, Mus musculus
gcccccaaaggttgctttcactacc

SEQ ID NO: 307991 - DNA, 25 bp, Mus musculus
gcccccaacacggcgagcctcgtgc

SEQ ID NO: 307992 - DNA, 25 bp, Mus musculus
gcccccaaccatcaaatcgggacaa

SEQ ID NO: 307993 - DNA, 25 bp, Mus musculus
gcccccaactattgtgaccagatgg

SEQ ID NO: 307994 - DNA, 25 bp, Mus musculus
gcccccacagccgtgtttgaccggg

SEQ ID NO: 307995 - DNA, 25 bp, Mus musculus
gcccccacagctccttcccagctgg

SEQ ID NO: 307996 - DNA, 25 bp, Mus musculus
gcccccacagtttgtatctacttga

SEQ ID NO: 307997 - DNA, 25 bp, Mus musculus
gcccccaccagcttcccttcagggc

SEQ ID NO: 307998 - DNA, 25 bp, Mus musculus
gcccccaccaggcctcggtgtctcc

SEQ ID NO: 307999 - DNA, 25 bp, Mus musculus
gcccccacctactgagctggtctgt

SEQ ID NO: 308000 - DNA, 25 bp, Mus musculus
gcccccacctactggggacttctgg

SEQ ID NO: 308001 - DNA, 25 bp, Mus musculus
gcccccacctagatcaagcactggg

SEQ ID NO: 308002 - DNA, 25 bp, Mus musculus
gcccccacctgaagaaaatggagac

SEQ ID NO: 308003 - DNA, 25 bp, Mus musculus
gcccccacttaatgcccaaaggata

SEQ ID NO: 308004 - DNA, 25 bp, Mus musculus
gcccccagaagagttctcttccttc

SEQ ID NO: 308005 - DNA, 25 bp, Mus musculus
gcccccagagagctctcatggtacc

SEQ ID NO: 308006 - DNA, 25 bp, Mus musculus
gcccccagagaggcagagcccctgg

SEQ ID NO: 308007 - DNA, 25 bp, Mus musculus
gcccccagagattaatgtggctgct

SEQ ID NO: 308008 - DNA, 25 bp, Mus musculus
gcccccagaggctgaagatggaaac

SEQ ID NO: 308009 - DNA, 25 bp, Mus musculus
gcccccagagggagaaggggagtag

SEQ ID NO: 308010 - DNA, 25 bp, Mus musculus
gcccccagaggtgtcgtggaggtgt

SEQ ID NO: 308011 - DNA, 25 bp, Mus musculus
gcccccagcagtggataaaatattt

SEQ ID NO: 308012 - DNA, 25 bp, Mus musculus
gcccccagcccagtgcactaagggg

SEQ ID NO: 308013 - DNA, 25 bp, Mus musculus
gcccccagcttcggcttgttttatt

SEQ ID NO: 308014 - DNA, 25 bp, Mus musculus
gcccccagcttcgggtcttttcacc

SEQ ID NO: 308015 - DNA, 25 bp, Mus musculus
gcccccaggagttattcctcataaa

SEQ ID NO: 308016 - DNA, 25 bp, Mus musculus
gcccccagggtcccgcaagaatcaa

SEQ ID NO: 308017 - DNA, 25 bp, Mus musculus
gcccccagtcagatctgtctcgaga

SEQ ID NO: 308018 - DNA, 25 bp, Mus musculus
gcccccagtcaggccggggctgtgc

SEQ ID NO: 308019 - DNA, 25 bp, Mus musculus
gcccccagtgagcctccctctcccc

SEQ ID NO: 308020 - DNA, 25 bp, Mus musculus
gcccccattcttcctcggtgtgcag

SEQ ID NO: 308021 - DNA, 25 bp, Mus musculus
gcccccatttgaataagactgtcaa

SEQ ID NO: 308022 - DNA, 25 bp, Mus musculus
gccccccaactgagggcaggctgga

SEQ ID NO: 308023 - DNA, 25 bp, Mus musculus
gccccccaaggaggagtcaggcctc

SEQ ID NO: 308024 - DNA, 25 bp, Mus musculus
gccccccagaatggtgggacgctcg

SEQ ID NO: 308025 - DNA, 25 bp, Mus musculus
gccccccagcacctggctgacagcc

SEQ ID NO: 308026 - DNA, 25 bp, Mus musculus
gccccccagccacgagcctcccaag

SEQ ID NO: 308027 - DNA, 25 bp, Mus musculus
gccccccagccaggatgatgtctac

SEQ ID NO: 308028 - DNA, 25 bp, Mus musculus
gccccccagccagtgtgaccccaca

SEQ ID NO: 308029 - DNA, 25 bp, Mus musculus
gccccccagctccagtgaggacagc

SEQ ID NO: 308030 - DNA, 25 bp, Mus musculus
gccccccctggacagcaagccccgc

SEQ ID NO: 308031 - DNA, 25 bp, Mus musculus
gccccccgatctagtgttgacagcc

SEQ ID NO: 308032 - DNA, 25 bp, Mus musculus
gccccccgcggacttccaatagtag

SEQ ID NO: 308033 - DNA, 25 bp, Mus musculus
gccccccgggattgcctatcctcta

SEQ ID NO: 308034 - DNA, 25 bp, Mus musculus
gccccccttttctgaatgaagatat

SEQ ID NO: 308035 - DNA, 25 bp, Mus musculus
gcccccgaaagagggtggtgtcatg

SEQ ID NO: 308036 - DNA, 25 bp, Mus musculus
gcccccgaccagagcagagggctgc

SEQ ID NO: 308037 - DNA, 25 bp, Mus musculus
gcccccgcaaggagatggagttcta

SEQ ID NO: 308038 - DNA, 25 bp, Mus musculus
gcccccgcaggataaggaagcctgt

SEQ ID NO: 308039 - DNA, 25 bp, Mus musculus
gcccccgcagggagctccgctttgg

SEQ ID NO: 308040 - DNA, 25 bp, Mus musculus
gcccccgcaggtgcgcttgagaagt

SEQ ID NO: 308041 - DNA, 25 bp, Mus musculus
gcccccgccgcgccttcatcaagta

SEQ ID NO: 308042 - DNA, 25 bp, Mus musculus
gcccccgccgtgtgagcgtcctggg

SEQ ID NO: 308043 - DNA, 25 bp, Mus musculus
gcccccggatgatggtcactttgct

SEQ ID NO: 308044 - DNA, 25 bp, Mus musculus
gcccccggcagcaggatgaaacgag

SEQ ID NO: 308045 - DNA, 25 bp, Mus musculus
gcccccggcagcagtctcactttat

SEQ ID NO: 308046 - DNA, 25 bp, Mus musculus
gcccccggcagtcaggagatggagg

SEQ ID NO: 308047 - DNA, 25 bp, Mus musculus
gcccccgtccagacactactttgct

SEQ ID NO: 308048 - DNA, 25 bp, Mus musculus
gcccccgtgttcaaggatgccgccg

SEQ ID NO: 308049 - DNA, 25 bp, Mus musculus
gccccctaactctaggatgaagagg

SEQ ID NO: 308050 - DNA, 25 bp, Mus musculus
gccccctagacaggataagacgctg

SEQ ID NO: 308051 - DNA, 25 bp, Mus musculus
gccccctagcctggtctgggacctg

SEQ ID NO: 308052 - DNA, 25 bp, Mus musculus
gccccctcacagctctcagggcctg

SEQ ID NO: 308053 - DNA, 25 bp, Mus musculus
gccccctcaccagccccggctgcac

SEQ ID NO: 308054 - DNA, 25 bp, Mus musculus
gccccctcagcccaggatctagagt

SEQ ID NO: 308055 - DNA, 25 bp, Mus musculus
gccccctcagcccagggtctcccta

SEQ ID NO: 308056 - DNA, 25 bp, Mus musculus
gccccctcagcccaggtggtgctct

SEQ ID NO: 308057 - DNA, 25 bp, Mus musculus
gccccctcaggagccaacatgttgg

SEQ ID NO: 308058 - DNA, 25 bp, Mus musculus
gccccctccccctgaccagctgtcc

SEQ ID NO: 308059 - DNA, 25 bp, Mus musculus
gccccctccggtcgccatggatcgg

SEQ ID NO: 308060 - DNA, 25 bp, Mus musculus
gccccctcggtgactctgtgaacct

SEQ ID NO: 308061 - DNA, 25 bp, Mus musculus
gccccctcgtctgctccacttccac

SEQ ID NO: 308062 - DNA, 25 bp, Mus musculus
gccccctctagtgagcactcccagt

SEQ ID NO: 308063 - DNA, 25 bp, Mus musculus
gccccctctccaggtgtctccagtg

SEQ ID NO: 308064 - DNA, 25 bp, Mus musculus
gccccctgaaagcctctggagatgg

SEQ ID NO: 308065 - DNA, 25 bp, Mus musculus
gccccctgcagttggacatttggct

SEQ ID NO: 308066 - DNA, 25 bp, Mus musculus
gccccctggcaggttcagagcattg

SEQ ID NO: 308067 - DNA, 25 bp, Mus musculus
gccccctggcctgagaagcctgtac

SEQ ID NO: 308068 - DNA, 25 bp, Mus musculus
gccccctggcctgattgcagcccgg

SEQ ID NO: 308069 - DNA, 25 bp, Mus musculus
gccccctgtggagaggagatacttc

SEQ ID NO: 308070 - DNA, 25 bp, Mus musculus
gcccccttggaacagtctggccaga

SEQ ID NO: 308071 - DNA, 25 bp, Mus musculus
gccccctttcacagagcatgatctc

SEQ ID NO: 308072 - DNA, 25 bp, Mus musculus
gccccctttcacaggctcctgagca

SEQ ID NO: 308073 - DNA, 25 bp, Mus musculus
gccccctttcatacctgctactaca

SEQ ID NO: 308074 - DNA, 25 bp, Mus musculus
gccccgaaacgccagcgatgggctg

SEQ ID NO: 308075 - DNA, 25 bp, Mus musculus
gccccgaacaacagacgagctaaac

SEQ ID NO: 308076 - DNA, 25 bp, Mus musculus
gccccgaacaacaggtcttcacaca

SEQ ID NO: 308077 - DNA, 25 bp, Mus musculus
gccccgaagccccggccaccatgtt

SEQ ID NO: 308078 - DNA, 25 bp, Mus musculus
gccccgacacaggtggagaatataa

SEQ ID NO: 308079 - DNA, 25 bp, Mus musculus
gccccgacacaggtgtgtatccaga

SEQ ID NO: 308080 - DNA, 25 bp, Mus musculus
gccccgacccaggggagcagcgcgg

SEQ ID NO: 308081 - DNA, 25 bp, Mus musculus
gccccgacccagtggctagacctag

SEQ ID NO: 308082 - DNA, 25 bp, Mus musculus
gccccgaccctgagttctgaggctc

SEQ ID NO: 308083 - DNA, 25 bp, Mus musculus
gccccgagaaagaggtgggacttct

SEQ ID NO: 308084 - DNA, 25 bp, Mus musculus
gccccgagaacgacccaggttcaag

SEQ ID NO: 308085 - DNA, 25 bp, Mus musculus
gccccgagagaagtcaatgaaagga

SEQ ID NO: 308086 - DNA, 25 bp, Mus musculus
gccccgaggcagaatctagatcttg

SEQ ID NO: 308087 - DNA, 25 bp, Mus musculus
gccccgaggcagatgtgtccttccg

SEQ ID NO: 308088 - DNA, 25 bp, Mus musculus
gccccgaggcaggtctctgctgacc

SEQ ID NO: 308089 - DNA, 25 bp, Mus musculus
gccccgaggcggttctcctgattct

SEQ ID NO: 308090 - DNA, 25 bp, Mus musculus
gccccgagtagctgggtatcatagt

SEQ ID NO: 308091 - DNA, 25 bp, Mus musculus
gccccgatcttggtcattgcctttc

SEQ ID NO: 308092 - DNA, 25 bp, Mus musculus
gccccgcaacagcaatccaaacttc

SEQ ID NO: 308093 - DNA, 25 bp, Mus musculus
gccccgcacagtatcagaaattatg

SEQ ID NO: 308094 - DNA, 25 bp, Mus musculus
gccccgcaccgatgatattatcaaa

SEQ ID NO: 308095 - DNA, 25 bp, Mus musculus
gccccgccacccagatctggaacaa

SEQ ID NO: 308096 - DNA, 25 bp, Mus musculus
gccccgccacccagcggccacatcc

SEQ ID NO: 308097 - DNA, 25 bp, Mus musculus
gccccgccagtcaagggacgcaagc

SEQ ID NO: 308098 - DNA, 25 bp, Mus musculus
gccccgccccagaaacatcgaatga

SEQ ID NO: 308099 - DNA, 25 bp, Mus musculus
gccccgccccagtgcaaacagctac

SEQ ID NO: 308100 - DNA, 25 bp, Mus musculus
gccccgcccgaggcactagagcagc

SEQ ID NO: 308101 - DNA, 25 bp, Mus musculus
gccccgcccggtggacaccaagggc

SEQ ID NO: 308102 - DNA, 25 bp, Mus musculus
gccccgccgcaggcccggacacaga

SEQ ID NO: 308103 - DNA, 25 bp, Mus musculus
gccccgccggccaatgggcccagtg

SEQ ID NO: 308104 - DNA, 25 bp, Mus musculus
gccccgcctcgctggccagatcttc

SEQ ID NO: 308105 - DNA, 25 bp, Mus musculus
gccccgccttgaacagagaaagcac

SEQ ID NO: 308106 - DNA, 25 bp, Mus musculus
gccccgcggcacgagacaatgaata

SEQ ID NO: 308107 - DNA, 25 bp, Mus musculus
gccccgctacggctcaatcgtggat

SEQ ID NO: 308108 - DNA, 25 bp, Mus musculus
gccccgctatgagcttgaggaggca

SEQ ID NO: 308109 - DNA, 25 bp, Mus musculus
gccccggaagcaggtgcggtgctac

SEQ ID NO: 308110 - DNA, 25 bp, Mus musculus
gccccggaaggaaaagcgcaatggt

SEQ ID NO: 308111 - DNA, 25 bp, Mus musculus
gccccggacagagacagggcagggc

SEQ ID NO: 308112 - DNA, 25 bp, Mus musculus
gccccggacccctggttctccacat

SEQ ID NO: 308113 - DNA, 25 bp, Mus musculus
gccccggaccgcgcggccacaaaaa

SEQ ID NO: 308114 - DNA, 25 bp, Mus musculus
gccccggagaagagccctaggcgat

SEQ ID NO: 308115 - DNA, 25 bp, Mus musculus
gccccggagaaggagtgagagagag

SEQ ID NO: 308116 - DNA, 25 bp, Mus musculus
gccccggaggaggtgacagagttag

SEQ ID NO: 308117 - DNA, 25 bp, Mus musculus
gccccggatggcatggaggagccag

SEQ ID NO: 308118 - DNA, 25 bp, Mus musculus
gccccggatggccgggctcgtggcg

SEQ ID NO: 308119 - DNA, 25 bp, Mus musculus
gccccggatgtggatggaaaagccg

SEQ ID NO: 308120 - DNA, 25 bp, Mus musculus
gccccggatgtggttgccaaaacaa

SEQ ID NO: 308121 - DNA, 25 bp, Mus musculus
gccccggccagctgactgctgtcca

SEQ ID NO: 308122 - DNA, 25 bp, Mus musculus
gccccggccctctgcgcctgtgtct

SEQ ID NO: 308123 - DNA, 25 bp, Mus musculus
gccccggcgctgagcctcaaaatgc

SEQ ID NO: 308124 - DNA, 25 bp, Mus musculus
gccccggctgcccactccgccttga

SEQ ID NO: 308125 - DNA, 25 bp, Mus musculus
gccccggctgccctcaaagcggagg

SEQ ID NO: 308126 - DNA, 25 bp, Mus musculus
gccccgggaaggaaaagcgcaatgg

SEQ ID NO: 308127 - DNA, 25 bp, Mus musculus
gccccgggacgtggtcaacgtggtg

SEQ ID NO: 308128 - DNA, 25 bp, Mus musculus
gccccgggagagacggagatttcca

SEQ ID NO: 308129 - DNA, 25 bp, Mus musculus
gccccgggccagacctcagctcgca

SEQ ID NO: 308130 - DNA, 25 bp, Mus musculus
gccccgggccgtgggaaatgcagtt

SEQ ID NO: 308131 - DNA, 25 bp, Mus musculus
gccccgggccgtgggctgcccagct

SEQ ID NO: 308132 - DNA, 25 bp, Mus musculus
gccccgggcggcttggctgcccacc

SEQ ID NO: 308133 - DNA, 25 bp, Mus musculus
gccccgggcgggagtcaggcctcgt

SEQ ID NO: 308134 - DNA, 25 bp, Mus musculus
gccccggggctacaggctcaccatc

SEQ ID NO: 308135 - DNA, 25 bp, Mus musculus
gccccggggctgagctggctagaga

SEQ ID NO: 308136 - DNA, 25 bp, Mus musculus
gccccgggtgacgttgcacaggcat

SEQ ID NO: 308137 - DNA, 25 bp, Mus musculus
gccccgggtggcaaggctggagcag

SEQ ID NO: 308138 - DNA, 25 bp, Mus musculus
gccccggtacatggagcttgtggag

SEQ ID NO: 308139 - DNA, 25 bp, Mus musculus
gccccggtagaggtatggatggatc

SEQ ID NO: 308140 - DNA, 25 bp, Mus musculus
gccccggtcaatgggtcctaaatgc

SEQ ID NO: 308141 - DNA, 25 bp, Mus musculus
gccccggtcagagaaaatgtcaagg

SEQ ID NO: 308142 - DNA, 25 bp, Mus musculus
gccccgtaacaggaattattttata

SEQ ID NO: 308143 - DNA, 25 bp, Mus musculus
gccccgtccccgccatgggctgcct

SEQ ID NO: 308144 - DNA, 25 bp, Mus musculus
gccccgtctgagggcagtcctttac

SEQ ID NO: 308145 - DNA, 25 bp, Mus musculus
gccccgttccaaggactcctttatc

SEQ ID NO: 308146 - DNA, 25 bp, Mus musculus
gccccgttccaaggcaagtccttgg

SEQ ID NO: 308147 - DNA, 25 bp, Mus musculus
gcccctaaaggtctcagaggtgggt

SEQ ID NO: 308148 - DNA, 25 bp, Mus musculus
gcccctacataaaatggttcctaca

SEQ ID NO: 308149 - DNA, 25 bp, Mus musculus
gcccctaccaggcgggatggagagc

SEQ ID NO: 308150 - DNA, 25 bp, Mus musculus
gcccctactcatgatgacgtgtcta

SEQ ID NO: 308151 - DNA, 25 bp, Mus musculus
gcccctagtggcaagggaaaacgaa

SEQ ID NO: 308152 - DNA, 25 bp, Mus musculus
gcccctataaaaactccgatgatcg

SEQ ID NO: 308153 - DNA, 25 bp, Mus musculus
gcccctatcccaggaatttgaagcc

SEQ ID NO: 308154 - DNA, 25 bp, Mus musculus
gcccctcaccgaggaggagaatggc

SEQ ID NO: 308155 - DNA, 25 bp, Mus musculus
gcccctcagccccagagcttcggtg

SEQ ID NO: 308156 - DNA, 25 bp, Mus musculus
gcccctcaggctcagcaccaaggag

SEQ ID NO: 308157 - DNA, 25 bp, Mus musculus
gcccctccagcaggaagaactagga

SEQ ID NO: 308158 - DNA, 25 bp, Mus musculus
gcccctcccatggagggtgctcgag

SEQ ID NO: 308159 - DNA, 25 bp, Mus musculus
gcccctccccgcttccgctctcggg

SEQ ID NO: 308160 - DNA, 25 bp, Mus musculus
gcccctccctgaactcggctgcacg

SEQ ID NO: 308161 - DNA, 25 bp, Mus musculus
gcccctcgggccaatcccagtggcc

SEQ ID NO: 308162 - DNA, 25 bp, Mus musculus
gcccctctacctcagggccccgccg

SEQ ID NO: 308163 - DNA, 25 bp, Mus musculus
gcccctctcactgggtcttctgggt

SEQ ID NO: 308164 - DNA, 25 bp, Mus musculus
gcccctctctcaggaatttgaagcc

SEQ ID NO: 308165 - DNA, 25 bp, Mus musculus
gcccctctgcacctaccctgtgccc

SEQ ID NO: 308166 - DNA, 25 bp, Mus musculus
gcccctctgctaatagttcctgcac

SEQ ID NO: 308167 - DNA, 25 bp, Mus musculus
gcccctctgctaatatggatgcaaa

SEQ ID NO: 308168 - DNA, 25 bp, Mus musculus
gcccctcttcctggagttccctgag

SEQ ID NO: 308169 - DNA, 25 bp, Mus musculus
gcccctgaagatggagagaagagga

SEQ ID NO: 308170 - DNA, 25 bp, Mus musculus
gcccctgaccagttagtcctctatt

SEQ ID NO: 308171 - DNA, 25 bp, Mus musculus
gcccctgactgctcttgtctgaaaa

SEQ ID NO: 308172 - DNA, 25 bp, Mus musculus
gcccctgacttgatgtgtcttacca

SEQ ID NO: 308173 - DNA, 25 bp, Mus musculus
gcccctgagcagggtgttcctgtat

SEQ ID NO: 308174 - DNA, 25 bp, Mus musculus
gcccctgataccaggggttccagtg

SEQ ID NO: 308175 - DNA, 25 bp, Mus musculus
gcccctgatatttgacattaacgag

SEQ ID NO: 308176 - DNA, 25 bp, Mus musculus
gcccctgattatcagtaccccaccc

SEQ ID NO: 308177 - DNA, 25 bp, Mus musculus
gcccctgcaaagataccgaagcaaa

SEQ ID NO: 308178 - DNA, 25 bp, Mus musculus
gcccctgcaaaggttttccatctcc

SEQ ID NO: 308179 - DNA, 25 bp, Mus musculus
gcccctgcagaagactgctagctac

SEQ ID NO: 308180 - DNA, 25 bp, Mus musculus
gcccctgccagggctgatggtgacc

SEQ ID NO: 308181 - DNA, 25 bp, Mus musculus
gcccctgcctaagccaaggaagtag

SEQ ID NO: 308182 - DNA, 25 bp, Mus musculus
gcccctgcctccctgcccacaaagt

SEQ ID NO: 308183 - DNA, 25 bp, Mus musculus
gcccctgcctgagcaaggggaccag

SEQ ID NO: 308184 - DNA, 25 bp, Mus musculus
gcccctgcgaccaggtgacccaatg

SEQ ID NO: 308185 - DNA, 25 bp, Mus musculus
gcccctggaacctgatctaacaaac

SEQ ID NO: 308186 - DNA, 25 bp, Mus musculus
gcccctggacttcagggagaggaac

SEQ ID NO: 308187 - DNA, 25 bp, Mus musculus
gcccctggagaacggggaagtctag

SEQ ID NO: 308188 - DNA, 25 bp, Mus musculus
gcccctggaggctgccacccgtctc

SEQ ID NO: 308189 - DNA, 25 bp, Mus musculus
gcccctggctgaggcagagcagctg

SEQ ID NO: 308190 - DNA, 25 bp, Mus musculus
gcccctgggccacagggtcctactg

SEQ ID NO: 308191 - DNA, 25 bp, Mus musculus
gcccctgggctggtggctctcgagg

SEQ ID NO: 308192 - DNA, 25 bp, Mus musculus
gcccctgtcatctctcaccctcgcc

SEQ ID NO: 308193 - DNA, 25 bp, Mus musculus
gcccctgtcgatctttgggttcctg

SEQ ID NO: 308194 - DNA, 25 bp, Mus musculus
gcccctgtcggaactgctgcactat

SEQ ID NO: 308195 - DNA, 25 bp, Mus musculus
gcccctgtgacattctgctgggctt

SEQ ID NO: 308196 - DNA, 25 bp, Mus musculus
gcccctgtgacattgtgctgggctt

SEQ ID NO: 308197 - DNA, 25 bp, Mus musculus
gcccctgtgagctgcaaaaggaagt

SEQ ID NO: 308198 - DNA, 25 bp, Mus musculus
gcccctgttctggtgattgaggctg

SEQ ID NO: 308199 - DNA, 25 bp, Mus musculus
gcccctgttggcatcctcaaatcca

SEQ ID NO: 308200 - DNA, 25 bp, Mus musculus
gccccttacaagaagacttgcctaa

SEQ ID NO: 308201 - DNA, 25 bp, Mus musculus
gccccttacaagaaggatgagaaca

SEQ ID NO: 308202 - DNA, 25 bp, Mus musculus
gccccttcacccagtgctgtcaatc

SEQ ID NO: 308203 - DNA, 25 bp, Mus musculus
gccccttcagaacctgtctgtcctg

SEQ ID NO: 308204 - DNA, 25 bp, Mus musculus
gccccttcagctgtgcagaacctgt

SEQ ID NO: 308205 - DNA, 25 bp, Mus musculus
gccccttcctgagcatctgtgggtg

SEQ ID NO: 308206 - DNA, 25 bp, Mus musculus
gccccttccttcccagtggatctga

SEQ ID NO: 308207 - DNA, 25 bp, Mus musculus
gccccttgagccataatgaagagtc

SEQ ID NO: 308208 - DNA, 25 bp, Mus musculus
gccccttgagtatggcaagaagaag

SEQ ID NO: 308209 - DNA, 25 bp, Mus musculus
gccccttgcaagtgcccctctcacc

SEQ ID NO: 308210 - DNA, 25 bp, Mus musculus
gccccttgcaagttctgggccaaga

SEQ ID NO: 308211 - DNA, 25 bp, Mus musculus
gccccttggatagactacgagtctg

SEQ ID NO: 308212 - DNA, 25 bp, Mus musculus
gccccttggatagagcatatttaat

SEQ ID NO: 308213 - DNA, 25 bp, Mus musculus
gccccttgtatagctgtcagggtga

SEQ ID NO: 308214 - DNA, 25 bp, Mus musculus
gcccctttcccatgggtcactgccc

SEQ ID NO: 308215 - DNA, 25 bp, Mus musculus
gcccctttgagcagcatatgaagaa

SEQ ID NO: 308216 - DNA, 25 bp, Mus musculus
gcccgaaactgagaagaccagagcc

SEQ ID NO: 308217 - DNA, 25 bp, Mus musculus
gcccgaaagagtctaaagcctgaca

SEQ ID NO: 308218 - DNA, 25 bp, Mus musculus
gcccgaaagagtctaaagcgcctga

SEQ ID NO: 308219 - DNA, 25 bp, Mus musculus
gcccgaacaggtcttattttagtca

SEQ ID NO: 308220 - DNA, 25 bp, Mus musculus
gcccgaagaagagctgtggtttctc

SEQ ID NO: 308221 - DNA, 25 bp, Mus musculus
gcccgaagctacaggactcttcccc

SEQ ID NO: 308222 - DNA, 25 bp, Mus musculus
gcccgaaggccgaatgttttggctg

SEQ ID NO: 308223 - DNA, 25 bp, Mus musculus
gcccgaaggccggtcgctgtggttc

SEQ ID NO: 308224 - DNA, 25 bp, Mus musculus
gcccgaagttgctcagtggacaaga

SEQ ID NO: 308225 - DNA, 25 bp, Mus musculus
gcccgaatatctcaagtatgcgaga

SEQ ID NO: 308226 - DNA, 25 bp, Mus musculus
gcccgaccagaaccgggtggtgggt

SEQ ID NO: 308227 - DNA, 25 bp, Mus musculus
gcccgaccatgaagacaccgtggaa

SEQ ID NO: 308228 - DNA, 25 bp, Mus musculus
gcccgaccatgaagatgaagcggca

SEQ ID NO: 308229 - DNA, 25 bp, Mus musculus
gcccgaccatgaaggtttataagaa

SEQ ID NO: 308230 - DNA, 25 bp, Mus musculus
gcccgaccctaggtacccaggtgac

SEQ ID NO: 308231 - DNA, 25 bp, Mus musculus
gcccgaccctgaagggacctttgac

SEQ ID NO: 308232 - DNA, 25 bp, Mus musculus
gcccgaccctgaaggtggacttgtt

SEQ ID NO: 308233 - DNA, 25 bp, Mus musculus
gcccgactgcagaggacccgcgcgc

SEQ ID NO: 308234 - DNA, 25 bp, Mus musculus
gcccgacttgccgggtctggaatgt

SEQ ID NO: 308235 - DNA, 25 bp, Mus musculus
gcccgacttgggcaggtaaaccacc

SEQ ID NO: 308236 - DNA, 25 bp, Mus musculus
gcccgagacagggactattccaaca

SEQ ID NO: 308237 - DNA, 25 bp, Mus musculus
gcccgagaggttcgtctgctttgcc

SEQ ID NO: 308238 - DNA, 25 bp, Mus musculus
gcccgagcagcttggccgacaggaa

SEQ ID NO: 308239 - DNA, 25 bp, Mus musculus
gcccgagcaggacttggatgttgtg

SEQ ID NO: 308240 - DNA, 25 bp, Mus musculus
gcccgagcggcggggtgaccatgga

SEQ ID NO: 308241 - DNA, 25 bp, Mus musculus
gcccgaggacgtgccaagccgcaat

SEQ ID NO: 308242 - DNA, 25 bp, Mus musculus
gcccgaggcagaggatttggacgtg

SEQ ID NO: 308243 - DNA, 25 bp, Mus musculus
gcccgaggccagagcatcccagcct

SEQ ID NO: 308244 - DNA, 25 bp, Mus musculus
gcccgaggggaccctgttgactgac

SEQ ID NO: 308245 - DNA, 25 bp, Mus musculus
gcccgagtaacagggattgccggaa

SEQ ID NO: 308246 - DNA, 25 bp, Mus musculus
gcccgagtcgggccggacagaacag

SEQ ID NO: 308247 - DNA, 25 bp, Mus musculus
gcccgagtggagctggacctcggcc

SEQ ID NO: 308248 - DNA, 25 bp, Mus musculus
gcccgatcatggagtattgataaca

SEQ ID NO: 308249 - DNA, 25 bp, Mus musculus
gcccgatgcaatgctgtcgatcatt

SEQ ID NO: 308250 - DNA, 25 bp, Mus musculus
gcccgatgccaaaatccaacaaacc

SEQ ID NO: 308251 - DNA, 25 bp, Mus musculus
gcccgatgccaaaattccaccaaac

SEQ ID NO: 308252 - DNA, 25 bp, Mus musculus
gcccgatgggggccatctcacccat

SEQ ID NO: 308253 - DNA, 25 bp, Mus musculus
gcccgcaaaagctccctccaacatg

SEQ ID NO: 308254 - DNA, 25 bp, Mus musculus
gcccgcaaggacgaactcatcaagt

SEQ ID NO: 308255 - DNA, 25 bp, Mus musculus
gcccgcactggagcgtgctcttcag

SEQ ID NO: 308256 - DNA, 25 bp, Mus musculus
gcccgcagccgccagaagcggcttt

SEQ ID NO: 308257 - DNA, 25 bp, Mus musculus
gcccgcagccgccaggccagaagcg

SEQ ID NO: 308258 - DNA, 25 bp, Mus musculus
gcccgcaggacagagagtcgatatg

SEQ ID NO: 308259 - DNA, 25 bp, Mus musculus
gcccgcagtaacttggattccaggt

SEQ ID NO: 308260 - DNA, 25 bp, Mus musculus
gcccgcagtgtgagtgcctgctcac

SEQ ID NO: 308261 - DNA, 25 bp, Mus musculus
gcccgcagtgtggaggcagttggct

SEQ ID NO: 308262 - DNA, 25 bp, Mus musculus
gcccgccacagctgagctgctcctc

SEQ ID NO: 308263 - DNA, 25 bp, Mus musculus
gcccgccacaggctggagcaggctg

SEQ ID NO: 308264 - DNA, 25 bp, Mus musculus
gcccgccaccccctgtatccctctg

SEQ ID NO: 308265 - DNA, 25 bp, Mus musculus
gcccgccagccaggttgcaagtgtt

SEQ ID NO: 308266 - DNA, 25 bp, Mus musculus
gcccgcccaaccagcagaggcctcc

SEQ ID NO: 308267 - DNA, 25 bp, Mus musculus
gcccgcccacaagtatgtcttggct

SEQ ID NO: 308268 - DNA, 25 bp, Mus musculus
gcccgcccaggttgtcttgacaccc

SEQ ID NO: 308269 - DNA, 25 bp, Mus musculus
gcccgccccaaagcctgccgacata

SEQ ID NO: 308270 - DNA, 25 bp, Mus musculus
gcccgccccgtccccgccatgggct

SEQ ID NO: 308271 - DNA, 25 bp, Mus musculus
gcccgcccggattgatgaactccca

SEQ ID NO: 308272 - DNA, 25 bp, Mus musculus
gcccgcccggcaatgggaaatccag

SEQ ID NO: 308273 - DNA, 25 bp, Mus musculus
gcccgcccggtgcatttctaggtcc

SEQ ID NO: 308274 - DNA, 25 bp, Mus musculus
gcccgcccggttatgtcattttctc

SEQ ID NO: 308275 - DNA, 25 bp, Mus musculus
gcccgccgagcagagaacggcaggc

SEQ ID NO: 308276 - DNA, 25 bp, Mus musculus
gcccgccgagcaggaagttctgacg

SEQ ID NO: 308277 - DNA, 25 bp, Mus musculus
gcccgccgctcgaaacctcgacctt

SEQ ID NO: 308278 - DNA, 25 bp, Mus musculus
gcccgcctatcaaccgtggccttcc

SEQ ID NO: 308279 - DNA, 25 bp, Mus musculus
gcccgcctcctgatccaggaccagc

SEQ ID NO: 308280 - DNA, 25 bp, Mus musculus
gcccgcctgccgcggaatcatggcc

SEQ ID NO: 308281 - DNA, 25 bp, Mus musculus
gcccgcctgggcagggatccctgct

SEQ ID NO: 308282 - DNA, 25 bp, Mus musculus
gcccgcctttggctcccatccaagt

SEQ ID NO: 308283 - DNA, 25 bp, Mus musculus
gcccgcgaagctctcggagactgga

SEQ ID NO: 308284 - DNA, 25 bp, Mus musculus
gcccgcgaaggaggtgtcgcggaag

SEQ ID NO: 308285 - DNA, 25 bp, Mus musculus
gcccgcgatgactgccactctccgc

SEQ ID NO: 308286 - DNA, 25 bp, Mus musculus
gcccgcgattgcagggagtcattcc

SEQ ID NO: 308287 - DNA, 25 bp, Mus musculus
gcccgcgattgcaggtctgttgtgg

SEQ ID NO: 308288 - DNA, 25 bp, Mus musculus
gcccgcgcagagccggctgatcttt

SEQ ID NO: 308289 - DNA, 25 bp, Mus musculus
gcccgcgcaggatccaagacacttt

SEQ ID NO: 308290 - DNA, 25 bp, Mus musculus
gcccgcgcaggttggtgggaactcg

SEQ ID NO: 308291 - DNA, 25 bp, Mus musculus
gcccgcgcaggtttggacgtcatga

SEQ ID NO: 308292 - DNA, 25 bp, Mus musculus
gcccgcgcgcctgaggcactttgaa

SEQ ID NO: 308293 - DNA, 25 bp, Mus musculus
gcccgcgcgggctgagctggactgg

SEQ ID NO: 308294 - DNA, 25 bp, Mus musculus
gcccgcgcgtaggcgtcaagatcaa

SEQ ID NO: 308295 - DNA, 25 bp, Mus musculus
gcccgcggcagatgaggaaacccag

SEQ ID NO: 308296 - DNA, 25 bp, Mus musculus
gcccgcggcagggaatgattttgca

SEQ ID NO: 308297 - DNA, 25 bp, Mus musculus
gcccgcggggactggtatccggttg

SEQ ID NO: 308298 - DNA, 25 bp, Mus musculus
gcccgctactttggtgacacacact

SEQ ID NO: 308299 - DNA, 25 bp, Mus musculus
gcccgctcaccggctgtaaaaaatg

SEQ ID NO: 308300 - DNA, 25 bp, Mus musculus
gcccgctctggccgacctaatcccc

SEQ ID NO: 308301 - DNA, 25 bp, Mus musculus
gcccgctctggccggagtgagagag

SEQ ID NO: 308302 - DNA, 25 bp, Mus musculus
gcccgctgaaaaaattgtgcaagca

SEQ ID NO: 308303 - DNA, 25 bp, Mus musculus
gcccgctgccccagggatctttggc

SEQ ID NO: 308304 - DNA, 25 bp, Mus musculus
gcccgctggtcggtctgggaacgta

SEQ ID NO: 308305 - DNA, 25 bp, Mus musculus
gcccgcttttctcagctgtgacttc

SEQ ID NO: 308306 - DNA, 25 bp, Mus musculus
gcccggaaaaggagtcaggcggagc

SEQ ID NO: 308307 - DNA, 25 bp, Mus musculus
gcccggaaagccccggcagcccaac

SEQ ID NO: 308308 - DNA, 25 bp, Mus musculus
gcccggaacaaagtaagaagctgtc

SEQ ID NO: 308309 - DNA, 25 bp, Mus musculus
gcccggaagaatacgtatcaccaaa

SEQ ID NO: 308310 - DNA, 25 bp, Mus musculus
gcccggaagtcgggtgacagaagac

SEQ ID NO: 308311 - DNA, 25 bp, Mus musculus
gcccggacccgagatgagcaataac

SEQ ID NO: 308312 - DNA, 25 bp, Mus musculus
gcccggaccgccagattgtgccttc

SEQ ID NO: 308313 - DNA, 25 bp, Mus musculus
gcccggacctcagcagaaatctccc

SEQ ID NO: 308314 - DNA, 25 bp, Mus musculus
gcccggacctcaggtctctgcctcc

SEQ ID NO: 308315 - DNA, 25 bp, Mus musculus
gcccggagaagatggtgaacctgga

SEQ ID NO: 308316 - DNA, 25 bp, Mus musculus
gcccggagagagctctcagggcctg

SEQ ID NO: 308317 - DNA, 25 bp, Mus musculus
gcccggagatgcgggtttgcctgca

SEQ ID NO: 308318 - DNA, 25 bp, Mus musculus
gcccggagcaagactgtcaaggcct

SEQ ID NO: 308319 - DNA, 25 bp, Mus musculus
gcccggagcaaggacgaaggtgttt

SEQ ID NO: 308320 - DNA, 25 bp, Mus musculus
gcccggagcaaggtaacaaataagg

SEQ ID NO: 308321 - DNA, 25 bp, Mus musculus
gcccggagcacgcagcccgactcaa

SEQ ID NO: 308322 - DNA, 25 bp, Mus musculus
gcccggagccgcgactgatttcctg

SEQ ID NO: 308323 - DNA, 25 bp, Mus musculus
gcccggagccgcgttggaggcctcc

SEQ ID NO: 308324 - DNA, 25 bp, Mus musculus
gcccggagcgagacactttcctgag

SEQ ID NO: 308325 - DNA, 25 bp, Mus musculus
gcccggagcgaggtagcaaacaaga

SEQ ID NO: 308326 - DNA, 25 bp, Mus musculus
gcccggagctgaccaaaccgggctc

SEQ ID NO: 308327 - DNA, 25 bp, Mus musculus
gcccggagctgaccggtctccctat

SEQ ID NO: 308328 - DNA, 25 bp, Mus musculus
gcccggaggagatggacgtggatga

SEQ ID NO: 308329 - DNA, 25 bp, Mus musculus
gcccggaggagatggagcacgcccc

SEQ ID NO: 308330 - DNA, 25 bp, Mus musculus
gcccggagtggcagtccggctctcc

SEQ ID NO: 308331 - DNA, 25 bp, Mus musculus
gcccggatcccgaggccacgtggca

SEQ ID NO: 308332 - DNA, 25 bp, Mus musculus
gcccggatgagcgagctggagcaga

SEQ ID NO: 308333 - DNA, 25 bp, Mus musculus
gcccggatgaggtggctctggtcca

SEQ ID NO: 308334 - DNA, 25 bp, Mus musculus
gcccggattaaggggacctggctga

SEQ ID NO: 308335 - DNA, 25 bp, Mus musculus
gcccggcaccaggcaatctttggca

SEQ ID NO: 308336 - DNA, 25 bp, Mus musculus
gcccggcagaatggctcccgcaaag

SEQ ID NO: 308337 - DNA, 25 bp, Mus musculus
gcccggcagccgaggttcctgcctc

SEQ ID NO: 308338 - DNA, 25 bp, Mus musculus
gcccggcaggtgaaggcctatgaga

SEQ ID NO: 308339 - DNA, 25 bp, Mus musculus
gcccggcccactcagaggctgagaa

SEQ ID NO: 308340 - DNA, 25 bp, Mus musculus
gcccggcccagcccggtcaagcagg

SEQ ID NO: 308341 - DNA, 25 bp, Mus musculus
gcccggccctcctgaagcccttttt

SEQ ID NO: 308342 - DNA, 25 bp, Mus musculus
gcccggccggggaccaatctccgct

SEQ ID NO: 308343 - DNA, 25 bp, Mus musculus
gcccggcctcgggtgtttctgtttg

SEQ ID NO: 308344 - DNA, 25 bp, Mus musculus
gcccggcctctgatgacccccggag

SEQ ID NO: 308345 - DNA, 25 bp, Mus musculus
gcccggcctctgatgcttgattata

SEQ ID NO: 308346 - DNA, 25 bp, Mus musculus
gcccggcctggcaggtagcagaggc

SEQ ID NO: 308347 - DNA, 25 bp, Mus musculus
gcccggcctggcaggtttaagtttc

SEQ ID NO: 308348 - DNA, 25 bp, Mus musculus
gcccggcctggcagtttctagtcct

SEQ ID NO: 308349 - DNA, 25 bp, Mus musculus
gcccggcgccggttcagtcctcgcc

SEQ ID NO: 308350 - DNA, 25 bp, Mus musculus
gcccggcgcggcgggagccgctccc

SEQ ID NO: 308351 - DNA, 25 bp, Mus musculus
gcccggcgggcgggtaaataacaga

SEQ ID NO: 308352 - DNA, 25 bp, Mus musculus
gcccggctacatggcatcagtggat

SEQ ID NO: 308353 - DNA, 25 bp, Mus musculus
gcccggctcaggacaatggattttc

SEQ ID NO: 308354 - DNA, 25 bp, Mus musculus
gcccggctccctcaggtataagtat

SEQ ID NO: 308355 - DNA, 25 bp, Mus musculus
gcccggctgcaggcgaatctggttt

SEQ ID NO: 308356 - DNA, 25 bp, Mus musculus
gcccggctgtacacttccggcctgc

SEQ ID NO: 308357 - DNA, 25 bp, Mus musculus
gcccggcttagaactctccgctggt

SEQ ID NO: 308358 - DNA, 25 bp, Mus musculus
gcccggcttccggagatatgacgtg

SEQ ID NO: 308359 - DNA, 25 bp, Mus musculus
gcccggcttccggagtttgtgatcc

SEQ ID NO: 308360 - DNA, 25 bp, Mus musculus
gcccggcttcgtgtatcctcagaga

SEQ ID NO: 308361 - DNA, 25 bp, Mus musculus
gcccgggaaagaacgcacagtggta

SEQ ID NO: 308362 - DNA, 25 bp, Mus musculus
gcccgggaagagttcagccggcgct

SEQ ID NO: 308363 - DNA, 25 bp, Mus musculus
gcccgggacaaagggtgaagcaggg

SEQ ID NO: 308364 - DNA, 25 bp, Mus musculus
gcccgggacaactatgggaagaaga

SEQ ID NO: 308365 - DNA, 25 bp, Mus musculus
gcccgggacccagtgcaggtcctaa

SEQ ID NO: 308366 - DNA, 25 bp, Mus musculus
gcccgggacccgcaggtcctaatct

SEQ ID NO: 308367 - DNA, 25 bp, Mus musculus
gcccgggacccttatgacctgatgg

SEQ ID NO: 308368 - DNA, 25 bp, Mus musculus
gcccgggacccttctgccactgctg

SEQ ID NO: 308369 - DNA, 25 bp, Mus musculus
gcccgggaccgcaggtgtgggatat

SEQ ID NO: 308370 - DNA, 25 bp, Mus musculus
gcccgggaccgcagttgagtggtga

SEQ ID NO: 308371 - DNA, 25 bp, Mus musculus
gcccgggacttcatgcgattgagaa

SEQ ID NO: 308372 - DNA, 25 bp, Mus musculus
gcccgggacttcatgttgatcacag

SEQ ID NO: 308373 - DNA, 25 bp, Mus musculus
gcccgggagagcaatgtcacacttg

SEQ ID NO: 308374 - DNA, 25 bp, Mus musculus
gcccgggagcaggctgaagctgagg

SEQ ID NO: 308375 - DNA, 25 bp, Mus musculus
gcccgggagcgacgatgtcaaccta

SEQ ID NO: 308376 - DNA, 25 bp, Mus musculus
gcccgggaggcgctggcggtggtgt

SEQ ID NO: 308377 - DNA, 25 bp, Mus musculus
gcccgggcaagacatccacatcttt

SEQ ID NO: 308378 - DNA, 25 bp, Mus musculus
gcccgggcaggtaaatttaacacaa

SEQ ID NO: 308379 - DNA, 25 bp, Mus musculus
gcccgggccgcgccatgggctgcct

SEQ ID NO: 308380 - DNA, 25 bp, Mus musculus
gcccgggccgctcgatgaacctcta

SEQ ID NO: 308381 - DNA, 25 bp, Mus musculus
gcccgggcctcaggaaccaatgaca

SEQ ID NO: 308382 - DNA, 25 bp, Mus musculus
gcccgggcggcaggacctgctagaa

SEQ ID NO: 308383 - DNA, 25 bp, Mus musculus
gcccgggcttccagacgatactgta

SEQ ID NO: 308384 - DNA, 25 bp, Mus musculus
gcccggggagagatactccatgttt

SEQ ID NO: 308385 - DNA, 25 bp, Mus musculus
gcccggggattacaggttaaaatga

SEQ ID NO: 308386 - DNA, 25 bp, Mus musculus
gcccggggcggacagacctacgcaa

SEQ ID NO: 308387 - DNA, 25 bp, Mus musculus
gcccggggcggacagatctgacaca

SEQ ID NO: 308388 - DNA, 25 bp, Mus musculus
gcccggggggaaggattggatggtg

SEQ ID NO: 308389 - DNA, 25 bp, Mus musculus
gcccggggtccgcggtactgtgagg

SEQ ID NO: 308390 - DNA, 25 bp, Mus musculus
gcccggggtgaaggtgagcctcatg

SEQ ID NO: 308391 - DNA, 25 bp, Mus musculus
gcccgggtaacatccggatatgtac

SEQ ID NO: 308392 - DNA, 25 bp, Mus musculus
gcccgggtctccgtgacaagattgt

SEQ ID NO: 308393 - DNA, 25 bp, Mus musculus
gcccgggtgtgggacttgtgtgagg

SEQ ID NO: 308394 - DNA, 25 bp, Mus musculus
gcccggtaaagtgccggcagagcag

SEQ ID NO: 308395 - DNA, 25 bp, Mus musculus
gcccggtcccacacgcctctgtaca

SEQ ID NO: 308396 - DNA, 25 bp, Mus musculus
gcccggtcccacacggacgtggggc

SEQ ID NO: 308397 - DNA, 25 bp, Mus musculus
gcccggtctccgcccggcagaacag

SEQ ID NO: 308398 - DNA, 25 bp, Mus musculus
gcccggtctccgtttgcagcggggc

SEQ ID NO: 308399 - DNA, 25 bp, Mus musculus
gcccggtcttccgctgaaggggatg

SEQ ID NO: 308400 - DNA, 25 bp, Mus musculus
gcccggtgaggagctgtgggaacct

SEQ ID NO: 308401 - DNA, 25 bp, Mus musculus
gcccggtgcacgatgcccccgaaaa

SEQ ID NO: 308402 - DNA, 25 bp, Mus musculus
gcccggtgtgtgcgtgtgcaagagc

SEQ ID NO: 308403 - DNA, 25 bp, Mus musculus
gcccggttagcagcccttggcgata

SEQ ID NO: 308404 - DNA, 25 bp, Mus musculus
gcccggttagcagctgccgcccttg

SEQ ID NO: 308405 - DNA, 25 bp, Mus musculus
gcccggtttcacatgagagcacatg

SEQ ID NO: 308406 - DNA, 25 bp, Mus musculus
gcccggtttcacttgagagcacatg

SEQ ID NO: 308407 - DNA, 25 bp, Mus musculus
gcccgtatagattacatctcgctta

SEQ ID NO: 308408 - DNA, 25 bp, Mus musculus
gcccgtataggcacgtcagctttac

SEQ ID NO: 308409 - DNA, 25 bp, Mus musculus
gcccgtatcctgaagctgtttgggt

SEQ ID NO: 308410 - DNA, 25 bp, Mus musculus
gcccgtatcctggtgttgggtatga

SEQ ID NO: 308411 - DNA, 25 bp, Mus musculus
gcccgtatgaccaggtcacaatcat

SEQ ID NO: 308412 - DNA, 25 bp, Mus musculus
gcccgtcaaaagattccaagaaaca

SEQ ID NO: 308413 - DNA, 25 bp, Mus musculus
gcccgtcacaagggcggtgacgaat

SEQ ID NO: 308414 - DNA, 25 bp, Mus musculus
gcccgtcacaaggttgtcaggaaca

SEQ ID NO: 308415 - DNA, 25 bp, Mus musculus
gcccgtcagccccacaccaaggaga

SEQ ID NO: 308416 - DNA, 25 bp, Mus musculus
gcccgtcagtgtgggtgctctttca

SEQ ID NO: 308417 - DNA, 25 bp, Mus musculus
gcccgtccagccaaggctgtcttca

SEQ ID NO: 308418 - DNA, 25 bp, Mus musculus
gcccgtcgaaaagacaattgggaag

SEQ ID NO: 308419 - DNA, 25 bp, Mus musculus
gcccgtgaagagtgtttcccgagag

SEQ ID NO: 308420 - DNA, 25 bp, Mus musculus
gcccgtgatgactgataaacaagct

SEQ ID NO: 308421 - DNA, 25 bp, Mus musculus
gcccgtgcgcagcaggctgcctgct

SEQ ID NO: 308422 - DNA, 25 bp, Mus musculus
gcccgtgctagaggaaccagcagat

SEQ ID NO: 308423 - DNA, 25 bp, Mus musculus
gcccgtgctgaaagtgtctgatgcc

SEQ ID NO: 308424 - DNA, 25 bp, Mus musculus
gcccgtggagaggaggtggtgtcag

SEQ ID NO: 308425 - DNA, 25 bp, Mus musculus
gcccgtggagaggtctgcaaacagc

SEQ ID NO: 308426 - DNA, 25 bp, Mus musculus
gcccgtggagcaagtgtttgccaag

SEQ ID NO: 308427 - DNA, 25 bp, Mus musculus
gcccgtggaggaggtggacatctac

SEQ ID NO: 308428 - DNA, 25 bp, Mus musculus
gcccgtggcaaaggtcttttggctg

SEQ ID NO: 308429 - DNA, 25 bp, Mus musculus
gcccgtgggattgcaggccctcaag

SEQ ID NO: 308430 - DNA, 25 bp, Mus musculus
gcccgtggtgctggggcctgtgctc

SEQ ID NO: 308431 - DNA, 25 bp, Mus musculus
gcccgtgtctgcaggtatatccgaa

SEQ ID NO: 308432 - DNA, 25 bp, Mus musculus
gcccgtgtggaagagttcaagctga

SEQ ID NO: 308433 - DNA, 25 bp, Mus musculus
gcccgtgtggttgcaccctcaggat

SEQ ID NO: 308434 - DNA, 25 bp, Mus musculus
gcccgtgttccagcaccacctctgc

SEQ ID NO: 308435 - DNA, 25 bp, Mus musculus
gcccgttatgaaatggcctcaaacc

SEQ ID NO: 308436 - DNA, 25 bp, Mus musculus
gcccgttcacgatcctcagcgtacc

SEQ ID NO: 308437 - DNA, 25 bp, Mus musculus
gcccgttcagggctgggcttcaaca

SEQ ID NO: 308438 - DNA, 25 bp, Mus musculus
gcccgttctgccagcctccgctcct

SEQ ID NO: 308439 - DNA, 25 bp, Mus musculus
gcccgttctgccagttcggataggt

SEQ ID NO: 308440 - DNA, 25 bp, Mus musculus
gcccgtttgcaggatgccggtgcag

SEQ ID NO: 308441 - DNA, 25 bp, Mus musculus
gcccgttttagcttggctgaagagg

SEQ ID NO: 308442 - DNA, 25 bp, Mus musculus
gccctaaacatctgggacgttaaag

SEQ ID NO: 308443 - DNA, 25 bp, Mus musculus
gccctaaagaagtattagatggaca

SEQ ID NO: 308444 - DNA, 25 bp, Mus musculus
gccctaaatgatggtgagctccaga

SEQ ID NO: 308445 - DNA, 25 bp, Mus musculus
gccctaacaaaggtgacactcgagg

SEQ ID NO: 308446 - DNA, 25 bp, Mus musculus
gccctaagaagggttgtgagccccg

SEQ ID NO: 308447 - DNA, 25 bp, Mus musculus
gccctaagaggttatcaagaaatcc

SEQ ID NO: 308448 - DNA, 25 bp, Mus musculus
gccctaagcaggtgagccctagatt

SEQ ID NO: 308449 - DNA, 25 bp, Mus musculus
gccctaatgacattatgccctacat

SEQ ID NO: 308450 - DNA, 25 bp, Mus musculus
gccctaccaccaaactggctgatag

SEQ ID NO: 308451 - DNA, 25 bp, Mus musculus
gccctaccacggagtttgtcacagt

SEQ ID NO: 308452 - DNA, 25 bp, Mus musculus
gccctaccaggggtttctctgtgta

SEQ ID NO: 308453 - DNA, 25 bp, Mus musculus
gccctaccagggtgtgggaacaagc

SEQ ID NO: 308454 - DNA, 25 bp, Mus musculus
gccctacccaggtggatggaacatg

SEQ ID NO: 308455 - DNA, 25 bp, Mus musculus
gccctacctggactttgatcctcac

SEQ ID NO: 308456 - DNA, 25 bp, Mus musculus
gccctacgcagctcccacagatacg

SEQ ID NO: 308457 - DNA, 25 bp, Mus musculus
gccctacgcaggtcctgtccagagt

SEQ ID NO: 308458 - DNA, 25 bp, Mus musculus
gccctactatatcaaccacgagacc

SEQ ID NO: 308459 - DNA, 25 bp, Mus musculus
gccctactgggggtgaacctggtcc

SEQ ID NO: 308460 - DNA, 25 bp, Mus musculus
gccctacttactctggatccaagac

SEQ ID NO: 308461 - DNA, 25 bp, Mus musculus
gccctagcagatgaaaaacgactgt

SEQ ID NO: 308462 - DNA, 25 bp, Mus musculus
gccctagccccagtcattgctgaga

SEQ ID NO: 308463 - DNA, 25 bp, Mus musculus
gccctagccccagtgtaagcttcaa

SEQ ID NO: 308464 - DNA, 25 bp, Mus musculus
gccctagcgcggaaacatcatccca

SEQ ID NO: 308465 - DNA, 25 bp, Mus musculus
gccctagcgcgggctgggaaggtgg

SEQ ID NO: 308466 - DNA, 25 bp, Mus musculus
gccctagcttgggggctttcaggta

SEQ ID NO: 308467 - DNA, 25 bp, Mus musculus
gccctaggaatgaagaacggcccct

SEQ ID NO: 308468 - DNA, 25 bp, Mus musculus
gccctaggaatgaagatggccagct

SEQ ID NO: 308469 - DNA, 25 bp, Mus musculus
gccctaggctcagaggctgatggtg

SEQ ID NO: 308470 - DNA, 25 bp, Mus musculus
gccctagggcagaaaacaaaaatca

SEQ ID NO: 308471 - DNA, 25 bp, Mus musculus
gccctatcagaacaccatcggggct

SEQ ID NO: 308472 - DNA, 25 bp, Mus musculus
gccctatgaggtgccattgacattt

SEQ ID NO: 308473 - DNA, 25 bp, Mus musculus
gccctatgggaatattcagagcagg

SEQ ID NO: 308474 - DNA, 25 bp, Mus musculus
gccctattacatcaaccatcaaaca

SEQ ID NO: 308475 - DNA, 25 bp, Mus musculus
gccctatttcaggaaactcccatct

SEQ ID NO: 308476 - DNA, 25 bp, Mus musculus
gccctatttcaggttgtctactttt

SEQ ID NO: 308477 - DNA, 25 bp, Mus musculus
gccctcaacagaagggatacttacc

SEQ ID NO: 308478 - DNA, 25 bp, Mus musculus
gccctcaacagagttcatgttctgt

SEQ ID NO: 308479 - DNA, 25 bp, Mus musculus
gccctcaactcaagtagtaggcgca

SEQ ID NO: 308480 - DNA, 25 bp, Mus musculus
gccctcaagaaagaagctgtttggg

SEQ ID NO: 308481 - DNA, 25 bp, Mus musculus
gccctcaagaaaggtgtggtgaccc

SEQ ID NO: 308482 - DNA, 25 bp, Mus musculus
gccctcaagacaatcattttctctg

SEQ ID NO: 308483 - DNA, 25 bp, Mus musculus
gccctcaatgcagtgactggatttg

SEQ ID NO: 308484 - DNA, 25 bp, Mus musculus
gccctcacacagagaggtctgaaga

SEQ ID NO: 308485 - DNA, 25 bp, Mus musculus
gccctcacacaggtttccctctgta

SEQ ID NO: 308486 - DNA, 25 bp, Mus musculus
gccctcacagacagactgtcagtgt

SEQ ID NO: 308487 - DNA, 25 bp, Mus musculus
gccctcaccaatgagctgagcaatg

SEQ ID NO: 308488 - DNA, 25 bp, Mus musculus
gccctcaccaatgcctctgcagggc

SEQ ID NO: 308489 - DNA, 25 bp, Mus musculus
gccctcagagcctgtggacatttca

SEQ ID NO: 308490 - DNA, 25 bp, Mus musculus
gccctcagagggccgggttaaacgg

SEQ ID NO: 308491 - DNA, 25 bp, Mus musculus
gccctcagatggcaggaccccacag

SEQ ID NO: 308492 - DNA, 25 bp, Mus musculus
gccctcagatggcaggcccaagtat

SEQ ID NO: 308493 - DNA, 25 bp, Mus musculus
gccctcagccccccagcacttgtgt

SEQ ID NO: 308494 - DNA, 25 bp, Mus musculus
gccctcagctccatgaagagtcttt

SEQ ID NO: 308495 - DNA, 25 bp, Mus musculus
gccctcagctccatgaagagttggc

SEQ ID NO: 308496 - DNA, 25 bp, Mus musculus
gccctcagtggctcccacagatacg

SEQ ID NO: 308497 - DNA, 25 bp, Mus musculus
gccctcagtggtcccctttaccacg

SEQ ID NO: 308498 - DNA, 25 bp, Mus musculus
gccctcatcaatgaggaactctatg

SEQ ID NO: 308499 - DNA, 25 bp, Mus musculus
gccctcatccagcagaaaaaagatg

SEQ ID NO: 308500 - DNA, 25 bp, Mus musculus
gccctcatctgcagggtccacgcca

SEQ ID NO: 308501 - DNA, 25 bp, Mus musculus
gccctcatgttatgaaatagaatgc

SEQ ID NO: 308502 - DNA, 25 bp, Mus musculus
gccctcattcaagaggtaatcagcc

SEQ ID NO: 308503 - DNA, 25 bp, Mus musculus
gccctcatttgagaacaagactatt

SEQ ID NO: 308504 - DNA, 25 bp, Mus musculus
gccctccaaagtgaggaacttctgc

SEQ ID NO: 308505 - DNA, 25 bp, Mus musculus
gccctccaaccacaggggccagcta

SEQ ID NO: 308506 - DNA, 25 bp, Mus musculus
gccctccaagcagaggacaaaatca

SEQ ID NO: 308507 - DNA, 25 bp, Mus musculus
gccctccaagcagaggtatgtgcag

SEQ ID NO: 308508 - DNA, 25 bp, Mus musculus
gccctccacagagttccccacaccc

SEQ ID NO: 308509 - DNA, 25 bp, Mus musculus
gccctccacagcccctacttccaga

SEQ ID NO: 308510 - DNA, 25 bp, Mus musculus
gccctccacaggagcaggcgagcag

SEQ ID NO: 308511 - DNA, 25 bp, Mus musculus
gccctccacttcctgttgtcggtgc

SEQ ID NO: 308512 - DNA, 25 bp, Mus musculus
gccctccagtagagaaataccggta

SEQ ID NO: 308513 - DNA, 25 bp, Mus musculus
gccctccatggacatagtcttgaag

SEQ ID NO: 308514 - DNA, 25 bp, Mus musculus
gccctcccaatgattttcagaataa

SEQ ID NO: 308515 - DNA, 25 bp, Mus musculus
gccctcccagccaccaaaggggagg

SEQ ID NO: 308516 - DNA, 25 bp, Mus musculus
gccctcccagtgacgtactggattg

SEQ ID NO: 308517 - DNA, 25 bp, Mus musculus
gccctccctcagacctgggaagatc

SEQ ID NO: 308518 - DNA, 25 bp, Mus musculus
gccctccgaagactgaaactgttat

SEQ ID NO: 308519 - DNA, 25 bp, Mus musculus
gccctccgcctcagatggcagtcaa

SEQ ID NO: 308520 - DNA, 25 bp, Mus musculus
gccctccgcctcagtaccaaacgtc

SEQ ID NO: 308521 - DNA, 25 bp, Mus musculus
gccctccggccaggcgattaaatcc

SEQ ID NO: 308522 - DNA, 25 bp, Mus musculus
gccctccgtctggctggttcttctg

SEQ ID NO: 308523 - DNA, 25 bp, Mus musculus
gccctccgttgaaagcaccatacca

SEQ ID NO: 308524 - DNA, 25 bp, Mus musculus
gccctcctcagaaagcagtgccccc

SEQ ID NO: 308525 - DNA, 25 bp, Mus musculus
gccctcctcagccccctcccgcctt

SEQ ID NO: 308526 - DNA, 25 bp, Mus musculus
gccctcctgcaagtttctccaggag

SEQ ID NO: 308527 - DNA, 25 bp, Mus musculus
gccctcctgcccaggtttgcacacc

SEQ ID NO: 308528 - DNA, 25 bp, Mus musculus
gccctccttgtctgtcttcatctcg

SEQ ID NO: 308529 - DNA, 25 bp, Mus musculus
gccctccttgtctgttgcggggcca

SEQ ID NO: 308530 - DNA, 25 bp, Mus musculus
gccctcgaaggttgcagctccaccc

SEQ ID NO: 308531 - DNA, 25 bp, Mus musculus
gccctcgaatgtgccgttctctgag

SEQ ID NO: 308532 - DNA, 25 bp, Mus musculus
gccctcgacttagaatattagaagt

SEQ ID NO: 308533 - DNA, 25 bp, Mus musculus
gccctcgacttaggagcaggctgcc

SEQ ID NO: 308534 - DNA, 25 bp, Mus musculus
gccctcgatgagatgtgatcttcgt

SEQ ID NO: 308535 - DNA, 25 bp, Mus musculus
gccctcgctcctccctcgagaggag

SEQ ID NO: 308536 - DNA, 25 bp, Mus musculus
gccctcggcgggcatggcccctgca

SEQ ID NO: 308537 - DNA, 25 bp, Mus musculus
gccctcggctgtagagagtcagtcg

SEQ ID NO: 308538 - DNA, 25 bp, Mus musculus
gccctctacaggagtgtgcaccgta

SEQ ID NO: 308539 - DNA, 25 bp, Mus musculus
gccctctacagtttcaggcctggtc

SEQ ID NO: 308540 - DNA, 25 bp, Mus musculus
gccctctcaagctcagccttttctt

SEQ ID NO: 308541 - DNA, 25 bp, Mus musculus
gccctctcaggttgtctcaactgca

SEQ ID NO: 308542 - DNA, 25 bp, Mus musculus
gccctctcatctacttccccctttc

SEQ ID NO: 308543 - DNA, 25 bp, Mus musculus
gccctctgaatgtcaagccccgccc

SEQ ID NO: 308544 - DNA, 25 bp, Mus musculus
gccctctgagtccaaccaagtttat

SEQ ID NO: 308545 - DNA, 25 bp, Mus musculus
gccctctgatgtgaaagagctggtc

SEQ ID NO: 308546 - DNA, 25 bp, Mus musculus
gccctctgattgaaattttcttctt

SEQ ID NO: 308547 - DNA, 25 bp, Mus musculus
gccctctgccagagcacaagagacc

SEQ ID NO: 308548 - DNA, 25 bp, Mus musculus
gccctctgtaaagtgatggctgcag

SEQ ID NO: 308549 - DNA, 25 bp, Mus musculus
gccctctgtcactgtcacgttcatg

SEQ ID NO: 308550 - DNA, 25 bp, Mus musculus
gccctctgtggacggaatcttggag

SEQ ID NO: 308551 - DNA, 25 bp, Mus musculus
gccctcttatgtcctcagagagtat

SEQ ID NO: 308552 - DNA, 25 bp, Mus musculus
gccctcttcaacaggttctactcag

SEQ ID NO: 308553 - DNA, 25 bp, Mus musculus
gccctcttcggggaagaaatagatg

SEQ ID NO: 308554 - DNA, 25 bp, Mus musculus
gccctcttctgcacatcgagtcacg

SEQ ID NO: 308555 - DNA, 25 bp, Mus musculus
gccctgaaagtcccgagtttatgtt

SEQ ID NO: 308556 - DNA, 25 bp, Mus musculus
gccctgaacagtgccatatgagaac

SEQ ID NO: 308557 - DNA, 25 bp, Mus musculus
gccctgaacagtgccgcaacataac

SEQ ID NO: 308558 - DNA, 25 bp, Mus musculus
gccctgaactatcctccatgtgaat

SEQ ID NO: 308559 - DNA, 25 bp, Mus musculus
gccctgaactgtactctctctatag

SEQ ID NO: 308560 - DNA, 25 bp, Mus musculus
gccctgaagaagaggtcacgaaaga

SEQ ID NO: 308561 - DNA, 25 bp, Mus musculus
gccctgaagtcgcagagaaagataa

SEQ ID NO: 308562 - DNA, 25 bp, Mus musculus
gccctgacaacaagagcctggccat

SEQ ID NO: 308563 - DNA, 25 bp, Mus musculus
gccctgaccacagactactggtgcc

SEQ ID NO: 308564 - DNA, 25 bp, Mus musculus
gccctgaccccggtgtgtgatagca

SEQ ID NO: 308565 - DNA, 25 bp, Mus musculus
gccctgaccgattcacaatgacatc

SEQ ID NO: 308566 - DNA, 25 bp, Mus musculus
gccctgacctcaggattggaaaact

SEQ ID NO: 308567 - DNA, 25 bp, Mus musculus
gccctgagaaactgggtgctcttct

SEQ ID NO: 308568 - DNA, 25 bp, Mus musculus
gccctgagacagactcacaccgctt

SEQ ID NO: 308569 - DNA, 25 bp, Mus musculus
gccctgagactgccagcaaattccc

SEQ ID NO: 308570 - DNA, 25 bp, Mus musculus
gccctgagagggagattcgtaatgt

SEQ ID NO: 308571 - DNA, 25 bp, Mus musculus
gccctgagcagagtcactgagggcc

SEQ ID NO: 308572 - DNA, 25 bp, Mus musculus
gccctgagcaggagtctgcaggtgc

SEQ ID NO: 308573 - DNA, 25 bp, Mus musculus
gccctgagccccgagggtcctgcgg

SEQ ID NO: 308574 - DNA, 25 bp, Mus musculus
gccctgagccccgtgtactggttcc

SEQ ID NO: 308575 - DNA, 25 bp, Mus musculus
gccctgagctggacaagtgacgcag

SEQ ID NO: 308576 - DNA, 25 bp, Mus musculus
gccctgaggaccaaggtgagcctgt

SEQ ID NO: 308577 - DNA, 25 bp, Mus musculus
gccctgaggatcccgagggcatcag

SEQ ID NO: 308578 - DNA, 25 bp, Mus musculus
gccctgaggatcccgggcgtgattg

SEQ ID NO: 308579 - DNA, 25 bp, Mus musculus
gccctgaggccctttatgctgctgg

SEQ ID NO: 308580 - DNA, 25 bp, Mus musculus
gccctgaggtgagagcagccatgga

SEQ ID NO: 308581 - DNA, 25 bp, Mus musculus
gccctgagtgttggcgggccatccc

SEQ ID NO: 308582 - DNA, 25 bp, Mus musculus
gccctgatagactaggatattttaa

SEQ ID NO: 308583 - DNA, 25 bp, Mus musculus
gccctgatagactaggttggtttgc

SEQ ID NO: 308584 - DNA, 25 bp, Mus musculus
gccctgatgtaggacgaagaatgac

SEQ ID NO: 308585 - DNA, 25 bp, Mus musculus
gccctgattccacgcttcttgccac

SEQ ID NO: 308586 - DNA, 25 bp, Mus musculus
gccctgcaaccccagcccgcacccg

SEQ ID NO: 308587 - DNA, 25 bp, Mus musculus
gccctgcaagcctgtatggatggat

SEQ ID NO: 308588 - DNA, 25 bp, Mus musculus
gccctgcacaggctagccctgctcc

SEQ ID NO: 308589 - DNA, 25 bp, Mus musculus
gccctgcaccagagaaatcataaac

SEQ ID NO: 308590 - DNA, 25 bp, Mus musculus
gccctgcaccaggcctgtattgatg

SEQ ID NO: 308591 - DNA, 25 bp, Mus musculus
gccctgcacccaagcccctccagtt

SEQ ID NO: 308592 - DNA, 25 bp, Mus musculus
gccctgcacccaagggcacagaccg

SEQ ID NO: 308593 - DNA, 25 bp, Mus musculus
gccctgcagagaaactcatcaagca

SEQ ID NO: 308594 - DNA, 25 bp, Mus musculus
gccctgcagagaaagaacatttcag

SEQ ID NO: 308595 - DNA, 25 bp, Mus musculus
gccctgcagcagctgattagagtaa

SEQ ID NO: 308596 - DNA, 25 bp, Mus musculus
gccctgcagccagacagtgacccca

SEQ ID NO: 308597 - DNA, 25 bp, Mus musculus
gccctgcagcccagggcgctgtgag

SEQ ID NO: 308598 - DNA, 25 bp, Mus musculus
gccctgcaggagaaggaagaacaaa

SEQ ID NO: 308599 - DNA, 25 bp, Mus musculus
gccctgcagggtttgtccgccctcc

SEQ ID NO: 308600 - DNA, 25 bp, Mus musculus
gccctgcagtgtcagtgctgcccta

SEQ ID NO: 308601 - DNA, 25 bp, Mus musculus
gccctgcagtgtcagttcctttcta

SEQ ID NO: 308602 - DNA, 25 bp, Mus musculus
gccctgcatcaaggagcttgtgtca

SEQ ID NO: 308603 - DNA, 25 bp, Mus musculus
gccctgccaagatggctccagctcc

SEQ ID NO: 308604 - DNA, 25 bp, Mus musculus
gccctgccaagatgggtgctcacag

SEQ ID NO: 308605 - DNA, 25 bp, Mus musculus
gccctgccaagattttcacctgacg

SEQ ID NO: 308606 - DNA, 25 bp, Mus musculus
gccctgccacatcatgacaagaaaa

SEQ ID NO: 308607 - DNA, 25 bp, Mus musculus
gccctgccacatcattcaaatattg

SEQ ID NO: 308608 - DNA, 25 bp, Mus musculus
gccctgccatgttggatgccgcctt

SEQ ID NO: 308609 - DNA, 25 bp, Mus musculus
gccctgcccagagcctgaccccagg

SEQ ID NO: 308610 - DNA, 25 bp, Mus musculus
gccctgcccagatactccccccagg

SEQ ID NO: 308611 - DNA, 25 bp, Mus musculus
gccctgcccattgtgtcctggggca

SEQ ID NO: 308612 - DNA, 25 bp, Mus musculus
gccctgccccagcaccacctaccct

SEQ ID NO: 308613 - DNA, 25 bp, Mus musculus
gccctgccccagctctgggcgtgga

SEQ ID NO: 308614 - DNA, 25 bp, Mus musculus
gccctgccccaggtggggaacctgg

SEQ ID NO: 308615 - DNA, 25 bp, Mus musculus
gccctgccgggagccctgcaggcca

SEQ ID NO: 308616 - DNA, 25 bp, Mus musculus
gccctgcctaccctaacccagaatt

SEQ ID NO: 308617 - DNA, 25 bp, Mus musculus
gccctgcctgagaagctcaaacagg

SEQ ID NO: 308618 - DNA, 25 bp, Mus musculus
gccctgcctgtcaggcttcctgcgg

SEQ ID NO: 308619 - DNA, 25 bp, Mus musculus
gccctgcctgtgggaagtgctttgg

SEQ ID NO: 308620 - DNA, 25 bp, Mus musculus
gccctgcctgtgggctcagtctcca

SEQ ID NO: 308621 - DNA, 25 bp, Mus musculus
gccctgcgaatcggagccccagatc

SEQ ID NO: 308622 - DNA, 25 bp, Mus musculus
gccctgcgcagatggtggacctgct

SEQ ID NO: 308623 - DNA, 25 bp, Mus musculus
gccctgcggacacgtcttttgctct

SEQ ID NO: 308624 - DNA, 25 bp, Mus musculus
gccctgcggacacgtgaatgtctga

SEQ ID NO: 308625 - DNA, 25 bp, Mus musculus
gccctgcggacacgtttcatcctat

SEQ ID NO: 308626 - DNA, 25 bp, Mus musculus
gccctgcggagagaggaccaaatgg

SEQ ID NO: 308627 - DNA, 25 bp, Mus musculus
gccctgcggagagggttcttgacca

SEQ ID NO: 308628 - DNA, 25 bp, Mus musculus
gccctgcggagagtaagcggaggcc

SEQ ID NO: 308629 - DNA, 25 bp, Mus musculus
gccctgcgggcacaggtggacgacc

SEQ ID NO: 308630 - DNA, 25 bp, Mus musculus
gccctgcgtaccagcatcgagaagg

SEQ ID NO: 308631 - DNA, 25 bp, Mus musculus
gccctgcgtaccaggtatggcatca

SEQ ID NO: 308632 - DNA, 25 bp, Mus musculus
gccctgctacattaataccctggag

SEQ ID NO: 308633 - DNA, 25 bp, Mus musculus
gccctgctgctagtaacgaaggcag

SEQ ID NO: 308634 - DNA, 25 bp, Mus musculus
gccctgctgctggctgtcatctact

SEQ ID NO: 308635 - DNA, 25 bp, Mus musculus
gccctgctgctgtggtgaaaggaca

SEQ ID NO: 308636 - DNA, 25 bp, Mus musculus
gccctgctggacattcaggagcttc

SEQ ID NO: 308637 - DNA, 25 bp, Mus musculus
gccctgctggacctgttcagcccct

SEQ ID NO: 308638 - DNA, 25 bp, Mus musculus
gccctgctgggtggggagacagcag

SEQ ID NO: 308639 - DNA, 25 bp, Mus musculus
gccctggaagctgcagactttgtgg

SEQ ID NO: 308640 - DNA, 25 bp, Mus musculus
gccctggaccccgagatccagttgg

SEQ ID NO: 308641 - DNA, 25 bp, Mus musculus
gccctggaccccgaggcactgcctc

SEQ ID NO: 308642 - DNA, 25 bp, Mus musculus
gccctggacctgggctcccagaggc

SEQ ID NO: 308643 - DNA, 25 bp, Mus musculus
gccctggacgttgagtgtggaaaat

SEQ ID NO: 308644 - DNA, 25 bp, Mus musculus
gccctggagagcaatatggtacctc

SEQ ID NO: 308645 - DNA, 25 bp, Mus musculus
gccctggagctcagcacaggggatg

SEQ ID NO: 308646 - DNA, 25 bp, Mus musculus
gccctggaggaaggaattctttgtg

SEQ ID NO: 308647 - DNA, 25 bp, Mus musculus
gccctggagtccatgtgtaaagagc

SEQ ID NO: 308648 - DNA, 25 bp, Mus musculus
gccctggatccaggtgaaccttctg

SEQ ID NO: 308649 - DNA, 25 bp, Mus musculus
gccctggatgccttttacaactacg

SEQ ID NO: 308650 - DNA, 25 bp, Mus musculus
gccctggatggggtggtgaagcgag

SEQ ID NO: 308651 - DNA, 25 bp, Mus musculus
gccctggcacacgccccaaggaaag

SEQ ID NO: 308652 - DNA, 25 bp, Mus musculus
gccctggcagagaacacagcaggga

SEQ ID NO: 308653 - DNA, 25 bp, Mus musculus
gccctggcagatgagcgtgaagctg

SEQ ID NO: 308654 - DNA, 25 bp, Mus musculus
gccctggcaggaaggagactgcggc

SEQ ID NO: 308655 - DNA, 25 bp, Mus musculus
gccctggcaggacaacagtccaggt

SEQ ID NO: 308656 - DNA, 25 bp, Mus musculus
gccctggcaggtctccctgcaggtc

SEQ ID NO: 308657 - DNA, 25 bp, Mus musculus
gccctggccaaggtcctggacaata

SEQ ID NO: 308658 - DNA, 25 bp, Mus musculus
gccctggccgagaggggagcccaga

SEQ ID NO: 308659 - DNA, 25 bp, Mus musculus
gccctggccgaggaagccgagatac

SEQ ID NO: 308660 - DNA, 25 bp, Mus musculus
gccctggcgcccagggcaaggacag

SEQ ID NO: 308661 - DNA, 25 bp, Mus musculus
gccctggcgcccagtgagtgaaccc

SEQ ID NO: 308662 - DNA, 25 bp, Mus musculus
gccctggctctggaccctcttctag

SEQ ID NO: 308663 - DNA, 25 bp, Mus musculus
gccctggctgggggatgggctcctg

SEQ ID NO: 308664 - DNA, 25 bp, Mus musculus
gccctggctgggggatgggctcttc

SEQ ID NO: 308665 - DNA, 25 bp, Mus musculus
gccctgggacaacagtttacctacg

SEQ ID NO: 308666 - DNA, 25 bp, Mus musculus
gccctgggagacggggttgaccgga

SEQ ID NO: 308667 - DNA, 25 bp, Mus musculus
gccctgggagcctctgacctccagg

SEQ ID NO: 308668 - DNA, 25 bp, Mus musculus
gccctgggcaggctgctggttgtct

SEQ ID NO: 308669 - DNA, 25 bp, Mus musculus
gccctgggcttgaagaaccagtagt

SEQ ID NO: 308670 - DNA, 25 bp, Mus musculus
gccctggggaagaagagtctgagga

SEQ ID NO: 308671 - DNA, 25 bp, Mus musculus
gccctggggagccttttgcccttct

SEQ ID NO: 308672 - DNA, 25 bp, Mus musculus
gccctggggccgaaggcctgggatg

SEQ ID NO: 308673 - DNA, 25 bp, Mus musculus
gccctggggttatgagggctggaga

SEQ ID NO: 308674 - DNA, 25 bp, Mus musculus
gccctgggtgtgagattctctccag

SEQ ID NO: 308675 - DNA, 25 bp, Mus musculus
gccctggtaaaagcagaagcagcag

SEQ ID NO: 308676 - DNA, 25 bp, Mus musculus
gccctggtaaatgctactgagtgac

SEQ ID NO: 308677 - DNA, 25 bp, Mus musculus
gccctggtcacaggtgcgggtagcg

SEQ ID NO: 308678 - DNA, 25 bp, Mus musculus
gccctggtgaatggggtcagtggtg

SEQ ID NO: 308679 - DNA, 25 bp, Mus musculus
gccctggtgattaggacaaagccaa

SEQ ID NO: 308680 - DNA, 25 bp, Mus musculus
gccctggtgcaagagagtgtccaag

SEQ ID NO: 308681 - DNA, 25 bp, Mus musculus
gccctggtggggttggtggctgtgt

SEQ ID NO: 308682 - DNA, 25 bp, Mus musculus
gccctggtgggtccaagtacagcac

SEQ ID NO: 308683 - DNA, 25 bp, Mus musculus
gccctggtgtacagggatcagaaca

SEQ ID NO: 308684 - DNA, 25 bp, Mus musculus
gccctgtaaatggcttgctgaaagg

SEQ ID NO: 308685 - DNA, 25 bp, Mus musculus
gccctgtacaaaggggcagccacag

SEQ ID NO: 308686 - DNA, 25 bp, Mus musculus
gccctgtacccagatgaagttgcct

SEQ ID NO: 308687 - DNA, 25 bp, Mus musculus
gccctgtcacctacatggataagaa

SEQ ID NO: 308688 - DNA, 25 bp, Mus musculus
gccctgtccaaagatctcaccacat

SEQ ID NO: 308689 - DNA, 25 bp, Mus musculus
gccctgtccaaaggaccatgacctt

SEQ ID NO: 308690 - DNA, 25 bp, Mus musculus
gccctgtccaaaggaggagaccttg

SEQ ID NO: 308691 - DNA, 25 bp, Mus musculus
gccctgtccaaaggcctcaatctaa

SEQ ID NO: 308692 - DNA, 25 bp, Mus musculus
gccctgtccccagccccctccccag

SEQ ID NO: 308693 - DNA, 25 bp, Mus musculus
gccctgtcccgaggacaagaagatg

SEQ ID NO: 308694 - DNA, 25 bp, Mus musculus
gccctgtcctgccatcatgaaggtt

SEQ ID NO: 308695 - DNA, 25 bp, Mus musculus
gccctgtcgccattggatcatctgt

SEQ ID NO: 308696 - DNA, 25 bp, Mus musculus
gccctgtcgcctgtctgccacaact

SEQ ID NO: 308697 - DNA, 25 bp, Mus musculus
gccctgtgacgaatggcacacgaaa

SEQ ID NO: 308698 - DNA, 25 bp, Mus musculus
gccctgtgagcactctgactctggt

SEQ ID NO: 308699 - DNA, 25 bp, Mus musculus
gccctgtgaggacctggaacgaggc

SEQ ID NO: 308700 - DNA, 25 bp, Mus musculus
gccctgtgaggttgaacttccggct

SEQ ID NO: 308701 - DNA, 25 bp, Mus musculus
gccctgtgagtttcaggtgccatgc

SEQ ID NO: 308702 - DNA, 25 bp, Mus musculus
gccctgtgcagatttccctcagggt

SEQ ID NO: 308703 - DNA, 25 bp, Mus musculus
gccctgtgcagccttgtgacagatt

SEQ ID NO: 308704 - DNA, 25 bp, Mus musculus
gccctgtgcagtatcgtaccgagaa

SEQ ID NO: 308705 - DNA, 25 bp, Mus musculus
gccctgtgctggtggatattcatta

SEQ ID NO: 308706 - DNA, 25 bp, Mus musculus
gccctgtggaggagtctctatggaa

SEQ ID NO: 308707 - DNA, 25 bp, Mus musculus
gccctgtggcataaggtgatgttcc

SEQ ID NO: 308708 - DNA, 25 bp, Mus musculus
gccctgtggctatattgctgccttc

SEQ ID NO: 308709 - DNA, 25 bp, Mus musculus
gccctgtggcttcattttccagttc

SEQ ID NO: 308710 - DNA, 25 bp, Mus musculus
gccctgtgtgaaggagcttctgcgt

SEQ ID NO: 308711 - DNA, 25 bp, Mus musculus
gccctgtgtgcaaagctgtgccacc

SEQ ID NO: 308712 - DNA, 25 bp, Mus musculus
gccctgttacctcgccgagctggaa

SEQ ID NO: 308713 - DNA, 25 bp, Mus musculus
gccctgttcagagccctgaagacaa

SEQ ID NO: 308714 - DNA, 25 bp, Mus musculus
gccctgttgagcaggccacagaagg

SEQ ID NO: 308715 - DNA, 25 bp, Mus musculus
gccctgttgcagccccaccatggag

SEQ ID NO: 308716 - DNA, 25 bp, Mus musculus
gccctgttgcaggttctgccaccag

SEQ ID NO: 308717 - DNA, 25 bp, Mus musculus
gcccttaaacaggaaatctttgaga

SEQ ID NO: 308718 - DNA, 25 bp, Mus musculus
gcccttaaacagttgcaggaaatct

SEQ ID NO: 308719 - DNA, 25 bp, Mus musculus
gcccttaacgtcggctgcccgcttt

SEQ ID NO: 308720 - DNA, 25 bp, Mus musculus
gcccttaatgaaaacattaaccagg

SEQ ID NO: 308721 - DNA, 25 bp, Mus musculus
gcccttacgctctcctactccgtgg

SEQ ID NO: 308722 - DNA, 25 bp, Mus musculus
gcccttagatttctacacgagaacc

SEQ ID NO: 308723 - DNA, 25 bp, Mus musculus
gcccttattgagttcattcaggctg

SEQ ID NO: 308724 - DNA, 25 bp, Mus musculus
gcccttcaagagcttctgcagtttg

SEQ ID NO: 308725 - DNA, 25 bp, Mus musculus
gcccttcaaggatatggactattca

SEQ ID NO: 308726 - DNA, 25 bp, Mus musculus
gcccttcaagttttcctggagcaaa

SEQ ID NO: 308727 - DNA, 25 bp, Mus musculus
gcccttcacaatgtgatacctgact

SEQ ID NO: 308728 - DNA, 25 bp, Mus musculus
gcccttcacagctgacattatctct

SEQ ID NO: 308729 - DNA, 25 bp, Mus musculus
gcccttcacagtggagattgtggac

SEQ ID NO: 308730 - DNA, 25 bp, Mus musculus
gcccttcactggccccttcatggct

SEQ ID NO: 308731 - DNA, 25 bp, Mus musculus
gcccttcagaaagtactgtccctga

SEQ ID NO: 308732 - DNA, 25 bp, Mus musculus
gcccttcaggaaagcctgtgggccg

SEQ ID NO: 308733 - DNA, 25 bp, Mus musculus
gcccttcaggagccacgtcagtgtt

SEQ ID NO: 308734 - DNA, 25 bp, Mus musculus
gcccttcaggaggcagcagaagctt

SEQ ID NO: 308735 - DNA, 25 bp, Mus musculus
gcccttcagtcagagatatatttct

SEQ ID NO: 308736 - DNA, 25 bp, Mus musculus
gcccttcagtgtaggatctcttcac

SEQ ID NO: 308737 - DNA, 25 bp, Mus musculus
gcccttccaggtgactggttatcct

SEQ ID NO: 308738 - DNA, 25 bp, Mus musculus
gcccttcccaatggtgatgatggtg

SEQ ID NO: 308739 - DNA, 25 bp, Mus musculus
gcccttcccagggtctgaatttcct

SEQ ID NO: 308740 - DNA, 25 bp, Mus musculus
gcccttcccttggtatgtctacgtt

SEQ ID NO: 308741 - DNA, 25 bp, Mus musculus
gcccttccgagctatccgggtgacc

SEQ ID NO: 308742 - DNA, 25 bp, Mus musculus
gcccttccgaggaagtctgccggct

SEQ ID NO: 308743 - DNA, 25 bp, Mus musculus
gcccttcctcacagaaaataaagca

SEQ ID NO: 308744 - DNA, 25 bp, Mus musculus
gcccttcctccgatggctacagatg

SEQ ID NO: 308745 - DNA, 25 bp, Mus musculus
gcccttcggcaaggtcggaacctgg

SEQ ID NO: 308746 - DNA, 25 bp, Mus musculus
gcccttcgggagacaaatgtgcgct

SEQ ID NO: 308747 - DNA, 25 bp, Mus musculus
gcccttcgggagccatcaagagttt

SEQ ID NO: 308748 - DNA, 25 bp, Mus musculus
gcccttcggtgttggtctggtcagc

SEQ ID NO: 308749 - DNA, 25 bp, Mus musculus
gcccttcgtggcagatctgattgcc

SEQ ID NO: 308750 - DNA, 25 bp, Mus musculus
gcccttcgtggcaggttgttcctac

SEQ ID NO: 308751 - DNA, 25 bp, Mus musculus
gcccttctagacacccaggacatgg

SEQ ID NO: 308752 - DNA, 25 bp, Mus musculus
gcccttctcatcaaggtgattctgg

SEQ ID NO: 308753 - DNA, 25 bp, Mus musculus
gcccttctccacccggacagagtcc

SEQ ID NO: 308754 - DNA, 25 bp, Mus musculus
gcccttctggcgacccccaggatct

SEQ ID NO: 308755 - DNA, 25 bp, Mus musculus
gcccttcttcccacaatattctgga

SEQ ID NO: 308756 - DNA, 25 bp, Mus musculus
gcccttcttcccacactcaccgagc

SEQ ID NO: 308757 - DNA, 25 bp, Mus musculus
gcccttcttcgacatggctgggctc

SEQ ID NO: 308758 - DNA, 25 bp, Mus musculus
gcccttcttcgtggatccaggttca

SEQ ID NO: 308759 - DNA, 25 bp, Mus musculus
gcccttgaagccacccgcggtcagc

SEQ ID NO: 308760 - DNA, 25 bp, Mus musculus
gcccttgaagcgcggctgggttcct

SEQ ID NO: 308761 - DNA, 25 bp, Mus musculus
gcccttgaagggtaagtggagaaag

SEQ ID NO: 308762 - DNA, 25 bp, Mus musculus
gcccttgactggtacagacttacgt

SEQ ID NO: 308763 - DNA, 25 bp, Mus musculus
gcccttgcagaaaaaaagatgcagg

SEQ ID NO: 308764 - DNA, 25 bp, Mus musculus
gcccttgcagcatgagttcaaagaa

SEQ ID NO: 308765 - DNA, 25 bp, Mus musculus
gcccttgcagcatggctgaccaact

SEQ ID NO: 308766 - DNA, 25 bp, Mus musculus
gcccttgcccaaggagtctctctgc

SEQ ID NO: 308767 - DNA, 25 bp, Mus musculus
gcccttgcccaaggatctgggaaac

SEQ ID NO: 308768 - DNA, 25 bp, Mus musculus
gcccttgcctccggttcacgctaaa

SEQ ID NO: 308769 - DNA, 25 bp, Mus musculus
gcccttgctcctgcttgcttcccag

SEQ ID NO: 308770 - DNA, 25 bp, Mus musculus
gcccttgctcctggaggcagtgaca

SEQ ID NO: 308771 - DNA, 25 bp, Mus musculus
gcccttggaagattggctctttgtg

SEQ ID NO: 308772 - DNA, 25 bp, Mus musculus
gcccttggagcaggtcaaagctgca

SEQ ID NO: 308773 - DNA, 25 bp, Mus musculus
gcccttggatggagccaaaaacaat

SEQ ID NO: 308774 - DNA, 25 bp, Mus musculus
gcccttggcagaggttacaaaatgt

SEQ ID NO: 308775 - DNA, 25 bp, Mus musculus
gcccttggttgcagatttgcaatac

SEQ ID NO: 308776 - DNA, 25 bp, Mus musculus
gcccttgtccccagcaagtcttctg

SEQ ID NO: 308777 - DNA, 25 bp, Mus musculus
gcccttgtgcagcacttagctagcc

SEQ ID NO: 308778 - DNA, 25 bp, Mus musculus
gcccttgtgcaggaagcatgcattg

SEQ ID NO: 308779 - DNA, 25 bp, Mus musculus
gcccttgttccaagaagaacgttgg

SEQ ID NO: 308780 - DNA, 25 bp, Mus musculus
gcccttgttccaagtatctccatac

SEQ ID NO: 308781 - DNA, 25 bp, Mus musculus
gccctttaaggcctccagcataaag

SEQ ID NO: 308782 - DNA, 25 bp, Mus musculus
gccctttacccctgcttcctgccta

SEQ ID NO: 308783 - DNA, 25 bp, Mus musculus
gccctttatctgacttgttggcaag

SEQ ID NO: 308784 - DNA, 25 bp, Mus musculus
gccctttatctgtagtgcaaagtac

SEQ ID NO: 308785 - DNA, 25 bp, Mus musculus
gccctttatctgtgaggtctgccat

SEQ ID NO: 308786 - DNA, 25 bp, Mus musculus
gccctttatgaacaaaggaagaact

SEQ ID NO: 308787 - DNA, 25 bp, Mus musculus
gccctttatggaacagacggagcgt

SEQ ID NO: 308788 - DNA, 25 bp, Mus musculus
gccctttattacaaggaatcgcctg

SEQ ID NO: 308789 - DNA, 25 bp, Mus musculus
gccctttccaccgaaggtttctctg

SEQ ID NO: 308790 - DNA, 25 bp, Mus musculus
gccctttctctggaacttcgagtca

SEQ ID NO: 308791 - DNA, 25 bp, Mus musculus
gccctttctctgggagctgaacatc

SEQ ID NO: 308792 - DNA, 25 bp, Mus musculus
gccctttctgccaaagttgctcacc

SEQ ID NO: 308793 - DNA, 25 bp, Mus musculus
gccctttctgtaccgatgcactccc

SEQ ID NO: 308794 - DNA, 25 bp, Mus musculus
gccctttcttgcatttagtaaagaa

SEQ ID NO: 308795 - DNA, 25 bp, Mus musculus
gccctttgaacttatattggatttt

SEQ ID NO: 308796 - DNA, 25 bp, Mus musculus
gccctttgaggacaccgctcagtgg

SEQ ID NO: 308797 - DNA, 25 bp, Mus musculus
gccctttgatattcggagctggagc

SEQ ID NO: 308798 - DNA, 25 bp, Mus musculus
gccctttgatattcggctgaattca

SEQ ID NO: 308799 - DNA, 25 bp, Mus musculus
gccctttgcttggtgggttcagggg

SEQ ID NO: 308800 - DNA, 25 bp, Mus musculus
gccctttggaaaaatacatttatat

SEQ ID NO: 308801 - DNA, 25 bp, Mus musculus
gcccttttatagaccagtttgaata

SEQ ID NO: 308802 - DNA, 25 bp, Mus musculus
gcccttttcagtgagaaagcgctgc

SEQ ID NO: 308803 - DNA, 25 bp, Mus musculus
gcccttttcccgtgtgttcagggag

SEQ ID NO: 308804 - DNA, 25 bp, Mus musculus
gcccttttcggcgtggttgagaaca

SEQ ID NO: 308805 - DNA, 25 bp, Mus musculus
gcccttttctgtagcgctggcgtgg

SEQ ID NO: 308806 - DNA, 25 bp, Mus musculus
gccctttttggctgcagagatacaa

SEQ ID NO: 308807 - DNA, 25 bp, Mus musculus
gccctttttgtgccgtggtgagaag

SEQ ID NO: 308808 - DNA, 25 bp, Mus musculus
gccgaaaaaatcagcccccgactct

SEQ ID NO: 308809 - DNA, 25 bp, Mus musculus
gccgaaaaaatcaggccccgactct

SEQ ID NO: 308810 - DNA, 25 bp, Mus musculus
gccgaaaagagagggggtccactgc

SEQ ID NO: 308811 - DNA, 25 bp, Mus musculus
gccgaaacactctctaatatgttta

SEQ ID NO: 308812 - DNA, 25 bp, Mus musculus
gccgaaaccatgcatgggcgcctga

SEQ ID NO: 308813 - DNA, 25 bp, Mus musculus
gccgaaacccagatgaggaataact

SEQ ID NO: 308814 - DNA, 25 bp, Mus musculus
gccgaaagaccagccaacaattctc

SEQ ID NO: 308815 - DNA, 25 bp, Mus musculus
gccgaaagcgaatattaattaaccc

SEQ ID NO: 308816 - DNA, 25 bp, Mus musculus
gccgaaaggtagcatcaccaccgcc

SEQ ID NO: 308817 - DNA, 25 bp, Mus musculus
gccgaaagtggggatgcaaacttgg

SEQ ID NO: 308818 - DNA, 25 bp, Mus musculus
gccgaaatcagatagtcttccccgc

SEQ ID NO: 308819 - DNA, 25 bp, Mus musculus
gccgaacaccggttttgcctcaatt

SEQ ID NO: 308820 - DNA, 25 bp, Mus musculus
gccgaacaccgtgcacttaatgcag

SEQ ID NO: 308821 - DNA, 25 bp, Mus musculus
gccgaacaggatcgcaatagtcggt

SEQ ID NO: 308822 - DNA, 25 bp, Mus musculus
gccgaacaggatcggatctaccgtt

SEQ ID NO: 308823 - DNA, 25 bp, Mus musculus
gccgaacaggatcggtctctccagt

SEQ ID NO: 308824 - DNA, 25 bp, Mus musculus
gccgaaccagaggagattggattcc

SEQ ID NO: 308825 - DNA, 25 bp, Mus musculus
gccgaaccagtggctgcagcactcc

SEQ ID NO: 308826 - DNA, 25 bp, Mus musculus
gccgaactcagacaggagcagagcc

SEQ ID NO: 308827 - DNA, 25 bp, Mus musculus
gccgaagagctcaagaagttaagtg

SEQ ID NO: 308828 - DNA, 25 bp, Mus musculus
gccgaagaggagcttggctttgatc

SEQ ID NO: 308829 - DNA, 25 bp, Mus musculus
gccgaagcaaggtgagatctccaga

SEQ ID NO: 308830 - DNA, 25 bp, Mus musculus
gccgaagcccccagttgtaccgagc

SEQ ID NO: 308831 - DNA, 25 bp, Mus musculus
gccgaagcgatctgctaatgcctcg

SEQ ID NO: 308832 - DNA, 25 bp, Mus musculus
gccgaagctaaccccccctggtgca

SEQ ID NO: 308833 - DNA, 25 bp, Mus musculus
gccgaagctcaatgacaatgtcagt

SEQ ID NO: 308834 - DNA, 25 bp, Mus musculus
gccgaagctgagatactccatgttt

SEQ ID NO: 308835 - DNA, 25 bp, Mus musculus
gccgaaggacgcgctatgaagtctt

SEQ ID NO: 308836 - DNA, 25 bp, Mus musculus
gccgaaggagcaggagccgctcccg

SEQ ID NO: 308837 - DNA, 25 bp, Mus musculus
gccgaaggcagcttggagaagagag

SEQ ID NO: 308838 - DNA, 25 bp, Mus musculus
gccgaaggcagtctttcagaaattt

SEQ ID NO: 308839 - DNA, 25 bp, Mus musculus
gccgaagttacagacccactgtccg

SEQ ID NO: 308840 - DNA, 25 bp, Mus musculus
gccgaagttacaggcccactgtccg

SEQ ID NO: 308841 - DNA, 25 bp, Mus musculus
gccgaataagggaagaaaggaaaga

SEQ ID NO: 308842 - DNA, 25 bp, Mus musculus
gccgaatccctttctaaataaagct

SEQ ID NO: 308843 - DNA, 25 bp, Mus musculus
gccgacaaagccaaagctgctcaga

SEQ ID NO: 308844 - DNA, 25 bp, Mus musculus
gccgacagaaaaatctcatcagagt

SEQ ID NO: 308845 - DNA, 25 bp, Mus musculus
gccgacagaaaaatgcatacacaga

SEQ ID NO: 308846 - DNA, 25 bp, Mus musculus
gccgacagcagctcctgagaaatgc

SEQ ID NO: 308847 - DNA, 25 bp, Mus musculus
gccgacagcagtaatctacagtagc

SEQ ID NO: 308848 - DNA, 25 bp, Mus musculus
gccgacagcctgcagccagccagga

SEQ ID NO: 308849 - DNA, 25 bp, Mus musculus
gccgacagcctgcaggatgctttgc

SEQ ID NO: 308850 - DNA, 25 bp, Mus musculus
gccgacaggagctacgagaggttca

SEQ ID NO: 308851 - DNA, 25 bp, Mus musculus
gccgacaggaggcgacccagtggaa

SEQ ID NO: 308852 - DNA, 25 bp, Mus musculus
gccgacagtacagaaccaacgaaac

SEQ ID NO: 308853 - DNA, 25 bp, Mus musculus
gccgacagtacagggttagctgagt

SEQ ID NO: 308854 - DNA, 25 bp, Mus musculus
gccgacatctgtagcatatatccgg

SEQ ID NO: 308855 - DNA, 25 bp, Mus musculus
gccgacccaggtctgtgcagacgtt

SEQ ID NO: 308856 - DNA, 25 bp, Mus musculus
gccgacccatgaagactcttgggag

SEQ ID NO: 308857 - DNA, 25 bp, Mus musculus
gccgacccatgaagatcccaattat

SEQ ID NO: 308858 - DNA, 25 bp, Mus musculus
gccgaccccgggatggcacaccatg

SEQ ID NO: 308859 - DNA, 25 bp, Mus musculus
gccgaccccgtgggctgttcatcac

SEQ ID NO: 308860 - DNA, 25 bp, Mus musculus
gccgacccctgcaggaagtggccag

SEQ ID NO: 308861 - DNA, 25 bp, Mus musculus
gccgaccgaggatttggagtttcat

SEQ ID NO: 308862 - DNA, 25 bp, Mus musculus
gccgacgaaatcgggaagctctttg

SEQ ID NO: 308863 - DNA, 25 bp, Mus musculus
gccgacgcccaaggaccacctaccc

SEQ ID NO: 308864 - DNA, 25 bp, Mus musculus
gccgactaccagcaggagtcgcctc

SEQ ID NO: 308865 - DNA, 25 bp, Mus musculus
gccgactaccagcaggcgttgctgc

SEQ ID NO: 308866 - DNA, 25 bp, Mus musculus
gccgactcagatccgtgatgagtgg

SEQ ID NO: 308867 - DNA, 25 bp, Mus musculus
gccgactccatgcagcacatttaaa

SEQ ID NO: 308868 - DNA, 25 bp, Mus musculus
gccgactccatgcaggtattgaggc

SEQ ID NO: 308869 - DNA, 25 bp, Mus musculus
gccgactccatgcaggtctatgaag

SEQ ID NO: 308870 - DNA, 25 bp, Mus musculus
gccgactccgggacagacaatctac

SEQ ID NO: 308871 - DNA, 25 bp, Mus musculus
gccgactccgtggaaacctctgtgt

SEQ ID NO: 308872 - DNA, 25 bp, Mus musculus
gccgactgctcaccaggaccctgcc

SEQ ID NO: 308873 - DNA, 25 bp, Mus musculus
gccgactggcagcaccgagtgccca

SEQ ID NO: 308874 - DNA, 25 bp, Mus musculus
gccgactgtggggtgtgccttcttc

SEQ ID NO: 308875 - DNA, 25 bp, Mus musculus
gccgacttcacctcttttggcaatg

SEQ ID NO: 308876 - DNA, 25 bp, Mus musculus
gccgactttgccagtatgttactga

SEQ ID NO: 308877 - DNA, 25 bp, Mus musculus
gccgagaaagaggcagagaaacccg

SEQ ID NO: 308878 - DNA, 25 bp, Mus musculus
gccgagaagaaggaactcggagagt

SEQ ID NO: 308879 - DNA, 25 bp, Mus musculus
gccgagaagccggaggttgagaaca

SEQ ID NO: 308880 - DNA, 25 bp, Mus musculus
gccgagaagcggcgtagggccacac

SEQ ID NO: 308881 - DNA, 25 bp, Mus musculus
gccgagaagcggggcctacagcgta

SEQ ID NO: 308882 - DNA, 25 bp, Mus musculus
gccgagaaggagtttcgaaactgca

SEQ ID NO: 308883 - DNA, 25 bp, Mus musculus
gccgagaaggctgcatctgtctgct

SEQ ID NO: 308884 - DNA, 25 bp, Mus musculus
gccgagaagttgacctcctcctctg

SEQ ID NO: 308885 - DNA, 25 bp, Mus musculus
gccgagaagttgacctcgtcctcca

SEQ ID NO: 308886 - DNA, 25 bp, Mus musculus
gccgagacctacgacttcctcttca

SEQ ID NO: 308887 - DNA, 25 bp, Mus musculus
gccgagacgtgatggttaagatctc

SEQ ID NO: 308888 - DNA, 25 bp, Mus musculus
gccgagagcctggtgggcagcctgg

SEQ ID NO: 308889 - DNA, 25 bp, Mus musculus
gccgagagtgactcatgaaatggcc

SEQ ID NO: 308890 - DNA, 25 bp, Mus musculus
gccgagatgttcagctacgagtcct

SEQ ID NO: 308891 - DNA, 25 bp, Mus musculus
gccgagatgttcagttatgaggagt

SEQ ID NO: 308892 - DNA, 25 bp, Mus musculus
gccgagcaacaggtgtcgttgacat

SEQ ID NO: 308893 - DNA, 25 bp, Mus musculus
gccgagcaagacaatcctaaccagt

SEQ ID NO: 308894 - DNA, 25 bp, Mus musculus
gccgagcaccagagacagccattct

SEQ ID NO: 308895 - DNA, 25 bp, Mus musculus
gccgagcagcggatcttcctcctgg

SEQ ID NO: 308896 - DNA, 25 bp, Mus musculus
gccgagcagcggattggccaacggc

SEQ ID NO: 308897 - DNA, 25 bp, Mus musculus
gccgagccaagaaactatgttccaa

SEQ ID NO: 308898 - DNA, 25 bp, Mus musculus
gccgagccaaggattttaaacagtt

SEQ ID NO: 308899 - DNA, 25 bp, Mus musculus
gccgagccaaggtgtgagatgcaca

SEQ ID NO: 308900 - DNA, 25 bp, Mus musculus
gccgagccatgaggtattactacaa

SEQ ID NO: 308901 - DNA, 25 bp, Mus musculus
gccgagcccggtccccagccaagaa

SEQ ID NO: 308902 - DNA, 25 bp, Mus musculus
gccgagcccgtaggtgagcctgatc

SEQ ID NO: 308903 - DNA, 25 bp, Mus musculus
gccgagccggacccctctgaccctc

SEQ ID NO: 308904 - DNA, 25 bp, Mus musculus
gccgagccggaccgattcagactcg

SEQ ID NO: 308905 - DNA, 25 bp, Mus musculus
gccgagccggaccgccgcaaggtca

SEQ ID NO: 308906 - DNA, 25 bp, Mus musculus
gccgagcctcaccccgagcagggga

SEQ ID NO: 308907 - DNA, 25 bp, Mus musculus
gccgagcctcacccgagcgcagacc

SEQ ID NO: 308908 - DNA, 25 bp, Mus musculus
gccgagcgaacgagtatcagcatgt

SEQ ID NO: 308909 - DNA, 25 bp, Mus musculus
gccgagcgccctcagttgagcccca

SEQ ID NO: 308910 - DNA, 25 bp, Mus musculus
gccgagcgtaagatcccctgcttcg

SEQ ID NO: 308911 - DNA, 25 bp, Mus musculus
gccgagcgtaaggctgatggatgtc

SEQ ID NO: 308912 - DNA, 25 bp, Mus musculus
gccgagctagcaacctttcccctcg

SEQ ID NO: 308913 - DNA, 25 bp, Mus musculus
gccgagctagctgctgcctgttgca

SEQ ID NO: 308914 - DNA, 25 bp, Mus musculus
gccgagctcagccaaccccaccaga

SEQ ID NO: 308915 - DNA, 25 bp, Mus musculus
gccgaggaaccctggggcatccccc

SEQ ID NO: 308916 - DNA, 25 bp, Mus musculus
gccgaggaagaactccagttctcat

SEQ ID NO: 308917 - DNA, 25 bp, Mus musculus
gccgaggagggatccaagaacctgc

SEQ ID NO: 308918 - DNA, 25 bp, Mus musculus
gccgaggaggggcgtgctggtcacc

SEQ ID NO: 308919 - DNA, 25 bp, Mus musculus
gccgaggagggtatttcctggtgga

SEQ ID NO: 308920 - DNA, 25 bp, Mus musculus
gccgaggcaagtttccttttagacc

SEQ ID NO: 308921 - DNA, 25 bp, Mus musculus
gccgaggccaaccgtccagaaggat

SEQ ID NO: 308922 - DNA, 25 bp, Mus musculus
gccgaggccaaccgtgtgctgctga

SEQ ID NO: 308923 - DNA, 25 bp, Mus musculus
gccgaggcccagcgatccctctgtg

SEQ ID NO: 308924 - DNA, 25 bp, Mus musculus
gccgaggcccaggtcagtctggacc

SEQ ID NO: 308925 - DNA, 25 bp, Mus musculus
gccgaggccgaggacatatgggtga

SEQ ID NO: 308926 - DNA, 25 bp, Mus musculus
gccgaggcgcgccggaagcccgaca

SEQ ID NO: 308927 - DNA, 25 bp, Mus musculus
gccgaggcggcagtgagctcctatg

SEQ ID NO: 308928 - DNA, 25 bp, Mus musculus
gccgaggcggcccagggccttgctg

SEQ ID NO: 308929 - DNA, 25 bp, Mus musculus
gccgaggctgtgtgtgtgaagttcc

SEQ ID NO: 308930 - DNA, 25 bp, Mus musculus
gccgagggagaggcaatacagagtg

SEQ ID NO: 308931 - DNA, 25 bp, Mus musculus
gccgagggagaggcactgatggagg

SEQ ID NO: 308932 - DNA, 25 bp, Mus musculus
gccgaggggtgaggagatttgaaaa

SEQ ID NO: 308933 - DNA, 25 bp, Mus musculus
gccgaggtcacacatgaaattatgg

SEQ ID NO: 308934 - DNA, 25 bp, Mus musculus
gccgaggtcacagatgaaattatgg

SEQ ID NO: 308935 - DNA, 25 bp, Mus musculus
gccgaggtcctcacctccttcactt

SEQ ID NO: 308936 - DNA, 25 bp, Mus musculus
gccgaggttctctagggtgaagaga

SEQ ID NO: 308937 - DNA, 25 bp, Mus musculus
gccgaggttctctagtctgcccgag

SEQ ID NO: 308938 - DNA, 25 bp, Mus musculus
gccgagtaccagagcccacagacgc

SEQ ID NO: 308939 - DNA, 25 bp, Mus musculus
gccgagtaccaggacctgacgttcc

SEQ ID NO: 308940 - DNA, 25 bp, Mus musculus
gccgagtaccaggctaaccctttca

SEQ ID NO: 308941 - DNA, 25 bp, Mus musculus
gccgagtataagcaattaaccctga

SEQ ID NO: 308942 - DNA, 25 bp, Mus musculus
gccgagtccgacggatcgctactct

SEQ ID NO: 308943 - DNA, 25 bp, Mus musculus
gccgagtctagagctcctccgggat

SEQ ID NO: 308944 - DNA, 25 bp, Mus musculus
gccgagtgatggggcgttgggcgct

SEQ ID NO: 308945 - DNA, 25 bp, Mus musculus
gccgagtgcaacatcctccgcaaag

SEQ ID NO: 308946 - DNA, 25 bp, Mus musculus
gccgagtgcagagagcaaagaccat

SEQ ID NO: 308947 - DNA, 25 bp, Mus musculus
gccgagtgtactgaggaaagcagag

SEQ ID NO: 308948 - DNA, 25 bp, Mus musculus
gccgagtgtactgaggcatatttaa

SEQ ID NO: 308949 - DNA, 25 bp, Mus musculus
gccgagtgttgctgaacacaaccgt

SEQ ID NO: 308950 - DNA, 25 bp, Mus musculus
gccgagttcagattctccgagtcaa

SEQ ID NO: 308951 - DNA, 25 bp, Mus musculus
gccgagttcagcaagctttgcagcc

SEQ ID NO: 308952 - DNA, 25 bp, Mus musculus
gccgagttcagggaacagattctcc

SEQ ID NO: 308953 - DNA, 25 bp, Mus musculus
gccgagttcggactttctgcactgg

SEQ ID NO: 308954 - DNA, 25 bp, Mus musculus
gccgagtttgcagaggatgacgtca

SEQ ID NO: 308955 - DNA, 25 bp, Mus musculus
gccgagtttgcagaggtgctggaaa

SEQ ID NO: 308956 - DNA, 25 bp, Mus musculus
gccgataaagattactctgtgacag

SEQ ID NO: 308957 - DNA, 25 bp, Mus musculus
gccgataagcaccggcctctggaaa

SEQ ID NO: 308958 - DNA, 25 bp, Mus musculus
gccgataggaagtatgaacatcatc

SEQ ID NO: 308959 - DNA, 25 bp, Mus musculus
gccgatcacagggagaacattctga

SEQ ID NO: 308960 - DNA, 25 bp, Mus musculus
gccgatcaggaggcaggttgtcaca

SEQ ID NO: 308961 - DNA, 25 bp, Mus musculus
gccgatccagggagaagtcaataaa

SEQ ID NO: 308962 - DNA, 25 bp, Mus musculus
gccgatccaggtcccggtccttctc

SEQ ID NO: 308963 - DNA, 25 bp, Mus musculus
gccgatcgccaatggttggttttga

SEQ ID NO: 308964 - DNA, 25 bp, Mus musculus
gccgatctctgccagctttgtttac

SEQ ID NO: 308965 - DNA, 25 bp, Mus musculus
gccgatgagtctgccaccatttgaa

SEQ ID NO: 308966 - DNA, 25 bp, Mus musculus
gccgatgagtctgcctgccattgct

SEQ ID NO: 308967 - DNA, 25 bp, Mus musculus
gccgatgatcttggttttgagttct

SEQ ID NO: 308968 - DNA, 25 bp, Mus musculus
gccgatgccagatgagacatcgttc

SEQ ID NO: 308969 - DNA, 25 bp, Mus musculus
gccgatgcccactggacttcaggaa

SEQ ID NO: 308970 - DNA, 25 bp, Mus musculus
gccgatgtaccaggaaacatccgag

SEQ ID NO: 308971 - DNA, 25 bp, Mus musculus
gccgatgtacgaggaccatcccaca

SEQ ID NO: 308972 - DNA, 25 bp, Mus musculus
gccgatgtacgagggaaggatcatc

SEQ ID NO: 308973 - DNA, 25 bp, Mus musculus
gccgattatccagagacagcccaaa

SEQ ID NO: 308974 - DNA, 25 bp, Mus musculus
gccgattcgcccagagtttgggaaa

SEQ ID NO: 308975 - DNA, 25 bp, Mus musculus
gccgattgccgacgtgttcttaatt

SEQ ID NO: 308976 - DNA, 25 bp, Mus musculus
gccgatttgggcacgatgtatacca

SEQ ID NO: 308977 - DNA, 25 bp, Mus musculus
gccgatttgggcacggactgtcagg

SEQ ID NO: 308978 - DNA, 25 bp, Mus musculus
gccgattttatgtggggagagaaaa

SEQ ID NO: 308979 - DNA, 25 bp, Mus musculus
gccgcaaacagggcctggatcctgc

SEQ ID NO: 308980 - DNA, 25 bp, Mus musculus
gccgcaaagaagttccaccaggtga

SEQ ID NO: 308981 - DNA, 25 bp, Mus musculus
gccgcaacagcagcttcgagagctg

SEQ ID NO: 308982 - DNA, 25 bp, Mus musculus
gccgcaacagcagggttctggctgc

SEQ ID NO: 308983 - DNA, 25 bp, Mus musculus
gccgcaagccagcacccacctgcac

SEQ ID NO: 308984 - DNA, 25 bp, Mus musculus
gccgcaagccaggacccacctgcac

SEQ ID NO: 308985 - DNA, 25 bp, Mus musculus
gccgcacagaactgactgtcccttt

SEQ ID NO: 308986 - DNA, 25 bp, Mus musculus
gccgcacagacccgaagtgtggagt

SEQ ID NO: 308987 - DNA, 25 bp, Mus musculus
gccgcacagacccgttcacgaacca

SEQ ID NO: 308988 - DNA, 25 bp, Mus musculus
gccgcacagacccgttccaggaggc

SEQ ID NO: 308989 - DNA, 25 bp, Mus musculus
gccgcacagccgggttccatgatgg

SEQ ID NO: 308990 - DNA, 25 bp, Mus musculus
gccgcacagccggtgctggagactg

SEQ ID NO: 308991 - DNA, 25 bp, Mus musculus
gccgcacagcctgctcttcctcctg

SEQ ID NO: 308992 - DNA, 25 bp, Mus musculus
gccgcaccgctacagggcattagga

SEQ ID NO: 308993 - DNA, 25 bp, Mus musculus
gccgcacctacgagctcctggaaac

SEQ ID NO: 308994 - DNA, 25 bp, Mus musculus
gccgcacctgccaggccacagacct

SEQ ID NO: 308995 - DNA, 25 bp, Mus musculus
gccgcacctgccaggtaagaagaaa

SEQ ID NO: 308996 - DNA, 25 bp, Mus musculus
gccgcacggcggacaaatgaagaga

SEQ ID NO: 308997 - DNA, 25 bp, Mus musculus
gccgcacggcgggaatctcttcctt

SEQ ID NO: 308998 - DNA, 25 bp, Mus musculus
gccgcactcaccactttgccctgtt

SEQ ID NO: 308999 - DNA, 25 bp, Mus musculus
gccgcactcatcatggtggacaatg

SEQ ID NO: 309000 - DNA, 25 bp, Mus musculus
gccgcagaacgcatcccacagctgg

SEQ ID NO: 309001 - DNA, 25 bp, Mus musculus
gccgcagaagtatgaggcttgggtg

SEQ ID NO: 309002 - DNA, 25 bp, Mus musculus
gccgcagacagagtgccctgggcga

SEQ ID NO: 309003 - DNA, 25 bp, Mus musculus
gccgcagaccggactccagattcca

SEQ ID NO: 309004 - DNA, 25 bp, Mus musculus
gccgcagagagaggttaccctgcat

SEQ ID NO: 309005 - DNA, 25 bp, Mus musculus
gccgcagcagccctgtttgatctgt

SEQ ID NO: 309006 - DNA, 25 bp, Mus musculus
gccgcagcatggagacaaaaaagcg

SEQ ID NO: 309007 - DNA, 25 bp, Mus musculus
gccgcagcatgggaaattaagcgag

SEQ ID NO: 309008 - DNA, 25 bp, Mus musculus
gccgcagcccaaggagatacagaat

SEQ ID NO: 309009 - DNA, 25 bp, Mus musculus
gccgcagccccgaggataatagaat

SEQ ID NO: 309010 - DNA, 25 bp, Mus musculus
gccgcagcctggtaacgaaggcagt

SEQ ID NO: 309011 - DNA, 25 bp, Mus musculus
gccgcagcctgttgggcaaggcggg

SEQ ID NO: 309012 - DNA, 25 bp, Mus musculus
gccgcaggaatcagccatgcatcat

SEQ ID NO: 309013 - DNA, 25 bp, Mus musculus
gccgcaggacagcaccacgccccac

SEQ ID NO: 309014 - DNA, 25 bp, Mus musculus
gccgcaggacggtgactgtcccagc

SEQ ID NO: 309015 - DNA, 25 bp, Mus musculus
gccgcaggatgcaggctggggctgt

SEQ ID NO: 309016 - DNA, 25 bp, Mus musculus
gccgcaggcggaaagtatccattat

SEQ ID NO: 309017 - DNA, 25 bp, Mus musculus
gccgcagggaagagcgggctaactc

SEQ ID NO: 309018 - DNA, 25 bp, Mus musculus
gccgcagtcgggccgccccaccttc

SEQ ID NO: 309019 - DNA, 25 bp, Mus musculus
gccgcagtgtaatgatcgatgaaga

SEQ ID NO: 309020 - DNA, 25 bp, Mus musculus
gccgcatgcaggtggaccctcagaa

SEQ ID NO: 309021 - DNA, 25 bp, Mus musculus
gccgcatgtttgtcattgcctttct

SEQ ID NO: 309022 - DNA, 25 bp, Mus musculus
gccgcattaaggacagccttctgca

SEQ ID NO: 309023 - DNA, 25 bp, Mus musculus
gccgccaactcctagctacaggcgg

SEQ ID NO: 309024 - DNA, 25 bp, Mus musculus
gccgccaagaaacaggctcgcagcc

SEQ ID NO: 309025 - DNA, 25 bp, Mus musculus
gccgccaagaagcaggctcgcagcc

SEQ ID NO: 309026 - DNA, 25 bp, Mus musculus
gccgccacaaagaaaggaaacacgg

SEQ ID NO: 309027 - DNA, 25 bp, Mus musculus
gccgccacagagttctgtccttgga

SEQ ID NO: 309028 - DNA, 25 bp, Mus musculus
gccgccacagccagaagttgaaatg

SEQ ID NO: 309029 - DNA, 25 bp, Mus musculus
gccgccacagcggccccgtgtctga

SEQ ID NO: 309030 - DNA, 25 bp, Mus musculus
gccgccacagcgtggtgtccttgtc

SEQ ID NO: 309031 - DNA, 25 bp, Mus musculus
gccgccacaggaactggtgtgccta

SEQ ID NO: 309032 - DNA, 25 bp, Mus musculus
gccgccacaggtcctgttgagtcag

SEQ ID NO: 309033 - DNA, 25 bp, Mus musculus
gccgccaccacctggaactggtgag

SEQ ID NO: 309034 - DNA, 25 bp, Mus musculus
gccgccaccacggcgggcgtccgaa

SEQ ID NO: 309035 - DNA, 25 bp, Mus musculus
gccgccaccatgagcgatcagcagc

SEQ ID NO: 309036 - DNA, 25 bp, Mus musculus
gccgccacgatgtgtgccgtgcagg

SEQ ID NO: 309037 - DNA, 25 bp, Mus musculus
gccgccagacacattgatttgaaac

SEQ ID NO: 309038 - DNA, 25 bp, Mus musculus
gccgccagacacattgtcataactt

SEQ ID NO: 309039 - DNA, 25 bp, Mus musculus
gccgccagacacattgtgaactgcc

SEQ ID NO: 309040 - DNA, 25 bp, Mus musculus
gccgccagccaggattggatccagt

SEQ ID NO: 309041 - DNA, 25 bp, Mus musculus
gccgccagcgccgtccgtgacctcg

SEQ ID NO: 309042 - DNA, 25 bp, Mus musculus
gccgccagctcgtatgaaaatccat

SEQ ID NO: 309043 - DNA, 25 bp, Mus musculus
gccgccagctgggtggctttgacac

SEQ ID NO: 309044 - DNA, 25 bp, Mus musculus
gccgccagggaaggctccccagagg

SEQ ID NO: 309045 - DNA, 25 bp, Mus musculus
gccgccagtgtcaggtcaattacca

SEQ ID NO: 309046 - DNA, 25 bp, Mus musculus
gccgccagtttcccacttgtcagaa

SEQ ID NO: 309047 - DNA, 25 bp, Mus musculus
gccgccataggtttatggagccgta

SEQ ID NO: 309048 - DNA, 25 bp, Mus musculus
gccgccatattcccgtggcatcttt

SEQ ID NO: 309049 - DNA, 25 bp, Mus musculus
gccgccatcaagcagggtttcaaag

SEQ ID NO: 309050 - DNA, 25 bp, Mus musculus
gccgccatcatgtctgccacaactt

SEQ ID NO: 309051 - DNA, 25 bp, Mus musculus
gccgccatccacacgttccgccagg

SEQ ID NO: 309052 - DNA, 25 bp, Mus musculus
gccgccatgactattctcccggggc

SEQ ID NO: 309053 - DNA, 25 bp, Mus musculus
gccgccatgctcgtgggctccctgc

SEQ ID NO: 309054 - DNA, 25 bp, Mus musculus
gccgccatggagtcctccaccttcg

SEQ ID NO: 309055 - DNA, 25 bp, Mus musculus
gccgccatgggtattaagagctgcg

SEQ ID NO: 309056 - DNA, 25 bp, Mus musculus
gccgccattaaggtgtctagtcaca

SEQ ID NO: 309057 - DNA, 25 bp, Mus musculus
gccgccattgaaacggataaggaag

SEQ ID NO: 309058 - DNA, 25 bp, Mus musculus
gccgccattgaaacgggatgggaac

SEQ ID NO: 309059 - DNA, 25 bp, Mus musculus
gccgcccaagacctccctgggcctc

SEQ ID NO: 309060 - DNA, 25 bp, Mus musculus
gccgcccaagagtcctttgctgttt

SEQ ID NO: 309061 - DNA, 25 bp, Mus musculus
gccgcccagcgagcgctgcgaagct

SEQ ID NO: 309062 - DNA, 25 bp, Mus musculus
gccgcccagtgttcctttgaagacc

SEQ ID NO: 309063 - DNA, 25 bp, Mus musculus
gccgcccagtgttgtcactggacct

SEQ ID NO: 309064 - DNA, 25 bp, Mus musculus
gccgccccacggcggagcctgaccc

SEQ ID NO: 309065 - DNA, 25 bp, Mus musculus
gccgccccacgggccatggaggaag

SEQ ID NO: 309066 - DNA, 25 bp, Mus musculus
gccgccccactgaagggcagtggaa

SEQ ID NO: 309067 - DNA, 25 bp, Mus musculus
gccgccccactgtaaggcagtggaa

SEQ ID NO: 309068 - DNA, 25 bp, Mus musculus
gccgcccccaggagttattcctcat

SEQ ID NO: 309069 - DNA, 25 bp, Mus musculus
gccgccccctcaggagccaacatgt

SEQ ID NO: 309070 - DNA, 25 bp, Mus musculus
gccgccccgccttgaacagagaaag

SEQ ID NO: 309071 - DNA, 25 bp, Mus musculus
gccgcccctgctattacaagccaga

SEQ ID NO: 309072 - DNA, 25 bp, Mus musculus
gccgcccgagcagttgccccagaat

SEQ ID NO: 309073 - DNA, 25 bp, Mus musculus
gccgcccgatgcaatgctgtcgatc

SEQ ID NO: 309074 - DNA, 25 bp, Mus musculus
gccgcccgcacggagcggcggcatg

SEQ ID NO: 309075 - DNA, 25 bp, Mus musculus
gccgcccgcagagctgtttggattt

SEQ ID NO: 309076 - DNA, 25 bp, Mus musculus
gccgcccgcccggcaatgggaaatc

SEQ ID NO: 309077 - DNA, 25 bp, Mus musculus
gccgcccgcccggttatgtcatttt

SEQ ID NO: 309078 - DNA, 25 bp, Mus musculus
gccgcccgcctggacaggatgtttg

SEQ ID NO: 309079 - DNA, 25 bp, Mus musculus
gccgcccgcgcagagccggctgatc

SEQ ID NO: 309080 - DNA, 25 bp, Mus musculus
gccgcccgcgcaggttggtgggaac

SEQ ID NO: 309081 - DNA, 25 bp, Mus musculus
gccgcccgcgcaggtttggacgtca

SEQ ID NO: 309082 - DNA, 25 bp, Mus musculus
gccgcccggaggtgcttgaggcgag

SEQ ID NO: 309083 - DNA, 25 bp, Mus musculus
gccgcccggccggggaccaatctcc

SEQ ID NO: 309084 - DNA, 25 bp, Mus musculus
gccgccctataggaaatggaattta

SEQ ID NO: 309085 - DNA, 25 bp, Mus musculus
gccgccctccccactgcgtctctct

SEQ ID NO: 309086 - DNA, 25 bp, Mus musculus
gccgccgagccggcgctaactggga

SEQ ID NO: 309087 - DNA, 25 bp, Mus musculus
gccgccgagctggagaactacgatg

SEQ ID NO: 309088 - DNA, 25 bp, Mus musculus
gccgccgagctggaggtggggcctg

SEQ ID NO: 309089 - DNA, 25 bp, Mus musculus
gccgccgcagatataaagacttgaa

SEQ ID NO: 309090 - DNA, 25 bp, Mus musculus
gccgccgccaagaaacaggctcgca

SEQ ID NO: 309091 - DNA, 25 bp, Mus musculus
gccgccgccaccatgagcgatcagc

SEQ ID NO: 309092 - DNA, 25 bp, Mus musculus
gccgccgccaggtgtgcaacagaag

SEQ ID NO: 309093 - DNA, 25 bp, Mus musculus
gccgccgccagtttcccacttgtca

SEQ ID NO: 309094 - DNA, 25 bp, Mus musculus
gccgccgcccaggtaactatagtcc

SEQ ID NO: 309095 - DNA, 25 bp, Mus musculus
gccgccgcccaggttctgggaaatt

SEQ ID NO: 309096 - DNA, 25 bp, Mus musculus
gccgccgccgccgctttccacccac

SEQ ID NO: 309097 - DNA, 25 bp, Mus musculus
gccgccgccgccggtgcataagtaa

SEQ ID NO: 309098 - DNA, 25 bp, Mus musculus
gccgccgccgctttccacccactcc

SEQ ID NO: 309099 - DNA, 25 bp, Mus musculus
gccgccgccggagcgacaggtgatt

SEQ ID NO: 309100 - DNA, 25 bp, Mus musculus
gccgccgccggtgcataagtaaagg

SEQ ID NO: 309101 - DNA, 25 bp, Mus musculus
gccgccgcctcacgggccagcaggt

SEQ ID NO: 309102 - DNA, 25 bp, Mus musculus
gccgccgcgagtaagaccacaggat

SEQ ID NO: 309103 - DNA, 25 bp, Mus musculus
gccgccgcgagtaagactcccttgt

SEQ ID NO: 309104 - DNA, 25 bp, Mus musculus
gccgccgcgagtaagggcgaatcgc

SEQ ID NO: 309105 - DNA, 25 bp, Mus musculus
gccgccgcgcgcgttccagggctcc

SEQ ID NO: 309106 - DNA, 25 bp, Mus musculus
gccgccgcggagcaggcatggagag

SEQ ID NO: 309107 - DNA, 25 bp, Mus musculus
gccgccgcggaggtctttggccagt

SEQ ID NO: 309108 - DNA, 25 bp, Mus musculus
gccgccgctgagcgccggagtactg

SEQ ID NO: 309109 - DNA, 25 bp, Mus musculus
gccgccgctgcagcatggtttattg

SEQ ID NO: 309110 - DNA, 25 bp, Mus musculus
gccgccggagcgacaggtgatttgg

SEQ ID NO: 309111 - DNA, 25 bp, Mus musculus
gccgccggcggaggacccagccccc

SEQ ID NO: 309112 - DNA, 25 bp, Mus musculus
gccgccggcgtcgcacccctctcta

SEQ ID NO: 309113 - DNA, 25 bp, Mus musculus
gccgccggcgtcggcctttcttttc

SEQ ID NO: 309114 - DNA, 25 bp, Mus musculus
gccgccgggagatgctgttgacgga

SEQ ID NO: 309115 - DNA, 25 bp, Mus musculus
gccgccgggcacctggtccgggcca

SEQ ID NO: 309116 - DNA, 25 bp, Mus musculus
gccgccgggtcagacgcctcttcgc

SEQ ID NO: 309117 - DNA, 25 bp, Mus musculus
gccgccggtgacagacgatactgta

SEQ ID NO: 309118 - DNA, 25 bp, Mus musculus
gccgccgtaggaactgacccgaggc

SEQ ID NO: 309119 - DNA, 25 bp, Mus musculus
gccgccgtcatggccgactactgga

SEQ ID NO: 309120 - DNA, 25 bp, Mus musculus
gccgccgtgagagagtacatcggca

SEQ ID NO: 309121 - DNA, 25 bp, Mus musculus
gccgccgtgcggggagcagcaatga

SEQ ID NO: 309122 - DNA, 25 bp, Mus musculus
gccgccgtgcggggatagctgcccc

SEQ ID NO: 309123 - DNA, 25 bp, Mus musculus
gccgccgtggaagaaaccctgatgg

SEQ ID NO: 309124 - DNA, 25 bp, Mus musculus
gccgccgtggaagagcagtatagct

SEQ ID NO: 309125 - DNA, 25 bp, Mus musculus
gccgccgtggaagagtacagttgtg

SEQ ID NO: 309126 - DNA, 25 bp, Mus musculus
gccgccgtggacgaggtgtccacag

SEQ ID NO: 309127 - DNA, 25 bp, Mus musculus
gccgcctacaggattcctgtctagt

SEQ ID NO: 309128 - DNA, 25 bp, Mus musculus
gccgcctacagtgcagggagactat

SEQ ID NO: 309129 - DNA, 25 bp, Mus musculus
gccgcctacttcgggctaacaggca

SEQ ID NO: 309130 - DNA, 25 bp, Mus musculus
gccgcctagcaggaactgtctacct

SEQ ID NO: 309131 - DNA, 25 bp, Mus musculus
gccgcctagcagtttgttttgttta

SEQ ID NO: 309132 - DNA, 25 bp, Mus musculus
gccgcctcacgggccagcaggtggc

SEQ ID NO: 309133 - DNA, 25 bp, Mus musculus
gccgcctcagaggtttaaacgcatc

SEQ ID NO: 309134 - DNA, 25 bp, Mus musculus
gccgcctccaggactgaccaaggcc

SEQ ID NO: 309135 - DNA, 25 bp, Mus musculus
gccgcctccagtgccgggagcccgt

SEQ ID NO: 309136 - DNA, 25 bp, Mus musculus
gccgcctcccaaggttacactgtgg

SEQ ID NO: 309137 - DNA, 25 bp, Mus musculus
gccgcctccctcgctttttcctgca

SEQ ID NO: 309138 - DNA, 25 bp, Mus musculus
gccgcctccctcgtccagtccacta

SEQ ID NO: 309139 - DNA, 25 bp, Mus musculus
gccgcctcctcagtatcaggcaccc

SEQ ID NO: 309140 - DNA, 25 bp, Mus musculus
gccgcctcctccgagcctgaagcta

SEQ ID NO: 309141 - DNA, 25 bp, Mus musculus
gccgcctcgggagagaggaagcggg

SEQ ID NO: 309142 - DNA, 25 bp, Mus musculus
gccgcctctagctgactggtgagca

SEQ ID NO: 309143 - DNA, 25 bp, Mus musculus
gccgcctctcgcagagttcgaggag

SEQ ID NO: 309144 - DNA, 25 bp, Mus musculus
gccgcctctcggggctgctcttctc

SEQ ID NO: 309145 - DNA, 25 bp, Mus musculus
gccgcctctctcggcatcctacatc

SEQ ID NO: 309146 - DNA, 25 bp, Mus musculus
gccgcctgatcaagatgacagcatg

SEQ ID NO: 309147 - DNA, 25 bp, Mus musculus
gccgcctgatcaagttctcctactc

SEQ ID NO: 309148 - DNA, 25 bp, Mus musculus
gccgcctgcagcagagatgctgagc

SEQ ID NO: 309149 - DNA, 25 bp, Mus musculus
gccgcctgcagcatgtttgtacacc

SEQ ID NO: 309150 - DNA, 25 bp, Mus musculus
gccgcctgcgcggctggccagctaa

SEQ ID NO: 309151 - DNA, 25 bp, Mus musculus
gccgcctgctgctgatgcgtcgagc

SEQ ID NO: 309152 - DNA, 25 bp, Mus musculus
gccgcctgctgctgatggatgtcgt

SEQ ID NO: 309153 - DNA, 25 bp, Mus musculus
gccgcctggaacagctggaagagaa

SEQ ID NO: 309154 - DNA, 25 bp, Mus musculus
gccgccttcctagccctcgtggtag

SEQ ID NO: 309155 - DNA, 25 bp, Mus musculus
gccgccttgctaggcccggtcggtg

SEQ ID NO: 309156 - DNA, 25 bp, Mus musculus
gccgccttggggcatcatgacaccg

SEQ ID NO: 309157 - DNA, 25 bp, Mus musculus
gccgccttttccagcaatccgaagg

SEQ ID NO: 309158 - DNA, 25 bp, Mus musculus
gccgcgaacaagaccccctctatgg

SEQ ID NO: 309159 - DNA, 25 bp, Mus musculus
gccgcgacatggactgtcctgtgca

SEQ ID NO: 309160 - DNA, 25 bp, Mus musculus
gccgcgacatggcctcagtgagctt

SEQ ID NO: 309161 - DNA, 25 bp, Mus musculus
gccgcgacctagaaggttttaggct

SEQ ID NO: 309162 - DNA, 25 bp, Mus musculus
gccgcgacctgaacacatgtcggag

SEQ ID NO: 309163 - DNA, 25 bp, Mus musculus
gccgcgaccttccagcagcagcatg

SEQ ID NO: 309164 - DNA, 25 bp, Mus musculus
gccgcgacgagaaccccagacagac

SEQ ID NO: 309165 - DNA, 25 bp, Mus musculus
gccgcgacgagccctgctggtgtgg

SEQ ID NO: 309166 - DNA, 25 bp, Mus musculus
gccgcgacgagctgaggagggcagg

SEQ ID NO: 309167 - DNA, 25 bp, Mus musculus
gccgcgagggtcgcgcagcgtgcag

SEQ ID NO: 309168 - DNA, 25 bp, Mus musculus
gccgcgagtaagaccacaggatggc

SEQ ID NO: 309169 - DNA, 25 bp, Mus musculus
gccgcgagtaagactcccttgtatc

SEQ ID NO: 309170 - DNA, 25 bp, Mus musculus
gccgcgagtaagggcgaatcgccag

SEQ ID NO: 309171 - DNA, 25 bp, Mus musculus
gccgcgatggaagagacattgatgg

SEQ ID NO: 309172 - DNA, 25 bp, Mus musculus
gccgcgccatcactcggaacccact

SEQ ID NO: 309173 - DNA, 25 bp, Mus musculus
gccgcgccatggatttggtgagctt

SEQ ID NO: 309174 - DNA, 25 bp, Mus musculus
gccgcgcccgggaggtgaagggccg

SEQ ID NO: 309175 - DNA, 25 bp, Mus musculus
gccgcgcccgggagtttcaggcatt

SEQ ID NO: 309176 - DNA, 25 bp, Mus musculus
gccgcgcctactgactatcaatgta

SEQ ID NO: 309177 - DNA, 25 bp, Mus musculus
gccgcgcctactgttccaggactat

SEQ ID NO: 309178 - DNA, 25 bp, Mus musculus
gccgcgcctggagagctccacgcag

SEQ ID NO: 309179 - DNA, 25 bp, Mus musculus
gccgcgcgcgcgttattggaaataa

SEQ ID NO: 309180 - DNA, 25 bp, Mus musculus
gccgcgcgcggggtgctgtgagtgg

SEQ ID NO: 309181 - DNA, 25 bp, Mus musculus
gccgcgcgcgttccagggctccgga

SEQ ID NO: 309182 - DNA, 25 bp, Mus musculus
gccgcgcggccatggagcagctgaa

SEQ ID NO: 309183 - DNA, 25 bp, Mus musculus
gccgcgcgtgtctccacagaggcgt

SEQ ID NO: 309184 - DNA, 25 bp, Mus musculus
gccgcgctgggaggcatgtcatgtt

SEQ ID NO: 309185 - DNA, 25 bp, Mus musculus
gccgcgctggtgttcgagttcctca

SEQ ID NO: 309186 - DNA, 25 bp, Mus musculus
gccgcgcttcagggcaactattgat

SEQ ID NO: 309187 - DNA, 25 bp, Mus musculus
gccgcgcttccgctccggccctcga

SEQ ID NO: 309188 - DNA, 25 bp, Mus musculus
gccgcggacagagcagactgtatcg

SEQ ID NO: 309189 - DNA, 25 bp, Mus musculus
gccgcggagcaggcatggagagtag

SEQ ID NO: 309190 - DNA, 25 bp, Mus musculus
gccgcggaggacgtggcctggggag

SEQ ID NO: 309191 - DNA, 25 bp, Mus musculus
gccgcggatccgcatttgcaggccc

SEQ ID NO: 309192 - DNA, 25 bp, Mus musculus
gccgcggatggccagccttggcctc

SEQ ID NO: 309193 - DNA, 25 bp, Mus musculus
gccgcggcacaaaatcagcgcctgg

SEQ ID NO: 309194 - DNA, 25 bp, Mus musculus
gccgcggcagccactaagccccagt

SEQ ID NO: 309195 - DNA, 25 bp, Mus musculus
gccgcggcagccagtcccgctcggc

SEQ ID NO: 309196 - DNA, 25 bp, Mus musculus
gccgcggcagccgctttcactatac

SEQ ID NO: 309197 - DNA, 25 bp, Mus musculus
gccgcggcccagaattgtaaaaccg

SEQ ID NO: 309198 - DNA, 25 bp, Mus musculus
gccgcggcccaggttaaatggaatc

SEQ ID NO: 309199 - DNA, 25 bp, Mus musculus
gccgcggccccccttcacgctcgat

SEQ ID NO: 309200 - DNA, 25 bp, Mus musculus
gccgcggccgaacatgggtgcaagg

SEQ ID NO: 309201 - DNA, 25 bp, Mus musculus
gccgcggccgaacgacagagactgc

SEQ ID NO: 309202 - DNA, 25 bp, Mus musculus
gccgcggccgcgcagaactgtcatt

SEQ ID NO: 309203 - DNA, 25 bp, Mus musculus
gccgcggccttcgggctaacaggca

SEQ ID NO: 309204 - DNA, 25 bp, Mus musculus
gccgcggcgcaaggaccggctccga

SEQ ID NO: 309205 - DNA, 25 bp, Mus musculus
gccgcggcggagcagaccatgctcg

SEQ ID NO: 309206 - DNA, 25 bp, Mus musculus
gccgcggcggcggagatcctgaggg

SEQ ID NO: 309207 - DNA, 25 bp, Mus musculus
gccgcggcgtctcagctccgcgtga

SEQ ID NO: 309208 - DNA, 25 bp, Mus musculus
gccgcggctgcctaggttctggtat

SEQ ID NO: 309209 - DNA, 25 bp, Mus musculus
gccgcgggaaagagtccagcctctg

SEQ ID NO: 309210 - DNA, 25 bp, Mus musculus
gccgcgggaaaggataaagcatcag

SEQ ID NO: 309211 - DNA, 25 bp, Mus musculus
gccgcgggcgcagataaagaagctg

SEQ ID NO: 309212 - DNA, 25 bp, Mus musculus
gccgcggggcgatgtgagccccagg

SEQ ID NO: 309213 - DNA, 25 bp, Mus musculus
gccgcggggcgtgggattgaagtga

SEQ ID NO: 309214 - DNA, 25 bp, Mus musculus
gccgcgggggcgaggtggccaggca

SEQ ID NO: 309215 - DNA, 25 bp, Mus musculus
gccgcgggggcgaggtgtccccatg

SEQ ID NO: 309216 - DNA, 25 bp, Mus musculus
gccgcgggttaccgtgcagacatgg

SEQ ID NO: 309217 - DNA, 25 bp, Mus musculus
gccgcggtcgcccagggactttgaa

SEQ ID NO: 309218 - DNA, 25 bp, Mus musculus
gccgcgtcatgggggttaattccta

SEQ ID NO: 309219 - DNA, 25 bp, Mus musculus
gccgcgtccagaccatttttgccct

SEQ ID NO: 309220 - DNA, 25 bp, Mus musculus
gccgcgtccgggtgatctctgggct

SEQ ID NO: 309221 - DNA, 25 bp, Mus musculus
gccgcgtctggtgacttctgtgact

SEQ ID NO: 309222 - DNA, 25 bp, Mus musculus
gccgcgtgcgaggatgaaacgagga

SEQ ID NO: 309223 - DNA, 25 bp, Mus musculus
gccgcgtgcgcaagggtgaaaaatt

SEQ ID NO: 309224 - DNA, 25 bp, Mus musculus
gccgcgtgcgcaaggtacgtgggag

SEQ ID NO: 309225 - DNA, 25 bp, Mus musculus
gccgcgtggacacccttcatggcgg

SEQ ID NO: 309226 - DNA, 25 bp, Mus musculus
gccgcgtggagcaggacctggcaat

SEQ ID NO: 309227 - DNA, 25 bp, Mus musculus
gccgctaatttgtggaacctctgag

SEQ ID NO: 309228 - DNA, 25 bp, Mus musculus
gccgctaatttgtggccgtctgctg

SEQ ID NO: 309229 - DNA, 25 bp, Mus musculus
gccgctaatttgtgtttacagacct

SEQ ID NO: 309230 - DNA, 25 bp, Mus musculus
gccgctaccggcagatcaccatccg

SEQ ID NO: 309231 - DNA, 25 bp, Mus musculus
gccgctacctcaagctgagggcaga

SEQ ID NO: 309232 - DNA, 25 bp, Mus musculus
gccgctacctcaaggagctgagcaa

SEQ ID NO: 309233 - DNA, 25 bp, Mus musculus
gccgctacctcaatcacagttgcag

SEQ ID NO: 309234 - DNA, 25 bp, Mus musculus
gccgctacggaagcctttgcttcct

SEQ ID NO: 309235 - DNA, 25 bp, Mus musculus
gccgctacgtgaatgagatcaagga

SEQ ID NO: 309236 - DNA, 25 bp, Mus musculus
gccgctactctcctcaaaactcaga

SEQ ID NO: 309237 - DNA, 25 bp, Mus musculus
gccgctactctcctcgacccatgag

SEQ ID NO: 309238 - DNA, 25 bp, Mus musculus
gccgctagcacaggcttctaaacct

SEQ ID NO: 309239 - DNA, 25 bp, Mus musculus
gccgctagcacaggggttgtgtggt

SEQ ID NO: 309240 - DNA, 25 bp, Mus musculus
gccgctagtgctcagagtgcctgca

SEQ ID NO: 309241 - DNA, 25 bp, Mus musculus
gccgctagtgctcagctacagcaac

SEQ ID NO: 309242 - DNA, 25 bp, Mus musculus
gccgctatcagatccatttgggctt

SEQ ID NO: 309243 - DNA, 25 bp, Mus musculus
gccgctcagcttactattaccatac

SEQ ID NO: 309244 - DNA, 25 bp, Mus musculus
gccgctccagaagctcgaagcggtc

SEQ ID NO: 309245 - DNA, 25 bp, Mus musculus
gccgctccatcagggttccagtgat

SEQ ID NO: 309246 - DNA, 25 bp, Mus musculus
gccgctccatcagtggctccacgta

SEQ ID NO: 309247 - DNA, 25 bp, Mus musculus
gccgctccgatccctacgtgaaaag

SEQ ID NO: 309248 - DNA, 25 bp, Mus musculus
gccgctccgctcacgaaaggcaagc

SEQ ID NO: 309249 - DNA, 25 bp, Mus musculus
gccgctccgctcacgtgctacctgt

SEQ ID NO: 309250 - DNA, 25 bp, Mus musculus
gccgctccttctagtggcagacctg

SEQ ID NO: 309251 - DNA, 25 bp, Mus musculus
gccgctcctttgcagactttgatcc

SEQ ID NO: 309252 - DNA, 25 bp, Mus musculus
gccgctcctttgcagccacagacag

SEQ ID NO: 309253 - DNA, 25 bp, Mus musculus
gccgctcgaagtcgctaggacttct

SEQ ID NO: 309254 - DNA, 25 bp, Mus musculus
gccgctcgagcccgctgcctgtgcc

SEQ ID NO: 309255 - DNA, 25 bp, Mus musculus
gccgctcgagcccggggactttgtg

SEQ ID NO: 309256 - DNA, 25 bp, Mus musculus
gccgctcgagcccggtacctgggcc

SEQ ID NO: 309257 - DNA, 25 bp, Mus musculus
gccgctctcagaacccaggaagctt

SEQ ID NO: 309258 - DNA, 25 bp, Mus musculus
gccgctctcaggtcaaatctaagtg

SEQ ID NO: 309259 - DNA, 25 bp, Mus musculus
gccgctctgaggtcgaatggtatgt

SEQ ID NO: 309260 - DNA, 25 bp, Mus musculus
gccgctctggggatgtcaacctaca

SEQ ID NO: 309261 - DNA, 25 bp, Mus musculus
gccgctcttggtttccatcgtgtgg

SEQ ID NO: 309262 - DNA, 25 bp, Mus musculus
gccgctgaagagcgtattgaagggc

SEQ ID NO: 309263 - DNA, 25 bp, Mus musculus
gccgctgaagatgtgcctcatccag

SEQ ID NO: 309264 - DNA, 25 bp, Mus musculus
gccgctgaatctcacttcaggccca

SEQ ID NO: 309265 - DNA, 25 bp, Mus musculus
gccgctgaatctcactttagatagt

SEQ ID NO: 309266 - DNA, 25 bp, Mus musculus
gccgctgagtggatacattccacca

SEQ ID NO: 309267 - DNA, 25 bp, Mus musculus
gccgctgcacgatttaccttcaaga

SEQ ID NO: 309268 - DNA, 25 bp, Mus musculus
gccgctgcagcatggtttattgaaa

SEQ ID NO: 309269 - DNA, 25 bp, Mus musculus
gccgctgcatccccagtccatctat

SEQ ID NO: 309270 - DNA, 25 bp, Mus musculus
gccgctgccgcgagataaaatcaaa

SEQ ID NO: 309271 - DNA, 25 bp, Mus musculus
gccgctgccggagattggcagactc

SEQ ID NO: 309272 - DNA, 25 bp, Mus musculus
gccgctgcgagtggccgccccacct

SEQ ID NO: 309273 - DNA, 25 bp, Mus musculus
gccgctgcggccagagcttcggtgc

SEQ ID NO: 309274 - DNA, 25 bp, Mus musculus
gccgctgctgggaataacagacaaa

SEQ ID NO: 309275 - DNA, 25 bp, Mus musculus
gccgctgctgggtggctgcgttgat

SEQ ID NO: 309276 - DNA, 25 bp, Mus musculus
gccgctgcttgcaaggagaagttga

SEQ ID NO: 309277 - DNA, 25 bp, Mus musculus
gccgctggacgcaagggcattgaaa

SEQ ID NO: 309278 - DNA, 25 bp, Mus musculus
gccgctggacgcaagggtttgtgtt

SEQ ID NO: 309279 - DNA, 25 bp, Mus musculus
gccgctggacgcgcggaaaggaaac

SEQ ID NO: 309280 - DNA, 25 bp, Mus musculus
gccgctggcatggacagttctgccc

SEQ ID NO: 309281 - DNA, 25 bp, Mus musculus
gccgctggccagtttcttcagcgaa

SEQ ID NO: 309282 - DNA, 25 bp, Mus musculus
gccgctgtacgcagttttacagaga

SEQ ID NO: 309283 - DNA, 25 bp, Mus musculus
gccgctgtagaattggaaaagcaac

SEQ ID NO: 309284 - DNA, 25 bp, Mus musculus
gccgctgtcaaaagtcttgcgctca

SEQ ID NO: 309285 - DNA, 25 bp, Mus musculus
gccgctgtcaagtcgatgagcagtt

SEQ ID NO: 309286 - DNA, 25 bp, Mus musculus
gccgctgtctgagcgcaggctgtga

SEQ ID NO: 309287 - DNA, 25 bp, Mus musculus
gccgctgtgaggtacagtcatgtcg

SEQ ID NO: 309288 - DNA, 25 bp, Mus musculus
gccgctgtggtctatgaaaccaatg

SEQ ID NO: 309289 - DNA, 25 bp, Mus musculus
gccgctgtggtgatgagatggacca

SEQ ID NO: 309290 - DNA, 25 bp, Mus musculus
gccgctgttgacagggtctgcagca

SEQ ID NO: 309291 - DNA, 25 bp, Mus musculus
gccgcttatcattaccagttcaaga

SEQ ID NO: 309292 - DNA, 25 bp, Mus musculus
gccgcttccatcagacctgaggtcc

SEQ ID NO: 309293 - DNA, 25 bp, Mus musculus
gccgcttcttcactgactatggttg

SEQ ID NO: 309294 - DNA, 25 bp, Mus musculus
gccgcttgcggaggtttggattcag

SEQ ID NO: 309295 - DNA, 25 bp, Mus musculus
gccgcttgcgtggctcggatggcgt

SEQ ID NO: 309296 - DNA, 25 bp, Mus musculus
gccgcttggatggggtattgacaaa

SEQ ID NO: 309297 - DNA, 25 bp, Mus musculus
gccgctttaggatcgctactcttag

SEQ ID NO: 309298 - DNA, 25 bp, Mus musculus
gccgctttcaggtagcactttgtat

SEQ ID NO: 309299 - DNA, 25 bp, Mus musculus
gccgctttccctcagcagacacgca

SEQ ID NO: 309300 - DNA, 25 bp, Mus musculus
gccgctttgtggcggacgtgacttg

SEQ ID NO: 309301 - DNA, 25 bp, Mus musculus
gccggaaaaatccatggtgcctgag

SEQ ID NO: 309302 - DNA, 25 bp, Mus musculus
gccggaaaaatccattaccagtgct

SEQ ID NO: 309303 - DNA, 25 bp, Mus musculus
gccggaaaacactggaagcaagaga

SEQ ID NO: 309304 - DNA, 25 bp, Mus musculus
gccggaaaacactggcggaaccagt

SEQ ID NO: 309305 - DNA, 25 bp, Mus musculus
gccggaaaagacaaggaccagcagc

SEQ ID NO: 309306 - DNA, 25 bp, Mus musculus
gccggaaagagacacagcagtccga

SEQ ID NO: 309307 - DNA, 25 bp, Mus musculus
gccggaaataagactgcagctttag

SEQ ID NO: 309308 - DNA, 25 bp, Mus musculus
gccggaacgagccatggaccctctc

SEQ ID NO: 309309 - DNA, 25 bp, Mus musculus
gccggaacgaggcttcatctaccca

SEQ ID NO: 309310 - DNA, 25 bp, Mus musculus
gccggaacttcaaggatgaagaaac

SEQ ID NO: 309311 - DNA, 25 bp, Mus musculus
gccggaacttcaagtcctcctgcat

SEQ ID NO: 309312 - DNA, 25 bp, Mus musculus
gccggaagatgatgccagaccagtt

SEQ ID NO: 309313 - DNA, 25 bp, Mus musculus
gccggaagcagtagctaagatgcga

SEQ ID NO: 309314 - DNA, 25 bp, Mus musculus
gccggaaggagtcccagccaagcgg

SEQ ID NO: 309315 - DNA, 25 bp, Mus musculus
gccggaagtgaagcccctgcccgga

SEQ ID NO: 309316 - DNA, 25 bp, Mus musculus
gccggacacattttaactgtgacaa

SEQ ID NO: 309317 - DNA, 25 bp, Mus musculus
gccggaccacaggccacaaaaagaa

SEQ ID NO: 309318 - DNA, 25 bp, Mus musculus
gccggacctacaacttctgaaaagc

SEQ ID NO: 309319 - DNA, 25 bp, Mus musculus
gccggacctacactgatgaagagtt

SEQ ID NO: 309320 - DNA, 25 bp, Mus musculus
gccggacgcagatcgcccacgtcca

SEQ ID NO: 309321 - DNA, 25 bp, Mus musculus
gccggactcagatttgataatgggc

SEQ ID NO: 309322 - DNA, 25 bp, Mus musculus
gccggactgctgtaggtctgaccac

SEQ ID NO: 309323 - DNA, 25 bp, Mus musculus
gccggagacacagcttggtgacaat

SEQ ID NO: 309324 - DNA, 25 bp, Mus musculus
gccggagacacaggccccatgggga

SEQ ID NO: 309325 - DNA, 25 bp, Mus musculus
gccggagcagagtctggccacagat

SEQ ID NO: 309326 - DNA, 25 bp, Mus musculus
gccggagcagggtccccagaagcac

SEQ ID NO: 309327 - DNA, 25 bp, Mus musculus
gccggagccgcaaaggatgaaacga

SEQ ID NO: 309328 - DNA, 25 bp, Mus musculus
gccggagcctccggttaagcctgat

SEQ ID NO: 309329 - DNA, 25 bp, Mus musculus
gccggagcggagcaatgcctaaatc

SEQ ID NO: 309330 - DNA, 25 bp, Mus musculus
gccggagcggctcaggttccagcta

SEQ ID NO: 309331 - DNA, 25 bp, Mus musculus
gccggagctatgtttcgaaaccagt

SEQ ID NO: 309332 - DNA, 25 bp, Mus musculus
gccggagctcagagaaagcagaaga

SEQ ID NO: 309333 - DNA, 25 bp, Mus musculus
gccggagctcagagggcgggatgtc

SEQ ID NO: 309334 - DNA, 25 bp, Mus musculus
gccggagctcagaggtgttttctat

SEQ ID NO: 309335 - DNA, 25 bp, Mus musculus
gccggagctcagaggttgactcttc

SEQ ID NO: 309336 - DNA, 25 bp, Mus musculus
gccggagctgctggacatgctgctg

SEQ ID NO: 309337 - DNA, 25 bp, Mus musculus
gccggagctgttttatgaccagaat

SEQ ID NO: 309338 - DNA, 25 bp, Mus musculus
gccggaggaagagggctgcctctga

SEQ ID NO: 309339 - DNA, 25 bp, Mus musculus
gccggaggactgaatagttgcagta

SEQ ID NO: 309340 - DNA, 25 bp, Mus musculus
gccggaggagaggtacagacatgaa

SEQ ID NO: 309341 - DNA, 25 bp, Mus musculus
gccggaggagggaagatcctccctc

SEQ ID NO: 309342 - DNA, 25 bp, Mus musculus
gccggaggagggaaggggctggaaa

SEQ ID NO: 309343 - DNA, 25 bp, Mus musculus
gccggaggatactcagctctggagc

SEQ ID NO: 309344 - DNA, 25 bp, Mus musculus
gccggaggcgagaggccccacgcat

SEQ ID NO: 309345 - DNA, 25 bp, Mus musculus
gccggagggcctcgagctgaaggga

SEQ ID NO: 309346 - DNA, 25 bp, Mus musculus
gccggagggcctcggtcacccagct

SEQ ID NO: 309347 - DNA, 25 bp, Mus musculus
gccggagtccagggtctccatagag

SEQ ID NO: 309348 - DNA, 25 bp, Mus musculus
gccggagtccgtctacagagagcca

SEQ ID NO: 309349 - DNA, 25 bp, Mus musculus
gccggagtctccgggctttggcgtt

SEQ ID NO: 309350 - DNA, 25 bp, Mus musculus
gccggagtgcccatgaacgggaagg

SEQ ID NO: 309351 - DNA, 25 bp, Mus musculus
gccggagtggcctctgcatcctaga

SEQ ID NO: 309352 - DNA, 25 bp, Mus musculus
gccggagtgggctggtgttcccggc

SEQ ID NO: 309353 - DNA, 25 bp, Mus musculus
gccggagttgcaagaccatagtctg

SEQ ID NO: 309354 - DNA, 25 bp, Mus musculus
gccggataatgacggcgtggagccc

SEQ ID NO: 309355 - DNA, 25 bp, Mus musculus
gccggataatgtgctagaatttgtg

SEQ ID NO: 309356 - DNA, 25 bp, Mus musculus
gccggatactggacatgctggtgtc

SEQ ID NO: 309357 - DNA, 25 bp, Mus musculus
gccggatactggatgaagacagctg

SEQ ID NO: 309358 - DNA, 25 bp, Mus musculus
gccggatcccagggcctagtaacta

SEQ ID NO: 309359 - DNA, 25 bp, Mus musculus
gccggatctcaccagggcccagtca

SEQ ID NO: 309360 - DNA, 25 bp, Mus musculus
gccggatctgatcagaacaggacgc

SEQ ID NO: 309361 - DNA, 25 bp, Mus musculus
gccggatctgatcaggtccagcctg

SEQ ID NO: 309362 - DNA, 25 bp, Mus musculus
gccggatctgatcagtctcggcatc

SEQ ID NO: 309363 - DNA, 25 bp, Mus musculus
gccggatgctgagatggtttttgat

SEQ ID NO: 309364 - DNA, 25 bp, Mus musculus
gccggatgctgtcggtggctacaga

SEQ ID NO: 309365 - DNA, 25 bp, Mus musculus
gccggattcaggaggtggatgccca

SEQ ID NO: 309366 - DNA, 25 bp, Mus musculus
gccggattgcctggagagtgtgaag

SEQ ID NO: 309367 - DNA, 25 bp, Mus musculus
gccggcaagagacggaagaacgagc

SEQ ID NO: 309368 - DNA, 25 bp, Mus musculus
gccggcaagcccctgccgacaccca

SEQ ID NO: 309369 - DNA, 25 bp, Mus musculus
gccggcaagcccctgcgacacctgc

SEQ ID NO: 309370 - DNA, 25 bp, Mus musculus
gccggcaccaacagcgccaggcagc

SEQ ID NO: 309371 - DNA, 25 bp, Mus musculus
gccggcacttaggagcagttctccg

SEQ ID NO: 309372 - DNA, 25 bp, Mus musculus
gccggcagagcaagccactcaggct

SEQ ID NO: 309373 - DNA, 25 bp, Mus musculus
gccggcagagcaaggtggagctcac

SEQ ID NO: 309374 - DNA, 25 bp, Mus musculus
gccggcagcaccggaaaactcaagg

SEQ ID NO: 309375 - DNA, 25 bp, Mus musculus
gccggcagcgtgaaggaaatggaat

SEQ ID NO: 309376 - DNA, 25 bp, Mus musculus
gccggcaggaactgtgtggacgacc

SEQ ID NO: 309377 - DNA, 25 bp, Mus musculus
gccggcaggcaccgaggtggtttgt

SEQ ID NO: 309378 - DNA, 25 bp, Mus musculus
gccggcatcagctgatttccaaaga

SEQ ID NO: 309379 - DNA, 25 bp, Mus musculus
gccggcatccacggcggaaccttag

SEQ ID NO: 309380 - DNA, 25 bp, Mus musculus
gccggcatccacggggctccacctg

SEQ ID NO: 309381 - DNA, 25 bp, Mus musculus
gccggcatcgccgcttacaagcacg

SEQ ID NO: 309382 - DNA, 25 bp, Mus musculus
gccggccacggcccggacacagagg

SEQ ID NO: 309383 - DNA, 25 bp, Mus musculus
gccggccagatgggcaagagttcaa

SEQ ID NO: 309384 - DNA, 25 bp, Mus musculus
gccggccagcagtactattactgga

SEQ ID NO: 309385 - DNA, 25 bp, Mus musculus
gccggccagccagataagtacggtt

SEQ ID NO: 309386 - DNA, 25 bp, Mus musculus
gccggccatgggctgaactacgctg

SEQ ID NO: 309387 - DNA, 25 bp, Mus musculus
gccggcccgaggcccggtcggtgag

SEQ ID NO: 309388 - DNA, 25 bp, Mus musculus
gccggcccgcaagctataagcgagc

SEQ ID NO: 309389 - DNA, 25 bp, Mus musculus
gccggcccgcagactttgtgttgct

SEQ ID NO: 309390 - DNA, 25 bp, Mus musculus
gccggcccgcgtacggcatccagaa

SEQ ID NO: 309391 - DNA, 25 bp, Mus musculus
gccggcccggattgatgacattgct

SEQ ID NO: 309392 - DNA, 25 bp, Mus musculus
gccggcccgggacccagtgcaggtc

SEQ ID NO: 309393 - DNA, 25 bp, Mus musculus
gccggccgaaggatcatctgtccct

SEQ ID NO: 309394 - DNA, 25 bp, Mus musculus
gccggccgaaggttcttgattgtct

SEQ ID NO: 309395 - DNA, 25 bp, Mus musculus
gccggccgagattgctaagaagcct

SEQ ID NO: 309396 - DNA, 25 bp, Mus musculus
gccggccgccgtccccagtgacctg

SEQ ID NO: 309397 - DNA, 25 bp, Mus musculus
gccggccgcgcgcgcgttattggaa

SEQ ID NO: 309398 - DNA, 25 bp, Mus musculus
gccggccggcgggtgcccagatcat

SEQ ID NO: 309399 - DNA, 25 bp, Mus musculus
gccggccgtcgggactctaatgagc

SEQ ID NO: 309400 - DNA, 25 bp, Mus musculus
gccggccgttgtgaacagaccctgc

SEQ ID NO: 309401 - DNA, 25 bp, Mus musculus
gccggccgttgtgctcccatgtgtg

SEQ ID NO: 309402 - DNA, 25 bp, Mus musculus
gccggccgttgtgggcaataccctt

SEQ ID NO: 309403 - DNA, 25 bp, Mus musculus
gccggcctaaaaggctgctctttgg

SEQ ID NO: 309404 - DNA, 25 bp, Mus musculus
gccggcctaaaagggctccttctcc

SEQ ID NO: 309405 - DNA, 25 bp, Mus musculus
gccggcctccaggtctgtgcacttg

SEQ ID NO: 309406 - DNA, 25 bp, Mus musculus
gccggcctgcgcaggaatcttggga

SEQ ID NO: 309407 - DNA, 25 bp, Mus musculus
gccggccttcagcacacagcacacc

SEQ ID NO: 309408 - DNA, 25 bp, Mus musculus
gccggcctttatcggatccggaagg

SEQ ID NO: 309409 - DNA, 25 bp, Mus musculus
gccggcgaccgcccgaaacaagaag

SEQ ID NO: 309410 - DNA, 25 bp, Mus musculus
gccggcgactctaggttgcagtgtg

SEQ ID NO: 309411 - DNA, 25 bp, Mus musculus
gccggcgcccctccttcctgagcat

SEQ ID NO: 309412 - DNA, 25 bp, Mus musculus
gccggcgccgggagtcctgttgaag

SEQ ID NO: 309413 - DNA, 25 bp, Mus musculus
gccggcggaggacccagcccccagc

SEQ ID NO: 309414 - DNA, 25 bp, Mus musculus
gccggcggcacgatgccggtgcagc

SEQ ID NO: 309415 - DNA, 25 bp, Mus musculus
gccggcgggaggctgacaatttccg

SEQ ID NO: 309416 - DNA, 25 bp, Mus musculus
gccggcgtccaagagtaagctaaaa

SEQ ID NO: 309417 - DNA, 25 bp, Mus musculus
gccggcgtccaagagtccatatgtt

SEQ ID NO: 309418 - DNA, 25 bp, Mus musculus
gccggcgtcgcacccctctctacct

SEQ ID NO: 309419 - DNA, 25 bp, Mus musculus
gccggcgtcggcctttcttttctcc

SEQ ID NO: 309420 - DNA, 25 bp, Mus musculus
gccggcgtgacagcatttgacattg

SEQ ID NO: 309421 - DNA, 25 bp, Mus musculus
gccggctagatcacagtcaagcagg

SEQ ID NO: 309422 - DNA, 25 bp, Mus musculus
gccggctcagagggaggaggacagc

SEQ ID NO: 309423 - DNA, 25 bp, Mus musculus
gccggctcgctaagccacactcatt

SEQ ID NO: 309424 - DNA, 25 bp, Mus musculus
gccggctcgctaagccggctgccct

SEQ ID NO: 309425 - DNA, 25 bp, Mus musculus
gccggctgaagccagcatcgagatc

SEQ ID NO: 309426 - DNA, 25 bp, Mus musculus
gccggctgaagccaggagccaaacc

SEQ ID NO: 309427 - DNA, 25 bp, Mus musculus
gccggctgaggagaaacaacaaata

SEQ ID NO: 309428 - DNA, 25 bp, Mus musculus
gccggctgatctggaccccgaggcc

SEQ ID NO: 309429 - DNA, 25 bp, Mus musculus
gccggctgatgccaagacggaagag

SEQ ID NO: 309430 - DNA, 25 bp, Mus musculus
gccggctggcagaacacagatctgt

SEQ ID NO: 309431 - DNA, 25 bp, Mus musculus
gccggctggcagccatggagaacgc

SEQ ID NO: 309432 - DNA, 25 bp, Mus musculus
gccggctgggctgctgattcacgga

SEQ ID NO: 309433 - DNA, 25 bp, Mus musculus
gccggcttccaggtaccaatgggga

SEQ ID NO: 309434 - DNA, 25 bp, Mus musculus
gccggcttggtgcctgttccggagc

SEQ ID NO: 309435 - DNA, 25 bp, Mus musculus
gccggcttttgaaagctctgcggag

SEQ ID NO: 309436 - DNA, 25 bp, Mus musculus
gccggcttttgaaaggaacagatta

SEQ ID NO: 309437 - DNA, 25 bp, Mus musculus
gccgggaaaggtaatgatgtgggcc

SEQ ID NO: 309438 - DNA, 25 bp, Mus musculus
gccgggaagagctggcatttcagtc

SEQ ID NO: 309439 - DNA, 25 bp, Mus musculus
gccgggaagaggtgctgagctatgc

SEQ ID NO: 309440 - DNA, 25 bp, Mus musculus
gccgggaagatgccagtgtacggtc

SEQ ID NO: 309441 - DNA, 25 bp, Mus musculus
gccgggacaaggtaatgttctcctt

SEQ ID NO: 309442 - DNA, 25 bp, Mus musculus
gccgggacagagagggtccgtcgta

SEQ ID NO: 309443 - DNA, 25 bp, Mus musculus
gccgggaccgacgccacagggcctc

SEQ ID NO: 309444 - DNA, 25 bp, Mus musculus
gccgggactcggggctgagcagcaa

SEQ ID NO: 309445 - DNA, 25 bp, Mus musculus
gccgggactcgggggacaggcacga

SEQ ID NO: 309446 - DNA, 25 bp, Mus musculus
gccgggagactcaagggatcctctg

SEQ ID NO: 309447 - DNA, 25 bp, Mus musculus
gccgggagagaccctcaggacttgt

SEQ ID NO: 309448 - DNA, 25 bp, Mus musculus
gccgggagagacgcagtgagaaagg

SEQ ID NO: 309449 - DNA, 25 bp, Mus musculus
gccgggagaggtcggcagacggcga

SEQ ID NO: 309450 - DNA, 25 bp, Mus musculus
gccgggagccggcaggcatgccccg

SEQ ID NO: 309451 - DNA, 25 bp, Mus musculus
gccgggaggtccggatgctgttgac

SEQ ID NO: 309452 - DNA, 25 bp, Mus musculus
gccgggagtcgattttaggtgatgg

SEQ ID NO: 309453 - DNA, 25 bp, Mus musculus
gccgggatacacgggacctcactgc

SEQ ID NO: 309454 - DNA, 25 bp, Mus musculus
gccgggatacaggtgtgaatgaggc

SEQ ID NO: 309455 - DNA, 25 bp, Mus musculus
gccgggatcaaggcagagatgcttt

SEQ ID NO: 309456 - DNA, 25 bp, Mus musculus
gccgggatcaggtggatcaactgag

SEQ ID NO: 309457 - DNA, 25 bp, Mus musculus
gccgggattaaagagcaaaagagag

SEQ ID NO: 309458 - DNA, 25 bp, Mus musculus
gccgggattaaagagtctattttca

SEQ ID NO: 309459 - DNA, 25 bp, Mus musculus
gccgggcaagctgccaaaagcctat

SEQ ID NO: 309460 - DNA, 25 bp, Mus musculus
gccgggcacctggtccgggccatca

SEQ ID NO: 309461 - DNA, 25 bp, Mus musculus
gccgggcagacaacggttggcatcg

SEQ ID NO: 309462 - DNA, 25 bp, Mus musculus
gccgggcagacaacgttcactttaa

SEQ ID NO: 309463 - DNA, 25 bp, Mus musculus
gccgggcagccaggcaccacctacc

SEQ ID NO: 309464 - DNA, 25 bp, Mus musculus
gccgggcagcgcaggtatcgccagg

SEQ ID NO: 309465 - DNA, 25 bp, Mus musculus
gccgggcagcgcaggtgccccgtgc

SEQ ID NO: 309466 - DNA, 25 bp, Mus musculus
gccgggcagcgcgcgcagagacact

SEQ ID NO: 309467 - DNA, 25 bp, Mus musculus
gccgggcagcggcctggaggaggga

SEQ ID NO: 309468 - DNA, 25 bp, Mus musculus
gccgggcagtgtgagctagcccttc

SEQ ID NO: 309469 - DNA, 25 bp, Mus musculus
gccgggcagtgtgagtgatttccgg

SEQ ID NO: 309470 - DNA, 25 bp, Mus musculus
gccgggcccatggaatccaaaacta

SEQ ID NO: 309471 - DNA, 25 bp, Mus musculus
gccgggcccgaaccctcttggctcg

SEQ ID NO: 309472 - DNA, 25 bp, Mus musculus
gccgggcccgggccaccaagcacct

SEQ ID NO: 309473 - DNA, 25 bp, Mus musculus
gccgggccgcagtgcctggtgaaga

SEQ ID NO: 309474 - DNA, 25 bp, Mus musculus
gccgggccgccaaggtatgccatca

SEQ ID NO: 309475 - DNA, 25 bp, Mus musculus
gccgggccgccatatgagacggttt

SEQ ID NO: 309476 - DNA, 25 bp, Mus musculus
gccgggccgccatattcattccttg

SEQ ID NO: 309477 - DNA, 25 bp, Mus musculus
gccgggccgcccaacaagatagctg

SEQ ID NO: 309478 - DNA, 25 bp, Mus musculus
gccgggcctcaggcctcagcattta

SEQ ID NO: 309479 - DNA, 25 bp, Mus musculus
gccgggcctcagtcttatgacctga

SEQ ID NO: 309480 - DNA, 25 bp, Mus musculus
gccgggcgagctggaaaccatggcc

SEQ ID NO: 309481 - DNA, 25 bp, Mus musculus
gccgggcgaggcctctgagaacact

SEQ ID NO: 309482 - DNA, 25 bp, Mus musculus
gccgggcggagccagatttagatga

SEQ ID NO: 309483 - DNA, 25 bp, Mus musculus
gccgggcggccagccttgcactatg

SEQ ID NO: 309484 - DNA, 25 bp, Mus musculus
gccgggcgggcgcagagctgagata

SEQ ID NO: 309485 - DNA, 25 bp, Mus musculus
gccgggcgggcgcagtgttatccac

SEQ ID NO: 309486 - DNA, 25 bp, Mus musculus
gccgggctaactggactcatgcagt

SEQ ID NO: 309487 - DNA, 25 bp, Mus musculus
gccgggctatgagatattactacaa

SEQ ID NO: 309488 - DNA, 25 bp, Mus musculus
gccgggctgaggagcatgaacggtg

SEQ ID NO: 309489 - DNA, 25 bp, Mus musculus
gccgggctgttgaggatgtgctcga

SEQ ID NO: 309490 - DNA, 25 bp, Mus musculus
gccgggctttatcaggtcctcatgg

SEQ ID NO: 309491 - DNA, 25 bp, Mus musculus
gccggggaaaggtgctctcccagga

SEQ ID NO: 309492 - DNA, 25 bp, Mus musculus
gccggggaaaggtgtctaaggatga

SEQ ID NO: 309493 - DNA, 25 bp, Mus musculus
gccggggactgtcggatagggactt

SEQ ID NO: 309494 - DNA, 25 bp, Mus musculus
gccggggactgtcggggtacagcat

SEQ ID NO: 309495 - DNA, 25 bp, Mus musculus
gccggggagaggtgggaaaagcttg

SEQ ID NO: 309496 - DNA, 25 bp, Mus musculus
gccggggagccgggggcactatgaa

SEQ ID NO: 309497 - DNA, 25 bp, Mus musculus
gccggggagctggaggggaacctga

SEQ ID NO: 309498 - DNA, 25 bp, Mus musculus
gccggggcaaggtctgttcactaga

SEQ ID NO: 309499 - DNA, 25 bp, Mus musculus
gccggggccgcaggaggcccagcct

SEQ ID NO: 309500 - DNA, 25 bp, Mus musculus
gccggggcgaggttctctccactat

SEQ ID NO: 309501 - DNA, 25 bp, Mus musculus
gccggggcgggacccagctgacctt

SEQ ID NO: 309502 - DNA, 25 bp, Mus musculus
gccggggctcgatgtctacactacg

SEQ ID NO: 309503 - DNA, 25 bp, Mus musculus
gccgggggaagagtacacacgaagg

SEQ ID NO: 309504 - DNA, 25 bp, Mus musculus
gccgggggcctgaccttccaatctg

SEQ ID NO: 309505 - DNA, 25 bp, Mus musculus
gccggggtgacggtggtcaacatga

SEQ ID NO: 309506 - DNA, 25 bp, Mus musculus
gccggggtgagaaggtcatcctttt

SEQ ID NO: 309507 - DNA, 25 bp, Mus musculus
gccgggtaacagaggaaccgatgat

SEQ ID NO: 309508 - DNA, 25 bp, Mus musculus
gccgggtaggcggatctgggacgat

SEQ ID NO: 309509 - DNA, 25 bp, Mus musculus
gccgggtcagacgcctcttcgccct

SEQ ID NO: 309510 - DNA, 25 bp, Mus musculus
gccgggtccttctcgagattttatt

SEQ ID NO: 309511 - DNA, 25 bp, Mus musculus
gccgggtcgcaagcgggctgcctct

SEQ ID NO: 309512 - DNA, 25 bp, Mus musculus
gccgggtgcccgcagatgtgcctca

SEQ ID NO: 309513 - DNA, 25 bp, Mus musculus
gccgggttttcagatccttaagctg

SEQ ID NO: 309514 - DNA, 25 bp, Mus musculus
gccgggttttcagcacactgcccca

SEQ ID NO: 309515 - DNA, 25 bp, Mus musculus
gccgggttttcagcctgaataccaa

SEQ ID NO: 309516 - DNA, 25 bp, Mus musculus
gccggtacaagcttcctgacagtgt

SEQ ID NO: 309517 - DNA, 25 bp, Mus musculus
gccggtaggaagaagccattgctcc

SEQ ID NO: 309518 - DNA, 25 bp, Mus musculus
gccggtcaagacagggtcttactgt

SEQ ID NO: 309519 - DNA, 25 bp, Mus musculus
gccggtcaagagttataccctgact

SEQ ID NO: 309520 - DNA, 25 bp, Mus musculus
gccggtcaaggtgtaaactcttcca

SEQ ID NO: 309521 - DNA, 25 bp, Mus musculus
gccggtcaagtgcacaaccctggct

SEQ ID NO: 309522 - DNA, 25 bp, Mus musculus
gccggtcctcactgccaaggcagca

SEQ ID NO: 309523 - DNA, 25 bp, Mus musculus
gccggtcgtgtggagagattgctct

SEQ ID NO: 309524 - DNA, 25 bp, Mus musculus
gccggtctccagcttcctgcgcttc

SEQ ID NO: 309525 - DNA, 25 bp, Mus musculus
gccggtctccagtgttcacaccgcg

SEQ ID NO: 309526 - DNA, 25 bp, Mus musculus
gccggtgacagacgatactgtatcc

SEQ ID NO: 309527 - DNA, 25 bp, Mus musculus
gccggtgacgccgccgaagatggcg

SEQ ID NO: 309528 - DNA, 25 bp, Mus musculus
gccggtgagtacgcctgctaagccc

SEQ ID NO: 309529 - DNA, 25 bp, Mus musculus
gccggtgcagccagatggagtggcc

SEQ ID NO: 309530 - DNA, 25 bp, Mus musculus
gccggtgcccccggccctcaaggat

SEQ ID NO: 309531 - DNA, 25 bp, Mus musculus
gccggtgccgggctttcaggtagct

SEQ ID NO: 309532 - DNA, 25 bp, Mus musculus
gccggtgctgagttaatatttgcca

SEQ ID NO: 309533 - DNA, 25 bp, Mus musculus
gccggtggagggtcaggatggctga

SEQ ID NO: 309534 - DNA, 25 bp, Mus musculus
gccggtggagggtgtcccctgcact

SEQ ID NO: 309535 - DNA, 25 bp, Mus musculus
gccggtggaggtcgactggccagga

SEQ ID NO: 309536 - DNA, 25 bp, Mus musculus
gccggtgtgctgaagagaactgctt

SEQ ID NO: 309537 - DNA, 25 bp, Mus musculus
gccggttagaactggtgcaggtcct

SEQ ID NO: 309538 - DNA, 25 bp, Mus musculus
gccggttaggcctgaggctgcttcc

SEQ ID NO: 309539 - DNA, 25 bp, Mus musculus
gccggttagggactgcatgagaaga

SEQ ID NO: 309540 - DNA, 25 bp, Mus musculus
gccggttaggggcgaatggacccgc

SEQ ID NO: 309541 - DNA, 25 bp, Mus musculus
gccggttccccgcagaagacctcct

SEQ ID NO: 309542 - DNA, 25 bp, Mus musculus
gccggttccgagggaggttcagaag

SEQ ID NO: 309543 - DNA, 25 bp, Mus musculus
gccggttccgaggtgtgtgaggacg

SEQ ID NO: 309544 - DNA, 25 bp, Mus musculus
gccggttccggttcggattctgtgt

SEQ ID NO: 309545 - DNA, 25 bp, Mus musculus
gccggttgagagggggcacaatata

SEQ ID NO: 309546 - DNA, 25 bp, Mus musculus
gccggtttatgctgcgtccctgacc

SEQ ID NO: 309547 - DNA, 25 bp, Mus musculus
gccgtaaaatcgaggttaataatgc

SEQ ID NO: 309548 - DNA, 25 bp, Mus musculus
gccgtaaccgagccccaatccatgt

SEQ ID NO: 309549 - DNA, 25 bp, Mus musculus
gccgtaagaacttgaaaactcctcc

SEQ ID NO: 309550 - DNA, 25 bp, Mus musculus
gccgtaagaactttcttttgcatgg

SEQ ID NO: 309551 - DNA, 25 bp, Mus musculus
gccgtaagaatttcatcctatctaa

SEQ ID NO: 309552 - DNA, 25 bp, Mus musculus
gccgtacaagcagtgagcttatggg

SEQ ID NO: 309553 - DNA, 25 bp, Mus musculus
gccgtacaatggtggtccatgagaa

SEQ ID NO: 309554 - DNA, 25 bp, Mus musculus
gccgtacacccagagaacctgtctc

SEQ ID NO: 309555 - DNA, 25 bp, Mus musculus
gccgtacacccagcttccggaataa

SEQ ID NO: 309556 - DNA, 25 bp, Mus musculus
gccgtaccaccggcatcgtgttgga

SEQ ID NO: 309557 - DNA, 25 bp, Mus musculus
gccgtaccagagccattcatcaggc

SEQ ID NO: 309558 - DNA, 25 bp, Mus musculus
gccgtaccagggacattcttctcct

SEQ ID NO: 309559 - DNA, 25 bp, Mus musculus
gccgtacctccaggtgatcaagctc

SEQ ID NO: 309560 - DNA, 25 bp, Mus musculus
gccgtactccaagaggctcgggtct

SEQ ID NO: 309561 - DNA, 25 bp, Mus musculus
gccgtactctcttaggaaaagaaga

SEQ ID NO: 309562 - DNA, 25 bp, Mus musculus
gccgtacttccgcacctcctctcca

SEQ ID NO: 309563 - DNA, 25 bp, Mus musculus
gccgtagacctgaaggtgtccccct

SEQ ID NO: 309564 - DNA, 25 bp, Mus musculus
gccgtagcctggatgttgccaaggc

SEQ ID NO: 309565 - DNA, 25 bp, Mus musculus
gccgtagggctgttgacctatcaaa

SEQ ID NO: 309566 - DNA, 25 bp, Mus musculus
gccgtattgagagttgcattgtagt

SEQ ID NO: 309567 - DNA, 25 bp, Mus musculus
gccgtattgaggaacaaaggactct

SEQ ID NO: 309568 - DNA, 25 bp, Mus musculus
gccgtcaaagtcgtgaccccaggct

SEQ ID NO: 309569 - DNA, 25 bp, Mus musculus
gccgtcaagatgcagggttccaagc

SEQ ID NO: 309570 - DNA, 25 bp, Mus musculus
gccgtcaagatgcagtacccccact

SEQ ID NO: 309571 - DNA, 25 bp, Mus musculus
gccgtcaccatgcccctggctagag

SEQ ID NO: 309572 - DNA, 25 bp, Mus musculus
gccgtcaccccaaaattttgtgaat

SEQ ID NO: 309573 - DNA, 25 bp, Mus musculus
gccgtcagacaaggaggaaggctca

SEQ ID NO: 309574 - DNA, 25 bp, Mus musculus
gccgtcagacaaggtaaggaattac

SEQ ID NO: 309575 - DNA, 25 bp, Mus musculus
gccgtcagcccagagctgatttatc

SEQ ID NO: 309576 - DNA, 25 bp, Mus musculus
gccgtcagtctcggcgtggaaagga

SEQ ID NO: 309577 - DNA, 25 bp, Mus musculus
gccgtcatctgcaaagcagaagcag

SEQ ID NO: 309578 - DNA, 25 bp, Mus musculus
gccgtcatctgctatagacatagat

SEQ ID NO: 309579 - DNA, 25 bp, Mus musculus
gccgtcatttatagggttatacagg

SEQ ID NO: 309580 - DNA, 25 bp, Mus musculus
gccgtccaagaacatgtaccctagt

SEQ ID NO: 309581 - DNA, 25 bp, Mus musculus
gccgtccaagaggccattgtgagct

SEQ ID NO: 309582 - DNA, 25 bp, Mus musculus
gccgtccacatgcttgtttatgaat

SEQ ID NO: 309583 - DNA, 25 bp, Mus musculus
gccgtccactccagggctctctaag

SEQ ID NO: 309584 - DNA, 25 bp, Mus musculus
gccgtccagggagtgaagccaagaa

SEQ ID NO: 309585 - DNA, 25 bp, Mus musculus
gccgtccatgaacatatcccgtact

SEQ ID NO: 309586 - DNA, 25 bp, Mus musculus
gccgtccatgaacatgggtccagga

SEQ ID NO: 309587 - DNA, 25 bp, Mus musculus
gccgtcctcaaagcctatgaagact

SEQ ID NO: 309588 - DNA, 25 bp, Mus musculus
gccgtcctgaaactgtaccagttca

SEQ ID NO: 309589 - DNA, 25 bp, Mus musculus
gccgtcctgcaccaacctgcgagcc

SEQ ID NO: 309590 - DNA, 25 bp, Mus musculus
gccgtccttgggaggttctggctgc

SEQ ID NO: 309591 - DNA, 25 bp, Mus musculus
gccgtcgagaaatcgagaacactgt

SEQ ID NO: 309592 - DNA, 25 bp, Mus musculus
gccgtcgagaaatcgagaacttgat

SEQ ID NO: 309593 - DNA, 25 bp, Mus musculus
gccgtcgcgcacaggattacatctt

SEQ ID NO: 309594 - DNA, 25 bp, Mus musculus
gccgtcgcgcacaggccctaccgtg

SEQ ID NO: 309595 - DNA, 25 bp, Mus musculus
gccgtcgctagagttttcaggaaga

SEQ ID NO: 309596 - DNA, 25 bp, Mus musculus
gccgtcgtcaggtgggtccgagcct

SEQ ID NO: 309597 - DNA, 25 bp, Mus musculus
gccgtctacagaaaacaagcacgag

SEQ ID NO: 309598 - DNA, 25 bp, Mus musculus
gccgtctcagattggctatgtagtc

SEQ ID NO: 309599 - DNA, 25 bp, Mus musculus
gccgtctctacttaagaagctctta

SEQ ID NO: 309600 - DNA, 25 bp, Mus musculus
gccgtctctggcaggcactgtaacc

SEQ ID NO: 309601 - DNA, 25 bp, Mus musculus
gccgtctgaagaactgagtgtgatt

SEQ ID NO: 309602 - DNA, 25 bp, Mus musculus
gccgtctgaagactgctctttgatg

SEQ ID NO: 309603 - DNA, 25 bp, Mus musculus
gccgtcttaaggagctaagggaaca

SEQ ID NO: 309604 - DNA, 25 bp, Mus musculus
gccgtgaaagaaaccggctctgaaa

SEQ ID NO: 309605 - DNA, 25 bp, Mus musculus
gccgtgaaaggctcagcggctgcag

SEQ ID NO: 309606 - DNA, 25 bp, Mus musculus
gccgtgaagacctgctgccgacaac

SEQ ID NO: 309607 - DNA, 25 bp, Mus musculus
gccgtgaagagtgagccggtggagc

SEQ ID NO: 309608 - DNA, 25 bp, Mus musculus
gccgtgacggagatttcttgaccta

SEQ ID NO: 309609 - DNA, 25 bp, Mus musculus
gccgtgagagagtacatcggcatca

SEQ ID NO: 309610 - DNA, 25 bp, Mus musculus
gccgtgaggagccggtccagattat

SEQ ID NO: 309611 - DNA, 25 bp, Mus musculus
gccgtgagtttcttgtaatagggcc

SEQ ID NO: 309612 - DNA, 25 bp, Mus musculus
gccgtgatccccaagggtgtgctgg

SEQ ID NO: 309613 - DNA, 25 bp, Mus musculus
gccgtgatccccaagtgcctggctg

SEQ ID NO: 309614 - DNA, 25 bp, Mus musculus
gccgtgatgggaaggtatggatgta

SEQ ID NO: 309615 - DNA, 25 bp, Mus musculus
gccgtgcactgggttaaaaacgaca

SEQ ID NO: 309616 - DNA, 25 bp, Mus musculus
gccgtgcagaagaatgccaccagta

SEQ ID NO: 309617 - DNA, 25 bp, Mus musculus
gccgtgcagagaaaatttcctgatg

SEQ ID NO: 309618 - DNA, 25 bp, Mus musculus
gccgtgcagagatcctgtacattcg

SEQ ID NO: 309619 - DNA, 25 bp, Mus musculus
gccgtgcagagcaagccatacagga

SEQ ID NO: 309620 - DNA, 25 bp, Mus musculus
gccgtgcagagcatctactgccgag

SEQ ID NO: 309621 - DNA, 25 bp, Mus musculus
gccgtgcagcaagacccagaagctg

SEQ ID NO: 309622 - DNA, 25 bp, Mus musculus
gccgtgcaggcagcggctgcgtagt

SEQ ID NO: 309623 - DNA, 25 bp, Mus musculus
gccgtgcagggttcactatcgttgt

SEQ ID NO: 309624 - DNA, 25 bp, Mus musculus
gccgtgcccgggaagagttcagccg

SEQ ID NO: 309625 - DNA, 25 bp, Mus musculus
gccgtgcccgtggtgtgccccctct

SEQ ID NO: 309626 - DNA, 25 bp, Mus musculus
gccgtgccgcgggagaggaaaagca

SEQ ID NO: 309627 - DNA, 25 bp, Mus musculus
gccgtgccgcgggtgtgccaggaga

SEQ ID NO: 309628 - DNA, 25 bp, Mus musculus
gccgtgccgctcttggtttccatcg

SEQ ID NO: 309629 - DNA, 25 bp, Mus musculus
gccgtgcggccagtgtgtgtgtatg

SEQ ID NO: 309630 - DNA, 25 bp, Mus musculus
gccgtggaagaaaccctgatggact

SEQ ID NO: 309631 - DNA, 25 bp, Mus musculus
gccgtggaagagcagtatagctgtg

SEQ ID NO: 309632 - DNA, 25 bp, Mus musculus
gccgtggaagagtacagttgtgaat

SEQ ID NO: 309633 - DNA, 25 bp, Mus musculus
gccgtggaagagtgaagacacctcg

SEQ ID NO: 309634 - DNA, 25 bp, Mus musculus
gccgtggacgagagtttcggggcca

SEQ ID NO: 309635 - DNA, 25 bp, Mus musculus
gccgtggacgaggtgtccacagaac

SEQ ID NO: 309636 - DNA, 25 bp, Mus musculus
gccgtggacttagagcatcactctt

SEQ ID NO: 309637 - DNA, 25 bp, Mus musculus
gccgtggatccagaccaaaaccaac

SEQ ID NO: 309638 - DNA, 25 bp, Mus musculus
gccgtggatgagttttgaagtgagg

SEQ ID NO: 309639 - DNA, 25 bp, Mus musculus
gccgtggatgctgtggtggaatgca

SEQ ID NO: 309640 - DNA, 25 bp, Mus musculus
gccgtggcagaggtagttctggtag

SEQ ID NO: 309641 - DNA, 25 bp, Mus musculus
gccgtggccatacaggtcctgtcca

SEQ ID NO: 309642 - DNA, 25 bp, Mus musculus
gccgtggccccagggttgtgagccc

SEQ ID NO: 309643 - DNA, 25 bp, Mus musculus
gccgtggctaattagcatctgaagt

SEQ ID NO: 309644 - DNA, 25 bp, Mus musculus
gccgtgggagcagaggtggagcgac

SEQ ID NO: 309645 - DNA, 25 bp, Mus musculus
gccgtgggatctagacgaggaccta

SEQ ID NO: 309646 - DNA, 25 bp, Mus musculus
gccgtgggatctaggacgctgcatt

SEQ ID NO: 309647 - DNA, 25 bp, Mus musculus
gccgtgggcagagttctctgaacga

SEQ ID NO: 309648 - DNA, 25 bp, Mus musculus
gccgtgggctccaaatctgaggtta

SEQ ID NO: 309649 - DNA, 25 bp, Mus musculus
gccgtgggtcacaagaagccgtctc

SEQ ID NO: 309650 - DNA, 25 bp, Mus musculus
gccgtgggtcacaaggtcaaagcaa

SEQ ID NO: 309651 - DNA, 25 bp, Mus musculus
gccgtggtccctacacgaatgaagt

SEQ ID NO: 309652 - DNA, 25 bp, Mus musculus
gccgtggtctgggtcaggccctgct

SEQ ID NO: 309653 - DNA, 25 bp, Mus musculus
gccgtggttgtgattgaacgggctg

SEQ ID NO: 309654 - DNA, 25 bp, Mus musculus
gccgtggttgtgcatgggcgcctga

SEQ ID NO: 309655 - DNA, 25 bp, Mus musculus
gccgtgtgacgcagtgggccatgaa

SEQ ID NO: 309656 - DNA, 25 bp, Mus musculus
gccgtgtgagagattggtgtccttt

SEQ ID NO: 309657 - DNA, 25 bp, Mus musculus
gccgtgtgagttctgtggggtgcag

SEQ ID NO: 309658 - DNA, 25 bp, Mus musculus
gccgtgtgctggcgattcacttcag

SEQ ID NO: 309659 - DNA, 25 bp, Mus musculus
gccgtgtgtggcctggtggatgact

SEQ ID NO: 309660 - DNA, 25 bp, Mus musculus
gccgtgttagatgagaaccacagtg

SEQ ID NO: 309661 - DNA, 25 bp, Mus musculus
gccgtgttagtccctataaccggta

SEQ ID NO: 309662 - DNA, 25 bp, Mus musculus
gccgttacacatgagagcagcatgg

SEQ ID NO: 309663 - DNA, 25 bp, Mus musculus
gccgttacacatgctatacctgctc

SEQ ID NO: 309664 - DNA, 25 bp, Mus musculus
gccgttagtggcggcttgacatcta

SEQ ID NO: 309665 - DNA, 25 bp, Mus musculus
gccgttatccagcatttccaggaga

SEQ ID NO: 309666 - DNA, 25 bp, Mus musculus
gccgttatctcacggcgaactttct

SEQ ID NO: 309667 - DNA, 25 bp, Mus musculus
gccgttcacttttcagtatatatgg

SEQ ID NO: 309668 - DNA, 25 bp, Mus musculus
gccgttcagaaaagttggactacat

SEQ ID NO: 309669 - DNA, 25 bp, Mus musculus
gccgttcattttcaaaagaaacagc

SEQ ID NO: 309670 - DNA, 25 bp, Mus musculus
gccgttccctttgcatcactggctc

SEQ ID NO: 309671 - DNA, 25 bp, Mus musculus
gccgttcttagccgatctctgagaa

SEQ ID NO: 309672 - DNA, 25 bp, Mus musculus
gccgttcttagccggtaccagacgt

SEQ ID NO: 309673 - DNA, 25 bp, Mus musculus
gccgttcttagccggtccttcagta

SEQ ID NO: 309674 - DNA, 25 bp, Mus musculus
gccgttcttcataaaactctgaagg

SEQ ID NO: 309675 - DNA, 25 bp, Mus musculus
gccgttgactgtgtactcgatttca

SEQ ID NO: 309676 - DNA, 25 bp, Mus musculus
gccgttgcaagatcgatgatgaaaa

SEQ ID NO: 309677 - DNA, 25 bp, Mus musculus
gccgttgttggagccactggcaagc

SEQ ID NO: 309678 - DNA, 25 bp, Mus musculus
gccgtttccacggaagatgctacca

SEQ ID NO: 309679 - DNA, 25 bp, Mus musculus
gccgtttctgcatctgaacaccgac

SEQ ID NO: 309680 - DNA, 25 bp, Mus musculus
gccgttttgagaagattgctgcatt

SEQ ID NO: 309681 - DNA, 25 bp, Mus musculus
gccgttttgaggctttggagaagat

SEQ ID NO: 309682 - DNA, 25 bp, Mus musculus
gccgtttttgtgatctgccagcttg

SEQ ID NO: 309683 - DNA, 25 bp, Mus musculus
gcctaaaaaagcattcaactcggag

SEQ ID NO: 309684 - DNA, 25 bp, Mus musculus
gcctaaaaaaggtctgtgcaccacg

SEQ ID NO: 309685 - DNA, 25 bp, Mus musculus
gcctaaaaagacggcacaaacacca

SEQ ID NO: 309686 - DNA, 25 bp, Mus musculus
gcctaaaaaggtggtgctgtgatga

SEQ ID NO: 309687 - DNA, 25 bp, Mus musculus
gcctaaacgccaggagcccttgccc

SEQ ID NO: 309688 - DNA, 25 bp, Mus musculus
gcctaaacgccagggaacctttgca

SEQ ID NO: 309689 - DNA, 25 bp, Mus musculus
gcctaacaagtggtggaccaagcac

SEQ ID NO: 309690 - DNA, 25 bp, Mus musculus
gcctaacacaggtggtgaccgttat

SEQ ID NO: 309691 - DNA, 25 bp, Mus musculus
gcctaaccagacagatggagaaaga

SEQ ID NO: 309692 - DNA, 25 bp, Mus musculus
gcctaactactacaggtattaagtt

SEQ ID NO: 309693 - DNA, 25 bp, Mus musculus
gcctaactttcagttcaaaccggag

SEQ ID NO: 309694 - DNA, 25 bp, Mus musculus
gcctaagaaacctcgagatcccaaa

SEQ ID NO: 309695 - DNA, 25 bp, Mus musculus
gcctaagaaacgagcaaaaaattcc

SEQ ID NO: 309696 - DNA, 25 bp, Mus musculus
gcctaagaaggcaccgacagcccga

SEQ ID NO: 309697 - DNA, 25 bp, Mus musculus
gcctaagaatggctcttaccgcccc

SEQ ID NO: 309698 - DNA, 25 bp, Mus musculus
gcctaagaatgggatgcctggaaca

SEQ ID NO: 309699 - DNA, 25 bp, Mus musculus
gcctaagcacaggcagcagagcttt

SEQ ID NO: 309700 - DNA, 25 bp, Mus musculus
gcctaagccacagtgacaacagcta

SEQ ID NO: 309701 - DNA, 25 bp, Mus musculus
gcctaagccagatctcaaagccatt

SEQ ID NO: 309702 - DNA, 25 bp, Mus musculus
gcctaagcctgatttctttattcaa

SEQ ID NO: 309703 - DNA, 25 bp, Mus musculus
gcctaagccttgctcagctccttta

SEQ ID NO: 309704 - DNA, 25 bp, Mus musculus
gcctaaggaatgattggatccagtg

SEQ ID NO: 309705 - DNA, 25 bp, Mus musculus
gcctaagtcctggtacgccatacca

SEQ ID NO: 309706 - DNA, 25 bp, Mus musculus
gcctaatatggcggtgtggctacag

SEQ ID NO: 309707 - DNA, 25 bp, Mus musculus
gcctaatcatgcaggaggatctgct

SEQ ID NO: 309708 - DNA, 25 bp, Mus musculus
gcctaatcatgcagggtcccacctc

SEQ ID NO: 309709 - DNA, 25 bp, Mus musculus
gcctaatgacagtaattatgccacc

SEQ ID NO: 309710 - DNA, 25 bp, Mus musculus
gcctaatgaccaagccttagggtca

SEQ ID NO: 309711 - DNA, 25 bp, Mus musculus
gcctaatggaccagctagtggaacc

SEQ ID NO: 309712 - DNA, 25 bp, Mus musculus
gcctaatgtaaaggggctctttcct

SEQ ID NO: 309713 - DNA, 25 bp, Mus musculus
gcctaatttggctgagtatgagttt

SEQ ID NO: 309714 - DNA, 25 bp, Mus musculus
gcctacaaacctggtctgaagcagc

SEQ ID NO: 309715 - DNA, 25 bp, Mus musculus
gcctacaaacctgtcgacttaaaac

SEQ ID NO: 309716 - DNA, 25 bp, Mus musculus
gcctacaaagaggcctttgccagtg

SEQ ID NO: 309717 - DNA, 25 bp, Mus musculus
gcctacaacagccggagagacctgg

SEQ ID NO: 309718 - DNA, 25 bp, Mus musculus
gcctacaaggatctgatttaaatta

SEQ ID NO: 309719 - DNA, 25 bp, Mus musculus
gcctacaatctgaatgaagaaagac

SEQ ID NO: 309720 - DNA, 25 bp, Mus musculus
gcctacaccacaaggggaggcaaaa

SEQ ID NO: 309721 - DNA, 25 bp, Mus musculus
gcctacacctcggagacctacctga

SEQ ID NO: 309722 - DNA, 25 bp, Mus musculus
gcctacactctagatggagtggatg

SEQ ID NO: 309723 - DNA, 25 bp, Mus musculus
gcctacagaagaggaggccactggg

SEQ ID NO: 309724 - DNA, 25 bp, Mus musculus
gcctacagccatcgggtgggaaaat

SEQ ID NO: 309725 - DNA, 25 bp, Mus musculus
gcctacagtattcagaggaaatata

SEQ ID NO: 309726 - DNA, 25 bp, Mus musculus
gcctacagtattcagttacggtctt

SEQ ID NO: 309727 - DNA, 25 bp, Mus musculus
gcctacagtattcatgagaacctgc

SEQ ID NO: 309728 - DNA, 25 bp, Mus musculus
gcctacagtctgaatgaagaaagac

SEQ ID NO: 309729 - DNA, 25 bp, Mus musculus
gcctacagtgacagaaatcagttcg

SEQ ID NO: 309730 - DNA, 25 bp, Mus musculus
gcctacagtgacagttacggacgag

SEQ ID NO: 309731 - DNA, 25 bp, Mus musculus
gcctacagtgcgcgcgatgaggctg

SEQ ID NO: 309732 - DNA, 25 bp, Mus musculus
gcctacatctggtagtttacaagaa

SEQ ID NO: 309733 - DNA, 25 bp, Mus musculus
gcctacattaatgattccattggct

SEQ ID NO: 309734 - DNA, 25 bp, Mus musculus
gcctacattaatgctaccgtcttga

SEQ ID NO: 309735 - DNA, 25 bp, Mus musculus
gcctaccacgtcagtcctcgttgcc

SEQ ID NO: 309736 - DNA, 25 bp, Mus musculus
gcctaccagaaagccttgtgcctct

SEQ ID NO: 309737 - DNA, 25 bp, Mus musculus
gcctaccagaaagtttgcttacctg

SEQ ID NO: 309738 - DNA, 25 bp, Mus musculus
gcctaccagagcaatttttatatgg

SEQ ID NO: 309739 - DNA, 25 bp, Mus musculus
gcctacccaaggaaactgccaggaa

SEQ ID NO: 309740 - DNA, 25 bp, Mus musculus
gcctacccaaggaaactgccaggca

SEQ ID NO: 309741 - DNA, 25 bp, Mus musculus
gcctacccagagaactggcagaagc

SEQ ID NO: 309742 - DNA, 25 bp, Mus musculus
gcctacccagagataagaagcattt

SEQ ID NO: 309743 - DNA, 25 bp, Mus musculus
gcctacccaggaagaagctcactat

SEQ ID NO: 309744 - DNA, 25 bp, Mus musculus
gcctacccatctgacagatcacagt

SEQ ID NO: 309745 - DNA, 25 bp, Mus musculus
gcctaccccaaaaattatggaccct

SEQ ID NO: 309746 - DNA, 25 bp, Mus musculus
gcctacccctgaccatcccctcatc

SEQ ID NO: 309747 - DNA, 25 bp, Mus musculus
gcctacccgacagccccataaggcc

SEQ ID NO: 309748 - DNA, 25 bp, Mus musculus
gcctacccgacaggaaggtctatat

SEQ ID NO: 309749 - DNA, 25 bp, Mus musculus
gcctaccctgaggaagctggaaggt

SEQ ID NO: 309750 - DNA, 25 bp, Mus musculus
gcctaccctgggagtttttcgtagg

SEQ ID NO: 309751 - DNA, 25 bp, Mus musculus
gcctaccgtgccagcccccatgcat

SEQ ID NO: 309752 - DNA, 25 bp, Mus musculus
gcctaccgtgcttgccattccccta

SEQ ID NO: 309753 - DNA, 25 bp, Mus musculus
gcctaccgtgtggataaacgttttg

SEQ ID NO: 309754 - DNA, 25 bp, Mus musculus
gcctaccgtgtggccttcagtgggg

SEQ ID NO: 309755 - DNA, 25 bp, Mus musculus
gcctacctctggatcgctcctttga

SEQ ID NO: 309756 - DNA, 25 bp, Mus musculus
gcctacctgccgcaaatctcccagc

SEQ ID NO: 309757 - DNA, 25 bp, Mus musculus
gcctaccttcaaggcctgcacgctg

SEQ ID NO: 309758 - DNA, 25 bp, Mus musculus
gcctaccttcttctgtatatgcacc

SEQ ID NO: 309759 - DNA, 25 bp, Mus musculus
gcctacgaagccgatttttgggaat

SEQ ID NO: 309760 - DNA, 25 bp, Mus musculus
gcctacgaagccgtgacactgatga

SEQ ID NO: 309761 - DNA, 25 bp, Mus musculus
gcctacgccgcctatgtattgtatt

SEQ ID NO: 309762 - DNA, 25 bp, Mus musculus
gcctacgccgcctctgtttggggca

SEQ ID NO: 309763 - DNA, 25 bp, Mus musculus
gcctacgcgggacgggcccagttct

SEQ ID NO: 309764 - DNA, 25 bp, Mus musculus
gcctacgcgggacggggcttctgac

SEQ ID NO: 309765 - DNA, 25 bp, Mus musculus
gcctacggacaggatcgagagctga

SEQ ID NO: 309766 - DNA, 25 bp, Mus musculus
gcctacggatcaggtcgtgtcttat

SEQ ID NO: 309767 - DNA, 25 bp, Mus musculus
gcctacggatcagtgacctgagggt

SEQ ID NO: 309768 - DNA, 25 bp, Mus musculus
gcctacggtggatcatgggctctat

SEQ ID NO: 309769 - DNA, 25 bp, Mus musculus
gcctacgtccagcaggcgggcttgg

SEQ ID NO: 309770 - DNA, 25 bp, Mus musculus
gcctactacaacctggactgcagtg

SEQ ID NO: 309771 - DNA, 25 bp, Mus musculus
gcctactacaacctggcgtgacggg

SEQ ID NO: 309772 - DNA, 25 bp, Mus musculus
gcctactacaaccttgcggagtgtg

SEQ ID NO: 309773 - DNA, 25 bp, Mus musculus
gcctactacagagtgatgctgagga

SEQ ID NO: 309774 - DNA, 25 bp, Mus musculus
gcctactacagagttggtgaatatg

SEQ ID NO: 309775 - DNA, 25 bp, Mus musculus
gcctactactcttaaaaaacagttg

SEQ ID NO: 309776 - DNA, 25 bp, Mus musculus
gcctactactgtcgtttatatgcta

SEQ ID NO: 309777 - DNA, 25 bp, Mus musculus
gcctactataagaagatggactaag

SEQ ID NO: 309778 - DNA, 25 bp, Mus musculus
gcctactataagccagattcccctg

SEQ ID NO: 309779 - DNA, 25 bp, Mus musculus
gcctactatcccagccccccaggtt

SEQ ID NO: 309780 - DNA, 25 bp, Mus musculus
gcctactatcccagtatgcaaccga

SEQ ID NO: 309781 - DNA, 25 bp, Mus musculus
gcctactatcccagtgtttgaaaga

SEQ ID NO: 309782 - DNA, 25 bp, Mus musculus
gcctactcagggctaacatcagggc

SEQ ID NO: 309783 - DNA, 25 bp, Mus musculus
gcctactctatcgctgcaggtgtgc

SEQ ID NO: 309784 - DNA, 25 bp, Mus musculus
gcctactctatgtgtgctcatctgt

SEQ ID NO: 309785 - DNA, 25 bp, Mus musculus
gcctactctgtgaaggcccgagacc

SEQ ID NO: 309786 - DNA, 25 bp, Mus musculus
gcctactgaagatcgacttggagag

SEQ ID NO: 309787 - DNA, 25 bp, Mus musculus
gcctactgaaggcctcctcaaaaga

SEQ ID NO: 309788 - DNA, 25 bp, Mus musculus
gcctactgcagtcagctggccgctg

SEQ ID NO: 309789 - DNA, 25 bp, Mus musculus
gcctactgccagcggactcagaggc

SEQ ID NO: 309790 - DNA, 25 bp, Mus musculus
gcctactgccaggctccggtcgaac

SEQ ID NO: 309791 - DNA, 25 bp, Mus musculus
gcctactggacatctcccaaaccca

SEQ ID NO: 309792 - DNA, 25 bp, Mus musculus
gcctactggaggaatgctgggaccc

SEQ ID NO: 309793 - DNA, 25 bp, Mus musculus
gcctactgggcaaggtggtttggga

SEQ ID NO: 309794 - DNA, 25 bp, Mus musculus
gcctactggggaaggagaagctgat

SEQ ID NO: 309795 - DNA, 25 bp, Mus musculus
gcctactgtttacagtacagcaata

SEQ ID NO: 309796 - DNA, 25 bp, Mus musculus
gcctacttcagcaggtccctgcatc

SEQ ID NO: 309797 - DNA, 25 bp, Mus musculus
gcctacttcgggctaacaggcagtg

SEQ ID NO: 309798 - DNA, 25 bp, Mus musculus
gcctacttcttcaggttccggaagc

SEQ ID NO: 309799 - DNA, 25 bp, Mus musculus
gcctagaaaaagaattcttgaagtc

SEQ ID NO: 309800 - DNA, 25 bp, Mus musculus
gcctagaacagatggaaagtgggaa

SEQ ID NO: 309801 - DNA, 25 bp, Mus musculus
gcctagaacaggcagcagaagaagc

SEQ ID NO: 309802 - DNA, 25 bp, Mus musculus
gcctagaagagctccgaggttgcag

SEQ ID NO: 309803 - DNA, 25 bp, Mus musculus
gcctagaagagtatgagcccagagg

SEQ ID NO: 309804 - DNA, 25 bp, Mus musculus
gcctagaagctgagggttcaaggaa

SEQ ID NO: 309805 - DNA, 25 bp, Mus musculus
gcctagacctgacgggacatcctgt

SEQ ID NO: 309806 - DNA, 25 bp, Mus musculus
gcctagacctgtcagaggcctgtag

SEQ ID NO: 309807 - DNA, 25 bp, Mus musculus
gcctagactttctgagtaccatgga

SEQ ID NO: 309808 - DNA, 25 bp, Mus musculus
gcctagagagcaagttcattacagc

SEQ ID NO: 309809 - DNA, 25 bp, Mus musculus
gcctagagggcagagacaatgaata

SEQ ID NO: 309810 - DNA, 25 bp, Mus musculus
gcctagatctaaggaactaatgaaa

SEQ ID NO: 309811 - DNA, 25 bp, Mus musculus
gcctagccaaagatatgaggatcaa

SEQ ID NO: 309812 - DNA, 25 bp, Mus musculus
gcctagcgccgagagatagtgctgg

SEQ ID NO: 309813 - DNA, 25 bp, Mus musculus
gcctagcgccgagagattggagaat

SEQ ID NO: 309814 - DNA, 25 bp, Mus musculus
gcctagcggacccagttcagcttgc

SEQ ID NO: 309815 - DNA, 25 bp, Mus musculus
gcctagcgtctcagagtgcctggtg

SEQ ID NO: 309816 - DNA, 25 bp, Mus musculus
gcctagcgtctcagccaacaagata

SEQ ID NO: 309817 - DNA, 25 bp, Mus musculus
gcctagctcaagtcttttattcaaa

SEQ ID NO: 309818 - DNA, 25 bp, Mus musculus
gcctagctctcagagctcctcctcc

SEQ ID NO: 309819 - DNA, 25 bp, Mus musculus
gcctagctgtcatggacagttactt

SEQ ID NO: 309820 - DNA, 25 bp, Mus musculus
gcctagcttctgaagttgtaatgat

SEQ ID NO: 309821 - DNA, 25 bp, Mus musculus
gcctagctttgtatagtccagatgt

SEQ ID NO: 309822 - DNA, 25 bp, Mus musculus
gcctaggactgctgatggaattgtc

SEQ ID NO: 309823 - DNA, 25 bp, Mus musculus
gcctaggaggttggaggctcggatg

SEQ ID NO: 309824 - DNA, 25 bp, Mus musculus
gcctaggcgggaggtgtttctgttt

SEQ ID NO: 309825 - DNA, 25 bp, Mus musculus
gcctaggctataaagagcaaaacaa

SEQ ID NO: 309826 - DNA, 25 bp, Mus musculus
gcctagggaaagagacagcacggcg

SEQ ID NO: 309827 - DNA, 25 bp, Mus musculus
gcctagggagccgtgtggagcaaaa

SEQ ID NO: 309828 - DNA, 25 bp, Mus musculus
gcctagtactgccaaccccacgggt

SEQ ID NO: 309829 - DNA, 25 bp, Mus musculus
gcctagtactggaggagagttaata

SEQ ID NO: 309830 - DNA, 25 bp, Mus musculus
gcctagtcatctgcgaacacgactc

SEQ ID NO: 309831 - DNA, 25 bp, Mus musculus
gcctagtccttttcagacccgggtc

SEQ ID NO: 309832 - DNA, 25 bp, Mus musculus
gcctagtcgaagcccagagaagaag

SEQ ID NO: 309833 - DNA, 25 bp, Mus musculus
gcctagtcgaagtgcccccctcctt

SEQ ID NO: 309834 - DNA, 25 bp, Mus musculus
gcctagtgagtttacaggctggtga

SEQ ID NO: 309835 - DNA, 25 bp, Mus musculus
gcctagttagtacagatgcagacag

SEQ ID NO: 309836 - DNA, 25 bp, Mus musculus
gcctagttgaaggaatttgacaaga

SEQ ID NO: 309837 - DNA, 25 bp, Mus musculus
gcctatacaaggctggacgtaaaga

SEQ ID NO: 309838 - DNA, 25 bp, Mus musculus
gcctatactacctacaatacccttc

SEQ ID NO: 309839 - DNA, 25 bp, Mus musculus
gcctatactagtgagcatcagatgg

SEQ ID NO: 309840 - DNA, 25 bp, Mus musculus
gcctatagataagaatagcagagaa

SEQ ID NO: 309841 - DNA, 25 bp, Mus musculus
gcctatatattgaaaatccctgact

SEQ ID NO: 309842 - DNA, 25 bp, Mus musculus
gcctatatattgaagtgcggtgttt

SEQ ID NO: 309843 - DNA, 25 bp, Mus musculus
gcctatatcaagaaggctgctttgc

SEQ ID NO: 309844 - DNA, 25 bp, Mus musculus
gcctatatgaggttggcgcatcctt

SEQ ID NO: 309845 - DNA, 25 bp, Mus musculus
gcctatattggtgctggccaacaag

SEQ ID NO: 309846 - DNA, 25 bp, Mus musculus
gcctatcaccagctcctcaggttat

SEQ ID NO: 309847 - DNA, 25 bp, Mus musculus
gcctatcaccagttatcctaccttg

SEQ ID NO: 309848 - DNA, 25 bp, Mus musculus
gcctatcagcgggcttatccgctgg

SEQ ID NO: 309849 - DNA, 25 bp, Mus musculus
gcctatcagcgggtcatagaagagc

SEQ ID NO: 309850 - DNA, 25 bp, Mus musculus
gcctatcagctgcaggtggccaaga

SEQ ID NO: 309851 - DNA, 25 bp, Mus musculus
gcctatcagtgagtaccgtggcctt

SEQ ID NO: 309852 - DNA, 25 bp, Mus musculus
gcctatccagaccctcctcccagag

SEQ ID NO: 309853 - DNA, 25 bp, Mus musculus
gcctatccagagaaccattctgatg

SEQ ID NO: 309854 - DNA, 25 bp, Mus musculus
gcctatcctacagggaaatgcatag

SEQ ID NO: 309855 - DNA, 25 bp, Mus musculus
gcctatctcgacgtcggatgcgcca

SEQ ID NO: 309856 - DNA, 25 bp, Mus musculus
gcctatctgattcaggtacacaact

SEQ ID NO: 309857 - DNA, 25 bp, Mus musculus
gcctatctgtttgtctctagataag

SEQ ID NO: 309858 - DNA, 25 bp, Mus musculus
gcctatgaagcaaccacatgaaatt

SEQ ID NO: 309859 - DNA, 25 bp, Mus musculus
gcctatgaaggaaccacatgaaatt

SEQ ID NO: 309860 - DNA, 25 bp, Mus musculus
gcctatgaaggaggttccgagttgg

SEQ ID NO: 309861 - DNA, 25 bp, Mus musculus
gcctatgacttcaaggctgacatct

SEQ ID NO: 309862 - DNA, 25 bp, Mus musculus
gcctatgagttagaggtcttgttgc

SEQ ID NO: 309863 - DNA, 25 bp, Mus musculus
gcctatgatgatcctcatgggtgtt

SEQ ID NO: 309864 - DNA, 25 bp, Mus musculus
gcctatgatggatctgatgaacgac

SEQ ID NO: 309865 - DNA, 25 bp, Mus musculus
gcctatgatgggaagattaaagtct

SEQ ID NO: 309866 - DNA, 25 bp, Mus musculus
gcctatgatgtgagagaacaagaga

SEQ ID NO: 309867 - DNA, 25 bp, Mus musculus
gcctatgcaacccccagtccccagt

SEQ ID NO: 309868 - DNA, 25 bp, Mus musculus
gcctatgcaagactcatttcacctg

SEQ ID NO: 309869 - DNA, 25 bp, Mus musculus
gcctatgcaggagggagcctcacag

SEQ ID NO: 309870 - DNA, 25 bp, Mus musculus
gcctatgcaggtgtgctgatgatga

SEQ ID NO: 309871 - DNA, 25 bp, Mus musculus
gcctatggagagttcctcaccatgt

SEQ ID NO: 309872 - DNA, 25 bp, Mus musculus
gcctatggagggaggagtgatgggc

SEQ ID NO: 309873 - DNA, 25 bp, Mus musculus
gcctatggaggggtggacaaatcct

SEQ ID NO: 309874 - DNA, 25 bp, Mus musculus
gcctatggagtggcaaaaactactc

SEQ ID NO: 309875 - DNA, 25 bp, Mus musculus
gcctatggagtgttggcagatatcc

SEQ ID NO: 309876 - DNA, 25 bp, Mus musculus
gcctatggataaggttaaaaatttt

SEQ ID NO: 309877 - DNA, 25 bp, Mus musculus
gcctatggatgccctcttggcttct

SEQ ID NO: 309878 - DNA, 25 bp, Mus musculus
gcctatggcggagtagtgtatcaag

SEQ ID NO: 309879 - DNA, 25 bp, Mus musculus
gcctatggcggtgttgtttaccagg

SEQ ID NO: 309880 - DNA, 25 bp, Mus musculus
gcctatgggacaccactgtcccaat

SEQ ID NO: 309881 - DNA, 25 bp, Mus musculus
gcctatgggggaaggtgacgccatc

SEQ ID NO: 309882 - DNA, 25 bp, Mus musculus
gcctatgtcagcactttaatgggtg

SEQ ID NO: 309883 - DNA, 25 bp, Mus musculus
gcctatgtggcaggctgggtcctag

SEQ ID NO: 309884 - DNA, 25 bp, Mus musculus
gcctattaagctgatccacaccgac

SEQ ID NO: 309885 - DNA, 25 bp, Mus musculus
gcctattaagggctcgctgctgaag

SEQ ID NO: 309886 - DNA, 25 bp, Mus musculus
gcctattacatgccaacaattctct

SEQ ID NO: 309887 - DNA, 25 bp, Mus musculus
gcctattacatggatacatgggcgg

SEQ ID NO: 309888 - DNA, 25 bp, Mus musculus
gcctattcaagatctgcacgtttcc

SEQ ID NO: 309889 - DNA, 25 bp, Mus musculus
gcctattctacaagcatggcctgat

SEQ ID NO: 309890 - DNA, 25 bp, Mus musculus
gcctattctgagaaggggctcctgt

SEQ ID NO: 309891 - DNA, 25 bp, Mus musculus
gcctattctgagaaggttccctgta

SEQ ID NO: 309892 - DNA, 25 bp, Mus musculus
gcctattgctatgaagttgaatctg

SEQ ID NO: 309893 - DNA, 25 bp, Mus musculus
gcctattgtgaggaactaatgacca

SEQ ID NO: 309894 - DNA, 25 bp, Mus musculus
gcctattgtggcaagtggtttgtga

SEQ ID NO: 309895 - DNA, 25 bp, Mus musculus
gcctatttcaagataaacaagctgg

SEQ ID NO: 309896 - DNA, 25 bp, Mus musculus
gcctatttccagcagggtgacatgg

SEQ ID NO: 309897 - DNA, 25 bp, Mus musculus
gcctatttgggtggggagaagagac

SEQ ID NO: 309898 - DNA, 25 bp, Mus musculus
gcctattttggatttcagtgaatta

SEQ ID NO: 309899 - DNA, 25 bp, Mus musculus
gcctattttggcaactccgaagatg

SEQ ID NO: 309900 - DNA, 25 bp, Mus musculus
gcctcaaaaccaaaaatcctgactt

SEQ ID NO: 309901 - DNA, 25 bp, Mus musculus
gcctcaaaaccaagtcactccttgt

SEQ ID NO: 309902 - DNA, 25 bp, Mus musculus
gcctcaaacacatccacttcagcac

SEQ ID NO: 309903 - DNA, 25 bp, Mus musculus
gcctcaaacacatgtgactctccta

SEQ ID NO: 309904 - DNA, 25 bp, Mus musculus
gcctcaaatgaagaatcaccgccgc

SEQ ID NO: 309905 - DNA, 25 bp, Mus musculus
gcctcaacacccatgtgaagccttt

SEQ ID NO: 309906 - DNA, 25 bp, Mus musculus
gcctcaacctcccaagactcctaca

SEQ ID NO: 309907 - DNA, 25 bp, Mus musculus
gcctcaactcgaagctcctcccaac

SEQ ID NO: 309908 - DNA, 25 bp, Mus musculus
gcctcaagatcagaggatcccactg

SEQ ID NO: 309909 - DNA, 25 bp, Mus musculus
gcctcaagatgaaggtctcagatct

SEQ ID NO: 309910 - DNA, 25 bp, Mus musculus
gcctcaatcacttggggaaaggcga

SEQ ID NO: 309911 - DNA, 25 bp, Mus musculus
gcctcacaagggactcatgcagtgg

SEQ ID NO: 309912 - DNA, 25 bp, Mus musculus
gcctcacacaagtttaaaaggatgc

SEQ ID NO: 309913 - DNA, 25 bp, Mus musculus
gcctcacaccaagcctgaagaacaa

SEQ ID NO: 309914 - DNA, 25 bp, Mus musculus
gcctcaccagtgaagcggcccctga

SEQ ID NO: 309915 - DNA, 25 bp, Mus musculus
gcctcaccatcctggtatccgtggt

SEQ ID NO: 309916 - DNA, 25 bp, Mus musculus
gcctcacccagcagcaccctcagcg

SEQ ID NO: 309917 - DNA, 25 bp, Mus musculus
gcctcacctctcaattgtgggttga

SEQ ID NO: 309918 - DNA, 25 bp, Mus musculus
gcctcacctgctccaggtttccttc

SEQ ID NO: 309919 - DNA, 25 bp, Mus musculus
gcctcacctgggtgctacagaagac

SEQ ID NO: 309920 - DNA, 25 bp, Mus musculus
gcctcaccttgctgtgccctcacgc

SEQ ID NO: 309921 - DNA, 25 bp, Mus musculus
gcctcactctagggtgaagcctgct

SEQ ID NO: 309922 - DNA, 25 bp, Mus musculus
gcctcactgaaagctgggaagtcat

SEQ ID NO: 309923 - DNA, 25 bp, Mus musculus
gcctcactggaatcccagctggcta

SEQ ID NO: 309924 - DNA, 25 bp, Mus musculus
gcctcacttcggtgggctcggatgg

SEQ ID NO: 309925 - DNA, 25 bp, Mus musculus
gcctcagaaaagagctctgtcttcc

SEQ ID NO: 309926 - DNA, 25 bp, Mus musculus
gcctcagaacgcgagcactttcatc

SEQ ID NO: 309927 - DNA, 25 bp, Mus musculus
gcctcagaaggatgcgggctcctgg

SEQ ID NO: 309928 - DNA, 25 bp, Mus musculus
gcctcagaaggtggccttcccagga

SEQ ID NO: 309929 - DNA, 25 bp, Mus musculus
gcctcagaattcagggaagctacct

SEQ ID NO: 309930 - DNA, 25 bp, Mus musculus
gcctcagaattcaggtgttccatga

SEQ ID NO: 309931 - DNA, 25 bp, Mus musculus
gcctcagaggaggagtattccacca

SEQ ID NO: 309932 - DNA, 25 bp, Mus musculus
gcctcagaggtggaagaagagaagt

SEQ ID NO: 309933 - DNA, 25 bp, Mus musculus
gcctcagcaatgtgaagctgaacga

SEQ ID NO: 309934 - DNA, 25 bp, Mus musculus
gcctcagcagaacaaaccaaagaaa

SEQ ID NO: 309935 - DNA, 25 bp, Mus musculus
gcctcagcagccaatggaaacgata

SEQ ID NO: 309936 - DNA, 25 bp, Mus musculus
gcctcagcagggctgccctttggaa

SEQ ID NO: 309937 - DNA, 25 bp, Mus musculus
gcctcagcatccgcctgatctctca

SEQ ID NO: 309938 - DNA, 25 bp, Mus musculus
gcctcagctgcacactgccccattg

SEQ ID NO: 309939 - DNA, 25 bp, Mus musculus
gcctcaggaagaaactatcaataca

SEQ ID NO: 309940 - DNA, 25 bp, Mus musculus
gcctcaggaatacatcatggaattg

SEQ ID NO: 309941 - DNA, 25 bp, Mus musculus
gcctcagggagagatgagcaataac

SEQ ID NO: 309942 - DNA, 25 bp, Mus musculus
gcctcagggcgtggccatagtgaac

SEQ ID NO: 309943 - DNA, 25 bp, Mus musculus
gcctcaggtgagcaggatcggaacg

SEQ ID NO: 309944 - DNA, 25 bp, Mus musculus
gcctcagtacctggtactggtctct

SEQ ID NO: 309945 - DNA, 25 bp, Mus musculus
gcctcagtggtgggttttttcaggg

SEQ ID NO: 309946 - DNA, 25 bp, Mus musculus
gcctcagtgtcagggagtgttcctg

SEQ ID NO: 309947 - DNA, 25 bp, Mus musculus
gcctcagtgtcagtgattcgggtac

SEQ ID NO: 309948 - DNA, 25 bp, Mus musculus
gcctcagtgtggcctcccctggttt

SEQ ID NO: 309949 - DNA, 25 bp, Mus musculus
gcctcagttgccgattgctgttctt

SEQ ID NO: 309950 - DNA, 25 bp, Mus musculus
gcctcagtttctcctcttggataac

SEQ ID NO: 309951 - DNA, 25 bp, Mus musculus
gcctcagtttctgctcttggataac

SEQ ID NO: 309952 - DNA, 25 bp, Mus musculus
gcctcatcaagagggctgggtcaag

SEQ ID NO: 309953 - DNA, 25 bp, Mus musculus
gcctcatcctggtgacatctcccat

SEQ ID NO: 309954 - DNA, 25 bp, Mus musculus
gcctcatccttatacgagaaaccat

SEQ ID NO: 309955 - DNA, 25 bp, Mus musculus
gcctcatccttataggagaaaccat

SEQ ID NO: 309956 - DNA, 25 bp, Mus musculus
gcctcatcggaaatttgtatgcccg

SEQ ID NO: 309957 - DNA, 25 bp, Mus musculus
gcctcatcgtggattactcctgcgc

SEQ ID NO: 309958 - DNA, 25 bp, Mus musculus
gcctcatctgcatggactcttactc

SEQ ID NO: 309959 - DNA, 25 bp, Mus musculus
gcctcatcttcaaggccacaggacc

SEQ ID NO: 309960 - DNA, 25 bp, Mus musculus
gcctcatcttcttcctgacagctat

SEQ ID NO: 309961 - DNA, 25 bp, Mus musculus
gcctcatgaacgcaaggactttgaa

SEQ ID NO: 309962 - DNA, 25 bp, Mus musculus
gcctcatgaacgcaatgtggaccat

SEQ ID NO: 309963 - DNA, 25 bp, Mus musculus
gcctcatgaagacgtcttcatcatg

SEQ ID NO: 309964 - DNA, 25 bp, Mus musculus
gcctcatgaaggttcctttggcttc

SEQ ID NO: 309965 - DNA, 25 bp, Mus musculus
gcctcatgcctttgggcttggaagt

SEQ ID NO: 309966 - DNA, 25 bp, Mus musculus
gcctcatgcttaagctgaagtggtg

SEQ ID NO: 309967 - DNA, 25 bp, Mus musculus
gcctcatgcttaaggctctctatct

SEQ ID NO: 309968 - DNA, 25 bp, Mus musculus
gcctcatggaatcagctgctctgcc

SEQ ID NO: 309969 - DNA, 25 bp, Mus musculus
gcctcatggaatcaggtgccaacag

SEQ ID NO: 309970 - DNA, 25 bp, Mus musculus
gcctcatggcacaggagcttgaagg

SEQ ID NO: 309971 - DNA, 25 bp, Mus musculus
gcctcattacatcagattacgagct

SEQ ID NO: 309972 - DNA, 25 bp, Mus musculus
gcctcatttccgctgcccgtatggt

SEQ ID NO: 309973 - DNA, 25 bp, Mus musculus
gcctccaaaagccggaaggagaagg

SEQ ID NO: 309974 - DNA, 25 bp, Mus musculus
gcctccaaaagccggtgaagatcgt

SEQ ID NO: 309975 - DNA, 25 bp, Mus musculus
gcctccaacaaagcaaagtaacaat

SEQ ID NO: 309976 - DNA, 25 bp, Mus musculus
gcctccaacaaaggtcgtcctcctt

SEQ ID NO: 309977 - DNA, 25 bp, Mus musculus
gcctccaacacccgctgcctcaacg

SEQ ID NO: 309978 - DNA, 25 bp, Mus musculus
gcctccaacgtatcccaccaaatat

SEQ ID NO: 309979 - DNA, 25 bp, Mus musculus
gcctccaagcccagcatgtgaggga

SEQ ID NO: 309980 - DNA, 25 bp, Mus musculus
gcctccaagcccaggtaactgttca

SEQ ID NO: 309981 - DNA, 25 bp, Mus musculus
gcctccaagggttcccgtgagaacg

SEQ ID NO: 309982 - DNA, 25 bp, Mus musculus
gcctccaagtatgagaaagagctaa

SEQ ID NO: 309983 - DNA, 25 bp, Mus musculus
gcctccaagtccagagtcccggcca

SEQ ID NO: 309984 - DNA, 25 bp, Mus musculus
gcctccacagagctggtggttccag

SEQ ID NO: 309985 - DNA, 25 bp, Mus musculus
gcctccacagaggttgtgcccacca

SEQ ID NO: 309986 - DNA, 25 bp, Mus musculus
gcctccacccacctctcactcccca

SEQ ID NO: 309987 - DNA, 25 bp, Mus musculus
gcctccacccccagaaacgtgtgcc

SEQ ID NO: 309988 - DNA, 25 bp, Mus musculus
gcctccacctcctcagtggcatgcc

SEQ ID NO: 309989 - DNA, 25 bp, Mus musculus
gcctccacggcggtgcaagttgctc

SEQ ID NO: 309990 - DNA, 25 bp, Mus musculus
gcctccacggcggtgcctggagagc

SEQ ID NO: 309991 - DNA, 25 bp, Mus musculus
gcctccacggggtttgacttcatgc

SEQ ID NO: 309992 - DNA, 25 bp, Mus musculus
gcctccactcaggtctgggaacgta

SEQ ID NO: 309993 - DNA, 25 bp, Mus musculus
gcctccactccagctggtggctggc

SEQ ID NO: 309994 - DNA, 25 bp, Mus musculus
gcctccagaaccgcaaagatgctgg

SEQ ID NO: 309995 - DNA, 25 bp, Mus musculus
gcctccagagcagagtgccagctgg

SEQ ID NO: 309996 - DNA, 25 bp, Mus musculus
gcctccagatctggggttggtgtca

SEQ ID NO: 309997 - DNA, 25 bp, Mus musculus
gcctccagatgccttacaagaggag

SEQ ID NO: 309998 - DNA, 25 bp, Mus musculus
gcctccagatgccttacagcacatg

SEQ ID NO: 309999 - DNA, 25 bp, Mus musculus
gcctccagcagataagagtaaagaa

SEQ ID NO: 310000 - DNA, 25 bp, Mus musculus
gcctccagcaggaacacagaggaaa

SEQ ID NO: 310001 - DNA, 25 bp, Mus musculus
gcctccagcaggggctggattcagg

SEQ ID NO: 310002 - DNA, 25 bp, Mus musculus
gcctccagtagagaagctgaaggga

SEQ ID NO: 310003 - DNA, 25 bp, Mus musculus
gcctccatacagtgctctgtgaaga

SEQ ID NO: 310004 - DNA, 25 bp, Mus musculus
gcctccatcaggattccatggacaa

SEQ ID NO: 310005 - DNA, 25 bp, Mus musculus
gcctccatcgtgagacataggaggc

SEQ ID NO: 310006 - DNA, 25 bp, Mus musculus
gcctccatcgtgaggaactatgaat

SEQ ID NO: 310007 - DNA, 25 bp, Mus musculus
gcctccatcgtgaggtagttgaaat

SEQ ID NO: 310008 - DNA, 25 bp, Mus musculus
gcctccatggaccctggacttcggg

SEQ ID NO: 310009 - DNA, 25 bp, Mus musculus
gcctccatgtggatataccgctgtg

SEQ ID NO: 310010 - DNA, 25 bp, Mus musculus
gcctccatgtggcatttggcacatc

SEQ ID NO: 310011 - DNA, 25 bp, Mus musculus
gcctccattcacaaggattcaggga

SEQ ID NO: 310012 - DNA, 25 bp, Mus musculus
gcctcccaagaaaccagctcttcgg

SEQ ID NO: 310013 - DNA, 25 bp, Mus musculus
gcctcccaaggaaggagtctatgaa

SEQ ID NO: 310014 - DNA, 25 bp, Mus musculus
gcctcccaaggaagttcatgttctg

SEQ ID NO: 310015 - DNA, 25 bp, Mus musculus
gcctcccaaggttacactgtggcta

SEQ ID NO: 310016 - DNA, 25 bp, Mus musculus
gcctcccaagttcttggggacacat

SEQ ID NO: 310017 - DNA, 25 bp, Mus musculus
gcctcccaatttcaggctcacccat

SEQ ID NO: 310018 - DNA, 25 bp, Mus musculus
gcctcccacatcaaggtggtggtcg

SEQ ID NO: 310019 - DNA, 25 bp, Mus musculus
gcctcccactggttatagcactcca

SEQ ID NO: 310020 - DNA, 25 bp, Mus musculus
gcctcccactgtagaagggaccagt

SEQ ID NO: 310021 - DNA, 25 bp, Mus musculus
gcctcccagagatcctcttcccagc

SEQ ID NO: 310022 - DNA, 25 bp, Mus musculus
gcctcccagatacccagaaatggaa

SEQ ID NO: 310023 - DNA, 25 bp, Mus musculus
gcctcccagcagaaggagtgtcctc

SEQ ID NO: 310024 - DNA, 25 bp, Mus musculus
gcctcccagcagaaggcagcaagcg

SEQ ID NO: 310025 - DNA, 25 bp, Mus musculus
gcctcccaggaagagagggagaagg

SEQ ID NO: 310026 - DNA, 25 bp, Mus musculus
gcctccccacagaggtggaagcact

SEQ ID NO: 310027 - DNA, 25 bp, Mus musculus
gcctccccagagcaggagactctga

SEQ ID NO: 310028 - DNA, 25 bp, Mus musculus
gcctccccagagcagtgctaccatc

SEQ ID NO: 310029 - DNA, 25 bp, Mus musculus
gcctccccagcaacaattgaaatgg

SEQ ID NO: 310030 - DNA, 25 bp, Mus musculus
gcctccccagcaacactgcaatggc

SEQ ID NO: 310031 - DNA, 25 bp, Mus musculus
gcctccccagcagtcctttgagaaa

SEQ ID NO: 310032 - DNA, 25 bp, Mus musculus
gcctccccagcgaggggacaaaggc

SEQ ID NO: 310033 - DNA, 25 bp, Mus musculus
gcctccccaggtccccctgactttc

SEQ ID NO: 310034 - DNA, 25 bp, Mus musculus
gcctccccatggaagtctgctcgac

SEQ ID NO: 310035 - DNA, 25 bp, Mus musculus
gcctcccccggcccacaatgtcctg

SEQ ID NO: 310036 - DNA, 25 bp, Mus musculus
gcctccccgacgcaggtcctacggc

SEQ ID NO: 310037 - DNA, 25 bp, Mus musculus
gcctccccgacgcaggtgttctttg

SEQ ID NO: 310038 - DNA, 25 bp, Mus musculus
gcctccccgactcggccatcgacaa

SEQ ID NO: 310039 - DNA, 25 bp, Mus musculus
gcctcccgctgctcctgggtgctgg

SEQ ID NO: 310040 - DNA, 25 bp, Mus musculus
gcctccctaccaggaggaagcagtg

SEQ ID NO: 310041 - DNA, 25 bp, Mus musculus
gcctccctcacagaccaagtctgaa

SEQ ID NO: 310042 - DNA, 25 bp, Mus musculus
gcctccctccctggcagggggagga

SEQ ID NO: 310043 - DNA, 25 bp, Mus musculus
gcctccctcgctttttcctgcaata

SEQ ID NO: 310044 - DNA, 25 bp, Mus musculus
gcctccctcgtccagtccactagca

SEQ ID NO: 310045 - DNA, 25 bp, Mus musculus
gcctccctgagactctttgctgatt

SEQ ID NO: 310046 - DNA, 25 bp, Mus musculus
gcctccctgagcctccatgtactca

SEQ ID NO: 310047 - DNA, 25 bp, Mus musculus
gcctccctggaacgggtgaagttga

SEQ ID NO: 310048 - DNA, 25 bp, Mus musculus
gcctccgagaggttggcctgcttgg

SEQ ID NO: 310049 - DNA, 25 bp, Mus musculus
gcctccgcaaaaggttcgaaccttc

SEQ ID NO: 310050 - DNA, 25 bp, Mus musculus
gcctccgcaaaaggttggaagcaat

SEQ ID NO: 310051 - DNA, 25 bp, Mus musculus
gcctccgcaccaacgttttgaggac

SEQ ID NO: 310052 - DNA, 25 bp, Mus musculus
gcctccgccccagaaaaaggagaag

SEQ ID NO: 310053 - DNA, 25 bp, Mus musculus
gcctccgctcaggaacgagttcaag

SEQ ID NO: 310054 - DNA, 25 bp, Mus musculus
gcctccgctcaggtaaacagaatct

SEQ ID NO: 310055 - DNA, 25 bp, Mus musculus
gcctccgctgggtggtaaatgcagt

SEQ ID NO: 310056 - DNA, 25 bp, Mus musculus
gcctccgcttccgtgatgtgctaac

SEQ ID NO: 310057 - DNA, 25 bp, Mus musculus
gcctccggccaggcgagcagactac

SEQ ID NO: 310058 - DNA, 25 bp, Mus musculus
gcctccggggaccttcctggtgcgg

SEQ ID NO: 310059 - DNA, 25 bp, Mus musculus
gcctccgggggtgtctctttggagg

SEQ ID NO: 310060 - DNA, 25 bp, Mus musculus
gcctccgggtaaagaggtgtatgca

SEQ ID NO: 310061 - DNA, 25 bp, Mus musculus
gcctccgtcaacactgaggccttca

SEQ ID NO: 310062 - DNA, 25 bp, Mus musculus
gcctccgtcagctgcagccgactcc

SEQ ID NO: 310063 - DNA, 25 bp, Mus musculus
gcctccgtcatgacgcaacttcggc

SEQ ID NO: 310064 - DNA, 25 bp, Mus musculus
gcctccgtcccccacacacctgctc

SEQ ID NO: 310065 - DNA, 25 bp, Mus musculus
gcctccgtgctgggggcagaatcct

SEQ ID NO: 310066 - DNA, 25 bp, Mus musculus
gcctccgtggagcgactatcctggg

SEQ ID NO: 310067 - DNA, 25 bp, Mus musculus
gcctcctaaggaagcacctccctta

SEQ ID NO: 310068 - DNA, 25 bp, Mus musculus
gcctcctaaggaaggctcagagaaa

SEQ ID NO: 310069 - DNA, 25 bp, Mus musculus
gcctcctaaggaagggtacctggaa

SEQ ID NO: 310070 - DNA, 25 bp, Mus musculus
gcctcctcaagagctttcatcattt

SEQ ID NO: 310071 - DNA, 25 bp, Mus musculus
gcctcctcaagctaaagaacgcttc

SEQ ID NO: 310072 - DNA, 25 bp, Mus musculus
gcctcctcaaggttggctcaaaaac

SEQ ID NO: 310073 - DNA, 25 bp, Mus musculus
gcctcctcaccacagcttccactca

SEQ ID NO: 310074 - DNA, 25 bp, Mus musculus
gcctcctccatgaagcttcgtggat

SEQ ID NO: 310075 - DNA, 25 bp, Mus musculus
gcctcctcccccaggcttcagcacc

SEQ ID NO: 310076 - DNA, 25 bp, Mus musculus
gcctcctccgagaattatatcagaa

SEQ ID NO: 310077 - DNA, 25 bp, Mus musculus
gcctcctcctaccccatcccagcat

SEQ ID NO: 310078 - DNA, 25 bp, Mus musculus
gcctcctcgaggctgtgtgactctg

SEQ ID NO: 310079 - DNA, 25 bp, Mus musculus
gcctcctcgcagcaggaagaagtag

SEQ ID NO: 310080 - DNA, 25 bp, Mus musculus
gcctcctcgcggcattggaggcgga

SEQ ID NO: 310081 - DNA, 25 bp, Mus musculus
gcctcctcgtcctagccatctgcat

SEQ ID NO: 310082 - DNA, 25 bp, Mus musculus
gcctcctcgtcctaggtattctcat

SEQ ID NO: 310083 - DNA, 25 bp, Mus musculus
gcctcctctgaactggatgccagta

SEQ ID NO: 310084 - DNA, 25 bp, Mus musculus
gcctcctctgaactgtataaaatgg

SEQ ID NO: 310085 - DNA, 25 bp, Mus musculus
gcctcctcttgtgatgaagctcaac

SEQ ID NO: 310086 - DNA, 25 bp, Mus musculus
gcctcctcttttctggacaagatgg

SEQ ID NO: 310087 - DNA, 25 bp, Mus musculus
gcctcctgaatgcagttggaatgcc

SEQ ID NO: 310088 - DNA, 25 bp, Mus musculus
gcctcctgatacaggagttccactc

SEQ ID NO: 310089 - DNA, 25 bp, Mus musculus
gcctcctggaatgccgccatgacta

SEQ ID NO: 310090 - DNA, 25 bp, Mus musculus
gcctcctggatatatctattcttcc

SEQ ID NO: 310091 - DNA, 25 bp, Mus musculus
gcctcctggcagcctggtgatcctg

SEQ ID NO: 310092 - DNA, 25 bp, Mus musculus
gcctcctggccaggtggccattgaa

SEQ ID NO: 310093 - DNA, 25 bp, Mus musculus
gcctcctggctccagatgacctcat

SEQ ID NO: 310094 - DNA, 25 bp, Mus musculus
gcctcctggctccagcggacgcccg

SEQ ID NO: 310095 - DNA, 25 bp, Mus musculus
gcctcctggttcggggccgtcgtga

SEQ ID NO: 310096 - DNA, 25 bp, Mus musculus
gcctcctgttccaggatggaggtaa

SEQ ID NO: 310097 - DNA, 25 bp, Mus musculus
gcctccttaagggtcttgagaccat

SEQ ID NO: 310098 - DNA, 25 bp, Mus musculus
gcctccttcagatgacggattccac

SEQ ID NO: 310099 - DNA, 25 bp, Mus musculus
gcctccttcaggcctcaggcttggg

SEQ ID NO: 310100 - DNA, 25 bp, Mus musculus
gcctccttgaggcagctggaagctg

SEQ ID NO: 310101 - DNA, 25 bp, Mus musculus
gcctcctttcaggatgctgtgcgca

SEQ ID NO: 310102 - DNA, 25 bp, Mus musculus
gcctcgaaacagaggcgctccagcg

SEQ ID NO: 310103 - DNA, 25 bp, Mus musculus
gcctcgaaacatgagcatgcccaca

SEQ ID NO: 310104 - DNA, 25 bp, Mus musculus
gcctcgaatacgaaaatggatcgaa

SEQ ID NO: 310105 - DNA, 25 bp, Mus musculus
gcctcgaatgacacccatgaaccgc

SEQ ID NO: 310106 - DNA, 25 bp, Mus musculus
gcctcgacagcctgatgggggatga

SEQ ID NO: 310107 - DNA, 25 bp, Mus musculus
gcctcgacagcctgattggagatag

SEQ ID NO: 310108 - DNA, 25 bp, Mus musculus
gcctcgactgaccctgactgcacca

SEQ ID NO: 310109 - DNA, 25 bp, Mus musculus
gcctcgaggatgaagaaagaagcat

SEQ ID NO: 310110 - DNA, 25 bp, Mus musculus
gcctcgatgccctggtcgtgtgccc

SEQ ID NO: 310111 - DNA, 25 bp, Mus musculus
gcctcgcaaactatttcaatggaag

SEQ ID NO: 310112 - DNA, 25 bp, Mus musculus
gcctcgcaaagagttataccctgac

SEQ ID NO: 310113 - DNA, 25 bp, Mus musculus
gcctcgcaccggaagaaaagatgtg

SEQ ID NO: 310114 - DNA, 25 bp, Mus musculus
gcctcgccaagagttcctccagcag

SEQ ID NO: 310115 - DNA, 25 bp, Mus musculus
gcctcgccaaggtatgtggaccgag

SEQ ID NO: 310116 - DNA, 25 bp, Mus musculus
gcctcgccaccagtcaactcctagt

SEQ ID NO: 310117 - DNA, 25 bp, Mus musculus
gcctcgccaccagtgctgaggatca

SEQ ID NO: 310118 - DNA, 25 bp, Mus musculus
gcctcgccaccagttaaaaagtatg

SEQ ID NO: 310119 - DNA, 25 bp, Mus musculus
gcctcgccagaagccccccagcacc

SEQ ID NO: 310120 - DNA, 25 bp, Mus musculus
gcctcgcccgactatctctcaccta

SEQ ID NO: 310121 - DNA, 25 bp, Mus musculus
gcctcgccgcgcagactgggaagag

SEQ ID NO: 310122 - DNA, 25 bp, Mus musculus
gcctcgccgcgcaggatctaccaag

SEQ ID NO: 310123 - DNA, 25 bp, Mus musculus
gcctcgccgtctggggcctcatttc

SEQ ID NO: 310124 - DNA, 25 bp, Mus musculus
gcctcgccttccaagagttttcttg

SEQ ID NO: 310125 - DNA, 25 bp, Mus musculus
gcctcgcgcagcatgaaagatgtat

SEQ ID NO: 310126 - DNA, 25 bp, Mus musculus
gcctcgcgcagcatgtcaaagaaaa

SEQ ID NO: 310127 - DNA, 25 bp, Mus musculus
gcctcgcgctataaccacttccgat

SEQ ID NO: 310128 - DNA, 25 bp, Mus musculus
gcctcgcggcttgactaaaatgtca

SEQ ID NO: 310129 - DNA, 25 bp, Mus musculus
gcctcgcggggcaggtgtccatgtt

SEQ ID NO: 310130 - DNA, 25 bp, Mus musculus
gcctcgctacgataggaaacagatg

SEQ ID NO: 310131 - DNA, 25 bp, Mus musculus
gcctcgctacgataggaacacatca

SEQ ID NO: 310132 - DNA, 25 bp, Mus musculus
gcctcgctacgatagtggttccatg

SEQ ID NO: 310133 - DNA, 25 bp, Mus musculus
gcctcgctaggatgcttcatttcta

SEQ ID NO: 310134 - DNA, 25 bp, Mus musculus
gcctcgctggccagatcttccttgg

SEQ ID NO: 310135 - DNA, 25 bp, Mus musculus
gcctcgctgggcagatcttccttgg

SEQ ID NO: 310136 - DNA, 25 bp, Mus musculus
gcctcgctggtggctggaggggtag

SEQ ID NO: 310137 - DNA, 25 bp, Mus musculus
gcctcggagacgcggctcctgtgcg

SEQ ID NO: 310138 - DNA, 25 bp, Mus musculus
gcctcggagcagagcgatcagcagc

SEQ ID NO: 310139 - DNA, 25 bp, Mus musculus
gcctcggcatgttcgtgtggacaaa

SEQ ID NO: 310140 - DNA, 25 bp, Mus musculus
gcctcggcccagcacagccccccag

SEQ ID NO: 310141 - DNA, 25 bp, Mus musculus
gcctcggccgtggtaagggaacaat

SEQ ID NO: 310142 - DNA, 25 bp, Mus musculus
gcctcggcgcggatgtggttagaac

SEQ ID NO: 310143 - DNA, 25 bp, Mus musculus
gcctcggcgtacaggagaatgactc

SEQ ID NO: 310144 - DNA, 25 bp, Mus musculus
gcctcgggagagaggaagcgggaga

SEQ ID NO: 310145 - DNA, 25 bp, Mus musculus
gcctcgggtctccagacacagtttc

SEQ ID NO: 310146 - DNA, 25 bp, Mus musculus
gcctcgggtctccaggacacagccc

SEQ ID NO: 310147 - DNA, 25 bp, Mus musculus
gcctcgggtctccaggtgtcctatc

SEQ ID NO: 310148 - DNA, 25 bp, Mus musculus
gcctcggtcagtcaacacagtgttc

SEQ ID NO: 310149 - DNA, 25 bp, Mus musculus
gcctcggtgctggcgccggagtact

SEQ ID NO: 310150 - DNA, 25 bp, Mus musculus
gcctcggttcctgtaaagctggtgg

SEQ ID NO: 310151 - DNA, 25 bp, Mus musculus
gcctcgtacgggtattcccagggcc

SEQ ID NO: 310152 - DNA, 25 bp, Mus musculus
gcctcgtactcagaaacgaaagctg

SEQ ID NO: 310153 - DNA, 25 bp, Mus musculus
gcctcgtcatctgggagggcattga

SEQ ID NO: 310154 - DNA, 25 bp, Mus musculus
gcctcgtcatgcacaccaagatgaa

SEQ ID NO: 310155 - DNA, 25 bp, Mus musculus
gcctcgtgatcaggaagaaaagcaa

SEQ ID NO: 310156 - DNA, 25 bp, Mus musculus
gcctcgtgatcaggaggaatctgag

SEQ ID NO: 310157 - DNA, 25 bp, Mus musculus
gcctcgtgatcagtagcaagattga

SEQ ID NO: 310158 - DNA, 25 bp, Mus musculus
gcctcgtggagttcaggaccttgca

SEQ ID NO: 310159 - DNA, 25 bp, Mus musculus
gcctcgtgtctttggctaattctgg

SEQ ID NO: 310160 - DNA, 25 bp, Mus musculus
gcctcgtgtctttgtaaagtcgggc

SEQ ID NO: 310161 - DNA, 25 bp, Mus musculus
gcctcgttcactccaatgatggcac

SEQ ID NO: 310162 - DNA, 25 bp, Mus musculus
gcctcgttctctgaaccttcagctg

SEQ ID NO: 310163 - DNA, 25 bp, Mus musculus
gcctctaaaaacccacaactccttg

SEQ ID NO: 310164 - DNA, 25 bp, Mus musculus
gcctctaaaaagccacaactccttg

SEQ ID NO: 310165 - DNA, 25 bp, Mus musculus
gcctctaaccagatggactatccat

SEQ ID NO: 310166 - DNA, 25 bp, Mus musculus
gcctctaagtgccatcacctgtttg

SEQ ID NO: 310167 - DNA, 25 bp, Mus musculus
gcctctaagttgctgactgtccagg

SEQ ID NO: 310168 - DNA, 25 bp, Mus musculus
gcctctacagcctgggctgcgcctt

SEQ ID NO: 310169 - DNA, 25 bp, Mus musculus
gcctctaccccctgctgaatgaggc

SEQ ID NO: 310170 - DNA, 25 bp, Mus musculus
gcctctaccggacacacctgctctc

SEQ ID NO: 310171 - DNA, 25 bp, Mus musculus
gcctctacctaacaccccaattcct

SEQ ID NO: 310172 - DNA, 25 bp, Mus musculus
gcctctacctctttctagtaacaat

SEQ ID NO: 310173 - DNA, 25 bp, Mus musculus
gcctctactcaatagtcaaggaggt

SEQ ID NO: 310174 - DNA, 25 bp, Mus musculus
gcctctactccaggatggaggcctc

SEQ ID NO: 310175 - DNA, 25 bp, Mus musculus
gcctctagctgactggtgagcaccg

SEQ ID NO: 310176 - DNA, 25 bp, Mus musculus
gcctctaggaaggtatggcctcaca

SEQ ID NO: 310177 - DNA, 25 bp, Mus musculus
gcctctatcccacagatggtatggt

SEQ ID NO: 310178 - DNA, 25 bp, Mus musculus
gcctctatctggggactgcctccag

SEQ ID NO: 310179 - DNA, 25 bp, Mus musculus
gcctctatctgggttggacctcgag

SEQ ID NO: 310180 - DNA, 25 bp, Mus musculus
gcctctatggcggaacctaaggaag

SEQ ID NO: 310181 - DNA, 25 bp, Mus musculus
gcctctatggcggatcctgtctcta

SEQ ID NO: 310182 - DNA, 25 bp, Mus musculus
gcctctatgggtcgcgggtctactc

SEQ ID NO: 310183 - DNA, 25 bp, Mus musculus
gcctctatgggtcggttccgggagc

SEQ ID NO: 310184 - DNA, 25 bp, Mus musculus
gcctctcaaaggacagtgaactttt

SEQ ID NO: 310185 - DNA, 25 bp, Mus musculus
gcctctcaacgattcccacgcctac

SEQ ID NO: 310186 - DNA, 25 bp, Mus musculus
gcctctcaactggtgtggtgtggat

SEQ ID NO: 310187 - DNA, 25 bp, Mus musculus
gcctctcaatgggtgttcaggataa

SEQ ID NO: 310188 - DNA, 25 bp, Mus musculus
gcctctcacagaatacatccagcca

SEQ ID NO: 310189 - DNA, 25 bp, Mus musculus
gcctctcagaagacaaaagagagca

SEQ ID NO: 310190 - DNA, 25 bp, Mus musculus
gcctctcagaagcatcactatttca

SEQ ID NO: 310191 - DNA, 25 bp, Mus musculus
gcctctcagagataaaatcaaagac

SEQ ID NO: 310192 - DNA, 25 bp, Mus musculus
gcctctcatctccgacttcttcgcc

SEQ ID NO: 310193 - DNA, 25 bp, Mus musculus
gcctctcatggtcgctgtcttaaat

SEQ ID NO: 310194 - DNA, 25 bp, Mus musculus
gcctctccaaggtggcccagctgcc

SEQ ID NO: 310195 - DNA, 25 bp, Mus musculus
gcctctccagggccctgacgtcaag

SEQ ID NO: 310196 - DNA, 25 bp, Mus musculus
gcctctccaggggaaaataagtcac

SEQ ID NO: 310197 - DNA, 25 bp, Mus musculus
gcctctccagttcctttgtccctgt

SEQ ID NO: 310198 - DNA, 25 bp, Mus musculus
gcctctccgtacagatcttcgtccc

SEQ ID NO: 310199 - DNA, 25 bp, Mus musculus
gcctctccgtacagcgccatggcta

SEQ ID NO: 310200 - DNA, 25 bp, Mus musculus
gcctctcctctatgctcctttcctg

SEQ ID NO: 310201 - DNA, 25 bp, Mus musculus
gcctctcctctatggctcagcactg

SEQ ID NO: 310202 - DNA, 25 bp, Mus musculus
gcctctcgcagagttcgaggagggg

SEQ ID NO: 310203 - DNA, 25 bp, Mus musculus
gcctctcggggctgctcttctcggg

SEQ ID NO: 310204 - DNA, 25 bp, Mus musculus
gcctctctcggcatcctacatcaat

SEQ ID NO: 310205 - DNA, 25 bp, Mus musculus
gcctctctgagcagtggtagtgtga

SEQ ID NO: 310206 - DNA, 25 bp, Mus musculus
gcctctctggaactgaaaagctcca

SEQ ID NO: 310207 - DNA, 25 bp, Mus musculus
gcctctctggagtccatgtatctgt

SEQ ID NO: 310208 - DNA, 25 bp, Mus musculus
gcctctctgtgcgcggcaatacaga

SEQ ID NO: 310209 - DNA, 25 bp, Mus musculus
gcctctcttggaattaaaggacatt

SEQ ID NO: 310210 - DNA, 25 bp, Mus musculus
gcctctgaaacccgctgtacgctgg

SEQ ID NO: 310211 - DNA, 25 bp, Mus musculus
gcctctgaaacccggtagtgcaact

SEQ ID NO: 310212 - DNA, 25 bp, Mus musculus
gcctctgaactggaaatcccacctg

SEQ ID NO: 310213 - DNA, 25 bp, Mus musculus
gcctctgaagcaggcagcacccgag

SEQ ID NO: 310214 - DNA, 25 bp, Mus musculus
gcctctgacggggcatatctgctgt

SEQ ID NO: 310215 - DNA, 25 bp, Mus musculus
gcctctgactacccgtgatacttaa

SEQ ID NO: 310216 - DNA, 25 bp, Mus musculus
gcctctgactgtccctggccacatc

SEQ ID NO: 310217 - DNA, 25 bp, Mus musculus
gcctctgagaaggagcgcagaccct

SEQ ID NO: 310218 - DNA, 25 bp, Mus musculus
gcctctgagaaggtctgcgaatgga

SEQ ID NO: 310219 - DNA, 25 bp, Mus musculus
gcctctgaggaaagatataaaaact

SEQ ID NO: 310220 - DNA, 25 bp, Mus musculus
gcctctgaggccttcttgctaagga

SEQ ID NO: 310221 - DNA, 25 bp, Mus musculus
gcctctgagggaactacatgaatga

SEQ ID NO: 310222 - DNA, 25 bp, Mus musculus
gcctctgataaaggcaactgttgga

SEQ ID NO: 310223 - DNA, 25 bp, Mus musculus
gcctctgatgctgagcccaggaagt

SEQ ID NO: 310224 - DNA, 25 bp, Mus musculus
gcctctgatgctggctggggacatc

SEQ ID NO: 310225 - DNA, 25 bp, Mus musculus
gcctctgcagatgcctgagcactct

SEQ ID NO: 310226 - DNA, 25 bp, Mus musculus
gcctctgcagcactgccagagttga

SEQ ID NO: 310227 - DNA, 25 bp, Mus musculus
gcctctgcaggtggcgacctgcaca

SEQ ID NO: 310228 - DNA, 25 bp, Mus musculus
gcctctgcccacagagagcccagac

SEQ ID NO: 310229 - DNA, 25 bp, Mus musculus
gcctctgcccaccaggcttggaagg

SEQ ID NO: 310230 - DNA, 25 bp, Mus musculus
gcctctgccccccaattattaagaa

SEQ ID NO: 310231 - DNA, 25 bp, Mus musculus
gcctctgccctgaaggctggataat

SEQ ID NO: 310232 - DNA, 25 bp, Mus musculus
gcctctgccttcctggattcaccgg

SEQ ID NO: 310233 - DNA, 25 bp, Mus musculus
gcctctgctcagcctgaaggacttc

SEQ ID NO: 310234 - DNA, 25 bp, Mus musculus
gcctctgctgtgctgaaatggaggc

SEQ ID NO: 310235 - DNA, 25 bp, Mus musculus
gcctctgctgttcagccagggacag

SEQ ID NO: 310236 - DNA, 25 bp, Mus musculus
gcctctgcttgtaaggcatctcaga

SEQ ID NO: 310237 - DNA, 25 bp, Mus musculus
gcctctggacagcggaggctgctga

SEQ ID NO: 310238 - DNA, 25 bp, Mus musculus
gcctctggagaccggtggaggatct

SEQ ID NO: 310239 - DNA, 25 bp, Mus musculus
gcctctggagccgattcaaaaggtg

SEQ ID NO: 310240 - DNA, 25 bp, Mus musculus
gcctctggaggaaagagccagactt

SEQ ID NO: 310241 - DNA, 25 bp, Mus musculus
gcctctggaggctccatctccattc

SEQ ID NO: 310242 - DNA, 25 bp, Mus musculus
gcctctggatttatcactttttaat

SEQ ID NO: 310243 - DNA, 25 bp, Mus musculus
gcctctggcagaaggttctctctct

SEQ ID NO: 310244 - DNA, 25 bp, Mus musculus
gcctctggcagagcctgccccagtt

SEQ ID NO: 310245 - DNA, 25 bp, Mus musculus
gcctctggcctcaggtaaccatgga

SEQ ID NO: 310246 - DNA, 25 bp, Mus musculus
gcctctggcgggatggactcctgtc

SEQ ID NO: 310247 - DNA, 25 bp, Mus musculus
gcctctggcggggctgcagtatggc

SEQ ID NO: 310248 - DNA, 25 bp, Mus musculus
gcctctgtacacgtccggatagctt

SEQ ID NO: 310249 - DNA, 25 bp, Mus musculus
gcctctgtcccccaggtttcacggg

SEQ ID NO: 310250 - DNA, 25 bp, Mus musculus
gcctctgtcctcataccagaatctg

SEQ ID NO: 310251 - DNA, 25 bp, Mus musculus
gcctctgtctgggcggcaatctgct

SEQ ID NO: 310252 - DNA, 25 bp, Mus musculus
gcctctgtcttaaaggccgttgatg

SEQ ID NO: 310253 - DNA, 25 bp, Mus musculus
gcctctgtcttaaaggtatctcatt

SEQ ID NO: 310254 - DNA, 25 bp, Mus musculus
gcctctgtgagctagagaagatcca

SEQ ID NO: 310255 - DNA, 25 bp, Mus musculus
gcctctgtgagctaggaaccggagt

SEQ ID NO: 310256 - DNA, 25 bp, Mus musculus
gcctctgtggatgaggtcactactt

SEQ ID NO: 310257 - DNA, 25 bp, Mus musculus
gcctctgtggttgagctagaaaatt

SEQ ID NO: 310258 - DNA, 25 bp, Mus musculus
gcctctgtgtctcactaatgctcat

SEQ ID NO: 310259 - DNA, 25 bp, Mus musculus
gcctctgtgtctcgtttaaaaagct

SEQ ID NO: 310260 - DNA, 25 bp, Mus musculus
gcctctgtgtggagaaatctgacgt

SEQ ID NO: 310261 - DNA, 25 bp, Mus musculus
gcctctgtgtggatgccttcaaagg

SEQ ID NO: 310262 - DNA, 25 bp, Mus musculus
gcctctgtgtgggtactatcttggc

SEQ ID NO: 310263 - DNA, 25 bp, Mus musculus
gcctctgttaccgtaaagccttggg

SEQ ID NO: 310264 - DNA, 25 bp, Mus musculus
gcctcttaaagaaaaatcaagaact

SEQ ID NO: 310265 - DNA, 25 bp, Mus musculus
gcctcttaagggagatcgccacgac

SEQ ID NO: 310266 - DNA, 25 bp, Mus musculus
gcctcttaaggtcattttcttggtg

SEQ ID NO: 310267 - DNA, 25 bp, Mus musculus
gcctcttacgtgtgttctcagggga

SEQ ID NO: 310268 - DNA, 25 bp, Mus musculus
gcctcttatgaaggtctacggcttg

SEQ ID NO: 310269 - DNA, 25 bp, Mus musculus
gcctcttcaagccctctccaggcca

SEQ ID NO: 310270 - DNA, 25 bp, Mus musculus
gcctcttcacaattacgctcgattt

SEQ ID NO: 310271 - DNA, 25 bp, Mus musculus
gcctcttcattgctggctttgcggt

SEQ ID NO: 310272 - DNA, 25 bp, Mus musculus
gcctcttccaaggaatttgaaatca

SEQ ID NO: 310273 - DNA, 25 bp, Mus musculus
gcctcttccaaggagtgccggtgcg

SEQ ID NO: 310274 - DNA, 25 bp, Mus musculus
gcctcttcgaacggcacccaccagg

SEQ ID NO: 310275 - DNA, 25 bp, Mus musculus
gcctcttcgcttggggtgcacacag

SEQ ID NO: 310276 - DNA, 25 bp, Mus musculus
gcctcttctagtctcaacagatcac

SEQ ID NO: 310277 - DNA, 25 bp, Mus musculus
gcctcttctctgagtttctcagtgt

SEQ ID NO: 310278 - DNA, 25 bp, Mus musculus
gcctcttctctgtgcctttcttcct

SEQ ID NO: 310279 - DNA, 25 bp, Mus musculus
gcctcttgaagaagtggatgacctg

SEQ ID NO: 310280 - DNA, 25 bp, Mus musculus
gcctcttgaagaagtttcctgtggc

SEQ ID NO: 310281 - DNA, 25 bp, Mus musculus
gcctcttgaagtcagtttcagagga

SEQ ID NO: 310282 - DNA, 25 bp, Mus musculus
gcctcttgccatgctggccgaggcg

SEQ ID NO: 310283 - DNA, 25 bp, Mus musculus
gcctcttgcctgctagcagccacat

SEQ ID NO: 310284 - DNA, 25 bp, Mus musculus
gcctcttgctcagccacagaacatc

SEQ ID NO: 310285 - DNA, 25 bp, Mus musculus
gcctcttgctcagggtcctcttaaa

SEQ ID NO: 310286 - DNA, 25 bp, Mus musculus
gcctcttgggaataggccctttgga

SEQ ID NO: 310287 - DNA, 25 bp, Mus musculus
gcctcttggtccttgaggatttcaa

SEQ ID NO: 310288 - DNA, 25 bp, Mus musculus
gcctcttggtccttgttccaccctc

SEQ ID NO: 310289 - DNA, 25 bp, Mus musculus
gcctctttaaaagaacagatgcaca

SEQ ID NO: 310290 - DNA, 25 bp, Mus musculus
gcctctttaaattgaaaatacagaa

SEQ ID NO: 310291 - DNA, 25 bp, Mus musculus
gcctctttggaggctcatccaaaat

SEQ ID NO: 310292 - DNA, 25 bp, Mus musculus
gcctctttggctgctgggaacgctt

SEQ ID NO: 310293 - DNA, 25 bp, Mus musculus
gcctcttttgctatgctcagcacat

SEQ ID NO: 310294 - DNA, 25 bp, Mus musculus
gcctgaaaaagaggcggcgggccag

SEQ ID NO: 310295 - DNA, 25 bp, Mus musculus
gcctgaaaaaggtactgttggatgt

SEQ ID NO: 310296 - DNA, 25 bp, Mus musculus
gcctgaaaaatacattgccctagat

SEQ ID NO: 310297 - DNA, 25 bp, Mus musculus
gcctgaaaagagattcatctgtttg

SEQ ID NO: 310298 - DNA, 25 bp, Mus musculus
gcctgaaaagagatttcgatagtga

SEQ ID NO: 310299 - DNA, 25 bp, Mus musculus
gcctgaaaagatcccaccaaatatt

SEQ ID NO: 310300 - DNA, 25 bp, Mus musculus
gcctgaaagcatccagtttgtgctc

SEQ ID NO: 310301 - DNA, 25 bp, Mus musculus
gcctgaacaagatgcactcccatcc

SEQ ID NO: 310302 - DNA, 25 bp, Mus musculus
gcctgaacaagctcagccctgggga

SEQ ID NO: 310303 - DNA, 25 bp, Mus musculus
gcctgaacaaggctcttcctcctgg

SEQ ID NO: 310304 - DNA, 25 bp, Mus musculus
gcctgaacagaaaggtcaaatcatt

SEQ ID NO: 310305 - DNA, 25 bp, Mus musculus
gcctgaacagagagctgaaattatc

SEQ ID NO: 310306 - DNA, 25 bp, Mus musculus
gcctgaaccgcccgttgaccgagat

SEQ ID NO: 310307 - DNA, 25 bp, Mus musculus
gcctgaacctggctgcttttgctgc

SEQ ID NO: 310308 - DNA, 25 bp, Mus musculus
gcctgaacggctccaggactgggat

SEQ ID NO: 310309 - DNA, 25 bp, Mus musculus
gcctgaactcgcaggcaccttttgt

SEQ ID NO: 310310 - DNA, 25 bp, Mus musculus
gcctgaactcgcaggttctggctgg

SEQ ID NO: 310311 - DNA, 25 bp, Mus musculus
gcctgaagaagatgactttgaaaaa

SEQ ID NO: 310312 - DNA, 25 bp, Mus musculus
gcctgaagaagatggattatgacaa

SEQ ID NO: 310313 - DNA, 25 bp, Mus musculus
gcctgaagaaggagctgcgggagct

SEQ ID NO: 310314 - DNA, 25 bp, Mus musculus
gcctgaagacctcccataacacgac

SEQ ID NO: 310315 - DNA, 25 bp, Mus musculus
gcctgaagagaagccttccagcacc

SEQ ID NO: 310316 - DNA, 25 bp, Mus musculus
gcctgaagaggacatggatgacact

SEQ ID NO: 310317 - DNA, 25 bp, Mus musculus
gcctgaagcaaggtattggttttcg

SEQ ID NO: 310318 - DNA, 25 bp, Mus musculus
gcctgaagctaagctcccttcgaac

SEQ ID NO: 310319 - DNA, 25 bp, Mus musculus
gcctgaaggacctccacaggagtgt

SEQ ID NO: 310320 - DNA, 25 bp, Mus musculus
gcctgaagggaatactaagatgctt

SEQ ID NO: 310321 - DNA, 25 bp, Mus musculus
gcctgaagtgtcagcttgatactca

SEQ ID NO: 310322 - DNA, 25 bp, Mus musculus
gcctgaagtgtcaggcgtttgcaca

SEQ ID NO: 310323 - DNA, 25 bp, Mus musculus
gcctgaatcgcccaagagcctacag

SEQ ID NO: 310324 - DNA, 25 bp, Mus musculus
gcctgaatctcctggagaaagaaac

SEQ ID NO: 310325 - DNA, 25 bp, Mus musculus
gcctgacaatgcaagtgcaccttcc

SEQ ID NO: 310326 - DNA, 25 bp, Mus musculus
gcctgacaccgatggcagactttct

SEQ ID NO: 310327 - DNA, 25 bp, Mus musculus
gcctgacactgactctcatggtacc

SEQ ID NO: 310328 - DNA, 25 bp, Mus musculus
gcctgacagaaggtctccgggcaca

SEQ ID NO: 310329 - DNA, 25 bp, Mus musculus
gcctgacagactgagccccttaggt

SEQ ID NO: 310330 - DNA, 25 bp, Mus musculus
gcctgacagctggctgaagggagag

SEQ ID NO: 310331 - DNA, 25 bp, Mus musculus
gcctgacagtgcagggtcaccatca

SEQ ID NO: 310332 - DNA, 25 bp, Mus musculus
gcctgacatgggattctctccaacg

SEQ ID NO: 310333 - DNA, 25 bp, Mus musculus
gcctgacatgggcctccttgaatct

SEQ ID NO: 310334 - DNA, 25 bp, Mus musculus
gcctgacattatcctggatgacttg

SEQ ID NO: 310335 - DNA, 25 bp, Mus musculus
gcctgaccaaggagcaggcggagct

SEQ ID NO: 310336 - DNA, 25 bp, Mus musculus
gcctgaccatcaagctgacccctgc

SEQ ID NO: 310337 - DNA, 25 bp, Mus musculus
gcctgacccagaggtctttgaccca

SEQ ID NO: 310338 - DNA, 25 bp, Mus musculus
gcctgaccccagaagtagaaatcca

SEQ ID NO: 310339 - DNA, 25 bp, Mus musculus
gcctgaccccagcccagccagtggt

SEQ ID NO: 310340 - DNA, 25 bp, Mus musculus
gcctgaccccgaagcttgatggtgt

SEQ ID NO: 310341 - DNA, 25 bp, Mus musculus
gcctgaccccgaagttgatgaaaca

SEQ ID NO: 310342 - DNA, 25 bp, Mus musculus
gcctgacctgcgtgcatcagagtct

SEQ ID NO: 310343 - DNA, 25 bp, Mus musculus
gcctgaccttataaacttcagtgcc

SEQ ID NO: 310344 - DNA, 25 bp, Mus musculus
gcctgacgaggggtctccgggcaca

SEQ ID NO: 310345 - DNA, 25 bp, Mus musculus
gcctgacgcctcaagcacttgtctc

SEQ ID NO: 310346 - DNA, 25 bp, Mus musculus
gcctgacgcctcaagggttgagaca

SEQ ID NO: 310347 - DNA, 25 bp, Mus musculus
gcctgacggagcaggcctgtctcgt

SEQ ID NO: 310348 - DNA, 25 bp, Mus musculus
gcctgactcagaacaggtgagaact

SEQ ID NO: 310349 - DNA, 25 bp, Mus musculus
gcctgactcagactggttgggcgct

SEQ ID NO: 310350 - DNA, 25 bp, Mus musculus
gcctgactcaggcaggccagctttc

SEQ ID NO: 310351 - DNA, 25 bp, Mus musculus
gcctgactcaggtaggcctgtcaac

SEQ ID NO: 310352 - DNA, 25 bp, Mus musculus
gcctgactcaggtctgctggcagga

SEQ ID NO: 310353 - DNA, 25 bp, Mus musculus
gcctgactggttgtgtcaccaacat

SEQ ID NO: 310354 - DNA, 25 bp, Mus musculus
gcctgacttcccaggagctgatgca

SEQ ID NO: 310355 - DNA, 25 bp, Mus musculus
gcctgactttttcgctgccttgggg

SEQ ID NO: 310356 - DNA, 25 bp, Mus musculus
gcctgactttttcggtgcctcctga

SEQ ID NO: 310357 - DNA, 25 bp, Mus musculus
gcctgagaagctcaaacaggccgag

SEQ ID NO: 310358 - DNA, 25 bp, Mus musculus
gcctgagacccaacagaaaaatggc

SEQ ID NO: 310359 - DNA, 25 bp, Mus musculus
gcctgagacttacagattgccaaaa

SEQ ID NO: 310360 - DNA, 25 bp, Mus musculus
gcctgagaggcgtccccattcctgg

SEQ ID NO: 310361 - DNA, 25 bp, Mus musculus
gcctgagagtgaaataaagaaagat

SEQ ID NO: 310362 - DNA, 25 bp, Mus musculus
gcctgagagtgaatgggcaagagaa

SEQ ID NO: 310363 - DNA, 25 bp, Mus musculus
gcctgagagtggcaggaagaagtcc

SEQ ID NO: 310364 - DNA, 25 bp, Mus musculus
gcctgagagtggtaatcttttggta

SEQ ID NO: 310365 - DNA, 25 bp, Mus musculus
gcctgagcaaggaggacttcgtgga

SEQ ID NO: 310366 - DNA, 25 bp, Mus musculus
gcctgagcaaggagtggctccgcgg

SEQ ID NO: 310367 - DNA, 25 bp, Mus musculus
gcctgagcatccagggtgagtgtcc

SEQ ID NO: 310368 - DNA, 25 bp, Mus musculus
gcctgagcattggaaacaagctccc

SEQ ID NO: 310369 - DNA, 25 bp, Mus musculus
gcctgagcctccagtgttgagtgga

SEQ ID NO: 310370 - DNA, 25 bp, Mus musculus
gcctgagcctcgttccagggtcaca

SEQ ID NO: 310371 - DNA, 25 bp, Mus musculus
gcctgagcgcattgaggaaagcggg

SEQ ID NO: 310372 - DNA, 25 bp, Mus musculus
gcctgagctaggattggtagcttat

SEQ ID NO: 310373 - DNA, 25 bp, Mus musculus
gcctgaggaatagacttttcactga

SEQ ID NO: 310374 - DNA, 25 bp, Mus musculus
gcctgaggaatagccctggctttcc

SEQ ID NO: 310375 - DNA, 25 bp, Mus musculus
gcctgaggaatagcttctggaattt

SEQ ID NO: 310376 - DNA, 25 bp, Mus musculus
gcctgaggagacgcagaggcagggc

SEQ ID NO: 310377 - DNA, 25 bp, Mus musculus
gcctgaggagcttttcatgcagatt

SEQ ID NO: 310378 - DNA, 25 bp, Mus musculus
gcctgaggaggattcagaatttcct

SEQ ID NO: 310379 - DNA, 25 bp, Mus musculus
gcctgaggagtcccggcgtggagcg

SEQ ID NO: 310380 - DNA, 25 bp, Mus musculus
gcctgaggagtcccggctcatcact

SEQ ID NO: 310381 - DNA, 25 bp, Mus musculus
gcctgaggatcttcgggtatttggc

SEQ ID NO: 310382 - DNA, 25 bp, Mus musculus
gcctgaggtacaaggtgaactgtgg

SEQ ID NO: 310383 - DNA, 25 bp, Mus musculus
gcctgaggtccagatgggctcctca

SEQ ID NO: 310384 - DNA, 25 bp, Mus musculus
gcctgaggtccaggaactgttaaga

SEQ ID NO: 310385 - DNA, 25 bp, Mus musculus
gcctgagtacagacgtgacttgtag

SEQ ID NO: 310386 - DNA, 25 bp, Mus musculus
gcctgagtacgaggaggaaatctcc

SEQ ID NO: 310387 - DNA, 25 bp, Mus musculus
gcctgagtgactctgccgacccctt

SEQ ID NO: 310388 - DNA, 25 bp, Mus musculus
gcctgagtgactctgctcttctaga

SEQ ID NO: 310389 - DNA, 25 bp, Mus musculus
gcctgagtgaggatcatggctgctg

SEQ ID NO: 310390 - DNA, 25 bp, Mus musculus
gcctgagtgccagtgcccgccccat

SEQ ID NO: 310391 - DNA, 25 bp, Mus musculus
gcctgagtgcgcaagcaaaagaaag

SEQ ID NO: 310392 - DNA, 25 bp, Mus musculus
gcctgagtgcgcgtggaacctaggg

SEQ ID NO: 310393 - DNA, 25 bp, Mus musculus
gcctgagttcacagagcatgcaacc

SEQ ID NO: 310394 - DNA, 25 bp, Mus musculus
gcctgatcaagatgacagcatggag

SEQ ID NO: 310395 - DNA, 25 bp, Mus musculus
gcctgatcaagttctcctactcagc

SEQ ID NO: 310396 - DNA, 25 bp, Mus musculus
gcctgatctccaactaggcggccgt

SEQ ID NO: 310397 - DNA, 25 bp, Mus musculus
gcctgatctggaagtggctcaggaa

SEQ ID NO: 310398 - DNA, 25 bp, Mus musculus
gcctgatctttaggaggagcaggct

SEQ ID NO: 310399 - DNA, 25 bp, Mus musculus
gcctgatgaaaatgcctttgagtaa

SEQ ID NO: 310400 - DNA, 25 bp, Mus musculus
gcctgatgaaagcatctgtggcaag

SEQ ID NO: 310401 - DNA, 25 bp, Mus musculus
gcctgatgaatgaggtgtgtacttt

SEQ ID NO: 310402 - DNA, 25 bp, Mus musculus
gcctgatgcattcacagggtgatct

SEQ ID NO: 310403 - DNA, 25 bp, Mus musculus
gcctgatgcctccgctggaaaccat

SEQ ID NO: 310404 - DNA, 25 bp, Mus musculus
gcctgatgctgcctcacacaagaaa

SEQ ID NO: 310405 - DNA, 25 bp, Mus musculus
gcctgatgctggccagccggtttaa

SEQ ID NO: 310406 - DNA, 25 bp, Mus musculus
gcctgatgggcaggcaccaggagag

SEQ ID NO: 310407 - DNA, 25 bp, Mus musculus
gcctgatgtatgaggcttcctgcgg

SEQ ID NO: 310408 - DNA, 25 bp, Mus musculus
gcctgatgtgaggctcctcatagtc

SEQ ID NO: 310409 - DNA, 25 bp, Mus musculus
gcctgcaaaaggaggtgttcctgct

SEQ ID NO: 310410 - DNA, 25 bp, Mus musculus
gcctgcaacctgccgaataaggcca

SEQ ID NO: 310411 - DNA, 25 bp, Mus musculus
gcctgcaacctgccgagaaaccctt

SEQ ID NO: 310412 - DNA, 25 bp, Mus musculus
gcctgcaagccaggccattccccag

SEQ ID NO: 310413 - DNA, 25 bp, Mus musculus
gcctgcaagccaggtggagcagcca

SEQ ID NO: 310414 - DNA, 25 bp, Mus musculus
gcctgcaagccaggttccttaaaag

SEQ ID NO: 310415 - DNA, 25 bp, Mus musculus
gcctgcaagctgcaggttgcttcta

SEQ ID NO: 310416 - DNA, 25 bp, Mus musculus
gcctgcaagttataccacatcacag

SEQ ID NO: 310417 - DNA, 25 bp, Mus musculus
gcctgcaccagagcaatgttcttct

SEQ ID NO: 310418 - DNA, 25 bp, Mus musculus
gcctgcacgcaaggtggccgaaggc

SEQ ID NO: 310419 - DNA, 25 bp, Mus musculus
gcctgcacgtggaccacagtgaact

SEQ ID NO: 310420 - DNA, 25 bp, Mus musculus
gcctgcacgtgggtccctggaggct

SEQ ID NO: 310421 - DNA, 25 bp, Mus musculus
gcctgcactggcacacaggcatttg

SEQ ID NO: 310422 - DNA, 25 bp, Mus musculus
gcctgcactttacaggtggctttgc

SEQ ID NO: 310423 - DNA, 25 bp, Mus musculus
gcctgcagaatcggccagcgcccga

SEQ ID NO: 310424 - DNA, 25 bp, Mus musculus
gcctgcagaatctggaggctggtga

SEQ ID NO: 310425 - DNA, 25 bp, Mus musculus
gcctgcagacctctgacaaggatga

SEQ ID NO: 310426 - DNA, 25 bp, Mus musculus
gcctgcagacctctgagcgaacatc

SEQ ID NO: 310427 - DNA, 25 bp, Mus musculus
gcctgcagagaggaaaaccaaagaa

SEQ ID NO: 310428 - DNA, 25 bp, Mus musculus
gcctgcagagccagagccagctgac

SEQ ID NO: 310429 - DNA, 25 bp, Mus musculus
gcctgcagagccagagtctgcagac

SEQ ID NO: 310430 - DNA, 25 bp, Mus musculus
gcctgcagaggcagatataatggaa

SEQ ID NO: 310431 - DNA, 25 bp, Mus musculus
gcctgcagaggctgatataatggaa

SEQ ID NO: 310432 - DNA, 25 bp, Mus musculus
gcctgcagcaggaattggggaattc

SEQ ID NO: 310433 - DNA, 25 bp, Mus musculus
gcctgcagccacgatggacagtctg

SEQ ID NO: 310434 - DNA, 25 bp, Mus musculus
gcctgcagcctgtggtatcctgtgg

SEQ ID NO: 310435 - DNA, 25 bp, Mus musculus
gcctgcaggaaccaggttggtctgg

SEQ ID NO: 310436 - DNA, 25 bp, Mus musculus
gcctgcaggaaccagttggaaggac

SEQ ID NO: 310437 - DNA, 25 bp, Mus musculus
gcctgcaggcctttgagttgtccag

SEQ ID NO: 310438 - DNA, 25 bp, Mus musculus
gcctgcaggcctttgctggagcatg

SEQ ID NO: 310439 - DNA, 25 bp, Mus musculus
gcctgcaggcctttgggaaggaatg

SEQ ID NO: 310440 - DNA, 25 bp, Mus musculus
gcctgcagtcaaaatcaagcactgc

SEQ ID NO: 310441 - DNA, 25 bp, Mus musculus
gcctgcagtcaaatggatctggctt

SEQ ID NO: 310442 - DNA, 25 bp, Mus musculus
gcctgcagtccagagtggaccagat

SEQ ID NO: 310443 - DNA, 25 bp, Mus musculus
gcctgcagtccaggatagatatgat

SEQ ID NO: 310444 - DNA, 25 bp, Mus musculus
gcctgcagtccaggtcctgcgactg

SEQ ID NO: 310445 - DNA, 25 bp, Mus musculus
gcctgcagtggatacattgttgcaa

SEQ ID NO: 310446 - DNA, 25 bp, Mus musculus
gcctgcagtgtgcaatggtgctcca

SEQ ID NO: 310447 - DNA, 25 bp, Mus musculus
gcctgcagttccacaggctcaggga

SEQ ID NO: 310448 - DNA, 25 bp, Mus musculus
gcctgcagttctgtttctctctgta

SEQ ID NO: 310449 - DNA, 25 bp, Mus musculus
gcctgcagttcttccacttgatccc

SEQ ID NO: 310450 - DNA, 25 bp, Mus musculus
gcctgcataaggctgcggagaaggg

SEQ ID NO: 310451 - DNA, 25 bp, Mus musculus
gcctgcataaggttataagtacatg

SEQ ID NO: 310452 - DNA, 25 bp, Mus musculus
gcctgcataagtgagcaactgttca

SEQ ID NO: 310453 - DNA, 25 bp, Mus musculus
gcctgcatcaggtcctagaccaaag

SEQ ID NO: 310454 - DNA, 25 bp, Mus musculus
gcctgcatcatggtatttgatgtcc

SEQ ID NO: 310455 - DNA, 25 bp, Mus musculus
gcctgcatcctcaagaggaagcccg

SEQ ID NO: 310456 - DNA, 25 bp, Mus musculus
gcctgcatcgagggagtagaactga

SEQ ID NO: 310457 - DNA, 25 bp, Mus musculus
gcctgcatctacctttgcagatcaa

SEQ ID NO: 310458 - DNA, 25 bp, Mus musculus
gcctgcatctgtctcttaaccttca

SEQ ID NO: 310459 - DNA, 25 bp, Mus musculus
gcctgcattttaaggagtgcatgcg

SEQ ID NO: 310460 - DNA, 25 bp, Mus musculus
gcctgccaactctgaaaagaagaaa

SEQ ID NO: 310461 - DNA, 25 bp, Mus musculus
gcctgccaagaccctaccactgaag

SEQ ID NO: 310462 - DNA, 25 bp, Mus musculus
gcctgccaagtttgatgaagcggag

SEQ ID NO: 310463 - DNA, 25 bp, Mus musculus
gcctgccacaggaagagagctcaga

SEQ ID NO: 310464 - DNA, 25 bp, Mus musculus
gcctgccaccaaaggtcgggtcatt

SEQ ID NO: 310465 - DNA, 25 bp, Mus musculus
gcctgccaggattttaccggaagac

SEQ ID NO: 310466 - DNA, 25 bp, Mus musculus
gcctgccaggctctagttcattgaa

SEQ ID NO: 310467 - DNA, 25 bp, Mus musculus
gcctgccatcctcaggttcaggcag

SEQ ID NO: 310468 - DNA, 25 bp, Mus musculus
gcctgccatgaaatggccctgcgga

SEQ ID NO: 310469 - DNA, 25 bp, Mus musculus
gcctgccatgagacgaaagtaggtg

SEQ ID NO: 310470 - DNA, 25 bp, Mus musculus
gcctgccatgaggaattcttctact

SEQ ID NO: 310471 - DNA, 25 bp, Mus musculus
gcctgccattgctgctctgacagtt

SEQ ID NO: 310472 - DNA, 25 bp, Mus musculus
gcctgccattgctgctgacaaggac

SEQ ID NO: 310473 - DNA, 25 bp, Mus musculus
gcctgccattgctgctgattactct

SEQ ID NO: 310474 - DNA, 25 bp, Mus musculus
gcctgccccactaagattgaagatt

SEQ ID NO: 310475 - DNA, 25 bp, Mus musculus
gcctgccccgaaatcacactgtgga

SEQ ID NO: 310476 - DNA, 25 bp, Mus musculus
gcctgccccgccaaatgcagagaag

SEQ ID NO: 310477 - DNA, 25 bp, Mus musculus
gcctgcccgaaagagtctaaagcgc

SEQ ID NO: 310478 - DNA, 25 bp, Mus musculus
gcctgccctccgttgaaagcaccat

SEQ ID NO: 310479 - DNA, 25 bp, Mus musculus
gcctgccgagcaatgccaagtgagt

SEQ ID NO: 310480 - DNA, 25 bp, Mus musculus
gcctgccgcaacgatgggaagctcc

SEQ ID NO: 310481 - DNA, 25 bp, Mus musculus
gcctgccgcggaatcatggcccaag

SEQ ID NO: 310482 - DNA, 25 bp, Mus musculus
gcctgccgctgggcgtccgacctcc

SEQ ID NO: 310483 - DNA, 25 bp, Mus musculus
gcctgccgctggtaagactttgaac

SEQ ID NO: 310484 - DNA, 25 bp, Mus musculus
gcctgccggctgaggagaaacaaca

SEQ ID NO: 310485 - DNA, 25 bp, Mus musculus
gcctgcctcacaagggactcatgca

SEQ ID NO: 310486 - DNA, 25 bp, Mus musculus
gcctgcctgcagccactacctcctc

SEQ ID NO: 310487 - DNA, 25 bp, Mus musculus
gcctgcctggggaatgaattccaca

SEQ ID NO: 310488 - DNA, 25 bp, Mus musculus
gcctgccttcctatgtagcactcag

SEQ ID NO: 310489 - DNA, 25 bp, Mus musculus
gcctgccttgaggacgggcagaacc

SEQ ID NO: 310490 - DNA, 25 bp, Mus musculus
gcctgccttgaggctggctactgtt

SEQ ID NO: 310491 - DNA, 25 bp, Mus musculus
gcctgcgaagatataaatgagtgtg

SEQ ID NO: 310492 - DNA, 25 bp, Mus musculus
gcctgcgacggccagggtggaacta

SEQ ID NO: 310493 - DNA, 25 bp, Mus musculus
gcctgcgagtcccaggtttgaagag

SEQ ID NO: 310494 - DNA, 25 bp, Mus musculus
gcctgcgagtcccagtgctgtaatt

SEQ ID NO: 310495 - DNA, 25 bp, Mus musculus
gcctgcgcaaaatcacgcttaaagg

SEQ ID NO: 310496 - DNA, 25 bp, Mus musculus
gcctgcgcaggaatcttgggaagct

SEQ ID NO: 310497 - DNA, 25 bp, Mus musculus
gcctgcgcggcggcgggcaccatcc

SEQ ID NO: 310498 - DNA, 25 bp, Mus musculus
gcctgcgcggcggctggtttcctca

SEQ ID NO: 310499 - DNA, 25 bp, Mus musculus
gcctgcgcgtcacgccttggcccat

SEQ ID NO: 310500 - DNA, 25 bp, Mus musculus
gcctgcggaggataagacctctgaa

SEQ ID NO: 310501 - DNA, 25 bp, Mus musculus
gcctgcggccaggaggtggcttaca

SEQ ID NO: 310502 - DNA, 25 bp, Mus musculus
gcctgcgggcgcggattgtgccttc

SEQ ID NO: 310503 - DNA, 25 bp, Mus musculus
gcctgcgggggagttttacagagag

SEQ ID NO: 310504 - DNA, 25 bp, Mus musculus
gcctgcggtagaaaaagcagacgga

SEQ ID NO: 310505 - DNA, 25 bp, Mus musculus
gcctgcggttaagtgagcaaaccaa

SEQ ID NO: 310506 - DNA, 25 bp, Mus musculus
gcctgcgtctgctgcatctctgagc

SEQ ID NO: 310507 - DNA, 25 bp, Mus musculus
gcctgcgtctgctgcggtttctttg

SEQ ID NO: 310508 - DNA, 25 bp, Mus musculus
gcctgcgtctgtttgctttgagcgc

SEQ ID NO: 310509 - DNA, 25 bp, Mus musculus
gcctgcgtgacgtgtcacgatgtct

SEQ ID NO: 310510 - DNA, 25 bp, Mus musculus
gcctgctaacaggtgatatttttga

SEQ ID NO: 310511 - DNA, 25 bp, Mus musculus
gcctgctacaaggtgcagcagaaag

SEQ ID NO: 310512 - DNA, 25 bp, Mus musculus
gcctgctacagaggttgcaagtgtt

SEQ ID NO: 310513 - DNA, 25 bp, Mus musculus
gcctgctacggccgcactcggaacc

SEQ ID NO: 310514 - DNA, 25 bp, Mus musculus
gcctgctataaagaaactacataaa

SEQ ID NO: 310515 - DNA, 25 bp, Mus musculus
gcctgctataaaggacttagaagtc

SEQ ID NO: 310516 - DNA, 25 bp, Mus musculus
gcctgctatgagaaactccccaact

SEQ ID NO: 310517 - DNA, 25 bp, Mus musculus
gcctgctccagacgtcttgagagca

SEQ ID NO: 310518 - DNA, 25 bp, Mus musculus
gcctgctcctcagccctaaagaacc

SEQ ID NO: 310519 - DNA, 25 bp, Mus musculus
gcctgctctacagaaaataaatcat

SEQ ID NO: 310520 - DNA, 25 bp, Mus musculus
gcctgctctctcttgacccaagcca

SEQ ID NO: 310521 - DNA, 25 bp, Mus musculus
gcctgctgaccgacaggctctgcgc

SEQ ID NO: 310522 - DNA, 25 bp, Mus musculus
gcctgctgaccgatttctgcatgaa

SEQ ID NO: 310523 - DNA, 25 bp, Mus musculus
gcctgctgagcaagcgttttggtgc

SEQ ID NO: 310524 - DNA, 25 bp, Mus musculus
gcctgctgaggactggctgccccag

SEQ ID NO: 310525 - DNA, 25 bp, Mus musculus
gcctgctgcaaagcctgcctggggc

SEQ ID NO: 310526 - DNA, 25 bp, Mus musculus
gcctgctgcagctggacccaacatc

SEQ ID NO: 310527 - DNA, 25 bp, Mus musculus
gcctgctgccgatctcagtctctgg

SEQ ID NO: 310528 - DNA, 25 bp, Mus musculus
gcctgctgctcacacacacacacac

SEQ ID NO: 310529 - DNA, 25 bp, Mus musculus
gcctgctgctgatgcgtcgagccct

SEQ ID NO: 310530 - DNA, 25 bp, Mus musculus
gcctgctgctgatggatgtcgtgga

SEQ ID NO: 310531 - DNA, 25 bp, Mus musculus
gcctgctgctgcctccaggtggagg

SEQ ID NO: 310532 - DNA, 25 bp, Mus musculus
gcctgctgctgctgggtgctggaga

SEQ ID NO: 310533 - DNA, 25 bp, Mus musculus
gcctgctgcttctaggtgctggaga

SEQ ID NO: 310534 - DNA, 25 bp, Mus musculus
gcctgctggaaagagattgctctct

SEQ ID NO: 310535 - DNA, 25 bp, Mus musculus
gcctgctggaagtctctaataaaga

SEQ ID NO: 310536 - DNA, 25 bp, Mus musculus
gcctgctggacagcgtgctggaagg

SEQ ID NO: 310537 - DNA, 25 bp, Mus musculus
gcctgctggagctgctattgttgat

SEQ ID NO: 310538 - DNA, 25 bp, Mus musculus
gcctgctggaggtacgaggatgtcg

SEQ ID NO: 310539 - DNA, 25 bp, Mus musculus
gcctgctggcagcctccggacccct

SEQ ID NO: 310540 - DNA, 25 bp, Mus musculus
gcctgctggccaaaataccgactgg

SEQ ID NO: 310541 - DNA, 25 bp, Mus musculus
gcctgctggccaatgacactctgaa

SEQ ID NO: 310542 - DNA, 25 bp, Mus musculus
gcctgctggctggcggggtgccacg

SEQ ID NO: 310543 - DNA, 25 bp, Mus musculus
gcctgctgggaaagtccagatagta

SEQ ID NO: 310544 - DNA, 25 bp, Mus musculus
gcctgcttacaggaagccgagatac

SEQ ID NO: 310545 - DNA, 25 bp, Mus musculus
gcctgcttctcggttcagcatgggc

SEQ ID NO: 310546 - DNA, 25 bp, Mus musculus
gcctgcttctggagggtgatgccca

SEQ ID NO: 310547 - DNA, 25 bp, Mus musculus
gcctgcttgagcgcggcatccagcc

SEQ ID NO: 310548 - DNA, 25 bp, Mus musculus
gcctgctttacagatcgctgtggag

SEQ ID NO: 310549 - DNA, 25 bp, Mus musculus
gcctgctttacagctgacttggagc

SEQ ID NO: 310550 - DNA, 25 bp, Mus musculus
gcctgcttttgccctctccgctccc

SEQ ID NO: 310551 - DNA, 25 bp, Mus musculus
gcctggaaaagctgctaaagctggg

SEQ ID NO: 310552 - DNA, 25 bp, Mus musculus
gcctggaaaatgccatcgagacaca

SEQ ID NO: 310553 - DNA, 25 bp, Mus musculus
gcctggaaaccagggatcctggtag

SEQ ID NO: 310554 - DNA, 25 bp, Mus musculus
gcctggaaagccaggaataagatgt

SEQ ID NO: 310555 - DNA, 25 bp, Mus musculus
gcctggaaagccaggacgttaaagg

SEQ ID NO: 310556 - DNA, 25 bp, Mus musculus
gcctggaaaggtacagttaaagaat

SEQ ID NO: 310557 - DNA, 25 bp, Mus musculus
gcctggaacagctggaagagaagac

SEQ ID NO: 310558 - DNA, 25 bp, Mus musculus
gcctggaacccatcagatcttcccc

SEQ ID NO: 310559 - DNA, 25 bp, Mus musculus
gcctggaagcaagaggttgcagaat

SEQ ID NO: 310560 - DNA, 25 bp, Mus musculus
gcctggaagccctcgatgccaattc

SEQ ID NO: 310561 - DNA, 25 bp, Mus musculus
gcctggaaggctgggttcctgaatg

SEQ ID NO: 310562 - DNA, 25 bp, Mus musculus
gcctggaaggtcccggagcatgcaa

SEQ ID NO: 310563 - DNA, 25 bp, Mus musculus
gcctggaaggtcccggagcatgcat

SEQ ID NO: 310564 - DNA, 25 bp, Mus musculus
gcctggaaggtcccggattgaaaag

SEQ ID NO: 310565 - DNA, 25 bp, Mus musculus
gcctggaatctcaggcaaaacccat

SEQ ID NO: 310566 - DNA, 25 bp, Mus musculus
gcctggaatctgcgacccatacgtg

SEQ ID NO: 310567 - DNA, 25 bp, Mus musculus
gcctggacagaaatatcttgagcct

SEQ ID NO: 310568 - DNA, 25 bp, Mus musculus
gcctggacagaaggtctgtgtgtgg

SEQ ID NO: 310569 - DNA, 25 bp, Mus musculus
gcctggacagcattgccgccaccac

SEQ ID NO: 310570 - DNA, 25 bp, Mus musculus
gcctggacaggggctctttagagca

SEQ ID NO: 310571 - DNA, 25 bp, Mus musculus
gcctggaccaatgggtccaattggt

SEQ ID NO: 310572 - DNA, 25 bp, Mus musculus
gcctggaccactggcagcattagca

SEQ ID NO: 310573 - DNA, 25 bp, Mus musculus
gcctggaccgagagaaagtccctga

SEQ ID NO: 310574 - DNA, 25 bp, Mus musculus
gcctggaccgcagaggagagccccc

SEQ ID NO: 310575 - DNA, 25 bp, Mus musculus
gcctggacctacaacaccacctctg

SEQ ID NO: 310576 - DNA, 25 bp, Mus musculus
gcctggactgatgggaaggaggcca

SEQ ID NO: 310577 - DNA, 25 bp, Mus musculus
gcctggagaaagaggctgccactcg

SEQ ID NO: 310578 - DNA, 25 bp, Mus musculus
gcctggagaaagaggtggaggtgat

SEQ ID NO: 310579 - DNA, 25 bp, Mus musculus
gcctggagaaagagtggaggtgatt

SEQ ID NO: 310580 - DNA, 25 bp, Mus musculus
gcctggagaaggtcccacctgctcg

SEQ ID NO: 310581 - DNA, 25 bp, Mus musculus
gcctggagaatagctcctgtatcag

SEQ ID NO: 310582 - DNA, 25 bp, Mus musculus
gcctggagagaggagcaccgtgaga

SEQ ID NO: 310583 - DNA, 25 bp, Mus musculus
gcctggagaggtccatatcctgtat

SEQ ID NO: 310584 - DNA, 25 bp, Mus musculus
gcctggagcatgagagcgtagcagg

SEQ ID NO: 310585 - DNA, 25 bp, Mus musculus
gcctggagcatgaggagtggtggag

SEQ ID NO: 310586 - DNA, 25 bp, Mus musculus
gcctggagcattgctgaatatgctt

SEQ ID NO: 310587 - DNA, 25 bp, Mus musculus
gcctggagccgaaatcatgtccaca

SEQ ID NO: 310588 - DNA, 25 bp, Mus musculus
gcctggagctgcaggttcggggtga

SEQ ID NO: 310589 - DNA, 25 bp, Mus musculus
gcctggaggagctgaattttctgaa

SEQ ID NO: 310590 - DNA, 25 bp, Mus musculus
gcctggaggagctgttttctgaaga

SEQ ID NO: 310591 - DNA, 25 bp, Mus musculus
gcctggaggatgggctaggaaatca

SEQ ID NO: 310592 - DNA, 25 bp, Mus musculus
gcctggaggtccgagcacaccctga

SEQ ID NO: 310593 - DNA, 25 bp, Mus musculus
gcctggaggtccgaggcgagtgagc

SEQ ID NO: 310594 - DNA, 25 bp, Mus musculus
gcctggagttgcagctgttccatcg

SEQ ID NO: 310595 - DNA, 25 bp, Mus musculus
gcctggatcaggaagcatatattca

SEQ ID NO: 310596 - DNA, 25 bp, Mus musculus
gcctggatctggagcctgatctctc

SEQ ID NO: 310597 - DNA, 25 bp, Mus musculus
gcctggatgagagggtttaccagcc

SEQ ID NO: 310598 - DNA, 25 bp, Mus musculus
gcctggatgatctatacctactcag

SEQ ID NO: 310599 - DNA, 25 bp, Mus musculus
gcctggatgttcaaattggggaatg

SEQ ID NO: 310600 - DNA, 25 bp, Mus musculus
gcctggattaaaaaggatcagttct

SEQ ID NO: 310601 - DNA, 25 bp, Mus musculus
gcctggattaaaaagggccaaatcc

SEQ ID NO: 310602 - DNA, 25 bp, Mus musculus
gcctggattaaaaagtgcctgcacc

SEQ ID NO: 310603 - DNA, 25 bp, Mus musculus
gcctggattcacaggaattcactgt

SEQ ID NO: 310604 - DNA, 25 bp, Mus musculus
gcctggcaagggctactgacagtcg

SEQ ID NO: 310605 - DNA, 25 bp, Mus musculus
gcctggcaatggtctgccaggaact

SEQ ID NO: 310606 - DNA, 25 bp, Mus musculus
gcctggcacaaggtgatagagggaa

SEQ ID NO: 310607 - DNA, 25 bp, Mus musculus
gcctggcacatgccctggtggaacc

SEQ ID NO: 310608 - DNA, 25 bp, Mus musculus
gcctggccaccagccccactctgcc

SEQ ID NO: 310609 - DNA, 25 bp, Mus musculus
gcctggccaccaggataaagcatga

SEQ ID NO: 310610 - DNA, 25 bp, Mus musculus
gcctggccagatcagcatatagggc

SEQ ID NO: 310611 - DNA, 25 bp, Mus musculus
gcctggccagcattcaggagcttct

SEQ ID NO: 310612 - DNA, 25 bp, Mus musculus
gcctggccaggagtgaattggagga

SEQ ID NO: 310613 - DNA, 25 bp, Mus musculus
gcctggccaggatccattttctcaa

SEQ ID NO: 310614 - DNA, 25 bp, Mus musculus
gcctggccagggagaggagatcgag

SEQ ID NO: 310615 - DNA, 25 bp, Mus musculus
gcctggccaggtctggcatattctg

SEQ ID NO: 310616 - DNA, 25 bp, Mus musculus
gcctggccagtgatcttctagagtg

SEQ ID NO: 310617 - DNA, 25 bp, Mus musculus
gcctggccagttcagcatatagggc

SEQ ID NO: 310618 - DNA, 25 bp, Mus musculus
gcctggccataggcttcttccctgg

SEQ ID NO: 310619 - DNA, 25 bp, Mus musculus
gcctggcccacagaattacggcagc

SEQ ID NO: 310620 - DNA, 25 bp, Mus musculus
gcctggcccacagactgacccttgg

SEQ ID NO: 310621 - DNA, 25 bp, Mus musculus
gcctggccccatgggtccttctggt

SEQ ID NO: 310622 - DNA, 25 bp, Mus musculus
gcctggccccccgggcgatggcatc

SEQ ID NO: 310623 - DNA, 25 bp, Mus musculus
gcctggcccctacataaaatggttc

SEQ ID NO: 310624 - DNA, 25 bp, Mus musculus
gcctggcccggaagatgcaagccaa

SEQ ID NO: 310625 - DNA, 25 bp, Mus musculus
gcctggcccggacttagcattcagg

SEQ ID NO: 310626 - DNA, 25 bp, Mus musculus
gcctggcccggtcacagcaaactgg

SEQ ID NO: 310627 - DNA, 25 bp, Mus musculus
gcctggccctaagggcaactccgga

SEQ ID NO: 310628 - DNA, 25 bp, Mus musculus
gcctggccctcacggtatatgctat

SEQ ID NO: 310629 - DNA, 25 bp, Mus musculus
gcctggccctccgggtccttctgga

SEQ ID NO: 310630 - DNA, 25 bp, Mus musculus
gcctggccgctgtagaattggaaaa

SEQ ID NO: 310631 - DNA, 25 bp, Mus musculus
gcctggccgggcaagctgccaaaag

SEQ ID NO: 310632 - DNA, 25 bp, Mus musculus
gcctggcctccggataaagatagag

SEQ ID NO: 310633 - DNA, 25 bp, Mus musculus
gcctggcctccgggtttgtattgag

SEQ ID NO: 310634 - DNA, 25 bp, Mus musculus
gcctggcctgcttgaaatggaattt

SEQ ID NO: 310635 - DNA, 25 bp, Mus musculus
gcctggcgaggctcaaagcccgatt

SEQ ID NO: 310636 - DNA, 25 bp, Mus musculus
gcctggcgccccacagcttgaggag

SEQ ID NO: 310637 - DNA, 25 bp, Mus musculus
gcctggcggcttaaaaggcagtatg

SEQ ID NO: 310638 - DNA, 25 bp, Mus musculus
gcctggcgttcatggaatatgaaga

SEQ ID NO: 310639 - DNA, 25 bp, Mus musculus
gcctggctaagagggaaggctcctg

SEQ ID NO: 310640 - DNA, 25 bp, Mus musculus
gcctggctcacctctgctattgtag

SEQ ID NO: 310641 - DNA, 25 bp, Mus musculus
gcctggctgggatgggtgctacagt

SEQ ID NO: 310642 - DNA, 25 bp, Mus musculus
gcctggcttctaataacatgctgta

SEQ ID NO: 310643 - DNA, 25 bp, Mus musculus
gcctgggaacaaaggaggaggacat

SEQ ID NO: 310644 - DNA, 25 bp, Mus musculus
gcctgggaactccagcccttttaca

SEQ ID NO: 310645 - DNA, 25 bp, Mus musculus
gcctgggaagagaagaaccaaagat

SEQ ID NO: 310646 - DNA, 25 bp, Mus musculus
gcctgggaagctccaggtgcggttt

SEQ ID NO: 310647 - DNA, 25 bp, Mus musculus
gcctgggagagagggttgaaaacta

SEQ ID NO: 310648 - DNA, 25 bp, Mus musculus
gcctgggagcgagttaagagaaaat

SEQ ID NO: 310649 - DNA, 25 bp, Mus musculus
gcctgggaggccaggattgataagt

SEQ ID NO: 310650 - DNA, 25 bp, Mus musculus
gcctgggaggccaggctttttgatc

SEQ ID NO: 310651 - DNA, 25 bp, Mus musculus
gcctgggagtgaacggtctcaggag

SEQ ID NO: 310652 - DNA, 25 bp, Mus musculus
gcctgggagttcgctatctgcaggt

SEQ ID NO: 310653 - DNA, 25 bp, Mus musculus
gcctgggatgggaggtcccacgtga

SEQ ID NO: 310654 - DNA, 25 bp, Mus musculus
gcctgggattaaagattcatcagtg

SEQ ID NO: 310655 - DNA, 25 bp, Mus musculus
gcctgggcaaaggggggctcctggc

SEQ ID NO: 310656 - DNA, 25 bp, Mus musculus
gcctgggcaagctggtggtaacgga

SEQ ID NO: 310657 - DNA, 25 bp, Mus musculus
gcctgggcacacaggccagcggtgt

SEQ ID NO: 310658 - DNA, 25 bp, Mus musculus
gcctgggcacacagggttttgaagg

SEQ ID NO: 310659 - DNA, 25 bp, Mus musculus
gcctgggcagggatccctgctgcct

SEQ ID NO: 310660 - DNA, 25 bp, Mus musculus
gcctgggccaagatgaaagcttgcg

SEQ ID NO: 310661 - DNA, 25 bp, Mus musculus
gcctgggccacagggacttggatgt

SEQ ID NO: 310662 - DNA, 25 bp, Mus musculus
gcctgggccacggagcagctgaagg

SEQ ID NO: 310663 - DNA, 25 bp, Mus musculus
gcctgggcctcaagtccccaagact

SEQ ID NO: 310664 - DNA, 25 bp, Mus musculus
gcctgggcgcaggaagatttggaaa

SEQ ID NO: 310665 - DNA, 25 bp, Mus musculus
gcctgggcggagccccttaggtgag

SEQ ID NO: 310666 - DNA, 25 bp, Mus musculus
gcctgggcggagtagcgctggggac

SEQ ID NO: 310667 - DNA, 25 bp, Mus musculus
gcctgggctacaaagctgctgatga

SEQ ID NO: 310668 - DNA, 25 bp, Mus musculus
gcctgggctacagagctcaccatgc

SEQ ID NO: 310669 - DNA, 25 bp, Mus musculus
gcctgggctgagatgaggtgccact

SEQ ID NO: 310670 - DNA, 25 bp, Mus musculus
gcctgggctgcgggagccaatgtcc

SEQ ID NO: 310671 - DNA, 25 bp, Mus musculus
gcctgggctgcgggtttgttttctg

SEQ ID NO: 310672 - DNA, 25 bp, Mus musculus
gcctgggcttcaggtgctgtgggac

SEQ ID NO: 310673 - DNA, 25 bp, Mus musculus
gcctggggaaagcattgtggaattt

SEQ ID NO: 310674 - DNA, 25 bp, Mus musculus
gcctggggaagactcaagggcaaat

SEQ ID NO: 310675 - DNA, 25 bp, Mus musculus
gcctggggaaggtgactttccagtg

SEQ ID NO: 310676 - DNA, 25 bp, Mus musculus
gcctggggagaggccgacccgtgga

SEQ ID NO: 310677 - DNA, 25 bp, Mus musculus
gcctggggatggtgtgaccccacaa

SEQ ID NO: 310678 - DNA, 25 bp, Mus musculus
gcctggggcaggtcacctagcattg

SEQ ID NO: 310679 - DNA, 25 bp, Mus musculus
gcctggggcatgcaggcttcctgct

SEQ ID NO: 310680 - DNA, 25 bp, Mus musculus
gcctggggcgaggaaccaccgaccg

SEQ ID NO: 310681 - DNA, 25 bp, Mus musculus
gcctggggcggagtggcagcccagc

SEQ ID NO: 310682 - DNA, 25 bp, Mus musculus
gcctggggcggtcagtttagaatgg

SEQ ID NO: 310683 - DNA, 25 bp, Mus musculus
gcctggggtccccagaatcactatc

SEQ ID NO: 310684 - DNA, 25 bp, Mus musculus
gcctggggtccccagcaggaagggc

SEQ ID NO: 310685 - DNA, 25 bp, Mus musculus
gcctggggtccccagccgatcgggt

SEQ ID NO: 310686 - DNA, 25 bp, Mus musculus
gcctggggtcccggacaagagtaca

SEQ ID NO: 310687 - DNA, 25 bp, Mus musculus
gcctggggtcccggatatttggaag

SEQ ID NO: 310688 - DNA, 25 bp, Mus musculus
gcctggggtgagaagggcgttctct

SEQ ID NO: 310689 - DNA, 25 bp, Mus musculus
gcctggggttgggcgacagagagag

SEQ ID NO: 310690 - DNA, 25 bp, Mus musculus
gcctgggtagcccgtgtcccatcac

SEQ ID NO: 310691 - DNA, 25 bp, Mus musculus
gcctgggtagcccgttacatcttca

SEQ ID NO: 310692 - DNA, 25 bp, Mus musculus
gcctgggtctcccagtttgtcactc

SEQ ID NO: 310693 - DNA, 25 bp, Mus musculus
gcctgggtggacaggtgagcaatgc

SEQ ID NO: 310694 - DNA, 25 bp, Mus musculus
gcctggtactaatggatagatgcct

SEQ ID NO: 310695 - DNA, 25 bp, Mus musculus
gcctggtactaatgtgccagtatta

SEQ ID NO: 310696 - DNA, 25 bp, Mus musculus
gcctggtactcacaccgcatgacta

SEQ ID NO: 310697 - DNA, 25 bp, Mus musculus
gcctggtactcacactgcggtccaa

SEQ ID NO: 310698 - DNA, 25 bp, Mus musculus
gcctggtactcacagcgcatgacta

SEQ ID NO: 310699 - DNA, 25 bp, Mus musculus
gcctggtactcacagtgcggtccaa

SEQ ID NO: 310700 - DNA, 25 bp, Mus musculus
gcctggtactggagcagagggtccc

SEQ ID NO: 310701 - DNA, 25 bp, Mus musculus
gcctggtagcccaggcaagcgcttc

SEQ ID NO: 310702 - DNA, 25 bp, Mus musculus
gcctggtatatgctcccggcaactt

SEQ ID NO: 310703 - DNA, 25 bp, Mus musculus
gcctggtatccttggggcactgcgt

SEQ ID NO: 310704 - DNA, 25 bp, Mus musculus
gcctggtcaggcagtccctcgagag

SEQ ID NO: 310705 - DNA, 25 bp, Mus musculus
gcctggtcaggtgaaagcagccatt

SEQ ID NO: 310706 - DNA, 25 bp, Mus musculus
gcctggtcaggtgagcagattgatg

SEQ ID NO: 310707 - DNA, 25 bp, Mus musculus
gcctggtcagtgtcagctggtcact

SEQ ID NO: 310708 - DNA, 25 bp, Mus musculus
gcctggtcctacgatcccaggctcc

SEQ ID NO: 310709 - DNA, 25 bp, Mus musculus
gcctggtcctacggctgtgtggtga

SEQ ID NO: 310710 - DNA, 25 bp, Mus musculus
gcctggtctaaagaatcagaagtac

SEQ ID NO: 310711 - DNA, 25 bp, Mus musculus
gcctggtctacaaagaaatgttctg

SEQ ID NO: 310712 - DNA, 25 bp, Mus musculus
gcctggtctacaagatcacagagca

SEQ ID NO: 310713 - DNA, 25 bp, Mus musculus
gcctggtctacagaatagacatgct

SEQ ID NO: 310714 - DNA, 25 bp, Mus musculus
gcctggtctacagagctctcagaca

SEQ ID NO: 310715 - DNA, 25 bp, Mus musculus
gcctggtctacagatacaaatatag

SEQ ID NO: 310716 - DNA, 25 bp, Mus musculus
gcctggtctacatagggctccaaca

SEQ ID NO: 310717 - DNA, 25 bp, Mus musculus
gcctggtcttcagagtggaattggg

SEQ ID NO: 310718 - DNA, 25 bp, Mus musculus
gcctggtctttggagatatggaagg

SEQ ID NO: 310719 - DNA, 25 bp, Mus musculus
gcctggtgacaagaagactagcagt

SEQ ID NO: 310720 - DNA, 25 bp, Mus musculus
gcctggtgacaagggagaccagggc

SEQ ID NO: 310721 - DNA, 25 bp, Mus musculus
gcctggtgatccctgcagacggctc

SEQ ID NO: 310722 - DNA, 25 bp, Mus musculus
gcctggtgcagctggtgctgctggc

SEQ ID NO: 310723 - DNA, 25 bp, Mus musculus
gcctggtggaaagacagctggaaca

SEQ ID NO: 310724 - DNA, 25 bp, Mus musculus
gcctggtggaagctccatggttatt

SEQ ID NO: 310725 - DNA, 25 bp, Mus musculus
gcctggtggaaggggagcaaactgg

SEQ ID NO: 310726 - DNA, 25 bp, Mus musculus
gcctggtggaggcggacctatgtgg

SEQ ID NO: 310727 - DNA, 25 bp, Mus musculus
gcctggtggatgactatgggctcag

SEQ ID NO: 310728 - DNA, 25 bp, Mus musculus
gcctggtggcgacagatgtgaaggc

SEQ ID NO: 310729 - DNA, 25 bp, Mus musculus
gcctggtggctcaagttttcctgac

SEQ ID NO: 310730 - DNA, 25 bp, Mus musculus
gcctggtggtgcacaatcctggagg

SEQ ID NO: 310731 - DNA, 25 bp, Mus musculus
gcctggtgtcccgggatgccaagcc

SEQ ID NO: 310732 - DNA, 25 bp, Mus musculus
gcctggtgtctctggtcccatgggt

SEQ ID NO: 310733 - DNA, 25 bp, Mus musculus
gcctggtgtgggctaaattggttcc

SEQ ID NO: 310734 - DNA, 25 bp, Mus musculus
gcctggttcttcaagatctggagac

SEQ ID NO: 310735 - DNA, 25 bp, Mus musculus
gcctggttcttcaaggccacgaaag

SEQ ID NO: 310736 - DNA, 25 bp, Mus musculus
gcctggttgccaaggctacataaac

SEQ ID NO: 310737 - DNA, 25 bp, Mus musculus
gcctggttgccaaggtccaaggacc

SEQ ID NO: 310738 - DNA, 25 bp, Mus musculus
gcctggtttccactgagtccttagc

SEQ ID NO: 310739 - DNA, 25 bp, Mus musculus
gcctggtttccactgcacctcctgg

SEQ ID NO: 310740 - DNA, 25 bp, Mus musculus
gcctggtttccctggatcaggacat

SEQ ID NO: 310741 - DNA, 25 bp, Mus musculus
gcctgtaccattgcctatggcctgg

SEQ ID NO: 310742 - DNA, 25 bp, Mus musculus
gcctgtaccttcattacgtgcgacc

SEQ ID NO: 310743 - DNA, 25 bp, Mus musculus
gcctgtaccttcattgaactccaag

SEQ ID NO: 310744 - DNA, 25 bp, Mus musculus
gcctgtataagagccctgaagacaa

SEQ ID NO: 310745 - DNA, 25 bp, Mus musculus
gcctgtataaggtaggtgcacgcct

SEQ ID NO: 310746 - DNA, 25 bp, Mus musculus
gcctgtatgagaagctgaagcagtc

SEQ ID NO: 310747 - DNA, 25 bp, Mus musculus
gcctgtatgtgttgaggaggagaga

SEQ ID NO: 310748 - DNA, 25 bp, Mus musculus
gcctgtattggccttctgtatactg

SEQ ID NO: 310749 - DNA, 25 bp, Mus musculus
gcctgtcagcaaagttatttcgctt

SEQ ID NO: 310750 - DNA, 25 bp, Mus musculus
gcctgtcaggaccgaataaacctga

SEQ ID NO: 310751 - DNA, 25 bp, Mus musculus
gcctgtcagtcccaggtcctgccca

SEQ ID NO: 310752 - DNA, 25 bp, Mus musculus
gcctgtcatccagaatgccttattg

SEQ ID NO: 310753 - DNA, 25 bp, Mus musculus
gcctgtcatccagggcttcctacta

SEQ ID NO: 310754 - DNA, 25 bp, Mus musculus
gcctgtcatcctcgaagccaagctg

SEQ ID NO: 310755 - DNA, 25 bp, Mus musculus
gcctgtcatcctcgtgcctggctgc

SEQ ID NO: 310756 - DNA, 25 bp, Mus musculus
gcctgtcatgaggaactcagaaatc

SEQ ID NO: 310757 - DNA, 25 bp, Mus musculus
gcctgtcatgaggaactcagccacc

SEQ ID NO: 310758 - DNA, 25 bp, Mus musculus
gcctgtccagacatcttcttctcca

SEQ ID NO: 310759 - DNA, 25 bp, Mus musculus
gcctgtccagggatttggacatttg

SEQ ID NO: 310760 - DNA, 25 bp, Mus musculus
gcctgtcctacaatgatgatgtgct

SEQ ID NO: 310761 - DNA, 25 bp, Mus musculus
gcctgtcctcctgctgatgctttca

SEQ ID NO: 310762 - DNA, 25 bp, Mus musculus
gcctgtcctggttgttcctcaaagt

SEQ ID NO: 310763 - DNA, 25 bp, Mus musculus
gcctgtcgcaggctgttgattcaga

SEQ ID NO: 310764 - DNA, 25 bp, Mus musculus
gcctgtcgcagggagcttatggggg

SEQ ID NO: 310765 - DNA, 25 bp, Mus musculus
gcctgtctcagagagcctgggcaca

SEQ ID NO: 310766 - DNA, 25 bp, Mus musculus
gcctgtctcagatgtcttcagtacc

SEQ ID NO: 310767 - DNA, 25 bp, Mus musculus
gcctgtctgaaaagggccggcagga

SEQ ID NO: 310768 - DNA, 25 bp, Mus musculus
gcctgtctgagccgctacagaacct

SEQ ID NO: 310769 - DNA, 25 bp, Mus musculus
gcctgtctgaggccctggccagatg

SEQ ID NO: 310770 - DNA, 25 bp, Mus musculus
gcctgtctgcactggtgaccatgta

SEQ ID NO: 310771 - DNA, 25 bp, Mus musculus
gcctgtctgccccatgtccatcatc

SEQ ID NO: 310772 - DNA, 25 bp, Mus musculus
gcctgtctgctcctggccttcccag

SEQ ID NO: 310773 - DNA, 25 bp, Mus musculus
gcctgtctgtgactggattggccgc

SEQ ID NO: 310774 - DNA, 25 bp, Mus musculus
gcctgtgaagacttggatgaatgtg

SEQ ID NO: 310775 - DNA, 25 bp, Mus musculus
gcctgtgaagcgagcgcagcaatct

SEQ ID NO: 310776 - DNA, 25 bp, Mus musculus
gcctgtgaagcgcctcagtgggctc

SEQ ID NO: 310777 - DNA, 25 bp, Mus musculus
gcctgtgaagtcttggatgaatgtg

SEQ ID NO: 310778 - DNA, 25 bp, Mus musculus
gcctgtgactcaggattctctacct

SEQ ID NO: 310779 - DNA, 25 bp, Mus musculus
gcctgtgagaaccacctcagtgggc

SEQ ID NO: 310780 - DNA, 25 bp, Mus musculus
gcctgtgagaacgacctcagtgggc

SEQ ID NO: 310781 - DNA, 25 bp, Mus musculus
gcctgtgagcaaaaacctgtgctgg

SEQ ID NO: 310782 - DNA, 25 bp, Mus musculus
gcctgtgagcaaagaggcaagagac

SEQ ID NO: 310783 - DNA, 25 bp, Mus musculus
gcctgtgaggtctgtgcattttcct

SEQ ID NO: 310784 - DNA, 25 bp, Mus musculus
gcctgtgcaagggcggcctgagctg

SEQ ID NO: 310785 - DNA, 25 bp, Mus musculus
gcctgtgcagtggcactccaaagtc

SEQ ID NO: 310786 - DNA, 25 bp, Mus musculus
gcctgtgcatgccatgacccccgag

SEQ ID NO: 310787 - DNA, 25 bp, Mus musculus
gcctgtgccaaggtcgagtatgcct

SEQ ID NO: 310788 - DNA, 25 bp, Mus musculus
gcctgtgccagggtgtgagggtaag

SEQ ID NO: 310789 - DNA, 25 bp, Mus musculus
gcctgtgccagtgttctttccaggg

SEQ ID NO: 310790 - DNA, 25 bp, Mus musculus
gcctgtgccctcggaaccaccatct

SEQ ID NO: 310791 - DNA, 25 bp, Mus musculus
gcctgtgccggcctttaatgtgatc

SEQ ID NO: 310792 - DNA, 25 bp, Mus musculus
gcctgtgccttggacggctgttctc

SEQ ID NO: 310793 - DNA, 25 bp, Mus musculus
gcctgtgctagacagtgtgctcaat

SEQ ID NO: 310794 - DNA, 25 bp, Mus musculus
gcctgtgctcaggggagaaaggcct

SEQ ID NO: 310795 - DNA, 25 bp, Mus musculus
gcctgtgctcaggtaatggaaaagg

SEQ ID NO: 310796 - DNA, 25 bp, Mus musculus
gcctgtgcttagagctcctcctccc

SEQ ID NO: 310797 - DNA, 25 bp, Mus musculus
gcctgtgcttcagagtctgaaaggg

SEQ ID NO: 310798 - DNA, 25 bp, Mus musculus
gcctgtgcttgccaggggctgacaa

SEQ ID NO: 310799 - DNA, 25 bp, Mus musculus
gcctgtggaagtcggtgatggcatg

SEQ ID NO: 310800 - DNA, 25 bp, Mus musculus
gcctgtggagggttgtctaccggac

SEQ ID NO: 310801 - DNA, 25 bp, Mus musculus
gcctgtggatcaagtgtttgcaaaa

SEQ ID NO: 310802 - DNA, 25 bp, Mus musculus
gcctgtgggacccgaacaatttcga

SEQ ID NO: 310803 - DNA, 25 bp, Mus musculus
gcctgtggggaaaaccagttgggtc

SEQ ID NO: 310804 - DNA, 25 bp, Mus musculus
gcctgtggggaaagcatctgaacta

SEQ ID NO: 310805 - DNA, 25 bp, Mus musculus
gcctgtgggtcgggcacattgcctc

SEQ ID NO: 310806 - DNA, 25 bp, Mus musculus
gcctgtgggtcggggaagagttggg

SEQ ID NO: 310807 - DNA, 25 bp, Mus musculus
gcctgtgtcagatcgaaccttgttc

SEQ ID NO: 310808 - DNA, 25 bp, Mus musculus
gcctgtgtcaggagcatatgcagga

SEQ ID NO: 310809 - DNA, 25 bp, Mus musculus
gcctgtgtggatgtgaacgagtgtg

SEQ ID NO: 310810 - DNA, 25 bp, Mus musculus
gcctgtgtggctcaagtggcctttt

SEQ ID NO: 310811 - DNA, 25 bp, Mus musculus
gcctgtgtgggcctgggactttgcc

SEQ ID NO: 310812 - DNA, 25 bp, Mus musculus
gcctgtgtggttgtgaacgagtgtg

SEQ ID NO: 310813 - DNA, 25 bp, Mus musculus
gcctgtgtgtctcagcctcagcttt

SEQ ID NO: 310814 - DNA, 25 bp, Mus musculus
gcctgtgttcggcaggttcgcagac

SEQ ID NO: 310815 - DNA, 25 bp, Mus musculus
gcctgtgttgctacccctctgggca

SEQ ID NO: 310816 - DNA, 25 bp, Mus musculus
gcctgttaagaccactgttcccttc

SEQ ID NO: 310817 - DNA, 25 bp, Mus musculus
gcctgttacacagcccagggaatat

SEQ ID NO: 310818 - DNA, 25 bp, Mus musculus
gcctgttacaggtctgcagcatagt

SEQ ID NO: 310819 - DNA, 25 bp, Mus musculus
gcctgttcaagaaatcaacatgcag

SEQ ID NO: 310820 - DNA, 25 bp, Mus musculus
gcctgttcaaggttcgcccagagac

SEQ ID NO: 310821 - DNA, 25 bp, Mus musculus
gcctgttcctaacactaatgagcga

SEQ ID NO: 310822 - DNA, 25 bp, Mus musculus
gcctgttcctctgaaaaggaaaaga

SEQ ID NO: 310823 - DNA, 25 bp, Mus musculus
gcctgttcttgtggctcaggggact

SEQ ID NO: 310824 - DNA, 25 bp, Mus musculus
gcctgttgctgctgttatttccgag

SEQ ID NO: 310825 - DNA, 25 bp, Mus musculus
gcctgtttagaagtaacagcctcca

SEQ ID NO: 310826 - DNA, 25 bp, Mus musculus
gcctgttttggacccaacagactgc

SEQ ID NO: 310827 - DNA, 25 bp, Mus musculus
gcctgtttttccaaggagtgtgggg

SEQ ID NO: 310828 - DNA, 25 bp, Mus musculus
gccttaaaaaagaatccatgcccag

SEQ ID NO: 310829 - DNA, 25 bp, Mus musculus
gccttaaaaaaggatgctcatgtgg

SEQ ID NO: 310830 - DNA, 25 bp, Mus musculus
gccttaaaagaaaccatggaatggg

SEQ ID NO: 310831 - DNA, 25 bp, Mus musculus
gccttaaatcagtgtcggtgacgtt

SEQ ID NO: 310832 - DNA, 25 bp, Mus musculus
gccttaaattgggtgcttccaatag

SEQ ID NO: 310833 - DNA, 25 bp, Mus musculus
gccttaaattggttctactagtgct

SEQ ID NO: 310834 - DNA, 25 bp, Mus musculus
gccttaagaaagaatgggaaacagc

SEQ ID NO: 310835 - DNA, 25 bp, Mus musculus
gccttaatgggtctggttctccaca

SEQ ID NO: 310836 - DNA, 25 bp, Mus musculus
gccttacactacttctaaagatggc

SEQ ID NO: 310837 - DNA, 25 bp, Mus musculus
gccttaccatgtgccctggggggca

SEQ ID NO: 310838 - DNA, 25 bp, Mus musculus
gccttacctccagaacccgctcagt

SEQ ID NO: 310839 - DNA, 25 bp, Mus musculus
gccttactggggtttggaaatagtg

SEQ ID NO: 310840 - DNA, 25 bp, Mus musculus
gccttagaacaagatttaccggaca

SEQ ID NO: 310841 - DNA, 25 bp, Mus musculus
gccttagactccatgtgctcggcgc

SEQ ID NO: 310842 - DNA, 25 bp, Mus musculus
gccttagaggcctcactagggcagg

SEQ ID NO: 310843 - DNA, 25 bp, Mus musculus
gccttagcatccagtgggtgtataa

SEQ ID NO: 310844 - DNA, 25 bp, Mus musculus
gccttagccaagagctgtcccgacc

SEQ ID NO: 310845 - DNA, 25 bp, Mus musculus
gccttagctaccgccaccagaagca

SEQ ID NO: 310846 - DNA, 25 bp, Mus musculus
gccttagggcaagattctcagccac

SEQ ID NO: 310847 - DNA, 25 bp, Mus musculus
gccttagtccgagccgccatgggct

SEQ ID NO: 310848 - DNA, 25 bp, Mus musculus
gccttagtcctgatgctgtctatgt

SEQ ID NO: 310849 - DNA, 25 bp, Mus musculus
gccttagtcctgtcccccagctctc

SEQ ID NO: 310850 - DNA, 25 bp, Mus musculus
gccttagtgcaggaaacttcgcggc

SEQ ID NO: 310851 - DNA, 25 bp, Mus musculus
gccttagtgggctgggtgggtgaag

SEQ ID NO: 310852 - DNA, 25 bp, Mus musculus
gccttatacccggagagagaagcgc

SEQ ID NO: 310853 - DNA, 25 bp, Mus musculus
gccttatactggaacaagaaacagt

SEQ ID NO: 310854 - DNA, 25 bp, Mus musculus
gccttatactggaagaagaaacagt

SEQ ID NO: 310855 - DNA, 25 bp, Mus musculus
gccttatcagtcagggttacagagt

SEQ ID NO: 310856 - DNA, 25 bp, Mus musculus
gccttatgaaaactggtgaagggcc

SEQ ID NO: 310857 - DNA, 25 bp, Mus musculus
gccttatgccctggttccacggcaa

SEQ ID NO: 310858 - DNA, 25 bp, Mus musculus
gccttatggaggaaggtcgtggact

SEQ ID NO: 310859 - DNA, 25 bp, Mus musculus
gccttattcaaggcctggtgtgtgc

SEQ ID NO: 310860 - DNA, 25 bp, Mus musculus
gccttattcaaggggtgtggaatat

SEQ ID NO: 310861 - DNA, 25 bp, Mus musculus
gccttattccagaactttgtgccct

SEQ ID NO: 310862 - DNA, 25 bp, Mus musculus
gccttcaaaagaatggcagtctgca

SEQ ID NO: 310863 - DNA, 25 bp, Mus musculus
gccttcaaaagtgtgctggggaaca

SEQ ID NO: 310864 - DNA, 25 bp, Mus musculus
gccttcaaaatgcgtttcaagcacc

SEQ ID NO: 310865 - DNA, 25 bp, Mus musculus
gccttcaaacgtgtttggacttatt

SEQ ID NO: 310866 - DNA, 25 bp, Mus musculus
gccttcaaagaatgtctgtaaggca

SEQ ID NO: 310867 - DNA, 25 bp, Mus musculus
gccttcaaagacctactgaaagcca

SEQ ID NO: 310868 - DNA, 25 bp, Mus musculus
gccttcaaccgaaacaagctcccat

SEQ ID NO: 310869 - DNA, 25 bp, Mus musculus
gccttcaacctgacgctgtccatgc

SEQ ID NO: 310870 - DNA, 25 bp, Mus musculus
gccttcaacctggatgccctccaca

SEQ ID NO: 310871 - DNA, 25 bp, Mus musculus
gccttcaacggaggtactgtattgg

SEQ ID NO: 310872 - DNA, 25 bp, Mus musculus
gccttcaagaaagatgtccttggct

SEQ ID NO: 310873 - DNA, 25 bp, Mus musculus
gccttcaagacagatcctcaagaat

SEQ ID NO: 310874 - DNA, 25 bp, Mus musculus
gccttcaagacagcgtgggtgggct

SEQ ID NO: 310875 - DNA, 25 bp, Mus musculus
gccttcaaggcctgacaacatcgct

SEQ ID NO: 310876 - DNA, 25 bp, Mus musculus
gccttcaaggcgccccccacaggct

SEQ ID NO: 310877 - DNA, 25 bp, Mus musculus
gccttcaaggtgaagtacatggagt

SEQ ID NO: 310878 - DNA, 25 bp, Mus musculus
gccttcaatgagaagtgaacatgta

SEQ ID NO: 310879 - DNA, 25 bp, Mus musculus
gccttcacaatctccagaactacag

SEQ ID NO: 310880 - DNA, 25 bp, Mus musculus
gccttcacatggtctcttcagatgg

SEQ ID NO: 310881 - DNA, 25 bp, Mus musculus
gccttcaccagggatgactctgttc

SEQ ID NO: 310882 - DNA, 25 bp, Mus musculus
gccttcacggcggagtgttcctgta

SEQ ID NO: 310883 - DNA, 25 bp, Mus musculus
gccttcactggggcactcagaaaga

SEQ ID NO: 310884 - DNA, 25 bp, Mus musculus
gccttcagacagaaaacgaagtcca

SEQ ID NO: 310885 - DNA, 25 bp, Mus musculus
gccttcagccacatcccagagggtt

SEQ ID NO: 310886 - DNA, 25 bp, Mus musculus
gccttcagccggtttcaccgcgtgg

SEQ ID NO: 310887 - DNA, 25 bp, Mus musculus
gccttcagcctcagaaccgcaaatt

SEQ ID NO: 310888 - DNA, 25 bp, Mus musculus
gccttcagcctcagcccagcgtaag

SEQ ID NO: 310889 - DNA, 25 bp, Mus musculus
gccttcagcctcaggttatgaaaat

SEQ ID NO: 310890 - DNA, 25 bp, Mus musculus
gccttcagcctcagtggtgacccaa

SEQ ID NO: 310891 - DNA, 25 bp, Mus musculus
gccttcaggaaggcagcctcctatc

SEQ ID NO: 310892 - DNA, 25 bp, Mus musculus
gccttcaggagcgggcctgtgtgat

SEQ ID NO: 310893 - DNA, 25 bp, Mus musculus
gccttcaggaggaggacttactgtg

SEQ ID NO: 310894 - DNA, 25 bp, Mus musculus
gccttcaggaggaggtggcaaaccc

SEQ ID NO: 310895 - DNA, 25 bp, Mus musculus
gccttcaggaggtatgctgcttggg

SEQ ID NO: 310896 - DNA, 25 bp, Mus musculus
gccttcaggctttgcagggaccctt

SEQ ID NO: 310897 - DNA, 25 bp, Mus musculus
gccttcatcgacaaggtgcgcttcc

SEQ ID NO: 310898 - DNA, 25 bp, Mus musculus
gccttcatcttccagagaggaggct

SEQ ID NO: 310899 - DNA, 25 bp, Mus musculus
gccttcatgccatttcagtgcccga

SEQ ID NO: 310900 - DNA, 25 bp, Mus musculus
gccttcatgtgccaggctggcgact

SEQ ID NO: 310901 - DNA, 25 bp, Mus musculus
gccttcattcaacgtgatgaaagga

SEQ ID NO: 310902 - DNA, 25 bp, Mus musculus
gccttcattcaagggttttatggac

SEQ ID NO: 310903 - DNA, 25 bp, Mus musculus
gccttccaaacagaacctttccctg

SEQ ID NO: 310904 - DNA, 25 bp, Mus musculus
gccttccaaacagtttcaaagaggc

SEQ ID NO: 310905 - DNA, 25 bp, Mus musculus
gccttccaacatctgagcagctcaa

SEQ ID NO: 310906 - DNA, 25 bp, Mus musculus
gccttccaagagttttcttggaggc

SEQ ID NO: 310907 - DNA, 25 bp, Mus musculus
gccttccaaggaaacctctgccgct

SEQ ID NO: 310908 - DNA, 25 bp, Mus musculus
gccttccaaggttgagagctgttgg

SEQ ID NO: 310909 - DNA, 25 bp, Mus musculus
gccttccacgagttcgaggaagcca

SEQ ID NO: 310910 - DNA, 25 bp, Mus musculus
gccttccagaacagggaaaggcagg

SEQ ID NO: 310911 - DNA, 25 bp, Mus musculus
gccttccagaccggtggcagacatg

SEQ ID NO: 310912 - DNA, 25 bp, Mus musculus
gccttccagatacattgacatcagc

SEQ ID NO: 310913 - DNA, 25 bp, Mus musculus
gccttccagatacgtcttccaagtt

SEQ ID NO: 310914 - DNA, 25 bp, Mus musculus
gccttccaggagatggagttgctat

SEQ ID NO: 310915 - DNA, 25 bp, Mus musculus
gccttccaggaggggctggagggtc

SEQ ID NO: 310916 - DNA, 25 bp, Mus musculus
gccttccatatgaccaaaggctact

SEQ ID NO: 310917 - DNA, 25 bp, Mus musculus
gccttccatcatgaggaaatttgcc

SEQ ID NO: 310918 - DNA, 25 bp, Mus musculus
gccttcccaccttcaaaactggtga

SEQ ID NO: 310919 - DNA, 25 bp, Mus musculus
gccttcccagaagaaaacatgaatt

SEQ ID NO: 310920 - DNA, 25 bp, Mus musculus
gccttcccccttggttgcctctctg

SEQ ID NO: 310921 - DNA, 25 bp, Mus musculus
gccttccccttagctcagagctctg

SEQ ID NO: 310922 - DNA, 25 bp, Mus musculus
gccttccctcaggacatcaatgcaa

SEQ ID NO: 310923 - DNA, 25 bp, Mus musculus
gccttccctcaggtgtcagatcccc

SEQ ID NO: 310924 - DNA, 25 bp, Mus musculus
gccttccgagatgagacggcagtga

SEQ ID NO: 310925 - DNA, 25 bp, Mus musculus
gccttccgagggcagtactgctatg

SEQ ID NO: 310926 - DNA, 25 bp, Mus musculus
gccttccgcctggggtgactgtccc

SEQ ID NO: 310927 - DNA, 25 bp, Mus musculus
gccttccgggctccctggtcctgag

SEQ ID NO: 310928 - DNA, 25 bp, Mus musculus
gccttcctactactgctcccagggc

SEQ ID NO: 310929 - DNA, 25 bp, Mus musculus
gccttcctagccctcgtggtagctg

SEQ ID NO: 310930 - DNA, 25 bp, Mus musculus
gccttcctatgtagcactcagcatg

SEQ ID NO: 310931 - DNA, 25 bp, Mus musculus
gccttcctcaagcagtataattcgt

SEQ ID NO: 310932 - DNA, 25 bp, Mus musculus
gccttcctcaatcacctctcccagt

SEQ ID NO: 310933 - DNA, 25 bp, Mus musculus
gccttcctcaatcacttatcacagt

SEQ ID NO: 310934 - DNA, 25 bp, Mus musculus
gccttcctcagcccaggtcctgagg

SEQ ID NO: 310935 - DNA, 25 bp, Mus musculus
gccttcctcagcgagctggagcccc

SEQ ID NO: 310936 - DNA, 25 bp, Mus musculus
gccttcctgagatactgcagcctct

SEQ ID NO: 310937 - DNA, 25 bp, Mus musculus
gccttcctgctggtgtcagtgtctg

SEQ ID NO: 310938 - DNA, 25 bp, Mus musculus
gccttcctggagcatgcagacggag

SEQ ID NO: 310939 - DNA, 25 bp, Mus musculus
gccttcctgtcagtgctctggatgt

SEQ ID NO: 310940 - DNA, 25 bp, Mus musculus
gccttcctgtcgatccccagcctca

SEQ ID NO: 310941 - DNA, 25 bp, Mus musculus
gccttcctgtgtgccctgctttccc

SEQ ID NO: 310942 - DNA, 25 bp, Mus musculus
gccttcctgtgtggaacaacgaagc

SEQ ID NO: 310943 - DNA, 25 bp, Mus musculus
gccttccttatcagaggtcgactca

SEQ ID NO: 310944 - DNA, 25 bp, Mus musculus
gccttccttatcaggaactcaataa

SEQ ID NO: 310945 - DNA, 25 bp, Mus musculus
gccttccttatcagtgtagcccagt

SEQ ID NO: 310946 - DNA, 25 bp, Mus musculus
gccttcctttgaggagagtactaaa

SEQ ID NO: 310947 - DNA, 25 bp, Mus musculus
gccttcgagaggtgctgagcttgtg

SEQ ID NO: 310948 - DNA, 25 bp, Mus musculus
gccttcgagcacatgcccttaggcc

SEQ ID NO: 310949 - DNA, 25 bp, Mus musculus
gccttcgagcacatgggagtgttgt

SEQ ID NO: 310950 - DNA, 25 bp, Mus musculus
gccttcgataccgacatccatgctg

SEQ ID NO: 310951 - DNA, 25 bp, Mus musculus
gccttcgccagttctcaggccgcct

SEQ ID NO: 310952 - DNA, 25 bp, Mus musculus
gccttcgccatgtccttatgtggga

SEQ ID NO: 310953 - DNA, 25 bp, Mus musculus
gccttcgcgaggtggtggctgagcc

SEQ ID NO: 310954 - DNA, 25 bp, Mus musculus
gccttcgcgccgacgaaatggctac

SEQ ID NO: 310955 - DNA, 25 bp, Mus musculus
gccttcgcgtcacggtcttgttgca

SEQ ID NO: 310956 - DNA, 25 bp, Mus musculus
gccttcggtgacatgaccaatgagg

SEQ ID NO: 310957 - DNA, 25 bp, Mus musculus
gccttcgtctctcaggtgccgcacc

SEQ ID NO: 310958 - DNA, 25 bp, Mus musculus
gccttctaagctacctgaaccagct

SEQ ID NO: 310959 - DNA, 25 bp, Mus musculus
gccttctatagcccgtgtgattgat

SEQ ID NO: 310960 - DNA, 25 bp, Mus musculus
gccttctataggcctctgctcgatg

SEQ ID NO: 310961 - DNA, 25 bp, Mus musculus
gccttctatagtgagattatatagt

SEQ ID NO: 310962 - DNA, 25 bp, Mus musculus
gccttctatgtcatggtggggtttt

SEQ ID NO: 310963 - DNA, 25 bp, Mus musculus
gccttctcaggaagtaaaccaggtt

SEQ ID NO: 310964 - DNA, 25 bp, Mus musculus
gccttctcaggaagttctgatccag

SEQ ID NO: 310965 - DNA, 25 bp, Mus musculus
gccttctcctgaaacactgtgcccc

SEQ ID NO: 310966 - DNA, 25 bp, Mus musculus
gccttctctaggaacaatgtgttct

SEQ ID NO: 310967 - DNA, 25 bp, Mus musculus
gccttctctctgaaggtgttcctca

SEQ ID NO: 310968 - DNA, 25 bp, Mus musculus
gccttctctgggttccctggacgtt

SEQ ID NO: 310969 - DNA, 25 bp, Mus musculus
gccttctgaaagacccggccatgct

SEQ ID NO: 310970 - DNA, 25 bp, Mus musculus
gccttctgagatagcaagcagattg

SEQ ID NO: 310971 - DNA, 25 bp, Mus musculus
gccttctgagttaatatgacagata

SEQ ID NO: 310972 - DNA, 25 bp, Mus musculus
gccttctgagttattgcggaagcag

SEQ ID NO: 310973 - DNA, 25 bp, Mus musculus
gccttctgagttgtagttagcgcct

SEQ ID NO: 310974 - DNA, 25 bp, Mus musculus
gccttctgagttttcctcttgctcc

SEQ ID NO: 310975 - DNA, 25 bp, Mus musculus
gccttctgataatagtgttatccaa

SEQ ID NO: 310976 - DNA, 25 bp, Mus musculus
gccttctggagcacatcttatactg

SEQ ID NO: 310977 - DNA, 25 bp, Mus musculus
gccttctggcagggtccctgcatgt

SEQ ID NO: 310978 - DNA, 25 bp, Mus musculus
gccttctgtcaggtgagcgtcctca

SEQ ID NO: 310979 - DNA, 25 bp, Mus musculus
gccttcttactgtgtcctactgaaa

SEQ ID NO: 310980 - DNA, 25 bp, Mus musculus
gccttcttccttcaggtccttcatt

SEQ ID NO: 310981 - DNA, 25 bp, Mus musculus
gccttcttctgggagaagtttgaaa

SEQ ID NO: 310982 - DNA, 25 bp, Mus musculus
gccttcttgagctgaaaattgagaa

SEQ ID NO: 310983 - DNA, 25 bp, Mus musculus
gccttcttgagggccttcttgaagt

SEQ ID NO: 310984 - DNA, 25 bp, Mus musculus
gccttcttggagaggtaaccccagg

SEQ ID NO: 310985 - DNA, 25 bp, Mus musculus
gccttctttcaggaaatgctgtcat

SEQ ID NO: 310986 - DNA, 25 bp, Mus musculus
gccttctttgatgtgaagacaacac

SEQ ID NO: 310987 - DNA, 25 bp, Mus musculus
gccttcttttatgaggtctcccgcc

SEQ ID NO: 310988 - DNA, 25 bp, Mus musculus
gccttcttttgacccacataataat

SEQ ID NO: 310989 - DNA, 25 bp, Mus musculus
gccttgaaaaccagatacaatggag

SEQ ID NO: 310990 - DNA, 25 bp, Mus musculus
gccttgaaaagatgaatgagaacag

SEQ ID NO: 310991 - DNA, 25 bp, Mus musculus
gccttgaaaagattggccacctgct

SEQ ID NO: 310992 - DNA, 25 bp, Mus musculus
gccttgaaaaggtagacccacaact

SEQ ID NO: 310993 - DNA, 25 bp, Mus musculus
gccttgaaagatttacaagggccct

SEQ ID NO: 310994 - DNA, 25 bp, Mus musculus
gccttgaaagcagccgctaacgtcc

SEQ ID NO: 310995 - DNA, 25 bp, Mus musculus
gccttgaaagcccccaaaatagaga

SEQ ID NO: 310996 - DNA, 25 bp, Mus musculus
gccttgacaatatcaacatgacaca

SEQ ID NO: 310997 - DNA, 25 bp, Mus musculus
gccttgacctgttgaggagacttct

SEQ ID NO: 310998 - DNA, 25 bp, Mus musculus
gccttgacgagatgctgttggctgc

SEQ ID NO: 310999 - DNA, 25 bp, Mus musculus
gccttgacgaggggatgagagagtc

SEQ ID NO: 311000 - DNA, 25 bp, Mus musculus
gccttgagagtctatcaccactact

SEQ ID NO: 311001 - DNA, 25 bp, Mus musculus
gccttgagggatgctgactgtgcac

SEQ ID NO: 311002 - DNA, 25 bp, Mus musculus
gccttgagtgagcataatgaagctg

SEQ ID NO: 311003 - DNA, 25 bp, Mus musculus
gccttgagtgaggcatttcatgagg

SEQ ID NO: 311004 - DNA, 25 bp, Mus musculus
gccttgataggaccttcgagaagtc

SEQ ID NO: 311005 - DNA, 25 bp, Mus musculus
gccttgataggagctgtttacttgg

SEQ ID NO: 311006 - DNA, 25 bp, Mus musculus
gccttgatatgtcgaccggaagaaa

SEQ ID NO: 311007 - DNA, 25 bp, Mus musculus
gccttgatgtgagccatgagcctca

SEQ ID NO: 311008 - DNA, 25 bp, Mus musculus
gccttgattggccctcctttttctg

SEQ ID NO: 311009 - DNA, 25 bp, Mus musculus
gccttgatttgaaggagccaagcaa

SEQ ID NO: 311010 - DNA, 25 bp, Mus musculus
gccttgcaagcaaggtgcagagctt

SEQ ID NO: 311011 - DNA, 25 bp, Mus musculus
gccttgcaagctatgtctgagctca

SEQ ID NO: 311012 - DNA, 25 bp, Mus musculus
gccttgcaaggggagagttagattt

SEQ ID NO: 311013 - DNA, 25 bp, Mus musculus
gccttgcagagacattttgagcagc

SEQ ID NO: 311014 - DNA, 25 bp, Mus musculus
gccttgccaaggtccacccgactcc

SEQ ID NO: 311015 - DNA, 25 bp, Mus musculus
gccttgccaggaaaatactaaagtt

SEQ ID NO: 311016 - DNA, 25 bp, Mus musculus
gccttgccttctctcaaactcctgt

SEQ ID NO: 311017 - DNA, 25 bp, Mus musculus
gccttgcgatggcggtacagagact

SEQ ID NO: 311018 - DNA, 25 bp, Mus musculus
gccttgcggcgccggacaggatgtt

SEQ ID NO: 311019 - DNA, 25 bp, Mus musculus
gccttgctaatccgaataatttaaa

SEQ ID NO: 311020 - DNA, 25 bp, Mus musculus
gccttgctaggcccggtcggtgagc

SEQ ID NO: 311021 - DNA, 25 bp, Mus musculus
gccttgctcaggagtatcccggcaa

SEQ ID NO: 311022 - DNA, 25 bp, Mus musculus
gccttgctcaggtttcccttcctca

SEQ ID NO: 311023 - DNA, 25 bp, Mus musculus
gccttgctgaggaagagaagtttat

SEQ ID NO: 311024 - DNA, 25 bp, Mus musculus
gccttgcttaccctagaagccgttg

SEQ ID NO: 311025 - DNA, 25 bp, Mus musculus
gccttgcttcagccgtctgtggagg

SEQ ID NO: 311026 - DNA, 25 bp, Mus musculus
gccttgcttcaggcgtctgtggagg

SEQ ID NO: 311027 - DNA, 25 bp, Mus musculus
gccttggaaggaggtgggcctcccc

SEQ ID NO: 311028 - DNA, 25 bp, Mus musculus
gccttggaattgaagatggatcacc

SEQ ID NO: 311029 - DNA, 25 bp, Mus musculus
gccttggacctgaggtggcatcttt

SEQ ID NO: 311030 - DNA, 25 bp, Mus musculus
gccttggaccttaagatttcctatt

SEQ ID NO: 311031 - DNA, 25 bp, Mus musculus
gccttggagagtctccaaggacttt

SEQ ID NO: 311032 - DNA, 25 bp, Mus musculus
gccttggaggaaactttgcttccca

SEQ ID NO: 311033 - DNA, 25 bp, Mus musculus
gccttggaggacagatgccctgctg

SEQ ID NO: 311034 - DNA, 25 bp, Mus musculus
gccttggcaacagaccccaatatcc

SEQ ID NO: 311035 - DNA, 25 bp, Mus musculus
gccttggcagaggtgagtaaaaaga

SEQ ID NO: 311036 - DNA, 25 bp, Mus musculus
gccttggcagaggtggataactgca

SEQ ID NO: 311037 - DNA, 25 bp, Mus musculus
gccttggcagcacaaacttgaccta

SEQ ID NO: 311038 - DNA, 25 bp, Mus musculus
gccttggcaggggccagtccctgtc

SEQ ID NO: 311039 - DNA, 25 bp, Mus musculus
gccttggcaggtctctcttcagtac

SEQ ID NO: 311040 - DNA, 25 bp, Mus musculus
gccttggcctgtggtcaaaatccag

SEQ ID NO: 311041 - DNA, 25 bp, Mus musculus
gccttggcgcggactggtatccggt

SEQ ID NO: 311042 - DNA, 25 bp, Mus musculus
gccttggctttggagctcctgatgg

SEQ ID NO: 311043 - DNA, 25 bp, Mus musculus
gccttggctttggaggtcggtgagc

SEQ ID NO: 311044 - DNA, 25 bp, Mus musculus
gccttgggaaacaagaaagacagag

SEQ ID NO: 311045 - DNA, 25 bp, Mus musculus
gccttgggaagatgctgctctttgg

SEQ ID NO: 311046 - DNA, 25 bp, Mus musculus
gccttgggaagatgctggagaccta

SEQ ID NO: 311047 - DNA, 25 bp, Mus musculus
gccttgggaagatggctccttctcc

SEQ ID NO: 311048 - DNA, 25 bp, Mus musculus
gccttgggatctttgctttctcatg

SEQ ID NO: 311049 - DNA, 25 bp, Mus musculus
gccttggggctcggatggtaaaaca

SEQ ID NO: 311050 - DNA, 25 bp, Mus musculus
gccttggggctcggcatctatattg

SEQ ID NO: 311051 - DNA, 25 bp, Mus musculus
gccttggtaaatgatgtggcaccat

SEQ ID NO: 311052 - DNA, 25 bp, Mus musculus
gccttggtacaggcagcagttatgg

SEQ ID NO: 311053 - DNA, 25 bp, Mus musculus
gccttggtccggagaaacattcatg

SEQ ID NO: 311054 - DNA, 25 bp, Mus musculus
gccttggtcgatccactctctcatg

SEQ ID NO: 311055 - DNA, 25 bp, Mus musculus
gccttggtgacaccttcaggtggaa

SEQ ID NO: 311056 - DNA, 25 bp, Mus musculus
gccttggtggaggaaccagagtcta

SEQ ID NO: 311057 - DNA, 25 bp, Mus musculus
gccttgtaaaaaggtatatcatgta

SEQ ID NO: 311058 - DNA, 25 bp, Mus musculus
gccttgtaaacatcagctgcgggca

SEQ ID NO: 311059 - DNA, 25 bp, Mus musculus
gccttgtacaaaggtctctggtaag

SEQ ID NO: 311060 - DNA, 25 bp, Mus musculus
gccttgtacaaaggttggtgttcag

SEQ ID NO: 311061 - DNA, 25 bp, Mus musculus
gccttgtacaggtatcacaaggctg

SEQ ID NO: 311062 - DNA, 25 bp, Mus musculus
gccttgtataaagtacactggacac

SEQ ID NO: 311063 - DNA, 25 bp, Mus musculus
gccttgtcaagctcgaaccagcccc

SEQ ID NO: 311064 - DNA, 25 bp, Mus musculus
gccttgtcacaaaggaagttgttca

SEQ ID NO: 311065 - DNA, 25 bp, Mus musculus
gccttgtcagaacctggcaccaccg

SEQ ID NO: 311066 - DNA, 25 bp, Mus musculus
gccttgtcaggggtgacacccctgg

SEQ ID NO: 311067 - DNA, 25 bp, Mus musculus
gccttgtcgggtgtgatcatggtgt

SEQ ID NO: 311068 - DNA, 25 bp, Mus musculus
gccttgtgcctacttgagcatcgat

SEQ ID NO: 311069 - DNA, 25 bp, Mus musculus
gccttgtggaaaacaacaggtttac

SEQ ID NO: 311070 - DNA, 25 bp, Mus musculus
gccttgtggaaaagctgacaacgta

SEQ ID NO: 311071 - DNA, 25 bp, Mus musculus
gccttgtggagcgggtaatggatga

SEQ ID NO: 311072 - DNA, 25 bp, Mus musculus
gccttgtggaggaactacttcatcc

SEQ ID NO: 311073 - DNA, 25 bp, Mus musculus
gccttgtgtcaaaagcctatgtccc

SEQ ID NO: 311074 - DNA, 25 bp, Mus musculus
gccttgtgtcaaaagggaagatgga

SEQ ID NO: 311075 - DNA, 25 bp, Mus musculus
gccttgtgtgttgaggatgggagtc

SEQ ID NO: 311076 - DNA, 25 bp, Mus musculus
gccttgttagaagtccctccgctcc

SEQ ID NO: 311077 - DNA, 25 bp, Mus musculus
gccttgttcaacagaacaagtaaga

SEQ ID NO: 311078 - DNA, 25 bp, Mus musculus
gccttgttcaacaggtttatggtcg

SEQ ID NO: 311079 - DNA, 25 bp, Mus musculus
gccttgttcaacagttgttggtctt

SEQ ID NO: 311080 - DNA, 25 bp, Mus musculus
gccttgttcaggacgcacccctctc

SEQ ID NO: 311081 - DNA, 25 bp, Mus musculus
gccttgttcagggggagctggtgac

SEQ ID NO: 311082 - DNA, 25 bp, Mus musculus
gcctttaacccaggtgactcatatt

SEQ ID NO: 311083 - DNA, 25 bp, Mus musculus
gcctttaatctgagaggccagtcac

SEQ ID NO: 311084 - DNA, 25 bp, Mus musculus
gcctttacaagcccttgtcccagca

SEQ ID NO: 311085 - DNA, 25 bp, Mus musculus
gcctttacagagatgagcatcagga

SEQ ID NO: 311086 - DNA, 25 bp, Mus musculus
gcctttaccagcctgccgacataag

SEQ ID NO: 311087 - DNA, 25 bp, Mus musculus
gcctttaccaggacagccacttcca

SEQ ID NO: 311088 - DNA, 25 bp, Mus musculus
gcctttaccagggtctcagcactgc

SEQ ID NO: 311089 - DNA, 25 bp, Mus musculus
gcctttacgagcagagggagccaaa

SEQ ID NO: 311090 - DNA, 25 bp, Mus musculus
gcctttactccagacaaatcgccat

SEQ ID NO: 311091 - DNA, 25 bp, Mus musculus
gcctttactccagtgcctatgactc

SEQ ID NO: 311092 - DNA, 25 bp, Mus musculus
gcctttactttcaacatcaaagtgg

SEQ ID NO: 311093 - DNA, 25 bp, Mus musculus
gcctttagcaccagttcctctttcc

SEQ ID NO: 311094 - DNA, 25 bp, Mus musculus
gcctttagccccagtggatctaaag

SEQ ID NO: 311095 - DNA, 25 bp, Mus musculus
gcctttaggtcgctgatctgccagg

SEQ ID NO: 311096 - DNA, 25 bp, Mus musculus
gcctttaggtcgctgcacacagggc

SEQ ID NO: 311097 - DNA, 25 bp, Mus musculus
gcctttatcagaaagctgtcggtga

SEQ ID NO: 311098 - DNA, 25 bp, Mus musculus
gcctttatcggatccggaagggggt

SEQ ID NO: 311099 - DNA, 25 bp, Mus musculus
gcctttcaaaggtagtttacaaatg

SEQ ID NO: 311100 - DNA, 25 bp, Mus musculus
gcctttcaacaaacgaactccaatg

SEQ ID NO: 311101 - DNA, 25 bp, Mus musculus
gcctttcatcttccaattctcctct

SEQ ID NO: 311102 - DNA, 25 bp, Mus musculus
gcctttcatgattatagtgcagcag

SEQ ID NO: 311103 - DNA, 25 bp, Mus musculus
gcctttccaacagagggagacgatg

SEQ ID NO: 311104 - DNA, 25 bp, Mus musculus
gcctttccattgtaaatcttagtgt

SEQ ID NO: 311105 - DNA, 25 bp, Mus musculus
gcctttccccggaggaattcgtgga

SEQ ID NO: 311106 - DNA, 25 bp, Mus musculus
gcctttcccggtgggacgctcgtcc

SEQ ID NO: 311107 - DNA, 25 bp, Mus musculus
gcctttccgatacgttctggaccct

SEQ ID NO: 311108 - DNA, 25 bp, Mus musculus
gcctttccgcgacagagactaggcc

SEQ ID NO: 311109 - DNA, 25 bp, Mus musculus
gcctttccgcgacaggcaggagact

SEQ ID NO: 311110 - DNA, 25 bp, Mus musculus
gcctttccgcgacaggggtccctcc

SEQ ID NO: 311111 - DNA, 25 bp, Mus musculus
gcctttccgcgacaggtcagggtat

SEQ ID NO: 311112 - DNA, 25 bp, Mus musculus
gcctttcctactggctggacccatg

SEQ ID NO: 311113 - DNA, 25 bp, Mus musculus
gcctttcctgcaagcatttgacatt

SEQ ID NO: 311114 - DNA, 25 bp, Mus musculus
gcctttcctttcaggcctcagggct

SEQ ID NO: 311115 - DNA, 25 bp, Mus musculus
gcctttctcagtcagggtgacaagg

SEQ ID NO: 311116 - DNA, 25 bp, Mus musculus
gcctttctggagaaaaacaaaatgt

SEQ ID NO: 311117 - DNA, 25 bp, Mus musculus
gcctttctgtgaagaaaagacatgc

SEQ ID NO: 311118 - DNA, 25 bp, Mus musculus
gcctttcttagacacatgcagccgc

SEQ ID NO: 311119 - DNA, 25 bp, Mus musculus
gcctttctttagtgtacactctttt

SEQ ID NO: 311120 - DNA, 25 bp, Mus musculus
gcctttctttctgccctgtttcacc

SEQ ID NO: 311121 - DNA, 25 bp, Mus musculus
gcctttgaaaaagcgctctccagtg

SEQ ID NO: 311122 - DNA, 25 bp, Mus musculus
gcctttgaaaaagctgtcaagagca

SEQ ID NO: 311123 - DNA, 25 bp, Mus musculus
gcctttgaaaagctttctccagacc

SEQ ID NO: 311124 - DNA, 25 bp, Mus musculus
gcctttgaagccaggtgtttggcct

SEQ ID NO: 311125 - DNA, 25 bp, Mus musculus
gcctttgacaaaaaatcagctgccc

SEQ ID NO: 311126 - DNA, 25 bp, Mus musculus
gcctttgacaacagctacagtaggg

SEQ ID NO: 311127 - DNA, 25 bp, Mus musculus
gcctttgacaacaggggaggcactt

SEQ ID NO: 311128 - DNA, 25 bp, Mus musculus
gcctttgaccaggaacttagcccag

SEQ ID NO: 311129 - DNA, 25 bp, Mus musculus
gcctttgaccaggtaaccggtgtgg

SEQ ID NO: 311130 - DNA, 25 bp, Mus musculus
gcctttgaccatgcggatccttcca

SEQ ID NO: 311131 - DNA, 25 bp, Mus musculus
gcctttgagaagcatgtggatggca

SEQ ID NO: 311132 - DNA, 25 bp, Mus musculus
gcctttgagaggaacaaatgtggta

SEQ ID NO: 311133 - DNA, 25 bp, Mus musculus
gcctttgaggaaagggaacgggaga

SEQ ID NO: 311134 - DNA, 25 bp, Mus musculus
gcctttgaggtcttgctgatcctac

SEQ ID NO: 311135 - DNA, 25 bp, Mus musculus
gcctttgatctgaaggaaggcgaag

SEQ ID NO: 311136 - DNA, 25 bp, Mus musculus
gcctttgatgccgtcctgcttgagc

SEQ ID NO: 311137 - DNA, 25 bp, Mus musculus
gcctttgcaaaacatggcagaagaa

SEQ ID NO: 311138 - DNA, 25 bp, Mus musculus
gcctttgcaaaagactggctggaac

SEQ ID NO: 311139 - DNA, 25 bp, Mus musculus
gcctttgcaaaagtgatctgcaatt

SEQ ID NO: 311140 - DNA, 25 bp, Mus musculus
gcctttgcaagtcaggccgtctact

SEQ ID NO: 311141 - DNA, 25 bp, Mus musculus
gcctttgcacctgagaacccatcag

SEQ ID NO: 311142 - DNA, 25 bp, Mus musculus
gcctttgcaggtgacagcagcatgg

SEQ ID NO: 311143 - DNA, 25 bp, Mus musculus
gcctttgctgcccagtttgaaggat

SEQ ID NO: 311144 - DNA, 25 bp, Mus musculus
gcctttgctggggacacccagaatg

SEQ ID NO: 311145 - DNA, 25 bp, Mus musculus
gcctttgctggggacagtaaatcca

SEQ ID NO: 311146 - DNA, 25 bp, Mus musculus
gcctttgctttgacactggccaaaa

SEQ ID NO: 311147 - DNA, 25 bp, Mus musculus
gcctttggaaagtgacactgatgag

SEQ ID NO: 311148 - DNA, 25 bp, Mus musculus
gcctttggaagagatggagagagaa

SEQ ID NO: 311149 - DNA, 25 bp, Mus musculus
gcctttggagggagttatgggggga

SEQ ID NO: 311150 - DNA, 25 bp, Mus musculus
gcctttggcaactgcgagtgctacg

SEQ ID NO: 311151 - DNA, 25 bp, Mus musculus
gcctttggcactgtagctatctctg

SEQ ID NO: 311152 - DNA, 25 bp, Mus musculus
gcctttggcagtcagaccaagccac

SEQ ID NO: 311153 - DNA, 25 bp, Mus musculus
gcctttgggaaggcgacagacttat

SEQ ID NO: 311154 - DNA, 25 bp, Mus musculus
gcctttggggatgtcgtcaccgtca

SEQ ID NO: 311155 - DNA, 25 bp, Mus musculus
gcctttgtagaccaaagcccatggc

SEQ ID NO: 311156 - DNA, 25 bp, Mus musculus
gcctttgtagaccaagtggtgtcta

SEQ ID NO: 311157 - DNA, 25 bp, Mus musculus
gcctttgtcaatctggtacaccagg

SEQ ID NO: 311158 - DNA, 25 bp, Mus musculus
gcctttgtctggaagcggcctctgg

SEQ ID NO: 311159 - DNA, 25 bp, Mus musculus
gcctttgtctggtcccccttcctgt

SEQ ID NO: 311160 - DNA, 25 bp, Mus musculus
gcctttgtgcgagacggcccccttg

SEQ ID NO: 311161 - DNA, 25 bp, Mus musculus
gcctttgttcaggaatatcgttcag

SEQ ID NO: 311162 - DNA, 25 bp, Mus musculus
gcctttgtttggtgctcctaaaagg

SEQ ID NO: 311163 - DNA, 25 bp, Mus musculus
gcctttgtttggtgttaggcaggaa

SEQ ID NO: 311164 - DNA, 25 bp, Mus musculus
gccttttacaatgctcatgacctga

SEQ ID NO: 311165 - DNA, 25 bp, Mus musculus
gccttttatcaggttccttagctgg

SEQ ID NO: 311166 - DNA, 25 bp, Mus musculus
gccttttatgcatcttggcatggct

SEQ ID NO: 311167 - DNA, 25 bp, Mus musculus
gccttttcagaactcaagctcttct

SEQ ID NO: 311168 - DNA, 25 bp, Mus musculus
gccttttcagggctacagtgcatgt

SEQ ID NO: 311169 - DNA, 25 bp, Mus musculus
gccttttccagcaatccgaaggtcc

SEQ ID NO: 311170 - DNA, 25 bp, Mus musculus
gccttttcccatcaacctgctgtcc

SEQ ID NO: 311171 - DNA, 25 bp, Mus musculus
gccttttcctcatggctgtgacatt

SEQ ID NO: 311172 - DNA, 25 bp, Mus musculus
gccttttgacagccacacctgcgcc

SEQ ID NO: 311173 - DNA, 25 bp, Mus musculus
gccttttgtaacagttggatgaaaa

SEQ ID NO: 311174 - DNA, 25 bp, Mus musculus
gccttttgtcagggattcgataaac

SEQ ID NO: 311175 - DNA, 25 bp, Mus musculus
gccttttgtgaagatcatcacagtt

SEQ ID NO: 311176 - DNA, 25 bp, Mus musculus
gcctttttcaagaccaacagcaacc

SEQ ID NO: 311177 - DNA, 25 bp, Mus musculus
gcctttttcctatattgttgatctt

SEQ ID NO: 311178 - DNA, 25 bp, Mus musculus
gcctttttcctattcttctgcccta

SEQ ID NO: 311179 - DNA, 25 bp, Mus musculus
gcgaaaaactatgagattaaaacaa

SEQ ID NO: 311180 - DNA, 25 bp, Mus musculus
gcgaaaaactatgagttctgaattt

SEQ ID NO: 311181 - DNA, 25 bp, Mus musculus
gcgaaaaagggatgactgagtggga

SEQ ID NO: 311182 - DNA, 25 bp, Mus musculus
gcgaaaaggccaagattcttcagga

SEQ ID NO: 311183 - DNA, 25 bp, Mus musculus
gcgaaaatcagatcaaagatgagaa

SEQ ID NO: 311184 - DNA, 25 bp, Mus musculus
gcgaaacagcagtgaccagctcact

SEQ ID NO: 311185 - DNA, 25 bp, Mus musculus
gcgaaaccaggtccacaggatgatt

SEQ ID NO: 311186 - DNA, 25 bp, Mus musculus
gcgaaagaagactttaagaaacaat

SEQ ID NO: 311187 - DNA, 25 bp, Mus musculus
gcgaaagaagagtggaggaaccaca

SEQ ID NO: 311188 - DNA, 25 bp, Mus musculus
gcgaaagaaggtaaaatttatgaag

SEQ ID NO: 311189 - DNA, 25 bp, Mus musculus
gcgaaagcaggtccccagcctggca

SEQ ID NO: 311190 - DNA, 25 bp, Mus musculus
gcgaaagctcagcccagtgtcgtgt

SEQ ID NO: 311191 - DNA, 25 bp, Mus musculus
gcgaaagctgataacacatgatcct

SEQ ID NO: 311192 - DNA, 25 bp, Mus musculus
gcgaaagctgattccaaattacaga

SEQ ID NO: 311193 - DNA, 25 bp, Mus musculus
gcgaaagctggttccttgtggagaa

SEQ ID NO: 311194 - DNA, 25 bp, Mus musculus
gcgaaagctggtttaactcacatta

SEQ ID NO: 311195 - DNA, 25 bp, Mus musculus
gcgaaaggaacagagtgacttaacc

SEQ ID NO: 311196 - DNA, 25 bp, Mus musculus
gcgaaaggctccaggggtgatggac

SEQ ID NO: 311197 - DNA, 25 bp, Mus musculus
gcgaaatgtgtaagctgctggctct

SEQ ID NO: 311198 - DNA, 25 bp, Mus musculus
gcgaacaagccgtggcaaggagatg

SEQ ID NO: 311199 - DNA, 25 bp, Mus musculus
gcgaacaagccgtggcattaaaaaa

SEQ ID NO: 311200 - DNA, 25 bp, Mus musculus
gcgaacaatacaggtggccaagaag

SEQ ID NO: 311201 - DNA, 25 bp, Mus musculus
gcgaacaatacagtcaggatggcta

SEQ ID NO: 311202 - DNA, 25 bp, Mus musculus
gcgaacatatttgagaagatagatg

SEQ ID NO: 311203 - DNA, 25 bp, Mus musculus
gcgaaccacagaaagcgtccatcct

SEQ ID NO: 311204 - DNA, 25 bp, Mus musculus
gcgaacctggacaagcctggacaaa

SEQ ID NO: 311205 - DNA, 25 bp, Mus musculus
gcgaacctggtagcctataacattc

SEQ ID NO: 311206 - DNA, 25 bp, Mus musculus
gcgaaccttgcccatggcgaattgt

SEQ ID NO: 311207 - DNA, 25 bp, Mus musculus
gcgaaccttgggaattcgacaccgg

SEQ ID NO: 311208 - DNA, 25 bp, Mus musculus
gcgaacgagagagctgttctctacc

SEQ ID NO: 311209 - DNA, 25 bp, Mus musculus
gcgaacgagagatgctcccttcgga

SEQ ID NO: 311210 - DNA, 25 bp, Mus musculus
gcgaacgtgttcttgacagctacca

SEQ ID NO: 311211 - DNA, 25 bp, Mus musculus
gcgaacgtgttcttggtttctgcca

SEQ ID NO: 311212 - DNA, 25 bp, Mus musculus
gcgaagaagcaatgatggagcagga

SEQ ID NO: 311213 - DNA, 25 bp, Mus musculus
gcgaagaataggtgtgatgaatgca

SEQ ID NO: 311214 - DNA, 25 bp, Mus musculus
gcgaagacgggagcgggagcagcgt

SEQ ID NO: 311215 - DNA, 25 bp, Mus musculus
gcgaagatagagatctggccgcccc

SEQ ID NO: 311216 - DNA, 25 bp, Mus musculus
gcgaagccataccggcgaacgcccg

SEQ ID NO: 311217 - DNA, 25 bp, Mus musculus
gcgaagcggaccgaggacttgtgtg

SEQ ID NO: 311218 - DNA, 25 bp, Mus musculus
gcgaagctcaaggccacttcttact

SEQ ID NO: 311219 - DNA, 25 bp, Mus musculus
gcgaagctcagagggatcagaaaca

SEQ ID NO: 311220 - DNA, 25 bp, Mus musculus
gcgaagctcccgccatgagaatttc

SEQ ID NO: 311221 - DNA, 25 bp, Mus musculus
gcgaaggaagtactattactggact

SEQ ID NO: 311222 - DNA, 25 bp, Mus musculus
gcgaaggaggatgaggaacctgggg

SEQ ID NO: 311223 - DNA, 25 bp, Mus musculus
gcgaaggagggtggccggactgcag

SEQ ID NO: 311224 - DNA, 25 bp, Mus musculus
gcgaaggatgggacaaggcctgggg

SEQ ID NO: 311225 - DNA, 25 bp, Mus musculus
gcgaaggatggtggaagaaaagtgt

SEQ ID NO: 311226 - DNA, 25 bp, Mus musculus
gcgaaggcactacagatgttcatct

SEQ ID NO: 311227 - DNA, 25 bp, Mus musculus
gcgaaggcggaagtggttctgctgc

SEQ ID NO: 311228 - DNA, 25 bp, Mus musculus
gcgaagggagcgctgatcatggctc

SEQ ID NO: 311229 - DNA, 25 bp, Mus musculus
gcgaaggtcaagcacccctattgag

SEQ ID NO: 311230 - DNA, 25 bp, Mus musculus
gcgaaggtcaaggccacaggcctct

SEQ ID NO: 311231 - DNA, 25 bp, Mus musculus
gcgaagtctgtgattcgtaagacag

SEQ ID NO: 311232 - DNA, 25 bp, Mus musculus
gcgaagtcttcgtgggacctcgcaa

SEQ ID NO: 311233 - DNA, 25 bp, Mus musculus
gcgaagtggagagcgtgaaagagtt

SEQ ID NO: 311234 - DNA, 25 bp, Mus musculus
gcgaatcaaagagatggatctgtcc

SEQ ID NO: 311235 - DNA, 25 bp, Mus musculus
gcgaatcaaagaggatgtatataca

SEQ ID NO: 311236 - DNA, 25 bp, Mus musculus
gcgaatccccaggcacagaaggagc

SEQ ID NO: 311237 - DNA, 25 bp, Mus musculus
gcgaatccccagtatgcagtgtata

SEQ ID NO: 311238 - DNA, 25 bp, Mus musculus
gcgaatcggtgttgagaaactctct

SEQ ID NO: 311239 - DNA, 25 bp, Mus musculus
gcgaatgatcagatgagaggctgta

SEQ ID NO: 311240 - DNA, 25 bp, Mus musculus
gcgaatggaaggagagtccagatta

SEQ ID NO: 311241 - DNA, 25 bp, Mus musculus
gcgaatggagggtggagcttttgtg

SEQ ID NO: 311242 - DNA, 25 bp, Mus musculus
gcgaatggtttttggtctcagtgtg

SEQ ID NO: 311243 - DNA, 25 bp, Mus musculus
gcgaattgttgggatgattgcgaag

SEQ ID NO: 311244 - DNA, 25 bp, Mus musculus
gcgaatttaacacagtgttgctggc

SEQ ID NO: 311245 - DNA, 25 bp, Mus musculus
gcgacaaacagaacagaaaagaaat

SEQ ID NO: 311246 - DNA, 25 bp, Mus musculus
gcgacaaacagaatgcaacaaggat

SEQ ID NO: 311247 - DNA, 25 bp, Mus musculus
gcgacaacagatggagaagtcttta

SEQ ID NO: 311248 - DNA, 25 bp, Mus musculus
gcgacaacatctggagagagacttg

SEQ ID NO: 311249 - DNA, 25 bp, Mus musculus
gcgacaagatgcctggccgagtggt

SEQ ID NO: 311250 - DNA, 25 bp, Mus musculus
gcgacaagccgaactgctttgagct

SEQ ID NO: 311251 - DNA, 25 bp, Mus musculus
gcgacaaggcggcagactttctgca

SEQ ID NO: 311252 - DNA, 25 bp, Mus musculus
gcgacaaggtaaaagaagaaatgaa

SEQ ID NO: 311253 - DNA, 25 bp, Mus musculus
gcgacaatgacgatagaaagatcct

SEQ ID NO: 311254 - DNA, 25 bp, Mus musculus
gcgacaatgacgattctgactgccc

SEQ ID NO: 311255 - DNA, 25 bp, Mus musculus
gcgacaatgatgaagactctaaaat

SEQ ID NO: 311256 - DNA, 25 bp, Mus musculus
gcgacaatgatgaaggaaagaagaa

SEQ ID NO: 311257 - DNA, 25 bp, Mus musculus
gcgacaccaggaacaccggacagaa

SEQ ID NO: 311258 - DNA, 25 bp, Mus musculus
gcgacaccggcagaaaaagttacgt

SEQ ID NO: 311259 - DNA, 25 bp, Mus musculus
gcgacaccggcagttccagttacta

SEQ ID NO: 311260 - DNA, 25 bp, Mus musculus
gcgacacggagacgaccatgccgtc

SEQ ID NO: 311261 - DNA, 25 bp, Mus musculus
gcgacagaaagatgtccgaccccgg

SEQ ID NO: 311262 - DNA, 25 bp, Mus musculus
gcgacagaaaggaatcccaatgctg

SEQ ID NO: 311263 - DNA, 25 bp, Mus musculus
gcgacagattggttctaggtcttat

SEQ ID NO: 311264 - DNA, 25 bp, Mus musculus
gcgacagcaggaagacaggaagatc

SEQ ID NO: 311265 - DNA, 25 bp, Mus musculus
gcgacagcaggaaggaaagaaagga

SEQ ID NO: 311266 - DNA, 25 bp, Mus musculus
gcgacagccaggtatgccatcatgc

SEQ ID NO: 311267 - DNA, 25 bp, Mus musculus
gcgacagcccaagcgaaccccagct

SEQ ID NO: 311268 - DNA, 25 bp, Mus musculus
gcgacagcggcaaaatagtgtttct

SEQ ID NO: 311269 - DNA, 25 bp, Mus musculus
gcgacagcgggcgggattcccgaag

SEQ ID NO: 311270 - DNA, 25 bp, Mus musculus
gcgacagtacctggaggagctgcag

SEQ ID NO: 311271 - DNA, 25 bp, Mus musculus
gcgacatcacaagagccccatgcta

SEQ ID NO: 311272 - DNA, 25 bp, Mus musculus
gcgacatcacaaggatgatgagggt

SEQ ID NO: 311273 - DNA, 25 bp, Mus musculus
gcgacatcactcagctttccactgc

SEQ ID NO: 311274 - DNA, 25 bp, Mus musculus
gcgacatcgacatcaagatcatcgc

SEQ ID NO: 311275 - DNA, 25 bp, Mus musculus
gcgacatctcaggtgtcgttgacat

SEQ ID NO: 311276 - DNA, 25 bp, Mus musculus
gcgacatggaagcaagtgtggaggc

SEQ ID NO: 311277 - DNA, 25 bp, Mus musculus
gcgacatgttcaaggtaattcagag

SEQ ID NO: 311278 - DNA, 25 bp, Mus musculus
gcgaccaacagaaaacaagcacgag

SEQ ID NO: 311279 - DNA, 25 bp, Mus musculus
gcgaccaacagattcctgttgcgtg

SEQ ID NO: 311280 - DNA, 25 bp, Mus musculus
gcgaccaatgagggagagcccatga

SEQ ID NO: 311281 - DNA, 25 bp, Mus musculus
gcgaccagaggcagagtgaagaaat

SEQ ID NO: 311282 - DNA, 25 bp, Mus musculus
gcgaccagatgcggtggtagcaaag

SEQ ID NO: 311283 - DNA, 25 bp, Mus musculus
gcgacccaagttgcatttaaatatt

SEQ ID NO: 311284 - DNA, 25 bp, Mus musculus
gcgacccaagttgctggacaaattt

SEQ ID NO: 311285 - DNA, 25 bp, Mus musculus
gcgacccacacgtcaaactacaact

SEQ ID NO: 311286 - DNA, 25 bp, Mus musculus
gcgacccagagcttagttcacaagc

SEQ ID NO: 311287 - DNA, 25 bp, Mus musculus
gcgacccaggacgagggcttcatca

SEQ ID NO: 311288 - DNA, 25 bp, Mus musculus
gcgaccccagctctatttcagaatc

SEQ ID NO: 311289 - DNA, 25 bp, Mus musculus
gcgaccccaggaccagctctctcct

SEQ ID NO: 311290 - DNA, 25 bp, Mus musculus
gcgaccccggcaggtcagaagacat

SEQ ID NO: 311291 - DNA, 25 bp, Mus musculus
gcgaccctctaaagacaagattgag

SEQ ID NO: 311292 - DNA, 25 bp, Mus musculus
gcgaccctctaaagacatcgcctgg

SEQ ID NO: 311293 - DNA, 25 bp, Mus musculus
gcgaccctgacagagtcatgtggct

SEQ ID NO: 311294 - DNA, 25 bp, Mus musculus
gcgaccctgcaagagttctttttgc

SEQ ID NO: 311295 - DNA, 25 bp, Mus musculus
gcgaccctgcaagatggagggggca

SEQ ID NO: 311296 - DNA, 25 bp, Mus musculus
gcgaccgcagacgggaccttctttt

SEQ ID NO: 311297 - DNA, 25 bp, Mus musculus
gcgaccgcagacgggagctgcaaag

SEQ ID NO: 311298 - DNA, 25 bp, Mus musculus
gcgaccgcagcaacccttctgggtg

SEQ ID NO: 311299 - DNA, 25 bp, Mus musculus
gcgaccgcccgaaacaagaagcact

SEQ ID NO: 311300 - DNA, 25 bp, Mus musculus
gcgaccgcccggtagtgtctctatt

SEQ ID NO: 311301 - DNA, 25 bp, Mus musculus
gcgaccgcccggtgttgcttctgct

SEQ ID NO: 311302 - DNA, 25 bp, Mus musculus
gcgaccggctgaaggcagacacatc

SEQ ID NO: 311303 - DNA, 25 bp, Mus musculus
gcgaccggctgaaggcttgtgaaaa

SEQ ID NO: 311304 - DNA, 25 bp, Mus musculus
gcgaccggctgaagggcctctggaa

SEQ ID NO: 311305 - DNA, 25 bp, Mus musculus
gcgaccgtgatggtaacaaatcaca

SEQ ID NO: 311306 - DNA, 25 bp, Mus musculus
gcgaccgtggctcctaatgtacagc

SEQ ID NO: 311307 - DNA, 25 bp, Mus musculus
gcgacctagaaggttttaggctagc

SEQ ID NO: 311308 - DNA, 25 bp, Mus musculus
gcgacctccgcaatttcaccgagat

SEQ ID NO: 311309 - DNA, 25 bp, Mus musculus
gcgacctccgcagctaggtaatttt

SEQ ID NO: 311310 - DNA, 25 bp, Mus musculus
gcgacctcctgataggcaacatgtc

SEQ ID NO: 311311 - DNA, 25 bp, Mus musculus
gcgacctctgtggtaacatggccaa

SEQ ID NO: 311312 - DNA, 25 bp, Mus musculus
gcgaccttcagggaaaatgccaagt

SEQ ID NO: 311313 - DNA, 25 bp, Mus musculus
gcgaccttccagcagcagcatgaag

SEQ ID NO: 311314 - DNA, 25 bp, Mus musculus
gcgacgcagaaaaccaacagaacca

SEQ ID NO: 311315 - DNA, 25 bp, Mus musculus
gcgacgcagaggagcctttgggatt

SEQ ID NO: 311316 - DNA, 25 bp, Mus musculus
gcgacgccgcgaggatctaagatgt

SEQ ID NO: 311317 - DNA, 25 bp, Mus musculus
gcgacgcgcggaggaaaacttggtt

SEQ ID NO: 311318 - DNA, 25 bp, Mus musculus
gcgacgctggctctctcttggcctg

SEQ ID NO: 311319 - DNA, 25 bp, Mus musculus
gcgacggaagctgagccagacccag

SEQ ID NO: 311320 - DNA, 25 bp, Mus musculus
gcgacggaagctgatcctcttccca

SEQ ID NO: 311321 - DNA, 25 bp, Mus musculus
gcgacggaggcagcatctgcatctc

SEQ ID NO: 311322 - DNA, 25 bp, Mus musculus
gcgacggccctaagggtggaactac

SEQ ID NO: 311323 - DNA, 25 bp, Mus musculus
gcgacggccctaaggtttgaggatt

SEQ ID NO: 311324 - DNA, 25 bp, Mus musculus
gcgacggccctaagtgggagccggt

SEQ ID NO: 311325 - DNA, 25 bp, Mus musculus
gcgacggcgctatggtggattgtcc

SEQ ID NO: 311326 - DNA, 25 bp, Mus musculus
gcgacggttccgagctgtagccctc

SEQ ID NO: 311327 - DNA, 25 bp, Mus musculus
gcgacgtcagacacttagctgcctg

SEQ ID NO: 311328 - DNA, 25 bp, Mus musculus
gcgacgtcaggtactcaatgcaaga

SEQ ID NO: 311329 - DNA, 25 bp, Mus musculus
gcgacgtctggagaatgctgggacc

SEQ ID NO: 311330 - DNA, 25 bp, Mus musculus
gcgacgtctggagcttcggggttct

SEQ ID NO: 311331 - DNA, 25 bp, Mus musculus
gcgacgtggaggaggtattcacaga

SEQ ID NO: 311332 - DNA, 25 bp, Mus musculus
gcgactaagcaggaagggatggaag

SEQ ID NO: 311333 - DNA, 25 bp, Mus musculus
gcgactacatggccatccacaagga

SEQ ID NO: 311334 - DNA, 25 bp, Mus musculus
gcgactatagctctccaggtcaatg

SEQ ID NO: 311335 - DNA, 25 bp, Mus musculus
gcgactatagctctctgctcagtac

SEQ ID NO: 311336 - DNA, 25 bp, Mus musculus
gcgactctaggttgcagtgtgtgct

SEQ ID NO: 311337 - DNA, 25 bp, Mus musculus
gcgactctgagacagactgcatgta

SEQ ID NO: 311338 - DNA, 25 bp, Mus musculus
gcgactctgagagcagaggggcagg

SEQ ID NO: 311339 - DNA, 25 bp, Mus musculus
gcgactgagcacacctgaggagagg

SEQ ID NO: 311340 - DNA, 25 bp, Mus musculus
gcgactgaggcgccgcccggttaac

SEQ ID NO: 311341 - DNA, 25 bp, Mus musculus
gcgactgcagcctattccaagccta

SEQ ID NO: 311342 - DNA, 25 bp, Mus musculus
gcgactgcaggtaacgggcaaccaa

SEQ ID NO: 311343 - DNA, 25 bp, Mus musculus
gcgactgctccgagctcacaggaag

SEQ ID NO: 311344 - DNA, 25 bp, Mus musculus
gcgactggagaaggtcttcgcttat

SEQ ID NO: 311345 - DNA, 25 bp, Mus musculus
gcgactggagaagtatgtgggtgcc

SEQ ID NO: 311346 - DNA, 25 bp, Mus musculus
gcgactggctatcccagatggatga

SEQ ID NO: 311347 - DNA, 25 bp, Mus musculus
gcgactgtctcagatcttgtaggac

SEQ ID NO: 311348 - DNA, 25 bp, Mus musculus
gcgactgtggagtgtgcacagcccc

SEQ ID NO: 311349 - DNA, 25 bp, Mus musculus
gcgactgtgtttgaggaattatttt

SEQ ID NO: 311350 - DNA, 25 bp, Mus musculus
gcgacttaccaaagaggaattcaag

SEQ ID NO: 311351 - DNA, 25 bp, Mus musculus
gcgacttccaccaaggcctcctatc

SEQ ID NO: 311352 - DNA, 25 bp, Mus musculus
gcgacttccaccaaggtatggtgtg

SEQ ID NO: 311353 - DNA, 25 bp, Mus musculus
gcgacttccctgagctcaccatgga

SEQ ID NO: 311354 - DNA, 25 bp, Mus musculus
gcgactttcctcaggacccctcatg

SEQ ID NO: 311355 - DNA, 25 bp, Mus musculus
gcgagaaacagcaacattacttcac

SEQ ID NO: 311356 - DNA, 25 bp, Mus musculus
gcgagaaacagcgtcatagcaggag

SEQ ID NO: 311357 - DNA, 25 bp, Mus musculus
gcgagaaactgatgaagtgactgag

SEQ ID NO: 311358 - DNA, 25 bp, Mus musculus
gcgagaaatgagagaaacgcaccaa

SEQ ID NO: 311359 - DNA, 25 bp, Mus musculus
gcgagaaatggaaacagctgctgtc

SEQ ID NO: 311360 - DNA, 25 bp, Mus musculus
gcgagaacctggagacggaccagtg

SEQ ID NO: 311361 - DNA, 25 bp, Mus musculus
gcgagaagaaggagaaaatcacttc

SEQ ID NO: 311362 - DNA, 25 bp, Mus musculus
gcgagaagaaggagccagctattca

SEQ ID NO: 311363 - DNA, 25 bp, Mus musculus
gcgagaaggacccggctcgcgctgc

SEQ ID NO: 311364 - DNA, 25 bp, Mus musculus
gcgagacaactaaattttccaatga

SEQ ID NO: 311365 - DNA, 25 bp, Mus musculus
gcgagacaactggaacccacagttc

SEQ ID NO: 311366 - DNA, 25 bp, Mus musculus
gcgagacccaaatcttggtgggctg

SEQ ID NO: 311367 - DNA, 25 bp, Mus musculus
gcgagaccctgatctgggggatggg

SEQ ID NO: 311368 - DNA, 25 bp, Mus musculus
gcgagaccggggcatggaacaagat

SEQ ID NO: 311369 - DNA, 25 bp, Mus musculus
gcgagacctgtatagcagaacatca

SEQ ID NO: 311370 - DNA, 25 bp, Mus musculus
gcgagacgaaagcagcttttaatat

SEQ ID NO: 311371 - DNA, 25 bp, Mus musculus
gcgagacgcgcctcgataaggaaaa

SEQ ID NO: 311372 - DNA, 25 bp, Mus musculus
gcgagacgtggaggtactatgcctg

SEQ ID NO: 311373 - DNA, 25 bp, Mus musculus
gcgagactaaagaaacgtgttcctg

SEQ ID NO: 311374 - DNA, 25 bp, Mus musculus
gcgagactaagaccatggccaaagt

SEQ ID NO: 311375 - DNA, 25 bp, Mus musculus
gcgagactaagagccccactgctgc

SEQ ID NO: 311376 - DNA, 25 bp, Mus musculus
gcgagactgagagccctgagcccgg

SEQ ID NO: 311377 - DNA, 25 bp, Mus musculus
gcgagactgagaggctatcagggcg

SEQ ID NO: 311378 - DNA, 25 bp, Mus musculus
gcgagactgaggaagattgacttct

SEQ ID NO: 311379 - DNA, 25 bp, Mus musculus
gcgagacttgcaaaaggtgctggat

SEQ ID NO: 311380 - DNA, 25 bp, Mus musculus
gcgagagactgacctagtctggctt

SEQ ID NO: 311381 - DNA, 25 bp, Mus musculus
gcgagagcagaaggaacttgacctc

SEQ ID NO: 311382 - DNA, 25 bp, Mus musculus
gcgagagctgctacgatgcagacag

SEQ ID NO: 311383 - DNA, 25 bp, Mus musculus
gcgagagctgctacgccacacagtc

SEQ ID NO: 311384 - DNA, 25 bp, Mus musculus
gcgagaggagcagcggcccctgaag

SEQ ID NO: 311385 - DNA, 25 bp, Mus musculus
gcgagaggagggctctggtctggcc

SEQ ID NO: 311386 - DNA, 25 bp, Mus musculus
gcgagaggagggtgctgactactct

SEQ ID NO: 311387 - DNA, 25 bp, Mus musculus
gcgagaggaggtctcgaagtcctcg

SEQ ID NO: 311388 - DNA, 25 bp, Mus musculus
gcgagagggtggtccggtgagcaac

SEQ ID NO: 311389 - DNA, 25 bp, Mus musculus
gcgagaggtcaaggccccacgcatg

SEQ ID NO: 311390 - DNA, 25 bp, Mus musculus
gcgagagtccacgagaaatggaaga

SEQ ID NO: 311391 - DNA, 25 bp, Mus musculus
gcgagagtccacgatatgttttctt

SEQ ID NO: 311392 - DNA, 25 bp, Mus musculus
gcgagagtccacggttttctctgtg

SEQ ID NO: 311393 - DNA, 25 bp, Mus musculus
gcgagagtgggctgtaaaaaatggt

SEQ ID NO: 311394 - DNA, 25 bp, Mus musculus
gcgagagttctctagaaccaggcag

SEQ ID NO: 311395 - DNA, 25 bp, Mus musculus
gcgagatcaaagcactggcgcctgc

SEQ ID NO: 311396 - DNA, 25 bp, Mus musculus
gcgagatcaaagcactgggggagct

SEQ ID NO: 311397 - DNA, 25 bp, Mus musculus
gcgagatcatcaaaccagaagattt

SEQ ID NO: 311398 - DNA, 25 bp, Mus musculus
gcgagatcctcaaggggaaactgtt

SEQ ID NO: 311399 - DNA, 25 bp, Mus musculus
gcgagatctcaggtctcctgtgagc

SEQ ID NO: 311400 - DNA, 25 bp, Mus musculus
gcgagatgaagcacacaggcatttg

SEQ ID NO: 311401 - DNA, 25 bp, Mus musculus
gcgagatttcccagaccacgaactg

SEQ ID NO: 311402 - DNA, 25 bp, Mus musculus
gcgagatttcccagggatccggcac

SEQ ID NO: 311403 - DNA, 25 bp, Mus musculus
gcgagcaaaaagatttaaggcaaga

SEQ ID NO: 311404 - DNA, 25 bp, Mus musculus
gcgagcaaaaagggcaacaatagtt

SEQ ID NO: 311405 - DNA, 25 bp, Mus musculus
gcgagcacccgggatacacttttgg

SEQ ID NO: 311406 - DNA, 25 bp, Mus musculus
gcgagcacccggggaggcagagtaa

SEQ ID NO: 311407 - DNA, 25 bp, Mus musculus
gcgagcacggttcagatcctgaggg

SEQ ID NO: 311408 - DNA, 25 bp, Mus musculus
gcgagcactcaggagttttgggaat

SEQ ID NO: 311409 - DNA, 25 bp, Mus musculus
gcgagcagaaacttggacccttctg

SEQ ID NO: 311410 - DNA, 25 bp, Mus musculus
gcgagcagatgagggcgctgtgtgc

SEQ ID NO: 311411 - DNA, 25 bp, Mus musculus
gcgagcagccatgatgagtctcctc

SEQ ID NO: 311412 - DNA, 25 bp, Mus musculus
gcgagcaggacgggaaggatgcgaa

SEQ ID NO: 311413 - DNA, 25 bp, Mus musculus
gcgagcaggagagcgtgaaagagtt

SEQ ID NO: 311414 - DNA, 25 bp, Mus musculus
gcgagccaaaatgggctccgggcct

SEQ ID NO: 311415 - DNA, 25 bp, Mus musculus
gcgagccaaaatgggttttatggaa

SEQ ID NO: 311416 - DNA, 25 bp, Mus musculus
gcgagccacatttgccaaaaagcag

SEQ ID NO: 311417 - DNA, 25 bp, Mus musculus
gcgagccagcagctctgaactccaa

SEQ ID NO: 311418 - DNA, 25 bp, Mus musculus
gcgagccaggatgtccacctcgtac

SEQ ID NO: 311419 - DNA, 25 bp, Mus musculus
gcgagccagggcaaaggagcatttt

SEQ ID NO: 311420 - DNA, 25 bp, Mus musculus
gcgagccatcacaggccggatccca

SEQ ID NO: 311421 - DNA, 25 bp, Mus musculus
gcgagcccaagatctataacaatct

SEQ ID NO: 311422 - DNA, 25 bp, Mus musculus
gcgagcccagcaggaagatgcatta

SEQ ID NO: 311423 - DNA, 25 bp, Mus musculus
gcgagcccaggatgggctctaagtc

SEQ ID NO: 311424 - DNA, 25 bp, Mus musculus
gcgagcccaggcaagaagacagcaa

SEQ ID NO: 311425 - DNA, 25 bp, Mus musculus
gcgagcccagggaatatttttagtc

SEQ ID NO: 311426 - DNA, 25 bp, Mus musculus
gcgagcccagtacgctccagaagga

SEQ ID NO: 311427 - DNA, 25 bp, Mus musculus
gcgagccccaaatgaaaacgggccc

SEQ ID NO: 311428 - DNA, 25 bp, Mus musculus
gcgagccccaacggcagccacaagt

SEQ ID NO: 311429 - DNA, 25 bp, Mus musculus
gcgagcccccatgattcagtaacct

SEQ ID NO: 311430 - DNA, 25 bp, Mus musculus
gcgagcccccatggctccataccca

SEQ ID NO: 311431 - DNA, 25 bp, Mus musculus
gcgagcccctcggtcttcaaagctt

SEQ ID NO: 311432 - DNA, 25 bp, Mus musculus
gcgagcccgcatggattccaggtgt

SEQ ID NO: 311433 - DNA, 25 bp, Mus musculus
gcgagcccgcgaggtcactatcgtc

SEQ ID NO: 311434 - DNA, 25 bp, Mus musculus
gcgagcccgtggttgtgccccctct

SEQ ID NO: 311435 - DNA, 25 bp, Mus musculus
gcgagccgagctgtcacgaccggag

SEQ ID NO: 311436 - DNA, 25 bp, Mus musculus
gcgagccgcagtggttttatgaaga

SEQ ID NO: 311437 - DNA, 25 bp, Mus musculus
gcgagccgccgggagatgctgttga

SEQ ID NO: 311438 - DNA, 25 bp, Mus musculus
gcgagcgaagagagcaaagaccatg

SEQ ID NO: 311439 - DNA, 25 bp, Mus musculus
gcgagcgaagtaagcggaggcctgg

SEQ ID NO: 311440 - DNA, 25 bp, Mus musculus
gcgagcgagcgtgacctacagcact

SEQ ID NO: 311441 - DNA, 25 bp, Mus musculus
gcgagcgcagttacccagcatgcca

SEQ ID NO: 311442 - DNA, 25 bp, Mus musculus
gcgagcgcggggccgcaagcagtgc

SEQ ID NO: 311443 - DNA, 25 bp, Mus musculus
gcgagcggaaactcacaggctaagc

SEQ ID NO: 311444 - DNA, 25 bp, Mus musculus
gcgagcggaaactggatcgcttcaa

SEQ ID NO: 311445 - DNA, 25 bp, Mus musculus
gcgagcggtcctaacatttaaaaag

SEQ ID NO: 311446 - DNA, 25 bp, Mus musculus
gcgagcggtcctagtcttctcagta

SEQ ID NO: 311447 - DNA, 25 bp, Mus musculus
gcgagcgtctggcaggtccaagggt

SEQ ID NO: 311448 - DNA, 25 bp, Mus musculus
gcgagctaacctgagattacaagag

SEQ ID NO: 311449 - DNA, 25 bp, Mus musculus
gcgagctaacctgaggcatgtctag

SEQ ID NO: 311450 - DNA, 25 bp, Mus musculus
gcgagctacaagtattctgaggaag

SEQ ID NO: 311451 - DNA, 25 bp, Mus musculus
gcgagctccagcaagaaaaattcct

SEQ ID NO: 311452 - DNA, 25 bp, Mus musculus
gcgagctccgcaaagagaggcagat

SEQ ID NO: 311453 - DNA, 25 bp, Mus musculus
gcgagctccgcaaagccaaatcaaa

SEQ ID NO: 311454 - DNA, 25 bp, Mus musculus
gcgagctccggaaaattgtgcaagc

SEQ ID NO: 311455 - DNA, 25 bp, Mus musculus
gcgagctctgcttgctggttgttgg

SEQ ID NO: 311456 - DNA, 25 bp, Mus musculus
gcgagctgaaattctgtcccctctg

SEQ ID NO: 311457 - DNA, 25 bp, Mus musculus
gcgagctggtgtcagacatggctaa

SEQ ID NO: 311458 - DNA, 25 bp, Mus musculus
gcgagctggtgtcagtctctgcttc

SEQ ID NO: 311459 - DNA, 25 bp, Mus musculus
gcgagctgtgtggaaaaaatgtggg

SEQ ID NO: 311460 - DNA, 25 bp, Mus musculus
gcgagctgtgtggtgacttaccaat

SEQ ID NO: 311461 - DNA, 25 bp, Mus musculus
gcgagctgttgatgtgatggcacca

SEQ ID NO: 311462 - DNA, 25 bp, Mus musculus
gcgagcttaaagatcgatcccgcag

SEQ ID NO: 311463 - DNA, 25 bp, Mus musculus
gcgagctttcctttgaagcacctaa

SEQ ID NO: 311464 - DNA, 25 bp, Mus musculus
gcgaggaaacaggcactctcgattt

SEQ ID NO: 311465 - DNA, 25 bp, Mus musculus
gcgaggaaggcaggaaagaagaggt

SEQ ID NO: 311466 - DNA, 25 bp, Mus musculus
gcgaggacagaaccatccgagtatg

SEQ ID NO: 311467 - DNA, 25 bp, Mus musculus
gcgaggacagccccttgctctgcca

SEQ ID NO: 311468 - DNA, 25 bp, Mus musculus
gcgaggacagcgactttgaagattc

SEQ ID NO: 311469 - DNA, 25 bp, Mus musculus
gcgaggacagcggctggaatggtct

SEQ ID NO: 311470 - DNA, 25 bp, Mus musculus
gcgaggacgagagctctatttcagt

SEQ ID NO: 311471 - DNA, 25 bp, Mus musculus
gcgaggacgagagctctggtgcaag

SEQ ID NO: 311472 - DNA, 25 bp, Mus musculus
gcgaggacgatccactgcaacacac

SEQ ID NO: 311473 - DNA, 25 bp, Mus musculus
gcgaggacgggctgtccttgttgga

SEQ ID NO: 311474 - DNA, 25 bp, Mus musculus
gcgaggactagtgttacaggtggga

SEQ ID NO: 311475 - DNA, 25 bp, Mus musculus
gcgaggactgcaagctaccttgcaa

SEQ ID NO: 311476 - DNA, 25 bp, Mus musculus
gcgaggactgcaagctgccctgcaa

SEQ ID NO: 311477 - DNA, 25 bp, Mus musculus
gcgaggacttcaggtggaccagcac

SEQ ID NO: 311478 - DNA, 25 bp, Mus musculus
gcgaggagagcaaggataagcgccg

SEQ ID NO: 311479 - DNA, 25 bp, Mus musculus
gcgaggagcagaggctgtgtgaagg

SEQ ID NO: 311480 - DNA, 25 bp, Mus musculus
gcgaggagcagatatggcctccatc

SEQ ID NO: 311481 - DNA, 25 bp, Mus musculus
gcgaggaggagctggagcacagcca

SEQ ID NO: 311482 - DNA, 25 bp, Mus musculus
gcgaggaggaggccctgcgggcgct

SEQ ID NO: 311483 - DNA, 25 bp, Mus musculus
gcgaggagggttcagcccttcccct

SEQ ID NO: 311484 - DNA, 25 bp, Mus musculus
gcgaggagggttcagctcggatgtg

SEQ ID NO: 311485 - DNA, 25 bp, Mus musculus
gcgaggagttcgcccccatggctgc

SEQ ID NO: 311486 - DNA, 25 bp, Mus musculus
gcgaggatggtcatgaaagtccact

SEQ ID NO: 311487 - DNA, 25 bp, Mus musculus
gcgaggcagttgttctccatggccc

SEQ ID NO: 311488 - DNA, 25 bp, Mus musculus
gcgaggcatgtggctctggtttcca

SEQ ID NO: 311489 - DNA, 25 bp, Mus musculus
gcgaggccaggcgggctgggaaggt

SEQ ID NO: 311490 - DNA, 25 bp, Mus musculus
gcgaggccccactcctgaaaggact

SEQ ID NO: 311491 - DNA, 25 bp, Mus musculus
gcgaggccctggtcacaggctctcc

SEQ ID NO: 311492 - DNA, 25 bp, Mus musculus
gcgaggccctggtcacaggctctgt

SEQ ID NO: 311493 - DNA, 25 bp, Mus musculus
gcgaggccgagatctgtcgctttat

SEQ ID NO: 311494 - DNA, 25 bp, Mus musculus
gcgaggccgaggttgcttcctagaa

SEQ ID NO: 311495 - DNA, 25 bp, Mus musculus
gcgaggccgcaatctgtcgctttat

SEQ ID NO: 311496 - DNA, 25 bp, Mus musculus
gcgaggcctccacagagctggtggt

SEQ ID NO: 311497 - DNA, 25 bp, Mus musculus
gcgaggcgagcgtgcacagtgctct

SEQ ID NO: 311498 - DNA, 25 bp, Mus musculus
gcgaggcgaggcaccatgacaaccc

SEQ ID NO: 311499 - DNA, 25 bp, Mus musculus
gcgaggcgccacgacctgtgctacc

SEQ ID NO: 311500 - DNA, 25 bp, Mus musculus
gcgaggcgccacggtagcgcctggc

SEQ ID NO: 311501 - DNA, 25 bp, Mus musculus
gcgaggctccaagggatttggtttc

SEQ ID NO: 311502 - DNA, 25 bp, Mus musculus
gcgaggctccaaggttaataatgcg

SEQ ID NO: 311503 - DNA, 25 bp, Mus musculus
gcgaggctggaggcaccatgagcca

SEQ ID NO: 311504 - DNA, 25 bp, Mus musculus
gcgagggcgaggatcatctgtctgg

SEQ ID NO: 311505 - DNA, 25 bp, Mus musculus
gcgagggcggcagacgccagtgctg

SEQ ID NO: 311506 - DNA, 25 bp, Mus musculus
gcgaggggaagattgcatctgggta

SEQ ID NO: 311507 - DNA, 25 bp, Mus musculus
gcgaggggaaggtgaagtatttgtt

SEQ ID NO: 311508 - DNA, 25 bp, Mus musculus
gcgaggggtgagctgaacccccgtt

SEQ ID NO: 311509 - DNA, 25 bp, Mus musculus
gcgagggtcgcgcagcgtgcagggt

SEQ ID NO: 311510 - DNA, 25 bp, Mus musculus
gcgaggtcttcgaaagaaccaagca

SEQ ID NO: 311511 - DNA, 25 bp, Mus musculus
gcgaggtcttcggccttcccaggac

SEQ ID NO: 311512 - DNA, 25 bp, Mus musculus
gcgaggtgcctgggtccaagccggc

SEQ ID NO: 311513 - DNA, 25 bp, Mus musculus
gcgaggtgcctgttaaagtccgcgg

SEQ ID NO: 311514 - DNA, 25 bp, Mus musculus
gcgaggtggagcatacatccatcct

SEQ ID NO: 311515 - DNA, 25 bp, Mus musculus
gcgaggtggaggagagaacattgaa

SEQ ID NO: 311516 - DNA, 25 bp, Mus musculus
gcgaggtggaggtggcctggggagt

SEQ ID NO: 311517 - DNA, 25 bp, Mus musculus
gcgaggttcaagtagtatctttacc

SEQ ID NO: 311518 - DNA, 25 bp, Mus musculus
gcgaggttgttaagactactgggaa

SEQ ID NO: 311519 - DNA, 25 bp, Mus musculus
gcgaggttgttaagatcctggaccg

SEQ ID NO: 311520 - DNA, 25 bp, Mus musculus
gcgagtaagtccagatctgatttgt

SEQ ID NO: 311521 - DNA, 25 bp, Mus musculus
gcgagtagcaggaataaacacgttt

SEQ ID NO: 311522 - DNA, 25 bp, Mus musculus
gcgagtagcaggaggcgtccggtcg

SEQ ID NO: 311523 - DNA, 25 bp, Mus musculus
gcgagtatttgctggtgctgtagcc

SEQ ID NO: 311524 - DNA, 25 bp, Mus musculus
gcgagtcacctgctgtaattggcaa

SEQ ID NO: 311525 - DNA, 25 bp, Mus musculus
gcgagtcatcaacctaatgcctgaa

SEQ ID NO: 311526 - DNA, 25 bp, Mus musculus
gcgagtcccaagccccacccacaaa

SEQ ID NO: 311527 - DNA, 25 bp, Mus musculus
gcgagtcccaggtttgaagagtggc

SEQ ID NO: 311528 - DNA, 25 bp, Mus musculus
gcgagtcccagtgctgtaattacag

SEQ ID NO: 311529 - DNA, 25 bp, Mus musculus
gcgagtccttatgacacgtccccat

SEQ ID NO: 311530 - DNA, 25 bp, Mus musculus
gcgagtcgccggaggacacagagct

SEQ ID NO: 311531 - DNA, 25 bp, Mus musculus
gcgagtctactcggaaaaagagagg

SEQ ID NO: 311532 - DNA, 25 bp, Mus musculus
gcgagtctactgtctgccaaaatgt

SEQ ID NO: 311533 - DNA, 25 bp, Mus musculus
gcgagtctcggcaaagtctactgac

SEQ ID NO: 311534 - DNA, 25 bp, Mus musculus
gcgagtctcgggactgaggctcagc

SEQ ID NO: 311535 - DNA, 25 bp, Mus musculus
gcgagtcttcggggccctctgtcct

SEQ ID NO: 311536 - DNA, 25 bp, Mus musculus
gcgagtctttcaggaagaagacctt

SEQ ID NO: 311537 - DNA, 25 bp, Mus musculus
gcgagtgactgtgtaacggagcacc

SEQ ID NO: 311538 - DNA, 25 bp, Mus musculus
gcgagtgagccccagaccacctcat

SEQ ID NO: 311539 - DNA, 25 bp, Mus musculus
gcgagtgagccccaggtctgtctcc

SEQ ID NO: 311540 - DNA, 25 bp, Mus musculus
gcgagtgatgcttattctttgggag

SEQ ID NO: 311541 - DNA, 25 bp, Mus musculus
gcgagtggaaggtcctcatcatgga

SEQ ID NO: 311542 - DNA, 25 bp, Mus musculus
gcgagtggaagtcgtggaagacatc

SEQ ID NO: 311543 - DNA, 25 bp, Mus musculus
gcgagtggacccagaggagacttgt

SEQ ID NO: 311544 - DNA, 25 bp, Mus musculus
gcgagtggacccagccccgggaaca

SEQ ID NO: 311545 - DNA, 25 bp, Mus musculus
gcgagtggacccagggctgttggga

SEQ ID NO: 311546 - DNA, 25 bp, Mus musculus
gcgagtggcagagttgcacagcaaa

SEQ ID NO: 311547 - DNA, 25 bp, Mus musculus
gcgagtgtctcccaggctttgaagg

SEQ ID NO: 311548 - DNA, 25 bp, Mus musculus
gcgagttaaagcacatggtgatgag

SEQ ID NO: 311549 - DNA, 25 bp, Mus musculus
gcgagttacaggagggaatcttgac

SEQ ID NO: 311550 - DNA, 25 bp, Mus musculus
gcgagttattaggatgcctggtgtg

SEQ ID NO: 311551 - DNA, 25 bp, Mus musculus
gcgagttattaggcacatgactcag

SEQ ID NO: 311552 - DNA, 25 bp, Mus musculus
gcgagttcaagaacctggacatcac

SEQ ID NO: 311553 - DNA, 25 bp, Mus musculus
gcgagttcaagctgatcatggctcc

SEQ ID NO: 311554 - DNA, 25 bp, Mus musculus
gcgagttcaagggcagagaacatgg

SEQ ID NO: 311555 - DNA, 25 bp, Mus musculus
gcgagttcatgaaagatcgattata

SEQ ID NO: 311556 - DNA, 25 bp, Mus musculus
gcgagttcttctggcaccagcccat

SEQ ID NO: 311557 - DNA, 25 bp, Mus musculus
gcgataaaccattgttgaggaccag

SEQ ID NO: 311558 - DNA, 25 bp, Mus musculus
gcgatacgacgaaatggtggaatca

SEQ ID NO: 311559 - DNA, 25 bp, Mus musculus
gcgatacgacggttgaaactgagct

SEQ ID NO: 311560 - DNA, 25 bp, Mus musculus
gcgataggtacagttctgacacaac

SEQ ID NO: 311561 - DNA, 25 bp, Mus musculus
gcgatataaacctgaaggcatcagt

SEQ ID NO: 311562 - DNA, 25 bp, Mus musculus
gcgatatatacagatttgcaacagc

SEQ ID NO: 311563 - DNA, 25 bp, Mus musculus
gcgatatcttctttctcatctttgg

SEQ ID NO: 311564 - DNA, 25 bp, Mus musculus
gcgatattccctgactgctgcccga

SEQ ID NO: 311565 - DNA, 25 bp, Mus musculus
gcgatattccctgatgttgcattga

SEQ ID NO: 311566 - DNA, 25 bp, Mus musculus
gcgatcagaggaacaaggagcccag

SEQ ID NO: 311567 - DNA, 25 bp, Mus musculus
gcgatcaggtctgaggatatgacat

SEQ ID NO: 311568 - DNA, 25 bp, Mus musculus
gcgatccaaacgggaacaatataag

SEQ ID NO: 311569 - DNA, 25 bp, Mus musculus
gcgatcccacagatccaacttttac

SEQ ID NO: 311570 - DNA, 25 bp, Mus musculus
gcgatcccacagtgcaatttggtct

SEQ ID NO: 311571 - DNA, 25 bp, Mus musculus
gcgatccgcagaagacctaaccgat

SEQ ID NO: 311572 - DNA, 25 bp, Mus musculus
gcgatccgcagagcagcttaagaaa

SEQ ID NO: 311573 - DNA, 25 bp, Mus musculus
gcgatcctcccccaacactacaggc

SEQ ID NO: 311574 - DNA, 25 bp, Mus musculus
gcgatcctcccccatcactacaggc

SEQ ID NO: 311575 - DNA, 25 bp, Mus musculus
gcgatcctgagacaggctccgtcca

SEQ ID NO: 311576 - DNA, 25 bp, Mus musculus
gcgatcctgtaagactttaacccat

SEQ ID NO: 311577 - DNA, 25 bp, Mus musculus
gcgatcctgtaaggcactggtgaag

SEQ ID NO: 311578 - DNA, 25 bp, Mus musculus
gcgatcgcaggattgaaattccaag

SEQ ID NO: 311579 - DNA, 25 bp, Mus musculus
gcgatcggaagagaccaagcaaaat

SEQ ID NO: 311580 - DNA, 25 bp, Mus musculus
gcgatctccgagaaaattttgccaa

SEQ ID NO: 311581 - DNA, 25 bp, Mus musculus
gcgatctggagccccgcaagtgcca

SEQ ID NO: 311582 - DNA, 25 bp, Mus musculus
gcgatctggagctgcagcgctcacc

SEQ ID NO: 311583 - DNA, 25 bp, Mus musculus
gcgatctgggtggaaatggaattta

SEQ ID NO: 311584 - DNA, 25 bp, Mus musculus
gcgatcttgagcaaaagagcccgat

SEQ ID NO: 311585 - DNA, 25 bp, Mus musculus
gcgatcttgaggtggctaccgtctc

SEQ ID NO: 311586 - DNA, 25 bp, Mus musculus
gcgatgaagcagaactgcggacatc

SEQ ID NO: 311587 - DNA, 25 bp, Mus musculus
gcgatgaagcagtatcaggaggaaa

SEQ ID NO: 311588 - DNA, 25 bp, Mus musculus
gcgatgaagccgcccatttcaatac

SEQ ID NO: 311589 - DNA, 25 bp, Mus musculus
gcgatgaagccggctacctctgtcg

SEQ ID NO: 311590 - DNA, 25 bp, Mus musculus
gcgatgaatcacaggacctggagtt

SEQ ID NO: 311591 - DNA, 25 bp, Mus musculus
gcgatgacagtgaagatccagccat

SEQ ID NO: 311592 - DNA, 25 bp, Mus musculus
gcgatgacagtgaaggtatgctgca

SEQ ID NO: 311593 - DNA, 25 bp, Mus musculus
gcgatgacagtgaagtgtaacaact

SEQ ID NO: 311594 - DNA, 25 bp, Mus musculus
gcgatgacgatagtggttccggaag

SEQ ID NO: 311595 - DNA, 25 bp, Mus musculus
gcgatgagaaagatgtctcaaccct

SEQ ID NO: 311596 - DNA, 25 bp, Mus musculus
gcgatgagccaaggcatagagatct

SEQ ID NO: 311597 - DNA, 25 bp, Mus musculus
gcgatgataactttgtgatgtctgg

SEQ ID NO: 311598 - DNA, 25 bp, Mus musculus
gcgatgatttttttggaatgggcaa

SEQ ID NO: 311599 - DNA, 25 bp, Mus musculus
gcgatgcaggaagcgctgctccgaa

SEQ ID NO: 311600 - DNA, 25 bp, Mus musculus
gcgatgccatcgtgaccatgctcaa

SEQ ID NO: 311601 - DNA, 25 bp, Mus musculus
gcgatgctcctccgggaagaatggg

SEQ ID NO: 311602 - DNA, 25 bp, Mus musculus
gcgatgctcctccggtgccagtgac

SEQ ID NO: 311603 - DNA, 25 bp, Mus musculus
gcgatgcttcttcagtacaggctat

SEQ ID NO: 311604 - DNA, 25 bp, Mus musculus
gcgatggaagagacattgatggaca

SEQ ID NO: 311605 - DNA, 25 bp, Mus musculus
gcgatggaggtagaaaatcttctgg

SEQ ID NO: 311606 - DNA, 25 bp, Mus musculus
gcgatggatcataattgggtttctt

SEQ ID NO: 311607 - DNA, 25 bp, Mus musculus
gcgatggcggtacagagactcagcc

SEQ ID NO: 311608 - DNA, 25 bp, Mus musculus
gcgatgggatccctgctttgtggaa

SEQ ID NO: 311609 - DNA, 25 bp, Mus musculus
gcgatgggcctgaggctcttcgcgg

SEQ ID NO: 311610 - DNA, 25 bp, Mus musculus
gcgatgtactgaaggtctttgacga

SEQ ID NO: 311611 - DNA, 25 bp, Mus musculus
gcgatgtctgccctggatgacttga

SEQ ID NO: 311612 - DNA, 25 bp, Mus musculus
gcgatgtggagaggtggagaatcta

SEQ ID NO: 311613 - DNA, 25 bp, Mus musculus
gcgatgtgtgatcttttggagtgct

SEQ ID NO: 311614 - DNA, 25 bp, Mus musculus
gcgatgttatccaggccctggacct

SEQ ID NO: 311615 - DNA, 25 bp, Mus musculus
gcgatgttatccaggctccctgtcc

SEQ ID NO: 311616 - DNA, 25 bp, Mus musculus
gcgattaaaggcctgaagctcatgg

SEQ ID NO: 311617 - DNA, 25 bp, Mus musculus
gcgattaataaaaagacctcacagt

SEQ ID NO: 311618 - DNA, 25 bp, Mus musculus
gcgattatcagaatccctctgcgca

SEQ ID NO: 311619 - DNA, 25 bp, Mus musculus
gcgattatcagagtccagtagagga

SEQ ID NO: 311620 - DNA, 25 bp, Mus musculus
gcgattcaaccctcctgggatcagc

SEQ ID NO: 311621 - DNA, 25 bp, Mus musculus
gcgattcaagaatttgcatcatgaa

SEQ ID NO: 311622 - DNA, 25 bp, Mus musculus
gcgattcaagagtgcactcttcctt

SEQ ID NO: 311623 - DNA, 25 bp, Mus musculus
gcgattcatctaaatggtgccatga

SEQ ID NO: 311624 - DNA, 25 bp, Mus musculus
gcgattctcatcgcttttatgaaac

SEQ ID NO: 311625 - DNA, 25 bp, Mus musculus
gcgattgaagagtcttttcacagag

SEQ ID NO: 311626 - DNA, 25 bp, Mus musculus
gcgattgcagggagtcattcccagc

SEQ ID NO: 311627 - DNA, 25 bp, Mus musculus
gcgattgcaggtctgttgtgggggc

SEQ ID NO: 311628 - DNA, 25 bp, Mus musculus
gcgattgccaaccagacgtaccacc

SEQ ID NO: 311629 - DNA, 25 bp, Mus musculus
gcgattggaagaaatcaagaagttg

SEQ ID NO: 311630 - DNA, 25 bp, Mus musculus
gcgattggaagaagaatgaagacct

SEQ ID NO: 311631 - DNA, 25 bp, Mus musculus
gcgattgtgtcgaacaaatagtgga

SEQ ID NO: 311632 - DNA, 25 bp, Mus musculus
gcgattgtgtcggacggtgggagtg

SEQ ID NO: 311633 - DNA, 25 bp, Mus musculus
gcgattgtgtctgaggtcaactgaa

SEQ ID NO: 311634 - DNA, 25 bp, Mus musculus
gcgatttacgaaatctaccagagaa

SEQ ID NO: 311635 - DNA, 25 bp, Mus musculus
gcgatttccgggacctcatgtcttg

SEQ ID NO: 311636 - DNA, 25 bp, Mus musculus
gcgatttggaataattgatgtgact

SEQ ID NO: 311637 - DNA, 25 bp, Mus musculus
gcgatttggaatattcgatgttaca

SEQ ID NO: 311638 - DNA, 25 bp, Mus musculus
gcgatttttgagaactgatagtgca

SEQ ID NO: 311639 - DNA, 25 bp, Mus musculus
gcgcaaaatcacgcttaaaggatgg

SEQ ID NO: 311640 - DNA, 25 bp, Mus musculus
gcgcaaacagaaaactcagaacttt

SEQ ID NO: 311641 - DNA, 25 bp, Mus musculus
gcgcaaactgactgatgatgcttcg

SEQ ID NO: 311642 - DNA, 25 bp, Mus musculus
gcgcaaactggcgccccttgtctca

SEQ ID NO: 311643 - DNA, 25 bp, Mus musculus
gcgcaaactgggcaaacgctacaag

SEQ ID NO: 311644 - DNA, 25 bp, Mus musculus
gcgcaaagactggcggaggccaggc

SEQ ID NO: 311645 - DNA, 25 bp, Mus musculus
gcgcaaagagatggagtcatgcact

SEQ ID NO: 311646 - DNA, 25 bp, Mus musculus
gcgcaaatccttcctgaaacttcat

SEQ ID NO: 311647 - DNA, 25 bp, Mus musculus
gcgcaaccaggcccaggagggtgac

SEQ ID NO: 311648 - DNA, 25 bp, Mus musculus
gcgcaactcagatggctccagatgc

SEQ ID NO: 311649 - DNA, 25 bp, Mus musculus
gcgcaactcaggctgactcccctat

SEQ ID NO: 311650 - DNA, 25 bp, Mus musculus
gcgcaactggcaagcctctatggaa

SEQ ID NO: 311651 - DNA, 25 bp, Mus musculus
gcgcaactggcaagtttacaggctg

SEQ ID NO: 311652 - DNA, 25 bp, Mus musculus
gcgcaagatgcgccagcgcactgcc

SEQ ID NO: 311653 - DNA, 25 bp, Mus musculus
gcgcaagcagtgggaacagcgcttc

SEQ ID NO: 311654 - DNA, 25 bp, Mus musculus
gcgcaaggagatgctgtggggcctg

SEQ ID NO: 311655 - DNA, 25 bp, Mus musculus
gcgcaaggagatggtggggctgcga

SEQ ID NO: 311656 - DNA, 25 bp, Mus musculus
gcgcaaggagatgttgtctgtaggt

SEQ ID NO: 311657 - DNA, 25 bp, Mus musculus
gcgcaagtattttccgccaagagct

SEQ ID NO: 311658 - DNA, 25 bp, Mus musculus
gcgcaagttcacagatgtgaccttg

SEQ ID NO: 311659 - DNA, 25 bp, Mus musculus
gcgcaataacgttacaaattataat

SEQ ID NO: 311660 - DNA, 25 bp, Mus musculus
gcgcaattcccaccaaatatacgag

SEQ ID NO: 311661 - DNA, 25 bp, Mus musculus
gcgcaattccttggggtaatgatgt

SEQ ID NO: 311662 - DNA, 25 bp, Mus musculus
gcgcacaagaaatatggggtgtgcc

SEQ ID NO: 311663 - DNA, 25 bp, Mus musculus
gcgcacaagaagatctctcgtctgc

SEQ ID NO: 311664 - DNA, 25 bp, Mus musculus
gcgcacacggaagtgaatccagcag

SEQ ID NO: 311665 - DNA, 25 bp, Mus musculus
gcgcacacggaagtgatcagctctg

SEQ ID NO: 311666 - DNA, 25 bp, Mus musculus
gcgcacagcaaacagagccctttgc

SEQ ID NO: 311667 - DNA, 25 bp, Mus musculus
gcgcacagcggggactcgaggccag

SEQ ID NO: 311668 - DNA, 25 bp, Mus musculus
gcgcacagcggtaaaatgtcggctc

SEQ ID NO: 311669 - DNA, 25 bp, Mus musculus
gcgcaccaaggccatggtggcgtgt

SEQ ID NO: 311670 - DNA, 25 bp, Mus musculus
gcgcaccacgagcagataagaggag

SEQ ID NO: 311671 - DNA, 25 bp, Mus musculus
gcgcaccacgagcagttgttccaag

SEQ ID NO: 311672 - DNA, 25 bp, Mus musculus
gcgcaccattaatctgtacccgctt

SEQ ID NO: 311673 - DNA, 25 bp, Mus musculus
gcgcaccgcaaagatgtgaaatttg

SEQ ID NO: 311674 - DNA, 25 bp, Mus musculus
gcgcacctacgggctgactcctcac

SEQ ID NO: 311675 - DNA, 25 bp, Mus musculus
gcgcacctgccggctgcgaccgagg

SEQ ID NO: 311676 - DNA, 25 bp, Mus musculus
gcgcaccttcctccggcatgagatc

SEQ ID NO: 311677 - DNA, 25 bp, Mus musculus
gcgcaccttcctcctgcaacagaat

SEQ ID NO: 311678 - DNA, 25 bp, Mus musculus
gcgcaccttggagaagattgctggc

SEQ ID NO: 311679 - DNA, 25 bp, Mus musculus
gcgcaccttggagagaatatgtttg

SEQ ID NO: 311680 - DNA, 25 bp, Mus musculus
gcgcaccttggtggaacactctgga

SEQ ID NO: 311681 - DNA, 25 bp, Mus musculus
gcgcacgaagaagactggaaacagc

SEQ ID NO: 311682 - DNA, 25 bp, Mus musculus
gcgcacgaagaagcctcagcaaaag

SEQ ID NO: 311683 - DNA, 25 bp, Mus musculus
gcgcacgaccggtggcttgttggca

SEQ ID NO: 311684 - DNA, 25 bp, Mus musculus
gcgcacgactgctgatgaagtgact

SEQ ID NO: 311685 - DNA, 25 bp, Mus musculus
gcgcacgagtccggggaagtgtgtt

SEQ ID NO: 311686 - DNA, 25 bp, Mus musculus
gcgcacgccggaccctgagccgtaa

SEQ ID NO: 311687 - DNA, 25 bp, Mus musculus
gcgcacgccgtggtgcgcagttcct

SEQ ID NO: 311688 - DNA, 25 bp, Mus musculus
gcgcacggcatctataatgtcaccc

SEQ ID NO: 311689 - DNA, 25 bp, Mus musculus
gcgcacggcatctatgcggagctga

SEQ ID NO: 311690 - DNA, 25 bp, Mus musculus
gcgcacggcatctatgtacgtgccc

SEQ ID NO: 311691 - DNA, 25 bp, Mus musculus
gcgcacggctccagaaagatgacag

SEQ ID NO: 311692 - DNA, 25 bp, Mus musculus
gcgcacggttcagcaactgcgctcc

SEQ ID NO: 311693 - DNA, 25 bp, Mus musculus
gcgcacgtagtggacaagctactgc

SEQ ID NO: 311694 - DNA, 25 bp, Mus musculus
gcgcacgtagtggtcacaggaggct

SEQ ID NO: 311695 - DNA, 25 bp, Mus musculus
gcgcacgtgcatagatacctgctgc

SEQ ID NO: 311696 - DNA, 25 bp, Mus musculus
gcgcactagggaaggtcccggatgt

SEQ ID NO: 311697 - DNA, 25 bp, Mus musculus
gcgcactctgagatcttggcatata

SEQ ID NO: 311698 - DNA, 25 bp, Mus musculus
gcgcactctgtgggtcatttctctg

SEQ ID NO: 311699 - DNA, 25 bp, Mus musculus
gcgcactgtcagatgtagaaatccc

SEQ ID NO: 311700 - DNA, 25 bp, Mus musculus
gcgcactgtcaggtaaatccatttc

SEQ ID NO: 311701 - DNA, 25 bp, Mus musculus
gcgcactgtgcgagaaaaagcggat

SEQ ID NO: 311702 - DNA, 25 bp, Mus musculus
gcgcactgtgcgaggcatgctgccc

SEQ ID NO: 311703 - DNA, 25 bp, Mus musculus
gcgcacttcggcaagttggagtgct

SEQ ID NO: 311704 - DNA, 25 bp, Mus musculus
gcgcagaactgggattgtctttctg

SEQ ID NO: 311705 - DNA, 25 bp, Mus musculus
gcgcagaactgggggatgcagagag

SEQ ID NO: 311706 - DNA, 25 bp, Mus musculus
gcgcagaactggttcttccccagag

SEQ ID NO: 311707 - DNA, 25 bp, Mus musculus
gcgcagacaggtgtcagctgactcc

SEQ ID NO: 311708 - DNA, 25 bp, Mus musculus
gcgcagacatggcggagtcttctga

SEQ ID NO: 311709 - DNA, 25 bp, Mus musculus
gcgcagaccaggatggctgcccaag

SEQ ID NO: 311710 - DNA, 25 bp, Mus musculus
gcgcagacgagagtctcggccacca

SEQ ID NO: 311711 - DNA, 25 bp, Mus musculus
gcgcagacgcaccagctcccttccc

SEQ ID NO: 311712 - DNA, 25 bp, Mus musculus
gcgcagacgcaccagggggactccc

SEQ ID NO: 311713 - DNA, 25 bp, Mus musculus
gcgcagacgcaccaggtcacacaca

SEQ ID NO: 311714 - DNA, 25 bp, Mus musculus
gcgcagacgcttccattgtctaaag

SEQ ID NO: 311715 - DNA, 25 bp, Mus musculus
gcgcagagaagagcaccctccaagc

SEQ ID NO: 311716 - DNA, 25 bp, Mus musculus
gcgcagagaaggtcctaaaggggtg

SEQ ID NO: 311717 - DNA, 25 bp, Mus musculus
gcgcagagaggtccaggatgcctta

SEQ ID NO: 311718 - DNA, 25 bp, Mus musculus
gcgcagagaggtccaggatgctgtg

SEQ ID NO: 311719 - DNA, 25 bp, Mus musculus
gcgcagagatggttggcctgctatg

SEQ ID NO: 311720 - DNA, 25 bp, Mus musculus
gcgcagagcagattttctgcattta

SEQ ID NO: 311721 - DNA, 25 bp, Mus musculus
gcgcagagcgcgggtgatgtgaaca

SEQ ID NO: 311722 - DNA, 25 bp, Mus musculus
gcgcagagcgggcgatactgcagcc

SEQ ID NO: 311723 - DNA, 25 bp, Mus musculus
gcgcagagctagaggtcacctggag

SEQ ID NO: 311724 - DNA, 25 bp, Mus musculus
gcgcagaggctggggacagtactta

SEQ ID NO: 311725 - DNA, 25 bp, Mus musculus
gcgcagatgacagggcggaacttgc

SEQ ID NO: 311726 - DNA, 25 bp, Mus musculus
gcgcagatgatggctctgtggcctt

SEQ ID NO: 311727 - DNA, 25 bp, Mus musculus
gcgcagatttggatgactttttttc

SEQ ID NO: 311728 - DNA, 25 bp, Mus musculus
gcgcagatttgggattttgaacttc

SEQ ID NO: 311729 - DNA, 25 bp, Mus musculus
gcgcagcaaggtgtatgatgaaaaa

SEQ ID NO: 311730 - DNA, 25 bp, Mus musculus
gcgcagcacaagcgagggaagctaa

SEQ ID NO: 311731 - DNA, 25 bp, Mus musculus
gcgcagcaggaagaatttcagcata

SEQ ID NO: 311732 - DNA, 25 bp, Mus musculus
gcgcagcaggaaggtgctgtataat

SEQ ID NO: 311733 - DNA, 25 bp, Mus musculus
gcgcagcagggaagttggggggact

SEQ ID NO: 311734 - DNA, 25 bp, Mus musculus
gcgcagcataatgctaaagaagtaa

SEQ ID NO: 311735 - DNA, 25 bp, Mus musculus
gcgcagcatgaaagatgtattccag

SEQ ID NO: 311736 - DNA, 25 bp, Mus musculus
gcgcagcatgtcaaagaaaagagga

SEQ ID NO: 311737 - DNA, 25 bp, Mus musculus
gcgcagccaccgcacctgcgggagg

SEQ ID NO: 311738 - DNA, 25 bp, Mus musculus
gcgcagccaccgcgctcatgcgtgc

SEQ ID NO: 311739 - DNA, 25 bp, Mus musculus
gcgcagccatgagcgagacggtcat

SEQ ID NO: 311740 - DNA, 25 bp, Mus musculus
gcgcagccatggagccccgcgcgaa

SEQ ID NO: 311741 - DNA, 25 bp, Mus musculus
gcgcagcccaagagactgaattccc

SEQ ID NO: 311742 - DNA, 25 bp, Mus musculus
gcgcagcccgagctacttccccacg

SEQ ID NO: 311743 - DNA, 25 bp, Mus musculus
gcgcagcccgcgggggagccgccgc

SEQ ID NO: 311744 - DNA, 25 bp, Mus musculus
gcgcagcccgggtgcaattaaaagg

SEQ ID NO: 311745 - DNA, 25 bp, Mus musculus
gcgcagccgctctgaggtcgaatgg

SEQ ID NO: 311746 - DNA, 25 bp, Mus musculus
gcgcagcgacaatggaggtgaattg

SEQ ID NO: 311747 - DNA, 25 bp, Mus musculus
gcgcagcgacattgtgtgttccaga

SEQ ID NO: 311748 - DNA, 25 bp, Mus musculus
gcgcagcgagcggagagtcatggat

SEQ ID NO: 311749 - DNA, 25 bp, Mus musculus
gcgcagcgagcggggtgctgagttc

SEQ ID NO: 311750 - DNA, 25 bp, Mus musculus
gcgcagcggaagaaatggcaaaatg

SEQ ID NO: 311751 - DNA, 25 bp, Mus musculus
gcgcagctcgaacgatcgccggggc

SEQ ID NO: 311752 - DNA, 25 bp, Mus musculus
gcgcagctcggcatttcagtcgaac

SEQ ID NO: 311753 - DNA, 25 bp, Mus musculus
gcgcagctctacccactccgagcaa

SEQ ID NO: 311754 - DNA, 25 bp, Mus musculus
gcgcagctgcagcctgacagagctg

SEQ ID NO: 311755 - DNA, 25 bp, Mus musculus
gcgcagctgcagctcctcctaggtg

SEQ ID NO: 311756 - DNA, 25 bp, Mus musculus
gcgcagctgcaggcaaaatgaagga

SEQ ID NO: 311757 - DNA, 25 bp, Mus musculus
gcgcagctgcagggaggggaactac

SEQ ID NO: 311758 - DNA, 25 bp, Mus musculus
gcgcagctgggagagacttcataag

SEQ ID NO: 311759 - DNA, 25 bp, Mus musculus
gcgcagcttgggatcctggtatctc

SEQ ID NO: 311760 - DNA, 25 bp, Mus musculus
gcgcaggaactcaaggaatgactat

SEQ ID NO: 311761 - DNA, 25 bp, Mus musculus
gcgcaggaactcaagggagctaaga

SEQ ID NO: 311762 - DNA, 25 bp, Mus musculus
gcgcaggaactcaagttgaccgcct

SEQ ID NO: 311763 - DNA, 25 bp, Mus musculus
gcgcaggaagccagcgagtcatcct

SEQ ID NO: 311764 - DNA, 25 bp, Mus musculus
gcgcaggagagcgagatttcaacaa

SEQ ID NO: 311765 - DNA, 25 bp, Mus musculus
gcgcaggagagcgagtctgcggtgt

SEQ ID NO: 311766 - DNA, 25 bp, Mus musculus
gcgcaggagcgtggattggtgacca

SEQ ID NO: 311767 - DNA, 25 bp, Mus musculus
gcgcaggaggaaaggacccaggaga

SEQ ID NO: 311768 - DNA, 25 bp, Mus musculus
gcgcaggagtcccagttcttgcttc

SEQ ID NO: 311769 - DNA, 25 bp, Mus musculus
gcgcaggatgcaggagttcctcagg

SEQ ID NO: 311770 - DNA, 25 bp, Mus musculus
gcgcaggcaggggggacctgaacca

SEQ ID NO: 311771 - DNA, 25 bp, Mus musculus
gcgcaggcgcgcagtgaaagccggc

SEQ ID NO: 311772 - DNA, 25 bp, Mus musculus
gcgcagggacttacaaagagctttc

SEQ ID NO: 311773 - DNA, 25 bp, Mus musculus
gcgcagggagcgagagtgtgaacat

SEQ ID NO: 311774 - DNA, 25 bp, Mus musculus
gcgcagggaggcaatggcagctaca

SEQ ID NO: 311775 - DNA, 25 bp, Mus musculus
gcgcagggccggctgcacaatctgc

SEQ ID NO: 311776 - DNA, 25 bp, Mus musculus
gcgcagggccggctgtgtggcctct

SEQ ID NO: 311777 - DNA, 25 bp, Mus musculus
gcgcaggtcattggcgacagggttc

SEQ ID NO: 311778 - DNA, 25 bp, Mus musculus
gcgcaggtcattggggttccccagt

SEQ ID NO: 311779 - DNA, 25 bp, Mus musculus
gcgcaggtgagtggatgatcacttg

SEQ ID NO: 311780 - DNA, 25 bp, Mus musculus
gcgcagtatcacagcctgaagctgg

SEQ ID NO: 311781 - DNA, 25 bp, Mus musculus
gcgcagtatggacagcattgggccc

SEQ ID NO: 311782 - DNA, 25 bp, Mus musculus
gcgcagtatggagagcatcgagatt

SEQ ID NO: 311783 - DNA, 25 bp, Mus musculus
gcgcagtcctaaatggtggccctcc

SEQ ID NO: 311784 - DNA, 25 bp, Mus musculus
gcgcagtcctaggactgcatttacc

SEQ ID NO: 311785 - DNA, 25 bp, Mus musculus
gcgcagtcctagggcctggtggcct

SEQ ID NO: 311786 - DNA, 25 bp, Mus musculus
gcgcagtcctaggtgaagaagactc

SEQ ID NO: 311787 - DNA, 25 bp, Mus musculus
gcgcagtcttgagtaatccagaatg

SEQ ID NO: 311788 - DNA, 25 bp, Mus musculus
gcgcagtcttgcagggtcagtcata

SEQ ID NO: 311789 - DNA, 25 bp, Mus musculus
gcgcagtgacgtgggctggcgcttg

SEQ ID NO: 311790 - DNA, 25 bp, Mus musculus
gcgcagtgctagctcttctgtcgga

SEQ ID NO: 311791 - DNA, 25 bp, Mus musculus
gcgcagtggttgggaactgtgaagc

SEQ ID NO: 311792 - DNA, 25 bp, Mus musculus
gcgcagtgtgaaactggcccaggag

SEQ ID NO: 311793 - DNA, 25 bp, Mus musculus
gcgcagtgttgcatgatcaaaagga

SEQ ID NO: 311794 - DNA, 25 bp, Mus musculus
gcgcatcaagacccttcgcaggtgt

SEQ ID NO: 311795 - DNA, 25 bp, Mus musculus
gcgcatcaaggagctggagtcagat

SEQ ID NO: 311796 - DNA, 25 bp, Mus musculus
gcgcatcaaggggatatctagttgg

SEQ ID NO: 311797 - DNA, 25 bp, Mus musculus
gcgcatcagccgtggatgaacaggc

SEQ ID NO: 311798 - DNA, 25 bp, Mus musculus
gcgcatcagtttagtgctgacagta

SEQ ID NO: 311799 - DNA, 25 bp, Mus musculus
gcgcatcatccccaggcgctttgcc

SEQ ID NO: 311800 - DNA, 25 bp, Mus musculus
gcgcatccaggtcatccttcgggct

SEQ ID NO: 311801 - DNA, 25 bp, Mus musculus
gcgcatcccagggttctgcctgtgc

SEQ ID NO: 311802 - DNA, 25 bp, Mus musculus
gcgcatcccgtttcaagaaagtatg

SEQ ID NO: 311803 - DNA, 25 bp, Mus musculus
gcgcatccctgagaacacaccagtg

SEQ ID NO: 311804 - DNA, 25 bp, Mus musculus
gcgcatccctgaggtcttccacacc

SEQ ID NO: 311805 - DNA, 25 bp, Mus musculus
gcgcatcctctcctggtggagagag

SEQ ID NO: 311806 - DNA, 25 bp, Mus musculus
gcgcatcctgcagccacattgccaa

SEQ ID NO: 311807 - DNA, 25 bp, Mus musculus
gcgcatcgcagagttgacatcctgc

SEQ ID NO: 311808 - DNA, 25 bp, Mus musculus
gcgcatcgcggcctcaaagcggagg

SEQ ID NO: 311809 - DNA, 25 bp, Mus musculus
gcgcatcggcaagctggtcgtttga

SEQ ID NO: 311810 - DNA, 25 bp, Mus musculus
gcgcatcgtgaaggagatgctccgc

SEQ ID NO: 311811 - DNA, 25 bp, Mus musculus
gcgcatctgagaacggtgatgctag

SEQ ID NO: 311812 - DNA, 25 bp, Mus musculus
gcgcatctgtgagatggcagcctac

SEQ ID NO: 311813 - DNA, 25 bp, Mus musculus
gcgcatgaaagggtctggtgagaag

SEQ ID NO: 311814 - DNA, 25 bp, Mus musculus
gcgcatgaagttcatgcaaagaggc

SEQ ID NO: 311815 - DNA, 25 bp, Mus musculus
gcgcatgcagagcagggtgggccag

SEQ ID NO: 311816 - DNA, 25 bp, Mus musculus
gcgcatgcgtcagtggtcgcagaca

SEQ ID NO: 311817 - DNA, 25 bp, Mus musculus
gcgcatggagtacgtgtttgactac

SEQ ID NO: 311818 - DNA, 25 bp, Mus musculus
gcgcatggtgcagtctgttgtctac

SEQ ID NO: 311819 - DNA, 25 bp, Mus musculus
gcgcattaggcggtgggtctcggaa

SEQ ID NO: 311820 - DNA, 25 bp, Mus musculus
gcgcattagggccaatgaggcgagc

SEQ ID NO: 311821 - DNA, 25 bp, Mus musculus
gcgcattcgcaaaggaacgggagat

SEQ ID NO: 311822 - DNA, 25 bp, Mus musculus
gcgcattcgcaaaggacgcatggaa

SEQ ID NO: 311823 - DNA, 25 bp, Mus musculus
gcgcatttaaatcgttctgatgaac

SEQ ID NO: 311824 - DNA, 25 bp, Mus musculus
gcgcattttcacagggaacaagttt

SEQ ID NO: 311825 - DNA, 25 bp, Mus musculus
gcgccaaaggggccaaggagaagat

SEQ ID NO: 311826 - DNA, 25 bp, Mus musculus
gcgccaagagaaaattcaggacgcc

SEQ ID NO: 311827 - DNA, 25 bp, Mus musculus
gcgccaagagacgaggatggccgca

SEQ ID NO: 311828 - DNA, 25 bp, Mus musculus
gcgccaagccgaggtatctccagac

SEQ ID NO: 311829 - DNA, 25 bp, Mus musculus
gcgccaagccgagtgccaggtcacc

SEQ ID NO: 311830 - DNA, 25 bp, Mus musculus
gcgccaagcgctacactcaagatga

SEQ ID NO: 311831 - DNA, 25 bp, Mus musculus
gcgccaagtgagagtcagcttgcga

SEQ ID NO: 311832 - DNA, 25 bp, Mus musculus
gcgccaccccctgctcctgctgctc

SEQ ID NO: 311833 - DNA, 25 bp, Mus musculus
gcgccacctgagaaaagaaaagaag

SEQ ID NO: 311834 - DNA, 25 bp, Mus musculus
gcgccacctgagaagagaagagaag

SEQ ID NO: 311835 - DNA, 25 bp, Mus musculus
gcgccacctgagagatctcaggttt

SEQ ID NO: 311836 - DNA, 25 bp, Mus musculus
gcgccacctgaggcctcccagcata

SEQ ID NO: 311837 - DNA, 25 bp, Mus musculus
gcgccacgagaacgtcattgggcta

SEQ ID NO: 311838 - DNA, 25 bp, Mus musculus
gcgccacgagaactggacatttggt

SEQ ID NO: 311839 - DNA, 25 bp, Mus musculus
gcgccacgcttagactagctgtgtt

SEQ ID NO: 311840 - DNA, 25 bp, Mus musculus
gcgccactgccaggtcagatgctgc

SEQ ID NO: 311841 - DNA, 25 bp, Mus musculus
gcgccactgccagtggccaaacgaa

SEQ ID NO: 311842 - DNA, 25 bp, Mus musculus
gcgccagaccccagcctatggtatc

SEQ ID NO: 311843 - DNA, 25 bp, Mus musculus
gcgccagagcagccaacatgagtct

SEQ ID NO: 311844 - DNA, 25 bp, Mus musculus
gcgccagagccggtggcggtgggat

SEQ ID NO: 311845 - DNA, 25 bp, Mus musculus
gcgccagaggcaggcaatgatacag

SEQ ID NO: 311846 - DNA, 25 bp, Mus musculus
gcgccagaggcaggtaacctcggcc

SEQ ID NO: 311847 - DNA, 25 bp, Mus musculus
gcgccagataccctaactcagatta

SEQ ID NO: 311848 - DNA, 25 bp, Mus musculus
gcgccagatgctggaggtaaagatg

SEQ ID NO: 311849 - DNA, 25 bp, Mus musculus
gcgccagcacatctgcagagaaaac

SEQ ID NO: 311850 - DNA, 25 bp, Mus musculus
gcgccagccaagaagaagatgaagc

SEQ ID NO: 311851 - DNA, 25 bp, Mus musculus
gcgccagccaaggtggggctgcagt

SEQ ID NO: 311852 - DNA, 25 bp, Mus musculus
gcgccagccaggagcatagaagaca

SEQ ID NO: 311853 - DNA, 25 bp, Mus musculus
gcgccagctcagaggcaggtttttc

SEQ ID NO: 311854 - DNA, 25 bp, Mus musculus
gcgccagcttgtgcggctagaagag

SEQ ID NO: 311855 - DNA, 25 bp, Mus musculus
gcgccagcttgtgcgtgatattgtg

SEQ ID NO: 311856 - DNA, 25 bp, Mus musculus
gcgccaggaacgtctttggaaagtc

SEQ ID NO: 311857 - DNA, 25 bp, Mus musculus
gcgccaggaacgttgtgaggactga

SEQ ID NO: 311858 - DNA, 25 bp, Mus musculus
gcgccaggctcagccgagatgccgc

SEQ ID NO: 311859 - DNA, 25 bp, Mus musculus
gcgccagggcaaggaggtcagacct

SEQ ID NO: 311860 - DNA, 25 bp, Mus musculus
gcgccagtaaagcagtggtggcagc

SEQ ID NO: 311861 - DNA, 25 bp, Mus musculus
gcgccagtaaagcagttttcctttg

SEQ ID NO: 311862 - DNA, 25 bp, Mus musculus
gcgccatcaaccaggaaagccgggt

SEQ ID NO: 311863 - DNA, 25 bp, Mus musculus
gcgccatcagccaggtcaggaatct

SEQ ID NO: 311864 - DNA, 25 bp, Mus musculus
gcgccatcagcgaggctgctgcgca

SEQ ID NO: 311865 - DNA, 25 bp, Mus musculus
gcgccatcatcagatggcaaggtca

SEQ ID NO: 311866 - DNA, 25 bp, Mus musculus
gcgccatcatcagctctaggagttc

SEQ ID NO: 311867 - DNA, 25 bp, Mus musculus
gcgccatgacaagatcgtgattgtg

SEQ ID NO: 311868 - DNA, 25 bp, Mus musculus
gcgccattgaagtgtggggctttgg

SEQ ID NO: 311869 - DNA, 25 bp, Mus musculus
gcgccattggtgagctgaaaaatga

SEQ ID NO: 311870 - DNA, 25 bp, Mus musculus
gcgcccaaagtctcaggggcctacc

SEQ ID NO: 311871 - DNA, 25 bp, Mus musculus
gcgcccacgccggtgtctgcagcta

SEQ ID NO: 311872 - DNA, 25 bp, Mus musculus
gcgcccacgccgtatatcaaggcct

SEQ ID NO: 311873 - DNA, 25 bp, Mus musculus
gcgcccacgttgggatctgaaccaa

SEQ ID NO: 311874 - DNA, 25 bp, Mus musculus
gcgcccaggcgaggcactgggctcc

SEQ ID NO: 311875 - DNA, 25 bp, Mus musculus
gcgcccagggaccagcctgcactgg

SEQ ID NO: 311876 - DNA, 25 bp, Mus musculus
gcgcccagggaccagtagaacaaca

SEQ ID NO: 311877 - DNA, 25 bp, Mus musculus
gcgcccaggggagatgtataccagg

SEQ ID NO: 311878 - DNA, 25 bp, Mus musculus
gcgcccaggttctcagagccatcgt

SEQ ID NO: 311879 - DNA, 25 bp, Mus musculus
gcgcccagtctgatacacttttggc

SEQ ID NO: 311880 - DNA, 25 bp, Mus musculus
gcgcccatcaagataagtgggcaga

SEQ ID NO: 311881 - DNA, 25 bp, Mus musculus
gcgcccatgcagatggcctctgcac

SEQ ID NO: 311882 - DNA, 25 bp, Mus musculus
gcgccccaacagattccacgaggac

SEQ ID NO: 311883 - DNA, 25 bp, Mus musculus
gcgccccaccagaaaacgaggagga

SEQ ID NO: 311884 - DNA, 25 bp, Mus musculus
gcgccccagcagatggtaacaaaag

SEQ ID NO: 311885 - DNA, 25 bp, Mus musculus
gcgccccagcctccaccatgccaat

SEQ ID NO: 311886 - DNA, 25 bp, Mus musculus
gcgccccagcgccctgtgtgtcaaa

SEQ ID NO: 311887 - DNA, 25 bp, Mus musculus
gcgccccagctgtggggcagttttg

SEQ ID NO: 311888 - DNA, 25 bp, Mus musculus
gcgcccccagccactggcccctacc

SEQ ID NO: 311889 - DNA, 25 bp, Mus musculus
gcgcccccgccgcgccttcatcaag

SEQ ID NO: 311890 - DNA, 25 bp, Mus musculus
gcgccccctccggtcgccatggatc

SEQ ID NO: 311891 - DNA, 25 bp, Mus musculus
gcgccccctgcagttggacatttgg

SEQ ID NO: 311892 - DNA, 25 bp, Mus musculus
gcgccccgcaccgatgatattatca

SEQ ID NO: 311893 - DNA, 25 bp, Mus musculus
gcgcccctccttcctgagcatgatg

SEQ ID NO: 311894 - DNA, 25 bp, Mus musculus
gcgcccgaccctaggtacccaggtg

SEQ ID NO: 311895 - DNA, 25 bp, Mus musculus
gcgcccgagcagcttggccgacagg

SEQ ID NO: 311896 - DNA, 25 bp, Mus musculus
gcgcccgcgatgactgccactctcc

SEQ ID NO: 311897 - DNA, 25 bp, Mus musculus
gcgcccgcgcgggtcgcccaatgag

SEQ ID NO: 311898 - DNA, 25 bp, Mus musculus
gcgcccggagcaagactgtcaaggc

SEQ ID NO: 311899 - DNA, 25 bp, Mus musculus
gcgcccggagcaaggacgaaggtgt

SEQ ID NO: 311900 - DNA, 25 bp, Mus musculus
gcgcccggagcaaggtaacaaataa

SEQ ID NO: 311901 - DNA, 25 bp, Mus musculus
gcgcccgggaggtgaagggccggat

SEQ ID NO: 311902 - DNA, 25 bp, Mus musculus
gcgcccgggagtttcaggcatttgc

SEQ ID NO: 311903 - DNA, 25 bp, Mus musculus
gcgcccgggcctcaggaaccaatga

SEQ ID NO: 311904 - DNA, 25 bp, Mus musculus
gcgcccggggagagatactccatgt

SEQ ID NO: 311905 - DNA, 25 bp, Mus musculus
gcgcccgtcacaagggcggtgacga

SEQ ID NO: 311906 - DNA, 25 bp, Mus musculus
gcgcccgtcacaaggttgtcaggaa

SEQ ID NO: 311907 - DNA, 25 bp, Mus musculus
gcgccctaagcaggtgagccctaga

SEQ ID NO: 311908 - DNA, 25 bp, Mus musculus
gcgccctcagatgtcacctgtacgg

SEQ ID NO: 311909 - DNA, 25 bp, Mus musculus
gcgccctcaggatgactgagtggga

SEQ ID NO: 311910 - DNA, 25 bp, Mus musculus
gcgccctcagtgggaagatgcccga

SEQ ID NO: 311911 - DNA, 25 bp, Mus musculus
gcgccctcctcagaaagcagtgccc

SEQ ID NO: 311912 - DNA, 25 bp, Mus musculus
gcgccctgagctggacaagtgacgc

SEQ ID NO: 311913 - DNA, 25 bp, Mus musculus
gcgccctgccaagattttcacctga

SEQ ID NO: 311914 - DNA, 25 bp, Mus musculus
gcgccctggacctgggctcccagag

SEQ ID NO: 311915 - DNA, 25 bp, Mus musculus
gcgcccttcctccgatggctacaga

SEQ ID NO: 311916 - DNA, 25 bp, Mus musculus
gcgccgaacagcagcgggcggggac

SEQ ID NO: 311917 - DNA, 25 bp, Mus musculus
gcgccgagcgccctcagttgagccc

SEQ ID NO: 311918 - DNA, 25 bp, Mus musculus
gcgccgagcggggcgaggtggcact

SEQ ID NO: 311919 - DNA, 25 bp, Mus musculus
gcgccgagcgggtcctcaggactcc

SEQ ID NO: 311920 - DNA, 25 bp, Mus musculus
gcgccgaggcccagcgatccctctg

SEQ ID NO: 311921 - DNA, 25 bp, Mus musculus
gcgccgaggcccaggtcagtctgga

SEQ ID NO: 311922 - DNA, 25 bp, Mus musculus
gcgccgagtgcagagagcaaagacc

SEQ ID NO: 311923 - DNA, 25 bp, Mus musculus
gcgccgatcaggttaaagatcgagg

SEQ ID NO: 311924 - DNA, 25 bp, Mus musculus
gcgccgcaacagcagcttcgagagc

SEQ ID NO: 311925 - DNA, 25 bp, Mus musculus
gcgccgcaacagcagggttctggct

SEQ ID NO: 311926 - DNA, 25 bp, Mus musculus
gcgccgcacaggtcccacacagcag

SEQ ID NO: 311927 - DNA, 25 bp, Mus musculus
gcgccgcaggacggtgactgtccca

SEQ ID NO: 311928 - DNA, 25 bp, Mus musculus
gcgccgcagtcgggccgccccacct

SEQ ID NO: 311929 - DNA, 25 bp, Mus musculus
gcgccgccagctcgtatgaaaatcc

SEQ ID NO: 311930 - DNA, 25 bp, Mus musculus
gcgccgccatgctcgtgggctccct

SEQ ID NO: 311931 - DNA, 25 bp, Mus musculus
gcgccgccccactgaagggcagtgg

SEQ ID NO: 311932 - DNA, 25 bp, Mus musculus
gcgccgccccctcaggagccaacat

SEQ ID NO: 311933 - DNA, 25 bp, Mus musculus
gcgccgccgagccggcgctaactgg

SEQ ID NO: 311934 - DNA, 25 bp, Mus musculus
gcgccgccgggttcaagcgctgtct

SEQ ID NO: 311935 - DNA, 25 bp, Mus musculus
gcgccgccggtgtggccgtggctga

SEQ ID NO: 311936 - DNA, 25 bp, Mus musculus
gcgccgcggcagccactaagcccca

SEQ ID NO: 311937 - DNA, 25 bp, Mus musculus
gcgccgcggcagccgctttcactat

SEQ ID NO: 311938 - DNA, 25 bp, Mus musculus
gcgccgcggccccccttcacgctcg

SEQ ID NO: 311939 - DNA, 25 bp, Mus musculus
gcgccgctgcatccccagtccatct

SEQ ID NO: 311940 - DNA, 25 bp, Mus musculus
gcgccgctgcgagtggccgccccac

SEQ ID NO: 311941 - DNA, 25 bp, Mus musculus
gcgccgctgcggttctccagaccag

SEQ ID NO: 311942 - DNA, 25 bp, Mus musculus
gcgccgctgtgaggtacagtcatgt

SEQ ID NO: 311943 - DNA, 25 bp, Mus musculus
gcgccggacgaccgaagccaggaca

SEQ ID NO: 311944 - DNA, 25 bp, Mus musculus
gcgccggagctatgtttcgaaacca

SEQ ID NO: 311945 - DNA, 25 bp, Mus musculus
gcgccggccacggcccggacacaga

SEQ ID NO: 311946 - DNA, 25 bp, Mus musculus
gcgccgggaccgacgccacagggcc

SEQ ID NO: 311947 - DNA, 25 bp, Mus musculus
gcgccgggagccggcaggcatgccc

SEQ ID NO: 311948 - DNA, 25 bp, Mus musculus
gcgccgggagtcgattttaggtgat

SEQ ID NO: 311949 - DNA, 25 bp, Mus musculus
gcgccgggatacacgggacctcact

SEQ ID NO: 311950 - DNA, 25 bp, Mus musculus
gcgccgggccgcagtgcctggtgaa

SEQ ID NO: 311951 - DNA, 25 bp, Mus musculus
gcgccgggccgcccaacaagatagc

SEQ ID NO: 311952 - DNA, 25 bp, Mus musculus
gcgccggtgctgagttaatatttgc

SEQ ID NO: 311953 - DNA, 25 bp, Mus musculus
gcgccgtctctggcaggcactgtaa

SEQ ID NO: 311954 - DNA, 25 bp, Mus musculus
gcgccgtgcagaagaatgccaccag

SEQ ID NO: 311955 - DNA, 25 bp, Mus musculus
gcgccgtggtctgggtcaggccctg

SEQ ID NO: 311956 - DNA, 25 bp, Mus musculus
gcgcctacaacagccggagagacct

SEQ ID NO: 311957 - DNA, 25 bp, Mus musculus
gcgcctactcagggctaacatcagg

SEQ ID NO: 311958 - DNA, 25 bp, Mus musculus
gcgcctactctatcgctgcaggtgt

SEQ ID NO: 311959 - DNA, 25 bp, Mus musculus
gcgcctactctatgtgtgctcatct

SEQ ID NO: 311960 - DNA, 25 bp, Mus musculus
gcgcctactgccagcggactcagag

SEQ ID NO: 311961 - DNA, 25 bp, Mus musculus
gcgcctactgccaggctccggtcga

SEQ ID NO: 311962 - DNA, 25 bp, Mus musculus
gcgcctagaaaaagaattcttgaag

SEQ ID NO: 311963 - DNA, 25 bp, Mus musculus
gcgcctagagaagcctccccagctt

SEQ ID NO: 311964 - DNA, 25 bp, Mus musculus
gcgcctagagggcagagacaatgaa

SEQ ID NO: 311965 - DNA, 25 bp, Mus musculus
gcgcctaggcgggaggtgtttctgt

SEQ ID NO: 311966 - DNA, 25 bp, Mus musculus
gcgcctaggggaggatcatgcggca

SEQ ID NO: 311967 - DNA, 25 bp, Mus musculus
gcgcctagttgaaggaatttgacaa

SEQ ID NO: 311968 - DNA, 25 bp, Mus musculus
gcgcctatgatgggaagattaaagt

SEQ ID NO: 311969 - DNA, 25 bp, Mus musculus
gcgcctatttgggtggggagaagag

SEQ ID NO: 311970 - DNA, 25 bp, Mus musculus
gcgcctcaaaaccaaaaatcctgac

SEQ ID NO: 311971 - DNA, 25 bp, Mus musculus
gcgcctcaaaaccaagtcactcctt

SEQ ID NO: 311972 - DNA, 25 bp, Mus musculus
gcgcctcaaacacatccacttcagc

SEQ ID NO: 311973 - DNA, 25 bp, Mus musculus
gcgcctcaaacacatgtgactctcc

SEQ ID NO: 311974 - DNA, 25 bp, Mus musculus
gcgcctcatcgggggcacagagatg

SEQ ID NO: 311975 - DNA, 25 bp, Mus musculus
gcgcctcatcgtggattactcctgc

SEQ ID NO: 311976 - DNA, 25 bp, Mus musculus
gcgcctccagaacagcatgttttgg

SEQ ID NO: 311977 - DNA, 25 bp, Mus musculus
gcgcctccaggaacacttctgtttc

SEQ ID NO: 311978 - DNA, 25 bp, Mus musculus
gcgcctccagtgaccaaagacttga

SEQ ID NO: 311979 - DNA, 25 bp, Mus musculus
gcgcctccagtttttggctttcact

SEQ ID NO: 311980 - DNA, 25 bp, Mus musculus
gcgcctccgccccagaaaaaggaga

SEQ ID NO: 311981 - DNA, 25 bp, Mus musculus
gcgcctcgcagggctcaacatatgc

SEQ ID NO: 311982 - DNA, 25 bp, Mus musculus
gcgcctctactccaggatggaggcc

SEQ ID NO: 311983 - DNA, 25 bp, Mus musculus
gcgcctctcagtgctcaggagctgt

SEQ ID NO: 311984 - DNA, 25 bp, Mus musculus
gcgcctctgatgctgagcccaggaa

SEQ ID NO: 311985 - DNA, 25 bp, Mus musculus
gcgcctctgtaaaacccagaaccca

SEQ ID NO: 311986 - DNA, 25 bp, Mus musculus
gcgcctgaagggaatactaagatgc

SEQ ID NO: 311987 - DNA, 25 bp, Mus musculus
gcgcctgagctaggattggtagctt

SEQ ID NO: 311988 - DNA, 25 bp, Mus musculus
gcgcctgagtacagacgtgacttgt

SEQ ID NO: 311989 - DNA, 25 bp, Mus musculus
gcgcctgcagcaggaattggggaat

SEQ ID NO: 311990 - DNA, 25 bp, Mus musculus
gcgcctgcaggactttaagctcgac

SEQ ID NO: 311991 - DNA, 25 bp, Mus musculus
gcgcctgcaggcaagaaggagttaa

SEQ ID NO: 311992 - DNA, 25 bp, Mus musculus
gcgcctgcaggcttttgaggctccc

SEQ ID NO: 311993 - DNA, 25 bp, Mus musculus
gcgcctgcaggggctccctccagac

SEQ ID NO: 311994 - DNA, 25 bp, Mus musculus
gcgcctgcaggtctctgcaagaaca

SEQ ID NO: 311995 - DNA, 25 bp, Mus musculus
gcgcctgcaggtggtggtggaagag

SEQ ID NO: 311996 - DNA, 25 bp, Mus musculus
gcgcctgcaggttcacattgagatc

SEQ ID NO: 311997 - DNA, 25 bp, Mus musculus
gcgcctgccccgaaatcacactgtg

SEQ ID NO: 311998 - DNA, 25 bp, Mus musculus
gcgcctgccccgccaaatgcagaga

SEQ ID NO: 311999 - DNA, 25 bp, Mus musculus
gcgcctgcgcggcggcgggcaccat

SEQ ID NO: 312000 - DNA, 25 bp, Mus musculus
gcgcctgcgcggcggctggtttcct

SEQ ID NO: 312001 - DNA, 25 bp, Mus musculus
gcgcctgcgggggagttttacagag

SEQ ID NO: 312002 - DNA, 25 bp, Mus musculus
gcgcctggagagctccacgcaggag

SEQ ID NO: 312003 - DNA, 25 bp, Mus musculus
gcgcctggagcatgcagccaagcaa

SEQ ID NO: 312004 - DNA, 25 bp, Mus musculus
gcgcctggagtctcactgttagagt

SEQ ID NO: 312005 - DNA, 25 bp, Mus musculus
gcgcctggccaggatccattttctc

SEQ ID NO: 312006 - DNA, 25 bp, Mus musculus
gcgcctggccaggtctggcatattc

SEQ ID NO: 312007 - DNA, 25 bp, Mus musculus
gcgcctggccataggcttcttccct

SEQ ID NO: 312008 - DNA, 25 bp, Mus musculus
gcgcctggcctccggataaagatag

SEQ ID NO: 312009 - DNA, 25 bp, Mus musculus
gcgcctggcctccgggtttgtattg

SEQ ID NO: 312010 - DNA, 25 bp, Mus musculus
gcgcctggcctgcttgaaatggaat

SEQ ID NO: 312011 - DNA, 25 bp, Mus musculus
gcgcctgtgaagcgagcgcagcaat

SEQ ID NO: 312012 - DNA, 25 bp, Mus musculus
gcgcctgtgaagcgcctcagtgggc

SEQ ID NO: 312013 - DNA, 25 bp, Mus musculus
gcgcctgtgtcaggagcatatgcag

SEQ ID NO: 312014 - DNA, 25 bp, Mus musculus
gcgcctgtttagaagtaacagcctc

SEQ ID NO: 312015 - DNA, 25 bp, Mus musculus
gcgccttccctcaggacatcaatgc

SEQ ID NO: 312016 - DNA, 25 bp, Mus musculus
gcgccttccctcaggtgtcagatcc

SEQ ID NO: 312017 - DNA, 25 bp, Mus musculus
gcgccttctctaggaacaatgtgtt

SEQ ID NO: 312018 - DNA, 25 bp, Mus musculus
gcgccttctttcaggaaatgctgtc

SEQ ID NO: 312019 - DNA, 25 bp, Mus musculus
gcgcctttctttagtgtacactctt

SEQ ID NO: 312020 - DNA, 25 bp, Mus musculus
gcgcctttggaagagatggagagag

SEQ ID NO: 312021 - DNA, 25 bp, Mus musculus
gcgcctttgtgcgagacggccccct

SEQ ID NO: 312022 - DNA, 25 bp, Mus musculus
gcgcgacaagccgaactgctttgag

SEQ ID NO: 312023 - DNA, 25 bp, Mus musculus
gcgcgaccccagctctatttcagaa

SEQ ID NO: 312024 - DNA, 25 bp, Mus musculus
gcgcgaccccaggaccagctctctc

SEQ ID NO: 312025 - DNA, 25 bp, Mus musculus
gcgcgacgtcagacacttagctgcc

SEQ ID NO: 312026 - DNA, 25 bp, Mus musculus
gcgcgacgtcaggtactcaatgcaa

SEQ ID NO: 312027 - DNA, 25 bp, Mus musculus
gcgcgactggaggataccagttcac

SEQ ID NO: 312028 - DNA, 25 bp, Mus musculus
gcgcgactgggtggggctgcttcgg

SEQ ID NO: 312029 - DNA, 25 bp, Mus musculus
gcgcgagcgagcgtgacctacagca

SEQ ID NO: 312030 - DNA, 25 bp, Mus musculus
gcgcgagcggaaactcacaggctaa

SEQ ID NO: 312031 - DNA, 25 bp, Mus musculus
gcgcgagcggaaactggatcgcttc

SEQ ID NO: 312032 - DNA, 25 bp, Mus musculus
gcgcgaggagctccagaaatcttga

SEQ ID NO: 312033 - DNA, 25 bp, Mus musculus
gcgcgaggagttcgcccccatggct

SEQ ID NO: 312034 - DNA, 25 bp, Mus musculus
gcgcgaggcagcatggtctgagacg

SEQ ID NO: 312035 - DNA, 25 bp, Mus musculus
gcgcgaggtggagcatacatccatc

SEQ ID NO: 312036 - DNA, 25 bp, Mus musculus
gcgcgaggtggaggagagaacattg

SEQ ID NO: 312037 - DNA, 25 bp, Mus musculus
gcgcgaggtggaggtggcctgggga

SEQ ID NO: 312038 - DNA, 25 bp, Mus musculus
gcgcgcaagcagtgggaacagcgct

SEQ ID NO: 312039 - DNA, 25 bp, Mus musculus
gcgcgcacaagaagatctctcgtct

SEQ ID NO: 312040 - DNA, 25 bp, Mus musculus
gcgcgcacagagctgaagcgctgca

SEQ ID NO: 312041 - DNA, 25 bp, Mus musculus
gcgcgcacagatgggctgtatgggg

SEQ ID NO: 312042 - DNA, 25 bp, Mus musculus
gcgcgcacagatttgaagactgaaa

SEQ ID NO: 312043 - DNA, 25 bp, Mus musculus
gcgcgcacagctgggtggctgtggt

SEQ ID NO: 312044 - DNA, 25 bp, Mus musculus
gcgcgcacaggcctcctctgtcacc

SEQ ID NO: 312045 - DNA, 25 bp, Mus musculus
gcgcgcaccgggttacacaataaat

SEQ ID NO: 312046 - DNA, 25 bp, Mus musculus
gcgcgcacgccgtggtgcgcagttc

SEQ ID NO: 312047 - DNA, 25 bp, Mus musculus
gcgcgcacgtagtggacaagctact

SEQ ID NO: 312048 - DNA, 25 bp, Mus musculus
gcgcgcacgtagtggtcacaggagg

SEQ ID NO: 312049 - DNA, 25 bp, Mus musculus
gcgcgcagcccaagagactgaattc

SEQ ID NO: 312050 - DNA, 25 bp, Mus musculus
gcgcgcagcggaagaaatggcaaaa

SEQ ID NO: 312051 - DNA, 25 bp, Mus musculus
gcgcgcagctggggtcatgatatac

SEQ ID NO: 312052 - DNA, 25 bp, Mus musculus
gcgcgccaagagaaaattcaggacg

SEQ ID NO: 312053 - DNA, 25 bp, Mus musculus
gcgcgccaagagacgaggatggccg

SEQ ID NO: 312054 - DNA, 25 bp, Mus musculus
gcgcgccaagccgaggtatctccag

SEQ ID NO: 312055 - DNA, 25 bp, Mus musculus
gcgcgccaagccgagtgccaggtca

SEQ ID NO: 312056 - DNA, 25 bp, Mus musculus
gcgcgccaggaacgtctttggaaag

SEQ ID NO: 312057 - DNA, 25 bp, Mus musculus
gcgcgccaggaacgttgtgaggact

SEQ ID NO: 312058 - DNA, 25 bp, Mus musculus
gcgcgcccatcaagataagtgggca

SEQ ID NO: 312059 - DNA, 25 bp, Mus musculus
gcgcgccccctccggtcgccatgga

SEQ ID NO: 312060 - DNA, 25 bp, Mus musculus
gcgcgccctggccaacagcctcgct

SEQ ID NO: 312061 - DNA, 25 bp, Mus musculus
gcgcgccgagggtgtgtgggatgac

SEQ ID NO: 312062 - DNA, 25 bp, Mus musculus
gcgcgccgagttgaactttctagat

SEQ ID NO: 312063 - DNA, 25 bp, Mus musculus
gcgcgccgctgcggttctccagacc

SEQ ID NO: 312064 - DNA, 25 bp, Mus musculus
gcgcgccgctgtgaggtacagtcat

SEQ ID NO: 312065 - DNA, 25 bp, Mus musculus
gcgcgccgggccgcagtgcctggtg

SEQ ID NO: 312066 - DNA, 25 bp, Mus musculus
gcgcgccgggccgcccaacaagata

SEQ ID NO: 312067 - DNA, 25 bp, Mus musculus
gcgcgcctgaggcactttgaattgc

SEQ ID NO: 312068 - DNA, 25 bp, Mus musculus
gcgcgcctgcaggactttaagctcg

SEQ ID NO: 312069 - DNA, 25 bp, Mus musculus
gcgcgcctgcaggcaagaaggagtt

SEQ ID NO: 312070 - DNA, 25 bp, Mus musculus
gcgcgcctttaaagtgaaggacacc

SEQ ID NO: 312071 - DNA, 25 bp, Mus musculus
gcgcgcgacgtcagacacttagctg

SEQ ID NO: 312072 - DNA, 25 bp, Mus musculus
gcgcgcgacgtcaggtactcaatgc

SEQ ID NO: 312073 - DNA, 25 bp, Mus musculus
gcgcgcgagaagctcgcgctgtatg

SEQ ID NO: 312074 - DNA, 25 bp, Mus musculus
gcgcgcgaggagttcgcccccatgg

SEQ ID NO: 312075 - DNA, 25 bp, Mus musculus
gcgcgcgaggtggagcatacatcca

SEQ ID NO: 312076 - DNA, 25 bp, Mus musculus
gcgcgcgaggtggaggagagaacat

SEQ ID NO: 312077 - DNA, 25 bp, Mus musculus
gcgcgcgaggtggaggtggcctggg

SEQ ID NO: 312078 - DNA, 25 bp, Mus musculus
gcgcgcgcagacttacactttgaac

SEQ ID NO: 312079 - DNA, 25 bp, Mus musculus
gcgcgcgcagagccaacagagaaac

SEQ ID NO: 312080 - DNA, 25 bp, Mus musculus
gcgcgcgcagaggtttcatagtcct

SEQ ID NO: 312081 - DNA, 25 bp, Mus musculus
gcgcgcgcagccaaagtgtatgtct

SEQ ID NO: 312082 - DNA, 25 bp, Mus musculus
gcgcgcgccagttggacatttggct

SEQ ID NO: 312083 - DNA, 25 bp, Mus musculus
gcgcgcgccgctgcggttctccaga

SEQ ID NO: 312084 - DNA, 25 bp, Mus musculus
gcgcgcgcgtgacgagtgaccaaaa

SEQ ID NO: 312085 - DNA, 25 bp, Mus musculus
gcgcgcggacagagacactgtacta

SEQ ID NO: 312086 - DNA, 25 bp, Mus musculus
gcgcgcggacccagagtgcttggga

SEQ ID NO: 312087 - DNA, 25 bp, Mus musculus
gcgcgcggagcagactgtcgctaac

SEQ ID NO: 312088 - DNA, 25 bp, Mus musculus
gcgcgcggagcagccctctctatag

SEQ ID NO: 312089 - DNA, 25 bp, Mus musculus
gcgcgcggccaggtcttggtttcct

SEQ ID NO: 312090 - DNA, 25 bp, Mus musculus
gcgcgcggccaggtgagttggagtg

SEQ ID NO: 312091 - DNA, 25 bp, Mus musculus
gcgcgcggcccaggggatccaaagc

SEQ ID NO: 312092 - DNA, 25 bp, Mus musculus
gcgcgcggcccaggtttggatctcc

SEQ ID NO: 312093 - DNA, 25 bp, Mus musculus
gcgcgcggcggcaagagcaaccttc

SEQ ID NO: 312094 - DNA, 25 bp, Mus musculus
gcgcgcgtccgaaatgctgagcttc

SEQ ID NO: 312095 - DNA, 25 bp, Mus musculus
gcgcgctaaaaatgcttgtttctgg

SEQ ID NO: 312096 - DNA, 25 bp, Mus musculus
gcgcgctagaagatgttaaagaacc

SEQ ID NO: 312097 - DNA, 25 bp, Mus musculus
gcgcgctagaagctactcaggtgca

SEQ ID NO: 312098 - DNA, 25 bp, Mus musculus
gcgcgctcaagaatttgtcttcggc

SEQ ID NO: 312099 - DNA, 25 bp, Mus musculus
gcgcgctccttcccgggcttttcgc

SEQ ID NO: 312100 - DNA, 25 bp, Mus musculus
gcgcgctctcaggaggaggcaaaaa

SEQ ID NO: 312101 - DNA, 25 bp, Mus musculus
gcgcgctctcaggctagagttcacg

SEQ ID NO: 312102 - DNA, 25 bp, Mus musculus
gcgcgctgggccgaggctcttctgc

SEQ ID NO: 312103 - DNA, 25 bp, Mus musculus
gcgcgctttgagggcctgaagaaga

SEQ ID NO: 312104 - DNA, 25 bp, Mus musculus
gcgcggaaattagggcaagagccag

SEQ ID NO: 312105 - DNA, 25 bp, Mus musculus
gcgcggacacagcatgcccatttcc

SEQ ID NO: 312106 - DNA, 25 bp, Mus musculus
gcgcggacagagacactgtactaca

SEQ ID NO: 312107 - DNA, 25 bp, Mus musculus
gcgcggacccagagtgcttgggatc

SEQ ID NO: 312108 - DNA, 25 bp, Mus musculus
gcgcggaccccagcccgccggagtc

SEQ ID NO: 312109 - DNA, 25 bp, Mus musculus
gcgcggacgcggagacgtttgaatt

SEQ ID NO: 312110 - DNA, 25 bp, Mus musculus
gcgcggacgcggagtctggtccatc

SEQ ID NO: 312111 - DNA, 25 bp, Mus musculus
gcgcggagactgaggtgctgggtgt

SEQ ID NO: 312112 - DNA, 25 bp, Mus musculus
gcgcggagagagaactgctctgatg

SEQ ID NO: 312113 - DNA, 25 bp, Mus musculus
gcgcggagagagaaggaaccaacac

SEQ ID NO: 312114 - DNA, 25 bp, Mus musculus
gcgcggagagaggcctgctgaaaat

SEQ ID NO: 312115 - DNA, 25 bp, Mus musculus
gcgcggagcagactgtcgctaacca

SEQ ID NO: 312116 - DNA, 25 bp, Mus musculus
gcgcggagcagccctctctatagcc

SEQ ID NO: 312117 - DNA, 25 bp, Mus musculus
gcgcggagcagggcggcgagtccac

SEQ ID NO: 312118 - DNA, 25 bp, Mus musculus
gcgcggagccggttcgaggagcaga

SEQ ID NO: 312119 - DNA, 25 bp, Mus musculus
gcgcggcaaccaaccgtctggatct

SEQ ID NO: 312120 - DNA, 25 bp, Mus musculus
gcgcggcagactcagctgtgctgga

SEQ ID NO: 312121 - DNA, 25 bp, Mus musculus
gcgcggcagactcaggcacctctgt

SEQ ID NO: 312122 - DNA, 25 bp, Mus musculus
gcgcggcagccgacgatacagacgg

SEQ ID NO: 312123 - DNA, 25 bp, Mus musculus
gcgcggcagccgacggaggacccgc

SEQ ID NO: 312124 - DNA, 25 bp, Mus musculus
gcgcggcagccgacggcaccagagt

SEQ ID NO: 312125 - DNA, 25 bp, Mus musculus
gcgcggccaaaaggcggacgccgcg

SEQ ID NO: 312126 - DNA, 25 bp, Mus musculus
gcgcggccagggcaaagtgcaaaca

SEQ ID NO: 312127 - DNA, 25 bp, Mus musculus
gcgcggccaggtcttggtttcctaa

SEQ ID NO: 312128 - DNA, 25 bp, Mus musculus
gcgcggccaggtgagttggagtgag

SEQ ID NO: 312129 - DNA, 25 bp, Mus musculus
gcgcggccatggagcagctgaaggc

SEQ ID NO: 312130 - DNA, 25 bp, Mus musculus
gcgcggcccaggggatccaaagccc

SEQ ID NO: 312131 - DNA, 25 bp, Mus musculus
gcgcggcccaggtttggatctcctg

SEQ ID NO: 312132 - DNA, 25 bp, Mus musculus
gcgcggccgaggtacaatgtcacgc

SEQ ID NO: 312133 - DNA, 25 bp, Mus musculus
gcgcggcgcggagcttagcagatca

SEQ ID NO: 312134 - DNA, 25 bp, Mus musculus
gcgcggcgcggagtcacattagctt

SEQ ID NO: 312135 - DNA, 25 bp, Mus musculus
gcgcggcggaggttgccccggaggc

SEQ ID NO: 312136 - DNA, 25 bp, Mus musculus
gcgcggcggcaagagcaaccttcaa

SEQ ID NO: 312137 - DNA, 25 bp, Mus musculus
gcgcggcgggggcggcagttctggc

SEQ ID NO: 312138 - DNA, 25 bp, Mus musculus
gcgcggcgtggctggtcgggatggt

SEQ ID NO: 312139 - DNA, 25 bp, Mus musculus
gcgcggctctcaagcagaaaaatgg

SEQ ID NO: 312140 - DNA, 25 bp, Mus musculus
gcgcggctctcaaggaggccaaagc

SEQ ID NO: 312141 - DNA, 25 bp, Mus musculus
gcgcggctgcagtctttaagaaata

SEQ ID NO: 312142 - DNA, 25 bp, Mus musculus
gcgcggcttggagctccttcctgat

SEQ ID NO: 312143 - DNA, 25 bp, Mus musculus
gcgcgggaccagatgccggcaacag

SEQ ID NO: 312144 - DNA, 25 bp, Mus musculus
gcgcgggaccaggtactttgtgttc

SEQ ID NO: 312145 - DNA, 25 bp, Mus musculus
gcgcgggagaagcagcttatggcaa

SEQ ID NO: 312146 - DNA, 25 bp, Mus musculus
gcgcgggagaagcagggatctgggc

SEQ ID NO: 312147 - DNA, 25 bp, Mus musculus
gcgcgggaggcggagagtgtcactg

SEQ ID NO: 312148 - DNA, 25 bp, Mus musculus
gcgcgggaggcggctctagatggca

SEQ ID NO: 312149 - DNA, 25 bp, Mus musculus
gcgcgggaggcgtacgagatgagaa

SEQ ID NO: 312150 - DNA, 25 bp, Mus musculus
gcgcgggcagcggtaaaatgtcggc

SEQ ID NO: 312151 - DNA, 25 bp, Mus musculus
gcgcgggccggtgtacattggtgaa

SEQ ID NO: 312152 - DNA, 25 bp, Mus musculus
gcgcgggcgctgcaggggctgacat

SEQ ID NO: 312153 - DNA, 25 bp, Mus musculus
gcgcgggctccagaggcgtccggtc

SEQ ID NO: 312154 - DNA, 25 bp, Mus musculus
gcgcgggctgagctggactggccat

SEQ ID NO: 312155 - DNA, 25 bp, Mus musculus
gcgcggggaagagtcttgcgctcag

SEQ ID NO: 312156 - DNA, 25 bp, Mus musculus
gcgcggggagagttaagaatcatgg

SEQ ID NO: 312157 - DNA, 25 bp, Mus musculus
gcgcggggagatggtggcctggaga

SEQ ID NO: 312158 - DNA, 25 bp, Mus musculus
gcgcggggcaaggaggaggagtttg

SEQ ID NO: 312159 - DNA, 25 bp, Mus musculus
gcgcggggcaagtgtggtccccgca

SEQ ID NO: 312160 - DNA, 25 bp, Mus musculus
gcgcggggtcagcacatggtttggg

SEQ ID NO: 312161 - DNA, 25 bp, Mus musculus
gcgcggggtgatggcaggagaactg

SEQ ID NO: 312162 - DNA, 25 bp, Mus musculus
gcgcggggtgcagaggtctctgtgt

SEQ ID NO: 312163 - DNA, 25 bp, Mus musculus
gcgcggggtgcggaggtcgctcatc

SEQ ID NO: 312164 - DNA, 25 bp, Mus musculus
gcgcggggtttctcggccgcgcgcg

SEQ ID NO: 312165 - DNA, 25 bp, Mus musculus
gcgcgggtggtgtaagaataaacga

SEQ ID NO: 312166 - DNA, 25 bp, Mus musculus
gcgcggtagcggtgaacgctgttgc

SEQ ID NO: 312167 - DNA, 25 bp, Mus musculus
gcgcggtagcggtgccttctctccg

SEQ ID NO: 312168 - DNA, 25 bp, Mus musculus
gcgcggtagcggtgggtgtcaccga

SEQ ID NO: 312169 - DNA, 25 bp, Mus musculus
gcgcggtagcggtgtatgtgggatc

SEQ ID NO: 312170 - DNA, 25 bp, Mus musculus
gcgcggtcaagaaaggctctggagc

SEQ ID NO: 312171 - DNA, 25 bp, Mus musculus
gcgcggtcaaggatcatctgcttcg

SEQ ID NO: 312172 - DNA, 25 bp, Mus musculus
gcgcggtcgcggcggtgacctacag

SEQ ID NO: 312173 - DNA, 25 bp, Mus musculus
gcgcggtgccgcagtctcaaaccat

SEQ ID NO: 312174 - DNA, 25 bp, Mus musculus
gcgcggttggagagagtgtgaacat

SEQ ID NO: 312175 - DNA, 25 bp, Mus musculus
gcgcgtagtgattgaggatggtgtg

SEQ ID NO: 312176 - DNA, 25 bp, Mus musculus
gcgcgtcacgccttggcccattgca

SEQ ID NO: 312177 - DNA, 25 bp, Mus musculus
gcgcgtcagtgggtacccagaaagg

SEQ ID NO: 312178 - DNA, 25 bp, Mus musculus
gcgcgtccagggtttcctctcctgt

SEQ ID NO: 312179 - DNA, 25 bp, Mus musculus
gcgcgtccaggttaaatgaatacct

SEQ ID NO: 312180 - DNA, 25 bp, Mus musculus
gcgcgtcccagggacccagctgaag

SEQ ID NO: 312181 - DNA, 25 bp, Mus musculus
gcgcgtctcagggaactgagccgtg

SEQ ID NO: 312182 - DNA, 25 bp, Mus musculus
gcgcgtggatgactgaagctggccc

SEQ ID NO: 312183 - DNA, 25 bp, Mus musculus
gcgcgtggatgactgggcagccacg

SEQ ID NO: 312184 - DNA, 25 bp, Mus musculus
gcgcgttgcgccaggcaggacactg

SEQ ID NO: 312185 - DNA, 25 bp, Mus musculus
gcgcgttgcgccaggtgtagctcca

SEQ ID NO: 312186 - DNA, 25 bp, Mus musculus
gcgctaaaaatgcttgtttctgggg

SEQ ID NO: 312187 - DNA, 25 bp, Mus musculus
gcgctaaaaggtcctgtttcttctg

SEQ ID NO: 312188 - DNA, 25 bp, Mus musculus
gcgctaaaagtgatgcgattgacta

SEQ ID NO: 312189 - DNA, 25 bp, Mus musculus
gcgctaaactttgtgacttgcacta

SEQ ID NO: 312190 - DNA, 25 bp, Mus musculus
gcgctaagaggatccagaaggagct

SEQ ID NO: 312191 - DNA, 25 bp, Mus musculus
gcgctacaaagatgagcgggaccga

SEQ ID NO: 312192 - DNA, 25 bp, Mus musculus
gcgctacagtatgagggagtggggc

SEQ ID NO: 312193 - DNA, 25 bp, Mus musculus
gcgctacataaggtatctttccgac

SEQ ID NO: 312194 - DNA, 25 bp, Mus musculus
gcgctacattgcccccacagtgctg

SEQ ID NO: 312195 - DNA, 25 bp, Mus musculus
gcgctacattggtcatcaaacaggt

SEQ ID NO: 312196 - DNA, 25 bp, Mus musculus
gcgctaccagtgtagcctatgccca

SEQ ID NO: 312197 - DNA, 25 bp, Mus musculus
gcgctactgcccactcaacatcaga

SEQ ID NO: 312198 - DNA, 25 bp, Mus musculus
gcgctactgcccattgaaaaatctg

SEQ ID NO: 312199 - DNA, 25 bp, Mus musculus
gcgctagaagatgttaaagaaccac

SEQ ID NO: 312200 - DNA, 25 bp, Mus musculus
gcgctagaagctactcaggtgcaag

SEQ ID NO: 312201 - DNA, 25 bp, Mus musculus
gcgctaggctgtaagctgtacttct

SEQ ID NO: 312202 - DNA, 25 bp, Mus musculus
gcgctataaccgagactggtacaag

SEQ ID NO: 312203 - DNA, 25 bp, Mus musculus
gcgctataaccgggctgggcctggg

SEQ ID NO: 312204 - DNA, 25 bp, Mus musculus
gcgctatcatgagggtccatgcctt

SEQ ID NO: 312205 - DNA, 25 bp, Mus musculus
gcgctatgagaaaattattttcgcc

SEQ ID NO: 312206 - DNA, 25 bp, Mus musculus
gcgctatgagaaattactcttctgc

SEQ ID NO: 312207 - DNA, 25 bp, Mus musculus
gcgctatgggtcaggtagtgggcag

SEQ ID NO: 312208 - DNA, 25 bp, Mus musculus
gcgctatgggtcatctgttccggcc

SEQ ID NO: 312209 - DNA, 25 bp, Mus musculus
gcgctattcaggcctttggagcagc

SEQ ID NO: 312210 - DNA, 25 bp, Mus musculus
gcgctcaaagatccaggtgctgtgg

SEQ ID NO: 312211 - DNA, 25 bp, Mus musculus
gcgctcaaaggactgtgtattcagc

SEQ ID NO: 312212 - DNA, 25 bp, Mus musculus
gcgctcaaaggcaaaggaggatggc

SEQ ID NO: 312213 - DNA, 25 bp, Mus musculus
gcgctcaacaaggacccctcatgcc

SEQ ID NO: 312214 - DNA, 25 bp, Mus musculus
gcgctcaagaatttgtcttcggcaa

SEQ ID NO: 312215 - DNA, 25 bp, Mus musculus
gcgctcaagccgcgacttttgccat

SEQ ID NO: 312216 - DNA, 25 bp, Mus musculus
gcgctcaagccgcggcttctacaaa

SEQ ID NO: 312217 - DNA, 25 bp, Mus musculus
gcgctcaagcggctcacccaggaat

SEQ ID NO: 312218 - DNA, 25 bp, Mus musculus
gcgctcaccctgattgactcgtggt

SEQ ID NO: 312219 - DNA, 25 bp, Mus musculus
gcgctcaccctgcgactactgtgaa

SEQ ID NO: 312220 - DNA, 25 bp, Mus musculus
gcgctcacgggaaccagtgaccttt

SEQ ID NO: 312221 - DNA, 25 bp, Mus musculus
gcgctcagagcgtaaacgaccccgg

SEQ ID NO: 312222 - DNA, 25 bp, Mus musculus
gcgctcagatccgtatgtaaagacc

SEQ ID NO: 312223 - DNA, 25 bp, Mus musculus
gcgctcatcatgctccgtcgggagg

SEQ ID NO: 312224 - DNA, 25 bp, Mus musculus
gcgctcatcatggctcgcctgcgcc

SEQ ID NO: 312225 - DNA, 25 bp, Mus musculus
gcgctccagcagattgctttattca

SEQ ID NO: 312226 - DNA, 25 bp, Mus musculus
gcgctccagcagcactctgttttct

SEQ ID NO: 312227 - DNA, 25 bp, Mus musculus
gcgctcccaggtaggtgagctccag

SEQ ID NO: 312228 - DNA, 25 bp, Mus musculus
gcgctccccgaggtgtgaatgaggc

SEQ ID NO: 312229 - DNA, 25 bp, Mus musculus
gcgctccctgcactccccaggaccc

SEQ ID NO: 312230 - DNA, 25 bp, Mus musculus
gcgctccgccgattcctttgtgatc

SEQ ID NO: 312231 - DNA, 25 bp, Mus musculus
gcgctccgccggtgagcacgagcct

SEQ ID NO: 312232 - DNA, 25 bp, Mus musculus
gcgctccgctagccaacatgagtct

SEQ ID NO: 312233 - DNA, 25 bp, Mus musculus
gcgctccgggagtaaagacatttcc

SEQ ID NO: 312234 - DNA, 25 bp, Mus musculus
gcgctccgggccagagcctgagcct

SEQ ID NO: 312235 - DNA, 25 bp, Mus musculus
gcgctccgtcaagaatccggagatc

SEQ ID NO: 312236 - DNA, 25 bp, Mus musculus
gcgctccgtcaaggtgtcggacgac

SEQ ID NO: 312237 - DNA, 25 bp, Mus musculus
gcgctcctaggggtggcgaccgtgc

SEQ ID NO: 312238 - DNA, 25 bp, Mus musculus
gcgctcctcgagggcataacctggg

SEQ ID NO: 312239 - DNA, 25 bp, Mus musculus
gcgctcctggcaggaaggcctgcgc

SEQ ID NO: 312240 - DNA, 25 bp, Mus musculus
gcgctccttcccgggcttttcgcag

SEQ ID NO: 312241 - DNA, 25 bp, Mus musculus
gcgctcgacatggagatgagtgtga

SEQ ID NO: 312242 - DNA, 25 bp, Mus musculus
gcgctcgacatggaggaccctctgt

SEQ ID NO: 312243 - DNA, 25 bp, Mus musculus
gcgctcgcaacgaggagactccaga

SEQ ID NO: 312244 - DNA, 25 bp, Mus musculus
gcgctcgcacacggcctctgtgctc

SEQ ID NO: 312245 - DNA, 25 bp, Mus musculus
gcgctcgcacacggcctggaggtgt

SEQ ID NO: 312246 - DNA, 25 bp, Mus musculus
gcgctcgcacacgggggacgccccc

SEQ ID NO: 312247 - DNA, 25 bp, Mus musculus
gcgctcggaactgtgtcgtgattaa

SEQ ID NO: 312248 - DNA, 25 bp, Mus musculus
gcgctcgggaaggctcctcgccgtc

SEQ ID NO: 312249 - DNA, 25 bp, Mus musculus
gcgctcgggaaggcttttgacccgc

SEQ ID NO: 312250 - DNA, 25 bp, Mus musculus
gcgctcggtgagttgcaggatccag

SEQ ID NO: 312251 - DNA, 25 bp, Mus musculus
gcgctcgtgcaagttccctggctcc

SEQ ID NO: 312252 - DNA, 25 bp, Mus musculus
gcgctctacaggggaggtggatgct

SEQ ID NO: 312253 - DNA, 25 bp, Mus musculus
gcgctctcaggaggaggcaaaaaac

SEQ ID NO: 312254 - DNA, 25 bp, Mus musculus
gcgctctcaggctagagttcacgtt

SEQ ID NO: 312255 - DNA, 25 bp, Mus musculus
gcgctctcgtagaaattgctccaaa

SEQ ID NO: 312256 - DNA, 25 bp, Mus musculus
gcgctctcgtagatctgccacctcc

SEQ ID NO: 312257 - DNA, 25 bp, Mus musculus
gcgctctcgtaggctgaagagtgaa

SEQ ID NO: 312258 - DNA, 25 bp, Mus musculus
gcgctctctgctgacctatgaggag

SEQ ID NO: 312259 - DNA, 25 bp, Mus musculus
gcgctctctgctgagtctgaagatg

SEQ ID NO: 312260 - DNA, 25 bp, Mus musculus
gcgctctgcagctggtcacagctct

SEQ ID NO: 312261 - DNA, 25 bp, Mus musculus
gcgctctgcagctgtatgttgtatg

SEQ ID NO: 312262 - DNA, 25 bp, Mus musculus
gcgctctgcgaccagctcccaagta

SEQ ID NO: 312263 - DNA, 25 bp, Mus musculus
gcgctctgtgttagcggggtgccac

SEQ ID NO: 312264 - DNA, 25 bp, Mus musculus
gcgctcttccatacagatgatattg

SEQ ID NO: 312265 - DNA, 25 bp, Mus musculus
gcgctcttctgttatgttcttgctg

SEQ ID NO: 312266 - DNA, 25 bp, Mus musculus
gcgctcttttttgctggatagagag

SEQ ID NO: 312267 - DNA, 25 bp, Mus musculus
gcgctgacaggtacagagctatcgt

SEQ ID NO: 312268 - DNA, 25 bp, Mus musculus
gcgctgacaggtactgggtttggat

SEQ ID NO: 312269 - DNA, 25 bp, Mus musculus
gcgctgaccgacaaaaagatcaggc

SEQ ID NO: 312270 - DNA, 25 bp, Mus musculus
gcgctgactgacatctactgccgag

SEQ ID NO: 312271 - DNA, 25 bp, Mus musculus
gcgctgactggaaggatctgcgatg

SEQ ID NO: 312272 - DNA, 25 bp, Mus musculus
gcgctgactttgagaaacggaagcc

SEQ ID NO: 312273 - DNA, 25 bp, Mus musculus
gcgctgactttggcctgcatgaggg

SEQ ID NO: 312274 - DNA, 25 bp, Mus musculus
gcgctgagactaaagtctttaagaa

SEQ ID NO: 312275 - DNA, 25 bp, Mus musculus
gcgctgagggtcgagaatacaagaa

SEQ ID NO: 312276 - DNA, 25 bp, Mus musculus
gcgctgagggtcggtgccagcacat

SEQ ID NO: 312277 - DNA, 25 bp, Mus musculus
gcgctgatatggagaaccttcacac

SEQ ID NO: 312278 - DNA, 25 bp, Mus musculus
gcgctgcaacaatgaatggcatgca

SEQ ID NO: 312279 - DNA, 25 bp, Mus musculus
gcgctgcaacaatggcgccccctgt

SEQ ID NO: 312280 - DNA, 25 bp, Mus musculus
gcgctgcacccgcaaagcctccagg

SEQ ID NO: 312281 - DNA, 25 bp, Mus musculus
gcgctgcacgccttcagagacggca

SEQ ID NO: 312282 - DNA, 25 bp, Mus musculus
gcgctgcagggtaattcagagatct

SEQ ID NO: 312283 - DNA, 25 bp, Mus musculus
gcgctgcagtcaggcatcaaggagt

SEQ ID NO: 312284 - DNA, 25 bp, Mus musculus
gcgctgccacagcgctgtgtagttc

SEQ ID NO: 312285 - DNA, 25 bp, Mus musculus
gcgctgccagccggaacagtgagca

SEQ ID NO: 312286 - DNA, 25 bp, Mus musculus
gcgctgccattcaagtggcagccac

SEQ ID NO: 312287 - DNA, 25 bp, Mus musculus
gcgctgcccaggctgaaggcatccc

SEQ ID NO: 312288 - DNA, 25 bp, Mus musculus
gcgctgcccgggatctccatctttc

SEQ ID NO: 312289 - DNA, 25 bp, Mus musculus
gcgctgccctggggctgtgtctggc

SEQ ID NO: 312290 - DNA, 25 bp, Mus musculus
gcgctgcctcagagcccaccgcaac

SEQ ID NO: 312291 - DNA, 25 bp, Mus musculus
gcgctgccttgactgtggaaagagc

SEQ ID NO: 312292 - DNA, 25 bp, Mus musculus
gcgctgccttgagagtcgcttcaaa

SEQ ID NO: 312293 - DNA, 25 bp, Mus musculus
gcgctgcgagagaggaagacgactg

SEQ ID NO: 312294 - DNA, 25 bp, Mus musculus
gcgctgcgctaattgtaaattcacc

SEQ ID NO: 312295 - DNA, 25 bp, Mus musculus
gcgctgcgctccgggagtaaagaca

SEQ ID NO: 312296 - DNA, 25 bp, Mus musculus
gcgctgcgctcggtgagtgcaggat

SEQ ID NO: 312297 - DNA, 25 bp, Mus musculus
gcgctgcgctgcgtgacagctggtg

SEQ ID NO: 312298 - DNA, 25 bp, Mus musculus
gcgctgcgctgcgtgcatccgtgca

SEQ ID NO: 312299 - DNA, 25 bp, Mus musculus
gcgctgcggcaccgcttgtcctggg

SEQ ID NO: 312300 - DNA, 25 bp, Mus musculus
gcgctgcggcaccggctggcccgcg

SEQ ID NO: 312301 - DNA, 25 bp, Mus musculus
gcgctgcggcaccgtttcctctaca

SEQ ID NO: 312302 - DNA, 25 bp, Mus musculus
gcgctgcggcgtggagcaaaacaat

SEQ ID NO: 312303 - DNA, 25 bp, Mus musculus
gcgctgcgtgacagctggtggcaca

SEQ ID NO: 312304 - DNA, 25 bp, Mus musculus
gcgctgcgtgcatccgtgcagcccg

SEQ ID NO: 312305 - DNA, 25 bp, Mus musculus
gcgctgctacgtgagaacttgaagc

SEQ ID NO: 312306 - DNA, 25 bp, Mus musculus
gcgctgctacgtgagtttttcagat

SEQ ID NO: 312307 - DNA, 25 bp, Mus musculus
gcgctgctcagaacgaaccaagaat

SEQ ID NO: 312308 - DNA, 25 bp, Mus musculus
gcgctgctcagaacggatcaataag

SEQ ID NO: 312309 - DNA, 25 bp, Mus musculus
gcgctgctcggagcctggtggaggt

SEQ ID NO: 312310 - DNA, 25 bp, Mus musculus
gcgctgctgaggagaatgcggaggc

SEQ ID NO: 312311 - DNA, 25 bp, Mus musculus
gcgctgcttcagagatgagtgaaaa

SEQ ID NO: 312312 - DNA, 25 bp, Mus musculus
gcgctgcttcagcacctctgggagc

SEQ ID NO: 312313 - DNA, 25 bp, Mus musculus
gcgctgcttgaaaagacactgagtc

SEQ ID NO: 312314 - DNA, 25 bp, Mus musculus
gcgctgctttagagtctccagagcc

SEQ ID NO: 312315 - DNA, 25 bp, Mus musculus
gcgctgctttaggcccaggagggtg

SEQ ID NO: 312316 - DNA, 25 bp, Mus musculus
gcgctggaaccctctagcacctaaa

SEQ ID NO: 312317 - DNA, 25 bp, Mus musculus
gcgctggaaccctctgtgcagagag

SEQ ID NO: 312318 - DNA, 25 bp, Mus musculus
gcgctggaagagactctcatggaca

SEQ ID NO: 312319 - DNA, 25 bp, Mus musculus
gcgctggacgggtggagtgtcatct

SEQ ID NO: 312320 - DNA, 25 bp, Mus musculus
gcgctggagcgaccgccaggctccc

SEQ ID NO: 312321 - DNA, 25 bp, Mus musculus
gcgctggagggcaagatattagcat

SEQ ID NO: 312322 - DNA, 25 bp, Mus musculus
gcgctggcaggtcccagggattttg

SEQ ID NO: 312323 - DNA, 25 bp, Mus musculus
gcgctggcaggttgtagatacccca

SEQ ID NO: 312324 - DNA, 25 bp, Mus musculus
gcgctggcgcaagatgacgttgcac

SEQ ID NO: 312325 - DNA, 25 bp, Mus musculus
gcgctggcggaatggcttcctttgg

SEQ ID NO: 312326 - DNA, 25 bp, Mus musculus
gcgctggcgggtgatgaagcctgga

SEQ ID NO: 312327 - DNA, 25 bp, Mus musculus
gcgctggcgggtgttccgaatgcca

SEQ ID NO: 312328 - DNA, 25 bp, Mus musculus
gcgctggctgtggatctcaggtgac

SEQ ID NO: 312329 - DNA, 25 bp, Mus musculus
gcgctgggaggcatgtcatgttacc

SEQ ID NO: 312330 - DNA, 25 bp, Mus musculus
gcgctgggcagacgaaagagcctgt

SEQ ID NO: 312331 - DNA, 25 bp, Mus musculus
gcgctgggcagggagatctgacggg

SEQ ID NO: 312332 - DNA, 25 bp, Mus musculus
gcgctgggcagtccattctctttgg

SEQ ID NO: 312333 - DNA, 25 bp, Mus musculus
gcgctgggccgaggctcttctgcga

SEQ ID NO: 312334 - DNA, 25 bp, Mus musculus
gcgctgggctcctggtctctgggcc

SEQ ID NO: 312335 - DNA, 25 bp, Mus musculus
gcgctgggtgaaagtgttgacagcc

SEQ ID NO: 312336 - DNA, 25 bp, Mus musculus
gcgctgggtggagaaaaatgtttta

SEQ ID NO: 312337 - DNA, 25 bp, Mus musculus
gcgctggtcgggctgtggcagtttc

SEQ ID NO: 312338 - DNA, 25 bp, Mus musculus
gcgctggtgtgccaggagagtacta

SEQ ID NO: 312339 - DNA, 25 bp, Mus musculus
gcgctggtgttcgagttcctcaggt

SEQ ID NO: 312340 - DNA, 25 bp, Mus musculus
gcgctgtacaagcttggcttcttca

SEQ ID NO: 312341 - DNA, 25 bp, Mus musculus
gcgctgtacaaggttcactctaatt

SEQ ID NO: 312342 - DNA, 25 bp, Mus musculus
gcgctgtacgaggctccagcatacc

SEQ ID NO: 312343 - DNA, 25 bp, Mus musculus
gcgctgtatagaatgcggggttcgc

SEQ ID NO: 312344 - DNA, 25 bp, Mus musculus
gcgctgtcagatcaagatccacttc

SEQ ID NO: 312345 - DNA, 25 bp, Mus musculus
gcgctgtccagggtcttcaaagctt

SEQ ID NO: 312346 - DNA, 25 bp, Mus musculus
gcgctgtccttctcctccgcctctg

SEQ ID NO: 312347 - DNA, 25 bp, Mus musculus
gcgctgtcttcgagagaaaagttgg

SEQ ID NO: 312348 - DNA, 25 bp, Mus musculus
gcgctgtcttcggctcttcatagcc

SEQ ID NO: 312349 - DNA, 25 bp, Mus musculus
gcgctgtgcaggggagcaccgcggc

SEQ ID NO: 312350 - DNA, 25 bp, Mus musculus
gcgctgtggagataaagaagctgag

SEQ ID NO: 312351 - DNA, 25 bp, Mus musculus
gcgctgtggggatggaaatgcagga

SEQ ID NO: 312352 - DNA, 25 bp, Mus musculus
gcgcttaacatgaaggaccttctgt

SEQ ID NO: 312353 - DNA, 25 bp, Mus musculus
gcgcttaacatggagatgagtgtga

SEQ ID NO: 312354 - DNA, 25 bp, Mus musculus
gcgcttaacatggaggaccctctgt

SEQ ID NO: 312355 - DNA, 25 bp, Mus musculus
gcgcttaagtttatgaattcctcag

SEQ ID NO: 312356 - DNA, 25 bp, Mus musculus
gcgcttaagtttatggctgcagttc

SEQ ID NO: 312357 - DNA, 25 bp, Mus musculus
gcgcttaagtttatgtgctctatgc

SEQ ID NO: 312358 - DNA, 25 bp, Mus musculus
gcgcttagcatacagaatatgaaca

SEQ ID NO: 312359 - DNA, 25 bp, Mus musculus
gcgcttagcatacaggtccaaccca

SEQ ID NO: 312360 - DNA, 25 bp, Mus musculus
gcgcttatttgaggagaatgagatc

SEQ ID NO: 312361 - DNA, 25 bp, Mus musculus
gcgcttatttgaggagtttgggctt

SEQ ID NO: 312362 - DNA, 25 bp, Mus musculus
gcgcttcaacagggccatggaggaa

SEQ ID NO: 312363 - DNA, 25 bp, Mus musculus
gcgcttcattcaagtgcgcaaactt

SEQ ID NO: 312364 - DNA, 25 bp, Mus musculus
gcgcttcattcaatttgatcaagag

SEQ ID NO: 312365 - DNA, 25 bp, Mus musculus
gcgcttccggtcagatgttcacacg

SEQ ID NO: 312366 - DNA, 25 bp, Mus musculus
gcgcttcctgtccgtacagagactc

SEQ ID NO: 312367 - DNA, 25 bp, Mus musculus
gcgcttcggagaagatgtggacccc

SEQ ID NO: 312368 - DNA, 25 bp, Mus musculus
gcgcttcggagaaggcctcctgcca

SEQ ID NO: 312369 - DNA, 25 bp, Mus musculus
gcgcttctagtgccgcttctcgaat

SEQ ID NO: 312370 - DNA, 25 bp, Mus musculus
gcgcttctcccacagtgcgtgctat

SEQ ID NO: 312371 - DNA, 25 bp, Mus musculus
gcgcttctgcagctggcactggggc

SEQ ID NO: 312372 - DNA, 25 bp, Mus musculus
gcgcttgcagaaggggcgcctaagc

SEQ ID NO: 312373 - DNA, 25 bp, Mus musculus
gcgcttgcaggcatgacgagtgtgc

SEQ ID NO: 312374 - DNA, 25 bp, Mus musculus
gcgcttggaaaagcacttggagctg

SEQ ID NO: 312375 - DNA, 25 bp, Mus musculus
gcgcttggaaaagtgctcatgacct

SEQ ID NO: 312376 - DNA, 25 bp, Mus musculus
gcgcttggagaatggcagcagcagc

SEQ ID NO: 312377 - DNA, 25 bp, Mus musculus
gcgcttggcagagccagacatcaga

SEQ ID NO: 312378 - DNA, 25 bp, Mus musculus
gcgctttcaagctcctgctgaacca

SEQ ID NO: 312379 - DNA, 25 bp, Mus musculus
gcgctttcaggcccgcacaggcgca

SEQ ID NO: 312380 - DNA, 25 bp, Mus musculus
gcgctttcaggtaaaatggaactac

SEQ ID NO: 312381 - DNA, 25 bp, Mus musculus
gcgctttcccgagacttcccaagaa

SEQ ID NO: 312382 - DNA, 25 bp, Mus musculus
gcgctttcttagatgttgccttcat

SEQ ID NO: 312383 - DNA, 25 bp, Mus musculus
gcgctttgagggcctgaagaagatc

SEQ ID NO: 312384 - DNA, 25 bp, Mus musculus
gcgctttggagagcgtcaagatcaa

SEQ ID NO: 312385 - DNA, 25 bp, Mus musculus
gcgctttggaggtgacaaacttgaa

SEQ ID NO: 312386 - DNA, 25 bp, Mus musculus
gcgctttggcagcggatctccatct

SEQ ID NO: 312387 - DNA, 25 bp, Mus musculus
gcgctttgtgcaggaagaagactac

SEQ ID NO: 312388 - DNA, 25 bp, Mus musculus
gcgctttgtgcaggcccagaggaac

SEQ ID NO: 312389 - DNA, 25 bp, Mus musculus
gcgcttttgatttcctgtcccctga

SEQ ID NO: 312390 - DNA, 25 bp, Mus musculus
gcggaaacaggcattgaagacaaga

SEQ ID NO: 312391 - DNA, 25 bp, Mus musculus
gcggaaagaaaacgagctgtttgac

SEQ ID NO: 312392 - DNA, 25 bp, Mus musculus
gcggaaagatggcgtaccttctcat

SEQ ID NO: 312393 - DNA, 25 bp, Mus musculus
gcggaaagtgcgagacggtcgcaga

SEQ ID NO: 312394 - DNA, 25 bp, Mus musculus
gcggaaagtgcgaggagatgctcac

SEQ ID NO: 312395 - DNA, 25 bp, Mus musculus
gcggaaatatccagagcgacgagat

SEQ ID NO: 312396 - DNA, 25 bp, Mus musculus
gcggaaatatccagatttagagcga

SEQ ID NO: 312397 - DNA, 25 bp, Mus musculus
gcggaaatgtactcaattagcatga

SEQ ID NO: 312398 - DNA, 25 bp, Mus musculus
gcggaaattagggcaagagccagag

SEQ ID NO: 312399 - DNA, 25 bp, Mus musculus
gcggaaatttgttagaaagcctgca

SEQ ID NO: 312400 - DNA, 25 bp, Mus musculus
gcggaaccggagctggactggccat

SEQ ID NO: 312401 - DNA, 25 bp, Mus musculus
gcggaacgggaatgctgatcactgg

SEQ ID NO: 312402 - DNA, 25 bp, Mus musculus
gcggaactaaagcaaatggttatga

SEQ ID NO: 312403 - DNA, 25 bp, Mus musculus
gcggaagaacaccaaagagtgagta

SEQ ID NO: 312404 - DNA, 25 bp, Mus musculus
gcggaagaacaccaaattttaagag

SEQ ID NO: 312405 - DNA, 25 bp, Mus musculus
gcggaagaagagaagaaagatgagg

SEQ ID NO: 312406 - DNA, 25 bp, Mus musculus
gcggaagaggtggagatcagcagag

SEQ ID NO: 312407 - DNA, 25 bp, Mus musculus
gcggaagaggtggaggccccagtca

SEQ ID NO: 312408 - DNA, 25 bp, Mus musculus
gcggaagcagaggatctctcagcat

SEQ ID NO: 312409 - DNA, 25 bp, Mus musculus
gcggaagcagagggacctgtaccgc

SEQ ID NO: 312410 - DNA, 25 bp, Mus musculus
gcggaagcatggaaactagagagat

SEQ ID NO: 312411 - DNA, 25 bp, Mus musculus
gcggaagcgagtgggcgtgtggaat

SEQ ID NO: 312412 - DNA, 25 bp, Mus musculus
gcggaagggaagggatgcatgggca

SEQ ID NO: 312413 - DNA, 25 bp, Mus musculus
gcggaagggaagggctcgggtccgc

SEQ ID NO: 312414 - DNA, 25 bp, Mus musculus
gcggaataatgatacctcgttcgtg

SEQ ID NO: 312415 - DNA, 25 bp, Mus musculus
gcggaatagagggaaacaggccacc

SEQ ID NO: 312416 - DNA, 25 bp, Mus musculus
gcggacaaagcagatctgcaggtgt

SEQ ID NO: 312417 - DNA, 25 bp, Mus musculus
gcggacaaagcagcttccaggagct

SEQ ID NO: 312418 - DNA, 25 bp, Mus musculus
gcggacaaagcaggggtcgggtcag

SEQ ID NO: 312419 - DNA, 25 bp, Mus musculus
gcggacaatacaggctaggggtgtt

SEQ ID NO: 312420 - DNA, 25 bp, Mus musculus
gcggacacagcatgcccatttccag

SEQ ID NO: 312421 - DNA, 25 bp, Mus musculus
gcggacacgtcttttgctctgcatg

SEQ ID NO: 312422 - DNA, 25 bp, Mus musculus
gcggacacgtgaatgtctgaagccg

SEQ ID NO: 312423 - DNA, 25 bp, Mus musculus
gcggacacgtttcatcctatctaag

SEQ ID NO: 312424 - DNA, 25 bp, Mus musculus
gcggacacttgtgaagcagcaggaa

SEQ ID NO: 312425 - DNA, 25 bp, Mus musculus
gcggacacttgtggagcattctgga

SEQ ID NO: 312426 - DNA, 25 bp, Mus musculus
gcggacagagcagactgtatcgtga

SEQ ID NO: 312427 - DNA, 25 bp, Mus musculus
gcggacaggagatgaccggttcgaa

SEQ ID NO: 312428 - DNA, 25 bp, Mus musculus
gcggacatcatggagtatgctgtga

SEQ ID NO: 312429 - DNA, 25 bp, Mus musculus
gcggacatcttcctgaggaatgtca

SEQ ID NO: 312430 - DNA, 25 bp, Mus musculus
gcggacatcttcctggacacatctt

SEQ ID NO: 312431 - DNA, 25 bp, Mus musculus
gcggacatgtcagtggaaacctctg

SEQ ID NO: 312432 - DNA, 25 bp, Mus musculus
gcggacattgtttactccctgaagg

SEQ ID NO: 312433 - DNA, 25 bp, Mus musculus
gcggaccaagcacagcctcctctta

SEQ ID NO: 312434 - DNA, 25 bp, Mus musculus
gcggaccaagctcagcctcctctta

SEQ ID NO: 312435 - DNA, 25 bp, Mus musculus
gcggacccagagtgcttgggatccc

SEQ ID NO: 312436 - DNA, 25 bp, Mus musculus
gcggacccagttcagcttgctcagg

SEQ ID NO: 312437 - DNA, 25 bp, Mus musculus
gcggaccccagcccgccggagtcct

SEQ ID NO: 312438 - DNA, 25 bp, Mus musculus
gcggaccccatgaaggtacgggtgg

SEQ ID NO: 312439 - DNA, 25 bp, Mus musculus
gcggaccccatgaagtgtttggtgt

SEQ ID NO: 312440 - DNA, 25 bp, Mus musculus
gcggaccctggcctgcctgagggat

SEQ ID NO: 312441 - DNA, 25 bp, Mus musculus
gcggaccgagaacctctccataatg

SEQ ID NO: 312442 - DNA, 25 bp, Mus musculus
gcggaccgagaagaaccgatcgcac

SEQ ID NO: 312443 - DNA, 25 bp, Mus musculus
gcggaccgaggacttgtgtgaggaa

SEQ ID NO: 312444 - DNA, 25 bp, Mus musculus
gcggacctcagcctttatcctcatg

SEQ ID NO: 312445 - DNA, 25 bp, Mus musculus
gcggacctcaggaaccctgatgaca

SEQ ID NO: 312446 - DNA, 25 bp, Mus musculus
gcggacgagaatggaaacttgagtt

SEQ ID NO: 312447 - DNA, 25 bp, Mus musculus
gcggacgagaatgggcaattgcttc

SEQ ID NO: 312448 - DNA, 25 bp, Mus musculus
gcggacgcagaattcggcccctgcc

SEQ ID NO: 312449 - DNA, 25 bp, Mus musculus
gcggacgcaggtccgctacagagcg

SEQ ID NO: 312450 - DNA, 25 bp, Mus musculus
gcggacgcggaagatctcagcggtt

SEQ ID NO: 312451 - DNA, 25 bp, Mus musculus
gcggacgcggaagggaccagatttt

SEQ ID NO: 312452 - DNA, 25 bp, Mus musculus
gcggacgcggagacgtttgaattag

SEQ ID NO: 312453 - DNA, 25 bp, Mus musculus
gcggacgcggagtctggtccatcga

SEQ ID NO: 312454 - DNA, 25 bp, Mus musculus
gcggacggacccctggacttcgtct

SEQ ID NO: 312455 - DNA, 25 bp, Mus musculus
gcggacggacttgatgtggatgact

SEQ ID NO: 312456 - DNA, 25 bp, Mus musculus
gcggacggtggtcagtgtcctcaag

SEQ ID NO: 312457 - DNA, 25 bp, Mus musculus
gcggactaataggactgaggatctc

SEQ ID NO: 312458 - DNA, 25 bp, Mus musculus
gcggactaataggcagatacatgca

SEQ ID NO: 312459 - DNA, 25 bp, Mus musculus
gcggactcagacggtcagcgtcaat

SEQ ID NO: 312460 - DNA, 25 bp, Mus musculus
gcggactcccggagaagcctcccca

SEQ ID NO: 312461 - DNA, 25 bp, Mus musculus
gcggactctgggagtctgtcccagg

SEQ ID NO: 312462 - DNA, 25 bp, Mus musculus
gcggactgtgacaggcatcatagct

SEQ ID NO: 312463 - DNA, 25 bp, Mus musculus
gcggacttcaggtgactcggactct

SEQ ID NO: 312464 - DNA, 25 bp, Mus musculus
gcggacttcaggtgattcacaagat

SEQ ID NO: 312465 - DNA, 25 bp, Mus musculus
gcggacttccaggctcagtgtttag

SEQ ID NO: 312466 - DNA, 25 bp, Mus musculus
gcggagaagagaatacagacagatt

SEQ ID NO: 312467 - DNA, 25 bp, Mus musculus
gcggagaagaggaattcatgaagta

SEQ ID NO: 312468 - DNA, 25 bp, Mus musculus
gcggagaagctgaggacaagatcta

SEQ ID NO: 312469 - DNA, 25 bp, Mus musculus
gcggagaagtcaggttccaaggagc

SEQ ID NO: 312470 - DNA, 25 bp, Mus musculus
gcggagaagtggatgtcgcgtggag

SEQ ID NO: 312471 - DNA, 25 bp, Mus musculus
gcggagaagtggtgaaggccttgga

SEQ ID NO: 312472 - DNA, 25 bp, Mus musculus
gcggagaatgtttgcatattgatga

SEQ ID NO: 312473 - DNA, 25 bp, Mus musculus
gcggagaatgtttggatattgatga

SEQ ID NO: 312474 - DNA, 25 bp, Mus musculus
gcggagacagggggctcaccctacc

SEQ ID NO: 312475 - DNA, 25 bp, Mus musculus
gcggagacaggttgcagaattcagc

SEQ ID NO: 312476 - DNA, 25 bp, Mus musculus
gcggagacaggtttcggccgagtcc

SEQ ID NO: 312477 - DNA, 25 bp, Mus musculus
gcggagaccagaaccccagctgaaa

SEQ ID NO: 312478 - DNA, 25 bp, Mus musculus
gcggagacccttccaatctgaacat

SEQ ID NO: 312479 - DNA, 25 bp, Mus musculus
gcggagacgtaagatcaacgagaga

SEQ ID NO: 312480 - DNA, 25 bp, Mus musculus
gcggagactgaggtgctgggtgtgt

SEQ ID NO: 312481 - DNA, 25 bp, Mus musculus
gcggagacttttaggccatctcttg

SEQ ID NO: 312482 - DNA, 25 bp, Mus musculus
gcggagacttttagggccaaagatc

SEQ ID NO: 312483 - DNA, 25 bp, Mus musculus
gcggagagactgggatgagcacagc

SEQ ID NO: 312484 - DNA, 25 bp, Mus musculus
gcggagagagaactgctctgatggc

SEQ ID NO: 312485 - DNA, 25 bp, Mus musculus
gcggagagagaaggaaccaacacaa

SEQ ID NO: 312486 - DNA, 25 bp, Mus musculus
gcggagagagcaacttcttcgggag

SEQ ID NO: 312487 - DNA, 25 bp, Mus musculus
gcggagagaggcctgctgaaaatga

SEQ ID NO: 312488 - DNA, 25 bp, Mus musculus
gcggagagaggtcttatcagctgca

SEQ ID NO: 312489 - DNA, 25 bp, Mus musculus
gcggagagcaagactggtagtggct

SEQ ID NO: 312490 - DNA, 25 bp, Mus musculus
gcggagagcatggatacgtattatc

SEQ ID NO: 312491 - DNA, 25 bp, Mus musculus
gcggagagcgacatgtccttccgaa

SEQ ID NO: 312492 - DNA, 25 bp, Mus musculus
gcggagagcggtcccgtaggcctca

SEQ ID NO: 312493 - DNA, 25 bp, Mus musculus
gcggagaggcaggtctctggagctg

SEQ ID NO: 312494 - DNA, 25 bp, Mus musculus
gcggagagtagattggatccagtgt

SEQ ID NO: 312495 - DNA, 25 bp, Mus musculus
gcggagatccccagagacagaactt

SEQ ID NO: 312496 - DNA, 25 bp, Mus musculus
gcggagatgtacggttcctcatttg

SEQ ID NO: 312497 - DNA, 25 bp, Mus musculus
gcggagattcggcgacctgacaaag

SEQ ID NO: 312498 - DNA, 25 bp, Mus musculus
gcggagattcggcggtttatcaaga

SEQ ID NO: 312499 - DNA, 25 bp, Mus musculus
gcggagcaaaccggtggccagaacc

SEQ ID NO: 312500 - DNA, 25 bp, Mus musculus
gcggagcaactgaagactcaggact

SEQ ID NO: 312501 - DNA, 25 bp, Mus musculus
gcggagcagaatgatttccagagca

SEQ ID NO: 312502 - DNA, 25 bp, Mus musculus
gcggagcagcagcgagaatgcttcg

SEQ ID NO: 312503 - DNA, 25 bp, Mus musculus
gcggagcagcaggcgttgcagaaac

SEQ ID NO: 312504 - DNA, 25 bp, Mus musculus
gcggagcaggctgccgactacaggt

SEQ ID NO: 312505 - DNA, 25 bp, Mus musculus
gcggagcagggtaaaggccggcgag

SEQ ID NO: 312506 - DNA, 25 bp, Mus musculus
gcggagcaggtctacaggcttatgc

SEQ ID NO: 312507 - DNA, 25 bp, Mus musculus
gcggagcatatgctgatcctgggca

SEQ ID NO: 312508 - DNA, 25 bp, Mus musculus
gcggagcatcagacatttccactgg

SEQ ID NO: 312509 - DNA, 25 bp, Mus musculus
gcggagcattctgtgcccccaaggt

SEQ ID NO: 312510 - DNA, 25 bp, Mus musculus
gcggagcattgtgaccactgactgg

SEQ ID NO: 312511 - DNA, 25 bp, Mus musculus
gcggagccaacatcaacagaatcaa

SEQ ID NO: 312512 - DNA, 25 bp, Mus musculus
gcggagccactgacggaccagagtg

SEQ ID NO: 312513 - DNA, 25 bp, Mus musculus
gcggagccagatttagatgaaaaaa

SEQ ID NO: 312514 - DNA, 25 bp, Mus musculus
gcggagccagcaagccccgcccaac

SEQ ID NO: 312515 - DNA, 25 bp, Mus musculus
gcggagccccatcttgatatggaag

SEQ ID NO: 312516 - DNA, 25 bp, Mus musculus
gcggagcccgagggctactcttccg

SEQ ID NO: 312517 - DNA, 25 bp, Mus musculus
gcggagccggttcgaggagcagaat

SEQ ID NO: 312518 - DNA, 25 bp, Mus musculus
gcggagcctaagtctgtaccaaaac

SEQ ID NO: 312519 - DNA, 25 bp, Mus musculus
gcggagcctttcccggtgggacgct

SEQ ID NO: 312520 - DNA, 25 bp, Mus musculus
gcggagcgcggaggtgatgctagcg

SEQ ID NO: 312521 - DNA, 25 bp, Mus musculus
gcggagcggagccccatcttgatat

SEQ ID NO: 312522 - DNA, 25 bp, Mus musculus
gcggagcggtagaggcaagagcttc

SEQ ID NO: 312523 - DNA, 25 bp, Mus musculus
gcggagcggtagagggagttgcatg

SEQ ID NO: 312524 - DNA, 25 bp, Mus musculus
gcggagctccgactggaaataccag

SEQ ID NO: 312525 - DNA, 25 bp, Mus musculus
gcggagctccgactggagtctccaa

SEQ ID NO: 312526 - DNA, 25 bp, Mus musculus
gcggagctcgcgactcactgtgtgc

SEQ ID NO: 312527 - DNA, 25 bp, Mus musculus
gcggagctcggaattagctgaacat

SEQ ID NO: 312528 - DNA, 25 bp, Mus musculus
gcggagctgccgccttcagggccga

SEQ ID NO: 312529 - DNA, 25 bp, Mus musculus
gcggagctgggaggcccagccagca

SEQ ID NO: 312530 - DNA, 25 bp, Mus musculus
gcggagctgtagatatggcataaga

SEQ ID NO: 312531 - DNA, 25 bp, Mus musculus
gcggagctgtagctggcccatgagc

SEQ ID NO: 312532 - DNA, 25 bp, Mus musculus
gcggagctgtaggcaagagataaca

SEQ ID NO: 312533 - DNA, 25 bp, Mus musculus
gcggagcttttgcaggtggctttgc

SEQ ID NO: 312534 - DNA, 25 bp, Mus musculus
gcggaggaaggagctaactctcccc

SEQ ID NO: 312535 - DNA, 25 bp, Mus musculus
gcggaggaagtccttccgaggttgg

SEQ ID NO: 312536 - DNA, 25 bp, Mus musculus
gcggaggacaagggaccgtcacgac

SEQ ID NO: 312537 - DNA, 25 bp, Mus musculus
gcggaggacagctcaatcgagctgg

SEQ ID NO: 312538 - DNA, 25 bp, Mus musculus
gcggaggacagctcagctgttgaat

SEQ ID NO: 312539 - DNA, 25 bp, Mus musculus
gcggaggactgaggggggtccgcct

SEQ ID NO: 312540 - DNA, 25 bp, Mus musculus
gcggaggagataggcgtttctaatg

SEQ ID NO: 312541 - DNA, 25 bp, Mus musculus
gcggaggagctgggtccatattgtg

SEQ ID NO: 312542 - DNA, 25 bp, Mus musculus
gcggaggagctgggtgatggctgtg

SEQ ID NO: 312543 - DNA, 25 bp, Mus musculus
gcggaggaggagttctccaacacaa

SEQ ID NO: 312544 - DNA, 25 bp, Mus musculus
gcggaggaggcggacgagcaaaaat

SEQ ID NO: 312545 - DNA, 25 bp, Mus musculus
gcggaggagggcagcagaaccagac

SEQ ID NO: 312546 - DNA, 25 bp, Mus musculus
gcggaggagggcaggaatcccagcc

SEQ ID NO: 312547 - DNA, 25 bp, Mus musculus
gcggaggagggggaggccgctcacg

SEQ ID NO: 312548 - DNA, 25 bp, Mus musculus
gcggaggataggtcggccagtgagg

SEQ ID NO: 312549 - DNA, 25 bp, Mus musculus
gcggaggattcacgtatgggaccca

SEQ ID NO: 312550 - DNA, 25 bp, Mus musculus
gcggaggcaggcaaaacccacggtg

SEQ ID NO: 312551 - DNA, 25 bp, Mus musculus
gcggaggccgcaggttggtgttcga

SEQ ID NO: 312552 - DNA, 25 bp, Mus musculus
gcggaggccgcgtgtaatgttcaag

SEQ ID NO: 312553 - DNA, 25 bp, Mus musculus
gcggaggcctgctgatgctcctgcc

SEQ ID NO: 312554 - DNA, 25 bp, Mus musculus
gcggagggaagtgttgacgctgctg

SEQ ID NO: 312555 - DNA, 25 bp, Mus musculus
gcggagggccaaaaaagtgtgcgct

SEQ ID NO: 312556 - DNA, 25 bp, Mus musculus
gcggagggccgcaacaccaagaagg

SEQ ID NO: 312557 - DNA, 25 bp, Mus musculus
gcggaggggcactgggtcgtcatgt

SEQ ID NO: 312558 - DNA, 25 bp, Mus musculus
gcggaggggcaggttctggtattgg

SEQ ID NO: 312559 - DNA, 25 bp, Mus musculus
gcggaggggtggaaaatgacattcc

SEQ ID NO: 312560 - DNA, 25 bp, Mus musculus
gcggaggggtgggaggctgccggcg

SEQ ID NO: 312561 - DNA, 25 bp, Mus musculus
gcggagggtcctggaaacactcagt

SEQ ID NO: 312562 - DNA, 25 bp, Mus musculus
gcggagtaatgacagacattgagat

SEQ ID NO: 312563 - DNA, 25 bp, Mus musculus
gcggagtaatgacagctcagttcct

SEQ ID NO: 312564 - DNA, 25 bp, Mus musculus
gcggagtaatgacagctccttcctc

SEQ ID NO: 312565 - DNA, 25 bp, Mus musculus
gcggagtcagaaggtagcaggtgcc

SEQ ID NO: 312566 - DNA, 25 bp, Mus musculus
gcggagtcaggctcttgtctgggga

SEQ ID NO: 312567 - DNA, 25 bp, Mus musculus
gcggagtcgcaggtgactccatacc

SEQ ID NO: 312568 - DNA, 25 bp, Mus musculus
gcggagtcgcaggtgttttgcaaac

SEQ ID NO: 312569 - DNA, 25 bp, Mus musculus
gcggagtcggaggccctaatgctgg

SEQ ID NO: 312570 - DNA, 25 bp, Mus musculus
gcggagtctggagccgccatggata

SEQ ID NO: 312571 - DNA, 25 bp, Mus musculus
gcggagtgaacgatcatgaaggaag

SEQ ID NO: 312572 - DNA, 25 bp, Mus musculus
gcggagtggagaagtatattggatt

SEQ ID NO: 312573 - DNA, 25 bp, Mus musculus
gcggagtgttggtaactaaatgacc

SEQ ID NO: 312574 - DNA, 25 bp, Mus musculus
gcggagttcgagactaccaggtatg

SEQ ID NO: 312575 - DNA, 25 bp, Mus musculus
gcggagttgagattcccaccctgct

SEQ ID NO: 312576 - DNA, 25 bp, Mus musculus
gcggataacaggctgaccacagtgg

SEQ ID NO: 312577 - DNA, 25 bp, Mus musculus
gcggataccaaactgttttctggac

SEQ ID NO: 312578 - DNA, 25 bp, Mus musculus
gcggatactgtaaggtatgtcactg

SEQ ID NO: 312579 - DNA, 25 bp, Mus musculus
gcggatactgtaagtgagggagctg

SEQ ID NO: 312580 - DNA, 25 bp, Mus musculus
gcggatatgtggccgatctgtcccc

SEQ ID NO: 312581 - DNA, 25 bp, Mus musculus
gcggatcacgagtgaccgtcttcta

SEQ ID NO: 312582 - DNA, 25 bp, Mus musculus
gcggatcatgtgcagagcctggccc

SEQ ID NO: 312583 - DNA, 25 bp, Mus musculus
gcggatccggcagcttaggttgtcc

SEQ ID NO: 312584 - DNA, 25 bp, Mus musculus
gcggatccggcaggaattgaagtta

SEQ ID NO: 312585 - DNA, 25 bp, Mus musculus
gcggatccgggagcctgagcctttg

SEQ ID NO: 312586 - DNA, 25 bp, Mus musculus
gcggatctgggtacgcgtctacagc

SEQ ID NO: 312587 - DNA, 25 bp, Mus musculus
gcggatgaagagaggcatgttggag

SEQ ID NO: 312588 - DNA, 25 bp, Mus musculus
gcggatgaagttagcaggagatgcg

SEQ ID NO: 312589 - DNA, 25 bp, Mus musculus
gcggatgagcatcaccctggaatga

SEQ ID NO: 312590 - DNA, 25 bp, Mus musculus
gcggatgctcacggaacgaatgttc

SEQ ID NO: 312591 - DNA, 25 bp, Mus musculus
gcggatggagaatatattcctcctt

SEQ ID NO: 312592 - DNA, 25 bp, Mus musculus
gcggatggaggagagggctctgctc

SEQ ID NO: 312593 - DNA, 25 bp, Mus musculus
gcggatggccagccttggcctcacg

SEQ ID NO: 312594 - DNA, 25 bp, Mus musculus
gcggattccagcccaacatgcaaat

SEQ ID NO: 312595 - DNA, 25 bp, Mus musculus
gcggattcggagcattcttgaagta

SEQ ID NO: 312596 - DNA, 25 bp, Mus musculus
gcggattcggatggattccaaagag

SEQ ID NO: 312597 - DNA, 25 bp, Mus musculus
gcggattcgggttcgggagcagcgg

SEQ ID NO: 312598 - DNA, 25 bp, Mus musculus
gcggattctcgggaggatccgagcg

SEQ ID NO: 312599 - DNA, 25 bp, Mus musculus
gcggattctcgggaggtggctgtct

SEQ ID NO: 312600 - DNA, 25 bp, Mus musculus
gcggatttctggagccctgctttaa

SEQ ID NO: 312601 - DNA, 25 bp, Mus musculus
gcggattttgcccaggaccagccat

SEQ ID NO: 312602 - DNA, 25 bp, Mus musculus
gcggcaaaacccaggcaagtgctct

SEQ ID NO: 312603 - DNA, 25 bp, Mus musculus
gcggcaaaagagctttatggatttc

SEQ ID NO: 312604 - DNA, 25 bp, Mus musculus
gcggcaaaagagtgatagaaggaag

SEQ ID NO: 312605 - DNA, 25 bp, Mus musculus
gcggcaaagaggcattctggaattt

SEQ ID NO: 312606 - DNA, 25 bp, Mus musculus
gcggcaaagcagctcctggaggaga

SEQ ID NO: 312607 - DNA, 25 bp, Mus musculus
gcggcaacctggcctctagacgtcc

SEQ ID NO: 312608 - DNA, 25 bp, Mus musculus
gcggcaacggacagctcggattctg

SEQ ID NO: 312609 - DNA, 25 bp, Mus musculus
gcggcacaaaatcagcgcctgggag

SEQ ID NO: 312610 - DNA, 25 bp, Mus musculus
gcggcacagccccctgcgggtgttt

SEQ ID NO: 312611 - DNA, 25 bp, Mus musculus
gcggcacagctggctggaccagatc

SEQ ID NO: 312612 - DNA, 25 bp, Mus musculus
gcggcaccatggcaaccgaagaacc

SEQ ID NO: 312613 - DNA, 25 bp, Mus musculus
gcggcacccctgagtacttggctcc

SEQ ID NO: 312614 - DNA, 25 bp, Mus musculus
gcggcacctggtcagtgagcctgga

SEQ ID NO: 312615 - DNA, 25 bp, Mus musculus
gcggcacggcggagggaggaaatat

SEQ ID NO: 312616 - DNA, 25 bp, Mus musculus
gcggcacggcgggagtcagcattgg

SEQ ID NO: 312617 - DNA, 25 bp, Mus musculus
gcggcacggcggggatcccactgcc

SEQ ID NO: 312618 - DNA, 25 bp, Mus musculus
gcggcacggcgggtttcaaatgata

SEQ ID NO: 312619 - DNA, 25 bp, Mus musculus
gcggcacgggaaggcagaagaaata

SEQ ID NO: 312620 - DNA, 25 bp, Mus musculus
gcggcagaatggacagttgctcaga

SEQ ID NO: 312621 - DNA, 25 bp, Mus musculus
gcggcagaatgggtgcagacctctg

SEQ ID NO: 312622 - DNA, 25 bp, Mus musculus
gcggcagacgcagcttcggcttcat

SEQ ID NO: 312623 - DNA, 25 bp, Mus musculus
gcggcagactcagctgtgctggatg

SEQ ID NO: 312624 - DNA, 25 bp, Mus musculus
gcggcagactcaggcacctctgtca

SEQ ID NO: 312625 - DNA, 25 bp, Mus musculus
gcggcagagccaggctagtgaaccg

SEQ ID NO: 312626 - DNA, 25 bp, Mus musculus
gcggcagaggagaaccctcttggct

SEQ ID NO: 312627 - DNA, 25 bp, Mus musculus
gcggcagagtctagccaccaagatc

SEQ ID NO: 312628 - DNA, 25 bp, Mus musculus
gcggcagatgccccacaggatcgcc

SEQ ID NO: 312629 - DNA, 25 bp, Mus musculus
gcggcagcagcgcagcctcaggctg

SEQ ID NO: 312630 - DNA, 25 bp, Mus musculus
gcggcagcaggaacggagcacctcc

SEQ ID NO: 312631 - DNA, 25 bp, Mus musculus
gcggcagcaggcaaggagatgagac

SEQ ID NO: 312632 - DNA, 25 bp, Mus musculus
gcggcagcaggcattaaaaaaatat

SEQ ID NO: 312633 - DNA, 25 bp, Mus musculus
gcggcagcaggccgggggacagtaa

SEQ ID NO: 312634 - DNA, 25 bp, Mus musculus
gcggcagcagggccgggagcaggct

SEQ ID NO: 312635 - DNA, 25 bp, Mus musculus
gcggcagccaacaagatgtcatggc

SEQ ID NO: 312636 - DNA, 25 bp, Mus musculus
gcggcagccaacaaggacaaagtcg

SEQ ID NO: 312637 - DNA, 25 bp, Mus musculus
gcggcagccaggacatagtcacatt

SEQ ID NO: 312638 - DNA, 25 bp, Mus musculus
gcggcagccagggaacatctcaagt

SEQ ID NO: 312639 - DNA, 25 bp, Mus musculus
gcggcagccaggtgcagggcagtct

SEQ ID NO: 312640 - DNA, 25 bp, Mus musculus
gcggcagccaggtgggatgctatgg

SEQ ID NO: 312641 - DNA, 25 bp, Mus musculus
gcggcagccgacgatacagacggca

SEQ ID NO: 312642 - DNA, 25 bp, Mus musculus
gcggcagccgacggaggacccgctc

SEQ ID NO: 312643 - DNA, 25 bp, Mus musculus
gcggcagccgacggcaccagagttt

SEQ ID NO: 312644 - DNA, 25 bp, Mus musculus
gcggcagccggtcactatcgtctga

SEQ ID NO: 312645 - DNA, 25 bp, Mus musculus
gcggcagcctaaggactaacggtta

SEQ ID NO: 312646 - DNA, 25 bp, Mus musculus
gcggcagcctaagggcacagcccga

SEQ ID NO: 312647 - DNA, 25 bp, Mus musculus
gcggcagcctctttgactatgaaca

SEQ ID NO: 312648 - DNA, 25 bp, Mus musculus
gcggcagcctctttgggttcgtttc

SEQ ID NO: 312649 - DNA, 25 bp, Mus musculus
gcggcagcgccgatgccgcctgcag

SEQ ID NO: 312650 - DNA, 25 bp, Mus musculus
gcggcagcggggcctgcggctcgac

SEQ ID NO: 312651 - DNA, 25 bp, Mus musculus
gcggcagctgctgaccctgagcaat

SEQ ID NO: 312652 - DNA, 25 bp, Mus musculus
gcggcaggcactggtgtaatggata

SEQ ID NO: 312653 - DNA, 25 bp, Mus musculus
gcggcaggcgggtacaaaaatatac

SEQ ID NO: 312654 - DNA, 25 bp, Mus musculus
gcggcaggctcaggccaccccacat

SEQ ID NO: 312655 - DNA, 25 bp, Mus musculus
gcggcaggctcaggctaccgagtct

SEQ ID NO: 312656 - DNA, 25 bp, Mus musculus
gcggcagggatttgcttcaacctgg

SEQ ID NO: 312657 - DNA, 25 bp, Mus musculus
gcggcagggatttgtttcgcctgca

SEQ ID NO: 312658 - DNA, 25 bp, Mus musculus
gcggcaggtaactgtagctgtcttc

SEQ ID NO: 312659 - DNA, 25 bp, Mus musculus
gcggcagtagagtcagatacagagt

SEQ ID NO: 312660 - DNA, 25 bp, Mus musculus
gcggcagtgattcatcagaaaagtt

SEQ ID NO: 312661 - DNA, 25 bp, Mus musculus
gcggcatcgagaggagtggctcagg

SEQ ID NO: 312662 - DNA, 25 bp, Mus musculus
gcggcattaccttggttctgaccag

SEQ ID NO: 312663 - DNA, 25 bp, Mus musculus
gcggccaaaaggcggacgccgcggg

SEQ ID NO: 312664 - DNA, 25 bp, Mus musculus
gcggccaaggatccatctgcagttg

SEQ ID NO: 312665 - DNA, 25 bp, Mus musculus
gcggccaatagctctcagggcctgt

SEQ ID NO: 312666 - DNA, 25 bp, Mus musculus
gcggccacaaccgcggaagaaaacg

SEQ ID NO: 312667 - DNA, 25 bp, Mus musculus
gcggccacacggctggatagccggt

SEQ ID NO: 312668 - DNA, 25 bp, Mus musculus
gcggccacacgtgacactggccaag

SEQ ID NO: 312669 - DNA, 25 bp, Mus musculus
gcggccacacgttctgcggggagtg

SEQ ID NO: 312670 - DNA, 25 bp, Mus musculus
gcggccacagccccactccacagcg

SEQ ID NO: 312671 - DNA, 25 bp, Mus musculus
gcggccacaggccactgcagagcaa

SEQ ID NO: 312672 - DNA, 25 bp, Mus musculus
gcggccacagtcatggccttccctc

SEQ ID NO: 312673 - DNA, 25 bp, Mus musculus
gcggccaccatgccgatcaataagt

SEQ ID NO: 312674 - DNA, 25 bp, Mus musculus
gcggccaccgcgcaggcttgacatc

SEQ ID NO: 312675 - DNA, 25 bp, Mus musculus
gcggccaccgcttgaatctccccga

SEQ ID NO: 312676 - DNA, 25 bp, Mus musculus
gcggccacctacttgctggggcttc

SEQ ID NO: 312677 - DNA, 25 bp, Mus musculus
gcggccacctaggcctgcagctgag

SEQ ID NO: 312678 - DNA, 25 bp, Mus musculus
gcggccacctaggcttcagtgggga

SEQ ID NO: 312679 - DNA, 25 bp, Mus musculus
gcggccacggcagggttaacctctg

SEQ ID NO: 312680 - DNA, 25 bp, Mus musculus
gcggccagagggttggtcctgtgga

SEQ ID NO: 312681 - DNA, 25 bp, Mus musculus
gcggccagcagatcgtgtccagccc

SEQ ID NO: 312682 - DNA, 25 bp, Mus musculus
gcggccagcaggtactcctgagcac

SEQ ID NO: 312683 - DNA, 25 bp, Mus musculus
gcggccagcccagggcaaacgctac

SEQ ID NO: 312684 - DNA, 25 bp, Mus musculus
gcggccagcccaggggcacctaccc

SEQ ID NO: 312685 - DNA, 25 bp, Mus musculus
gcggccagcggagagcaaagaccat

SEQ ID NO: 312686 - DNA, 25 bp, Mus musculus
gcggccagcggggacaatcccagaa

SEQ ID NO: 312687 - DNA, 25 bp, Mus musculus
gcggccagcgggttcccgaggagat

SEQ ID NO: 312688 - DNA, 25 bp, Mus musculus
gcggccaggtgaggctccatcaagg

SEQ ID NO: 312689 - DNA, 25 bp, Mus musculus
gcggccagtcagaatacagtttggt

SEQ ID NO: 312690 - DNA, 25 bp, Mus musculus
gcggccagtgaaccggttccacttg

SEQ ID NO: 312691 - DNA, 25 bp, Mus musculus
gcggccagttggggtgctgtggaca

SEQ ID NO: 312692 - DNA, 25 bp, Mus musculus
gcggccatctgccggctctggggga

SEQ ID NO: 312693 - DNA, 25 bp, Mus musculus
gcggccatctgccgggaaggaagca

SEQ ID NO: 312694 - DNA, 25 bp, Mus musculus
gcggccatgaagaacaattgccagc

SEQ ID NO: 312695 - DNA, 25 bp, Mus musculus
gcggccatgaagaacgtgaccgagc

SEQ ID NO: 312696 - DNA, 25 bp, Mus musculus
gcggccatgaagaacttccacagga

SEQ ID NO: 312697 - DNA, 25 bp, Mus musculus
gcggccatgaagcatgtctgctgtg

SEQ ID NO: 312698 - DNA, 25 bp, Mus musculus
gcggccatgaaggcgggtgctactt

SEQ ID NO: 312699 - DNA, 25 bp, Mus musculus
gcggccatgatggctgaccatgatg

SEQ ID NO: 312700 - DNA, 25 bp, Mus musculus
gcggccatggcggggcccctaacgg

SEQ ID NO: 312701 - DNA, 25 bp, Mus musculus
gcggcccagcctcaggtcacgcccg

SEQ ID NO: 312702 - DNA, 25 bp, Mus musculus
gcggcccaggcccaccctgcaactc

SEQ ID NO: 312703 - DNA, 25 bp, Mus musculus
gcggcccaggcccattattgtgatc

SEQ ID NO: 312704 - DNA, 25 bp, Mus musculus
gcggcccatgtccatccctatcatc

SEQ ID NO: 312705 - DNA, 25 bp, Mus musculus
gcggccccccttcacgctcgatttc

SEQ ID NO: 312706 - DNA, 25 bp, Mus musculus
gcggccccgagcaggtttcaaatga

SEQ ID NO: 312707 - DNA, 25 bp, Mus musculus
gcggccccgaggagtcagcattggc

SEQ ID NO: 312708 - DNA, 25 bp, Mus musculus
gcggcccctgcagaagactgctagc

SEQ ID NO: 312709 - DNA, 25 bp, Mus musculus
gcggcccggagagagctctcagggc

SEQ ID NO: 312710 - DNA, 25 bp, Mus musculus
gcggccctaagaagggttgtgagcc

SEQ ID NO: 312711 - DNA, 25 bp, Mus musculus
gcggccctacctggactttgatcct

SEQ ID NO: 312712 - DNA, 25 bp, Mus musculus
gcggccctgcagatcaccagcaaaa

SEQ ID NO: 312713 - DNA, 25 bp, Mus musculus
gcggccctgcaggagtgactagcac

SEQ ID NO: 312714 - DNA, 25 bp, Mus musculus
gcggcccttcccagggtctgaattt

SEQ ID NO: 312715 - DNA, 25 bp, Mus musculus
gcggccgaacatgggtgcaaggatt

SEQ ID NO: 312716 - DNA, 25 bp, Mus musculus
gcggccgaacgacagagactgcagc

SEQ ID NO: 312717 - DNA, 25 bp, Mus musculus
gcggccgaagctgagatactccatg

SEQ ID NO: 312718 - DNA, 25 bp, Mus musculus
gcggccgaccagatgtgaggtgaga

SEQ ID NO: 312719 - DNA, 25 bp, Mus musculus
gcggccgagaagcggcgtagggcca

SEQ ID NO: 312720 - DNA, 25 bp, Mus musculus
gcggccgagaagcggggcctacagc

SEQ ID NO: 312721 - DNA, 25 bp, Mus musculus
gcggccgagcaccagagacagccat

SEQ ID NO: 312722 - DNA, 25 bp, Mus musculus
gcggccgaggcggcagtgagctcct

SEQ ID NO: 312723 - DNA, 25 bp, Mus musculus
gcggccgagggtacttgtggaaggc

SEQ ID NO: 312724 - DNA, 25 bp, Mus musculus
gcggccgcaggcagcaggtgcccgg

SEQ ID NO: 312725 - DNA, 25 bp, Mus musculus
gcggccgcaggcctgaagctcatgg

SEQ ID NO: 312726 - DNA, 25 bp, Mus musculus
gcggccgccaaggacagtcacgagg

SEQ ID NO: 312727 - DNA, 25 bp, Mus musculus
gcggccgccacgatgtgtgccgtgc

SEQ ID NO: 312728 - DNA, 25 bp, Mus musculus
gcggccgccagtctccacagaggcg

SEQ ID NO: 312729 - DNA, 25 bp, Mus musculus
gcggccgcccaagagtcctttgctg

SEQ ID NO: 312730 - DNA, 25 bp, Mus musculus
gcggccgcctccaggactgaccaag

SEQ ID NO: 312731 - DNA, 25 bp, Mus musculus
gcggccgcgcagaactgtcattatt

SEQ ID NO: 312732 - DNA, 25 bp, Mus musculus
gcggccgcgtcatggccgtgcctgc

SEQ ID NO: 312733 - DNA, 25 bp, Mus musculus
gcggccgctgtcaaaagtcttgcgc

SEQ ID NO: 312734 - DNA, 25 bp, Mus musculus
gcggccggaagatggcagactttct

SEQ ID NO: 312735 - DNA, 25 bp, Mus musculus
gcggccggaaggagtggaatgtgac

SEQ ID NO: 312736 - DNA, 25 bp, Mus musculus
gcggccggaagtgttactgtgacaa

SEQ ID NO: 312737 - DNA, 25 bp, Mus musculus
gcggccggaccacaggccacaaaaa

SEQ ID NO: 312738 - DNA, 25 bp, Mus musculus
gcggccggactcagatttgataatg

SEQ ID NO: 312739 - DNA, 25 bp, Mus musculus
gcggccggagggattcatcagtggg

SEQ ID NO: 312740 - DNA, 25 bp, Mus musculus
gcggccggagggattcgaggacgcg

SEQ ID NO: 312741 - DNA, 25 bp, Mus musculus
gcggccggagtggcctctgcatcct

SEQ ID NO: 312742 - DNA, 25 bp, Mus musculus
gcggccggagtgggctggtgttccc

SEQ ID NO: 312743 - DNA, 25 bp, Mus musculus
gcggccggatgagattatgcgggac

SEQ ID NO: 312744 - DNA, 25 bp, Mus musculus
gcggccggatgccactacgaaggag

SEQ ID NO: 312745 - DNA, 25 bp, Mus musculus
gcggccggccgaaggatcatctgtc

SEQ ID NO: 312746 - DNA, 25 bp, Mus musculus
gcggccggccgaaggttcttgattg

SEQ ID NO: 312747 - DNA, 25 bp, Mus musculus
gcggccggctggcagccatggagaa

SEQ ID NO: 312748 - DNA, 25 bp, Mus musculus
gcggccgggagagaccctcaggact

SEQ ID NO: 312749 - DNA, 25 bp, Mus musculus
gcggccgggagagacgcagtgagaa

SEQ ID NO: 312750 - DNA, 25 bp, Mus musculus
gcggccgggggaacacacccgtgct

SEQ ID NO: 312751 - DNA, 25 bp, Mus musculus
gcggccgggtaggcggatctgggac

SEQ ID NO: 312752 - DNA, 25 bp, Mus musculus
gcggccggttccgagggaggttcag

SEQ ID NO: 312753 - DNA, 25 bp, Mus musculus
gcggccggttccgaggtgtgtgagg

SEQ ID NO: 312754 - DNA, 25 bp, Mus musculus
gcggccgtaaggattcacctgaggg

SEQ ID NO: 312755 - DNA, 25 bp, Mus musculus
gcggccgtaagtttgctaactgtgg

SEQ ID NO: 312756 - DNA, 25 bp, Mus musculus
gcggccgtcaggagcagccatgtct

SEQ ID NO: 312757 - DNA, 25 bp, Mus musculus
gcggcctaaactccagtctttcccc

SEQ ID NO: 312758 - DNA, 25 bp, Mus musculus
gcggcctcaaggtctgaggcgtcaa

SEQ ID NO: 312759 - DNA, 25 bp, Mus musculus
gcggcctcaaggttggagaccagat

SEQ ID NO: 312760 - DNA, 25 bp, Mus musculus
gcggcctcaagtgaccttgcaagga

SEQ ID NO: 312761 - DNA, 25 bp, Mus musculus
gcggcctcactagtgttcccaggag

SEQ ID NO: 312762 - DNA, 25 bp, Mus musculus
gcggcctcactatcagacatgcagc

SEQ ID NO: 312763 - DNA, 25 bp, Mus musculus
gcggcctcaggtccattcagaagct

SEQ ID NO: 312764 - DNA, 25 bp, Mus musculus
gcggcctccgtcagctgcagccgac

SEQ ID NO: 312765 - DNA, 25 bp, Mus musculus
gcggcctcgcaccggaagaaaagat

SEQ ID NO: 312766 - DNA, 25 bp, Mus musculus
gcggcctgacccggctccactctag

SEQ ID NO: 312767 - DNA, 25 bp, Mus musculus
gcggcctgagatccagagacaatgg

SEQ ID NO: 312768 - DNA, 25 bp, Mus musculus
gcggcctgatctggaagtggctcag

SEQ ID NO: 312769 - DNA, 25 bp, Mus musculus
gcggcctgcagatcttgaaccagat

SEQ ID NO: 312770 - DNA, 25 bp, Mus musculus
gcggcctgcagcacatcttcattac

SEQ ID NO: 312771 - DNA, 25 bp, Mus musculus
gcggcctgctgggttcacggctcag

SEQ ID NO: 312772 - DNA, 25 bp, Mus musculus
gcggcctggcccggacttagcattc

SEQ ID NO: 312773 - DNA, 25 bp, Mus musculus
gcggcctggtggtgcacaatcctgg

SEQ ID NO: 312774 - DNA, 25 bp, Mus musculus
gcggccttcgggctaacaggcagtg

SEQ ID NO: 312775 - DNA, 25 bp, Mus musculus
gcggccttgacgagatgctgttggc

SEQ ID NO: 312776 - DNA, 25 bp, Mus musculus
gcggccttgacgaggggatgagaga

SEQ ID NO: 312777 - DNA, 25 bp, Mus musculus
gcggccttgcttcacgcgtctgtgg

SEQ ID NO: 312778 - DNA, 25 bp, Mus musculus
gcggccttgcttcaggcgtctgtgg

SEQ ID NO: 312779 - DNA, 25 bp, Mus musculus
gcggcctttaggatgggaaagttga

SEQ ID NO: 312780 - DNA, 25 bp, Mus musculus
gcggcctttaggctccccatatata

SEQ ID NO: 312781 - DNA, 25 bp, Mus musculus
gcggcgaaatgtagctttggcaccg

SEQ ID NO: 312782 - DNA, 25 bp, Mus musculus
gcggcgaacgagagagctgttctct

SEQ ID NO: 312783 - DNA, 25 bp, Mus musculus
gcggcgaacgagagatgctcccttc

SEQ ID NO: 312784 - DNA, 25 bp, Mus musculus
gcggcgacaggtcttctacttacaa

SEQ ID NO: 312785 - DNA, 25 bp, Mus musculus
gcggcgacatggaagcaagtgtgga

SEQ ID NO: 312786 - DNA, 25 bp, Mus musculus
gcggcgacgcaggttgatatcaaaa

SEQ ID NO: 312787 - DNA, 25 bp, Mus musculus
gcggcgacgcgggaagaagtcccag

SEQ ID NO: 312788 - DNA, 25 bp, Mus musculus
gcggcgagaaggacccggctcgcgc

SEQ ID NO: 312789 - DNA, 25 bp, Mus musculus
gcggcgagacccaaatcttggtggg

SEQ ID NO: 312790 - DNA, 25 bp, Mus musculus
gcggcgagcaaggtctgctgaagac

SEQ ID NO: 312791 - DNA, 25 bp, Mus musculus
gcggcgagccccaaatgaaaacggg

SEQ ID NO: 312792 - DNA, 25 bp, Mus musculus
gcggcgagccccaacggcagccaca

SEQ ID NO: 312793 - DNA, 25 bp, Mus musculus
gcggcgaggccccactcctgaaagg

SEQ ID NO: 312794 - DNA, 25 bp, Mus musculus
gcggcgagtgggaaagacaagaaaa

SEQ ID NO: 312795 - DNA, 25 bp, Mus musculus
gcggcgatctccgagaaaattttgc

SEQ ID NO: 312796 - DNA, 25 bp, Mus musculus
gcggcgcaaggaccggctccgagcc

SEQ ID NO: 312797 - DNA, 25 bp, Mus musculus
gcggcgcaataacgttacaaattat

SEQ ID NO: 312798 - DNA, 25 bp, Mus musculus
gcggcgcagaccaggatggctgccc

SEQ ID NO: 312799 - DNA, 25 bp, Mus musculus
gcggcgccaagatccccagctcaag

SEQ ID NO: 312800 - DNA, 25 bp, Mus musculus
gcggcgccacgagctggtgattgca

SEQ ID NO: 312801 - DNA, 25 bp, Mus musculus
gcggcgccagccaggagcatagaag

SEQ ID NO: 312802 - DNA, 25 bp, Mus musculus
gcggcgccaggtctgaccacccgga

SEQ ID NO: 312803 - DNA, 25 bp, Mus musculus
gcggcgccggacgaccgaagccagg

SEQ ID NO: 312804 - DNA, 25 bp, Mus musculus
gcggcgcctgccccgaaatcacact

SEQ ID NO: 312805 - DNA, 25 bp, Mus musculus
gcggcgcctgccccgccaaatgcag

SEQ ID NO: 312806 - DNA, 25 bp, Mus musculus
gcggcgcgactggaggataccagtt

SEQ ID NO: 312807 - DNA, 25 bp, Mus musculus
gcggcgcgactgggtggggctgctt

SEQ ID NO: 312808 - DNA, 25 bp, Mus musculus
gcggcgcgaggcagcatggtctgag

SEQ ID NO: 312809 - DNA, 25 bp, Mus musculus
gcggcgcgcacagagctgaagcgct

SEQ ID NO: 312810 - DNA, 25 bp, Mus musculus
gcggcgcgcacagctgggtggctgt

SEQ ID NO: 312811 - DNA, 25 bp, Mus musculus
gcggcgcgccgagggtgtgtgggat

SEQ ID NO: 312812 - DNA, 25 bp, Mus musculus
gcggcgcgccgagttgaactttcta

SEQ ID NO: 312813 - DNA, 25 bp, Mus musculus
gcggcgcgcgcagaggtttcatagt

SEQ ID NO: 312814 - DNA, 25 bp, Mus musculus
gcggcgcggagagagaactgctctg

SEQ ID NO: 312815 - DNA, 25 bp, Mus musculus
gcggcgcggagagaggcctgctgaa

SEQ ID NO: 312816 - DNA, 25 bp, Mus musculus
gcggcgcggagcttagcagatcata

SEQ ID NO: 312817 - DNA, 25 bp, Mus musculus
gcggcgcggagtcacattagctttt

SEQ ID NO: 312818 - DNA, 25 bp, Mus musculus
gcggcgcgggaggtgctggagagtc

SEQ ID NO: 312819 - DNA, 25 bp, Mus musculus
gcggcgcgggcagcggtaaaatgtc

SEQ ID NO: 312820 - DNA, 25 bp, Mus musculus
gcggcgcggggagagttaagaatca

SEQ ID NO: 312821 - DNA, 25 bp, Mus musculus
gcggcgctagctaggcggccgtcac

SEQ ID NO: 312822 - DNA, 25 bp, Mus musculus
gcggcgctcagagatggagagagaa

SEQ ID NO: 312823 - DNA, 25 bp, Mus musculus
gcggcgctcatcatgctccgtcggg

SEQ ID NO: 312824 - DNA, 25 bp, Mus musculus
gcggcgctcatcatggctcgcctgc

SEQ ID NO: 312825 - DNA, 25 bp, Mus musculus
gcggcgctccagcagattgctttat

SEQ ID NO: 312826 - DNA, 25 bp, Mus musculus
gcggcgctccagcagcactctgttt

SEQ ID NO: 312827 - DNA, 25 bp, Mus musculus
gcggcgctgcggagagctcagagct

SEQ ID NO: 312828 - DNA, 25 bp, Mus musculus
gcggcgctgcggcaatgccaagtga

SEQ ID NO: 312829 - DNA, 25 bp, Mus musculus
gcggcgctggagcctggaatgcttc

SEQ ID NO: 312830 - DNA, 25 bp, Mus musculus
gcggcgctggcgggtgatgaagcct

SEQ ID NO: 312831 - DNA, 25 bp, Mus musculus
gcggcgctggcgggtgttccgaatg

SEQ ID NO: 312832 - DNA, 25 bp, Mus musculus
gcggcgctgtcagatcaagatccac

SEQ ID NO: 312833 - DNA, 25 bp, Mus musculus
gcggcggaagggttaccctcgatcc

SEQ ID NO: 312834 - DNA, 25 bp, Mus musculus
gcggcggacagggagaatcccgtat

SEQ ID NO: 312835 - DNA, 25 bp, Mus musculus
gcggcggaccgcagcagaagaagga

SEQ ID NO: 312836 - DNA, 25 bp, Mus musculus
gcggcggagcagaaatagatgaaga

SEQ ID NO: 312837 - DNA, 25 bp, Mus musculus
gcggcggagcagaccatgctcgcat

SEQ ID NO: 312838 - DNA, 25 bp, Mus musculus
gcggcggagcagattcggaggcgcc

SEQ ID NO: 312839 - DNA, 25 bp, Mus musculus
gcggcggaggagggggaggccgctc

SEQ ID NO: 312840 - DNA, 25 bp, Mus musculus
gcggcggagtctggagccgccatgg

SEQ ID NO: 312841 - DNA, 25 bp, Mus musculus
gcggcggcaagagcaaccttcaaac

SEQ ID NO: 312842 - DNA, 25 bp, Mus musculus
gcggcggcagaaatgatggaagaac

SEQ ID NO: 312843 - DNA, 25 bp, Mus musculus
gcggcggcagaacccagcagtgatg

SEQ ID NO: 312844 - DNA, 25 bp, Mus musculus
gcggcggcagccggtcactatcgtc

SEQ ID NO: 312845 - DNA, 25 bp, Mus musculus
gcggcggcaggattgtcttgagaat

SEQ ID NO: 312846 - DNA, 25 bp, Mus musculus
gcggcggcaggcgggtacaaaaata

SEQ ID NO: 312847 - DNA, 25 bp, Mus musculus
gcggcggcaggctcctcctacgctg

SEQ ID NO: 312848 - DNA, 25 bp, Mus musculus
gcggcggcccagacaggtgatttgg

SEQ ID NO: 312849 - DNA, 25 bp, Mus musculus
gcggcggccccggagaagatggagg

SEQ ID NO: 312850 - DNA, 25 bp, Mus musculus
gcggcggcccgacgctgcggccagg

SEQ ID NO: 312851 - DNA, 25 bp, Mus musculus
gcggcggcgaaatgtagctttggca

SEQ ID NO: 312852 - DNA, 25 bp, Mus musculus
gcggcggcgacgcgggaagaagtcc

SEQ ID NO: 312853 - DNA, 25 bp, Mus musculus
gcggcggcgccggtgccaagtgctg

SEQ ID NO: 312854 - DNA, 25 bp, Mus musculus
gcggcggcggaccggcggcggcggc

SEQ ID NO: 312855 - DNA, 25 bp, Mus musculus
gcggcggcggagatcctgagggaag

SEQ ID NO: 312856 - DNA, 25 bp, Mus musculus
gcggcggcggcagaacccagcagtg

SEQ ID NO: 312857 - DNA, 25 bp, Mus musculus
gcggcggcggcccagacaggtgatt

SEQ ID NO: 312858 - DNA, 25 bp, Mus musculus
gcggcggcggcggggagaactacga

SEQ ID NO: 312859 - DNA, 25 bp, Mus musculus
gcggcggcggggagaactacgatga

SEQ ID NO: 312860 - DNA, 25 bp, Mus musculus
gcggcggcgggttaacttcggctga

SEQ ID NO: 312861 - DNA, 25 bp, Mus musculus
gcggcggcgggttggagttcaaggt

SEQ ID NO: 312862 - DNA, 25 bp, Mus musculus
gcggcggctaccggggcggtgatac

SEQ ID NO: 312863 - DNA, 25 bp, Mus musculus
gcggcggctcgcgacctcaatgtac

SEQ ID NO: 312864 - DNA, 25 bp, Mus musculus
gcggcgggacaagctggggtctcag

SEQ ID NO: 312865 - DNA, 25 bp, Mus musculus
gcggcgggacaaggagcagggcagg

SEQ ID NO: 312866 - DNA, 25 bp, Mus musculus
gcggcgggacaaggaggtctgaaga

SEQ ID NO: 312867 - DNA, 25 bp, Mus musculus
gcggcgggacagttgggcaaggcgg

SEQ ID NO: 312868 - DNA, 25 bp, Mus musculus
gcggcgggacccgggtcctgataag

SEQ ID NO: 312869 - DNA, 25 bp, Mus musculus
gcggcgggagcgagggagcggacat

SEQ ID NO: 312870 - DNA, 25 bp, Mus musculus
gcggcgggatcctataagttgcaag

SEQ ID NO: 312871 - DNA, 25 bp, Mus musculus
gcggcgggatcctatgcatattttt

SEQ ID NO: 312872 - DNA, 25 bp, Mus musculus
gcggcgggcgagcagagcagaccca

SEQ ID NO: 312873 - DNA, 25 bp, Mus musculus
gcggcgggcgagcaggtggaaggga

SEQ ID NO: 312874 - DNA, 25 bp, Mus musculus
gcggcggggaggacttgcactaaga

SEQ ID NO: 312875 - DNA, 25 bp, Mus musculus
gcggcggggcagactgaagtgttgg

SEQ ID NO: 312876 - DNA, 25 bp, Mus musculus
gcggcggggcaggagcaaaacaatt

SEQ ID NO: 312877 - DNA, 25 bp, Mus musculus
gcggcggggcaggtgtagtaacatg

SEQ ID NO: 312878 - DNA, 25 bp, Mus musculus
gcggcgggggcggcagttctggcag

SEQ ID NO: 312879 - DNA, 25 bp, Mus musculus
gcggcgggtcgcgaggtgcagacat

SEQ ID NO: 312880 - DNA, 25 bp, Mus musculus
gcggcggtcaaggccctcagcctcc

SEQ ID NO: 312881 - DNA, 25 bp, Mus musculus
gcggcggtcaaggtcacggtctcgg

SEQ ID NO: 312882 - DNA, 25 bp, Mus musculus
gcggcggtcgcgcggaccatcgggg

SEQ ID NO: 312883 - DNA, 25 bp, Mus musculus
gcggcggtgacaatgagttttcttg

SEQ ID NO: 312884 - DNA, 25 bp, Mus musculus
gcggcggtgacaatggtaaacctag

SEQ ID NO: 312885 - DNA, 25 bp, Mus musculus
gcggcggtgcagatttcttgaccta

SEQ ID NO: 312886 - DNA, 25 bp, Mus musculus
gcggcggttcaggaattacacagtc

SEQ ID NO: 312887 - DNA, 25 bp, Mus musculus
gcggcggttcaggggtatggaaact

SEQ ID NO: 312888 - DNA, 25 bp, Mus musculus
gcggcggttgagacttctccattcc

SEQ ID NO: 312889 - DNA, 25 bp, Mus musculus
gcggcgtccgcgcgccgctgtgccc

SEQ ID NO: 312890 - DNA, 25 bp, Mus musculus
gcggcgtccgctcagaccagcagtg

SEQ ID NO: 312891 - DNA, 25 bp, Mus musculus
gcggcgtccggacactgcagaagga

SEQ ID NO: 312892 - DNA, 25 bp, Mus musculus
gcggcgtcctcagatatagccatat

SEQ ID NO: 312893 - DNA, 25 bp, Mus musculus
gcggcgtctcagctccgcgtgagtc

SEQ ID NO: 312894 - DNA, 25 bp, Mus musculus
gcggcgtgagcccagatcatgcaga

SEQ ID NO: 312895 - DNA, 25 bp, Mus musculus
gcggcgtggctggtcgggatggtgg

SEQ ID NO: 312896 - DNA, 25 bp, Mus musculus
gcggcgttctgatgagtgacccaca

SEQ ID NO: 312897 - DNA, 25 bp, Mus musculus
gcggcgttctggttttttgcattga

SEQ ID NO: 312898 - DNA, 25 bp, Mus musculus
gcggctacaggcggcaggaaatgct

SEQ ID NO: 312899 - DNA, 25 bp, Mus musculus
gcggctacccagctcgatcgagagc

SEQ ID NO: 312900 - DNA, 25 bp, Mus musculus
gcggctaccggggcggtgatacttc

SEQ ID NO: 312901 - DNA, 25 bp, Mus musculus
gcggctatttaccagaccaagaagg

SEQ ID NO: 312902 - DNA, 25 bp, Mus musculus
gcggctatttaccaggacattcgac

SEQ ID NO: 312903 - DNA, 25 bp, Mus musculus
gcggctatttaccaggtgaggacac

SEQ ID NO: 312904 - DNA, 25 bp, Mus musculus
gcggctcacaaagaacaagggagaa

SEQ ID NO: 312905 - DNA, 25 bp, Mus musculus
gcggctcaccggctcgattctggcc

SEQ ID NO: 312906 - DNA, 25 bp, Mus musculus
gcggctcaccgggtcgattctggcc

SEQ ID NO: 312907 - DNA, 25 bp, Mus musculus
gcggctcagagcaatcaggaccgaa

SEQ ID NO: 312908 - DNA, 25 bp, Mus musculus
gcggctcagagctaccaggagcccg

SEQ ID NO: 312909 - DNA, 25 bp, Mus musculus
gcggctcagaggaaagaatacccac

SEQ ID NO: 312910 - DNA, 25 bp, Mus musculus
gcggctccaaagagggctatgtgct

SEQ ID NO: 312911 - DNA, 25 bp, Mus musculus
gcggctcccccaggtttccatcgtg

SEQ ID NO: 312912 - DNA, 25 bp, Mus musculus
gcggctcccgatggaaatcctatga

SEQ ID NO: 312913 - DNA, 25 bp, Mus musculus
gcggctccggaaaatccactgtggg

SEQ ID NO: 312914 - DNA, 25 bp, Mus musculus
gcggctccggaaactgctccccagg

SEQ ID NO: 312915 - DNA, 25 bp, Mus musculus
gcggctcctcagatatagccatatt

SEQ ID NO: 312916 - DNA, 25 bp, Mus musculus
gcggctcctcagtattgtggaatgt

SEQ ID NO: 312917 - DNA, 25 bp, Mus musculus
gcggctcctcagtgtcggcggcgga

SEQ ID NO: 312918 - DNA, 25 bp, Mus musculus
gcggctcctctggggcttagtcctt

SEQ ID NO: 312919 - DNA, 25 bp, Mus musculus
gcggctcgcgacctcaatgtacctc

SEQ ID NO: 312920 - DNA, 25 bp, Mus musculus
gcggctcggcctggtgtctccaaac

SEQ ID NO: 312921 - DNA, 25 bp, Mus musculus
gcggctcgggcatggaaactatcaa

SEQ ID NO: 312922 - DNA, 25 bp, Mus musculus
gcggctcgtgcaagcgtgccaagta

SEQ ID NO: 312923 - DNA, 25 bp, Mus musculus
gcggctctagggcgtcccggggccc

SEQ ID NO: 312924 - DNA, 25 bp, Mus musculus
gcggctctagggggccagagtttgt

SEQ ID NO: 312925 - DNA, 25 bp, Mus musculus
gcggctctcaagcagaaaaatggct

SEQ ID NO: 312926 - DNA, 25 bp, Mus musculus
gcggctctcaaggaggccaaagcaa

SEQ ID NO: 312927 - DNA, 25 bp, Mus musculus
gcggctgacactagctgcagccgac

SEQ ID NO: 312928 - DNA, 25 bp, Mus musculus
gcggctgacagaaggacatttggat

SEQ ID NO: 312929 - DNA, 25 bp, Mus musculus
gcggctgacagcgtcctgaggttag

SEQ ID NO: 312930 - DNA, 25 bp, Mus musculus
gcggctgacaggttcttacagtctt

SEQ ID NO: 312931 - DNA, 25 bp, Mus musculus
gcggctgacggaggtgtcccctgaa

SEQ ID NO: 312932 - DNA, 25 bp, Mus musculus
gcggctgatagcgatcattgctgtc

SEQ ID NO: 312933 - DNA, 25 bp, Mus musculus
gcggctgatagcggggatcccagca

SEQ ID NO: 312934 - DNA, 25 bp, Mus musculus
gcggctgcaaatgacacaacacgga

SEQ ID NO: 312935 - DNA, 25 bp, Mus musculus
gcggctgcaaatggtaacgatcgga

SEQ ID NO: 312936 - DNA, 25 bp, Mus musculus
gcggctgcagaagcgtctcctgtaa

SEQ ID NO: 312937 - DNA, 25 bp, Mus musculus
gcggctgcagcaggccaccatggca

SEQ ID NO: 312938 - DNA, 25 bp, Mus musculus
gcggctgcagcgggaagatgtcatg

SEQ ID NO: 312939 - DNA, 25 bp, Mus musculus
gcggctgcagtctttaagaaataga

SEQ ID NO: 312940 - DNA, 25 bp, Mus musculus
gcggctgcagtgtggtggcacaaga

SEQ ID NO: 312941 - DNA, 25 bp, Mus musculus
gcggctgccaaaagcggaggccaaa

SEQ ID NO: 312942 - DNA, 25 bp, Mus musculus
gcggctgccagaaacttcagtgccc

SEQ ID NO: 312943 - DNA, 25 bp, Mus musculus
gcggctgcccgggcagtgacggaca

SEQ ID NO: 312944 - DNA, 25 bp, Mus musculus
gcggctgccctgagaaacctcgacc

SEQ ID NO: 312945 - DNA, 25 bp, Mus musculus
gcggctgcctaggttctggtattgg

SEQ ID NO: 312946 - DNA, 25 bp, Mus musculus
gcggctgcgactccgagcaccactc

SEQ ID NO: 312947 - DNA, 25 bp, Mus musculus
gcggctgcgagcgctgtagacctgg

SEQ ID NO: 312948 - DNA, 25 bp, Mus musculus
gcggctgctcagagtatagaaatat

SEQ ID NO: 312949 - DNA, 25 bp, Mus musculus
gcggctgctcaggtccaatcagcat

SEQ ID NO: 312950 - DNA, 25 bp, Mus musculus
gcggctgctgcacagccctcctaag

SEQ ID NO: 312951 - DNA, 25 bp, Mus musculus
gcggctgctgcacaggaataaagga

SEQ ID NO: 312952 - DNA, 25 bp, Mus musculus
gcggctggaggaggcgggcgtccga

SEQ ID NO: 312953 - DNA, 25 bp, Mus musculus
gcggctggaggttttcccgctcaga

SEQ ID NO: 312954 - DNA, 25 bp, Mus musculus
gcggctggagtcgaatttggaaata

SEQ ID NO: 312955 - DNA, 25 bp, Mus musculus
gcggctggagtgcccacgatggcct

SEQ ID NO: 312956 - DNA, 25 bp, Mus musculus
gcggctggcagaacttgatcaccag

SEQ ID NO: 312957 - DNA, 25 bp, Mus musculus
gcggctggcagagactcctgaaagg

SEQ ID NO: 312958 - DNA, 25 bp, Mus musculus
gcggctggcagctgcagaagagacc

SEQ ID NO: 312959 - DNA, 25 bp, Mus musculus
gcggctggccacgtgtggttgaatc

SEQ ID NO: 312960 - DNA, 25 bp, Mus musculus
gcggctggtaaagctgtcctgcctg

SEQ ID NO: 312961 - DNA, 25 bp, Mus musculus
gcggctggttggcgagaatctgctt

SEQ ID NO: 312962 - DNA, 25 bp, Mus musculus
gcggctggttgggaatgtgactatt

SEQ ID NO: 312963 - DNA, 25 bp, Mus musculus
gcggctgtatgtggacggatgacga

SEQ ID NO: 312964 - DNA, 25 bp, Mus musculus
gcggctgtcactcctgctggttgca

SEQ ID NO: 312965 - DNA, 25 bp, Mus musculus
gcggctgtggagcaggctcctagaa

SEQ ID NO: 312966 - DNA, 25 bp, Mus musculus
gcggcttctgcacgcccctccaggc

SEQ ID NO: 312967 - DNA, 25 bp, Mus musculus
gcggcttctgctgcaggagtcagca

SEQ ID NO: 312968 - DNA, 25 bp, Mus musculus
gcggctttctatagagctgggctcg

SEQ ID NO: 312969 - DNA, 25 bp, Mus musculus
gcggctttctataggtatggggact

SEQ ID NO: 312970 - DNA, 25 bp, Mus musculus
gcggctttggaggggctgtgggttt

SEQ ID NO: 312971 - DNA, 25 bp, Mus musculus
gcgggaaaccgctgaagctgacgta

SEQ ID NO: 312972 - DNA, 25 bp, Mus musculus
gcgggaaagtcttagcacctccgca

SEQ ID NO: 312973 - DNA, 25 bp, Mus musculus
gcgggaaagtcttagtgtcgagcac

SEQ ID NO: 312974 - DNA, 25 bp, Mus musculus
gcgggaacaagagaataaaggccgc

SEQ ID NO: 312975 - DNA, 25 bp, Mus musculus
gcgggaacaagagataaaactatta

SEQ ID NO: 312976 - DNA, 25 bp, Mus musculus
gcgggaacaggagctcctcttgcgg

SEQ ID NO: 312977 - DNA, 25 bp, Mus musculus
gcgggaaccaggtgctacagaagac

SEQ ID NO: 312978 - DNA, 25 bp, Mus musculus
gcgggaacgcatcgtattgacgaca

SEQ ID NO: 312979 - DNA, 25 bp, Mus musculus
gcgggaactgctggtgtgatccttg

SEQ ID NO: 312980 - DNA, 25 bp, Mus musculus
gcgggaagaatggaaaatgtttata

SEQ ID NO: 312981 - DNA, 25 bp, Mus musculus
gcgggaagcctcaggaactcacccc

SEQ ID NO: 312982 - DNA, 25 bp, Mus musculus
gcgggaagcctcaggctgtgggcgc

SEQ ID NO: 312983 - DNA, 25 bp, Mus musculus
gcgggaagcctcagtgccactaagc

SEQ ID NO: 312984 - DNA, 25 bp, Mus musculus
gcgggaagctaagaaactgaggctc

SEQ ID NO: 312985 - DNA, 25 bp, Mus musculus
gcgggaaggccagggtcatttctct

SEQ ID NO: 312986 - DNA, 25 bp, Mus musculus
gcgggaattggtctcggtgtgatta

SEQ ID NO: 312987 - DNA, 25 bp, Mus musculus
gcgggaattggtctgggcgtcatca

SEQ ID NO: 312988 - DNA, 25 bp, Mus musculus
gcgggaattggtcttggagttctta

SEQ ID NO: 312989 - DNA, 25 bp, Mus musculus
gcgggacaagctggggtctcagaat

SEQ ID NO: 312990 - DNA, 25 bp, Mus musculus
gcgggacaaggagcagggcaggaga

SEQ ID NO: 312991 - DNA, 25 bp, Mus musculus
gcgggacaaggaggtctgaagaagg

SEQ ID NO: 312992 - DNA, 25 bp, Mus musculus
gcgggacagatgcaaagccgccatg

SEQ ID NO: 312993 - DNA, 25 bp, Mus musculus
gcgggaccaagactccacttcagtt

SEQ ID NO: 312994 - DNA, 25 bp, Mus musculus
gcgggaccaaggttatttcgtcatc

SEQ ID NO: 312995 - DNA, 25 bp, Mus musculus
gcgggaccaatgctcaggtctagag

SEQ ID NO: 312996 - DNA, 25 bp, Mus musculus
gcgggaccagatgccggcaacagat

SEQ ID NO: 312997 - DNA, 25 bp, Mus musculus
gcgggaccagctgatccgagcacac

SEQ ID NO: 312998 - DNA, 25 bp, Mus musculus
gcgggaccaggatgggctcaggccc

SEQ ID NO: 312999 - DNA, 25 bp, Mus musculus
gcgggaccaggcctttaagaccatt

SEQ ID NO: 313000 - DNA, 25 bp, Mus musculus
gcgggaccaggtactttgtgttctg

SEQ ID NO: 313001 - DNA, 25 bp, Mus musculus
gcgggaccccgagatcgccggggct

SEQ ID NO: 313002 - DNA, 25 bp, Mus musculus
gcgggacccgagatccacgtgtcgg

SEQ ID NO: 313003 - DNA, 25 bp, Mus musculus
gcgggacccgagctgtgtctcttca

SEQ ID NO: 313004 - DNA, 25 bp, Mus musculus
gcgggacccgggtcctgataagccc

SEQ ID NO: 313005 - DNA, 25 bp, Mus musculus
gcgggacccttaagggccacaccaa

SEQ ID NO: 313006 - DNA, 25 bp, Mus musculus
gcgggaccgcagattatttttaatg

SEQ ID NO: 313007 - DNA, 25 bp, Mus musculus
gcgggaccgcagggattctcctgat

SEQ ID NO: 313008 - DNA, 25 bp, Mus musculus
gcgggacctgggtgtctcttccaag

SEQ ID NO: 313009 - DNA, 25 bp, Mus musculus
gcgggacgcaaaggaggaagccagc

SEQ ID NO: 313010 - DNA, 25 bp, Mus musculus
gcgggacgctgacgggctgacaggc

SEQ ID NO: 313011 - DNA, 25 bp, Mus musculus
gcgggacgctgacggggtggaggag

SEQ ID NO: 313012 - DNA, 25 bp, Mus musculus
gcgggacgtggcgaggggatcgtgg

SEQ ID NO: 313013 - DNA, 25 bp, Mus musculus
gcgggactagggagtgttcagtcac

SEQ ID NO: 313014 - DNA, 25 bp, Mus musculus
gcgggactggctagaaaatactaaa

SEQ ID NO: 313015 - DNA, 25 bp, Mus musculus
gcgggacttgtgccggtcctgcccc

SEQ ID NO: 313016 - DNA, 25 bp, Mus musculus
gcgggagaagatggttggtaaaggc

SEQ ID NO: 313017 - DNA, 25 bp, Mus musculus
gcgggagaagcagcttatggcaaac

SEQ ID NO: 313018 - DNA, 25 bp, Mus musculus
gcgggagaagcagggatctgggcac

SEQ ID NO: 313019 - DNA, 25 bp, Mus musculus
gcgggagaaggctctgcaccccgac

SEQ ID NO: 313020 - DNA, 25 bp, Mus musculus
gcgggagaaggctctgtccaacatg

SEQ ID NO: 313021 - DNA, 25 bp, Mus musculus
gcgggagaaggttgatccaaaagat

SEQ ID NO: 313022 - DNA, 25 bp, Mus musculus
gcgggagaaggtttttcgttggaat

SEQ ID NO: 313023 - DNA, 25 bp, Mus musculus
gcgggagacactgaggctttcaggt

SEQ ID NO: 313024 - DNA, 25 bp, Mus musculus
gcgggagagacagctttttcctgca

SEQ ID NO: 313025 - DNA, 25 bp, Mus musculus
gcgggagatgagacgtgacttgtag

SEQ ID NO: 313026 - DNA, 25 bp, Mus musculus
gcgggagcacatcgactccagcacc

SEQ ID NO: 313027 - DNA, 25 bp, Mus musculus
gcgggagcagcaccccttggggaaa

SEQ ID NO: 313028 - DNA, 25 bp, Mus musculus
gcgggagcaggccggaagctcattt

SEQ ID NO: 313029 - DNA, 25 bp, Mus musculus
gcgggagccaggagaacgggatgct

SEQ ID NO: 313030 - DNA, 25 bp, Mus musculus
gcgggagccagttccaggcgaatct

SEQ ID NO: 313031 - DNA, 25 bp, Mus musculus
gcgggagcgagggagcggacatgga

SEQ ID NO: 313032 - DNA, 25 bp, Mus musculus
gcgggagcgtcaggtcttgagagag

SEQ ID NO: 313033 - DNA, 25 bp, Mus musculus
gcgggaggcgaagactcatgaaatg

SEQ ID NO: 313034 - DNA, 25 bp, Mus musculus
gcgggaggcggagagtgtcactgac

SEQ ID NO: 313035 - DNA, 25 bp, Mus musculus
gcgggaggcggctctagatggcacc

SEQ ID NO: 313036 - DNA, 25 bp, Mus musculus
gcgggaggcgtacgagatgagaaca

SEQ ID NO: 313037 - DNA, 25 bp, Mus musculus
gcgggagggctgggcctgcagccgg

SEQ ID NO: 313038 - DNA, 25 bp, Mus musculus
gcgggatccgcacgaaataaatcat

SEQ ID NO: 313039 - DNA, 25 bp, Mus musculus
gcgggatcctataagttgcaaggtt

SEQ ID NO: 313040 - DNA, 25 bp, Mus musculus
gcgggatcctatgcatatttttcat

SEQ ID NO: 313041 - DNA, 25 bp, Mus musculus
gcgggatgtgaccagatgcatattc

SEQ ID NO: 313042 - DNA, 25 bp, Mus musculus
gcgggatgtgaccaggagatggctg

SEQ ID NO: 313043 - DNA, 25 bp, Mus musculus
gcgggatgtgaccaggtggccttga

SEQ ID NO: 313044 - DNA, 25 bp, Mus musculus
gcgggattataccggctgcagtacc

SEQ ID NO: 313045 - DNA, 25 bp, Mus musculus
gcgggattataccggggcccagtca

SEQ ID NO: 313046 - DNA, 25 bp, Mus musculus
gcgggattccggtcacagtttgcac

SEQ ID NO: 313047 - DNA, 25 bp, Mus musculus
gcgggattgctcagaaaaagatcat

SEQ ID NO: 313048 - DNA, 25 bp, Mus musculus
gcgggattgctcagaacttctcggt

SEQ ID NO: 313049 - DNA, 25 bp, Mus musculus
gcgggattgctcagctgccttggct

SEQ ID NO: 313050 - DNA, 25 bp, Mus musculus
gcgggattgctcagggcattgaaaa

SEQ ID NO: 313051 - DNA, 25 bp, Mus musculus
gcgggcaacagttcactgaggaatt

SEQ ID NO: 313052 - DNA, 25 bp, Mus musculus
gcgggcaagtctgaccttcatcact

SEQ ID NO: 313053 - DNA, 25 bp, Mus musculus
gcgggcaagtctgccctgacggtga

SEQ ID NO: 313054 - DNA, 25 bp, Mus musculus
gcgggcaataatctatagaccatgg

SEQ ID NO: 313055 - DNA, 25 bp, Mus musculus
gcgggcacaccgcagggagaaaact

SEQ ID NO: 313056 - DNA, 25 bp, Mus musculus
gcgggcacaggtggacgaccccccg

SEQ ID NO: 313057 - DNA, 25 bp, Mus musculus
gcgggcaccagtgagatcccatttc

SEQ ID NO: 313058 - DNA, 25 bp, Mus musculus
gcgggcaccgaagaggctaaccatt

SEQ ID NO: 313059 - DNA, 25 bp, Mus musculus
gcgggcaccgagagtgttgagggcg

SEQ ID NO: 313060 - DNA, 25 bp, Mus musculus
gcgggcaccgggagctggtgattgc

SEQ ID NO: 313061 - DNA, 25 bp, Mus musculus
gcgggcactcaggttcgagtgacgg

SEQ ID NO: 313062 - DNA, 25 bp, Mus musculus
gcgggcagagaggaactaggaagta

SEQ ID NO: 313063 - DNA, 25 bp, Mus musculus
gcgggcagagatgaacgggcttgca

SEQ ID NO: 313064 - DNA, 25 bp, Mus musculus
gcgggcagagtctgctcattgaatc

SEQ ID NO: 313065 - DNA, 25 bp, Mus musculus
gcgggcagagttttatctttaagct

SEQ ID NO: 313066 - DNA, 25 bp, Mus musculus
gcgggcagcagcttggcaaatggtc

SEQ ID NO: 313067 - DNA, 25 bp, Mus musculus
gcgggcagcaggtcactacgttcac

SEQ ID NO: 313068 - DNA, 25 bp, Mus musculus
gcgggcagcagtgacagccctgctg

SEQ ID NO: 313069 - DNA, 25 bp, Mus musculus
gcgggcagccatgaggcggcaggcc

SEQ ID NO: 313070 - DNA, 25 bp, Mus musculus
gcgggcagcgatacgcttgcctggt

SEQ ID NO: 313071 - DNA, 25 bp, Mus musculus
gcgggcagcgatacggctttggacc

SEQ ID NO: 313072 - DNA, 25 bp, Mus musculus
gcgggcagcggtaaaatgtcggctc

SEQ ID NO: 313073 - DNA, 25 bp, Mus musculus
gcgggcagtctgggctgctggctct

SEQ ID NO: 313074 - DNA, 25 bp, Mus musculus
gcgggcatatcaagaatgctgtgaa

SEQ ID NO: 313075 - DNA, 25 bp, Mus musculus
gcgggcattgcagatggaaggatta

SEQ ID NO: 313076 - DNA, 25 bp, Mus musculus
gcgggcattgcagcgtgcaatgatg

SEQ ID NO: 313077 - DNA, 25 bp, Mus musculus
gcgggccaccaggctattacaagcc

SEQ ID NO: 313078 - DNA, 25 bp, Mus musculus
gcgggccacgtgcaggaaacatccg

SEQ ID NO: 313079 - DNA, 25 bp, Mus musculus
gcgggcccagttgctgatagcccaa

SEQ ID NO: 313080 - DNA, 25 bp, Mus musculus
gcgggcccggaaatgcacttagcga

SEQ ID NO: 313081 - DNA, 25 bp, Mus musculus
gcgggcccgggactgtgcagcatgg

SEQ ID NO: 313082 - DNA, 25 bp, Mus musculus
gcgggcccgggccgcgccatgggct

SEQ ID NO: 313083 - DNA, 25 bp, Mus musculus
gcgggcccgtgaggtggtgatgctt

SEQ ID NO: 313084 - DNA, 25 bp, Mus musculus
gcgggcccgtgagttcatattcttt

SEQ ID NO: 313085 - DNA, 25 bp, Mus musculus
gcgggccctagcgcggaaacatcat

SEQ ID NO: 313086 - DNA, 25 bp, Mus musculus
gcgggccctagcgcgggctgggaag

SEQ ID NO: 313087 - DNA, 25 bp, Mus musculus
gcgggccctgacgatctgctggtat

SEQ ID NO: 313088 - DNA, 25 bp, Mus musculus
gcgggccgagatgtggtgatctacc

SEQ ID NO: 313089 - DNA, 25 bp, Mus musculus
gcgggccgaggttggatcatggtag

SEQ ID NO: 313090 - DNA, 25 bp, Mus musculus
gcgggccgcgacatggactgtcctg

SEQ ID NO: 313091 - DNA, 25 bp, Mus musculus
gcgggccggcgaaatggcaaaatgt

SEQ ID NO: 313092 - DNA, 25 bp, Mus musculus
gcgggcgaaggggaactgatcacag

SEQ ID NO: 313093 - DNA, 25 bp, Mus musculus
gcgggcgacaggaagaactaggaag

SEQ ID NO: 313094 - DNA, 25 bp, Mus musculus
gcgggcgacaggtggtttcactcca

SEQ ID NO: 313095 - DNA, 25 bp, Mus musculus
gcgggcgactcaggcaccatgagcc

SEQ ID NO: 313096 - DNA, 25 bp, Mus musculus
gcgggcgagcagagcagacccagga

SEQ ID NO: 313097 - DNA, 25 bp, Mus musculus
gcgggcgagcaggtggaagggactc

SEQ ID NO: 313098 - DNA, 25 bp, Mus musculus
gcgggcgcaaggcctctctttctga

SEQ ID NO: 313099 - DNA, 25 bp, Mus musculus
gcgggcgcagagaagagcaccctcc

SEQ ID NO: 313100 - DNA, 25 bp, Mus musculus
gcgggcgcagagaaggtcctaaagg

SEQ ID NO: 313101 - DNA, 25 bp, Mus musculus
gcgggcgcagagctgagatactggt

SEQ ID NO: 313102 - DNA, 25 bp, Mus musculus
gcgggcgcagataaagaagctgagg

SEQ ID NO: 313103 - DNA, 25 bp, Mus musculus
gcgggcgcagtgttatccacacagt

SEQ ID NO: 313104 - DNA, 25 bp, Mus musculus
gcgggcgcggagcagggcggcgagt

SEQ ID NO: 313105 - DNA, 25 bp, Mus musculus
gcgggcgcggattgtgccttctgaa

SEQ ID NO: 313106 - DNA, 25 bp, Mus musculus
gcgggcgctacagggcttttctcca

SEQ ID NO: 313107 - DNA, 25 bp, Mus musculus
gcgggcgctacaggtggacaacatc

SEQ ID NO: 313108 - DNA, 25 bp, Mus musculus
gcgggcgctaggtccgtctcccagg

SEQ ID NO: 313109 - DNA, 25 bp, Mus musculus
gcgggcgctgcaggggctgacatgg

SEQ ID NO: 313110 - DNA, 25 bp, Mus musculus
gcgggcgctgggcagacgaaagagc

SEQ ID NO: 313111 - DNA, 25 bp, Mus musculus
gcgggcgctgggcagtccattctct

SEQ ID NO: 313112 - DNA, 25 bp, Mus musculus
gcgggcggccgtcaggagcagccat

SEQ ID NO: 313113 - DNA, 25 bp, Mus musculus
gcgggcggctgacagcgtcctgagg

SEQ ID NO: 313114 - DNA, 25 bp, Mus musculus
gcgggcggctgacaggttcttacag

SEQ ID NO: 313115 - DNA, 25 bp, Mus musculus
gcgggcgtcggttgggtttctctgt

SEQ ID NO: 313116 - DNA, 25 bp, Mus musculus
gcgggcgttaaagctctcgtggcgc

SEQ ID NO: 313117 - DNA, 25 bp, Mus musculus
gcgggctagcgcatttcagatctgc

SEQ ID NO: 313118 - DNA, 25 bp, Mus musculus
gcgggctccagaggcgtccggtcgc

SEQ ID NO: 313119 - DNA, 25 bp, Mus musculus
gcgggctcccctcaggctggcctgc

SEQ ID NO: 313120 - DNA, 25 bp, Mus musculus
gcgggctcccctcagggtcatgtag

SEQ ID NO: 313121 - DNA, 25 bp, Mus musculus
gcgggctcgggaatgggaaacagca

SEQ ID NO: 313122 - DNA, 25 bp, Mus musculus
gcgggctctccaggggaaaataagt

SEQ ID NO: 313123 - DNA, 25 bp, Mus musculus
gcgggctgcgtggcattgtcgccag

SEQ ID NO: 313124 - DNA, 25 bp, Mus musculus
gcgggctggtgagaagacgcttccc

SEQ ID NO: 313125 - DNA, 25 bp, Mus musculus
gcgggcttagggtggagcgaccctg

SEQ ID NO: 313126 - DNA, 25 bp, Mus musculus
gcgggcttcaggtagaagccactca

SEQ ID NO: 313127 - DNA, 25 bp, Mus musculus
gcgggcttcaggtgaggatcccatt

SEQ ID NO: 313128 - DNA, 25 bp, Mus musculus
gcgggcttcagtgctggaggaggcc

SEQ ID NO: 313129 - DNA, 25 bp, Mus musculus
gcggggaaatggactcagtggcttt

SEQ ID NO: 313130 - DNA, 25 bp, Mus musculus
gcggggaacggtaatcccgctcaag

SEQ ID NO: 313131 - DNA, 25 bp, Mus musculus
gcggggacagatctcaagaccagag

SEQ ID NO: 313132 - DNA, 25 bp, Mus musculus
gcggggacagtaagaagacaattca

SEQ ID NO: 313133 - DNA, 25 bp, Mus musculus
gcggggacagtgcctttgacgatga

SEQ ID NO: 313134 - DNA, 25 bp, Mus musculus
gcggggactggacacctgggctgtc

SEQ ID NO: 313135 - DNA, 25 bp, Mus musculus
gcggggagagccttttccagggctc

SEQ ID NO: 313136 - DNA, 25 bp, Mus musculus
gcggggagaggccaacttatttgtc

SEQ ID NO: 313137 - DNA, 25 bp, Mus musculus
gcggggagaggggcgtagtggcaac

SEQ ID NO: 313138 - DNA, 25 bp, Mus musculus
gcggggagatggtggcctggagagc

SEQ ID NO: 313139 - DNA, 25 bp, Mus musculus
gcggggaggctggggaaggaagcca

SEQ ID NO: 313140 - DNA, 25 bp, Mus musculus
gcggggaggctggtgcaaacagctg

SEQ ID NO: 313141 - DNA, 25 bp, Mus musculus
gcggggagtgaggggagctaccgtc

SEQ ID NO: 313142 - DNA, 25 bp, Mus musculus
gcggggatcagggcagagatggcct

SEQ ID NO: 313143 - DNA, 25 bp, Mus musculus
gcggggatggtcgaggacttgcact

SEQ ID NO: 313144 - DNA, 25 bp, Mus musculus
gcggggcaaaatggagctcgacgcc

SEQ ID NO: 313145 - DNA, 25 bp, Mus musculus
gcggggcaaggaggaggagtttgac

SEQ ID NO: 313146 - DNA, 25 bp, Mus musculus
gcggggcaagtgtggtccccgcagg

SEQ ID NO: 313147 - DNA, 25 bp, Mus musculus
gcggggcaggtgcccatgttggaag

SEQ ID NO: 313148 - DNA, 25 bp, Mus musculus
gcggggcatgtagagtgatcgatgg

SEQ ID NO: 313149 - DNA, 25 bp, Mus musculus
gcggggccagctgagcaattgtgtt

SEQ ID NO: 313150 - DNA, 25 bp, Mus musculus
gcggggccgtgaggaggataaaagc

SEQ ID NO: 313151 - DNA, 25 bp, Mus musculus
gcggggccgtgaggtatccagctca

SEQ ID NO: 313152 - DNA, 25 bp, Mus musculus
gcggggcctcggaaccgtctggatc

SEQ ID NO: 313153 - DNA, 25 bp, Mus musculus
gcggggcgagagtgggctgtaaaaa

SEQ ID NO: 313154 - DNA, 25 bp, Mus musculus
gcggggcgaggccgatactccatgt

SEQ ID NO: 313155 - DNA, 25 bp, Mus musculus
gcggggcgatgtgagccccaggtgt

SEQ ID NO: 313156 - DNA, 25 bp, Mus musculus
gcggggcgcagctgggcaccacaag

SEQ ID NO: 313157 - DNA, 25 bp, Mus musculus
gcggggcgctgacaggtactgggtt

SEQ ID NO: 313158 - DNA, 25 bp, Mus musculus
gcggggcgtgggattgaagtgagtg

SEQ ID NO: 313159 - DNA, 25 bp, Mus musculus
gcggggctcacgagaatcatcattc

SEQ ID NO: 313160 - DNA, 25 bp, Mus musculus
gcggggctcacgtttcagatgagtg

SEQ ID NO: 313161 - DNA, 25 bp, Mus musculus
gcggggctgcgaggggcatgaagga

SEQ ID NO: 313162 - DNA, 25 bp, Mus musculus
gcggggctgtggatctttccagaac

SEQ ID NO: 313163 - DNA, 25 bp, Mus musculus
gcgggggaagacgatcactttttaa

SEQ ID NO: 313164 - DNA, 25 bp, Mus musculus
gcgggggaagacgatgtgtggtgtc

SEQ ID NO: 313165 - DNA, 25 bp, Mus musculus
gcgggggaggtgaagcccctccagg

SEQ ID NO: 313166 - DNA, 25 bp, Mus musculus
gcgggggcagctccccaggcctcac

SEQ ID NO: 313167 - DNA, 25 bp, Mus musculus
gcgggggcagctccccagtgaggtg

SEQ ID NO: 313168 - DNA, 25 bp, Mus musculus
gcgggggcgaggtggccaggcagac

SEQ ID NO: 313169 - DNA, 25 bp, Mus musculus
gcgggggcgaggtgtccccatgact

SEQ ID NO: 313170 - DNA, 25 bp, Mus musculus
gcgggggcgcggtctggaagctgac

SEQ ID NO: 313171 - DNA, 25 bp, Mus musculus
gcgggggcggcagttctggcaggtg

SEQ ID NO: 313172 - DNA, 25 bp, Mus musculus
gcggggggaagtgggcacatacaat

SEQ ID NO: 313173 - DNA, 25 bp, Mus musculus
gcgggggtgagttgtcagtggggct

SEQ ID NO: 313174 - DNA, 25 bp, Mus musculus
gcgggggtgccacggacttgagcat

SEQ ID NO: 313175 - DNA, 25 bp, Mus musculus
gcgggggtgccacggtgaccatcgt

SEQ ID NO: 313176 - DNA, 25 bp, Mus musculus
gcggggtcagcacatggtttgggac

SEQ ID NO: 313177 - DNA, 25 bp, Mus musculus
gcggggtgagaaagaggagacagag

SEQ ID NO: 313178 - DNA, 25 bp, Mus musculus
gcggggtgagaaaggggagacagag

SEQ ID NO: 313179 - DNA, 25 bp, Mus musculus
gcggggtgagccaggcctcgagcac

SEQ ID NO: 313180 - DNA, 25 bp, Mus musculus
gcggggtgagccagtgactccactg

SEQ ID NO: 313181 - DNA, 25 bp, Mus musculus
gcggggtgcagaggtctctgtgttg

SEQ ID NO: 313182 - DNA, 25 bp, Mus musculus
gcggggtgcggaggtcgctcatccg

SEQ ID NO: 313183 - DNA, 25 bp, Mus musculus
gcggggtggccagggctctggctga

SEQ ID NO: 313184 - DNA, 25 bp, Mus musculus
gcggggtgtgggccctcccaggccc

SEQ ID NO: 313185 - DNA, 25 bp, Mus musculus
gcggggtgtggggatttcgctttat

SEQ ID NO: 313186 - DNA, 25 bp, Mus musculus
gcggggttacaaatagcacgctgaa

SEQ ID NO: 313187 - DNA, 25 bp, Mus musculus
gcggggttacaaatatgagctcccc

SEQ ID NO: 313188 - DNA, 25 bp, Mus musculus
gcggggttgggaatggctttgctgt

SEQ ID NO: 313189 - DNA, 25 bp, Mus musculus
gcggggttggggggcttctgcttct

SEQ ID NO: 313190 - DNA, 25 bp, Mus musculus
gcggggttggggtcgatactgacac

SEQ ID NO: 313191 - DNA, 25 bp, Mus musculus
gcggggtttctcggccgcgcgcggt

SEQ ID NO: 313192 - DNA, 25 bp, Mus musculus
gcgggtaagcagttatgcctccacc

SEQ ID NO: 313193 - DNA, 25 bp, Mus musculus
gcgggtacggcctacgagttacaat

SEQ ID NO: 313194 - DNA, 25 bp, Mus musculus
gcgggtagtttagtgaagctgtggg

SEQ ID NO: 313195 - DNA, 25 bp, Mus musculus
gcgggtcaagttacagatttgggac

SEQ ID NO: 313196 - DNA, 25 bp, Mus musculus
gcgggtcaggtaaaacatcagagag

SEQ ID NO: 313197 - DNA, 25 bp, Mus musculus
gcgggtcattcagtacctcagtagt

SEQ ID NO: 313198 - DNA, 25 bp, Mus musculus
gcgggtcattcagtagtaacagatg

SEQ ID NO: 313199 - DNA, 25 bp, Mus musculus
gcgggtcccaagagacaggggtccg

SEQ ID NO: 313200 - DNA, 25 bp, Mus musculus
gcgggtcctactgtattatggagat

SEQ ID NO: 313201 - DNA, 25 bp, Mus musculus
gcgggtcctgcgttcttggcccagc

SEQ ID NO: 313202 - DNA, 25 bp, Mus musculus
gcgggtcgcgaggtgcagacatggc

SEQ ID NO: 313203 - DNA, 25 bp, Mus musculus
gcgggtctcacgatctttggcatga

SEQ ID NO: 313204 - DNA, 25 bp, Mus musculus
gcgggtctcacggaactctgatttc

SEQ ID NO: 313205 - DNA, 25 bp, Mus musculus
gcgggtctcagaaagaagaaacaat

SEQ ID NO: 313206 - DNA, 25 bp, Mus musculus
gcgggtctcaggacaagccaatgac

SEQ ID NO: 313207 - DNA, 25 bp, Mus musculus
gcgggtctcccaggaccgtcagaag

SEQ ID NO: 313208 - DNA, 25 bp, Mus musculus
gcgggtctttgagaggtatatcttt

SEQ ID NO: 313209 - DNA, 25 bp, Mus musculus
gcgggtgaatgatccccaatcaggg

SEQ ID NO: 313210 - DNA, 25 bp, Mus musculus
gcgggtgaatgggccaccacccaag

SEQ ID NO: 313211 - DNA, 25 bp, Mus musculus
gcgggtgctgcccggcggtcccgcg

SEQ ID NO: 313212 - DNA, 25 bp, Mus musculus
gcgggtgctgtgcgcttctattcca

SEQ ID NO: 313213 - DNA, 25 bp, Mus musculus
gcgggtgcttgtaggtggcgggacg

SEQ ID NO: 313214 - DNA, 25 bp, Mus musculus
gcgggtggcgccagctagccggatc

SEQ ID NO: 313215 - DNA, 25 bp, Mus musculus
gcgggtggcggccgggatctgggac

SEQ ID NO: 313216 - DNA, 25 bp, Mus musculus
gcgggtgtggcaggaatgattaata

SEQ ID NO: 313217 - DNA, 25 bp, Mus musculus
gcgggtgtttggggcctacacgccc

SEQ ID NO: 313218 - DNA, 25 bp, Mus musculus
gcgggttaccgtgcagacatggcca

SEQ ID NO: 313219 - DNA, 25 bp, Mus musculus
gcgggttgctgaggacaggacccga

SEQ ID NO: 313220 - DNA, 25 bp, Mus musculus
gcgggtttcgacttctcgccgaggg

SEQ ID NO: 313221 - DNA, 25 bp, Mus musculus
gcgggtttgccacaatctgcctgtg

SEQ ID NO: 313222 - DNA, 25 bp, Mus musculus
gcgggtttgggtctgtacacatgag

SEQ ID NO: 313223 - DNA, 25 bp, Mus musculus
gcgggttttgctggaccgcagcaag

SEQ ID NO: 313224 - DNA, 25 bp, Mus musculus
gcggtaaatgggcttcttggtaatg

SEQ ID NO: 313225 - DNA, 25 bp, Mus musculus
gcggtaacagagtactgtttggcag

SEQ ID NO: 313226 - DNA, 25 bp, Mus musculus
gcggtaactcgatcccgtactcttc

SEQ ID NO: 313227 - DNA, 25 bp, Mus musculus
gcggtaccagcccctctcccgagga

SEQ ID NO: 313228 - DNA, 25 bp, Mus musculus
gcggtactgaaggattctccagtga

SEQ ID NO: 313229 - DNA, 25 bp, Mus musculus
gcggtagaacgagccatttattgaa

SEQ ID NO: 313230 - DNA, 25 bp, Mus musculus
gcggtagcggtgaacgctgttgctc

SEQ ID NO: 313231 - DNA, 25 bp, Mus musculus
gcggtagcggtgccttctctccgtg

SEQ ID NO: 313232 - DNA, 25 bp, Mus musculus
gcggtagcggtgggtgtcaccgaag

SEQ ID NO: 313233 - DNA, 25 bp, Mus musculus
gcggtagcggtgtatgtgggatcct

SEQ ID NO: 313234 - DNA, 25 bp, Mus musculus
gcggtagctcggtttcttctgggac

SEQ ID NO: 313235 - DNA, 25 bp, Mus musculus
gcggtaggagggaactgagccgtgg

SEQ ID NO: 313236 - DNA, 25 bp, Mus musculus
gcggtatcggggggagtacaaggac

SEQ ID NO: 313237 - DNA, 25 bp, Mus musculus
gcggtatggaggagaaaccaaggta

SEQ ID NO: 313238 - DNA, 25 bp, Mus musculus
gcggtcaatgggtgggtgaggtggt

SEQ ID NO: 313239 - DNA, 25 bp, Mus musculus
gcggtcaatggtcagcaagatccag

SEQ ID NO: 313240 - DNA, 25 bp, Mus musculus
gcggtcactcagctcacagtggtac

SEQ ID NO: 313241 - DNA, 25 bp, Mus musculus
gcggtcactgagcctctgcaggtgt

SEQ ID NO: 313242 - DNA, 25 bp, Mus musculus
gcggtcactgaggtactggcggagg

SEQ ID NO: 313243 - DNA, 25 bp, Mus musculus
gcggtcatcaccggggcttgcgaca

SEQ ID NO: 313244 - DNA, 25 bp, Mus musculus
gcggtcatcaccggggttccatttt

SEQ ID NO: 313245 - DNA, 25 bp, Mus musculus
gcggtccaggagattgtgccttctg

SEQ ID NO: 313246 - DNA, 25 bp, Mus musculus
gcggtccatgagcaatggcaacagt

SEQ ID NO: 313247 - DNA, 25 bp, Mus musculus
gcggtccatgagtgaattagtagaa

SEQ ID NO: 313248 - DNA, 25 bp, Mus musculus
gcggtccattcaggagatggagttc

SEQ ID NO: 313249 - DNA, 25 bp, Mus musculus
gcggtccctcagattgctgaagcta

SEQ ID NO: 313250 - DNA, 25 bp, Mus musculus
gcggtcctacagttggggaatggcg

SEQ ID NO: 313251 - DNA, 25 bp, Mus musculus
gcggtccttggacttcaggaaccat

SEQ ID NO: 313252 - DNA, 25 bp, Mus musculus
gcggtcgagcagctggagaatcctg

SEQ ID NO: 313253 - DNA, 25 bp, Mus musculus
gcggtcgcccaggctccgcccccac

SEQ ID NO: 313254 - DNA, 25 bp, Mus musculus
gcggtcgcccagggactttgaatat

SEQ ID NO: 313255 - DNA, 25 bp, Mus musculus
gcggtcgccggttcccactatgtag

SEQ ID NO: 313256 - DNA, 25 bp, Mus musculus
gcggtcgcgcggaccatcggggctg

SEQ ID NO: 313257 - DNA, 25 bp, Mus musculus
gcggtcgcggcggtgacctacagca

SEQ ID NO: 313258 - DNA, 25 bp, Mus musculus
gcggtcggggctggtcaggacaaag

SEQ ID NO: 313259 - DNA, 25 bp, Mus musculus
gcggtctggatcagaccttgtgacc

SEQ ID NO: 313260 - DNA, 25 bp, Mus musculus
gcggtctgggccagagcttcgagtg

SEQ ID NO: 313261 - DNA, 25 bp, Mus musculus
gcggtctgggccaggtgcgtgctat

SEQ ID NO: 313262 - DNA, 25 bp, Mus musculus
gcggtcttaagaatcaacataaagt

SEQ ID NO: 313263 - DNA, 25 bp, Mus musculus
gcggtgaagcggagccctgcaggcc

SEQ ID NO: 313264 - DNA, 25 bp, Mus musculus
gcggtgaagcgggtcgccctcccgg

SEQ ID NO: 313265 - DNA, 25 bp, Mus musculus
gcggtgacaatgagttttcttggag

SEQ ID NO: 313266 - DNA, 25 bp, Mus musculus
gcggtgacaatggtaaacctagcct

SEQ ID NO: 313267 - DNA, 25 bp, Mus musculus
gcggtgacagataagaactgagtca

SEQ ID NO: 313268 - DNA, 25 bp, Mus musculus
gcggtgacagataagtgtccagctg

SEQ ID NO: 313269 - DNA, 25 bp, Mus musculus
gcggtgacagataagttcggaataa

SEQ ID NO: 313270 - DNA, 25 bp, Mus musculus
gcggtgacctcctcagtgggaacac

SEQ ID NO: 313271 - DNA, 25 bp, Mus musculus
gcggtgagattccaggtggcagaca

SEQ ID NO: 313272 - DNA, 25 bp, Mus musculus
gcggtgagcgacatgtccttccgaa

SEQ ID NO: 313273 - DNA, 25 bp, Mus musculus
gcggtgagcgacgggccgcattgac

SEQ ID NO: 313274 - DNA, 25 bp, Mus musculus
gcggtgaggagaggtttcatagtcc

SEQ ID NO: 313275 - DNA, 25 bp, Mus musculus
gcggtgagtgatcgtgagacatgac

SEQ ID NO: 313276 - DNA, 25 bp, Mus musculus
gcggtgataacggatagacaggaaa

SEQ ID NO: 313277 - DNA, 25 bp, Mus musculus
gcggtgataagtcagatgaatgaga

SEQ ID NO: 313278 - DNA, 25 bp, Mus musculus
gcggtgatctcagacgggtcaccct

SEQ ID NO: 313279 - DNA, 25 bp, Mus musculus
gcggtgatctcagccttgccggagc

SEQ ID NO: 313280 - DNA, 25 bp, Mus musculus
gcggtgatgcgcaagggctacgagg

SEQ ID NO: 313281 - DNA, 25 bp, Mus musculus
gcggtgatgcgcaaggtatgaatgc

SEQ ID NO: 313282 - DNA, 25 bp, Mus musculus
gcggtgcaagcaggttatgaggtga

SEQ ID NO: 313283 - DNA, 25 bp, Mus musculus
gcggtgcagactggcccttcaaatt

SEQ ID NO: 313284 - DNA, 25 bp, Mus musculus
gcggtgcaggactgggctacacaga

SEQ ID NO: 313285 - DNA, 25 bp, Mus musculus
gcggtgcaggactgggctacgcaga

SEQ ID NO: 313286 - DNA, 25 bp, Mus musculus
gcggtgccccaaaccagcgtgcctc

SEQ ID NO: 313287 - DNA, 25 bp, Mus musculus
gcggtgccgcagtctcaaaccatga

SEQ ID NO: 313288 - DNA, 25 bp, Mus musculus
gcggtgcgtaaaaaaatatttcttg

SEQ ID NO: 313289 - DNA, 25 bp, Mus musculus
gcggtgctcacagcagagggtcccc

SEQ ID NO: 313290 - DNA, 25 bp, Mus musculus
gcggtgctcagggaggttacagcct

SEQ ID NO: 313291 - DNA, 25 bp, Mus musculus
gcggtgctcagtgtctggagacatg

SEQ ID NO: 313292 - DNA, 25 bp, Mus musculus
gcggtgctccaggacagcatcgcaa

SEQ ID NO: 313293 - DNA, 25 bp, Mus musculus
gcggtggactgggcgctggagagcg

SEQ ID NO: 313294 - DNA, 25 bp, Mus musculus
gcggtggagacaaggagtttttggg

SEQ ID NO: 313295 - DNA, 25 bp, Mus musculus
gcggtggagcccaagtttcagccat

SEQ ID NO: 313296 - DNA, 25 bp, Mus musculus
gcggtggaggcgggggccctagctg

SEQ ID NO: 313297 - DNA, 25 bp, Mus musculus
gcggtggcaacggggaggcacacgg

SEQ ID NO: 313298 - DNA, 25 bp, Mus musculus
gcggtggccagcacgcaatcagcgg

SEQ ID NO: 313299 - DNA, 25 bp, Mus musculus
gcggtggcctgcaggtagctcgcgg

SEQ ID NO: 313300 - DNA, 25 bp, Mus musculus
gcggtgggatccaccaccacgggct

SEQ ID NO: 313301 - DNA, 25 bp, Mus musculus
gcggtggtagtggaagcaattttgg

SEQ ID NO: 313302 - DNA, 25 bp, Mus musculus
gcggtggtagtggtggctatggcgg

SEQ ID NO: 313303 - DNA, 25 bp, Mus musculus
gcggtggtgcttacgaacacagata

SEQ ID NO: 313304 - DNA, 25 bp, Mus musculus
gcggtgtacctgcagcctgcactgg

SEQ ID NO: 313305 - DNA, 25 bp, Mus musculus
gcggtgtacggcgcaacctgcggca

SEQ ID NO: 313306 - DNA, 25 bp, Mus musculus
gcggtgtcaagaaaaggaagtcgag

SEQ ID NO: 313307 - DNA, 25 bp, Mus musculus
gcggtgtcaagccacagagcaacaa

SEQ ID NO: 313308 - DNA, 25 bp, Mus musculus
gcggtgtcaaggaaccacaaaccac

SEQ ID NO: 313309 - DNA, 25 bp, Mus musculus
gcggtgtcgatgggggccgttgact

SEQ ID NO: 313310 - DNA, 25 bp, Mus musculus
gcggtgtcgtggaagggttttatgg

SEQ ID NO: 313311 - DNA, 25 bp, Mus musculus
gcggtgtgaagtaagcaatggcttc

SEQ ID NO: 313312 - DNA, 25 bp, Mus musculus
gcggtgtgcatgttgaccccaacaa

SEQ ID NO: 313313 - DNA, 25 bp, Mus musculus
gcggtgttcgcggggctcgtgctcg

SEQ ID NO: 313314 - DNA, 25 bp, Mus musculus
gcggttaagaggggcagactgaagt

SEQ ID NO: 313315 - DNA, 25 bp, Mus musculus
gcggttaagagggggtctcactgtg

SEQ ID NO: 313316 - DNA, 25 bp, Mus musculus
gcggttacaggatgagctgagtgag

SEQ ID NO: 313317 - DNA, 25 bp, Mus musculus
gcggttacagggcatctgactggaa

SEQ ID NO: 313318 - DNA, 25 bp, Mus musculus
gcggttacagggtcttacttattcc

SEQ ID NO: 313319 - DNA, 25 bp, Mus musculus
gcggttagtcgagaactgatagaag

SEQ ID NO: 313320 - DNA, 25 bp, Mus musculus
gcggttcgcgcgcagtggtaactca

SEQ ID NO: 313321 - DNA, 25 bp, Mus musculus
gcggttctcccgaggaggcatgata

SEQ ID NO: 313322 - DNA, 25 bp, Mus musculus
gcggttctcccgagggctgggataa

SEQ ID NO: 313323 - DNA, 25 bp, Mus musculus
gcggttgagacttctccattccctc

SEQ ID NO: 313324 - DNA, 25 bp, Mus musculus
gcggttgcagacggcacgaccatgg

SEQ ID NO: 313325 - DNA, 25 bp, Mus musculus
gcggttgcaggaattggccaacggc

SEQ ID NO: 313326 - DNA, 25 bp, Mus musculus
gcggttgcaggcctggcgtccgcct

SEQ ID NO: 313327 - DNA, 25 bp, Mus musculus
gcggttgcctgtagtcagaagatgg

SEQ ID NO: 313328 - DNA, 25 bp, Mus musculus
gcggttggacaagggctgcaaacac

SEQ ID NO: 313329 - DNA, 25 bp, Mus musculus
gcggttggagagagtgtgaacatgg

SEQ ID NO: 313330 - DNA, 25 bp, Mus musculus
gcggttggctggcgtgccctacgtt

SEQ ID NO: 313331 - DNA, 25 bp, Mus musculus
gcggttgggcagtgaatccaaaact

SEQ ID NO: 313332 - DNA, 25 bp, Mus musculus
gcggttgtcaggagatataacagac

SEQ ID NO: 313333 - DNA, 25 bp, Mus musculus
gcggtttcaggacaatctctcctgt

SEQ ID NO: 313334 - DNA, 25 bp, Mus musculus
gcggtttccagatgaagctctcaat

SEQ ID NO: 313335 - DNA, 25 bp, Mus musculus
gcggtttgcactggtccaacccaga

SEQ ID NO: 313336 - DNA, 25 bp, Mus musculus
gcggtttgccagggaaaatcatagt

SEQ ID NO: 313337 - DNA, 25 bp, Mus musculus
gcggtttgccagggcgacggaacaa

SEQ ID NO: 313338 - DNA, 25 bp, Mus musculus
gcggtttgccaggtcggatgatgag

SEQ ID NO: 313339 - DNA, 25 bp, Mus musculus
gcggtttgctggaaaggaagcagac

SEQ ID NO: 313340 - DNA, 25 bp, Mus musculus
gcggtttgctggtacacactggtgg

SEQ ID NO: 313341 - DNA, 25 bp, Mus musculus
gcggttttgcgaaggatgcacctca

SEQ ID NO: 313342 - DNA, 25 bp, Mus musculus
gcggttttgcgccccctcctctctc

SEQ ID NO: 313343 - DNA, 25 bp, Mus musculus
gcgtaaaaatgagtgaaaaagatga

SEQ ID NO: 313344 - DNA, 25 bp, Mus musculus
gcgtaaaaatggaaatgcttgatga

SEQ ID NO: 313345 - DNA, 25 bp, Mus musculus
gcgtaaagagactgatgtctggacc

SEQ ID NO: 313346 - DNA, 25 bp, Mus musculus
gcgtaaagaggttctccccaatcac

SEQ ID NO: 313347 - DNA, 25 bp, Mus musculus
gcgtaacaagccgcattttctggcg

SEQ ID NO: 313348 - DNA, 25 bp, Mus musculus
gcgtaaggagccttagctgccagcg

SEQ ID NO: 313349 - DNA, 25 bp, Mus musculus
gcgtaaggagccttgccctgtgtgt

SEQ ID NO: 313350 - DNA, 25 bp, Mus musculus
gcgtaagtggccctcaaagcggagg

SEQ ID NO: 313351 - DNA, 25 bp, Mus musculus
gcgtaatgacttccctgctgggaca

SEQ ID NO: 313352 - DNA, 25 bp, Mus musculus
gcgtacagggatcttgtcctttgct

SEQ ID NO: 313353 - DNA, 25 bp, Mus musculus
gcgtacagggggtggtactggggtt

SEQ ID NO: 313354 - DNA, 25 bp, Mus musculus
gcgtacccattcaggctgcaacagg

SEQ ID NO: 313355 - DNA, 25 bp, Mus musculus
gcgtaccccagaccgattttgcacc

SEQ ID NO: 313356 - DNA, 25 bp, Mus musculus
gcgtaccctacagaaacactcaagg

SEQ ID NO: 313357 - DNA, 25 bp, Mus musculus
gcgtacgaggcagaaatgctgagct

SEQ ID NO: 313358 - DNA, 25 bp, Mus musculus
gcgtacgctggcccttctgtattat

SEQ ID NO: 313359 - DNA, 25 bp, Mus musculus
gcgtacgctggttatttgctggcgt

SEQ ID NO: 313360 - DNA, 25 bp, Mus musculus
gcgtacttcgggaggaattatgctt

SEQ ID NO: 313361 - DNA, 25 bp, Mus musculus
gcgtacttcgggagggatgtactga

SEQ ID NO: 313362 - DNA, 25 bp, Mus musculus
gcgtagaagccgaactcccgtcgtt

SEQ ID NO: 313363 - DNA, 25 bp, Mus musculus
gcgtagagaaggctggcaagagatc

SEQ ID NO: 313364 - DNA, 25 bp, Mus musculus
gcgtagagaatgcgggtttccgctt

SEQ ID NO: 313365 - DNA, 25 bp, Mus musculus
gcgtagcaagcccgtcctggacaat

SEQ ID NO: 313366 - DNA, 25 bp, Mus musculus
gcgtagctctggtgcaccctctgct

SEQ ID NO: 313367 - DNA, 25 bp, Mus musculus
gcgtagctctgttcccacttcaccc

SEQ ID NO: 313368 - DNA, 25 bp, Mus musculus
gcgtaggaagggtggtgctgatcgg

SEQ ID NO: 313369 - DNA, 25 bp, Mus musculus
gcgtaggagcaatacaccaagtatc

SEQ ID NO: 313370 - DNA, 25 bp, Mus musculus
gcgtaggatcatggggtactcaatg

SEQ ID NO: 313371 - DNA, 25 bp, Mus musculus
gcgtaggatcatgggttcctcggcc

SEQ ID NO: 313372 - DNA, 25 bp, Mus musculus
gcgtaggatgcagggcattttcccg

SEQ ID NO: 313373 - DNA, 25 bp, Mus musculus
gcgtaggatgcaggggtctcactgt

SEQ ID NO: 313374 - DNA, 25 bp, Mus musculus
gcgtatcagcagtgtagtgattttg

SEQ ID NO: 313375 - DNA, 25 bp, Mus musculus
gcgtatcccagaacaacctgcggca

SEQ ID NO: 313376 - DNA, 25 bp, Mus musculus
gcgtatgctgggtgaacttcgaggc

SEQ ID NO: 313377 - DNA, 25 bp, Mus musculus
gcgtattaacaagtaagtgtggaca

SEQ ID NO: 313378 - DNA, 25 bp, Mus musculus
gcgtatttaagcagagatgacgtca

SEQ ID NO: 313379 - DNA, 25 bp, Mus musculus
gcgtatttcagatgatgacactgcc

SEQ ID NO: 313380 - DNA, 25 bp, Mus musculus
gcgtcaagcagactcgccagtgatg

SEQ ID NO: 313381 - DNA, 25 bp, Mus musculus
gcgtcactgaccggaggaacaagga

SEQ ID NO: 313382 - DNA, 25 bp, Mus musculus
gcgtcagcgggggaacagtacattg

SEQ ID NO: 313383 - DNA, 25 bp, Mus musculus
gcgtcaggagcctgatgggaaggtg

SEQ ID NO: 313384 - DNA, 25 bp, Mus musculus
gcgtcagtaagccagaccactgagc

SEQ ID NO: 313385 - DNA, 25 bp, Mus musculus
gcgtcagtctgaaggtgcttcctgg

SEQ ID NO: 313386 - DNA, 25 bp, Mus musculus
gcgtcagtctgcctttgcctgatca

SEQ ID NO: 313387 - DNA, 25 bp, Mus musculus
gcgtcagtgggtacccagaaagggt

SEQ ID NO: 313388 - DNA, 25 bp, Mus musculus
gcgtcatcaaccctggagaatgcaa

SEQ ID NO: 313389 - DNA, 25 bp, Mus musculus
gcgtcatgggcccgattgacgacag

SEQ ID NO: 313390 - DNA, 25 bp, Mus musculus
gcgtcatgggggttaattcctatat

SEQ ID NO: 313391 - DNA, 25 bp, Mus musculus
gcgtcatggggtgtgtgagtgttat

SEQ ID NO: 313392 - DNA, 25 bp, Mus musculus
gcgtcatgtgcagagacaggctttg

SEQ ID NO: 313393 - DNA, 25 bp, Mus musculus
gcgtcatgtgcaggctttgatatgt

SEQ ID NO: 313394 - DNA, 25 bp, Mus musculus
gcgtcattcagagaggaatgcgatt

SEQ ID NO: 313395 - DNA, 25 bp, Mus musculus
gcgtccaagagtaagctaaaaaagc

SEQ ID NO: 313396 - DNA, 25 bp, Mus musculus
gcgtccaagagtccatatgttgtga

SEQ ID NO: 313397 - DNA, 25 bp, Mus musculus
gcgtccagcgtgcgcccctccagca

SEQ ID NO: 313398 - DNA, 25 bp, Mus musculus
gcgtccatctgaagaaaaagaaaga

SEQ ID NO: 313399 - DNA, 25 bp, Mus musculus
gcgtccatctgacaatggattctga

SEQ ID NO: 313400 - DNA, 25 bp, Mus musculus
gcgtccatctgcaaggaccatggtg

SEQ ID NO: 313401 - DNA, 25 bp, Mus musculus
gcgtcccagcgcagggacagtcacg

SEQ ID NO: 313402 - DNA, 25 bp, Mus musculus
gcgtcccaggcctggaatgcttccg

SEQ ID NO: 313403 - DNA, 25 bp, Mus musculus
gcgtcccatggcctagccgcccgcc

SEQ ID NO: 313404 - DNA, 25 bp, Mus musculus
gcgtccccaactcttcctcccctct

SEQ ID NO: 313405 - DNA, 25 bp, Mus musculus
gcgtccccgcggacggcactgagag

SEQ ID NO: 313406 - DNA, 25 bp, Mus musculus
gcgtccccggtgaggcatatgctat

SEQ ID NO: 313407 - DNA, 25 bp, Mus musculus
gcgtccccggtgaggtataaagagg

SEQ ID NO: 313408 - DNA, 25 bp, Mus musculus
gcgtccccggtggaatgcaagactt

SEQ ID NO: 313409 - DNA, 25 bp, Mus musculus
gcgtcccgagggaaatggagcagtg

SEQ ID NO: 313410 - DNA, 25 bp, Mus musculus
gcgtcccgcaggtcctgcatgtcca

SEQ ID NO: 313411 - DNA, 25 bp, Mus musculus
gcgtccgcaggtttgatgagatctt

SEQ ID NO: 313412 - DNA, 25 bp, Mus musculus
gcgtccgcgccaggttcatcatttg

SEQ ID NO: 313413 - DNA, 25 bp, Mus musculus
gcgtccgctcagaccagcagtgccg

SEQ ID NO: 313414 - DNA, 25 bp, Mus musculus
gcgtccgctgctgccatccctcagg

SEQ ID NO: 313415 - DNA, 25 bp, Mus musculus
gcgtccgtgcccgttctgtacttca

SEQ ID NO: 313416 - DNA, 25 bp, Mus musculus
gcgtcctaacgggcaatgtcatcat

SEQ ID NO: 313417 - DNA, 25 bp, Mus musculus
gcgtcctcagatatagccatatttg

SEQ ID NO: 313418 - DNA, 25 bp, Mus musculus
gcgtcctcatacacagcgtgcaggg

SEQ ID NO: 313419 - DNA, 25 bp, Mus musculus
gcgtcctccgcagcctctactcaat

SEQ ID NO: 313420 - DNA, 25 bp, Mus musculus
gcgtcctccgcaggttcgtggtacg

SEQ ID NO: 313421 - DNA, 25 bp, Mus musculus
gcgtcctcgttggagtgacatcgtc

SEQ ID NO: 313422 - DNA, 25 bp, Mus musculus
gcgtcctctcgagacatgaaaaatg

SEQ ID NO: 313423 - DNA, 25 bp, Mus musculus
gcgtcctctcggaggtaacagctag

SEQ ID NO: 313424 - DNA, 25 bp, Mus musculus
gcgtcctctgacccactcttggaac

SEQ ID NO: 313425 - DNA, 25 bp, Mus musculus
gcgtcctgaagcgctgtgctttggc

SEQ ID NO: 313426 - DNA, 25 bp, Mus musculus
gcgtcctgctgtctcaggtgctcct

SEQ ID NO: 313427 - DNA, 25 bp, Mus musculus
gcgtcgagcagagtgtctacattgt

SEQ ID NO: 313428 - DNA, 25 bp, Mus musculus
gcgtcgagcccaggaggaagaaggc

SEQ ID NO: 313429 - DNA, 25 bp, Mus musculus
gcgtcgatcccagatgtagaactct

SEQ ID NO: 313430 - DNA, 25 bp, Mus musculus
gcgtcgatcccaggtgcacctccgc

SEQ ID NO: 313431 - DNA, 25 bp, Mus musculus
gcgtcgatcccaggtgcttgtcctg

SEQ ID NO: 313432 - DNA, 25 bp, Mus musculus
gcgtcgcagtcaggcctcagctgca

SEQ ID NO: 313433 - DNA, 25 bp, Mus musculus
gcgtcgcagtcagtactgttacata

SEQ ID NO: 313434 - DNA, 25 bp, Mus musculus
gcgtcgccaagcaggtagggccttc

SEQ ID NO: 313435 - DNA, 25 bp, Mus musculus
gcgtcgccaccatgaccaccgcgtc

SEQ ID NO: 313436 - DNA, 25 bp, Mus musculus
gcgtcgccggggatagaagtggaat

SEQ ID NO: 313437 - DNA, 25 bp, Mus musculus
gcgtcgctccgaaatcatgtccaca

SEQ ID NO: 313438 - DNA, 25 bp, Mus musculus
gcgtcggaaactcagatgaatgaag

SEQ ID NO: 313439 - DNA, 25 bp, Mus musculus
gcgtcggaacagccgtgaagcacct

SEQ ID NO: 313440 - DNA, 25 bp, Mus musculus
gcgtcggacatgcagtggaaagttc

SEQ ID NO: 313441 - DNA, 25 bp, Mus musculus
gcgtcgggaccaggatgaggctgta

SEQ ID NO: 313442 - DNA, 25 bp, Mus musculus
gcgtcgggccctcagccctaccagc

SEQ ID NO: 313443 - DNA, 25 bp, Mus musculus
gcgtcgggccctcagtgagttgcag

SEQ ID NO: 313444 - DNA, 25 bp, Mus musculus
gcgtcgtagtcagcattttcttgag

SEQ ID NO: 313445 - DNA, 25 bp, Mus musculus
gcgtcgtgtcttgggtcttctccat

SEQ ID NO: 313446 - DNA, 25 bp, Mus musculus
gcgtctaaagccattgaaaaggacg

SEQ ID NO: 313447 - DNA, 25 bp, Mus musculus
gcgtctaaagccgccctcacctttt

SEQ ID NO: 313448 - DNA, 25 bp, Mus musculus
gcgtctaaagcttcaagttatataa

SEQ ID NO: 313449 - DNA, 25 bp, Mus musculus
gcgtctaaaggaaattgatgggaaa

SEQ ID NO: 313450 - DNA, 25 bp, Mus musculus
gcgtctaaaggcttcgagtaccttc

SEQ ID NO: 313451 - DNA, 25 bp, Mus musculus
gcgtctacaaacttcaccaaactgc

SEQ ID NO: 313452 - DNA, 25 bp, Mus musculus
gcgtctacaaagcccggttcctgga

SEQ ID NO: 313453 - DNA, 25 bp, Mus musculus
gcgtctacggcggagtggaacactc

SEQ ID NO: 313454 - DNA, 25 bp, Mus musculus
gcgtctactccagtaaatcctgtca

SEQ ID NO: 313455 - DNA, 25 bp, Mus musculus
gcgtctagggagtagaacagaggcg

SEQ ID NO: 313456 - DNA, 25 bp, Mus musculus
gcgtctatagccaaggacattaagg

SEQ ID NO: 313457 - DNA, 25 bp, Mus musculus
gcgtctatctgagatgccttattgg

SEQ ID NO: 313458 - DNA, 25 bp, Mus musculus
gcgtctcactcacatagctaaccca

SEQ ID NO: 313459 - DNA, 25 bp, Mus musculus
gcgtctcactcacatgtgctggaga

SEQ ID NO: 313460 - DNA, 25 bp, Mus musculus
gcgtctcatgatggagagaagagga

SEQ ID NO: 313461 - DNA, 25 bp, Mus musculus
gcgtctcccaggtgttcttgaagtt

SEQ ID NO: 313462 - DNA, 25 bp, Mus musculus
gcgtctccgctggcgagcctccctg

SEQ ID NO: 313463 - DNA, 25 bp, Mus musculus
gcgtctcctgcacgtgaggagcatg

SEQ ID NO: 313464 - DNA, 25 bp, Mus musculus
gcgtctcgagacaagaccataaagt

SEQ ID NO: 313465 - DNA, 25 bp, Mus musculus
gcgtctcgagacaagaccatcatca

SEQ ID NO: 313466 - DNA, 25 bp, Mus musculus
gcgtctcgagcctatcctctactcc

SEQ ID NO: 313467 - DNA, 25 bp, Mus musculus
gcgtctcgaggaacgcctcgatgct

SEQ ID NO: 313468 - DNA, 25 bp, Mus musculus
gcgtctctcgaatctacactgaccc

SEQ ID NO: 313469 - DNA, 25 bp, Mus musculus
gcgtctctcgaggttgcctgatata

SEQ ID NO: 313470 - DNA, 25 bp, Mus musculus
gcgtctctgcagaagtttgatggtg

SEQ ID NO: 313471 - DNA, 25 bp, Mus musculus
gcgtctgcaaagataaaagctttga

SEQ ID NO: 313472 - DNA, 25 bp, Mus musculus
gcgtctgccaggcagacggctctgt

SEQ ID NO: 313473 - DNA, 25 bp, Mus musculus
gcgtctgctgcatctctgagctgct

SEQ ID NO: 313474 - DNA, 25 bp, Mus musculus
gcgtctgctgcggtttctttgctct

SEQ ID NO: 313475 - DNA, 25 bp, Mus musculus
gcgtctggagcaggtgtgccacaga

SEQ ID NO: 313476 - DNA, 25 bp, Mus musculus
gcgtctggcacagctgctgaaccag

SEQ ID NO: 313477 - DNA, 25 bp, Mus musculus
gcgtctggcacaggcttctgccctc

SEQ ID NO: 313478 - DNA, 25 bp, Mus musculus
gcgtctggcaggtccaagggtagcc

SEQ ID NO: 313479 - DNA, 25 bp, Mus musculus
gcgtctgtttgctttgagcgctgcc

SEQ ID NO: 313480 - DNA, 25 bp, Mus musculus
gcgtcttatgggttggaggatgaag

SEQ ID NO: 313481 - DNA, 25 bp, Mus musculus
gcgtcttcaggtaataaagctctta

SEQ ID NO: 313482 - DNA, 25 bp, Mus musculus
gcgtcttccgtgcaggcgcctaaaa

SEQ ID NO: 313483 - DNA, 25 bp, Mus musculus
gcgtcttctctggggtctatgtttc

SEQ ID NO: 313484 - DNA, 25 bp, Mus musculus
gcgtcttggggggtgtgaagaagtt

SEQ ID NO: 313485 - DNA, 25 bp, Mus musculus
gcgtcttggtggtgtgtcggagctc

SEQ ID NO: 313486 - DNA, 25 bp, Mus musculus
gcgtcttgttacaggaagaaccccc

SEQ ID NO: 313487 - DNA, 25 bp, Mus musculus
gcgtctttccagcccctgctggctc

SEQ ID NO: 313488 - DNA, 25 bp, Mus musculus
gcgtctttccaggtcatcctgttca

SEQ ID NO: 313489 - DNA, 25 bp, Mus musculus
gcgtctttggagggtggaagagcag

SEQ ID NO: 313490 - DNA, 25 bp, Mus musculus
gcgtgaaactgacaccccggaggca

SEQ ID NO: 313491 - DNA, 25 bp, Mus musculus
gcgtgaacacagaaatcccttcact

SEQ ID NO: 313492 - DNA, 25 bp, Mus musculus
gcgtgaacacagggggcttccgaag

SEQ ID NO: 313493 - DNA, 25 bp, Mus musculus
gcgtgaacacagtaacctcagtcac

SEQ ID NO: 313494 - DNA, 25 bp, Mus musculus
gcgtgaaccctaggttctgctgcct

SEQ ID NO: 313495 - DNA, 25 bp, Mus musculus
gcgtgaagaacctaatatcaggaca

SEQ ID NO: 313496 - DNA, 25 bp, Mus musculus
gcgtgaagaacctgcaactggacaa

SEQ ID NO: 313497 - DNA, 25 bp, Mus musculus
gcgtgaatgggggcaatggcatctc

SEQ ID NO: 313498 - DNA, 25 bp, Mus musculus
gcgtgacctccaactacattgactg

SEQ ID NO: 313499 - DNA, 25 bp, Mus musculus
gcgtgactggctggtgtgcaggatt

SEQ ID NO: 313500 - DNA, 25 bp, Mus musculus
gcgtgactgtttggtgctgcagagc

SEQ ID NO: 313501 - DNA, 25 bp, Mus musculus
gcgtgagaaagataggttgcagctg

SEQ ID NO: 313502 - DNA, 25 bp, Mus musculus
gcgtgagcggagagtgaagtgtgtc

SEQ ID NO: 313503 - DNA, 25 bp, Mus musculus
gcgtgagtcgaaacattgtggattt

SEQ ID NO: 313504 - DNA, 25 bp, Mus musculus
gcgtgagtgagattccctgttctgc

SEQ ID NO: 313505 - DNA, 25 bp, Mus musculus
gcgtgatcagaggtcaacagtctgg

SEQ ID NO: 313506 - DNA, 25 bp, Mus musculus
gcgtgatcaggggttcttattggtg

SEQ ID NO: 313507 - DNA, 25 bp, Mus musculus
gcgtgatctcggagtcctccgggca

SEQ ID NO: 313508 - DNA, 25 bp, Mus musculus
gcgtgatctcgggcaatggcagcag

SEQ ID NO: 313509 - DNA, 25 bp, Mus musculus
gcgtgatctgggtactgtggcaaga

SEQ ID NO: 313510 - DNA, 25 bp, Mus musculus
gcgtgcaattagagaaagataaggg

SEQ ID NO: 313511 - DNA, 25 bp, Mus musculus
gcgtgcaattaggcgtgcagccggc

SEQ ID NO: 313512 - DNA, 25 bp, Mus musculus
gcgtgcacagcagaggcagacaggc

SEQ ID NO: 313513 - DNA, 25 bp, Mus musculus
gcgtgcacctaatgccacagagcaa

SEQ ID NO: 313514 - DNA, 25 bp, Mus musculus
gcgtgcagaagcagaaagaagaaga

SEQ ID NO: 313515 - DNA, 25 bp, Mus musculus
gcgtgcagtgatcgtttcagctctg

SEQ ID NO: 313516 - DNA, 25 bp, Mus musculus
gcgtgcagtggagctccgcgtgagt

SEQ ID NO: 313517 - DNA, 25 bp, Mus musculus
gcgtgccaagcaggcagctgtgtta

SEQ ID NO: 313518 - DNA, 25 bp, Mus musculus
gcgtgccaatgcgcttaagaaaatc

SEQ ID NO: 313519 - DNA, 25 bp, Mus musculus
gcgtgccaatgcgtgcatgtcctgc

SEQ ID NO: 313520 - DNA, 25 bp, Mus musculus
gcgtgccacagttcttgctgctgat

SEQ ID NO: 313521 - DNA, 25 bp, Mus musculus
gcgtgcccacgagacttttctttga

SEQ ID NO: 313522 - DNA, 25 bp, Mus musculus
gcgtgcccacgagttcccacttgga

SEQ ID NO: 313523 - DNA, 25 bp, Mus musculus
gcgtgcccagggcctagtgcttgtt

SEQ ID NO: 313524 - DNA, 25 bp, Mus musculus
gcgtgcccagggtcctgtgggcact

SEQ ID NO: 313525 - DNA, 25 bp, Mus musculus
gcgtgcccaggttgtgtagcctgac

SEQ ID NO: 313526 - DNA, 25 bp, Mus musculus
gcgtgccgacagactaacctaacat

SEQ ID NO: 313527 - DNA, 25 bp, Mus musculus
gcgtgccgacaggagatgatttctc

SEQ ID NO: 313528 - DNA, 25 bp, Mus musculus
gcgtgcctatcaatcccaggctccg

SEQ ID NO: 313529 - DNA, 25 bp, Mus musculus
gcgtgcctatcaggaaaggactcag

SEQ ID NO: 313530 - DNA, 25 bp, Mus musculus
gcgtgcgacaaggaaacttatggaa

SEQ ID NO: 313531 - DNA, 25 bp, Mus musculus
gcgtgcgacaagggtgactattata

SEQ ID NO: 313532 - DNA, 25 bp, Mus musculus
gcgtgcgacaaggtccgcagatgca

SEQ ID NO: 313533 - DNA, 25 bp, Mus musculus
gcgtgcgcaagggtgaaaaatttgg

SEQ ID NO: 313534 - DNA, 25 bp, Mus musculus
gcgtgcgcaaggtacgtgggagcaa

SEQ ID NO: 313535 - DNA, 25 bp, Mus musculus
gcgtgcgcagactttcctcttcatt

SEQ ID NO: 313536 - DNA, 25 bp, Mus musculus
gcgtgcgcatcacccagaacacacc

SEQ ID NO: 313537 - DNA, 25 bp, Mus musculus
gcgtgcgccaggtgtcttctgcaga

SEQ ID NO: 313538 - DNA, 25 bp, Mus musculus
gcgtgcgggtgtgaacaacgtgggc

SEQ ID NO: 313539 - DNA, 25 bp, Mus musculus
gcgtgcgttcaggaggcagactccg

SEQ ID NO: 313540 - DNA, 25 bp, Mus musculus
gcgtgctcatggaaacttcgggtgg

SEQ ID NO: 313541 - DNA, 25 bp, Mus musculus
gcgtgctcatggggtacgtgtgtgc

SEQ ID NO: 313542 - DNA, 25 bp, Mus musculus
gcgtgctccgagggaagctctacaa

SEQ ID NO: 313543 - DNA, 25 bp, Mus musculus
gcgtgctgaatgatgctgggatcca

SEQ ID NO: 313544 - DNA, 25 bp, Mus musculus
gcgtgctgagagcgaaccccgactg

SEQ ID NO: 313545 - DNA, 25 bp, Mus musculus
gcgtgctgcagactggtcttctcag

SEQ ID NO: 313546 - DNA, 25 bp, Mus musculus
gcgtgctgctgagagcggccccttt

SEQ ID NO: 313547 - DNA, 25 bp, Mus musculus
gcgtgctgctgagaggttcatgtac

SEQ ID NO: 313548 - DNA, 25 bp, Mus musculus
gcgtggaaaacatggggcttctcac

SEQ ID NO: 313549 - DNA, 25 bp, Mus musculus
gcgtggaagaggtcagcagagcact

SEQ ID NO: 313550 - DNA, 25 bp, Mus musculus
gcgtggaagaggtcagggccaaaac

SEQ ID NO: 313551 - DNA, 25 bp, Mus musculus
gcgtggaagagtccccaagagctgc

SEQ ID NO: 313552 - DNA, 25 bp, Mus musculus
gcgtggaaggcagaaaccaggtggc

SEQ ID NO: 313553 - DNA, 25 bp, Mus musculus
gcgtggaagggggaggcacacggtc

SEQ ID NO: 313554 - DNA, 25 bp, Mus musculus
gcgtggacacccttcatggcggctg

SEQ ID NO: 313555 - DNA, 25 bp, Mus musculus
gcgtggaccacgaatgtgccgcttc

SEQ ID NO: 313556 - DNA, 25 bp, Mus musculus
gcgtggacccagctgtcctggaaga

SEQ ID NO: 313557 - DNA, 25 bp, Mus musculus
gcgtggagaatgtgggctcatggca

SEQ ID NO: 313558 - DNA, 25 bp, Mus musculus
gcgtggagcaggacctggcaatggg

SEQ ID NO: 313559 - DNA, 25 bp, Mus musculus
gcgtggagcagggccgactgatctt

SEQ ID NO: 313560 - DNA, 25 bp, Mus musculus
gcgtggagctgagaaccagtcttct

SEQ ID NO: 313561 - DNA, 25 bp, Mus musculus
gcgtggagctgagctcactccgtgt

SEQ ID NO: 313562 - DNA, 25 bp, Mus musculus
gcgtggaggtggggtgctgtgagtg

SEQ ID NO: 313563 - DNA, 25 bp, Mus musculus
gcgtggagttacagctgccttgcct

SEQ ID NO: 313564 - DNA, 25 bp, Mus musculus
gcgtggatcacgaaggtaacttcat

SEQ ID NO: 313565 - DNA, 25 bp, Mus musculus
gcgtggatcacgaattgggccggtg

SEQ ID NO: 313566 - DNA, 25 bp, Mus musculus
gcgtggatcggaactccagcgaccc

SEQ ID NO: 313567 - DNA, 25 bp, Mus musculus
gcgtggatcggcggttcattacagc

SEQ ID NO: 313568 - DNA, 25 bp, Mus musculus
gcgtggatcggttcgccttgcgcca

SEQ ID NO: 313569 - DNA, 25 bp, Mus musculus
gcgtggatgacaaggcatctgtggg

SEQ ID NO: 313570 - DNA, 25 bp, Mus musculus
gcgtggatgactgaagctggccccg

SEQ ID NO: 313571 - DNA, 25 bp, Mus musculus
gcgtggatgactgggcagccacgcc

SEQ ID NO: 313572 - DNA, 25 bp, Mus musculus
gcgtggattggccggctatggggca

SEQ ID NO: 313573 - DNA, 25 bp, Mus musculus
gcgtggcagtgtacagctgtaagaa

SEQ ID NO: 313574 - DNA, 25 bp, Mus musculus
gcgtggcccccgaggatgtcagtgc

SEQ ID NO: 313575 - DNA, 25 bp, Mus musculus
gcgtggccttaaagtctttaagaaa

SEQ ID NO: 313576 - DNA, 25 bp, Mus musculus
gcgtggcggagatggcgcggccgat

SEQ ID NO: 313577 - DNA, 25 bp, Mus musculus
gcgtggctgggaaccaccgtcactt

SEQ ID NO: 313578 - DNA, 25 bp, Mus musculus
gcgtggcttccggagacagaaaaga

SEQ ID NO: 313579 - DNA, 25 bp, Mus musculus
gcgtggcttccggatcctttgtgta

SEQ ID NO: 313580 - DNA, 25 bp, Mus musculus
gcgtgggaaaaagaccaaagattca

SEQ ID NO: 313581 - DNA, 25 bp, Mus musculus
gcgtgggaaactgctctcctatgtg

SEQ ID NO: 313582 - DNA, 25 bp, Mus musculus
gcgtgggaacagagccctttgggag

SEQ ID NO: 313583 - DNA, 25 bp, Mus musculus
gcgtgggacacctgcctgcagtaca

SEQ ID NO: 313584 - DNA, 25 bp, Mus musculus
gcgtgggagtcgagagactgaccaa

SEQ ID NO: 313585 - DNA, 25 bp, Mus musculus
gcgtgggagtcgagttctaaaacaa

SEQ ID NO: 313586 - DNA, 25 bp, Mus musculus
gcgtgggatgacgaggaagaggaac

SEQ ID NO: 313587 - DNA, 25 bp, Mus musculus
gcgtgggcaagtcagaatcaaccta

SEQ ID NO: 313588 - DNA, 25 bp, Mus musculus
gcgtgggcaagtcagacagtatctc

SEQ ID NO: 313589 - DNA, 25 bp, Mus musculus
gcgtgggcaagtcagcgattgtagt

SEQ ID NO: 313590 - DNA, 25 bp, Mus musculus
gcgtgggcggccggaggtttgccaa

SEQ ID NO: 313591 - DNA, 25 bp, Mus musculus
gcgtgggtgtcccagaaatttcagc

SEQ ID NO: 313592 - DNA, 25 bp, Mus musculus
gcgtggtcagcatgattcgattctt

SEQ ID NO: 313593 - DNA, 25 bp, Mus musculus
gcgtggtccgcgtcggtgctggcct

SEQ ID NO: 313594 - DNA, 25 bp, Mus musculus
gcgtggtgctggaggtgtcctgtcc

SEQ ID NO: 313595 - DNA, 25 bp, Mus musculus
gcgtggtgctggagttaaaggcaga

SEQ ID NO: 313596 - DNA, 25 bp, Mus musculus
gcgtggtggtgaccggaactttcta

SEQ ID NO: 313597 - DNA, 25 bp, Mus musculus
gcgtgtaacagatgctccatcctca

SEQ ID NO: 313598 - DNA, 25 bp, Mus musculus
gcgtgtaacaggggctccttattgg

SEQ ID NO: 313599 - DNA, 25 bp, Mus musculus
gcgtgtacggcggagatgaagttgg

SEQ ID NO: 313600 - DNA, 25 bp, Mus musculus
gcgtgtcacccgcggttcctgagac

SEQ ID NO: 313601 - DNA, 25 bp, Mus musculus
gcgtgtcagaaaatgagcttggtgt

SEQ ID NO: 313602 - DNA, 25 bp, Mus musculus
gcgtgtccggccctgaacgccatga

SEQ ID NO: 313603 - DNA, 25 bp, Mus musculus
gcgtgtcctaacgagaatgtcatac

SEQ ID NO: 313604 - DNA, 25 bp, Mus musculus
gcgtgtcctatgactggccactgac

SEQ ID NO: 313605 - DNA, 25 bp, Mus musculus
gcgtgtcctatgactggctgatcct

SEQ ID NO: 313606 - DNA, 25 bp, Mus musculus
gcgtgtctgagaaccttctcccgga

SEQ ID NO: 313607 - DNA, 25 bp, Mus musculus
gcgtgtgagcgtggcacaagacttg

SEQ ID NO: 313608 - DNA, 25 bp, Mus musculus
gcgtgtgaggtacaggtgtcggctc

SEQ ID NO: 313609 - DNA, 25 bp, Mus musculus
gcgtgtgatggggccaaactgagcc

SEQ ID NO: 313610 - DNA, 25 bp, Mus musculus
gcgtgtgccttctgggcattgaaga

SEQ ID NO: 313611 - DNA, 25 bp, Mus musculus
gcgtgtgcgccctgggtccaactga

SEQ ID NO: 313612 - DNA, 25 bp, Mus musculus
gcgtgtgctcgtggcacggaggtgc

SEQ ID NO: 313613 - DNA, 25 bp, Mus musculus
gcgtgtgtggagttcaccttccagc

SEQ ID NO: 313614 - DNA, 25 bp, Mus musculus
gcgtgtgtggtgttcaccttccagc

SEQ ID NO: 313615 - DNA, 25 bp, Mus musculus
gcgtgtgttaagccatcaaacaatg

SEQ ID NO: 313616 - DNA, 25 bp, Mus musculus
gcgtgtgttaaggtctcattttttt

SEQ ID NO: 313617 - DNA, 25 bp, Mus musculus
gcgtgtgttaaggttaccaacatat

SEQ ID NO: 313618 - DNA, 25 bp, Mus musculus
gcgtgttagaggagatttaccttca

SEQ ID NO: 313619 - DNA, 25 bp, Mus musculus
gcgtgttctcccggacgagggatct

SEQ ID NO: 313620 - DNA, 25 bp, Mus musculus
gcgtgttctgagatgacagtcatgt

SEQ ID NO: 313621 - DNA, 25 bp, Mus musculus
gcgtgttctgaggatcctggaaagc

SEQ ID NO: 313622 - DNA, 25 bp, Mus musculus
gcgtgttgctggatgagtattggag

SEQ ID NO: 313623 - DNA, 25 bp, Mus musculus
gcgtgttgctggctgccatgcctat

SEQ ID NO: 313624 - DNA, 25 bp, Mus musculus
gcgtgttgctggctggattgccttt

SEQ ID NO: 313625 - DNA, 25 bp, Mus musculus
gcgtgttggggacaaagagaaagta

SEQ ID NO: 313626 - DNA, 25 bp, Mus musculus
gcgtgttggtcgcctctctgccttt

SEQ ID NO: 313627 - DNA, 25 bp, Mus musculus
gcgtgttggtcgcgggggttctact

SEQ ID NO: 313628 - DNA, 25 bp, Mus musculus
gcgttaattgaacactgttaattta

SEQ ID NO: 313629 - DNA, 25 bp, Mus musculus
gcgttacagccaggcatgctgagcc

SEQ ID NO: 313630 - DNA, 25 bp, Mus musculus
gcgttacatcgacagacatctgcaa

SEQ ID NO: 313631 - DNA, 25 bp, Mus musculus
gcgttactgccgatgcaatgccacc

SEQ ID NO: 313632 - DNA, 25 bp, Mus musculus
gcgttagactcagaggagctgtgat

SEQ ID NO: 313633 - DNA, 25 bp, Mus musculus
gcgttagactcagagtcataaggtc

SEQ ID NO: 313634 - DNA, 25 bp, Mus musculus
gcgttagatctggctctgttgctgt

SEQ ID NO: 313635 - DNA, 25 bp, Mus musculus
gcgttagccccgtggacccagcagc

SEQ ID NO: 313636 - DNA, 25 bp, Mus musculus
gcgttagccccgtgggtgctcgtgt

SEQ ID NO: 313637 - DNA, 25 bp, Mus musculus
gcgttagccttcaaaccatgaagtg

SEQ ID NO: 313638 - DNA, 25 bp, Mus musculus
gcgttagccttcggttgtttgtctg

SEQ ID NO: 313639 - DNA, 25 bp, Mus musculus
gcgttatcagagtgaagccatagag

SEQ ID NO: 313640 - DNA, 25 bp, Mus musculus
gcgttatcgagcctactagttcaat

SEQ ID NO: 313641 - DNA, 25 bp, Mus musculus
gcgttatcgaggaaagcatgtggat

SEQ ID NO: 313642 - DNA, 25 bp, Mus musculus
gcgttatcgaggtaatatatataat

SEQ ID NO: 313643 - DNA, 25 bp, Mus musculus
gcgttattgctcggggtgacaaaga

SEQ ID NO: 313644 - DNA, 25 bp, Mus musculus
gcgttcaacgctccagttataaacc

SEQ ID NO: 313645 - DNA, 25 bp, Mus musculus
gcgttcaagttaattatgacctggc

SEQ ID NO: 313646 - DNA, 25 bp, Mus musculus
gcgttcaagttaattctgtcagacc

SEQ ID NO: 313647 - DNA, 25 bp, Mus musculus
gcgttcaagtttgagctgggaagat

SEQ ID NO: 313648 - DNA, 25 bp, Mus musculus
gcgttcacaagatcatttccatgtg

SEQ ID NO: 313649 - DNA, 25 bp, Mus musculus
gcgttcacaagtctgagttcacttg

SEQ ID NO: 313650 - DNA, 25 bp, Mus musculus
gcgttcacagagtgcaaattcacct

SEQ ID NO: 313651 - DNA, 25 bp, Mus musculus
gcgttcactgaggcagttgcacctg

SEQ ID NO: 313652 - DNA, 25 bp, Mus musculus
gcgttcaggaggcagactccggggt

SEQ ID NO: 313653 - DNA, 25 bp, Mus musculus
gcgttcagttaatggaatcttctga

SEQ ID NO: 313654 - DNA, 25 bp, Mus musculus
gcgttcattccggctagccctgctc

SEQ ID NO: 313655 - DNA, 25 bp, Mus musculus
gcgttccaaaagctgccgcagtggc

SEQ ID NO: 313656 - DNA, 25 bp, Mus musculus
gcgttcccggctgtcactgagcact

SEQ ID NO: 313657 - DNA, 25 bp, Mus musculus
gcgttccgaagcgcctccctcttga

SEQ ID NO: 313658 - DNA, 25 bp, Mus musculus
gcgttccgaagcgcggtcaacatgg

SEQ ID NO: 313659 - DNA, 25 bp, Mus musculus
gcgttcttcacaggtggcttctgct

SEQ ID NO: 313660 - DNA, 25 bp, Mus musculus
gcgttcttgctaactgtccagttaa

SEQ ID NO: 313661 - DNA, 25 bp, Mus musculus
gcgttgaacaacatgggacgaaact

SEQ ID NO: 313662 - DNA, 25 bp, Mus musculus
gcgttgaagaacagagcatttagct

SEQ ID NO: 313663 - DNA, 25 bp, Mus musculus
gcgttgaagaacagggagtgcttgg

SEQ ID NO: 313664 - DNA, 25 bp, Mus musculus
gcgttgcgccaggcaggacactgct

SEQ ID NO: 313665 - DNA, 25 bp, Mus musculus
gcgttgcgccaggtgtagctccact

SEQ ID NO: 313666 - DNA, 25 bp, Mus musculus
gcgttgctggtacaattaccagaac

SEQ ID NO: 313667 - DNA, 25 bp, Mus musculus
gcgttggagggtgctgagtactcct

SEQ ID NO: 313668 - DNA, 25 bp, Mus musculus
gcgttggatggttacatccaggcat

SEQ ID NO: 313669 - DNA, 25 bp, Mus musculus
gcgttgggatcagattgataagtat

SEQ ID NO: 313670 - DNA, 25 bp, Mus musculus
gcgttggggagtatccgcctccgac

SEQ ID NO: 313671 - DNA, 25 bp, Mus musculus
gcgttggtttttcagaagatatggc

SEQ ID NO: 313672 - DNA, 25 bp, Mus musculus
gcgttggtttttctaggaaatcaag

SEQ ID NO: 313673 - DNA, 25 bp, Mus musculus
gcgttggtttttgtctccctgcaac

SEQ ID NO: 313674 - DNA, 25 bp, Mus musculus
gcgttgtcacctgaggcccttctcc

SEQ ID NO: 313675 - DNA, 25 bp, Mus musculus
gcgttgtcacctggagcattccaga

SEQ ID NO: 313676 - DNA, 25 bp, Mus musculus
gcgttgtcagtcttatggggcccag

SEQ ID NO: 313677 - DNA, 25 bp, Mus musculus
gcgttgttaggaagatgatccatat

SEQ ID NO: 313678 - DNA, 25 bp, Mus musculus
gcgttgttaggattatgtactgaag

SEQ ID NO: 313679 - DNA, 25 bp, Mus musculus
gcgtttatttcaagtgtcaccagac

SEQ ID NO: 313680 - DNA, 25 bp, Mus musculus
gcgtttcagagggcccatagcctgt

SEQ ID NO: 313681 - DNA, 25 bp, Mus musculus
gcgtttcctgggcagactcagccat

SEQ ID NO: 313682 - DNA, 25 bp, Mus musculus
gcgtttcgggtccccggctacagca

SEQ ID NO: 313683 - DNA, 25 bp, Mus musculus
gcgtttctcccctgctcctctccag

SEQ ID NO: 313684 - DNA, 25 bp, Mus musculus
gcgtttgcacaaagttcgagaagga

SEQ ID NO: 313685 - DNA, 25 bp, Mus musculus
gcgtttgcaggccatcgaagacggc

SEQ ID NO: 313686 - DNA, 25 bp, Mus musculus
gcgtttgcttcatgactttatatgg

SEQ ID NO: 313687 - DNA, 25 bp, Mus musculus
gcgtttggaggtgccctccaagacc

SEQ ID NO: 313688 - DNA, 25 bp, Mus musculus
gcgtttggcgcgatgtctcacacca

SEQ ID NO: 313689 - DNA, 25 bp, Mus musculus
gcgtttggcgcgatgtgcctgcgac

SEQ ID NO: 313690 - DNA, 25 bp, Mus musculus
gcgtttgttggacagatgcaccaac

SEQ ID NO: 313691 - DNA, 25 bp, Mus musculus
gcgttttcagaaaagatgtctttga

SEQ ID NO: 313692 - DNA, 25 bp, Mus musculus
gcgttttcctcaggcgcagacactc

SEQ ID NO: 313693 - DNA, 25 bp, Mus musculus
gcgtttttcaaggatgtcactgatt

SEQ ID NO: 313694 - DNA, 25 bp, Mus musculus
gcgtttttcaagtatgaagtcagag

SEQ ID NO: 313695 - DNA, 25 bp, Mus musculus
gctaaaaaaagaaatcacaattcac

SEQ ID NO: 313696 - DNA, 25 bp, Mus musculus
gctaaaaaaagaaggtgacacagca

SEQ ID NO: 313697 - DNA, 25 bp, Mus musculus
gctaaaaagtgggaaatgaaagctt

SEQ ID NO: 313698 - DNA, 25 bp, Mus musculus
gctaaaacctgagaatctgcccgag

SEQ ID NO: 313699 - DNA, 25 bp, Mus musculus
gctaaaactacaagagtggatcatg

SEQ ID NO: 313700 - DNA, 25 bp, Mus musculus
gctaaaagccaagcacggaaataac

SEQ ID NO: 313701 - DNA, 25 bp, Mus musculus
gctaaaagctctgggggtgaaatgg

SEQ ID NO: 313702 - DNA, 25 bp, Mus musculus
gctaaaagctctgggggtgaacatg

SEQ ID NO: 313703 - DNA, 25 bp, Mus musculus
gctaaaattacaagttgatcgtgtc

SEQ ID NO: 313704 - DNA, 25 bp, Mus musculus
gctaaaatttccacctgctgatctt

SEQ ID NO: 313705 - DNA, 25 bp, Mus musculus
gctaaacaacaagatctgtgatatt

SEQ ID NO: 313706 - DNA, 25 bp, Mus musculus
gctaaacaagaaactcgggtgccct

SEQ ID NO: 313707 - DNA, 25 bp, Mus musculus
gctaaacaagaatttaaagaggacg

SEQ ID NO: 313708 - DNA, 25 bp, Mus musculus
gctaaaccattgctggcctcgaact

SEQ ID NO: 313709 - DNA, 25 bp, Mus musculus
gctaaactcagcccaaggcttgcag

SEQ ID NO: 313710 - DNA, 25 bp, Mus musculus
gctaaactctcaccaaaatgtgagc

SEQ ID NO: 313711 - DNA, 25 bp, Mus musculus
gctaaactgcaacacggctaaggaa

SEQ ID NO: 313712 - DNA, 25 bp, Mus musculus
gctaaacttcaaggctgtagagagg

SEQ ID NO: 313713 - DNA, 25 bp, Mus musculus
gctaaactttgtgacttgcactaag

SEQ ID NO: 313714 - DNA, 25 bp, Mus musculus
gctaaagacgggccagcaggcctgg

SEQ ID NO: 313715 - DNA, 25 bp, Mus musculus
gctaaagatggagaaggagaggaac

SEQ ID NO: 313716 - DNA, 25 bp, Mus musculus
gctaaagcagaggtgcagtgagcct

SEQ ID NO: 313717 - DNA, 25 bp, Mus musculus
gctaaagcatgaccccgtggccctt

SEQ ID NO: 313718 - DNA, 25 bp, Mus musculus
gctaaagcccattatctccagcctg

SEQ ID NO: 313719 - DNA, 25 bp, Mus musculus
gctaaagccgatgctcaggaaaagg

SEQ ID NO: 313720 - DNA, 25 bp, Mus musculus
gctaaagccgatggcttcgggagca

SEQ ID NO: 313721 - DNA, 25 bp, Mus musculus
gctaaaggaagacttcgctgatgaa

SEQ ID NO: 313722 - DNA, 25 bp, Mus musculus
gctaaaggactggaaaggagacaag

SEQ ID NO: 313723 - DNA, 25 bp, Mus musculus
gctaaaggaggctgtgaggggaaga

SEQ ID NO: 313724 - DNA, 25 bp, Mus musculus
gctaaaggcagaccattccacattg

SEQ ID NO: 313725 - DNA, 25 bp, Mus musculus
gctaaaggggaagaaaagacatgct

SEQ ID NO: 313726 - DNA, 25 bp, Mus musculus
gctaaaggggaagtgaaatcttgtg

SEQ ID NO: 313727 - DNA, 25 bp, Mus musculus
gctaaagttgctgaggttgccaaga

SEQ ID NO: 313728 - DNA, 25 bp, Mus musculus
gctaaagttttacagtggaaagccc

SEQ ID NO: 313729 - DNA, 25 bp, Mus musculus
gctaaataaccagagtatgctggat

SEQ ID NO: 313730 - DNA, 25 bp, Mus musculus
gctaaatacaatgcctttaacttgt

SEQ ID NO: 313731 - DNA, 25 bp, Mus musculus
gctaaatcacatcaggtgacagagt

SEQ ID NO: 313732 - DNA, 25 bp, Mus musculus
gctaacaatcttggcaaagcgcaag

SEQ ID NO: 313733 - DNA, 25 bp, Mus musculus
gctaacaatgagccgtggaagaagc

SEQ ID NO: 313734 - DNA, 25 bp, Mus musculus
gctaacacagttgctcctgaattcg

SEQ ID NO: 313735 - DNA, 25 bp, Mus musculus
gctaacatcttcctggcttctgctg

SEQ ID NO: 313736 - DNA, 25 bp, Mus musculus
gctaacatgaagctgttctttctac

SEQ ID NO: 313737 - DNA, 25 bp, Mus musculus
gctaacatgaaggcagacaagttgt

SEQ ID NO: 313738 - DNA, 25 bp, Mus musculus
gctaacatggggttcggagcgaccg

SEQ ID NO: 313739 - DNA, 25 bp, Mus musculus
gctaaccaaggaagggatgctacag

SEQ ID NO: 313740 - DNA, 25 bp, Mus musculus
gctaaccaaggtttgcccacaggaa

SEQ ID NO: 313741 - DNA, 25 bp, Mus musculus
gctaacccaggaactggtgctccta

SEQ ID NO: 313742 - DNA, 25 bp, Mus musculus
gctaacccaggagaacgtcagctgc

SEQ ID NO: 313743 - DNA, 25 bp, Mus musculus
gctaacccctctcctccataagcag

SEQ ID NO: 313744 - DNA, 25 bp, Mus musculus
gctaacctcaaagcctctccgacca

SEQ ID NO: 313745 - DNA, 25 bp, Mus musculus
gctaacctcacacaggtggctgtgg

SEQ ID NO: 313746 - DNA, 25 bp, Mus musculus
gctaacctcacacagtacagatctc

SEQ ID NO: 313747 - DNA, 25 bp, Mus musculus
gctaacctcaccaaaggctattcgg

SEQ ID NO: 313748 - DNA, 25 bp, Mus musculus
gctaacctcaccaagtaccgggaag

SEQ ID NO: 313749 - DNA, 25 bp, Mus musculus
gctaacctgagattacaagagcgac

SEQ ID NO: 313750 - DNA, 25 bp, Mus musculus
gctaacctgaggcatgtctaggcca

SEQ ID NO: 313751 - DNA, 25 bp, Mus musculus
gctaacgacaacagcccaaggagct

SEQ ID NO: 313752 - DNA, 25 bp, Mus musculus
gctaacgaggacgtctgcctggcag

SEQ ID NO: 313753 - DNA, 25 bp, Mus musculus
gctaacggatttgtcccactcactt

SEQ ID NO: 313754 - DNA, 25 bp, Mus musculus
gctaacggatttgttggatggattt

SEQ ID NO: 313755 - DNA, 25 bp, Mus musculus
gctaactcaggagaggagccattta

SEQ ID NO: 313756 - DNA, 25 bp, Mus musculus
gctaactcaggagaggctgctccca

SEQ ID NO: 313757 - DNA, 25 bp, Mus musculus
gctaactcaggagaggtacttggaa

SEQ ID NO: 313758 - DNA, 25 bp, Mus musculus
gctaactcaggccgggaaccgatga

SEQ ID NO: 313759 - DNA, 25 bp, Mus musculus
gctaactctgagggcacgtcagagg

SEQ ID NO: 313760 - DNA, 25 bp, Mus musculus
gctaactctgagttcctgaaattcg

SEQ ID NO: 313761 - DNA, 25 bp, Mus musculus
gctaactgagaccatgcagaggcct

SEQ ID NO: 313762 - DNA, 25 bp, Mus musculus
gctaactgaggggttggcaaaacaa

SEQ ID NO: 313763 - DNA, 25 bp, Mus musculus
gctaactgataaaattctaccagtg

SEQ ID NO: 313764 - DNA, 25 bp, Mus musculus
gctaactgataaactccagggattc

SEQ ID NO: 313765 - DNA, 25 bp, Mus musculus
gctaacttacagagttgagtggcct

SEQ ID NO: 313766 - DNA, 25 bp, Mus musculus
gctaacttacaggttctgacgggaa

SEQ ID NO: 313767 - DNA, 25 bp, Mus musculus
gctaacttcagtgcttatccctctg

SEQ ID NO: 313768 - DNA, 25 bp, Mus musculus
gctaactttccactatttgctgcct

SEQ ID NO: 313769 - DNA, 25 bp, Mus musculus
gctaagaaactgccaggagtaggaa

SEQ ID NO: 313770 - DNA, 25 bp, Mus musculus
gctaagaaaggaccctcaacacctt

SEQ ID NO: 313771 - DNA, 25 bp, Mus musculus
gctaagaaataagcagatccttgta

SEQ ID NO: 313772 - DNA, 25 bp, Mus musculus
gctaagaaataaggatcgttcatct

SEQ ID NO: 313773 - DNA, 25 bp, Mus musculus
gctaagaaatatgaagcacaagccc

SEQ ID NO: 313774 - DNA, 25 bp, Mus musculus
gctaagaacggaaagaccaagaagt

SEQ ID NO: 313775 - DNA, 25 bp, Mus musculus
gctaagaaggaggggtgaggctgct

SEQ ID NO: 313776 - DNA, 25 bp, Mus musculus
gctaagagccaggtaatttctaatg

SEQ ID NO: 313777 - DNA, 25 bp, Mus musculus
gctaagagggcgaatattcgcctcc

SEQ ID NO: 313778 - DNA, 25 bp, Mus musculus
gctaagagggcgaattgtggagccc

SEQ ID NO: 313779 - DNA, 25 bp, Mus musculus
gctaagcaactccgcctccctgcct

SEQ ID NO: 313780 - DNA, 25 bp, Mus musculus
gctaagcaactccggagcctggtga

SEQ ID NO: 313781 - DNA, 25 bp, Mus musculus
gctaagcagccagatttagatcatg

SEQ ID NO: 313782 - DNA, 25 bp, Mus musculus
gctaagcaggtctgaagaaaggtca

SEQ ID NO: 313783 - DNA, 25 bp, Mus musculus
gctaagcagtaccagtttgctagtg

SEQ ID NO: 313784 - DNA, 25 bp, Mus musculus
gctaagccagtgggagtgtgcagcc

SEQ ID NO: 313785 - DNA, 25 bp, Mus musculus
gctaagcccaaacttgcacgagcca

SEQ ID NO: 313786 - DNA, 25 bp, Mus musculus
gctaagcccagatggctctgactcc

SEQ ID NO: 313787 - DNA, 25 bp, Mus musculus
gctaagctgccgggcatgtctaggc

SEQ ID NO: 313788 - DNA, 25 bp, Mus musculus
gctaaggaaaggtacaaaaatatac

SEQ ID NO: 313789 - DNA, 25 bp, Mus musculus
gctaaggaacaagactgggatcaga

SEQ ID NO: 313790 - DNA, 25 bp, Mus musculus
gctaaggaacatggggcagcaggag

SEQ ID NO: 313791 - DNA, 25 bp, Mus musculus
gctaaggaacatgggtgtagtgatt

SEQ ID NO: 313792 - DNA, 25 bp, Mus musculus
gctaaggaagggtcttctacttaca

SEQ ID NO: 313793 - DNA, 25 bp, Mus musculus
gctaaggacattgagacagaaagac

SEQ ID NO: 313794 - DNA, 25 bp, Mus musculus
gctaaggagagcaaggctctgtaca

SEQ ID NO: 313795 - DNA, 25 bp, Mus musculus
gctaaggatccagcgtctgttgaca

SEQ ID NO: 313796 - DNA, 25 bp, Mus musculus
gctaaggatccaggaccacaagcca

SEQ ID NO: 313797 - DNA, 25 bp, Mus musculus
gctaaggatccagggctcactgatc

SEQ ID NO: 313798 - DNA, 25 bp, Mus musculus
gctaaggatcctgaccccgaacttc

SEQ ID NO: 313799 - DNA, 25 bp, Mus musculus
gctaaggcaaccagagtaccagtga

SEQ ID NO: 313800 - DNA, 25 bp, Mus musculus
gctaaggcgagggattttaggtgat

SEQ ID NO: 313801 - DNA, 25 bp, Mus musculus
gctaagggaagatacacctatggct

SEQ ID NO: 313802 - DNA, 25 bp, Mus musculus
gctaagggacagatggctatgaacg

SEQ ID NO: 313803 - DNA, 25 bp, Mus musculus
gctaagggacagggggctgaaagag

SEQ ID NO: 313804 - DNA, 25 bp, Mus musculus
gctaagtacacaaatgatgacttct

SEQ ID NO: 313805 - DNA, 25 bp, Mus musculus
gctaagtctgacccccattgttccc

SEQ ID NO: 313806 - DNA, 25 bp, Mus musculus
gctaagtggctctgtatttctgtca

SEQ ID NO: 313807 - DNA, 25 bp, Mus musculus
gctaagtggctgagccaaaccagca

SEQ ID NO: 313808 - DNA, 25 bp, Mus musculus
gctaatacgagggagaagacaccca

SEQ ID NO: 313809 - DNA, 25 bp, Mus musculus
gctaatactctttaaggaagattac

SEQ ID NO: 313810 - DNA, 25 bp, Mus musculus
gctaatatcccaacggagtcctcct

SEQ ID NO: 313811 - DNA, 25 bp, Mus musculus
gctaatcagcaaggagctagctgag

SEQ ID NO: 313812 - DNA, 25 bp, Mus musculus
gctaatcatcgtttaacaatggaac

SEQ ID NO: 313813 - DNA, 25 bp, Mus musculus
gctaatcctggaggtcctagaagac

SEQ ID NO: 313814 - DNA, 25 bp, Mus musculus
gctaatcctggagttagcagcccaa

SEQ ID NO: 313815 - DNA, 25 bp, Mus musculus
gctaatctaggtcttgccgtggaat

SEQ ID NO: 313816 - DNA, 25 bp, Mus musculus
gctaatgaaagacagaaacaaactg

SEQ ID NO: 313817 - DNA, 25 bp, Mus musculus
gctaatgaaagacagggacatgaaa

SEQ ID NO: 313818 - DNA, 25 bp, Mus musculus
gctaatgaagcaagtgtggaggcaa

SEQ ID NO: 313819 - DNA, 25 bp, Mus musculus
gctaatgaatggattggtatgtgtg

SEQ ID NO: 313820 - DNA, 25 bp, Mus musculus
gctaatgacatcaggacccgggtcg

SEQ ID NO: 313821 - DNA, 25 bp, Mus musculus
gctaatgatactgtcggccagtgaa

SEQ ID NO: 313822 - DNA, 25 bp, Mus musculus
gctaatgatcaaagcgctgcagggg

SEQ ID NO: 313823 - DNA, 25 bp, Mus musculus
gctaatgatcaacggttccagtttg

SEQ ID NO: 313824 - DNA, 25 bp, Mus musculus
gctaatgatgcctatcctggcccgc

SEQ ID NO: 313825 - DNA, 25 bp, Mus musculus
gctaatgcagagatccactgccaga

SEQ ID NO: 313826 - DNA, 25 bp, Mus musculus
gctaatgcagaggggagtttgccca

SEQ ID NO: 313827 - DNA, 25 bp, Mus musculus
gctaatgcagtcccaccccctgtac

SEQ ID NO: 313828 - DNA, 25 bp, Mus musculus
gctaatgccttgctgtgcttctaca

SEQ ID NO: 313829 - DNA, 25 bp, Mus musculus
gctaatgccttgggcgctgggctgc

SEQ ID NO: 313830 - DNA, 25 bp, Mus musculus
gctaatggctcagctttcaacattt

SEQ ID NO: 313831 - DNA, 25 bp, Mus musculus
gctaatgggaagagtacatctcgga

SEQ ID NO: 313832 - DNA, 25 bp, Mus musculus
gctaatgtaagaatgtctacaagca

SEQ ID NO: 313833 - DNA, 25 bp, Mus musculus
gctaatgtcaacagaccgctccggc

SEQ ID NO: 313834 - DNA, 25 bp, Mus musculus
gctaatgtcagcagaccgctccggc

SEQ ID NO: 313835 - DNA, 25 bp, Mus musculus
gctaattcagacacaatggcctgtg

SEQ ID NO: 313836 - DNA, 25 bp, Mus musculus
gctaattcatacagattcatctgaa

SEQ ID NO: 313837 - DNA, 25 bp, Mus musculus
gctaattcatacaggtcccatggcc

SEQ ID NO: 313838 - DNA, 25 bp, Mus musculus
gctaattcgtctgaggaagaatgtt

SEQ ID NO: 313839 - DNA, 25 bp, Mus musculus
gctaatttatgatcgttgtccaact

SEQ ID NO: 313840 - DNA, 25 bp, Mus musculus
gctaatttgtggaacctctgagggg

SEQ ID NO: 313841 - DNA, 25 bp, Mus musculus
gctaatttgtggccgtctgctgacc

SEQ ID NO: 313842 - DNA, 25 bp, Mus musculus
gctaatttgtgtttacagacctgca

SEQ ID NO: 313843 - DNA, 25 bp, Mus musculus
gctacaaaagatttaaagatgaccc

SEQ ID NO: 313844 - DNA, 25 bp, Mus musculus
gctacaaaagcagcagcaacagaag

SEQ ID NO: 313845 - DNA, 25 bp, Mus musculus
gctacaaaaggtgcaccaatgggca

SEQ ID NO: 313846 - DNA, 25 bp, Mus musculus
gctacaaaaggtgcttccactcaga

SEQ ID NO: 313847 - DNA, 25 bp, Mus musculus
gctacaaagtgaagtgctcaggagc

SEQ ID NO: 313848 - DNA, 25 bp, Mus musculus
gctacaacaaaactacagacagtcg

SEQ ID NO: 313849 - DNA, 25 bp, Mus musculus
gctacaacaaccgccgagacctgaa

SEQ ID NO: 313850 - DNA, 25 bp, Mus musculus
gctacaacagcgtttatggggccca

SEQ ID NO: 313851 - DNA, 25 bp, Mus musculus
gctacaacttcaggaaaagctcctc

SEQ ID NO: 313852 - DNA, 25 bp, Mus musculus
gctacaagaagagatacgaggagga

SEQ ID NO: 313853 - DNA, 25 bp, Mus musculus
gctacaagaggaatcattgacctga

SEQ ID NO: 313854 - DNA, 25 bp, Mus musculus
gctacaagcacaactcctaatagta

SEQ ID NO: 313855 - DNA, 25 bp, Mus musculus
gctacaagcagtgccggctacagtg

SEQ ID NO: 313856 - DNA, 25 bp, Mus musculus
gctacaaggagaacgtggacttatg

SEQ ID NO: 313857 - DNA, 25 bp, Mus musculus
gctacaaggagaacgttgacatttg

SEQ ID NO: 313858 - DNA, 25 bp, Mus musculus
gctacaaggaggatctcagtaagag

SEQ ID NO: 313859 - DNA, 25 bp, Mus musculus
gctacaagtgttgatacccataata

SEQ ID NO: 313860 - DNA, 25 bp, Mus musculus
gctacaagtgttgttcccatggtgc

SEQ ID NO: 313861 - DNA, 25 bp, Mus musculus
gctacaatccctctacttcggaacc

SEQ ID NO: 313862 - DNA, 25 bp, Mus musculus
gctacaatgcaacgtggccctgaat

SEQ ID NO: 313863 - DNA, 25 bp, Mus musculus
gctacacaaaaggtggttgttggag

SEQ ID NO: 313864 - DNA, 25 bp, Mus musculus
gctacacaaatggctacacggatgc

SEQ ID NO: 313865 - DNA, 25 bp, Mus musculus
gctacacaggacatcatgcctatgc

SEQ ID NO: 313866 - DNA, 25 bp, Mus musculus
gctacacaggacttcatgcctatgc

SEQ ID NO: 313867 - DNA, 25 bp, Mus musculus
gctacacatacacagggagcatgac

SEQ ID NO: 313868 - DNA, 25 bp, Mus musculus
gctacacatgcaactgtgttattgg

SEQ ID NO: 313869 - DNA, 25 bp, Mus musculus
gctacaccatccccccgcaggctgg

SEQ ID NO: 313870 - DNA, 25 bp, Mus musculus
gctacacccaagaatgtggcaatct

SEQ ID NO: 313871 - DNA, 25 bp, Mus musculus
gctacacccaagcgagcctgtcagc

SEQ ID NO: 313872 - DNA, 25 bp, Mus musculus
gctacaccccctcacgcctcacagt

SEQ ID NO: 313873 - DNA, 25 bp, Mus musculus
gctacacctgccggtcagggatccc

SEQ ID NO: 313874 - DNA, 25 bp, Mus musculus
gctacacctgccggtccaaccgtga

SEQ ID NO: 313875 - DNA, 25 bp, Mus musculus
gctacacgaggtgcagtgggtggtg

SEQ ID NO: 313876 - DNA, 25 bp, Mus musculus
gctacacgagtgggtggtgcaaagg

SEQ ID NO: 313877 - DNA, 25 bp, Mus musculus
gctacacgcagacagtggacatttg

SEQ ID NO: 313878 - DNA, 25 bp, Mus musculus
gctacactgggcgccctgtgctttg

SEQ ID NO: 313879 - DNA, 25 bp, Mus musculus
gctacagaactcaggtttaacagaa

SEQ ID NO: 313880 - DNA, 25 bp, Mus musculus
gctacagaataagcttagatatgcc

SEQ ID NO: 313881 - DNA, 25 bp, Mus musculus
gctacagagagcagattctgccctt

SEQ ID NO: 313882 - DNA, 25 bp, Mus musculus
gctacagaggtgggcttactgtaag

SEQ ID NO: 313883 - DNA, 25 bp, Mus musculus
gctacagaggtgtccaacaggccat

SEQ ID NO: 313884 - DNA, 25 bp, Mus musculus
gctacagagtggccaccctttgtgg

SEQ ID NO: 313885 - DNA, 25 bp, Mus musculus
gctacagatatgggacacagcaggc

SEQ ID NO: 313886 - DNA, 25 bp, Mus musculus
gctacagcagaggaataaatgaaga

SEQ ID NO: 313887 - DNA, 25 bp, Mus musculus
gctacagcagcggcgagagatgctc

SEQ ID NO: 313888 - DNA, 25 bp, Mus musculus
gctacagccatgatgattgtgggtt

SEQ ID NO: 313889 - DNA, 25 bp, Mus musculus
gctacagcctcagatgaaatcatgc

SEQ ID NO: 313890 - DNA, 25 bp, Mus musculus
gctacagctacctagcatgtccaaa

SEQ ID NO: 313891 - DNA, 25 bp, Mus musculus
gctacagctgggctgggaggatcgg

SEQ ID NO: 313892 - DNA, 25 bp, Mus musculus
gctacagcttggggaagggaacata

SEQ ID NO: 313893 - DNA, 25 bp, Mus musculus
gctacaggaatacagagaccgtctc

SEQ ID NO: 313894 - DNA, 25 bp, Mus musculus
gctacaggaatacaggattttggtt

SEQ ID NO: 313895 - DNA, 25 bp, Mus musculus
gctacaggaatggagagtggcaagc

SEQ ID NO: 313896 - DNA, 25 bp, Mus musculus
gctacaggaggatctaagatgtcca

SEQ ID NO: 313897 - DNA, 25 bp, Mus musculus
gctacaggcagcagctccggtctga

SEQ ID NO: 313898 - DNA, 25 bp, Mus musculus
gctacagggaacccaagcacccctt

SEQ ID NO: 313899 - DNA, 25 bp, Mus musculus
gctacaggtgatcacgctcaccatc

SEQ ID NO: 313900 - DNA, 25 bp, Mus musculus
gctacaggtgtctagtggtaaagcg

SEQ ID NO: 313901 - DNA, 25 bp, Mus musculus
gctacagtatgagggagtggggccg

SEQ ID NO: 313902 - DNA, 25 bp, Mus musculus
gctacagtcatacagtccagacaag

SEQ ID NO: 313903 - DNA, 25 bp, Mus musculus
gctacagtctgcctttcagtcagaa

SEQ ID NO: 313904 - DNA, 25 bp, Mus musculus
gctacagtgatcaggttcagcgtcc

SEQ ID NO: 313905 - DNA, 25 bp, Mus musculus
gctacataaggtatctttccgacct

SEQ ID NO: 313906 - DNA, 25 bp, Mus musculus
gctacatcaaaagaggcttccagtt

SEQ ID NO: 313907 - DNA, 25 bp, Mus musculus
gctacatcaaaaggtacttcgagtt

SEQ ID NO: 313908 - DNA, 25 bp, Mus musculus
gctacatcgctgggactaatggcaa

SEQ ID NO: 313909 - DNA, 25 bp, Mus musculus
gctacatcggaggaaatgaggccag

SEQ ID NO: 313910 - DNA, 25 bp, Mus musculus
gctacatcgtggtggacagtgaact

SEQ ID NO: 313911 - DNA, 25 bp, Mus musculus
gctacatcgtggtgtatgttgtatg

SEQ ID NO: 313912 - DNA, 25 bp, Mus musculus
gctacatctcaggccagggctttga

SEQ ID NO: 313913 - DNA, 25 bp, Mus musculus
gctacatctcaggcccctggtttga

SEQ ID NO: 313914 - DNA, 25 bp, Mus musculus
gctacattaatgccaccctgcaggc

SEQ ID NO: 313915 - DNA, 25 bp, Mus musculus
gctacattcctcagggaactgaaac

SEQ ID NO: 313916 - DNA, 25 bp, Mus musculus
gctacattgagagtcaggtacagtg

SEQ ID NO: 313917 - DNA, 25 bp, Mus musculus
gctacattgagagtcatcctttttc

SEQ ID NO: 313918 - DNA, 25 bp, Mus musculus
gctacattgaggggtacgtgccatc

SEQ ID NO: 313919 - DNA, 25 bp, Mus musculus
gctacattgaggggtctgtgcactt

SEQ ID NO: 313920 - DNA, 25 bp, Mus musculus
gctacattggctggggctccaacgg

SEQ ID NO: 313921 - DNA, 25 bp, Mus musculus
gctacattggctggtgtcccttctg

SEQ ID NO: 313922 - DNA, 25 bp, Mus musculus
gctaccaacaagtatgaggtagacg

SEQ ID NO: 313923 - DNA, 25 bp, Mus musculus
gctaccaagaccgagatgccgcgcc

SEQ ID NO: 313924 - DNA, 25 bp, Mus musculus
gctaccacaaccagctgctgaaccg

SEQ ID NO: 313925 - DNA, 25 bp, Mus musculus
gctaccacacaaggtttgacggatg

SEQ ID NO: 313926 - DNA, 25 bp, Mus musculus
gctaccacagaagctgaaccggaag

SEQ ID NO: 313927 - DNA, 25 bp, Mus musculus
gctaccacagaggccttgccccttc

SEQ ID NO: 313928 - DNA, 25 bp, Mus musculus
gctaccactcaggctctcgccttga

SEQ ID NO: 313929 - DNA, 25 bp, Mus musculus
gctaccagccacaggagctcttagg

SEQ ID NO: 313930 - DNA, 25 bp, Mus musculus
gctaccagcggctctgctctgcttt

SEQ ID NO: 313931 - DNA, 25 bp, Mus musculus
gctaccaggagtttgttcaggaagt

SEQ ID NO: 313932 - DNA, 25 bp, Mus musculus
gctaccaggttcccagtcttctcac

SEQ ID NO: 313933 - DNA, 25 bp, Mus musculus
gctaccagtattgtacccatgatgc

SEQ ID NO: 313934 - DNA, 25 bp, Mus musculus
gctaccagtgtagcctatgcccatc

SEQ ID NO: 313935 - DNA, 25 bp, Mus musculus
gctaccataggagactacacggact

SEQ ID NO: 313936 - DNA, 25 bp, Mus musculus
gctaccataggctccacttacctgt

SEQ ID NO: 313937 - DNA, 25 bp, Mus musculus
gctaccatctgaagagtctactcgg

SEQ ID NO: 313938 - DNA, 25 bp, Mus musculus
gctacccaagcagggtggccactgc

SEQ ID NO: 313939 - DNA, 25 bp, Mus musculus
gctacccaaggccgcacatgcctac

SEQ ID NO: 313940 - DNA, 25 bp, Mus musculus
gctacccagctcgatcgagagctga

SEQ ID NO: 313941 - DNA, 25 bp, Mus musculus
gctaccccaaaacaggccccagggc

SEQ ID NO: 313942 - DNA, 25 bp, Mus musculus
gctaccccaaaacagtgggaaatgc

SEQ ID NO: 313943 - DNA, 25 bp, Mus musculus
gctaccccaacaatgcaccttccgg

SEQ ID NO: 313944 - DNA, 25 bp, Mus musculus
gctaccccaacaggccccgggtgct

SEQ ID NO: 313945 - DNA, 25 bp, Mus musculus
gctacccccagatccctgcagcccc

SEQ ID NO: 313946 - DNA, 25 bp, Mus musculus
gctacccccgagctgctcttgtgaa

SEQ ID NO: 313947 - DNA, 25 bp, Mus musculus
gctaccccggcaaagctgttgctga

SEQ ID NO: 313948 - DNA, 25 bp, Mus musculus
gctaccctattaatgcctcctcctc

SEQ ID NO: 313949 - DNA, 25 bp, Mus musculus
gctaccctattaatggcttccaggc

SEQ ID NO: 313950 - DNA, 25 bp, Mus musculus
gctaccctgctaaatgttaggccgg

SEQ ID NO: 313951 - DNA, 25 bp, Mus musculus
gctacccttcctgcacccaggacgt

SEQ ID NO: 313952 - DNA, 25 bp, Mus musculus
gctacccttctggttctttgtgtgg

SEQ ID NO: 313953 - DNA, 25 bp, Mus musculus
gctaccgaggcctaggatcagttct

SEQ ID NO: 313954 - DNA, 25 bp, Mus musculus
gctaccgatcaccgcaacggccatt

SEQ ID NO: 313955 - DNA, 25 bp, Mus musculus
gctaccgatcaccggggctaccgtg

SEQ ID NO: 313956 - DNA, 25 bp, Mus musculus
gctaccggacagctttcttcggaaa

SEQ ID NO: 313957 - DNA, 25 bp, Mus musculus
gctaccggagccgcatcaatgagaa

SEQ ID NO: 313958 - DNA, 25 bp, Mus musculus
gctaccggaggtatggggcagatgt

SEQ ID NO: 313959 - DNA, 25 bp, Mus musculus
gctaccggagttggatcggtcatgg

SEQ ID NO: 313960 - DNA, 25 bp, Mus musculus
gctaccggcagatcaccatccggag

SEQ ID NO: 313961 - DNA, 25 bp, Mus musculus
gctaccgggcatcggccctgggcag

SEQ ID NO: 313962 - DNA, 25 bp, Mus musculus
gctaccggggagcattcagcctgtg

SEQ ID NO: 313963 - DNA, 25 bp, Mus musculus
gctaccggggagtaacaatgaagag

SEQ ID NO: 313964 - DNA, 25 bp, Mus musculus
gctaccgtcgctttctccagctgag

SEQ ID NO: 313965 - DNA, 25 bp, Mus musculus
gctaccgtcttgctggtgagcaccg

SEQ ID NO: 313966 - DNA, 25 bp, Mus musculus
gctacctacggctctcttaagagcc

SEQ ID NO: 313967 - DNA, 25 bp, Mus musculus
gctacctacggggaacttgaaatac

SEQ ID NO: 313968 - DNA, 25 bp, Mus musculus
gctacctactagagccggagaacag

SEQ ID NO: 313969 - DNA, 25 bp, Mus musculus
gctacctcaagctgagggcagagca

SEQ ID NO: 313970 - DNA, 25 bp, Mus musculus
gctacctcaaggagctgagcaagcg

SEQ ID NO: 313971 - DNA, 25 bp, Mus musculus
gctacctcaatcacagttgcagccc

SEQ ID NO: 313972 - DNA, 25 bp, Mus musculus
gctacctcagtctcacggatgattg

SEQ ID NO: 313973 - DNA, 25 bp, Mus musculus
gctacctctggggtgaatgagagtg

SEQ ID NO: 313974 - DNA, 25 bp, Mus musculus
gctacctctgtgcaatgaaggtaac

SEQ ID NO: 313975 - DNA, 25 bp, Mus musculus
gctacctgcaaaatgtaactgcgga

SEQ ID NO: 313976 - DNA, 25 bp, Mus musculus
gctacctgcaccagagacggaaaac

SEQ ID NO: 313977 - DNA, 25 bp, Mus musculus
gctacctgcaccaggattctaatcc

SEQ ID NO: 313978 - DNA, 25 bp, Mus musculus
gctacctgcagggctgaccagctgg

SEQ ID NO: 313979 - DNA, 25 bp, Mus musculus
gctacctgcctaaccagcccctccg

SEQ ID NO: 313980 - DNA, 25 bp, Mus musculus
gctacctggaaccaggcacggctgg

SEQ ID NO: 313981 - DNA, 25 bp, Mus musculus
gctacctggaagaagccctgcagag

SEQ ID NO: 313982 - DNA, 25 bp, Mus musculus
gctacctggaagagtgcctgctcac

SEQ ID NO: 313983 - DNA, 25 bp, Mus musculus
gctacctggacttaactgtgccacc

SEQ ID NO: 313984 - DNA, 25 bp, Mus musculus
gctacctggagatgttccgagaaca

SEQ ID NO: 313985 - DNA, 25 bp, Mus musculus
gctacctgggagccatcgagggaat

SEQ ID NO: 313986 - DNA, 25 bp, Mus musculus
gctaccttaggatcgagcggtccac

SEQ ID NO: 313987 - DNA, 25 bp, Mus musculus
gctaccttcaagatgctgtcccctc

SEQ ID NO: 313988 - DNA, 25 bp, Mus musculus
gctacctttgaacgaatcccgctca

SEQ ID NO: 313989 - DNA, 25 bp, Mus musculus
gctacgaagcaggctgcaccctgga

SEQ ID NO: 313990 - DNA, 25 bp, Mus musculus
gctacgacccgggagcccataagta

SEQ ID NO: 313991 - DNA, 25 bp, Mus musculus
gctacgacgtgctgtgtgcagcagc

SEQ ID NO: 313992 - DNA, 25 bp, Mus musculus
gctacgacgtggttgcgcagacagc

SEQ ID NO: 313993 - DNA, 25 bp, Mus musculus
gctacgactacagtcagggtagtac

SEQ ID NO: 313994 - DNA, 25 bp, Mus musculus
gctacgaggaagtaccatttaggtc

SEQ ID NO: 313995 - DNA, 25 bp, Mus musculus
gctacgaggcaaaggtgtacagtgc

SEQ ID NO: 313996 - DNA, 25 bp, Mus musculus
gctacgatagccatgagggcagaag

SEQ ID NO: 313997 - DNA, 25 bp, Mus musculus
gctacgatagccattcccttcaggc

SEQ ID NO: 313998 - DNA, 25 bp, Mus musculus
gctacgataggaaacagatgggaag

SEQ ID NO: 313999 - DNA, 25 bp, Mus musculus
gctacgataggaacacatcaagagg

SEQ ID NO: 314000 - DNA, 25 bp, Mus musculus
gctacgataggtacctgtgtcgtgt

SEQ ID NO: 314001 - DNA, 25 bp, Mus musculus
gctacgatagtggttccatgtcaga

SEQ ID NO: 314002 - DNA, 25 bp, Mus musculus
gctacgcaccaaaggtgtgactttg

SEQ ID NO: 314003 - DNA, 25 bp, Mus musculus
gctacgcaggggaaatcctggccgc

SEQ ID NO: 314004 - DNA, 25 bp, Mus musculus
gctacgcatcatgccactgccttct

SEQ ID NO: 314005 - DNA, 25 bp, Mus musculus
gctacgccaggcacaaatatgccag

SEQ ID NO: 314006 - DNA, 25 bp, Mus musculus
gctacgcctgtgaggtctgtgcatt

SEQ ID NO: 314007 - DNA, 25 bp, Mus musculus
gctacgcgcggtatgtggcctttgc

SEQ ID NO: 314008 - DNA, 25 bp, Mus musculus
gctacgcggcaaagcagctcctgga

SEQ ID NO: 314009 - DNA, 25 bp, Mus musculus
gctacgctttggccccaaacccatg

SEQ ID NO: 314010 - DNA, 25 bp, Mus musculus
gctacggaagccgcagtggtggagg

SEQ ID NO: 314011 - DNA, 25 bp, Mus musculus
gctacggaagcctttgcttccttac

SEQ ID NO: 314012 - DNA, 25 bp, Mus musculus
gctacggcaaatactggtaacccag

SEQ ID NO: 314013 - DNA, 25 bp, Mus musculus
gctacggcacagtgcttgctgaatt

SEQ ID NO: 314014 - DNA, 25 bp, Mus musculus
gctacggccgcactcggaacccact

SEQ ID NO: 314015 - DNA, 25 bp, Mus musculus
gctacggctgggttacccagtgagg

SEQ ID NO: 314016 - DNA, 25 bp, Mus musculus
gctacgggcacggctcggatggcgt

SEQ ID NO: 314017 - DNA, 25 bp, Mus musculus
gctacgggcagcagagttcattccg

SEQ ID NO: 314018 - DNA, 25 bp, Mus musculus
gctacggtctctgctgcgctacatg

SEQ ID NO: 314019 - DNA, 25 bp, Mus musculus
gctacgtcaaggtcccaaagcccac

SEQ ID NO: 314020 - DNA, 25 bp, Mus musculus
gctacgtcctcccgaccatgctcgc

SEQ ID NO: 314021 - DNA, 25 bp, Mus musculus
gctacgtgagaacttgaagcaagat

SEQ ID NO: 314022 - DNA, 25 bp, Mus musculus
gctacgtgagtttttcagattatca

SEQ ID NO: 314023 - DNA, 25 bp, Mus musculus
gctacgttttcattgtgatctctgg

SEQ ID NO: 314024 - DNA, 25 bp, Mus musculus
gctactaaggagggcgcagatgtcc

SEQ ID NO: 314025 - DNA, 25 bp, Mus musculus
gctactaaggagggcgctctctgtg

SEQ ID NO: 314026 - DNA, 25 bp, Mus musculus
gctactacaagaaacatggcatcag

SEQ ID NO: 314027 - DNA, 25 bp, Mus musculus
gctactacacgtgggctgtcttctg

SEQ ID NO: 314028 - DNA, 25 bp, Mus musculus
gctactactgtgctgaggagaccaa

SEQ ID NO: 314029 - DNA, 25 bp, Mus musculus
gctactatgagaagctccataagta

SEQ ID NO: 314030 - DNA, 25 bp, Mus musculus
gctactcaggcagatccgttttgtg

SEQ ID NO: 314031 - DNA, 25 bp, Mus musculus
gctactcaggcagtatctccaggag

SEQ ID NO: 314032 - DNA, 25 bp, Mus musculus
gctactccagaaaaatcttcaaatg

SEQ ID NO: 314033 - DNA, 25 bp, Mus musculus
gctactccagcacagatggatacag

SEQ ID NO: 314034 - DNA, 25 bp, Mus musculus
gctactccaggaggcaccatgtggg

SEQ ID NO: 314035 - DNA, 25 bp, Mus musculus
gctactccaggtacgtaggtgccat

SEQ ID NO: 314036 - DNA, 25 bp, Mus musculus
gctactccaggtttcttgaactcca

SEQ ID NO: 314037 - DNA, 25 bp, Mus musculus
gctactcccaccccgggatcgctca

SEQ ID NO: 314038 - DNA, 25 bp, Mus musculus
gctactccccagaagtctggagagc

SEQ ID NO: 314039 - DNA, 25 bp, Mus musculus
gctactcctgatgaacaaaacaggg

SEQ ID NO: 314040 - DNA, 25 bp, Mus musculus
gctactcgcggttcccagagctaga

SEQ ID NO: 314041 - DNA, 25 bp, Mus musculus
gctactctccagggtcttcctggct

SEQ ID NO: 314042 - DNA, 25 bp, Mus musculus
gctactctcctcaaaactcagattg

SEQ ID NO: 314043 - DNA, 25 bp, Mus musculus
gctactctcctcgacccatgagctt

SEQ ID NO: 314044 - DNA, 25 bp, Mus musculus
gctactctgagataaagccactctt

SEQ ID NO: 314045 - DNA, 25 bp, Mus musculus
gctactctgagtgttataggctcca

SEQ ID NO: 314046 - DNA, 25 bp, Mus musculus
gctactctgggcctcaggagttcag

SEQ ID NO: 314047 - DNA, 25 bp, Mus musculus
gctactgaaccacaagaacccatgt

SEQ ID NO: 314048 - DNA, 25 bp, Mus musculus
gctactgatagttgccttatcttcc

SEQ ID NO: 314049 - DNA, 25 bp, Mus musculus
gctactgatagttgcggatgacgga

SEQ ID NO: 314050 - DNA, 25 bp, Mus musculus
gctactgatctgtgctctaccgtgt

SEQ ID NO: 314051 - DNA, 25 bp, Mus musculus
gctactgatctgtggtgctgcacag

SEQ ID NO: 314052 - DNA, 25 bp, Mus musculus
gctactgcagagccatcctgactcg

SEQ ID NO: 314053 - DNA, 25 bp, Mus musculus
gctactgcaggggagccctatcatg

SEQ ID NO: 314054 - DNA, 25 bp, Mus musculus
gctactgcaggtaaatgagatcaac

SEQ ID NO: 314055 - DNA, 25 bp, Mus musculus
gctactgccaggcaatgaacatcgt

SEQ ID NO: 314056 - DNA, 25 bp, Mus musculus
gctactgcccactcaacatcagaac

SEQ ID NO: 314057 - DNA, 25 bp, Mus musculus
gctactgcccattgaaaaatctgga

SEQ ID NO: 314058 - DNA, 25 bp, Mus musculus
gctactgctatggagcggaattcct

SEQ ID NO: 314059 - DNA, 25 bp, Mus musculus
gctactgctatgggtttcagtcccc

SEQ ID NO: 314060 - DNA, 25 bp, Mus musculus
gctactggagaagaagtcttggaca

SEQ ID NO: 314061 - DNA, 25 bp, Mus musculus
gctactggagaaggtgcaaaacatg

SEQ ID NO: 314062 - DNA, 25 bp, Mus musculus
gctactggagccaagatgataaatc

SEQ ID NO: 314063 - DNA, 25 bp, Mus musculus
gctactggatacaggggtctgtgat

SEQ ID NO: 314064 - DNA, 25 bp, Mus musculus
gctactgtatcccttttggctaggg

SEQ ID NO: 314065 - DNA, 25 bp, Mus musculus
gctactgtcatccttgtctcattgg

SEQ ID NO: 314066 - DNA, 25 bp, Mus musculus
gctactgtgcgcaatggatctgtcc

SEQ ID NO: 314067 - DNA, 25 bp, Mus musculus
gctacttaaaccagaatgcatacac

SEQ ID NO: 314068 - DNA, 25 bp, Mus musculus
gctacttaaaccaggtttgcatgca

SEQ ID NO: 314069 - DNA, 25 bp, Mus musculus
gctacttagaaccaccataacacaa

SEQ ID NO: 314070 - DNA, 25 bp, Mus musculus
gctacttcgcgtgggctgtcttctg

SEQ ID NO: 314071 - DNA, 25 bp, Mus musculus
gctacttcgtaagaatgtcttccaa

SEQ ID NO: 314072 - DNA, 25 bp, Mus musculus
gctacttctcaaggaaacttcattc

SEQ ID NO: 314073 - DNA, 25 bp, Mus musculus
gctacttctcaaggaggcgcttcca

SEQ ID NO: 314074 - DNA, 25 bp, Mus musculus
gctacttctccaaggaaaaggaatc

SEQ ID NO: 314075 - DNA, 25 bp, Mus musculus
gctacttctcctggacgtgcgaccg

SEQ ID NO: 314076 - DNA, 25 bp, Mus musculus
gctacttctcctggcaacgatatcc

SEQ ID NO: 314077 - DNA, 25 bp, Mus musculus
gctacttctctgtcagcacagggta

SEQ ID NO: 314078 - DNA, 25 bp, Mus musculus
gctacttctgggaacatcatgacaa

SEQ ID NO: 314079 - DNA, 25 bp, Mus musculus
gctacttggccttgatgaggagtgg

SEQ ID NO: 314080 - DNA, 25 bp, Mus musculus
gctactttacctctctgcagaaagc

SEQ ID NO: 314081 - DNA, 25 bp, Mus musculus
gctacttttaagatttttgaagact

SEQ ID NO: 314082 - DNA, 25 bp, Mus musculus
gctagaaaagaaagtgagttcctca

SEQ ID NO: 314083 - DNA, 25 bp, Mus musculus
gctagaaacaaaggctagtctaccc

SEQ ID NO: 314084 - DNA, 25 bp, Mus musculus
gctagaaagcagatggaaaggcagc

SEQ ID NO: 314085 - DNA, 25 bp, Mus musculus
gctagaaaggaagatcctggccctg

SEQ ID NO: 314086 - DNA, 25 bp, Mus musculus
gctagaacaacagcgacagctattt

SEQ ID NO: 314087 - DNA, 25 bp, Mus musculus
gctagaacaacaggtgttgggagcc

SEQ ID NO: 314088 - DNA, 25 bp, Mus musculus
gctagaacagaaactgcagttggtg

SEQ ID NO: 314089 - DNA, 25 bp, Mus musculus
gctagaagtcggccaaaactgttat

SEQ ID NO: 314090 - DNA, 25 bp, Mus musculus
gctagaattcgatttcagaaatata

SEQ ID NO: 314091 - DNA, 25 bp, Mus musculus
gctagaattcggtgggctggtatgt

SEQ ID NO: 314092 - DNA, 25 bp, Mus musculus
gctagacaagtgctacgttgaagaa

SEQ ID NO: 314093 - DNA, 25 bp, Mus musculus
gctagacaggcaggacaggtcctgg

SEQ ID NO: 314094 - DNA, 25 bp, Mus musculus
gctagacatgtacgatggctttctg

SEQ ID NO: 314095 - DNA, 25 bp, Mus musculus
gctagaccaactttgcagagttcag

SEQ ID NO: 314096 - DNA, 25 bp, Mus musculus
gctagaccctggagggaagggtggt

SEQ ID NO: 314097 - DNA, 25 bp, Mus musculus
gctagaccgtaggggttcacgaacc

SEQ ID NO: 314098 - DNA, 25 bp, Mus musculus
gctagacgccaaggttgtggagctg

SEQ ID NO: 314099 - DNA, 25 bp, Mus musculus
gctagacgtggctgtgagtcctgat

SEQ ID NO: 314100 - DNA, 25 bp, Mus musculus
gctagactacagggaaagccaccca

SEQ ID NO: 314101 - DNA, 25 bp, Mus musculus
gctagactggctgcgaagctggggt

SEQ ID NO: 314102 - DNA, 25 bp, Mus musculus
gctagactgggtctatggctatcga

SEQ ID NO: 314103 - DNA, 25 bp, Mus musculus
gctagacttgttaagtttctagtgg

SEQ ID NO: 314104 - DNA, 25 bp, Mus musculus
gctagagaaggagctggagcagagc

SEQ ID NO: 314105 - DNA, 25 bp, Mus musculus
gctagagacggtcgctcgcattcgg

SEQ ID NO: 314106 - DNA, 25 bp, Mus musculus
gctagagatcagtcggtactccctg

SEQ ID NO: 314107 - DNA, 25 bp, Mus musculus
gctagagcataaggtttatctcaag

SEQ ID NO: 314108 - DNA, 25 bp, Mus musculus
gctagagcatggaaaaccgtggact

SEQ ID NO: 314109 - DNA, 25 bp, Mus musculus
gctagagccccgaaggactgctgca

SEQ ID NO: 314110 - DNA, 25 bp, Mus musculus
gctagagccccgaaggcacacatga

SEQ ID NO: 314111 - DNA, 25 bp, Mus musculus
gctagagcggcgagagtaatccata

SEQ ID NO: 314112 - DNA, 25 bp, Mus musculus
gctagagcgtgtgggcatcgttctg

SEQ ID NO: 314113 - DNA, 25 bp, Mus musculus
gctagagctgacgggggtggcaccg

SEQ ID NO: 314114 - DNA, 25 bp, Mus musculus
gctagaggaagcctccatttacagt

SEQ ID NO: 314115 - DNA, 25 bp, Mus musculus
gctagaggaaggcagagcatgggcc

SEQ ID NO: 314116 - DNA, 25 bp, Mus musculus
gctagaggagggcatggataattac

SEQ ID NO: 314117 - DNA, 25 bp, Mus musculus
gctagagtatgagaacttctatgcg

SEQ ID NO: 314118 - DNA, 25 bp, Mus musculus
gctagagtcattgcaggcccggcac

SEQ ID NO: 314119 - DNA, 25 bp, Mus musculus
gctagagttcaaaggcggcgagtcc

SEQ ID NO: 314120 - DNA, 25 bp, Mus musculus
gctagagtttatggatccgcctccg

SEQ ID NO: 314121 - DNA, 25 bp, Mus musculus
gctagataaggtcctggagaccttg

SEQ ID NO: 314122 - DNA, 25 bp, Mus musculus
gctagataaggtcctggaggaggat

SEQ ID NO: 314123 - DNA, 25 bp, Mus musculus
gctagatcacagtcaagcaggtaga

SEQ ID NO: 314124 - DNA, 25 bp, Mus musculus
gctagatgaggttgatatgtcagac

SEQ ID NO: 314125 - DNA, 25 bp, Mus musculus
gctagattgagatgagcagctctca

SEQ ID NO: 314126 - DNA, 25 bp, Mus musculus
gctagcaaagcactgctgttcttga

SEQ ID NO: 314127 - DNA, 25 bp, Mus musculus
gctagcaatctctgcacctttgggg

SEQ ID NO: 314128 - DNA, 25 bp, Mus musculus
gctagcacaggcttctaaacctact

SEQ ID NO: 314129 - DNA, 25 bp, Mus musculus
gctagcacaggggttgtgtggtgag

SEQ ID NO: 314130 - DNA, 25 bp, Mus musculus
gctagcactaacgtgaccctggctg

SEQ ID NO: 314131 - DNA, 25 bp, Mus musculus
gctagcactaactgacctgggcctg

SEQ ID NO: 314132 - DNA, 25 bp, Mus musculus
gctagcagagcaggatccaagtgaa

SEQ ID NO: 314133 - DNA, 25 bp, Mus musculus
gctagcagatgaagatctcaggccc

SEQ ID NO: 314134 - DNA, 25 bp, Mus musculus
gctagcagcccaggatcaaagaatc

SEQ ID NO: 314135 - DNA, 25 bp, Mus musculus
gctagcagcccaggggaacgggggg

SEQ ID NO: 314136 - DNA, 25 bp, Mus musculus
gctagcagcccaggggtggaggaga

SEQ ID NO: 314137 - DNA, 25 bp, Mus musculus
gctagcagtaatggtaagtatactg

SEQ ID NO: 314138 - DNA, 25 bp, Mus musculus
gctagcagtaatggtccatcctgat

SEQ ID NO: 314139 - DNA, 25 bp, Mus musculus
gctagcataattcagaaaatcagaa

SEQ ID NO: 314140 - DNA, 25 bp, Mus musculus
gctagcatcagggcccatttggagg

SEQ ID NO: 314141 - DNA, 25 bp, Mus musculus
gctagcatgagaacaaatataaagc

SEQ ID NO: 314142 - DNA, 25 bp, Mus musculus
gctagcatgagcatcagttggggaa

SEQ ID NO: 314143 - DNA, 25 bp, Mus musculus
gctagccaagatatcaacctgaatt

SEQ ID NO: 314144 - DNA, 25 bp, Mus musculus
gctagccaaggtgctggattaaaag

SEQ ID NO: 314145 - DNA, 25 bp, Mus musculus
gctagcgaaccagtaatggtcagca

SEQ ID NO: 314146 - DNA, 25 bp, Mus musculus
gctagcgaggacagaaccatccgag

SEQ ID NO: 314147 - DNA, 25 bp, Mus musculus
gctagcgaggacagccccttgctct

SEQ ID NO: 314148 - DNA, 25 bp, Mus musculus
gctagcgggtaagcagttatgcctc

SEQ ID NO: 314149 - DNA, 25 bp, Mus musculus
gctagctactccaggtacgtaggtg

SEQ ID NO: 314150 - DNA, 25 bp, Mus musculus
gctagctagttcaggcactggctcc

SEQ ID NO: 314151 - DNA, 25 bp, Mus musculus
gctagctatctggaggtgacccctg

SEQ ID NO: 314152 - DNA, 25 bp, Mus musculus
gctagctatgacctatgaggagatc

SEQ ID NO: 314153 - DNA, 25 bp, Mus musculus
gctagctctggtacacctacacaga

SEQ ID NO: 314154 - DNA, 25 bp, Mus musculus
gctagctgaggaacatctgattgcc

SEQ ID NO: 314155 - DNA, 25 bp, Mus musculus
gctagctgaggtgcggagctgaccc

SEQ ID NO: 314156 - DNA, 25 bp, Mus musculus
gctagctgggcaagatggtgtcaca

SEQ ID NO: 314157 - DNA, 25 bp, Mus musculus
gctagctggttgcagaggttttgga

SEQ ID NO: 314158 - DNA, 25 bp, Mus musculus
gctagctgtcttactcatcagagtt

SEQ ID NO: 314159 - DNA, 25 bp, Mus musculus
gctaggaacaaagagaacctgcacc

SEQ ID NO: 314160 - DNA, 25 bp, Mus musculus
gctaggaacaaagagaccccgaggc

SEQ ID NO: 314161 - DNA, 25 bp, Mus musculus
gctaggaacaaaggtcaggtgccca

SEQ ID NO: 314162 - DNA, 25 bp, Mus musculus
gctaggaactgtcaggctggtctgc

SEQ ID NO: 314163 - DNA, 25 bp, Mus musculus
gctaggaagaggtcagccatgtcat

SEQ ID NO: 314164 - DNA, 25 bp, Mus musculus
gctaggagacaaggtgagccctaga

SEQ ID NO: 314165 - DNA, 25 bp, Mus musculus
gctaggagcagagatcaagttcttg

SEQ ID NO: 314166 - DNA, 25 bp, Mus musculus
gctaggagcggtgtcctgtgccatc

SEQ ID NO: 314167 - DNA, 25 bp, Mus musculus
gctaggataacagtgacgtatgact

SEQ ID NO: 314168 - DNA, 25 bp, Mus musculus
gctaggatttcagtttacccatcat

SEQ ID NO: 314169 - DNA, 25 bp, Mus musculus
gctaggcctccaggaggaccttgtt

SEQ ID NO: 314170 - DNA, 25 bp, Mus musculus
gctaggcctccaggaggagactccc

SEQ ID NO: 314171 - DNA, 25 bp, Mus musculus
gctaggctgtaagctgtacttcttc

SEQ ID NO: 314172 - DNA, 25 bp, Mus musculus
gctagggaacgggagagtggccttg

SEQ ID NO: 314173 - DNA, 25 bp, Mus musculus
gctagggaatgaaggtgaagagatt

SEQ ID NO: 314174 - DNA, 25 bp, Mus musculus
gctagggatttgctggttttaggct

SEQ ID NO: 314175 - DNA, 25 bp, Mus musculus
gctagggttaaaggagacattccaa

SEQ ID NO: 314176 - DNA, 25 bp, Mus musculus
gctaggtgccaagagggagctccgc

SEQ ID NO: 314177 - DNA, 25 bp, Mus musculus
gctaggtgttccctgctgctctcaa

SEQ ID NO: 314178 - DNA, 25 bp, Mus musculus
gctagtaagcagtctgcaaacagca

SEQ ID NO: 314179 - DNA, 25 bp, Mus musculus
gctagtactggaaggaaggtgcaca

SEQ ID NO: 314180 - DNA, 25 bp, Mus musculus
gctagtagagctggaggtggagtgc

SEQ ID NO: 314181 - DNA, 25 bp, Mus musculus
gctagtagagtatatggaggaacgt

SEQ ID NO: 314182 - DNA, 25 bp, Mus musculus
gctagtagcagaagctgggagggca

SEQ ID NO: 314183 - DNA, 25 bp, Mus musculus
gctagtagtgacaggacactactgg

SEQ ID NO: 314184 - DNA, 25 bp, Mus musculus
gctagtcaccatcctgtcctactgt

SEQ ID NO: 314185 - DNA, 25 bp, Mus musculus
gctagtcactgggaggtgtccctgt

SEQ ID NO: 314186 - DNA, 25 bp, Mus musculus
gctagtcttttaatggagaatggag

SEQ ID NO: 314187 - DNA, 25 bp, Mus musculus
gctagtcttttaggtaagaagtatg

SEQ ID NO: 314188 - DNA, 25 bp, Mus musculus
gctagtgaccagatactgttaaagc

SEQ ID NO: 314189 - DNA, 25 bp, Mus musculus
gctagtgaccaggatcgactgcggg

SEQ ID NO: 314190 - DNA, 25 bp, Mus musculus
gctagtgagaccggaccagctcccc

SEQ ID NO: 314191 - DNA, 25 bp, Mus musculus
gctagtgcaaaactgccagtgtatg

SEQ ID NO: 314192 - DNA, 25 bp, Mus musculus
gctagtgcaaagatcagctactatg

SEQ ID NO: 314193 - DNA, 25 bp, Mus musculus
gctagtgcaacccgtggcagtcaag

SEQ ID NO: 314194 - DNA, 25 bp, Mus musculus
gctagtgcagcttgagtagcttatc

SEQ ID NO: 314195 - DNA, 25 bp, Mus musculus
gctagtgcagcttggagtggatttg

SEQ ID NO: 314196 - DNA, 25 bp, Mus musculus
gctagtgcattagcctgccaccacc

SEQ ID NO: 314197 - DNA, 25 bp, Mus musculus
gctagtgctcagagtgcctgcagtc

SEQ ID NO: 314198 - DNA, 25 bp, Mus musculus
gctagtgctcagctacagcaacgtt

SEQ ID NO: 314199 - DNA, 25 bp, Mus musculus
gctagtggacactagactacatcgt

SEQ ID NO: 314200 - DNA, 25 bp, Mus musculus
gctagtggagatgccgttcctatga

SEQ ID NO: 314201 - DNA, 25 bp, Mus musculus
gctagtggagcaccaaggagtttca

SEQ ID NO: 314202 - DNA, 25 bp, Mus musculus
gctagtggaggagtttcatttctgc

SEQ ID NO: 314203 - DNA, 25 bp, Mus musculus
gctagtggagggggttacaactaag

SEQ ID NO: 314204 - DNA, 25 bp, Mus musculus
gctagtggagtgcactgaggccaaa

SEQ ID NO: 314205 - DNA, 25 bp, Mus musculus
gctagtgtaaaagaaagatgatgac

SEQ ID NO: 314206 - DNA, 25 bp, Mus musculus
gctagtgtcttctcgcatgcacgcc

SEQ ID NO: 314207 - DNA, 25 bp, Mus musculus
gctagttcaggcactggctccagca

SEQ ID NO: 314208 - DNA, 25 bp, Mus musculus
gctagttccagataactgcctttgt

SEQ ID NO: 314209 - DNA, 25 bp, Mus musculus
gctagttggaaaggcatttacactc

SEQ ID NO: 314210 - DNA, 25 bp, Mus musculus
gctagttggaaggctccgcccacta

SEQ ID NO: 314211 - DNA, 25 bp, Mus musculus
gctagtttgtttgaggaagctcaca

SEQ ID NO: 314212 - DNA, 25 bp, Mus musculus
gctataaaaattacagtaccaaagc

SEQ ID NO: 314213 - DNA, 25 bp, Mus musculus
gctataaaattacagagaatgcatc

SEQ ID NO: 314214 - DNA, 25 bp, Mus musculus
gctataaaattacagctcagtctgg

SEQ ID NO: 314215 - DNA, 25 bp, Mus musculus
gctataaagcagtatcgtcatctga

SEQ ID NO: 314216 - DNA, 25 bp, Mus musculus
gctataacacagcagtcatactact

SEQ ID NO: 314217 - DNA, 25 bp, Mus musculus
gctataacacaggagtcatactact

SEQ ID NO: 314218 - DNA, 25 bp, Mus musculus
gctataaccgagactggtacaagcg

SEQ ID NO: 314219 - DNA, 25 bp, Mus musculus
gctataaccgggctgggcctgggag

SEQ ID NO: 314220 - DNA, 25 bp, Mus musculus
gctataacgtctgcatactatcgtg

SEQ ID NO: 314221 - DNA, 25 bp, Mus musculus
gctataatctggtatgtgtatcaca

SEQ ID NO: 314222 - DNA, 25 bp, Mus musculus
gctatacaaggtgggcctgggtctg

SEQ ID NO: 314223 - DNA, 25 bp, Mus musculus
gctatacctcacaggtgatccactg

SEQ ID NO: 314224 - DNA, 25 bp, Mus musculus
gctatagaaacgggttctgctgcct

SEQ ID NO: 314225 - DNA, 25 bp, Mus musculus
gctatagaaaggctgaaggcactgg

SEQ ID NO: 314226 - DNA, 25 bp, Mus musculus
gctatagaaagggcgctttcgttgc

SEQ ID NO: 314227 - DNA, 25 bp, Mus musculus
gctatagaaggtaattacactcttc

SEQ ID NO: 314228 - DNA, 25 bp, Mus musculus
gctatagacttcagtttgatttcca

SEQ ID NO: 314229 - DNA, 25 bp, Mus musculus
gctatagcctggacctgctctcctt

SEQ ID NO: 314230 - DNA, 25 bp, Mus musculus
gctatagcctggtgcttgagaaggc

SEQ ID NO: 314231 - DNA, 25 bp, Mus musculus
gctatagctcagctgcctcatatac

SEQ ID NO: 314232 - DNA, 25 bp, Mus musculus
gctataggaggatctcccagaagct

SEQ ID NO: 314233 - DNA, 25 bp, Mus musculus
gctatagtcatttacaaaatggttc

SEQ ID NO: 314234 - DNA, 25 bp, Mus musculus
gctatataccatgaggcttacagtc

SEQ ID NO: 314235 - DNA, 25 bp, Mus musculus
gctatatcaagtttcatgcaggctc

SEQ ID NO: 314236 - DNA, 25 bp, Mus musculus
gctatatcggagacacagcttcatg

SEQ ID NO: 314237 - DNA, 25 bp, Mus musculus
gctatattcagggctacaacaaggc

SEQ ID NO: 314238 - DNA, 25 bp, Mus musculus
gctatattcaggtgacagacttcgg

SEQ ID NO: 314239 - DNA, 25 bp, Mus musculus
gctatattgatgttgattgatgtgg

SEQ ID NO: 314240 - DNA, 25 bp, Mus musculus
gctatattgatgttggaaactgtgg

SEQ ID NO: 314241 - DNA, 25 bp, Mus musculus
gctatcaactgagacattgtctttc

SEQ ID NO: 314242 - DNA, 25 bp, Mus musculus
gctatcacaaataaagaaaaggaaa

SEQ ID NO: 314243 - DNA, 25 bp, Mus musculus
gctatcacaaatatttcctcttctg

SEQ ID NO: 314244 - DNA, 25 bp, Mus musculus
gctatcagaataaggttcagcctat

SEQ ID NO: 314245 - DNA, 25 bp, Mus musculus
gctatcatgagggtccatgccttcc

SEQ ID NO: 314246 - DNA, 25 bp, Mus musculus
gctatcatggtgagtcatctccatc

SEQ ID NO: 314247 - DNA, 25 bp, Mus musculus
gctatccacgcagcctctgcctcgg

SEQ ID NO: 314248 - DNA, 25 bp, Mus musculus
gctatccacgcagctgccccttacc

SEQ ID NO: 314249 - DNA, 25 bp, Mus musculus
gctatccagatgtaagtgccctgga

SEQ ID NO: 314250 - DNA, 25 bp, Mus musculus
gctatccagatgtacgtgccctgga

SEQ ID NO: 314251 - DNA, 25 bp, Mus musculus
gctatcccaggaccgggacttcatc

SEQ ID NO: 314252 - DNA, 25 bp, Mus musculus
gctatcccaggcccctctgcccccc

SEQ ID NO: 314253 - DNA, 25 bp, Mus musculus
gctatccccctcacagtaattcttc

SEQ ID NO: 314254 - DNA, 25 bp, Mus musculus
gctatccctggctccctcatcagcg

SEQ ID NO: 314255 - DNA, 25 bp, Mus musculus
gctatcctaagtgatgtgccagcat

SEQ ID NO: 314256 - DNA, 25 bp, Mus musculus
gctatcctgaggttgcaggtcagca

SEQ ID NO: 314257 - DNA, 25 bp, Mus musculus
gctatcgacaacatgaatgaatctg

SEQ ID NO: 314258 - DNA, 25 bp, Mus musculus
gctatcgtggatggagacaggattg

SEQ ID NO: 314259 - DNA, 25 bp, Mus musculus
gctatcgtgtgagccagatcttctg

SEQ ID NO: 314260 - DNA, 25 bp, Mus musculus
gctatctacagtgggcagcaaagat

SEQ ID NO: 314261 - DNA, 25 bp, Mus musculus
gctatctacagtgggccggcggcca

SEQ ID NO: 314262 - DNA, 25 bp, Mus musculus
gctatctaccacaaatattatcact

SEQ ID NO: 314263 - DNA, 25 bp, Mus musculus
gctatctaccacaacctgaagaaca

SEQ ID NO: 314264 - DNA, 25 bp, Mus musculus
gctatctccggtccaaatatcacac

SEQ ID NO: 314265 - DNA, 25 bp, Mus musculus
gctatctggaggtgacccctgattc

SEQ ID NO: 314266 - DNA, 25 bp, Mus musculus
gctatctggcaagagcggcctcggt

SEQ ID NO: 314267 - DNA, 25 bp, Mus musculus
gctatctgttatgaaacaaatgtcc

SEQ ID NO: 314268 - DNA, 25 bp, Mus musculus
gctatcttcgagataagacagtgat

SEQ ID NO: 314269 - DNA, 25 bp, Mus musculus
gctatcttgcagttcatggcatctc

SEQ ID NO: 314270 - DNA, 25 bp, Mus musculus
gctatgaacaccctccttgacggcc

SEQ ID NO: 314271 - DNA, 25 bp, Mus musculus
gctatgaacgagcagttttggcaat

SEQ ID NO: 314272 - DNA, 25 bp, Mus musculus
gctatgaagccaagattgtaagggc

SEQ ID NO: 314273 - DNA, 25 bp, Mus musculus
gctatgaagctacctacagccagct

SEQ ID NO: 314274 - DNA, 25 bp, Mus musculus
gctatgaagctctggccatgggcaa

SEQ ID NO: 314275 - DNA, 25 bp, Mus musculus
gctatgaaggggtcagaatacaaga

SEQ ID NO: 314276 - DNA, 25 bp, Mus musculus
gctatgacagaacagtttttggcct

SEQ ID NO: 314277 - DNA, 25 bp, Mus musculus
gctatgacagccagcccgctttcag

SEQ ID NO: 314278 - DNA, 25 bp, Mus musculus
gctatgacattgcctcccacccgct

SEQ ID NO: 314279 - DNA, 25 bp, Mus musculus
gctatgacccccctctctcccttct

SEQ ID NO: 314280 - DNA, 25 bp, Mus musculus
gctatgaccttactgtcccttttgc

SEQ ID NO: 314281 - DNA, 25 bp, Mus musculus
gctatgaccttgaggacagacaagg

SEQ ID NO: 314282 - DNA, 25 bp, Mus musculus
gctatgactagagacctgcagggga

SEQ ID NO: 314283 - DNA, 25 bp, Mus musculus
gctatgagaaaattattttcgcctt

SEQ ID NO: 314284 - DNA, 25 bp, Mus musculus
gctatgagaaattactcttctgcgg

SEQ ID NO: 314285 - DNA, 25 bp, Mus musculus
gctatgagctaccgggacaagagtg

SEQ ID NO: 314286 - DNA, 25 bp, Mus musculus
gctatgaggagggtattcctacatg

SEQ ID NO: 314287 - DNA, 25 bp, Mus musculus
gctatgaggcacaaggagcaagacc

SEQ ID NO: 314288 - DNA, 25 bp, Mus musculus
gctatgagtgcagaaaatattaatg

SEQ ID NO: 314289 - DNA, 25 bp, Mus musculus
gctatgagtgcagcgtgttacccat

SEQ ID NO: 314290 - DNA, 25 bp, Mus musculus
gctatgagtgcagttttcagcagat

SEQ ID NO: 314291 - DNA, 25 bp, Mus musculus
gctatgatcaacgcctgtagggact

SEQ ID NO: 314292 - DNA, 25 bp, Mus musculus
gctatgcaaaagttatgatggttaa

SEQ ID NO: 314293 - DNA, 25 bp, Mus musculus
gctatgcaaccgaagctgacattat

SEQ ID NO: 314294 - DNA, 25 bp, Mus musculus
gctatgcaagggctacagagccccc

SEQ ID NO: 314295 - DNA, 25 bp, Mus musculus
gctatgccagaacagatagtcgtac

SEQ ID NO: 314296 - DNA, 25 bp, Mus musculus
gctatgccagctcttctcctatgcc

SEQ ID NO: 314297 - DNA, 25 bp, Mus musculus
gctatgccaggaacccatctctcaa

SEQ ID NO: 314298 - DNA, 25 bp, Mus musculus
gctatgcccagaacatcccaaccca

SEQ ID NO: 314299 - DNA, 25 bp, Mus musculus
gctatgccccaagattcagtcccaa

SEQ ID NO: 314300 - DNA, 25 bp, Mus musculus
gctatgccccaaggaaagagtgcca

SEQ ID NO: 314301 - DNA, 25 bp, Mus musculus
gctatgcccggaattgaaagaattt

SEQ ID NO: 314302 - DNA, 25 bp, Mus musculus
gctatgccttctaggtttgatatcg

SEQ ID NO: 314303 - DNA, 25 bp, Mus musculus
gctatgctaagtatgagagccagac

SEQ ID NO: 314304 - DNA, 25 bp, Mus musculus
gctatgctatcgagatggtgacttg

SEQ ID NO: 314305 - DNA, 25 bp, Mus musculus
gctatgctatcgaggtttttaagcc

SEQ ID NO: 314306 - DNA, 25 bp, Mus musculus
gctatgctcatagggtacagcatgt

SEQ ID NO: 314307 - DNA, 25 bp, Mus musculus
gctatgctctcagaggttcctgaca

SEQ ID NO: 314308 - DNA, 25 bp, Mus musculus
gctatgctctcaggctggcatcatg

SEQ ID NO: 314309 - DNA, 25 bp, Mus musculus
gctatgctgataaggccttgctcaa

SEQ ID NO: 314310 - DNA, 25 bp, Mus musculus
gctatgctgcaggaaatgacctgca

SEQ ID NO: 314311 - DNA, 25 bp, Mus musculus
gctatggaaaggtttttcaagtacg

SEQ ID NO: 314312 - DNA, 25 bp, Mus musculus
gctatggagagaagcaaatttccat

SEQ ID NO: 314313 - DNA, 25 bp, Mus musculus
gctatggagagaagcaggagcttga

SEQ ID NO: 314314 - DNA, 25 bp, Mus musculus
gctatggagagagtatgctggataa

SEQ ID NO: 314315 - DNA, 25 bp, Mus musculus
gctatggagaggtgggaaaggggtg

SEQ ID NO: 314316 - DNA, 25 bp, Mus musculus
gctatggagtgcctttctttctgcc

SEQ ID NO: 314317 - DNA, 25 bp, Mus musculus
gctatggatggtgctttgcaaggat

SEQ ID NO: 314318 - DNA, 25 bp, Mus musculus
gctatggcaaccagtataatgtttg

SEQ ID NO: 314319 - DNA, 25 bp, Mus musculus
gctatggcaaggtgttccaggtgag

SEQ ID NO: 314320 - DNA, 25 bp, Mus musculus
gctatggcaatgacaccagccagca

SEQ ID NO: 314321 - DNA, 25 bp, Mus musculus
gctatggcagaaagccctgcaggaa

SEQ ID NO: 314322 - DNA, 25 bp, Mus musculus
gctatggcagagtgctgggattaca

SEQ ID NO: 314323 - DNA, 25 bp, Mus musculus
gctatggcagctacttaaaattctg

SEQ ID NO: 314324 - DNA, 25 bp, Mus musculus
gctatggcaggtgattggagttgtg

SEQ ID NO: 314325 - DNA, 25 bp, Mus musculus
gctatggcagtggttttatgaagag

SEQ ID NO: 314326 - DNA, 25 bp, Mus musculus
gctatggcggtggacatcatcctgg

SEQ ID NO: 314327 - DNA, 25 bp, Mus musculus
gctatggctctcattattttcacaa

SEQ ID NO: 314328 - DNA, 25 bp, Mus musculus
gctatggcttaagaccgaagggagg

SEQ ID NO: 314329 - DNA, 25 bp, Mus musculus
gctatggcttaagggaccgacgtct

SEQ ID NO: 314330 - DNA, 25 bp, Mus musculus
gctatgggagatgataaaagctttg

SEQ ID NO: 314331 - DNA, 25 bp, Mus musculus
gctatgggccctctgggaccaagag

SEQ ID NO: 314332 - DNA, 25 bp, Mus musculus
gctatgggggcctgggtccaagccg

SEQ ID NO: 314333 - DNA, 25 bp, Mus musculus
gctatggggggacctgcactcagca

SEQ ID NO: 314334 - DNA, 25 bp, Mus musculus
gctatgggtcaggtagtgggcagca

SEQ ID NO: 314335 - DNA, 25 bp, Mus musculus
gctatgggttcaggttctgccacca

SEQ ID NO: 314336 - DNA, 25 bp, Mus musculus
gctatggtaaaagtttcatttgatc

SEQ ID NO: 314337 - DNA, 25 bp, Mus musculus
gctatggtggaggtagaagattttg

SEQ ID NO: 314338 - DNA, 25 bp, Mus musculus
gctatggtttaagacgcttaaagga

SEQ ID NO: 314339 - DNA, 25 bp, Mus musculus
gctatgtcagaaggcttatcaggtt

SEQ ID NO: 314340 - DNA, 25 bp, Mus musculus
gctatgtcaggaaaccatccaatgc

SEQ ID NO: 314341 - DNA, 25 bp, Mus musculus
gctatgtcgaccagtatgaggtttg

SEQ ID NO: 314342 - DNA, 25 bp, Mus musculus
gctatgtctgccagtgtgccccagg

SEQ ID NO: 314343 - DNA, 25 bp, Mus musculus
gctatgtgaaggtgctcctggtcac

SEQ ID NO: 314344 - DNA, 25 bp, Mus musculus
gctatgtgctgcagactgaagtggc

SEQ ID NO: 314345 - DNA, 25 bp, Mus musculus
gctatgtgctgcaggctacatgtga

SEQ ID NO: 314346 - DNA, 25 bp, Mus musculus
gctatgtgtatggcttggcaaattg

SEQ ID NO: 314347 - DNA, 25 bp, Mus musculus
gctatgtgtatggtgattccaccag

SEQ ID NO: 314348 - DNA, 25 bp, Mus musculus
gctatgttgagattcattttatgtg

SEQ ID NO: 314349 - DNA, 25 bp, Mus musculus
gctatgttgagcttcgttacgacga

SEQ ID NO: 314350 - DNA, 25 bp, Mus musculus
gctattaaagctggtgagaaatgcc

SEQ ID NO: 314351 - DNA, 25 bp, Mus musculus
gctattaaccaggtcttcaagatga

SEQ ID NO: 314352 - DNA, 25 bp, Mus musculus
gctattaagaagaagacaaaaaagc

SEQ ID NO: 314353 - DNA, 25 bp, Mus musculus
gctattaccgctctagccgcagcca

SEQ ID NO: 314354 - DNA, 25 bp, Mus musculus
gctattacgagtatggctacatctt

SEQ ID NO: 314355 - DNA, 25 bp, Mus musculus
gctattagagccagatcatctgtct

SEQ ID NO: 314356 - DNA, 25 bp, Mus musculus
gctattagagtgtgctcaagagtat

SEQ ID NO: 314357 - DNA, 25 bp, Mus musculus
gctattatcatagaccttcaggcaa

SEQ ID NO: 314358 - DNA, 25 bp, Mus musculus
gctattatcatgatactaccacaag

SEQ ID NO: 314359 - DNA, 25 bp, Mus musculus
gctattcaaaacagcgtggaagatg

SEQ ID NO: 314360 - DNA, 25 bp, Mus musculus
gctattcagccagatgaactttcaa

SEQ ID NO: 314361 - DNA, 25 bp, Mus musculus
gctattccaaagatactggcattgc

SEQ ID NO: 314362 - DNA, 25 bp, Mus musculus
gctattcccagctccaccagagaag

SEQ ID NO: 314363 - DNA, 25 bp, Mus musculus
gctattctacaggaaaaatccgctg

SEQ ID NO: 314364 - DNA, 25 bp, Mus musculus
gctattctaggaaggctgccttgac

SEQ ID NO: 314365 - DNA, 25 bp, Mus musculus
gctattctagtgacgccaagagact

SEQ ID NO: 314366 - DNA, 25 bp, Mus musculus
gctattctgcatctgagtgggaact

SEQ ID NO: 314367 - DNA, 25 bp, Mus musculus
gctattctgctcgtcagcacatcat

SEQ ID NO: 314368 - DNA, 25 bp, Mus musculus
gctattgaaagagaggtcttacttg

SEQ ID NO: 314369 - DNA, 25 bp, Mus musculus
gctattgatggaaaagggttccttt

SEQ ID NO: 314370 - DNA, 25 bp, Mus musculus
gctattgatggaaagggtccaattg

SEQ ID NO: 314371 - DNA, 25 bp, Mus musculus
gctattgcacggatggtgaactttg

SEQ ID NO: 314372 - DNA, 25 bp, Mus musculus
gctattgcagaggtggcttttgcag

SEQ ID NO: 314373 - DNA, 25 bp, Mus musculus
gctattgcaggtttcctggcagaac

SEQ ID NO: 314374 - DNA, 25 bp, Mus musculus
gctattgctcaggccctggcacatc

SEQ ID NO: 314375 - DNA, 25 bp, Mus musculus
gctattggcttctcccatgatgacc

SEQ ID NO: 314376 - DNA, 25 bp, Mus musculus
gctatttacagagcccatggatggg

SEQ ID NO: 314377 - DNA, 25 bp, Mus musculus
gctatttaccagaccaagaaggtct

SEQ ID NO: 314378 - DNA, 25 bp, Mus musculus
gctatttaccaggacattcgacatg

SEQ ID NO: 314379 - DNA, 25 bp, Mus musculus
gctatttaccaggtgaggacacttg

SEQ ID NO: 314380 - DNA, 25 bp, Mus musculus
gctatttcaggctttgatgggacag

SEQ ID NO: 314381 - DNA, 25 bp, Mus musculus
gctatttcatgctggatgacctcaa

SEQ ID NO: 314382 - DNA, 25 bp, Mus musculus
gctatttcttgttgccaaaacaaag

SEQ ID NO: 314383 - DNA, 25 bp, Mus musculus
gctatttgaccatctgttctgtgcc

SEQ ID NO: 314384 - DNA, 25 bp, Mus musculus
gctatttgcgtagccgcctgtgtgg

SEQ ID NO: 314385 - DNA, 25 bp, Mus musculus
gctatttgtgaggcgaacattgagg

SEQ ID NO: 314386 - DNA, 25 bp, Mus musculus
gctcaaaaaaaaaaagcctctaaga

SEQ ID NO: 314387 - DNA, 25 bp, Mus musculus
gctcaaaaaagccaggcctctgatc

SEQ ID NO: 314388 - DNA, 25 bp, Mus musculus
gctcaaaatgtgcctctcccagtgt

SEQ ID NO: 314389 - DNA, 25 bp, Mus musculus
gctcaaacaagtgtgatgctctgct

SEQ ID NO: 314390 - DNA, 25 bp, Mus musculus
gctcaaacacagctcaaagattaga

SEQ ID NO: 314391 - DNA, 25 bp, Mus musculus
gctcaaacaggctctggaaaaactg

SEQ ID NO: 314392 - DNA, 25 bp, Mus musculus
gctcaaactaagtggcctgcttgat

SEQ ID NO: 314393 - DNA, 25 bp, Mus musculus
gctcaaagattcaggctggacaatt

SEQ ID NO: 314394 - DNA, 25 bp, Mus musculus
gctcaaagattcaggttctccccaa

SEQ ID NO: 314395 - DNA, 25 bp, Mus musculus
gctcaaagcatggggacattcaatc

SEQ ID NO: 314396 - DNA, 25 bp, Mus musculus
gctcaaagccatggtttgactctgc

SEQ ID NO: 314397 - DNA, 25 bp, Mus musculus
gctcaaaggagagaaatgtcaacgt

SEQ ID NO: 314398 - DNA, 25 bp, Mus musculus
gctcaaagggaaggaaaacgcttgt

SEQ ID NO: 314399 - DNA, 25 bp, Mus musculus
gctcaaagggcaagcttctactcag

SEQ ID NO: 314400 - DNA, 25 bp, Mus musculus
gctcaaagtcaagaaaaaacaagaa

SEQ ID NO: 314401 - DNA, 25 bp, Mus musculus
gctcaaagtcaagatctcaaaatgt

SEQ ID NO: 314402 - DNA, 25 bp, Mus musculus
gctcaaattcggggcttcctcgagc

SEQ ID NO: 314403 - DNA, 25 bp, Mus musculus
gctcaaattcggtgcagcccggaat

SEQ ID NO: 314404 - DNA, 25 bp, Mus musculus
gctcaacaagactgcaagtggcaat

SEQ ID NO: 314405 - DNA, 25 bp, Mus musculus
gctcaacaaggacccctcatgcctc

SEQ ID NO: 314406 - DNA, 25 bp, Mus musculus
gctcaacaaggagctggtgattgca

SEQ ID NO: 314407 - DNA, 25 bp, Mus musculus
gctcaacaaggctctccagagcaac

SEQ ID NO: 314408 - DNA, 25 bp, Mus musculus
gctcaacagccatctccagtggctt

SEQ ID NO: 314409 - DNA, 25 bp, Mus musculus
gctcaacatgtatggcttccgaaaa

SEQ ID NO: 314410 - DNA, 25 bp, Mus musculus
gctcaacatgtctcattcagttcct

SEQ ID NO: 314411 - DNA, 25 bp, Mus musculus
gctcaaccagacgcacctctagtat

SEQ ID NO: 314412 - DNA, 25 bp, Mus musculus
gctcaaccagatccttgcatgaacc

SEQ ID NO: 314413 - DNA, 25 bp, Mus musculus
gctcaaccagggcatcgttctgcct

SEQ ID NO: 314414 - DNA, 25 bp, Mus musculus
gctcaaccagtggacatatcaggcc

SEQ ID NO: 314415 - DNA, 25 bp, Mus musculus
gctcaacctcaagggctgtgaggtg

SEQ ID NO: 314416 - DNA, 25 bp, Mus musculus
gctcaacctgctggttggtggggaa

SEQ ID NO: 314417 - DNA, 25 bp, Mus musculus
gctcaactatgcagtaaagacgctc

SEQ ID NO: 314418 - DNA, 25 bp, Mus musculus
gctcaactatgcttaactgcggatc

SEQ ID NO: 314419 - DNA, 25 bp, Mus musculus
gctcaactggcaggcgtgaagtgca

SEQ ID NO: 314420 - DNA, 25 bp, Mus musculus
gctcaacttgtccaatttcgaggac

SEQ ID NO: 314421 - DNA, 25 bp, Mus musculus
gctcaagaaggcaagattactgtgt

SEQ ID NO: 314422 - DNA, 25 bp, Mus musculus
gctcaagaggaaggctacgtgttct

SEQ ID NO: 314423 - DNA, 25 bp, Mus musculus
gctcaagcaggaacctagcaaaact

SEQ ID NO: 314424 - DNA, 25 bp, Mus musculus
gctcaagcagggccacaatgccaca

SEQ ID NO: 314425 - DNA, 25 bp, Mus musculus
gctcaagcaggtaacaaatcacaag

SEQ ID NO: 314426 - DNA, 25 bp, Mus musculus
gctcaagccgcgacttttgccatga

SEQ ID NO: 314427 - DNA, 25 bp, Mus musculus
gctcaagccgcggcttctacaaacc

SEQ ID NO: 314428 - DNA, 25 bp, Mus musculus
gctcaagctgcaggaggaggcaaaa

SEQ ID NO: 314429 - DNA, 25 bp, Mus musculus
gctcaaggaagcctctgtgcctctg

SEQ ID NO: 314430 - DNA, 25 bp, Mus musculus
gctcaaggaggctcaacgcacagcg

SEQ ID NO: 314431 - DNA, 25 bp, Mus musculus
gctcaagtcctttcagtcttttgat

SEQ ID NO: 314432 - DNA, 25 bp, Mus musculus
gctcaagtgtaagagtgtgtttgac

SEQ ID NO: 314433 - DNA, 25 bp, Mus musculus
gctcaagttaaagagaatgaaaatg

SEQ ID NO: 314434 - DNA, 25 bp, Mus musculus
gctcaagttcaggacctctcctatt

SEQ ID NO: 314435 - DNA, 25 bp, Mus musculus
gctcaagttcgattggatccgagac

SEQ ID NO: 314436 - DNA, 25 bp, Mus musculus
gctcaagttcttctctgtgttcctc

SEQ ID NO: 314437 - DNA, 25 bp, Mus musculus
gctcaagttttctacagagatcccc

SEQ ID NO: 314438 - DNA, 25 bp, Mus musculus
gctcaatacggttattactctggga

SEQ ID NO: 314439 - DNA, 25 bp, Mus musculus
gctcaatacttctaccagaatcgag

SEQ ID NO: 314440 - DNA, 25 bp, Mus musculus
gctcaatacttctatttttttattc

SEQ ID NO: 314441 - DNA, 25 bp, Mus musculus
gctcaatgaacaggttgataaagaa

SEQ ID NO: 314442 - DNA, 25 bp, Mus musculus
gctcaatgacgcctgggtcctaaag

SEQ ID NO: 314443 - DNA, 25 bp, Mus musculus
gctcaatgagacagccaagcagcac

SEQ ID NO: 314444 - DNA, 25 bp, Mus musculus
gctcaatgagacaggacatgggtca

SEQ ID NO: 314445 - DNA, 25 bp, Mus musculus
gctcaatgagagcaggtcaaggagg

SEQ ID NO: 314446 - DNA, 25 bp, Mus musculus
gctcaatgagagcagtgggagccgg

SEQ ID NO: 314447 - DNA, 25 bp, Mus musculus
gctcaatgcacatcttcaagaaaaa

SEQ ID NO: 314448 - DNA, 25 bp, Mus musculus
gctcaatggataaaggagccgggtg

SEQ ID NO: 314449 - DNA, 25 bp, Mus musculus
gctcaatgtcacctataattcacag

SEQ ID NO: 314450 - DNA, 25 bp, Mus musculus
gctcaattggaaaagaggtccttct

SEQ ID NO: 314451 - DNA, 25 bp, Mus musculus
gctcaattggaaaaggaatcttcta

SEQ ID NO: 314452 - DNA, 25 bp, Mus musculus
gctcaattttaaggcagtgtgtgaa

SEQ ID NO: 314453 - DNA, 25 bp, Mus musculus
gctcacaaaaaacttcatcaaagaa

SEQ ID NO: 314454 - DNA, 25 bp, Mus musculus
gctcacaaaacaggagacatttgat

SEQ ID NO: 314455 - DNA, 25 bp, Mus musculus
gctcacaaagaacaagggagaagca

SEQ ID NO: 314456 - DNA, 25 bp, Mus musculus
gctcacaaagcaaagacaaatgagc

SEQ ID NO: 314457 - DNA, 25 bp, Mus musculus
gctcacaaagcaaagccagggcata

SEQ ID NO: 314458 - DNA, 25 bp, Mus musculus
gctcacaaagcaaagccagtgaaac

SEQ ID NO: 314459 - DNA, 25 bp, Mus musculus
gctcacacacagggcgtgcgcaggg

SEQ ID NO: 314460 - DNA, 25 bp, Mus musculus
gctcacacagctgaaaaagtctggt

SEQ ID NO: 314461 - DNA, 25 bp, Mus musculus
gctcacaccgacctgagaaatgcca

SEQ ID NO: 314462 - DNA, 25 bp, Mus musculus
gctcacaccgactgcgtaattcgaa

SEQ ID NO: 314463 - DNA, 25 bp, Mus musculus
gctcacaccgataaccctaacaagc

SEQ ID NO: 314464 - DNA, 25 bp, Mus musculus
gctcacacgaggtagctcgcggcgt

SEQ ID NO: 314465 - DNA, 25 bp, Mus musculus
gctcacagaagagagctgtgaattc

SEQ ID NO: 314466 - DNA, 25 bp, Mus musculus
gctcacagaagcctgcagagcctat

SEQ ID NO: 314467 - DNA, 25 bp, Mus musculus
gctcacagaaggctgttcatttaga

SEQ ID NO: 314468 - DNA, 25 bp, Mus musculus
gctcacagaatgcaagtcacacaag

SEQ ID NO: 314469 - DNA, 25 bp, Mus musculus
gctcacagcctagcctgtgtttgtg

SEQ ID NO: 314470 - DNA, 25 bp, Mus musculus
gctcacagctactgcgggggactcc

SEQ ID NO: 314471 - DNA, 25 bp, Mus musculus
gctcacagctgttctgcccgaggac

SEQ ID NO: 314472 - DNA, 25 bp, Mus musculus
gctcacaggaatagatttcttatct

SEQ ID NO: 314473 - DNA, 25 bp, Mus musculus
gctcacagtctcagaaaccattgaa

SEQ ID NO: 314474 - DNA, 25 bp, Mus musculus
gctcacagtctcagccacagagaac

SEQ ID NO: 314475 - DNA, 25 bp, Mus musculus
gctcaccaagagctttgtaaatgga

SEQ ID NO: 314476 - DNA, 25 bp, Mus musculus
gctcaccaagcgggtcaaaaatgct

SEQ ID NO: 314477 - DNA, 25 bp, Mus musculus
gctcaccaagctactccattcccgc

SEQ ID NO: 314478 - DNA, 25 bp, Mus musculus
gctcaccaccctgaggcaaagaaat

SEQ ID NO: 314479 - DNA, 25 bp, Mus musculus
gctcaccaccctgagtccagacaga

SEQ ID NO: 314480 - DNA, 25 bp, Mus musculus
gctcaccatggcagaacctgcaact

SEQ ID NO: 314481 - DNA, 25 bp, Mus musculus
gctcaccattggagaccggtttggg

SEQ ID NO: 314482 - DNA, 25 bp, Mus musculus
gctcacccacagagtgctgacctag

SEQ ID NO: 314483 - DNA, 25 bp, Mus musculus
gctcacccagagcttgtcaatgtcc

SEQ ID NO: 314484 - DNA, 25 bp, Mus musculus
gctcacccgagacgtgatcgtccgc

SEQ ID NO: 314485 - DNA, 25 bp, Mus musculus
gctcaccctgattgactcgtggtgc

SEQ ID NO: 314486 - DNA, 25 bp, Mus musculus
gctcaccctgcgactactgtgaaga

SEQ ID NO: 314487 - DNA, 25 bp, Mus musculus
gctcacctccgctgcctgccttgtc

SEQ ID NO: 314488 - DNA, 25 bp, Mus musculus
gctcacctctgagatacttggagat

SEQ ID NO: 314489 - DNA, 25 bp, Mus musculus
gctcacctgcggcttgggtgactca

SEQ ID NO: 314490 - DNA, 25 bp, Mus musculus
gctcaccttcatggagaaggtgcac

SEQ ID NO: 314491 - DNA, 25 bp, Mus musculus
gctcaccttgaaaatgaagtccctc

SEQ ID NO: 314492 - DNA, 25 bp, Mus musculus
gctcaccttgtgttcgacttccacc

SEQ ID NO: 314493 - DNA, 25 bp, Mus musculus
gctcacgaaagaaaggccagaggga

SEQ ID NO: 314494 - DNA, 25 bp, Mus musculus
gctcacgagaagatgtgtatgtcga

SEQ ID NO: 314495 - DNA, 25 bp, Mus musculus
gctcacgagggcgaggctcggctat

SEQ ID NO: 314496 - DNA, 25 bp, Mus musculus
gctcacgatccaggtcagagcagca

SEQ ID NO: 314497 - DNA, 25 bp, Mus musculus
gctcacgatccaggtgttcactggg

SEQ ID NO: 314498 - DNA, 25 bp, Mus musculus
gctcacgccgagcagctgccccagg

SEQ ID NO: 314499 - DNA, 25 bp, Mus musculus
gctcacgcctctcttctgtattatg

SEQ ID NO: 314500 - DNA, 25 bp, Mus musculus
gctcacgcctcttgaccagcagtta

SEQ ID NO: 314501 - DNA, 25 bp, Mus musculus
gctcacggagggaccaacatcaata

SEQ ID NO: 314502 - DNA, 25 bp, Mus musculus
gctcacggcggaaggcaagattgag

SEQ ID NO: 314503 - DNA, 25 bp, Mus musculus
gctcactcaaggtaatagcgctcat

SEQ ID NO: 314504 - DNA, 25 bp, Mus musculus
gctcactcaggagccgttgcccacg

SEQ ID NO: 314505 - DNA, 25 bp, Mus musculus
gctcactcatgcaggttgctgatgc

SEQ ID NO: 314506 - DNA, 25 bp, Mus musculus
gctcactgaggctggaccacgttca

SEQ ID NO: 314507 - DNA, 25 bp, Mus musculus
gctcactgccaaggggacaatgacg

SEQ ID NO: 314508 - DNA, 25 bp, Mus musculus
gctcactgccaaggtgaaagcagcc

SEQ ID NO: 314509 - DNA, 25 bp, Mus musculus
gctcactggaagagccgcccgcacc

SEQ ID NO: 314510 - DNA, 25 bp, Mus musculus
gctcactggaagagcctcagaaaca

SEQ ID NO: 314511 - DNA, 25 bp, Mus musculus
gctcactggatcgccgcccttcact

SEQ ID NO: 314512 - DNA, 25 bp, Mus musculus
gctcactgtggaggagctgaagttc

SEQ ID NO: 314513 - DNA, 25 bp, Mus musculus
gctcacttgaaggacacccagctcc

SEQ ID NO: 314514 - DNA, 25 bp, Mus musculus
gctcacttgggtgctggtctcctac

SEQ ID NO: 314515 - DNA, 25 bp, Mus musculus
gctcagaaaagccaggcctgtgatc

SEQ ID NO: 314516 - DNA, 25 bp, Mus musculus
gctcagaaacaggcggaaaaactga

SEQ ID NO: 314517 - DNA, 25 bp, Mus musculus
gctcagaaagcctttccctaacagg

SEQ ID NO: 314518 - DNA, 25 bp, Mus musculus
gctcagaaagctgtgtatgatcgga

SEQ ID NO: 314519 - DNA, 25 bp, Mus musculus
gctcagaaaggatgtcaaagtcttt

SEQ ID NO: 314520 - DNA, 25 bp, Mus musculus
gctcagaacagcatcccctacccca

SEQ ID NO: 314521 - DNA, 25 bp, Mus musculus
gctcagaacaggtcttcacatgctc

SEQ ID NO: 314522 - DNA, 25 bp, Mus musculus
gctcagaacccgagggtttctctgc

SEQ ID NO: 314523 - DNA, 25 bp, Mus musculus
gctcagaacgaaccaagaattgtca

SEQ ID NO: 314524 - DNA, 25 bp, Mus musculus
gctcagaacggatcaataagccaag

SEQ ID NO: 314525 - DNA, 25 bp, Mus musculus
gctcagaagcaacaggagtgcagga

SEQ ID NO: 314526 - DNA, 25 bp, Mus musculus
gctcagaagccaagctgctgcattt

SEQ ID NO: 314527 - DNA, 25 bp, Mus musculus
gctcagaagcccagatggtgcagtc

SEQ ID NO: 314528 - DNA, 25 bp, Mus musculus
gctcagaatgctggtggacaagaag

SEQ ID NO: 314529 - DNA, 25 bp, Mus musculus
gctcagacaaagatgggctacaccc

SEQ ID NO: 314530 - DNA, 25 bp, Mus musculus
gctcagacagccgtgcttatggaga

SEQ ID NO: 314531 - DNA, 25 bp, Mus musculus
gctcagacagtgggtgtccacccag

SEQ ID NO: 314532 - DNA, 25 bp, Mus musculus
gctcagaccagatggccaagctgcg

SEQ ID NO: 314533 - DNA, 25 bp, Mus musculus
gctcagaccttaagggatagagaag

SEQ ID NO: 314534 - DNA, 25 bp, Mus musculus
gctcagacttggatacccttctgca

SEQ ID NO: 314535 - DNA, 25 bp, Mus musculus
gctcagagacaaggttctccccacc

SEQ ID NO: 314536 - DNA, 25 bp, Mus musculus
gctcagagacccaagtgcataagta

SEQ ID NO: 314537 - DNA, 25 bp, Mus musculus
gctcagagaccgcaatctcactggt

SEQ ID NO: 314538 - DNA, 25 bp, Mus musculus
gctcagagaccgcaatgtgtatgtc

SEQ ID NO: 314539 - DNA, 25 bp, Mus musculus
gctcagagagaatccaccttgacac

SEQ ID NO: 314540 - DNA, 25 bp, Mus musculus
gctcagagagtcggcgtccctacag

SEQ ID NO: 314541 - DNA, 25 bp, Mus musculus
gctcagagagtcgggtctgagtgcc

SEQ ID NO: 314542 - DNA, 25 bp, Mus musculus
gctcagagcagctttgacctcgaaa

SEQ ID NO: 314543 - DNA, 25 bp, Mus musculus
gctcagagggatcagaaacatcgag

SEQ ID NO: 314544 - DNA, 25 bp, Mus musculus
gctcagagtggcctctcaaaggcag

SEQ ID NO: 314545 - DNA, 25 bp, Mus musculus
gctcagatcaggtaagggagcacac

SEQ ID NO: 314546 - DNA, 25 bp, Mus musculus
gctcagatccgtatgtaaagaccta

SEQ ID NO: 314547 - DNA, 25 bp, Mus musculus
gctcagatgtcacaggttaaagaaa

SEQ ID NO: 314548 - DNA, 25 bp, Mus musculus
gctcagatgttagaagatgtagcta

SEQ ID NO: 314549 - DNA, 25 bp, Mus musculus
gctcagatgttagcactagcaacaa

SEQ ID NO: 314550 - DNA, 25 bp, Mus musculus
gctcagattacagatttctgctcct

SEQ ID NO: 314551 - DNA, 25 bp, Mus musculus
gctcagcaaagaagttgggatatct

SEQ ID NO: 314552 - DNA, 25 bp, Mus musculus
gctcagcaaaggcagctgagatgct

SEQ ID NO: 314553 - DNA, 25 bp, Mus musculus
gctcagcaaggctgagcgccgcgtg

SEQ ID NO: 314554 - DNA, 25 bp, Mus musculus
gctcagcaagggccgcgtgttggag

SEQ ID NO: 314555 - DNA, 25 bp, Mus musculus
gctcagcaagtattcgactcacctg

SEQ ID NO: 314556 - DNA, 25 bp, Mus musculus
gctcagcaatagtctggaagaaagg

SEQ ID NO: 314557 - DNA, 25 bp, Mus musculus
gctcagcagaatggcactacaagat

SEQ ID NO: 314558 - DNA, 25 bp, Mus musculus
gctcagcagggacgcccgaggagct

SEQ ID NO: 314559 - DNA, 25 bp, Mus musculus
gctcagcatcagggagccataattc

SEQ ID NO: 314560 - DNA, 25 bp, Mus musculus
gctcagcatcagggattgttacaga

SEQ ID NO: 314561 - DNA, 25 bp, Mus musculus
gctcagcatgaaagcatccctggag

SEQ ID NO: 314562 - DNA, 25 bp, Mus musculus
gctcagccacaggggcattaggaga

SEQ ID NO: 314563 - DNA, 25 bp, Mus musculus
gctcagccagacagagtccggccac

SEQ ID NO: 314564 - DNA, 25 bp, Mus musculus
gctcagccagagcaaagtaaagaca

SEQ ID NO: 314565 - DNA, 25 bp, Mus musculus
gctcagccagctgagggagtatgat

SEQ ID NO: 314566 - DNA, 25 bp, Mus musculus
gctcagccatgaagatgagggtgtc

SEQ ID NO: 314567 - DNA, 25 bp, Mus musculus
gctcagcccatgaagcaagcttggg

SEQ ID NO: 314568 - DNA, 25 bp, Mus musculus
gctcagcctggaagacctgccaggc

SEQ ID NO: 314569 - DNA, 25 bp, Mus musculus
gctcagccttgaggtcccactggaa

SEQ ID NO: 314570 - DNA, 25 bp, Mus musculus
gctcagcgatcaggatatgacatta

SEQ ID NO: 314571 - DNA, 25 bp, Mus musculus
gctcagcgcttagcccggaagacca

SEQ ID NO: 314572 - DNA, 25 bp, Mus musculus
gctcagcgtcccatggcctagccgc

SEQ ID NO: 314573 - DNA, 25 bp, Mus musculus
gctcagcgtgaagatgtactggttc

SEQ ID NO: 314574 - DNA, 25 bp, Mus musculus
gctcagcgtggagcccttggatgaa

SEQ ID NO: 314575 - DNA, 25 bp, Mus musculus
gctcagcgtggagctgcagcccttg

SEQ ID NO: 314576 - DNA, 25 bp, Mus musculus
gctcagctacaggctcagaaagaag

SEQ ID NO: 314577 - DNA, 25 bp, Mus musculus
gctcagctacctcggtaccagtact

SEQ ID NO: 314578 - DNA, 25 bp, Mus musculus
gctcagctatggactgtctaacttt

SEQ ID NO: 314579 - DNA, 25 bp, Mus musculus
gctcagctatggagtcagtgacttt

SEQ ID NO: 314580 - DNA, 25 bp, Mus musculus
gctcagctatggagtctgtatcttt

SEQ ID NO: 314581 - DNA, 25 bp, Mus musculus
gctcagctcagcacaatcctggagg

SEQ ID NO: 314582 - DNA, 25 bp, Mus musculus
gctcagctcaggtactagaagacac

SEQ ID NO: 314583 - DNA, 25 bp, Mus musculus
gctcagctctaattggtttcaaatg

SEQ ID NO: 314584 - DNA, 25 bp, Mus musculus
gctcagctctgctctaaagcaaatc

SEQ ID NO: 314585 - DNA, 25 bp, Mus musculus
gctcagctgagcccagtccctgcag

SEQ ID NO: 314586 - DNA, 25 bp, Mus musculus
gctcagctgcgcatcctgcctctgc

SEQ ID NO: 314587 - DNA, 25 bp, Mus musculus
gctcagctgcgtcggcacccaggaa

SEQ ID NO: 314588 - DNA, 25 bp, Mus musculus
gctcagcttggcagaacacatgtcg

SEQ ID NO: 314589 - DNA, 25 bp, Mus musculus
gctcaggaaaggactttcctggaac

SEQ ID NO: 314590 - DNA, 25 bp, Mus musculus
gctcaggaacagccccacagcagca

SEQ ID NO: 314591 - DNA, 25 bp, Mus musculus
gctcaggaacagtatcatcaacatt

SEQ ID NO: 314592 - DNA, 25 bp, Mus musculus
gctcaggaatgcaacttctcggtat

SEQ ID NO: 314593 - DNA, 25 bp, Mus musculus
gctcaggacagagggactgctgcag

SEQ ID NO: 314594 - DNA, 25 bp, Mus musculus
gctcaggaccatgcgcaatcaggat

SEQ ID NO: 314595 - DNA, 25 bp, Mus musculus
gctcaggaccatgcgcctgcggagt

SEQ ID NO: 314596 - DNA, 25 bp, Mus musculus
gctcaggagatcatgcctcccgcag

SEQ ID NO: 314597 - DNA, 25 bp, Mus musculus
gctcaggagcaagattgccaaggga

SEQ ID NO: 314598 - DNA, 25 bp, Mus musculus
gctcaggagcaagtttcaggttagt

SEQ ID NO: 314599 - DNA, 25 bp, Mus musculus
gctcaggagcagcgggtttattgcc

SEQ ID NO: 314600 - DNA, 25 bp, Mus musculus
gctcaggagcgaaagtgacaccagc

SEQ ID NO: 314601 - DNA, 25 bp, Mus musculus
gctcaggagctcaacgagctggact

SEQ ID NO: 314602 - DNA, 25 bp, Mus musculus
gctcaggatcctaccctctagacgt

SEQ ID NO: 314603 - DNA, 25 bp, Mus musculus
gctcaggcggagaagtactctcaaa

SEQ ID NO: 314604 - DNA, 25 bp, Mus musculus
gctcaggctcacaagaaataccatt

SEQ ID NO: 314605 - DNA, 25 bp, Mus musculus
gctcaggctcacaaggcagaaaaaa

SEQ ID NO: 314606 - DNA, 25 bp, Mus musculus
gctcaggctgagaagtactctcaga

SEQ ID NO: 314607 - DNA, 25 bp, Mus musculus
gctcagggaatggactatttgcatg

SEQ ID NO: 314608 - DNA, 25 bp, Mus musculus
gctcagggcacaggaataacagaag

SEQ ID NO: 314609 - DNA, 25 bp, Mus musculus
gctcagggcagccaagcctgagcaa

SEQ ID NO: 314610 - DNA, 25 bp, Mus musculus
gctcagggcagtggtcctcatagtc

SEQ ID NO: 314611 - DNA, 25 bp, Mus musculus
gctcagggtaggagggtgggatgga

SEQ ID NO: 314612 - DNA, 25 bp, Mus musculus
gctcagggtgaggcgacccctctga

SEQ ID NO: 314613 - DNA, 25 bp, Mus musculus
gctcaggtaagagagatctggagct

SEQ ID NO: 314614 - DNA, 25 bp, Mus musculus
gctcaggtcagcctccatgtactca

SEQ ID NO: 314615 - DNA, 25 bp, Mus musculus
gctcaggtcccacgccctggcacat

SEQ ID NO: 314616 - DNA, 25 bp, Mus musculus
gctcaggtctccagggcctggaatg

SEQ ID NO: 314617 - DNA, 25 bp, Mus musculus
gctcaggtgctcaggtgtgtgtgac

SEQ ID NO: 314618 - DNA, 25 bp, Mus musculus
gctcaggtgggttagccaaccccac

SEQ ID NO: 314619 - DNA, 25 bp, Mus musculus
gctcagtaacaagcttcttaacccc

SEQ ID NO: 314620 - DNA, 25 bp, Mus musculus
gctcagtcaatggagagaacaagcc

SEQ ID NO: 314621 - DNA, 25 bp, Mus musculus
gctcagtcactcagctgcagcagag

SEQ ID NO: 314622 - DNA, 25 bp, Mus musculus
gctcagtcctagtactgatgtcaac

SEQ ID NO: 314623 - DNA, 25 bp, Mus musculus
gctcagtcctagtaggagagatcca

SEQ ID NO: 314624 - DNA, 25 bp, Mus musculus
gctcagtctgtcaagggggtggcac

SEQ ID NO: 314625 - DNA, 25 bp, Mus musculus
gctcagtgctcagggtttaagtctt

SEQ ID NO: 314626 - DNA, 25 bp, Mus musculus
gctcagtgctgaatggggctttccc

SEQ ID NO: 314627 - DNA, 25 bp, Mus musculus
gctcagtggcagcactccgccagag

SEQ ID NO: 314628 - DNA, 25 bp, Mus musculus
gctcataaatcagccttacgatggg

SEQ ID NO: 314629 - DNA, 25 bp, Mus musculus
gctcatacagagtccaggctgtcat

SEQ ID NO: 314630 - DNA, 25 bp, Mus musculus
gctcatacagtctcaacagatcacc

SEQ ID NO: 314631 - DNA, 25 bp, Mus musculus
gctcatagaagttaatggaacccct

SEQ ID NO: 314632 - DNA, 25 bp, Mus musculus
gctcatagatgtaggtgaaaaatct

SEQ ID NO: 314633 - DNA, 25 bp, Mus musculus
gctcataggacagtctcccatggct

SEQ ID NO: 314634 - DNA, 25 bp, Mus musculus
gctcatagtctctaggatgctccag

SEQ ID NO: 314635 - DNA, 25 bp, Mus musculus
gctcatatccaggagagagtctccg

SEQ ID NO: 314636 - DNA, 25 bp, Mus musculus
gctcatatccaggaggtgacccaca

SEQ ID NO: 314637 - DNA, 25 bp, Mus musculus
gctcatatccaggagttgatcttta

SEQ ID NO: 314638 - DNA, 25 bp, Mus musculus
gctcatattaaggaggccttgtcag

SEQ ID NO: 314639 - DNA, 25 bp, Mus musculus
gctcatcaaagaaacccatcttcat

SEQ ID NO: 314640 - DNA, 25 bp, Mus musculus
gctcatcaagaaagggtacacccag

SEQ ID NO: 314641 - DNA, 25 bp, Mus musculus
gctcatcaagtgaggaatctgagga

SEQ ID NO: 314642 - DNA, 25 bp, Mus musculus
gctcatcagcatccagtcctggctt

SEQ ID NO: 314643 - DNA, 25 bp, Mus musculus
gctcatcatacagaacagtaccttt

SEQ ID NO: 314644 - DNA, 25 bp, Mus musculus
gctcatcatgctccgtcgggaggct

SEQ ID NO: 314645 - DNA, 25 bp, Mus musculus
gctcatcatggctcgcctgcgccgc

SEQ ID NO: 314646 - DNA, 25 bp, Mus musculus
gctcatccaaggaggcgagtacttt

SEQ ID NO: 314647 - DNA, 25 bp, Mus musculus
gctcatccaagtcctaccaggaacg

SEQ ID NO: 314648 - DNA, 25 bp, Mus musculus
gctcatccagatctgcaacgggctt

SEQ ID NO: 314649 - DNA, 25 bp, Mus musculus
gctcatccagctcagcacattgcaa

SEQ ID NO: 314650 - DNA, 25 bp, Mus musculus
gctcatccaggaacaacttccacgg

SEQ ID NO: 314651 - DNA, 25 bp, Mus musculus
gctcatccaggtgggatatgagcct

SEQ ID NO: 314652 - DNA, 25 bp, Mus musculus
gctcatccgaagtatcctggagaac

SEQ ID NO: 314653 - DNA, 25 bp, Mus musculus
gctcatccgggccgtggaagcatca

SEQ ID NO: 314654 - DNA, 25 bp, Mus musculus
gctcatcctagcaggtatgccacag

SEQ ID NO: 314655 - DNA, 25 bp, Mus musculus
gctcatcctccccctcaagttcaaa

SEQ ID NO: 314656 - DNA, 25 bp, Mus musculus
gctcatcctgagccttgagccagat

SEQ ID NO: 314657 - DNA, 25 bp, Mus musculus
gctcatcctgagttctccacaccct

SEQ ID NO: 314658 - DNA, 25 bp, Mus musculus
gctcatcctggaccctgcatgctga

SEQ ID NO: 314659 - DNA, 25 bp, Mus musculus
gctcatcgagaaacatggcttagtt

SEQ ID NO: 314660 - DNA, 25 bp, Mus musculus
gctcatcgaggagaatcagcgcctc

SEQ ID NO: 314661 - DNA, 25 bp, Mus musculus
gctcatcgcctcttggattctgtgt

SEQ ID NO: 314662 - DNA, 25 bp, Mus musculus
gctcatctacaggtgccaagtcggg

SEQ ID NO: 314663 - DNA, 25 bp, Mus musculus
gctcatctcaccaaggattacacag

SEQ ID NO: 314664 - DNA, 25 bp, Mus musculus
gctcatgaaggagctctttgatcgt

SEQ ID NO: 314665 - DNA, 25 bp, Mus musculus
gctcatgaaggctctggtctcagtg

SEQ ID NO: 314666 - DNA, 25 bp, Mus musculus
gctcatgaaggtcaacaccatcacc

SEQ ID NO: 314667 - DNA, 25 bp, Mus musculus
gctcatgcaggtccatgcctcccgc

SEQ ID NO: 314668 - DNA, 25 bp, Mus musculus
gctcatggaagaggttcaaaccttg

SEQ ID NO: 314669 - DNA, 25 bp, Mus musculus
gctcatggaagaggtttattaacaa

SEQ ID NO: 314670 - DNA, 25 bp, Mus musculus
gctcatggagagagcagtagagatg

SEQ ID NO: 314671 - DNA, 25 bp, Mus musculus
gctcatggagcttgagatcttcttg

SEQ ID NO: 314672 - DNA, 25 bp, Mus musculus
gctcatgggacaggtgaacaccttt

SEQ ID NO: 314673 - DNA, 25 bp, Mus musculus
gctcatggtagcgaccacctgcagc

SEQ ID NO: 314674 - DNA, 25 bp, Mus musculus
gctcatgtcagcagataggatctgt

SEQ ID NO: 314675 - DNA, 25 bp, Mus musculus
gctcatgtcagcaggaaatgatgga

SEQ ID NO: 314676 - DNA, 25 bp, Mus musculus
gctcatgtcagcaggctggcgcatt

SEQ ID NO: 314677 - DNA, 25 bp, Mus musculus
gctcatgtgcagaaggtctcgagga

SEQ ID NO: 314678 - DNA, 25 bp, Mus musculus
gctcatgttgatccgtggcttcagt

SEQ ID NO: 314679 - DNA, 25 bp, Mus musculus
gctcattactacactgctctgctca

SEQ ID NO: 314680 - DNA, 25 bp, Mus musculus
gctcattataggggtgatcctgtat

SEQ ID NO: 314681 - DNA, 25 bp, Mus musculus
gctcattcaggataggggaatggtc

SEQ ID NO: 314682 - DNA, 25 bp, Mus musculus
gctcattcgaagatgttttcggtgc

SEQ ID NO: 314683 - DNA, 25 bp, Mus musculus
gctcattctgctggctgctgctgct

SEQ ID NO: 314684 - DNA, 25 bp, Mus musculus
gctcattgaaggacagccaaataga

SEQ ID NO: 314685 - DNA, 25 bp, Mus musculus
gctcattgaaggttcaaccattttg

SEQ ID NO: 314686 - DNA, 25 bp, Mus musculus
gctcattgaggtgaatgggcagaac

SEQ ID NO: 314687 - DNA, 25 bp, Mus musculus
gctcattgcctacagattgtctgtg

SEQ ID NO: 314688 - DNA, 25 bp, Mus musculus
gctcattgtccttgattggctcttt

SEQ ID NO: 314689 - DNA, 25 bp, Mus musculus
gctcattgtccttggcaggacctca

SEQ ID NO: 314690 - DNA, 25 bp, Mus musculus
gctcattgtccttgtttatgctgct

SEQ ID NO: 314691 - DNA, 25 bp, Mus musculus
gctcattgtgattatgtgggtacgg

SEQ ID NO: 314692 - DNA, 25 bp, Mus musculus
gctcattgtgggaaactccaaacag

SEQ ID NO: 314693 - DNA, 25 bp, Mus musculus
gctcattgtggggaccagcgggaag

SEQ ID NO: 314694 - DNA, 25 bp, Mus musculus
gctcattgtggtactgataggttcc

SEQ ID NO: 314695 - DNA, 25 bp, Mus musculus
gctcattgttgtagaggatctgaga

SEQ ID NO: 314696 - DNA, 25 bp, Mus musculus
gctcatttatgataattagcaccat

SEQ ID NO: 314697 - DNA, 25 bp, Mus musculus
gctcatttcaggttgctcaccacaa

SEQ ID NO: 314698 - DNA, 25 bp, Mus musculus
gctcatttcccacagacctggattt

SEQ ID NO: 314699 - DNA, 25 bp, Mus musculus
gctccaaaaaaggcaaattgaagaa

SEQ ID NO: 314700 - DNA, 25 bp, Mus musculus
gctccaaaatgtcaggaattagctc

SEQ ID NO: 314701 - DNA, 25 bp, Mus musculus
gctccaaaattcaggtgattgacat

SEQ ID NO: 314702 - DNA, 25 bp, Mus musculus
gctccaaagagctttggcaatccac

SEQ ID NO: 314703 - DNA, 25 bp, Mus musculus
gctccaaagagggctatgtgctcaa

SEQ ID NO: 314704 - DNA, 25 bp, Mus musculus
gctccaaagtcggtttctgtatgca

SEQ ID NO: 314705 - DNA, 25 bp, Mus musculus
gctccaaccaccagttttggttcat

SEQ ID NO: 314706 - DNA, 25 bp, Mus musculus
gctccaaccccccggccctgcctgc

SEQ ID NO: 314707 - DNA, 25 bp, Mus musculus
gctccaacgatgtgaaagagttcct

SEQ ID NO: 314708 - DNA, 25 bp, Mus musculus
gctccaactcttggcattgaccttg

SEQ ID NO: 314709 - DNA, 25 bp, Mus musculus
gctccaactggcgtccctacagccg

SEQ ID NO: 314710 - DNA, 25 bp, Mus musculus
gctccaactgggtctgagtgcccgg

SEQ ID NO: 314711 - DNA, 25 bp, Mus musculus
gctccaagaagaggttctcccagat

SEQ ID NO: 314712 - DNA, 25 bp, Mus musculus
gctccaagaatggcgggcatatcga

SEQ ID NO: 314713 - DNA, 25 bp, Mus musculus
gctccaagacagcgcatagaagctc

SEQ ID NO: 314714 - DNA, 25 bp, Mus musculus
gctccaagacagcgcccatgcaggt

SEQ ID NO: 314715 - DNA, 25 bp, Mus musculus
gctccaagagcgatatgagatcgtg

SEQ ID NO: 314716 - DNA, 25 bp, Mus musculus
gctccaagaggtgtgtgatagcacg

SEQ ID NO: 314717 - DNA, 25 bp, Mus musculus
gctccaagcctcagctgctgttgca

SEQ ID NO: 314718 - DNA, 25 bp, Mus musculus
gctccaagcctcaggattcctctat

SEQ ID NO: 314719 - DNA, 25 bp, Mus musculus
gctccaaggcgtctgaatttcctgt

SEQ ID NO: 314720 - DNA, 25 bp, Mus musculus
gctccaaggggagcctcctttccca

SEQ ID NO: 314721 - DNA, 25 bp, Mus musculus
gctccaagtccgagctctgaactca

SEQ ID NO: 314722 - DNA, 25 bp, Mus musculus
gctccaatgcgatgcaaatcctctg

SEQ ID NO: 314723 - DNA, 25 bp, Mus musculus
gctccaatgcgatgctttggctcag

SEQ ID NO: 314724 - DNA, 25 bp, Mus musculus
gctccaatgtcaaatgtgactatga

SEQ ID NO: 314725 - DNA, 25 bp, Mus musculus
gctccacaaacgtgcagttcagtcc

SEQ ID NO: 314726 - DNA, 25 bp, Mus musculus
gctccacaaacgtggtgaatacatc

SEQ ID NO: 314727 - DNA, 25 bp, Mus musculus
gctccacaagcaaaaccttgagatt

SEQ ID NO: 314728 - DNA, 25 bp, Mus musculus
gctccacacaatatgacgtgttcac

SEQ ID NO: 314729 - DNA, 25 bp, Mus musculus
gctccacacgggacaagctctgact

SEQ ID NO: 314730 - DNA, 25 bp, Mus musculus
gctccacacggttacaggcccaaaa

SEQ ID NO: 314731 - DNA, 25 bp, Mus musculus
gctccacactgtcccggagagtgga

SEQ ID NO: 314732 - DNA, 25 bp, Mus musculus
gctccacagcacatttggtcagaaa

SEQ ID NO: 314733 - DNA, 25 bp, Mus musculus
gctccacagcaggtggctggattca

SEQ ID NO: 314734 - DNA, 25 bp, Mus musculus
gctccacaggagatggctttcacgg

SEQ ID NO: 314735 - DNA, 25 bp, Mus musculus
gctccacatacaagggacagtggca

SEQ ID NO: 314736 - DNA, 25 bp, Mus musculus
gctccacatgaactcacagaagaac

SEQ ID NO: 314737 - DNA, 25 bp, Mus musculus
gctccacatgacattctctggcttc

SEQ ID NO: 314738 - DNA, 25 bp, Mus musculus
gctccacatgcaggcttcccgagga

SEQ ID NO: 314739 - DNA, 25 bp, Mus musculus
gctccacatgcaggtgtggtacatc

SEQ ID NO: 314740 - DNA, 25 bp, Mus musculus
gctccacatgccatttaccaatcta

SEQ ID NO: 314741 - DNA, 25 bp, Mus musculus
gctccaccactgagtttgaagagcc

SEQ ID NO: 314742 - DNA, 25 bp, Mus musculus
gctccaccatcatctggctatgtat

SEQ ID NO: 314743 - DNA, 25 bp, Mus musculus
gctccacccaggctaccttcatggt

SEQ ID NO: 314744 - DNA, 25 bp, Mus musculus
gctccaccccctactccccgagcca

SEQ ID NO: 314745 - DNA, 25 bp, Mus musculus
gctccacccgcgagggtggcccgag

SEQ ID NO: 314746 - DNA, 25 bp, Mus musculus
gctccaccgcggtctgacagcggat

SEQ ID NO: 314747 - DNA, 25 bp, Mus musculus
gctccaccgcggttggaattcgagg

SEQ ID NO: 314748 - DNA, 25 bp, Mus musculus
gctccaccgcggttggtgttcgagg

SEQ ID NO: 314749 - DNA, 25 bp, Mus musculus
gctccacctaaaagtgctggacgag

SEQ ID NO: 314750 - DNA, 25 bp, Mus musculus
gctccacctaaagagccactggaca

SEQ ID NO: 314751 - DNA, 25 bp, Mus musculus
gctccacctaaagtactgaccaagt

SEQ ID NO: 314752 - DNA, 25 bp, Mus musculus
gctccacctggaaatgttctgcgaa

SEQ ID NO: 314753 - DNA, 25 bp, Mus musculus
gctccacctgttatttggccggtcg

SEQ ID NO: 314754 - DNA, 25 bp, Mus musculus
gctccaccttcaagcttcagaacat

SEQ ID NO: 314755 - DNA, 25 bp, Mus musculus
gctccaccttcaatttggaaggcct

SEQ ID NO: 314756 - DNA, 25 bp, Mus musculus
gctccaccttcagacccaggcctgc

SEQ ID NO: 314757 - DNA, 25 bp, Mus musculus
gctccacgcggtagcactcagcatg

SEQ ID NO: 314758 - DNA, 25 bp, Mus musculus
gctccacggcaatagacccagtgac

SEQ ID NO: 314759 - DNA, 25 bp, Mus musculus
gctccacggtccaggaagaatgttt

SEQ ID NO: 314760 - DNA, 25 bp, Mus musculus
gctccactgctcaggttgaaggttt

SEQ ID NO: 314761 - DNA, 25 bp, Mus musculus
gctccagaaccagaaccggagtgtt

SEQ ID NO: 314762 - DNA, 25 bp, Mus musculus
gctccagaaccagataattagcacc

SEQ ID NO: 314763 - DNA, 25 bp, Mus musculus
gctccagaaccagtgtctgacagtt

SEQ ID NO: 314764 - DNA, 25 bp, Mus musculus
gctccagaagacaggactcagctga

SEQ ID NO: 314765 - DNA, 25 bp, Mus musculus
gctccagacagtccaatgccacttt

SEQ ID NO: 314766 - DNA, 25 bp, Mus musculus
gctccagacagtcctaacaggggct

SEQ ID NO: 314767 - DNA, 25 bp, Mus musculus
gctccagagcacagatacctgactg

SEQ ID NO: 314768 - DNA, 25 bp, Mus musculus
gctccagagccggggaatggtctag

SEQ ID NO: 314769 - DNA, 25 bp, Mus musculus
gctccagagccggtttagtctccac

SEQ ID NO: 314770 - DNA, 25 bp, Mus musculus
gctccagagctacttctccttcagg

SEQ ID NO: 314771 - DNA, 25 bp, Mus musculus
gctccagagctgctctgcgtacaag

SEQ ID NO: 314772 - DNA, 25 bp, Mus musculus
gctccagagctggcaggacctacag

SEQ ID NO: 314773 - DNA, 25 bp, Mus musculus
gctccagatgaagatccaggaggat

SEQ ID NO: 314774 - DNA, 25 bp, Mus musculus
gctccagatgaagtcaggaggcaag

SEQ ID NO: 314775 - DNA, 25 bp, Mus musculus
gctccagatgatgagaagctgtatg

SEQ ID NO: 314776 - DNA, 25 bp, Mus musculus
gctccagatgctgtggccagcgtca

SEQ ID NO: 314777 - DNA, 25 bp, Mus musculus
gctccagatggcagcacacgccaaa

SEQ ID NO: 314778 - DNA, 25 bp, Mus musculus
gctccagattcaggcgacaactggc

SEQ ID NO: 314779 - DNA, 25 bp, Mus musculus
gctccagcacaggatgcgggctcct

SEQ ID NO: 314780 - DNA, 25 bp, Mus musculus
gctccagcaccagctcttttgatat

SEQ ID NO: 314781 - DNA, 25 bp, Mus musculus
gctccagcaccagcttgctttctct

SEQ ID NO: 314782 - DNA, 25 bp, Mus musculus
gctccagcacgatggagaatagggc

SEQ ID NO: 314783 - DNA, 25 bp, Mus musculus
gctccagcagattgctttattcacc

SEQ ID NO: 314784 - DNA, 25 bp, Mus musculus
gctccagcagcactctgttttctac

SEQ ID NO: 314785 - DNA, 25 bp, Mus musculus
gctccagcaggaccttctaccgttt

SEQ ID NO: 314786 - DNA, 25 bp, Mus musculus
gctccagcaggctcttgcttgataa

SEQ ID NO: 314787 - DNA, 25 bp, Mus musculus
gctccagcagggagagcagagacgg

SEQ ID NO: 314788 - DNA, 25 bp, Mus musculus
gctccagcatagccccacggcctgc

SEQ ID NO: 314789 - DNA, 25 bp, Mus musculus
gctccagcattgctgaagtgcagag

SEQ ID NO: 314790 - DNA, 25 bp, Mus musculus
gctccagccagggatagagaaggct

SEQ ID NO: 314791 - DNA, 25 bp, Mus musculus
gctccagccccctgaagacgatgac

SEQ ID NO: 314792 - DNA, 25 bp, Mus musculus
gctccagcctgagagcttcggtgca

SEQ ID NO: 314793 - DNA, 25 bp, Mus musculus
gctccagcctgggagggcctaggaa

SEQ ID NO: 314794 - DNA, 25 bp, Mus musculus
gctccagcgccggggactctgatgg

SEQ ID NO: 314795 - DNA, 25 bp, Mus musculus
gctccagctaccagtgtccaaatga

SEQ ID NO: 314796 - DNA, 25 bp, Mus musculus
gctccagctccaggtacttcgagtt

SEQ ID NO: 314797 - DNA, 25 bp, Mus musculus
gctccagctctccagatcatggctc

SEQ ID NO: 314798 - DNA, 25 bp, Mus musculus
gctccagctgctgacccaggtcctg

SEQ ID NO: 314799 - DNA, 25 bp, Mus musculus
gctccagcttcctgaatgttttggc

SEQ ID NO: 314800 - DNA, 25 bp, Mus musculus
gctccaggacaagatgcgagctaca

SEQ ID NO: 314801 - DNA, 25 bp, Mus musculus
gctccaggacaaggaagaaaccgtt

SEQ ID NO: 314802 - DNA, 25 bp, Mus musculus
gctccaggagaccagggagagaaat

SEQ ID NO: 314803 - DNA, 25 bp, Mus musculus
gctccaggagagggaaaagatgccg

SEQ ID NO: 314804 - DNA, 25 bp, Mus musculus
gctccaggagctgattcagaaaggc

SEQ ID NO: 314805 - DNA, 25 bp, Mus musculus
gctccaggaggcactgaagaaacaa

SEQ ID NO: 314806 - DNA, 25 bp, Mus musculus
gctccaggaggttatttccatgctt

SEQ ID NO: 314807 - DNA, 25 bp, Mus musculus
gctccaggatttgggagccaaagac

SEQ ID NO: 314808 - DNA, 25 bp, Mus musculus
gctccaggatttggggtggtatcac

SEQ ID NO: 314809 - DNA, 25 bp, Mus musculus
gctccaggccagcagacacacaacc

SEQ ID NO: 314810 - DNA, 25 bp, Mus musculus
gctccaggccagcagccctgtctcc

SEQ ID NO: 314811 - DNA, 25 bp, Mus musculus
gctccaggccccagctttggtggcc

SEQ ID NO: 314812 - DNA, 25 bp, Mus musculus
gctccaggtaagtgctggccattca

SEQ ID NO: 314813 - DNA, 25 bp, Mus musculus
gctccaggtggccgagaagctgttt

SEQ ID NO: 314814 - DNA, 25 bp, Mus musculus
gctccagtaacagttacagaaaccc

SEQ ID NO: 314815 - DNA, 25 bp, Mus musculus
gctccagtatgcagattaagaaaca

SEQ ID NO: 314816 - DNA, 25 bp, Mus musculus
gctccagtccgttgtggggactgaa

SEQ ID NO: 314817 - DNA, 25 bp, Mus musculus
gctccagtgcgactttactggaaag

SEQ ID NO: 314818 - DNA, 25 bp, Mus musculus
gctccagtgtagagggccaagtcca

SEQ ID NO: 314819 - DNA, 25 bp, Mus musculus
gctccagtgtagatttatttttata

SEQ ID NO: 314820 - DNA, 25 bp, Mus musculus
gctccagtgtaggctctcagacact

SEQ ID NO: 314821 - DNA, 25 bp, Mus musculus
gctccagtgtaggtgttggaactgt

SEQ ID NO: 314822 - DNA, 25 bp, Mus musculus
gctccagtgtgactggtttcatatg

SEQ ID NO: 314823 - DNA, 25 bp, Mus musculus
gctccagttgtgagatgtggtgatc

SEQ ID NO: 314824 - DNA, 25 bp, Mus musculus
gctccagttttacaggaatctgggc

SEQ ID NO: 314825 - DNA, 25 bp, Mus musculus
gctccataaagcccatgcaggtgct

SEQ ID NO: 314826 - DNA, 25 bp, Mus musculus
gctccatacacatatggaggggctt

SEQ ID NO: 314827 - DNA, 25 bp, Mus musculus
gctccatacatcagccctcgtggta

SEQ ID NO: 314828 - DNA, 25 bp, Mus musculus
gctccatacatcagttttgcaggtg

SEQ ID NO: 314829 - DNA, 25 bp, Mus musculus
gctccatacccaaaggtatcacagc

SEQ ID NO: 314830 - DNA, 25 bp, Mus musculus
gctccatatatcaaatctggaggtg

SEQ ID NO: 314831 - DNA, 25 bp, Mus musculus
gctccatcaacaggatcattcggac

SEQ ID NO: 314832 - DNA, 25 bp, Mus musculus
gctccatcaaggtgctctcgtcagt

SEQ ID NO: 314833 - DNA, 25 bp, Mus musculus
gctccatcacgcaaggcatcccgag

SEQ ID NO: 314834 - DNA, 25 bp, Mus musculus
gctccatcagggttccagtgatctg

SEQ ID NO: 314835 - DNA, 25 bp, Mus musculus
gctccatcagtggctccacgtacac

SEQ ID NO: 314836 - DNA, 25 bp, Mus musculus
gctccatccccaggtgctgctttcc

SEQ ID NO: 314837 - DNA, 25 bp, Mus musculus
gctccatcctggcctcccttttttt

SEQ ID NO: 314838 - DNA, 25 bp, Mus musculus
gctccatcctgttactgagctgcgt

SEQ ID NO: 314839 - DNA, 25 bp, Mus musculus
gctccatcggcgggctcctggcctt

SEQ ID NO: 314840 - DNA, 25 bp, Mus musculus
gctccatcggcggggaagtttggtg

SEQ ID NO: 314841 - DNA, 25 bp, Mus musculus
gctccatcttccaggagaaccacaa

SEQ ID NO: 314842 - DNA, 25 bp, Mus musculus
gctccatgaagtacaaaggcatatt

SEQ ID NO: 314843 - DNA, 25 bp, Mus musculus
gctccatgcagctgaggtctacatt

SEQ ID NO: 314844 - DNA, 25 bp, Mus musculus
gctccatgctgtcagccgttgacta

SEQ ID NO: 314845 - DNA, 25 bp, Mus musculus
gctccattcagagcataccagaaat

SEQ ID NO: 314846 - DNA, 25 bp, Mus musculus
gctccattcagttttcctttttcag

SEQ ID NO: 314847 - DNA, 25 bp, Mus musculus
gctccattgacacaattgttccagt

SEQ ID NO: 314848 - DNA, 25 bp, Mus musculus
gctccattgacgatggcacgaacat

SEQ ID NO: 314849 - DNA, 25 bp, Mus musculus
gctccatttgtgaagatatcgatga

SEQ ID NO: 314850 - DNA, 25 bp, Mus musculus
gctccatttgtgaagatgaagatga

SEQ ID NO: 314851 - DNA, 25 bp, Mus musculus
gctcccaaagcattagcagagacac

SEQ ID NO: 314852 - DNA, 25 bp, Mus musculus
gctcccaacaggttctgggcctctg

SEQ ID NO: 314853 - DNA, 25 bp, Mus musculus
gctcccaacccctccaaggcccgag

SEQ ID NO: 314854 - DNA, 25 bp, Mus musculus
gctcccaagtatgagcccaattttg

SEQ ID NO: 314855 - DNA, 25 bp, Mus musculus
gctcccacacagccttggacaaatt

SEQ ID NO: 314856 - DNA, 25 bp, Mus musculus
gctcccacacaggtgagaagcccta

SEQ ID NO: 314857 - DNA, 25 bp, Mus musculus
gctcccacagagctgatttatccag

SEQ ID NO: 314858 - DNA, 25 bp, Mus musculus
gctcccaccatgatgggaagaaagg

SEQ ID NO: 314859 - DNA, 25 bp, Mus musculus
gctcccaccgagcaggtgacattcc

SEQ ID NO: 314860 - DNA, 25 bp, Mus musculus
gctcccaccgcagcccagggagaaa

SEQ ID NO: 314861 - DNA, 25 bp, Mus musculus
gctcccaccgcaggtatcatccgga

SEQ ID NO: 314862 - DNA, 25 bp, Mus musculus
gctcccacctgcaccttatagccat

SEQ ID NO: 314863 - DNA, 25 bp, Mus musculus
gctcccacctggttttctctgtata

SEQ ID NO: 314864 - DNA, 25 bp, Mus musculus
gctcccacgcagagggtctggagac

SEQ ID NO: 314865 - DNA, 25 bp, Mus musculus
gctcccactgcaatttgaagagctt

SEQ ID NO: 314866 - DNA, 25 bp, Mus musculus
gctcccactgcttcacacaggctat

SEQ ID NO: 314867 - DNA, 25 bp, Mus musculus
gctcccactggcatgctagtcccac

SEQ ID NO: 314868 - DNA, 25 bp, Mus musculus
gctcccagaatggatgtaaccatta

SEQ ID NO: 314869 - DNA, 25 bp, Mus musculus
gctcccagaatgttatggctgcagc

SEQ ID NO: 314870 - DNA, 25 bp, Mus musculus
gctcccagagggaattcctgagcaa

SEQ ID NO: 314871 - DNA, 25 bp, Mus musculus
gctcccagatggtgtcataagccga

SEQ ID NO: 314872 - DNA, 25 bp, Mus musculus
gctcccagcgaggagagagtgtata

SEQ ID NO: 314873 - DNA, 25 bp, Mus musculus
gctcccagcgctttggagctgtgtg

SEQ ID NO: 314874 - DNA, 25 bp, Mus musculus
gctcccagcggcagagatagctgtt

SEQ ID NO: 314875 - DNA, 25 bp, Mus musculus
gctcccagcggcagctgagcagaat

SEQ ID NO: 314876 - DNA, 25 bp, Mus musculus
gctcccaggactggtcaatgtggct

SEQ ID NO: 314877 - DNA, 25 bp, Mus musculus
gctcccaggagaatttcacccacct

SEQ ID NO: 314878 - DNA, 25 bp, Mus musculus
gctcccaggccctgaatgaagaaga

SEQ ID NO: 314879 - DNA, 25 bp, Mus musculus
gctcccaggccttgggaaaagctgt

SEQ ID NO: 314880 - DNA, 25 bp, Mus musculus
gctcccaggtcgggaccctggtgac

SEQ ID NO: 314881 - DNA, 25 bp, Mus musculus
gctcccaggtcggtgttttatctgc

SEQ ID NO: 314882 - DNA, 25 bp, Mus musculus
gctcccagtgtgctccaactgctgg

SEQ ID NO: 314883 - DNA, 25 bp, Mus musculus
gctcccatcctgaagtttatcccga

SEQ ID NO: 314884 - DNA, 25 bp, Mus musculus
gctccccaaagaccctctatgggat

SEQ ID NO: 314885 - DNA, 25 bp, Mus musculus
gctccccaacagggagttggcacgg

SEQ ID NO: 314886 - DNA, 25 bp, Mus musculus
gctccccaaggaggtattccccacc

SEQ ID NO: 314887 - DNA, 25 bp, Mus musculus
gctccccaagtacccgcctacagtt

SEQ ID NO: 314888 - DNA, 25 bp, Mus musculus
gctccccaatcagagtgcggagatc

SEQ ID NO: 314889 - DNA, 25 bp, Mus musculus
gctccccaccagcacctcctaccgg

SEQ ID NO: 314890 - DNA, 25 bp, Mus musculus
gctccccatgagaaattgccagtag

SEQ ID NO: 314891 - DNA, 25 bp, Mus musculus
gctcccccaggccggtagtggtgga

SEQ ID NO: 314892 - DNA, 25 bp, Mus musculus
gctcccccaggtttccatcgtgtgg

SEQ ID NO: 314893 - DNA, 25 bp, Mus musculus
gctccccctcagatccaacactcct

SEQ ID NO: 314894 - DNA, 25 bp, Mus musculus
gctccccctcagggatccgtgaacc

SEQ ID NO: 314895 - DNA, 25 bp, Mus musculus
gctccccctggggtctggagggaga

SEQ ID NO: 314896 - DNA, 25 bp, Mus musculus
gctcccccttagacactactttgct

SEQ ID NO: 314897 - DNA, 25 bp, Mus musculus
gctccccgaggtgtgaatgaggcag

SEQ ID NO: 314898 - DNA, 25 bp, Mus musculus
gctccccggcccacgaagcatgtaa

SEQ ID NO: 314899 - DNA, 25 bp, Mus musculus
gctccccggcggagatgaggaaact

SEQ ID NO: 314900 - DNA, 25 bp, Mus musculus
gctccccggcggaggtgtgacccca

SEQ ID NO: 314901 - DNA, 25 bp, Mus musculus
gctccccggctgagagtctccagag

SEQ ID NO: 314902 - DNA, 25 bp, Mus musculus
gctccccgttaggccagcaggtggc

SEQ ID NO: 314903 - DNA, 25 bp, Mus musculus
gctcccctcaggctggcctgccttc

SEQ ID NO: 314904 - DNA, 25 bp, Mus musculus
gctcccctcagggtcatgtagggat

SEQ ID NO: 314905 - DNA, 25 bp, Mus musculus
gctcccctcgaagcagcaccgggac

SEQ ID NO: 314906 - DNA, 25 bp, Mus musculus
gctcccgaaaccaagtggagctgat

SEQ ID NO: 314907 - DNA, 25 bp, Mus musculus
gctcccgaaactgaccactgcggca

SEQ ID NO: 314908 - DNA, 25 bp, Mus musculus
gctcccgagagagggaaacaacagt

SEQ ID NO: 314909 - DNA, 25 bp, Mus musculus
gctcccgagagagggtcagcctctc

SEQ ID NO: 314910 - DNA, 25 bp, Mus musculus
gctcccgccaaacgccatgagaatt

SEQ ID NO: 314911 - DNA, 25 bp, Mus musculus
gctcccgccagagctcaggccctgg

SEQ ID NO: 314912 - DNA, 25 bp, Mus musculus
gctcccgccagctcaaggtgatgct

SEQ ID NO: 314913 - DNA, 25 bp, Mus musculus
gctcccgccaggagaatggtgccag

SEQ ID NO: 314914 - DNA, 25 bp, Mus musculus
gctcccgcccctggtgtgctaccac

SEQ ID NO: 314915 - DNA, 25 bp, Mus musculus
gctcccgcctcgggttgctgttctg

SEQ ID NO: 314916 - DNA, 25 bp, Mus musculus
gctcccgctaagtcgtcagcgcaga

SEQ ID NO: 314917 - DNA, 25 bp, Mus musculus
gctcccgctagtgttgcagaggttt

SEQ ID NO: 314918 - DNA, 25 bp, Mus musculus
gctcccggaaagtgaattatacttc

SEQ ID NO: 314919 - DNA, 25 bp, Mus musculus
gctcccgggagcagagaagaaagcg

SEQ ID NO: 314920 - DNA, 25 bp, Mus musculus
gctcccgggagcagtgatgaaaaga

SEQ ID NO: 314921 - DNA, 25 bp, Mus musculus
gctcccgggagcggggcagccacag

SEQ ID NO: 314922 - DNA, 25 bp, Mus musculus
gctcccgggagcggtcgagctagag

SEQ ID NO: 314923 - DNA, 25 bp, Mus musculus
gctcccgggccaaggctagccaacg

SEQ ID NO: 314924 - DNA, 25 bp, Mus musculus
gctcccggggcatagccaccccgct

SEQ ID NO: 314925 - DNA, 25 bp, Mus musculus
gctcccgtattaggagacacagaag

SEQ ID NO: 314926 - DNA, 25 bp, Mus musculus
gctcccgtccgaggtacccagactc

SEQ ID NO: 314927 - DNA, 25 bp, Mus musculus
gctcccgtccgaggtgtgaatgaca

SEQ ID NO: 314928 - DNA, 25 bp, Mus musculus
gctcccgtttgagcccggttcctgg

SEQ ID NO: 314929 - DNA, 25 bp, Mus musculus
gctccctaaagttgcagaattaaga

SEQ ID NO: 314930 - DNA, 25 bp, Mus musculus
gctccctactgagtggccacccttt

SEQ ID NO: 314931 - DNA, 25 bp, Mus musculus
gctccctagaagatggattcatggg

SEQ ID NO: 314932 - DNA, 25 bp, Mus musculus
gctccctagaagggcaacaacccgg

SEQ ID NO: 314933 - DNA, 25 bp, Mus musculus
gctccctcaaaccccggcttcttca

SEQ ID NO: 314934 - DNA, 25 bp, Mus musculus
gctccctcaaagatgaacgagaccg

SEQ ID NO: 314935 - DNA, 25 bp, Mus musculus
gctccctcagctgctcctggacttc

SEQ ID NO: 314936 - DNA, 25 bp, Mus musculus
gctccctcaggtataagtattgttt

SEQ ID NO: 314937 - DNA, 25 bp, Mus musculus
gctccctcatccacgaaggttttgc

SEQ ID NO: 314938 - DNA, 25 bp, Mus musculus
gctccctcatccacggtttgtggaa

SEQ ID NO: 314939 - DNA, 25 bp, Mus musculus
gctccctccagactccatctgcgca

SEQ ID NO: 314940 - DNA, 25 bp, Mus musculus
gctccctccagcgccaacgtcacca

SEQ ID NO: 314941 - DNA, 25 bp, Mus musculus
gctccctcccgatgagaagaagcaa

SEQ ID NO: 314942 - DNA, 25 bp, Mus musculus
gctccctcccgggatatttgcttga

SEQ ID NO: 314943 - DNA, 25 bp, Mus musculus
gctccctccgatgtcatatgcctgc

SEQ ID NO: 314944 - DNA, 25 bp, Mus musculus
gctccctctgtcaagggggtgtcgt

SEQ ID NO: 314945 - DNA, 25 bp, Mus musculus
gctccctctgtcaagttaacactca

SEQ ID NO: 314946 - DNA, 25 bp, Mus musculus
gctccctgacagaggatggtttgtt

SEQ ID NO: 314947 - DNA, 25 bp, Mus musculus
gctccctgacagctatattgtcttc

SEQ ID NO: 314948 - DNA, 25 bp, Mus musculus
gctccctgacaggcccgagcctacg

SEQ ID NO: 314949 - DNA, 25 bp, Mus musculus
gctccctgacaggggagagcacccc

SEQ ID NO: 314950 - DNA, 25 bp, Mus musculus
gctccctgaggggtacctcggaatc

SEQ ID NO: 314951 - DNA, 25 bp, Mus musculus
gctccctgagtttgacgactctgac

SEQ ID NO: 314952 - DNA, 25 bp, Mus musculus
gctccctgatcaagatggactgtaa

SEQ ID NO: 314953 - DNA, 25 bp, Mus musculus
gctccctgcacaggggtgacagtcc

SEQ ID NO: 314954 - DNA, 25 bp, Mus musculus
gctccctgcactccccaggacccca

SEQ ID NO: 314955 - DNA, 25 bp, Mus musculus
gctccctgcagggtcccacaaaaca

SEQ ID NO: 314956 - DNA, 25 bp, Mus musculus
gctccctgcatgtacccctcaatgg

SEQ ID NO: 314957 - DNA, 25 bp, Mus musculus
gctccctgctccggcaagacattgc

SEQ ID NO: 314958 - DNA, 25 bp, Mus musculus
gctccctggacccaggctgccctgc

SEQ ID NO: 314959 - DNA, 25 bp, Mus musculus
gctccctgggtgtcactggtgcaga

SEQ ID NO: 314960 - DNA, 25 bp, Mus musculus
gctcccttactcagttcccttacaa

SEQ ID NO: 314961 - DNA, 25 bp, Mus musculus
gctcccttgggaagccggaggaagc

SEQ ID NO: 314962 - DNA, 25 bp, Mus musculus
gctcccttgggaatttagaagccgg

SEQ ID NO: 314963 - DNA, 25 bp, Mus musculus
gctcccttggggttctcacgcggtt

SEQ ID NO: 314964 - DNA, 25 bp, Mus musculus
gctccctttgcgcacaggttacatc

SEQ ID NO: 314965 - DNA, 25 bp, Mus musculus
gctccctttgggttctcaggccgcc

SEQ ID NO: 314966 - DNA, 25 bp, Mus musculus
gctccgaaagcatgtggaattccgg

SEQ ID NO: 314967 - DNA, 25 bp, Mus musculus
gctccgaaatcaggcagaagaggag

SEQ ID NO: 314968 - DNA, 25 bp, Mus musculus
gctccgactcagatcagctcgaacg

SEQ ID NO: 314969 - DNA, 25 bp, Mus musculus
gctccgactcagattctttatacaa

SEQ ID NO: 314970 - DNA, 25 bp, Mus musculus
gctccgactggaaataccagagggg

SEQ ID NO: 314971 - DNA, 25 bp, Mus musculus
gctccgactggagtctccaaaacct

SEQ ID NO: 314972 - DNA, 25 bp, Mus musculus
gctccgagagcaggtctggggatgg

SEQ ID NO: 314973 - DNA, 25 bp, Mus musculus
gctccgagaggagacattccaaatg

SEQ ID NO: 314974 - DNA, 25 bp, Mus musculus
gctccgagaggtagctctggctggc

SEQ ID NO: 314975 - DNA, 25 bp, Mus musculus
gctccgagaggtcctggcccagact

SEQ ID NO: 314976 - DNA, 25 bp, Mus musculus
gctccgagagtgctcccagaggttc

SEQ ID NO: 314977 - DNA, 25 bp, Mus musculus
gctccgagccaggattgaaattcca

SEQ ID NO: 314978 - DNA, 25 bp, Mus musculus
gctccgaggacagagccaccagcca

SEQ ID NO: 314979 - DNA, 25 bp, Mus musculus
gctccgagggcagctactgcaagac

SEQ ID NO: 314980 - DNA, 25 bp, Mus musculus
gctccgagtctggatcatctctgga

SEQ ID NO: 314981 - DNA, 25 bp, Mus musculus
gctccgatccctacgtgaaaagcta

SEQ ID NO: 314982 - DNA, 25 bp, Mus musculus
gctccgatgtgtctgagctgtccag

SEQ ID NO: 314983 - DNA, 25 bp, Mus musculus
gctccgcaaagagaggcagatgaag

SEQ ID NO: 314984 - DNA, 25 bp, Mus musculus
gctccgcaaagccaaatcaaataga

SEQ ID NO: 314985 - DNA, 25 bp, Mus musculus
gctccgcaaggaaaggctcctagaa

SEQ ID NO: 314986 - DNA, 25 bp, Mus musculus
gctccgcagacaagatgccttggat

SEQ ID NO: 314987 - DNA, 25 bp, Mus musculus
gctccgcagacacccgctgtgagcg

SEQ ID NO: 314988 - DNA, 25 bp, Mus musculus
gctccgcagacaccttccgccaaga

SEQ ID NO: 314989 - DNA, 25 bp, Mus musculus
gctccgcagaggtcgcagcgtgagc

SEQ ID NO: 314990 - DNA, 25 bp, Mus musculus
gctccgcagcaagatcgaggagctg

SEQ ID NO: 314991 - DNA, 25 bp, Mus musculus
gctccgcagccagaggagtatctga

SEQ ID NO: 314992 - DNA, 25 bp, Mus musculus
gctccgcagccagaggggctcggtc

SEQ ID NO: 314993 - DNA, 25 bp, Mus musculus
gctccgcagcccgaatcctattcta

SEQ ID NO: 314994 - DNA, 25 bp, Mus musculus
gctccgcagccgaggctcgcgctgt

SEQ ID NO: 314995 - DNA, 25 bp, Mus musculus
gctccgccaccagggccagagcttg

SEQ ID NO: 314996 - DNA, 25 bp, Mus musculus
gctccgccagagggacagtcggccc

SEQ ID NO: 314997 - DNA, 25 bp, Mus musculus
gctccgcccagacggctcagaggtg

SEQ ID NO: 314998 - DNA, 25 bp, Mus musculus
gctccgccgagcacagtgtatgaag

SEQ ID NO: 314999 - DNA, 25 bp, Mus musculus
gctccgccgaggaagaaaatactcg

SEQ ID NO: 315000 - DNA, 25 bp, Mus musculus
gctccgcctacgtggcctataacat

SEQ ID NO: 315001 - DNA, 25 bp, Mus musculus
gctccgcctttggcaactgcgagtg

SEQ ID NO: 315002 - DNA, 25 bp, Mus musculus
gctccgcctttggcactgtagctat

SEQ ID NO: 315003 - DNA, 25 bp, Mus musculus
gctccgcctttggcagtcagaccaa

SEQ ID NO: 315004 - DNA, 25 bp, Mus musculus
gctccgcgagccgcgaagccaaaaa

SEQ ID NO: 315005 - DNA, 25 bp, Mus musculus
gctccgcgagccgctggtgcacggc

SEQ ID NO: 315006 - DNA, 25 bp, Mus musculus
gctccgcgccgagaatcaagaactt

SEQ ID NO: 315007 - DNA, 25 bp, Mus musculus
gctccgcgccgagattaaaagaaag

SEQ ID NO: 315008 - DNA, 25 bp, Mus musculus
gctccgcgggctgaggaaatataag

SEQ ID NO: 315009 - DNA, 25 bp, Mus musculus
gctccgcgggctggccctccaagac

SEQ ID NO: 315010 - DNA, 25 bp, Mus musculus
gctccgcgtgagaatcaaatacctg

SEQ ID NO: 315011 - DNA, 25 bp, Mus musculus
gctccgctagccaacatgagtctgt

SEQ ID NO: 315012 - DNA, 25 bp, Mus musculus
gctccgctcacgaaaggcaagctga

SEQ ID NO: 315013 - DNA, 25 bp, Mus musculus
gctccgctcacgtgctacctgtcct

SEQ ID NO: 315014 - DNA, 25 bp, Mus musculus
gctccggaaaatccactgtgggtgc

SEQ ID NO: 315015 - DNA, 25 bp, Mus musculus
gctccggaaactgctccccagggtc

SEQ ID NO: 315016 - DNA, 25 bp, Mus musculus
gctccggaaagggctctatcacgga

SEQ ID NO: 315017 - DNA, 25 bp, Mus musculus
gctccggacagaccatggcaacgta

SEQ ID NO: 315018 - DNA, 25 bp, Mus musculus
gctccggacaggatgcatttgctta

SEQ ID NO: 315019 - DNA, 25 bp, Mus musculus
gctccggacagtttccttttagacc

SEQ ID NO: 315020 - DNA, 25 bp, Mus musculus
gctccggagatcacagctgcacgag

SEQ ID NO: 315021 - DNA, 25 bp, Mus musculus
gctccggagatcattataggtaaaa

SEQ ID NO: 315022 - DNA, 25 bp, Mus musculus
gctccggaggaaagccatcatgtta

SEQ ID NO: 315023 - DNA, 25 bp, Mus musculus
gctccggaggaaaggatttctccat

SEQ ID NO: 315024 - DNA, 25 bp, Mus musculus
gctccggcaaatcagccacacagag

SEQ ID NO: 315025 - DNA, 25 bp, Mus musculus
gctccggcaaattaggtctgacttt

SEQ ID NO: 315026 - DNA, 25 bp, Mus musculus
gctccggcagggaagcccagccctg

SEQ ID NO: 315027 - DNA, 25 bp, Mus musculus
gctccggccttaatgggcaacgtgg

SEQ ID NO: 315028 - DNA, 25 bp, Mus musculus
gctccggcggccgctacaaggtggg

SEQ ID NO: 315029 - DNA, 25 bp, Mus musculus
gctccggcgggcggcctcattgctc

SEQ ID NO: 315030 - DNA, 25 bp, Mus musculus
gctccggcgggcggtggtacaggat

SEQ ID NO: 315031 - DNA, 25 bp, Mus musculus
gctccgggagaaggatcagtggtga

SEQ ID NO: 315032 - DNA, 25 bp, Mus musculus
gctccgggccagagcctgagccttt

SEQ ID NO: 315033 - DNA, 25 bp, Mus musculus
gctccgggctgagtcaagtccatca

SEQ ID NO: 315034 - DNA, 25 bp, Mus musculus
gctccgggtgtgaagggtgagagtg

SEQ ID NO: 315035 - DNA, 25 bp, Mus musculus
gctccggtcactatgagtgaaacat

SEQ ID NO: 315036 - DNA, 25 bp, Mus musculus
gctccggtcactatggtgataaagt

SEQ ID NO: 315037 - DNA, 25 bp, Mus musculus
gctccgtatagaggaagcccagccc

SEQ ID NO: 315038 - DNA, 25 bp, Mus musculus
gctccgtattataaccacagtggaa

SEQ ID NO: 315039 - DNA, 25 bp, Mus musculus
gctccgtattataacctcatcgtgt

SEQ ID NO: 315040 - DNA, 25 bp, Mus musculus
gctccgtcaagaatccggagatcgt

SEQ ID NO: 315041 - DNA, 25 bp, Mus musculus
gctccgtcaagcccccggaagcctc

SEQ ID NO: 315042 - DNA, 25 bp, Mus musculus
gctccgtcaaggtgtcggacgacac

SEQ ID NO: 315043 - DNA, 25 bp, Mus musculus
gctccgtcctggatactccatgttt

SEQ ID NO: 315044 - DNA, 25 bp, Mus musculus
gctccgtgcccgagtttcaggtgcc

SEQ ID NO: 315045 - DNA, 25 bp, Mus musculus
gctccgtggagggtacactagctca

SEQ ID NO: 315046 - DNA, 25 bp, Mus musculus
gctccgtttggggcggcaacctttg

SEQ ID NO: 315047 - DNA, 25 bp, Mus musculus
gctccgtttggggctacgccttcta

SEQ ID NO: 315048 - DNA, 25 bp, Mus musculus
gctcctaaactttccacatctacat

SEQ ID NO: 315049 - DNA, 25 bp, Mus musculus
gctcctaaccgcgttggctctccca

SEQ ID NO: 315050 - DNA, 25 bp, Mus musculus
gctcctaacttatctacactgaccc

SEQ ID NO: 315051 - DNA, 25 bp, Mus musculus
gctcctaccactgacaaagtctccc

SEQ ID NO: 315052 - DNA, 25 bp, Mus musculus
gctcctacctgaagagcaccaagct

SEQ ID NO: 315053 - DNA, 25 bp, Mus musculus
gctcctactggaaggtacccagggc

SEQ ID NO: 315054 - DNA, 25 bp, Mus musculus
gctcctaggggtggcgaccgtgctg

SEQ ID NO: 315055 - DNA, 25 bp, Mus musculus
gctcctaggtgcaggcagtctaaag

SEQ ID NO: 315056 - DNA, 25 bp, Mus musculus
gctcctatatcatagcaagaggagg

SEQ ID NO: 315057 - DNA, 25 bp, Mus musculus
gctcctattcaggccatgtggctgg

SEQ ID NO: 315058 - DNA, 25 bp, Mus musculus
gctcctatttgtgggattgttcatc

SEQ ID NO: 315059 - DNA, 25 bp, Mus musculus
gctcctcacaagcagaaacacctgg

SEQ ID NO: 315060 - DNA, 25 bp, Mus musculus
gctcctcacaagcagtctttcacag

SEQ ID NO: 315061 - DNA, 25 bp, Mus musculus
gctcctcaccgcagcacccccactg

SEQ ID NO: 315062 - DNA, 25 bp, Mus musculus
gctcctcaccggaacaaggagccca

SEQ ID NO: 315063 - DNA, 25 bp, Mus musculus
gctcctcacctgcctgcagcaacaa

SEQ ID NO: 315064 - DNA, 25 bp, Mus musculus
gctcctcactccagccggatgtatg

SEQ ID NO: 315065 - DNA, 25 bp, Mus musculus
gctcctcagccatgagaaaacaaga

SEQ ID NO: 315066 - DNA, 25 bp, Mus musculus
gctcctcagccctaaagaaccacca

SEQ ID NO: 315067 - DNA, 25 bp, Mus musculus
gctcctccacaggctctggtcaggg

SEQ ID NO: 315068 - DNA, 25 bp, Mus musculus
gctcctccagagctcccagacctct

SEQ ID NO: 315069 - DNA, 25 bp, Mus musculus
gctcctccagatgtcaacttgtgga

SEQ ID NO: 315070 - DNA, 25 bp, Mus musculus
gctcctccagcaggcttgtgacatc

SEQ ID NO: 315071 - DNA, 25 bp, Mus musculus
gctcctccagcagtgggtttttctt

SEQ ID NO: 315072 - DNA, 25 bp, Mus musculus
gctcctccagggtccggtactggga

SEQ ID NO: 315073 - DNA, 25 bp, Mus musculus
gctcctccaggtgtttgtggtagcc

SEQ ID NO: 315074 - DNA, 25 bp, Mus musculus
gctcctccatcttggcatgtgctcc

SEQ ID NO: 315075 - DNA, 25 bp, Mus musculus
gctcctccgacgtggtgacgtatgc

SEQ ID NO: 315076 - DNA, 25 bp, Mus musculus
gctcctccggcactttgacacagac

SEQ ID NO: 315077 - DNA, 25 bp, Mus musculus
gctcctccggtacaaggttctgctg

SEQ ID NO: 315078 - DNA, 25 bp, Mus musculus
gctcctcctctcggtacttctccat

SEQ ID NO: 315079 - DNA, 25 bp, Mus musculus
gctcctcgagggcataacctgggtc

SEQ ID NO: 315080 - DNA, 25 bp, Mus musculus
gctcctcggaagaggagaaggggac

SEQ ID NO: 315081 - DNA, 25 bp, Mus musculus
gctcctcggaagcactgctacagga

SEQ ID NO: 315082 - DNA, 25 bp, Mus musculus
gctcctcggaagcatctcctctggc

SEQ ID NO: 315083 - DNA, 25 bp, Mus musculus
gctcctcgtgtgcggattcctttgt

SEQ ID NO: 315084 - DNA, 25 bp, Mus musculus
gctcctcgtgtgcggtgcacgatct

SEQ ID NO: 315085 - DNA, 25 bp, Mus musculus
gctcctctagaggctgtggggtggg

SEQ ID NO: 315086 - DNA, 25 bp, Mus musculus
gctcctctcaggccgcctctagacg

SEQ ID NO: 315087 - DNA, 25 bp, Mus musculus
gctcctctcaggccgggttcgagtg

SEQ ID NO: 315088 - DNA, 25 bp, Mus musculus
gctcctctcaggccggtgacgctga

SEQ ID NO: 315089 - DNA, 25 bp, Mus musculus
gctcctctcttagactatcccccga

SEQ ID NO: 315090 - DNA, 25 bp, Mus musculus
gctcctctcttggtcaaactacaac

SEQ ID NO: 315091 - DNA, 25 bp, Mus musculus
gctcctctgatgaccacggctcctt

SEQ ID NO: 315092 - DNA, 25 bp, Mus musculus
gctcctctggaaagacccccctttg

SEQ ID NO: 315093 - DNA, 25 bp, Mus musculus
gctcctctggcatgaacctctcagg

SEQ ID NO: 315094 - DNA, 25 bp, Mus musculus
gctcctctggggcttagtccttggc

SEQ ID NO: 315095 - DNA, 25 bp, Mus musculus
gctcctcttctctggggcctggaat

SEQ ID NO: 315096 - DNA, 25 bp, Mus musculus
gctcctcttctgcagaactgggagt

SEQ ID NO: 315097 - DNA, 25 bp, Mus musculus
gctcctcttctgcagtctacctgtg

SEQ ID NO: 315098 - DNA, 25 bp, Mus musculus
gctcctcttgagaatattctccttc

SEQ ID NO: 315099 - DNA, 25 bp, Mus musculus
gctcctcttgagcattgcgccagcc

SEQ ID NO: 315100 - DNA, 25 bp, Mus musculus
gctcctctttaccagtaaccaggtg

SEQ ID NO: 315101 - DNA, 25 bp, Mus musculus
gctcctgaaccagctggtccctgag

SEQ ID NO: 315102 - DNA, 25 bp, Mus musculus
gctcctgaagacccagggggcaagc

SEQ ID NO: 315103 - DNA, 25 bp, Mus musculus
gctcctgaaggaagaagaactgaag

SEQ ID NO: 315104 - DNA, 25 bp, Mus musculus
gctcctgaatgtacccctctagacg

SEQ ID NO: 315105 - DNA, 25 bp, Mus musculus
gctcctgagcagggacctgaggtgc

SEQ ID NO: 315106 - DNA, 25 bp, Mus musculus
gctcctgagcaggtcttgggaccca

SEQ ID NO: 315107 - DNA, 25 bp, Mus musculus
gctcctgagccaggttgatgtagga

SEQ ID NO: 315108 - DNA, 25 bp, Mus musculus
gctcctgagcccggctgtgctggat

SEQ ID NO: 315109 - DNA, 25 bp, Mus musculus
gctcctgatgaagaccctcttgtga

SEQ ID NO: 315110 - DNA, 25 bp, Mus musculus
gctcctgatgaaggactatgtgctg

SEQ ID NO: 315111 - DNA, 25 bp, Mus musculus
gctcctgatgcaccagattgtacaa

SEQ ID NO: 315112 - DNA, 25 bp, Mus musculus
gctcctgatgcgggagcacagtcgg

SEQ ID NO: 315113 - DNA, 25 bp, Mus musculus
gctcctgatggtgcctgatggcttc

SEQ ID NO: 315114 - DNA, 25 bp, Mus musculus
gctcctgatgtcactggtctccatg

SEQ ID NO: 315115 - DNA, 25 bp, Mus musculus
gctcctgcacagattgcgctggctc

SEQ ID NO: 315116 - DNA, 25 bp, Mus musculus
gctcctgcagcaaagccaccatgcc

SEQ ID NO: 315117 - DNA, 25 bp, Mus musculus
gctcctgcagcaaaggccgatacaa

SEQ ID NO: 315118 - DNA, 25 bp, Mus musculus
gctcctgcagccggatgtatggaat

SEQ ID NO: 315119 - DNA, 25 bp, Mus musculus
gctcctgcaggagggctgctggcct

SEQ ID NO: 315120 - DNA, 25 bp, Mus musculus
gctcctgcaggtggaagcacttcag

SEQ ID NO: 315121 - DNA, 25 bp, Mus musculus
gctcctgcatttggggttcctgctg

SEQ ID NO: 315122 - DNA, 25 bp, Mus musculus
gctcctgccaatgggaagctcctgg

SEQ ID NO: 315123 - DNA, 25 bp, Mus musculus
gctcctgcctacaggttaggccggg

SEQ ID NO: 315124 - DNA, 25 bp, Mus musculus
gctcctgccttgatgacagggtccc

SEQ ID NO: 315125 - DNA, 25 bp, Mus musculus
gctcctgcgcgcgcccggcctggcc

SEQ ID NO: 315126 - DNA, 25 bp, Mus musculus
gctcctgcggcaaggggacatgctt

SEQ ID NO: 315127 - DNA, 25 bp, Mus musculus
gctcctgcgggcggcatcgctgtcc

SEQ ID NO: 315128 - DNA, 25 bp, Mus musculus
gctcctgctctgctctgcctcggca

SEQ ID NO: 315129 - DNA, 25 bp, Mus musculus
gctcctgcttccggtgttccgaatg

SEQ ID NO: 315130 - DNA, 25 bp, Mus musculus
gctcctggaacaggaacgttggcgg

SEQ ID NO: 315131 - DNA, 25 bp, Mus musculus
gctcctggaactatgtcttcagtac

SEQ ID NO: 315132 - DNA, 25 bp, Mus musculus
gctcctggaactgaataaaagctgt

SEQ ID NO: 315133 - DNA, 25 bp, Mus musculus
gctcctggaactgtgttacatcctg

SEQ ID NO: 315134 - DNA, 25 bp, Mus musculus
gctcctggaatcagcagccagtgag

SEQ ID NO: 315135 - DNA, 25 bp, Mus musculus
gctcctggagcaagaaaagcagaga

SEQ ID NO: 315136 - DNA, 25 bp, Mus musculus
gctcctggagcagcctgactctgac

SEQ ID NO: 315137 - DNA, 25 bp, Mus musculus
gctcctggaggctttggaaatgtac

SEQ ID NO: 315138 - DNA, 25 bp, Mus musculus
gctcctggatgaaaggtcgagattt

SEQ ID NO: 315139 - DNA, 25 bp, Mus musculus
gctcctggcaggaaggcctgcgctt

SEQ ID NO: 315140 - DNA, 25 bp, Mus musculus
gctcctggcatggtacttttctcac

SEQ ID NO: 315141 - DNA, 25 bp, Mus musculus
gctcctggcggaggccatgaagctg

SEQ ID NO: 315142 - DNA, 25 bp, Mus musculus
gctcctggctgttggagacaggagc

SEQ ID NO: 315143 - DNA, 25 bp, Mus musculus
gctcctgggatcctataaatttgaa

SEQ ID NO: 315144 - DNA, 25 bp, Mus musculus
gctcctggggctgcgccggagcgca

SEQ ID NO: 315145 - DNA, 25 bp, Mus musculus
gctcctggtacagtgacagctctta

SEQ ID NO: 315146 - DNA, 25 bp, Mus musculus
gctcctggtctcaggaatctatgaa

SEQ ID NO: 315147 - DNA, 25 bp, Mus musculus
gctcctggtctcaggtaatctccaa

SEQ ID NO: 315148 - DNA, 25 bp, Mus musculus
gctcctggtctgagaggtcttcctg

SEQ ID NO: 315149 - DNA, 25 bp, Mus musculus
gctcctggtgccaagggcgaagctg

SEQ ID NO: 315150 - DNA, 25 bp, Mus musculus
gctcctgtacaggttggcggacctc

SEQ ID NO: 315151 - DNA, 25 bp, Mus musculus
gctcctgtcggcatggcagcccacc

SEQ ID NO: 315152 - DNA, 25 bp, Mus musculus
gctcctgtgctagtttcgcatttgg

SEQ ID NO: 315153 - DNA, 25 bp, Mus musculus
gctcctgtgtagtgtgaaacagaag

SEQ ID NO: 315154 - DNA, 25 bp, Mus musculus
gctcctgtgtatgctacaggagggg

SEQ ID NO: 315155 - DNA, 25 bp, Mus musculus
gctccttaccaggagatcgagactc

SEQ ID NO: 315156 - DNA, 25 bp, Mus musculus
gctccttacttcagaggagctggct

SEQ ID NO: 315157 - DNA, 25 bp, Mus musculus
gctccttacttcagtacaggtcaag

SEQ ID NO: 315158 - DNA, 25 bp, Mus musculus
gctccttatcccactctgcccgacc

SEQ ID NO: 315159 - DNA, 25 bp, Mus musculus
gctccttcacccgggaggaagctga

SEQ ID NO: 315160 - DNA, 25 bp, Mus musculus
gctccttcccgggcttttcgcagtg

SEQ ID NO: 315161 - DNA, 25 bp, Mus musculus
gctccttccctgagcatagtaacat

SEQ ID NO: 315162 - DNA, 25 bp, Mus musculus
gctccttcctgttggcaaccgtgtc

SEQ ID NO: 315163 - DNA, 25 bp, Mus musculus
gctccttcctgttgggcatctccta

SEQ ID NO: 315164 - DNA, 25 bp, Mus musculus
gctccttctacagagccttggggat

SEQ ID NO: 315165 - DNA, 25 bp, Mus musculus
gctccttctacagtgctcctttgtc

SEQ ID NO: 315166 - DNA, 25 bp, Mus musculus
gctccttctagtggcagacctgttg

SEQ ID NO: 315167 - DNA, 25 bp, Mus musculus
gctccttctgtaggtgtgctgatga

SEQ ID NO: 315168 - DNA, 25 bp, Mus musculus
gctccttgaaagacctgcctggagt

SEQ ID NO: 315169 - DNA, 25 bp, Mus musculus
gctccttgaatacctctgcaggtgt

SEQ ID NO: 315170 - DNA, 25 bp, Mus musculus
gctccttgataagctcgttggcgag

SEQ ID NO: 315171 - DNA, 25 bp, Mus musculus
gctccttgatctcagatctgcagac

SEQ ID NO: 315172 - DNA, 25 bp, Mus musculus
gctccttgatctcaggtgattactg

SEQ ID NO: 315173 - DNA, 25 bp, Mus musculus
gctccttgcagatttctaacgagcg

SEQ ID NO: 315174 - DNA, 25 bp, Mus musculus
gctcctttctgccagggacatgaaa

SEQ ID NO: 315175 - DNA, 25 bp, Mus musculus
gctcctttgcagactttgatcctca

SEQ ID NO: 315176 - DNA, 25 bp, Mus musculus
gctcctttgcagagcctgaccagac

SEQ ID NO: 315177 - DNA, 25 bp, Mus musculus
gctcctttgcagccacagacagtaa

SEQ ID NO: 315178 - DNA, 25 bp, Mus musculus
gctcctttggtgccacaagccccgc

SEQ ID NO: 315179 - DNA, 25 bp, Mus musculus
gctcgaaaaaacatgcagagatctc

SEQ ID NO: 315180 - DNA, 25 bp, Mus musculus
gctcgaaaactccaggatgtgtttg

SEQ ID NO: 315181 - DNA, 25 bp, Mus musculus
gctcgaaaatggggtccaagggtag

SEQ ID NO: 315182 - DNA, 25 bp, Mus musculus
gctcgaaacagatcagccagcatta

SEQ ID NO: 315183 - DNA, 25 bp, Mus musculus
gctcgaaacagtagtttagtatgat

SEQ ID NO: 315184 - DNA, 25 bp, Mus musculus
gctcgaaactgcatgttgcgggatg

SEQ ID NO: 315185 - DNA, 25 bp, Mus musculus
gctcgaaagtccaaggtgccccgag

SEQ ID NO: 315186 - DNA, 25 bp, Mus musculus
gctcgaaatgggaaccctaatgggg

SEQ ID NO: 315187 - DNA, 25 bp, Mus musculus
gctcgaacagacaagcctttgagga

SEQ ID NO: 315188 - DNA, 25 bp, Mus musculus
gctcgaacagacaagggtgtgtctg

SEQ ID NO: 315189 - DNA, 25 bp, Mus musculus
gctcgaacggccaggtgtcgtgatt

SEQ ID NO: 315190 - DNA, 25 bp, Mus musculus
gctcgaagcagaatcagagaagctg

SEQ ID NO: 315191 - DNA, 25 bp, Mus musculus
gctcgaagtcgctaggacttctctc

SEQ ID NO: 315192 - DNA, 25 bp, Mus musculus
gctcgaatttaagcgtctagccagc

SEQ ID NO: 315193 - DNA, 25 bp, Mus musculus
gctcgacaaagcatagtaacattcc

SEQ ID NO: 315194 - DNA, 25 bp, Mus musculus
gctcgacatggagatgagtgtgaat

SEQ ID NO: 315195 - DNA, 25 bp, Mus musculus
gctcgacatggaggaccctctgtca

SEQ ID NO: 315196 - DNA, 25 bp, Mus musculus
gctcgactgtgcccggaatcccagt

SEQ ID NO: 315197 - DNA, 25 bp, Mus musculus
gctcgacttctgcagctaatgggaa

SEQ ID NO: 315198 - DNA, 25 bp, Mus musculus
gctcgagaagggcagttatacgacg

SEQ ID NO: 315199 - DNA, 25 bp, Mus musculus
gctcgagaagtctgatcagcggata

SEQ ID NO: 315200 - DNA, 25 bp, Mus musculus
gctcgagactcaaggtcaacatggc

SEQ ID NO: 315201 - DNA, 25 bp, Mus musculus
gctcgagactcaagtttagctgtta

SEQ ID NO: 315202 - DNA, 25 bp, Mus musculus
gctcgagcagagtccgtctcccagg

SEQ ID NO: 315203 - DNA, 25 bp, Mus musculus
gctcgagcaggacttccaatagtag

SEQ ID NO: 315204 - DNA, 25 bp, Mus musculus
gctcgagcaggttaggagaaggaca

SEQ ID NO: 315205 - DNA, 25 bp, Mus musculus
gctcgagccagacagattccctcct

SEQ ID NO: 315206 - DNA, 25 bp, Mus musculus
gctcgagcccgctgcctgtgcctat

SEQ ID NO: 315207 - DNA, 25 bp, Mus musculus
gctcgagcccggggactttgtgcag

SEQ ID NO: 315208 - DNA, 25 bp, Mus musculus
gctcgagcccggtacctgggccagc

SEQ ID NO: 315209 - DNA, 25 bp, Mus musculus
gctcgaggagtgcatgggtacagag

SEQ ID NO: 315210 - DNA, 25 bp, Mus musculus
gctcgaggtgccccgggtgaacgcg

SEQ ID NO: 315211 - DNA, 25 bp, Mus musculus
gctcgagtcaccgtttgccatctct

SEQ ID NO: 315212 - DNA, 25 bp, Mus musculus
gctcgagtgatcatgtgcctctcct

SEQ ID NO: 315213 - DNA, 25 bp, Mus musculus
gctcgagttgctccttcctctccac

SEQ ID NO: 315214 - DNA, 25 bp, Mus musculus
gctcgatgcggccaaagagatgtca

SEQ ID NO: 315215 - DNA, 25 bp, Mus musculus
gctcgatgcgggtggtaggaatgta

SEQ ID NO: 315216 - DNA, 25 bp, Mus musculus
gctcgatgcgttcacaatcttctac

SEQ ID NO: 315217 - DNA, 25 bp, Mus musculus
gctcgatggcatcaagttcatgggc

SEQ ID NO: 315218 - DNA, 25 bp, Mus musculus
gctcgcaaaggctggcaaaacccac

SEQ ID NO: 315219 - DNA, 25 bp, Mus musculus
gctcgcaacgaggagactccagaac

SEQ ID NO: 315220 - DNA, 25 bp, Mus musculus
gctcgcaagctgcaggctgcactga

SEQ ID NO: 315221 - DNA, 25 bp, Mus musculus
gctcgcaagctgcgggtgcagcagg

SEQ ID NO: 315222 - DNA, 25 bp, Mus musculus
gctcgcacaccgagatatgaggatc

SEQ ID NO: 315223 - DNA, 25 bp, Mus musculus
gctcgcacacggcctctgtgctcga

SEQ ID NO: 315224 - DNA, 25 bp, Mus musculus
gctcgcacacggcctggaggtgtga

SEQ ID NO: 315225 - DNA, 25 bp, Mus musculus
gctcgcacacgggggacgccccctt

SEQ ID NO: 315226 - DNA, 25 bp, Mus musculus
gctcgcacaggctaggtatgacgga

SEQ ID NO: 315227 - DNA, 25 bp, Mus musculus
gctcgcacagtgatgatgtgctgac

SEQ ID NO: 315228 - DNA, 25 bp, Mus musculus
gctcgcacagtgggctgttggtgct

SEQ ID NO: 315229 - DNA, 25 bp, Mus musculus
gctcgcacagtggtttcaagtgccc

SEQ ID NO: 315230 - DNA, 25 bp, Mus musculus
gctcgcagaggcaggggtagagcca

SEQ ID NO: 315231 - DNA, 25 bp, Mus musculus
gctcgcagctagcaggtgccttcca

SEQ ID NO: 315232 - DNA, 25 bp, Mus musculus
gctcgcagtgcttagagaacgatgt

SEQ ID NO: 315233 - DNA, 25 bp, Mus musculus
gctcgcagtgcttagctcttctgtc

SEQ ID NO: 315234 - DNA, 25 bp, Mus musculus
gctcgcagttcaaggagatgccaga

SEQ ID NO: 315235 - DNA, 25 bp, Mus musculus
gctcgcataggcagttctcccagat

SEQ ID NO: 315236 - DNA, 25 bp, Mus musculus
gctcgccaaggctggctggctactc

SEQ ID NO: 315237 - DNA, 25 bp, Mus musculus
gctcgccaggctggaacgctttagc

SEQ ID NO: 315238 - DNA, 25 bp, Mus musculus
gctcgccagggaagtctactgaccc

SEQ ID NO: 315239 - DNA, 25 bp, Mus musculus
gctcgccagggtggctgtctgccca

SEQ ID NO: 315240 - DNA, 25 bp, Mus musculus
gctcgcccaacttcatcaagccagg

SEQ ID NO: 315241 - DNA, 25 bp, Mus musculus
gctcgccccagaggtcacccggcct

SEQ ID NO: 315242 - DNA, 25 bp, Mus musculus
gctcgccccagaggtgacccttacc

SEQ ID NO: 315243 - DNA, 25 bp, Mus musculus
gctcgccccgagagactgaattccc

SEQ ID NO: 315244 - DNA, 25 bp, Mus musculus
gctcgccctgccgggagccctgcag

SEQ ID NO: 315245 - DNA, 25 bp, Mus musculus
gctcgccgagggcataacctgggtc

SEQ ID NO: 315246 - DNA, 25 bp, Mus musculus
gctcgccgggggaagagtacacacg

SEQ ID NO: 315247 - DNA, 25 bp, Mus musculus
gctcgccgtggggctgcagcagcct

SEQ ID NO: 315248 - DNA, 25 bp, Mus musculus
gctcgcctaccctgggagtttttcg

SEQ ID NO: 315249 - DNA, 25 bp, Mus musculus
gctcgcctcagagtgtgttcagttc

SEQ ID NO: 315250 - DNA, 25 bp, Mus musculus
gctcgcctcagagttccctggcagc

SEQ ID NO: 315251 - DNA, 25 bp, Mus musculus
gctcgcctgcaaggttcctgctgct

SEQ ID NO: 315252 - DNA, 25 bp, Mus musculus
gctcgcctgcaagtgtctcacttta

SEQ ID NO: 315253 - DNA, 25 bp, Mus musculus
gctcgccttgccttctctcaaactc

SEQ ID NO: 315254 - DNA, 25 bp, Mus musculus
gctcgcgaaccttgcccatggcgaa

SEQ ID NO: 315255 - DNA, 25 bp, Mus musculus
gctcgcgaaccttgggaattcgaca

SEQ ID NO: 315256 - DNA, 25 bp, Mus musculus
gctcgcgctgacgcagtatgagatg

SEQ ID NO: 315257 - DNA, 25 bp, Mus musculus
gctcgcgctgggtgcatgtaccaag

SEQ ID NO: 315258 - DNA, 25 bp, Mus musculus
gctcgcgctgtatttcagggtgcat

SEQ ID NO: 315259 - DNA, 25 bp, Mus musculus
gctcgcggccgagggtacttgtgga

SEQ ID NO: 315260 - DNA, 25 bp, Mus musculus
gctcgcggcgagggtggtcctggac

SEQ ID NO: 315261 - DNA, 25 bp, Mus musculus
gctcgcggcgaggtaattgaagata

SEQ ID NO: 315262 - DNA, 25 bp, Mus musculus
gctcgcggcggatagaaggacaagg

SEQ ID NO: 315263 - DNA, 25 bp, Mus musculus
gctcgcggcgggtaccttaacatgg

SEQ ID NO: 315264 - DNA, 25 bp, Mus musculus
gctcgctaagccacactcattctcc

SEQ ID NO: 315265 - DNA, 25 bp, Mus musculus
gctcgctaagccggctgccctttct

SEQ ID NO: 315266 - DNA, 25 bp, Mus musculus
gctcgctacgaggtgtgggctcacc

SEQ ID NO: 315267 - DNA, 25 bp, Mus musculus
gctcgctactacaagaaacatggca

SEQ ID NO: 315268 - DNA, 25 bp, Mus musculus
gctcggaaacgaatacctccacggg

SEQ ID NO: 315269 - DNA, 25 bp, Mus musculus
gctcggaactgtgtcgtgattaaat

SEQ ID NO: 315270 - DNA, 25 bp, Mus musculus
gctcggaatgatgagagccagctct

SEQ ID NO: 315271 - DNA, 25 bp, Mus musculus
gctcggaatgatgagctctcccctg

SEQ ID NO: 315272 - DNA, 25 bp, Mus musculus
gctcggaatgggaaccctaatggca

SEQ ID NO: 315273 - DNA, 25 bp, Mus musculus
gctcggaatgggaaccctaatgggg

SEQ ID NO: 315274 - DNA, 25 bp, Mus musculus
gctcggactcgagaggtcactggat

SEQ ID NO: 315275 - DNA, 25 bp, Mus musculus
gctcggactcgagagttacaggtca

SEQ ID NO: 315276 - DNA, 25 bp, Mus musculus
gctcggagatcgcttttgtggctac

SEQ ID NO: 315277 - DNA, 25 bp, Mus musculus
gctcggagatcgtatacttgaaggc

SEQ ID NO: 315278 - DNA, 25 bp, Mus musculus
gctcggagatggaggctcagctgtc

SEQ ID NO: 315279 - DNA, 25 bp, Mus musculus
gctcggagcaggctcaggccatcca

SEQ ID NO: 315280 - DNA, 25 bp, Mus musculus
gctcggaggacaggtcaatggccaa

SEQ ID NO: 315281 - DNA, 25 bp, Mus musculus
gctcggatgccagatgttgcatgtg

SEQ ID NO: 315282 - DNA, 25 bp, Mus musculus
gctcggatgtggataaaaatatcca

SEQ ID NO: 315283 - DNA, 25 bp, Mus musculus
gctcggatgtggatgcaaatgaaaa

SEQ ID NO: 315284 - DNA, 25 bp, Mus musculus
gctcggccacctccggggccaagat

SEQ ID NO: 315285 - DNA, 25 bp, Mus musculus
gctcggccagagaggccggggcccg

SEQ ID NO: 315286 - DNA, 25 bp, Mus musculus
gctcggcccaggataagtacggttt

SEQ ID NO: 315287 - DNA, 25 bp, Mus musculus
gctcggcccagggctcccagtttgt

SEQ ID NO: 315288 - DNA, 25 bp, Mus musculus
gctcggcctggtgtctccaaacaaa

SEQ ID NO: 315289 - DNA, 25 bp, Mus musculus
gctcggccttccagttttacctgct

SEQ ID NO: 315290 - DNA, 25 bp, Mus musculus
gctcggcgccaaagctgatggtgag

SEQ ID NO: 315291 - DNA, 25 bp, Mus musculus
gctcggcgccctggaagaccagagc

SEQ ID NO: 315292 - DNA, 25 bp, Mus musculus
gctcggcggcagcaggcaaggagat

SEQ ID NO: 315293 - DNA, 25 bp, Mus musculus
gctcggcggcagcaggcattaaaaa

SEQ ID NO: 315294 - DNA, 25 bp, Mus musculus
gctcggcgtcgccggcagctgcagc

SEQ ID NO: 315295 - DNA, 25 bp, Mus musculus
gctcggctcacggatgatgactctt

SEQ ID NO: 315296 - DNA, 25 bp, Mus musculus
gctcggctgcagggtaagaccagct

SEQ ID NO: 315297 - DNA, 25 bp, Mus musculus
gctcggctgcgcagctgcccctgtc

SEQ ID NO: 315298 - DNA, 25 bp, Mus musculus
gctcggctgcgcaggaaagtgccca

SEQ ID NO: 315299 - DNA, 25 bp, Mus musculus
gctcggcttcagagcactaaagcga

SEQ ID NO: 315300 - DNA, 25 bp, Mus musculus
gctcggcttcagctggaaaggcatc

SEQ ID NO: 315301 - DNA, 25 bp, Mus musculus
gctcggcttcaggtgaagctgagga

SEQ ID NO: 315302 - DNA, 25 bp, Mus musculus
gctcggcttcctgagatgaagaaac

SEQ ID NO: 315303 - DNA, 25 bp, Mus musculus
gctcgggaaaagttagctttatacg

SEQ ID NO: 315304 - DNA, 25 bp, Mus musculus
gctcgggaaagccatgtggagattg

SEQ ID NO: 315305 - DNA, 25 bp, Mus musculus
gctcgggaaggctcctcgccgtctt

SEQ ID NO: 315306 - DNA, 25 bp, Mus musculus
gctcgggaaggcttttgacccgctg

SEQ ID NO: 315307 - DNA, 25 bp, Mus musculus
gctcgggacggagatgaaaccagac

SEQ ID NO: 315308 - DNA, 25 bp, Mus musculus
gctcgggacggttcagtgtatcttt

SEQ ID NO: 315309 - DNA, 25 bp, Mus musculus
gctcgggcagctgtgtgcctgcttt

SEQ ID NO: 315310 - DNA, 25 bp, Mus musculus
gctcgggcatggaaactatcaatac

SEQ ID NO: 315311 - DNA, 25 bp, Mus musculus
gctcgggcggggaccggagctgatc

SEQ ID NO: 315312 - DNA, 25 bp, Mus musculus
gctcgggctcagtggatgagaccct

SEQ ID NO: 315313 - DNA, 25 bp, Mus musculus
gctcgggctcagtggttgttgacct

SEQ ID NO: 315314 - DNA, 25 bp, Mus musculus
gctcgggctgcagatttattgccaa

SEQ ID NO: 315315 - DNA, 25 bp, Mus musculus
gctcgggctgttgacagctagaata

SEQ ID NO: 315316 - DNA, 25 bp, Mus musculus
gctcggggacaacaccagcgactgc

SEQ ID NO: 315317 - DNA, 25 bp, Mus musculus
gctcggggcggtaggaaatcagtct

SEQ ID NO: 315318 - DNA, 25 bp, Mus musculus
gctcggtacaggttgtaagttctac

SEQ ID NO: 315319 - DNA, 25 bp, Mus musculus
gctcggtcaagggggagtgcagaag

SEQ ID NO: 315320 - DNA, 25 bp, Mus musculus
gctcggtctggtttatctccggcat

SEQ ID NO: 315321 - DNA, 25 bp, Mus musculus
gctcggtgagttgcaggatccagca

SEQ ID NO: 315322 - DNA, 25 bp, Mus musculus
gctcggtggaagagggtcagggctg

SEQ ID NO: 315323 - DNA, 25 bp, Mus musculus
gctcggtgggacagaaactcatcat

SEQ ID NO: 315324 - DNA, 25 bp, Mus musculus
gctcggtgggacagctgggaacact

SEQ ID NO: 315325 - DNA, 25 bp, Mus musculus
gctcggtgtgtcccttagaagattt

SEQ ID NO: 315326 - DNA, 25 bp, Mus musculus
gctcggtgtgtgctgcttttgatac

SEQ ID NO: 315327 - DNA, 25 bp, Mus musculus
gctcgtaaagctcaatgtcgacagc

SEQ ID NO: 315328 - DNA, 25 bp, Mus musculus
gctcgtaccaggcacagaagaatga

SEQ ID NO: 315329 - DNA, 25 bp, Mus musculus
gctcgtcagaagagaagacgccagc

SEQ ID NO: 315330 - DNA, 25 bp, Mus musculus
gctcgtcagaagaggagtccaaaat

SEQ ID NO: 315331 - DNA, 25 bp, Mus musculus
gctcgtccgtggaggttgtcagaga

SEQ ID NO: 315332 - DNA, 25 bp, Mus musculus
gctcgtcctacgaagattatacaga

SEQ ID NO: 315333 - DNA, 25 bp, Mus musculus
gctcgtctccggcaatctctgagtt

SEQ ID NO: 315334 - DNA, 25 bp, Mus musculus
gctcgtctccggcaggaatttaatg

SEQ ID NO: 315335 - DNA, 25 bp, Mus musculus
gctcgtctgatgtcatggctccgaa

SEQ ID NO: 315336 - DNA, 25 bp, Mus musculus
gctcgtctgatgttcacctcacctc

SEQ ID NO: 315337 - DNA, 25 bp, Mus musculus
gctcgtgaaactagaaatgatggaa

SEQ ID NO: 315338 - DNA, 25 bp, Mus musculus
gctcgtgaaagattcaactggcatg

SEQ ID NO: 315339 - DNA, 25 bp, Mus musculus
gctcgtgaaagtgcattgttggtgt

SEQ ID NO: 315340 - DNA, 25 bp, Mus musculus
gctcgtgagttcagcgacattaagg

SEQ ID NO: 315341 - DNA, 25 bp, Mus musculus
gctcgtgcaagcgtgccaagtatcc

SEQ ID NO: 315342 - DNA, 25 bp, Mus musculus
gctcgtgccaagtctcacacaggtc

SEQ ID NO: 315343 - DNA, 25 bp, Mus musculus
gctcgtggtccagaaccctctgatt

SEQ ID NO: 315344 - DNA, 25 bp, Mus musculus
gctcgttcaagagggagcccgcctg

SEQ ID NO: 315345 - DNA, 25 bp, Mus musculus
gctcgttcaagggggcgactttctc

SEQ ID NO: 315346 - DNA, 25 bp, Mus musculus
gctcgtttcaagagaacggcaggct

SEQ ID NO: 315347 - DNA, 25 bp, Mus musculus
gctcgtttccctggattatgccatc

SEQ ID NO: 315348 - DNA, 25 bp, Mus musculus
gctcgtttccctgggtatttctctg

SEQ ID NO: 315349 - DNA, 25 bp, Mus musculus
gctcgtttctggtccatacattgtg

SEQ ID NO: 315350 - DNA, 25 bp, Mus musculus
gctctaaaaactcaagatgtggagt

SEQ ID NO: 315351 - DNA, 25 bp, Mus musculus
gctctaaagaaggatgtggactgtg

SEQ ID NO: 315352 - DNA, 25 bp, Mus musculus
gctctaaagcgagacctagatgccc

SEQ ID NO: 315353 - DNA, 25 bp, Mus musculus
gctctaaatgggatatccttctcgt

SEQ ID NO: 315354 - DNA, 25 bp, Mus musculus
gctctaacaggacccaggtctccct

SEQ ID NO: 315355 - DNA, 25 bp, Mus musculus
gctctaacagggcaggatggcccag

SEQ ID NO: 315356 - DNA, 25 bp, Mus musculus
gctctaacctgcctgtgatggtatg

SEQ ID NO: 315357 - DNA, 25 bp, Mus musculus
gctctaagatggtgcagtgaaccac

SEQ ID NO: 315358 - DNA, 25 bp, Mus musculus
gctctaagattgaagatcgagcgtt

SEQ ID NO: 315359 - DNA, 25 bp, Mus musculus
gctctaagtagtgagtctattgaga

SEQ ID NO: 315360 - DNA, 25 bp, Mus musculus
gctctaagttaggcaagagttcaaa

SEQ ID NO: 315361 - DNA, 25 bp, Mus musculus
gctctaatacagactcagccatggt

SEQ ID NO: 315362 - DNA, 25 bp, Mus musculus
gctctaatacagtggcttctttctc

SEQ ID NO: 315363 - DNA, 25 bp, Mus musculus
gctctaattggtttcaaatgtattt

SEQ ID NO: 315364 - DNA, 25 bp, Mus musculus
gctctacaagaattttacagccctg

SEQ ID NO: 315365 - DNA, 25 bp, Mus musculus
gctctacaaggtctccaacggtgca

SEQ ID NO: 315366 - DNA, 25 bp, Mus musculus
gctctacacgatgcggccgaaagtc

SEQ ID NO: 315367 - DNA, 25 bp, Mus musculus
gctctacacgtatgaagtacacaga

SEQ ID NO: 315368 - DNA, 25 bp, Mus musculus
gctctacagaaaataaatcataatg

SEQ ID NO: 315369 - DNA, 25 bp, Mus musculus
gctctacagagaatccccggcagcc

SEQ ID NO: 315370 - DNA, 25 bp, Mus musculus
gctctacagagtgagcctaggaggc

SEQ ID NO: 315371 - DNA, 25 bp, Mus musculus
gctctacagataacccccggcagcc

SEQ ID NO: 315372 - DNA, 25 bp, Mus musculus
gctctacaggaacccgtcattgcct

SEQ ID NO: 315373 - DNA, 25 bp, Mus musculus
gctctacatagaagttgaccagata

SEQ ID NO: 315374 - DNA, 25 bp, Mus musculus
gctctacattcccaaggtgatggtg

SEQ ID NO: 315375 - DNA, 25 bp, Mus musculus
gctctaccagaacctgacccgggaa

SEQ ID NO: 315376 - DNA, 25 bp, Mus musculus
gctctaccagtccttcgtgaaggac

SEQ ID NO: 315377 - DNA, 25 bp, Mus musculus
gctctaccggcttgatctcagtgaa

SEQ ID NO: 315378 - DNA, 25 bp, Mus musculus
gctctacctaggcacaaaaggcaac

SEQ ID NO: 315379 - DNA, 25 bp, Mus musculus
gctctaccttgaaggcccacaatgt

SEQ ID NO: 315380 - DNA, 25 bp, Mus musculus
gctctacgagaaataccgacagtat

SEQ ID NO: 315381 - DNA, 25 bp, Mus musculus
gctctactcgtcctcttccacttcc

SEQ ID NO: 315382 - DNA, 25 bp, Mus musculus
gctctactgccagactactggactt

SEQ ID NO: 315383 - DNA, 25 bp, Mus musculus
gctctactgccagtgtctgttgtag

SEQ ID NO: 315384 - DNA, 25 bp, Mus musculus
gctctactggccagaaggccagcaa

SEQ ID NO: 315385 - DNA, 25 bp, Mus musculus
gctctagagaaggagctagaagcga

SEQ ID NO: 315386 - DNA, 25 bp, Mus musculus
gctctagagccgtcaagctgattta

SEQ ID NO: 315387 - DNA, 25 bp, Mus musculus
gctctagccgagatgtggtgaccaa

SEQ ID NO: 315388 - DNA, 25 bp, Mus musculus
gctctagccgaggccatgtggagca

SEQ ID NO: 315389 - DNA, 25 bp, Mus musculus
gctctagtggaccagaggatatctg

SEQ ID NO: 315390 - DNA, 25 bp, Mus musculus
gctctataaacaggcggcagcagct

SEQ ID NO: 315391 - DNA, 25 bp, Mus musculus
gctctataaacaggtcttagagcct

SEQ ID NO: 315392 - DNA, 25 bp, Mus musculus
gctctataaggatgttcgcaacctg

SEQ ID NO: 315393 - DNA, 25 bp, Mus musculus
gctctatacacatagttacttggga

SEQ ID NO: 315394 - DNA, 25 bp, Mus musculus
gctctataccttacggtccctttcc

SEQ ID NO: 315395 - DNA, 25 bp, Mus musculus
gctctatcacaggccaaaacaactt

SEQ ID NO: 315396 - DNA, 25 bp, Mus musculus
gctctatcgaggctacatgaaggac

SEQ ID NO: 315397 - DNA, 25 bp, Mus musculus
gctctatgaaaaactgatgagccct

SEQ ID NO: 315398 - DNA, 25 bp, Mus musculus
gctctatgaaaagtctgtcagtttg

SEQ ID NO: 315399 - DNA, 25 bp, Mus musculus
gctctatgaggaatgagtggccttg

SEQ ID NO: 315400 - DNA, 25 bp, Mus musculus
gctctatggctcccttcttctcatg

SEQ ID NO: 315401 - DNA, 25 bp, Mus musculus
gctctatgtactacaatggcattgg

SEQ ID NO: 315402 - DNA, 25 bp, Mus musculus
gctctattacccaggggaccccagc

SEQ ID NO: 315403 - DNA, 25 bp, Mus musculus
gctctattggctaatgggccaattc

SEQ ID NO: 315404 - DNA, 25 bp, Mus musculus
gctctattgggtaatgggccaattc

SEQ ID NO: 315405 - DNA, 25 bp, Mus musculus
gctctatttgatgttcatgcagaag

SEQ ID NO: 315406 - DNA, 25 bp, Mus musculus
gctctcaaaacagatctgtctgatt

SEQ ID NO: 315407 - DNA, 25 bp, Mus musculus
gctctcaaaatgagccccggcagcc

SEQ ID NO: 315408 - DNA, 25 bp, Mus musculus
gctctcaaactcctgccctgcataa

SEQ ID NO: 315409 - DNA, 25 bp, Mus musculus
gctctcaaagccaaactgcagatga

SEQ ID NO: 315410 - DNA, 25 bp, Mus musculus
gctctcaaaggtcttcctgcagcat

SEQ ID NO: 315411 - DNA, 25 bp, Mus musculus
gctctcaatgcaggtcaatggccaa

SEQ ID NO: 315412 - DNA, 25 bp, Mus musculus
gctctcacaggtccgctacagagcg

SEQ ID NO: 315413 - DNA, 25 bp, Mus musculus
gctctcacccaccgacctttgcaca

SEQ ID NO: 315414 - DNA, 25 bp, Mus musculus
gctctcacccgcccgagttcgtcaa

SEQ ID NO: 315415 - DNA, 25 bp, Mus musculus
gctctcacccggtacttggtggagg

SEQ ID NO: 315416 - DNA, 25 bp, Mus musculus
gctctcaccgagcgcagccttgggt

SEQ ID NO: 315417 - DNA, 25 bp, Mus musculus
gctctcactgaccctctccccttaa

SEQ ID NO: 315418 - DNA, 25 bp, Mus musculus
gctctcacttccagaggaactcaag

SEQ ID NO: 315419 - DNA, 25 bp, Mus musculus
gctctcagaaggcaaatgtgccgag

SEQ ID NO: 315420 - DNA, 25 bp, Mus musculus
gctctcagaaggccaagttcgacag

SEQ ID NO: 315421 - DNA, 25 bp, Mus musculus
gctctcagacaggaacagaaattct

SEQ ID NO: 315422 - DNA, 25 bp, Mus musculus
gctctcagacaggtttggtcgcaag

SEQ ID NO: 315423 - DNA, 25 bp, Mus musculus
gctctcagaggcagatgacctggat

SEQ ID NO: 315424 - DNA, 25 bp, Mus musculus
gctctcagcagatgatcctctaggc

SEQ ID NO: 315425 - DNA, 25 bp, Mus musculus
gctctcagcagatggtacctggacc

SEQ ID NO: 315426 - DNA, 25 bp, Mus musculus
gctctcagctcagcggaacctgcct

SEQ ID NO: 315427 - DNA, 25 bp, Mus musculus
gctctcagctcagcggtcacacagc

SEQ ID NO: 315428 - DNA, 25 bp, Mus musculus
gctctcaggagagaggtacaaagaa

SEQ ID NO: 315429 - DNA, 25 bp, Mus musculus
gctctcaggctctgggagttggaac

SEQ ID NO: 315430 - DNA, 25 bp, Mus musculus
gctctcattgaggcttatgtaaaca

SEQ ID NO: 315431 - DNA, 25 bp, Mus musculus
gctctcatttagtcaattggatcca

SEQ ID NO: 315432 - DNA, 25 bp, Mus musculus
gctctccaaaagtaaagcaccgtgg

SEQ ID NO: 315433 - DNA, 25 bp, Mus musculus
gctctccaccgggaaaatctgaaca

SEQ ID NO: 315434 - DNA, 25 bp, Mus musculus
gctctccagcaggttacagtacctt

SEQ ID NO: 315435 - DNA, 25 bp, Mus musculus
gctctccatggacacactacagatg

SEQ ID NO: 315436 - DNA, 25 bp, Mus musculus
gctctccatggacagactacagatg

SEQ ID NO: 315437 - DNA, 25 bp, Mus musculus
gctctccattgcgaggctcctgaca

SEQ ID NO: 315438 - DNA, 25 bp, Mus musculus
gctctccccgatggctcattgcgtg

SEQ ID NO: 315439 - DNA, 25 bp, Mus musculus
gctctccccggattgacttggcctc

SEQ ID NO: 315440 - DNA, 25 bp, Mus musculus
gctctccccgtctaaaagttggttt

SEQ ID NO: 315441 - DNA, 25 bp, Mus musculus
gctctccctcaagacatctccgacc

SEQ ID NO: 315442 - DNA, 25 bp, Mus musculus
gctctccctcaagtgctgcattgac

SEQ ID NO: 315443 - DNA, 25 bp, Mus musculus
gctctccgagggcgggcggcgacag

SEQ ID NO: 315444 - DNA, 25 bp, Mus musculus
gctctccgcagcaggatgagccggc

SEQ ID NO: 315445 - DNA, 25 bp, Mus musculus
gctctccgcagcagtttacaatctg

SEQ ID NO: 315446 - DNA, 25 bp, Mus musculus
gctctccgcccacagagatgagccg

SEQ ID NO: 315447 - DNA, 25 bp, Mus musculus
gctctccggcaccggactttttcct

SEQ ID NO: 315448 - DNA, 25 bp, Mus musculus
gctctccggcaccgggccatggcgg

SEQ ID NO: 315449 - DNA, 25 bp, Mus musculus
gctctccgggtgtaaagatctttca

SEQ ID NO: 315450 - DNA, 25 bp, Mus musculus
gctctccggtctgaaccggctgatt

SEQ ID NO: 315451 - DNA, 25 bp, Mus musculus
gctctcctacactgggctcctccac

SEQ ID NO: 315452 - DNA, 25 bp, Mus musculus
gctctcctacactggtgacaagacg

SEQ ID NO: 315453 - DNA, 25 bp, Mus musculus
gctctcctcaatatgccctacacag

SEQ ID NO: 315454 - DNA, 25 bp, Mus musculus
gctctcctcaatatggaaagtacct

SEQ ID NO: 315455 - DNA, 25 bp, Mus musculus
gctctcctcagcccttcagggtggt

SEQ ID NO: 315456 - DNA, 25 bp, Mus musculus
gctctcctgcaaaggctgaggagct

SEQ ID NO: 315457 - DNA, 25 bp, Mus musculus
gctctcctgcaaatgtccaaacgga

SEQ ID NO: 315458 - DNA, 25 bp, Mus musculus
gctctcctgcaagtgtcctgtggga

SEQ ID NO: 315459 - DNA, 25 bp, Mus musculus
gctctcctgcaggaagtggacattg

SEQ ID NO: 315460 - DNA, 25 bp, Mus musculus
gctctcctgccttcctttctttgat

SEQ ID NO: 315461 - DNA, 25 bp, Mus musculus
gctctcctgttaggcgtctcttttc

SEQ ID NO: 315462 - DNA, 25 bp, Mus musculus
gctctccttcagtaaattcaagatg

SEQ ID NO: 315463 - DNA, 25 bp, Mus musculus
gctctccttgccgaatgcctaaatc

SEQ ID NO: 315464 - DNA, 25 bp, Mus musculus
gctctcctttcaagaattacaggcc

SEQ ID NO: 315465 - DNA, 25 bp, Mus musculus
gctctcgagagaagcgagagaagcg

SEQ ID NO: 315466 - DNA, 25 bp, Mus musculus
gctctcgcagagacgtggagctatt

SEQ ID NO: 315467 - DNA, 25 bp, Mus musculus
gctctcggcaggccgtttagggacg

SEQ ID NO: 315468 - DNA, 25 bp, Mus musculus
gctctcgtagaaattgctccaaaga

SEQ ID NO: 315469 - DNA, 25 bp, Mus musculus
gctctcgtagatctgccacctccct

SEQ ID NO: 315470 - DNA, 25 bp, Mus musculus
gctctcgtaggctgaagagtgaacc

SEQ ID NO: 315471 - DNA, 25 bp, Mus musculus
gctctcgtcctaggctaggcggccg

SEQ ID NO: 315472 - DNA, 25 bp, Mus musculus
gctctcgtcctagggggagcttctg

SEQ ID NO: 315473 - DNA, 25 bp, Mus musculus
gctctctaacacccttatttagaag

SEQ ID NO: 315474 - DNA, 25 bp, Mus musculus
gctctctaaggatggtcctgccccc

SEQ ID NO: 315475 - DNA, 25 bp, Mus musculus
gctctctaagggccatgcagctccc

SEQ ID NO: 315476 - DNA, 25 bp, Mus musculus
gctctctacctgcaggcagcctgat

SEQ ID NO: 315477 - DNA, 25 bp, Mus musculus
gctctctagaactgaactcattata

SEQ ID NO: 315478 - DNA, 25 bp, Mus musculus
gctctctagcagccctacgttcttc

SEQ ID NO: 315479 - DNA, 25 bp, Mus musculus
gctctctatgagaatagagcacagt

SEQ ID NO: 315480 - DNA, 25 bp, Mus musculus
gctctctatgatcttaccaatatat

SEQ ID NO: 315481 - DNA, 25 bp, Mus musculus
gctctctatttcacgctgcccccga

SEQ ID NO: 315482 - DNA, 25 bp, Mus musculus
gctctctatttggagagaaatacat

SEQ ID NO: 315483 - DNA, 25 bp, Mus musculus
gctctctcagcgcatctcctccctc

SEQ ID NO: 315484 - DNA, 25 bp, Mus musculus
gctctctcaggagttaaaaataaag

SEQ ID NO: 315485 - DNA, 25 bp, Mus musculus
gctctctccagccaggatgtgatgg

SEQ ID NO: 315486 - DNA, 25 bp, Mus musculus
gctctctccccatgactgacttgga

SEQ ID NO: 315487 - DNA, 25 bp, Mus musculus
gctctctcctaactggtcagtacca

SEQ ID NO: 315488 - DNA, 25 bp, Mus musculus
gctctctcgaaaggttctgtacctc

SEQ ID NO: 315489 - DNA, 25 bp, Mus musculus
gctctctcggcagagtcattcccga

SEQ ID NO: 315490 - DNA, 25 bp, Mus musculus
gctctctcggcaggcctggctgaga

SEQ ID NO: 315491 - DNA, 25 bp, Mus musculus
gctctctcttgacccaagccacgaa

SEQ ID NO: 315492 - DNA, 25 bp, Mus musculus
gctctctgaagcaggacctggagtt

SEQ ID NO: 315493 - DNA, 25 bp, Mus musculus
gctctctgacaggtgtccccagaac

SEQ ID NO: 315494 - DNA, 25 bp, Mus musculus
gctctctgaccgggactttgaatat

SEQ ID NO: 315495 - DNA, 25 bp, Mus musculus
gctctctgaggtggaggctctcctg

SEQ ID NO: 315496 - DNA, 25 bp, Mus musculus
gctctctgctgacctatgaggagat

SEQ ID NO: 315497 - DNA, 25 bp, Mus musculus
gctctctgctgagtctgaagatgca

SEQ ID NO: 315498 - DNA, 25 bp, Mus musculus
gctctctggtggttcatccctgagt

SEQ ID NO: 315499 - DNA, 25 bp, Mus musculus
gctctctgtggttgagtacgtgaag

SEQ ID NO: 315500 - DNA, 25 bp, Mus musculus
gctctctttcaacgctggagacgta

SEQ ID NO: 315501 - DNA, 25 bp, Mus musculus
gctctctttcaaggctggagacgta

SEQ ID NO: 315502 - DNA, 25 bp, Mus musculus
gctctctttcagggagacatagcct

SEQ ID NO: 315503 - DNA, 25 bp, Mus musculus
gctctgaaaaagtcaccttaatttt

SEQ ID NO: 315504 - DNA, 25 bp, Mus musculus
gctctgaaaaatagtcacaaagcac

SEQ ID NO: 315505 - DNA, 25 bp, Mus musculus
gctctgaagaaggatgtggactgtg

SEQ ID NO: 315506 - DNA, 25 bp, Mus musculus
gctctgaagccagaggtacttgatg

SEQ ID NO: 315507 - DNA, 25 bp, Mus musculus
gctctgaagggtacaccatgaggcc

SEQ ID NO: 315508 - DNA, 25 bp, Mus musculus
gctctgaagggtggaataagcagca

SEQ ID NO: 315509 - DNA, 25 bp, Mus musculus
gctctgaagtcaccctgccagcaag

SEQ ID NO: 315510 - DNA, 25 bp, Mus musculus
gctctgaccacagttttcctgactt

SEQ ID NO: 315511 - DNA, 25 bp, Mus musculus
gctctgacctgggacccctcatggt

SEQ ID NO: 315512 - DNA, 25 bp, Mus musculus
gctctgactatgcatcatctatact

SEQ ID NO: 315513 - DNA, 25 bp, Mus musculus
gctctgactgttctctctcttgcct

SEQ ID NO: 315514 - DNA, 25 bp, Mus musculus
gctctgacttctgtttctcttcagc

SEQ ID NO: 315515 - DNA, 25 bp, Mus musculus
gctctgacttggggaagaaagtgaa

SEQ ID NO: 315516 - DNA, 25 bp, Mus musculus
gctctgagaacaggaagcccagccc

SEQ ID NO: 315517 - DNA, 25 bp, Mus musculus
gctctgagaagtactctcaagttca

SEQ ID NO: 315518 - DNA, 25 bp, Mus musculus
gctctgagaatgtatgactcggtgg

SEQ ID NO: 315519 - DNA, 25 bp, Mus musculus
gctctgagaccagacgtctccacca

SEQ ID NO: 315520 - DNA, 25 bp, Mus musculus
gctctgagacctcgccatgcccttg

SEQ ID NO: 315521 - DNA, 25 bp, Mus musculus
gctctgagaggatgtgcccgatatt

SEQ ID NO: 315522 - DNA, 25 bp, Mus musculus
gctctgagaggcccctgcccggatg

SEQ ID NO: 315523 - DNA, 25 bp, Mus musculus
gctctgagataggtgtcttccacct

SEQ ID NO: 315524 - DNA, 25 bp, Mus musculus
gctctgagcaactagggttacaggg

SEQ ID NO: 315525 - DNA, 25 bp, Mus musculus
gctctgagcaactagtctaaatgtt

SEQ ID NO: 315526 - DNA, 25 bp, Mus musculus
gctctgaggcaggtacccacccgga

SEQ ID NO: 315527 - DNA, 25 bp, Mus musculus
gctctgagggttccaattggttcca

SEQ ID NO: 315528 - DNA, 25 bp, Mus musculus
gctctgaggtaggtgtcttccacct

SEQ ID NO: 315529 - DNA, 25 bp, Mus musculus
gctctgataagtatggaacaactcc

SEQ ID NO: 315530 - DNA, 25 bp, Mus musculus
gctctgatgtatggatcggaacgtc

SEQ ID NO: 315531 - DNA, 25 bp, Mus musculus
gctctgattaaaggtggagcagccc

SEQ ID NO: 315532 - DNA, 25 bp, Mus musculus
gctctgattaaagtaacgacattct

SEQ ID NO: 315533 - DNA, 25 bp, Mus musculus
gctctgattccaagcctggaagggc

SEQ ID NO: 315534 - DNA, 25 bp, Mus musculus
gctctgattggaggtcggtgagctg

SEQ ID NO: 315535 - DNA, 25 bp, Mus musculus
gctctgatttcttggaatagaaacc

SEQ ID NO: 315536 - DNA, 25 bp, Mus musculus
gctctgatttcttgggtgaagaaaa

SEQ ID NO: 315537 - DNA, 25 bp, Mus musculus
gctctgcaacaaaggcttcaccaca

SEQ ID NO: 315538 - DNA, 25 bp, Mus musculus
gctctgcaacaaaggtactggtgag

SEQ ID NO: 315539 - DNA, 25 bp, Mus musculus
gctctgcaagaacacatacagtgtc

SEQ ID NO: 315540 - DNA, 25 bp, Mus musculus
gctctgcaagaacactgtcttcaag

SEQ ID NO: 315541 - DNA, 25 bp, Mus musculus
gctctgcaagagaagctgatggtcc

SEQ ID NO: 315542 - DNA, 25 bp, Mus musculus
gctctgcaaggacatccaggcagaa

SEQ ID NO: 315543 - DNA, 25 bp, Mus musculus
gctctgcaaggctgtgtatacagtt

SEQ ID NO: 315544 - DNA, 25 bp, Mus musculus
gctctgcaagtacggttagaacacc

SEQ ID NO: 315545 - DNA, 25 bp, Mus musculus
gctctgcaatggcaggcctagccag

SEQ ID NO: 315546 - DNA, 25 bp, Mus musculus
gctctgcaatggcagtctgttccgg

SEQ ID NO: 315547 - DNA, 25 bp, Mus musculus
gctctgcacagacaggagcatgcaa

SEQ ID NO: 315548 - DNA, 25 bp, Mus musculus
gctctgcacagacaggagcatgcat

SEQ ID NO: 315549 - DNA, 25 bp, Mus musculus
gctctgcaccagagattgtgcacga

SEQ ID NO: 315550 - DNA, 25 bp, Mus musculus
gctctgcaccaggtctacctgggtt

SEQ ID NO: 315551 - DNA, 25 bp, Mus musculus
gctctgcagagacaggagctgctgc

SEQ ID NO: 315552 - DNA, 25 bp, Mus musculus
gctctgcagagacaggtactgagtt

SEQ ID NO: 315553 - DNA, 25 bp, Mus musculus
gctctgcagctggtcacagctctgg

SEQ ID NO: 315554 - DNA, 25 bp, Mus musculus
gctctgcagctgtatgttgtatggg

SEQ ID NO: 315555 - DNA, 25 bp, Mus musculus
gctctgcagtggaaggcaaagagaa

SEQ ID NO: 315556 - DNA, 25 bp, Mus musculus
gctctgcatacggtagtcttttaca

SEQ ID NO: 315557 - DNA, 25 bp, Mus musculus
gctctgcatccggggacagagtcct

SEQ ID NO: 315558 - DNA, 25 bp, Mus musculus
gctctgcccaacaaggcacctccca

SEQ ID NO: 315559 - DNA, 25 bp, Mus musculus
gctctgcccacacagggtgtgtccc

SEQ ID NO: 315560 - DNA, 25 bp, Mus musculus
gctctgcccacacaggttctgcagt

SEQ ID NO: 315561 - DNA, 25 bp, Mus musculus
gctctgccctgattccttctggaac

SEQ ID NO: 315562 - DNA, 25 bp, Mus musculus
gctctgccctggattggtagcttat

SEQ ID NO: 315563 - DNA, 25 bp, Mus musculus
gctctgccctgtgagtttcaggtgc

SEQ ID NO: 315564 - DNA, 25 bp, Mus musculus
gctctgcctcagcagccaatggaaa

SEQ ID NO: 315565 - DNA, 25 bp, Mus musculus
gctctgcctcagcagggctgccctt

SEQ ID NO: 315566 - DNA, 25 bp, Mus musculus
gctctgcgaccagctcccaagtacc

SEQ ID NO: 315567 - DNA, 25 bp, Mus musculus
gctctgcgcagtgctagctcttctg

SEQ ID NO: 315568 - DNA, 25 bp, Mus musculus
gctctgcgcgtccagggtttcctct

SEQ ID NO: 315569 - DNA, 25 bp, Mus musculus
gctctgcgcgtccaggttaaatgaa

SEQ ID NO: 315570 - DNA, 25 bp, Mus musculus
gctctgcggaggtgctgctggggaa

SEQ ID NO: 315571 - DNA, 25 bp, Mus musculus
gctctgcgggccagaatcaccgccg

SEQ ID NO: 315572 - DNA, 25 bp, Mus musculus
gctctgcgtgcccagggtcctgtgg

SEQ ID NO: 315573 - DNA, 25 bp, Mus musculus
gctctgctatcaaggtgcagagccc

SEQ ID NO: 315574 - DNA, 25 bp, Mus musculus
gctctgctcaggatcccagccagcc

SEQ ID NO: 315575 - DNA, 25 bp, Mus musculus
gctctgctcccccaggccggtagtg

SEQ ID NO: 315576 - DNA, 25 bp, Mus musculus
gctctgctcctgccaatgggaagct

SEQ ID NO: 315577 - DNA, 25 bp, Mus musculus
gctctgctctgggatgctgcaggac

SEQ ID NO: 315578 - DNA, 25 bp, Mus musculus
gctctgctgacagggcagtttcaca

SEQ ID NO: 315579 - DNA, 25 bp, Mus musculus
gctctgctgactgtgcagaatcggg

SEQ ID NO: 315580 - DNA, 25 bp, Mus musculus
gctctgctgcatcagaacctcttac

SEQ ID NO: 315581 - DNA, 25 bp, Mus musculus
gctctgctgcatcagcccagcacta

SEQ ID NO: 315582 - DNA, 25 bp, Mus musculus
gctctgctgcatcaggtaccaccag

SEQ ID NO: 315583 - DNA, 25 bp, Mus musculus
gctctgctgctgctggaacgggttc

SEQ ID NO: 315584 - DNA, 25 bp, Mus musculus
gctctgctgtgggaacttatttaga

SEQ ID NO: 315585 - DNA, 25 bp, Mus musculus
gctctgcttgtgggccaccccttcc

SEQ ID NO: 315586 - DNA, 25 bp, Mus musculus
gctctggaccgggtagcaaatgcca

SEQ ID NO: 315587 - DNA, 25 bp, Mus musculus
gctctggacctgcagacccaagaat

SEQ ID NO: 315588 - DNA, 25 bp, Mus musculus
gctctggacctgcagcacgtgggat

SEQ ID NO: 315589 - DNA, 25 bp, Mus musculus
gctctggagaaagagtttgagagga

SEQ ID NO: 315590 - DNA, 25 bp, Mus musculus
gctctggagctgccatcaacacccc

SEQ ID NO: 315591 - DNA, 25 bp, Mus musculus
gctctggaggcgagaaccatgtgtg

SEQ ID NO: 315592 - DNA, 25 bp, Mus musculus
gctctggaggcgagtatttcctaaa

SEQ ID NO: 315593 - DNA, 25 bp, Mus musculus
gctctggagttgctttttgcaatgt

SEQ ID NO: 315594 - DNA, 25 bp, Mus musculus
gctctggagttggctgcaacaggtg

SEQ ID NO: 315595 - DNA, 25 bp, Mus musculus
gctctggatctagtgacagcagcta

SEQ ID NO: 315596 - DNA, 25 bp, Mus musculus
gctctggatctggtgaagcaggaag

SEQ ID NO: 315597 - DNA, 25 bp, Mus musculus
gctctggatgagagggagatgagac

SEQ ID NO: 315598 - DNA, 25 bp, Mus musculus
gctctggcaaggactcacacacgag

SEQ ID NO: 315599 - DNA, 25 bp, Mus musculus
gctctggcaaggtaccctggctaaa

SEQ ID NO: 315600 - DNA, 25 bp, Mus musculus
gctctggcacagccggagagaagcc

SEQ ID NO: 315601 - DNA, 25 bp, Mus musculus
gctctggcacaggtgctttgccaga

SEQ ID NO: 315602 - DNA, 25 bp, Mus musculus
gctctggccaggttccgggagaccc

SEQ ID NO: 315603 - DNA, 25 bp, Mus musculus
gctctggcccagcagctggagcaat

SEQ ID NO: 315604 - DNA, 25 bp, Mus musculus
gctctggccgacctaatccccagga

SEQ ID NO: 315605 - DNA, 25 bp, Mus musculus
gctctggccggagtgagagagagag

SEQ ID NO: 315606 - DNA, 25 bp, Mus musculus
gctctggctccagagaaatcttcta

SEQ ID NO: 315607 - DNA, 25 bp, Mus musculus
gctctggctgcagggaattgatgtc

SEQ ID NO: 315608 - DNA, 25 bp, Mus musculus
gctctgggaccggattcccgaagcc

SEQ ID NO: 315609 - DNA, 25 bp, Mus musculus
gctctgggatgctgcaggaccagga

SEQ ID NO: 315610 - DNA, 25 bp, Mus musculus
gctctggggaagccttggccacgag

SEQ ID NO: 315611 - DNA, 25 bp, Mus musculus
gctctggggaagctgctgcccagac

SEQ ID NO: 315612 - DNA, 25 bp, Mus musculus
gctctgggtacccgctttcttgatc

SEQ ID NO: 315613 - DNA, 25 bp, Mus musculus
gctctgggtgagaggctgcccctgg

SEQ ID NO: 315614 - DNA, 25 bp, Mus musculus
gctctggtccagcagatgcgtcgag

SEQ ID NO: 315615 - DNA, 25 bp, Mus musculus
gctctggtcgaggaagatgggctcc

SEQ ID NO: 315616 - DNA, 25 bp, Mus musculus
gctctggtcttaggttcttgattgt

SEQ ID NO: 315617 - DNA, 25 bp, Mus musculus
gctctggtgatgatgtggccctcac

SEQ ID NO: 315618 - DNA, 25 bp, Mus musculus
gctctggtgatgtactccaacctgg

SEQ ID NO: 315619 - DNA, 25 bp, Mus musculus
gctctggttagaggtgaagaatatt

SEQ ID NO: 315620 - DNA, 25 bp, Mus musculus
gctctgtaagcagcctaggatgtca

SEQ ID NO: 315621 - DNA, 25 bp, Mus musculus
gctctgtaccttggacaaagtgggg

SEQ ID NO: 315622 - DNA, 25 bp, Mus musculus
gctctgtagcaggtctagtgacagg

SEQ ID NO: 315623 - DNA, 25 bp, Mus musculus
gctctgtcatcacagacaccctctc

SEQ ID NO: 315624 - DNA, 25 bp, Mus musculus
gctctgtcatcacagattctttaag

SEQ ID NO: 315625 - DNA, 25 bp, Mus musculus
gctctgtcatccgaaaactccaggg

SEQ ID NO: 315626 - DNA, 25 bp, Mus musculus
gctctgtcatccgccctagcacaaa

SEQ ID NO: 315627 - DNA, 25 bp, Mus musculus
gctctgtcatgggtcctctacagcc

SEQ ID NO: 315628 - DNA, 25 bp, Mus musculus
gctctgtccagaaggacaaggtgga

SEQ ID NO: 315629 - DNA, 25 bp, Mus musculus
gctctgtccccaggcgtatgggcaa

SEQ ID NO: 315630 - DNA, 25 bp, Mus musculus
gctctgtccccagggactgaaagga

SEQ ID NO: 315631 - DNA, 25 bp, Mus musculus
gctctgtccccagtgcatgggtaca

SEQ ID NO: 315632 - DNA, 25 bp, Mus musculus
gctctgtctagagctgaggacctgg

SEQ ID NO: 315633 - DNA, 25 bp, Mus musculus
gctctgtctaggtatcttttggata

SEQ ID NO: 315634 - DNA, 25 bp, Mus musculus
gctctgtctccacgaccctgctttt

SEQ ID NO: 315635 - DNA, 25 bp, Mus musculus
gctctgtgaaaggtaaccccaggtg

SEQ ID NO: 315636 - DNA, 25 bp, Mus musculus
gctctgtgaagccgaggaagtggag

SEQ ID NO: 315637 - DNA, 25 bp, Mus musculus
gctctgtgacctcctcctctactgc

SEQ ID NO: 315638 - DNA, 25 bp, Mus musculus
gctctgtgataccagaccctgaaga

SEQ ID NO: 315639 - DNA, 25 bp, Mus musculus
gctctgtgatgaccaagatcttcca

SEQ ID NO: 315640 - DNA, 25 bp, Mus musculus
gctctgtgctcctggcacacacttg

SEQ ID NO: 315641 - DNA, 25 bp, Mus musculus
gctctgtggaatcaccctgccccac

SEQ ID NO: 315642 - DNA, 25 bp, Mus musculus
gctctgtgggaagacaaagccattg

SEQ ID NO: 315643 - DNA, 25 bp, Mus musculus
gctctgtgtgcgggagaaaccactg

SEQ ID NO: 315644 - DNA, 25 bp, Mus musculus
gctctgtgtgcggggatctgaagtt

SEQ ID NO: 315645 - DNA, 25 bp, Mus musculus
gctctgtgtgcgtgtattctagtca

SEQ ID NO: 315646 - DNA, 25 bp, Mus musculus
gctctgtgtgcgtgttaaaagagcc

SEQ ID NO: 315647 - DNA, 25 bp, Mus musculus
gctctgtgttagcggggtgccacgg

SEQ ID NO: 315648 - DNA, 25 bp, Mus musculus
gctctgttactgccaggcatctgga

SEQ ID NO: 315649 - DNA, 25 bp, Mus musculus
gctctgttactgcccatgaaacccc

SEQ ID NO: 315650 - DNA, 25 bp, Mus musculus
gctctgttgcatatgacatggaaag

SEQ ID NO: 315651 - DNA, 25 bp, Mus musculus
gctctgttgcgctgacccctgccca

SEQ ID NO: 315652 - DNA, 25 bp, Mus musculus
gctctgttgctaacggacatggcgg

SEQ ID NO: 315653 - DNA, 25 bp, Mus musculus
gctcttaaaacaagtgcctccaaaa

SEQ ID NO: 315654 - DNA, 25 bp, Mus musculus
gctcttaaaacaagtgttttgtcaa

SEQ ID NO: 315655 - DNA, 25 bp, Mus musculus
gctcttaaactcggtgtgtatgaag

SEQ ID NO: 315656 - DNA, 25 bp, Mus musculus
gctcttaagaaggactgcagtgagg

SEQ ID NO: 315657 - DNA, 25 bp, Mus musculus
gctcttacaggcaccaacagagaga

SEQ ID NO: 315658 - DNA, 25 bp, Mus musculus
gctcttaccaatcttgaactttcca

SEQ ID NO: 315659 - DNA, 25 bp, Mus musculus
gctcttactgccaagatatagatga

SEQ ID NO: 315660 - DNA, 25 bp, Mus musculus
gctcttagagattcccaccctgctg

SEQ ID NO: 315661 - DNA, 25 bp, Mus musculus
gctcttatcaggtatggggcagatg

SEQ ID NO: 315662 - DNA, 25 bp, Mus musculus
gctcttcaagtacggggtacagcta

SEQ ID NO: 315663 - DNA, 25 bp, Mus musculus
gctcttcacctgcttcctggcagtg

SEQ ID NO: 315664 - DNA, 25 bp, Mus musculus
gctcttcacggaactcgatggagca

SEQ ID NO: 315665 - DNA, 25 bp, Mus musculus
gctcttcacggcactggttctaagg

SEQ ID NO: 315666 - DNA, 25 bp, Mus musculus
gctcttcagaaacaggtctggatgc

SEQ ID NO: 315667 - DNA, 25 bp, Mus musculus
gctcttcagaaacaggtctggcagg

SEQ ID NO: 315668 - DNA, 25 bp, Mus musculus
gctcttcagacaggcccagtgctcg

SEQ ID NO: 315669 - DNA, 25 bp, Mus musculus
gctcttcatccagcagatccgaatc

SEQ ID NO: 315670 - DNA, 25 bp, Mus musculus
gctcttcatccagcattccatgatc

SEQ ID NO: 315671 - DNA, 25 bp, Mus musculus
gctcttccaacacttcgacaaaatt

SEQ ID NO: 315672 - DNA, 25 bp, Mus musculus
gctcttccacacacgccaccccacc

SEQ ID NO: 315673 - DNA, 25 bp, Mus musculus
gctcttccacacacggaggaggttg

SEQ ID NO: 315674 - DNA, 25 bp, Mus musculus
gctcttccacaggtctgttggtgcc

SEQ ID NO: 315675 - DNA, 25 bp, Mus musculus
gctcttccaggtgacagtcacagaa

SEQ ID NO: 315676 - DNA, 25 bp, Mus musculus
gctcttccagtgggaaacattctct

SEQ ID NO: 315677 - DNA, 25 bp, Mus musculus
gctcttccatacagatgatattgaa

SEQ ID NO: 315678 - DNA, 25 bp, Mus musculus
gctcttcccccacagtcccagacga

SEQ ID NO: 315679 - DNA, 25 bp, Mus musculus
gctcttccgtcataacgggcctgtg

SEQ ID NO: 315680 - DNA, 25 bp, Mus musculus
gctcttcctacagttggtcccgcag

SEQ ID NO: 315681 - DNA, 25 bp, Mus musculus
gctcttcctcgcgtttcatgcaggc

SEQ ID NO: 315682 - DNA, 25 bp, Mus musculus
gctcttcctgctcaggagactgctt

SEQ ID NO: 315683 - DNA, 25 bp, Mus musculus
gctcttcctgggcggcggccagcgc

SEQ ID NO: 315684 - DNA, 25 bp, Mus musculus
gctcttcgtcaaggaaacctgcaga

SEQ ID NO: 315685 - DNA, 25 bp, Mus musculus
gctcttcgtcaaggccggaagtgat

SEQ ID NO: 315686 - DNA, 25 bp, Mus musculus
gctcttctaaagacctcaaaggaag

SEQ ID NO: 315687 - DNA, 25 bp, Mus musculus
gctcttctcagagaagaaaagcgag

SEQ ID NO: 315688 - DNA, 25 bp, Mus musculus
gctcttctccaccaagtcaaagtaa

SEQ ID NO: 315689 - DNA, 25 bp, Mus musculus
gctcttctccatagcagactagaga

SEQ ID NO: 315690 - DNA, 25 bp, Mus musculus
gctcttctccatatacctggtgatg

SEQ ID NO: 315691 - DNA, 25 bp, Mus musculus
gctcttctgcatgaacttctgcaca

SEQ ID NO: 315692 - DNA, 25 bp, Mus musculus
gctcttctgcatgaatttcagttcg

SEQ ID NO: 315693 - DNA, 25 bp, Mus musculus
gctcttctggaaagctaggtagaag

SEQ ID NO: 315694 - DNA, 25 bp, Mus musculus
gctcttctggaaaggcctagactgg

SEQ ID NO: 315695 - DNA, 25 bp, Mus musculus
gctcttgaccaagttccaggaagac

SEQ ID NO: 315696 - DNA, 25 bp, Mus musculus
gctcttgactcgagaagtcgtcaca

SEQ ID NO: 315697 - DNA, 25 bp, Mus musculus
gctcttgagaccagcaggtttctgg

SEQ ID NO: 315698 - DNA, 25 bp, Mus musculus
gctcttgagccagcccatacccagc

SEQ ID NO: 315699 - DNA, 25 bp, Mus musculus
gctcttgcagctgtctagcccatgc

SEQ ID NO: 315700 - DNA, 25 bp, Mus musculus
gctcttgccatgcttccaccactgc

SEQ ID NO: 315701 - DNA, 25 bp, Mus musculus
gctcttgcctggacctcctcccatc

SEQ ID NO: 315702 - DNA, 25 bp, Mus musculus
gctcttggagatttttgcagctcaa

SEQ ID NO: 315703 - DNA, 25 bp, Mus musculus
gctcttggcgcgatgaggaaactga

SEQ ID NO: 315704 - DNA, 25 bp, Mus musculus
gctcttgggagagcgcattaaagag

SEQ ID NO: 315705 - DNA, 25 bp, Mus musculus
gctcttgggtgacaattggtgcgac

SEQ ID NO: 315706 - DNA, 25 bp, Mus musculus
gctcttggtgacaaggtgaattccc

SEQ ID NO: 315707 - DNA, 25 bp, Mus musculus
gctcttggtgtggacacttcccgag

SEQ ID NO: 315708 - DNA, 25 bp, Mus musculus
gctcttggtgtgggacgcccctaaa

SEQ ID NO: 315709 - DNA, 25 bp, Mus musculus
gctcttgtcacaggtggtgagattg

SEQ ID NO: 315710 - DNA, 25 bp, Mus musculus
gctcttgtctggggcttcaatgggg

SEQ ID NO: 315711 - DNA, 25 bp, Mus musculus
gctctttacctacaactgctgcttg

SEQ ID NO: 315712 - DNA, 25 bp, Mus musculus
gctctttagggttctactttaccaa

SEQ ID NO: 315713 - DNA, 25 bp, Mus musculus
gctctttattcagaagtaccgggct

SEQ ID NO: 315714 - DNA, 25 bp, Mus musculus
gctctttattctgtcaaccacagaa

SEQ ID NO: 315715 - DNA, 25 bp, Mus musculus
gctctttcctatggatttggccatg

SEQ ID NO: 315716 - DNA, 25 bp, Mus musculus
gctctttctgagacaccccctgttt

SEQ ID NO: 315717 - DNA, 25 bp, Mus musculus
gctctttgagcataggtcctgatca

SEQ ID NO: 315718 - DNA, 25 bp, Mus musculus
gctctttgaggacctttactctttg

SEQ ID NO: 315719 - DNA, 25 bp, Mus musculus
gctctttgccctcaggcaccgaata

SEQ ID NO: 315720 - DNA, 25 bp, Mus musculus
gctctttggcagatcagtaatggaa

SEQ ID NO: 315721 - DNA, 25 bp, Mus musculus
gctctttgggcacaggaaagccatc

SEQ ID NO: 315722 - DNA, 25 bp, Mus musculus
gctctttgtcaggtaagaatgattg

SEQ ID NO: 315723 - DNA, 25 bp, Mus musculus
gctctttgtcctaagattagcctca

SEQ ID NO: 315724 - DNA, 25 bp, Mus musculus
gctctttgttcgaataaatgctgct

SEQ ID NO: 315725 - DNA, 25 bp, Mus musculus
gctcttttccaggcatggtttattg

SEQ ID NO: 315726 - DNA, 25 bp, Mus musculus
gctcttttccaggtggttttcctgg

SEQ ID NO: 315727 - DNA, 25 bp, Mus musculus
gctcttttctcagagcaacacgttt

SEQ ID NO: 315728 - DNA, 25 bp, Mus musculus
gctcttttttgctggatagagagag

SEQ ID NO: 315729 - DNA, 25 bp, Mus musculus
gctgaaaaactacaaaatccacagg

SEQ ID NO: 315730 - DNA, 25 bp, Mus musculus
gctgaaaaactacagaagttaaatg

SEQ ID NO: 315731 - DNA, 25 bp, Mus musculus
gctgaaaaagagctgcatgagaaat

SEQ ID NO: 315732 - DNA, 25 bp, Mus musculus
gctgaaaaagcaatacgaggattct

SEQ ID NO: 315733 - DNA, 25 bp, Mus musculus
gctgaaaacaaacgatacaaggagg

SEQ ID NO: 315734 - DNA, 25 bp, Mus musculus
gctgaaaacaaacggtcctgctgtc

SEQ ID NO: 315735 - DNA, 25 bp, Mus musculus
gctgaaaacatgggtacaggaccct

SEQ ID NO: 315736 - DNA, 25 bp, Mus musculus
gctgaaaacctcggctctctgctcc

SEQ ID NO: 315737 - DNA, 25 bp, Mus musculus
gctgaaaagaagatccagccgcagc

SEQ ID NO: 315738 - DNA, 25 bp, Mus musculus
gctgaaaatgaagagataggcgctc

SEQ ID NO: 315739 - DNA, 25 bp, Mus musculus
gctgaaacagggaccgcgtggcgcg

SEQ ID NO: 315740 - DNA, 25 bp, Mus musculus
gctgaaaccattaagttcgagaagc

SEQ ID NO: 315741 - DNA, 25 bp, Mus musculus
gctgaaacccagatccttactgact

SEQ ID NO: 315742 - DNA, 25 bp, Mus musculus
gctgaaaccgatcccagctctaccg

SEQ ID NO: 315743 - DNA, 25 bp, Mus musculus
gctgaaactaagccgcccagccacc

SEQ ID NO: 315744 - DNA, 25 bp, Mus musculus
gctgaaactgaaggctggcaacatg

SEQ ID NO: 315745 - DNA, 25 bp, Mus musculus
gctgaaactgatgccatgcagaact

SEQ ID NO: 315746 - DNA, 25 bp, Mus musculus
gctgaaactgtatgccatgttcctg

SEQ ID NO: 315747 - DNA, 25 bp, Mus musculus
gctgaaagaggtggaagcggcaaag

SEQ ID NO: 315748 - DNA, 25 bp, Mus musculus
gctgaaagcagggtgtggacaggcc

SEQ ID NO: 315749 - DNA, 25 bp, Mus musculus
gctgaaaggagatgagtccccggca

SEQ ID NO: 315750 - DNA, 25 bp, Mus musculus
gctgaaagtgaaacactagaccagc

SEQ ID NO: 315751 - DNA, 25 bp, Mus musculus
gctgaaagtgaaaccagaggaggag

SEQ ID NO: 315752 - DNA, 25 bp, Mus musculus
gctgaaagtttggcttttcatggcc

SEQ ID NO: 315753 - DNA, 25 bp, Mus musculus
gctgaaatactaggttgcaggaatc

SEQ ID NO: 315754 - DNA, 25 bp, Mus musculus
gctgaaatctaccagaacaatctgg

SEQ ID NO: 315755 - DNA, 25 bp, Mus musculus
gctgaaatctaccagttgagaaatg

SEQ ID NO: 315756 - DNA, 25 bp, Mus musculus
gctgaaatggacgtatgttccatca

SEQ ID NO: 315757 - DNA, 25 bp, Mus musculus
gctgaaattacggccgagatccagt

SEQ ID NO: 315758 - DNA, 25 bp, Mus musculus
gctgaaattggatgcaaaacatcca

SEQ ID NO: 315759 - DNA, 25 bp, Mus musculus
gctgaacaaccaactgggcagcaac

SEQ ID NO: 315760 - DNA, 25 bp, Mus musculus
gctgaacaagaagatctaccgcatt

SEQ ID NO: 315761 - DNA, 25 bp, Mus musculus
gctgaacaagtactctacgcacctg

SEQ ID NO: 315762 - DNA, 25 bp, Mus musculus
gctgaacaatgcaagaaaacgaagt

SEQ ID NO: 315763 - DNA, 25 bp, Mus musculus
gctgaacaggaacatagcggcggag

SEQ ID NO: 315764 - DNA, 25 bp, Mus musculus
gctgaacattacaagaagacgctgc

SEQ ID NO: 315765 - DNA, 25 bp, Mus musculus
gctgaacattacaaggtgggagagg

SEQ ID NO: 315766 - DNA, 25 bp, Mus musculus
gctgaacattataagattccccccc

SEQ ID NO: 315767 - DNA, 25 bp, Mus musculus
gctgaaccaagtctgtgatgaggac

SEQ ID NO: 315768 - DNA, 25 bp, Mus musculus
gctgaaccacaggaattcaaaccca

SEQ ID NO: 315769 - DNA, 25 bp, Mus musculus
gctgaaccacaggatgtgaactact

SEQ ID NO: 315770 - DNA, 25 bp, Mus musculus
gctgaaccagctcaaaggcaaatca

SEQ ID NO: 315771 - DNA, 25 bp, Mus musculus
gctgaaccaggccgcgttgtctgtc

SEQ ID NO: 315772 - DNA, 25 bp, Mus musculus
gctgaaccgagcctgttcctgcgcc

SEQ ID NO: 315773 - DNA, 25 bp, Mus musculus
gctgaacctaaggctgctgactttc

SEQ ID NO: 315774 - DNA, 25 bp, Mus musculus
gctgaaccttgagaggcttataccc

SEQ ID NO: 315775 - DNA, 25 bp, Mus musculus
gctgaacgagggttcagccgactcc

SEQ ID NO: 315776 - DNA, 25 bp, Mus musculus
gctgaacgctgagatcatctttctg

SEQ ID NO: 315777 - DNA, 25 bp, Mus musculus
gctgaactggcagaacagctgattt

SEQ ID NO: 315778 - DNA, 25 bp, Mus musculus
gctgaagaaaaggccttggcaatta

SEQ ID NO: 315779 - DNA, 25 bp, Mus musculus
gctgaagaaaagtactctcaaaaag

SEQ ID NO: 315780 - DNA, 25 bp, Mus musculus
gctgaagaaagaattgatattttgg

SEQ ID NO: 315781 - DNA, 25 bp, Mus musculus
gctgaagaaattgaagcagctggag

SEQ ID NO: 315782 - DNA, 25 bp, Mus musculus
gctgaagaacatgatgcaaggagac

SEQ ID NO: 315783 - DNA, 25 bp, Mus musculus
gctgaagaacatggactggaaagtt

SEQ ID NO: 315784 - DNA, 25 bp, Mus musculus
gctgaagaaccaagcaatgtcttca

SEQ ID NO: 315785 - DNA, 25 bp, Mus musculus
gctgaagaagagagggactcaaagc

SEQ ID NO: 315786 - DNA, 25 bp, Mus musculus
gctgaagaagagcagtttccggagg

SEQ ID NO: 315787 - DNA, 25 bp, Mus musculus
gctgaagaagagcatcatggtccac

SEQ ID NO: 315788 - DNA, 25 bp, Mus musculus
gctgaagaagatcggtcagcacctg

SEQ ID NO: 315789 - DNA, 25 bp, Mus musculus
gctgaagaagattcgccggtacaag

SEQ ID NO: 315790 - DNA, 25 bp, Mus musculus
gctgaagaagcaatatggtattcat

SEQ ID NO: 315791 - DNA, 25 bp, Mus musculus
gctgaagaagcaatgaactcccagg

SEQ ID NO: 315792 - DNA, 25 bp, Mus musculus
gctgaagaaggcgccctttgtggca

SEQ ID NO: 315793 - DNA, 25 bp, Mus musculus
gctgaagaaggtggctgctgggaaa

SEQ ID NO: 315794 - DNA, 25 bp, Mus musculus
gctgaagacacaggggctccttatt

SEQ ID NO: 315795 - DNA, 25 bp, Mus musculus
gctgaagagagagagaagacagttc

SEQ ID NO: 315796 - DNA, 25 bp, Mus musculus
gctgaagagcacggatgttctttgg

SEQ ID NO: 315797 - DNA, 25 bp, Mus musculus
gctgaagagcagacttggaggtaac

SEQ ID NO: 315798 - DNA, 25 bp, Mus musculus
gctgaagagctcaggtgtaccagct

SEQ ID NO: 315799 - DNA, 25 bp, Mus musculus
gctgaagaggtcccaggtaaatcac

SEQ ID NO: 315800 - DNA, 25 bp, Mus musculus
gctgaagagttgtgttagggtttta

SEQ ID NO: 315801 - DNA, 25 bp, Mus musculus
gctgaagatgatcaaaaagccgacc

SEQ ID NO: 315802 - DNA, 25 bp, Mus musculus
gctgaagatgtttccacagtgcctt

SEQ ID NO: 315803 - DNA, 25 bp, Mus musculus
gctgaagcagaactgtgtgtgggac

SEQ ID NO: 315804 - DNA, 25 bp, Mus musculus
gctgaagcagctcaccatgtccaaa

SEQ ID NO: 315805 - DNA, 25 bp, Mus musculus
gctgaagcaggaatagcctgcacag

SEQ ID NO: 315806 - DNA, 25 bp, Mus musculus
gctgaagcaggaatggacagaccaa

SEQ ID NO: 315807 - DNA, 25 bp, Mus musculus
gctgaagcaggacacaccaggaaga

SEQ ID NO: 315808 - DNA, 25 bp, Mus musculus
gctgaagcaggctattgaagaggaa

SEQ ID NO: 315809 - DNA, 25 bp, Mus musculus
gctgaagcaggcttccagccagctg

SEQ ID NO: 315810 - DNA, 25 bp, Mus musculus
gctgaagcaggtaaaaaacaagaag

SEQ ID NO: 315811 - DNA, 25 bp, Mus musculus
gctgaagcaggtcataaagccccga

SEQ ID NO: 315812 - DNA, 25 bp, Mus musculus
gctgaagccagagagtcatggatgc

SEQ ID NO: 315813 - DNA, 25 bp, Mus musculus
gctgaagccagcatcgagatcaaca

SEQ ID NO: 315814 - DNA, 25 bp, Mus musculus
gctgaagccaggagccaaaccagag

SEQ ID NO: 315815 - DNA, 25 bp, Mus musculus
gctgaagcccagaagccctacccat

SEQ ID NO: 315816 - DNA, 25 bp, Mus musculus
gctgaagcccagaagctgtgattgg

SEQ ID NO: 315817 - DNA, 25 bp, Mus musculus
gctgaagccgagagaaatgtcttca

SEQ ID NO: 315818 - DNA, 25 bp, Mus musculus
gctgaagccgggaggggctttttac

SEQ ID NO: 315819 - DNA, 25 bp, Mus musculus
gctgaagccgtaagggttggagctc

SEQ ID NO: 315820 - DNA, 25 bp, Mus musculus
gctgaagcctgaaggtctccaccag

SEQ ID NO: 315821 - DNA, 25 bp, Mus musculus
gctgaagcgggatctgttctctcag

SEQ ID NO: 315822 - DNA, 25 bp, Mus musculus
gctgaagctaagccccaagcattct

SEQ ID NO: 315823 - DNA, 25 bp, Mus musculus
gctgaagctacagggttgaaaaata

SEQ ID NO: 315824 - DNA, 25 bp, Mus musculus
gctgaagctcggaaacaagctccca

SEQ ID NO: 315825 - DNA, 25 bp, Mus musculus
gctgaagctgaacctgagccagcgg

SEQ ID NO: 315826 - DNA, 25 bp, Mus musculus
gctgaagctgatcaggctctaaggg

SEQ ID NO: 315827 - DNA, 25 bp, Mus musculus
gctgaagctggggggtcgtgtgaag

SEQ ID NO: 315828 - DNA, 25 bp, Mus musculus
gctgaaggacgagggccttgggtac

SEQ ID NO: 315829 - DNA, 25 bp, Mus musculus
gctgaaggacttgaggaacttcctg

SEQ ID NO: 315830 - DNA, 25 bp, Mus musculus
gctgaaggagaacttgagagagatt

SEQ ID NO: 315831 - DNA, 25 bp, Mus musculus
gctgaaggagaccagaaggactcca

SEQ ID NO: 315832 - DNA, 25 bp, Mus musculus
gctgaaggagctgaggtgggctggt

SEQ ID NO: 315833 - DNA, 25 bp, Mus musculus
gctgaaggaggtctctctgctcctt

SEQ ID NO: 315834 - DNA, 25 bp, Mus musculus
gctgaaggctacaaggtgctggtgg

SEQ ID NO: 315835 - DNA, 25 bp, Mus musculus
gctgaaggctcgcaacaccaagaag

SEQ ID NO: 315836 - DNA, 25 bp, Mus musculus
gctgaagggagagttcgtgtcgatg

SEQ ID NO: 315837 - DNA, 25 bp, Mus musculus
gctgaagtcatgaactccaatgtgg

SEQ ID NO: 315838 - DNA, 25 bp, Mus musculus
gctgaagtcccgaggccaaccgcgt

SEQ ID NO: 315839 - DNA, 25 bp, Mus musculus
gctgaagtcccgaggttgagcccca

SEQ ID NO: 315840 - DNA, 25 bp, Mus musculus
gctgaagtgaggggggtccagcgag

SEQ ID NO: 315841 - DNA, 25 bp, Mus musculus
gctgaagtgagtgggcccagccacg

SEQ ID NO: 315842 - DNA, 25 bp, Mus musculus
gctgaagtggtgtgctcggaggaca

SEQ ID NO: 315843 - DNA, 25 bp, Mus musculus
gctgaagttacagtcaccggaagaa

SEQ ID NO: 315844 - DNA, 25 bp, Mus musculus
gctgaagttagacacaccagaagag

SEQ ID NO: 315845 - DNA, 25 bp, Mus musculus
gctgaagttcggttcctgtgtgacg

SEQ ID NO: 315846 - DNA, 25 bp, Mus musculus
gctgaataataccaggtggtgccac

SEQ ID NO: 315847 - DNA, 25 bp, Mus musculus
gctgaatataaactgtcattattga

SEQ ID NO: 315848 - DNA, 25 bp, Mus musculus
gctgaatatgaactctcatccttat

SEQ ID NO: 315849 - DNA, 25 bp, Mus musculus
gctgaatcagctcaaatctaataag

SEQ ID NO: 315850 - DNA, 25 bp, Mus musculus
gctgaatcgaaaggctcaggtcaca

SEQ ID NO: 315851 - DNA, 25 bp, Mus musculus
gctgaatctcacttcaggcccagag

SEQ ID NO: 315852 - DNA, 25 bp, Mus musculus
gctgaatctcactttagatagtgac

SEQ ID NO: 315853 - DNA, 25 bp, Mus musculus
gctgaatgaaagggagaagaaggaa

SEQ ID NO: 315854 - DNA, 25 bp, Mus musculus
gctgaatgagaaagaccttgtcctg

SEQ ID NO: 315855 - DNA, 25 bp, Mus musculus
gctgaatgatgctgggatccagatg

SEQ ID NO: 315856 - DNA, 25 bp, Mus musculus
gctgaatgccatcaaactacaactc

SEQ ID NO: 315857 - DNA, 25 bp, Mus musculus
gctgaatgtcaaagattgtaacata

SEQ ID NO: 315858 - DNA, 25 bp, Mus musculus
gctgaatgtcatgtatttcaacaat

SEQ ID NO: 315859 - DNA, 25 bp, Mus musculus
gctgaattcagaggtggcgagtgaa

SEQ ID NO: 315860 - DNA, 25 bp, Mus musculus
gctgaattctgagggactaactacg

SEQ ID NO: 315861 - DNA, 25 bp, Mus musculus
gctgaatttacggtcaccattcttg

SEQ ID NO: 315862 - DNA, 25 bp, Mus musculus
gctgaatttacggtggctctcccaa

SEQ ID NO: 315863 - DNA, 25 bp, Mus musculus
gctgaattttagagaacgagttagt

SEQ ID NO: 315864 - DNA, 25 bp, Mus musculus
gctgaattttagagaatggctctga

SEQ ID NO: 315865 - DNA, 25 bp, Mus musculus
gctgacaaagagcttccactttccg

SEQ ID NO: 315866 - DNA, 25 bp, Mus musculus
gctgacaaagggcactggttcaatg

SEQ ID NO: 315867 - DNA, 25 bp, Mus musculus
gctgacaaatgacacccagtcttct

SEQ ID NO: 315868 - DNA, 25 bp, Mus musculus
gctgacaacaaatggaccccttctt

SEQ ID NO: 315869 - DNA, 25 bp, Mus musculus
gctgacaacaaatgtcactagtgcc

SEQ ID NO: 315870 - DNA, 25 bp, Mus musculus
gctgacaagccccagggcagtcctt

SEQ ID NO: 315871 - DNA, 25 bp, Mus musculus
gctgacaagccccagggtgccacct

SEQ ID NO: 315872 - DNA, 25 bp, Mus musculus
gctgacaaggaaagctggtgaagca

SEQ ID NO: 315873 - DNA, 25 bp, Mus musculus
gctgacaaggaaagctgtctgcaat

SEQ ID NO: 315874 - DNA, 25 bp, Mus musculus
gctgacaaggaagcggcctttgacg

SEQ ID NO: 315875 - DNA, 25 bp, Mus musculus
gctgacaaggaaggcctgaagggaa

SEQ ID NO: 315876 - DNA, 25 bp, Mus musculus
gctgacaaggacacctgctttgaat

SEQ ID NO: 315877 - DNA, 25 bp, Mus musculus
gctgacaaggcacccacatcttttg

SEQ ID NO: 315878 - DNA, 25 bp, Mus musculus
gctgacaagtggagaaatgattagc

SEQ ID NO: 315879 - DNA, 25 bp, Mus musculus
gctgacaagtggagtcattttataa

SEQ ID NO: 315880 - DNA, 25 bp, Mus musculus
gctgacacaggaggacctccaccat

SEQ ID NO: 315881 - DNA, 25 bp, Mus musculus
gctgacacctcagggcacacttgcc

SEQ ID NO: 315882 - DNA, 25 bp, Mus musculus
gctgacactagctgcagccgactcc

SEQ ID NO: 315883 - DNA, 25 bp, Mus musculus
gctgacagaacaggtcctgctgcag

SEQ ID NO: 315884 - DNA, 25 bp, Mus musculus
gctgacagaacccgaaaagggccct

SEQ ID NO: 315885 - DNA, 25 bp, Mus musculus
gctgacagaacccgagctgcctgcc

SEQ ID NO: 315886 - DNA, 25 bp, Mus musculus
gctgacagaattaacggcacagcca

SEQ ID NO: 315887 - DNA, 25 bp, Mus musculus
gctgacagacagtatctgaacacag

SEQ ID NO: 315888 - DNA, 25 bp, Mus musculus
gctgacagaccaagtctgctgaaga

SEQ ID NO: 315889 - DNA, 25 bp, Mus musculus
gctgacagacgaggtaaacagccca

SEQ ID NO: 315890 - DNA, 25 bp, Mus musculus
gctgacagagaaacgtctgtctgca

SEQ ID NO: 315891 - DNA, 25 bp, Mus musculus
gctgacagagcttttcttcatgcat

SEQ ID NO: 315892 - DNA, 25 bp, Mus musculus
gctgacagccagaagaattggctgg

SEQ ID NO: 315893 - DNA, 25 bp, Mus musculus
gctgacagccagaaggtagcccctg

SEQ ID NO: 315894 - DNA, 25 bp, Mus musculus
gctgacaggggttccacagcactgg

SEQ ID NO: 315895 - DNA, 25 bp, Mus musculus
gctgacatcacagatgagctccagt

SEQ ID NO: 315896 - DNA, 25 bp, Mus musculus
gctgacatcatcgagaccctgagga

SEQ ID NO: 315897 - DNA, 25 bp, Mus musculus
gctgacatcatcgaggcgctgcaca

SEQ ID NO: 315898 - DNA, 25 bp, Mus musculus
gctgacatcctgttgtacgtggtga

SEQ ID NO: 315899 - DNA, 25 bp, Mus musculus
gctgacatgtgcctgagcggagcgt

SEQ ID NO: 315900 - DNA, 25 bp, Mus musculus
gctgacatgtggagcattggcgtca

SEQ ID NO: 315901 - DNA, 25 bp, Mus musculus
gctgacattacaggaccaggtggac

SEQ ID NO: 315902 - DNA, 25 bp, Mus musculus
gctgacattactggcatgcctgtgg

SEQ ID NO: 315903 - DNA, 25 bp, Mus musculus
gctgacattcagagttgaaactgtg

SEQ ID NO: 315904 - DNA, 25 bp, Mus musculus
gctgacattcaggtgcagtctttgt

SEQ ID NO: 315905 - DNA, 25 bp, Mus musculus
gctgaccaagcccactccccaccgc

SEQ ID NO: 315906 - DNA, 25 bp, Mus musculus
gctgaccaaggagagagatggcatg

SEQ ID NO: 315907 - DNA, 25 bp, Mus musculus
gctgaccaaggcattggaattgtga

SEQ ID NO: 315908 - DNA, 25 bp, Mus musculus
gctgaccaaggcgccatggaaaagg

SEQ ID NO: 315909 - DNA, 25 bp, Mus musculus
gctgaccaagggactgcacaggact

SEQ ID NO: 315910 - DNA, 25 bp, Mus musculus
gctgaccacaccctgttcttgcttc

SEQ ID NO: 315911 - DNA, 25 bp, Mus musculus
gctgaccacatctgtcaaattatca

SEQ ID NO: 315912 - DNA, 25 bp, Mus musculus
gctgaccaggcagttctagatgagc

SEQ ID NO: 315913 - DNA, 25 bp, Mus musculus
gctgaccagtgactccaatatgcct

SEQ ID NO: 315914 - DNA, 25 bp, Mus musculus
gctgaccatactggacaccctttca

SEQ ID NO: 315915 - DNA, 25 bp, Mus musculus
gctgaccattactgggggatgcaga

SEQ ID NO: 315916 - DNA, 25 bp, Mus musculus
gctgacccactgaagctgggggcgg

SEQ ID NO: 315917 - DNA, 25 bp, Mus musculus
gctgacccagatatatttgtatgcg

SEQ ID NO: 315918 - DNA, 25 bp, Mus musculus
gctgacccagcggcgaggacgaggc

SEQ ID NO: 315919 - DNA, 25 bp, Mus musculus
gctgacccaggacatttgacacctc

SEQ ID NO: 315920 - DNA, 25 bp, Mus musculus
gctgacccagtttgctgagaagttt

SEQ ID NO: 315921 - DNA, 25 bp, Mus musculus
gctgaccccagagcaccagactgtg

SEQ ID NO: 315922 - DNA, 25 bp, Mus musculus
gctgaccccagcaagacattcaccc

SEQ ID NO: 315923 - DNA, 25 bp, Mus musculus
gctgacccccaagaggccattaact

SEQ ID NO: 315924 - DNA, 25 bp, Mus musculus
gctgacccccaaggccatcgcccac

SEQ ID NO: 315925 - DNA, 25 bp, Mus musculus
gctgaccctgtgtctcaggggccta

SEQ ID NO: 315926 - DNA, 25 bp, Mus musculus
gctgaccgacaaaaagatcaggcaa

SEQ ID NO: 315927 - DNA, 25 bp, Mus musculus
gctgaccggggcaggaagtggtcct

SEQ ID NO: 315928 - DNA, 25 bp, Mus musculus
gctgaccgtgctattcactggcaat

SEQ ID NO: 315929 - DNA, 25 bp, Mus musculus
gctgaccgtggtgagttgaggggtg

SEQ ID NO: 315930 - DNA, 25 bp, Mus musculus
gctgaccgttgaatcttttgagcat

SEQ ID NO: 315931 - DNA, 25 bp, Mus musculus
gctgacctactaggtcactgcccag

SEQ ID NO: 315932 - DNA, 25 bp, Mus musculus
gctgacctcaaggtttccctggaga

SEQ ID NO: 315933 - DNA, 25 bp, Mus musculus
gctgacctcactcagagccatgatg

SEQ ID NO: 315934 - DNA, 25 bp, Mus musculus
gctgacctcgaggaagtggacattg

SEQ ID NO: 315935 - DNA, 25 bp, Mus musculus
gctgacctgcagcaggtgatagagg

SEQ ID NO: 315936 - DNA, 25 bp, Mus musculus
gctgacctgccaatcccatctctcc

SEQ ID NO: 315937 - DNA, 25 bp, Mus musculus
gctgacctggagaagctgacctctc

SEQ ID NO: 315938 - DNA, 25 bp, Mus musculus
gctgaccttcatgcaaggctgggcc

SEQ ID NO: 315939 - DNA, 25 bp, Mus musculus
gctgaccttgctggactcgccagtg

SEQ ID NO: 315940 - DNA, 25 bp, Mus musculus
gctgacgaatgcaaggcaccaacag

SEQ ID NO: 315941 - DNA, 25 bp, Mus musculus
gctgacgaatgcaaggtgagagcac

SEQ ID NO: 315942 - DNA, 25 bp, Mus musculus
gctgacgagcatgagaggaggagct

SEQ ID NO: 315943 - DNA, 25 bp, Mus musculus
gctgacgagcatgagcttagcagcc

SEQ ID NO: 315944 - DNA, 25 bp, Mus musculus
gctgacgagcatgagtggggtccgg

SEQ ID NO: 315945 - DNA, 25 bp, Mus musculus
gctgacgcagatcattaagtgtcag

SEQ ID NO: 315946 - DNA, 25 bp, Mus musculus
gctgacgcaggatcctacccagaga

SEQ ID NO: 315947 - DNA, 25 bp, Mus musculus
gctgacgcgggtgggtcatcgtgga

SEQ ID NO: 315948 - DNA, 25 bp, Mus musculus
gctgacgctagtcagggacaagaag

SEQ ID NO: 315949 - DNA, 25 bp, Mus musculus
gctgacgctcagagagggggaggca

SEQ ID NO: 315950 - DNA, 25 bp, Mus musculus
gctgacgctcagaggttttctcttt

SEQ ID NO: 315951 - DNA, 25 bp, Mus musculus
gctgacggaccccggcaggaggact

SEQ ID NO: 315952 - DNA, 25 bp, Mus musculus
gctgacggacccctgtttgtaagcg

SEQ ID NO: 315953 - DNA, 25 bp, Mus musculus
gctgacggagacagggagttctcag

SEQ ID NO: 315954 - DNA, 25 bp, Mus musculus
gctgacggagggtgaggagttctac

SEQ ID NO: 315955 - DNA, 25 bp, Mus musculus
gctgacggaggtgtcccctgaactg

SEQ ID NO: 315956 - DNA, 25 bp, Mus musculus
gctgacggcaccatggcgtttatgt

SEQ ID NO: 315957 - DNA, 25 bp, Mus musculus
gctgacgtagaggaaatgctgtcat

SEQ ID NO: 315958 - DNA, 25 bp, Mus musculus
gctgacgtcatagtacaggattcat

SEQ ID NO: 315959 - DNA, 25 bp, Mus musculus
gctgactactccagtcactgtgggg

SEQ ID NO: 315960 - DNA, 25 bp, Mus musculus
gctgactactccatgcggctctgca

SEQ ID NO: 315961 - DNA, 25 bp, Mus musculus
gctgactcagcaaatggaacttcca

SEQ ID NO: 315962 - DNA, 25 bp, Mus musculus
gctgactcagcccggcaagctgaca

SEQ ID NO: 315963 - DNA, 25 bp, Mus musculus
gctgactcaggaatttgaagcctat

SEQ ID NO: 315964 - DNA, 25 bp, Mus musculus
gctgactcatatgagtccaacactg

SEQ ID NO: 315965 - DNA, 25 bp, Mus musculus
gctgactcatatgccctggtgtggg

SEQ ID NO: 315966 - DNA, 25 bp, Mus musculus
gctgactccaggaggaatgctgtgg

SEQ ID NO: 315967 - DNA, 25 bp, Mus musculus
gctgactccaggtctgttctcagag

SEQ ID NO: 315968 - DNA, 25 bp, Mus musculus
gctgactcccagacattgggcctgt

SEQ ID NO: 315969 - DNA, 25 bp, Mus musculus
gctgactcccagaccatctcctaca

SEQ ID NO: 315970 - DNA, 25 bp, Mus musculus
gctgactcccaggatgccctgatgg

SEQ ID NO: 315971 - DNA, 25 bp, Mus musculus
gctgactcgcaacgagtctgtagct

SEQ ID NO: 315972 - DNA, 25 bp, Mus musculus
gctgactcggatcgagccctaacgg

SEQ ID NO: 315973 - DNA, 25 bp, Mus musculus
gctgactcggccaaccaatggaatc

SEQ ID NO: 315974 - DNA, 25 bp, Mus musculus
gctgactcggctgaaagcaaaatca

SEQ ID NO: 315975 - DNA, 25 bp, Mus musculus
gctgactcgggtcattacaaagaaa

SEQ ID NO: 315976 - DNA, 25 bp, Mus musculus
gctgactcgggttatcttctctgta

SEQ ID NO: 315977 - DNA, 25 bp, Mus musculus
gctgactctcacaggggagaagcga

SEQ ID NO: 315978 - DNA, 25 bp, Mus musculus
gctgactgagcacactctgcagagg

SEQ ID NO: 315979 - DNA, 25 bp, Mus musculus
gctgactgagcacgcggtggaggga

SEQ ID NO: 315980 - DNA, 25 bp, Mus musculus
gctgactgagctcggattgggaaaa

SEQ ID NO: 315981 - DNA, 25 bp, Mus musculus
gctgactgcagagaggctggcctcc

SEQ ID NO: 315982 - DNA, 25 bp, Mus musculus
gctgactgcagatctgatttgtact

SEQ ID NO: 315983 - DNA, 25 bp, Mus musculus
gctgactgctgcggacaagttttta

SEQ ID NO: 315984 - DNA, 25 bp, Mus musculus
gctgactgctgtacacttcctgaag

SEQ ID NO: 315985 - DNA, 25 bp, Mus musculus
gctgactggaaagcactctccagcc

SEQ ID NO: 315986 - DNA, 25 bp, Mus musculus
gctgactggaaggatctgcgatggc

SEQ ID NO: 315987 - DNA, 25 bp, Mus musculus
gctgacttccagatgatgttgatcc

SEQ ID NO: 315988 - DNA, 25 bp, Mus musculus
gctgacttgatagcatagaaaattg

SEQ ID NO: 315989 - DNA, 25 bp, Mus musculus
gctgacttgcaggttgatatgtcag

SEQ ID NO: 315990 - DNA, 25 bp, Mus musculus
gctgagaaacagcacacagggccag

SEQ ID NO: 315991 - DNA, 25 bp, Mus musculus
gctgagaaacaggtggaagagctgt

SEQ ID NO: 315992 - DNA, 25 bp, Mus musculus
gctgagaaagaagctgctccagctg

SEQ ID NO: 315993 - DNA, 25 bp, Mus musculus
gctgagaaagacaggttgcagctgt

SEQ ID NO: 315994 - DNA, 25 bp, Mus musculus
gctgagaaatggcatttatctggga

SEQ ID NO: 315995 - DNA, 25 bp, Mus musculus
gctgagaaccgggaccgcgtggcgc

SEQ ID NO: 315996 - DNA, 25 bp, Mus musculus
gctgagaacggaaacctccacatgg

SEQ ID NO: 315997 - DNA, 25 bp, Mus musculus
gctgagaaggatgcccactgagcag

SEQ ID NO: 315998 - DNA, 25 bp, Mus musculus
gctgagaatatgtacttttctcact

SEQ ID NO: 315999 - DNA, 25 bp, Mus musculus
gctgagaatccagaaatggcctcca

SEQ ID NO: 316000 - DNA, 25 bp, Mus musculus
gctgagaatccagatccagggttcc

SEQ ID NO: 316001 - DNA, 25 bp, Mus musculus
gctgagaatccaggtctcccggact

SEQ ID NO: 316002 - DNA, 25 bp, Mus musculus
gctgagacaggcacataagactttg

SEQ ID NO: 316003 - DNA, 25 bp, Mus musculus
gctgagaccttcaccttccagagaa

SEQ ID NO: 316004 - DNA, 25 bp, Mus musculus
gctgagaccttccaggaacttccat

SEQ ID NO: 316005 - DNA, 25 bp, Mus musculus
gctgagaccttccaggtggaggatt

SEQ ID NO: 316006 - DNA, 25 bp, Mus musculus
gctgagactaaagtctttaagaaat

SEQ ID NO: 316007 - DNA, 25 bp, Mus musculus
gctgagagagaggatgagaccgggg

SEQ ID NO: 316008 - DNA, 25 bp, Mus musculus
gctgagagcacggactagaagtgag

SEQ ID NO: 316009 - DNA, 25 bp, Mus musculus
gctgagagcgaaccccgactgcagg

SEQ ID NO: 316010 - DNA, 25 bp, Mus musculus
gctgagagctggctcccttccccag

SEQ ID NO: 316011 - DNA, 25 bp, Mus musculus
gctgagagtaagatttatgacattc

SEQ ID NO: 316012 - DNA, 25 bp, Mus musculus
gctgagagtcgggccctgtctccaa

SEQ ID NO: 316013 - DNA, 25 bp, Mus musculus
gctgagagtcgggggcctggtgtac

SEQ ID NO: 316014 - DNA, 25 bp, Mus musculus
gctgagatcattaggaaacaggtct

SEQ ID NO: 316015 - DNA, 25 bp, Mus musculus
gctgagatcattaggtctcagccac

SEQ ID NO: 316016 - DNA, 25 bp, Mus musculus
gctgagatcttggaaatagcagaca

SEQ ID NO: 316017 - DNA, 25 bp, Mus musculus
gctgagatggaaaagcaaaaggtgg

SEQ ID NO: 316018 - DNA, 25 bp, Mus musculus
gctgagatggaaaaggtggcgcgtt

SEQ ID NO: 316019 - DNA, 25 bp, Mus musculus
gctgagattaaagacagctgcagca

SEQ ID NO: 316020 - DNA, 25 bp, Mus musculus
gctgagattaaaggcctctggggac

SEQ ID NO: 316021 - DNA, 25 bp, Mus musculus
gctgagattacagaatcgtatggaa

SEQ ID NO: 316022 - DNA, 25 bp, Mus musculus
gctgagattacagagaaaacagagg

SEQ ID NO: 316023 - DNA, 25 bp, Mus musculus
gctgagattacagaggcctcattca

SEQ ID NO: 316024 - DNA, 25 bp, Mus musculus
gctgagattacagggacagtgatca

SEQ ID NO: 316025 - DNA, 25 bp, Mus musculus
gctgagattacaggtgtggttgaat

SEQ ID NO: 316026 - DNA, 25 bp, Mus musculus
gctgagattgaagaaaccgggctcc

SEQ ID NO: 316027 - DNA, 25 bp, Mus musculus
gctgagattgccaggcccgacgact

SEQ ID NO: 316028 - DNA, 25 bp, Mus musculus
gctgagcaaacagctgcccgggagg

SEQ ID NO: 316029 - DNA, 25 bp, Mus musculus
gctgagcaaagatgaagcggcagct

SEQ ID NO: 316030 - DNA, 25 bp, Mus musculus
gctgagcaaaggagtgattctcgat

SEQ ID NO: 316031 - DNA, 25 bp, Mus musculus
gctgagcaaattcagatataaaaag

SEQ ID NO: 316032 - DNA, 25 bp, Mus musculus
gctgagcaaattcagctaataattt

SEQ ID NO: 316033 - DNA, 25 bp, Mus musculus
gctgagcaagagatgcctgccttga

SEQ ID NO: 316034 - DNA, 25 bp, Mus musculus
gctgagcaaggatgaagatggaaag

SEQ ID NO: 316035 - DNA, 25 bp, Mus musculus
gctgagcaccagggcttccagctgg

SEQ ID NO: 316036 - DNA, 25 bp, Mus musculus
gctgagcacggagcctggtggaggt

SEQ ID NO: 316037 - DNA, 25 bp, Mus musculus
gctgagcacgttgagccacgtggtg

SEQ ID NO: 316038 - DNA, 25 bp, Mus musculus
gctgagcagaagggccttcttgaag

SEQ ID NO: 316039 - DNA, 25 bp, Mus musculus
gctgagcagcacgcctccggtctac

SEQ ID NO: 316040 - DNA, 25 bp, Mus musculus
gctgagcagcaggctgacgaggtcc

SEQ ID NO: 316041 - DNA, 25 bp, Mus musculus
gctgagcagcaggtgaaccagctgg

SEQ ID NO: 316042 - DNA, 25 bp, Mus musculus
gctgagcccatgagtggaaacaagt

SEQ ID NO: 316043 - DNA, 25 bp, Mus musculus
gctgagcccccgcaggataaggaag

SEQ ID NO: 316044 - DNA, 25 bp, Mus musculus
gctgagcccccgcaggtgcgcttga

SEQ ID NO: 316045 - DNA, 25 bp, Mus musculus
gctgagccctgcgccaaaacgacac

SEQ ID NO: 316046 - DNA, 25 bp, Mus musculus
gctgagccgagagaagagccctggg

SEQ ID NO: 316047 - DNA, 25 bp, Mus musculus
gctgagccgcattaaggacagcctt

SEQ ID NO: 316048 - DNA, 25 bp, Mus musculus
gctgagcctggggaacaaaaactgc

SEQ ID NO: 316049 - DNA, 25 bp, Mus musculus
gctgagcctgggtcactgttctggg

SEQ ID NO: 316050 - DNA, 25 bp, Mus musculus
gctgagcgagagagggaactggagg

SEQ ID NO: 316051 - DNA, 25 bp, Mus musculus
gctgagcgaggagtgactgcaaagt

SEQ ID NO: 316052 - DNA, 25 bp, Mus musculus
gctgagcgaggtgtgactgcaaagt

SEQ ID NO: 316053 - DNA, 25 bp, Mus musculus
gctgagcgcagtgggagatttgaaa

SEQ ID NO: 316054 - DNA, 25 bp, Mus musculus
gctgagcgctgagattggtgtcctt

SEQ ID NO: 316055 - DNA, 25 bp, Mus musculus
gctgagcgctgattcctgagtcagg

SEQ ID NO: 316056 - DNA, 25 bp, Mus musculus
gctgagcggactggcttttatgaaa

SEQ ID NO: 316057 - DNA, 25 bp, Mus musculus
gctgagcgtggagaaaaagcagcga

SEQ ID NO: 316058 - DNA, 25 bp, Mus musculus
gctgagctcaatatggatcaaaatt

SEQ ID NO: 316059 - DNA, 25 bp, Mus musculus
gctgagctgaactgagctgagctgg

SEQ ID NO: 316060 - DNA, 25 bp, Mus musculus
gctgagctgagctggagagtcagtc

SEQ ID NO: 316061 - DNA, 25 bp, Mus musculus
gctgagctgcgaggggtcctgagaa

SEQ ID NO: 316062 - DNA, 25 bp, Mus musculus
gctgagctgggagagtcagtccttc

SEQ ID NO: 316063 - DNA, 25 bp, Mus musculus
gctgagcttgagcagcatcagaaaa

SEQ ID NO: 316064 - DNA, 25 bp, Mus musculus
gctgagcttgagcagctgagtccct

SEQ ID NO: 316065 - DNA, 25 bp, Mus musculus
gctgagcttgcaggcatctagtctt

SEQ ID NO: 316066 - DNA, 25 bp, Mus musculus
gctgagcttgctaagctacaagaag

SEQ ID NO: 316067 - DNA, 25 bp, Mus musculus
gctgagcttgctaaggtggaagaag

SEQ ID NO: 316068 - DNA, 25 bp, Mus musculus
gctgaggaaacaggccgaggaagat

SEQ ID NO: 316069 - DNA, 25 bp, Mus musculus
gctgaggaacatctgattgccttca

SEQ ID NO: 316070 - DNA, 25 bp, Mus musculus
gctgaggaaccactgaactggcatt

SEQ ID NO: 316071 - DNA, 25 bp, Mus musculus
gctgaggaagagaagtttattgata

SEQ ID NO: 316072 - DNA, 25 bp, Mus musculus
gctgaggaagccgccactggagaat

SEQ ID NO: 316073 - DNA, 25 bp, Mus musculus
gctgaggaatgtgatggttctccag

SEQ ID NO: 316074 - DNA, 25 bp, Mus musculus
gctgaggaatgtgcccctgtccctt

SEQ ID NO: 316075 - DNA, 25 bp, Mus musculus
gctgaggacattaagagtggaaagc

SEQ ID NO: 316076 - DNA, 25 bp, Mus musculus
gctgaggacattaaggccacccgag

SEQ ID NO: 316077 - DNA, 25 bp, Mus musculus
gctgaggacttctcagagtctgtcc

SEQ ID NO: 316078 - DNA, 25 bp, Mus musculus
gctgaggagaagcaaaccaagagtt

SEQ ID NO: 316079 - DNA, 25 bp, Mus musculus
gctgaggagagggaactagttccct

SEQ ID NO: 316080 - DNA, 25 bp, Mus musculus
gctgaggagctcttccaggaatctg

SEQ ID NO: 316081 - DNA, 25 bp, Mus musculus
gctgaggattttccatctttaaatc

SEQ ID NO: 316082 - DNA, 25 bp, Mus musculus
gctgaggcagagaaaaggcaggagc

SEQ ID NO: 316083 - DNA, 25 bp, Mus musculus
gctgaggcaggaaggttcgttctcc

SEQ ID NO: 316084 - DNA, 25 bp, Mus musculus
gctgaggcaggacggattctgatgc

SEQ ID NO: 316085 - DNA, 25 bp, Mus musculus
gctgaggcaggacggctgctgtgaa

SEQ ID NO: 316086 - DNA, 25 bp, Mus musculus
gctgaggcagggtcagaaagcatgg

SEQ ID NO: 316087 - DNA, 25 bp, Mus musculus
gctgaggcatcagatgcttatacca

SEQ ID NO: 316088 - DNA, 25 bp, Mus musculus
gctgaggccaggtctcttaaccttc

SEQ ID NO: 316089 - DNA, 25 bp, Mus musculus
gctgaggccgcagggttgcagaaac

SEQ ID NO: 316090 - DNA, 25 bp, Mus musculus
gctgaggccgggaccggagctgatc

SEQ ID NO: 316091 - DNA, 25 bp, Mus musculus
gctgaggcgaaagagagccgggtca

SEQ ID NO: 316092 - DNA, 25 bp, Mus musculus
gctgaggcggggcatcgtgaagctg

SEQ ID NO: 316093 - DNA, 25 bp, Mus musculus
gctgaggctcaggagaccaccatca

SEQ ID NO: 316094 - DNA, 25 bp, Mus musculus
gctgaggctcagtggagaccagagg

SEQ ID NO: 316095 - DNA, 25 bp, Mus musculus
gctgagggaaagaaaaataccttga

SEQ ID NO: 316096 - DNA, 25 bp, Mus musculus
gctgagggaaagagttcacatgaga

SEQ ID NO: 316097 - DNA, 25 bp, Mus musculus
gctgagggaaagattgacggcgggg

SEQ ID NO: 316098 - DNA, 25 bp, Mus musculus
gctgagggaccagacaaaaagtccc

SEQ ID NO: 316099 - DNA, 25 bp, Mus musculus
gctgagggagacgcactacttcggc

SEQ ID NO: 316100 - DNA, 25 bp, Mus musculus
gctgagggctctagcttggacagcc

SEQ ID NO: 316101 - DNA, 25 bp, Mus musculus
gctgagggctctagtgtcactgctc

SEQ ID NO: 316102 - DNA, 25 bp, Mus musculus
gctgagggtcgagaatacaagaaaa

SEQ ID NO: 316103 - DNA, 25 bp, Mus musculus
gctgagggtcggtgccagcacatca

SEQ ID NO: 316104 - DNA, 25 bp, Mus musculus
gctgagggtggttagaaagctgtct

SEQ ID NO: 316105 - DNA, 25 bp, Mus musculus
gctgaggtggagaaggccaagggga

SEQ ID NO: 316106 - DNA, 25 bp, Mus musculus
gctgaggtggagaaggccgagtaca

SEQ ID NO: 316107 - DNA, 25 bp, Mus musculus
gctgaggtggaggagatcctggtgc

SEQ ID NO: 316108 - DNA, 25 bp, Mus musculus
gctgaggtggtatataaccgttccc

SEQ ID NO: 316109 - DNA, 25 bp, Mus musculus
gctgagtaagccgagttctctagcc

SEQ ID NO: 316110 - DNA, 25 bp, Mus musculus
gctgagtacaggatatgaatcagag

SEQ ID NO: 316111 - DNA, 25 bp, Mus musculus
gctgagtacaggcgtgggtgactga

SEQ ID NO: 316112 - DNA, 25 bp, Mus musculus
gctgagtaccacgcggacatctatg

SEQ ID NO: 316113 - DNA, 25 bp, Mus musculus
gctgagtaccacgcgggggaagggc

SEQ ID NO: 316114 - DNA, 25 bp, Mus musculus
gctgagtatagacaactgtcatcat

SEQ ID NO: 316115 - DNA, 25 bp, Mus musculus
gctgagtatagaggtgctccagacc

SEQ ID NO: 316116 - DNA, 25 bp, Mus musculus
gctgagtataggaaggggccagatt

SEQ ID NO: 316117 - DNA, 25 bp, Mus musculus
gctgagtcatggacggtttgaagat

SEQ ID NO: 316118 - DNA, 25 bp, Mus musculus
gctgagtcatggacgttcggggatg

SEQ ID NO: 316119 - DNA, 25 bp, Mus musculus
gctgagtccaggtgcagctgctgga

SEQ ID NO: 316120 - DNA, 25 bp, Mus musculus
gctgagtccaggtgttttggttcat

SEQ ID NO: 316121 - DNA, 25 bp, Mus musculus
gctgagtcccaaaggatgcatgctg

SEQ ID NO: 316122 - DNA, 25 bp, Mus musculus
gctgagtcccaaagggtcttcagat

SEQ ID NO: 316123 - DNA, 25 bp, Mus musculus
gctgagtcccaaaggtgtcctgcag

SEQ ID NO: 316124 - DNA, 25 bp, Mus musculus
gctgagtctaaagggaagcgattat

SEQ ID NO: 316125 - DNA, 25 bp, Mus musculus
gctgagtgacaggggacccatgagc

SEQ ID NO: 316126 - DNA, 25 bp, Mus musculus
gctgagtgacatcgcatcggctctt

SEQ ID NO: 316127 - DNA, 25 bp, Mus musculus
gctgagtgacatcggcgccagagct

SEQ ID NO: 316128 - DNA, 25 bp, Mus musculus
gctgagtgagaaaaggatgattgag

SEQ ID NO: 316129 - DNA, 25 bp, Mus musculus
gctgagtgagaaaaggccctcaact

SEQ ID NO: 316130 - DNA, 25 bp, Mus musculus
gctgagtgcaagtgtcctgcaggag

SEQ ID NO: 316131 - DNA, 25 bp, Mus musculus
gctgagtgctgaagaggaagagcag

SEQ ID NO: 316132 - DNA, 25 bp, Mus musculus
gctgagtggagtggggacggcagcg

SEQ ID NO: 316133 - DNA, 25 bp, Mus musculus
gctgagtgtaagggttcccgagaga

SEQ ID NO: 316134 - DNA, 25 bp, Mus musculus
gctgagtgtcctaggtcttgagaga

SEQ ID NO: 316135 - DNA, 25 bp, Mus musculus
gctgagttcacagaaacttcgtggc

SEQ ID NO: 316136 - DNA, 25 bp, Mus musculus
gctgagttcacagagttctcagtat

SEQ ID NO: 316137 - DNA, 25 bp, Mus musculus
gctgagttccagagcccccttcact

SEQ ID NO: 316138 - DNA, 25 bp, Mus musculus
gctgagttctggaatacagtgagta

SEQ ID NO: 316139 - DNA, 25 bp, Mus musculus
gctgagtttgaggaggctcaacgca

SEQ ID NO: 316140 - DNA, 25 bp, Mus musculus
gctgataaaattctggagctggagg

SEQ ID NO: 316141 - DNA, 25 bp, Mus musculus
gctgataacacaggccatggcgcag

SEQ ID NO: 316142 - DNA, 25 bp, Mus musculus
gctgataacacaggtgccttcttca

SEQ ID NO: 316143 - DNA, 25 bp, Mus musculus
gctgataaccacggctctgaagcgt

SEQ ID NO: 316144 - DNA, 25 bp, Mus musculus
gctgataaccacgtctctgggtcct

SEQ ID NO: 316145 - DNA, 25 bp, Mus musculus
gctgataccaacaaggcaaagggtg

SEQ ID NO: 316146 - DNA, 25 bp, Mus musculus
gctgataccggtgacagtggtaaag

SEQ ID NO: 316147 - DNA, 25 bp, Mus musculus
gctgatagcgatcattgctgtcttc

SEQ ID NO: 316148 - DNA, 25 bp, Mus musculus
gctgatagcggggatcccagcattg

SEQ ID NO: 316149 - DNA, 25 bp, Mus musculus
gctgatagtggtaaggccatcgaag

SEQ ID NO: 316150 - DNA, 25 bp, Mus musculus
gctgatagtggtaagtgcggctggc

SEQ ID NO: 316151 - DNA, 25 bp, Mus musculus
gctgatatggagaaccttcacacct

SEQ ID NO: 316152 - DNA, 25 bp, Mus musculus
gctgatcaaactggattcagaacac

SEQ ID NO: 316153 - DNA, 25 bp, Mus musculus
gctgatcaaaggaaaggactcagct

SEQ ID NO: 316154 - DNA, 25 bp, Mus musculus
gctgatcaagaggcctgccaagccc

SEQ ID NO: 316155 - DNA, 25 bp, Mus musculus
gctgatcaagccagccatctcccct

SEQ ID NO: 316156 - DNA, 25 bp, Mus musculus
gctgatcaaggaaccttctgtggat

SEQ ID NO: 316157 - DNA, 25 bp, Mus musculus
gctgatcaaggtcttggataaactt

SEQ ID NO: 316158 - DNA, 25 bp, Mus musculus
gctgatcaggtccagggcaatggca

SEQ ID NO: 316159 - DNA, 25 bp, Mus musculus
gctgatccagacggccacccgagac

SEQ ID NO: 316160 - DNA, 25 bp, Mus musculus
gctgatccagtgaagtcgagttcca

SEQ ID NO: 316161 - DNA, 25 bp, Mus musculus
gctgatcccaagggttggcccctag

SEQ ID NO: 316162 - DNA, 25 bp, Mus musculus
gctgatccccagacagttacacgtc

SEQ ID NO: 316163 - DNA, 25 bp, Mus musculus
gctgatccccagctgtgctcaggat

SEQ ID NO: 316164 - DNA, 25 bp, Mus musculus
gctgatcccccagagaggccaggct

SEQ ID NO: 316165 - DNA, 25 bp, Mus musculus
gctgatcccccagagagtcatggac

SEQ ID NO: 316166 - DNA, 25 bp, Mus musculus
gctgatccctagagatgtcttcctg

SEQ ID NO: 316167 - DNA, 25 bp, Mus musculus
gctgatccctaggtcagacgggaac

SEQ ID NO: 316168 - DNA, 25 bp, Mus musculus
gctgatcctatggtgaatcccccgg

SEQ ID NO: 316169 - DNA, 25 bp, Mus musculus
gctgatcgaagagttagcaatagcg

SEQ ID NO: 316170 - DNA, 25 bp, Mus musculus
gctgatcgagaaaacataaagaaca

SEQ ID NO: 316171 - DNA, 25 bp, Mus musculus
gctgatcgcctcaaggagtatgtct

SEQ ID NO: 316172 - DNA, 25 bp, Mus musculus
gctgatctcctaggagtgcgcgatg

SEQ ID NO: 316173 - DNA, 25 bp, Mus musculus
gctgatctcctaggtttcaggaatg

SEQ ID NO: 316174 - DNA, 25 bp, Mus musculus
gctgatctgcagactcagccttatg

SEQ ID NO: 316175 - DNA, 25 bp, Mus musculus
gctgatctgcagtcagcaactctta

SEQ ID NO: 316176 - DNA, 25 bp, Mus musculus
gctgatctgcatccccaaaagcatc

SEQ ID NO: 316177 - DNA, 25 bp, Mus musculus
gctgatgaaaaacagggaagctgcc

SEQ ID NO: 316178 - DNA, 25 bp, Mus musculus
gctgatgaaaaacagggaagctgct

SEQ ID NO: 316179 - DNA, 25 bp, Mus musculus
gctgatgaagccatcaaaggatttt

SEQ ID NO: 316180 - DNA, 25 bp, Mus musculus
gctgatgaaggacaaccctccatat

SEQ ID NO: 316181 - DNA, 25 bp, Mus musculus
gctgatgaaggagagagaagtgcag

SEQ ID NO: 316182 - DNA, 25 bp, Mus musculus
gctgatgaaggagcttgaagagatc

SEQ ID NO: 316183 - DNA, 25 bp, Mus musculus
gctgatgaagggtccgcaggtccgg

SEQ ID NO: 316184 - DNA, 25 bp, Mus musculus
gctgatgacacagattctgagctgg

SEQ ID NO: 316185 - DNA, 25 bp, Mus musculus
gctgatgacccagtcttatctcctc

SEQ ID NO: 316186 - DNA, 25 bp, Mus musculus
gctgatgaccctgactatatagtgc

SEQ ID NO: 316187 - DNA, 25 bp, Mus musculus
gctgatgaccgacccttgggtaggt

SEQ ID NO: 316188 - DNA, 25 bp, Mus musculus
gctgatgactccgaaccaactgtga

SEQ ID NO: 316189 - DNA, 25 bp, Mus musculus
gctgatgagctcaacggtttagcct

SEQ ID NO: 316190 - DNA, 25 bp, Mus musculus
gctgatgagctcaactctgaagtgt

SEQ ID NO: 316191 - DNA, 25 bp, Mus musculus
gctgatgagctcaagggtttagcct

SEQ ID NO: 316192 - DNA, 25 bp, Mus musculus
gctgatgagctcaagtctgaagtgt

SEQ ID NO: 316193 - DNA, 25 bp, Mus musculus
gctgatgaggatcctcagctcctcc

SEQ ID NO: 316194 - DNA, 25 bp, Mus musculus
gctgatgatcaggaccagtgtccag

SEQ ID NO: 316195 - DNA, 25 bp, Mus musculus
gctgatgcagacggagaagcagttc

SEQ ID NO: 316196 - DNA, 25 bp, Mus musculus
gctgatgcagactttgtggtgctcg

SEQ ID NO: 316197 - DNA, 25 bp, Mus musculus
gctgatgcagctcccccaccagtcc

SEQ ID NO: 316198 - DNA, 25 bp, Mus musculus
gctgatgccagtcattgcattcagc

SEQ ID NO: 316199 - DNA, 25 bp, Mus musculus
gctgatgccagtcattgtatacaac

SEQ ID NO: 316200 - DNA, 25 bp, Mus musculus
gctgatgccattctatttatttcgg

SEQ ID NO: 316201 - DNA, 25 bp, Mus musculus
gctgatgccctgcaccactttgcca

SEQ ID NO: 316202 - DNA, 25 bp, Mus musculus
gctgatgctcggtgaaggaggtcgt

SEQ ID NO: 316203 - DNA, 25 bp, Mus musculus
gctgatgctgtagagagacaatgtc

SEQ ID NO: 316204 - DNA, 25 bp, Mus musculus
gctgatggaattgaacttttgagca

SEQ ID NO: 316205 - DNA, 25 bp, Mus musculus
gctgatggacagccctgggatcgat

SEQ ID NO: 316206 - DNA, 25 bp, Mus musculus
gctgatggacggctctcagacactg

SEQ ID NO: 316207 - DNA, 25 bp, Mus musculus
gctgatggagaacaggatgaagaag

SEQ ID NO: 316208 - DNA, 25 bp, Mus musculus
gctgatggagagaggtgccagcgtg

SEQ ID NO: 316209 - DNA, 25 bp, Mus musculus
gctgatggagagttatttgcttggg

SEQ ID NO: 316210 - DNA, 25 bp, Mus musculus
gctgatggagcatctgggtggtcta

SEQ ID NO: 316211 - DNA, 25 bp, Mus musculus
gctgatggagctatatacgccatgg

SEQ ID NO: 316212 - DNA, 25 bp, Mus musculus
gctgatggagtatggtgatgaagct

SEQ ID NO: 316213 - DNA, 25 bp, Mus musculus
gctgatggagtgatgggagccagga

SEQ ID NO: 316214 - DNA, 25 bp, Mus musculus
gctgatggcagcctctccaggcaga

SEQ ID NO: 316215 - DNA, 25 bp, Mus musculus
gctgatggcatgtgtccaaatgatg

SEQ ID NO: 316216 - DNA, 25 bp, Mus musculus
gctgatggccatggtcaagaaaaaa

SEQ ID NO: 316217 - DNA, 25 bp, Mus musculus
gctgatggcggtgaagacaaagtag

SEQ ID NO: 316218 - DNA, 25 bp, Mus musculus
gctgatggctattcggagaataatg

SEQ ID NO: 316219 - DNA, 25 bp, Mus musculus
gctgatggtgaagatcccatacatc

SEQ ID NO: 316220 - DNA, 25 bp, Mus musculus
gctgatgtaaagattttgctggaag

SEQ ID NO: 316221 - DNA, 25 bp, Mus musculus
gctgatgtcattctcccatgtgtga

SEQ ID NO: 316222 - DNA, 25 bp, Mus musculus
gctgatgtcccgccgaacgcagtgc

SEQ ID NO: 316223 - DNA, 25 bp, Mus musculus
gctgatgtgggtgtagcactcctgg

SEQ ID NO: 316224 - DNA, 25 bp, Mus musculus
gctgattccagttacttcctgcctt

SEQ ID NO: 316225 - DNA, 25 bp, Mus musculus
gctgattcccctggatcattcggac

SEQ ID NO: 316226 - DNA, 25 bp, Mus musculus
gctgattcgagaggttccgtgagga

SEQ ID NO: 316227 - DNA, 25 bp, Mus musculus
gctgattcgagcgacttcggagcac

SEQ ID NO: 316228 - DNA, 25 bp, Mus musculus
gctgattcgagcggggttccttgtg

SEQ ID NO: 316229 - DNA, 25 bp, Mus musculus
gctgattgagaagctgggaggctgg

SEQ ID NO: 316230 - DNA, 25 bp, Mus musculus
gctgattgggaaggtttggcctgga

SEQ ID NO: 316231 - DNA, 25 bp, Mus musculus
gctgattgtagacaccggtaccaac

SEQ ID NO: 316232 - DNA, 25 bp, Mus musculus
gctgattgtgaaaacattcgtatag

SEQ ID NO: 316233 - DNA, 25 bp, Mus musculus
gctgatttacagaagataacaaagt

SEQ ID NO: 316234 - DNA, 25 bp, Mus musculus
gctgatttacagaagtgctaggcct

SEQ ID NO: 316235 - DNA, 25 bp, Mus musculus
gctgatttacagaagtggacaagaa

SEQ ID NO: 316236 - DNA, 25 bp, Mus musculus
gctgatttaggaggacaggtgtgag

SEQ ID NO: 316237 - DNA, 25 bp, Mus musculus
gctgattttcccgaatactcctcaa

SEQ ID NO: 316238 - DNA, 25 bp, Mus musculus
gctgattttgccaagtcatctcaca

SEQ ID NO: 316239 - DNA, 25 bp, Mus musculus
gctgatttttcaggcccaatgatga

SEQ ID NO: 316240 - DNA, 25 bp, Mus musculus
gctgatttttcaggggatgtttcgg

SEQ ID NO: 316241 - DNA, 25 bp, Mus musculus
gctgcaaaaacaaagctcctgggct

SEQ ID NO: 316242 - DNA, 25 bp, Mus musculus
gctgcaaaaacttgagaattacatt

SEQ ID NO: 316243 - DNA, 25 bp, Mus musculus
gctgcaaaaaggtcctggtctctcc

SEQ ID NO: 316244 - DNA, 25 bp, Mus musculus
gctgcaaaacccaaagccctttgcc

SEQ ID NO: 316245 - DNA, 25 bp, Mus musculus
gctgcaaaagagcaccagcacagct

SEQ ID NO: 316246 - DNA, 25 bp, Mus musculus
gctgcaaaagcgggcctcctgctgc

SEQ ID NO: 316247 - DNA, 25 bp, Mus musculus
gctgcaaaagcgggtggaggagagc

SEQ ID NO: 316248 - DNA, 25 bp, Mus musculus
gctgcaaataacgtgaactgtggac

SEQ ID NO: 316249 - DNA, 25 bp, Mus musculus
gctgcaaatgacacaacacggaaag

SEQ ID NO: 316250 - DNA, 25 bp, Mus musculus
gctgcaaatggtaacgatcggaaca

SEQ ID NO: 316251 - DNA, 25 bp, Mus musculus
gctgcaaatttacagagcagcatgg

SEQ ID NO: 316252 - DNA, 25 bp, Mus musculus
gctgcaacaaccttgaccttattca

SEQ ID NO: 316253 - DNA, 25 bp, Mus musculus
gctgcaacaatgaatggcatgcatt

SEQ ID NO: 316254 - DNA, 25 bp, Mus musculus
gctgcaacaatggcgccccctgtaa

SEQ ID NO: 316255 - DNA, 25 bp, Mus musculus
gctgcaacagcaaggtggccacgaa

SEQ ID NO: 316256 - DNA, 25 bp, Mus musculus
gctgcaacagcgaggcagaggctcc

SEQ ID NO: 316257 - DNA, 25 bp, Mus musculus
gctgcaaccatgagaccagcaccaa

SEQ ID NO: 316258 - DNA, 25 bp, Mus musculus
gctgcaaccatgatcaagcacttcc

SEQ ID NO: 316259 - DNA, 25 bp, Mus musculus
gctgcaaccatggatgacaaggagt

SEQ ID NO: 316260 - DNA, 25 bp, Mus musculus
gctgcaaccgaggtcacatggtggg

SEQ ID NO: 316261 - DNA, 25 bp, Mus musculus
gctgcaactttaagatggagccaga

SEQ ID NO: 316262 - DNA, 25 bp, Mus musculus
gctgcaagaaaccttgtcactagat

SEQ ID NO: 316263 - DNA, 25 bp, Mus musculus
gctgcaagaccaaggacgagtcttg

SEQ ID NO: 316264 - DNA, 25 bp, Mus musculus
gctgcaagactaggtttgccagatc

SEQ ID NO: 316265 - DNA, 25 bp, Mus musculus
gctgcaagatggaagaaaatctggg

SEQ ID NO: 316266 - DNA, 25 bp, Mus musculus
gctgcaagatggaagggctctctaa

SEQ ID NO: 316267 - DNA, 25 bp, Mus musculus
gctgcaagcatccagagcaagaaga

SEQ ID NO: 316268 - DNA, 25 bp, Mus musculus
gctgcaagcatccagggcttatcag

SEQ ID NO: 316269 - DNA, 25 bp, Mus musculus
gctgcaagccctgagcttgtcccac

SEQ ID NO: 316270 - DNA, 25 bp, Mus musculus
gctgcaagccctggctgcttttaga

SEQ ID NO: 316271 - DNA, 25 bp, Mus musculus
gctgcaagcggattgggtttccttc

SEQ ID NO: 316272 - DNA, 25 bp, Mus musculus
gctgcaaggcaggttggcgtgggtg

SEQ ID NO: 316273 - DNA, 25 bp, Mus musculus
gctgcaagtgggtctccaacaagtg

SEQ ID NO: 316274 - DNA, 25 bp, Mus musculus
gctgcaatcatcaggagcaaagagc

SEQ ID NO: 316275 - DNA, 25 bp, Mus musculus
gctgcaatgaggtcaactccgtcaa

SEQ ID NO: 316276 - DNA, 25 bp, Mus musculus
gctgcaatggcagaacacaagaatt

SEQ ID NO: 316277 - DNA, 25 bp, Mus musculus
gctgcaatggcagcctggactgcat

SEQ ID NO: 316278 - DNA, 25 bp, Mus musculus
gctgcaatggcaggttttactgcaa

SEQ ID NO: 316279 - DNA, 25 bp, Mus musculus
gctgcacaaaacgagatctggcaga

SEQ ID NO: 316280 - DNA, 25 bp, Mus musculus
gctgcacaaaacgagtgacgagtat

SEQ ID NO: 316281 - DNA, 25 bp, Mus musculus
gctgcacaaacgagctccttatgtc

SEQ ID NO: 316282 - DNA, 25 bp, Mus musculus
gctgcacaaacgaggggaatatatt

SEQ ID NO: 316283 - DNA, 25 bp, Mus musculus
gctgcacaagtcacgggtcacagtg

SEQ ID NO: 316284 - DNA, 25 bp, Mus musculus
gctgcacaatgccttaggattcttt

SEQ ID NO: 316285 - DNA, 25 bp, Mus musculus
gctgcacacttacgtccacgccacg

SEQ ID NO: 316286 - DNA, 25 bp, Mus musculus
gctgcacagaaagactaccaccata

SEQ ID NO: 316287 - DNA, 25 bp, Mus musculus
gctgcacagaaagccaggggctggg

SEQ ID NO: 316288 - DNA, 25 bp, Mus musculus
gctgcacagaaagggagagtcctgc

SEQ ID NO: 316289 - DNA, 25 bp, Mus musculus
gctgcacagagagaattttgttcag

SEQ ID NO: 316290 - DNA, 25 bp, Mus musculus
gctgcacagcagaggtggaaaatgg

SEQ ID NO: 316291 - DNA, 25 bp, Mus musculus
gctgcacaggagggtcacttccctc

SEQ ID NO: 316292 - DNA, 25 bp, Mus musculus
gctgcacagtgatcatcaaggaggt

SEQ ID NO: 316293 - DNA, 25 bp, Mus musculus
gctgcacagtgatgactcttccacg

SEQ ID NO: 316294 - DNA, 25 bp, Mus musculus
gctgcacagtgtatgagaagcagcg

SEQ ID NO: 316295 - DNA, 25 bp, Mus musculus
gctgcacatatgaggtgcttgagca

SEQ ID NO: 316296 - DNA, 25 bp, Mus musculus
gctgcacatatgagtgttttaaaat

SEQ ID NO: 316297 - DNA, 25 bp, Mus musculus
gctgcacatcaagacctgtgttcct

SEQ ID NO: 316298 - DNA, 25 bp, Mus musculus
gctgcacatcaaggtccctttgtgt

SEQ ID NO: 316299 - DNA, 25 bp, Mus musculus
gctgcaccagattataagtgcctgg

SEQ ID NO: 316300 - DNA, 25 bp, Mus musculus
gctgcaccagattgatgtcctcgaa

SEQ ID NO: 316301 - DNA, 25 bp, Mus musculus
gctgcaccccgtcagtcatatcatt

SEQ ID NO: 316302 - DNA, 25 bp, Mus musculus
gctgcacccctacagccccagctaa

SEQ ID NO: 316303 - DNA, 25 bp, Mus musculus
gctgcacccctacaggatggtcaga

SEQ ID NO: 316304 - DNA, 25 bp, Mus musculus
gctgcacccctacaggtctgtctga

SEQ ID NO: 316305 - DNA, 25 bp, Mus musculus
gctgcacccctacagtcagggtttc

SEQ ID NO: 316306 - DNA, 25 bp, Mus musculus
gctgcacccctacagtgttctcaac

SEQ ID NO: 316307 - DNA, 25 bp, Mus musculus
gctgcacccgcaaagcctccaggtg

SEQ ID NO: 316308 - DNA, 25 bp, Mus musculus
gctgcacctatatcctgaataaaaa

SEQ ID NO: 316309 - DNA, 25 bp, Mus musculus
gctgcacctggagatctgcctgtca

SEQ ID NO: 316310 - DNA, 25 bp, Mus musculus
gctgcacgatagtatgaccggttgc

SEQ ID NO: 316311 - DNA, 25 bp, Mus musculus
gctgcacgccgccagagacggcaaa

SEQ ID NO: 316312 - DNA, 25 bp, Mus musculus
gctgcacgccggcatgtgtttcttt

SEQ ID NO: 316313 - DNA, 25 bp, Mus musculus
gctgcacgccgtaatttctaatgcc

SEQ ID NO: 316314 - DNA, 25 bp, Mus musculus
gctgcacgccttcagagacggcaaa

SEQ ID NO: 316315 - DNA, 25 bp, Mus musculus
gctgcacggcgggagggagcccaga

SEQ ID NO: 316316 - DNA, 25 bp, Mus musculus
gctgcacgtcaggacaaagtggggc

SEQ ID NO: 316317 - DNA, 25 bp, Mus musculus
gctgcactacacagccattaggaac

SEQ ID NO: 316318 - DNA, 25 bp, Mus musculus
gctgcactcaaaagtcagcgtggga

SEQ ID NO: 316319 - DNA, 25 bp, Mus musculus
gctgcactcagaaccattgttggag

SEQ ID NO: 316320 - DNA, 25 bp, Mus musculus
gctgcactcagctgccaactccagc

SEQ ID NO: 316321 - DNA, 25 bp, Mus musculus
gctgcactcaggaagaggagacaga

SEQ ID NO: 316322 - DNA, 25 bp, Mus musculus
gctgcactcgcagaacaccagcctc

SEQ ID NO: 316323 - DNA, 25 bp, Mus musculus
gctgcactgaaataaccagctttca

SEQ ID NO: 316324 - DNA, 25 bp, Mus musculus
gctgcactgtacagacagtggattt

SEQ ID NO: 316325 - DNA, 25 bp, Mus musculus
gctgcacttcagacgaattatcaat

SEQ ID NO: 316326 - DNA, 25 bp, Mus musculus
gctgcagaaaaagacggcctgtcag

SEQ ID NO: 316327 - DNA, 25 bp, Mus musculus
gctgcagaaaaaggagcaggtaggg

SEQ ID NO: 316328 - DNA, 25 bp, Mus musculus
gctgcagaaaatatggtggtcactg

SEQ ID NO: 316329 - DNA, 25 bp, Mus musculus
gctgcagaaaggtcagacgggaaca

SEQ ID NO: 316330 - DNA, 25 bp, Mus musculus
gctgcagaaccaggtggagaatcta

SEQ ID NO: 316331 - DNA, 25 bp, Mus musculus
gctgcagaacctgaggcactgaaag

SEQ ID NO: 316332 - DNA, 25 bp, Mus musculus
gctgcagaacgagtttgttgtattc

SEQ ID NO: 316333 - DNA, 25 bp, Mus musculus
gctgcagaagccatggctcggatgg

SEQ ID NO: 316334 - DNA, 25 bp, Mus musculus
gctgcagaaggactggcccagcctg

SEQ ID NO: 316335 - DNA, 25 bp, Mus musculus
gctgcagaatatgtgtacatgtgtg

SEQ ID NO: 316336 - DNA, 25 bp, Mus musculus
gctgcagaatgcagcagtttgcaaa

SEQ ID NO: 316337 - DNA, 25 bp, Mus musculus
gctgcagaatgcaggtgtaatgtct

SEQ ID NO: 316338 - DNA, 25 bp, Mus musculus
gctgcagaatgctggccttgcagat

SEQ ID NO: 316339 - DNA, 25 bp, Mus musculus
gctgcagaatggtaatacacagctg

SEQ ID NO: 316340 - DNA, 25 bp, Mus musculus
gctgcagacagtcttcatcagctgc

SEQ ID NO: 316341 - DNA, 25 bp, Mus musculus
gctgcagactctgatactaccacaa

SEQ ID NO: 316342 - DNA, 25 bp, Mus musculus
gctgcagactggtcttctcagtaca

SEQ ID NO: 316343 - DNA, 25 bp, Mus musculus
gctgcagacttgacatcgtctttaa

SEQ ID NO: 316344 - DNA, 25 bp, Mus musculus
gctgcagagagtcaggaacgtggaa

SEQ ID NO: 316345 - DNA, 25 bp, Mus musculus
gctgcagagccagtgagccctgcct

SEQ ID NO: 316346 - DNA, 25 bp, Mus musculus
gctgcagagcgggaggagactcgga

SEQ ID NO: 316347 - DNA, 25 bp, Mus musculus
gctgcagagcttcgagcttccatta

SEQ ID NO: 316348 - DNA, 25 bp, Mus musculus
gctgcagaggactgtatgaacgagg

SEQ ID NO: 316349 - DNA, 25 bp, Mus musculus
gctgcagaggataagtactctcaga

SEQ ID NO: 316350 - DNA, 25 bp, Mus musculus
gctgcagaggccagagctattaaga

SEQ ID NO: 316351 - DNA, 25 bp, Mus musculus
gctgcagaggtccagacgtcgcctc

SEQ ID NO: 316352 - DNA, 25 bp, Mus musculus
gctgcagagtgaaatgacactgctg

SEQ ID NO: 316353 - DNA, 25 bp, Mus musculus
gctgcagagtgagcaccaggttttg

SEQ ID NO: 316354 - DNA, 25 bp, Mus musculus
gctgcagagtgatgtcaagtacaaa

SEQ ID NO: 316355 - DNA, 25 bp, Mus musculus
gctgcagataagtgattgacatttc

SEQ ID NO: 316356 - DNA, 25 bp, Mus musculus
gctgcagataagttactctcagctg

SEQ ID NO: 316357 - DNA, 25 bp, Mus musculus
gctgcagatccgcccctccttctcc

SEQ ID NO: 316358 - DNA, 25 bp, Mus musculus
gctgcagatccggtcctctccgggc

SEQ ID NO: 316359 - DNA, 25 bp, Mus musculus
gctgcagatgcacagatttgacata

SEQ ID NO: 316360 - DNA, 25 bp, Mus musculus
gctgcagatgcgggaggggaaaatg

SEQ ID NO: 316361 - DNA, 25 bp, Mus musculus
gctgcagatttgggacacagcaggc

SEQ ID NO: 316362 - DNA, 25 bp, Mus musculus
gctgcagcaagagttccactgttgt

SEQ ID NO: 316363 - DNA, 25 bp, Mus musculus
gctgcagcaataccctgcagcaagg

SEQ ID NO: 316364 - DNA, 25 bp, Mus musculus
gctgcagcacttcagtgctgtcttc

SEQ ID NO: 316365 - DNA, 25 bp, Mus musculus
gctgcagcagaagattctctgtggc

SEQ ID NO: 316366 - DNA, 25 bp, Mus musculus
gctgcagcagatggagcagaggaag

SEQ ID NO: 316367 - DNA, 25 bp, Mus musculus
gctgcagcaggagttaaaaataaag

SEQ ID NO: 316368 - DNA, 25 bp, Mus musculus
gctgcagcaggccaccatggcagaa

SEQ ID NO: 316369 - DNA, 25 bp, Mus musculus
gctgcagcaggctgttctgcagatg

SEQ ID NO: 316370 - DNA, 25 bp, Mus musculus
gctgcagcagggctcatggcagata

SEQ ID NO: 316371 - DNA, 25 bp, Mus musculus
gctgcagccaacgggattggtcgcc

SEQ ID NO: 316372 - DNA, 25 bp, Mus musculus
gctgcagcccacttcttagatgcag

SEQ ID NO: 316373 - DNA, 25 bp, Mus musculus
gctgcagcccagaagggtgtgcaga

SEQ ID NO: 316374 - DNA, 25 bp, Mus musculus
gctgcagccccagggcctgcttccg

SEQ ID NO: 316375 - DNA, 25 bp, Mus musculus
gctgcagcccctgtccaggtgattg

SEQ ID NO: 316376 - DNA, 25 bp, Mus musculus
gctgcagccgaggcagacgaggcat

SEQ ID NO: 316377 - DNA, 25 bp, Mus musculus
gctgcagccgagggaatgggcttgg

SEQ ID NO: 316378 - DNA, 25 bp, Mus musculus
gctgcagccgatacgacaaatagaa

SEQ ID NO: 316379 - DNA, 25 bp, Mus musculus
gctgcagccggaaggatccctgtgg

SEQ ID NO: 316380 - DNA, 25 bp, Mus musculus
gctgcagcctctgtccggatagctt

SEQ ID NO: 316381 - DNA, 25 bp, Mus musculus
gctgcagcgagaggtggaggtagag

SEQ ID NO: 316382 - DNA, 25 bp, Mus musculus
gctgcagcgctagatggaggtgaat

SEQ ID NO: 316383 - DNA, 25 bp, Mus musculus
gctgcagcgctatgcttggcgcaaa

SEQ ID NO: 316384 - DNA, 25 bp, Mus musculus
gctgcagcgctatgtgatgtacaaa

SEQ ID NO: 316385 - DNA, 25 bp, Mus musculus
gctgcagcggcttcctctggggggt

SEQ ID NO: 316386 - DNA, 25 bp, Mus musculus
gctgcagcgggaagatgtcatgact

SEQ ID NO: 316387 - DNA, 25 bp, Mus musculus
gctgcagctgcccaggccaagcagg

SEQ ID NO: 316388 - DNA, 25 bp, Mus musculus
gctgcagctgctgaaggaagcaatg

SEQ ID NO: 316389 - DNA, 25 bp, Mus musculus
gctgcagctggaggtgtggaacacc

SEQ ID NO: 316390 - DNA, 25 bp, Mus musculus
gctgcagcttcctgcctgttcacct

SEQ ID NO: 316391 - DNA, 25 bp, Mus musculus
gctgcagcttcgctcttgtggacaa

SEQ ID NO: 316392 - DNA, 25 bp, Mus musculus
gctgcaggagagcgcacacacgtag

SEQ ID NO: 316393 - DNA, 25 bp, Mus musculus
gctgcaggagcagctgacaggtctg

SEQ ID NO: 316394 - DNA, 25 bp, Mus musculus
gctgcaggagtggcatctcccactc

SEQ ID NO: 316395 - DNA, 25 bp, Mus musculus
gctgcaggatgatgcgattcatgct

SEQ ID NO: 316396 - DNA, 25 bp, Mus musculus
gctgcaggcatccaagcatttgtgg

SEQ ID NO: 316397 - DNA, 25 bp, Mus musculus
gctgcaggcatgaggtgttctggct

SEQ ID NO: 316398 - DNA, 25 bp, Mus musculus
gctgcaggcgcgaggttctgcagac

SEQ ID NO: 316399 - DNA, 25 bp, Mus musculus
gctgcaggcggcccaagatgtccat

SEQ ID NO: 316400 - DNA, 25 bp, Mus musculus
gctgcaggcggcttgaagatgagca

SEQ ID NO: 316401 - DNA, 25 bp, Mus musculus
gctgcagggatgaaggacacaggga

SEQ ID NO: 316402 - DNA, 25 bp, Mus musculus
gctgcagggatgaaggtctgtcagt

SEQ ID NO: 316403 - DNA, 25 bp, Mus musculus
gctgcagggcaagatccggactctt

SEQ ID NO: 316404 - DNA, 25 bp, Mus musculus
gctgcagggcacccgccaacatgag

SEQ ID NO: 316405 - DNA, 25 bp, Mus musculus
gctgcaggtggtgagcgccgagcag

SEQ ID NO: 316406 - DNA, 25 bp, Mus musculus
gctgcagtaattccgaaatcaacat

SEQ ID NO: 316407 - DNA, 25 bp, Mus musculus
gctgcagtaattccgagtcctgaag

SEQ ID NO: 316408 - DNA, 25 bp, Mus musculus
gctgcagtagaaaaagttaagaagt

SEQ ID NO: 316409 - DNA, 25 bp, Mus musculus
gctgcagtcagcaaaatatccagag

SEQ ID NO: 316410 - DNA, 25 bp, Mus musculus
gctgcagtcaggcatcaaggagtcc

SEQ ID NO: 316411 - DNA, 25 bp, Mus musculus
gctgcagtcccacttgttcggccag

SEQ ID NO: 316412 - DNA, 25 bp, Mus musculus
gctgcagtcccccctagccagcgga

SEQ ID NO: 316413 - DNA, 25 bp, Mus musculus
gctgcagtcccccctcaggacattc

SEQ ID NO: 316414 - DNA, 25 bp, Mus musculus
gctgcagtcccccctgaatgggtcc

SEQ ID NO: 316415 - DNA, 25 bp, Mus musculus
gctgcagtcgtgaggtaccgaaaga

SEQ ID NO: 316416 - DNA, 25 bp, Mus musculus
gctgcagtggatgagcaacatgttc

SEQ ID NO: 316417 - DNA, 25 bp, Mus musculus
gctgcagtggatgatgagtctgact

SEQ ID NO: 316418 - DNA, 25 bp, Mus musculus
gctgcagtggttttaagctataaca

SEQ ID NO: 316419 - DNA, 25 bp, Mus musculus
gctgcagtgtaaacaattagattta

SEQ ID NO: 316420 - DNA, 25 bp, Mus musculus
gctgcagtgtagggtaaacacaaga

SEQ ID NO: 316421 - DNA, 25 bp, Mus musculus
gctgcagtgtggggaaatcccacct

SEQ ID NO: 316422 - DNA, 25 bp, Mus musculus
gctgcagtgtggtggcacaagactt

SEQ ID NO: 316423 - DNA, 25 bp, Mus musculus
gctgcagttccaggaggaggacttc

SEQ ID NO: 316424 - DNA, 25 bp, Mus musculus
gctgcagttccaggtccctgagggt

SEQ ID NO: 316425 - DNA, 25 bp, Mus musculus
gctgcagttttgaggcaagaaatct

SEQ ID NO: 316426 - DNA, 25 bp, Mus musculus
gctgcatacccctgcccagatcaag

SEQ ID NO: 316427 - DNA, 25 bp, Mus musculus
gctgcatactcacgtgaatgatggc

SEQ ID NO: 316428 - DNA, 25 bp, Mus musculus
gctgcatagatgacgccacacgcgg

SEQ ID NO: 316429 - DNA, 25 bp, Mus musculus
gctgcatatctaggggagtatgtgc

SEQ ID NO: 316430 - DNA, 25 bp, Mus musculus
gctgcatcagaacctcttacatatg

SEQ ID NO: 316431 - DNA, 25 bp, Mus musculus
gctgcatcagcccagcactatggtg

SEQ ID NO: 316432 - DNA, 25 bp, Mus musculus
gctgcatcaggtaccaccagcttct

SEQ ID NO: 316433 - DNA, 25 bp, Mus musculus
gctgcatccagaggtctggtagcag

SEQ ID NO: 316434 - DNA, 25 bp, Mus musculus
gctgcatcccagctggaagcaggag

SEQ ID NO: 316435 - DNA, 25 bp, Mus musculus
gctgcatcccagctgtcgctgactc

SEQ ID NO: 316436 - DNA, 25 bp, Mus musculus
gctgcatccccagtccatctatgat

SEQ ID NO: 316437 - DNA, 25 bp, Mus musculus
gctgcatccttcgaatgctgactcc

SEQ ID NO: 316438 - DNA, 25 bp, Mus musculus
gctgcatctgcctgcaccgtactag

SEQ ID NO: 316439 - DNA, 25 bp, Mus musculus
gctgcatctgcctgctgggctcagt

SEQ ID NO: 316440 - DNA, 25 bp, Mus musculus
gctgcatgaccagtgtagtccatgg

SEQ ID NO: 316441 - DNA, 25 bp, Mus musculus
gctgcatgcagaacccttaccagtt

SEQ ID NO: 316442 - DNA, 25 bp, Mus musculus
gctgcatgcagctggtgcagaaccc

SEQ ID NO: 316443 - DNA, 25 bp, Mus musculus
gctgcatgcggacaggcctgagtac

SEQ ID NO: 316444 - DNA, 25 bp, Mus musculus
gctgcatgcggacaggccttgtttt

SEQ ID NO: 316445 - DNA, 25 bp, Mus musculus
gctgcatgcggaccaggccttgttt

SEQ ID NO: 316446 - DNA, 25 bp, Mus musculus
gctgcatgggcacagtgaccccagt

SEQ ID NO: 316447 - DNA, 25 bp, Mus musculus
gctgcatgtctacaagcatttgtca

SEQ ID NO: 316448 - DNA, 25 bp, Mus musculus
gctgcatgtgctccctctctatagc

SEQ ID NO: 316449 - DNA, 25 bp, Mus musculus
gctgcattctggcgcctagtgagaa

SEQ ID NO: 316450 - DNA, 25 bp, Mus musculus
gctgcattgcatgcagcgtgcaggg

SEQ ID NO: 316451 - DNA, 25 bp, Mus musculus
gctgcattggaggttaaaattatac

SEQ ID NO: 316452 - DNA, 25 bp, Mus musculus
gctgcattggcggaggtgtggacct

SEQ ID NO: 316453 - DNA, 25 bp, Mus musculus
gctgccaaaacagatgaagaaccac

SEQ ID NO: 316454 - DNA, 25 bp, Mus musculus
gctgccaacagcctatcttcttcct

SEQ ID NO: 316455 - DNA, 25 bp, Mus musculus
gctgccaacaggaggttctgcagtc

SEQ ID NO: 316456 - DNA, 25 bp, Mus musculus
gctgccaaccaggactgggcaaagc

SEQ ID NO: 316457 - DNA, 25 bp, Mus musculus
gctgccaaccagttgtctaatgggt

SEQ ID NO: 316458 - DNA, 25 bp, Mus musculus
gctgccaactgagaggactggctgc

SEQ ID NO: 316459 - DNA, 25 bp, Mus musculus
gctgccaactggcaggggacatgaa

SEQ ID NO: 316460 - DNA, 25 bp, Mus musculus
gctgccaactggcaggtatttgaca

SEQ ID NO: 316461 - DNA, 25 bp, Mus musculus
gctgccaatcaacaatgtgcccaga

SEQ ID NO: 316462 - DNA, 25 bp, Mus musculus
gctgccaatgggattggtcgcctgg

SEQ ID NO: 316463 - DNA, 25 bp, Mus musculus
gctgccaattttgagcagttcctcc

SEQ ID NO: 316464 - DNA, 25 bp, Mus musculus
gctgccaatttttgacaacagaaca

SEQ ID NO: 316465 - DNA, 25 bp, Mus musculus
gctgccacacaatcaggacttccca

SEQ ID NO: 316466 - DNA, 25 bp, Mus musculus
gctgccacagcgctgtgtagttctg

SEQ ID NO: 316467 - DNA, 25 bp, Mus musculus
gctgccaccatgaaaggagaagcgg

SEQ ID NO: 316468 - DNA, 25 bp, Mus musculus
gctgccactgcccacccccgcgatg

SEQ ID NO: 316469 - DNA, 25 bp, Mus musculus
gctgccactttcagacctagatact

SEQ ID NO: 316470 - DNA, 25 bp, Mus musculus
gctgccactttccagccttccccga

SEQ ID NO: 316471 - DNA, 25 bp, Mus musculus
gctgccactttccaggtgacatatc

SEQ ID NO: 316472 - DNA, 25 bp, Mus musculus
gctgccagagggaaattgtgggaaa

SEQ ID NO: 316473 - DNA, 25 bp, Mus musculus
gctgccagattgtggctctgaactt

SEQ ID NO: 316474 - DNA, 25 bp, Mus musculus
gctgccagcacaagaaccaggcaga

SEQ ID NO: 316475 - DNA, 25 bp, Mus musculus
gctgccagcaggtagatcatgatcc

SEQ ID NO: 316476 - DNA, 25 bp, Mus musculus
gctgccagcaggtctccccctcctc

SEQ ID NO: 316477 - DNA, 25 bp, Mus musculus
gctgccagcataagacagtgatgat

SEQ ID NO: 316478 - DNA, 25 bp, Mus musculus
gctgccagccaggcttcccggattt

SEQ ID NO: 316479 - DNA, 25 bp, Mus musculus
gctgccagccagggactaggccctg

SEQ ID NO: 316480 - DNA, 25 bp, Mus musculus
gctgccagccggaacagtgagcaga

SEQ ID NO: 316481 - DNA, 25 bp, Mus musculus
gctgccagcgggcgaactttctgac

SEQ ID NO: 316482 - DNA, 25 bp, Mus musculus
gctgccagtagcaaggaggccaatg

SEQ ID NO: 316483 - DNA, 25 bp, Mus musculus
gctgccagtagcaagttgcaggagg

SEQ ID NO: 316484 - DNA, 25 bp, Mus musculus
gctgccagttgcctctcagtttcag

SEQ ID NO: 316485 - DNA, 25 bp, Mus musculus
gctgccatactgaagctgacattat

SEQ ID NO: 316486 - DNA, 25 bp, Mus musculus
gctgccatagcaaaaaagcaagaag

SEQ ID NO: 316487 - DNA, 25 bp, Mus musculus
gctgccataggagtcagtgactttt

SEQ ID NO: 316488 - DNA, 25 bp, Mus musculus
gctgccatcaaattatttttaatga

SEQ ID NO: 316489 - DNA, 25 bp, Mus musculus
gctgccatcaccttggcatttagta

SEQ ID NO: 316490 - DNA, 25 bp, Mus musculus
gctgccatccctggatgtcagtgct

SEQ ID NO: 316491 - DNA, 25 bp, Mus musculus
gctgccatggtagtgatggacagaa

SEQ ID NO: 316492 - DNA, 25 bp, Mus musculus
gctgccatgtacgagctggtggtga

SEQ ID NO: 316493 - DNA, 25 bp, Mus musculus
gctgccattcaaacacacacaggag

SEQ ID NO: 316494 - DNA, 25 bp, Mus musculus
gctgccattcaaattcatgagatat

SEQ ID NO: 316495 - DNA, 25 bp, Mus musculus
gctgccattcaagaaggagaaaata

SEQ ID NO: 316496 - DNA, 25 bp, Mus musculus
gctgccattcaagtggcagccacag

SEQ ID NO: 316497 - DNA, 25 bp, Mus musculus
gctgccattgagaaaatgaaacagc

SEQ ID NO: 316498 - DNA, 25 bp, Mus musculus
gctgccattgagacgtaccaccaga

SEQ ID NO: 316499 - DNA, 25 bp, Mus musculus
gctgccattgtcgagggggtggcac

SEQ ID NO: 316500 - DNA, 25 bp, Mus musculus
gctgccattgtcgaggtgtcaagct

SEQ ID NO: 316501 - DNA, 25 bp, Mus musculus
gctgcccaaagagcatgccaccagc

SEQ ID NO: 316502 - DNA, 25 bp, Mus musculus
gctgcccaaagagccccctcagagc

SEQ ID NO: 316503 - DNA, 25 bp, Mus musculus
gctgcccaaagcctgagacccaccc

SEQ ID NO: 316504 - DNA, 25 bp, Mus musculus
gctgcccaaagggacactacatgaa

SEQ ID NO: 316505 - DNA, 25 bp, Mus musculus
gctgcccaacaccagaactattgtc

SEQ ID NO: 316506 - DNA, 25 bp, Mus musculus
gctgcccaagaccagctcacggatg

SEQ ID NO: 316507 - DNA, 25 bp, Mus musculus
gctgcccaagaggtcactgagcact

SEQ ID NO: 316508 - DNA, 25 bp, Mus musculus
gctgcccaagcgccggagtactgga

SEQ ID NO: 316509 - DNA, 25 bp, Mus musculus
gctgcccaaggtgaacttgatcttc

SEQ ID NO: 316510 - DNA, 25 bp, Mus musculus
gctgcccaaggttgttgctaagttg

SEQ ID NO: 316511 - DNA, 25 bp, Mus musculus
gctgcccacacgctgattctctacc

SEQ ID NO: 316512 - DNA, 25 bp, Mus musculus
gctgcccacacgctgcaggtgctgt

SEQ ID NO: 316513 - DNA, 25 bp, Mus musculus
gctgcccacagagaggtgacagaat

SEQ ID NO: 316514 - DNA, 25 bp, Mus musculus
gctgcccacaggaaataacagtatt

SEQ ID NO: 316515 - DNA, 25 bp, Mus musculus
gctgcccactgccggatcctaataa

SEQ ID NO: 316516 - DNA, 25 bp, Mus musculus
gctgcccacttgggaggcagaggcc

SEQ ID NO: 316517 - DNA, 25 bp, Mus musculus
gctgcccagaaggagtcgaaagcca

SEQ ID NO: 316518 - DNA, 25 bp, Mus musculus
gctgcccagcaaaaatcccaggatc

SEQ ID NO: 316519 - DNA, 25 bp, Mus musculus
gctgcccagcaaaaatgggggcagc

SEQ ID NO: 316520 - DNA, 25 bp, Mus musculus
gctgcccagccggtaagaccagctg

SEQ ID NO: 316521 - DNA, 25 bp, Mus musculus
gctgcccaggctgaaggcatcccac

SEQ ID NO: 316522 - DNA, 25 bp, Mus musculus
gctgcccagtttgccactgcgctgg

SEQ ID NO: 316523 - DNA, 25 bp, Mus musculus
gctgccccaggagacctaggcagac

SEQ ID NO: 316524 - DNA, 25 bp, Mus musculus
gctgccccaggagtttcctgaagtc

SEQ ID NO: 316525 - DNA, 25 bp, Mus musculus
gctgccccaggatccacctgatggc

SEQ ID NO: 316526 - DNA, 25 bp, Mus musculus
gctgccccagggatctttggccagc

SEQ ID NO: 316527 - DNA, 25 bp, Mus musculus
gctgccccagggttcttttaggttg

SEQ ID NO: 316528 - DNA, 25 bp, Mus musculus
gctgccccaggttgccactgatgta

SEQ ID NO: 316529 - DNA, 25 bp, Mus musculus
gctgccccaggttgtgtggaggaaa

SEQ ID NO: 316530 - DNA, 25 bp, Mus musculus
gctgcccccagtgagcctccctctc

SEQ ID NO: 316531 - DNA, 25 bp, Mus musculus
gctgccccccaggtcaagtggctgg

SEQ ID NO: 316532 - DNA, 25 bp, Mus musculus
gctgccccccaggtcttgactcagg

SEQ ID NO: 316533 - DNA, 25 bp, Mus musculus
gctgccccgaggcggttctcctgat

SEQ ID NO: 316534 - DNA, 25 bp, Mus musculus
gctgccccgggacgtggtcaacgtg

SEQ ID NO: 316535 - DNA, 25 bp, Mus musculus
gctgcccctcagcagcagcaacagc

SEQ ID NO: 316536 - DNA, 25 bp, Mus musculus
gctgcccgaaaggctgagaccgctg

SEQ ID NO: 316537 - DNA, 25 bp, Mus musculus
gctgcccgccgccaatatgcctgaa

SEQ ID NO: 316538 - DNA, 25 bp, Mus musculus
gctgcccgcggggactggtatccgg

SEQ ID NO: 316539 - DNA, 25 bp, Mus musculus
gctgcccggctgcaggcgaatctgg

SEQ ID NO: 316540 - DNA, 25 bp, Mus musculus
gctgcccggtgtgtgcgtgtgcaag

SEQ ID NO: 316541 - DNA, 25 bp, Mus musculus
gctgcccgtcaaaagattccaagaa

SEQ ID NO: 316542 - DNA, 25 bp, Mus musculus
gctgcccgtggaggaggtggacatc

SEQ ID NO: 316543 - DNA, 25 bp, Mus musculus
gctgccctagagatagtcaataaca

SEQ ID NO: 316544 - DNA, 25 bp, Mus musculus
gctgccctagagatcaagatattat

SEQ ID NO: 316545 - DNA, 25 bp, Mus musculus
gctgccctattcctcagggtctcta

SEQ ID NO: 316546 - DNA, 25 bp, Mus musculus
gctgccctgagaaacctcgaccttg

SEQ ID NO: 316547 - DNA, 25 bp, Mus musculus
gctgccctgcagtaccacatcaaca

SEQ ID NO: 316548 - DNA, 25 bp, Mus musculus
gctgccctgcccattgtgtcctggg

SEQ ID NO: 316549 - DNA, 25 bp, Mus musculus
gctgccctgcctgtgggaagtgctt

SEQ ID NO: 316550 - DNA, 25 bp, Mus musculus
gctgccctgcctgtgggctcagtct

SEQ ID NO: 316551 - DNA, 25 bp, Mus musculus
gctgccctggggctgtgtctggctg

SEQ ID NO: 316552 - DNA, 25 bp, Mus musculus
gctgccctgtccccagccccctccc

SEQ ID NO: 316553 - DNA, 25 bp, Mus musculus
gctgcccttaaacaggaaatctttg

SEQ ID NO: 316554 - DNA, 25 bp, Mus musculus
gctgcccttaaacagttgcaggaaa

SEQ ID NO: 316555 - DNA, 25 bp, Mus musculus
gctgcccttcttcgacatggctggg

SEQ ID NO: 316556 - DNA, 25 bp, Mus musculus
gctgcccttcttcgtggatccaggt

SEQ ID NO: 316557 - DNA, 25 bp, Mus musculus
gctgcccttgaagggtaagtggaga

SEQ ID NO: 316558 - DNA, 25 bp, Mus musculus
gctgccgaatgaaaaggtgcagcat

SEQ ID NO: 316559 - DNA, 25 bp, Mus musculus
gctgccgacacagccacagcatttc

SEQ ID NO: 316560 - DNA, 25 bp, Mus musculus
gctgccgactagaagttattttagc

SEQ ID NO: 316561 - DNA, 25 bp, Mus musculus
gctgccgactaggatgaaggacgca

SEQ ID NO: 316562 - DNA, 25 bp, Mus musculus
gctgccgactatactgaagcagaaa

SEQ ID NO: 316563 - DNA, 25 bp, Mus musculus
gctgccgactatcaagaatgaccca

SEQ ID NO: 316564 - DNA, 25 bp, Mus musculus
gctgccgactatggaaatcctatga

SEQ ID NO: 316565 - DNA, 25 bp, Mus musculus
gctgccgactcctgatagaggaagg

SEQ ID NO: 316566 - DNA, 25 bp, Mus musculus
gctgccgactgcgaatcgccaggac

SEQ ID NO: 316567 - DNA, 25 bp, Mus musculus
gctgccgactgctgatctcttcgtt

SEQ ID NO: 316568 - DNA, 25 bp, Mus musculus
gctgccgactggacccagctgaagc

SEQ ID NO: 316569 - DNA, 25 bp, Mus musculus
gctgccgactggtcaatatagacct

SEQ ID NO: 316570 - DNA, 25 bp, Mus musculus
gctgccgactgtgtccatgttggaa

SEQ ID NO: 316571 - DNA, 25 bp, Mus musculus
gctgccgacttaaccgtgtggaagc

SEQ ID NO: 316572 - DNA, 25 bp, Mus musculus
gctgccgaggaggctagacaaatgg

SEQ ID NO: 316573 - DNA, 25 bp, Mus musculus
gctgccgataagtacgccctggagc

SEQ ID NO: 316574 - DNA, 25 bp, Mus musculus
gctgccgatctcagtctctggtccc

SEQ ID NO: 316575 - DNA, 25 bp, Mus musculus
gctgccgcccctgctattacaagcc

SEQ ID NO: 316576 - DNA, 25 bp, Mus musculus
gctgccgccgtcatggccgactact

SEQ ID NO: 316577 - DNA, 25 bp, Mus musculus
gctgccgccgtgcggggagcagcaa

SEQ ID NO: 316578 - DNA, 25 bp, Mus musculus
gctgccgccgtgcggggatagctgc

SEQ ID NO: 316579 - DNA, 25 bp, Mus musculus
gctgccgcctcagaggtttaaacgc

SEQ ID NO: 316580 - DNA, 25 bp, Mus musculus
gctgccgcctccagtgccgggagcc

SEQ ID NO: 316581 - DNA, 25 bp, Mus musculus
gctgccgcgagataaaatcaaagac

SEQ ID NO: 316582 - DNA, 25 bp, Mus musculus
gctgccgctccacagtggctccacg

SEQ ID NO: 316583 - DNA, 25 bp, Mus musculus
gctgccgctccagaagctcgaagcg

SEQ ID NO: 316584 - DNA, 25 bp, Mus musculus
gctgccgctgagtggatacattcca

SEQ ID NO: 316585 - DNA, 25 bp, Mus musculus
gctgccgtaagaatttcatcctatc

SEQ ID NO: 316586 - DNA, 25 bp, Mus musculus
gctgccgtgacgcatgatctttctt

SEQ ID NO: 316587 - DNA, 25 bp, Mus musculus
gctgccgtgacggttgcaggccgag

SEQ ID NO: 316588 - DNA, 25 bp, Mus musculus
gctgccgtgcactgggttaaaaacg

SEQ ID NO: 316589 - DNA, 25 bp, Mus musculus
gctgccgtgtgagttctgtggggtg

SEQ ID NO: 316590 - DNA, 25 bp, Mus musculus
gctgccgttaggctactacatgggc

SEQ ID NO: 316591 - DNA, 25 bp, Mus musculus
gctgccgtttagctcgatgagagaa

SEQ ID NO: 316592 - DNA, 25 bp, Mus musculus
gctgccgtttggtggtgaagcagta

SEQ ID NO: 316593 - DNA, 25 bp, Mus musculus
gctgcctacagataccatggcgttc

SEQ ID NO: 316594 - DNA, 25 bp, Mus musculus
gctgcctacagctcagcagagaaaa

SEQ ID NO: 316595 - DNA, 25 bp, Mus musculus
gctgcctacaggaaaaaaaatccct

SEQ ID NO: 316596 - DNA, 25 bp, Mus musculus
gctgcctacaggtgactggatggcc

SEQ ID NO: 316597 - DNA, 25 bp, Mus musculus
gctgcctaccagatatgaaagatca

SEQ ID NO: 316598 - DNA, 25 bp, Mus musculus
gctgcctacggacaggatcgagagc

SEQ ID NO: 316599 - DNA, 25 bp, Mus musculus
gctgcctactgggcaaggtggtttg

SEQ ID NO: 316600 - DNA, 25 bp, Mus musculus
gctgcctactggggaaggagaagct

SEQ ID NO: 316601 - DNA, 25 bp, Mus musculus
gctgcctcacaggtggataccttgg

SEQ ID NO: 316602 - DNA, 25 bp, Mus musculus
gctgcctcagagcccaccgcaacga

SEQ ID NO: 316603 - DNA, 25 bp, Mus musculus
gctgcctcagagtggggagtagtcc

SEQ ID NO: 316604 - DNA, 25 bp, Mus musculus
gctgcctcagcaagccccgcccaac

SEQ ID NO: 316605 - DNA, 25 bp, Mus musculus
gctgcctcaggctacaaggaaggag

SEQ ID NO: 316606 - DNA, 25 bp, Mus musculus
gctgcctcaggtacaactgatgaga

SEQ ID NO: 316607 - DNA, 25 bp, Mus musculus
gctgcctcaggtacctttgaccgga

SEQ ID NO: 316608 - DNA, 25 bp, Mus musculus
gctgcctcaggtcgcatagggcatg

SEQ ID NO: 316609 - DNA, 25 bp, Mus musculus
gctgcctcagtttcagctcttggat

SEQ ID NO: 316610 - DNA, 25 bp, Mus musculus
gctgcctcagtttctgctcttggat

SEQ ID NO: 316611 - DNA, 25 bp, Mus musculus
gctgcctcagtttgacagcagtcat

SEQ ID NO: 316612 - DNA, 25 bp, Mus musculus
gctgcctcctcaagagctttcatca

SEQ ID NO: 316613 - DNA, 25 bp, Mus musculus
gctgcctcctcaaggttggctcaaa

SEQ ID NO: 316614 - DNA, 25 bp, Mus musculus
gctgcctcctggcagcctggtgatc

SEQ ID NO: 316615 - DNA, 25 bp, Mus musculus
gctgcctcgaatcttaggtgcccgg

SEQ ID NO: 316616 - DNA, 25 bp, Mus musculus
gctgcctctaagatctcaggatgga

SEQ ID NO: 316617 - DNA, 25 bp, Mus musculus
gctgcctctcaaatgaacctctagt

SEQ ID NO: 316618 - DNA, 25 bp, Mus musculus
gctgcctctggcgggatggactcct

SEQ ID NO: 316619 - DNA, 25 bp, Mus musculus
gctgcctctggcggggctgcagtat

SEQ ID NO: 316620 - DNA, 25 bp, Mus musculus
gctgcctcttccaccttccagcaga

SEQ ID NO: 316621 - DNA, 25 bp, Mus musculus
gctgcctcttgaagaagtggatgac

SEQ ID NO: 316622 - DNA, 25 bp, Mus musculus
gctgcctcttgaagtcagtttcaga

SEQ ID NO: 316623 - DNA, 25 bp, Mus musculus
gctgcctgaagagaagccttccagc

SEQ ID NO: 316624 - DNA, 25 bp, Mus musculus
gctgcctgagccctaggaccatgaa

SEQ ID NO: 316625 - DNA, 25 bp, Mus musculus
gctgcctgagcttcatgccctcaca

SEQ ID NO: 316626 - DNA, 25 bp, Mus musculus
gctgcctgagggtacaagttcagta

SEQ ID NO: 316627 - DNA, 25 bp, Mus musculus
gctgcctgagggttaaaattctgtg

SEQ ID NO: 316628 - DNA, 25 bp, Mus musculus
gctgcctgaggtagtgactgtgcta

SEQ ID NO: 316629 - DNA, 25 bp, Mus musculus
gctgcctgcatctacctttgcagat

SEQ ID NO: 316630 - DNA, 25 bp, Mus musculus
gctgcctgcatctgtctcttaacct

SEQ ID NO: 316631 - DNA, 25 bp, Mus musculus
gctgcctgcttctcggttcagcatg

SEQ ID NO: 316632 - DNA, 25 bp, Mus musculus
gctgcctggacagcattgccgccac

SEQ ID NO: 316633 - DNA, 25 bp, Mus musculus
gctgcctggacaggggctctttaga

SEQ ID NO: 316634 - DNA, 25 bp, Mus musculus
gctgcctggctcacctctgctattg

SEQ ID NO: 316635 - DNA, 25 bp, Mus musculus
gctgccttcacggcggagtgttcct

SEQ ID NO: 316636 - DNA, 25 bp, Mus musculus
gctgccttcctcaagcagtataatt

SEQ ID NO: 316637 - DNA, 25 bp, Mus musculus
gctgccttctgagttaatatgacag

SEQ ID NO: 316638 - DNA, 25 bp, Mus musculus
gctgccttctgagttattgcggaag

SEQ ID NO: 316639 - DNA, 25 bp, Mus musculus
gctgccttctgagttgtagttagcg

SEQ ID NO: 316640 - DNA, 25 bp, Mus musculus
gctgccttctgagttttcctcttgc

SEQ ID NO: 316641 - DNA, 25 bp, Mus musculus
gctgccttgaaagatttacaagggc

SEQ ID NO: 316642 - DNA, 25 bp, Mus musculus
gctgccttgaaagcccccaaaatag

SEQ ID NO: 316643 - DNA, 25 bp, Mus musculus
gctgccttgagagtcgcttcaaagt

SEQ ID NO: 316644 - DNA, 25 bp, Mus musculus
gctgccttgccttactcagacactg

SEQ ID NO: 316645 - DNA, 25 bp, Mus musculus
gctgcctttgagaagcatgtggatg

SEQ ID NO: 316646 - DNA, 25 bp, Mus musculus
gctgccttttcctgggatcagcctt

SEQ ID NO: 316647 - DNA, 25 bp, Mus musculus
gctgccttttgacatcccagaggag

SEQ ID NO: 316648 - DNA, 25 bp, Mus musculus
gctgcgaacctggtagcctataaca

SEQ ID NO: 316649 - DNA, 25 bp, Mus musculus
gctgcgaaggaagtactattactgg

SEQ ID NO: 316650 - DNA, 25 bp, Mus musculus
gctgcgacaaggcccttggactgga

SEQ ID NO: 316651 - DNA, 25 bp, Mus musculus
gctgcgacagattggttctaggtct

SEQ ID NO: 316652 - DNA, 25 bp, Mus musculus
gctgcgaccaggctttggcgttgtt

SEQ ID NO: 316653 - DNA, 25 bp, Mus musculus
gctgcgaccttgccctcctgcgtgc

SEQ ID NO: 316654 - DNA, 25 bp, Mus musculus
gctgcgactccgagcaccactccca

SEQ ID NO: 316655 - DNA, 25 bp, Mus musculus
gctgcgagaggagcagcggcccctg

SEQ ID NO: 316656 - DNA, 25 bp, Mus musculus
gctgcgagaggagggtgctgactac

SEQ ID NO: 316657 - DNA, 25 bp, Mus musculus
gctgcgagaggccaaggtgacctgc

SEQ ID NO: 316658 - DNA, 25 bp, Mus musculus
gctgcgagcgcagttacccagcatg

SEQ ID NO: 316659 - DNA, 25 bp, Mus musculus
gctgcgagcgctgtagacctggaca

SEQ ID NO: 316660 - DNA, 25 bp, Mus musculus
gctgcgaggccgcaatctgtcgctt

SEQ ID NO: 316661 - DNA, 25 bp, Mus musculus
gctgcgataaaccattgttgaggac

SEQ ID NO: 316662 - DNA, 25 bp, Mus musculus
gctgcgatgagcttaaaagatgatg

SEQ ID NO: 316663 - DNA, 25 bp, Mus musculus
gctgcgattacatcaccctgacctg

SEQ ID NO: 316664 - DNA, 25 bp, Mus musculus
gctgcgcaaggtttctctgtgtagc

SEQ ID NO: 316665 - DNA, 25 bp, Mus musculus
gctgcgcaaggtttctgacatgaag

SEQ ID NO: 316666 - DNA, 25 bp, Mus musculus
gctgcgcacagagtcccaaaagaaa

SEQ ID NO: 316667 - DNA, 25 bp, Mus musculus
gctgcgcacagattccccaaaggcc

SEQ ID NO: 316668 - DNA, 25 bp, Mus musculus
gctgcgcagactactttactggaaa

SEQ ID NO: 316669 - DNA, 25 bp, Mus musculus
gctgcgcagagcgcgggtgatgtga

SEQ ID NO: 316670 - DNA, 25 bp, Mus musculus
gctgcgcagctgcagctcctcctag

SEQ ID NO: 316671 - DNA, 25 bp, Mus musculus
gctgcgcagctgcaggcaaaatgaa

SEQ ID NO: 316672 - DNA, 25 bp, Mus musculus
gctgcgcatgaagttcatgcaaaga

SEQ ID NO: 316673 - DNA, 25 bp, Mus musculus
gctgcgccaaattttcacctgacgg

SEQ ID NO: 316674 - DNA, 25 bp, Mus musculus
gctgcgccctgggattcatcactca

SEQ ID NO: 316675 - DNA, 25 bp, Mus musculus
gctgcgccgggaccgacgccacagg

SEQ ID NO: 316676 - DNA, 25 bp, Mus musculus
gctgcgcgagaggaatgcgctcatg

SEQ ID NO: 316677 - DNA, 25 bp, Mus musculus
gctgcgcgagagtatgtcttggctg

SEQ ID NO: 316678 - DNA, 25 bp, Mus musculus
gctgcgcgcgcagacttacactttg

SEQ ID NO: 316679 - DNA, 25 bp, Mus musculus
gctgcgcgcgcagagccaacagaga

SEQ ID NO: 316680 - DNA, 25 bp, Mus musculus
gctgcgcgcgcagccaaagtgtatg

SEQ ID NO: 316681 - DNA, 25 bp, Mus musculus
gctgcgcggttggacgagtgaccaa

SEQ ID NO: 316682 - DNA, 25 bp, Mus musculus
gctgcgcgtcccagggacccagctg

SEQ ID NO: 316683 - DNA, 25 bp, Mus musculus
gctgcgctcaacaaggacccctcat

SEQ ID NO: 316684 - DNA, 25 bp, Mus musculus
gctgcgctcagagcgtaaacgaccc

SEQ ID NO: 316685 - DNA, 25 bp, Mus musculus
gctgcgctccgggagtaaagacatt

SEQ ID NO: 316686 - DNA, 25 bp, Mus musculus
gctgcgctcggtgagtgcaggatcc

SEQ ID NO: 316687 - DNA, 25 bp, Mus musculus
gctgcgctgaggctccagccttccc

SEQ ID NO: 316688 - DNA, 25 bp, Mus musculus
gctgcgctgcgagagaggaagacga

SEQ ID NO: 316689 - DNA, 25 bp, Mus musculus
gctgcgctgcgctaattgtaaattc

SEQ ID NO: 316690 - DNA, 25 bp, Mus musculus
gctgcgctgcgtgacagctggtggc

SEQ ID NO: 316691 - DNA, 25 bp, Mus musculus
gctgcgctgcgtgcatccgtgcagc

SEQ ID NO: 316692 - DNA, 25 bp, Mus musculus
gctgcgctgggttgtggcagcattg

SEQ ID NO: 316693 - DNA, 25 bp, Mus musculus
gctgcgcttcgcccgcagcctcgcc

SEQ ID NO: 316694 - DNA, 25 bp, Mus musculus
gctgcggaagaacgcagaggtgacc

SEQ ID NO: 316695 - DNA, 25 bp, Mus musculus
gctgcggaaggatgatccagtcacc

SEQ ID NO: 316696 - DNA, 25 bp, Mus musculus
gctgcggacctcagcctttatcctc

SEQ ID NO: 316697 - DNA, 25 bp, Mus musculus
gctgcggacctcaggaaccctgatg

SEQ ID NO: 316698 - DNA, 25 bp, Mus musculus
gctgcggagacaggttgcagaattc

SEQ ID NO: 316699 - DNA, 25 bp, Mus musculus
gctgcggagcattctgtgcccccaa

SEQ ID NO: 316700 - DNA, 25 bp, Mus musculus
gctgcggagcattgtgaccactgac

SEQ ID NO: 316701 - DNA, 25 bp, Mus musculus
gctgcggcaccgcttgtcctgggct

SEQ ID NO: 316702 - DNA, 25 bp, Mus musculus
gctgcggcaccggctggcccgcggg

SEQ ID NO: 316703 - DNA, 25 bp, Mus musculus
gctgcggcaccgtttcctctacagg

SEQ ID NO: 316704 - DNA, 25 bp, Mus musculus
gctgcggcagcaagaacagaagcag

SEQ ID NO: 316705 - DNA, 25 bp, Mus musculus
gctgcggcagcacgtctgactctac

SEQ ID NO: 316706 - DNA, 25 bp, Mus musculus
gctgcggcagggcatcatgaagcag

SEQ ID NO: 316707 - DNA, 25 bp, Mus musculus
gctgcggccaatagctctcagggcc

SEQ ID NO: 316708 - DNA, 25 bp, Mus musculus
gctgcggccacacgtgacactggcc

SEQ ID NO: 316709 - DNA, 25 bp, Mus musculus
gctgcggccacacgttctgcgggga

SEQ ID NO: 316710 - DNA, 25 bp, Mus musculus
gctgcggccagagcttcggtgcaac

SEQ ID NO: 316711 - DNA, 25 bp, Mus musculus
gctgcggccgcgtcatggccgtgcc

SEQ ID NO: 316712 - DNA, 25 bp, Mus musculus
gctgcggcctgacccggctccactc

SEQ ID NO: 316713 - DNA, 25 bp, Mus musculus
gctgcggcgggacagttgggcaagg

SEQ ID NO: 316714 - DNA, 25 bp, Mus musculus
gctgcggcgtggagcaaaacaattg

SEQ ID NO: 316715 - DNA, 25 bp, Mus musculus
gctgcggctgcccgggcagtgacgg

SEQ ID NO: 316716 - DNA, 25 bp, Mus musculus
gctgcggctggaggttttcccgctc

SEQ ID NO: 316717 - DNA, 25 bp, Mus musculus
gctgcggctggagtgcccacgatgg

SEQ ID NO: 316718 - DNA, 25 bp, Mus musculus
gctgcgggaaaccgctgaagctgac

SEQ ID NO: 316719 - DNA, 25 bp, Mus musculus
gctgcgggaccaatgctcaggtcta

SEQ ID NO: 316720 - DNA, 25 bp, Mus musculus
gctgcgggcaccgggagctggtgat

SEQ ID NO: 316721 - DNA, 25 bp, Mus musculus
gctgcgggcccggaaatgcacttag

SEQ ID NO: 316722 - DNA, 25 bp, Mus musculus
gctgcgggcccgggactgtgcagca

SEQ ID NO: 316723 - DNA, 25 bp, Mus musculus
gctgcgggccggcgaaatggcaaaa

SEQ ID NO: 316724 - DNA, 25 bp, Mus musculus
gctgcgggcgagatgtatacatctc

SEQ ID NO: 316725 - DNA, 25 bp, Mus musculus
gctgcgggctcgggaatgggaaaca

SEQ ID NO: 316726 - DNA, 25 bp, Mus musculus
gctgcgggtgaatgatccccaatca

SEQ ID NO: 316727 - DNA, 25 bp, Mus musculus
gctgcgggtgaatgggccaccaccc

SEQ ID NO: 316728 - DNA, 25 bp, Mus musculus
gctgcggtagctcggtttcttctgg

SEQ ID NO: 316729 - DNA, 25 bp, Mus musculus
gctgcgtaagtggccctcaaagcgg

SEQ ID NO: 316730 - DNA, 25 bp, Mus musculus
gctgcgtagagaatgcgggtttccg

SEQ ID NO: 316731 - DNA, 25 bp, Mus musculus
gctgcgtccctctggggctgtggtc

SEQ ID NO: 316732 - DNA, 25 bp, Mus musculus
gctgcgtctttggagggtggaagag

SEQ ID NO: 316733 - DNA, 25 bp, Mus musculus
gctgcgtgcagattaccttatgctg

SEQ ID NO: 316734 - DNA, 25 bp, Mus musculus
gctgcgtgcccagggcctagtgctt

SEQ ID NO: 316735 - DNA, 25 bp, Mus musculus
gctgcgtgcccaggttgtgtagcct

SEQ ID NO: 316736 - DNA, 25 bp, Mus musculus
gctgcgttcactgaggcagttgcac

SEQ ID NO: 316737 - DNA, 25 bp, Mus musculus
gctgcgttgagatttggtgactgag

SEQ ID NO: 316738 - DNA, 25 bp, Mus musculus
gctgcgtttgagcctgagcctttgc

SEQ ID NO: 316739 - DNA, 25 bp, Mus musculus
gctgctaaactgcaacacggctaag

SEQ ID NO: 316740 - DNA, 25 bp, Mus musculus
gctgctaaagcttattgagcggtcc

SEQ ID NO: 316741 - DNA, 25 bp, Mus musculus
gctgctaaagggttatcacacatcg

SEQ ID NO: 316742 - DNA, 25 bp, Mus musculus
gctgctaaccgggtctttggggctg

SEQ ID NO: 316743 - DNA, 25 bp, Mus musculus
gctgctaagggaagatacacctatg

SEQ ID NO: 316744 - DNA, 25 bp, Mus musculus
gctgctaatgtcagcagaccgctcc

SEQ ID NO: 316745 - DNA, 25 bp, Mus musculus
gctgctacctggaagaagccctgca

SEQ ID NO: 316746 - DNA, 25 bp, Mus musculus
gctgctacgtgagaacttgaagcaa

SEQ ID NO: 316747 - DNA, 25 bp, Mus musculus
gctgctacgtgagtttttcagatta

SEQ ID NO: 316748 - DNA, 25 bp, Mus musculus
gctgctactactgtgctgaggagac

SEQ ID NO: 316749 - DNA, 25 bp, Mus musculus
gctgctagaaggctgaagaacctgg

SEQ ID NO: 316750 - DNA, 25 bp, Mus musculus
gctgctagaattcgatttcagaaat

SEQ ID NO: 316751 - DNA, 25 bp, Mus musculus
gctgctagaattcggtgggctggta

SEQ ID NO: 316752 - DNA, 25 bp, Mus musculus
gctgctagacaggcttgtgttgcgg

SEQ ID NO: 316753 - DNA, 25 bp, Mus musculus
gctgctagacgtggctgtgagtcct

SEQ ID NO: 316754 - DNA, 25 bp, Mus musculus
gctgctagtggagatgccgttccta

SEQ ID NO: 316755 - DNA, 25 bp, Mus musculus
gctgctagtggagcaccaaggagtt

SEQ ID NO: 316756 - DNA, 25 bp, Mus musculus
gctgctagtggaggagtttcatttc

SEQ ID NO: 316757 - DNA, 25 bp, Mus musculus
gctgctagtggagggggttacaact

SEQ ID NO: 316758 - DNA, 25 bp, Mus musculus
gctgctagtggagtgcactgaggcc

SEQ ID NO: 316759 - DNA, 25 bp, Mus musculus
gctgctatacgaaggggctcctggg

SEQ ID NO: 316760 - DNA, 25 bp, Mus musculus
gctgctataggcatgaaagaagtga

SEQ ID NO: 316761 - DNA, 25 bp, Mus musculus
gctgctataggctactattggaaag

SEQ ID NO: 316762 - DNA, 25 bp, Mus musculus
gctgctatcgggggaggagtgtctc

SEQ ID NO: 316763 - DNA, 25 bp, Mus musculus
gctgctatcgtggatggagacagga

SEQ ID NO: 316764 - DNA, 25 bp, Mus musculus
gctgctatctgttatgaaacaaatg

SEQ ID NO: 316765 - DNA, 25 bp, Mus musculus
gctgctatgaacaccctccttgacg

SEQ ID NO: 316766 - DNA, 25 bp, Mus musculus
gctgctatggatggtgctttgcaag

SEQ ID NO: 316767 - DNA, 25 bp, Mus musculus
gctgctatgtgaaggtgctcctggt

SEQ ID NO: 316768 - DNA, 25 bp, Mus musculus
gctgctatgtggccaccctggagaa

SEQ ID NO: 316769 - DNA, 25 bp, Mus musculus
gctgctcaacaggacttggatgttg

SEQ ID NO: 316770 - DNA, 25 bp, Mus musculus
gctgctcaacaggctcacaccactc

SEQ ID NO: 316771 - DNA, 25 bp, Mus musculus
gctgctcaaccagacgcacctctag

SEQ ID NO: 316772 - DNA, 25 bp, Mus musculus
gctgctcaaccagtggacatatcag

SEQ ID NO: 316773 - DNA, 25 bp, Mus musculus
gctgctcaaggactcggagactccc

SEQ ID NO: 316774 - DNA, 25 bp, Mus musculus
gctgctcaaggtactccaggactcg

SEQ ID NO: 316775 - DNA, 25 bp, Mus musculus
gctgctcaccattggagaccggttt

SEQ ID NO: 316776 - DNA, 25 bp, Mus musculus
gctgctcactgacagggtttctctg

SEQ ID NO: 316777 - DNA, 25 bp, Mus musculus
gctgctcactgcattggataccctg

SEQ ID NO: 316778 - DNA, 25 bp, Mus musculus
gctgctcagaacgaaccaagaattg

SEQ ID NO: 316779 - DNA, 25 bp, Mus musculus
gctgctcagaacggatcaataagcc

SEQ ID NO: 316780 - DNA, 25 bp, Mus musculus
gctgctcagaaggctcaggaggcat

SEQ ID NO: 316781 - DNA, 25 bp, Mus musculus
gctgctcagcaaggctgagcgccgc

SEQ ID NO: 316782 - DNA, 25 bp, Mus musculus
gctgctcagcaagggccgcgtgttg

SEQ ID NO: 316783 - DNA, 25 bp, Mus musculus
gctgctcagctctgctctaaagcaa

SEQ ID NO: 316784 - DNA, 25 bp, Mus musculus
gctgctcaggaaaggactttcctgg

SEQ ID NO: 316785 - DNA, 25 bp, Mus musculus
gctgctcagggcagccaagcctgag

SEQ ID NO: 316786 - DNA, 25 bp, Mus musculus
gctgctcagggcagtggtcctcata

SEQ ID NO: 316787 - DNA, 25 bp, Mus musculus
gctgctcaggtcagcctccatgtac

SEQ ID NO: 316788 - DNA, 25 bp, Mus musculus
gctgctcatggaaacgtgtgccgtc

SEQ ID NO: 316789 - DNA, 25 bp, Mus musculus
gctgctcatggatgaagttgctgcc

SEQ ID NO: 316790 - DNA, 25 bp, Mus musculus
gctgctccaagcagtgcctggctgc

SEQ ID NO: 316791 - DNA, 25 bp, Mus musculus
gctgctccacgcggtagcactcagc

SEQ ID NO: 316792 - DNA, 25 bp, Mus musculus
gctgctccagagaatgacggacaag

SEQ ID NO: 316793 - DNA, 25 bp, Mus musculus
gctgctccagagcatctaaagaaaa

SEQ ID NO: 316794 - DNA, 25 bp, Mus musculus
gctgctccagagctacttctccttc

SEQ ID NO: 316795 - DNA, 25 bp, Mus musculus
gctgctccagagctgctctgcgtac

SEQ ID NO: 316796 - DNA, 25 bp, Mus musculus
gctgctccagagctggagaagcggg

SEQ ID NO: 316797 - DNA, 25 bp, Mus musculus
gctgctccagagctggcaggaccta

SEQ ID NO: 316798 - DNA, 25 bp, Mus musculus
gctgctccaggaaattgccaaacat

SEQ ID NO: 316799 - DNA, 25 bp, Mus musculus
gctgctccaggagcctgaagctacc

SEQ ID NO: 316800 - DNA, 25 bp, Mus musculus
gctgctccagggtggggcactgtgt

SEQ ID NO: 316801 - DNA, 25 bp, Mus musculus
gctgctccattgacacaattgttcc

SEQ ID NO: 316802 - DNA, 25 bp, Mus musculus
gctgctccattgacgatggcacgaa

SEQ ID NO: 316803 - DNA, 25 bp, Mus musculus
gctgctcccagcatggcggacaagg

SEQ ID NO: 316804 - DNA, 25 bp, Mus musculus
gctgctcccagcgtttcccaacaga

SEQ ID NO: 316805 - DNA, 25 bp, Mus musculus
gctgctcccatgatgttcctgtaca

SEQ ID NO: 316806 - DNA, 25 bp, Mus musculus
gctgctcccggcaggaaaaggaagc

SEQ ID NO: 316807 - DNA, 25 bp, Mus musculus
gctgctcccgtccccaccgacaacg

SEQ ID NO: 316808 - DNA, 25 bp, Mus musculus
gctgctccctttgcgcacaggttac

SEQ ID NO: 316809 - DNA, 25 bp, Mus musculus
gctgctcctagaagcgtgcaatcac

SEQ ID NO: 316810 - DNA, 25 bp, Mus musculus
gctgctcctgcaggtggaagcactt

SEQ ID NO: 316811 - DNA, 25 bp, Mus musculus
gctgctcctggaggctttggaaatg

SEQ ID NO: 316812 - DNA, 25 bp, Mus musculus
gctgctcctggtaacttcaattttt

SEQ ID NO: 316813 - DNA, 25 bp, Mus musculus
gctgctcgcaagctgcaggctgcac

SEQ ID NO: 316814 - DNA, 25 bp, Mus musculus
gctgctcgcaagctgcgggtgcagc

SEQ ID NO: 316815 - DNA, 25 bp, Mus musculus
gctgctcgccgagggcataacctgg

SEQ ID NO: 316816 - DNA, 25 bp, Mus musculus
gctgctctagcaccacatctgccac

SEQ ID NO: 316817 - DNA, 25 bp, Mus musculus
gctgctctctatttcacgctgcccc

SEQ ID NO: 316818 - DNA, 25 bp, Mus musculus
gctgctctctatttggagagaaata

SEQ ID NO: 316819 - DNA, 25 bp, Mus musculus
gctgctctgagacctcgccatgccc

SEQ ID NO: 316820 - DNA, 25 bp, Mus musculus
gctgctctgcgccaaggacactgcc

SEQ ID NO: 316821 - DNA, 25 bp, Mus musculus
gctgctctggcaaggccagacctcc

SEQ ID NO: 316822 - DNA, 25 bp, Mus musculus
gctgctctgggtaaccaaggctcta

SEQ ID NO: 316823 - DNA, 25 bp, Mus musculus
gctgctcttcgggaatcatggccca

SEQ ID NO: 316824 - DNA, 25 bp, Mus musculus
gctgctgaagaaaagtactctcaaa

SEQ ID NO: 316825 - DNA, 25 bp, Mus musculus
gctgctgaagaaagaattgatattt

SEQ ID NO: 316826 - DNA, 25 bp, Mus musculus
gctgctgaagaaattgaagcagctg

SEQ ID NO: 316827 - DNA, 25 bp, Mus musculus
gctgctgaagaacttttccagtccc

SEQ ID NO: 316828 - DNA, 25 bp, Mus musculus
gctgctgaagaggcagaggagtcct

SEQ ID NO: 316829 - DNA, 25 bp, Mus musculus
gctgctgaagctggggggtcgtgtg

SEQ ID NO: 316830 - DNA, 25 bp, Mus musculus
gctgctgaattttagagaacgagtt

SEQ ID NO: 316831 - DNA, 25 bp, Mus musculus
gctgctgaattttagagaatggctc

SEQ ID NO: 316832 - DNA, 25 bp, Mus musculus
gctgctgacaggccgggtgaccaag

SEQ ID NO: 316833 - DNA, 25 bp, Mus musculus
gctgctgacagtatccctggaagac

SEQ ID NO: 316834 - DNA, 25 bp, Mus musculus
gctgctgactccaggaggaatgctg

SEQ ID NO: 316835 - DNA, 25 bp, Mus musculus
gctgctgactccaggtctgttctca

SEQ ID NO: 316836 - DNA, 25 bp, Mus musculus
gctgctgactcccagacattgggcc

SEQ ID NO: 316837 - DNA, 25 bp, Mus musculus
gctgctgactcccagaccatctcct

SEQ ID NO: 316838 - DNA, 25 bp, Mus musculus
gctgctgactcccaggatgccctga

SEQ ID NO: 316839 - DNA, 25 bp, Mus musculus
gctgctgactcctctgcaggtgtca

SEQ ID NO: 316840 - DNA, 25 bp, Mus musculus
gctgctgactgtgtcaacaaggctc

SEQ ID NO: 316841 - DNA, 25 bp, Mus musculus
gctgctgagactttccagttctcag

SEQ ID NO: 316842 - DNA, 25 bp, Mus musculus
gctgctgagagcggcccctttgttg

SEQ ID NO: 316843 - DNA, 25 bp, Mus musculus
gctgctgagaggttcatgtactgga

SEQ ID NO: 316844 - DNA, 25 bp, Mus musculus
gctgctgagatcttggaaatagcag

SEQ ID NO: 316845 - DNA, 25 bp, Mus musculus
gctgctgagcaaggatgaagatgga

SEQ ID NO: 316846 - DNA, 25 bp, Mus musculus
gctgctgagcagctgcagcagcccc

SEQ ID NO: 316847 - DNA, 25 bp, Mus musculus
gctgctgagcaggtagataataaag

SEQ ID NO: 316848 - DNA, 25 bp, Mus musculus
gctgctgagcaggttcaattttata

SEQ ID NO: 316849 - DNA, 25 bp, Mus musculus
gctgctgagcctggggaacaaaaac

SEQ ID NO: 316850 - DNA, 25 bp, Mus musculus
gctgctgagcctgggtcactgttct

SEQ ID NO: 316851 - DNA, 25 bp, Mus musculus
gctgctgagcgctgagattggtgtc

SEQ ID NO: 316852 - DNA, 25 bp, Mus musculus
gctgctgagcgctgattcctgagtc

SEQ ID NO: 316853 - DNA, 25 bp, Mus musculus
gctgctgaggaacttgtatgaaagt

SEQ ID NO: 316854 - DNA, 25 bp, Mus musculus
gctgctgaggagaatgcggaggcca

SEQ ID NO: 316855 - DNA, 25 bp, Mus musculus
gctgctgagtacaggatatgaatca

SEQ ID NO: 316856 - DNA, 25 bp, Mus musculus
gctgctgagtacaggcgtgggtgac

SEQ ID NO: 316857 - DNA, 25 bp, Mus musculus
gctgctgatgaaccacgccttcatc

SEQ ID NO: 316858 - DNA, 25 bp, Mus musculus
gctgctgatgaaggagagagaagtg

SEQ ID NO: 316859 - DNA, 25 bp, Mus musculus
gctgctgatgaagggtccgcaggtc

SEQ ID NO: 316860 - DNA, 25 bp, Mus musculus
gctgctgatggtcgacacccgcacc

SEQ ID NO: 316861 - DNA, 25 bp, Mus musculus
gctgctgattgggaacaagtcagac

SEQ ID NO: 316862 - DNA, 25 bp, Mus musculus
gctgctgcacagccctcctaagggt

SEQ ID NO: 316863 - DNA, 25 bp, Mus musculus
gctgctgcacaggaataaaggacat

SEQ ID NO: 316864 - DNA, 25 bp, Mus musculus
gctgctgcaccagattataagtgcc

SEQ ID NO: 316865 - DNA, 25 bp, Mus musculus
gctgctgcaccagattgatgtcctc

SEQ ID NO: 316866 - DNA, 25 bp, Mus musculus
gctgctgcagccctgccagtttgac

SEQ ID NO: 316867 - DNA, 25 bp, Mus musculus
gctgctgcagccgaggcagacgagg

SEQ ID NO: 316868 - DNA, 25 bp, Mus musculus
gctgctgcagccgagggaatgggct

SEQ ID NO: 316869 - DNA, 25 bp, Mus musculus
gctgctgcaggtactagaagacaca

SEQ ID NO: 316870 - DNA, 25 bp, Mus musculus
gctgctgcaggtcctgtgggaatgg

SEQ ID NO: 316871 - DNA, 25 bp, Mus musculus
gctgctgcaggttaccaacatatcc

SEQ ID NO: 316872 - DNA, 25 bp, Mus musculus
gctgctgcaggttgctgagaaatgt

SEQ ID NO: 316873 - DNA, 25 bp, Mus musculus
gctgctgcagtgctggggatcaaac

SEQ ID NO: 316874 - DNA, 25 bp, Mus musculus
gctgctgccactgcccacccccgcg

SEQ ID NO: 316875 - DNA, 25 bp, Mus musculus
gctgctgccagagggaaattgtggg

SEQ ID NO: 316876 - DNA, 25 bp, Mus musculus
gctgctgccagataaagatagagaa

SEQ ID NO: 316877 - DNA, 25 bp, Mus musculus
gctgctgccagcaggacggccagcc

SEQ ID NO: 316878 - DNA, 25 bp, Mus musculus
gctgctgccagccaggcttcccgga

SEQ ID NO: 316879 - DNA, 25 bp, Mus musculus
gctgctgccagccagggactaggcc

SEQ ID NO: 316880 - DNA, 25 bp, Mus musculus
gctgctgccaggaagaattcagttg

SEQ ID NO: 316881 - DNA, 25 bp, Mus musculus
gctgctgcctctgattggccttggt

SEQ ID NO: 316882 - DNA, 25 bp, Mus musculus
gctgctgcctgtattgaccaagaag

SEQ ID NO: 316883 - DNA, 25 bp, Mus musculus
gctgctgcgagaggccaaggtgacc

SEQ ID NO: 316884 - DNA, 25 bp, Mus musculus
gctgctgcgagtctgttgctgtgga

SEQ ID NO: 316885 - DNA, 25 bp, Mus musculus
gctgctgcgcacagagtcccaaaag

SEQ ID NO: 316886 - DNA, 25 bp, Mus musculus
gctgctgcgcacagattccccaaag

SEQ ID NO: 316887 - DNA, 25 bp, Mus musculus
gctgctgcgcagaagaagagctgtt

SEQ ID NO: 316888 - DNA, 25 bp, Mus musculus
gctgctgcgcttcgcccgcagcctc

SEQ ID NO: 316889 - DNA, 25 bp, Mus musculus
gctgctgctaactgtgtggtttaat

SEQ ID NO: 316890 - DNA, 25 bp, Mus musculus
gctgctgctcggagagcgggactac

SEQ ID NO: 316891 - DNA, 25 bp, Mus musculus
gctgctgctcggcaatgatggcagt

SEQ ID NO: 316892 - DNA, 25 bp, Mus musculus
gctgctgctcggcgctggagaatct

SEQ ID NO: 316893 - DNA, 25 bp, Mus musculus
gctgctgctctgtaaagaagaagaa

SEQ ID NO: 316894 - DNA, 25 bp, Mus musculus
gctgctgctgagtgagcgggtgagc

SEQ ID NO: 316895 - DNA, 25 bp, Mus musculus
gctgctgctgccagataaagataga

SEQ ID NO: 316896 - DNA, 25 bp, Mus musculus
gctgctgctgctcggcgctggagaa

SEQ ID NO: 316897 - DNA, 25 bp, Mus musculus
gctgctgctgctgctggtcacgtga

SEQ ID NO: 316898 - DNA, 25 bp, Mus musculus
gctgctgctgctggcctctccggag

SEQ ID NO: 316899 - DNA, 25 bp, Mus musculus
gctgctgctgctggtcacgtgaaga

SEQ ID NO: 316900 - DNA, 25 bp, Mus musculus
gctgctgctggaacgggttccagcc

SEQ ID NO: 316901 - DNA, 25 bp, Mus musculus
gctgctgctggccggtataactgca

SEQ ID NO: 316902 - DNA, 25 bp, Mus musculus
gctgctgctggcctctccggagtcc

SEQ ID NO: 316903 - DNA, 25 bp, Mus musculus
gctgctgctggctgggctggttctt

SEQ ID NO: 316904 - DNA, 25 bp, Mus musculus
gctgctgctgggcgctgtctcagcc

SEQ ID NO: 316905 - DNA, 25 bp, Mus musculus
gctgctgctgggtgctggagagtct

SEQ ID NO: 316906 - DNA, 25 bp, Mus musculus
gctgctggaaaagccacacctgcgc

SEQ ID NO: 316907 - DNA, 25 bp, Mus musculus
gctgctggaaaaggtacctgagatt

SEQ ID NO: 316908 - DNA, 25 bp, Mus musculus
gctgctggaagtgagagggtccaag

SEQ ID NO: 316909 - DNA, 25 bp, Mus musculus
gctgctggacctaccggcatgttct

SEQ ID NO: 316910 - DNA, 25 bp, Mus musculus
gctgctggacggagcgggatgaccc

SEQ ID NO: 316911 - DNA, 25 bp, Mus musculus
gctgctggagagagggaaatctaca

SEQ ID NO: 316912 - DNA, 25 bp, Mus musculus
gctgctggagaggttatcaatgctg

SEQ ID NO: 316913 - DNA, 25 bp, Mus musculus
gctgctggaggtctctcctggtgac

SEQ ID NO: 316914 - DNA, 25 bp, Mus musculus
gctgctggatcagaaaaggaagtgg

SEQ ID NO: 316915 - DNA, 25 bp, Mus musculus
gctgctggatcagaccctgaatctg

SEQ ID NO: 316916 - DNA, 25 bp, Mus musculus
gctgctggatcagactaagagcagc

SEQ ID NO: 316917 - DNA, 25 bp, Mus musculus
gctgctggatcagaggtatcctgtc

SEQ ID NO: 316918 - DNA, 25 bp, Mus musculus
gctgctggatgagattctggacttt

SEQ ID NO: 316919 - DNA, 25 bp, Mus musculus
gctgctggattcgatgatatggaag

SEQ ID NO: 316920 - DNA, 25 bp, Mus musculus
gctgctggcagaagctggaatgcct

SEQ ID NO: 316921 - DNA, 25 bp, Mus musculus
gctgctggcagcaatgctggctttc

SEQ ID NO: 316922 - DNA, 25 bp, Mus musculus
gctgctggccagggtttaacgttta

SEQ ID NO: 316923 - DNA, 25 bp, Mus musculus
gctgctggccgcacttggttacaag

SEQ ID NO: 316924 - DNA, 25 bp, Mus musculus
gctgctggccggtataactgcaacc

SEQ ID NO: 316925 - DNA, 25 bp, Mus musculus
gctgctggctaagaggagaaaggca

SEQ ID NO: 316926 - DNA, 25 bp, Mus musculus
gctgctggctgagaaaatggctgtt

SEQ ID NO: 316927 - DNA, 25 bp, Mus musculus
gctgctggctgggctggttcttctg

SEQ ID NO: 316928 - DNA, 25 bp, Mus musculus
gctgctgggaaaggaaggatttaat

SEQ ID NO: 316929 - DNA, 25 bp, Mus musculus
gctgctgggaaggatctggttctac

SEQ ID NO: 316930 - DNA, 25 bp, Mus musculus
gctgctgggaagggagagcacctgg

SEQ ID NO: 316931 - DNA, 25 bp, Mus musculus
gctgctgggaagtccgcccgtgctg

SEQ ID NO: 316932 - DNA, 25 bp, Mus musculus
gctgctgggaataacagacaaaaga

SEQ ID NO: 316933 - DNA, 25 bp, Mus musculus
gctgctgggcgctgtctcagcctct

SEQ ID NO: 316934 - DNA, 25 bp, Mus musculus
gctgctgggcttggttcctgcctca

SEQ ID NO: 316935 - DNA, 25 bp, Mus musculus
gctgctggggtccagctgtcaccct

SEQ ID NO: 316936 - DNA, 25 bp, Mus musculus
gctgctggggtccagggaaaggctc

SEQ ID NO: 316937 - DNA, 25 bp, Mus musculus
gctgctggtagatgctgacggctag

SEQ ID NO: 316938 - DNA, 25 bp, Mus musculus
gctgctggtagatggtgactagagg

SEQ ID NO: 316939 - DNA, 25 bp, Mus musculus
gctgctggtccccctggtgctactg

SEQ ID NO: 316940 - DNA, 25 bp, Mus musculus
gctgctggtgagaggaagctttgtc

SEQ ID NO: 316941 - DNA, 25 bp, Mus musculus
gctgctggtgctcaggcattgcagc

SEQ ID NO: 316942 - DNA, 25 bp, Mus musculus
gctgctggtgggcaggtgtgctgat

SEQ ID NO: 316943 - DNA, 25 bp, Mus musculus
gctgctggtgggcagtggagaaaaa

SEQ ID NO: 316944 - DNA, 25 bp, Mus musculus
gctgctggtttatttacaccaagct

SEQ ID NO: 316945 - DNA, 25 bp, Mus musculus
gctgctgtatgcccttctctaggaa

SEQ ID NO: 316946 - DNA, 25 bp, Mus musculus
gctgctgtcactggtgctcctggct

SEQ ID NO: 316947 - DNA, 25 bp, Mus musculus
gctgctgtccaagttggggctcgct

SEQ ID NO: 316948 - DNA, 25 bp, Mus musculus
gctgctgtccacaggtccacggtgt

SEQ ID NO: 316949 - DNA, 25 bp, Mus musculus
gctgctgtccttcctgcttagacgc

SEQ ID NO: 316950 - DNA, 25 bp, Mus musculus
gctgctgtctgcaaggagaagatcg

SEQ ID NO: 316951 - DNA, 25 bp, Mus musculus
gctgctgtgcagctttttagaactt

SEQ ID NO: 316952 - DNA, 25 bp, Mus musculus
gctgctgtgctctcctgctatgcag

SEQ ID NO: 316953 - DNA, 25 bp, Mus musculus
gctgctgtggaagctgggattcttc

SEQ ID NO: 316954 - DNA, 25 bp, Mus musculus
gctgctgtggaagtgtggcttcttc

SEQ ID NO: 316955 - DNA, 25 bp, Mus musculus
gctgctgttaaggaagaagagctgg

SEQ ID NO: 316956 - DNA, 25 bp, Mus musculus
gctgctgttgctcggtgcgggcgag

SEQ ID NO: 316957 - DNA, 25 bp, Mus musculus
gctgctgtttcctcctaggatgtca

SEQ ID NO: 316958 - DNA, 25 bp, Mus musculus
gctgcttaatagatcacaactggct

SEQ ID NO: 316959 - DNA, 25 bp, Mus musculus
gctgcttacgctcagacagtccagg

SEQ ID NO: 316960 - DNA, 25 bp, Mus musculus
gctgcttactgtgagcgtgcaatga

SEQ ID NO: 316961 - DNA, 25 bp, Mus musculus
gctgcttagagagttttgtcaagag

SEQ ID NO: 316962 - DNA, 25 bp, Mus musculus
gctgcttataagagagcttcatgga

SEQ ID NO: 316963 - DNA, 25 bp, Mus musculus
gctgcttataaggtgcacacaggac

SEQ ID NO: 316964 - DNA, 25 bp, Mus musculus
gctgcttatggagaccacacaggag

SEQ ID NO: 316965 - DNA, 25 bp, Mus musculus
gctgcttcaagaggcttggctttct

SEQ ID NO: 316966 - DNA, 25 bp, Mus musculus
gctgcttcagagatgagtgaaaatt

SEQ ID NO: 316967 - DNA, 25 bp, Mus musculus
gctgcttcagcacctctgggagcct

SEQ ID NO: 316968 - DNA, 25 bp, Mus musculus
gctgcttcaggaattctctgatcaa

SEQ ID NO: 316969 - DNA, 25 bp, Mus musculus
gctgcttcagtctcgttcgagaaat

SEQ ID NO: 316970 - DNA, 25 bp, Mus musculus
gctgcttccagcagaataacaacaa

SEQ ID NO: 316971 - DNA, 25 bp, Mus musculus
gctgcttccaggcttttatttgtgg

SEQ ID NO: 316972 - DNA, 25 bp, Mus musculus
gctgcttccctctttccatgaagtc

SEQ ID NO: 316973 - DNA, 25 bp, Mus musculus
gctgcttccgggtgttggaaggaca

SEQ ID NO: 316974 - DNA, 25 bp, Mus musculus
gctgcttctaggtgctggagagtct

SEQ ID NO: 316975 - DNA, 25 bp, Mus musculus
gctgcttctcagtcaggatggctaa

SEQ ID NO: 316976 - DNA, 25 bp, Mus musculus
gctgcttctcgttggtgcctttgtg

SEQ ID NO: 316977 - DNA, 25 bp, Mus musculus
gctgcttctgccaagattacagtag

SEQ ID NO: 316978 - DNA, 25 bp, Mus musculus
gctgcttctgccttgtccccacaga

SEQ ID NO: 316979 - DNA, 25 bp, Mus musculus
gctgcttctggatttatttattatt

SEQ ID NO: 316980 - DNA, 25 bp, Mus musculus
gctgcttctggctggccggcctggc

SEQ ID NO: 316981 - DNA, 25 bp, Mus musculus
gctgcttctgggtgccggtgaatcc

SEQ ID NO: 316982 - DNA, 25 bp, Mus musculus
gctgcttcttcacgtgacctgacag

SEQ ID NO: 316983 - DNA, 25 bp, Mus musculus
gctgcttcttgaaaggaactctgtt

SEQ ID NO: 316984 - DNA, 25 bp, Mus musculus
gctgcttgaaaagacactgagtcct

SEQ ID NO: 316985 - DNA, 25 bp, Mus musculus
gctgcttgacaacaagcctgaccac

SEQ ID NO: 316986 - DNA, 25 bp, Mus musculus
gctgcttgcaaaggtggtacccggg

SEQ ID NO: 316987 - DNA, 25 bp, Mus musculus
gctgcttgctcatcccagcctgctt

SEQ ID NO: 316988 - DNA, 25 bp, Mus musculus
gctgcttgtgtcgggaatgtgtttc

SEQ ID NO: 316989 - DNA, 25 bp, Mus musculus
gctgctttaaacatggtaccgggtg

SEQ ID NO: 316990 - DNA, 25 bp, Mus musculus
gctgctttaaacatgtacccctcta

SEQ ID NO: 316991 - DNA, 25 bp, Mus musculus
gctgctttagagtctccagagccag

SEQ ID NO: 316992 - DNA, 25 bp, Mus musculus
gctgctttaggcccaggagggtgac

SEQ ID NO: 316993 - DNA, 25 bp, Mus musculus
gctgctttgcggactttgaatgtgg

SEQ ID NO: 316994 - DNA, 25 bp, Mus musculus
gctgctttgcggtactggaattgca

SEQ ID NO: 316995 - DNA, 25 bp, Mus musculus
gctgcttttaagtaacggcacagcc

SEQ ID NO: 316996 - DNA, 25 bp, Mus musculus
gctggaaaacacagccatcaccatc

SEQ ID NO: 316997 - DNA, 25 bp, Mus musculus
gctggaaaacacaggtcgcctgacg

SEQ ID NO: 316998 - DNA, 25 bp, Mus musculus
gctggaaaacagctttcctagcaag

SEQ ID NO: 316999 - DNA, 25 bp, Mus musculus
gctggaaaagccacacctgcgccct

SEQ ID NO: 317000 - DNA, 25 bp, Mus musculus
gctggaaaagccgctggacgactct

SEQ ID NO: 317001 - DNA, 25 bp, Mus musculus
gctggaaaagccgtcccgcacggtg

SEQ ID NO: 317002 - DNA, 25 bp, Mus musculus
gctggaaaagcgagctgggagaaca

SEQ ID NO: 317003 - DNA, 25 bp, Mus musculus
gctggaaaagcgaggccttggaaca

SEQ ID NO: 317004 - DNA, 25 bp, Mus musculus
gctggaaaaggtacctgagattgtg

SEQ ID NO: 317005 - DNA, 25 bp, Mus musculus
gctggaaaggaagaggagccgctgc

SEQ ID NO: 317006 - DNA, 25 bp, Mus musculus
gctggaaatggaaccagtgaccttt

SEQ ID NO: 317007 - DNA, 25 bp, Mus musculus
gctggaaatgtaggtggttgtgagc

SEQ ID NO: 317008 - DNA, 25 bp, Mus musculus
gctggaacacaaaacgaaacctcgt

SEQ ID NO: 317009 - DNA, 25 bp, Mus musculus
gctggaacagctggacatgcgccgg

SEQ ID NO: 317010 - DNA, 25 bp, Mus musculus
gctggaacagctgggctccctttcc

SEQ ID NO: 317011 - DNA, 25 bp, Mus musculus
gctggaacagtggccgcacgaggga

SEQ ID NO: 317012 - DNA, 25 bp, Mus musculus
gctggaaccctctagcacctaaagg

SEQ ID NO: 317013 - DNA, 25 bp, Mus musculus
gctggaaccctctgtgcagagaggt

SEQ ID NO: 317014 - DNA, 25 bp, Mus musculus
gctggaacctggagggaaaagcagt

SEQ ID NO: 317015 - DNA, 25 bp, Mus musculus
gctggaacggctattcgctgcctga

SEQ ID NO: 317016 - DNA, 25 bp, Mus musculus
gctggaacggctgctggtccaggtc

SEQ ID NO: 317017 - DNA, 25 bp, Mus musculus
gctggaacggctggtggtgaggtcg

SEQ ID NO: 317018 - DNA, 25 bp, Mus musculus
gctggaactaaaggaaggccctcat

SEQ ID NO: 317019 - DNA, 25 bp, Mus musculus
gctggaagacgtgaaattgcaagct

SEQ ID NO: 317020 - DNA, 25 bp, Mus musculus
gctggaagacgtgaatatccgctcc

SEQ ID NO: 317021 - DNA, 25 bp, Mus musculus
gctggaagaggacaagctgggctgc

SEQ ID NO: 317022 - DNA, 25 bp, Mus musculus
gctggaagaggactagtgtctgtcc

SEQ ID NO: 317023 - DNA, 25 bp, Mus musculus
gctggaagagtaccgttccccagct

SEQ ID NO: 317024 - DNA, 25 bp, Mus musculus
gctggaagagtatctgtgggaggca

SEQ ID NO: 317025 - DNA, 25 bp, Mus musculus
gctggaagagtattctttggtacag

SEQ ID NO: 317026 - DNA, 25 bp, Mus musculus
gctggaagatttatacaaaaggttt

SEQ ID NO: 317027 - DNA, 25 bp, Mus musculus
gctggaagcagatgttttgggtcca

SEQ ID NO: 317028 - DNA, 25 bp, Mus musculus
gctggaaggaggaagatgggctcct

SEQ ID NO: 317029 - DNA, 25 bp, Mus musculus
gctggaaggggagtgggctcacccg

SEQ ID NO: 317030 - DNA, 25 bp, Mus musculus
gctggaagtaaaggtcaccttggct

SEQ ID NO: 317031 - DNA, 25 bp, Mus musculus
gctggaagtgaagaacccagattcc

SEQ ID NO: 317032 - DNA, 25 bp, Mus musculus
gctggaagtgaaggcctgaaccaaa

SEQ ID NO: 317033 - DNA, 25 bp, Mus musculus
gctggaataaaaattgggatgaatg

SEQ ID NO: 317034 - DNA, 25 bp, Mus musculus
gctggaatcggaaggcaggagagta

SEQ ID NO: 317035 - DNA, 25 bp, Mus musculus
gctggaatctggccctggttctgag

SEQ ID NO: 317036 - DNA, 25 bp, Mus musculus
gctggaatctgtgggcgggcagctg

SEQ ID NO: 317037 - DNA, 25 bp, Mus musculus
gctggaatgaaaggcattttcccga

SEQ ID NO: 317038 - DNA, 25 bp, Mus musculus
gctggaatgcagataacaattgaaa

SEQ ID NO: 317039 - DNA, 25 bp, Mus musculus
gctggaatgcagcttgaaggtcttc

SEQ ID NO: 317040 - DNA, 25 bp, Mus musculus
gctggaatgcgcagattaagaaaca

SEQ ID NO: 317041 - DNA, 25 bp, Mus musculus
gctggaattaaagctctaagaacag

SEQ ID NO: 317042 - DNA, 25 bp, Mus musculus
gctggaattaaaggaaactagaagt

SEQ ID NO: 317043 - DNA, 25 bp, Mus musculus
gctggaattacaggatgagcctgcc

SEQ ID NO: 317044 - DNA, 25 bp, Mus musculus
gctggaattccagattcgagtcaat

SEQ ID NO: 317045 - DNA, 25 bp, Mus musculus
gctggaattccaggcacgtgctcta

SEQ ID NO: 317046 - DNA, 25 bp, Mus musculus
gctggacaaaatggggtggatggtg

SEQ ID NO: 317047 - DNA, 25 bp, Mus musculus
gctggacaagagcggttccggagcc

SEQ ID NO: 317048 - DNA, 25 bp, Mus musculus
gctggacaaggcccgagtccggaag

SEQ ID NO: 317049 - DNA, 25 bp, Mus musculus
gctggacaatttaggctacagaaca

SEQ ID NO: 317050 - DNA, 25 bp, Mus musculus
gctggacacggctgtccagggcaca

SEQ ID NO: 317051 - DNA, 25 bp, Mus musculus
gctggacagaactcagcagatatct

SEQ ID NO: 317052 - DNA, 25 bp, Mus musculus
gctggacagagagttaattgacaag

SEQ ID NO: 317053 - DNA, 25 bp, Mus musculus
gctggacaggagaggatgggagcca

SEQ ID NO: 317054 - DNA, 25 bp, Mus musculus
gctggacaggatgtgtgaagatctg

SEQ ID NO: 317055 - DNA, 25 bp, Mus musculus
gctggacattctggggaacggattg

SEQ ID NO: 317056 - DNA, 25 bp, Mus musculus
gctggaccacccttggtgaaggcag

SEQ ID NO: 317057 - DNA, 25 bp, Mus musculus
gctggaccagatgcggtgagcaccc

SEQ ID NO: 317058 - DNA, 25 bp, Mus musculus
gctggaccaggagcagccatgtctg

SEQ ID NO: 317059 - DNA, 25 bp, Mus musculus
gctggacccagaaggattgccacaa

SEQ ID NO: 317060 - DNA, 25 bp, Mus musculus
gctggacccagaaggtttgaggctc

SEQ ID NO: 317061 - DNA, 25 bp, Mus musculus
gctggacccgctgcggctgctgtat

SEQ ID NO: 317062 - DNA, 25 bp, Mus musculus
gctggacccgtccattggagaattc

SEQ ID NO: 317063 - DNA, 25 bp, Mus musculus
gctggaccctgtggaagggcggctg

SEQ ID NO: 317064 - DNA, 25 bp, Mus musculus
gctggaccgaagcccaaagcccacc

SEQ ID NO: 317065 - DNA, 25 bp, Mus musculus
gctggacctagcaggcttacagttc

SEQ ID NO: 317066 - DNA, 25 bp, Mus musculus
gctggacctcaatggcaatgccctc

SEQ ID NO: 317067 - DNA, 25 bp, Mus musculus
gctggacctccgggtcctgtgggtc

SEQ ID NO: 317068 - DNA, 25 bp, Mus musculus
gctggacctgggggcagcccgggcc

SEQ ID NO: 317069 - DNA, 25 bp, Mus musculus
gctggacgagaactacaatatgtac

SEQ ID NO: 317070 - DNA, 25 bp, Mus musculus
gctggacgaggtgccagtcattata

SEQ ID NO: 317071 - DNA, 25 bp, Mus musculus
gctggacgcaagggcattgaaaaca

SEQ ID NO: 317072 - DNA, 25 bp, Mus musculus
gctggacgcaagggtttgtgtttag

SEQ ID NO: 317073 - DNA, 25 bp, Mus musculus
gctggacgcacagcctttgcttcct

SEQ ID NO: 317074 - DNA, 25 bp, Mus musculus
gctggacgcgcggaaaggaaacctc

SEQ ID NO: 317075 - DNA, 25 bp, Mus musculus
gctggacgcgggagagaagatggag

SEQ ID NO: 317076 - DNA, 25 bp, Mus musculus
gctggacgctcggactgggctatat

SEQ ID NO: 317077 - DNA, 25 bp, Mus musculus
gctggacgggacctcattcctctct

SEQ ID NO: 317078 - DNA, 25 bp, Mus musculus
gctggactccacgtggaacttaggc

SEQ ID NO: 317079 - DNA, 25 bp, Mus musculus
gctggactgaaggacgcagatagag

SEQ ID NO: 317080 - DNA, 25 bp, Mus musculus
gctggactgcagaggccacttcttc

SEQ ID NO: 317081 - DNA, 25 bp, Mus musculus
gctggactgcctgaacagggacaac

SEQ ID NO: 317082 - DNA, 25 bp, Mus musculus
gctggactggcaaatcacccctttt

SEQ ID NO: 317083 - DNA, 25 bp, Mus musculus
gctggactgttatccaactgaggag

SEQ ID NO: 317084 - DNA, 25 bp, Mus musculus
gctggagaaaattagagccccttcc

SEQ ID NO: 317085 - DNA, 25 bp, Mus musculus
gctggagaaagagtacttcttagcc

SEQ ID NO: 317086 - DNA, 25 bp, Mus musculus
gctggagaagaatatggagaagatc

SEQ ID NO: 317087 - DNA, 25 bp, Mus musculus
gctggagaaggcattcggggcacgg

SEQ ID NO: 317088 - DNA, 25 bp, Mus musculus
gctggagaaggtggacggtatcctg

SEQ ID NO: 317089 - DNA, 25 bp, Mus musculus
gctggagaagttgtgtgactccctc

SEQ ID NO: 317090 - DNA, 25 bp, Mus musculus
gctggagaatcttctctgtccactt

SEQ ID NO: 317091 - DNA, 25 bp, Mus musculus
gctggagaattccttctctgaagcg

SEQ ID NO: 317092 - DNA, 25 bp, Mus musculus
gctggagagaaggataaaggggagt

SEQ ID NO: 317093 - DNA, 25 bp, Mus musculus
gctggagagaaggcctgcctgccta

SEQ ID NO: 317094 - DNA, 25 bp, Mus musculus
gctggagagaagggctattggctta

SEQ ID NO: 317095 - DNA, 25 bp, Mus musculus
gctggagagaaggtcatttgagacc

SEQ ID NO: 317096 - DNA, 25 bp, Mus musculus
gctggagagagggaaatctacaagc

SEQ ID NO: 317097 - DNA, 25 bp, Mus musculus
gctggagagctgtgtggctgagcag

SEQ ID NO: 317098 - DNA, 25 bp, Mus musculus
gctggagaggaaggcacagagaact

SEQ ID NO: 317099 - DNA, 25 bp, Mus musculus
gctggagagtaggtggcattgaccc

SEQ ID NO: 317100 - DNA, 25 bp, Mus musculus
gctggagatcaggaggcgccagctg

SEQ ID NO: 317101 - DNA, 25 bp, Mus musculus
gctggagatcaggattgacttgtgg

SEQ ID NO: 317102 - DNA, 25 bp, Mus musculus
gctggagatcaggttcaatgctccc

SEQ ID NO: 317103 - DNA, 25 bp, Mus musculus
gctggagcaaagattgcgccaggct

SEQ ID NO: 317104 - DNA, 25 bp, Mus musculus
gctggagcaaagtgaaaaagatttg

SEQ ID NO: 317105 - DNA, 25 bp, Mus musculus
gctggagcagaagaataaagagata

SEQ ID NO: 317106 - DNA, 25 bp, Mus musculus
gctggagcagaagatctatccctat

SEQ ID NO: 317107 - DNA, 25 bp, Mus musculus
gctggagcagaaggataaacaaagg

SEQ ID NO: 317108 - DNA, 25 bp, Mus musculus
gctggagcagaggagataatcggag

SEQ ID NO: 317109 - DNA, 25 bp, Mus musculus
gctggagcagaggagatcatcgggg

SEQ ID NO: 317110 - DNA, 25 bp, Mus musculus
gctggagcagaggatttcagcgtca

SEQ ID NO: 317111 - DNA, 25 bp, Mus musculus
gctggagcagcttgaacttgagaag

SEQ ID NO: 317112 - DNA, 25 bp, Mus musculus
gctggagcaggaaagatctataccc

SEQ ID NO: 317113 - DNA, 25 bp, Mus musculus
gctggagcagggccacgtggcaccg

SEQ ID NO: 317114 - DNA, 25 bp, Mus musculus
gctggagccacaaactcctgcttcc

SEQ ID NO: 317115 - DNA, 25 bp, Mus musculus
gctggagccacaaattgcggttgcc

SEQ ID NO: 317116 - DNA, 25 bp, Mus musculus
gctggagccagaagaacagacaagg

SEQ ID NO: 317117 - DNA, 25 bp, Mus musculus
gctggagccagaaggtttggattcc

SEQ ID NO: 317118 - DNA, 25 bp, Mus musculus
gctggagccagaggctgcattgtga

SEQ ID NO: 317119 - DNA, 25 bp, Mus musculus
gctggagcccaaaaagatggcactt

SEQ ID NO: 317120 - DNA, 25 bp, Mus musculus
gctggagcccacgaaccttctttta

SEQ ID NO: 317121 - DNA, 25 bp, Mus musculus
gctggagccccgagcccttccagca

SEQ ID NO: 317122 - DNA, 25 bp, Mus musculus
gctggagccccgagctcctctaatt

SEQ ID NO: 317123 - DNA, 25 bp, Mus musculus
gctggagcccctgaaagagatgaca

SEQ ID NO: 317124 - DNA, 25 bp, Mus musculus
gctggagcccgagtggcaccagctt

SEQ ID NO: 317125 - DNA, 25 bp, Mus musculus
gctggagcccgatggttttcggaag

SEQ ID NO: 317126 - DNA, 25 bp, Mus musculus
gctggagcgaccgccaggctcccag

SEQ ID NO: 317127 - DNA, 25 bp, Mus musculus
gctggagctcggcaggcatttcagg

SEQ ID NO: 317128 - DNA, 25 bp, Mus musculus
gctggagctgagatgacgttgcacc

SEQ ID NO: 317129 - DNA, 25 bp, Mus musculus
gctggagctgaggagattattggtg

SEQ ID NO: 317130 - DNA, 25 bp, Mus musculus
gctggagctgctgagatcttagcct

SEQ ID NO: 317131 - DNA, 25 bp, Mus musculus
gctggagctgctgagggagctgaat

SEQ ID NO: 317132 - DNA, 25 bp, Mus musculus
gctggagcttttgcggtttgtagtg

SEQ ID NO: 317133 - DNA, 25 bp, Mus musculus
gctggagcttttgcgttcagttcgg

SEQ ID NO: 317134 - DNA, 25 bp, Mus musculus
gctggaggaaaccaggaatgggcct

SEQ ID NO: 317135 - DNA, 25 bp, Mus musculus
gctggaggaagccaagaagaagctg

SEQ ID NO: 317136 - DNA, 25 bp, Mus musculus
gctggaggacaaaggggagacacca

SEQ ID NO: 317137 - DNA, 25 bp, Mus musculus
gctggaggacaaaggtcaagcaggt

SEQ ID NO: 317138 - DNA, 25 bp, Mus musculus
gctggaggacttcaggtatccgtgg

SEQ ID NO: 317139 - DNA, 25 bp, Mus musculus
gctggaggacttcagtgtgtctcca

SEQ ID NO: 317140 - DNA, 25 bp, Mus musculus
gctggaggaggccaagcacattgct

SEQ ID NO: 317141 - DNA, 25 bp, Mus musculus
gctggaggaggcgggcgtccgaaac

SEQ ID NO: 317142 - DNA, 25 bp, Mus musculus
gctggaggcagaaagaattgcctat

SEQ ID NO: 317143 - DNA, 25 bp, Mus musculus
gctggaggcccaggatttggtgtca

SEQ ID NO: 317144 - DNA, 25 bp, Mus musculus
gctggaggcccaggtgcgcaagttg

SEQ ID NO: 317145 - DNA, 25 bp, Mus musculus
gctggaggcccccaggattccccct

SEQ ID NO: 317146 - DNA, 25 bp, Mus musculus
gctggaggcctctgagatcgaggat

SEQ ID NO: 317147 - DNA, 25 bp, Mus musculus
gctggagggagacagaagcaggtgg

SEQ ID NO: 317148 - DNA, 25 bp, Mus musculus
gctggagggagacagaaggaggtgg

SEQ ID NO: 317149 - DNA, 25 bp, Mus musculus
gctggagggagacagagcaggtggc

SEQ ID NO: 317150 - DNA, 25 bp, Mus musculus
gctggagggcaagatattagcattt

SEQ ID NO: 317151 - DNA, 25 bp, Mus musculus
gctggaggtcatggtgaaacatcca

SEQ ID NO: 317152 - DNA, 25 bp, Mus musculus
gctggaggtcatggtgaaacatgag

SEQ ID NO: 317153 - DNA, 25 bp, Mus musculus
gctggaggtgttcagctcctgcttc

SEQ ID NO: 317154 - DNA, 25 bp, Mus musculus
gctggaggtgttcagggaggcagat

SEQ ID NO: 317155 - DNA, 25 bp, Mus musculus
gctggaggttaaagcttctgccaca

SEQ ID NO: 317156 - DNA, 25 bp, Mus musculus
gctggaggtttgctgttatttcgct

SEQ ID NO: 317157 - DNA, 25 bp, Mus musculus
gctggagtagacaggctcctcatag

SEQ ID NO: 317158 - DNA, 25 bp, Mus musculus
gctggagtagagaaggtccatctct

SEQ ID NO: 317159 - DNA, 25 bp, Mus musculus
gctggagtcaagggagatcgtggtg

SEQ ID NO: 317160 - DNA, 25 bp, Mus musculus
gctggagtcacgggaagtcctgcat

SEQ ID NO: 317161 - DNA, 25 bp, Mus musculus
gctggagtcagaacagggagccccc

SEQ ID NO: 317162 - DNA, 25 bp, Mus musculus
gctggagtcagaggagtttgacaag

SEQ ID NO: 317163 - DNA, 25 bp, Mus musculus
gctggagtccatcctgatggagtgc

SEQ ID NO: 317164 - DNA, 25 bp, Mus musculus
gctggagtccatgtttactgtcttg

SEQ ID NO: 317165 - DNA, 25 bp, Mus musculus
gctggagtccattcgacaaagatga

SEQ ID NO: 317166 - DNA, 25 bp, Mus musculus
gctggagtcgaatttggaaatactg

SEQ ID NO: 317167 - DNA, 25 bp, Mus musculus
gctggagtgagagagcctgtgctgt

SEQ ID NO: 317168 - DNA, 25 bp, Mus musculus
gctggagtgagagaggaggagcgct

SEQ ID NO: 317169 - DNA, 25 bp, Mus musculus
gctggagtgagagctgggaagtcat

SEQ ID NO: 317170 - DNA, 25 bp, Mus musculus
gctggagtgaggcctgccaccccta

SEQ ID NO: 317171 - DNA, 25 bp, Mus musculus
gctggagtgtactggatgtttgaga

SEQ ID NO: 317172 - DNA, 25 bp, Mus musculus
gctggagtgtgagataacacgtata

SEQ ID NO: 317173 - DNA, 25 bp, Mus musculus
gctggagttggcgcgcaggctacca

SEQ ID NO: 317174 - DNA, 25 bp, Mus musculus
gctggagtttcaggaactaatgacc

SEQ ID NO: 317175 - DNA, 25 bp, Mus musculus
gctggatacagttaccagtaagatt

SEQ ID NO: 317176 - DNA, 25 bp, Mus musculus
gctggatagaaggaagcaggccagc

SEQ ID NO: 317177 - DNA, 25 bp, Mus musculus
gctggatagagcggcagtacatccc

SEQ ID NO: 317178 - DNA, 25 bp, Mus musculus
gctggatagtaaggtgaacatcatt

SEQ ID NO: 317179 - DNA, 25 bp, Mus musculus
gctggatcagaaaaggaagtggaag

SEQ ID NO: 317180 - DNA, 25 bp, Mus musculus
gctggatcagaccctgaatctgtgg

SEQ ID NO: 317181 - DNA, 25 bp, Mus musculus
gctggatcagactaagagcagcgtt

SEQ ID NO: 317182 - DNA, 25 bp, Mus musculus
gctggatcagaggtatcctgtcttg

SEQ ID NO: 317183 - DNA, 25 bp, Mus musculus
gctggatcaggatgcgggctcctgg

SEQ ID NO: 317184 - DNA, 25 bp, Mus musculus
gctggatcaggtattccttttttgt

SEQ ID NO: 317185 - DNA, 25 bp, Mus musculus
gctggatcaggttaactttgtggct

SEQ ID NO: 317186 - DNA, 25 bp, Mus musculus
gctggatcagtttaggatttaagaa

SEQ ID NO: 317187 - DNA, 25 bp, Mus musculus
gctggatcatgcacctccagagatc

SEQ ID NO: 317188 - DNA, 25 bp, Mus musculus
gctggatccccacaatgatctgcat

SEQ ID NO: 317189 - DNA, 25 bp, Mus musculus
gctggatccgggaggaacatcacaa

SEQ ID NO: 317190 - DNA, 25 bp, Mus musculus
gctggatccggtggacacaccactg

SEQ ID NO: 317191 - DNA, 25 bp, Mus musculus
gctggatccgtaccccaagtaccac

SEQ ID NO: 317192 - DNA, 25 bp, Mus musculus
gctggatccgtattcttgttcctag

SEQ ID NO: 317193 - DNA, 25 bp, Mus musculus
gctggatctgaagatccttcttgat

SEQ ID NO: 317194 - DNA, 25 bp, Mus musculus
gctggatctgaaggcggcacgtttt

SEQ ID NO: 317195 - DNA, 25 bp, Mus musculus
gctggatgaagatgggtttgtggag

SEQ ID NO: 317196 - DNA, 25 bp, Mus musculus
gctggatgaccggttctaatcagag

SEQ ID NO: 317197 - DNA, 25 bp, Mus musculus
gctggatgatcctagcaaacagaag

SEQ ID NO: 317198 - DNA, 25 bp, Mus musculus
gctggatgatgaagttctcatcatt

SEQ ID NO: 317199 - DNA, 25 bp, Mus musculus
gctggatgccatcgatgccctcatg

SEQ ID NO: 317200 - DNA, 25 bp, Mus musculus
gctggatggcagccatagattgtaa

SEQ ID NO: 317201 - DNA, 25 bp, Mus musculus
gctggatgtcagctctctgctggaa

SEQ ID NO: 317202 - DNA, 25 bp, Mus musculus
gctggatgtctctgcaccatcggtt

SEQ ID NO: 317203 - DNA, 25 bp, Mus musculus
gctggatgtgcagtattcccccaca

SEQ ID NO: 317204 - DNA, 25 bp, Mus musculus
gctggattcaaggggaagaagccag

SEQ ID NO: 317205 - DNA, 25 bp, Mus musculus
gctggattgtagaacttcaatgcag

SEQ ID NO: 317206 - DNA, 25 bp, Mus musculus
gctggatttatccaggtgtgaaatt

SEQ ID NO: 317207 - DNA, 25 bp, Mus musculus
gctggatttatgataaagctgctca

SEQ ID NO: 317208 - DNA, 25 bp, Mus musculus
gctggcaaactgttctgtggtggtt

SEQ ID NO: 317209 - DNA, 25 bp, Mus musculus
gctggcaaagagtgatggcgtgcag

SEQ ID NO: 317210 - DNA, 25 bp, Mus musculus
gctggcaaagattttctttgaggtc

SEQ ID NO: 317211 - DNA, 25 bp, Mus musculus
gctggcaaaggcgggttccagcact

SEQ ID NO: 317212 - DNA, 25 bp, Mus musculus
gctggcaaaggtgggttccagcact

SEQ ID NO: 317213 - DNA, 25 bp, Mus musculus
gctggcaataaggagaggatggctg

SEQ ID NO: 317214 - DNA, 25 bp, Mus musculus
gctggcaatctcagagctaagtaaa

SEQ ID NO: 317215 - DNA, 25 bp, Mus musculus
gctggcaatctcagtttgtgactct

SEQ ID NO: 317216 - DNA, 25 bp, Mus musculus
gctggcacaggagagggaggcctgg

SEQ ID NO: 317217 - DNA, 25 bp, Mus musculus
gctggcacaggaggcctggaggagc

SEQ ID NO: 317218 - DNA, 25 bp, Mus musculus
gctggcaccagctgaggatggttcc

SEQ ID NO: 317219 - DNA, 25 bp, Mus musculus
gctggcaccttccggcagaaaggtg

SEQ ID NO: 317220 - DNA, 25 bp, Mus musculus
gctggcactcagggagcatggcact

SEQ ID NO: 317221 - DNA, 25 bp, Mus musculus
gctggcactgaggtttgggaaccag

SEQ ID NO: 317222 - DNA, 25 bp, Mus musculus
gctggcagaagtagagaaggatgtc

SEQ ID NO: 317223 - DNA, 25 bp, Mus musculus
gctggcagaatgagaatgtgattct

SEQ ID NO: 317224 - DNA, 25 bp, Mus musculus
gctggcagagaagcaacatggcttc

SEQ ID NO: 317225 - DNA, 25 bp, Mus musculus
gctggcagagaagcaataccacatc

SEQ ID NO: 317226 - DNA, 25 bp, Mus musculus
gctggcagagactcctgaaaggact

SEQ ID NO: 317227 - DNA, 25 bp, Mus musculus
gctggcagagcctcattaacttcgt

SEQ ID NO: 317228 - DNA, 25 bp, Mus musculus
gctggcagagtcccgttgccgagag

SEQ ID NO: 317229 - DNA, 25 bp, Mus musculus
gctggcagagtctaagtgttctgag

SEQ ID NO: 317230 - DNA, 25 bp, Mus musculus
gctggcagcaatgctggctttcaat

SEQ ID NO: 317231 - DNA, 25 bp, Mus musculus
gctggcagcgaacatgcgccgggat

SEQ ID NO: 317232 - DNA, 25 bp, Mus musculus
gctggcaggaaggccatattgacac

SEQ ID NO: 317233 - DNA, 25 bp, Mus musculus
gctggcaggaaggccatcttgacac

SEQ ID NO: 317234 - DNA, 25 bp, Mus musculus
gctggcaggaggcagaaaggatgag

SEQ ID NO: 317235 - DNA, 25 bp, Mus musculus
gctggcaggaggcaggtcattcatt

SEQ ID NO: 317236 - DNA, 25 bp, Mus musculus
gctggcagggctaacttcccgctcg

SEQ ID NO: 317237 - DNA, 25 bp, Mus musculus
gctggcaggtcccagggattttgga

SEQ ID NO: 317238 - DNA, 25 bp, Mus musculus
gctggcagtaactggcaagaagaca

SEQ ID NO: 317239 - DNA, 25 bp, Mus musculus
gctggcatactacaggatctatggg

SEQ ID NO: 317240 - DNA, 25 bp, Mus musculus
gctggcatcgtcaagaccactggga

SEQ ID NO: 317241 - DNA, 25 bp, Mus musculus
gctggcatcttgaaggtaagtgacc

SEQ ID NO: 317242 - DNA, 25 bp, Mus musculus
gctggcatgaaatcctggggcagag

SEQ ID NO: 317243 - DNA, 25 bp, Mus musculus
gctggcatggaagatgaaagagaag

SEQ ID NO: 317244 - DNA, 25 bp, Mus musculus
gctggcatggacagttctgccccag

SEQ ID NO: 317245 - DNA, 25 bp, Mus musculus
gctggcatgtctaagccaatcaaag

SEQ ID NO: 317246 - DNA, 25 bp, Mus musculus
gctggccaagttcagcaagaaggcc

SEQ ID NO: 317247 - DNA, 25 bp, Mus musculus
gctggccacagagttcctggagtcc

SEQ ID NO: 317248 - DNA, 25 bp, Mus musculus
gctggccacaggcctgcccaaggct

SEQ ID NO: 317249 - DNA, 25 bp, Mus musculus
gctggccacctctgcgatgctcaaa

SEQ ID NO: 317250 - DNA, 25 bp, Mus musculus
gctggccactgagctcaccctcgtt

SEQ ID NO: 317251 - DNA, 25 bp, Mus musculus
gctggccactgaggacccctataat

SEQ ID NO: 317252 - DNA, 25 bp, Mus musculus
gctggccactggtttatatccagaa

SEQ ID NO: 317253 - DNA, 25 bp, Mus musculus
gctggccactgtggtcaaagcacga

SEQ ID NO: 317254 - DNA, 25 bp, Mus musculus
gctggccactgtgtttacttatttt

SEQ ID NO: 317255 - DNA, 25 bp, Mus musculus
gctggccagactcagacacaacaac

SEQ ID NO: 317256 - DNA, 25 bp, Mus musculus
gctggccagcaacacaacaacattt

SEQ ID NO: 317257 - DNA, 25 bp, Mus musculus
gctggccagctttggaatctctgtt

SEQ ID NO: 317258 - DNA, 25 bp, Mus musculus
gctggccagctttggcactttctag

SEQ ID NO: 317259 - DNA, 25 bp, Mus musculus
gctggccagtcaagatagccagccc

SEQ ID NO: 317260 - DNA, 25 bp, Mus musculus
gctggccagtgggttgatttcttca

SEQ ID NO: 317261 - DNA, 25 bp, Mus musculus
gctggccagtttcttcagcgaacct

SEQ ID NO: 317262 - DNA, 25 bp, Mus musculus
gctggccatcactgatgtgtccttc

SEQ ID NO: 317263 - DNA, 25 bp, Mus musculus
gctggccatcactgcttcaccacga

SEQ ID NO: 317264 - DNA, 25 bp, Mus musculus
gctggccatgagtactttgtgttct

SEQ ID NO: 317265 - DNA, 25 bp, Mus musculus
gctggcccaagaggcattatcgacc

SEQ ID NO: 317266 - DNA, 25 bp, Mus musculus
gctggcccaggaggtgtctgagact

SEQ ID NO: 317267 - DNA, 25 bp, Mus musculus
gctggcccaggcctccaggactgag

SEQ ID NO: 317268 - DNA, 25 bp, Mus musculus
gctggccccgagatgaagtgactga

SEQ ID NO: 317269 - DNA, 25 bp, Mus musculus
gctggcccctgtcgatctttgggtt

SEQ ID NO: 317270 - DNA, 25 bp, Mus musculus
gctggcccctgtcggaactgctgca

SEQ ID NO: 317271 - DNA, 25 bp, Mus musculus
gctggccctcagctccatgaagagt

SEQ ID NO: 317272 - DNA, 25 bp, Mus musculus
gctggccctcctggtgctgatggcc

SEQ ID NO: 317273 - DNA, 25 bp, Mus musculus
gctggccctctacaggagtgtgcac

SEQ ID NO: 317274 - DNA, 25 bp, Mus musculus
gctggccctctggtgtgccacagat

SEQ ID NO: 317275 - DNA, 25 bp, Mus musculus
gctggccctggagcctggttacctg

SEQ ID NO: 317276 - DNA, 25 bp, Mus musculus
gctggccctgggtattgactttgca

SEQ ID NO: 317277 - DNA, 25 bp, Mus musculus
gctggccgagaaaaacgggtatgtg

SEQ ID NO: 317278 - DNA, 25 bp, Mus musculus
gctggccgaggaacacctgctgaag

SEQ ID NO: 317279 - DNA, 25 bp, Mus musculus
gctggccgcacttggttacaagaac

SEQ ID NO: 317280 - DNA, 25 bp, Mus musculus
gctggccgcaggctggcaacatggc

SEQ ID NO: 317281 - DNA, 25 bp, Mus musculus
gctggccggccagactacagcaatg

SEQ ID NO: 317282 - DNA, 25 bp, Mus musculus
gctggccgtggatattagcatttgg

SEQ ID NO: 317283 - DNA, 25 bp, Mus musculus
gctggcctacattctaaggtgattc

SEQ ID NO: 317284 - DNA, 25 bp, Mus musculus
gctggcctcaacagttcctgggtgg

SEQ ID NO: 317285 - DNA, 25 bp, Mus musculus
gctggcctcccaagaaaccagctct

SEQ ID NO: 317286 - DNA, 25 bp, Mus musculus
gctggcctcccaagttcttggggac

SEQ ID NO: 317287 - DNA, 25 bp, Mus musculus
gctggcctgacaggagtccccggca

SEQ ID NO: 317288 - DNA, 25 bp, Mus musculus
gctggcctggaaaggtacagttaaa

SEQ ID NO: 317289 - DNA, 25 bp, Mus musculus
gctggcctggcgttccacgcctacg

SEQ ID NO: 317290 - DNA, 25 bp, Mus musculus
gctggccttatgtccagccatttca

SEQ ID NO: 317291 - DNA, 25 bp, Mus musculus
gctggccttcttgagctgaaaattg

SEQ ID NO: 317292 - DNA, 25 bp, Mus musculus
gctggccttcttgagggccttcttg

SEQ ID NO: 317293 - DNA, 25 bp, Mus musculus
gctggccttgcaggtctctcttcag

SEQ ID NO: 317294 - DNA, 25 bp, Mus musculus
gctggccttggcagcacaaacttga

SEQ ID NO: 317295 - DNA, 25 bp, Mus musculus
gctggccttggcaggtctctcttca

SEQ ID NO: 317296 - DNA, 25 bp, Mus musculus
gctggcgaaagctgataacacatga

SEQ ID NO: 317297 - DNA, 25 bp, Mus musculus
gctggcgaaagctgattccaaatta

SEQ ID NO: 317298 - DNA, 25 bp, Mus musculus
gctggcgaaagctggttccttgtgg

SEQ ID NO: 317299 - DNA, 25 bp, Mus musculus
gctggcgaaagctggtttaactcac

SEQ ID NO: 317300 - DNA, 25 bp, Mus musculus
gctggcgaaggatgatgccctgggg

SEQ ID NO: 317301 - DNA, 25 bp, Mus musculus
gctggcgactattcttctatgagtg

SEQ ID NO: 317302 - DNA, 25 bp, Mus musculus
gctggcgcaagatgacgttgcaccg

SEQ ID NO: 317303 - DNA, 25 bp, Mus musculus
gctggcgctaaaaggtcctgtttct

SEQ ID NO: 317304 - DNA, 25 bp, Mus musculus
gctggcgctaaaagtgatgcgattg

SEQ ID NO: 317305 - DNA, 25 bp, Mus musculus
gctggcgctggagagcctgaccaga

SEQ ID NO: 317306 - DNA, 25 bp, Mus musculus
gctggcggtaacagagtactgtttg

SEQ ID NO: 317307 - DNA, 25 bp, Mus musculus
gctggcgtagatcgactgtgccgct

SEQ ID NO: 317308 - DNA, 25 bp, Mus musculus
gctggcgttggatggttacatccag

SEQ ID NO: 317309 - DNA, 25 bp, Mus musculus
gctggctaagaatgtgactgtggcc

SEQ ID NO: 317310 - DNA, 25 bp, Mus musculus
gctggctaagaggagaaaggcagcc

SEQ ID NO: 317311 - DNA, 25 bp, Mus musculus
gctggctaccatgggagccccgcaa

SEQ ID NO: 317312 - DNA, 25 bp, Mus musculus
gctggctacccaaggccgcacatgc

SEQ ID NO: 317313 - DNA, 25 bp, Mus musculus
gctggctacgggcacggctcggatg

SEQ ID NO: 317314 - DNA, 25 bp, Mus musculus
gctggctcaaggaaccatctggtga

SEQ ID NO: 317315 - DNA, 25 bp, Mus musculus
gctggctcagaggtgtctgccttat

SEQ ID NO: 317316 - DNA, 25 bp, Mus musculus
gctggctcagagttctcagtatgtg

SEQ ID NO: 317317 - DNA, 25 bp, Mus musculus
gctggctcagctcccaagtgccaag

SEQ ID NO: 317318 - DNA, 25 bp, Mus musculus
gctggctccgccgagcacagtgtat

SEQ ID NO: 317319 - DNA, 25 bp, Mus musculus
gctggctccgccgaggaagaaaata

SEQ ID NO: 317320 - DNA, 25 bp, Mus musculus
gctggctctctgaacccccacattg

SEQ ID NO: 317321 - DNA, 25 bp, Mus musculus
gctggctctgtctagagctgaggac

SEQ ID NO: 317322 - DNA, 25 bp, Mus musculus
gctggctcttaagatcttctgtgtg

SEQ ID NO: 317323 - DNA, 25 bp, Mus musculus
gctggctgaacagacttggctttct

SEQ ID NO: 317324 - DNA, 25 bp, Mus musculus
gctggctgaacagagaacagagttt

SEQ ID NO: 317325 - DNA, 25 bp, Mus musculus
gctggctgaacagtgagcttcacta

SEQ ID NO: 317326 - DNA, 25 bp, Mus musculus
gctggctgaacagtttccgctgcct

SEQ ID NO: 317327 - DNA, 25 bp, Mus musculus
gctggctgaatagcctgagaaatgc

SEQ ID NO: 317328 - DNA, 25 bp, Mus musculus
gctggctgagaaaatggctgttgat

SEQ ID NO: 317329 - DNA, 25 bp, Mus musculus
gctggctgatagggtgggagagggc

SEQ ID NO: 317330 - DNA, 25 bp, Mus musculus
gctggctgctaaccgggtctttggg

SEQ ID NO: 317331 - DNA, 25 bp, Mus musculus
gctggctggaggcactttcccagag

SEQ ID NO: 317332 - DNA, 25 bp, Mus musculus
gctggctggaggttggggtttcttg

SEQ ID NO: 317333 - DNA, 25 bp, Mus musculus
gctggctgtcagctgctgactgtgc

SEQ ID NO: 317334 - DNA, 25 bp, Mus musculus
gctggctgtggatctcaggtgactc

SEQ ID NO: 317335 - DNA, 25 bp, Mus musculus
gctggctgtgtgcggtctgttcctg

SEQ ID NO: 317336 - DNA, 25 bp, Mus musculus
gctggcttacagacaaagcctattt

SEQ ID NO: 317337 - DNA, 25 bp, Mus musculus
gctggcttacaggttcagaggttca

SEQ ID NO: 317338 - DNA, 25 bp, Mus musculus
gctggcttcaatatggaatctttct

SEQ ID NO: 317339 - DNA, 25 bp, Mus musculus
gctggcttccaaatggaactctgaa

SEQ ID NO: 317340 - DNA, 25 bp, Mus musculus
gctggctttgaagaatcaggcccag

SEQ ID NO: 317341 - DNA, 25 bp, Mus musculus
gctggcttttacagacccataactg

SEQ ID NO: 317342 - DNA, 25 bp, Mus musculus
gctggcttttacagggagggtagac

SEQ ID NO: 317343 - DNA, 25 bp, Mus musculus
gctggcttttacagttgttctgatg

SEQ ID NO: 317344 - DNA, 25 bp, Mus musculus
gctggcttttctgattcaccccacc

SEQ ID NO: 317345 - DNA, 25 bp, Mus musculus
gctggcttttctgattttcagaaag

SEQ ID NO: 317346 - DNA, 25 bp, Mus musculus
gctggcttttgctggagggagctgg

SEQ ID NO: 317347 - DNA, 25 bp, Mus musculus
gctgggaaagaagatgaaagcagaa

SEQ ID NO: 317348 - DNA, 25 bp, Mus musculus
gctgggaaagaagggactcgtactg

SEQ ID NO: 317349 - DNA, 25 bp, Mus musculus
gctgggaaagaatctgcatgtgtgc

SEQ ID NO: 317350 - DNA, 25 bp, Mus musculus
gctgggaaaggaaggatttaatgcc

SEQ ID NO: 317351 - DNA, 25 bp, Mus musculus
gctgggaaagggaattttaatattc

SEQ ID NO: 317352 - DNA, 25 bp, Mus musculus
gctgggaaagggagcctttactttc

SEQ ID NO: 317353 - DNA, 25 bp, Mus musculus
gctgggaacaagtaccattaattaa

SEQ ID NO: 317354 - DNA, 25 bp, Mus musculus
gctgggaaccggcggcttcatggcg

SEQ ID NO: 317355 - DNA, 25 bp, Mus musculus
gctgggaaggatctggttctacacc

SEQ ID NO: 317356 - DNA, 25 bp, Mus musculus
gctgggaagggagagcacctggcca

SEQ ID NO: 317357 - DNA, 25 bp, Mus musculus
gctgggaagtgtcgccagagaaaca

SEQ ID NO: 317358 - DNA, 25 bp, Mus musculus
gctgggaagtgtcgcttccaacagt

SEQ ID NO: 317359 - DNA, 25 bp, Mus musculus
gctgggaattcatatgactgtgatg

SEQ ID NO: 317360 - DNA, 25 bp, Mus musculus
gctgggaattcatgtctgcccggac

SEQ ID NO: 317361 - DNA, 25 bp, Mus musculus
gctgggacaattgaacaattgccta

SEQ ID NO: 317362 - DNA, 25 bp, Mus musculus
gctgggacaattgactggctgtgtt

SEQ ID NO: 317363 - DNA, 25 bp, Mus musculus
gctgggacacaaggtgtcccaaatg

SEQ ID NO: 317364 - DNA, 25 bp, Mus musculus
gctgggacaggaaatgctgtcattc

SEQ ID NO: 317365 - DNA, 25 bp, Mus musculus
gctgggacaggtggccctaagaact

SEQ ID NO: 317366 - DNA, 25 bp, Mus musculus
gctgggacatgatgtgattaagacg

SEQ ID NO: 317367 - DNA, 25 bp, Mus musculus
gctgggacctacctgaactacctgg

SEQ ID NO: 317368 - DNA, 25 bp, Mus musculus
gctgggacctacgtatcacaaggct

SEQ ID NO: 317369 - DNA, 25 bp, Mus musculus
gctgggacgagcggatacgggccac

SEQ ID NO: 317370 - DNA, 25 bp, Mus musculus
gctgggactaaagagatggatgtcc

SEQ ID NO: 317371 - DNA, 25 bp, Mus musculus
gctgggactaaaggggacagctgtt

SEQ ID NO: 317372 - DNA, 25 bp, Mus musculus
gctgggagaaagaaggcatgtcatg

SEQ ID NO: 317373 - DNA, 25 bp, Mus musculus
gctgggagacccaagacgatactgt

SEQ ID NO: 317374 - DNA, 25 bp, Mus musculus
gctgggagacccaagctgtcctgga

SEQ ID NO: 317375 - DNA, 25 bp, Mus musculus
gctgggagaccttgagacagatggg

SEQ ID NO: 317376 - DNA, 25 bp, Mus musculus
gctgggagagacttcataagggctg

SEQ ID NO: 317377 - DNA, 25 bp, Mus musculus
gctgggagagcagcgggaacttcat

SEQ ID NO: 317378 - DNA, 25 bp, Mus musculus
gctgggagagcaggaggtgtaaaga

SEQ ID NO: 317379 - DNA, 25 bp, Mus musculus
gctgggagagggggaccaagtcatt

SEQ ID NO: 317380 - DNA, 25 bp, Mus musculus
gctgggagcccaggcctccagatct

SEQ ID NO: 317381 - DNA, 25 bp, Mus musculus
gctgggagccgggagccccgatgac

SEQ ID NO: 317382 - DNA, 25 bp, Mus musculus
gctgggaggagagcgacatgtttgt

SEQ ID NO: 317383 - DNA, 25 bp, Mus musculus
gctgggaggaggtggcccagagtgg

SEQ ID NO: 317384 - DNA, 25 bp, Mus musculus
gctgggaggtggagatgtcatcagg

SEQ ID NO: 317385 - DNA, 25 bp, Mus musculus
gctgggagtaagtcgaatctacaaa

SEQ ID NO: 317386 - DNA, 25 bp, Mus musculus
gctgggagtgtctggcaccgtggac

SEQ ID NO: 317387 - DNA, 25 bp, Mus musculus
gctgggagtgtgttcatgtgaacga

SEQ ID NO: 317388 - DNA, 25 bp, Mus musculus
gctgggagtgtgttgatgtgaacga

SEQ ID NO: 317389 - DNA, 25 bp, Mus musculus
gctgggatcattgtctgcgtggtgg

SEQ ID NO: 317390 - DNA, 25 bp, Mus musculus
gctgggatccagaatccaactgtgt

SEQ ID NO: 317391 - DNA, 25 bp, Mus musculus
gctgggatccagaatttggggtgct

SEQ ID NO: 317392 - DNA, 25 bp, Mus musculus
gctgggatcgctttagaatgtgata

SEQ ID NO: 317393 - DNA, 25 bp, Mus musculus
gctgggatcggtttttgtgaattct

SEQ ID NO: 317394 - DNA, 25 bp, Mus musculus
gctgggatcgtttgtttatatggtt

SEQ ID NO: 317395 - DNA, 25 bp, Mus musculus
gctgggatggggaacatgacatcga

SEQ ID NO: 317396 - DNA, 25 bp, Mus musculus
gctgggattaaagagacttccttga

SEQ ID NO: 317397 - DNA, 25 bp, Mus musculus
gctgggattaaagatccagctgagc

SEQ ID NO: 317398 - DNA, 25 bp, Mus musculus
gctgggattaaagcagatataattt

SEQ ID NO: 317399 - DNA, 25 bp, Mus musculus
gctgggattaaagcgtgagggtcac

SEQ ID NO: 317400 - DNA, 25 bp, Mus musculus
gctgggattaaaggggtccctccaa

SEQ ID NO: 317401 - DNA, 25 bp, Mus musculus
gctgggattaaaggtgtgggaacaa

SEQ ID NO: 317402 - DNA, 25 bp, Mus musculus
gctgggattaaaggttgtaagcatc

SEQ ID NO: 317403 - DNA, 25 bp, Mus musculus
gctgggattaaagtgctctgtgaag

SEQ ID NO: 317404 - DNA, 25 bp, Mus musculus
gctgggattaatgatgctctccaag

SEQ ID NO: 317405 - DNA, 25 bp, Mus musculus
gctgggattacagactcctccaccc

SEQ ID NO: 317406 - DNA, 25 bp, Mus musculus
gctgggattacaggttccacagcac

SEQ ID NO: 317407 - DNA, 25 bp, Mus musculus
gctgggattacaggttggcttcctg

SEQ ID NO: 317408 - DNA, 25 bp, Mus musculus
gctgggattacagtcttgaaataca

SEQ ID NO: 317409 - DNA, 25 bp, Mus musculus
gctgggattagaggagttggaaccc

SEQ ID NO: 317410 - DNA, 25 bp, Mus musculus
gctgggattatgaggactccaagcc

SEQ ID NO: 317411 - DNA, 25 bp, Mus musculus
gctgggattccaggatggcagctcc

SEQ ID NO: 317412 - DNA, 25 bp, Mus musculus
gctgggattccaggtgacagagtgc

SEQ ID NO: 317413 - DNA, 25 bp, Mus musculus
gctgggattgcagttttcaaagata

SEQ ID NO: 317414 - DNA, 25 bp, Mus musculus
gctgggcaaagaggtgcgtgagcac

SEQ ID NO: 317415 - DNA, 25 bp, Mus musculus
gctgggcacagattggtgttggtac

SEQ ID NO: 317416 - DNA, 25 bp, Mus musculus
gctgggcacgggagcctatgggaag

SEQ ID NO: 317417 - DNA, 25 bp, Mus musculus
gctgggcacgggagtccgggtttgc

SEQ ID NO: 317418 - DNA, 25 bp, Mus musculus
gctgggcactcagggcccaggacgg

SEQ ID NO: 317419 - DNA, 25 bp, Mus musculus
gctgggcactcaggtgaagccaaca

SEQ ID NO: 317420 - DNA, 25 bp, Mus musculus
gctgggcactcatgcatgctagtcc

SEQ ID NO: 317421 - DNA, 25 bp, Mus musculus
gctgggcagagggatctttggccag

SEQ ID NO: 317422 - DNA, 25 bp, Mus musculus
gctgggcatctgtgtgatctcagtg

SEQ ID NO: 317423 - DNA, 25 bp, Mus musculus
gctgggccaatgaaaaccaactcta

SEQ ID NO: 317424 - DNA, 25 bp, Mus musculus
gctgggcccagaccctggcctatgg

SEQ ID NO: 317425 - DNA, 25 bp, Mus musculus
gctgggcccaggggagaaatacgaa

SEQ ID NO: 317426 - DNA, 25 bp, Mus musculus
gctgggcccagtatcgttgatctga

SEQ ID NO: 317427 - DNA, 25 bp, Mus musculus
gctgggccccacaaggacctgctct

SEQ ID NO: 317428 - DNA, 25 bp, Mus musculus
gctgggccctggcaggacaacagtc

SEQ ID NO: 317429 - DNA, 25 bp, Mus musculus
gctgggccctgtttttgggaataac

SEQ ID NO: 317430 - DNA, 25 bp, Mus musculus
gctgggccgactccgggacagacaa

SEQ ID NO: 317431 - DNA, 25 bp, Mus musculus
gctgggccgactccgtggaaacctc

SEQ ID NO: 317432 - DNA, 25 bp, Mus musculus
gctgggccgaggctcttctgcgatg

SEQ ID NO: 317433 - DNA, 25 bp, Mus musculus
gctgggccgggattctgaaaggcct

SEQ ID NO: 317434 - DNA, 25 bp, Mus musculus
gctgggcctcgtggagttcaggacc

SEQ ID NO: 317435 - DNA, 25 bp, Mus musculus
gctgggcctggcaggggctgcgatg

SEQ ID NO: 317436 - DNA, 25 bp, Mus musculus
gctgggcctggcaggttcagtcctc

SEQ ID NO: 317437 - DNA, 25 bp, Mus musculus
gctgggccttgggggcctgggctgg

SEQ ID NO: 317438 - DNA, 25 bp, Mus musculus
gctgggcgagtacatggagaagcta

SEQ ID NO: 317439 - DNA, 25 bp, Mus musculus
gctgggcgctcagcagttctccgac

SEQ ID NO: 317440 - DNA, 25 bp, Mus musculus
gctgggcgctggaagagactctcat

SEQ ID NO: 317441 - DNA, 25 bp, Mus musculus
gctgggcgtggaagctatggaggtt

SEQ ID NO: 317442 - DNA, 25 bp, Mus musculus
gctgggctacaaggtgaagaagcat

SEQ ID NO: 317443 - DNA, 25 bp, Mus musculus
gctgggctcagagggagtggggccg

SEQ ID NO: 317444 - DNA, 25 bp, Mus musculus
gctgggctccagatctactactctg

SEQ ID NO: 317445 - DNA, 25 bp, Mus musculus
gctgggctcctggtctctgggccag

SEQ ID NO: 317446 - DNA, 25 bp, Mus musculus
gctgggctcggagttttcaggaaga

SEQ ID NO: 317447 - DNA, 25 bp, Mus musculus
gctgggctgcaagcggattgggttt

SEQ ID NO: 317448 - DNA, 25 bp, Mus musculus
gctgggctgcctgcctgcctgcctg

SEQ ID NO: 317449 - DNA, 25 bp, Mus musculus
gctgggcttggaggcaagggcagtg

SEQ ID NO: 317450 - DNA, 25 bp, Mus musculus
gctgggcttggttcctgcctcaaga

SEQ ID NO: 317451 - DNA, 25 bp, Mus musculus
gctgggcttgtgtcttccaaaatta

SEQ ID NO: 317452 - DNA, 25 bp, Mus musculus
gctgggctttccaagttacctgatt

SEQ ID NO: 317453 - DNA, 25 bp, Mus musculus
gctgggcttttgcaggcacaacccg

SEQ ID NO: 317454 - DNA, 25 bp, Mus musculus
gctggggaacatggaaagctgcctt

SEQ ID NO: 317455 - DNA, 25 bp, Mus musculus
gctggggaagaccttgcacttgact

SEQ ID NO: 317456 - DNA, 25 bp, Mus musculus
gctggggaagcctgggtcacgtgaa

SEQ ID NO: 317457 - DNA, 25 bp, Mus musculus
gctggggaagctggctgtgactcga

SEQ ID NO: 317458 - DNA, 25 bp, Mus musculus
gctggggaagctgggatctcaagca

SEQ ID NO: 317459 - DNA, 25 bp, Mus musculus
gctggggaaggaaggtgaccattgt

SEQ ID NO: 317460 - DNA, 25 bp, Mus musculus
gctggggaaggaagtgagcctggtg

SEQ ID NO: 317461 - DNA, 25 bp, Mus musculus
gctggggaaggacgcatctcttcgc

SEQ ID NO: 317462 - DNA, 25 bp, Mus musculus
gctggggaccgagccctctgattgc

SEQ ID NO: 317463 - DNA, 25 bp, Mus musculus
gctggggacttggggacggctgttc

SEQ ID NO: 317464 - DNA, 25 bp, Mus musculus
gctggggatgtgaagatcatcagaa

SEQ ID NO: 317465 - DNA, 25 bp, Mus musculus
gctggggcaagcctgaacctgtcac

SEQ ID NO: 317466 - DNA, 25 bp, Mus musculus
gctggggcagaagtggcagtgtgtg

SEQ ID NO: 317467 - DNA, 25 bp, Mus musculus
gctggggcccgagttctctgggcta

SEQ ID NO: 317468 - DNA, 25 bp, Mus musculus
gctggggcctaactggtttgcattt

SEQ ID NO: 317469 - DNA, 25 bp, Mus musculus
gctggggccttggtgttgggagccc

SEQ ID NO: 317470 - DNA, 25 bp, Mus musculus
gctggggctacagatagggtctctc

SEQ ID NO: 317471 - DNA, 25 bp, Mus musculus
gctggggctacagatttatgacatt

SEQ ID NO: 317472 - DNA, 25 bp, Mus musculus
gctggggctactacggttgcaatga

SEQ ID NO: 317473 - DNA, 25 bp, Mus musculus
gctggggctggacgttgagatcacc

SEQ ID NO: 317474 - DNA, 25 bp, Mus musculus
gctgggggagtccagggccgcgtca

SEQ ID NO: 317475 - DNA, 25 bp, Mus musculus
gctgggggagtgcgggaacagaact

SEQ ID NO: 317476 - DNA, 25 bp, Mus musculus
gctgggggctgggggggccaagatg

SEQ ID NO: 317477 - DNA, 25 bp, Mus musculus
gctgggggtcgcggggctcggatgg

SEQ ID NO: 317478 - DNA, 25 bp, Mus musculus
gctggggtacgcccgagctccagca

SEQ ID NO: 317479 - DNA, 25 bp, Mus musculus
gctggggtccagctgtcaccctgct

SEQ ID NO: 317480 - DNA, 25 bp, Mus musculus
gctggggtccagggaaaggctcgag

SEQ ID NO: 317481 - DNA, 25 bp, Mus musculus
gctggggtgcagaatttctgaagtg

SEQ ID NO: 317482 - DNA, 25 bp, Mus musculus
gctgggtcagccgggatcaactgca

SEQ ID NO: 317483 - DNA, 25 bp, Mus musculus
gctgggtcagccggttttttcatta

SEQ ID NO: 317484 - DNA, 25 bp, Mus musculus
gctgggtcaggactaatgtaattgt

SEQ ID NO: 317485 - DNA, 25 bp, Mus musculus
gctgggtcagggataaaaagagcaa

SEQ ID NO: 317486 - DNA, 25 bp, Mus musculus
gctgggtcaggtcaggaagcaggct

SEQ ID NO: 317487 - DNA, 25 bp, Mus musculus
gctgggtcaggtggccactctagct

SEQ ID NO: 317488 - DNA, 25 bp, Mus musculus
gctgggtcatacggtaacatttcac

SEQ ID NO: 317489 - DNA, 25 bp, Mus musculus
gctgggtccagcggctggaggaagt

SEQ ID NO: 317490 - DNA, 25 bp, Mus musculus
gctgggtcgctaccaccagtgctac

SEQ ID NO: 317491 - DNA, 25 bp, Mus musculus
gctgggtgaaagtgttgacagcccc

SEQ ID NO: 317492 - DNA, 25 bp, Mus musculus
gctgggtgacagagtggaccagatt

SEQ ID NO: 317493 - DNA, 25 bp, Mus musculus
gctgggtgacctgggatggattcat

SEQ ID NO: 317494 - DNA, 25 bp, Mus musculus
gctgggtgataggtgaccatggagg

SEQ ID NO: 317495 - DNA, 25 bp, Mus musculus
gctgggtgcagaaactggaaacaaa

SEQ ID NO: 317496 - DNA, 25 bp, Mus musculus
gctgggtgcagtgacccttaccctg

SEQ ID NO: 317497 - DNA, 25 bp, Mus musculus
gctgggtggagaaaaatgttttaca

SEQ ID NO: 317498 - DNA, 25 bp, Mus musculus
gctgggtggagagatcattcctcga

SEQ ID NO: 317499 - DNA, 25 bp, Mus musculus
gctgggtgtggcaaggggaaactgt

SEQ ID NO: 317500 - DNA, 25 bp, Mus musculus
gctgggttcccagtgatagaaaacg

SEQ ID NO: 317501 - DNA, 25 bp, Mus musculus
gctgggtttaaagaatacttgaact

SEQ ID NO: 317502 - DNA, 25 bp, Mus musculus
gctgggtttgccgattcccacccct

SEQ ID NO: 317503 - DNA, 25 bp, Mus musculus
gctgggtttgccggattatcacaaa

SEQ ID NO: 317504 - DNA, 25 bp, Mus musculus
gctggtaaaagctgatgaagagact

SEQ ID NO: 317505 - DNA, 25 bp, Mus musculus
gctggtaaagctgtcctgcctgtta

SEQ ID NO: 317506 - DNA, 25 bp, Mus musculus
gctggtaaaggagagaatgaagatg

SEQ ID NO: 317507 - DNA, 25 bp, Mus musculus
gctggtaaccaaagctgttctgtgt

SEQ ID NO: 317508 - DNA, 25 bp, Mus musculus
gctggtacagtatgctgtgtcccac

SEQ ID NO: 317509 - DNA, 25 bp, Mus musculus
gctggtagaccagtaacttccctct

SEQ ID NO: 317510 - DNA, 25 bp, Mus musculus
gctggtagagaagggaccacagtat

SEQ ID NO: 317511 - DNA, 25 bp, Mus musculus
gctggtagatgctgacggctagacc

SEQ ID NO: 317512 - DNA, 25 bp, Mus musculus
gctggtagatggtgactagaggact

SEQ ID NO: 317513 - DNA, 25 bp, Mus musculus
gctggtagatttgttgaatgacaaa

SEQ ID NO: 317514 - DNA, 25 bp, Mus musculus
gctggtagcctcggattccagaggg

SEQ ID NO: 317515 - DNA, 25 bp, Mus musculus
gctggtatcatgggtataggtccag

SEQ ID NO: 317516 - DNA, 25 bp, Mus musculus
gctggtatctgaagacgctcatgat

SEQ ID NO: 317517 - DNA, 25 bp, Mus musculus
gctggtatgttgccagatggatttg

SEQ ID NO: 317518 - DNA, 25 bp, Mus musculus
gctggtattccaggaatcatggccc

SEQ ID NO: 317519 - DNA, 25 bp, Mus musculus
gctggtcaaagatgacctggatgga

SEQ ID NO: 317520 - DNA, 25 bp, Mus musculus
gctggtcaagaacagcatgggtaca

SEQ ID NO: 317521 - DNA, 25 bp, Mus musculus
gctggtcaagggtctagagacatgt

SEQ ID NO: 317522 - DNA, 25 bp, Mus musculus
gctggtcacaggagtcctttggaac

SEQ ID NO: 317523 - DNA, 25 bp, Mus musculus
gctggtcacaggtgcccagcagagg

SEQ ID NO: 317524 - DNA, 25 bp, Mus musculus
gctggtcacatggtgacctggcctc

SEQ ID NO: 317525 - DNA, 25 bp, Mus musculus
gctggtcacgagctcttctgatctc

SEQ ID NO: 317526 - DNA, 25 bp, Mus musculus
gctggtcacgaggtaaccatcttgg

SEQ ID NO: 317527 - DNA, 25 bp, Mus musculus
gctggtcagagaattgaccttgctg

SEQ ID NO: 317528 - DNA, 25 bp, Mus musculus
gctggtcagccaaatggtgttgtgt

SEQ ID NO: 317529 - DNA, 25 bp, Mus musculus
gctggtcagccaaatgtctttctgt

SEQ ID NO: 317530 - DNA, 25 bp, Mus musculus
gctggtcagccaaattgaggatgcc

SEQ ID NO: 317531 - DNA, 25 bp, Mus musculus
gctggtcatcgaggtcttccagaaa

SEQ ID NO: 317532 - DNA, 25 bp, Mus musculus
gctggtcattaagggaaagatggag

SEQ ID NO: 317533 - DNA, 25 bp, Mus musculus
gctggtccaccgtgtcagactcagt

SEQ ID NO: 317534 - DNA, 25 bp, Mus musculus
gctggtccagctggtcttcacagtc

SEQ ID NO: 317535 - DNA, 25 bp, Mus musculus
gctggtccaggtacatccctgaggg

SEQ ID NO: 317536 - DNA, 25 bp, Mus musculus
gctggtccatcctctggaccgtgat

SEQ ID NO: 317537 - DNA, 25 bp, Mus musculus
gctggtccccctggtgctactggct

SEQ ID NO: 317538 - DNA, 25 bp, Mus musculus
gctggtccgagggctactgacagtc

SEQ ID NO: 317539 - DNA, 25 bp, Mus musculus
gctggtcgcagaagtacagcacgtg

SEQ ID NO: 317540 - DNA, 25 bp, Mus musculus
gctggtgaaatgaggaagaaaagcg

SEQ ID NO: 317541 - DNA, 25 bp, Mus musculus
gctggtgaagagcatattccgcgta

SEQ ID NO: 317542 - DNA, 25 bp, Mus musculus
gctggtgaagagctcgtatatccag

SEQ ID NO: 317543 - DNA, 25 bp, Mus musculus
gctggtgaagagctggtatatccag

SEQ ID NO: 317544 - DNA, 25 bp, Mus musculus
gctggtgaagcacctcctggacctc

SEQ ID NO: 317545 - DNA, 25 bp, Mus musculus
gctggtgaaggttcaattgtgaata

SEQ ID NO: 317546 - DNA, 25 bp, Mus musculus
gctggtgaagttatgtaatccaaag

SEQ ID NO: 317547 - DNA, 25 bp, Mus musculus
gctggtgactcacagctgaaggtgg

SEQ ID NO: 317548 - DNA, 25 bp, Mus musculus
gctggtgactcacagggaacaaccc

SEQ ID NO: 317549 - DNA, 25 bp, Mus musculus
gctggtgagaagaacagcagtggtg

SEQ ID NO: 317550 - DNA, 25 bp, Mus musculus
gctggtgagaggaagctttgtctcc

SEQ ID NO: 317551 - DNA, 25 bp, Mus musculus
gctggtgatcaaggtgttcctggag

SEQ ID NO: 317552 - DNA, 25 bp, Mus musculus
gctggtgcaaagttggtatatccaa

SEQ ID NO: 317553 - DNA, 25 bp, Mus musculus
gctggtgcacgaccttctgccccct

SEQ ID NO: 317554 - DNA, 25 bp, Mus musculus
gctggtgcctgactttaagcaagaa

SEQ ID NO: 317555 - DNA, 25 bp, Mus musculus
gctggtgccttcagaattgttttac

SEQ ID NO: 317556 - DNA, 25 bp, Mus musculus
gctggtgctcaggcattgcagctct

SEQ ID NO: 317557 - DNA, 25 bp, Mus musculus
gctggtgctccggcattgcagctct

SEQ ID NO: 317558 - DNA, 25 bp, Mus musculus
gctggtgctccgtggaccctaatga

SEQ ID NO: 317559 - DNA, 25 bp, Mus musculus
gctggtgctgcatgggctcccctca

SEQ ID NO: 317560 - DNA, 25 bp, Mus musculus
gctggtgctgccccacacctctggc

SEQ ID NO: 317561 - DNA, 25 bp, Mus musculus
gctggtgctgcccccggccagccct

SEQ ID NO: 317562 - DNA, 25 bp, Mus musculus
gctggtgctgctggtgctcggggta

SEQ ID NO: 317563 - DNA, 25 bp, Mus musculus
gctggtgctggggtcctttatggag

SEQ ID NO: 317564 - DNA, 25 bp, Mus musculus
gctggtgctgtgtggatctctcaga

SEQ ID NO: 317565 - DNA, 25 bp, Mus musculus
gctggtggaactggaaggcacaatg

SEQ ID NO: 317566 - DNA, 25 bp, Mus musculus
gctggtggaaggaggcaggattgac

SEQ ID NO: 317567 - DNA, 25 bp, Mus musculus
gctggtggagaaggtgtaaccagcc

SEQ ID NO: 317568 - DNA, 25 bp, Mus musculus
gctggtggagaccagcatgattggg

SEQ ID NO: 317569 - DNA, 25 bp, Mus musculus
gctggtggagcactacaccacagat

SEQ ID NO: 317570 - DNA, 25 bp, Mus musculus
gctggtggagctggatcgggcggtg

SEQ ID NO: 317571 - DNA, 25 bp, Mus musculus
gctggtggaggaacatggccaccac

SEQ ID NO: 317572 - DNA, 25 bp, Mus musculus
gctggtggaggaggaagtgaacatc

SEQ ID NO: 317573 - DNA, 25 bp, Mus musculus
gctggtggaggcatggctggaaaga

SEQ ID NO: 317574 - DNA, 25 bp, Mus musculus
gctggtggagggtgtcaccgaaggc

SEQ ID NO: 317575 - DNA, 25 bp, Mus musculus
gctggtggagtgttctccagtttta

SEQ ID NO: 317576 - DNA, 25 bp, Mus musculus
gctggtggagttctaccccacaatc

SEQ ID NO: 317577 - DNA, 25 bp, Mus musculus
gctggtggagttctatgccccgtgg

SEQ ID NO: 317578 - DNA, 25 bp, Mus musculus
gctggtggagttctatgccccttgg

SEQ ID NO: 317579 - DNA, 25 bp, Mus musculus
gctggtggcattccattgacaattt

SEQ ID NO: 317580 - DNA, 25 bp, Mus musculus
gctggtggccagagagctgaagcgc

SEQ ID NO: 317581 - DNA, 25 bp, Mus musculus
gctggtggccgccgacaacactggt

SEQ ID NO: 317582 - DNA, 25 bp, Mus musculus
gctggtggccgccgatacatatacc

SEQ ID NO: 317583 - DNA, 25 bp, Mus musculus
gctggtggctcagtttctacagtta

SEQ ID NO: 317584 - DNA, 25 bp, Mus musculus
gctggtggctcagtttcttcggctg

SEQ ID NO: 317585 - DNA, 25 bp, Mus musculus
gctggtgggaatcagtgggtatcac

SEQ ID NO: 317586 - DNA, 25 bp, Mus musculus
gctggtgggaccagtttaaaaggat

SEQ ID NO: 317587 - DNA, 25 bp, Mus musculus
gctggtgggcaggtgtgctgatgtc

SEQ ID NO: 317588 - DNA, 25 bp, Mus musculus
gctggtgggcagtggagaaaaatgg

SEQ ID NO: 317589 - DNA, 25 bp, Mus musculus
gctggtggtcctggggccatcagct

SEQ ID NO: 317590 - DNA, 25 bp, Mus musculus
gctggtggtcctggggtacaatggt

SEQ ID NO: 317591 - DNA, 25 bp, Mus musculus
gctggtggtgaactaaagcaccgag

SEQ ID NO: 317592 - DNA, 25 bp, Mus musculus
gctggtggtgaactgctgtatcttg

SEQ ID NO: 317593 - DNA, 25 bp, Mus musculus
gctggtggtgaagtatatcatgtat

SEQ ID NO: 317594 - DNA, 25 bp, Mus musculus
gctggtgtactggagaaaatgtttt

SEQ ID NO: 317595 - DNA, 25 bp, Mus musculus
gctggtgtactggagagggtgtaac

SEQ ID NO: 317596 - DNA, 25 bp, Mus musculus
gctggtgtcaacattgtggagatgc

SEQ ID NO: 317597 - DNA, 25 bp, Mus musculus
gctggtgtcactgcagatgagagtg

SEQ ID NO: 317598 - DNA, 25 bp, Mus musculus
gctggtgtcagacatggctaaagag

SEQ ID NO: 317599 - DNA, 25 bp, Mus musculus
gctggtgtcagtctctgcttccttc

SEQ ID NO: 317600 - DNA, 25 bp, Mus musculus
gctggtgtccgagatgcatgctgtt

SEQ ID NO: 317601 - DNA, 25 bp, Mus musculus
gctggtgtccgaggtcttcagatta

SEQ ID NO: 317602 - DNA, 25 bp, Mus musculus
gctggtgtccgagtgtcctgcaggt

SEQ ID NO: 317603 - DNA, 25 bp, Mus musculus
gctggtgtcctaggccacagaagga

SEQ ID NO: 317604 - DNA, 25 bp, Mus musculus
gctggtgtcggaggatataaaattc

SEQ ID NO: 317605 - DNA, 25 bp, Mus musculus
gctggtgtctggtggcactgacacc

SEQ ID NO: 317606 - DNA, 25 bp, Mus musculus
gctggtgtgccaacgaggaatatcc

SEQ ID NO: 317607 - DNA, 25 bp, Mus musculus
gctggtgtgccaacgccagcttttt

SEQ ID NO: 317608 - DNA, 25 bp, Mus musculus
gctggtgtgccaggagagtactaaa

SEQ ID NO: 317609 - DNA, 25 bp, Mus musculus
gctggtgtggatggagaggtccctg

SEQ ID NO: 317610 - DNA, 25 bp, Mus musculus
gctggtgttcgagttcctcaggtcc

SEQ ID NO: 317611 - DNA, 25 bp, Mus musculus
gctggtgttttcaggcctctgctcg

SEQ ID NO: 317612 - DNA, 25 bp, Mus musculus
gctggttcgaaggccatgacagtag

SEQ ID NO: 317613 - DNA, 25 bp, Mus musculus
gctggttcgaaggggctcatcctgt

SEQ ID NO: 317614 - DNA, 25 bp, Mus musculus
gctggttctgagaatctgcctgtgg

SEQ ID NO: 317615 - DNA, 25 bp, Mus musculus
gctggttctgagttctcatctccct

SEQ ID NO: 317616 - DNA, 25 bp, Mus musculus
gctggttctgcaggagcagagcccg

SEQ ID NO: 317617 - DNA, 25 bp, Mus musculus
gctggttcttaagtcagagagcgag

SEQ ID NO: 317618 - DNA, 25 bp, Mus musculus
gctggttgaagagggtgctgatact

SEQ ID NO: 317619 - DNA, 25 bp, Mus musculus
gctggttgaagaggtgcacacttta

SEQ ID NO: 317620 - DNA, 25 bp, Mus musculus
gctggttggagaaatctctggtcgc

SEQ ID NO: 317621 - DNA, 25 bp, Mus musculus
gctggttggatgggcacacgctgcc

SEQ ID NO: 317622 - DNA, 25 bp, Mus musculus
gctggtttatttacaccaagctgga

SEQ ID NO: 317623 - DNA, 25 bp, Mus musculus
gctggtttcagaggaggcctttccc

SEQ ID NO: 317624 - DNA, 25 bp, Mus musculus
gctggtttcccgggtatgcatggac

SEQ ID NO: 317625 - DNA, 25 bp, Mus musculus
gctggtttccgaggtctctgtgttg

SEQ ID NO: 317626 - DNA, 25 bp, Mus musculus
gctggtttgcgctccctccaacatg

SEQ ID NO: 317627 - DNA, 25 bp, Mus musculus
gctgtaaaactactgagaaggtcct

SEQ ID NO: 317628 - DNA, 25 bp, Mus musculus
gctgtaaaactactgtcctcggccc

SEQ ID NO: 317629 - DNA, 25 bp, Mus musculus
gctgtaaaactactgttttggtgaa

SEQ ID NO: 317630 - DNA, 25 bp, Mus musculus
gctgtaaaagagaggaggctcacat

SEQ ID NO: 317631 - DNA, 25 bp, Mus musculus
gctgtaaacagagactcacttctgc

SEQ ID NO: 317632 - DNA, 25 bp, Mus musculus
gctgtaaagtatgtgggctggaaaa

SEQ ID NO: 317633 - DNA, 25 bp, Mus musculus
gctgtaaagtatgtggttctgctca

SEQ ID NO: 317634 - DNA, 25 bp, Mus musculus
gctgtaaatgaaggaatatgctcag

SEQ ID NO: 317635 - DNA, 25 bp, Mus musculus
gctgtaactacagaggcctccaggt

SEQ ID NO: 317636 - DNA, 25 bp, Mus musculus
gctgtaactacagttgtgcccctgt

SEQ ID NO: 317637 - DNA, 25 bp, Mus musculus
gctgtaagaaggtgattttaaaaat

SEQ ID NO: 317638 - DNA, 25 bp, Mus musculus
gctgtaatcattgagaatgaaaaga

SEQ ID NO: 317639 - DNA, 25 bp, Mus musculus
gctgtaatgaaggaaaatatctgca

SEQ ID NO: 317640 - DNA, 25 bp, Mus musculus
gctgtaattgtagctgatgaagagt

SEQ ID NO: 317641 - DNA, 25 bp, Mus musculus
gctgtaattgtaggtgccgcaccag

SEQ ID NO: 317642 - DNA, 25 bp, Mus musculus
gctgtacaagattgggcagcccaga

SEQ ID NO: 317643 - DNA, 25 bp, Mus musculus
gctgtacaagattggtcaactcaga

SEQ ID NO: 317644 - DNA, 25 bp, Mus musculus
gctgtacaagcttggcttcttcaaa

SEQ ID NO: 317645 - DNA, 25 bp, Mus musculus
gctgtacaaggtgctgagttccctt

SEQ ID NO: 317646 - DNA, 25 bp, Mus musculus
gctgtacaaggttcactctaattgt

SEQ ID NO: 317647 - DNA, 25 bp, Mus musculus
gctgtacagagatggcccacacgga

SEQ ID NO: 317648 - DNA, 25 bp, Mus musculus
gctgtacagggatggctaccagaga

SEQ ID NO: 317649 - DNA, 25 bp, Mus musculus
gctgtacatgggatgctagccaacg

SEQ ID NO: 317650 - DNA, 25 bp, Mus musculus
gctgtaccaccttcccaggaccagt

SEQ ID NO: 317651 - DNA, 25 bp, Mus musculus
gctgtaccacttagatagttgaagt

SEQ ID NO: 317652 - DNA, 25 bp, Mus musculus
gctgtaccagataacatgtttaggt

SEQ ID NO: 317653 - DNA, 25 bp, Mus musculus
gctgtaccagatcccacaacgtctc

SEQ ID NO: 317654 - DNA, 25 bp, Mus musculus
gctgtaccccgggagggacattgct

SEQ ID NO: 317655 - DNA, 25 bp, Mus musculus
gctgtacctagaaggaagagaaaag

SEQ ID NO: 317656 - DNA, 25 bp, Mus musculus
gctgtacgaggctccagcataccat

SEQ ID NO: 317657 - DNA, 25 bp, Mus musculus
gctgtacgcagttttacagagagca

SEQ ID NO: 317658 - DNA, 25 bp, Mus musculus
gctgtacgcgtcttgttggagatct

SEQ ID NO: 317659 - DNA, 25 bp, Mus musculus
gctgtacgcgtgccggaattgcgat

SEQ ID NO: 317660 - DNA, 25 bp, Mus musculus
gctgtactacgtaaccaccaaagac

SEQ ID NO: 317661 - DNA, 25 bp, Mus musculus
gctgtactcaaggagaatctgggag

SEQ ID NO: 317662 - DNA, 25 bp, Mus musculus
gctgtactccacgtgatccgaggac

SEQ ID NO: 317663 - DNA, 25 bp, Mus musculus
gctgtactggatgcaagacgctatg

SEQ ID NO: 317664 - DNA, 25 bp, Mus musculus
gctgtactgggtcaatgatgccgta

SEQ ID NO: 317665 - DNA, 25 bp, Mus musculus
gctgtagaaaaagggcttttcctag

SEQ ID NO: 317666 - DNA, 25 bp, Mus musculus
gctgtagacaccacgggtgctggtg

SEQ ID NO: 317667 - DNA, 25 bp, Mus musculus
gctgtagcagtgcaccacatatcta

SEQ ID NO: 317668 - DNA, 25 bp, Mus musculus
gctgtagccaaagagactgcttcta

SEQ ID NO: 317669 - DNA, 25 bp, Mus musculus
gctgtaggactttgagctgaggctg

SEQ ID NO: 317670 - DNA, 25 bp, Mus musculus
gctgtaggtccgccggtttcaacct

SEQ ID NO: 317671 - DNA, 25 bp, Mus musculus
gctgtagtagtgactctcttttggc

SEQ ID NO: 317672 - DNA, 25 bp, Mus musculus
gctgtagtgcatgagtttccagatc

SEQ ID NO: 317673 - DNA, 25 bp, Mus musculus
gctgtataaggtacatttgaagaat

SEQ ID NO: 317674 - DNA, 25 bp, Mus musculus
gctgtataatgaaagcccagttcgg

SEQ ID NO: 317675 - DNA, 25 bp, Mus musculus
gctgtataccctggtcagcctgctg

SEQ ID NO: 317676 - DNA, 25 bp, Mus musculus
gctgtataccggtcagctgctggaa

SEQ ID NO: 317677 - DNA, 25 bp, Mus musculus
gctgtatccacgagaggcacgccac

SEQ ID NO: 317678 - DNA, 25 bp, Mus musculus
gctgtatccataggagttttaaagc

SEQ ID NO: 317679 - DNA, 25 bp, Mus musculus
gctgtatccataggatttacatgga

SEQ ID NO: 317680 - DNA, 25 bp, Mus musculus
gctgtatctggtgctctaccttagc

SEQ ID NO: 317681 - DNA, 25 bp, Mus musculus
gctgtatctggtgctctaccttcag

SEQ ID NO: 317682 - DNA, 25 bp, Mus musculus
gctgtatgaggaagtaaagctctac

SEQ ID NO: 317683 - DNA, 25 bp, Mus musculus
gctgtatgcccttctctaggaaggc

SEQ ID NO: 317684 - DNA, 25 bp, Mus musculus
gctgtatggaaagatggcctctgca

SEQ ID NO: 317685 - DNA, 25 bp, Mus musculus
gctgtatggcgatgagaatgaagtt

SEQ ID NO: 317686 - DNA, 25 bp, Mus musculus
gctgtatggcggcccgtgggacgtg

SEQ ID NO: 317687 - DNA, 25 bp, Mus musculus
gctgtatgtatacgacaccacggcg

SEQ ID NO: 317688 - DNA, 25 bp, Mus musculus
gctgtatgtatacgatccccccaca

SEQ ID NO: 317689 - DNA, 25 bp, Mus musculus
gctgtatgtatacgcaccaccacca

SEQ ID NO: 317690 - DNA, 25 bp, Mus musculus
gctgtatgtggacggatgacgactc

SEQ ID NO: 317691 - DNA, 25 bp, Mus musculus
gctgtattacagcagcaatattcac

SEQ ID NO: 317692 - DNA, 25 bp, Mus musculus
gctgtatttgaaaaaactggccacg

SEQ ID NO: 317693 - DNA, 25 bp, Mus musculus
gctgtatttggaatgggctgcttct

SEQ ID NO: 317694 - DNA, 25 bp, Mus musculus
gctgtcaaactacagagtgaatgcc

SEQ ID NO: 317695 - DNA, 25 bp, Mus musculus
gctgtcaaacttcagagtgaatgcc

SEQ ID NO: 317696 - DNA, 25 bp, Mus musculus
gctgtcaaaggggagaagctgcttg

SEQ ID NO: 317697 - DNA, 25 bp, Mus musculus
gctgtcaacaaggtctaggaaacct

SEQ ID NO: 317698 - DNA, 25 bp, Mus musculus
gctgtcaagaacaaggcccagtctg

SEQ ID NO: 317699 - DNA, 25 bp, Mus musculus
gctgtcaagtcgatgagcagtttgc

SEQ ID NO: 317700 - DNA, 25 bp, Mus musculus
gctgtcacaaagatcatagcccagg

SEQ ID NO: 317701 - DNA, 25 bp, Mus musculus
gctgtcaccaacattaccacagcat

SEQ ID NO: 317702 - DNA, 25 bp, Mus musculus
gctgtcaccaaggaccccaactggt

SEQ ID NO: 317703 - DNA, 25 bp, Mus musculus
gctgtcaccaaggcccacgtttttg

SEQ ID NO: 317704 - DNA, 25 bp, Mus musculus
gctgtcaccatcattaccacagcat

SEQ ID NO: 317705 - DNA, 25 bp, Mus musculus
gctgtcacccatatggcccacacgg

SEQ ID NO: 317706 - DNA, 25 bp, Mus musculus
gctgtcacccatggtccgacttttg

SEQ ID NO: 317707 - DNA, 25 bp, Mus musculus
gctgtcactcagaagaaacccagag

SEQ ID NO: 317708 - DNA, 25 bp, Mus musculus
gctgtcactcaggtctgtggaggaa

SEQ ID NO: 317709 - DNA, 25 bp, Mus musculus
gctgtcactcctgctggttgcatgt

SEQ ID NO: 317710 - DNA, 25 bp, Mus musculus
gctgtcactggtgctcctggctctg

SEQ ID NO: 317711 - DNA, 25 bp, Mus musculus
gctgtcagaactcaaataattttgc

SEQ ID NO: 317712 - DNA, 25 bp, Mus musculus
gctgtcagaactcagcatcttatgg

SEQ ID NO: 317713 - DNA, 25 bp, Mus musculus
gctgtcagaactcagtcaggctgtt

SEQ ID NO: 317714 - DNA, 25 bp, Mus musculus
gctgtcagaagaaagagtgcagcag

SEQ ID NO: 317715 - DNA, 25 bp, Mus musculus
gctgtcagagactatgaaatccctg

SEQ ID NO: 317716 - DNA, 25 bp, Mus musculus
gctgtcaggaagaggagctttggct

SEQ ID NO: 317717 - DNA, 25 bp, Mus musculus
gctgtcaggaagaggctgtcaacag

SEQ ID NO: 317718 - DNA, 25 bp, Mus musculus
gctgtcaggaagagggagtcccagc

SEQ ID NO: 317719 - DNA, 25 bp, Mus musculus
gctgtcaggaagggactggaatacg

SEQ ID NO: 317720 - DNA, 25 bp, Mus musculus
gctgtcaggcagaatgggcttatgt

SEQ ID NO: 317721 - DNA, 25 bp, Mus musculus
gctgtcagtgggtttcaccagctaa

SEQ ID NO: 317722 - DNA, 25 bp, Mus musculus
gctgtcatcgaaggagctgtgcggt

SEQ ID NO: 317723 - DNA, 25 bp, Mus musculus
gctgtcatggaaagttacttcaatg

SEQ ID NO: 317724 - DNA, 25 bp, Mus musculus
gctgtcatggacagttacttcaatg

SEQ ID NO: 317725 - DNA, 25 bp, Mus musculus
gctgtcatggaggtttatcaccaga

SEQ ID NO: 317726 - DNA, 25 bp, Mus musculus
gctgtcattcactgtataagcatga

SEQ ID NO: 317727 - DNA, 25 bp, Mus musculus
gctgtccaagttggggctcgctgtg

SEQ ID NO: 317728 - DNA, 25 bp, Mus musculus
gctgtccacaggtccacggtgtggt

SEQ ID NO: 317729 - DNA, 25 bp, Mus musculus
gctgtccagatcacggaccaggagg

SEQ ID NO: 317730 - DNA, 25 bp, Mus musculus
gctgtccagcaggccacgattgctg

SEQ ID NO: 317731 - DNA, 25 bp, Mus musculus
gctgtccagggtcttcaaagcttca

SEQ ID NO: 317732 - DNA, 25 bp, Mus musculus
gctgtcccacattggcaagacattg

SEQ ID NO: 317733 - DNA, 25 bp, Mus musculus
gctgtcccacctcagcaccaggacc

SEQ ID NO: 317734 - DNA, 25 bp, Mus musculus
gctgtcccaccttgtgcgccccgca

SEQ ID NO: 317735 - DNA, 25 bp, Mus musculus
gctgtcccagatgaacgggcttgca

SEQ ID NO: 317736 - DNA, 25 bp, Mus musculus
gctgtcccaggggtgactttcctgt

SEQ ID NO: 317737 - DNA, 25 bp, Mus musculus
gctgtcccaggtgctcctggtcacg

SEQ ID NO: 317738 - DNA, 25 bp, Mus musculus
gctgtcccattctctggtgccctgc

SEQ ID NO: 317739 - DNA, 25 bp, Mus musculus
gctgtccccaggaggccccactcac

SEQ ID NO: 317740 - DNA, 25 bp, Mus musculus
gctgtcccccagccgagtttgtctt

SEQ ID NO: 317741 - DNA, 25 bp, Mus musculus
gctgtcccccaggcgagtttgtctt

SEQ ID NO: 317742 - DNA, 25 bp, Mus musculus
gctgtcccctcagttccccagtgaa

SEQ ID NO: 317743 - DNA, 25 bp, Mus musculus
gctgtcccgagttgaggccggcgct

SEQ ID NO: 317744 - DNA, 25 bp, Mus musculus
gctgtccgagagaagacacagctgg

SEQ ID NO: 317745 - DNA, 25 bp, Mus musculus
gctgtccgagagaagaccaccaagg

SEQ ID NO: 317746 - DNA, 25 bp, Mus musculus
gctgtccgagagaaggtgggtgaca

SEQ ID NO: 317747 - DNA, 25 bp, Mus musculus
gctgtccgcactgtgagaaggaggg

SEQ ID NO: 317748 - DNA, 25 bp, Mus musculus
gctgtccgtgccagacctcgcagta

SEQ ID NO: 317749 - DNA, 25 bp, Mus musculus
gctgtccgtgccagtaaccctgacc

SEQ ID NO: 317750 - DNA, 25 bp, Mus musculus
gctgtcctagggacaaagtatagac

SEQ ID NO: 317751 - DNA, 25 bp, Mus musculus
gctgtcctaggggctcaaggaacct

SEQ ID NO: 317752 - DNA, 25 bp, Mus musculus
gctgtcctatgcttcccatgatgaa

SEQ ID NO: 317753 - DNA, 25 bp, Mus musculus
gctgtcctcaccaagatcctccaat

SEQ ID NO: 317754 - DNA, 25 bp, Mus musculus
gctgtcctcaccaaggtttctctgg

SEQ ID NO: 317755 - DNA, 25 bp, Mus musculus
gctgtcctccccgttctgatacccg

SEQ ID NO: 317756 - DNA, 25 bp, Mus musculus
gctgtcctgaggattcggccctttt

SEQ ID NO: 317757 - DNA, 25 bp, Mus musculus
gctgtcctggaactgtgttacatcc

SEQ ID NO: 317758 - DNA, 25 bp, Mus musculus
gctgtcctgtggagagcctccaacg

SEQ ID NO: 317759 - DNA, 25 bp, Mus musculus
gctgtcctgtggaggtgtaaagaaa

SEQ ID NO: 317760 - DNA, 25 bp, Mus musculus
gctgtccttaatgaacctcccactg

SEQ ID NO: 317761 - DNA, 25 bp, Mus musculus
gctgtccttacagggaatttaatga

SEQ ID NO: 317762 - DNA, 25 bp, Mus musculus
gctgtccttgaagagcccacctgaa

SEQ ID NO: 317763 - DNA, 25 bp, Mus musculus
gctgtcgcagacggttcccagcagt

SEQ ID NO: 317764 - DNA, 25 bp, Mus musculus
gctgtcgcatccatgtcattgacca

SEQ ID NO: 317765 - DNA, 25 bp, Mus musculus
gctgtcggaagcaaggtctggtcca

SEQ ID NO: 317766 - DNA, 25 bp, Mus musculus
gctgtcgtgagaagcatggtgaaga

SEQ ID NO: 317767 - DNA, 25 bp, Mus musculus
gctgtcgtgagaaggtatagcagtg

SEQ ID NO: 317768 - DNA, 25 bp, Mus musculus
gctgtctacgagaccctgaagaatc

SEQ ID NO: 317769 - DNA, 25 bp, Mus musculus
gctgtctatgagacattgaaaaata

SEQ ID NO: 317770 - DNA, 25 bp, Mus musculus
gctgtctcaagtaccggcagtcctt

SEQ ID NO: 317771 - DNA, 25 bp, Mus musculus
gctgtctcaggacactgctggccga

SEQ ID NO: 317772 - DNA, 25 bp, Mus musculus
gctgtctcagggtgaaagagcaatc

SEQ ID NO: 317773 - DNA, 25 bp, Mus musculus
gctgtctcaggtggcccctgtgctc

SEQ ID NO: 317774 - DNA, 25 bp, Mus musculus
gctgtctccaagccaagaggacctg

SEQ ID NO: 317775 - DNA, 25 bp, Mus musculus
gctgtctccaggtgacattccaagc

SEQ ID NO: 317776 - DNA, 25 bp, Mus musculus
gctgtctccgcaggggaacagtaca

SEQ ID NO: 317777 - DNA, 25 bp, Mus musculus
gctgtctctcagatgaccactctag

SEQ ID NO: 317778 - DNA, 25 bp, Mus musculus
gctgtctctgacaaatcgccagtac

SEQ ID NO: 317779 - DNA, 25 bp, Mus musculus
gctgtctctgacaaattctctccag

SEQ ID NO: 317780 - DNA, 25 bp, Mus musculus
gctgtctgagtctgaagaagacaaa

SEQ ID NO: 317781 - DNA, 25 bp, Mus musculus
gctgtctgcaaggagaagatcggat

SEQ ID NO: 317782 - DNA, 25 bp, Mus musculus
gctgtctgcaatcccaaaccttgtc

SEQ ID NO: 317783 - DNA, 25 bp, Mus musculus
gctgtctggacagagtttgatgagt

SEQ ID NO: 317784 - DNA, 25 bp, Mus musculus
gctgtctggcacaagggtgactgtg

SEQ ID NO: 317785 - DNA, 25 bp, Mus musculus
gctgtctgtatccagcgagacggtc

SEQ ID NO: 317786 - DNA, 25 bp, Mus musculus
gctgtctgtgaacaaatctaccagt

SEQ ID NO: 317787 - DNA, 25 bp, Mus musculus
gctgtctgtgcagtactccaggaga

SEQ ID NO: 317788 - DNA, 25 bp, Mus musculus
gctgtctgtggctgtcctccaggag

SEQ ID NO: 317789 - DNA, 25 bp, Mus musculus
gctgtctgttgtttctctgctgccc

SEQ ID NO: 317790 - DNA, 25 bp, Mus musculus
gctgtcttcgagagaaaagttggag

SEQ ID NO: 317791 - DNA, 25 bp, Mus musculus
gctgtcttcggctcttcatagcctg

SEQ ID NO: 317792 - DNA, 25 bp, Mus musculus
gctgtcttgcaggtggaatgccatc

SEQ ID NO: 317793 - DNA, 25 bp, Mus musculus
gctgtcttggtcgatgggatgcttt

SEQ ID NO: 317794 - DNA, 25 bp, Mus musculus
gctgtcttggtcggaggtggctatt

SEQ ID NO: 317795 - DNA, 25 bp, Mus musculus
gctgtctttacagtatgtaggccat

SEQ ID NO: 317796 - DNA, 25 bp, Mus musculus
gctgtgaaaagccattggcacagcg

SEQ ID NO: 317797 - DNA, 25 bp, Mus musculus
gctgtgaaaagggtcaagcagtgta

SEQ ID NO: 317798 - DNA, 25 bp, Mus musculus
gctgtgaaagctgtccagcagaagg

SEQ ID NO: 317799 - DNA, 25 bp, Mus musculus
gctgtgaaatcttctattccaagga

SEQ ID NO: 317800 - DNA, 25 bp, Mus musculus
gctgtgaactagagcttctggaatt

SEQ ID NO: 317801 - DNA, 25 bp, Mus musculus
gctgtgaagccacgcttgcctctcc

SEQ ID NO: 317802 - DNA, 25 bp, Mus musculus
gctgtgaagccacgttgtgggacct

SEQ ID NO: 317803 - DNA, 25 bp, Mus musculus
gctgtgaatctgtttcccatgctga

SEQ ID NO: 317804 - DNA, 25 bp, Mus musculus
gctgtgaatgaaataatagctactc

SEQ ID NO: 317805 - DNA, 25 bp, Mus musculus
gctgtgaatgtctgtgtcagcagct

SEQ ID NO: 317806 - DNA, 25 bp, Mus musculus
gctgtgacaaaggggaggaaatctt

SEQ ID NO: 317807 - DNA, 25 bp, Mus musculus
gctgtgacaactgccccctggaaca

SEQ ID NO: 317808 - DNA, 25 bp, Mus musculus
gctgtgacacttggtccctccagct

SEQ ID NO: 317809 - DNA, 25 bp, Mus musculus
gctgtgacagatctgagcactgagg

SEQ ID NO: 317810 - DNA, 25 bp, Mus musculus
gctgtgacagcacctccgtccgagg

SEQ ID NO: 317811 - DNA, 25 bp, Mus musculus
gctgtgacccaccaacatgacctgg

SEQ ID NO: 317812 - DNA, 25 bp, Mus musculus
gctgtgacccaggagctgccttaca

SEQ ID NO: 317813 - DNA, 25 bp, Mus musculus
gctgtgaccgagatcaagatccact

SEQ ID NO: 317814 - DNA, 25 bp, Mus musculus
gctgtgaccgaggttgaacatttca

SEQ ID NO: 317815 - DNA, 25 bp, Mus musculus
gctgtgactgagagcgagctgacca

SEQ ID NO: 317816 - DNA, 25 bp, Mus musculus
gctgtgactgagagtgagaaagcgc

SEQ ID NO: 317817 - DNA, 25 bp, Mus musculus
gctgtgactttacaggaaaaccacc

SEQ ID NO: 317818 - DNA, 25 bp, Mus musculus
gctgtgactttgcagtttcaccaaa

SEQ ID NO: 317819 - DNA, 25 bp, Mus musculus
gctgtgagacagacattgacgagtg

SEQ ID NO: 317820 - DNA, 25 bp, Mus musculus
gctgtgagacagactcttcctgagt

SEQ ID NO: 317821 - DNA, 25 bp, Mus musculus
gctgtgagaggcttcctccccagga

SEQ ID NO: 317822 - DNA, 25 bp, Mus musculus
gctgtgagagtgaagccgcccagag

SEQ ID NO: 317823 - DNA, 25 bp, Mus musculus
gctgtgagcaagatcattgagcgct

SEQ ID NO: 317824 - DNA, 25 bp, Mus musculus
gctgtgagcaaggctctacccctgg

SEQ ID NO: 317825 - DNA, 25 bp, Mus musculus
gctgtgagcaagtgaacacggattc

SEQ ID NO: 317826 - DNA, 25 bp, Mus musculus
gctgtgagccggtgatctctgggct

SEQ ID NO: 317827 - DNA, 25 bp, Mus musculus
gctgtgaggacagcatccctggcac

SEQ ID NO: 317828 - DNA, 25 bp, Mus musculus
gctgtgagtgctccgtggcctctca

SEQ ID NO: 317829 - DNA, 25 bp, Mus musculus
gctgtgagttgcacggatgttctga

SEQ ID NO: 317830 - DNA, 25 bp, Mus musculus
gctgtgatcacggtgacaaacttga

SEQ ID NO: 317831 - DNA, 25 bp, Mus musculus
gctgtgatcgctgggttcctgagac

SEQ ID NO: 317832 - DNA, 25 bp, Mus musculus
gctgtgcaaatggcaagctgtgcat

SEQ ID NO: 317833 - DNA, 25 bp, Mus musculus
gctgtgcaaatggtacaatcagctg

SEQ ID NO: 317834 - DNA, 25 bp, Mus musculus
gctgtgcaagctgacttcggagatt

SEQ ID NO: 317835 - DNA, 25 bp, Mus musculus
gctgtgcacattcaggagtgtgttc

SEQ ID NO: 317836 - DNA, 25 bp, Mus musculus
gctgtgcaccacgagatgtgtgtta

SEQ ID NO: 317837 - DNA, 25 bp, Mus musculus
gctgtgcaccacgaggatcagaact

SEQ ID NO: 317838 - DNA, 25 bp, Mus musculus
gctgtgcagacagcccctgcaggaa

SEQ ID NO: 317839 - DNA, 25 bp, Mus musculus
gctgtgcagagcagatctggtggcc

SEQ ID NO: 317840 - DNA, 25 bp, Mus musculus
gctgtgcagcagcaggaggtgtatg

SEQ ID NO: 317841 - DNA, 25 bp, Mus musculus
gctgtgcagcttcaggaccacagcc

SEQ ID NO: 317842 - DNA, 25 bp, Mus musculus
gctgtgcatcggaggtcaccttcgt

SEQ ID NO: 317843 - DNA, 25 bp, Mus musculus
gctgtgccaacaaggcagagatgga

SEQ ID NO: 317844 - DNA, 25 bp, Mus musculus
gctgtgcccctggctgggtttggtt

SEQ ID NO: 317845 - DNA, 25 bp, Mus musculus
gctgtgcccctgttcacctgctgtt

SEQ ID NO: 317846 - DNA, 25 bp, Mus musculus
gctgtgccctgctgggtggggagac

SEQ ID NO: 317847 - DNA, 25 bp, Mus musculus
gctgtgccgactacgtggaggagcc

SEQ ID NO: 317848 - DNA, 25 bp, Mus musculus
gctgtgcctaccgtgccagccccca

SEQ ID NO: 317849 - DNA, 25 bp, Mus musculus
gctgtgcctgtcctggttgttcctc

SEQ ID NO: 317850 - DNA, 25 bp, Mus musculus
gctgtgccttgcacaacccggtctc

SEQ ID NO: 317851 - DNA, 25 bp, Mus musculus
gctgtgctaccttaggatcgagcgg

SEQ ID NO: 317852 - DNA, 25 bp, Mus musculus
gctgtgctgcagaaaaagcagacgg

SEQ ID NO: 317853 - DNA, 25 bp, Mus musculus
gctgtgctgcgcaaggtttctctgt

SEQ ID NO: 317854 - DNA, 25 bp, Mus musculus
gctgtgctgcgcaaggtttctgaca

SEQ ID NO: 317855 - DNA, 25 bp, Mus musculus
gctgtgctgtgttggtccggaccgc

SEQ ID NO: 317856 - DNA, 25 bp, Mus musculus
gctgtgcttgaggtgattgaagaag

SEQ ID NO: 317857 - DNA, 25 bp, Mus musculus
gctgtggaaatattgcatactccta

SEQ ID NO: 317858 - DNA, 25 bp, Mus musculus
gctgtggaaatggggaacttctgtg

SEQ ID NO: 317859 - DNA, 25 bp, Mus musculus
gctgtggaaatggggcactttctgc

SEQ ID NO: 317860 - DNA, 25 bp, Mus musculus
gctgtggaaatggggggtcttcttg

SEQ ID NO: 317861 - DNA, 25 bp, Mus musculus
gctgtggaagagtccctgattgtcc

SEQ ID NO: 317862 - DNA, 25 bp, Mus musculus
gctgtggaagctgggattcttcaag

SEQ ID NO: 317863 - DNA, 25 bp, Mus musculus
gctgtggaagtgtggcttcttccgt

SEQ ID NO: 317864 - DNA, 25 bp, Mus musculus
gctgtggacaagaaaggtgacactc

SEQ ID NO: 317865 - DNA, 25 bp, Mus musculus
gctgtggaccagtacctgatactac

SEQ ID NO: 317866 - DNA, 25 bp, Mus musculus
gctgtggagattcatgacttgcaga

SEQ ID NO: 317867 - DNA, 25 bp, Mus musculus
gctgtggagcaggctcctagaaggt

SEQ ID NO: 317868 - DNA, 25 bp, Mus musculus
gctgtggaggagaatggggagacct

SEQ ID NO: 317869 - DNA, 25 bp, Mus musculus
gctgtggagggacagcaactgcttt

SEQ ID NO: 317870 - DNA, 25 bp, Mus musculus
gctgtggagggacagtgacaggttt

SEQ ID NO: 317871 - DNA, 25 bp, Mus musculus
gctgtggcacaaggcaaagacatca

SEQ ID NO: 317872 - DNA, 25 bp, Mus musculus
gctgtggcacacatcactcaactgc

SEQ ID NO: 317873 - DNA, 25 bp, Mus musculus
gctgtggcagaattctcttttgtta

SEQ ID NO: 317874 - DNA, 25 bp, Mus musculus
gctgtggcagactaactccagtctc

SEQ ID NO: 317875 - DNA, 25 bp, Mus musculus
gctgtggcagatttgcaaacacgac

SEQ ID NO: 317876 - DNA, 25 bp, Mus musculus
gctgtggcattaagcactgaatgca

SEQ ID NO: 317877 - DNA, 25 bp, Mus musculus
gctgtggccacgtgttctgccgatc

SEQ ID NO: 317878 - DNA, 25 bp, Mus musculus
gctgtggctgctgatgccatactcc

SEQ ID NO: 317879 - DNA, 25 bp, Mus musculus
gctgtggctgctgtctccccattca

SEQ ID NO: 317880 - DNA, 25 bp, Mus musculus
gctgtggcttcaagttttggaaaca

SEQ ID NO: 317881 - DNA, 25 bp, Mus musculus
gctgtgggaaagtacattgagcatt

SEQ ID NO: 317882 - DNA, 25 bp, Mus musculus
gctgtgggaacttatttagaagtct

SEQ ID NO: 317883 - DNA, 25 bp, Mus musculus
gctgtgggaagaacactgctgtgct

SEQ ID NO: 317884 - DNA, 25 bp, Mus musculus
gctgtgggagctgtgatggatgatg

SEQ ID NO: 317885 - DNA, 25 bp, Mus musculus
gctgtgggaggtgctgtggacaggg

SEQ ID NO: 317886 - DNA, 25 bp, Mus musculus
gctgtgggattatctgaacgatgct

SEQ ID NO: 317887 - DNA, 25 bp, Mus musculus
gctgtgggcagggtgcctggctacg

SEQ ID NO: 317888 - DNA, 25 bp, Mus musculus
gctgtggggagaccggtactttgat

SEQ ID NO: 317889 - DNA, 25 bp, Mus musculus
gctgtggggtccctggctcctggcc

SEQ ID NO: 317890 - DNA, 25 bp, Mus musculus
gctgtggtctatgaaaccaatgttt

SEQ ID NO: 317891 - DNA, 25 bp, Mus musculus
gctgtggtgacgctagagaactggc

SEQ ID NO: 317892 - DNA, 25 bp, Mus musculus
gctgtggtgcacaggacacaaaaaa

SEQ ID NO: 317893 - DNA, 25 bp, Mus musculus
gctgtggtgcacagtttccctcagg

SEQ ID NO: 317894 - DNA, 25 bp, Mus musculus
gctgtggtgcggctgtgtggcacct

SEQ ID NO: 317895 - DNA, 25 bp, Mus musculus
gctgtggtggaagaggagacaagtt

SEQ ID NO: 317896 - DNA, 25 bp, Mus musculus
gctgtgtaaaaagagtattacaaca

SEQ ID NO: 317897 - DNA, 25 bp, Mus musculus
gctgtgtaaaaaggaagtgttaaac

SEQ ID NO: 317898 - DNA, 25 bp, Mus musculus
gctgtgtaactcagaaagaagatta

SEQ ID NO: 317899 - DNA, 25 bp, Mus musculus
gctgtgtaatgaagaaaagtccatc

SEQ ID NO: 317900 - DNA, 25 bp, Mus musculus
gctgtgtaatgaagacttgtgacac

SEQ ID NO: 317901 - DNA, 25 bp, Mus musculus
gctgtgtatcagaggacctcagaat

SEQ ID NO: 317902 - DNA, 25 bp, Mus musculus
gctgtgtccaagctgtcagtagaag

SEQ ID NO: 317903 - DNA, 25 bp, Mus musculus
gctgtgtcctcaggtggcagtttat

SEQ ID NO: 317904 - DNA, 25 bp, Mus musculus
gctgtgtcctgaggatctttccaac

SEQ ID NO: 317905 - DNA, 25 bp, Mus musculus
gctgtgtcctgagtatcccaggcgc

SEQ ID NO: 317906 - DNA, 25 bp, Mus musculus
gctgtgtctgatgtcctggaatcgg

SEQ ID NO: 317907 - DNA, 25 bp, Mus musculus
gctgtgtgacctcaggggagctgct

SEQ ID NO: 317908 - DNA, 25 bp, Mus musculus
gctgtgtgaccttggggaaagatgg

SEQ ID NO: 317909 - DNA, 25 bp, Mus musculus
gctgtgtgaccttggttcttccatc

SEQ ID NO: 317910 - DNA, 25 bp, Mus musculus
gctgtgtgatgattgaagattatga

SEQ ID NO: 317911 - DNA, 25 bp, Mus musculus
gctgtgtgcaggagagatgggtgga

SEQ ID NO: 317912 - DNA, 25 bp, Mus musculus
gctgtgtgcctcagtgctaggttta

SEQ ID NO: 317913 - DNA, 25 bp, Mus musculus
gctgtgtgcctctgtgctaggttta

SEQ ID NO: 317914 - DNA, 25 bp, Mus musculus
gctgtgtgcggtctgttcctgcgcc

SEQ ID NO: 317915 - DNA, 25 bp, Mus musculus
gctgtgtggatatctatgatagaga

SEQ ID NO: 317916 - DNA, 25 bp, Mus musculus
gctgtgtggatatgtttctgaacaa

SEQ ID NO: 317917 - DNA, 25 bp, Mus musculus
gctgtgtggatattgtgattcgtca

SEQ ID NO: 317918 - DNA, 25 bp, Mus musculus
gctgtgtgggagacggccccgactc

SEQ ID NO: 317919 - DNA, 25 bp, Mus musculus
gctgtgtgtcggagaggctggtcca

SEQ ID NO: 317920 - DNA, 25 bp, Mus musculus
gctgtgtgtcggagcctccgaagta

SEQ ID NO: 317921 - DNA, 25 bp, Mus musculus
gctgtgttactgaggcaacgtttca

SEQ ID NO: 317922 - DNA, 25 bp, Mus musculus
gctgtgttactgagggactttgtaa

SEQ ID NO: 317923 - DNA, 25 bp, Mus musculus
gctgtgttcagccctgacagaagct

SEQ ID NO: 317924 - DNA, 25 bp, Mus musculus
gctgtgttcaggctcttcaaacggc

SEQ ID NO: 317925 - DNA, 25 bp, Mus musculus
gctgtgtttgaggaggtagggtctg

SEQ ID NO: 317926 - DNA, 25 bp, Mus musculus
gctgtgtttgaggaggtgtacagga

SEQ ID NO: 317927 - DNA, 25 bp, Mus musculus
gctgtgttttattggatcgtggagt

SEQ ID NO: 317928 - DNA, 25 bp, Mus musculus
gctgttaacagttcaaggcctggca

SEQ ID NO: 317929 - DNA, 25 bp, Mus musculus
gctgttaatactgtggatttcttca

SEQ ID NO: 317930 - DNA, 25 bp, Mus musculus
gctgttaatagtgtcccttttccca

SEQ ID NO: 317931 - DNA, 25 bp, Mus musculus
gctgttacaggtactgcgaatgatg

SEQ ID NO: 317932 - DNA, 25 bp, Mus musculus
gctgttacagtttttcagctgccct

SEQ ID NO: 317933 - DNA, 25 bp, Mus musculus
gctgttacctcttatgccctgctgt

SEQ ID NO: 317934 - DNA, 25 bp, Mus musculus
gctgttacctcttctggctcatcgc

SEQ ID NO: 317935 - DNA, 25 bp, Mus musculus
gctgttacggaggcgaagaggatct

SEQ ID NO: 317936 - DNA, 25 bp, Mus musculus
gctgttacgggctgtgacaatctcc

SEQ ID NO: 317937 - DNA, 25 bp, Mus musculus
gctgttagtaagaatcccagtaaac

SEQ ID NO: 317938 - DNA, 25 bp, Mus musculus
gctgttatcggaaataaagaaagat

SEQ ID NO: 317939 - DNA, 25 bp, Mus musculus
gctgttatgtcagtatatgactgct

SEQ ID NO: 317940 - DNA, 25 bp, Mus musculus
gctgttattctggtatgggacgttt

SEQ ID NO: 317941 - DNA, 25 bp, Mus musculus
gctgttattgaaaggtgacattccc

SEQ ID NO: 317942 - DNA, 25 bp, Mus musculus
gctgttcaccaggagctggaatttg

SEQ ID NO: 317943 - DNA, 25 bp, Mus musculus
gctgttcagagactgggtgggtctt

SEQ ID NO: 317944 - DNA, 25 bp, Mus musculus
gctgttcagagatggtggagactga

SEQ ID NO: 317945 - DNA, 25 bp, Mus musculus
gctgttcagagtaggtggcgatgtc

SEQ ID NO: 317946 - DNA, 25 bp, Mus musculus
gctgttcagagtcatgcagttgctg

SEQ ID NO: 317947 - DNA, 25 bp, Mus musculus
gctgttcagggtgactcatattctc

SEQ ID NO: 317948 - DNA, 25 bp, Mus musculus
gctgttcagtcaaggacagtggcct

SEQ ID NO: 317949 - DNA, 25 bp, Mus musculus
gctgttccaaccccgatgctctgaa

SEQ ID NO: 317950 - DNA, 25 bp, Mus musculus
gctgttccaccaggctgggccggta

SEQ ID NO: 317951 - DNA, 25 bp, Mus musculus
gctgttccaccagtatttgaggcag

SEQ ID NO: 317952 - DNA, 25 bp, Mus musculus
gctgttccagttacagattcatggt

SEQ ID NO: 317953 - DNA, 25 bp, Mus musculus
gctgttcccatttatgtacaggtgt

SEQ ID NO: 317954 - DNA, 25 bp, Mus musculus
gctgttcccgatccgtacttcggtg

SEQ ID NO: 317955 - DNA, 25 bp, Mus musculus
gctgttccttcctggaggacgactt

SEQ ID NO: 317956 - DNA, 25 bp, Mus musculus
gctgttcgcgaagaatcgagatccg

SEQ ID NO: 317957 - DNA, 25 bp, Mus musculus
gctgttcgcgaagtgcgtccccacg

SEQ ID NO: 317958 - DNA, 25 bp, Mus musculus
gctgttctaaagaggacagatcaca

SEQ ID NO: 317959 - DNA, 25 bp, Mus musculus
gctgttctaaagagtaaccaggact

SEQ ID NO: 317960 - DNA, 25 bp, Mus musculus
gctgttctaaagagtccaggtctcc

SEQ ID NO: 317961 - DNA, 25 bp, Mus musculus
gctgttctaaagagttggagaacag

SEQ ID NO: 317962 - DNA, 25 bp, Mus musculus
gctgttctggctagccggatcagcc

SEQ ID NO: 317963 - DNA, 25 bp, Mus musculus
gctgttctgtatgcttcctgcgggc

SEQ ID NO: 317964 - DNA, 25 bp, Mus musculus
gctgttcttgcgacatttgtgacac

SEQ ID NO: 317965 - DNA, 25 bp, Mus musculus
gctgttctttaaaggggactttgcc

SEQ ID NO: 317966 - DNA, 25 bp, Mus musculus
gctgttctttaaaggggagtttgtg

SEQ ID NO: 317967 - DNA, 25 bp, Mus musculus
gctgttctttatcctgggtgctgtg

SEQ ID NO: 317968 - DNA, 25 bp, Mus musculus
gctgttgaaaaaagcttatccatga

SEQ ID NO: 317969 - DNA, 25 bp, Mus musculus
gctgttgacagggtctgcagcatag

SEQ ID NO: 317970 - DNA, 25 bp, Mus musculus
gctgttgagaagacgggatatcgct

SEQ ID NO: 317971 - DNA, 25 bp, Mus musculus
gctgttgaggatgtgctcgagaccc

SEQ ID NO: 317972 - DNA, 25 bp, Mus musculus
gctgttgcagtcttcgcataaggaa

SEQ ID NO: 317973 - DNA, 25 bp, Mus musculus
gctgttgccaaattggctccactta

SEQ ID NO: 317974 - DNA, 25 bp, Mus musculus
gctgttgccgtgacctttgcagatc

SEQ ID NO: 317975 - DNA, 25 bp, Mus musculus
gctgttgctcggtgcgggcgagtca

SEQ ID NO: 317976 - DNA, 25 bp, Mus musculus
gctgttggaaagtcgacagaggcaa

SEQ ID NO: 317977 - DNA, 25 bp, Mus musculus
gctgttggacaagccccacgcaatc

SEQ ID NO: 317978 - DNA, 25 bp, Mus musculus
gctgttggagaacggggtgaccgtg

SEQ ID NO: 317979 - DNA, 25 bp, Mus musculus
gctgttggaggaactgtactgagtg

SEQ ID NO: 317980 - DNA, 25 bp, Mus musculus
gctgttggattatgggtgggtgcat

SEQ ID NO: 317981 - DNA, 25 bp, Mus musculus
gctgttggattatggtccacagtga

SEQ ID NO: 317982 - DNA, 25 bp, Mus musculus
gctgttggcagttctggcaggtgat

SEQ ID NO: 317983 - DNA, 25 bp, Mus musculus
gctgttggccgaggtggtcctgccg

SEQ ID NO: 317984 - DNA, 25 bp, Mus musculus
gctgttgggaagatttctgggcttc

SEQ ID NO: 317985 - DNA, 25 bp, Mus musculus
gctgttgggaagggtctctcattgg

SEQ ID NO: 317986 - DNA, 25 bp, Mus musculus
gctgttgggcatggaaccatctgga

SEQ ID NO: 317987 - DNA, 25 bp, Mus musculus
gctgttggggctaggtgtctccagt

SEQ ID NO: 317988 - DNA, 25 bp, Mus musculus
gctgttggggctagtgcttatcctg

SEQ ID NO: 317989 - DNA, 25 bp, Mus musculus
gctgttggtggcacggatggcaatg

SEQ ID NO: 317990 - DNA, 25 bp, Mus musculus
gctgttggttggagcatttgacatt

SEQ ID NO: 317991 - DNA, 25 bp, Mus musculus
gctgttggttggagtgctcaaggag

SEQ ID NO: 317992 - DNA, 25 bp, Mus musculus
gctgttgtaaaatggtatggcctca

SEQ ID NO: 317993 - DNA, 25 bp, Mus musculus
gctgttgtacttggccagccgtgtg

SEQ ID NO: 317994 - DNA, 25 bp, Mus musculus
gctgttgtgatctcagttcacgggg

SEQ ID NO: 317995 - DNA, 25 bp, Mus musculus
gctgtttaaattggggtccaagtac

SEQ ID NO: 317996 - DNA, 25 bp, Mus musculus
gctgtttaattcagattccaaggaa

SEQ ID NO: 317997 - DNA, 25 bp, Mus musculus
gctgtttatcgcaggaggcagaagg

SEQ ID NO: 317998 - DNA, 25 bp, Mus musculus
gctgtttatggaccttgagatcacc

SEQ ID NO: 317999 - DNA, 25 bp, Mus musculus
gctgtttcccgcgggcaaggcacga

SEQ ID NO: 318000 - DNA, 25 bp, Mus musculus
gctgtttcccgcgggtgtcctggct

SEQ ID NO: 318001 - DNA, 25 bp, Mus musculus
gctgtttcctccctgagaatgaggt

SEQ ID NO: 318002 - DNA, 25 bp, Mus musculus
gctgtttcctcctaggatgtcaggc

SEQ ID NO: 318003 - DNA, 25 bp, Mus musculus
gctgtttctattgaaaccatagaca

SEQ ID NO: 318004 - DNA, 25 bp, Mus musculus
gctgtttctattgaaggtgttgttg

SEQ ID NO: 318005 - DNA, 25 bp, Mus musculus
gctgtttctgggtgtggccatcccc

SEQ ID NO: 318006 - DNA, 25 bp, Mus musculus
gctgtttgagcgatttattgccaag

SEQ ID NO: 318007 - DNA, 25 bp, Mus musculus
gctgtttgaggcgatggattgtaag

SEQ ID NO: 318008 - DNA, 25 bp, Mus musculus
gctgtttgcaagaatgcatcttaac

SEQ ID NO: 318009 - DNA, 25 bp, Mus musculus
gctgtttgcaaggtatccattatga

SEQ ID NO: 318010 - DNA, 25 bp, Mus musculus
gctgtttgccgagattgctctctca

SEQ ID NO: 318011 - DNA, 25 bp, Mus musculus
gctgtttgtgacctcgtactagaag

SEQ ID NO: 318012 - DNA, 25 bp, Mus musculus
gctgttttaaaaggattgcgggctt

SEQ ID NO: 318013 - DNA, 25 bp, Mus musculus
gctgttttaaagcaaacggtgctgg

SEQ ID NO: 318014 - DNA, 25 bp, Mus musculus
gctgttttcacaggaactggtgact

SEQ ID NO: 318015 - DNA, 25 bp, Mus musculus
gctgttttgaaacatgtccacctcg

SEQ ID NO: 318016 - DNA, 25 bp, Mus musculus
gctgttttgaagattaaaggttgca

SEQ ID NO: 318017 - DNA, 25 bp, Mus musculus
gctgttttgatgattccaagagcag

SEQ ID NO: 318018 - DNA, 25 bp, Mus musculus
gctgttttggaatgagagacatgtc

SEQ ID NO: 318019 - DNA, 25 bp, Mus musculus
gctgtttttgaagagctacagacag

SEQ ID NO: 318020 - DNA, 25 bp, Mus musculus
gctgtttttgttgtacggacattgc

SEQ ID NO: 318021 - DNA, 25 bp, Mus musculus
gcttaaaaaggcaatgatagtgagg

SEQ ID NO: 318022 - DNA, 25 bp, Mus musculus
gcttaaaatcaggaaattttgccaa

SEQ ID NO: 318023 - DNA, 25 bp, Mus musculus
gcttaaaatcaggcagggagaagaa

SEQ ID NO: 318024 - DNA, 25 bp, Mus musculus
gcttaaaatttggattcctgtctct

SEQ ID NO: 318025 - DNA, 25 bp, Mus musculus
gcttaaacaacctagagcttcagga

SEQ ID NO: 318026 - DNA, 25 bp, Mus musculus
gcttaaacaaggtgattctgctgct

SEQ ID NO: 318027 - DNA, 25 bp, Mus musculus
gcttaaactgggagtgtgtgccgac

SEQ ID NO: 318028 - DNA, 25 bp, Mus musculus
gcttaaagagggcttggggcatatc

SEQ ID NO: 318029 - DNA, 25 bp, Mus musculus
gcttaacagaaaaggagtgtgtgag

SEQ ID NO: 318030 - DNA, 25 bp, Mus musculus
gcttaacagaacaggagtgtgtgag

SEQ ID NO: 318031 - DNA, 25 bp, Mus musculus
gcttaacatgaaggaccttctgtca

SEQ ID NO: 318032 - DNA, 25 bp, Mus musculus
gcttaacatggagatgagtgtgaat

SEQ ID NO: 318033 - DNA, 25 bp, Mus musculus
gcttaacatggaggaccctctgtca

SEQ ID NO: 318034 - DNA, 25 bp, Mus musculus
gcttaagagaaggtgttaggagtgg

SEQ ID NO: 318035 - DNA, 25 bp, Mus musculus
gcttaagggacagcaaggagtccgt

SEQ ID NO: 318036 - DNA, 25 bp, Mus musculus
gcttaagtttatgaattcctcagag

SEQ ID NO: 318037 - DNA, 25 bp, Mus musculus
gcttaagtttatggctgcagttccg

SEQ ID NO: 318038 - DNA, 25 bp, Mus musculus
gcttaagtttatgtgctctatgccc

SEQ ID NO: 318039 - DNA, 25 bp, Mus musculus
gcttaataaagaagatatgcaccta

SEQ ID NO: 318040 - DNA, 25 bp, Mus musculus
gcttaatactgcttaagtatttttc

SEQ ID NO: 318041 - DNA, 25 bp, Mus musculus
gcttaatatgagaaaggaacataat

SEQ ID NO: 318042 - DNA, 25 bp, Mus musculus
gcttaatatgtgaaaggaacataat

SEQ ID NO: 318043 - DNA, 25 bp, Mus musculus
gcttaatcaccaaggtcacgtgaaa

SEQ ID NO: 318044 - DNA, 25 bp, Mus musculus
gcttaatgaaaagtatttttctgac

SEQ ID NO: 318045 - DNA, 25 bp, Mus musculus
gcttaatgaaacccacagcactggt

SEQ ID NO: 318046 - DNA, 25 bp, Mus musculus
gcttaatgacaaattaaaagagatg

SEQ ID NO: 318047 - DNA, 25 bp, Mus musculus
gcttaattcctgaggtaaaggggaa

SEQ ID NO: 318048 - DNA, 25 bp, Mus musculus
gcttaattcctgaggttcttaatat

SEQ ID NO: 318049 - DNA, 25 bp, Mus musculus
gcttaattgagaaggcatacaaatg

SEQ ID NO: 318050 - DNA, 25 bp, Mus musculus
gcttacaaagaatggaattgctagt

SEQ ID NO: 318051 - DNA, 25 bp, Mus musculus
gcttacacatgtgcacattttactg

SEQ ID NO: 318052 - DNA, 25 bp, Mus musculus
gcttacagacgggctgactcctcac

SEQ ID NO: 318053 - DNA, 25 bp, Mus musculus
gcttacagacgggctttgctgttgg

SEQ ID NO: 318054 - DNA, 25 bp, Mus musculus
gcttacagtaagaggtaaagttcaa

SEQ ID NO: 318055 - DNA, 25 bp, Mus musculus
gcttacagtggaatgggcctgctcc

SEQ ID NO: 318056 - DNA, 25 bp, Mus musculus
gcttacagtgggaagacatgggatc

SEQ ID NO: 318057 - DNA, 25 bp, Mus musculus
gcttacataggtccccttcccctga

SEQ ID NO: 318058 - DNA, 25 bp, Mus musculus
gcttacatagtgcaactacagatag

SEQ ID NO: 318059 - DNA, 25 bp, Mus musculus
gcttaccaaaaggatatccaggtac

SEQ ID NO: 318060 - DNA, 25 bp, Mus musculus
gcttaccaaaaggtacctgtgtgcc

SEQ ID NO: 318061 - DNA, 25 bp, Mus musculus
gcttaccaacagggagtacaccttt

SEQ ID NO: 318062 - DNA, 25 bp, Mus musculus
gcttaccaacagtctcaagaaggat

SEQ ID NO: 318063 - DNA, 25 bp, Mus musculus
gcttaccaagcccgttctcaaaaga

SEQ ID NO: 318064 - DNA, 25 bp, Mus musculus
gcttaccaggaagcatctgtctgag

SEQ ID NO: 318065 - DNA, 25 bp, Mus musculus
gcttaccattgatcatgctactaat

SEQ ID NO: 318066 - DNA, 25 bp, Mus musculus
gcttacccaggtttggcatagaaat

SEQ ID NO: 318067 - DNA, 25 bp, Mus musculus
gcttacccagtggggtacatgtacc

SEQ ID NO: 318068 - DNA, 25 bp, Mus musculus
gcttaccttaccactgagatactag

SEQ ID NO: 318069 - DNA, 25 bp, Mus musculus
gcttacgctcagacagtccagggcc

SEQ ID NO: 318070 - DNA, 25 bp, Mus musculus
gcttacggactaggccagcaggtgg

SEQ ID NO: 318071 - DNA, 25 bp, Mus musculus
gcttacggactagggccctgcacac

SEQ ID NO: 318072 - DNA, 25 bp, Mus musculus
gcttacggactaggtggccatcaag

SEQ ID NO: 318073 - DNA, 25 bp, Mus musculus
gcttacgtagatgaagaacttcctg

SEQ ID NO: 318074 - DNA, 25 bp, Mus musculus
gcttacgtaggctccatggtgtatt

SEQ ID NO: 318075 - DNA, 25 bp, Mus musculus
gcttacgtcattgggaggaaaactc

SEQ ID NO: 318076 - DNA, 25 bp, Mus musculus
gcttacgtcattgggtgggtgttcg

SEQ ID NO: 318077 - DNA, 25 bp, Mus musculus
gcttactcagactctaaggagggat

SEQ ID NO: 318078 - DNA, 25 bp, Mus musculus
gcttactcaggatgtcaatgggccc

SEQ ID NO: 318079 - DNA, 25 bp, Mus musculus
gcttactctcttagcagtgaagcag

SEQ ID NO: 318080 - DNA, 25 bp, Mus musculus
gcttactgcaccgatcctagttccg

SEQ ID NO: 318081 - DNA, 25 bp, Mus musculus
gcttactggactatccgatacacct

SEQ ID NO: 318082 - DNA, 25 bp, Mus musculus
gcttactggccgcagcaagaacaag

SEQ ID NO: 318083 - DNA, 25 bp, Mus musculus
gcttactggcctttcaggcagcaag

SEQ ID NO: 318084 - DNA, 25 bp, Mus musculus
gcttactgtgagcgtgcaatgatgc

SEQ ID NO: 318085 - DNA, 25 bp, Mus musculus
gcttacttaaaggaagtggaacaac

SEQ ID NO: 318086 - DNA, 25 bp, Mus musculus
gcttacttcagccctgcattttgca

SEQ ID NO: 318087 - DNA, 25 bp, Mus musculus
gcttacttctacagtgatggagaaa

SEQ ID NO: 318088 - DNA, 25 bp, Mus musculus
gcttagaaagagcaactgtcctgtc

SEQ ID NO: 318089 - DNA, 25 bp, Mus musculus
gcttagacaggataaggaagcctgt

SEQ ID NO: 318090 - DNA, 25 bp, Mus musculus
gcttagagagaagaaagaatatctt

SEQ ID NO: 318091 - DNA, 25 bp, Mus musculus
gcttagagagaagaaatctccacag

SEQ ID NO: 318092 - DNA, 25 bp, Mus musculus
gcttagagagaagcaactggtctcc

SEQ ID NO: 318093 - DNA, 25 bp, Mus musculus
gcttagataagaaggtcggagctga

SEQ ID NO: 318094 - DNA, 25 bp, Mus musculus
gcttagatggaaaggtgtcgcaaca

SEQ ID NO: 318095 - DNA, 25 bp, Mus musculus
gcttagcaaggcacaacacgtacct

SEQ ID NO: 318096 - DNA, 25 bp, Mus musculus
gcttagcataaaggcatttacactc

SEQ ID NO: 318097 - DNA, 25 bp, Mus musculus
gcttagcatacagaatatgaacatc

SEQ ID NO: 318098 - DNA, 25 bp, Mus musculus
gcttagcatacaggtccaacccagt

SEQ ID NO: 318099 - DNA, 25 bp, Mus musculus
gcttagccgaggctgtgtgtgtgaa

SEQ ID NO: 318100 - DNA, 25 bp, Mus musculus
gcttagcgagcagggcgtaagaaca

SEQ ID NO: 318101 - DNA, 25 bp, Mus musculus
gcttagctgtgcaagctgacttcgg

SEQ ID NO: 318102 - DNA, 25 bp, Mus musculus
gcttaggaacccagattttgttcct

SEQ ID NO: 318103 - DNA, 25 bp, Mus musculus
gcttaggaccagctcgcaggattaa

SEQ ID NO: 318104 - DNA, 25 bp, Mus musculus
gcttaggacctgggatggattgtaa

SEQ ID NO: 318105 - DNA, 25 bp, Mus musculus
gcttaggagagtgacagctagaata

SEQ ID NO: 318106 - DNA, 25 bp, Mus musculus
gcttaggagccagaagctgactgct

SEQ ID NO: 318107 - DNA, 25 bp, Mus musculus
gcttaggagccagaaggaggctggc

SEQ ID NO: 318108 - DNA, 25 bp, Mus musculus
gcttaggagccagaggaagtcacag

SEQ ID NO: 318109 - DNA, 25 bp, Mus musculus
gcttagtgtggatctgttaagattc

SEQ ID NO: 318110 - DNA, 25 bp, Mus musculus
gcttataagactgaagagggaacaa

SEQ ID NO: 318111 - DNA, 25 bp, Mus musculus
gcttatacctcaagctggcacagtg

SEQ ID NO: 318112 - DNA, 25 bp, Mus musculus
gcttatagtatgagagcatattccg

SEQ ID NO: 318113 - DNA, 25 bp, Mus musculus
gcttatagtatgaggtacctgtcgt

SEQ ID NO: 318114 - DNA, 25 bp, Mus musculus
gcttatagtatgagtgatgtcctcg

SEQ ID NO: 318115 - DNA, 25 bp, Mus musculus
gcttatatggaaagtaaattcagtt

SEQ ID NO: 318116 - DNA, 25 bp, Mus musculus
gcttatatgtgcacatggcgactgc

SEQ ID NO: 318117 - DNA, 25 bp, Mus musculus
gcttatatgtggagctgtgtggaca

SEQ ID NO: 318118 - DNA, 25 bp, Mus musculus
gcttatcatcagcaacagcaacaga

SEQ ID NO: 318119 - DNA, 25 bp, Mus musculus
gcttatccaggttatcttctctgta

SEQ ID NO: 318120 - DNA, 25 bp, Mus musculus
gcttatccatgaaggagcctacaga

SEQ ID NO: 318121 - DNA, 25 bp, Mus musculus
gcttatccatgaaggagtccgctca

SEQ ID NO: 318122 - DNA, 25 bp, Mus musculus
gcttatcctggactgagctcctggc

SEQ ID NO: 318123 - DNA, 25 bp, Mus musculus
gcttatctagggtggaagaaagccc

SEQ ID NO: 318124 - DNA, 25 bp, Mus musculus
gcttatctgaggtggggaaagatca

SEQ ID NO: 318125 - DNA, 25 bp, Mus musculus
gcttatcttcctgagatgctgtccc

SEQ ID NO: 318126 - DNA, 25 bp, Mus musculus
gcttatgaacagatcaagcgggcca

SEQ ID NO: 318127 - DNA, 25 bp, Mus musculus
gcttatgacaaacatttttcagtat

SEQ ID NO: 318128 - DNA, 25 bp, Mus musculus
gcttatgacaggattgtggttgctg

SEQ ID NO: 318129 - DNA, 25 bp, Mus musculus
gcttatgacaggctgaagccatcag

SEQ ID NO: 318130 - DNA, 25 bp, Mus musculus
gcttatgccgtcatgtcccggaaca

SEQ ID NO: 318131 - DNA, 25 bp, Mus musculus
gcttatggagaccacacaggagggg

SEQ ID NO: 318132 - DNA, 25 bp, Mus musculus
gcttatggagcttttagaacgtttt

SEQ ID NO: 318133 - DNA, 25 bp, Mus musculus
gcttatggcagctgctgtgtggatg

SEQ ID NO: 318134 - DNA, 25 bp, Mus musculus
gcttatgggaggtccaaatatcaca

SEQ ID NO: 318135 - DNA, 25 bp, Mus musculus
gcttattaaaaacaatctggaactt

SEQ ID NO: 318136 - DNA, 25 bp, Mus musculus
gcttattatgctggataataagaaa

SEQ ID NO: 318137 - DNA, 25 bp, Mus musculus
gcttattccagaggcatttggattt

SEQ ID NO: 318138 - DNA, 25 bp, Mus musculus
gcttattccaggatggctaatcgcg

SEQ ID NO: 318139 - DNA, 25 bp, Mus musculus
gcttattcctgaagcagaaccacca

SEQ ID NO: 318140 - DNA, 25 bp, Mus musculus
gcttattcctgaaggaggctgtgaa

SEQ ID NO: 318141 - DNA, 25 bp, Mus musculus
gcttattcttttggcctaagatcac

SEQ ID NO: 318142 - DNA, 25 bp, Mus musculus
gcttattgagttcagctatgaactc

SEQ ID NO: 318143 - DNA, 25 bp, Mus musculus
gcttattgccaaagatactgatcaa

SEQ ID NO: 318144 - DNA, 25 bp, Mus musculus
gcttattgccaaagctagttatgaa

SEQ ID NO: 318145 - DNA, 25 bp, Mus musculus
gcttattgccaaagctgcgtctttg

SEQ ID NO: 318146 - DNA, 25 bp, Mus musculus
gcttattgtggggcatgaaggatgg

SEQ ID NO: 318147 - DNA, 25 bp, Mus musculus
gcttattgttcctgacaaccctcca

SEQ ID NO: 318148 - DNA, 25 bp, Mus musculus
gcttattgttcctggtttctctttg

SEQ ID NO: 318149 - DNA, 25 bp, Mus musculus
gcttatttctacatggtctcttcat

SEQ ID NO: 318150 - DNA, 25 bp, Mus musculus
gcttatttgaggagaatgagatcaa

SEQ ID NO: 318151 - DNA, 25 bp, Mus musculus
gcttatttgaggagtttgggctttg

SEQ ID NO: 318152 - DNA, 25 bp, Mus musculus
gcttattttgaagtgatgagactat

SEQ ID NO: 318153 - DNA, 25 bp, Mus musculus
gcttcaaaaatagctcggtcgagga

SEQ ID NO: 318154 - DNA, 25 bp, Mus musculus
gcttcaaacaagttcaaaaggatgc

SEQ ID NO: 318155 - DNA, 25 bp, Mus musculus
gcttcaaagccaaggcaaagctgat

SEQ ID NO: 318156 - DNA, 25 bp, Mus musculus
gcttcaaagccaaggctgcctacct

SEQ ID NO: 318157 - DNA, 25 bp, Mus musculus
gcttcaaatggatagtcacatgctg

SEQ ID NO: 318158 - DNA, 25 bp, Mus musculus
gcttcaacaaaggtgatctgcaatt

SEQ ID NO: 318159 - DNA, 25 bp, Mus musculus
gcttcaacaggaaggtgactgtgga

SEQ ID NO: 318160 - DNA, 25 bp, Mus musculus
gcttcaacagggccatggaggaagc

SEQ ID NO: 318161 - DNA, 25 bp, Mus musculus
gcttcaaccagggccagtccctgtc

SEQ ID NO: 318162 - DNA, 25 bp, Mus musculus
gcttcaagagaaagccttgtttgca

SEQ ID NO: 318163 - DNA, 25 bp, Mus musculus
gcttcaagagaaaggttcaatttta

SEQ ID NO: 318164 - DNA, 25 bp, Mus musculus
gcttcaagaggcttggctttctgag

SEQ ID NO: 318165 - DNA, 25 bp, Mus musculus
gcttcaagcaagtaaaggccggcga

SEQ ID NO: 318166 - DNA, 25 bp, Mus musculus
gcttcaagcagattaacctgtggaa

SEQ ID NO: 318167 - DNA, 25 bp, Mus musculus
gcttcaagcagcatgattgggctga

SEQ ID NO: 318168 - DNA, 25 bp, Mus musculus
gcttcaagcagcgttccacgcctac

SEQ ID NO: 318169 - DNA, 25 bp, Mus musculus
gcttcaagcagtgtggcattgtcct

SEQ ID NO: 318170 - DNA, 25 bp, Mus musculus
gcttcaagccagaagcctgcctgga

SEQ ID NO: 318171 - DNA, 25 bp, Mus musculus
gcttcaaggccaggttgatggaaac

SEQ ID NO: 318172 - DNA, 25 bp, Mus musculus
gcttcaagggcaagatcctatttat

SEQ ID NO: 318173 - DNA, 25 bp, Mus musculus
gcttcaagtgcaaggtcatcttcca

SEQ ID NO: 318174 - DNA, 25 bp, Mus musculus
gcttcaataaagcagttttccacat

SEQ ID NO: 318175 - DNA, 25 bp, Mus musculus
gcttcaatatggaatctttctgaca

SEQ ID NO: 318176 - DNA, 25 bp, Mus musculus
gcttcaatgtttcaggacagtcggc

SEQ ID NO: 318177 - DNA, 25 bp, Mus musculus
gcttcacatacaggagcgacagttt

SEQ ID NO: 318178 - DNA, 25 bp, Mus musculus
gcttcacattgtcagatctcagggc

SEQ ID NO: 318179 - DNA, 25 bp, Mus musculus
gcttcacattgtcagatgtccattc

SEQ ID NO: 318180 - DNA, 25 bp, Mus musculus
gcttcaccaccacctccaaagactg

SEQ ID NO: 318181 - DNA, 25 bp, Mus musculus
gcttcaccacgaccctggtgaacct

SEQ ID NO: 318182 - DNA, 25 bp, Mus musculus
gcttcaccccaggagaaagaaagca

SEQ ID NO: 318183 - DNA, 25 bp, Mus musculus
gcttcaccccaggtgaacaccttta

SEQ ID NO: 318184 - DNA, 25 bp, Mus musculus
gcttcaccccaggtttgtatggaga

SEQ ID NO: 318185 - DNA, 25 bp, Mus musculus
gcttcactagaaagaaaaatgactc

SEQ ID NO: 318186 - DNA, 25 bp, Mus musculus
gcttcactcctggagcaggcagcac

SEQ ID NO: 318187 - DNA, 25 bp, Mus musculus
gcttcactcctggagtagaaaaaga

SEQ ID NO: 318188 - DNA, 25 bp, Mus musculus
gcttcactgcgctggcattgaccaa

SEQ ID NO: 318189 - DNA, 25 bp, Mus musculus
gcttcagaagatggttacggctctg

SEQ ID NO: 318190 - DNA, 25 bp, Mus musculus
gcttcagaaggcacctcttcccttg

SEQ ID NO: 318191 - DNA, 25 bp, Mus musculus
gcttcagaagttaaggaaacatatt

SEQ ID NO: 318192 - DNA, 25 bp, Mus musculus
gcttcagacgcaagaccattcttta

SEQ ID NO: 318193 - DNA, 25 bp, Mus musculus
gcttcagagaaggacagtgtcccca

SEQ ID NO: 318194 - DNA, 25 bp, Mus musculus
gcttcagagaaggatgggggaacca

SEQ ID NO: 318195 - DNA, 25 bp, Mus musculus
gcttcagagactcaggattgaaaag

SEQ ID NO: 318196 - DNA, 25 bp, Mus musculus
gcttcagagagatggtgtcttgtca

SEQ ID NO: 318197 - DNA, 25 bp, Mus musculus
gcttcagagagctgccaggccgcaa

SEQ ID NO: 318198 - DNA, 25 bp, Mus musculus
gcttcagagagtgtttaattccttc

SEQ ID NO: 318199 - DNA, 25 bp, Mus musculus
gcttcagagattttgactttgtctt

SEQ ID NO: 318200 - DNA, 25 bp, Mus musculus
gcttcagagtgagatcatcatccaa

SEQ ID NO: 318201 - DNA, 25 bp, Mus musculus
gcttcagataccacggccagagatc

SEQ ID NO: 318202 - DNA, 25 bp, Mus musculus
gcttcagatcagagttggtgtggac

SEQ ID NO: 318203 - DNA, 25 bp, Mus musculus
gcttcagcagactgagtcgtggtcc

SEQ ID NO: 318204 - DNA, 25 bp, Mus musculus
gcttcagcagcatctacaggggcag

SEQ ID NO: 318205 - DNA, 25 bp, Mus musculus
gcttcagcagctctagccaagagtt

SEQ ID NO: 318206 - DNA, 25 bp, Mus musculus
gcttcagcaggagctgctaagtcgc

SEQ ID NO: 318207 - DNA, 25 bp, Mus musculus
gcttcagcgagggaagcttcttgac

SEQ ID NO: 318208 - DNA, 25 bp, Mus musculus
gcttcagcgccgccgctggagagat

SEQ ID NO: 318209 - DNA, 25 bp, Mus musculus
gcttcagcgtgtctcatactacaag

SEQ ID NO: 318210 - DNA, 25 bp, Mus musculus
gcttcagctgagtgtgacagataac

SEQ ID NO: 318211 - DNA, 25 bp, Mus musculus
gcttcagctgggtggcacagtgatt

SEQ ID NO: 318212 - DNA, 25 bp, Mus musculus
gcttcaggatgagctgcaaaggctg

SEQ ID NO: 318213 - DNA, 25 bp, Mus musculus
gcttcaggcgctagggtctgggaac

SEQ ID NO: 318214 - DNA, 25 bp, Mus musculus
gcttcagggagacacacctgcaaag

SEQ ID NO: 318215 - DNA, 25 bp, Mus musculus
gcttcaggtgaggcctttaccctcc

SEQ ID NO: 318216 - DNA, 25 bp, Mus musculus
gcttcaggttaggattcccaggaaa

SEQ ID NO: 318217 - DNA, 25 bp, Mus musculus
gcttcagtctcgttcgagaaatggc

SEQ ID NO: 318218 - DNA, 25 bp, Mus musculus
gcttcagtggaccaaattttcagga

SEQ ID NO: 318219 - DNA, 25 bp, Mus musculus
gcttcagtggaccagccttcgtggt

SEQ ID NO: 318220 - DNA, 25 bp, Mus musculus
gcttcagttggagcaggccctgcag

SEQ ID NO: 318221 - DNA, 25 bp, Mus musculus
gcttcataactcgaatgaaactttg

SEQ ID NO: 318222 - DNA, 25 bp, Mus musculus
gcttcatcaggaatggccttgatga

SEQ ID NO: 318223 - DNA, 25 bp, Mus musculus
gcttcatcaggagcaagagcagctc

SEQ ID NO: 318224 - DNA, 25 bp, Mus musculus
gcttcatccaaggcgttagacaaac

SEQ ID NO: 318225 - DNA, 25 bp, Mus musculus
gcttcatcctagcggtttgcctgag

SEQ ID NO: 318226 - DNA, 25 bp, Mus musculus
gcttcatctgcaaagaaatcctacg

SEQ ID NO: 318227 - DNA, 25 bp, Mus musculus
gcttcatctgtggcctggagagaga

SEQ ID NO: 318228 - DNA, 25 bp, Mus musculus
gcttcatcttcaggggtcagcagga

SEQ ID NO: 318229 - DNA, 25 bp, Mus musculus
gcttcatgaagaacatatgacatcc

SEQ ID NO: 318230 - DNA, 25 bp, Mus musculus
gcttcatggaagagggtagcacatt

SEQ ID NO: 318231 - DNA, 25 bp, Mus musculus
gcttcatggaagaggtccagaaagt

SEQ ID NO: 318232 - DNA, 25 bp, Mus musculus
gcttcatggactggtgtccaaagac

SEQ ID NO: 318233 - DNA, 25 bp, Mus musculus
gcttcatgggaggatccaaagggaa

SEQ ID NO: 318234 - DNA, 25 bp, Mus musculus
gcttcatgtctggatgtgtctagtc

SEQ ID NO: 318235 - DNA, 25 bp, Mus musculus
gcttcatgtggaaggtgtgaatctg

SEQ ID NO: 318236 - DNA, 25 bp, Mus musculus
gcttcattcaagtgcgcaaacttct

SEQ ID NO: 318237 - DNA, 25 bp, Mus musculus
gcttcattcaatttgatcaagagga

SEQ ID NO: 318238 - DNA, 25 bp, Mus musculus
gcttcattggaggtttaggattagc

SEQ ID NO: 318239 - DNA, 25 bp, Mus musculus
gcttcatttcaggctcctgtggctg

SEQ ID NO: 318240 - DNA, 25 bp, Mus musculus
gcttccaaagcacaggctggctcgg

SEQ ID NO: 318241 - DNA, 25 bp, Mus musculus
gcttccaaagcagatcctggagtaa

SEQ ID NO: 318242 - DNA, 25 bp, Mus musculus
gcttccaaagccacccgcggtcagc

SEQ ID NO: 318243 - DNA, 25 bp, Mus musculus
gcttccaaagccaggtgtcagatgt

SEQ ID NO: 318244 - DNA, 25 bp, Mus musculus
gcttccaaagcgcggctgggttcct

SEQ ID NO: 318245 - DNA, 25 bp, Mus musculus
gcttccaacatactgcagggttgtg

SEQ ID NO: 318246 - DNA, 25 bp, Mus musculus
gcttccaatacaagcacaggggagt

SEQ ID NO: 318247 - DNA, 25 bp, Mus musculus
gcttccaatccagagacctcttttc

SEQ ID NO: 318248 - DNA, 25 bp, Mus musculus
gcttccaatccagcctgaggtctcc

SEQ ID NO: 318249 - DNA, 25 bp, Mus musculus
gcttccacactgaggtgcactggca

SEQ ID NO: 318250 - DNA, 25 bp, Mus musculus
gcttccacagaaactcaagtcaagg

SEQ ID NO: 318251 - DNA, 25 bp, Mus musculus
gcttccacagaccatgccttaagaa

SEQ ID NO: 318252 - DNA, 25 bp, Mus musculus
gcttccacagccggagagtcaaaca

SEQ ID NO: 318253 - DNA, 25 bp, Mus musculus
gcttccacaggattttcaccttgta

SEQ ID NO: 318254 - DNA, 25 bp, Mus musculus
gcttccacaggtttcctttggatcc

SEQ ID NO: 318255 - DNA, 25 bp, Mus musculus
gcttccaccgcagtgtgaagaaaaa

SEQ ID NO: 318256 - DNA, 25 bp, Mus musculus
gcttccaccgttgtggccagaaccc

SEQ ID NO: 318257 - DNA, 25 bp, Mus musculus
gcttccacctagggactgccgcttc

SEQ ID NO: 318258 - DNA, 25 bp, Mus musculus
gcttccacctgtcacagcaaactgg

SEQ ID NO: 318259 - DNA, 25 bp, Mus musculus
gcttccacgacagctccctcttgat

SEQ ID NO: 318260 - DNA, 25 bp, Mus musculus
gcttccacgccacttgtcggcagct

SEQ ID NO: 318261 - DNA, 25 bp, Mus musculus
gcttccactaaagattcagagtcac

SEQ ID NO: 318262 - DNA, 25 bp, Mus musculus
gcttccactctggtcagacatggtt

SEQ ID NO: 318263 - DNA, 25 bp, Mus musculus
gcttccagaaaaatgaaactgtgaa

SEQ ID NO: 318264 - DNA, 25 bp, Mus musculus
gcttccagatggcctaccttcttgc

SEQ ID NO: 318265 - DNA, 25 bp, Mus musculus
gcttccagcagaataacaacaagcc

SEQ ID NO: 318266 - DNA, 25 bp, Mus musculus
gcttccagcagacatccttctacgg

SEQ ID NO: 318267 - DNA, 25 bp, Mus musculus
gcttccaggcagtgctgaaaaccaa

SEQ ID NO: 318268 - DNA, 25 bp, Mus musculus
gcttccaggcatgctcagggtatgg

SEQ ID NO: 318269 - DNA, 25 bp, Mus musculus
gcttccaggttcaggtgttggcagc

SEQ ID NO: 318270 - DNA, 25 bp, Mus musculus
gcttccatcagacctgaggtccaac

SEQ ID NO: 318271 - DNA, 25 bp, Mus musculus
gcttccatccgagattgagcttgaa

SEQ ID NO: 318272 - DNA, 25 bp, Mus musculus
gcttccatccgagcctgacctgatg

SEQ ID NO: 318273 - DNA, 25 bp, Mus musculus
gcttccatccgagtggcagcaagtt

SEQ ID NO: 318274 - DNA, 25 bp, Mus musculus
gcttccatctacaggcctgtccact

SEQ ID NO: 318275 - DNA, 25 bp, Mus musculus
gcttccatcttcaagccttctgtgg

SEQ ID NO: 318276 - DNA, 25 bp, Mus musculus
gcttccatgaaagagacaggtgttg

SEQ ID NO: 318277 - DNA, 25 bp, Mus musculus
gcttccattgaaagaggcttcatca

SEQ ID NO: 318278 - DNA, 25 bp, Mus musculus
gcttccatttctgcaaggagtcctg

SEQ ID NO: 318279 - DNA, 25 bp, Mus musculus
gcttcccaaaaatgtatccatcgag

SEQ ID NO: 318280 - DNA, 25 bp, Mus musculus
gcttcccaatcctcaaccagttctg

SEQ ID NO: 318281 - DNA, 25 bp, Mus musculus
gcttcccaatcctcgagccctgaca

SEQ ID NO: 318282 - DNA, 25 bp, Mus musculus
gcttcccagaagaatctgatgccaa

SEQ ID NO: 318283 - DNA, 25 bp, Mus musculus
gcttcccagatgaatgcactgatcc

SEQ ID NO: 318284 - DNA, 25 bp, Mus musculus
gcttcccagggccaacaggtgaccg

SEQ ID NO: 318285 - DNA, 25 bp, Mus musculus
gcttcccagggggatatccgcctga

SEQ ID NO: 318286 - DNA, 25 bp, Mus musculus
gcttccccacccaggcctggatacc

SEQ ID NO: 318287 - DNA, 25 bp, Mus musculus
gcttccccagagaacacagcaggga

SEQ ID NO: 318288 - DNA, 25 bp, Mus musculus
gcttccccatcaagatcccacgcaa

SEQ ID NO: 318289 - DNA, 25 bp, Mus musculus
gcttccccatctggcatgcccacgt

SEQ ID NO: 318290 - DNA, 25 bp, Mus musculus
gcttccccatgagaggtagctaagt

SEQ ID NO: 318291 - DNA, 25 bp, Mus musculus
gcttcccccagcagactggagggtg

SEQ ID NO: 318292 - DNA, 25 bp, Mus musculus
gcttccccctggagtcctttcactg

SEQ ID NO: 318293 - DNA, 25 bp, Mus musculus
gcttcccctcagtgaatgtggctct

SEQ ID NO: 318294 - DNA, 25 bp, Mus musculus
gcttcccctgtgaccctagtctctc

SEQ ID NO: 318295 - DNA, 25 bp, Mus musculus
gcttcccggagacaactagctgtgt

SEQ ID NO: 318296 - DNA, 25 bp, Mus musculus
gcttcccggagagccttacgagaga

SEQ ID NO: 318297 - DNA, 25 bp, Mus musculus
gcttcccggagcacttggaatctcc

SEQ ID NO: 318298 - DNA, 25 bp, Mus musculus
gcttccctcaggcgaaaatatttct

SEQ ID NO: 318299 - DNA, 25 bp, Mus musculus
gcttccctcgcaacctcctgacctc

SEQ ID NO: 318300 - DNA, 25 bp, Mus musculus
gcttccctcgcggggctgcggtccc

SEQ ID NO: 318301 - DNA, 25 bp, Mus musculus
gcttccctcggaggcacgcgcctac

SEQ ID NO: 318302 - DNA, 25 bp, Mus musculus
gcttccctcggagtacaacacagaa

SEQ ID NO: 318303 - DNA, 25 bp, Mus musculus
gcttccctgagctgggaacactcca

SEQ ID NO: 318304 - DNA, 25 bp, Mus musculus
gcttccctgcaagatatggttgcag

SEQ ID NO: 318305 - DNA, 25 bp, Mus musculus
gcttccctgcaaggagtgttacggc

SEQ ID NO: 318306 - DNA, 25 bp, Mus musculus
gcttccctgcccgaagggacagttt

SEQ ID NO: 318307 - DNA, 25 bp, Mus musculus
gcttccctgctacagcaacttctcc

SEQ ID NO: 318308 - DNA, 25 bp, Mus musculus
gcttccctggcacagaaacatcatc

SEQ ID NO: 318309 - DNA, 25 bp, Mus musculus
gcttccctggctaagcaagcttccc

SEQ ID NO: 318310 - DNA, 25 bp, Mus musculus
gcttccctgtctgtacctacagccg

SEQ ID NO: 318311 - DNA, 25 bp, Mus musculus
gcttccctgtttcagcaaccttcca

SEQ ID NO: 318312 - DNA, 25 bp, Mus musculus
gcttccctgtttcagcaaccttccc

SEQ ID NO: 318313 - DNA, 25 bp, Mus musculus
gcttccctgtttcagcaagcttccc

SEQ ID NO: 318314 - DNA, 25 bp, Mus musculus
gcttccctgtttcagcaagtttccc

SEQ ID NO: 318315 - DNA, 25 bp, Mus musculus
gcttccctgtttcagcaatcttccc

SEQ ID NO: 318316 - DNA, 25 bp, Mus musculus
gcttccctgtttcagcttccctgtt

SEQ ID NO: 318317 - DNA, 25 bp, Mus musculus
gcttccctgtttcaggattattttt

SEQ ID NO: 318318 - DNA, 25 bp, Mus musculus
gcttccgaccattagccaagtccag

SEQ ID NO: 318319 - DNA, 25 bp, Mus musculus
gcttccgagcaggggaagagttgct

SEQ ID NO: 318320 - DNA, 25 bp, Mus musculus
gcttccgagtccctcctggggggtc

SEQ ID NO: 318321 - DNA, 25 bp, Mus musculus
gcttccgatcaattcgaagccgatt

SEQ ID NO: 318322 - DNA, 25 bp, Mus musculus
gcttccgatcaggagagaaaagaaa

SEQ ID NO: 318323 - DNA, 25 bp, Mus musculus
gcttccgatccttacctcgtgaggc

SEQ ID NO: 318324 - DNA, 25 bp, Mus musculus
gcttccgcaggcgccatggaaaagg

SEQ ID NO: 318325 - DNA, 25 bp, Mus musculus
gcttccgcgtcgagatttggtgact

SEQ ID NO: 318326 - DNA, 25 bp, Mus musculus
gcttccggaaggaactggtgagcag

SEQ ID NO: 318327 - DNA, 25 bp, Mus musculus
gcttccggaaggcctctggattctc

SEQ ID NO: 318328 - DNA, 25 bp, Mus musculus
gcttccggagatatgacgtgttcac

SEQ ID NO: 318329 - DNA, 25 bp, Mus musculus
gcttccggagtttgtgatcctgtgc

SEQ ID NO: 318330 - DNA, 25 bp, Mus musculus
gcttccggtcagatgttcacacgga

SEQ ID NO: 318331 - DNA, 25 bp, Mus musculus
gcttccgtatctatttctgccaaat

SEQ ID NO: 318332 - DNA, 25 bp, Mus musculus
gcttccgtatctttttctgccaaat

SEQ ID NO: 318333 - DNA, 25 bp, Mus musculus
gcttccgttaaaggtcacacaactg

SEQ ID NO: 318334 - DNA, 25 bp, Mus musculus
gcttcctagagaccaagatcacaag

SEQ ID NO: 318335 - DNA, 25 bp, Mus musculus
gcttcctagcagaggaaaagaagct

SEQ ID NO: 318336 - DNA, 25 bp, Mus musculus
gcttcctagcaggagtgatgatgtg

SEQ ID NO: 318337 - DNA, 25 bp, Mus musculus
gcttcctaggatggtggcccagatg

SEQ ID NO: 318338 - DNA, 25 bp, Mus musculus
gcttcctatcgacatcccaggcgag

SEQ ID NO: 318339 - DNA, 25 bp, Mus musculus
gcttcctatcggcctttcagacatc

SEQ ID NO: 318340 - DNA, 25 bp, Mus musculus
gcttcctcaagctgagtcctgagag

SEQ ID NO: 318341 - DNA, 25 bp, Mus musculus
gcttcctcaagctggcagcagtgac

SEQ ID NO: 318342 - DNA, 25 bp, Mus musculus
gcttcctcacactcagagccttcca

SEQ ID NO: 318343 - DNA, 25 bp, Mus musculus
gcttcctcagacgctgactcatccc

SEQ ID NO: 318344 - DNA, 25 bp, Mus musculus
gcttcctcagcactggagacaagca

SEQ ID NO: 318345 - DNA, 25 bp, Mus musculus
gcttcctcagcatggctggaccgct

SEQ ID NO: 318346 - DNA, 25 bp, Mus musculus
gcttcctcagtgtggcttgacctaa

SEQ ID NO: 318347 - DNA, 25 bp, Mus musculus
gcttcctcataaggtcacgttcatg

SEQ ID NO: 318348 - DNA, 25 bp, Mus musculus
gcttcctccaggatggattcatggg

SEQ ID NO: 318349 - DNA, 25 bp, Mus musculus
gcttcctcgtccttgagagatgcca

SEQ ID NO: 318350 - DNA, 25 bp, Mus musculus
gcttcctcttcagcagccgctcttc

SEQ ID NO: 318351 - DNA, 25 bp, Mus musculus
gcttcctcttcgttattttaactgt

SEQ ID NO: 318352 - DNA, 25 bp, Mus musculus
gcttcctgaagccccagtcttatta

SEQ ID NO: 318353 - DNA, 25 bp, Mus musculus
gcttcctgaagggatgggctcttcc

SEQ ID NO: 318354 - DNA, 25 bp, Mus musculus
gcttcctgagaggctggcctccaca

SEQ ID NO: 318355 - DNA, 25 bp, Mus musculus
gcttcctgagagtgcccgaggcgcc

SEQ ID NO: 318356 - DNA, 25 bp, Mus musculus
gcttcctgagatgaagaaactgaaa

SEQ ID NO: 318357 - DNA, 25 bp, Mus musculus
gcttcctgagtggtatccttggcat

SEQ ID NO: 318358 - DNA, 25 bp, Mus musculus
gcttcctgatgaagttatagtgcct

SEQ ID NO: 318359 - DNA, 25 bp, Mus musculus
gcttcctgatgaatgtcattggtct

SEQ ID NO: 318360 - DNA, 25 bp, Mus musculus
gcttcctgatgaggagtctctgttt

SEQ ID NO: 318361 - DNA, 25 bp, Mus musculus
gcttcctgcagccaggtgggaagat

SEQ ID NO: 318362 - DNA, 25 bp, Mus musculus
gcttcctgccccagaaaacatcgga

SEQ ID NO: 318363 - DNA, 25 bp, Mus musculus
gcttcctgcctggcacggcgcagga

SEQ ID NO: 318364 - DNA, 25 bp, Mus musculus
gcttcctgcggcagagagtacttca

SEQ ID NO: 318365 - DNA, 25 bp, Mus musculus
gcttcctggacaagaggggaagtcc

SEQ ID NO: 318366 - DNA, 25 bp, Mus musculus
gcttcctggacaaggtagagcctca

SEQ ID NO: 318367 - DNA, 25 bp, Mus musculus
gcttcctggatgtccagaaggatgc

SEQ ID NO: 318368 - DNA, 25 bp, Mus musculus
gcttcctgggcacctgactcagcgt

SEQ ID NO: 318369 - DNA, 25 bp, Mus musculus
gcttcctggtagtcccatattatga

SEQ ID NO: 318370 - DNA, 25 bp, Mus musculus
gcttcctgtccgtacagagactcag

SEQ ID NO: 318371 - DNA, 25 bp, Mus musculus
gcttcctgtttgcagtatgatctgg

SEQ ID NO: 318372 - DNA, 25 bp, Mus musculus
gcttccttaagacagatgggagctt

SEQ ID NO: 318373 - DNA, 25 bp, Mus musculus
gcttccttcatccgctctgctttcc

SEQ ID NO: 318374 - DNA, 25 bp, Mus musculus
gcttcctttccgtagccagcccagg

SEQ ID NO: 318375 - DNA, 25 bp, Mus musculus
gcttcctttgaggaggattctggag

SEQ ID NO: 318376 - DNA, 25 bp, Mus musculus
gcttcctttgcttggccacagacaa

SEQ ID NO: 318377 - DNA, 25 bp, Mus musculus
gcttcgaaattacaggaagctctcg

SEQ ID NO: 318378 - DNA, 25 bp, Mus musculus
gcttcgaagaaagaagatggacgac

SEQ ID NO: 318379 - DNA, 25 bp, Mus musculus
gcttcgaatgcctggtgcagccgga

SEQ ID NO: 318380 - DNA, 25 bp, Mus musculus
gcttcgagaaaagatgagagtcacg

SEQ ID NO: 318381 - DNA, 25 bp, Mus musculus
gcttcgagaaaaggaaaatgagaag

SEQ ID NO: 318382 - DNA, 25 bp, Mus musculus
gcttcgagaacgaagaaagaaacag

SEQ ID NO: 318383 - DNA, 25 bp, Mus musculus
gcttcgagaacgtgactacgagaag

SEQ ID NO: 318384 - DNA, 25 bp, Mus musculus
gcttcgagaagaatttccgtgtgga

SEQ ID NO: 318385 - DNA, 25 bp, Mus musculus
gcttcgagaaggccaaagaatcttg

SEQ ID NO: 318386 - DNA, 25 bp, Mus musculus
gcttcgagaaggtgccgacaatggc

SEQ ID NO: 318387 - DNA, 25 bp, Mus musculus
gcttcgagaagtacgatgaagacca

SEQ ID NO: 318388 - DNA, 25 bp, Mus musculus
gcttcgagtcacaggcctgagggcc

SEQ ID NO: 318389 - DNA, 25 bp, Mus musculus
gcttcgagtcacagggggtgacatg

SEQ ID NO: 318390 - DNA, 25 bp, Mus musculus
gcttcgccatgcagtggccccggga

SEQ ID NO: 318391 - DNA, 25 bp, Mus musculus
gcttcgccatggtagcgatggtgga

SEQ ID NO: 318392 - DNA, 25 bp, Mus musculus
gcttcgccatggtggccatggtgga

SEQ ID NO: 318393 - DNA, 25 bp, Mus musculus
gcttcgccatgtactattttaccta

SEQ ID NO: 318394 - DNA, 25 bp, Mus musculus
gcttcggaaagtccttcaggctccc

SEQ ID NO: 318395 - DNA, 25 bp, Mus musculus
gcttcggaatgagaaaaaggagaag

SEQ ID NO: 318396 - DNA, 25 bp, Mus musculus
gcttcggacccacatggtggacctg

SEQ ID NO: 318397 - DNA, 25 bp, Mus musculus
gcttcggagaagatgtggacccctg

SEQ ID NO: 318398 - DNA, 25 bp, Mus musculus
gcttcggagaaggcctcctgccaga

SEQ ID NO: 318399 - DNA, 25 bp, Mus musculus
gcttcggcaaaaatgagtctcatag

SEQ ID NO: 318400 - DNA, 25 bp, Mus musculus
gcttcggcaagcaaggcttataccc

SEQ ID NO: 318401 - DNA, 25 bp, Mus musculus
gcttcggcaggttttgtcgctaacc

SEQ ID NO: 318402 - DNA, 25 bp, Mus musculus
gcttcgggactacctccccgggatg

SEQ ID NO: 318403 - DNA, 25 bp, Mus musculus
gcttcgggactagctccccgggatg

SEQ ID NO: 318404 - DNA, 25 bp, Mus musculus
gcttcgggcagctgctgattcacgg

SEQ ID NO: 318405 - DNA, 25 bp, Mus musculus
gcttcgggcccagctctccagtcta

SEQ ID NO: 318406 - DNA, 25 bp, Mus musculus
gcttcgggggccagccgccgccatg

SEQ ID NO: 318407 - DNA, 25 bp, Mus musculus
gcttcgggtagccggagtatgccgc

SEQ ID NO: 318408 - DNA, 25 bp, Mus musculus
gcttcggtctccagattcgcctcta

SEQ ID NO: 318409 - DNA, 25 bp, Mus musculus
gcttcggtgagagctcaaggcttct

SEQ ID NO: 318410 - DNA, 25 bp, Mus musculus
gcttcggtgtcaggaggacatgtct

SEQ ID NO: 318411 - DNA, 25 bp, Mus musculus
gcttcggtgtcaggggacactctta

SEQ ID NO: 318412 - DNA, 25 bp, Mus musculus
gcttcgtatcctagagaggtgctcg

SEQ ID NO: 318413 - DNA, 25 bp, Mus musculus
gcttcgtcccatggtccttcagagg

SEQ ID NO: 318414 - DNA, 25 bp, Mus musculus
gcttcgtggcgaagcagcaggatgt

SEQ ID NO: 318415 - DNA, 25 bp, Mus musculus
gcttcgtggcgatcaagaagaagca

SEQ ID NO: 318416 - DNA, 25 bp, Mus musculus
gcttcgtggctggcggactatttca

SEQ ID NO: 318417 - DNA, 25 bp, Mus musculus
gcttcgtggctggtttgactcagaa

SEQ ID NO: 318418 - DNA, 25 bp, Mus musculus
gcttcgttcttagatgagcccaggt

SEQ ID NO: 318419 - DNA, 25 bp, Mus musculus
gcttcgttttcacaggggccgatca

SEQ ID NO: 318420 - DNA, 25 bp, Mus musculus
gcttctaaagaaaggtattgaggct

SEQ ID NO: 318421 - DNA, 25 bp, Mus musculus
gcttctaaccactcacaatcagcgg

SEQ ID NO: 318422 - DNA, 25 bp, Mus musculus
gcttctaactcaggaaggcgaagtg

SEQ ID NO: 318423 - DNA, 25 bp, Mus musculus
gcttctaatcaccaagccccgccca

SEQ ID NO: 318424 - DNA, 25 bp, Mus musculus
gcttctactcaaattctggaatatc

SEQ ID NO: 318425 - DNA, 25 bp, Mus musculus
gcttctacttgtcagattgctgccc

SEQ ID NO: 318426 - DNA, 25 bp, Mus musculus
gcttctagacccaggagttttgctc

SEQ ID NO: 318427 - DNA, 25 bp, Mus musculus
gcttctagagatcatgagggcccac

SEQ ID NO: 318428 - DNA, 25 bp, Mus musculus
gcttctagagcctgtttctctctct

SEQ ID NO: 318429 - DNA, 25 bp, Mus musculus
gcttctagggacagaacaacagctt

SEQ ID NO: 318430 - DNA, 25 bp, Mus musculus
gcttctagtgccgcttctcgaatga

SEQ ID NO: 318431 - DNA, 25 bp, Mus musculus
gcttctatgaggttgactgtgggtt

SEQ ID NO: 318432 - DNA, 25 bp, Mus musculus
gcttctattaacagcttcgaccttg

SEQ ID NO: 318433 - DNA, 25 bp, Mus musculus
gcttctcaccaaggtctgagtacct

SEQ ID NO: 318434 - DNA, 25 bp, Mus musculus
gcttctcaccgcttagaattacata

SEQ ID NO: 318435 - DNA, 25 bp, Mus musculus
gcttctcaccgggcgagcctttcct

SEQ ID NO: 318436 - DNA, 25 bp, Mus musculus
gcttctcaccggtgcacgcctcctc

SEQ ID NO: 318437 - DNA, 25 bp, Mus musculus
gcttctcaccgttatcctaggcgtc

SEQ ID NO: 318438 - DNA, 25 bp, Mus musculus
gcttctcagtagtgatcaagctcgg

SEQ ID NO: 318439 - DNA, 25 bp, Mus musculus
gcttctccaagactctaaaaaacga

SEQ ID NO: 318440 - DNA, 25 bp, Mus musculus
gcttctccaagaggctactgaaaga

SEQ ID NO: 318441 - DNA, 25 bp, Mus musculus
gcttctccaccatcccttccagata

SEQ ID NO: 318442 - DNA, 25 bp, Mus musculus
gcttctccaggagagggaagaatta

SEQ ID NO: 318443 - DNA, 25 bp, Mus musculus
gcttctcccaaattaaatgatgaac

SEQ ID NO: 318444 - DNA, 25 bp, Mus musculus
gcttctcccacagtgcgtgctatta

SEQ ID NO: 318445 - DNA, 25 bp, Mus musculus
gcttctcccaggaagcctcaaggag

SEQ ID NO: 318446 - DNA, 25 bp, Mus musculus
gcttctcccaggaagcgtgcccaac

SEQ ID NO: 318447 - DNA, 25 bp, Mus musculus
gcttctcccaggaagtgcaaagagg

SEQ ID NO: 318448 - DNA, 25 bp, Mus musculus
gcttctccctccggaaagaacaagt

SEQ ID NO: 318449 - DNA, 25 bp, Mus musculus
gcttctccgagaacgggcagagaaa

SEQ ID NO: 318450 - DNA, 25 bp, Mus musculus
gcttctccgcaaaggcaccaccttc

SEQ ID NO: 318451 - DNA, 25 bp, Mus musculus
gcttctccgcaaagggtacacgcag

SEQ ID NO: 318452 - DNA, 25 bp, Mus musculus
gcttctcctgcagcgagcttcaagc

SEQ ID NO: 318453 - DNA, 25 bp, Mus musculus
gcttctcctgcagcgatatcgatga

SEQ ID NO: 318454 - DNA, 25 bp, Mus musculus
gcttctcctgggagggtcatctatg

SEQ ID NO: 318455 - DNA, 25 bp, Mus musculus
gcttctcctgggttggattgatctc

SEQ ID NO: 318456 - DNA, 25 bp, Mus musculus
gcttctcctggtggaccacagacca

SEQ ID NO: 318457 - DNA, 25 bp, Mus musculus
gcttctcgactgagggtccaaacct

SEQ ID NO: 318458 - DNA, 25 bp, Mus musculus
gcttctcgctgggaaatctacaaaa

SEQ ID NO: 318459 - DNA, 25 bp, Mus musculus
gcttctcgtgtaaggatcttctgcc

SEQ ID NO: 318460 - DNA, 25 bp, Mus musculus
gcttctcgttggtgcctttgtgcct

SEQ ID NO: 318461 - DNA, 25 bp, Mus musculus
gcttctctccagtggtggatgtgaa

SEQ ID NO: 318462 - DNA, 25 bp, Mus musculus
gcttctctccttggtcacgcccggg

SEQ ID NO: 318463 - DNA, 25 bp, Mus musculus
gcttctctctcggtggagacacaga

SEQ ID NO: 318464 - DNA, 25 bp, Mus musculus
gcttctctctgcaggtcaggaatct

SEQ ID NO: 318465 - DNA, 25 bp, Mus musculus
gcttctctctgcaggttaatatccg

SEQ ID NO: 318466 - DNA, 25 bp, Mus musculus
gcttctctcttccacttgtagtgta

SEQ ID NO: 318467 - DNA, 25 bp, Mus musculus
gcttctctgggtctgtgaactcgtc

SEQ ID NO: 318468 - DNA, 25 bp, Mus musculus
gcttctctgtctagggctgacggtt

SEQ ID NO: 318469 - DNA, 25 bp, Mus musculus
gcttctctgtggaataaatttgtgg

SEQ ID NO: 318470 - DNA, 25 bp, Mus musculus
gcttctgaaacctcaggtggaaccg

SEQ ID NO: 318471 - DNA, 25 bp, Mus musculus
gcttctgaaggagacccagcatgtg

SEQ ID NO: 318472 - DNA, 25 bp, Mus musculus
gcttctgaaggagccggcatgacca

SEQ ID NO: 318473 - DNA, 25 bp, Mus musculus
gcttctgacaatcgaatcccgccta

SEQ ID NO: 318474 - DNA, 25 bp, Mus musculus
gcttctgacaatggaatcccgccta

SEQ ID NO: 318475 - DNA, 25 bp, Mus musculus
gcttctgagaaagattgtctaaagc

SEQ ID NO: 318476 - DNA, 25 bp, Mus musculus
gcttctgcaaaagaaatacaaagag

SEQ ID NO: 318477 - DNA, 25 bp, Mus musculus
gcttctgcaaaagagctgcagggat

SEQ ID NO: 318478 - DNA, 25 bp, Mus musculus
gcttctgcaaggttctgtccccctg

SEQ ID NO: 318479 - DNA, 25 bp, Mus musculus
gcttctgcacagacttggagcagtt

SEQ ID NO: 318480 - DNA, 25 bp, Mus musculus
gcttctgcacgcccctccaggccgg

SEQ ID NO: 318481 - DNA, 25 bp, Mus musculus
gcttctgcagaaggtttcaacacta

SEQ ID NO: 318482 - DNA, 25 bp, Mus musculus
gcttctgcagctggcactggggctg

SEQ ID NO: 318483 - DNA, 25 bp, Mus musculus
gcttctgccaaggacctccctgcac

SEQ ID NO: 318484 - DNA, 25 bp, Mus musculus
gcttctgccaaggcgcagcacctcc

SEQ ID NO: 318485 - DNA, 25 bp, Mus musculus
gcttctgcccaggtgagaggtgttg

SEQ ID NO: 318486 - DNA, 25 bp, Mus musculus
gcttctgccccaggtgtaaagaaga

SEQ ID NO: 318487 - DNA, 25 bp, Mus musculus
gcttctgccttgtccccacagagag

SEQ ID NO: 318488 - DNA, 25 bp, Mus musculus
gcttctgcgaaactgaagaagatgc

SEQ ID NO: 318489 - DNA, 25 bp, Mus musculus
gcttctgcgggtgcttctgtttccg

SEQ ID NO: 318490 - DNA, 25 bp, Mus musculus
gcttctgctacagcggctgtacagc

SEQ ID NO: 318491 - DNA, 25 bp, Mus musculus
gcttctgctacaggagtcagcagcc

SEQ ID NO: 318492 - DNA, 25 bp, Mus musculus
gcttctgctgtatgggtggtctatc

SEQ ID NO: 318493 - DNA, 25 bp, Mus musculus
gcttctgctgtatggtgcccagcac

SEQ ID NO: 318494 - DNA, 25 bp, Mus musculus
gcttctggagaagctccagcacccg

SEQ ID NO: 318495 - DNA, 25 bp, Mus musculus
gcttctggaggcaaggatggccagg

SEQ ID NO: 318496 - DNA, 25 bp, Mus musculus
gcttctggaggcaaggctatgctgt

SEQ ID NO: 318497 - DNA, 25 bp, Mus musculus
gcttctggagggtgatgcccacgtg

SEQ ID NO: 318498 - DNA, 25 bp, Mus musculus
gcttctggcctcagatgccctgctg

SEQ ID NO: 318499 - DNA, 25 bp, Mus musculus
gcttctgggaggttgggaactacaa

SEQ ID NO: 318500 - DNA, 25 bp, Mus musculus
gcttctgggcgaggaaaaagtaaag

SEQ ID NO: 318501 - DNA, 25 bp, Mus musculus
gcttctgggcgaggagagaacacat

SEQ ID NO: 318502 - DNA, 25 bp, Mus musculus
gcttctggggaaggtgcagctggat

SEQ ID NO: 318503 - DNA, 25 bp, Mus musculus
gcttctgggtcagggggattgatgt

SEQ ID NO: 318504 - DNA, 25 bp, Mus musculus
gcttctggtttcaaggtgacagatc

SEQ ID NO: 318505 - DNA, 25 bp, Mus musculus
gcttctgtaagcatggtcccctgtg

SEQ ID NO: 318506 - DNA, 25 bp, Mus musculus
gcttctgtagaaaggaacatgtctc

SEQ ID NO: 318507 - DNA, 25 bp, Mus musculus
gcttctgtcggacggggctgaaaag

SEQ ID NO: 318508 - DNA, 25 bp, Mus musculus
gcttctgtcggacttagaagaattg

SEQ ID NO: 318509 - DNA, 25 bp, Mus musculus
gcttctgtgaagtcaccttaatttt

SEQ ID NO: 318510 - DNA, 25 bp, Mus musculus
gcttctgtgcacacatgtctgagag

SEQ ID NO: 318511 - DNA, 25 bp, Mus musculus
gcttctgtgctaacctcaggaggaa

SEQ ID NO: 318512 - DNA, 25 bp, Mus musculus
gcttctgtgggttagcgctaactgt

SEQ ID NO: 318513 - DNA, 25 bp, Mus musculus
gcttctgtgtcaagcccaacaagct

SEQ ID NO: 318514 - DNA, 25 bp, Mus musculus
gcttctgttaggtgctggagagtca

SEQ ID NO: 318515 - DNA, 25 bp, Mus musculus
gcttctgttcaggatatagatctga

SEQ ID NO: 318516 - DNA, 25 bp, Mus musculus
gcttctgttggagataccttcctat

SEQ ID NO: 318517 - DNA, 25 bp, Mus musculus
gcttctgtttccgggtgccatgcag

SEQ ID NO: 318518 - DNA, 25 bp, Mus musculus
gcttctgtttgaggttcctgggtgg

SEQ ID NO: 318519 - DNA, 25 bp, Mus musculus
gcttcttaatataacttgcaccgat

SEQ ID NO: 318520 - DNA, 25 bp, Mus musculus
gcttcttagtcaagggtctcatgta

SEQ ID NO: 318521 - DNA, 25 bp, Mus musculus
gcttcttagtcaaggttggcttcct

SEQ ID NO: 318522 - DNA, 25 bp, Mus musculus
gcttcttattggacaagtgcaactg

SEQ ID NO: 318523 - DNA, 25 bp, Mus musculus
gcttcttcacgtgacctgacagtga

SEQ ID NO: 318524 - DNA, 25 bp, Mus musculus
gcttcttcagacgaacagtcagcaa

SEQ ID NO: 318525 - DNA, 25 bp, Mus musculus
gcttcttcagcactggagaccagca

SEQ ID NO: 318526 - DNA, 25 bp, Mus musculus
gcttcttcaggactctttcatggag

SEQ ID NO: 318527 - DNA, 25 bp, Mus musculus
gcttcttcagtacaggctatgtttg

SEQ ID NO: 318528 - DNA, 25 bp, Mus musculus
gcttcttcagtgatactgtcagcag

SEQ ID NO: 318529 - DNA, 25 bp, Mus musculus
gcttcttccagccctgagatgctca

SEQ ID NO: 318530 - DNA, 25 bp, Mus musculus
gcttcttcccatcagcccaggccac

SEQ ID NO: 318531 - DNA, 25 bp, Mus musculus
gcttcttctcgaccaacttgcagcg

SEQ ID NO: 318532 - DNA, 25 bp, Mus musculus
gcttcttcttgaaatctacccagaa

SEQ ID NO: 318533 - DNA, 25 bp, Mus musculus
gcttcttgaaaggaactctgttgat

SEQ ID NO: 318534 - DNA, 25 bp, Mus musculus
gcttcttgccggccccgcccccgcc

SEQ ID NO: 318535 - DNA, 25 bp, Mus musculus
gcttcttgccgggatctgacccaga

SEQ ID NO: 318536 - DNA, 25 bp, Mus musculus
gcttcttggaaccctaagctgggct

SEQ ID NO: 318537 - DNA, 25 bp, Mus musculus
gcttctttacccacgtttttgcagc

SEQ ID NO: 318538 - DNA, 25 bp, Mus musculus
gcttctttagctctcctcacatggt

SEQ ID NO: 318539 - DNA, 25 bp, Mus musculus
gcttctttaggacgacagccatgtc

SEQ ID NO: 318540 - DNA, 25 bp, Mus musculus
gcttctttaggtctcctcacatggt

SEQ ID NO: 318541 - DNA, 25 bp, Mus musculus
gcttctttcagacaagcgtgagaat

SEQ ID NO: 318542 - DNA, 25 bp, Mus musculus
gcttctttcccgagggagcacgggt

SEQ ID NO: 318543 - DNA, 25 bp, Mus musculus
gcttctttcccgaggtgttcaccta

SEQ ID NO: 318544 - DNA, 25 bp, Mus musculus
gcttctttctttgaaggtgacgggc

SEQ ID NO: 318545 - DNA, 25 bp, Mus musculus
gcttctttgaggactccagattcca

SEQ ID NO: 318546 - DNA, 25 bp, Mus musculus
gcttcttttgggatccgagcaccag

SEQ ID NO: 318547 - DNA, 25 bp, Mus musculus
gcttctttttttcctactcactgtg

SEQ ID NO: 318548 - DNA, 25 bp, Mus musculus
gcttgaaaagacactgagtcctcga

SEQ ID NO: 318549 - DNA, 25 bp, Mus musculus
gcttgaaaatgcagaacagcttttt

SEQ ID NO: 318550 - DNA, 25 bp, Mus musculus
gcttgaaacagccgctgcaggagct

SEQ ID NO: 318551 - DNA, 25 bp, Mus musculus
gcttgaaacaggccggtagtggtgg

SEQ ID NO: 318552 - DNA, 25 bp, Mus musculus
gcttgaagaacctaaggcccgtgtc

SEQ ID NO: 318553 - DNA, 25 bp, Mus musculus
gcttgaagaagaccttccccaggag

SEQ ID NO: 318554 - DNA, 25 bp, Mus musculus
gcttgaagactctggtaggaacaac

SEQ ID NO: 318555 - DNA, 25 bp, Mus musculus
gcttgaagactctgtgcctggaatc

SEQ ID NO: 318556 - DNA, 25 bp, Mus musculus
gcttgaagatgataattagcaccat

SEQ ID NO: 318557 - DNA, 25 bp, Mus musculus
gcttgaagcatggcaatgaaatcta

SEQ ID NO: 318558 - DNA, 25 bp, Mus musculus
gcttgaagcatggccagaagacatg

SEQ ID NO: 318559 - DNA, 25 bp, Mus musculus
gcttgaatctcaggactccagagga

SEQ ID NO: 318560 - DNA, 25 bp, Mus musculus
gcttgaatctgctttttacctttgt

SEQ ID NO: 318561 - DNA, 25 bp, Mus musculus
gcttgacaacaagcctgaccaccac

SEQ ID NO: 318562 - DNA, 25 bp, Mus musculus
gcttgacggaagaatcgggcagctc

SEQ ID NO: 318563 - DNA, 25 bp, Mus musculus
gcttgactattgacctagccccatc

SEQ ID NO: 318564 - DNA, 25 bp, Mus musculus
gcttgactcccaaagcctacaagga

SEQ ID NO: 318565 - DNA, 25 bp, Mus musculus
gcttgactgggagaggatttgaatt

SEQ ID NO: 318566 - DNA, 25 bp, Mus musculus
gcttgagaaaaaccatggtgaatcc

SEQ ID NO: 318567 - DNA, 25 bp, Mus musculus
gcttgagagagagagccagctgctc

SEQ ID NO: 318568 - DNA, 25 bp, Mus musculus
gcttgagcagcatcagaaaagttcc

SEQ ID NO: 318569 - DNA, 25 bp, Mus musculus
gcttgagcagctgagtcccttccct

SEQ ID NO: 318570 - DNA, 25 bp, Mus musculus
gcttgagcagggagatggcggtaaa

SEQ ID NO: 318571 - DNA, 25 bp, Mus musculus
gcttgagcccgagaggagccacaga

SEQ ID NO: 318572 - DNA, 25 bp, Mus musculus
gcttgagcccgagaggcccatctga

SEQ ID NO: 318573 - DNA, 25 bp, Mus musculus
gcttgagcccgagagtttccaagga

SEQ ID NO: 318574 - DNA, 25 bp, Mus musculus
gcttgagcgcggcatccagccagcg

SEQ ID NO: 318575 - DNA, 25 bp, Mus musculus
gcttgaggtaatccattgtctgatc

SEQ ID NO: 318576 - DNA, 25 bp, Mus musculus
gcttgagtccaggttcacattgaga

SEQ ID NO: 318577 - DNA, 25 bp, Mus musculus
gcttgagtgcaagaggcaagtgcag

SEQ ID NO: 318578 - DNA, 25 bp, Mus musculus
gcttgagtgcaaggcaccccggctg

SEQ ID NO: 318579 - DNA, 25 bp, Mus musculus
gcttgagtggacaggctgaatttga

SEQ ID NO: 318580 - DNA, 25 bp, Mus musculus
gcttgagtgggccttcccgctccat

SEQ ID NO: 318581 - DNA, 25 bp, Mus musculus
gcttgagtgtgcgcgggtcactcac

SEQ ID NO: 318582 - DNA, 25 bp, Mus musculus
gcttgagtttccgatgagacagaag

SEQ ID NO: 318583 - DNA, 25 bp, Mus musculus
gcttgataaagggaggtatgaaagg

SEQ ID NO: 318584 - DNA, 25 bp, Mus musculus
gcttgatagtgagattggcagactc

SEQ ID NO: 318585 - DNA, 25 bp, Mus musculus
gcttgatgcaaggactcgtggggaa

SEQ ID NO: 318586 - DNA, 25 bp, Mus musculus
gcttgatgcagaatccaaatccaga

SEQ ID NO: 318587 - DNA, 25 bp, Mus musculus
gcttgatgcagctgtggcagaagta

SEQ ID NO: 318588 - DNA, 25 bp, Mus musculus
gcttgcaaacaggatgtctctccat

SEQ ID NO: 318589 - DNA, 25 bp, Mus musculus
gcttgcaaaggtggtacccgggaga

SEQ ID NO: 318590 - DNA, 25 bp, Mus musculus
gcttgcaagaagaacatccagagtc

SEQ ID NO: 318591 - DNA, 25 bp, Mus musculus
gcttgcaagaaggggaccagctgct

SEQ ID NO: 318592 - DNA, 25 bp, Mus musculus
gcttgcaatattaaagtaccaacca

SEQ ID NO: 318593 - DNA, 25 bp, Mus musculus
gcttgcaccagtctctcaccatgtc

SEQ ID NO: 318594 - DNA, 25 bp, Mus musculus
gcttgcagagatcgggttctgcggg

SEQ ID NO: 318595 - DNA, 25 bp, Mus musculus
gcttgcatcgggattctgtaacagc

SEQ ID NO: 318596 - DNA, 25 bp, Mus musculus
gcttgcatcggggtcagtggataaa

SEQ ID NO: 318597 - DNA, 25 bp, Mus musculus
gcttgcatgaggcaaaagagatttc

SEQ ID NO: 318598 - DNA, 25 bp, Mus musculus
gcttgcatgagggctcgctgcccac

SEQ ID NO: 318599 - DNA, 25 bp, Mus musculus
gcttgcatgcctgggccctggccca

SEQ ID NO: 318600 - DNA, 25 bp, Mus musculus
gcttgccacactgtgaccctaaaac

SEQ ID NO: 318601 - DNA, 25 bp, Mus musculus
gcttgccacagagcccttgcttagg

SEQ ID NO: 318602 - DNA, 25 bp, Mus musculus
gcttgccacaggagacgtggctgag

SEQ ID NO: 318603 - DNA, 25 bp, Mus musculus
gcttgccacttcaggatacatcaga

SEQ ID NO: 318604 - DNA, 25 bp, Mus musculus
gcttgccacttcaggtaaaatatag

SEQ ID NO: 318605 - DNA, 25 bp, Mus musculus
gcttgccagcgtttttcgttggaat

SEQ ID NO: 318606 - DNA, 25 bp, Mus musculus
gcttgccagggcaagaaatacagcc

SEQ ID NO: 318607 - DNA, 25 bp, Mus musculus
gcttgcccagctggctcctccaaga

SEQ ID NO: 318608 - DNA, 25 bp, Mus musculus
gcttgcccagtatgtgggatccttt

SEQ ID NO: 318609 - DNA, 25 bp, Mus musculus
gcttgccccagcggggacgaagcag

SEQ ID NO: 318610 - DNA, 25 bp, Mus musculus
gcttgccccagctgacgagatgaca

SEQ ID NO: 318611 - DNA, 25 bp, Mus musculus
gcttgccccgagtctccatctttgt

SEQ ID NO: 318612 - DNA, 25 bp, Mus musculus
gcttgccccggggacagaccaccgg

SEQ ID NO: 318613 - DNA, 25 bp, Mus musculus
gcttgccctcagagcctgtggacat

SEQ ID NO: 318614 - DNA, 25 bp, Mus musculus
gcttgccctcagagggccgggttaa

SEQ ID NO: 318615 - DNA, 25 bp, Mus musculus
gcttgccctggtcaggcagcagttg

SEQ ID NO: 318616 - DNA, 25 bp, Mus musculus
gcttgcctccaggctgaagaaggac

SEQ ID NO: 318617 - DNA, 25 bp, Mus musculus
gcttgcctccggaggtgtatgcagt

SEQ ID NO: 318618 - DNA, 25 bp, Mus musculus
gcttgcctctgaagcaggcagcacc

SEQ ID NO: 318619 - DNA, 25 bp, Mus musculus
gcttgccttccagacctatccctga

SEQ ID NO: 318620 - DNA, 25 bp, Mus musculus
gcttgcgctccgcaagccccgccca

SEQ ID NO: 318621 - DNA, 25 bp, Mus musculus
gcttgcggagggtcctggaaacact

SEQ ID NO: 318622 - DNA, 25 bp, Mus musculus
gcttgcggtcacctctgtcttccta

SEQ ID NO: 318623 - DNA, 25 bp, Mus musculus
gcttgcgttcgggaagatgctggtg

SEQ ID NO: 318624 - DNA, 25 bp, Mus musculus
gcttgctaagctacaagaagactca

SEQ ID NO: 318625 - DNA, 25 bp, Mus musculus
gcttgctaaggtggaagaagaaatt

SEQ ID NO: 318626 - DNA, 25 bp, Mus musculus
gcttgctcaggatggctgcagcaac

SEQ ID NO: 318627 - DNA, 25 bp, Mus musculus
gcttgctcaggctcctcggattaaa

SEQ ID NO: 318628 - DNA, 25 bp, Mus musculus
gcttgctcaggtagctaaagcagtg

SEQ ID NO: 318629 - DNA, 25 bp, Mus musculus
gcttgctcatcccagcctgcttttg

SEQ ID NO: 318630 - DNA, 25 bp, Mus musculus
gcttgctcattagcttttttccagg

SEQ ID NO: 318631 - DNA, 25 bp, Mus musculus
gcttgctcattaggtgtgtgatagc

SEQ ID NO: 318632 - DNA, 25 bp, Mus musculus
gcttgctctctcggacacggagagc

SEQ ID NO: 318633 - DNA, 25 bp, Mus musculus
gcttgctgaacccccacagaacctg

SEQ ID NO: 318634 - DNA, 25 bp, Mus musculus
gcttgctgaagctcaggtacctgac

SEQ ID NO: 318635 - DNA, 25 bp, Mus musculus
gcttgctgaagtggcttttcatggc

SEQ ID NO: 318636 - DNA, 25 bp, Mus musculus
gcttgctgacaagcccttcaaattg

SEQ ID NO: 318637 - DNA, 25 bp, Mus musculus
gcttgctgagactctccgctggtgt

SEQ ID NO: 318638 - DNA, 25 bp, Mus musculus
gcttgctgaggcctcttaagcaatg

SEQ ID NO: 318639 - DNA, 25 bp, Mus musculus
gcttgctgagggtttcccagtgtag

SEQ ID NO: 318640 - DNA, 25 bp, Mus musculus
gcttgctggcaagagtattcaggag

SEQ ID NO: 318641 - DNA, 25 bp, Mus musculus
gcttgctggcaaggtggcgacctgc

SEQ ID NO: 318642 - DNA, 25 bp, Mus musculus
gcttgctgtgtggctgagagtgcta

SEQ ID NO: 318643 - DNA, 25 bp, Mus musculus
gcttgcttaaaacatgctaattcca

SEQ ID NO: 318644 - DNA, 25 bp, Mus musculus
gcttgcttgttggtgattgtatcgc

SEQ ID NO: 318645 - DNA, 25 bp, Mus musculus
gcttggaaaagcacttggagctgct

SEQ ID NO: 318646 - DNA, 25 bp, Mus musculus
gcttggaaaagtgctcatgacctga

SEQ ID NO: 318647 - DNA, 25 bp, Mus musculus
gcttggaaacaactggtgccagcac

SEQ ID NO: 318648 - DNA, 25 bp, Mus musculus
gcttggaacatggagggttcactgt

SEQ ID NO: 318649 - DNA, 25 bp, Mus musculus
gcttggaatgagactgcagatcttg

SEQ ID NO: 318650 - DNA, 25 bp, Mus musculus
gcttggacaacataaggaagtcaga

SEQ ID NO: 318651 - DNA, 25 bp, Mus musculus
gcttggactgaaggtacgcagggaa

SEQ ID NO: 318652 - DNA, 25 bp, Mus musculus
gcttggagaagggtcttatggaagt

SEQ ID NO: 318653 - DNA, 25 bp, Mus musculus
gcttggagacatgagcagctactcc

SEQ ID NO: 318654 - DNA, 25 bp, Mus musculus
gcttggagacatgaggaactcagcc

SEQ ID NO: 318655 - DNA, 25 bp, Mus musculus
gcttggagacatgagggctcatccg

SEQ ID NO: 318656 - DNA, 25 bp, Mus musculus
gcttggagacatgagtctaaggttg

SEQ ID NO: 318657 - DNA, 25 bp, Mus musculus
gcttggagagactgggcagtttggc

SEQ ID NO: 318658 - DNA, 25 bp, Mus musculus
gcttggagaggaggtcttcttctcc

SEQ ID NO: 318659 - DNA, 25 bp, Mus musculus
gcttggagcaagatgagatggacca

SEQ ID NO: 318660 - DNA, 25 bp, Mus musculus
gcttggagcagctgggaacactcca

SEQ ID NO: 318661 - DNA, 25 bp, Mus musculus
gcttggagtgttcctaactttgaag

SEQ ID NO: 318662 - DNA, 25 bp, Mus musculus
gcttggagttgactgtgttccctgc

SEQ ID NO: 318663 - DNA, 25 bp, Mus musculus
gcttggagttgggaatgagcaatta

SEQ ID NO: 318664 - DNA, 25 bp, Mus musculus
gcttggataagattaatgtccttca

SEQ ID NO: 318665 - DNA, 25 bp, Mus musculus
gcttggatactggaagaagccataa

SEQ ID NO: 318666 - DNA, 25 bp, Mus musculus
gcttggatcacacagtgagaccctg

SEQ ID NO: 318667 - DNA, 25 bp, Mus musculus
gcttggatcgaaggcacggagggag

SEQ ID NO: 318668 - DNA, 25 bp, Mus musculus
gcttggatctactgagcgcagcctt

SEQ ID NO: 318669 - DNA, 25 bp, Mus musculus
gcttggatctactggttctgcagta

SEQ ID NO: 318670 - DNA, 25 bp, Mus musculus
gcttggatctactgtgggcccagcc

SEQ ID NO: 318671 - DNA, 25 bp, Mus musculus
gcttggatcttcccgctctgtgacc

SEQ ID NO: 318672 - DNA, 25 bp, Mus musculus
gcttggatcttcccggttctcggac

SEQ ID NO: 318673 - DNA, 25 bp, Mus musculus
gcttggatgaactgtatgacatcat

SEQ ID NO: 318674 - DNA, 25 bp, Mus musculus
gcttggatggagaggttggtacagg

SEQ ID NO: 318675 - DNA, 25 bp, Mus musculus
gcttggatggagcgtcagtgagtga

SEQ ID NO: 318676 - DNA, 25 bp, Mus musculus
gcttggatggggtattgacaaatct

SEQ ID NO: 318677 - DNA, 25 bp, Mus musculus
gcttggattacaggtgaccaggact

SEQ ID NO: 318678 - DNA, 25 bp, Mus musculus
gcttggattacaggtggtgctctgg

SEQ ID NO: 318679 - DNA, 25 bp, Mus musculus
gcttggcagagcaacttattttcaa

SEQ ID NO: 318680 - DNA, 25 bp, Mus musculus
gcttggcagagccagacatcagaac

SEQ ID NO: 318681 - DNA, 25 bp, Mus musculus
gcttggcatctgcaatgccgcgcca

SEQ ID NO: 318682 - DNA, 25 bp, Mus musculus
gcttggccagggttaactttgagga

SEQ ID NO: 318683 - DNA, 25 bp, Mus musculus
gcttggcgcgaaaaggtggacaagt

SEQ ID NO: 318684 - DNA, 25 bp, Mus musculus
gcttggcgcgatatgctaatgaaga

SEQ ID NO: 318685 - DNA, 25 bp, Mus musculus
gcttggcgcggtgaaggcgataaag

SEQ ID NO: 318686 - DNA, 25 bp, Mus musculus
gcttggctatggcatcttccactgc

SEQ ID NO: 318687 - DNA, 25 bp, Mus musculus
gcttggctatttcaggctttgatgg

SEQ ID NO: 318688 - DNA, 25 bp, Mus musculus
gcttggctttcagagacgagttaca

SEQ ID NO: 318689 - DNA, 25 bp, Mus musculus
gcttgggaattgacaggcatcgcct

SEQ ID NO: 318690 - DNA, 25 bp, Mus musculus
gcttgggactaccaggcctgtacgg

SEQ ID NO: 318691 - DNA, 25 bp, Mus musculus
gcttgggagccagccccagcagttg

SEQ ID NO: 318692 - DNA, 25 bp, Mus musculus
gcttgggaggctatggtcgtggtgg

SEQ ID NO: 318693 - DNA, 25 bp, Mus musculus
gcttgggaggggtcatccttcgggc

SEQ ID NO: 318694 - DNA, 25 bp, Mus musculus
gcttgggatctgggacactgaatgg

SEQ ID NO: 318695 - DNA, 25 bp, Mus musculus
gcttgggccgccttggcttcctttc

SEQ ID NO: 318696 - DNA, 25 bp, Mus musculus
gcttggggaatctggagcaattcaa

SEQ ID NO: 318697 - DNA, 25 bp, Mus musculus
gcttggggaatcttgctctttgatg

SEQ ID NO: 318698 - DNA, 25 bp, Mus musculus
gcttggggaccctagggctgtgcct

SEQ ID NO: 318699 - DNA, 25 bp, Mus musculus
gcttggggcaagatcgacatgctac

SEQ ID NO: 318700 - DNA, 25 bp, Mus musculus
gcttggggcaaggtggatacgacgc

SEQ ID NO: 318701 - DNA, 25 bp, Mus musculus
gcttggggccccacggatgctggtg

SEQ ID NO: 318702 - DNA, 25 bp, Mus musculus
gcttgggggagccatgacagtagct

SEQ ID NO: 318703 - DNA, 25 bp, Mus musculus
gcttggggtttgcccagatggggga

SEQ ID NO: 318704 - DNA, 25 bp, Mus musculus
gcttgggtaagcagtggattctgta

SEQ ID NO: 318705 - DNA, 25 bp, Mus musculus
gcttggtagcgtacattgcaaacat

SEQ ID NO: 318706 - DNA, 25 bp, Mus musculus
gcttggtatttggaatgcagaaaca

SEQ ID NO: 318707 - DNA, 25 bp, Mus musculus
gcttggtattttgaagtccctggat

SEQ ID NO: 318708 - DNA, 25 bp, Mus musculus
gcttggtccaggaaaatggacaaag

SEQ ID NO: 318709 - DNA, 25 bp, Mus musculus
gcttggtcctaaggccctttttgct

SEQ ID NO: 318710 - DNA, 25 bp, Mus musculus
gcttggtcctcactgtgatgatccg

SEQ ID NO: 318711 - DNA, 25 bp, Mus musculus
gcttggtgcggccagagagtcgata

SEQ ID NO: 318712 - DNA, 25 bp, Mus musculus
gcttggtgtctggatgatgcatccc

SEQ ID NO: 318713 - DNA, 25 bp, Mus musculus
gcttggttccagatgggtgtgtttt

SEQ ID NO: 318714 - DNA, 25 bp, Mus musculus
gcttggttccagggtgactgactga

SEQ ID NO: 318715 - DNA, 25 bp, Mus musculus
gcttggttgggaagtggattataaa

SEQ ID NO: 318716 - DNA, 25 bp, Mus musculus
gcttggttgttgaaggactcgggac

SEQ ID NO: 318717 - DNA, 25 bp, Mus musculus
gcttgtacaagcttcaaaaccgcta

SEQ ID NO: 318718 - DNA, 25 bp, Mus musculus
gcttgtacaagtctgcagatggcct

SEQ ID NO: 318719 - DNA, 25 bp, Mus musculus
gcttgtaccaccggtaactaaatga

SEQ ID NO: 318720 - DNA, 25 bp, Mus musculus
gcttgtaccaccggtatccatgcca

SEQ ID NO: 318721 - DNA, 25 bp, Mus musculus
gcttgtagatgtggaatggacagac

SEQ ID NO: 318722 - DNA, 25 bp, Mus musculus
gcttgtagatgtggatgaaaagaat

SEQ ID NO: 318723 - DNA, 25 bp, Mus musculus
gcttgtataagctggaaaacaggct

SEQ ID NO: 318724 - DNA, 25 bp, Mus musculus
gcttgtattgaaaaagcttgtggcg

SEQ ID NO: 318725 - DNA, 25 bp, Mus musculus
gcttgtcaacaggaggagccatggg

SEQ ID NO: 318726 - DNA, 25 bp, Mus musculus
gcttgtcaacagggtccaggtgcac

SEQ ID NO: 318727 - DNA, 25 bp, Mus musculus
gcttgtcaagaacagctggggaagt

SEQ ID NO: 318728 - DNA, 25 bp, Mus musculus
gcttgtcaatgaggcagaattccac

SEQ ID NO: 318729 - DNA, 25 bp, Mus musculus
gcttgtcagaatcaggtctgataga

SEQ ID NO: 318730 - DNA, 25 bp, Mus musculus
gcttgtcagattcaggtctgataga

SEQ ID NO: 318731 - DNA, 25 bp, Mus musculus
gcttgtcataaaagaaatgtacccc

SEQ ID NO: 318732 - DNA, 25 bp, Mus musculus
gcttgtcataaaagatgggcgaacc

SEQ ID NO: 318733 - DNA, 25 bp, Mus musculus
gcttgtcatctgagtcaacggttgc

SEQ ID NO: 318734 - DNA, 25 bp, Mus musculus
gcttgtccagggtatcttattttcc

SEQ ID NO: 318735 - DNA, 25 bp, Mus musculus
gcttgtccggcctctgtagagctca

SEQ ID NO: 318736 - DNA, 25 bp, Mus musculus
gcttgtccgggcgggttgaggcgcc

SEQ ID NO: 318737 - DNA, 25 bp, Mus musculus
gcttgtcctacaagcctggacaaac

SEQ ID NO: 318738 - DNA, 25 bp, Mus musculus
gcttgtcctacaaggccctcgttgc

SEQ ID NO: 318739 - DNA, 25 bp, Mus musculus
gcttgtctcctcaaggcaccttgtt

SEQ ID NO: 318740 - DNA, 25 bp, Mus musculus
gcttgtctctgcagaccgctcggga

SEQ ID NO: 318741 - DNA, 25 bp, Mus musculus
gcttgtgaaggaatctgattgcctt

SEQ ID NO: 318742 - DNA, 25 bp, Mus musculus
gcttgtgaatcagcaatgcagggac

SEQ ID NO: 318743 - DNA, 25 bp, Mus musculus
gcttgtgagaagaaatggaaatgat

SEQ ID NO: 318744 - DNA, 25 bp, Mus musculus
gcttgtgatagggagttctgaggct

SEQ ID NO: 318745 - DNA, 25 bp, Mus musculus
gcttgtgcagccacgacccaccgtg

SEQ ID NO: 318746 - DNA, 25 bp, Mus musculus
gcttgtgcaggtctggtcactcgag

SEQ ID NO: 318747 - DNA, 25 bp, Mus musculus
gcttgtgcaggtgacagcagcatgg

SEQ ID NO: 318748 - DNA, 25 bp, Mus musculus
gcttgtgcatgctggatctctcgtc

SEQ ID NO: 318749 - DNA, 25 bp, Mus musculus
gcttgtgctcaaacaggctctggaa

SEQ ID NO: 318750 - DNA, 25 bp, Mus musculus
gcttgtggcgttaaactttctccag

SEQ ID NO: 318751 - DNA, 25 bp, Mus musculus
gcttgtggctgctcccgcaggctgg

SEQ ID NO: 318752 - DNA, 25 bp, Mus musculus
gcttgtggctttgaccatccacgaa

SEQ ID NO: 318753 - DNA, 25 bp, Mus musculus
gcttgtggctttgagtctgacaaga

SEQ ID NO: 318754 - DNA, 25 bp, Mus musculus
gcttgtgggcagaagctgacgtttt

SEQ ID NO: 318755 - DNA, 25 bp, Mus musculus
gcttgtggtggctcgattcctgtct

SEQ ID NO: 318756 - DNA, 25 bp, Mus musculus
gcttgtgtcgggaatgtgtttctga

SEQ ID NO: 318757 - DNA, 25 bp, Mus musculus
gcttgtgtctgaaggtgcttcctgg

SEQ ID NO: 318758 - DNA, 25 bp, Mus musculus
gcttgtgtggacgctcgaattatca

SEQ ID NO: 318759 - DNA, 25 bp, Mus musculus
gcttgttaaggctgctgaaaaatgg

SEQ ID NO: 318760 - DNA, 25 bp, Mus musculus
gcttgttcaggtgtcctatgccatt

SEQ ID NO: 318761 - DNA, 25 bp, Mus musculus
gcttgttctgggggtggtggagttg

SEQ ID NO: 318762 - DNA, 25 bp, Mus musculus
gcttgttgaacaacagatgcagcga

SEQ ID NO: 318763 - DNA, 25 bp, Mus musculus
gcttgttggaggggactttcccaaa

SEQ ID NO: 318764 - DNA, 25 bp, Mus musculus
gctttaaaagcaaggatcatggagg

SEQ ID NO: 318765 - DNA, 25 bp, Mus musculus
gctttaaaaggaaaatacatagaaa

SEQ ID NO: 318766 - DNA, 25 bp, Mus musculus
gctttaaacaagaggctcaagatgt

SEQ ID NO: 318767 - DNA, 25 bp, Mus musculus
gctttaaacaaggggcgcagagaag

SEQ ID NO: 318768 - DNA, 25 bp, Mus musculus
gctttaaacatggtaccgggtgctg

SEQ ID NO: 318769 - DNA, 25 bp, Mus musculus
gctttaaacatgtacccctctatga

SEQ ID NO: 318770 - DNA, 25 bp, Mus musculus
gctttaacttggggtgagtcagaat

SEQ ID NO: 318771 - DNA, 25 bp, Mus musculus
gctttaattgacagattagctttat

SEQ ID NO: 318772 - DNA, 25 bp, Mus musculus
gctttacaataagattacatctcgc

SEQ ID NO: 318773 - DNA, 25 bp, Mus musculus
gctttacagaatggggagcgctctc

SEQ ID NO: 318774 - DNA, 25 bp, Mus musculus
gctttacagaatgtctgcggattat

SEQ ID NO: 318775 - DNA, 25 bp, Mus musculus
gctttacaggaaatctgacgtttgg

SEQ ID NO: 318776 - DNA, 25 bp, Mus musculus
gctttacatttaagacaaatgaaga

SEQ ID NO: 318777 - DNA, 25 bp, Mus musculus
gctttaccagaagagggcatcagat

SEQ ID NO: 318778 - DNA, 25 bp, Mus musculus
gctttaccagaccatagaatccaac

SEQ ID NO: 318779 - DNA, 25 bp, Mus musculus
gctttaccagagcaaggcttagatc

SEQ ID NO: 318780 - DNA, 25 bp, Mus musculus
gctttaccaggaacatttcagaggc

SEQ ID NO: 318781 - DNA, 25 bp, Mus musculus
gctttaccaggatatgactgcgcgg

SEQ ID NO: 318782 - DNA, 25 bp, Mus musculus
gctttaccagtctattgcatctgca

SEQ ID NO: 318783 - DNA, 25 bp, Mus musculus
gctttaccgagcaggacccttcatg

SEQ ID NO: 318784 - DNA, 25 bp, Mus musculus
gctttaccgagcaggtcacggaaga

SEQ ID NO: 318785 - DNA, 25 bp, Mus musculus
gctttactcgccaggcaagcgcttc

SEQ ID NO: 318786 - DNA, 25 bp, Mus musculus
gctttactctggactttggagacta

SEQ ID NO: 318787 - DNA, 25 bp, Mus musculus
gctttacttttggtatatcatgtat

SEQ ID NO: 318788 - DNA, 25 bp, Mus musculus
gctttagagcctatcgatctgactg

SEQ ID NO: 318789 - DNA, 25 bp, Mus musculus
gctttagagcctatggatctgactg

SEQ ID NO: 318790 - DNA, 25 bp, Mus musculus
gctttagcaagagcatggtcaatac

SEQ ID NO: 318791 - DNA, 25 bp, Mus musculus
gctttagcaaggcccgcggccatgc

SEQ ID NO: 318792 - DNA, 25 bp, Mus musculus
gctttagcattaaggaatcttggga

SEQ ID NO: 318793 - DNA, 25 bp, Mus musculus
gctttaggagggttggtggtcggat

SEQ ID NO: 318794 - DNA, 25 bp, Mus musculus
gctttaggagtccggtgagttggag

SEQ ID NO: 318795 - DNA, 25 bp, Mus musculus
gctttagtgataggctctctcctaa

SEQ ID NO: 318796 - DNA, 25 bp, Mus musculus
gctttagtgatagggttcactgtgg

SEQ ID NO: 318797 - DNA, 25 bp, Mus musculus
gctttagtgtagggccaagtccact

SEQ ID NO: 318798 - DNA, 25 bp, Mus musculus
gctttagtgtataggggagcaggcc

SEQ ID NO: 318799 - DNA, 25 bp, Mus musculus
gctttatacagaaagatgttggatc

SEQ ID NO: 318800 - DNA, 25 bp, Mus musculus
gctttatatccttttagtgttgggc

SEQ ID NO: 318801 - DNA, 25 bp, Mus musculus
gctttatcaggcgttctgtcaaaga

SEQ ID NO: 318802 - DNA, 25 bp, Mus musculus
gctttatcaggggcgttcaatttgt

SEQ ID NO: 318803 - DNA, 25 bp, Mus musculus
gctttatcaggtccacagagttgga

SEQ ID NO: 318804 - DNA, 25 bp, Mus musculus
gctttatcaggtcctcatgggtatc

SEQ ID NO: 318805 - DNA, 25 bp, Mus musculus
gctttatgaccctctggagatcttc

SEQ ID NO: 318806 - DNA, 25 bp, Mus musculus
gctttatgtcagtcagccccagcaa

SEQ ID NO: 318807 - DNA, 25 bp, Mus musculus
gctttcaaaaacaggatctgagtct

SEQ ID NO: 318808 - DNA, 25 bp, Mus musculus
gctttcaaaaacaggtcagcccttc

SEQ ID NO: 318809 - DNA, 25 bp, Mus musculus
gctttcaaagaacagcatgttttgg

SEQ ID NO: 318810 - DNA, 25 bp, Mus musculus
gctttcaaagccattggcacagcgt

SEQ ID NO: 318811 - DNA, 25 bp, Mus musculus
gctttcaaagtgaaacctccacatg

SEQ ID NO: 318812 - DNA, 25 bp, Mus musculus
gctttcaactgtatggtcttgggca

SEQ ID NO: 318813 - DNA, 25 bp, Mus musculus
gctttcaagctcctgctgaaccact

SEQ ID NO: 318814 - DNA, 25 bp, Mus musculus
gctttcaccaaaaagggaactacaa

SEQ ID NO: 318815 - DNA, 25 bp, Mus musculus
gctttcaccaaaggattctaaccac

SEQ ID NO: 318816 - DNA, 25 bp, Mus musculus
gctttcaccaaaggtcctggcatgg

SEQ ID NO: 318817 - DNA, 25 bp, Mus musculus
gctttcaccaaccaatcaaagttgt

SEQ ID NO: 318818 - DNA, 25 bp, Mus musculus
gctttcaccaagtgtggattcgcag

SEQ ID NO: 318819 - DNA, 25 bp, Mus musculus
gctttcacttaggaatgtgactctg

SEQ ID NO: 318820 - DNA, 25 bp, Mus musculus
gctttcagaaattccctgcggtggc

SEQ ID NO: 318821 - DNA, 25 bp, Mus musculus
gctttcagaagaatatgacagatac

SEQ ID NO: 318822 - DNA, 25 bp, Mus musculus
gctttcagaagacctggcggtgttt

SEQ ID NO: 318823 - DNA, 25 bp, Mus musculus
gctttcagactaaggtggacttcac

SEQ ID NO: 318824 - DNA, 25 bp, Mus musculus
gctttcagagacgagttacaattta

SEQ ID NO: 318825 - DNA, 25 bp, Mus musculus
gctttcagagttaacaaacatgatc

SEQ ID NO: 318826 - DNA, 25 bp, Mus musculus
gctttcagagttaacaggtggctgg

SEQ ID NO: 318827 - DNA, 25 bp, Mus musculus
gctttcagatacataccaaggaggg

SEQ ID NO: 318828 - DNA, 25 bp, Mus musculus
gctttcagccagagatcaccagaag

SEQ ID NO: 318829 - DNA, 25 bp, Mus musculus
gctttcagccagagggggcttttac

SEQ ID NO: 318830 - DNA, 25 bp, Mus musculus
gctttcagccccagctctcgggaca

SEQ ID NO: 318831 - DNA, 25 bp, Mus musculus
gctttcaggcccgcacaggcgcaca

SEQ ID NO: 318832 - DNA, 25 bp, Mus musculus
gctttcagtaggagtgtgacttgga

SEQ ID NO: 318833 - DNA, 25 bp, Mus musculus
gctttcatcggctcggatgtggtgg

SEQ ID NO: 318834 - DNA, 25 bp, Mus musculus
gctttcatttactgatgggagtcac

SEQ ID NO: 318835 - DNA, 25 bp, Mus musculus
gctttcatttactttgtggcctttt

SEQ ID NO: 318836 - DNA, 25 bp, Mus musculus
gctttccaaatgtgacgagaagaac

SEQ ID NO: 318837 - DNA, 25 bp, Mus musculus
gctttccaagttacctgatttaaaa

SEQ ID NO: 318838 - DNA, 25 bp, Mus musculus
gctttccacatgtctgccaggaact

SEQ ID NO: 318839 - DNA, 25 bp, Mus musculus
gctttccacctgtgggtccttgctg

SEQ ID NO: 318840 - DNA, 25 bp, Mus musculus
gctttccagagcggaaacgggtcct

SEQ ID NO: 318841 - DNA, 25 bp, Mus musculus
gctttccagaggcggccagcaggtg

SEQ ID NO: 318842 - DNA, 25 bp, Mus musculus
gctttccccaggccctccatgatga

SEQ ID NO: 318843 - DNA, 25 bp, Mus musculus
gctttcccgagacagcctgccagga

SEQ ID NO: 318844 - DNA, 25 bp, Mus musculus
gctttcccgagacttcccaagaaag

SEQ ID NO: 318845 - DNA, 25 bp, Mus musculus
gctttccctaacatcgagaaggtgt

SEQ ID NO: 318846 - DNA, 25 bp, Mus musculus
gctttccctcagcagacacgcaccc

SEQ ID NO: 318847 - DNA, 25 bp, Mus musculus
gctttccgcaaggccctttatggga

SEQ ID NO: 318848 - DNA, 25 bp, Mus musculus
gctttccggaaatggcactgttttt

SEQ ID NO: 318849 - DNA, 25 bp, Mus musculus
gctttccggaaatgtgagcgggaga

SEQ ID NO: 318850 - DNA, 25 bp, Mus musculus
gctttccggaagattcatcgcagag

SEQ ID NO: 318851 - DNA, 25 bp, Mus musculus
gctttccggcgagggctgtaaaaaa

SEQ ID NO: 318852 - DNA, 25 bp, Mus musculus
gctttcctgaggagcggcggcatgg

SEQ ID NO: 318853 - DNA, 25 bp, Mus musculus
gctttcctggaaaattgttgtgtct

SEQ ID NO: 318854 - DNA, 25 bp, Mus musculus
gctttcctggcacagaaacatcatc

SEQ ID NO: 318855 - DNA, 25 bp, Mus musculus
gctttcctggcacagcaagcttccc

SEQ ID NO: 318856 - DNA, 25 bp, Mus musculus
gctttcctggggatgggagtgagtg

SEQ ID NO: 318857 - DNA, 25 bp, Mus musculus
gctttcctttgggtattcccatctg

SEQ ID NO: 318858 - DNA, 25 bp, Mus musculus
gctttcgacccgaggactatctcca

SEQ ID NO: 318859 - DNA, 25 bp, Mus musculus
gctttcgacccggattctcaaaacc

SEQ ID NO: 318860 - DNA, 25 bp, Mus musculus
gctttcgaggagaaaattctatagc

SEQ ID NO: 318861 - DNA, 25 bp, Mus musculus
gctttcgctgaagagcatccgtgca

SEQ ID NO: 318862 - DNA, 25 bp, Mus musculus
gctttcggagcattttctgcagcta

SEQ ID NO: 318863 - DNA, 25 bp, Mus musculus
gctttcgtgaaggatgttttatttc

SEQ ID NO: 318864 - DNA, 25 bp, Mus musculus
gctttctaaatgaacttcagtaact

SEQ ID NO: 318865 - DNA, 25 bp, Mus musculus
gctttctaatagcagcgtccccatg

SEQ ID NO: 318866 - DNA, 25 bp, Mus musculus
gctttctatagagctgggctcgtcg

SEQ ID NO: 318867 - DNA, 25 bp, Mus musculus
gctttctataggtatggggactgct

SEQ ID NO: 318868 - DNA, 25 bp, Mus musculus
gctttctcagggctctggcgcactc

SEQ ID NO: 318869 - DNA, 25 bp, Mus musculus
gctttctcccaggtgctcaccattg

SEQ ID NO: 318870 - DNA, 25 bp, Mus musculus
gctttctcgttcagaatgtcatacc

SEQ ID NO: 318871 - DNA, 25 bp, Mus musculus
gctttctctctccagcgcctgtatt

SEQ ID NO: 318872 - DNA, 25 bp, Mus musculus
gctttctctctccagggagtgttcc

SEQ ID NO: 318873 - DNA, 25 bp, Mus musculus
gctttctcttgagactcgttactgg

SEQ ID NO: 318874 - DNA, 25 bp, Mus musculus
gctttctcttgagggtaacaagaag

SEQ ID NO: 318875 - DNA, 25 bp, Mus musculus
gctttctgatcaggtgttgtttgtg

SEQ ID NO: 318876 - DNA, 25 bp, Mus musculus
gctttctgcaaagagccgtctagac

SEQ ID NO: 318877 - DNA, 25 bp, Mus musculus
gctttctgcatgaggcttggatcta

SEQ ID NO: 318878 - DNA, 25 bp, Mus musculus
gctttctggagggagttggtggaat

SEQ ID NO: 318879 - DNA, 25 bp, Mus musculus
gctttcttagatgttgccttcatca

SEQ ID NO: 318880 - DNA, 25 bp, Mus musculus
gctttcttcaagcaccagattgtac

SEQ ID NO: 318881 - DNA, 25 bp, Mus musculus
gctttctttaacaaggtaaataagc

SEQ ID NO: 318882 - DNA, 25 bp, Mus musculus
gctttgaaagtggtaacctcggccg

SEQ ID NO: 318883 - DNA, 25 bp, Mus musculus
gctttgaactgataagacgccttga

SEQ ID NO: 318884 - DNA, 25 bp, Mus musculus
gctttgaactgataatggcaaagaa

SEQ ID NO: 318885 - DNA, 25 bp, Mus musculus
gctttgaacttcaagctcttttgga

SEQ ID NO: 318886 - DNA, 25 bp, Mus musculus
gctttgaagaagatgaagaggtggg

SEQ ID NO: 318887 - DNA, 25 bp, Mus musculus
gctttgaatggcaaggtgctggatg

SEQ ID NO: 318888 - DNA, 25 bp, Mus musculus
gctttgacacgagatgacataacac

SEQ ID NO: 318889 - DNA, 25 bp, Mus musculus
gctttgacagctgcaggtcctggtg

SEQ ID NO: 318890 - DNA, 25 bp, Mus musculus
gctttgactacagcacggtggatga

SEQ ID NO: 318891 - DNA, 25 bp, Mus musculus
gctttgacttcaacaccctcttcaa

SEQ ID NO: 318892 - DNA, 25 bp, Mus musculus
gctttgagatgggtaaccttttggt

SEQ ID NO: 318893 - DNA, 25 bp, Mus musculus
gctttgagatggtctgctttacggg

SEQ ID NO: 318894 - DNA, 25 bp, Mus musculus
gctttgaggaaagatcaaactcaga

SEQ ID NO: 318895 - DNA, 25 bp, Mus musculus
gctttgaggaagattgcaagcccaa

SEQ ID NO: 318896 - DNA, 25 bp, Mus musculus
gctttgaggaagcgagtctccagtt

SEQ ID NO: 318897 - DNA, 25 bp, Mus musculus
gctttgaggaagttatcaacatagt

SEQ ID NO: 318898 - DNA, 25 bp, Mus musculus
gctttgagtggaacgcaaccttcct

SEQ ID NO: 318899 - DNA, 25 bp, Mus musculus
gctttgataaatttgaattctgtga

SEQ ID NO: 318900 - DNA, 25 bp, Mus musculus
gctttgatcacagtattttcacaaa

SEQ ID NO: 318901 - DNA, 25 bp, Mus musculus
gctttgatgatctattggatgatac

SEQ ID NO: 318902 - DNA, 25 bp, Mus musculus
gctttgatggaaagaaaattgccca

SEQ ID NO: 318903 - DNA, 25 bp, Mus musculus
gctttgatggaaaggagttctggca

SEQ ID NO: 318904 - DNA, 25 bp, Mus musculus
gctttgcaaaagtacgatcagagca

SEQ ID NO: 318905 - DNA, 25 bp, Mus musculus
gctttgcaaagtgattcgtaagggc

SEQ ID NO: 318906 - DNA, 25 bp, Mus musculus
gctttgcaaatgctcagcagaggag

SEQ ID NO: 318907 - DNA, 25 bp, Mus musculus
gctttgcaaggaagccatcactcct

SEQ ID NO: 318908 - DNA, 25 bp, Mus musculus
gctttgcacacagatggagtggccg

SEQ ID NO: 318909 - DNA, 25 bp, Mus musculus
gctttgcactcagcccccactgtag

SEQ ID NO: 318910 - DNA, 25 bp, Mus musculus
gctttgcactcagcgtacatgttgt

SEQ ID NO: 318911 - DNA, 25 bp, Mus musculus
gctttgccaatgctcagcagagaag

SEQ ID NO: 318912 - DNA, 25 bp, Mus musculus
gctttgccacacagtgaagatgcca

SEQ ID NO: 318913 - DNA, 25 bp, Mus musculus
gctttgccaggaatctggtctgtct

SEQ ID NO: 318914 - DNA, 25 bp, Mus musculus
gctttgccgcagggggtgctacaga

SEQ ID NO: 318915 - DNA, 25 bp, Mus musculus
gctttgccgcaggggtcatgttagc

SEQ ID NO: 318916 - DNA, 25 bp, Mus musculus
gctttgcctgtgaggtttctgttta

SEQ ID NO: 318917 - DNA, 25 bp, Mus musculus
gctttgcgctcagggaaaggtgaac

SEQ ID NO: 318918 - DNA, 25 bp, Mus musculus
gctttgcgctcagggcatccatgtg

SEQ ID NO: 318919 - DNA, 25 bp, Mus musculus
gctttgctacaacgctaacagttcc

SEQ ID NO: 318920 - DNA, 25 bp, Mus musculus
gctttgctcagccttctggccgggg

SEQ ID NO: 318921 - DNA, 25 bp, Mus musculus
gctttgctcagtatgggtgagagca

SEQ ID NO: 318922 - DNA, 25 bp, Mus musculus
gctttgctcgaagttgtccagtctg

SEQ ID NO: 318923 - DNA, 25 bp, Mus musculus
gctttgctcgaggagtgcatgggta

SEQ ID NO: 318924 - DNA, 25 bp, Mus musculus
gctttgctcttggcactaaacaaga

SEQ ID NO: 318925 - DNA, 25 bp, Mus musculus
gctttgctcttggggagatgcgaaa

SEQ ID NO: 318926 - DNA, 25 bp, Mus musculus
gctttgctggagtatattgaaaaac

SEQ ID NO: 318927 - DNA, 25 bp, Mus musculus
gctttgctgggttgctatgatatgt

SEQ ID NO: 318928 - DNA, 25 bp, Mus musculus
gctttgctgtaaaagagaggaggct

SEQ ID NO: 318929 - DNA, 25 bp, Mus musculus
gctttgcttgaggtagtccattgtc

SEQ ID NO: 318930 - DNA, 25 bp, Mus musculus
gctttggaaattgccgcagatgacc

SEQ ID NO: 318931 - DNA, 25 bp, Mus musculus
gctttggacagaaaatcaccgtgct

SEQ ID NO: 318932 - DNA, 25 bp, Mus musculus
gctttggacaggatattgactagac

SEQ ID NO: 318933 - DNA, 25 bp, Mus musculus
gctttggactcagaggcttgctgca

SEQ ID NO: 318934 - DNA, 25 bp, Mus musculus
gctttggagaagaaccatcagtcat

SEQ ID NO: 318935 - DNA, 25 bp, Mus musculus
gctttggagaaggagcttcagtgac

SEQ ID NO: 318936 - DNA, 25 bp, Mus musculus
gctttggagagcgtcaagatcaagt

SEQ ID NO: 318937 - DNA, 25 bp, Mus musculus
gctttggagctgttggttttgaccc

SEQ ID NO: 318938 - DNA, 25 bp, Mus musculus
gctttggaggggctgtgggtttggg

SEQ ID NO: 318939 - DNA, 25 bp, Mus musculus
gctttggaggttctggaacagctaa

SEQ ID NO: 318940 - DNA, 25 bp, Mus musculus
gctttggaggttctggacggcattt

SEQ ID NO: 318941 - DNA, 25 bp, Mus musculus
gctttggaggttctgggacagcaac

SEQ ID NO: 318942 - DNA, 25 bp, Mus musculus
gctttggatgagtgtgaactggact

SEQ ID NO: 318943 - DNA, 25 bp, Mus musculus
gctttggatggctcccggacctctg

SEQ ID NO: 318944 - DNA, 25 bp, Mus musculus
gctttggatggtatgccttacactt

SEQ ID NO: 318945 - DNA, 25 bp, Mus musculus
gctttggatggtgatgatgaagatg

SEQ ID NO: 318946 - DNA, 25 bp, Mus musculus
gctttggatgtgccttcggaggcca

SEQ ID NO: 318947 - DNA, 25 bp, Mus musculus
gctttggcagcggatctccatcttt

SEQ ID NO: 318948 - DNA, 25 bp, Mus musculus
gctttggctcttttacagacctcaa

SEQ ID NO: 318949 - DNA, 25 bp, Mus musculus
gctttggctgaaaggacttctagat

SEQ ID NO: 318950 - DNA, 25 bp, Mus musculus
gctttgggaccggttcggaccatat

SEQ ID NO: 318951 - DNA, 25 bp, Mus musculus
gctttgggatgaagattgtggatgt

SEQ ID NO: 318952 - DNA, 25 bp, Mus musculus
gctttgggccggttgctgatgacgg

SEQ ID NO: 318953 - DNA, 25 bp, Mus musculus
gctttgggcttcttgtgtccattgt

SEQ ID NO: 318954 - DNA, 25 bp, Mus musculus
gctttggggtattataatattattg

SEQ ID NO: 318955 - DNA, 25 bp, Mus musculus
gctttggggtggtaatactggagac

SEQ ID NO: 318956 - DNA, 25 bp, Mus musculus
gctttgggtctcggcaaccaaactg

SEQ ID NO: 318957 - DNA, 25 bp, Mus musculus
gctttggtaagctgcgatatttaat

SEQ ID NO: 318958 - DNA, 25 bp, Mus musculus
gctttggtgggcagtcctggcagca

SEQ ID NO: 318959 - DNA, 25 bp, Mus musculus
gctttgtaatctcggattgtaaggg

SEQ ID NO: 318960 - DNA, 25 bp, Mus musculus
gctttgtcaagaacctacatggacg

SEQ ID NO: 318961 - DNA, 25 bp, Mus musculus
gctttgtcaagggatacctccttcc

SEQ ID NO: 318962 - DNA, 25 bp, Mus musculus
gctttgtcaagggctggggagcaga

SEQ ID NO: 318963 - DNA, 25 bp, Mus musculus
gctttgtcactatgccacagcccaa

SEQ ID NO: 318964 - DNA, 25 bp, Mus musculus
gctttgtctaccagcctcttaaagg

SEQ ID NO: 318965 - DNA, 25 bp, Mus musculus
gctttgtctaccaggatcctcaggg

SEQ ID NO: 318966 - DNA, 25 bp, Mus musculus
gctttgtctagactggctgttcctg

SEQ ID NO: 318967 - DNA, 25 bp, Mus musculus
gctttgtgatatgatgagaaaacca

SEQ ID NO: 318968 - DNA, 25 bp, Mus musculus
gctttgtgcaggaagaagactacga

SEQ ID NO: 318969 - DNA, 25 bp, Mus musculus
gctttgtgcaggcccagaggaactg

SEQ ID NO: 318970 - DNA, 25 bp, Mus musculus
gctttgtggcccagcatgacaacga

SEQ ID NO: 318971 - DNA, 25 bp, Mus musculus
gctttgtggcccaggatgacaacga

SEQ ID NO: 318972 - DNA, 25 bp, Mus musculus
gctttgtggcggacgtgacttgtag

SEQ ID NO: 318973 - DNA, 25 bp, Mus musculus
gctttgtgtactgctctgctgctgt

SEQ ID NO: 318974 - DNA, 25 bp, Mus musculus
gctttgtgtgggcttgcaaaattgc

SEQ ID NO: 318975 - DNA, 25 bp, Mus musculus
gctttgttaccttgctgtatcgaca

SEQ ID NO: 318976 - DNA, 25 bp, Mus musculus
gctttgttcagtcgggctctaagca

SEQ ID NO: 318977 - DNA, 25 bp, Mus musculus
gctttgttcagtcggtttccgtgag

SEQ ID NO: 318978 - DNA, 25 bp, Mus musculus
gctttgttctgaggtgacgccatct

SEQ ID NO: 318979 - DNA, 25 bp, Mus musculus
gctttgttgcttagcctcctgtacc

SEQ ID NO: 318980 - DNA, 25 bp, Mus musculus
gctttgttgcttaggattccctgca

SEQ ID NO: 318981 - DNA, 25 bp, Mus musculus
gctttgttggcaaagctagatcttt

SEQ ID NO: 318982 - DNA, 25 bp, Mus musculus
gctttgttggcaaagctgacaaacc

SEQ ID NO: 318983 - DNA, 25 bp, Mus musculus
gctttgttggcaaagcttcttcagc

SEQ ID NO: 318984 - DNA, 25 bp, Mus musculus
gctttgttggcaaaggtgactccaa

SEQ ID NO: 318985 - DNA, 25 bp, Mus musculus
gctttgtttctcccaggactcatga

SEQ ID NO: 318986 - DNA, 25 bp, Mus musculus
gcttttaaaaattgttgcttcctgt

SEQ ID NO: 318987 - DNA, 25 bp, Mus musculus
gcttttaaagcatgcgcagatgaca

SEQ ID NO: 318988 - DNA, 25 bp, Mus musculus
gcttttaaagcatgggcagtagctc

SEQ ID NO: 318989 - DNA, 25 bp, Mus musculus
gcttttaaaggattaaaggagagca

SEQ ID NO: 318990 - DNA, 25 bp, Mus musculus
gcttttaatgatctagtgaagccag

SEQ ID NO: 318991 - DNA, 25 bp, Mus musculus
gcttttaattcagttgaaaagggca

SEQ ID NO: 318992 - DNA, 25 bp, Mus musculus
gcttttacagacccataactggtgt

SEQ ID NO: 318993 - DNA, 25 bp, Mus musculus
gcttttacagggagggtagacctga

SEQ ID NO: 318994 - DNA, 25 bp, Mus musculus
gcttttacagttgttctgatgttcc

SEQ ID NO: 318995 - DNA, 25 bp, Mus musculus
gcttttacatgaaggtgcatctgct

SEQ ID NO: 318996 - DNA, 25 bp, Mus musculus
gcttttacatttgtcataatccttc

SEQ ID NO: 318997 - DNA, 25 bp, Mus musculus
gcttttactcggaccaacatatgct

SEQ ID NO: 318998 - DNA, 25 bp, Mus musculus
gcttttagagatgaggctggagggg

SEQ ID NO: 318999 - DNA, 25 bp, Mus musculus
gcttttagagtcgctgactcccctg

SEQ ID NO: 319000 - DNA, 25 bp, Mus musculus
gcttttagcccagatagtcgccaca

SEQ ID NO: 319001 - DNA, 25 bp, Mus musculus
gcttttaggactcagctccatgtct

SEQ ID NO: 319002 - DNA, 25 bp, Mus musculus
gcttttaggactcaggtctggctgt

SEQ ID NO: 319003 - DNA, 25 bp, Mus musculus
gcttttataagacaggaaaagactg

SEQ ID NO: 319004 - DNA, 25 bp, Mus musculus
gcttttataagatgaagacaggaaa

SEQ ID NO: 319005 - DNA, 25 bp, Mus musculus
gcttttataagtctttgcagattct

SEQ ID NO: 319006 - DNA, 25 bp, Mus musculus
gcttttatcccagaaatgtgaatcc

SEQ ID NO: 319007 - DNA, 25 bp, Mus musculus
gcttttatcccaggtgtgccatttt

SEQ ID NO: 319008 - DNA, 25 bp, Mus musculus
gcttttcagtctaagtgtacacagg

SEQ ID NO: 319009 - DNA, 25 bp, Mus musculus
gcttttcataccagctgcttttatg

SEQ ID NO: 319010 - DNA, 25 bp, Mus musculus
gcttttcatcatgggaggtgaggct

SEQ ID NO: 319011 - DNA, 25 bp, Mus musculus
gcttttcatcatggtcctccaggag

SEQ ID NO: 319012 - DNA, 25 bp, Mus musculus
gcttttcatctggagactgctcatc

SEQ ID NO: 319013 - DNA, 25 bp, Mus musculus
gcttttcatctggagagtctgcagg

SEQ ID NO: 319014 - DNA, 25 bp, Mus musculus
gcttttccaacgccgagatgactga

SEQ ID NO: 319015 - DNA, 25 bp, Mus musculus
gcttttcctcagattgtctaaagcc

SEQ ID NO: 319016 - DNA, 25 bp, Mus musculus
gcttttcctggaagagtatctacga

SEQ ID NO: 319017 - DNA, 25 bp, Mus musculus
gcttttcctggagagcctgacaagg

SEQ ID NO: 319018 - DNA, 25 bp, Mus musculus
gcttttcctttgagtccatcagcag

SEQ ID NO: 319019 - DNA, 25 bp, Mus musculus
gcttttctaaggcatcaatacttgt

SEQ ID NO: 319020 - DNA, 25 bp, Mus musculus
gcttttctcagctgtgacttctttt

SEQ ID NO: 319021 - DNA, 25 bp, Mus musculus
gcttttcttcagacggtttctctag

SEQ ID NO: 319022 - DNA, 25 bp, Mus musculus
gcttttcttctggcggcatcgctgt

SEQ ID NO: 319023 - DNA, 25 bp, Mus musculus
gcttttgaaagctctgcggagtcgg

SEQ ID NO: 319024 - DNA, 25 bp, Mus musculus
gcttttgaaaggaacagattatacc

SEQ ID NO: 319025 - DNA, 25 bp, Mus musculus
gcttttgaacttgatcgtactcgac

SEQ ID NO: 319026 - DNA, 25 bp, Mus musculus
gcttttgaacttggatgtccagagg

SEQ ID NO: 319027 - DNA, 25 bp, Mus musculus
gcttttgagagctgtctctcttttc

SEQ ID NO: 319028 - DNA, 25 bp, Mus musculus
gcttttgatttcctgtcccctgaac

SEQ ID NO: 319029 - DNA, 25 bp, Mus musculus
gcttttgcagaggtttcctggcaga

SEQ ID NO: 319030 - DNA, 25 bp, Mus musculus
gcttttgcagatgaatatgaaggag

SEQ ID NO: 319031 - DNA, 25 bp, Mus musculus
gcttttgcaggcacaacccggtctc

SEQ ID NO: 319032 - DNA, 25 bp, Mus musculus
gcttttgcagggggcaccctcccgc

SEQ ID NO: 319033 - DNA, 25 bp, Mus musculus
gcttttgcaggtctgacagcggatg

SEQ ID NO: 319034 - DNA, 25 bp, Mus musculus
gcttttgcaggtggctttgcagctg

SEQ ID NO: 319035 - DNA, 25 bp, Mus musculus
gcttttgcagtggacatcccagaaa

SEQ ID NO: 319036 - DNA, 25 bp, Mus musculus
gcttttgccagacaagcagtgaaac

SEQ ID NO: 319037 - DNA, 25 bp, Mus musculus
gcttttgccaggtgatggaaaacgt

SEQ ID NO: 319038 - DNA, 25 bp, Mus musculus
gcttttgccctctccgctccctgga

SEQ ID NO: 319039 - DNA, 25 bp, Mus musculus
gcttttgcggagatgcggcattcca

SEQ ID NO: 319040 - DNA, 25 bp, Mus musculus
gcttttgcggagtcactatttagaa

SEQ ID NO: 319041 - DNA, 25 bp, Mus musculus
gcttttgcggctaagtaagaagtat

SEQ ID NO: 319042 - DNA, 25 bp, Mus musculus
gcttttgctgagagtgtgtgactcc

SEQ ID NO: 319043 - DNA, 25 bp, Mus musculus
gcttttgctggagggagctgggaag

SEQ ID NO: 319044 - DNA, 25 bp, Mus musculus
gcttttggaagtgaagtttggtgag

SEQ ID NO: 319045 - DNA, 25 bp, Mus musculus
gcttttggtaatagaggatctgaga

SEQ ID NO: 319046 - DNA, 25 bp, Mus musculus
gcttttgtgccgcaggtcgagattt

SEQ ID NO: 319047 - DNA, 25 bp, Mus musculus
gcttttgtggacaggttggtttaat

SEQ ID NO: 319048 - DNA, 25 bp, Mus musculus
gcttttgtggacagtatttttgaac

SEQ ID NO: 319049 - DNA, 25 bp, Mus musculus
gctttttaaaggaaggcatcccacg

SEQ ID NO: 319050 - DNA, 25 bp, Mus musculus
gctttttaacaaggtgaactgaaga

SEQ ID NO: 319051 - DNA, 25 bp, Mus musculus
gctttttcagcttgcttcccagagc

SEQ ID NO: 319052 - DNA, 25 bp, Mus musculus
gctttttcaggaggcagtgactttc

SEQ ID NO: 319053 - DNA, 25 bp, Mus musculus
gctttttccaggatcccattgttaa

SEQ ID NO: 319054 - DNA, 25 bp, Mus musculus
gctttttcccaggcttggatttaga

SEQ ID NO: 319055 - DNA, 25 bp, Mus musculus
gctttttctcaggtgccttcagtca

SEQ ID NO: 319056 - DNA, 25 bp, Mus musculus
gctttttgagcagacctgggcccag

SEQ ID NO: 319057 - DNA, 25 bp, Mus musculus
gctttttgagcaggtcacaaaccta

SEQ ID NO: 319058 - DNA, 25 bp, Mus musculus
gctttttggattcagacgatgtcat

SEQ ID NO: 319059 - DNA, 25 bp, Mus musculus
gctttttggccgcaggttctctcca

SEQ ID NO: 319060 - DNA, 25 bp, Mus musculus
gctttttgtggagccccgcaatctg

SEQ ID NO: 319061 - DNA, 25 bp, Mus musculus
gcttttttacaggagaaaccctgtg

SEQ ID NO: 319062 - DNA, 25 bp, Mus musculus
gcttttttacctccgcacatccgtg

SEQ ID NO: 319063 - DNA, 25 bp, Mus musculus
gcttttttatcaggtcgcatcaaat

SEQ ID NO: 319064 - DNA, 25 bp, Mus musculus
gctttttttggccggacgagcaatg

SEQ ID NO: 319065 - DNA, 25 bp, Mus musculus
ggaaaaaaaaaccagtggagcagcg

SEQ ID NO: 319066 - DNA, 25 bp, Mus musculus
ggaaaaaagggaacgaagagctcta

SEQ ID NO: 319067 - DNA, 25 bp, Mus musculus
ggaaaaaagggtggccggcaagagt

SEQ ID NO: 319068 - DNA, 25 bp, Mus musculus
ggaaaaaatggacaggaatctgaat

SEQ ID NO: 319069 - DNA, 25 bp, Mus musculus
ggaaaaaatggacagttgtctcaaa

SEQ ID NO: 319070 - DNA, 25 bp, Mus musculus
ggaaaaaatgggtggacttggcctg

SEQ ID NO: 319071 - DNA, 25 bp, Mus musculus
ggaaaaacaagagttactcacaaaa

SEQ ID NO: 319072 - DNA, 25 bp, Mus musculus
ggaaaaacacagactgcgatggatc

SEQ ID NO: 319073 - DNA, 25 bp, Mus musculus
ggaaaaacagaggccagagggcatc

SEQ ID NO: 319074 - DNA, 25 bp, Mus musculus
ggaaaaacagggcttcaagcagcaa

SEQ ID NO: 319075 - DNA, 25 bp, Mus musculus
ggaaaaagaacaagaccgtggctac

SEQ ID NO: 319076 - DNA, 25 bp, Mus musculus
ggaaaaagatatccttttggataag

SEQ ID NO: 319077 - DNA, 25 bp, Mus musculus
ggaaaaagctcgccacccccatcag

SEQ ID NO: 319078 - DNA, 25 bp, Mus musculus
ggaaaaagctgaaggacagactgcg

SEQ ID NO: 319079 - DNA, 25 bp, Mus musculus
ggaaaaaggaaggtcatcgtggaga

SEQ ID NO: 319080 - DNA, 25 bp, Mus musculus
ggaaaaaggggagagcatcactggt

SEQ ID NO: 319081 - DNA, 25 bp, Mus musculus
ggaaaaaggttttgacgcatctgga

SEQ ID NO: 319082 - DNA, 25 bp, Mus musculus
ggaaaaagtcaagccgagatgactg

SEQ ID NO: 319083 - DNA, 25 bp, Mus musculus
ggaaaaagtcaaggaactcaacaga

SEQ ID NO: 319084 - DNA, 25 bp, Mus musculus
ggaaaaagttgccaggaaacaagct

SEQ ID NO: 319085 - DNA, 25 bp, Mus musculus
ggaaaaatatggaacaaaagttgaa

SEQ ID NO: 319086 - DNA, 25 bp, Mus musculus
ggaaaaatccatggtgcctgagttc

SEQ ID NO: 319087 - DNA, 25 bp, Mus musculus
ggaaaaatccattaccagtgcttgg

SEQ ID NO: 319088 - DNA, 25 bp, Mus musculus
ggaaaaatgaaggattcagaaaccc

SEQ ID NO: 319089 - DNA, 25 bp, Mus musculus
ggaaaaattaaccacatgagatatg

SEQ ID NO: 319090 - DNA, 25 bp, Mus musculus
ggaaaaattatatggtttgacggat

SEQ ID NO: 319091 - DNA, 25 bp, Mus musculus
ggaaaaatttggagacagaagctta

SEQ ID NO: 319092 - DNA, 25 bp, Mus musculus
ggaaaaatttggagctgacatcaac

SEQ ID NO: 319093 - DNA, 25 bp, Mus musculus
ggaaaacaaaggcatccttacttcg

SEQ ID NO: 319094 - DNA, 25 bp, Mus musculus
ggaaaacaaattagtgacagatcag

SEQ ID NO: 319095 - DNA, 25 bp, Mus musculus
ggaaaacacagccatcaccatcggc

SEQ ID NO: 319096 - DNA, 25 bp, Mus musculus
ggaaaacacaggtcgcctgacgagt

SEQ ID NO: 319097 - DNA, 25 bp, Mus musculus
ggaaaacacagtttggcttgtgcta

SEQ ID NO: 319098 - DNA, 25 bp, Mus musculus
ggaaaacactggaagcaagagaaaa

SEQ ID NO: 319099 - DNA, 25 bp, Mus musculus
ggaaaacactggcggaaccagtatt

SEQ ID NO: 319100 - DNA, 25 bp, Mus musculus
ggaaaacagaattataacaattgaa

SEQ ID NO: 319101 - DNA, 25 bp, Mus musculus
ggaaaacatgaggaaggacagacga

SEQ ID NO: 319102 - DNA, 25 bp, Mus musculus
ggaaaacatggggcttctcaccagc

SEQ ID NO: 319103 - DNA, 25 bp, Mus musculus
ggaaaacatgtatagactttgatga

SEQ ID NO: 319104 - DNA, 25 bp, Mus musculus
ggaaaacatgtatagctttagatga

SEQ ID NO: 319105 - DNA, 25 bp, Mus musculus
ggaaaacattaagtcttgggtactt

SEQ ID NO: 319106 - DNA, 25 bp, Mus musculus
ggaaaacattaataattaccgtgtt

SEQ ID NO: 319107 - DNA, 25 bp, Mus musculus
ggaaaaccaaaggtccagaatagcg

SEQ ID NO: 319108 - DNA, 25 bp, Mus musculus
ggaaaaccaagggctcaccttgtga

SEQ ID NO: 319109 - DNA, 25 bp, Mus musculus
ggaaaaccaatggctcaccctgtga

SEQ ID NO: 319110 - DNA, 25 bp, Mus musculus
ggaaaaccagagtccagcctctgaa

SEQ ID NO: 319111 - DNA, 25 bp, Mus musculus
ggaaaaccaggcacgcatcgaggag

SEQ ID NO: 319112 - DNA, 25 bp, Mus musculus
ggaaaaccaggttgctggtgaccag

SEQ ID NO: 319113 - DNA, 25 bp, Mus musculus
ggaaaacccaatctctgcgatttta

SEQ ID NO: 319114 - DNA, 25 bp, Mus musculus
ggaaaacctgaggagccaacagaag

SEQ ID NO: 319115 - DNA, 25 bp, Mus musculus
ggaaaacctgagggtgatttcagac

SEQ ID NO: 319116 - DNA, 25 bp, Mus musculus
ggaaaacgaagaaatgattctgggg

SEQ ID NO: 319117 - DNA, 25 bp, Mus musculus
ggaaaactgtccggccaggtatcat

SEQ ID NO: 319118 - DNA, 25 bp, Mus musculus
ggaaaactgttcaagctgggaggca

SEQ ID NO: 319119 - DNA, 25 bp, Mus musculus
ggaaaactgttcaagttgtccccca

SEQ ID NO: 319120 - DNA, 25 bp, Mus musculus
ggaaaacttgtgaggttctctaatg

SEQ ID NO: 319121 - DNA, 25 bp, Mus musculus
ggaaaagaaacctcttcggtgatct

SEQ ID NO: 319122 - DNA, 25 bp, Mus musculus
ggaaaagaaagagagttcgatgccc

SEQ ID NO: 319123 - DNA, 25 bp, Mus musculus
ggaaaagaaagctgttcagagctat

SEQ ID NO: 319124 - DNA, 25 bp, Mus musculus
ggaaaagaaagtctgccaaggcaca

SEQ ID NO: 319125 - DNA, 25 bp, Mus musculus
ggaaaagaacacagaacttgtcctt

SEQ ID NO: 319126 - DNA, 25 bp, Mus musculus
ggaaaagaacacagtgccctggttc

SEQ ID NO: 319127 - DNA, 25 bp, Mus musculus
ggaaaagaaccgacgagctcacctg

SEQ ID NO: 319128 - DNA, 25 bp, Mus musculus
ggaaaagaaccgtggctctccaggc

SEQ ID NO: 319129 - DNA, 25 bp, Mus musculus
ggaaaagaactaaatggcagcacaa

SEQ ID NO: 319130 - DNA, 25 bp, Mus musculus
ggaaaagaactaatttcagcatatg

SEQ ID NO: 319131 - DNA, 25 bp, Mus musculus
ggaaaagaactactgccgaaaccca

SEQ ID NO: 319132 - DNA, 25 bp, Mus musculus
ggaaaagaactgttcagctcctaat

SEQ ID NO: 319133 - DNA, 25 bp, Mus musculus
ggaaaagaaggtgggcgactgctgc

SEQ ID NO: 319134 - DNA, 25 bp, Mus musculus
ggaaaagaagttctgggagtcagcc

SEQ ID NO: 319135 - DNA, 25 bp, Mus musculus
ggaaaagaatctgcaggcacacgga

SEQ ID NO: 319136 - DNA, 25 bp, Mus musculus
ggaaaagacatggagatacagaatt

SEQ ID NO: 319137 - DNA, 25 bp, Mus musculus
ggaaaagacatggaggaagcaaggg

SEQ ID NO: 319138 - DNA, 25 bp, Mus musculus
ggaaaagacggaaagctcatcaagc

SEQ ID NO: 319139 - DNA, 25 bp, Mus musculus
ggaaaagacggaaaggagagatctg

SEQ ID NO: 319140 - DNA, 25 bp, Mus musculus
ggaaaagagctggattctaatccct

SEQ ID NO: 319141 - DNA, 25 bp, Mus musculus
ggaaaagaggaccccaggacttctt

SEQ ID NO: 319142 - DNA, 25 bp, Mus musculus
ggaaaagaggagtgggagctcaacc

SEQ ID NO: 319143 - DNA, 25 bp, Mus musculus
ggaaaagataaaacagcgtttattt

SEQ ID NO: 319144 - DNA, 25 bp, Mus musculus
ggaaaagataaataaagacaactct

SEQ ID NO: 319145 - DNA, 25 bp, Mus musculus
ggaaaagatatgatgaggaatttaa

SEQ ID NO: 319146 - DNA, 25 bp, Mus musculus
ggaaaagatgaaggagcttcatatg

SEQ ID NO: 319147 - DNA, 25 bp, Mus musculus
ggaaaagatgaaggggatggtaata

SEQ ID NO: 319148 - DNA, 25 bp, Mus musculus
ggaaaagcaactggatgaactgctt

SEQ ID NO: 319149 - DNA, 25 bp, Mus musculus
ggaaaagcaagaagcacatggcatg

SEQ ID NO: 319150 - DNA, 25 bp, Mus musculus
ggaaaagcagaccagccctagtcga

SEQ ID NO: 319151 - DNA, 25 bp, Mus musculus
ggaaaagcagacttgtgtcctggcc

SEQ ID NO: 319152 - DNA, 25 bp, Mus musculus
ggaaaagcagcagatataccagatt

SEQ ID NO: 319153 - DNA, 25 bp, Mus musculus
ggaaaagccaatagtaggaattcca

SEQ ID NO: 319154 - DNA, 25 bp, Mus musculus
ggaaaagccgctggacgactctgtg

SEQ ID NO: 319155 - DNA, 25 bp, Mus musculus
ggaaaagccgtcccgcacggtgacc

SEQ ID NO: 319156 - DNA, 25 bp, Mus musculus
ggaaaagcgagctgggagaacagct

SEQ ID NO: 319157 - DNA, 25 bp, Mus musculus
ggaaaagcgaggaggcggctcagtg

SEQ ID NO: 319158 - DNA, 25 bp, Mus musculus
ggaaaagcgaggccttggaacagcg

SEQ ID NO: 319159 - DNA, 25 bp, Mus musculus
ggaaaagctggtggacaataacaca

SEQ ID NO: 319160 - DNA, 25 bp, Mus musculus
ggaaaaggaagatgacaagagaaga

SEQ ID NO: 319161 - DNA, 25 bp, Mus musculus
ggaaaaggaagatggaggaaagaca

SEQ ID NO: 319162 - DNA, 25 bp, Mus musculus
ggaaaaggacaggacctttcctagc

SEQ ID NO: 319163 - DNA, 25 bp, Mus musculus
ggaaaaggacaggacgagtattata

SEQ ID NO: 319164 - DNA, 25 bp, Mus musculus
ggaaaaggacaggacggaaaaagag

SEQ ID NO: 319165 - DNA, 25 bp, Mus musculus
ggaaaaggagaagctacttgcaaag

SEQ ID NO: 319166 - DNA, 25 bp, Mus musculus
ggaaaaggagctctgtcaggtggtg

SEQ ID NO: 319167 - DNA, 25 bp, Mus musculus
ggaaaaggaggagtcagacacagac

SEQ ID NO: 319168 - DNA, 25 bp, Mus musculus
ggaaaaggatgcctggcggaaagct

SEQ ID NO: 319169 - DNA, 25 bp, Mus musculus
ggaaaaggattttgatcactggagg

SEQ ID NO: 319170 - DNA, 25 bp, Mus musculus
ggaaaaggattttggcaggaagaga

SEQ ID NO: 319171 - DNA, 25 bp, Mus musculus
ggaaaaggattttgttgaccagata

SEQ ID NO: 319172 - DNA, 25 bp, Mus musculus
ggaaaaggctaagagcctgaccagg

SEQ ID NO: 319173 - DNA, 25 bp, Mus musculus
ggaaaagtcaggctattgaccttct

SEQ ID NO: 319174 - DNA, 25 bp, Mus musculus
ggaaaagtcctggaggcaggcgaca

SEQ ID NO: 319175 - DNA, 25 bp, Mus musculus
ggaaaagtcctggaggctggagtca

SEQ ID NO: 319176 - DNA, 25 bp, Mus musculus
ggaaaagtctaaagggccagtgtcc

SEQ ID NO: 319177 - DNA, 25 bp, Mus musculus
ggaaaagtctaagggcagtttagct

SEQ ID NO: 319178 - DNA, 25 bp, Mus musculus
ggaaaagtgcatccatgcagtattc

SEQ ID NO: 319179 - DNA, 25 bp, Mus musculus
ggaaaagtgtgacaccatccatgtg

SEQ ID NO: 319180 - DNA, 25 bp, Mus musculus
ggaaaagtgtgagaccatccatgtg

SEQ ID NO: 319181 - DNA, 25 bp, Mus musculus
ggaaaagttgctggaaaccatggcc

SEQ ID NO: 319182 - DNA, 25 bp, Mus musculus
ggaaaagtttgtcaaagacatagat

SEQ ID NO: 319183 - DNA, 25 bp, Mus musculus
ggaaaataagcaaaaattcccagaa

SEQ ID NO: 319184 - DNA, 25 bp, Mus musculus
ggaaaataaggtacttcaatttagc

SEQ ID NO: 319185 - DNA, 25 bp, Mus musculus
ggaaaataaggtgttttcacgtcta

SEQ ID NO: 319186 - DNA, 25 bp, Mus musculus
ggaaaataagttctgaaaatcaact

SEQ ID NO: 319187 - DNA, 25 bp, Mus musculus
ggaaaatacagagcatacgatgcga

SEQ ID NO: 319188 - DNA, 25 bp, Mus musculus
ggaaaatacagatctgtgtcagcat

SEQ ID NO: 319189 - DNA, 25 bp, Mus musculus
ggaaaatacgtcaaagagcagtgac

SEQ ID NO: 319190 - DNA, 25 bp, Mus musculus
ggaaaatatcaggaagcagtgcatt

SEQ ID NO: 319191 - DNA, 25 bp, Mus musculus
ggaaaatatctttgtatcttaaaag

SEQ ID NO: 319192 - DNA, 25 bp, Mus musculus
ggaaaatatgggctggcgctgcaaa

SEQ ID NO: 319193 - DNA, 25 bp, Mus musculus
ggaaaatcagtgtctttacatccaa

SEQ ID NO: 319194 - DNA, 25 bp, Mus musculus
ggaaaatccagttcacagtgtagag

SEQ ID NO: 319195 - DNA, 25 bp, Mus musculus
ggaaaatgaaacttggggaccatgc

SEQ ID NO: 319196 - DNA, 25 bp, Mus musculus
ggaaaatgaaagttgtaagcatcaa

SEQ ID NO: 319197 - DNA, 25 bp, Mus musculus
ggaaaatgaagatgctagaaaataa

SEQ ID NO: 319198 - DNA, 25 bp, Mus musculus
ggaaaatgaaggttgcacgatttca

SEQ ID NO: 319199 - DNA, 25 bp, Mus musculus
ggaaaatgccgagctgccacaggca

SEQ ID NO: 319200 - DNA, 25 bp, Mus musculus
ggaaaatggctcagggggagcaccg

SEQ ID NO: 319201 - DNA, 25 bp, Mus musculus
ggaaaatgggaagacagatgtctga

SEQ ID NO: 319202 - DNA, 25 bp, Mus musculus
ggaaaatgggcaaggtgaaattggt

SEQ ID NO: 319203 - DNA, 25 bp, Mus musculus
ggaaaattactatagagaataggtc

SEQ ID NO: 319204 - DNA, 25 bp, Mus musculus
ggaaaattactataggctgcagaag

SEQ ID NO: 319205 - DNA, 25 bp, Mus musculus
ggaaaattgcaccaggtgatgttat

SEQ ID NO: 319206 - DNA, 25 bp, Mus musculus
ggaaaatttaaaaggttgcagtgtg

SEQ ID NO: 319207 - DNA, 25 bp, Mus musculus
ggaaacaaaagataaaatattttga

SEQ ID NO: 319208 - DNA, 25 bp, Mus musculus
ggaaacaaaccagactgacctcgga

SEQ ID NO: 319209 - DNA, 25 bp, Mus musculus
ggaaacaaaccagatcccccacctg

SEQ ID NO: 319210 - DNA, 25 bp, Mus musculus
ggaaacaaagtttgggggagcattc

SEQ ID NO: 319211 - DNA, 25 bp, Mus musculus
ggaaacaactgggctcgggccatca

SEQ ID NO: 319212 - DNA, 25 bp, Mus musculus
ggaaacaactggtgccagcacatca

SEQ ID NO: 319213 - DNA, 25 bp, Mus musculus
ggaaacaatgtcacgaacttgtttc
